United States Patent 7,618,814 (MICRORNA-RELATED NUCLEIC ACIDS AND USES THEREOF) - sequence listing, part 8

SEQ ID NO: 278205 - RNA, 32 nt, Human
uuucaguucacugcaaccuccaccucccaggu

SEQ ID NO: 278206 - RNA, 32 nt, Human
uuucaguucacugcagccucgaccucccaggc

SEQ ID NO: 278207 - RNA, 32 nt, Human
uuucaguugugagccuucuagggccccaggcu

SEQ ID NO: 278208 - RNA, 32 nt, Human
uuucaguuuagacccagcuaaguugggagcug

SEQ ID NO: 278209 - RNA, 32 nt, Human
uuucaguuucaaaucaaaccuugaaagacaua

SEQ ID NO: 278210 - RNA, 32 nt, Human
uuucaguuucacccucuauuuccaaagccauu

SEQ ID NO: 278211 - RNA, 32 nt, Human
uuucaguuucagacugaggucugcuaagaagc

SEQ ID NO: 278212 - RNA, 32 nt, Human
uuucaguuucccacccugccuggcuuucucuc

SEQ ID NO: 278213 - RNA, 32 nt, Human
uuucauaaacaacaugagugguuucuggagac

SEQ ID NO: 278214 - RNA, 32 nt, Human
uuucauaaacucauauaaggcacauggcauuu

SEQ ID NO: 278215 - RNA, 22 nt, Human
uuucauaaggccugcccuccca

SEQ ID NO: 278216 - RNA, 32 nt, Human
uuucauaaguucugcuuucagcauuuuccuua

SEQ ID NO: 278217 - RNA, 32 nt, Human
uuucauaauccugggauauauguaccauuguc

SEQ ID NO: 278218 - RNA, 32 nt, Human
uuucauaccaaagaagauggagagucuaaaau

SEQ ID NO: 278219 - RNA, 32 nt, Human
uuucauaccaguaccugaaguaggcucaauaa

SEQ ID NO: 278220 - RNA, 32 nt, Human
uuucauacccuuguaaguggguuauguggugg

SEQ ID NO: 278221 - RNA, 32 nt, Human
uuucauacuccccgcuuccacccuccaaccuc

SEQ ID NO: 278222 - RNA, 32 nt, Human
uuucauagaagagcccuggagaagacaguaga

SEQ ID NO: 278223 - RNA, 32 nt, Human
uuucauagacucauggaacugaagggaccuua

SEQ ID NO: 278224 - RNA, 32 nt, Human
uuucauagaggcagaaaguaggaaccagauag

SEQ ID NO: 278225 - RNA, 21 nt, Human
uuucauagauuugaaaaacuu

SEQ ID NO: 278226 - RNA, 32 nt, Human
uuucauagcuaagaaauaaaacuguuaaaguc

SEQ ID NO: 278227 - RNA, 32 nt, Human
uuucauagcugcauuaccauagcuaaacuccu

SEQ ID NO: 278228 - RNA, 32 nt, Human
uuucauaggcgagauccguguucuccauuuau

SEQ ID NO: 278229 - RNA, 32 nt, Human
uuucauaguacacaugagguggauauuugaua

SEQ ID NO: 278230 - RNA, 32 nt, Human
uuucauaguugggauuucagagcacugauacc

SEQ ID NO: 278231 - RNA, 32 nt, Human
uuucauauagggaagaguucugaucuguaccu

SEQ ID NO: 278232 - RNA, 32 nt, Human
uuucauaucacacuguuaaaaguuguguuuug

SEQ ID NO: 278233 - RNA, 32 nt, Human
uuucauaucgaguauggaacccuucagaucaa

SEQ ID NO: 278234 - RNA, 22 nt, Human
uuucauaugaaauugaaaaauu

SEQ ID NO: 278235 - RNA, 32 nt, Human
uuucauaugcccuauaaauguaaagaauuuau

SEQ ID NO: 278236 - RNA, 32 nt, Human
uuucauauucaccauucuuccaccucauugaa

SEQ ID NO: 278237 - RNA, 32 nt, Human
uuucauauuguucaaacacacaugcucuacaa

SEQ ID NO: 278238 - RNA, 32 nt, Human
uuucauauuuggaacuuuguaauagcgggagu

SEQ ID NO: 278239 - RNA, 32 nt, Human
uuucauauuuggaguaugaaaguagauucuau

SEQ ID NO: 278240 - RNA, 32 nt, Human
uuucaucaaucacgucuauguaaugaagccuc

SEQ ID NO: 278241 - RNA, 32 nt, Human
uuucaucacacccuuuuaacauuuaucuaaaa

SEQ ID NO: 278242 - RNA, 32 nt, Human
uuucaucacccagguauuaagcccagugccua

SEQ ID NO: 278243 - RNA, 32 nt, Human
uuucaucacggugaaacccccucucugcuaaa

SEQ ID NO: 278244 - RNA, 32 nt, Human
uuucaucagucacucacaugugcucaaggaau

SEQ ID NO: 278245 - RNA, 32 nt, Human
uuucaucauaauacauuauguuuaccuccauc

SEQ ID NO: 278246 - RNA, 32 nt, Human
uuucaucaucuacccaucuauuuggaaagcac

SEQ ID NO: 278247 - RNA, 32 nt, Human
uuucaucaugaauauuuugagcacacacucua

SEQ ID NO: 278248 - RNA, 32 nt, Human
uuucaucaugaggaaagcaguugaaaugaggc

SEQ ID NO: 278249 - RNA, 32 nt, Human
uuucaucauguuagccaggauggucuugaucu

SEQ ID NO: 278250 - RNA, 32 nt, Human
uuucaucauguuggccaggauggucucgaucu

SEQ ID NO: 278251 - RNA, 32 nt, Human
uuucaucauguuggccaggauggucucuuaac

SEQ ID NO: 278252 - RNA, 32 nt, Human
uuucaucauguuggccaggauggucuugaucu

SEQ ID NO: 278253 - RNA, 32 nt, Human
uuucaucauguuggccaggaugguuuugaucu

SEQ ID NO: 278254 - RNA, 32 nt, Human
uuucaucauguuggccaggcuagucuugaacu

SEQ ID NO: 278255 - RNA, 32 nt, Human
uuucauccagcucugguuucuguguuucaugu

SEQ ID NO: 278256 - RNA, 32 nt, Human
uuucauccaguugggaaacccaggaagccggc

SEQ ID NO: 278257 - RNA, 28 nt, Human
uuucaucccagaggggccucaucagcaa

SEQ ID NO: 278258 - RNA, 32 nt, Human
uuucauccccugacauugugggagaaauuuug

SEQ ID NO: 278259 - RNA, 32 nt, Human
uuucauccgcuguuuccuccccaaaacacaca

SEQ ID NO: 278260 - RNA, 32 nt, Human
uuucauccuacuuggagugcagagauaaaacc

SEQ ID NO: 278261 - RNA, 32 nt, Human
uuucauccucaccaauccugccagggagcuac

SEQ ID NO: 278262 - RNA, 19 nt, Human
uuucauccugacucugccc

SEQ ID NO: 278263 - RNA, 32 nt, Human
uuucauccugauucagcucugccuugcaucac

SEQ ID NO: 278264 - RNA, 32 nt, Human
uuucauccugcaggaggauguagcgccucagu

SEQ ID NO: 278265 - RNA, 32 nt, Human
uuucauccuggcuggagaauguggagaacuaa

SEQ ID NO: 278266 - RNA, 32 nt, Human
uuucauccuuuaguuacccaggccaguagcuu

SEQ ID NO: 278267 - RNA, 32 nt, Human
uuucaucgguucccucgcacuggaggaggcag

SEQ ID NO: 278268 - RNA, 32 nt, Human
uuucaucuacgaaggcccugagguucccauca

SEQ ID NO: 278269 - RNA, 24 nt, Human
uuucaucuaggcuggagugcaaug

SEQ ID NO: 278270 - RNA, 32 nt, Human
uuucaucucaacuauguuauaccuggacauuu

SEQ ID NO: 278271 - RNA, 32 nt, Human
uuucaucucaagggguucccugggucuugaac

SEQ ID NO: 278272 - RNA, 32 nt, Human
uuucaucucccaaggucuucuuucugaaacca

SEQ ID NO: 278273 - RNA, 32 nt, Human
uuucaucuccucauauugaaucauggaccaug

SEQ ID NO: 278274 - RNA, 32 nt, Human
uuucaucucggccccugucaaucugguuuuug

SEQ ID NO: 278275 - RNA, 32 nt, Human
uuucaucucucaucuuuuguccuccuuagcac

SEQ ID NO: 278276 - RNA, 32 nt, Human
uuucaucucugccaucucuaaagcacuuuuca

SEQ ID NO: 278277 - RNA, 21 nt, Human
uuucaucucuuccccuuguca

SEQ ID NO: 278278 - RNA, 32 nt, Human
uuucaucucuuccucccuauggguauuagaaa

SEQ ID NO: 278279 - RNA, 32 nt, Human
uuucaucucuuguauaugaugaucuggaucca

SEQ ID NO: 278280 - RNA, 32 nt, Human
uuucaucucuuuuucucugaguacguuucagu

SEQ ID NO: 278281 - RNA, 32 nt, Human
uuucaucugcuguugauacugaucucaaugca

SEQ ID NO: 278282 - RNA, 32 nt, Human
uuucaucugcuuacacugccucuuucucuugc

SEQ ID NO: 278283 - RNA, 32 nt, Human
uuucaucuggggauuuaccuguucauuuaauc

SEQ ID NO: 278284 - RNA, 32 nt, Human
uuucaucuguaaaugucagugucugaacagca

SEQ ID NO: 278285 - RNA, 32 nt, Human
uuucaucuguucacuuucuuagggaggguaaa

SEQ ID NO: 278286 - RNA, 32 nt, Human
uuucaucuucaguugucucugaugcagcuuau

SEQ ID NO: 278287 - RNA, 32 nt, Human
uuucaucuucuuucuuuuccuaaagaaucacg

SEQ ID NO: 278288 - RNA, 32 nt, Human
uuucaucuuuaagagugcaugugaguauauug

SEQ ID NO: 278289 - RNA, 24 nt, Human
uuucaucuuuccucccuccuccca

SEQ ID NO: 278290 - RNA, 32 nt, Human
uuucaugaaaugcaaaacaauaggacagcugc

SEQ ID NO: 278291 - RNA, 32 nt, Human
uuucaugaagcacaaguggaauuuaauacaua

SEQ ID NO: 278292 - RNA, 32 nt, Human
uuucaugagccccaaggcuggggccacagcuc

SEQ ID NO: 278293 - RNA, 32 nt, Human
uuucaugagcuuccaugcuugcuuuguuucug

SEQ ID NO: 278294 - RNA, 29 nt, Human
uuucaugaucaacaugggagacucccacg

SEQ ID NO: 278295 - RNA, 29 nt, Human
uuucaugcacacauuggacuccaggaacc

SEQ ID NO: 278296 - RNA, 32 nt, Human
uuucaugcaguuucugcuucauuuuccaagga

SEQ ID NO: 278297 - RNA, 32 nt, Human
uuucaugcaucguggaggccacguggucacug

SEQ ID NO: 278298 - RNA, 32 nt, Human
uuucaugcccagcauuaaaccaaguaucucau

SEQ ID NO: 278299 - RNA, 32 nt, Human
uuucaugcuacugcucuccuaauguuaguucu

SEQ ID NO: 278300 - RNA, 32 nt, Human
uuucaugcuaucucaguucaccuuccagcuac

SEQ ID NO: 278301 - RNA, 32 nt, Human
uuucaugcucuccccaaauucugucugauuuu

SEQ ID NO: 278302 - RNA, 32 nt, Human
uuucaugcuggcaugagaagauauccuuugaa

SEQ ID NO: 278303 - RNA, 31 nt, Human
uuucaugcuguggaaagagggugaaaagguu

SEQ ID NO: 278304 - RNA, 32 nt, Human
uuucaugcuuccuccucugauuuugccugugu

SEQ ID NO: 278305 - RNA, 32 nt, Human
uuucaugcuucugcccugucaaaggucccuau

SEQ ID NO: 278306 - RNA, 32 nt, Human
uuucauggaaccuggaggcugggcuucaggcu

SEQ ID NO: 278307 - RNA, 32 nt, Human
uuucauggagcagccacuuagcauugaauugc

SEQ ID NO: 278308 - RNA, 32 nt, Human
uuucauggaucagcuaaguugcaccaacuuug

SEQ ID NO: 278309 - RNA, 32 nt, Human
uuucauggaugcauacaccugccugcaggcgc

SEQ ID NO: 278310 - RNA, 32 nt, Human
uuucaugguugcgaagaccuaaccucaaaugc

SEQ ID NO: 278311 - RNA, 32 nt, Human
uuucauguagcagcaaugcagauuuggugaau

SEQ ID NO: 278312 - RNA, 32 nt, Human
uuucauguagccagcagaacugaagugugcug

SEQ ID NO: 278313 - RNA, 32 nt, Human
uuucauguauuuccacaagugccaaacauuuc

SEQ ID NO: 278314 - RNA, 32 nt, Human
uuucaugucaggcuugcuuugccuugugggcu

SEQ ID NO: 278315 - RNA, 32 nt, Human
uuucaugucccccaccucauguuuucaccuuu

SEQ ID NO: 278316 - RNA, 19 nt, Human
uuucauguggccucccacu

SEQ ID NO: 278317 - RNA, 23 nt, Human
uuucauguguuuuuuggcugcau

SEQ ID NO: 278318 - RNA, 32 nt, Human
uuucauguucuuggaccuuuuguacugaaaau

SEQ ID NO: 278319 - RNA, 32 nt, Human
uuucauguugaacacagcucucuccacucccu

SEQ ID NO: 278320 - RNA, 32 nt, Human
uuucauguuggggcuguaggccuggggcaggu

SEQ ID NO: 278321 - RNA, 32 nt, Human
uuucauguugggguggggacggaggggaaagg

SEQ ID NO: 278322 - RNA, 32 nt, Human
uuucauguuuuggguaucaguguuacauuaaa

SEQ ID NO: 278323 - RNA, 32 nt, Human
uuucauuaaacuugaagcagucguggcuuugg

SEQ ID NO: 278324 - RNA, 27 nt, Human
uuucauuaaagaauguuuuggaacuuu

SEQ ID NO: 278325 - RNA, 32 nt, Human
uuucauuaauucagugaaguugagacuucaua

SEQ ID NO: 278326 - RNA, 32 nt, Human
uuucauuacauacuuguuuaaacucugucuuc

SEQ ID NO: 278327 - RNA, 32 nt, Human
uuucauuaccaccaccacgugaccuggucuua

SEQ ID NO: 278328 - RNA, 32 nt, Human
uuucauuaccaccaccaucugaccuagucuua

SEQ ID NO: 278329 - RNA, 32 nt, Human
uuucauuaccaccaccaucugaccuggucuua

SEQ ID NO: 278330 - RNA, 32 nt, Human
uuucauuacccaagccucagaaaaacacacaa

SEQ ID NO: 278331 - RNA, 32 nt, Human
uuucauuagcaguugcucacaugucuuugggu

SEQ ID NO: 278332 - RNA, 22 nt, Human
uuucauuagccuggcuguccac

SEQ ID NO: 278333 - RNA, 32 nt, Human
uuucauuauucugccacaugcuuccagugcua

SEQ ID NO: 278334 - RNA, 22 nt, Human
uuucauucacauucacaaagca

SEQ ID NO: 278335 - RNA, 32 nt, Human
uuucauucagcaggguauuuucugccuuguug

SEQ ID NO: 278336 - RNA, 32 nt, Human
uuucauucauucuggagucuacuaauuuaccu

SEQ ID NO: 278337 - RNA, 32 nt, Human
uuucauucauuugugcuuuugcauuaaacugu

SEQ ID NO: 278338 - RNA, 32 nt, Human
uuucauuccagccugggcaacaugagugaaag

SEQ ID NO: 278339 - RNA, 25 nt, Human
uuucauuccagggaguucuccccuc

SEQ ID NO: 278340 - RNA, 32 nt, Human
uuucauuccauucuauuguuuacacaacgauu

SEQ ID NO: 278341 - RNA, 32 nt, Human
uuucauucgcugaaggaaaggcaagagaguug

SEQ ID NO: 278342 - RNA, 32 nt, Human
uuucauucuccacauccucuuuuguucuagug

SEQ ID NO: 278343 - RNA, 32 nt, Human
uuucauucucucuggaaacagacucagguuuc

SEQ ID NO: 278344 - RNA, 32 nt, Human
uuucauucuguaauucagcaguucugggugaa

SEQ ID NO: 278345 - RNA, 32 nt, Human
uuucauucuuuauccaugagcaccaggcuuug

SEQ ID NO: 278346 - RNA, 32 nt, Human
uuucauugaauuauaaccacaagccaccaccc

SEQ ID NO: 278347 - RNA, 32 nt, Human
uuucauugauuuuauugaucagugcauugaac

SEQ ID NO: 278348 - RNA, 24 nt, Human
uuucauugucacaccaaauaacca

SEQ ID NO: 278349 - RNA, 32 nt, Human
uuucauugugcaaaugaaaacguguguaucaa

SEQ ID NO: 278350 - RNA, 32 nt, Human
uuucauuguguuagccgggauggucuugaucu

SEQ ID NO: 278351 - RNA, 32 nt, Human
uuucauuuacaagcaagcaggccaggcagcug

SEQ ID NO: 278352 - RNA, 32 nt, Human
uuucauuuauucauccauccauucaacaagua

SEQ ID NO: 278353 - RNA, 32 nt, Human
uuucauuucauagcuuucaaaaaucaugcuaa

SEQ ID NO: 278354 - RNA, 28 nt, Human
uuucauuucaugaggcauuguauuauau

SEQ ID NO: 278355 - RNA, 32 nt, Human
uuucauuuccccaggucuucaguguugaugua

SEQ ID NO: 278356 - RNA, 21 nt, Human
uuucauuucccuggcuugcca

SEQ ID NO: 278357 - RNA, 32 nt, Human
uuucauuuccuacugauacaaggccuggagag

SEQ ID NO: 278358 - RNA, 19 nt, Human
uuucauuuccuccccaccc

SEQ ID NO: 278359 - RNA, 23 nt, Human
uuucauuuccugggggcuugcca

SEQ ID NO: 278360 - RNA, 32 nt, Human
uuucauuucuuucugcccuucuccuuugccuu

SEQ ID NO: 278361 - RNA, 21 nt, Human
uuucauuugcaaacuucuaca

SEQ ID NO: 278362 - RNA, 22 nt, Human
uuucauuugcagugguuaguca

SEQ ID NO: 278363 - RNA, 32 nt, Human
uuucauuugguuaguuucugggugauacugug

SEQ ID NO: 278364 - RNA, 32 nt, Human
uuucauuuguguaaauacgaugcugaauuuua

SEQ ID NO: 278365 - RNA, 26 nt, Human
uuucauuuguuauauauuacaaacca

SEQ ID NO: 278366 - RNA, 32 nt, Human
uuucauuuuagagaauggggcagauggggcaa

SEQ ID NO: 278367 - RNA, 32 nt, Human
uuucauuuucauuuuccagucuacuuuggggu

SEQ ID NO: 278368 - RNA, 32 nt, Human
uuucauuuuccaccuucucugccuccaguccc

SEQ ID NO: 278369 - RNA, 32 nt, Human
uuucauuuucuuucuuguuugacuguaugcaa

SEQ ID NO: 278370 - RNA, 32 nt, Human
uuucauuuugcaccugcagccaagcaaaugcc

SEQ ID NO: 278371 - RNA, 32 nt, Human
uuucauuuuuauuugggagucuuugugaccag

SEQ ID NO: 278372 - RNA, 32 nt, Human
uuuccaaaaagggaguuuccaggccagaagcc

SEQ ID NO: 278373 - RNA, 22 nt, Human
uuuccaaaacacuuuauacuuu

SEQ ID NO: 278374 - RNA, 24 nt, Human
uuuccaaaauacuuuauucucuca

SEQ ID NO: 278375 - RNA, 20 nt, Human
uuuccaaaauuacuucucuc

SEQ ID NO: 278376 - RNA, 32 nt, Human
uuuccaaagagcugggauuacaggcaugagcc

SEQ ID NO: 278377 - RNA, 32 nt, Human
uuuccaaagauagugacaggagagaacuggaa

SEQ ID NO: 278378 - RNA, 32 nt, Human
uuuccaaagaugacugcauagggaccaacacu

SEQ ID NO: 278379 - RNA, 32 nt, Human
uuuccaaagguggauuccuacaaggauuguaa

SEQ ID NO: 278380 - RNA, 22 nt, Human
uuuccaaaguauaggacauuug

SEQ ID NO: 278381 - RNA, 32 nt, Human
uuuccaacagcaugugcucacuuggugucucu

SEQ ID NO: 278382 - RNA, 32 nt, Human
uuuccaacauuguuuuguuauuacaaguaggg

SEQ ID NO: 278383 - RNA, 32 nt, Human
uuuccaaccaacaugaaaugacuauaaacggu

SEQ ID NO: 278384 - RNA, 32 nt, Human
uuuccaaccaaccaaauuucugcauucgaguc

SEQ ID NO: 278385 - RNA, 32 nt, Human
uuuccaacccaagcccccagaccaucugugga

SEQ ID NO: 278386 - RNA, 20 nt, Human
uuuccaaccuaacgagggaa

SEQ ID NO: 278387 - RNA, 32 nt, Human
uuuccaaccuccauuucagccugucugucuca

SEQ ID NO: 278388 - RNA, 32 nt, Human
uuuccaacucagcugaugaaucugucuagguc

SEQ ID NO: 278389 - RNA, 32 nt, Human
uuuccaacuccaguuucugucuugcuccaaaa

SEQ ID NO: 278390 - RNA, 32 nt, Human
uuuccaagcccacccuuuuccccugagcucag

SEQ ID NO: 278391 - RNA, 32 nt, Human
uuuccaagcuguuucgcuuugcaauauauuac

SEQ ID NO: 278392 - RNA, 32 nt, Human
uuuccaaggaagcagaagacgggaggggaggc

SEQ ID NO: 278393 - RNA, 32 nt, Human
uuuccaaggaaggaaaggcacacaaugguauc

SEQ ID NO: 278394 - RNA, 32 nt, Human
uuuccaaggacugggagcaaacuugcaggcuc

SEQ ID NO: 278395 - RNA, 32 nt, Human
uuuccaaggcauuucuguuuauucuuuaguaa

SEQ ID NO: 278396 - RNA, 32 nt, Human
uuuccaaggcuucuccaauucugcccaaaaau

SEQ ID NO: 278397 - RNA, 32 nt, Human
uuuccaagggaaaugcuggcuuuccaguggag

SEQ ID NO: 278398 - RNA, 32 nt, Human
uuuccaagggagcgauacuaaggcagacucag

SEQ ID NO: 278399 - RNA, 28 nt, Human
uuuccaaggucugcugccuucaucuaug

SEQ ID NO: 278400 - RNA, 24 nt, Human
uuuccaaguagcugggauuacagg

SEQ ID NO: 278401 - RNA, 32 nt, Human
uuuccaaguagcugggauuacaggcacccauc

SEQ ID NO: 278402 - RNA, 32 nt, Human
uuuccaagucuugccauauuucaagcaaagag

SEQ ID NO: 278403 - RNA, 31 nt, Human
uuuccaagugagaaggggagcagguguuuac

SEQ ID NO: 278404 - RNA, 32 nt, Human
uuuccaaucaccgacuguccugucuacauuag

SEQ ID NO: 278405 - RNA, 32 nt, Human
uuuccaaucccauguuccuccauucguguguc

SEQ ID NO: 278406 - RNA, 32 nt, Human
uuuccaauguggugacacaauuuuauauccca

SEQ ID NO: 278407 - RNA, 32 nt, Human
uuuccaauuauuccagccucguuguugaaaag

SEQ ID NO: 278408 - RNA, 32 nt, Human
uuuccaauuccauuaagggacccucucuuuuu

SEQ ID NO: 278409 - RNA, 32 nt, Human
uuuccaauugaugagaggagcagagaggaagg

SEQ ID NO: 278410 - RNA, 32 nt, Human
uuuccacaacuaagaaagcagaggccgggcau

SEQ ID NO: 278411 - RNA, 32 nt, Human
uuuccacaagaucugucuccagccuggccuca

SEQ ID NO: 278412 - RNA, 32 nt, Human
uuuccacaagauucccagagacaggaaaaucc

SEQ ID NO: 278413 - RNA, 32 nt, Human
uuuccacaaugccguggaugcugcagucaggc

SEQ ID NO: 278414 - RNA, 32 nt, Human
uuuccacacuugacagugguuggcuuugauga

SEQ ID NO: 278415 - RNA, 32 nt, Human
uuuccacagaggaggaaagagcaggcagcaga

SEQ ID NO: 278416 - RNA, 32 nt, Human
uuuccacagauggggagauagaagcucagaua

SEQ ID NO: 278417 - RNA, 32 nt, Human
uuuccacagucuugcauuucuagauacuucca

SEQ ID NO: 278418 - RNA, 32 nt, Human
uuuccacagugauauauuaaacccaaaaggaa

SEQ ID NO: 278419 - RNA, 32 nt, Human
uuuccacauguuggccaggaugguuucggucu

SEQ ID NO: 278420 - RNA, 32 nt, Human
uuuccacauucugauucaccagccuggaaacu

SEQ ID NO: 278421 - RNA, 32 nt, Human
uuuccaccccucucagcuugagguccuaccug

SEQ ID NO: 278422 - RNA, 32 nt, Human
uuuccacccucaccugcccccucauacagagu

SEQ ID NO: 278423 - RNA, 32 nt, Human
uuuccaccgugccaaggcuccuuacacgcauc

SEQ ID NO: 278424 - RNA, 32 nt, Human
uuuccaccuagcugauccuaaauguuccuucc

SEQ ID NO: 278425 - RNA, 32 nt, Human
uuuccaccuauuggcuauugugaauggugcug

SEQ ID NO: 278426 - RNA, 32 nt, Human
uuuccaccucacugucuccauccuccaccucu

SEQ ID NO: 278427 - RNA, 32 nt, Human
uuuccaccuccccuacaagugcccucgggucu

SEQ ID NO: 278428 - RNA, 32 nt, Human
uuuccaccuccugggccggggcucuggccccc

SEQ ID NO: 278429 - RNA, 32 nt, Human
uuuccaccucugccuuuaaggcauuuuuguca

SEQ ID NO: 278430 - RNA, 32 nt, Human
uuuccaccuuuaagaaugauuuugccaagaau

SEQ ID NO: 278431 - RNA, 32 nt, Human
uuuccacgggaggagaaucaagagugagccau

SEQ ID NO: 278432 - RNA, 32 nt, Human
uuuccacucaacaaccucccaccccuguccug

SEQ ID NO: 278433 - RNA, 32 nt, Human
uuuccacucugggaguggaggucaagaggccc

SEQ ID NO: 278434 - RNA, 32 nt, Human
uuuccacucugucuggugagcucugcuuuuuc

SEQ ID NO: 278435 - RNA, 32 nt, Human
uuuccacugaagcugaaccucugccuuuagga

SEQ ID NO: 278436 - RNA, 32 nt, Human
uuuccacugucagguacuucugacucccuggg

SEQ ID NO: 278437 - RNA, 32 nt, Human
uuuccacuucuuccuuucucuuucucucuucc

SEQ ID NO: 278438 - RNA, 32 nt, Human
uuuccacuugugaggccagccugguagaccuc

SEQ ID NO: 278439 - RNA, 32 nt, Human
uuuccacuugugggcuucagguguuuucaagc

SEQ ID NO: 278440 - RNA, 32 nt, Human
uuuccagaaacccgcuggacccucucuucucc

SEQ ID NO: 278441 - RNA, 32 nt, Human
uuuccagaaggucuuuaaugagcugcuggucc

SEQ ID NO: 278442 - RNA, 32 nt, Human
uuuccagacaucuuuuucagauugucuuaagc

SEQ ID NO: 278443 - RNA, 32 nt, Human
uuuccagaccaggacugaaauccagagagggu

SEQ ID NO: 278444 - RNA, 32 nt, Human
uuuccagagaccacaugugagcuucuuuuagg

SEQ ID NO: 278445 - RNA, 31 nt, Human
uuuccagagagagucaugcuggaggagaagg

SEQ ID NO: 278446 - RNA, 32 nt, Human
uuuccagagccccuaguuccaggauuuccaug

SEQ ID NO: 278447 - RNA, 32 nt, Human
uuuccagagcucccaguggacaugucagagac

SEQ ID NO: 278448 - RNA, 32 nt, Human
uuuccagagcucugucucuguacagcccucuc

SEQ ID NO: 278449 - RNA, 22 nt, Human
uuuccagaggauaggauauuua

SEQ ID NO: 278450 - RNA, 32 nt, Human
uuuccagagggggagcccagagcuugaaaggc

SEQ ID NO: 278451 - RNA, 32 nt, Human
uuuccagagguguguggcucuuaaguugacau

SEQ ID NO: 278452 - RNA, 32 nt, Human
uuuccagagguuagaaaacuugcuugaaguuc

SEQ ID NO: 278453 - RNA, 32 nt, Human
uuuccagagugcucgauacuguuaauuacauc

SEQ ID NO: 278454 - RNA, 32 nt, Human
uuuccagauagugucagcuuauuugaagauua

SEQ ID NO: 278455 - RNA, 32 nt, Human
uuuccagauauuaggucacagcagaagcagcc

SEQ ID NO: 278456 - RNA, 32 nt, Human
uuuccagauguccuagaaauccuagcaacaga

SEQ ID NO: 278457 - RNA, 32 nt, Human
uuuccagaugucugccaacaagaaaugacuca

SEQ ID NO: 278458 - RNA, 32 nt, Human
uuuccagauuacacuccagccugagucagcac

SEQ ID NO: 278459 - RNA, 32 nt, Human
uuuccagcaaacugagaaccugggaauuccug

SEQ ID NO: 278460 - RNA, 32 nt, Human
uuuccagcaggcagccuugcucuggcuggugg

SEQ ID NO: 278461 - RNA, 32 nt, Human
uuuccagcaugcaaucauuuccaucuuaugga

SEQ ID NO: 278462 - RNA, 32 nt, Human
uuuccagcccuuuuaugccugugugaucccac

SEQ ID NO: 278463 - RNA, 32 nt, Human
uuuccagccucaguccagggccccagaacuga

SEQ ID NO: 278464 - RNA, 32 nt, Human
uuuccagccuccagccucucauuucuggggcu

SEQ ID NO: 278465 - RNA, 32 nt, Human
uuuccagccuccaggauugugagaaauacaug

SEQ ID NO: 278466 - RNA, 32 nt, Human
uuuccagccuuccuccccaucucccauucucc

SEQ ID NO: 278467 - RNA, 32 nt, Human
uuuccagccuuugucacuagucuuugaggagg

SEQ ID NO: 278468 - RNA, 22 nt, Human
uuuccagcgagcccuguuccag

SEQ ID NO: 278469 - RNA, 32 nt, Human
uuuccagcuaggacacagcaggucgugauccg

SEQ ID NO: 278470 - RNA, 32 nt, Human
uuuccagcugagccacgccugccgggccaccu

SEQ ID NO: 278471 - RNA, 32 nt, Human
uuuccagcugcaauaagccgugccucauuaua

SEQ ID NO: 278472 - RNA, 32 nt, Human
uuuccaggaaccuugccaugcccacaccuacg

SEQ ID NO: 278473 - RNA, 32 nt, Human
uuuccaggaaguggccauauuggauccauuca

SEQ ID NO: 278474 - RNA, 32 nt, Human
uuuccaggacaguggcagaggcugauggagga

SEQ ID NO: 278475 - RNA, 32 nt, Human
uuuccaggacuagaaccgggaaccuggagccc

SEQ ID NO: 278476 - RNA, 32 nt, Human
uuuccaggacucaggaguggcacugggaagaa

SEQ ID NO: 278477 - RNA, 32 nt, Human
uuuccaggacugcccucuccagaaaaacagua

SEQ ID NO: 278478 - RNA, 32 nt, Human
uuuccaggaggaagacuagugguggauuccau

SEQ ID NO: 278479 - RNA, 32 nt, Human
uuuccaggauacugcauuggaaauugagucag

SEQ ID NO: 278480 - RNA, 32 nt, Human
uuuccaggauuuccuccaccuguaccuccagg

SEQ ID NO: 278481 - RNA, 32 nt, Human
uuuccaggccaccuucuccaucugcucacuga

SEQ ID NO: 278482 - RNA, 32 nt, Human
uuuccaggcccaccuucggccucccagcagcc

SEQ ID NO: 278483 - RNA, 32 nt, Human
uuuccaggcucucuucucucccucucucuccu

SEQ ID NO: 278484 - RNA, 32 nt, Human
uuuccaggcucuggagagaagcccucacccug

SEQ ID NO: 278485 - RNA, 32 nt, Human
uuuccaggcugaagugauucauucauuauucu

SEQ ID NO: 278486 - RNA, 32 nt, Human
uuuccagggacagaggcccaacuccaggacgc

SEQ ID NO: 278487 - RNA, 32 nt, Human
uuuccagggacucaaaauuccaaaaagguggu

SEQ ID NO: 278488 - RNA, 32 nt, Human
uuuccagggauuaggauuagaaggaauauuag

SEQ ID NO: 278489 - RNA, 32 nt, Human
uuuccagggccccagccugauggggcugcccu

SEQ ID NO: 278490 - RNA, 32 nt, Human
uuuccagggcuaaugccuccaucccagucauc

SEQ ID NO: 278491 - RNA, 32 nt, Human
uuuccaguaaaaacaugaccagcuuacaaaaa

SEQ ID NO: 278492 - RNA, 32 nt, Human
uuuccaguaaaacagucuucuccccucccucg

SEQ ID NO: 278493 - RNA, 32 nt, Human
uuuccaguaguuagcuuucuuccuggauuccu

SEQ ID NO: 278494 - RNA, 32 nt, Human
uuuccaguccucaugcaggguaucagcauugc

SEQ ID NO: 278495 - RNA, 32 nt, Human
uuuccagucugccaaucauauugggaaagugc

SEQ ID NO: 278496 - RNA, 31 nt, Human
uuuccaguggaaaaaggaaaagacugguaca

SEQ ID NO: 278497 - RNA, 32 nt, Human
uuuccaguggauacaaggggccuguucacgag

SEQ ID NO: 278498 - RNA, 32 nt, Human
uuuccagugguagcuugaccugagaugauacc

SEQ ID NO: 278499 - RNA, 32 nt, Human
uuuccaguucagaugcaacagggauacauuug

SEQ ID NO: 278500 - RNA, 32 nt, Human
uuuccaguucauuuacauuaagggccuggggg

SEQ ID NO: 278501 - RNA, 32 nt, Human
uuuccaguucccaguauguggcccagagugau

SEQ ID NO: 278502 - RNA, 32 nt, Human
uuuccauagcugggauauaggcugcagcuaua

SEQ ID NO: 278503 - RNA, 32 nt, Human
uuuccauaggaagaagucuuugcagaggaaau

SEQ ID NO: 278504 - RNA, 32 nt, Human
uuuccauaggcagagcgggugucagacugagg

SEQ ID NO: 278505 - RNA, 32 nt, Human
uuuccauaguuggcucuuuugugucaucuuac

SEQ ID NO: 278506 - RNA, 32 nt, Human
uuuccauauagacuauauacugugcaacuccc

SEQ ID NO: 278507 - RNA, 32 nt, Human
uuuccauaugaacugguuauuuuguauaaagu

SEQ ID NO: 278508 - RNA, 32 nt, Human
uuuccauaugacuggggaggccucagaaucau

SEQ ID NO: 278509 - RNA, 24 nt, Human
uuuccauauguauauaguaaaaua

SEQ ID NO: 278510 - RNA, 32 nt, Human
uuuccaucaagcaccagaguugcaguggcuug

SEQ ID NO: 278511 - RNA, 32 nt, Human
uuuccaucacaagccuuugggggaucugggac

SEQ ID NO: 278512 - RNA, 32 nt, Human
uuuccaucagagcccucggacacucccagccc

SEQ ID NO: 278513 - RNA, 32 nt, Human
uuuccaucauaguugcccacucccucuccuua

SEQ ID NO: 278514 - RNA, 32 nt, Human
uuuccaucccacccuggcuuccuuccuccacc

SEQ ID NO: 278515 - RNA, 32 nt, Human
uuuccaucccacccuuuucuuaaucgcuuccg

SEQ ID NO: 278516 - RNA, 32 nt, Human
uuuccauccuagugagaagcuggcccugcagg

SEQ ID NO: 278517 - RNA, 25 nt, Human
uuuccaucuaggacuagaaaaacuu

SEQ ID NO: 278518 - RNA, 32 nt, Human
uuuccaucucagacuggcuggccagggaacgc

SEQ ID NO: 278519 - RNA, 32 nt, Human
uuuccaucuccaccaucuauagugagccucuc

SEQ ID NO: 278520 - RNA, 32 nt, Human
uuuccaucuccagcuccccauuuccuuucuca

SEQ ID NO: 278521 - RNA, 32 nt, Human
uuuccaucugagaccaccucagccuggauuuu

SEQ ID NO: 278522 - RNA, 32 nt, Human
uuuccaucugcucucucuucuggguggagcug

SEQ ID NO: 278523 - RNA, 32 nt, Human
uuuccaucuuauuucauuuccauaacaguuga

SEQ ID NO: 278524 - RNA, 32 nt, Human
uuuccaucuucaguuucuaugacuguggaaua

SEQ ID NO: 278525 - RNA, 32 nt, Human
uuuccaucuucccacacaucucauugaauuug

SEQ ID NO: 278526 - RNA, 32 nt, Human
uuuccaucuuucuuuuucuuccuucugcugcu

SEQ ID NO: 278527 - RNA, 24 nt, Human
uuuccaugagaaaccaagaaacuu

SEQ ID NO: 278528 - RNA, 32 nt, Human
uuuccaugagcucuuggaggcaccaagaaaua

SEQ ID NO: 278529 - RNA, 32 nt, Human
uuuccaugcagcugaucuaaaagggaauaaaa

SEQ ID NO: 278530 - RNA, 32 nt, Human
uuuccaugccugggagggagaauaagaguaag

SEQ ID NO: 278531 - RNA, 32 nt, Human
uuuccaugcuccucucccuccaccuccuggcu

SEQ ID NO: 278532 - RNA, 32 nt, Human
uuuccauggcaaaauuugaagccacauguggu

SEQ ID NO: 278533 - RNA, 32 nt, Human
uuuccauggcagcaggaugcagggauuaauaa

SEQ ID NO: 278534 - RNA, 32 nt, Human
uuuccauggccuuuauuucuccucuuccagug

SEQ ID NO: 278535 - RNA, 32 nt, Human
uuuccaugggaggagagcaguaacccccagcg

SEQ ID NO: 278536 - RNA, 32 nt, Human
uuuccauguccccucccagagcugguggaccc

SEQ ID NO: 278537 - RNA, 32 nt, Human
uuuccauguuacccucccuuccucacauuguu

SEQ ID NO: 278538 - RNA, 32 nt, Human
uuuccauuaaaggguguguccaggaaggaaau

SEQ ID NO: 278539 - RNA, 32 nt, Human
uuuccauuacccuuuauuucugcuaacuuuuu

SEQ ID NO: 278540 - RNA, 32 nt, Human
uuuccauuaguaaaacacaagacuucagauuc

SEQ ID NO: 278541 - RNA, 32 nt, Human
uuuccauuccuauacaggaugugaaggucaga

SEQ ID NO: 278542 - RNA, 32 nt, Human
uuuccauuccucagcacagagcagaaaugaua

SEQ ID NO: 278543 - RNA, 32 nt, Human
uuuccauucucugcccagcagucucuuaccuu

SEQ ID NO: 278544 - RNA, 32 nt, Human
uuuccauugcaauuucuguggcugaggagacu

SEQ ID NO: 278545 - RNA, 32 nt, Human
uuuccauugcccacuuucuucucccucuccuu

SEQ ID NO: 278546 - RNA, 32 nt, Human
uuuccauugugccuuuugaauguugucuucuc

SEQ ID NO: 278547 - RNA, 32 nt, Human
uuuccauuuacccuucuuuucugacuauuuuu

SEQ ID NO: 278548 - RNA, 32 nt, Human
uuuccauuucaaagugguguucuaagucugcg

SEQ ID NO: 278549 - RNA, 32 nt, Human
uuuccauuucuuuuguauuuguuuucugugag

SEQ ID NO: 278550 - RNA, 32 nt, Human
uuuccauuugacuugcuguaagccugagggag

SEQ ID NO: 278551 - RNA, 32 nt, Human
uuuccauuuuauaaguagggaugcaaaauccg

SEQ ID NO: 278552 - RNA, 32 nt, Human
uuuccauuuuccacuuuuauagaccauccuuu

SEQ ID NO: 278553 - RNA, 20 nt, Human
uuuccauuuuuggggggcuu

SEQ ID NO: 278554 - RNA, 32 nt, Human
uuucccaaacauccuuuucauccugugcuucu

SEQ ID NO: 278555 - RNA, 32 nt, Human
uuucccaaacuaagugaacauuagauuuaauu

SEQ ID NO: 278556 - RNA, 32 nt, Human
uuucccaaaguguugggauuacaggcaugagc

SEQ ID NO: 278557 - RNA, 21 nt, Human
uuucccaaaguuucucuuugu

SEQ ID NO: 278558 - RNA, 22 nt, Human
uuucccaagaagaugaagaaug

SEQ ID NO: 278559 - RNA, 32 nt, Human
uuucccaagacuuggcuucuuccuccagauua

SEQ ID NO: 278560 - RNA, 32 nt, Human
uuucccaagcuccuucugcaaggggccugcag

SEQ ID NO: 278561 - RNA, 23 nt, Human
uuucccaagcuggagugcagugg

SEQ ID NO: 278562 - RNA, 32 nt, Human
uuucccaagcuggagugcaguggugcgaucau

SEQ ID NO: 278563 - RNA, 32 nt, Human
uuucccaagggaaagacuuucuggccugcuga

SEQ ID NO: 278564 - RNA, 32 nt, Human
uuucccaagucagacagaugucagcuucccag

SEQ ID NO: 278565 - RNA, 22 nt, Human
uuucccaauaguuuccucugca

SEQ ID NO: 278566 - RNA, 32 nt, Human
uuucccaauccaauccagccuugguuuuauuu

SEQ ID NO: 278567 - RNA, 32 nt, Human
uuucccacacaacuugcugggcaaagcacgau

SEQ ID NO: 278568 - RNA, 32 nt, Human
uuucccacacccacuucucuccuaucaccuuc

SEQ ID NO: 278569 - RNA, 32 nt, Human
uuucccacacgggcagaucaucagccuucaug

SEQ ID NO: 278570 - RNA, 32 nt, Human
uuucccacaggcugcagggcaggaaagguauu

SEQ ID NO: 278571 - RNA, 32 nt, Human
uuucccacaggcugcuuggcaggaaagauauu

SEQ ID NO: 278572 - RNA, 32 nt, Human
uuucccacauuauccaacugugcaucucaaac

SEQ ID NO: 278573 - RNA, 32 nt, Human
uuucccacauucuuuacauuuguaggauucau

SEQ ID NO: 278574 - RNA, 32 nt, Human
uuucccaccccagcugaccaugagacuuugcu

SEQ ID NO: 278575 - RNA, 19 nt, Human
uuucccaccccugcuucag

SEQ ID NO: 278576 - RNA, 32 nt, Human
uuucccacccucucccugacccaagucuuugc

SEQ ID NO: 278577 - RNA, 19 nt, Human
uuucccacucuuccacuga

SEQ ID NO: 278578 - RNA, 32 nt, Human
uuucccacugaaucccaggaagaaggcggcgg

SEQ ID NO: 278579 - RNA, 32 nt, Human
uuucccacugcacccccuccugcugcagaggg

SEQ ID NO: 278580 - RNA, 32 nt, Human
uuucccacugcacuccagccugagugacagag

SEQ ID NO: 278581 - RNA, 25 nt, Human
uuucccacugcuuacugugaguucu

SEQ ID NO: 278582 - RNA, 32 nt, Human
uuucccacugcuucuuccuccuuucucaacca

SEQ ID NO: 278583 - RNA, 32 nt, Human
uuucccacugggugggggugggaauggcggug

SEQ ID NO: 278584 - RNA, 32 nt, Human
uuucccacuuccucuccugagaccaggaacuc

SEQ ID NO: 278585 - RNA, 32 nt, Human
uuucccagaagggagagaggcagcaagucaga

SEQ ID NO: 278586 - RNA, 32 nt, Human
uuucccagaccagccggugguguggagagaaa

SEQ ID NO: 278587 - RNA, 32 nt, Human
uuucccagagcaacguggcauccugagaguca

SEQ ID NO: 278588 - RNA, 32 nt, Human
uuucccagaggagggacuaaaagagagggcag

SEQ ID NO: 278589 - RNA, 32 nt, Human
uuucccagagucuugcucugucgcccagguug

SEQ ID NO: 278590 - RNA, 32 nt, Human
uuucccagauagcaccuacccaacccaggaug

SEQ ID NO: 278591 - RNA, 32 nt, Human
uuucccagauucucggauucucgacucuuugc

SEQ ID NO: 278592 - RNA, 25 nt, Human
uuucccagccaggcccagccaccca

SEQ ID NO: 278593 - RNA, 20 nt, Human
uuucccagcccuccaccacu

SEQ ID NO: 278594 - RNA, 32 nt, Human
uuucccagccuauucuaaaucuuguuaaugac

SEQ ID NO: 278595 - RNA, 22 nt, Human
uuucccagccuccuggcugccu

SEQ ID NO: 278596 - RNA, 32 nt, Human
uuucccagcuacuccggaggcugcgguggaag

SEQ ID NO: 278597 - RNA, 32 nt, Human
uuucccagcuccagccuggagggaaggggaca

SEQ ID NO: 278598 - RNA, 32 nt, Human
uuucccagcuccucacagaggccugguuugcu

SEQ ID NO: 278599 - RNA, 32 nt, Human
uuucccagcugcacucgcccuguggacagccc

SEQ ID NO: 278600 - RNA, 32 nt, Human
uuucccagcugcaucugccccaaaagguugua

SEQ ID NO: 278601 - RNA, 32 nt, Human
uuucccagcuugccucuccugaaaaggccccc

SEQ ID NO: 278602 - RNA, 32 nt, Human
uuucccaggaaggccauugcaguuugacuggc

SEQ ID NO: 278603 - RNA, 32 nt, Human
uuucccaggcagccgcugcagucgccacaccu

SEQ ID NO: 278604 - RNA, 22 nt, Human
uuucccaggccuggguauccag

SEQ ID NO: 278605 - RNA, 32 nt, Human
uuucccaggcuaguagggcugugaggaaugca

SEQ ID NO: 278606 - RNA, 32 nt, Human
uuucccaggcuggagugcaauggcacaaucuu

SEQ ID NO: 278607 - RNA, 32 nt, Human
uuucccaggcuggagugcaaugggugaucuca

SEQ ID NO: 278608 - RNA, 32 nt, Human
uuucccaggcuggagugcacaaacauggcuca

SEQ ID NO: 278609 - RNA, 23 nt, Human
uuucccaggcuggagugcagagg

SEQ ID NO: 278610 - RNA, 32 nt, Human
uuucccaggcuggagugcaguggcgcuaucuu

SEQ ID NO: 278611 - RNA, 32 nt, Human
uuucccaggcuggagugcaguggugggaucuc

SEQ ID NO: 278612 - RNA, 32 nt, Human
uuucccaggcuggcgcugagaugggcaggugc

SEQ ID NO: 278613 - RNA, 32 nt, Human
uuucccaggcuggucucaaacuccugagcuca

SEQ ID NO: 278614 - RNA, 32 nt, Human
uuucccaggcuggucuugaacuccugagcgca

SEQ ID NO: 278615 - RNA, 32 nt, Human
uuucccaggcuggucuugaauuccugggauca

SEQ ID NO: 278616 - RNA, 32 nt, Human
uuucccagggggcagaggcaggggcgggaggg

SEQ ID NO: 278617 - RNA, 32 nt, Human
uuucccagguauaaaaccuaaaauuaagaagu

SEQ ID NO: 278618 - RNA, 32 nt, Human
uuucccagguuggaguauaguggugccgucau

SEQ ID NO: 278619 - RNA, 32 nt, Human
uuucccaguaaagaagguaaagaagauauaaa

SEQ ID NO: 278620 - RNA, 32 nt, Human
uuucccaguaggggcggccgggcagaggcgcc

SEQ ID NO: 278621 - RNA, 32 nt, Human
uuucccagugucuccccaugggguuaagcucu

SEQ ID NO: 278622 - RNA, 32 nt, Human
uuucccaguguguguucauuguaaacacuuuu

SEQ ID NO: 278623 - RNA, 32 nt, Human
uuucccaguguuguuagugaaauguuaaaauc

SEQ ID NO: 278624 - RNA, 32 nt, Human
uuucccaguuuauccggagcaggaugaauccc

SEQ ID NO: 278625 - RNA, 32 nt, Human
uuucccaguuugggaagugaggagaaccugcc

SEQ ID NO: 278626 - RNA, 32 nt, Human
uuucccaguuuuugcaccaaaauaaacuggua

SEQ ID NO: 278627 - RNA, 32 nt, Human
uuucccauaauuccagaaagcaaaaggcuuac

SEQ ID NO: 278628 - RNA, 32 nt, Human
uuucccauauacaaucuuccuuccuuagguaa

SEQ ID NO: 278629 - RNA, 32 nt, Human
uuucccauaugcauaggugcaccccuugggau

SEQ ID NO: 278630 - RNA, 32 nt, Human
uuucccaucagccuguuucuccaccuuagaaa

SEQ ID NO: 278631 - RNA, 32 nt, Human
uuucccaucccaggagcucauuauccagucug

SEQ ID NO: 278632 - RNA, 32 nt, Human
uuucccauccccaccuuccuuccuuuguccuu

SEQ ID NO: 278633 - RNA, 32 nt, Human
uuucccauccugcuguagacuucuugauuguc

SEQ ID NO: 278634 - RNA, 32 nt, Human
uuucccaugaacacuugcaguugcuaagggac

SEQ ID NO: 278635 - RNA, 32 nt, Human
uuucccauggcugcuucauuuguuguucauuu

SEQ ID NO: 278636 - RNA, 32 nt, Human
uuucccauggcuggaauacuuaccucagggac

SEQ ID NO: 278637 - RNA, 32 nt, Human
uuucccaugucagagcccccaaauggggguag

SEQ ID NO: 278638 - RNA, 32 nt, Human
uuucccauucacugcagucaucugacucauuu

SEQ ID NO: 278639 - RNA, 32 nt, Human
uuucccauucucuuucucaggaauggcuguua

SEQ ID NO: 278640 - RNA, 32 nt, Human
uuucccauuggguauucuuggaaccuuuguaa

SEQ ID NO: 278641 - RNA, 32 nt, Human
uuucccauuguucuguugcuccaccuuauugu

SEQ ID NO: 278642 - RNA, 32 nt, Human
uuuccccaaaggagguagaagauggggaagau

SEQ ID NO: 278643 - RNA, 32 nt, Human
uuuccccaacagcacagcuaaauuuccaaguc

SEQ ID NO: 278644 - RNA, 32 nt, Human
uuuccccaacagcucccggcaggggcgcucca

SEQ ID NO: 278645 - RNA, 32 nt, Human
uuuccccaacuaaagcgugaacuccuaguagg

SEQ ID NO: 278646 - RNA, 32 nt, Human
uuuccccaagcagaggagucaggacuugagaa

SEQ ID NO: 278647 - RNA, 32 nt, Human
uuuccccaaggcggcagagaggauggggcuga

SEQ ID NO: 278648 - RNA, 32 nt, Human
uuuccccaagugcugggauuacaggugugagc

SEQ ID NO: 278649 - RNA, 20 nt, Human
uuuccccacacuggggggcu

SEQ ID NO: 278650 - RNA, 32 nt, Human
uuuccccaccacaacccaccacggccaggcag

SEQ ID NO: 278651 - RNA, 23 nt, Human
uuuccccacccgagaugaaggau

SEQ ID NO: 278652 - RNA, 32 nt, Human
uuuccccaccucuuccuuccgcuccuuuaccu

SEQ ID NO: 278653 - RNA, 32 nt, Human
uuuccccagaagcagacuaugagaccaggauu

SEQ ID NO: 278654 - RNA, 32 nt, Human
uuuccccagaguacacagccugccuuuccacu

SEQ ID NO: 278655 - RNA, 32 nt, Human
uuuccccagcacagccuccugucgcugcaugc

SEQ ID NO: 278656 - RNA, 32 nt, Human
uuuccccagcauuuccaaaacuaccuaguccc

SEQ ID NO: 278657 - RNA, 32 nt, Human
uuuccccagcuccuauaccucuaccuuuccag

SEQ ID NO: 278658 - RNA, 32 nt, Human
uuuccccagcuggccuggacugccugugcucu

SEQ ID NO: 278659 - RNA, 32 nt, Human
uuuccccagcugugaaauggggccagucccca

SEQ ID NO: 278660 - RNA, 32 nt, Human
uuuccccaggagaagccaagaacuuguguguc

SEQ ID NO: 278661 - RNA, 32 nt, Human
uuuccccaggagagaguggucuggugggcuuc

SEQ ID NO: 278662 - RNA, 32 nt, Human
uuuccccaggcagagagagggggccccagccu

SEQ ID NO: 278663 - RNA, 32 nt, Human
uuuccccaguauaguggaaagacugaggcuuc

SEQ ID NO: 278664 - RNA, 32 nt, Human
uuuccccagucccuaucucccccauccccucc

SEQ ID NO: 278665 - RNA, 32 nt, Human
uuuccccauagacguaucaaaauauuacccau

SEQ ID NO: 278666 - RNA, 32 nt, Human
uuuccccauaggaagacagaccauaggcaaac

SEQ ID NO: 278667 - RNA, 32 nt, Human
uuuccccauaucuucucucccccaccuuuauc

SEQ ID NO: 278668 - RNA, 20 nt, Human
uuuccccaucccucugcacu

SEQ ID NO: 278669 - RNA, 32 nt, Human
uuuccccaucuucuucuuucagaucauuaaug

SEQ ID NO: 278670 - RNA, 32 nt, Human
uuuccccauguuggccaggcuggucuugaacu

SEQ ID NO: 278671 - RNA, 32 nt, Human
uuuccccauuguucuaugcacacagacagggu

SEQ ID NO: 278672 - RNA, 32 nt, Human
uuucccccaaaggcaucccagccugggggcca

SEQ ID NO: 278673 - RNA, 32 nt, Human
uuucccccaaccucccccuccuguccccucug

SEQ ID NO: 278674 - RNA, 32 nt, Human
uuucccccaccgccaucuccagagccaccauc

SEQ ID NO: 278675 - RNA, 32 nt, Human
uuucccccaguuuuggucugugacacauuugg

SEQ ID NO: 278676 - RNA, 24 nt, Human
uuucccccgucagucugggggcuu

SEQ ID NO: 278677 - RNA, 32 nt, Human
uuucccccucacugcaguugucugcauuuuua

SEQ ID NO: 278678 - RNA, 32 nt, Human
uuucccccugcucccccacagccgguucugca

SEQ ID NO: 278679 - RNA, 32 nt, Human
uuucccccuucucucucccucucccucucucu

SEQ ID NO: 278680 - RNA, 32 nt, Human
uuuccccguucacugaaggcccugcagucagg

SEQ ID NO: 278681 - RNA, 32 nt, Human
uuuccccuagcuuuccccagacacccuguuuu

SEQ ID NO: 278682 - RNA, 32 nt, Human
uuuccccuccacuugcugccaagaucauauuc

SEQ ID NO: 278683 - RNA, 32 nt, Human
uuuccccucccucccucccucccucccuuccu

SEQ ID NO: 278684 - RNA, 32 nt, Human
uuuccccuccggcacugacucucccccuccaa

SEQ ID NO: 278685 - RNA, 32 nt, Human
uuuccccuccuuuccuccuccugccccauaau

SEQ ID NO: 278686 - RNA, 32 nt, Human
uuuccccuccuuuucuuuuuccuuccuucuuu

SEQ ID NO: 278687 - RNA, 32 nt, Human
uuuccccucguugguccucccauucagagagg

SEQ ID NO: 278688 - RNA, 32 nt, Human
uuuccccucucccuccuacucucccccuuucu

SEQ ID NO: 278689 - RNA, 32 nt, Human
uuuccccugaaccagcccuggaccuuucugag

SEQ ID NO: 278690 - RNA, 32 nt, Human
uuuccccugcacucccgaccuuagcuuauuga

SEQ ID NO: 278691 - RNA, 32 nt, Human
uuuccccugccugcuccuccaugcugugagcu

SEQ ID NO: 278692 - RNA, 32 nt, Human
uuuccccugccuuucucauuccuuccuucguc

SEQ ID NO: 278693 - RNA, 32 nt, Human
uuuccccugcuguuugccccucagucuuuaua

SEQ ID NO: 278694 - RNA, 32 nt, Human
uuuccccuggacaaaaugauaccuaaacuguu

SEQ ID NO: 278695 - RNA, 32 nt, Human
uuuccccugggcagaugguaggcagggagcug

SEQ ID NO: 278696 - RNA, 32 nt, Human
uuuccccuggugccccagagacaggagcacaa

SEQ ID NO: 278697 - RNA, 32 nt, Human
uuuccccuguucuuuuuguguuaugcacuuaa

SEQ ID NO: 278698 - RNA, 32 nt, Human
uuuccccuucauucucacccugucugcuuuua

SEQ ID NO: 278699 - RNA, 32 nt, Human
uuuccccuucucccuucucucccagcagaacg

SEQ ID NO: 278700 - RNA, 32 nt, Human
uuuccccuuguacaauuaugcuguguuuuuaa

SEQ ID NO: 278701 - RNA, 32 nt, Human
uuuccccuuuucccaguccccugcuuuuugaa

SEQ ID NO: 278702 - RNA, 21 nt, Human
uuuccccuuuuccucuuugca

SEQ ID NO: 278703 - RNA, 32 nt, Human
uuucccgaguagcugggacuacagagauggca

SEQ ID NO: 278704 - RNA, 32 nt, Human
uuucccgcacugucuccagucacgauccagcc

SEQ ID NO: 278705 - RNA, 32 nt, Human
uuucccgccuccuugaugcuucuugaaaccua

SEQ ID NO: 278706 - RNA, 32 nt, Human
uuucccguggccccagccuggcccagcucccc

SEQ ID NO: 278707 - RNA, 32 nt, Human
uuucccuagggaccaggcacucauauggcggg

SEQ ID NO: 278708 - RNA, 32 nt, Human
uuucccuaggugccaucuccucaagcuacaaa

SEQ ID NO: 278709 - RNA, 32 nt, Human
uuucccuauaauuaaaagagguggugaguccu

SEQ ID NO: 278710 - RNA, 32 nt, Human
uuucccuaucuucucccccacgguauccuaaa

SEQ ID NO: 278711 - RNA, 32 nt, Human
uuucccuauucuguggauacagucccagaguu

SEQ ID NO: 278712 - RNA, 32 nt, Human
uuucccucagcacuuggcaucuugucaucuac

SEQ ID NO: 278713 - RNA, 32 nt, Human
uuucccucagcuuaaugcuuuugagucauuca

SEQ ID NO: 278714 - RNA, 32 nt, Human
uuucccucauccagcagcuggcaucugaccuu

SEQ ID NO: 278715 - RNA, 32 nt, Human
uuucccucauccaugcugugcuguguuauuua

SEQ ID NO: 278716 - RNA, 32 nt, Human
uuucccuccaccacugaugcagucccaccgaa

SEQ ID NO: 278717 - RNA, 32 nt, Human
uuucccuccaucugccccaggacaagagcaag

SEQ ID NO: 278718 - RNA, 32 nt, Human
uuucccucccaggagcccccuagguggcuggg

SEQ ID NO: 278719 - RNA, 32 nt, Human
uuucccucccucccucuccgcauucuucccuu

SEQ ID NO: 278720 - RNA, 32 nt, Human
uuucccuccucccauucucccaagggccucag

SEQ ID NO: 278721 - RNA, 32 nt, Human
uuucccuccuccucccccucuccgcucugugc

SEQ ID NO: 278722 - RNA, 22 nt, Human
uuucccuccugcuggagcaccg

SEQ ID NO: 278723 - RNA, 32 nt, Human
uuucccucgcucuccccucccugcuuggcccc

SEQ ID NO: 278724 - RNA, 32 nt, Human
uuucccucgucaauuaaacaaaggccaagaaa

SEQ ID NO: 278725 - RNA, 32 nt, Human
uuucccucgucaugcauuuccacauauccaca

SEQ ID NO: 278726 - RNA, 32 nt, Human
uuucccucuaauuuauuuugcauccuagugga

SEQ ID NO: 278727 - RNA, 23 nt, Human
uuucccucucagccuggaggcug

SEQ ID NO: 278728 - RNA, 32 nt, Human
uuucccucucccaggggccugaugucaucauu

SEQ ID NO: 278729 - RNA, 21 nt, Human
uuucccucugccuagaaugcu

SEQ ID NO: 278730 - RNA, 25 nt, Human
uuucccucugcuguggcggugacug

SEQ ID NO: 278731 - RNA, 32 nt, Human
uuucccucuggcccugacucucacugacucac

SEQ ID NO: 278732 - RNA, 32 nt, Human
uuucccucugggcccagccucuccccaccccc

SEQ ID NO: 278733 - RNA, 21 nt, Human
uuucccucugugcggcggccg

SEQ ID NO: 278734 - RNA, 28 nt, Human
uuucccucuuccgcugccucauuccuuu

SEQ ID NO: 278735 - RNA, 32 nt, Human
uuucccucuuuccugguaauuccuaaguaauu

SEQ ID NO: 278736 - RNA, 32 nt, Human
uuucccugacaauccccaucaccuuuaggggu

SEQ ID NO: 278737 - RNA, 32 nt, Human
uuucccugacggcccuugcugccugcauggcu

SEQ ID NO: 278738 - RNA, 32 nt, Human
uuucccugaggagugggcuccugcuccaugag

SEQ ID NO: 278739 - RNA, 32 nt, Human
uuucccugaguauagaguucuaauuuggggaa

SEQ ID NO: 278740 - RNA, 32 nt, Human
uuucccugagugcccagggugucuccucugcc

SEQ ID NO: 278741 - RNA, 32 nt, Human
uuucccugcaucccuuggccccucucuguuua

SEQ ID NO: 278742 - RNA, 19 nt, Human
uuucccugccuguauuaca

SEQ ID NO: 278743 - RNA, 32 nt, Human
uuucccugcgaguggacgugcccagcuguccc

SEQ ID NO: 278744 - RNA, 32 nt, Human
uuucccugcucucucugcucagaacacuacca

SEQ ID NO: 278745 - RNA, 32 nt, Human
uuucccugcuuugguuuguuugaaaucuaaau

SEQ ID NO: 278746 - RNA, 32 nt, Human
uuucccuggagguucuggaugaaggcugaaca

SEQ ID NO: 278747 - RNA, 32 nt, Human
uuucccuggcuggucucggacuccugggcuca

SEQ ID NO: 278748 - RNA, 32 nt, Human
uuucccugggcaaaguaaaagcuuucuuggag

SEQ ID NO: 278749 - RNA, 32 nt, Human
uuucccugggcugagaggggaagugcauaugu

SEQ ID NO: 278750 - RNA, 32 nt, Human
uuucccugucuucugcauaaucaugccuucuu

SEQ ID NO: 278751 - RNA, 32 nt, Human
uuucccugugacugaaccaggagaucuggcug

SEQ ID NO: 278752 - RNA, 32 nt, Human
uuucccugugcugugugcuugugugcaugugc

SEQ ID NO: 278753 - RNA, 32 nt, Human
uuucccuguucauggcaggccauggcccgggc

SEQ ID NO: 278754 - RNA, 32 nt, Human
uuucccuguuccagggaaggcguugggaugau

SEQ ID NO: 278755 - RNA, 32 nt, Human
uuucccuuaaguuccuccuuagugccaucaca

SEQ ID NO: 278756 - RNA, 32 nt, Human
uuucccuuacuucauccucccccucaucuccu

SEQ ID NO: 278757 - RNA, 32 nt, Human
uuucccuuauucacagagaauuuguccagcau

SEQ ID NO: 278758 - RNA, 32 nt, Human
uuucccuucagagcucacacaguggucaccau

SEQ ID NO: 278759 - RNA, 32 nt, Human
uuucccuucauuucccccuccuuugcuggaug

SEQ ID NO: 278760 - RNA, 32 nt, Human
uuucccuuccgcuucccucccuuucuucccac

SEQ ID NO: 278761 - RNA, 32 nt, Human
uuucccuuccuccuccucuucuccucccucuu

SEQ ID NO: 278762 - RNA, 32 nt, Human
uuucccuuccuuccuuccuuccuuccuuccuu

SEQ ID NO: 278763 - RNA, 32 nt, Human
uuucccuucuucaaauccucccacccuucaau

SEQ ID NO: 278764 - RNA, 32 nt, Human
uuucccuugcagaguguuugcugguagcagug

SEQ ID NO: 278765 - RNA, 32 nt, Human
uuucccuugccaguucccuggugacaguuacc

SEQ ID NO: 278766 - RNA, 32 nt, Human
uuucccuugccuggcccacugcaccugucccc

SEQ ID NO: 278767 - RNA, 18 nt, Human
uuucccuugcgugaagga

SEQ ID NO: 278768 - RNA, 32 nt, Human
uuucccuugcugcuccccuuguggccugacgc

SEQ ID NO: 278769 - RNA, 21 nt, Human
uuucccuugcuuuuggggguu

SEQ ID NO: 278770 - RNA, 32 nt, Human
uuucccuuggcugcccagucacccugccuggg

SEQ ID NO: 278771 - RNA, 32 nt, Human
uuucccuuuacacccuguaauuuauucaaaug

SEQ ID NO: 278772 - RNA, 32 nt, Human
uuucccuuuauuccuugccuggaccacuccac

SEQ ID NO: 278773 - RNA, 32 nt, Human
uuucccuuuccuucacauuuguggacuccugg

SEQ ID NO: 278774 - RNA, 32 nt, Human
uuucccuuugagaugaagugcuguucuuuugc

SEQ ID NO: 278775 - RNA, 32 nt, Human
uuucccuuugcaggaggguggagucccugggu

SEQ ID NO: 278776 - RNA, 32 nt, Human
uuucccuuugccacacugugguagguguuuga

SEQ ID NO: 278777 - RNA, 32 nt, Human
uuucccuuuggguuccauguuuuccuuguucc

SEQ ID NO: 278778 - RNA, 22 nt, Human
uuucccuuuucuaugaggacuu

SEQ ID NO: 278779 - RNA, 32 nt, Human
uuucccuuuuucucccuucccugaaagggccu

SEQ ID NO: 278780 - RNA, 32 nt, Human
uuucccuuuuugaguuugaaucauagccuuga

SEQ ID NO: 278781 - RNA, 32 nt, Human
uuucccuuuuugcuuccaaacuccucaacugg

SEQ ID NO: 278782 - RNA, 32 nt, Human
uuuccgaaaauggaggcauuccuuuccaaauc

SEQ ID NO: 278783 - RNA, 32 nt, Human
uuuccgacaaggacagccugggggaugagaug

SEQ ID NO: 278784 - RNA, 22 nt, Human
uuuccgcagacaccuucuguga

SEQ ID NO: 278785 - RNA, 32 nt, Human
uuuccgcaguuaggggcugcuauuucaacgca

SEQ ID NO: 278786 - RNA, 32 nt, Human
uuuccgcccugagcguggcagcugcugccggg

SEQ ID NO: 278787 - RNA, 32 nt, Human
uuuccgcuacucacccucccacccugagccug

SEQ ID NO: 278788 - RNA, 32 nt, Human
uuuccgcucacugcaaccuccgccucccaggu

SEQ ID NO: 278789 - RNA, 32 nt, Human
uuuccgcugcaaccaaucagaugagaggauuc

SEQ ID NO: 278790 - RNA, 32 nt, Human
uuuccgcugcugagcccugcccgccggccggc

SEQ ID NO: 278791 - RNA, 32 nt, Human
uuuccgcuguauuuucuugcagugugccauuc

SEQ ID NO: 278792 - RNA, 23 nt, Human
uuuccgcuguuccucagcgggcc

SEQ ID NO: 278793 - RNA, 32 nt, Human
uuuccgcuuugcacuccaccccgguagcagcu

SEQ ID NO: 278794 - RNA, 32 nt, Human
uuuccggaggacagccaacaagcgaugcugcc

SEQ ID NO: 278795 - RNA, 32 nt, Human
uuuccggaggggagauggauucccuggaaugg

SEQ ID NO: 278796 - RNA, 32 nt, Human
uuuccggcacacacggaguggcuuugacagau

SEQ ID NO: 278797 - RNA, 32 nt, Human
uuuccggcagugacgaccuacccacacgagaa

SEQ ID NO: 278798 - RNA, 32 nt, Human
uuuccgggaaccuggaccagacucuggcccag

SEQ ID NO: 278799 - RNA, 32 nt, Human
uuuccgggaacucacccaggagcaagcgagac

SEQ ID NO: 278800 - RNA, 32 nt, Human
uuuccgggggcggggaugagugcagcugggcu

SEQ ID NO: 278801 - RNA, 32 nt, Human
uuuccguauuucugcuguagaaguagaaauaa

SEQ ID NO: 278802 - RNA, 32 nt, Human
uuuccguccaacaacucuguagagcucucugc

SEQ ID NO: 278803 - RNA, 32 nt, Human
uuuccgucugggaacaguaccucugccccuga

SEQ ID NO: 278804 - RNA, 32 nt, Human
uuuccgucugucucaacagcugagauggggcc

SEQ ID NO: 278805 - RNA, 32 nt, Human
uuuccgugaacucuggugcuccugcaucucau

SEQ ID NO: 278806 - RNA, 32 nt, Human
uuuccuaaacccugcugccuucccaaaaauac

SEQ ID NO: 278807 - RNA, 32 nt, Human
uuuccuaaauauucuucuuuaccuuuaacaag

SEQ ID NO: 278808 - RNA, 32 nt, Human
uuuccuaagagggaguggaggcucggggccac

SEQ ID NO: 278809 - RNA, 32 nt, Human
uuuccuaauagggaagggaagcacaauggaaa

SEQ ID NO: 278810 - RNA, 32 nt, Human
uuuccuacaagugauuuaggggcagauccuga

SEQ ID NO: 278811 - RNA, 32 nt, Human
uuuccuacacagauucuuuuccccaucuccuc

SEQ ID NO: 278812 - RNA, 32 nt, Human
uuuccuacagaugaaggcucucauugcaaaca

SEQ ID NO: 278813 - RNA, 32 nt, Human
uuuccuaccccuucuacccucuccuuaaacau

SEQ ID NO: 278814 - RNA, 32 nt, Human
uuuccuacccuugugaacuuggagcacauuuc

SEQ ID NO: 278815 - RNA, 32 nt, Human
uuuccuaccuaguuucucccucuuguccugca

SEQ ID NO: 278816 - RNA, 32 nt, Human
uuuccuacuacaaagaauaacagcaguuagaa

SEQ ID NO: 278817 - RNA, 20 nt, Human
uuuccuacucugaguuacug

SEQ ID NO: 278818 - RNA, 32 nt, Human
uuuccuacugaguguaccacugccuucccuuc

SEQ ID NO: 278819 - RNA, 32 nt, Human
uuuccuacuucugcccuucccugccaccccuc

SEQ ID NO: 278820 - RNA, 32 nt, Human
uuuccuacuucuucagugccucuuucaccaau

SEQ ID NO: 278821 - RNA, 32 nt, Human
uuuccuagaagagaucaaagagugguugcuuc

SEQ ID NO: 278822 - RNA, 32 nt, Human
uuuccuagcccuucccccuccccaagacugug

SEQ ID NO: 278823 - RNA, 32 nt, Human
uuuccuaggaaacacagacauaggauagcuau

SEQ ID NO: 278824 - RNA, 32 nt, Human
uuuccuaguucuuuugucagaagaacucucuu

SEQ ID NO: 278825 - RNA, 32 nt, Human
uuuccuaucacugugaacuuugcugguacaga

SEQ ID NO: 278826 - RNA, 32 nt, Human
uuuccuaucucccauuugccuucgguccucaa

SEQ ID NO: 278827 - RNA, 32 nt, Human
uuuccuaucucuagcaaccuccugggccccau

SEQ ID NO: 278828 - RNA, 32 nt, Human
uuuccuaucuucacaccugccaccucauguuc

SEQ ID NO: 278829 - RNA, 32 nt, Human
uuuccuaucuuccuccagcuuccagcuaggcc

SEQ ID NO: 278830 - RNA, 32 nt, Human
uuuccuaucuuccuuccucucucucuuccucu

SEQ ID NO: 278831 - RNA, 32 nt, Human
uuuccuauucaagacguccuggaaaacuacau

SEQ ID NO: 278832 - RNA, 32 nt, Human
uuuccuauuuuaauugcuuuagggaagagcaa

SEQ ID NO: 278833 - RNA, 32 nt, Human
uuuccucaagggcaggggcuccuggccaucuu

SEQ ID NO: 278834 - RNA, 31 nt, Human
uuuccucaaguaauauaccuguuugaagcuu

SEQ ID NO: 278835 - RNA, 32 nt, Human
uuuccucaagugccgacaccucccucaucucu

SEQ ID NO: 278836 - RNA, 32 nt, Human
uuuccucacaugcucucaggagacaaggugug

SEQ ID NO: 278837 - RNA, 32 nt, Human
uuuccucaccagaaaaaugggaacaaggcaau

SEQ ID NO: 278838 - RNA, 32 nt, Human
uuuccucaccgacaguaccaucaugccuugag

SEQ ID NO: 278839 - RNA, 32 nt, Human
uuuccucaccuccagaucacacacaugcacac

SEQ ID NO: 278840 - RNA, 32 nt, Human
uuuccucacugauauugggaggagggaaaggc

SEQ ID NO: 278841 - RNA, 21 nt, Human
uuuccucagauugaaaagcuu

SEQ ID NO: 278842 - RNA, 32 nt, Human
uuuccucagauuuauuuugucuugccccauug

SEQ ID NO: 278843 - RNA, 32 nt, Human
uuuccucagccaaaggucccagccuuccuucu

SEQ ID NO: 278844 - RNA, 32 nt, Human
uuuccucaggcuuagguuucuggauuugaagu

SEQ ID NO: 278845 - RNA, 32 nt, Human
uuuccucagggauccaccacagucuaggccag

SEQ ID NO: 278846 - RNA, 32 nt, Human
uuuccucaucccuucaccuguggauggucagg

SEQ ID NO: 278847 - RNA, 32 nt, Human
uuuccucaucugagagcgaggcguggcagcgu

SEQ ID NO: 278848 - RNA, 32 nt, Human
uuuccucaucugcaaaaugggggcaauauguc

SEQ ID NO: 278849 - RNA, 32 nt, Human
uuuccucaucuguaaaggagagaggcuaagaa

SEQ ID NO: 278850 - RNA, 32 nt, Human
uuuccucaucuguaaaguggggagaaaagucu

SEQ ID NO: 278851 - RNA, 32 nt, Human
uuuccucaucuuccucuugcugcugccaugua

SEQ ID NO: 278852 - RNA, 32 nt, Human
uuuccuccaaaacaaaaauuagaggauuauuu

SEQ ID NO: 278853 - RNA, 32 nt, Human
uuuccuccacccuuuccucucccucaguuugc

SEQ ID NO: 278854 - RNA, 32 nt, Human
uuuccuccagccugaagucuucggcaaauagc

SEQ ID NO: 278855 - RNA, 32 nt, Human
uuuccuccagcucugcugaagccagcacagaa

SEQ ID NO: 278856 - RNA, 32 nt, Human
uuuccuccaguggagugggacuucucuggcuc

SEQ ID NO: 278857 - RNA, 32 nt, Human
uuuccuccauuguuguaaaacauguguuuugc

SEQ ID NO: 278858 - RNA, 23 nt, Human
uuuccuccauuuucuguguauug

SEQ ID NO: 278859 - RNA, 32 nt, Human
uuuccucccacuuagacucaaacacauuuuag

SEQ ID NO: 278860 - RNA, 32 nt, Human
uuuccucccagacucugacauggauguucaug

SEQ ID NO: 278861 - RNA, 32 nt, Human
uuuccuccccaaguuugcuauucaaaucaacu

SEQ ID NO: 278862 - RNA, 32 nt, Human
uuuccuccccaccccacuccccaaauacagag

SEQ ID NO: 278863 - RNA, 32 nt, Human
uuuccuccccuccaccaggggucacacaauca

SEQ ID NO: 278864 - RNA, 32 nt, Human
uuuccucccgcuucccucuccaugaagugauu

SEQ ID NO: 278865 - RNA, 32 nt, Human
uuuccucccucuaaaaucaaagagcugaauua

SEQ ID NO: 278866 - RNA, 32 nt, Human
uuuccucccucuucaucaacauaguaaaauaa

SEQ ID NO: 278867 - RNA, 32 nt, Human
uuuccucccugccucagcucccugcccagcca

SEQ ID NO: 278868 - RNA, 32 nt, Human
uuuccucccuuucauuugauaauuuuuccuuc

SEQ ID NO: 278869 - RNA, 32 nt, Human
uuuccucccuuucucccucucucccucuuccu

SEQ ID NO: 278870 - RNA, 32 nt, Human
uuuccuccucaagcaagcuuguugcaggcacu

SEQ ID NO: 278871 - RNA, 32 nt, Human
uuuccuccuccccuuuccccuucuccccacca

SEQ ID NO: 278872 - RNA, 32 nt, Human
uuuccuccuccuccucaccaagggcccaaccg

SEQ ID NO: 278873 - RNA, 32 nt, Human
uuuccuccuccuccuuggccuacucaacauga

SEQ ID NO: 278874 - RNA, 32 nt, Human
uuuccuccuguucccuccaccuacagguugua

SEQ ID NO: 278875 - RNA, 32 nt, Human
uuuccuccuucccaucuucugugcuuccagag

SEQ ID NO: 278876 - RNA, 32 nt, Human
uuuccuccuucccccucuaucuccuucuuucc

SEQ ID NO: 278877 - RNA, 32 nt, Human
uuuccuccuuguaggcauuucaucugugugug

SEQ ID NO: 278878 - RNA, 32 nt, Human
uuuccuccuuuaucacaaccaccguuacaagu

SEQ ID NO: 278879 - RNA, 32 nt, Human
uuuccuccuuucuccacuccaaugguuuaaug

SEQ ID NO: 278880 - RNA, 32 nt, Human
uuuccuccuuucucuguauauugggcucagag

SEQ ID NO: 278881 - RNA, 32 nt, Human
uuuccucgcagguggcaccugguaaaugguua

SEQ ID NO: 278882 - RNA, 32 nt, Human
uuuccucgcuuuuaaugaccucagccccgccu

SEQ ID NO: 278883 - RNA, 32 nt, Human
uuuccucggcauuuccccaacuccuucuccac

SEQ ID NO: 278884 - RNA, 32 nt, Human
uuuccucuaaccccucuccuccauagccuucu

SEQ ID NO: 278885 - RNA, 32 nt, Human
uuuccucuauacaucucuccccaacccuaggu

SEQ ID NO: 278886 - RNA, 32 nt, Human
uuuccucuccaccaucucacauuuugcuuuua

SEQ ID NO: 278887 - RNA, 32 nt, Human
uuuccucuccauccuucauccuccauuggucc

SEQ ID NO: 278888 - RNA, 32 nt, Human
uuuccucuccgccucuccuccccagccggccc

SEQ ID NO: 278889 - RNA, 32 nt, Human
uuuccucuccuccccucuggauuucucagaga

SEQ ID NO: 278890 - RNA, 32 nt, Human
uuuccucuccugggugcucugugcuucaacau

SEQ ID NO: 278891 - RNA, 32 nt, Human
uuuccucuccugugggaaggagaguugacucu

SEQ ID NO: 278892 - RNA, 32 nt, Human
uuuccucucuagugaaguccuuggggaucugc

SEQ ID NO: 278893 - RNA, 32 nt, Human
uuuccucucugccugcccuuuccugucccucc

SEQ ID NO: 278894 - RNA, 32 nt, Human
uuuccucucugccugcuccugucucucccugg

SEQ ID NO: 278895 - RNA, 32 nt, Human
uuuccucucuucuucccuucuuucugguuggu

SEQ ID NO: 278896 - RNA, 32 nt, Human
uuuccucucuucuucuuucgcgguucagcaug

SEQ ID NO: 278897 - RNA, 32 nt, Human
uuuccucugaguguguuuguguccuaaucuuc

SEQ ID NO: 278898 - RNA, 32 nt, Human
uuuccucugcagcugcuaaaacuacauguggc

SEQ ID NO: 278899 - RNA, 24 nt, Human
uuuccucugccccacucccugcca

SEQ ID NO: 278900 - RNA, 32 nt, Human
uuuccucugccuggaccccacuugcuccagcu

SEQ ID NO: 278901 - RNA, 32 nt, Human
uuuccucugcuccuccuucuccuacucuauau

SEQ ID NO: 278902 - RNA, 32 nt, Human
uuuccucugcuccucugccuguccucucccaa

SEQ ID NO: 278903 - RNA, 32 nt, Human
uuuccucuggacaaaaugacagcauccuggcg

SEQ ID NO: 278904 - RNA, 32 nt, Human
uuuccucugggaguuugacuagcccagcucug

SEQ ID NO: 278905 - RNA, 32 nt, Human
uuuccucuguacugugagacugugggagauuu

SEQ ID NO: 278906 - RNA, 24 nt, Human
uuuccucuguuuuuaaacaucuua

SEQ ID NO: 278907 - RNA, 32 nt, Human
uuuccucuuaaagagcugcucugagcuguggg

SEQ ID NO: 278908 - RNA, 32 nt, Human
uuuccucuuaagucucuacacacacauuuuga

SEQ ID NO: 278909 - RNA, 32 nt, Human
uuuccucuucaauuucuugccuauucaaguuu

SEQ ID NO: 278910 - RNA, 32 nt, Human
uuuccucuucagauccuggucugcaccucuag

SEQ ID NO: 278911 - RNA, 32 nt, Human
uuuccucuucccucgcaugucucccuccaguc

SEQ ID NO: 278912 - RNA, 32 nt, Human
uuuccucuuccuccuccuccuccuuggcaucc

SEQ ID NO: 278913 - RNA, 32 nt, Human
uuuccucuuccucuugaaugucuuuccaaugg

SEQ ID NO: 278914 - RNA, 32 nt, Human
uuuccucuucucucccuucaagccccacacuu

SEQ ID NO: 278915 - RNA, 32 nt, Human
uuuccucuucugaggcagaggcuggagcaguu

SEQ ID NO: 278916 - RNA, 32 nt, Human
uuuccucuucuuuuuccucugaccucugugac

SEQ ID NO: 278917 - RNA, 32 nt, Human
uuuccucuugccugagugccucacauacccua

SEQ ID NO: 278918 - RNA, 32 nt, Human
uuuccucuuggucacucccauucuugucucca

SEQ ID NO: 278919 - RNA, 32 nt, Human
uuuccucuuguccaggcucacgaguuagucca

SEQ ID NO: 278920 - RNA, 32 nt, Human
uuuccucuuuccccucuccaaugcccagcccc

SEQ ID NO: 278921 - RNA, 32 nt, Human
uuuccucuuucuuugugucucucuugaauaua

SEQ ID NO: 278922 - RNA, 32 nt, Human
uuuccucuuuugaaaucuccccaaaucgcuua

SEQ ID NO: 278923 - RNA, 32 nt, Human
uuuccucuuuuugccuuuaucuccccaacuaa

SEQ ID NO: 278924 - RNA, 21 nt, Human
uuuccugaagaauugaaaaac

SEQ ID NO: 278925 - RNA, 32 nt, Human
uuuccugaagccaccaccacuguggccacucc

SEQ ID NO: 278926 - RNA, 32 nt, Human
uuuccugacagauggauaagaaaacaauagaa

SEQ ID NO: 278927 - RNA, 32 nt, Human
uuuccugacagcagguguacacaugccaacac

SEQ ID NO: 278928 - RNA, 32 nt, Human
uuuccugacugcacuggccuggcagucuggcu

SEQ ID NO: 278929 - RNA, 32 nt, Human
uuuccugagaccucaaugaagcagaaauguac

SEQ ID NO: 278930 - RNA, 32 nt, Human
uuuccugagccaagcauccaauaucaugcccc

SEQ ID NO: 278931 - RNA, 32 nt, Human
uuuccugagccccagccacauggaugugucca

SEQ ID NO: 278932 - RNA, 32 nt, Human
uuuccugaggagaaaagccagaguggagucug

SEQ ID NO: 278933 - RNA, 32 nt, Human
uuuccugaggggaaggacugugaccugccaua

SEQ ID NO: 278934 - RNA, 32 nt, Human
uuuccugagguggugaggagagacugaaggcu

SEQ ID NO: 278935 - RNA, 32 nt, Human
uuuccugaguagcugacauuacggguacacuc

SEQ ID NO: 278936 - RNA, 32 nt, Human
uuuccugaguuggccaggcaugguggcucacg

SEQ ID NO: 278937 - RNA, 32 nt, Human
uuuccugauagcugcaggcuugagauugcagc

SEQ ID NO: 278938 - RNA, 18 nt, Human
uuuccugcaacgaaggag

SEQ ID NO: 278939 - RNA, 32 nt, Human
uuuccugcacagagaaggggugagggaagcau

SEQ ID NO: 278940 - RNA, 32 nt, Human
uuuccugcagcugacagauagacucagauuuu

SEQ ID NO: 278941 - RNA, 19 nt, Human
uuuccugccaguaacuaua

SEQ ID NO: 278942 - RNA, 32 nt, Human
uuuccugccaguucaggagagauucuuggcau

SEQ ID NO: 278943 - RNA, 32 nt, Human
uuuccugcccaggcuuggccucccaggacauc

SEQ ID NO: 278944 - RNA, 32 nt, Human
uuuccugcccugcagucugcagugccagcacg

SEQ ID NO: 278945 - RNA, 32 nt, Human
uuuccugccgcuuuuugacaaucuuguguauu

SEQ ID NO: 278946 - RNA, 32 nt, Human
uuuccugccuccaggagaauggagagaaaggg

SEQ ID NO: 278947 - RNA, 32 nt, Human
uuuccugccuccuuccucuccucucucuucuu

SEQ ID NO: 278948 - RNA, 32 nt, Human
uuuccugcgcuguuccaccucauucaacuuca

SEQ ID NO: 278949 - RNA, 32 nt, Human
uuuccugcuacugcuacugcugcugcugccac

SEQ ID NO: 278950 - RNA, 32 nt, Human
uuuccugcugaguacugcuaauaaaagugcua

SEQ ID NO: 278951 - RNA, 21 nt, Human
uuuccugcuucuuuggguugc

SEQ ID NO: 278952 - RNA, 20 nt, Human
uuuccugcuuuggggagcuu

SEQ ID NO: 278953 - RNA, 32 nt, Human
uuuccuggaagguguuuuuaucuggaagauag

SEQ ID NO: 278954 - RNA, 32 nt, Human
uuuccuggacugcucucuccagaaacagcaca

SEQ ID NO: 278955 - RNA, 32 nt, Human
uuuccuggauauccccagcagaggcuacagaa

SEQ ID NO: 278956 - RNA, 32 nt, Human
uuuccuggcaaggcaggcucucacaugccugg

SEQ ID NO: 278957 - RNA, 32 nt, Human
uuuccuggcauuucucuuccacgcgacgaggu

SEQ ID NO: 278958 - RNA, 32 nt, Human
uuuccuggcccagcuucuccuucucccucugc

SEQ ID NO: 278959 - RNA, 32 nt, Human
uuuccuggcccaggaccccgggaaugcccgag

SEQ ID NO: 278960 - RNA, 32 nt, Human
uuuccuggccuuucuccacucucccucaagcc

SEQ ID NO: 278961 - RNA, 30 nt, Human
uuuccuggcuucuccaugcacugucccugc

SEQ ID NO: 278962 - RNA, 32 nt, Human
uuuccugggcaagaguguaugcauacaaaguu

SEQ ID NO: 278963 - RNA, 31 nt, Human
uuuccuggguagaagggaaaagacuggaaaa

SEQ ID NO: 278964 - RNA, 32 nt, Human
uuuccuggguaguauuugggagagggaaaggc

SEQ ID NO: 278965 - RNA, 32 nt, Human
uuuccuggguccccucuccagcaagccuccac

SEQ ID NO: 278966 - RNA, 32 nt, Human
uuuccuggucccucacccccauggccccaggc

SEQ ID NO: 278967 - RNA, 32 nt, Human
uuuccuggucuguccuaggagcuguauaaaga

SEQ ID NO: 278968 - RNA, 32 nt, Human
uuuccugguucugcaggauggugcaggcucug

SEQ ID NO: 278969 - RNA, 32 nt, Human
uuuccugguugaaggaauaaugggugauuauu

SEQ ID NO: 278970 - RNA, 32 nt, Human
uuuccuguaggggagaggaagcaggcagcagg

SEQ ID NO: 278971 - RNA, 32 nt, Human
uuuccuguaucaaauaucuggcaauuuacaau

SEQ ID NO: 278972 - RNA, 32 nt, Human
uuuccugucauguucacucaucuuuaaauccu

SEQ ID NO: 278973 - RNA, 32 nt, Human
uuuccuguccuguaauugcauuuuaaguuuuc

SEQ ID NO: 278974 - RNA, 32 nt, Human
uuuccugucugugcuuucuuuuuccacgcugu

SEQ ID NO: 278975 - RNA, 32 nt, Human
uuuccugucuuauuucuaaauuuccuucuucc

SEQ ID NO: 278976 - RNA, 32 nt, Human
uuuccugugaagccugcgggccagcgagcuga

SEQ ID NO: 278977 - RNA, 32 nt, Human
uuuccugugccuuauuguuucucccucuucuc

SEQ ID NO: 278978 - RNA, 32 nt, Human
uuuccuguggagcugcucagugcccggcuuag

SEQ ID NO: 278979 - RNA, 32 nt, Human
uuuccuguggccaggcacagagccaggugcuu

SEQ ID NO: 278980 - RNA, 32 nt, Human
uuuccuguggucccuggagcagcacauccccc

SEQ ID NO: 278981 - RNA, 32 nt, Human
uuuccugugucaccccucccacaacaccaggc

SEQ ID NO: 278982 - RNA, 32 nt, Human
uuuccuguuacccagcccaaguuuucaucguc

SEQ ID NO: 278983 - RNA, 32 nt, Human
uuuccuguucagauccauacaggauuugcaag

SEQ ID NO: 278984 - RNA, 32 nt, Human
uuuccuguuggaacuucugaccugucagaaag

SEQ ID NO: 278985 - RNA, 32 nt, Human
uuuccuguugucucacuccugagggcuccugc

SEQ ID NO: 278986 - RNA, 32 nt, Human
uuuccuguuuccagggucugagugcaaguuca

SEQ ID NO: 278987 - RNA, 32 nt, Human
uuuccuguuugaccaaagauugcccaagucug

SEQ ID NO: 278988 - RNA, 32 nt, Human
uuuccuuauagaacauguugacauuaugugga

SEQ ID NO: 278989 - RNA, 32 nt, Human
uuuccuuaucuucucccccauggcauccuaaa

SEQ ID NO: 278990 - RNA, 32 nt, Human
uuuccuuaugucuggcaccgagguguacacaa

SEQ ID NO: 278991 - RNA, 32 nt, Human
uuuccuucaacucuggcaguuccccaggccuu

SEQ ID NO: 278992 - RNA, 30 nt, Human
uuuccuucaagccguaccuguaagaguaaa

SEQ ID NO: 278993 - RNA, 32 nt, Human
uuuccuucaccacuucuauuccuaaggucacc

SEQ ID NO: 278994 - RNA, 32 nt, Human
uuuccuucagccccucugcccugucccugcac

SEQ ID NO: 278995 - RNA, 32 nt, Human
uuuccuucaguaccagucuauaagcuacuguc

SEQ ID NO: 278996 - RNA, 32 nt, Human
uuuccuucauucucugacguauuucagaaauc

SEQ ID NO: 278997 - RNA, 32 nt, Human
uuuccuuccaagggcagcuccgucuuggcagg

SEQ ID NO: 278998 - RNA, 32 nt, Human
uuuccuuccaccucuuugaccuucccuccagc

SEQ ID NO: 278999 - RNA, 32 nt, Human
uuuccuuccaugucaguuugcuucuuuggguc

SEQ ID NO: 279000 - RNA, 22 nt, Human
uuuccuucccauuggggugcug

SEQ ID NO: 279001 - RNA, 32 nt, Human
uuuccuuccccuggacuguccucugacccuuu

SEQ ID NO: 279002 - RNA, 32 nt, Human
uuuccuuccccuuucucugucaucccagagga

SEQ ID NO: 279003 - RNA, 32 nt, Human
uuuccuucccuaauaccccacacccaaccugu

SEQ ID NO: 279004 - RNA, 32 nt, Human
uuuccuuccucuccucuuccccaucaggcaau

SEQ ID NO: 279005 - RNA, 32 nt, Human
uuuccuuccucuuuaucccuccuguuuuacuu

SEQ ID NO: 279006 - RNA, 32 nt, Human
uuuccuuccugaguuggggcaccagaaagaac

SEQ ID NO: 279007 - RNA, 32 nt, Human
uuuccuuccuguucucuggagaucuugcagaa

SEQ ID NO: 279008 - RNA, 32 nt, Human
uuuccuuccuuuaccauuuccuccuuggaauu

SEQ ID NO: 279009 - RNA, 32 nt, Human
uuuccuuccuuuugcucuuuccuuccuuccuu

SEQ ID NO: 279010 - RNA, 32 nt, Human
uuuccuucuagccugugacccuagggcugcug

SEQ ID NO: 279011 - RNA, 32 nt, Human
uuuccuucucaaggaguuggcuaagcaucagg

SEQ ID NO: 279012 - RNA, 32 nt, Human
uuuccuucucagacuugccaccuuuccccucu

SEQ ID NO: 279013 - RNA, 32 nt, Human
uuuccuucuccaggaauacugaacaugggagc

SEQ ID NO: 279014 - RNA, 32 nt, Human
uuuccuucuccucaugcccaagagaucugugc

SEQ ID NO: 279015 - RNA, 32 nt, Human
uuuccuucuccucuccugcauuuuccuccauc

SEQ ID NO: 279016 - RNA, 32 nt, Human
uuuccuucucuucucuuuccucccucucuucc

SEQ ID NO: 279017 - RNA, 24 nt, Human
uuuccuucugggccugggcagcug

SEQ ID NO: 279018 - RNA, 24 nt, Human
uuuccuucugucugcuggugacug

SEQ ID NO: 279019 - RNA, 32 nt, Human
uuuccuucuucagcaggaagggugggaaggga

SEQ ID NO: 279020 - RNA, 32 nt, Human
uuuccuucuuccuuccccuccucgccgccacc

SEQ ID NO: 279021 - RNA, 32 nt, Human
uuuccuucuuugcuuucaucccuguugcacug

SEQ ID NO: 279022 - RNA, 32 nt, Human
uuuccuugacaaguugauuuugcaauuguggu

SEQ ID NO: 279023 - RNA, 32 nt, Human
uuuccuugacuucucaacccagccugaagucc

SEQ ID NO: 279024 - RNA, 32 nt, Human
uuuccuugcugucucccuucuuucuauuugaa

SEQ ID NO: 279025 - RNA, 32 nt, Human
uuuccuuggcugagggaaguggccucuccccg

SEQ ID NO: 279026 - RNA, 32 nt, Human
uuuccuugggaacuggagugcaguaugagcug

SEQ ID NO: 279027 - RNA, 32 nt, Human
uuuccuugggagcuucugccuccgugggccuc

SEQ ID NO: 279028 - RNA, 32 nt, Human
uuuccuugggauagagguuguguuggggaaua

SEQ ID NO: 279029 - RNA, 32 nt, Human
uuuccuuggggaggggcgggugggucuggaug

SEQ ID NO: 279030 - RNA, 32 nt, Human
uuuccuuuaacucccuuuuuacacuuuauggu

SEQ ID NO: 279031 - RNA, 32 nt, Human
uuuccuuuaccaaggccagucaucccugcuuc

SEQ ID NO: 279032 - RNA, 32 nt, Human
uuuccuuuaugcaguagaugcuuucuuccucc

SEQ ID NO: 279033 - RNA, 32 nt, Human
uuuccuuuccaauauccucaugacauucaaua

SEQ ID NO: 279034 - RNA, 32 nt, Human
uuuccuuuccccucccccucccucuccaagcc

SEQ ID NO: 279035 - RNA, 32 nt, Human
uuuccuuucccuuucuuuccuuuuucccuguc

SEQ ID NO: 279036 - RNA, 32 nt, Human
uuuccuuucccuuucuuuucuuuugcuuuccu

SEQ ID NO: 279037 - RNA, 23 nt, Human
uuuccuuuccugugggcaugcug

SEQ ID NO: 279038 - RNA, 32 nt, Human
uuuccuuuccuuucuuucuuccuuuccuuccc

SEQ ID NO: 279039 - RNA, 32 nt, Human
uuuccuuucggagccucgguuuucucaucugc

SEQ ID NO: 279040 - RNA, 32 nt, Human
uuuccuuucuaaagauuaauuucuugggagca

SEQ ID NO: 279041 - RNA, 32 nt, Human
uuuccuuucuaggagggaagcuucugugcugc

SEQ ID NO: 279042 - RNA, 32 nt, Human
uuuccuuucucucuccucccgccgcccaagau

SEQ ID NO: 279043 - RNA, 32 nt, Human
uuuccuuucuggccccagccuagguggaggca

SEQ ID NO: 279044 - RNA, 32 nt, Human
uuuccuuucuuucuuguccaaguucagguuaa

SEQ ID NO: 279045 - RNA, 32 nt, Human
uuuccuuugccauuaaggaaugaacucuuuca

SEQ ID NO: 279046 - RNA, 32 nt, Human
uuuccuuuguagaaacaagggccaggccagcu

SEQ ID NO: 279047 - RNA, 32 nt, Human
uuuccuuugucgccccuccuuuuucugauuga

SEQ ID NO: 279048 - RNA, 32 nt, Human
uuuccuuuguuaaaggaggaaccguaacucuc

SEQ ID NO: 279049 - RNA, 32 nt, Human
uuuccuuuguuuccuugggugaaugcaggagc

SEQ ID NO: 279050 - RNA, 32 nt, Human
uuuccuuuuccaccauaggccccaaagcacuc

SEQ ID NO: 279051 - RNA, 32 nt, Human
uuuccuuuuccaccauaggccucaaagugcuc

SEQ ID NO: 279052 - RNA, 32 nt, Human
uuuccuuuuccaccauaugccucaaagcgcuc

SEQ ID NO: 279053 - RNA, 32 nt, Human
uuuccuuuuccucuugacugucuuuacgagug

SEQ ID NO: 279054 - RNA, 32 nt, Human
uuuccuuuucuugccaauucugaucugaacag

SEQ ID NO: 279055 - RNA, 32 nt, Human
uuuccuuuugagauggagucuugcucuguugc

SEQ ID NO: 279056 - RNA, 32 nt, Human
uuuccuuuugcacuugaaggacaaaggugcca

SEQ ID NO: 279057 - RNA, 32 nt, Human
uuuccuuuugccugaaggacuuuuucugcugg

SEQ ID NO: 279058 - RNA, 23 nt, Human
uuuccuuuuguccugggggugcc

SEQ ID NO: 279059 - RNA, 32 nt, Human
uuuccuuuuuccugugacaaaacaucuuuuca

SEQ ID NO: 279060 - RNA, 32 nt, Human
uuuccuuuuucuccucuuccauuucuuggguu

SEQ ID NO: 279061 - RNA, 32 nt, Human
uuuccuuuuucuuccuccuccagcaccuucgu

SEQ ID NO: 279062 - RNA, 32 nt, Human
uuuccuuuuuggggguacuuagcuuccaugcc

SEQ ID NO: 279063 - RNA, 32 nt, Human
uuucgaacucuguaaucccagcacuuugggag

SEQ ID NO: 279064 - RNA, 32 nt, Human
uuucgaagacucugcugccauccguucuccca

SEQ ID NO: 279065 - RNA, 32 nt, Human
uuucgaagucacaugauaacacacacaggaga

SEQ ID NO: 279066 - RNA, 32 nt, Human
uuucgaaguugagaagagaaccccuggaacgu

SEQ ID NO: 279067 - RNA, 32 nt, Human
uuucgaauuagaguguucugcuguucuagaag

SEQ ID NO: 279068 - RNA, 32 nt, Human
uuucgacaccucugccuggccugcugcuagcc

SEQ ID NO: 279069 - RNA, 22 nt, Human
uuucgacccagcuaggggccag

SEQ ID NO: 279070 - RNA, 32 nt, Human
uuucgacucacugcaaccucugccucccaggu

SEQ ID NO: 279071 - RNA, 32 nt, Human
uuucgacucgagcagugccacuuuaaaaaucu

SEQ ID NO: 279072 - RNA, 32 nt, Human
uuucgagaccagccuggccaacauggugaaac

SEQ ID NO: 279073 - RNA, 32 nt, Human
uuucgaggcaccuagaaguugaggcagccagc

SEQ ID NO: 279074 - RNA, 32 nt, Human
uuucgaggggaguuacaggcaaguuugguaaa

SEQ ID NO: 279075 - RNA, 32 nt, Human
uuucgagguauucuuuccaggccgagauugag

SEQ ID NO: 279076 - RNA, 32 nt, Human
uuucgcaacauaaucccagcacuuuggaacgc

SEQ ID NO: 279077 - RNA, 32 nt, Human
uuucgcaacugaaagucgcuacucgagccuug

SEQ ID NO: 279078 - RNA, 32 nt, Human
uuucgcaaguccagaaauugaggacucuggau

SEQ ID NO: 279079 - RNA, 32 nt, Human
uuucgcacaacccugaagcccaaagaaacugg

SEQ ID NO: 279080 - RNA, 17 nt, Human
uuucgcagccgcugccg

SEQ ID NO: 279081 - RNA, 32 nt, Human
uuucgcaucuauucgggagagacuagggcagg

SEQ ID NO: 279082 - RNA, 32 nt, Human
uuucgccacugcacaccagccugggugacagu

SEQ ID NO: 279083 - RNA, 32 nt, Human
uuucgccagguuggccaggcuggucuugugaa

SEQ ID NO: 279084 - RNA, 32 nt, Human
uuucgccauauuggccaggauggucucgaacu

SEQ ID NO: 279085 - RNA, 32 nt, Human
uuucgccaucuucuccauggaccacuauauac

SEQ ID NO: 279086 - RNA, 24 nt, Human
uuucgcccaggcuggagugcaaug

SEQ ID NO: 279087 - RNA, 24 nt, Human
uuucgcccaggcuggagugcagug

SEQ ID NO: 279088 - RNA, 32 nt, Human
uuucgccccaaaauaaugagaccucaccuggu

SEQ ID NO: 279089 - RNA, 32 nt, Human
uuucgccguguuggccaggauggucucgaucu

SEQ ID NO: 279090 - RNA, 32 nt, Human
uuucgccugagauauaaguuguacugcguaug

SEQ ID NO: 279091 - RNA, 32 nt, Human
uuucgccugcagcugcucaccggauccucagu

SEQ ID NO: 279092 - RNA, 32 nt, Human
uuucgccugcugucucugauggcucuggcaag

SEQ ID NO: 279093 - RNA, 32 nt, Human
uuucgccuggccaacagcaucucucaggugug

SEQ ID NO: 279094 - RNA, 32 nt, Human
uuucgccuguaaucccaacacuuugggaggcc

SEQ ID NO: 279095 - RNA, 32 nt, Human
uuucgcucaucucuuuucagauuggaagccug

SEQ ID NO: 279096 - RNA, 32 nt, Human
uuucgcucuuucuacugcuuacucuucggguc

SEQ ID NO: 279097 - RNA, 32 nt, Human
uuucgcuguucccaggcuggucucaaacuccu

SEQ ID NO: 279098 - RNA, 32 nt, Human
uuucgcuugaacauucccuugaucucaucagu

SEQ ID NO: 279099 - RNA, 32 nt, Human
uuucgcuuguugcccaggcuggagugcaaugg

SEQ ID NO: 279100 - RNA, 32 nt, Human
uuucggaccagccuggccaacguggugaaacc

SEQ ID NO: 279101 - RNA, 32 nt, Human
uuucggacuggccuggccgacgugguaaaacc

SEQ ID NO: 279102 - RNA, 32 nt, Human
uuucggagaguggagggugaaaggagggagag

SEQ ID NO: 279103 - RNA, 32 nt, Human
uuucggagaugggguuuugcuauguugcccag

SEQ ID NO: 279104 - RNA, 32 nt, Human
uuucggcaacuuguacgggcccagcuccuccc

SEQ ID NO: 279105 - RNA, 21 nt, Human
uuucggcaucgggccaucuca

SEQ ID NO: 279106 - RNA, 32 nt, Human
uuucggccacccugcuguccaucgugaacuuu

SEQ ID NO: 279107 - RNA, 32 nt, Human
uuucggcggggcugggagacugaggcccgcgg

SEQ ID NO: 279108 - RNA, 32 nt, Human
uuucggcucacuacaaccaccaccuccugggu

SEQ ID NO: 279109 - RNA, 32 nt, Human
uuucggcucacugcaacccccgucucccgggu

SEQ ID NO: 279110 - RNA, 32 nt, Human
uuucggcucacugcaaccuccaccuccugggu

SEQ ID NO: 279111 - RNA, 32 nt, Human
uuucggcucacugcaaccuccuccucccagag

SEQ ID NO: 279112 - RNA, 32 nt, Human
uuucggcucacugcaaccucugccucccaagu

SEQ ID NO: 279113 - RNA, 32 nt, Human
uuucggcucacugcaaccucugucuccugggu

SEQ ID NO: 279114 - RNA, 32 nt, Human
uuucggcucacugcaacuucugccucccgggu

SEQ ID NO: 279115 - RNA, 32 nt, Human
uuucggcuucugagacggcggcagcagcggca

SEQ ID NO: 279116 - RNA, 32 nt, Human
uuucgggaacuggaacuguuuaacuugaaccc

SEQ ID NO: 279117 - RNA, 32 nt, Human
uuucgggaaucaccgucgcugccaucaacaug

SEQ ID NO: 279118 - RNA, 32 nt, Human
uuucgggaggcugaggcaggaggaucauuuga

SEQ ID NO: 279119 - RNA, 32 nt, Human
uuucgggcaggguauggucucaaucaguuuuc

SEQ ID NO: 279120 - RNA, 32 nt, Human
uuucggggacaguaggguuggugggaguugcg

SEQ ID NO: 279121 - RNA, 32 nt, Human
uuucggggcccuggggcaucucacagggacca

SEQ ID NO: 279122 - RNA, 32 nt, Human
uuucggggccuuuuuaguuggcuacugaccug

SEQ ID NO: 279123 - RNA, 32 nt, Human
uuucggggguagccgcacccccagcacuucgg

SEQ ID NO: 279124 - RNA, 32 nt, Human
uuucgggggucaagggauccacacucaaguga

SEQ ID NO: 279125 - RNA, 32 nt, Human
uuucggggucucccccuccuuguugcuaaggc

SEQ ID NO: 279126 - RNA, 32 nt, Human
uuucggguuguggcaaaccccaaagagagcac

SEQ ID NO: 279127 - RNA, 32 nt, Human
uuucgguaucugcuguucacagcucuccacug

SEQ ID NO: 279128 - RNA, 32 nt, Human
uuucgguccggaggaggcgggagcagcuuccc

SEQ ID NO: 279129 - RNA, 32 nt, Human
uuucggucuccaaacucccuguuggcuuuuua

SEQ ID NO: 279130 - RNA, 32 nt, Human
  misc_feature (27)..(27): n is a, c, g or u
uuucggugacagaagagaugggcaganaacuu

SEQ ID NO: 279131 - RNA, 32 nt, Human
uuucgguggucacaaguaggggagacgggugc

SEQ ID NO: 279132 - RNA, 32 nt, Human
uuucgguuucuuccaagauuccuggccuuccc

SEQ ID NO: 279133 - RNA, 32 nt, Human
uuucgguuuucugccagccauugcgguuaaaa

SEQ ID NO: 279134 - RNA, 32 nt, Human
uuucguaagucagguuucuaagugagcucccu

SEQ ID NO: 279135 - RNA, 32 nt, Human
uuucguaucugcaaaggccacaggauccauuc

SEQ ID NO: 279136 - RNA, 32 nt, Human
uuucgucagcuggcuggagcagcaucgguccg

SEQ ID NO: 279137 - RNA, 32 nt, Human
uuucgucccuugccugccuucccaggagagac

SEQ ID NO: 279138 - RNA, 32 nt, Human
uuucguccugaguuucucaggccccaaccaug

SEQ ID NO: 279139 - RNA, 32 nt, Human
uuucgucugaagguaaugauagcuauacaguc

SEQ ID NO: 279140 - RNA, 32 nt, Human
uuucgucugcgcuggagaaccaggacaucaga

SEQ ID NO: 279141 - RNA, 32 nt, Human
uuucgugaccuugauuucuucccccaaauuua

SEQ ID NO: 279142 - RNA, 32 nt, Human
uuucgugagcccccucgaggaaccuggucucc

SEQ ID NO: 279143 - RNA, 31 nt, Human
uuucgugaugagcaugaaaaagauuguuuaa

SEQ ID NO: 279144 - RNA, 32 nt, Human
uuucguggauuucuguggagcuggcagagcuc

SEQ ID NO: 279145 - RNA, 32 nt, Human
uuucguggugagcagcagguccuucauggcuc

SEQ ID NO: 279146 - RNA, 32 nt, Human
uuucgugguucugcugagcauggucuuggcag

SEQ ID NO: 279147 - RNA, 32 nt, Human
uuucguuguauaauuaugaacaugcacaaguu

SEQ ID NO: 279148 - RNA, 32 nt, Human
uuucguuugguaguucaucugccuuuuaaccc

SEQ ID NO: 279149 - RNA, 32 nt, Human
uuucguuuucccaggcuaguagggcugugagg

SEQ ID NO: 279150 - RNA, 32 nt, Human
uuucuaaaaauacaaaaauuagccagguaugg

SEQ ID NO: 279151 - RNA, 32 nt, Human
uuucuaaaagacacaucucuugaaaaaugaga

SEQ ID NO: 279152 - RNA, 32 nt, Human
uuucuaaaaugacuuguucagggcuccuuuug

SEQ ID NO: 279153 - RNA, 32 nt, Human
uuucuaaacuauuuacuacacaguaauccaug

SEQ ID NO: 279154 - RNA, 32 nt, Human
uuucuaaagaaagagugaauaggcugggcaug

SEQ ID NO: 279155 - RNA, 32 nt, Human
uuucuaaaggaaaucaaaugaauggaggaacu

SEQ ID NO: 279156 - RNA, 32 nt, Human
uuucuaaauacucuauugucuuuaauaauugu

SEQ ID NO: 279157 - RNA, 32 nt, Human
uuucuaaaucugagaucucccuccagggaauc

SEQ ID NO: 279158 - RNA, 32 nt, Human
uuucuaaaugugaguucguguccucugccaga

SEQ ID NO: 279159 - RNA, 32 nt, Human
uuucuaaauucuuucaugagcuugccuaaaau

SEQ ID NO: 279160 - RNA, 32 nt, Human
uuucuaaccagcauccagaagguucguuagcc

SEQ ID NO: 279161 - RNA, 32 nt, Human
uuucuaacuguagcuaucauuacuggcugugg

SEQ ID NO: 279162 - RNA, 32 nt, Human
uuucuaacuucucaaguucuagagaaagaauu

SEQ ID NO: 279163 - RNA, 32 nt, Human
uuucuaagaggcaccuccaucgagggccgguc

SEQ ID NO: 279164 - RNA, 32 nt, Human
uuucuaagcaacucaaguuugcagugauucag

SEQ ID NO: 279165 - RNA, 32 nt, Human
uuucuaagucuucuccuggaucuacauuucca

SEQ ID NO: 279166 - RNA, 32 nt, Human
uuucuaaguuccccaacuacucucacacccuu

SEQ ID NO: 279167 - RNA, 32 nt, Human
uuucuaaucccucccuccucauucucucccua

SEQ ID NO: 279168 - RNA, 32 nt, Human
uuucuaaucuaucacuucaaaagaugguaauc

SEQ ID NO: 279169 - RNA, 32 nt, Human
uuucuaaugagcuguaugagaggugaaucucc

SEQ ID NO: 279170 - RNA, 32 nt, Human
uuucuaaugucuacaccauauuuuggauaaca

SEQ ID NO: 279171 - RNA, 32 nt, Human
uuucuacaaaaauacaaaacuuagcugggugu

SEQ ID NO: 279172 - RNA, 32 nt, Human
uuucuacaaaccuaugaauguagaaaccuacc

SEQ ID NO: 279173 - RNA, 32 nt, Human
uuucuacaacacagaguacugacucugccugg

SEQ ID NO: 279174 - RNA, 32 nt, Human
uuucuacaacuccgacucauuugcuacauucc

SEQ ID NO: 279175 - RNA, 32 nt, Human
uuucuacacaauaaaugcaguuuaugucuuuu

SEQ ID NO: 279176 - RNA, 32 nt, Human
uuucuacagaauugaaugccuguuauagaaaa

SEQ ID NO: 279177 - RNA, 32 nt, Human
uuucuacagagcugaguguugguuccuuuuuc

SEQ ID NO: 279178 - RNA, 32 nt, Human
uuucuacagugagaugugaucuugccaaagcc

SEQ ID NO: 279179 - RNA, 32 nt, Human
uuucuacauagacugcuuguuuugcacaagaa

SEQ ID NO: 279180 - RNA, 32 nt, Human
uuucuacaucuucauuauuuggaccuaaaacc

SEQ ID NO: 279181 - RNA, 32 nt, Human
uuucuaccagcccugcaaguuuccucauggac

SEQ ID NO: 279182 - RNA, 32 nt, Human
uuucuacccaaucaucuggauuucaagauucc

SEQ ID NO: 279183 - RNA, 32 nt, Human
uuucuacccugccucgucuuaagacauauuua

SEQ ID NO: 279184 - RNA, 32 nt, Human
uuucuacccuggcuccccuugguuucuacccu

SEQ ID NO: 279185 - RNA, 32 nt, Human
uuucuacccuuuacucccugcaaagaaacaag

SEQ ID NO: 279186 - RNA, 32 nt, Human
uuucuacccuuuccuuuguaaguuccugggca

SEQ ID NO: 279187 - RNA, 32 nt, Human
uuucuaccuuccagccucuccuuagagacacc

SEQ ID NO: 279188 - RNA, 21 nt, Human
uuucuaccuuugaaacugcaa

SEQ ID NO: 279189 - RNA, 21 nt, Human
uuucuacuaaaaauacaaaau

SEQ ID NO: 279190 - RNA, 32 nt, Human
uuucuacuaaaaauacaaaauuagcugggcau

SEQ ID NO: 279191 - RNA, 32 nt, Human
uuucuacuaagguaugaaugaagauaguggga

SEQ ID NO: 279192 - RNA, 32 nt, Human
uuucuacucauucaaagcacauuguagauauu

SEQ ID NO: 279193 - RNA, 32 nt, Human
uuucuacuccuccucagccucauaaagaccuu

SEQ ID NO: 279194 - RNA, 22 nt, Human
uuucuacucuccccauauucca

SEQ ID NO: 279195 - RNA, 32 nt, Human
uuucuacucuucaugccucauccugcagccuc

SEQ ID NO: 279196 - RNA, 32 nt, Human
uuucuacugcaaaccuccacauccuggaauca

SEQ ID NO: 279197 - RNA, 32 nt, Human
uuucuacuggaaaagauugugagauugaacuu

SEQ ID NO: 279198 - RNA, 32 nt, Human
uuucuacuucaaaccuuccucuagcagacugu

SEQ ID NO: 279199 - RNA, 32 nt, Human
uuucuacuucuaaagaauugcuuggcacuuuc

SEQ ID NO: 279200 - RNA, 32 nt, Human
uuucuacuuucagaaaagauucuguaguuuug

SEQ ID NO: 279201 - RNA, 32 nt, Human
uuucuagaaauggccccaugcacauauaaaca

SEQ ID NO: 279202 - RNA, 32 nt, Human
uuucuagaaauuacagcugccaguuuauagua

SEQ ID NO: 279203 - RNA, 32 nt, Human
uuucuagaacaucccugccagcucuucugccg

SEQ ID NO: 279204 - RNA, 32 nt, Human
uuucuagaaggaacccagccagccggcggaau

SEQ ID NO: 279205 - RNA, 32 nt, Human
uuucuagaaguuuccuguggaaccuggaggcu

SEQ ID NO: 279206 - RNA, 32 nt, Human
uuucuagaauggaaauagugagggccaaugcc

SEQ ID NO: 279207 - RNA, 32 nt, Human
uuucuagagacaggaguuuugcucuguugccc

SEQ ID NO: 279208 - RNA, 32 nt, Human
uuucuagagauucuaaugaaagcugccgaaag

SEQ ID NO: 279209 - RNA, 32 nt, Human
uuucuagagccagcaguacguggcuucagagg

SEQ ID NO: 279210 - RNA, 32 nt, Human
uuucuagagccuggcaagagcuccugaaccag

SEQ ID NO: 279211 - RNA, 32 nt, Human
uuucuagagguugggccuuaguucuguuaucc

SEQ ID NO: 279212 - RNA, 32 nt, Human
uuucuagauauaaggucuuugaggcagggcuc

SEQ ID NO: 279213 - RNA, 32 nt, Human
uuucuagauuuguggcuuuaagaaaaacaaaa

SEQ ID NO: 279214 - RNA, 32 nt, Human
uuucuagcagaacuccagguccucugaguuaa

SEQ ID NO: 279215 - RNA, 32 nt, Human
uuucuagcagggaauuucuuccacuugcagac

SEQ ID NO: 279216 - RNA, 32 nt, Human
uuucuagcaucucuccccacccucugagagcu

SEQ ID NO: 279217 - RNA, 32 nt, Human
uuucuagcccuagugggcaguccugucuuagc

SEQ ID NO: 279218 - RNA, 32 nt, Human
uuucuagccuucacucuccauugucuuuucug

SEQ ID NO: 279219 - RNA, 31 nt, Human
uuucuagcuaccuucugcccugugucuggca

SEQ ID NO: 279220 - RNA, 32 nt, Human
uuucuagcuugaucuugaugguuccuagagcc

SEQ ID NO: 279221 - RNA, 32 nt, Human
uuucuaggaaaggccggacaccagguuuugag

SEQ ID NO: 279222 - RNA, 32 nt, Human
uuucuaggaacauagguugauaugaaauaaag

SEQ ID NO: 279223 - RNA, 32 nt, Human
uuucuaggagcaccuccaggcuugcaaagaaa

SEQ ID NO: 279224 - RNA, 32 nt, Human
uuucuaggauccuaaccuguaagccauugaac

SEQ ID NO: 279225 - RNA, 32 nt, Human
uuucuaggcacaacuucuggcugucagacacu

SEQ ID NO: 279226 - RNA, 32 nt, Human
uuucuaggcaucucucagaucagacagcaaag

SEQ ID NO: 279227 - RNA, 32 nt, Human
uuucuaggccuugguuccuugccugaaaaaug

SEQ ID NO: 279228 - RNA, 32 nt, Human
uuucuaggcuacaauuuucucccaggaagcuu

SEQ ID NO: 279229 - RNA, 32 nt, Human
uuucuaggcuaggaguugggugcauuuguacc

SEQ ID NO: 279230 - RNA, 32 nt, Human
uuucuaggcugcagacgugguauagagaaucc

SEQ ID NO: 279231 - RNA, 32 nt, Human
uuucuagggacauuuuucuucuaagcucugua

SEQ ID NO: 279232 - RNA, 32 nt, Human
uuucuagggcugggaaacacuccuugcaucaa

SEQ ID NO: 279233 - RNA, 32 nt, Human
uuucuaggggaggugguaggcugcaugugcca

SEQ ID NO: 279234 - RNA, 32 nt, Human
uuucuagguaacugugcuuccacugagcaagc

SEQ ID NO: 279235 - RNA, 32 nt, Human
uuucuaggugugagcccuggugugggcguuuu

SEQ ID NO: 279236 - RNA, 32 nt, Human
uuucuagguucaccaguugagggacauuugga

SEQ ID NO: 279237 - RNA, 32 nt, Human
uuucuagguuuggguuuuucuaaaaauaaaag

SEQ ID NO: 279238 - RNA, 32 nt, Human
uuucuagucauuugaauaucuuccuguuaucu

SEQ ID NO: 279239 - RNA, 32 nt, Human
uuucuagucucagaaggaaggagagggaagcc

SEQ ID NO: 279240 - RNA, 32 nt, Human
uuucuagucuccuauaucaccaugaagaaagc

SEQ ID NO: 279241 - RNA, 32 nt, Human
uuucuagucucuacagcuguuucccucuuuuc

SEQ ID NO: 279242 - RNA, 32 nt, Human
uuucuagugcaagaaacugcaggcuggaucag

SEQ ID NO: 279243 - RNA, 32 nt, Human
uuucuaguuccuucugcuugcuuuauuaacuc

SEQ ID NO: 279244 - RNA, 32 nt, Human
uuucuauagaauaauaacauacccacacaauu

SEQ ID NO: 279245 - RNA, 32 nt, Human
uuucuauagauaaugaggaagaaaugguaugu

SEQ ID NO: 279246 - RNA, 32 nt, Human
uuucuauagcccuggcacugggcacagagccu

SEQ ID NO: 279247 - RNA, 32 nt, Human
uuucuauaggaaaugaagcuucccuggucccc

SEQ ID NO: 279248 - RNA, 32 nt, Human
uuucuauaguacagugcuuuucuguauuaacu

SEQ ID NO: 279249 - RNA, 32 nt, Human
uuucuauauccccuuaguccagccucucuucu

SEQ ID NO: 279250 - RNA, 32 nt, Human
uuucuaucaagcaagaaugccacguacucaga

SEQ ID NO: 279251 - RNA, 32 nt, Human
uuucuaucaaggugucauggauuuuuaaaauu

SEQ ID NO: 279252 - RNA, 32 nt, Human
uuucuaucacuauuguaauuugccaguucauu

SEQ ID NO: 279253 - RNA, 32 nt, Human
uuucuaucagccuuuuacuuuaggcaaaucuc

SEQ ID NO: 279254 - RNA, 32 nt, Human
uuucuauccaauaaugauugauaccucaaaug

SEQ ID NO: 279255 - RNA, 32 nt, Human
uuucuaucuccaugccuggcuuuuucuaauua

SEQ ID NO: 279256 - RNA, 32 nt, Human
uuucuaucuuccagaagguuccagugucugcc

SEQ ID NO: 279257 - RNA, 32 nt, Human
uuucuaugauguggcagaaaugggcuuggcuu

SEQ ID NO: 279258 - RNA, 23 nt, Human
uuucuaugauuaaucugcuguua

SEQ ID NO: 279259 - RNA, 32 nt, Human
uuucuaugcaguggccccuuaggccagugaug

SEQ ID NO: 279260 - RNA, 32 nt, Human
uuucuaugcauuucgauuugacaugacaaaga

SEQ ID NO: 279261 - RNA, 32 nt, Human
uuucuaugccccucccaccacccuccaccuag

SEQ ID NO: 279262 - RNA, 32 nt, Human
uuucuauguaguaaaccuggaauauggagaau

SEQ ID NO: 279263 - RNA, 32 nt, Human
uuucuaugugugccacacacaaugcaguauua

SEQ ID NO: 279264 - RNA, 32 nt, Human
uuucuauguuaucaagguaggagggaguguuu

SEQ ID NO: 279265 - RNA, 32 nt, Human
uuucuauuaaaaacuuaagugcauuccaagga

SEQ ID NO: 279266 - RNA, 32 nt, Human
uuucuauuaucaccaaacaauauguuaagugg

SEQ ID NO: 279267 - RNA, 32 nt, Human
uuucuauucaaagaugcuuuugccagucacau

SEQ ID NO: 279268 - RNA, 32 nt, Human
uuucuauucaaggaaccagacugugaacaagu

SEQ ID NO: 279269 - RNA, 32 nt, Human
uuucuauucuuauuuuucauccuuguuccuca

SEQ ID NO: 279270 - RNA, 32 nt, Human
uuucuauugaaguagaggaacagaguacaacu

SEQ ID NO: 279271 - RNA, 32 nt, Human
uuucuauuuuccucccuucucagacagggcca

SEQ ID NO: 279272 - RNA, 32 nt, Human
uuucucaaaagaauacauacauguggcaauaa

SEQ ID NO: 279273 - RNA, 32 nt, Human
uuucucaaaagcaucuuucccccaaauguaug

SEQ ID NO: 279274 - RNA, 32 nt, Human
uuucucaaacuacagagugagaguugguaaua

SEQ ID NO: 279275 - RNA, 32 nt, Human
uuucucaaagcacacaccacccacucugccaa

SEQ ID NO: 279276 - RNA, 32 nt, Human
uuucucaacccuugccugccucccuccagucu

SEQ ID NO: 279277 - RNA, 32 nt, Human
uuucucaaggugccguguuugccugaaaggac

SEQ ID NO: 279278 - RNA, 32 nt, Human
uuucucaaucuugaacucauagauuauuaucu

SEQ ID NO: 279279 - RNA, 22 nt, Human
uuucucacacuccacugcccaa

SEQ ID NO: 279280 - RNA, 32 nt, Human
uuucucacagcuuuuuguucuguuuuguauuu

SEQ ID NO: 279281 - RNA, 22 nt, Human
uuucucacauguggcucccccu

SEQ ID NO: 279282 - RNA, 32 nt, Human
uuucucaccaaagaguaugccugggagccucc

SEQ ID NO: 279283 - RNA, 32 nt, Human
uuucucaccauggggcagcauuucggggccuc

SEQ ID NO: 279284 - RNA, 32 nt, Human
uuucucaccccguucugcucccacaaggcccc

SEQ ID NO: 279285 - RNA, 32 nt, Human
uuucucaccuuucuuuccuguuucugggacuc

SEQ ID NO: 279286 - RNA, 32 nt, Human
uuucucacuaagugagaaugagaacugcugug

SEQ ID NO: 279287 - RNA, 32 nt, Human
uuucucacucucuauauccauuugaaauugau

SEQ ID NO: 279288 - RNA, 32 nt, Human
uuucucacuggaggcuggaaugaaugaucacu

SEQ ID NO: 279289 - RNA, 32 nt, Human
uuucucacugguaucacauggucuugcaguuu

SEQ ID NO: 279290 - RNA, 32 nt, Human
uuucucagaacugccguagucacuguauggaa

SEQ ID NO: 279291 - RNA, 32 nt, Human
uuucucagaccagcccuggaguaguggcccgg

SEQ ID NO: 279292 - RNA, 32 nt, Human
uuucucagagagauucccaucugcuuuaauuu

SEQ ID NO: 279293 - RNA, 32 nt, Human
uuucucagagcugaguaaaaugaaggaaaagc

SEQ ID NO: 279294 - RNA, 32 nt, Human
uuucucagagcuggagguugcugggcaccuaa

SEQ ID NO: 279295 - RNA, 32 nt, Human
uuucucagaggaggaggaauagacuuaaacga

SEQ ID NO: 279296 - RNA, 32 nt, Human
uuucucagcaucauuauugcucuuucagcauc

SEQ ID NO: 279297 - RNA, 18 nt, Human
uuucucagcaucugcuuu

SEQ ID NO: 279298 - RNA, 32 nt, Human
uuucucagcccuggaagggagggaaggcaugg

SEQ ID NO: 279299 - RNA, 32 nt, Human
uuucucagccuauuuuguguccuaaugauucg

SEQ ID NO: 279300 - RNA, 32 nt, Human
uuucucagcuucugcauuuccuucccugcucc

SEQ ID NO: 279301 - RNA, 32 nt, Human
uuucucaggauggagugaagaccuggagagga

SEQ ID NO: 279302 - RNA, 32 nt, Human
uuucucaggccugugauucacagacuuuaaca

SEQ ID NO: 279303 - RNA, 32 nt, Human
uuucucagguguucuucguucuggcccuucca

SEQ ID NO: 279304 - RNA, 32 nt, Human
uuucucagguucuuaacagccugugcaaacuc

SEQ ID NO: 279305 - RNA, 32 nt, Human
uuucucaguacaacagccauagugauucuguu

SEQ ID NO: 279306 - RNA, 32 nt, Human
uuucucagugggacaaaccagagcagagagca

SEQ ID NO: 279307 - RNA, 21 nt, Human
uuucucaguguucaucuucca

SEQ ID NO: 279308 - RNA, 32 nt, Human
uuucucauacuggccuguuuaggcccagcuca

SEQ ID NO: 279309 - RNA, 32 nt, Human
uuucucauaguuaauuucaucucuccgguaag

SEQ ID NO: 279310 - RNA, 32 nt, Human
uuucucauauuaugaccuucucauguuagcac

SEQ ID NO: 279311 - RNA, 18 nt, Human
uuucucauauucugcuuu

SEQ ID NO: 279312 - RNA, 32 nt, Human
uuucucauauuugguguaagauaaaaacuuaa

SEQ ID NO: 279313 - RNA, 32 nt, Human
uuucucaucaaaaccaauauagaccagaagac

SEQ ID NO: 279314 - RNA, 32 nt, Human
uuucucaucccucacccccucccaccuuguca

SEQ ID NO: 279315 - RNA, 32 nt, Human
uuucucaucuuucugcugccuucuccuccauu

SEQ ID NO: 279316 - RNA, 32 nt, Human
uuucucaucuuucuguguucaacuauccucuu

SEQ ID NO: 279317 - RNA, 32 nt, Human
uuucucaugaggccauauuuugaguucuuaaa

SEQ ID NO: 279318 - RNA, 32 nt, Human
uuucucaugccuugcguaugcagcaggaacug

SEQ ID NO: 279319 - RNA, 32 nt, Human
uuucucaugcuguacacaauaaauuuguuaga

SEQ ID NO: 279320 - RNA, 32 nt, Human
uuucucaugcuuucucuaacuuccucaccccu

SEQ ID NO: 279321 - RNA, 32 nt, Human
uuucucauggugcuauccuggugcuauugggg

SEQ ID NO: 279322 - RNA, 32 nt, Human
uuucucauguaguuucugugugguguucagag

SEQ ID NO: 279323 - RNA, 32 nt, Human
uuucucauguugaagccacugccuucaccuuc

SEQ ID NO: 279324 - RNA, 32 nt, Human
uuucucauuaaauauuaauauaugacauguaa

SEQ ID NO: 279325 - RNA, 32 nt, Human
uuucucauuggguggauggaugggugaggagg

SEQ ID NO: 279326 - RNA, 32 nt, Human
uuucuccaacuuggucuuucacagugguucgu

SEQ ID NO: 279327 - RNA, 32 nt, Human
uuucuccaagaagguacagauaccucagauuc

SEQ ID NO: 279328 - RNA, 19 nt, Human
uuucuccaagccagaggua

SEQ ID NO: 279329 - RNA, 32 nt, Human
uuucuccacaacaaaaaccacaacuugaagug

SEQ ID NO: 279330 - RNA, 32 nt, Human
uuucuccacacgugucacagccagauuucagc

SEQ ID NO: 279331 - RNA, 32 nt, Human
uuucuccacagaaccgucucaguucuaauugc

SEQ ID NO: 279332 - RNA, 32 nt, Human
uuucuccacagcuuuaccagcaucuguuguuu

SEQ ID NO: 279333 - RNA, 32 nt, Human
uuucuccacaguuggggucauggaaaugugua

SEQ ID NO: 279334 - RNA, 32 nt, Human
uuucuccaccaaaaauaacugauccugaaaca

SEQ ID NO: 279335 - RNA, 32 nt, Human
uuucuccaccauggacucaaucugagaacaac

SEQ ID NO: 279336 - RNA, 32 nt, Human
uuucuccacccuggcucccaaggcuuggcugu

SEQ ID NO: 279337 - RNA, 32 nt, Human
uuucuccacugagcacagccugguagggcugg

SEQ ID NO: 279338 - RNA, 32 nt, Human
uuucuccacugcacuggagcuuugaagaccua

SEQ ID NO: 279339 - RNA, 32 nt, Human
uuucuccagcagcugaggaaagaagggacacg

SEQ ID NO: 279340 - RNA, 32 nt, Human
uuucuccagcccugucuccaucugccccaacc

SEQ ID NO: 279341 - RNA, 32 nt, Human
uuucuccaggcagagggaggacaagugaugga

SEQ ID NO: 279342 - RNA, 32 nt, Human
uuucuccagggucacuguuuauuucaaagagg

SEQ ID NO: 279343 - RNA, 32 nt, Human
uuucuccaggugggagugcaguggcaugaucu

SEQ ID NO: 279344 - RNA, 32 nt, Human
uuucuccagugccauaauugcauuucauuuac

SEQ ID NO: 279345 - RNA, 32 nt, Human
uuucuccaguggaacaaagauugagaaccaca

SEQ ID NO: 279346 - RNA, 20 nt, Human
uuucuccauagucugccgcu

SEQ ID NO: 279347 - RNA, 32 nt, Human
uuucuccaucauccugauuagcauguuuauuc

SEQ ID NO: 279348 - RNA, 32 nt, Human
uuucuccauccagauugugacgguugcuaccu

SEQ ID NO: 279349 - RNA, 32 nt, Human
uuucuccauguaacuugcucacaugccuaucu

SEQ ID NO: 279350 - RNA, 19 nt, Human
uuucuccauguuggccagg

SEQ ID NO: 279351 - RNA, 32 nt, Human
uuucuccauugucucugccuuuacaacagagg

SEQ ID NO: 279352 - RNA, 32 nt, Human
uuucuccauuuugccuucuuauguauuuucaa

SEQ ID NO: 279353 - RNA, 19 nt, Human
uuucuccauuuuggucagg

SEQ ID NO: 279354 - RNA, 32 nt, Human
uuucucccaagauggcacaucucaguaccuuc

SEQ ID NO: 279355 - RNA, 32 nt, Human
uuucucccacagccaucagagcaggacucugg

SEQ ID NO: 279356 - RNA, 32 nt, Human
uuucucccagcuggguggaaggagaacacuag

SEQ ID NO: 279357 - RNA, 32 nt, Human
uuucucccaggagaggcuggaguguccaaaag

SEQ ID NO: 279358 - RNA, 32 nt, Human
uuucucccagggacccaggaaacuaggacuuu

SEQ ID NO: 279359 - RNA, 19 nt, Human
uuucucccagugaagcagg

SEQ ID NO: 279360 - RNA, 32 nt, Human
uuucucccaguggaggaaggugugcugugcac

SEQ ID NO: 279361 - RNA, 32 nt, Human
uuucucccaguuuggcacugugacacaguuca

SEQ ID NO: 279362 - RNA, 32 nt, Human
uuucucccauaauguuuccauaauuuuguaaa

SEQ ID NO: 279363 - RNA, 32 nt, Human
uuucucccaucuuaaggggcucuccucccuca

SEQ ID NO: 279364 - RNA, 32 nt, Human
uuucuccccaaaaauacauccuagccuuaaug

SEQ ID NO: 279365 - RNA, 32 nt, Human
uuucuccccaaaacugguaaugccaaccuuau

SEQ ID NO: 279366 - RNA, 23 nt, Human
uuucuccccaaauaugguccagg

SEQ ID NO: 279367 - RNA, 32 nt, Human
uuucuccccacacccuggaguggcaugguccu

SEQ ID NO: 279368 - RNA, 32 nt, Human
uuucuccccacccuggggcucuucuguggucu

SEQ ID NO: 279369 - RNA, 32 nt, Human
uuucuccccacggagcccagccuggauuccug

SEQ ID NO: 279370 - RNA, 20 nt, Human
uuucuccccagcauacagug

SEQ ID NO: 279371 - RNA, 32 nt, Human
uuucucccccaccccacuccccaaagcucugc

SEQ ID NO: 279372 - RNA, 32 nt, Human
uuucucccccacugccaccaccaggggugugu

SEQ ID NO: 279373 - RNA, 32 nt, Human
uuucucccccucucucucugccuuaggcucug

SEQ ID NO: 279374 - RNA, 32 nt, Human
uuucucccccuucucucccuuucuccuucucg

SEQ ID NO: 279375 - RNA, 32 nt, Human
uuucuccccugagaggagcuucugcuacucug

SEQ ID NO: 279376 - RNA, 32 nt, Human
uuucuccccugccccaccccggggcugacauu

SEQ ID NO: 279377 - RNA, 32 nt, Human
uuucuccccugcugugcggcuugggguaagug

SEQ ID NO: 279378 - RNA, 32 nt, Human
uuucucccgagacagggucuugcucuggcgcc

SEQ ID NO: 279379 - RNA, 18 nt, Human
uuucucccuccagccagg

SEQ ID NO: 279380 - RNA, 32 nt, Human
uuucucccuccccuaccagccucauucuucuc

SEQ ID NO: 279381 - RNA, 32 nt, Human
uuucucccuccccucagucccuagcaaccacu

SEQ ID NO: 279382 - RNA, 32 nt, Human
uuucucccuccuccuuuuccuguguucucuua

SEQ ID NO: 279383 - RNA, 32 nt, Human
uuucucccugccaaccuccuccucuccugcca

SEQ ID NO: 279384 - RNA, 32 nt, Human
uuucucccuggcugcagaacuagacacccuug

SEQ ID NO: 279385 - RNA, 27 nt, Human
uuucucccugucucugccugucuucca

SEQ ID NO: 279386 - RNA, 32 nt, Human
uuucucccuucccacucugccucaagugaaaa

SEQ ID NO: 279387 - RNA, 32 nt, Human
uuucucccuucccauuucuccccacuuucauc

SEQ ID NO: 279388 - RNA, 32 nt, Human
uuucucccuugcuuuuucucuggaccauccug

SEQ ID NO: 279389 - RNA, 32 nt, Human
uuucucccuuuuccucuucucacugcccugga

SEQ ID NO: 279390 - RNA, 32 nt, Human
uuucuccgaauguuauguuuugcuuuuaucuc

SEQ ID NO: 279391 - RNA, 32 nt, Human
uuucuccguagugcuugucuuuguuccaggaa

SEQ ID NO: 279392 - RNA, 32 nt, Human
uuucuccuacaaagggaagcagccuggaagaa

SEQ ID NO: 279393 - RNA, 32 nt, Human
uuucuccuacuuccucuugcucucuggcauuu

SEQ ID NO: 279394 - RNA, 32 nt, Human
uuucuccuagacccgugaccugagauguguga

SEQ ID NO: 279395 - RNA, 32 nt, Human
uuucuccuauuuuguuuuacuaguuuuaagau

SEQ ID NO: 279396 - RNA, 32 nt, Human
uuucuccucaagaaaagcgaaaggacagacug

SEQ ID NO: 279397 - RNA, 32 nt, Human
uuucuccuccaaccuccaucagucccagggcc

SEQ ID NO: 279398 - RNA, 32 nt, Human
uuucuccuccacccucuuaauugaugcuaugg

SEQ ID NO: 279399 - RNA, 32 nt, Human
uuucuccuccacccucuucccuucgcagcugu

SEQ ID NO: 279400 - RNA, 32 nt, Human
uuucuccucggaacaugacaaugaagcucuuu

SEQ ID NO: 279401 - RNA, 32 nt, Human
uuucuccucuccccaucggggauccgagacuc

SEQ ID NO: 279402 - RNA, 32 nt, Human
uuucuccucuccccucucccaagcacaucuga

SEQ ID NO: 279403 - RNA, 32 nt, Human
uuucuccucugucuuucucucucccucuccca

SEQ ID NO: 279404 - RNA, 32 nt, Human
uuucuccucuucucuucuugggacaggaauaa

SEQ ID NO: 279405 - RNA, 32 nt, Human
uuucuccucuuggcccuggccuacagaccaua

SEQ ID NO: 279406 - RNA, 32 nt, Human
uuucuccugcagccauggaugccgcucugcuc

SEQ ID NO: 279407 - RNA, 32 nt, Human
uuucuccugcagcuccccugggcuccgcggcc

SEQ ID NO: 279408 - RNA, 32 nt, Human
uuucuccugcucucccccaccgccguccccuu

SEQ ID NO: 279409 - RNA, 32 nt, Human
uuucuccugcugcacggaaagcuugcugggag

SEQ ID NO: 279410 - RNA, 32 nt, Human
uuucuccuggcugaggaagggaagggaacauc

SEQ ID NO: 279411 - RNA, 32 nt, Human
uuucuccuuaaccuuggggucaugguucagca

SEQ ID NO: 279412 - RNA, 32 nt, Human
uuucuccuuccagcagaugcagaaggagagaa

SEQ ID NO: 279413 - RNA, 32 nt, Human
uuucuccuuccugaccuuccucagucugcagc

SEQ ID NO: 279414 - RNA, 32 nt, Human
uuucuccuuccuuccuuccucuuucucucuuu

SEQ ID NO: 279415 - RNA, 32 nt, Human
uuucuccuucuccccuccuucuuuuucagacu

SEQ ID NO: 279416 - RNA, 32 nt, Human
uuucuccuucucuuucccuugagguuaggaaa

SEQ ID NO: 279417 - RNA, 19 nt, Human
uuucuccuucuucccuucc

SEQ ID NO: 279418 - RNA, 32 nt, Human
uuucuccuucuucuugguccuggcucccaagg

SEQ ID NO: 279419 - RNA, 22 nt, Human
uuucuccuuuauggccucccca

SEQ ID NO: 279420 - RNA, 20 nt, Human
uuucuccuuuuucuaccuuu

SEQ ID NO: 279421 - RNA, 24 nt, Human
uuucuccuuuuugggaucugccca

SEQ ID NO: 279422 - RNA, 32 nt, Human
uuucucgaaagccaugccagaagcagucuucc

SEQ ID NO: 279423 - RNA, 32 nt, Human
uuucucgauuuuaucuuucgcacagcaguucc

SEQ ID NO: 279424 - RNA, 32 nt, Human
uuucucgcacaggcuuggagugcaguggugcg

SEQ ID NO: 279425 - RNA, 32 nt, Human
uuucucgcugggccuuagcugccuucccucag

SEQ ID NO: 279426 - RNA, 32 nt, Human
uuucucggggcugggaaucacccuggaucccu

SEQ ID NO: 279427 - RNA, 32 nt, Human
uuucucgguuccaucucauccauuuccuuuuc

SEQ ID NO: 279428 - RNA, 32 nt, Human
uuucucguuugccuuucuauuuccuuccaaau

SEQ ID NO: 279429 - RNA, 20 nt, Human
uuucucguuuucaucauaua

SEQ ID NO: 279430 - RNA, 19 nt, Human
uuucucuaaucauuuuuuc

SEQ ID NO: 279431 - RNA, 24 nt, Human
uuucucuacaguuuaguuuuguca

SEQ ID NO: 279432 - RNA, 32 nt, Human
uuucucuaccggcuugcuuggaguuuggacag

SEQ ID NO: 279433 - RNA, 32 nt, Human
uuucucuacugaaaauauaaaaauuagccagg

SEQ ID NO: 279434 - RNA, 32 nt, Human
uuucucuacuucccucuccaccuugcucucuc

SEQ ID NO: 279435 - RNA, 32 nt, Human
uuucucuagaucugugcucuccgauguggcag

SEQ ID NO: 279436 - RNA, 32 nt, Human
uuucucuagcuaauuuuguggccaauguaaaa

SEQ ID NO: 279437 - RNA, 32 nt, Human
uuucucuagcucagccucacaggccaaagcau

SEQ ID NO: 279438 - RNA, 32 nt, Human
uuucucuauagugcaacaaacaugguuucuca

SEQ ID NO: 279439 - RNA, 23 nt, Human
uuucucuaucuuuuauuuuuuca

SEQ ID NO: 279440 - RNA, 32 nt, Human
uuucucuaugcucucucccaccccuguggcuc

SEQ ID NO: 279441 - RNA, 32 nt, Human
uuucucucaaagcguuuauugagaaacucaaa

SEQ ID NO: 279442 - RNA, 32 nt, Human
uuucucucacauuugcugaaugugagaucaga

SEQ ID NO: 279443 - RNA, 32 nt, Human
uuucucucagcaucuccacccaaccagcagaa

SEQ ID NO: 279444 - RNA, 32 nt, Human
uuucucucauuuguguucauggagauuguuuu

SEQ ID NO: 279445 - RNA, 32 nt, Human
uuucucucccucccucccuuccuuccucccau

SEQ ID NO: 279446 - RNA, 32 nt, Human
uuucucuccuccacuucauauuucauacccau

SEQ ID NO: 279447 - RNA, 32 nt, Human
uuucucuccuccccuucucucuuucugucuuu

SEQ ID NO: 279448 - RNA, 32 nt, Human
uuucucuccucuucucccuuuccuuucccaaa

SEQ ID NO: 279449 - RNA, 31 nt, Human
uuucucuccuuuucugggccuccucgcaaau

SEQ ID NO: 279450 - RNA, 32 nt, Human
uuucucucucacuauacaguauauugucaaug

SEQ ID NO: 279451 - RNA, 32 nt, Human
uuucucucuccuccugccauccugaguucugc

SEQ ID NO: 279452 - RNA, 32 nt, Human
uuucucucuccucucugcuucauaacggaaaa

SEQ ID NO: 279453 - RNA, 32 nt, Human
uuucucucugacccucuccccacugcucauuu

SEQ ID NO: 279454 - RNA, 32 nt, Human
uuucucucugaccucauuccaagaucaguuuu

SEQ ID NO: 279455 - RNA, 26 nt, Human
uuucucucuggugguucuggaggcug

SEQ ID NO: 279456 - RNA, 32 nt, Human
uuucucucuguccugucgucucuugucccucg

SEQ ID NO: 279457 - RNA, 24 nt, Human
uuucucucugucuuuggccagcug

SEQ ID NO: 279458 - RNA, 32 nt, Human
uuucucucuguggcgacuuuucugccuucccu

SEQ ID NO: 279459 - RNA, 32 nt, Human
uuucucucuuaacguuccugggagacuccaac

SEQ ID NO: 279460 - RNA, 32 nt, Human
uuucucucuuucucccuuucucuuuucucuac

SEQ ID NO: 279461 - RNA, 32 nt, Human
uuucucucuuucuuggugucuguccuuugccc

SEQ ID NO: 279462 - RNA, 32 nt, Human
uuucucucuuuuccuuuuauucugucauccuu

SEQ ID NO: 279463 - RNA, 32 nt, Human
uuucucugacaccuguagcagugucucaugca

SEQ ID NO: 279464 - RNA, 32 nt, Human
uuucucugagccugucuccuuccuucaauuuu

SEQ ID NO: 279465 - RNA, 32 nt, Human
uuucucugaucuccucucucucugugucugcu

SEQ ID NO: 279466 - RNA, 32 nt, Human
uuucucugcacuccagccuaggcaacagagca

SEQ ID NO: 279467 - RNA, 21 nt, Human
uuucucugcaguccccagcca

SEQ ID NO: 279468 - RNA, 20 nt, Human
uuucucugccauugcuuuca

SEQ ID NO: 279469 - RNA, 32 nt, Human
uuucucugcuaggagccagccuggguggcgcu

SEQ ID NO: 279470 - RNA, 32 nt, Human
uuucucuggcccuguccaugugacuuuggccc

SEQ ID NO: 279471 - RNA, 32 nt, Human
uuucucuggcgcuuuacuggccugggcacacc

SEQ ID NO: 279472 - RNA, 32 nt, Human
uuucucuggcuggaguguaggcuguaccccau

SEQ ID NO: 279473 - RNA, 32 nt, Human
uuucucuggcuucccuccaccaauccuggagc

SEQ ID NO: 279474 - RNA, 32 nt, Human
uuucucuggggucugcacagaggcagcagcau

SEQ ID NO: 279475 - RNA, 32 nt, Human
uuucucugugagccgcugccuccagggccaua

SEQ ID NO: 279476 - RNA, 32 nt, Human
uuucucugugccagaucuucagugccccuuuc

SEQ ID NO: 279477 - RNA, 32 nt, Human
uuucucugugcccuuuugacagcuccagggau

SEQ ID NO: 279478 - RNA, 32 nt, Human
uuucucuguguguguaguuuuguaaacacuau

SEQ ID NO: 279479 - RNA, 32 nt, Human
uuucucuguuacuggcgggaaguggauugugu

SEQ ID NO: 279480 - RNA, 32 nt, Human
uuucucuguucgggggccucccacagcacagc

SEQ ID NO: 279481 - RNA, 32 nt, Human
uuucucuguuuuguggacaggcagcagccucc

SEQ ID NO: 279482 - RNA, 32 nt, Human
uuucucuuagugcuuuuaguagguuauuguuu

SEQ ID NO: 279483 - RNA, 32 nt, Human
uuucucuucagcuguaaauaacaggauacaga

SEQ ID NO: 279484 - RNA, 32 nt, Human
uuucucuucccccagugccuagguugccagag

SEQ ID NO: 279485 - RNA, 32 nt, Human
uuucucuucccuucuuuucccuuuuccuuccc

SEQ ID NO: 279486 - RNA, 32 nt, Human
uuucucuucucccaccucucccacccaacacu

SEQ ID NO: 279487 - RNA, 32 nt, Human
uuucucuucuccccuuccauuucugccuuuug

SEQ ID NO: 279488 - RNA, 32 nt, Human
uuucucuucucccugccuuuccucugccuccu

SEQ ID NO: 279489 - RNA, 32 nt, Human
uuucucuucuuacugucccacagcuugguuuc

SEQ ID NO: 279490 - RNA, 32 nt, Human
uuucucuucuuagcuucuccauugucuaaauc

SEQ ID NO: 279491 - RNA, 32 nt, Human
uuucucuucuuccucagcuucuccauguuuag

SEQ ID NO: 279492 - RNA, 32 nt, Human
uuucucuucuuccucuugcgucuucccggccc

SEQ ID NO: 279493 - RNA, 32 nt, Human
uuucucuugaguuuuguuauguguuuugcugu

SEQ ID NO: 279494 - RNA, 32 nt, Human
uuucucuugcagccgccaugauucugaggccu

SEQ ID NO: 279495 - RNA, 32 nt, Human
uuucucuugcuaaucucucuuuuguuauagag

SEQ ID NO: 279496 - RNA, 32 nt, Human
uuucucuugggcaggcagagaguacagacugc

SEQ ID NO: 279497 - RNA, 32 nt, Human
uuucucuugucucugcugcucacaggccugcc

SEQ ID NO: 279498 - RNA, 32 nt, Human
uuucucuuguguuccugacuccuucccaauga

SEQ ID NO: 279499 - RNA, 32 nt, Human
uuucucuuuaguucuuugcaagaagguagaga

SEQ ID NO: 279500 - RNA, 32 nt, Human
uuucucuuucaguuagcuggaggacaggaugu

SEQ ID NO: 279501 - RNA, 32 nt, Human
uuucucuuucuuccugucacccugaggaaggu

SEQ ID NO: 279502 - RNA, 32 nt, Human
uuucucuuugcucuccuagauguggcucuucu

SEQ ID NO: 279503 - RNA, 32 nt, Human
uuucucuuuggguuucuuguuuaccaaagaag

SEQ ID NO: 279504 - RNA, 26 nt, Human
uuucucuuuguuuuuguccaguguug

SEQ ID NO: 279505 - RNA, 32 nt, Human
uuucucuuuucuccucuugauccuuucaagcg

SEQ ID NO: 279506 - RNA, 32 nt, Human
uuucucuuuucugggauuuccugggcuuuuau

SEQ ID NO: 279507 - RNA, 32 nt, Human
uuucucuuuucuucccuuccuuuguuuucaua

SEQ ID NO: 279508 - RNA, 32 nt, Human
uuucucuuuuggaucacuagcugcaaauuaag

SEQ ID NO: 279509 - RNA, 32 nt, Human
uuucucuuuuucuuccuccuuugggaucauug

SEQ ID NO: 279510 - RNA, 32 nt, Human
uuucucuuuuugagacagucucgcucuguuac

SEQ ID NO: 279511 - RNA, 32 nt, Human
uuucugaaaacaaugaaaagaguauauuuaac

SEQ ID NO: 279512 - RNA, 32 nt, Human
uuucugaaaccagcccaacuuuucucccagag

SEQ ID NO: 279513 - RNA, 32 nt, Human
uuucugaaacuugaacucagagcccaguggga

SEQ ID NO: 279514 - RNA, 32 nt, Human
uuucugaaaggcugggucccagguugucacgg

SEQ ID NO: 279515 - RNA, 32 nt, Human
uuucugaaauucacagaagccuaggaggacug

SEQ ID NO: 279516 - RNA, 32 nt, Human
uuucugaacccccuuuuccuugagagacgagu

SEQ ID NO: 279517 - RNA, 32 nt, Human
uuucugaagaagugggagagccauuggcgugg

SEQ ID NO: 279518 - RNA, 32 nt, Human
uuucugaagcugccuucaccacugccuaccug

SEQ ID NO: 279519 - RNA, 32 nt, Human
uuucugaaggcuguuccagcagggcugcccug

SEQ ID NO: 279520 - RNA, 32 nt, Human
uuucugaauucugcaguauuuucuaaacagga

SEQ ID NO: 279521 - RNA, 32 nt, Human
uuucugacagauuuuaaaaauugauaugauaa

SEQ ID NO: 279522 - RNA, 32 nt, Human
uuucugaccaaaggagcaagagguauaaugga

SEQ ID NO: 279523 - RNA, 32 nt, Human
uuucugaccccaaacccagcugcagcuucuca

SEQ ID NO: 279524 - RNA, 32 nt, Human
uuucugacccuucugguuucugugccauggcc

SEQ ID NO: 279525 - RNA, 32 nt, Human
uuucugaccucaugcugccacuucuucgaggc

SEQ ID NO: 279526 - RNA, 17 nt, Human
uuucugacuacagcauc

SEQ ID NO: 279527 - RNA, 32 nt, Human
uuucugacucugcuuggccauuuuauccuuuu

SEQ ID NO: 279528 - RNA, 32 nt, Human
uuucugacucuggugauauaaaaaucaaaucu

SEQ ID NO: 279529 - RNA, 32 nt, Human
uuucugacugguuuucuucagucccuuuaucu

SEQ ID NO: 279530 - RNA, 32 nt, Human
uuucugagacagagucucgcucuguugcccag

SEQ ID NO: 279531 - RNA, 32 nt, Human
uuucugagacaggggucucccucugucaccca

SEQ ID NO: 279532 - RNA, 32 nt, Human
uuucugagagaaggaaauaacaucugcaaaug

SEQ ID NO: 279533 - RNA, 32 nt, Human
uuucugagagcauucaauggaaguuaugucau

SEQ ID NO: 279534 - RNA, 32 nt, Human
uuucugagaugggagagcaacaaguagagaug

SEQ ID NO: 279535 - RNA, 32 nt, Human
uuucugagccugcuggacaugaagagcagaug

SEQ ID NO: 279536 - RNA, 32 nt, Human
uuucugaggaagagaaaauucagcgcuacagc

SEQ ID NO: 279537 - RNA, 32 nt, Human
uuucugaggggcccuugaggccaaucuuuucu

SEQ ID NO: 279538 - RNA, 32 nt, Human
uuucugagguucuagcuaguacagauuguaua

SEQ ID NO: 279539 - RNA, 32 nt, Human
uuucugagucauacuuuauguauuauuucuua

SEQ ID NO: 279540 - RNA, 32 nt, Human
uuucugauaccacugcacugucugagaauuuc

SEQ ID NO: 279541 - RNA, 32 nt, Human
uuucugauacuuuaugucuuugcucacccuca

SEQ ID NO: 279542 - RNA, 17 nt, Human
uuucugauaggacauuu

SEQ ID NO: 279543 - RNA, 32 nt, Human
uuucugauagugcccuugcucuucugucuguc

SEQ ID NO: 279544 - RNA, 21 nt, Human
uuucugauaguugaacuguaa

SEQ ID NO: 279545 - RNA, 32 nt, Human
uuucugauauagaauugcaauuuuaacacaca

SEQ ID NO: 279546 - RNA, 22 nt, Human
uuucugauauuagauauuaaaa

SEQ ID NO: 279547 - RNA, 32 nt, Human
uuucugauauuccucuaguuuuggauugccaa

SEQ ID NO: 279548 - RNA, 27 nt, Human
uuucugaucucagcuguguggcugcaa

SEQ ID NO: 279549 - RNA, 32 nt, Human
uuucugaucugugaaauggcccccaaaauacc

SEQ ID NO: 279550 - RNA, 32 nt, Human
uuucugaucuuaaaauuugguuaaugccuaua

SEQ ID NO: 279551 - RNA, 32 nt, Human
uuucugaugaggaggcagaugaugcagaugcu

SEQ ID NO: 279552 - RNA, 32 nt, Human
uuucugaugcagauucuugucuuguucuccac

SEQ ID NO: 279553 - RNA, 32 nt, Human
uuucugaugcccaccgaggagccccagccccg

SEQ ID NO: 279554 - RNA, 32 nt, Human
uuucugaugccucuguggguguguguaaguua

SEQ ID NO: 279555 - RNA, 24 nt, Human
uuucugauuccagauuggaaaaua

SEQ ID NO: 279556 - RNA, 32 nt, Human
uuucugauugcuacugugcugugugauaggcc

SEQ ID NO: 279557 - RNA, 32 nt, Human
uuucugauuguccaguuaagugaucaccaaag

SEQ ID NO: 279558 - RNA, 32 nt, Human
uuucugauuucacaagugugguguuuucccaa

SEQ ID NO: 279559 - RNA, 32 nt, Human
uuucugcaacugugcacuccucccuugguggc

SEQ ID NO: 279560 - RNA, 32 nt, Human
uuucugcaagggaaaucaugaaugacauaagu

SEQ ID NO: 279561 - RNA, 32 nt, Human
uuucugcacagcaaaagaaacuaccaucagag

SEQ ID NO: 279562 - RNA, 32 nt, Human
uuucugcacauccuuaccaacauuuguuauug

SEQ ID NO: 279563 - RNA, 20 nt, Human
uuucugcacccucgcaccca

SEQ ID NO: 279564 - RNA, 32 nt, Human
uuucugcacuuucgccccaucuaccagucuuu

SEQ ID NO: 279565 - RNA, 32 nt, Human
uuucugcaggaaaaccaacgagcauacccaca

SEQ ID NO: 279566 - RNA, 32 nt, Human
uuucugcaggaaaugugcccagcagcucuugg

SEQ ID NO: 279567 - RNA, 32 nt, Human
uuucugcaggacuccuuccuggcacucucucc

SEQ ID NO: 279568 - RNA, 32 nt, Human
uuucugcagggauaaaacuuuugagguggcca

SEQ ID NO: 279569 - RNA, 32 nt, Human
uuucugcaguuuaucacauuuugcuucaggca

SEQ ID NO: 279570 - RNA, 31 nt, Human
uuucugcaguuucgguuuucauuugcuucag

SEQ ID NO: 279571 - RNA, 26 nt, Human
uuucugcauaugaaguguguaaaaua

SEQ ID NO: 279572 - RNA, 32 nt, Human
uuucugcaucaucuguagauccuagucuaucu

SEQ ID NO: 279573 - RNA, 19 nt, Human
uuucugcaucuucccccaa

SEQ ID NO: 279574 - RNA, 32 nt, Human
uuucugcauuugauguuauaguuaauuauaca

SEQ ID NO: 279575 - RNA, 32 nt, Human
uuucugccaaucguucuugacuuucuggagcc

SEQ ID NO: 279576 - RNA, 32 nt, Human
uuucugccacaggaagcugggccgggcugcug

SEQ ID NO: 279577 - RNA, 32 nt, Human
uuucugccacccaggcuggaguacaguggcau

SEQ ID NO: 279578 - RNA, 32 nt, Human
uuucugccaccuacaggauagaccaugaagcu

SEQ ID NO: 279579 - RNA, 32 nt, Human
uuucugccacuuccgggucuaggcccugccca

SEQ ID NO: 279580 - RNA, 32 nt, Human
uuucugccagccugggcaacauagugagacuu

SEQ ID NO: 279581 - RNA, 32 nt, Human
uuucugccauauuucaaaaugguagaauaaau

SEQ ID NO: 279582 - RNA, 32 nt, Human
uuucugcccaaccgcauggugccuggaccuga

SEQ ID NO: 279583 - RNA, 22 nt, Human
uuucugcccagccugcucagca

SEQ ID NO: 279584 - RNA, 32 nt, Human
uuucugcccaggaucucagccccaggcugguu

SEQ ID NO: 279585 - RNA, 28 nt, Human
uuucugcccauguucgccucaucuaacc

SEQ ID NO: 279586 - RNA, 32 nt, Human
uuucugcccugcuuuccugggcucucagaagu

SEQ ID NO: 279587 - RNA, 32 nt, Human
uuucugccuaauuaaggagaagucuuuuauca

SEQ ID NO: 279588 - RNA, 32 nt, Human
uuucugccuaguuugaagacacuggucauccc

SEQ ID NO: 279589 - RNA, 32 nt, Human
uuucugccucagaacugucucuccugggccca

SEQ ID NO: 279590 - RNA, 32 nt, Human
uuucugccucauucaguuucuggggucaaauc

SEQ ID NO: 279591 - RNA, 32 nt, Human
uuucugccuccaggagcggcuccgugucacac

SEQ ID NO: 279592 - RNA, 32 nt, Human
uuucugccuccagguacagucuggcaccuggc

SEQ ID NO: 279593 - RNA, 32 nt, Human
uuucugccuggcaacagagcgagacuccgucu

SEQ ID NO: 279594 - RNA, 32 nt, Human
uuucugccuugugauggacccaggaggucucu

SEQ ID NO: 279595 - RNA, 32 nt, Human
uuucugccuuuccccucucacuucuuccccaa

SEQ ID NO: 279596 - RNA, 32 nt, Human
uuucugccuuuccuuugcaucuucucauauau

SEQ ID NO: 279597 - RNA, 32 nt, Human
uuucugccuuugauggcaauuuccuucgguuu

SEQ ID NO: 279598 - RNA, 32 nt, Human
uuucugccuuuguccucaauagaaccaacuug

SEQ ID NO: 279599 - RNA, 32 nt, Human
uuucugcgaguucuucugccuccugcuggaga

SEQ ID NO: 279600 - RNA, 32 nt, Human
uuucugcgcuccuagccugggugacagagcaa

SEQ ID NO: 279601 - RNA, 32 nt, Human
uuucugcgcuggaccugcucaccugagccugc

SEQ ID NO: 279602 - RNA, 20 nt, Human
uuucugcggggcaucaggcu

SEQ ID NO: 279603 - RNA, 32 nt, Human
uuucugcgucucucccuguaccaggcucaaaa

SEQ ID NO: 279604 - RNA, 32 nt, Human
uuucugcgucugcaaguggccugugggacugc

SEQ ID NO: 279605 - RNA, 22 nt, Human
uuucugcuaauuucaugcucca

SEQ ID NO: 279606 - RNA, 32 nt, Human
uuucugcuagaugcaaaacugacuaagcaugu

SEQ ID NO: 279607 - RNA, 21 nt, Human
uuucugcuauuuugcauccca

SEQ ID NO: 279608 - RNA, 32 nt, Human
uuucugcucaccgcaaccuccgccucccaggu

SEQ ID NO: 279609 - RNA, 18 nt, Human
uuucugcucccugcccag

SEQ ID NO: 279610 - RNA, 32 nt, Human
uuucugcuccuuggcuucuagauggcaccaug

SEQ ID NO: 279611 - RNA, 32 nt, Human
uuucugcucugccugcaggcccccaggcacuu

SEQ ID NO: 279612 - RNA, 32 nt, Human
uuucugcucuuuccccugucacucccacauca

SEQ ID NO: 279613 - RNA, 32 nt, Human
uuucugcugaaugccugcucccagcuguagcc

SEQ ID NO: 279614 - RNA, 32 nt, Human
uuucugcugagcacugggccugugcugggugg

SEQ ID NO: 279615 - RNA, 32 nt, Human
uuucugcugaguaguauuucauuguauggaug

SEQ ID NO: 279616 - RNA, 32 nt, Human
uuucugcugaucuguuccaagacagguuaaaa

SEQ ID NO: 279617 - RNA, 22 nt, Human
uuucugcugcaggaugaggcua

SEQ ID NO: 279618 - RNA, 32 nt, Human
uuucugcugccuccagcccuguuugcaugugc

SEQ ID NO: 279619 - RNA, 32 nt, Human
uuucugcugccuggcuauuccaugcucauggc

SEQ ID NO: 279620 - RNA, 32 nt, Human
uuucugcugcugcugacagauuaacccaacaa

SEQ ID NO: 279621 - RNA, 32 nt, Human
uuucugcugcuugcaaggaaaggaucccaugu

SEQ ID NO: 279622 - RNA, 32 nt, Human
uuucugcugguauucuggaggugggaaggacu

SEQ ID NO: 279623 - RNA, 32 nt, Human
uuucugcuguguccuuaggaugugcaguaaaa

SEQ ID NO: 279624 - RNA, 32 nt, Human
uuucugcuguuacuugcugccuccaggccagg

SEQ ID NO: 279625 - RNA, 32 nt, Human
uuucugcuuacucacuccuucucccucuuucu

SEQ ID NO: 279626 - RNA, 32 nt, Human
uuucugcuucaguugcugucagggcagcaguu

SEQ ID NO: 279627 - RNA, 32 nt, Human
uuucugcuuugaggcccuucccuuagauuaug

SEQ ID NO: 279628 - RNA, 32 nt, Human
uuucugcuuuucucccaccccuccuagcaccc

SEQ ID NO: 279629 - RNA, 32 nt, Human
uuucuggaaaacugccuuuuaucugcccagaa

SEQ ID NO: 279630 - RNA, 32 nt, Human
uuucuggaaauggcuguaggugguguugagaa

SEQ ID NO: 279631 - RNA, 32 nt, Human
uuucuggaaggggacagugaaaagaggaguga

SEQ ID NO: 279632 - RNA, 22 nt, Human
uuucuggaaguaguaauugcaa

SEQ ID NO: 279633 - RNA, 32 nt, Human
uuucuggacuccuaccuaucugugcauuuuac

SEQ ID NO: 279634 - RNA, 32 nt, Human
uuucuggacucuuuaaguucuaccacugaaaa

SEQ ID NO: 279635 - RNA, 32 nt, Human
uuucuggacugcacuguuguccuugcccucac

SEQ ID NO: 279636 - RNA, 32 nt, Human
uuucuggagagacagcauugauaaguggcaca

SEQ ID NO: 279637 - RNA, 32 nt, Human
uuucuggagaugaaccuuuaaauaagucguac

SEQ ID NO: 279638 - RNA, 25 nt, Human
uuucuggaggaaaagcuggggccag

SEQ ID NO: 279639 - RNA, 32 nt, Human
uuucuggaggcugcaccuacugaggaucucgg

SEQ ID NO: 279640 - RNA, 32 nt, Human
uuucuggagugagaguaaagaggcuuaauuag

SEQ ID NO: 279641 - RNA, 32 nt, Human
uuucuggaguuccaggaacacaaaccccaaca

SEQ ID NO: 279642 - RNA, 32 nt, Human
uuucuggaguuuuguuuugacuucugaggugc

SEQ ID NO: 279643 - RNA, 22 nt, Human
uuucuggauaccuuaauuguaa

SEQ ID NO: 279644 - RNA, 32 nt, Human
uuucuggauccuaggcuuaucuccacagagga

SEQ ID NO: 279645 - RNA, 32 nt, Human
uuucuggaugguucccagaggguuuccauggg

SEQ ID NO: 279646 - RNA, 32 nt, Human
uuucuggcagugagguaaaaucaggucuuuuu

SEQ ID NO: 279647 - RNA, 32 nt, Human
uuucuggccagaaaaucgacaccccaaaaguc

SEQ ID NO: 279648 - RNA, 32 nt, Human
uuucuggccuccagaacugggaaggaguaaau

SEQ ID NO: 279649 - RNA, 32 nt, Human
uuucuggccugaagcagucugcacugaaaggu

SEQ ID NO: 279650 - RNA, 32 nt, Human
uuucuggcgaguuaaguccagcagguucugcg

SEQ ID NO: 279651 - RNA, 32 nt, Human
uuucuggcgugagucaacagaucauguagaua

SEQ ID NO: 279652 - RNA, 32 nt, Human
uuucuggcucuagaccccuccuggaugugcca

SEQ ID NO: 279653 - RNA, 32 nt, Human
uuucuggcugcugugcugccuccugggcucca

SEQ ID NO: 279654 - RNA, 32 nt, Human
uuucuggcuucugcuucauccugcuccaucgg

SEQ ID NO: 279655 - RNA, 32 nt, Human
uuucugggaacacauucacacgcccauugcag

SEQ ID NO: 279656 - RNA, 32 nt, Human
uuucugggaagagaucaaaauggagucuccuu

SEQ ID NO: 279657 - RNA, 32 nt, Human
uuucugggaccuggaguuggccagucaccacc

SEQ ID NO: 279658 - RNA, 32 nt, Human
uuucugggaggaugacaugcagaggaacugag

SEQ ID NO: 279659 - RNA, 22 nt, Human
uuucugggagggugaauugcaa

SEQ ID NO: 279660 - RNA, 32 nt, Human
uuucugggcagcuuccuugaggacagaaacuu

SEQ ID NO: 279661 - RNA, 32 nt, Human
uuucugggcgcacagaagucacugugaaacag

SEQ ID NO: 279662 - RNA, 32 nt, Human
uuucugggcuguagaacuguucauguccaaca

SEQ ID NO: 279663 - RNA, 32 nt, Human
uuucugggcuugcguuucucuccucuaguggg

SEQ ID NO: 279664 - RNA, 32 nt, Human
uuucuggggaagcagaacugcagugacccacu

SEQ ID NO: 279665 - RNA, 32 nt, Human
uuucuggggaggcagagaggcagggacuuugg

SEQ ID NO: 279666 - RNA, 32 nt, Human
uuucuggggagggguggagaacucacauuuac

SEQ ID NO: 279667 - RNA, 32 nt, Human
uuucuggggagguguguguuugugaaaggaau

SEQ ID NO: 279668 - RNA, 32 nt, Human
uuucuggggccaggaagucagggucaacuccc

SEQ ID NO: 279669 - RNA, 32 nt, Human
uuucuggggcugggaguaauacugacaaucca

SEQ ID NO: 279670 - RNA, 32 nt, Human
uuucuggguaaaaacugguucuauaaauuaag

SEQ ID NO: 279671 - RNA, 32 nt, Human
uuucuggguaccucugguuagcacuuucuacu

SEQ ID NO: 279672 - RNA, 32 nt, Human
uuucuggguucugcaguugggaguugguuucu

SEQ ID NO: 279673 - RNA, 32 nt, Human
uuucuggguuguuuuuccuuccacucuggggu

SEQ ID NO: 279674 - RNA, 32 nt, Human
uuucuggguuuggcuggaguggagcaguuacu

SEQ ID NO: 279675 - RNA, 23 nt, Human
uuucugguagaaaguugcugcaa

SEQ ID NO: 279676 - RNA, 32 nt, Human
uuucuggucggaaaugucuguggugccagugu

SEQ ID NO: 279677 - RNA, 32 nt, Human
uuucuggugaggaaugaaagggccaaguguuc

SEQ ID NO: 279678 - RNA, 32 nt, Human
uuucuggugcccaagacagugaccugcagaug

SEQ ID NO: 279679 - RNA, 21 nt, Human
uuucugguggaguugcuguaa

SEQ ID NO: 279680 - RNA, 32 nt, Human
uuucugguguuacacauacacacucauacgug

SEQ ID NO: 279681 - RNA, 32 nt, Human
uuucugguucccuuggauuuagggauaguguc

SEQ ID NO: 279682 - RNA, 32 nt, Human
uuucugguuccuguaaugcacuguuuaacugu

SEQ ID NO: 279683 - RNA, 32 nt, Human
uuucugguugccucucuaugcuauuguguuca

SEQ ID NO: 279684 - RNA, 32 nt, Human
uuucuguaaccccuguuugugguacgagauaa

SEQ ID NO: 279685 - RNA, 32 nt, Human
uuucuguaacccuugguugccagagauaaagu

SEQ ID NO: 279686 - RNA, 32 nt, Human
uuucuguacagauauaucaaaucacaugaaau

SEQ ID NO: 279687 - RNA, 32 nt, Human
uuucuguauagugagggcggccagcaggaaga

SEQ ID NO: 279688 - RNA, 32 nt, Human
uuucuguaugacauauacauauacuuguuuau

SEQ ID NO: 279689 - RNA, 32 nt, Human
uuucuguauuuuuaguagagacaggguuucac

SEQ ID NO: 279690 - RNA, 32 nt, Human
uuucuguauuuuuaguagagaugggguuucac

SEQ ID NO: 279691 - RNA, 32 nt, Human
uuucugucacccagguuagaguagauuucagu

SEQ ID NO: 279692 - RNA, 32 nt, Human
uuucugucacugucaagcaaaacaaucaguag

SEQ ID NO: 279693 - RNA, 32 nt, Human
uuucuguccaucagaggacagcuguaugaaga

SEQ ID NO: 279694 - RNA, 32 nt, Human
uuucugucccuucuuggucucuuccagucguu

SEQ ID NO: 279695 - RNA, 32 nt, Human
uuucuguccucuuccuucuccauuuaugccug

SEQ ID NO: 279696 - RNA, 32 nt, Human
uuucuguccucuuuauggaauguagucgacgg

SEQ ID NO: 279697 - RNA, 32 nt, Human
uuucugucgcaggcugcgaggaaaggccccua

SEQ ID NO: 279698 - RNA, 32 nt, Human
uuucugucguccaggcuggagugcaguagcgc

SEQ ID NO: 279699 - RNA, 32 nt, Human
uuucugucuaacucgaagucuugaauccuagc

SEQ ID NO: 279700 - RNA, 32 nt, Human
uuucugucucccacgguguggucagugagcug

SEQ ID NO: 279701 - RNA, 32 nt, Human
uuucugucuucucgcugcucugugcccuuggu

SEQ ID NO: 279702 - RNA, 32 nt, Human
uuucugucuuuaauuaaccaagguguuaggug

SEQ ID NO: 279703 - RNA, 32 nt, Human
uuucugucuuucuccccugggcuccugucuca

SEQ ID NO: 279704 - RNA, 32 nt, Human
uuucugucuuucucccucuccuuguauugcuu

SEQ ID NO: 279705 - RNA, 32 nt, Human
uuucugucuuucuccuugugcccuuuggcucu

SEQ ID NO: 279706 - RNA, 32 nt, Human
uuucugugacaucacaaugggucugaucugca

SEQ ID NO: 279707 - RNA, 32 nt, Human
uuucugugacaucaugcugcaggacccuguuu

SEQ ID NO: 279708 - RNA, 32 nt, Human
uuucugugacugcuggccuucccuggagauca

SEQ ID NO: 279709 - RNA, 31 nt, Human
uuucugugacuucacuuucaccugcuccagg

SEQ ID NO: 279710 - RNA, 31 nt, Human
uuucugugacuuccccaagccgcaggugaga

SEQ ID NO: 279711 - RNA, 32 nt, Human
uuucugugagguaccuuacccaccucagcacc

SEQ ID NO: 279712 - RNA, 32 nt, Human
uuucugugagguggaaacagugguccugaauc

SEQ ID NO: 279713 - RNA, 32 nt, Human
uuucugugaugauucugagaaugcugaauaca

SEQ ID NO: 279714 - RNA, 32 nt, Human
uuucugugaugauuuguugagccuugcuggac

SEQ ID NO: 279715 - RNA, 32 nt, Human
uuucugugcacuguagccuuagugucaccuuu

SEQ ID NO: 279716 - RNA, 32 nt, Human
uuucugugccuuuccauuauuucuucagcuuc

SEQ ID NO: 279717 - RNA, 32 nt, Human
uuucuguggaaccucagaggccagccucgacu

SEQ ID NO: 279718 - RNA, 31 nt, Human
uuucuguggacaauguaacccuaaacacauc

SEQ ID NO: 279719 - RNA, 32 nt, Human
uuucuguggagguggggugggggagugguggg

SEQ ID NO: 279720 - RNA, 32 nt, Human
uuucugugguuuuugggcugauuccaaggggc

SEQ ID NO: 279721 - RNA, 32 nt, Human
uuucuguguaaaaacuggccacaaauaaauuc

SEQ ID NO: 279722 - RNA, 32 nt, Human
uuucuguguagaaacuggaagcuguucagggc

SEQ ID NO: 279723 - RNA, 32 nt, Human
uuucuguguaugaacugagaaauaugccuacu

SEQ ID NO: 279724 - RNA, 32 nt, Human
uuucuguguuauccuucuuaucccacuccaaa

SEQ ID NO: 279725 - RNA, 32 nt, Human
uuucuguguuuauacagaaucauggaaugcua

SEQ ID NO: 279726 - RNA, 32 nt, Human
uuucuguguuuauucauggaauuccaguuauc

SEQ ID NO: 279727 - RNA, 32 nt, Human
uuucuguuacucaugguuucaguuacucauag

SEQ ID NO: 279728 - RNA, 32 nt, Human
uuucuguuaucaaagcacaugacuaaaaugaa

SEQ ID NO: 279729 - RNA, 32 nt, Human
uuucuguuccagguuucuuccacccacgagca

SEQ ID NO: 279730 - RNA, 32 nt, Human
uuucuguugacagagauggagucagucauguc

SEQ ID NO: 279731 - RNA, 32 nt, Human
uuucuguugcuccacauccuugcuggcacuug

SEQ ID NO: 279732 - RNA, 32 nt, Human
uuucuguuguaggaagagagcgaggcaucccu

SEQ ID NO: 279733 - RNA, 32 nt, Human
uuucuguuguuguuucccagcuacaaccaacu

SEQ ID NO: 279734 - RNA, 32 nt, Human
uuucuguuucccaaggagcaggggugagcagg

SEQ ID NO: 279735 - RNA, 32 nt, Human
uuucuguuucucuuuucucuuaacgauuauca

SEQ ID NO: 279736 - RNA, 32 nt, Human
uuucuguuugcucagacccuguuuucauguug

SEQ ID NO: 279737 - RNA, 32 nt, Human
uuucuguuugugaauaaggccagcacucaaga

SEQ ID NO: 279738 - RNA, 32 nt, Human
uuucuguuuguuacggaacaugugggaauccc

SEQ ID NO: 279739 - RNA, 32 nt, Human
uuucuguuuuauuuaaaguaacugacauuuug

SEQ ID NO: 279740 - RNA, 32 nt, Human
uuucuguuuucuucucuuuucacuuuuuguuu

SEQ ID NO: 279741 - RNA, 32 nt, Human
uuucuguuuuucuguggcucuguccauggcau

SEQ ID NO: 279742 - RNA, 32 nt, Human
uuucuguuuuugucuguguccuaggucgguuu

SEQ ID NO: 279743 - RNA, 32 nt, Human
uuucuuaaacacaaauuucauuuccauuuaag

SEQ ID NO: 279744 - RNA, 32 nt, Human
uuucuuaaagaaugccuaaaguguaauaaggu

SEQ ID NO: 279745 - RNA, 32 nt, Human
uuucuuaaauccaaguuggccguuuuauuagu

SEQ ID NO: 279746 - RNA, 32 nt, Human
uuucuuaacacaaaagcaccccuucucuccua

SEQ ID NO: 279747 - RNA, 32 nt, Human
uuucuuaaccuacacauagucuauacauagau

SEQ ID NO: 279748 - RNA, 32 nt, Human
uuucuuaagccccagaaagccaaaaagaacau

SEQ ID NO: 279749 - RNA, 32 nt, Human
uuucuuaaggcugccuuccucucugaguacgu

SEQ ID NO: 279750 - RNA, 32 nt, Human
uuucuuaaguaucucaacaacaugucaaagcu

SEQ ID NO: 279751 - RNA, 32 nt, Human
uuucuuaauauacaaucuaucuuuuccacaaa

SEQ ID NO: 279752 - RNA, 32 nt, Human
uuucuuaauauaggauuucgcugugcucuuuu

SEQ ID NO: 279753 - RNA, 32 nt, Human
uuucuuaaucugaacaugaaggcuccauuagc

SEQ ID NO: 279754 - RNA, 32 nt, Human
uuucuuaauuauuggcugaaucugccuuggag

SEQ ID NO: 279755 - RNA, 32 nt, Human
uuucuuacagacugcauguaguuggguauaau

SEQ ID NO: 279756 - RNA, 32 nt, Human
uuucuuacagcuggaaugagggguggggagau

SEQ ID NO: 279757 - RNA, 32 nt, Human
uuucuuacccuuuuggacauuucuuuguugca

SEQ ID NO: 279758 - RNA, 32 nt, Human
uuucuuacucuaucauucugguguuuucauug

SEQ ID NO: 279759 - RNA, 32 nt, Human
uuucuuacugcaaccuucgccucccgaguuca

SEQ ID NO: 279760 - RNA, 32 nt, Human
uuucuuacuguuucucuggguuguuugucaga

SEQ ID NO: 279761 - RNA, 32 nt, Human
uuucuuagaaauaagcaagacagagcaggaaa

SEQ ID NO: 279762 - RNA, 32 nt, Human
uuucuuagaccaccuaagaugccacuuugaau

SEQ ID NO: 279763 - RNA, 32 nt, Human
uuucuuagcagacugcagucaauccacauuca

SEQ ID NO: 279764 - RNA, 32 nt, Human
uuucuuagccuuacuugaaucuugccuauaau

SEQ ID NO: 279765 - RNA, 21 nt, Human
uuucuuagccuuuuucuguuu

SEQ ID NO: 279766 - RNA, 32 nt, Human
uuucuuagcugcaagaauucauugcacaaugu

SEQ ID NO: 279767 - RNA, 23 nt, Human
uuucuuaggcuggagugcagugg

SEQ ID NO: 279768 - RNA, 32 nt, Human
uuucuuaggcuggccuuuaacuucugagcuca

SEQ ID NO: 279769 - RNA, 32 nt, Human
uuucuuaguacacaugagguggauauuugaua

SEQ ID NO: 279770 - RNA, 32 nt, Human
uuucuuauacucagucaaccacaacauggccu

SEQ ID NO: 279771 - RNA, 32 nt, Human
uuucuuaucaguguccuugacaagcauucaua

SEQ ID NO: 279772 - RNA, 32 nt, Human
uuucuuaucuguguuuguguuggcaugcaaga

SEQ ID NO: 279773 - RNA, 32 nt, Human
uuucuuaugaacagauauuuuuaacuuaaugg

SEQ ID NO: 279774 - RNA, 32 nt, Human
uuucuuaugcacugcacacucuggaccucacc

SEQ ID NO: 279775 - RNA, 32 nt, Human
uuucuuauggcagccccagcaaacaaaaacug

SEQ ID NO: 279776 - RNA, 32 nt, Human
uuucuuauggugcuggauuacuccuacagaac

SEQ ID NO: 279777 - RNA, 32 nt, Human
uuucuuauucuagaacacuuggagccugaacu

SEQ ID NO: 279778 - RNA, 32 nt, Human
uuucuuauuuacccuuuucucccuucccauuu

SEQ ID NO: 279779 - RNA, 32 nt, Human
uuucuuauuucaaagcuuauaaacuauuacuu

SEQ ID NO: 279780 - RNA, 32 nt, Human
uuucuuauuucaggagcuucauaggcauagac

SEQ ID NO: 279781 - RNA, 32 nt, Human
uuucuucaacugcuugcuuuucccaggcuugc

SEQ ID NO: 279782 - RNA, 32 nt, Human
uuucuucaaugagguguucgcagcagcagcca

SEQ ID NO: 279783 - RNA, 31 nt, Human
uuucuucacagcuuuuaccaugguuuauaau

SEQ ID NO: 279784 - RNA, 24 nt, Human
uuucuucagaagaauucuaugcua

SEQ ID NO: 279785 - RNA, 21 nt, Human
uuucuucagaggucacuucua

SEQ ID NO: 279786 - RNA, 32 nt, Human
uuucuucaggcagccggugcacaguggacuuu

SEQ ID NO: 279787 - RNA, 32 nt, Human
uuucuucagugaaaccuagaacaaaaguggaa

SEQ ID NO: 279788 - RNA, 32 nt, Human
uuucuucauacucugguucccuuucuacaaca

SEQ ID NO: 279789 - RNA, 21 nt, Human
uuucuucaucagugggaauaa

SEQ ID NO: 279790 - RNA, 32 nt, Human
uuucuucaucugagcagacaccagcuucagau

SEQ ID NO: 279791 - RNA, 32 nt, Human
uuucuucauggcuucugcuuuuuaaucuuagg

SEQ ID NO: 279792 - RNA, 32 nt, Human
uuucuucauguuggccaggcuggucucaaacu

SEQ ID NO: 279793 - RNA, 32 nt, Human
uuucuuccaauaggaaaccugauguuucugau

SEQ ID NO: 279794 - RNA, 32 nt, Human
uuucuuccaaucucucuuucucaaucucucug

SEQ ID NO: 279795 - RNA, 32 nt, Human
uuucuuccaucucccuugcaggcacagggcca

SEQ ID NO: 279796 - RNA, 32 nt, Human
uuucuuccaucuuuauucugacuagcuuccaa

SEQ ID NO: 279797 - RNA, 32 nt, Human
uuucuuccauuagaauacaaguuucaugagga

SEQ ID NO: 279798 - RNA, 32 nt, Human
uuucuuccauuuuaacacuuccugguugcaag

SEQ ID NO: 279799 - RNA, 32 nt, Human
uuucuucccaucucuucuugcugcuuaguguc

SEQ ID NO: 279800 - RNA, 32 nt, Human
uuucuucccauucuguucuguucuguucuccu

SEQ ID NO: 279801 - RNA, 32 nt, Human
uuucuucccucacugcugauucuuagauagaa

SEQ ID NO: 279802 - RNA, 32 nt, Human
uuucuucccuccagccaggguuucucuaaagg

SEQ ID NO: 279803 - RNA, 32 nt, Human
uuucuucccugcccagagccagccugggauug

SEQ ID NO: 279804 - RNA, 32 nt, Human
uuucuucccugcucagcuucugcucaggaguu

SEQ ID NO: 279805 - RNA, 32 nt, Human
uuucuucccuuccccuucuccccacaccugca

SEQ ID NO: 279806 - RNA, 32 nt, Human
uuucuucccuuuccuuccacggugucuguucc

SEQ ID NO: 279807 - RNA, 32 nt, Human
uuucuuccucacccugauuucuugcuuauuca

SEQ ID NO: 279808 - RNA, 32 nt, Human
uuucuuccucauucccucgucuuucccaaagg

SEQ ID NO: 279809 - RNA, 32 nt, Human
uuucuuccuccacaucuuguccuacuggaagg

SEQ ID NO: 279810 - RNA, 32 nt, Human
uuucuuccuccaccaugccugcagacuuuucc

SEQ ID NO: 279811 - RNA, 32 nt, Human
uuucuuccuccccugcucucucuccacccucc

SEQ ID NO: 279812 - RNA, 32 nt, Human
uuucuuccuccuccuccuccuccuccgggucc

SEQ ID NO: 279813 - RNA, 32 nt, Human
uuucuuccuccuucauuuuucuuccaaaauug

SEQ ID NO: 279814 - RNA, 20 nt, Human
uuucuuccugaucugcugcu

SEQ ID NO: 279815 - RNA, 32 nt, Human
uuucuuccugcuaaccuucugcucuggacugg

SEQ ID NO: 279816 - RNA, 32 nt, Human
uuucuuccuugacaggccuuggcuccaucucc

SEQ ID NO: 279817 - RNA, 32 nt, Human
uuucuuccuuuuucucucuccucuuuuccucc

SEQ ID NO: 279818 - RNA, 32 nt, Human
uuucuucggcucuguccuuugccgcucagacc

SEQ ID NO: 279819 - RNA, 32 nt, Human
uuucuucggucgucccgaauccggguucaucc

SEQ ID NO: 279820 - RNA, 32 nt, Human
uuucuucgguugucccgaauccggguucaucu

SEQ ID NO: 279821 - RNA, 32 nt, Human
uuucuucuaagggaggaggacaugguggagac

SEQ ID NO: 279822 - RNA, 32 nt, Human
uuucuucuagaaccagagaccagcaagugaaa

SEQ ID NO: 279823 - RNA, 32 nt, Human
uuucuucuagaguaacaaauguucuuuguuuu

SEQ ID NO: 279824 - RNA, 32 nt, Human
uuucuucuagauagcagcugucccaaagaaaa

SEQ ID NO: 279825 - RNA, 32 nt, Human
uuucuucuaugugaaacuugaaaugaggaaaa

SEQ ID NO: 279826 - RNA, 22 nt, Human
uuucuucuauuucaguuuuuca

SEQ ID NO: 279827 - RNA, 32 nt, Human
uuucuucucaaagugcgaguaacuuaaaaggu

SEQ ID NO: 279828 - RNA, 32 nt, Human
uuucuucuccaccucuucuuuuucucaugccc

SEQ ID NO: 279829 - RNA, 32 nt, Human
uuucuucucccuuuuugaaagaucuuuccuuu

SEQ ID NO: 279830 - RNA, 32 nt, Human
uuucuucuccuuugguagcagcucccugccuc

SEQ ID NO: 279831 - RNA, 32 nt, Human
uuucuucucucaacaggaaccugccugaggac

SEQ ID NO: 279832 - RNA, 32 nt, Human
uuucuucucucagucgaaguuugcuaagugag

SEQ ID NO: 279833 - RNA, 32 nt, Human
uuucuucucuuuccuucucucccuuucucauu

SEQ ID NO: 279834 - RNA, 32 nt, Human
uuucuucugaaggaugcuaucauuugcccucu

SEQ ID NO: 279835 - RNA, 32 nt, Human
uuucuucugaccuccuugccucuugucuugaa

SEQ ID NO: 279836 - RNA, 32 nt, Human
uuucuucugcauuuuagugguuccacaaguaa

SEQ ID NO: 279837 - RNA, 32 nt, Human
uuucuucugccucucuguguggguacugugug

SEQ ID NO: 279838 - RNA, 32 nt, Human
uuucuucugcggaaccuccaccccuccagugg

SEQ ID NO: 279839 - RNA, 32 nt, Human
uuucuucugggcuucagcaugauguucaauaa

SEQ ID NO: 279840 - RNA, 32 nt, Human
uuucuucuggguucaaccacuuuagccagaau

SEQ ID NO: 279841 - RNA, 32 nt, Human
uuucuucuguuuccuuuggaauucuucuuuuu

SEQ ID NO: 279842 - RNA, 32 nt, Human
uuucuucuuaaaaaucagcuauuuagaggugg

SEQ ID NO: 279843 - RNA, 32 nt, Human
uuucuucuucaaccuccaucccuggcuuccuc

SEQ ID NO: 279844 - RNA, 32 nt, Human
uuucuucuucuuuguuguucuucuagugugac

SEQ ID NO: 279845 - RNA, 32 nt, Human
uuucuucuucuuuuccuuuuggcaaagcagau

SEQ ID NO: 279846 - RNA, 32 nt, Human
uuucuucuucuuuuucuucuccuccuccuccu

SEQ ID NO: 279847 - RNA, 32 nt, Human
uuucuucuuggcugguucuuuguucugucccc

SEQ ID NO: 279848 - RNA, 32 nt, Human
uuucuucuuguagggcuuggugguguuuuauc

SEQ ID NO: 279849 - RNA, 32 nt, Human
uuucuucuuuugcuauaauuuuuaaccaaaaa

SEQ ID NO: 279850 - RNA, 32 nt, Human
uuucuucuuuuuauuuuuaauagaugaugccu

SEQ ID NO: 279851 - RNA, 24 nt, Human
uuucuugaaaagcuugucgguuca

SEQ ID NO: 279852 - RNA, 32 nt, Human
uuucuugaacuccuggccaacauggugaaacc

SEQ ID NO: 279853 - RNA, 32 nt, Human
uuucuugaagaagagaacaucuucucagaauc

SEQ ID NO: 279854 - RNA, 32 nt, Human
uuucuugaagaaugcuugggaucugugaggaa

SEQ ID NO: 279855 - RNA, 32 nt, Human
uuucuugaagaggcagcucaaaugucaccuuc

SEQ ID NO: 279856 - RNA, 32 nt, Human
uuucuugaaggggacugcauccuaguugaccu

SEQ ID NO: 279857 - RNA, 32 nt, Human
uuucuugaauuuaaucugggcacuuugcacug

SEQ ID NO: 279858 - RNA, 24 nt, Human
uuucuugaauuucagucugcugcu

SEQ ID NO: 279859 - RNA, 32 nt, Human
uuucuugagaaguucauuuauaccucaucacu

SEQ ID NO: 279860 - RNA, 32 nt, Human
uuucuugagccacguggaacugugggucaggu

SEQ ID NO: 279861 - RNA, 32 nt, Human
uuucuugagcccagggguuugaggcugcagug

SEQ ID NO: 279862 - RNA, 32 nt, Human
uuucuugaggcagggucucacucuguugacca

SEQ ID NO: 279863 - RNA, 32 nt, Human
uuucuugaugacccugcacaauacugugagga

SEQ ID NO: 279864 - RNA, 32 nt, Human
uuucuugauugggacucccgauuugcaaauuu

SEQ ID NO: 279865 - RNA, 32 nt, Human
uuucuugcacacaucaacuggcacacaugcac

SEQ ID NO: 279866 - RNA, 32 nt, Human
uuucuugcagcagaagaaagaagagacaggag

SEQ ID NO: 279867 - RNA, 32 nt, Human
uuucuugcagcugcucugagggagagacagug

SEQ ID NO: 279868 - RNA, 32 nt, Human
uuucuugcagucagcuucauaccauuuuuaaa

SEQ ID NO: 279869 - RNA, 32 nt, Human
uuucuugcaugaggcuagugugguguuuccug

SEQ ID NO: 279870 - RNA, 32 nt, Human
uuucuugcauuuucauaugcauuuuaaaagca

SEQ ID NO: 279871 - RNA, 32 nt, Human
uuucuugccaaaggcgguuccacccucgugau

SEQ ID NO: 279872 - RNA, 32 nt, Human
uuucuugccauuaguuuauaugacuuuaauau

SEQ ID NO: 279873 - RNA, 32 nt, Human
uuucuugccuguaacccuagcacuuugggagg

SEQ ID NO: 279874 - RNA, 32 nt, Human
uuucuugcgucuucuuuuccugacuaacucuu

SEQ ID NO: 279875 - RNA, 32 nt, Human
uuucuugcucaucagaaccucagcuaaucuac

SEQ ID NO: 279876 - RNA, 32 nt, Human
uuucuugcuccuguggauguauaggaagucaa

SEQ ID NO: 279877 - RNA, 32 nt, Human
uuucuugcuuucucuuuucccucucucuuucu

SEQ ID NO: 279878 - RNA, 32 nt, Human
uuucuugcuuuucauuugauuacccugcuuga

SEQ ID NO: 279879 - RNA, 32 nt, Human
uuucuuggaacgggggaaagaaaaugaaacuu

SEQ ID NO: 279880 - RNA, 32 nt, Human
uuucuuggagaagcgauggaugacagagauua

SEQ ID NO: 279881 - RNA, 32 nt, Human
uuugugugucugggcagucucucagccuccga

SEQ ID NO: 279882 - RNA, 32 nt, Human
uuugugugucugguuucucccuuccuuuccuc

SEQ ID NO: 279883 - RNA, 29 nt, Human
uuugugugucuguaugugugucuguguau

SEQ ID NO: 279884 - RNA, 29 nt, Human
uuugugugucugugcaugggccuggguac

SEQ ID NO: 279885 - RNA, 32 nt, Human
uuugugugugggaaguggaagcagcaugaagu

SEQ ID NO: 279886 - RNA, 32 nt, Human
uuuguguguguaugcauggcauauguacaacu

SEQ ID NO: 279887 - RNA, 32 nt, Human
uuuguguguguauguuuuuagauacguacgug

SEQ ID NO: 279888 - RNA, 32 nt, Human
uuuguguguucagccagacugggcaggugcag

SEQ ID NO: 279889 - RNA, 32 nt, Human
uuuguguguuguguaugugagccaucccacau

SEQ ID NO: 279890 - RNA, 32 nt, Human
uuuguguguuuuccaccucaguagccuugcac

SEQ ID NO: 279891 - RNA, 32 nt, Human
uuuguguuaaaauguugacaacagccacaccu

SEQ ID NO: 279892 - RNA, 32 nt, Human
uuuguguuauucaccacuguauucucaaauau

SEQ ID NO: 279893 - RNA, 32 nt, Human
uuuguguuauucaccacuguauucucaauauc

SEQ ID NO: 279894 - RNA, 32 nt, Human
uuuguguucacugauguuagggcugcuagggc

SEQ ID NO: 279895 - RNA, 32 nt, Human
uuuguguuccuuggcacccuguuggguauugg

SEQ ID NO: 279896 - RNA, 32 nt, Human
uuuguguucuucaaaaugugcauguuaaguau

SEQ ID NO: 279897 - RNA, 32 nt, Human
uuuguguugcagguguuugccaugugguaccu

SEQ ID NO: 279898 - RNA, 32 nt, Human
uuuguguugcuuaacccagcauccugaaccgu

SEQ ID NO: 279899 - RNA, 32 nt, Human
uuuguguuuacuuaaacugugcugcuaaguag

SEQ ID NO: 279900 - RNA, 32 nt, Human
uuuguguuucaguuggagggaauauaugauac

SEQ ID NO: 279901 - RNA, 32 nt, Human
uuuguguuugaaguaucugugcaugggaucgu

SEQ ID NO: 279902 - RNA, 32 nt, Human
uuuguguuugauucucucgauccuggcacauc

SEQ ID NO: 279903 - RNA, 32 nt, Human
uuuguguuugauuuuguuugauuucccucugc

SEQ ID NO: 279904 - RNA, 32 nt, Human
uuuguguuuguccugucuucucucacauuuga

SEQ ID NO: 279905 - RNA, 32 nt, Human
uuuguguuuguuuucuuguucuuaugguuguu

SEQ ID NO: 279906 - RNA, 32 nt, Human
uuuguuaaaacacagcaucauaacucagccag

SEQ ID NO: 279907 - RNA, 32 nt, Human
uuuguuaaaacuaaauguaagaaaaaucugcu

SEQ ID NO: 279908 - RNA, 32 nt, Human
uuuguuaaaccagaucuaguccgagucuuuuc

SEQ ID NO: 279909 - RNA, 32 nt, Human
uuuguuaagguucaagacagaugggcauaugu

SEQ ID NO: 279910 - RNA, 32 nt, Human
uuuguuaauuuccaugggaagccaugauggcc

SEQ ID NO: 279911 - RNA, 32 nt, Human
uuuguuacaauccugaaucuuugcuuuuugca

SEQ ID NO: 279912 - RNA, 32 nt, Human
uuuguuacacagaaauagauaacugaaacacc

SEQ ID NO: 279913 - RNA, 32 nt, Human
uuuguuacagauauacagauauacaaauauac

SEQ ID NO: 279914 - RNA, 24 nt, Human
uuuguuaccagccugggcaacaua

SEQ ID NO: 279915 - RNA, 32 nt, Human
uuuguuaccagccugggcaacauagugagacc

SEQ ID NO: 279916 - RNA, 32 nt, Human
uuuguuacccaggcuggagugcaguggcacaa

SEQ ID NO: 279917 - RNA, 32 nt, Human
uuuguuaccccaggggcuguggcaugucccag

SEQ ID NO: 279918 - RNA, 32 nt, Human
uuuguuaccuagaaggcuggacugcauaagca

SEQ ID NO: 279919 - RNA, 32 nt, Human
uuuguuacuacaaagccugccuccagcagccc

SEQ ID NO: 279920 - RNA, 32 nt, Human
uuuguuacugacugccuaaaaucacuuaaucu

SEQ ID NO: 279921 - RNA, 32 nt, Human
uuuguuacuucccucacuucaccuccauaaga

SEQ ID NO: 279922 - RNA, 32 nt, Human
uuuguuacuuuuaccaacaauguaauauaauu

SEQ ID NO: 279923 - RNA, 32 nt, Human
uuuguuagacagccacaguccugucuggguua

SEQ ID NO: 279924 - RNA, 32 nt, Human
uuuguuagccugggugcucaggguggacagcu

SEQ ID NO: 279925 - RNA, 32 nt, Human
uuuguuaggaaagagaaaggacaagaagagga

SEQ ID NO: 279926 - RNA, 32 nt, Human
uuuguuagggagagaagagggagaggcaggag

SEQ ID NO: 279927 - RNA, 32 nt, Human
uuuguuaguacuagaguuguuucccaaucacc

SEQ ID NO: 279928 - RNA, 32 nt, Human
uuuguuaguguuuagaaaacaauguuuuaaac

SEQ ID NO: 279929 - RNA, 32 nt, Human
uuuguuaguuauccgccgccaccaagacgcgg

SEQ ID NO: 279930 - RNA, 32 nt, Human
uuuguuauaacaaccucugcauauuccagguc

SEQ ID NO: 279931 - RNA, 32 nt, Human
uuuguuauaauaaccacuaguguuuuauccaa

SEQ ID NO: 279932 - RNA, 32 nt, Human
uuuguuauauccuagacuagacaugcgaaagu

SEQ ID NO: 279933 - RNA, 32 nt, Human
uuuguuaucuugcuucucuguaguuuugcauc

SEQ ID NO: 279934 - RNA, 32 nt, Human
uuuguuauguacaaauaauuuagcuuacacaa

SEQ ID NO: 279935 - RNA, 32 nt, Human
uuuguuauguuguuaaaucuugcugagacaaa

SEQ ID NO: 279936 - RNA, 32 nt, Human
uuuguucaaaccuguaauggcuuguaaacaaa

SEQ ID NO: 279937 - RNA, 32 nt, Human
uuuguucaacacaguaagcccugcucccuucc

SEQ ID NO: 279938 - RNA, 32 nt, Human
uuuguucaagcguuccucuggggaccggcagc

SEQ ID NO: 279939 - RNA, 32 nt, Human
uuuguucaccaguucuacagugauggggugcu

SEQ ID NO: 279940 - RNA, 32 nt, Human
uuuguucacugcaaccucugccuuccaagauc

SEQ ID NO: 279941 - RNA, 32 nt, Human
uuuguucagacagggucucgcuauguugccca

SEQ ID NO: 279942 - RNA, 32 nt, Human
uuuguucagagccugucuuuaaggcuggugug

SEQ ID NO: 279943 - RNA, 32 nt, Human
uuuguucagcaacauuuaguguuucagugaaa

SEQ ID NO: 279944 - RNA, 32 nt, Human
uuuguucauauuuucuccagacagaaaugcaa

SEQ ID NO: 279945 - RNA, 32 nt, Human
uuuguucauccuggagaauugaagggagguca

SEQ ID NO: 279946 - RNA, 32 nt, Human
uuuguucauugcuagaucaccaagggcuaaca

SEQ ID NO: 279947 - RNA, 32 nt, Human
uuuguucauuuuaauugcaaagcugccaaaau

SEQ ID NO: 279948 - RNA, 32 nt, Human
uuuguuccaggaauagcgcuccaggcuccugc

SEQ ID NO: 279949 - RNA, 32 nt, Human
uuuguuccccuccaggaugcugccggacugga

SEQ ID NO: 279950 - RNA, 32 nt, Human
uuuguuccccuucaccgcucucccucucauuc

SEQ ID NO: 279951 - RNA, 25 nt, Human
uuuguucccucauggaacuauaaca

SEQ ID NO: 279952 - RNA, 32 nt, Human
uuuguucccugccuuuccgccacaucacacgg

SEQ ID NO: 279953 - RNA, 20 nt, Human
uuuguucccuucccuguccc

SEQ ID NO: 279954 - RNA, 32 nt, Human
uuuguuccuccaccucuugcuccaaucagagg

SEQ ID NO: 279955 - RNA, 32 nt, Human
uuuguuccucucuccacugaagcugacuuagc

SEQ ID NO: 279956 - RNA, 32 nt, Human
uuuguuccugcagggugcagcuccugucugcu

SEQ ID NO: 279957 - RNA, 32 nt, Human
uuuguuccugguguuuguguuccaguuccacg

SEQ ID NO: 279958 - RNA, 32 nt, Human
uuuguuccuuucagauccuccacuuggcaggc

SEQ ID NO: 279959 - RNA, 32 nt, Human
uuuguucuaaagguugcauuuucaguuauagg

SEQ ID NO: 279960 - RNA, 32 nt, Human
uuuguucuaagcuggacggaugcuggcacaga

SEQ ID NO: 279961 - RNA, 32 nt, Human
uuuguucuagccacacuggcagcuguuagaug

SEQ ID NO: 279962 - RNA, 32 nt, Human
uuuguucuaucaccccucucccuaucauuaac

SEQ ID NO: 279963 - RNA, 32 nt, Human
uuuguucucaaggaauuugcauucuagaaagu

SEQ ID NO: 279964 - RNA, 31 nt, Human
uuuguucucaauaaauguuggguuugguaau

SEQ ID NO: 279965 - RNA, 21 nt, Human
uuuguucucaccucuaccugu

SEQ ID NO: 279966 - RNA, 32 nt, Human
uuuguucuccaauguggcuuguuauuuauguu

SEQ ID NO: 279967 - RNA, 32 nt, Human
uuuguucucccuuuuaaauccacugcccugac

SEQ ID NO: 279968 - RNA, 32 nt, Human
uuuguucucuuauuucugaggcccuucagucu

SEQ ID NO: 279969 - RNA, 32 nt, Human
uuuguucugaauuuuccagaccccugugcaga

SEQ ID NO: 279970 - RNA, 32 nt, Human
uuuguucugacagugcaugucuuuggaagcau

SEQ ID NO: 279971 - RNA, 32 nt, Human
uuuguucugcuuuaucuuuucauaaaggguug

SEQ ID NO: 279972 - RNA, 32 nt, Human
uuuguucuguaacucgagagccaguagcauug

SEQ ID NO: 279973 - RNA, 32 nt, Human
uuuguucugugcuaacagauaacugggacacc

SEQ ID NO: 279974 - RNA, 32 nt, Human
uuuguucuguucugucaugugccacaaaauau

SEQ ID NO: 279975 - RNA, 32 nt, Human
uuuguucuguuuuugcuuugcauuuggagaaa

SEQ ID NO: 279976 - RNA, 32 nt, Human
uuuguucuuagcagacuuggcuucauuuuggu

SEQ ID NO: 279977 - RNA, 32 nt, Human
uuuguucuuuuauucugcuuuuuaacuguaau

SEQ ID NO: 279978 - RNA, 32 nt, Human
uuuguugaaaacaaacuggaaacuuguuucuu

SEQ ID NO: 279979 - RNA, 23 nt, Human
uuuguugaaagaaaaugaaggaa

SEQ ID NO: 279980 - RNA, 32 nt, Human
uuuguugagacagggucuugcucugucaccca

SEQ ID NO: 279981 - RNA, 32 nt, Human
uuuguugagccucuuucugggucucugccugg

SEQ ID NO: 279982 - RNA, 32 nt, Human
uuuguugcaaaggaggaggaaaagggaggacu

SEQ ID NO: 279983 - RNA, 24 nt, Human
uuuguugcagcacagucccuggca

SEQ ID NO: 279984 - RNA, 23 nt, Human
uuuguugcaggaaauguauuuca

SEQ ID NO: 279985 - RNA, 32 nt, Human
uuuguugccagauuugaaagucacuggaacuu

SEQ ID NO: 279986 - RNA, 32 nt, Human
uuuguugccaggcuggagugcaguggcgcgau

SEQ ID NO: 279987 - RNA, 32 nt, Human
uuuguugcccaggcuggagugcaguggcacga

SEQ ID NO: 279988 - RNA, 32 nt, Human
uuuguugcccaggcuggagugcaguggucuga

SEQ ID NO: 279989 - RNA, 32 nt, Human
uuuguugcccaggcuggagugcgguggcguga

SEQ ID NO: 279990 - RNA, 32 nt, Human
uuuguugcccaggcuggagugcgguggugcaa

SEQ ID NO: 279991 - RNA, 32 nt, Human
uuuguugcccaggcuggaguguaguggcgcga

SEQ ID NO: 279992 - RNA, 32 nt, Human
uuuguugcccaggcuggggugcaguggcacga

SEQ ID NO: 279993 - RNA, 32 nt, Human
uuuguugccuaccucuuccuccacucauuugg

SEQ ID NO: 279994 - RNA, 32 nt, Human
uuuguugcuguagugggcagucaccuuccaac

SEQ ID NO: 279995 - RNA, 32 nt, Human
uuuguugcuguugcuguugcuguugcuguugc

SEQ ID NO: 279996 - RNA, 32 nt, Human
uuuguugcuugacuuucuggaguuuguauuau

SEQ ID NO: 279997 - RNA, 32 nt, Human
uuuguuggagagugucagacugaucuggaagu

SEQ ID NO: 279998 - RNA, 32 nt, Human
uuuguuggagugaagcauuuaaaagaguaagg

SEQ ID NO: 279999 - RNA, 32 nt, Human
uuuguuggcagacagggucucacuuugucacc

SEQ ID NO: 280000 - RNA, 32 nt, Human
uuuguuggcuuccuuuccuccugcugcacaug

SEQ ID NO: 280001 - RNA, 23 nt, Human
uuuguuggcuucuuugcuuucuc

SEQ ID NO: 280002 - RNA, 32 nt, Human
uuuguugggggaguugaggagugaagaaacac

SEQ ID NO: 280003 - RNA, 32 nt, Human
uuuguuggugcuuuguucucaguacaguaacu

SEQ ID NO: 280004 - RNA, 32 nt, Human
uuuguugguuccucucaucgaaaucagucuac

SEQ ID NO: 280005 - RNA, 32 nt, Human
uuuguuguaaagcaucuuaacuacacauauaa

SEQ ID NO: 280006 - RNA, 32 nt, Human
uuuguuguaagaaagacugugcagaggagugu

SEQ ID NO: 280007 - RNA, 22 nt, Human
uuuguugucaaagacagcacag

SEQ ID NO: 280008 - RNA, 22 nt, Human
uuuguugucucccucuuucuca

SEQ ID NO: 280009 - RNA, 32 nt, Human
uuuguugugcucaaauaaauguuuacuuaucu

SEQ ID NO: 280010 - RNA, 32 nt, Human
uuuguuguggggaggaggauggggaguaggac

SEQ ID NO: 280011 - RNA, 32 nt, Human
uuuguugugguguggggaggggagacgcugac

SEQ ID NO: 280012 - RNA, 32 nt, Human
uuuguuguguaaguccgucugugugcagcugu

SEQ ID NO: 280013 - RNA, 32 nt, Human
uuuguuguuaauguauuuaagcauuuuauagu

SEQ ID NO: 280014 - RNA, 32 nt, Human
uuuguuguuguuguuguucuggguaacuccaa

SEQ ID NO: 280015 - RNA, 32 nt, Human
uuuguuguuguuguuguuuugagauggagucu

SEQ ID NO: 280016 - RNA, 32 nt, Human
uuuguuguuguuguuuuucaaacuaagaauaa

SEQ ID NO: 280017 - RNA, 25 nt, Human
uuuguuguuguuuuuacguuuuuca

SEQ ID NO: 280018 - RNA, 32 nt, Human
uuuguuguuugaauggaaauggaaaagccagu

SEQ ID NO: 280019 - RNA, 32 nt, Human
uuuguuguuuuauuuuccuuuccagagccuuc

SEQ ID NO: 280020 - RNA, 20 nt, Human
uuuguuguuuucaguuuuuu

SEQ ID NO: 280021 - RNA, 32 nt, Human
uuuguuuaacaggucucuguaagcaagcuugc

SEQ ID NO: 280022 - RNA, 32 nt, Human
uuuguuuacaauaugaguuuuuccagaauaca

SEQ ID NO: 280023 - RNA, 32 nt, Human
uuuguuuacagucuuuguuuaacaaaccaugc

SEQ ID NO: 280024 - RNA, 32 nt, Human
uuuguuuacauugcucacgauuuucuaaaggc

SEQ ID NO: 280025 - RNA, 32 nt, Human
uuuguuuaccauucaguuccuccccuuuccuu

SEQ ID NO: 280026 - RNA, 32 nt, Human
uuuguuuacucuuuauaccaaaauucagugaa

SEQ ID NO: 280027 - RNA, 23 nt, Human
uuuguuuagaaguucaguuuuuu

SEQ ID NO: 280028 - RNA, 23 nt, Human
uuuguuuagaauuagguuuuuca

SEQ ID NO: 280029 - RNA, 32 nt, Human
uuuguuuagccaugugcaaauauugcccuaaa

SEQ ID NO: 280030 - RNA, 32 nt, Human
uuuguuuagccauguucaaauauugcccuaaa

SEQ ID NO: 280031 - RNA, 32 nt, Human
uuuguuuagguagagaagacaaguccaaagag

SEQ ID NO: 280032 - RNA, 32 nt, Human
uuuguuuaucagccugagcauauuucauuuua

SEQ ID NO: 280033 - RNA, 22 nt, Human
uuuguuuauuaaaauguguccu

SEQ ID NO: 280034 - RNA, 32 nt, Human
uuuguuuauuccugaaacauaguuacauaguu

SEQ ID NO: 280035 - RNA, 32 nt, Human
uuuguuucaagaggaacaagggaugagggaga

SEQ ID NO: 280036 - RNA, 32 nt, Human
uuuguuucaagagucauguuuccccagaugug

SEQ ID NO: 280037 - RNA, 32 nt, Human
uuuguuucacuugccucugcucgacuccgaga

SEQ ID NO: 280038 - RNA, 32 nt, Human
uuuguuucagaaucugcuacuugggcccucuu

SEQ ID NO: 280039 - RNA, 32 nt, Human
uuuguuucauuucaugccuuacuuaucaaaaa

SEQ ID NO: 280040 - RNA, 32 nt, Human
uuuguuucauuuucuucugucucaccucguua

SEQ ID NO: 280041 - RNA, 32 nt, Human
uuuguuuccaaguugaaaaccuuugggucuuu

SEQ ID NO: 280042 - RNA, 32 nt, Human
uuuguuucccaggcuggagugcaguggcacga

SEQ ID NO: 280043 - RNA, 19 nt, Human
uuuguuuccccgguggccc

SEQ ID NO: 280044 - RNA, 32 nt, Human
uuuguuuccccucagugucuguaacccuuagc

SEQ ID NO: 280045 - RNA, 32 nt, Human
uuuguuuccuccuugucacugaagauugggua

SEQ ID NO: 280046 - RNA, 32 nt, Human
uuuguuuccuuccuuccuuauuuccuuuaguu

SEQ ID NO: 280047 - RNA, 32 nt, Human
uuuguuuccuuuuuaaacuucuccccugcuuu

SEQ ID NO: 280048 - RNA, 32 nt, Human
uuuguuucuggcuuuuauggcuuaagguuuuc

SEQ ID NO: 280049 - RNA, 32 nt, Human
uuuguuucuuauuccuucacuuuuggggaaaa

SEQ ID NO: 280050 - RNA, 32 nt, Human
uuuguuucuuauuuaauaggcuuuuuacuuca

SEQ ID NO: 280051 - RNA, 32 nt, Human
uuuguuucuuuuguuaagcagcacuuauguag

SEQ ID NO: 280052 - RNA, 32 nt, Human
uuuguuugaugaagaaauaaacuucagcugaa

SEQ ID NO: 280053 - RNA, 32 nt, Human
uuuguuugauuuguucuauuccauccauuguc

SEQ ID NO: 280054 - RNA, 24 nt, Human
uuuguuugcucuuuuaguuuuuua

SEQ ID NO: 280055 - RNA, 32 nt, Human
uuuguuugcuuugggaucuuguuggaugcacu

SEQ ID NO: 280056 - RNA, 32 nt, Human
uuuguuugggaagcuauggaggaggacuuuua

SEQ ID NO: 280057 - RNA, 32 nt, Human
uuuguuuggggaggggaacaagccaauaaaga

SEQ ID NO: 280058 - RNA, 23 nt, Human
uuuguuuguaauuuuguuuuuca

SEQ ID NO: 280059 - RNA, 21 nt, Human
uuuguuuguauaaauaugccu

SEQ ID NO: 280060 - RNA, 32 nt, Human
uuuguuuguauccucuuuuauuuccuugagca

SEQ ID NO: 280061 - RNA, 22 nt, Human
uuuguuuguuauacucuuugca

SEQ ID NO: 280062 - RNA, 32 nt, Human
uuuguuuguuucucccccugggcucugcccca

SEQ ID NO: 280063 - RNA, 32 nt, Human
uuuguuuguuucuuugagauggagucuugcuc

SEQ ID NO: 280064 - RNA, 32 nt, Human
uuuguuuguuuguuuucccuuccccauuuccu

SEQ ID NO: 280065 - RNA, 23 nt, Human
uuuguuuguuuugcacuuuguca

SEQ ID NO: 280066 - RNA, 32 nt, Human
uuuguuuuaaggccacaccuuuuugaaguuuu

SEQ ID NO: 280067 - RNA, 32 nt, Human
uuuguuuuaauuacuugggcaucccaggaagc

SEQ ID NO: 280068 - RNA, 32 nt, Human
uuuguuuuagagaugggaucucaccauguugc

SEQ ID NO: 280069 - RNA, 32 nt, Human
uuuguuuuauccaccuaucccuauuaccugac

SEQ ID NO: 280070 - RNA, 32 nt, Human
uuuguuuuauuccugaaggaacaucaguaccc

SEQ ID NO: 280071 - RNA, 32 nt, Human
uuuguuuuauuucaaaaacaaaguacauuuuu

SEQ ID NO: 280072 - RNA, 32 nt, Human
uuuguuuucaguaacugaaucauagaacgagu

SEQ ID NO: 280073 - RNA, 23 nt, Human
uuuguuuucauaaaaucucuaca

SEQ ID NO: 280074 - RNA, 22 nt, Human
uuuguuuucauaauaccucaca

SEQ ID NO: 280075 - RNA, 32 nt, Human
uuuguuuuccaaaucaagguaacuugcucccu

SEQ ID NO: 280076 - RNA, 32 nt, Human
uuuguuuucccuuccccauuuccuuccuuccc

SEQ ID NO: 280077 - RNA, 32 nt, Human
uuuguuuuccucccucuccucuggcugcuaca

SEQ ID NO: 280078 - RNA, 32 nt, Human
uuuguuuuccucuccaucuacuuuucccugug

SEQ ID NO: 280079 - RNA, 32 nt, Human
uuuguuuuccuuccucuaaagaugucuuuaug

SEQ ID NO: 280080 - RNA, 32 nt, Human
uuuguuuuccuugccgcgacugugaagauaaa

SEQ ID NO: 280081 - RNA, 32 nt, Human
uuuguuuucucaaauauuugcuaugaaggguu

SEQ ID NO: 280082 - RNA, 32 nt, Human
uuuguuuucuguauguuguugggggaucaacu

SEQ ID NO: 280083 - RNA, 32 nt, Human
uuuguuuucuuuucuccucaacccagcauuuu

SEQ ID NO: 280084 - RNA, 32 nt, Human
uuuguuuugagacucucuugagauuuuucugg

SEQ ID NO: 280085 - RNA, 32 nt, Human
uuuguuuugcacuaaaguuucugugauuuaac

SEQ ID NO: 280086 - RNA, 32 nt, Human
uuuguuuugccaacaugaaaacuguuauaagg

SEQ ID NO: 280087 - RNA, 32 nt, Human
uuuguuuuggaaaucagcacuaguuuuaaaug

SEQ ID NO: 280088 - RNA, 32 nt, Human
uuuguuuuggccauuuccaccuggugaagauu

SEQ ID NO: 280089 - RNA, 32 nt, Human
uuuguuuuggggaccagguagggaggcuguug

SEQ ID NO: 280090 - RNA, 32 nt, Human
uuuguuuugguaccuuuaaauggugguguugu

SEQ ID NO: 280091 - RNA, 22 nt, Human
uuuguuuuggucaucccuaaua

SEQ ID NO: 280092 - RNA, 32 nt, Human
uuuguuuuggugugcacauccauuuuguuuuu

SEQ ID NO: 280093 - RNA, 32 nt, Human
uuuguuuuguagauggaguuucacuuuuguug

SEQ ID NO: 280094 - RNA, 32 nt, Human
uuuguuuugucuuuuaagaaaggaaagaaagg

SEQ ID NO: 280095 - RNA, 32 nt, Human
uuuguuuugugggcauuuccacacgaagccua

SEQ ID NO: 280096 - RNA, 32 nt, Human
uuuguuuuuacucaaugacaccauuuuuaguu

SEQ ID NO: 280097 - RNA, 24 nt, Human
uuuguuuuuaucuauaucuuggua

SEQ ID NO: 280098 - RNA, 32 nt, Human
uuuguuuuucauuccccucccucucuccccuc

SEQ ID NO: 280099 - RNA, 32 nt, Human
uuuguuuuucccuguaaauuuuagagucaucu

SEQ ID NO: 280100 - RNA, 32 nt, Human
uuuguuuuuccucccuugccuuaaguccuugg

SEQ ID NO: 280101 - RNA, 32 nt, Human
uuuguuuuugacacagagucucgcucugucgc

SEQ ID NO: 280102 - RNA, 32 nt, Human
uuuguuuuugagacaaguucucacucugucac

SEQ ID NO: 280103 - RNA, 32 nt, Human
uuuguuuuugagacacaguuucgcucuuauug

SEQ ID NO: 280104 - RNA, 32 nt, Human
uuuguuuuugagacagaauuuugcucuuguug

SEQ ID NO: 280105 - RNA, 32 nt, Human
uuuguuuuugagacagagucucacucugucac

SEQ ID NO: 280106 - RNA, 32 nt, Human
uuuguuuuugagacagagucucacucuguugc

SEQ ID NO: 280107 - RNA, 32 nt, Human
uuuguuuuugagacagagucucacuuugcuuc

SEQ ID NO: 280108 - RNA, 32 nt, Human
uuuguuuuugagacagagucucgcucugucac

SEQ ID NO: 280109 - RNA, 32 nt, Human
uuuguuuuugagacagagucucuuucugucgu

SEQ ID NO: 280110 - RNA, 32 nt, Human
uuuguuuuugagacagagucuugcucugucac

SEQ ID NO: 280111 - RNA, 32 nt, Human
uuuguuuuugagacagggucucgcucuauggc

SEQ ID NO: 280112 - RNA, 32 nt, Human
uuuguuuuugagaccgaaucucacucuguugc

SEQ ID NO: 280113 - RNA, 32 nt, Human
uuuguuuuugagacggagucucacucuguugc

SEQ ID NO: 280114 - RNA, 32 nt, Human
uuuguuuuugagacggagucucgcucugucgc

SEQ ID NO: 280115 - RNA, 32 nt, Human
uuuguuuuugagacggagucucgcucuguuuc

SEQ ID NO: 280116 - RNA, 32 nt, Human
uuuguuuuugagacggagucucgcuuuguuuc

SEQ ID NO: 280117 - RNA, 32 nt, Human
uuuguuuuugagacggaguuucacucuuauug

SEQ ID NO: 280118 - RNA, 32 nt, Human
uuuguuuuugagacggaguuucacucuuguug

SEQ ID NO: 280119 - RNA, 32 nt, Human
uuuguuuuugagacggaguuucccucuguugc

SEQ ID NO: 280120 - RNA, 32 nt, Human
uuuguuuuugagacugagucucacucugucac

SEQ ID NO: 280121 - RNA, 32 nt, Human
uuuguuuuugagacugagucucacuuuaucac

SEQ ID NO: 280122 - RNA, 32 nt, Human
uuuguuuuugagagaagguauugcucugucau

SEQ ID NO: 280123 - RNA, 32 nt, Human
uuuguuuuugagagggagucucacuuugugcc

SEQ ID NO: 280124 - RNA, 32 nt, Human
uuuguuuuugagauagggucuuuguugcucag

SEQ ID NO: 280125 - RNA, 32 nt, Human
uuuguuuuugagauggacucuagcucugucac

SEQ ID NO: 280126 - RNA, 32 nt, Human
uuuguuuuugagauggagucucacgcugucac

SEQ ID NO: 280127 - RNA, 32 nt, Human
uuuguuuuugagauggagucucacucuguuac

SEQ ID NO: 280128 - RNA, 32 nt, Human
uuuguuuuugagauggagucucgcucugucgc

SEQ ID NO: 280129 - RNA, 32 nt, Human
uuuguuuuugagauggagucucgcucuugucg

SEQ ID NO: 280130 - RNA, 32 nt, Human
uuuguuuuugagauggagucucuugcucuguc

SEQ ID NO: 280131 - RNA, 32 nt, Human
uuuguuuuugagauggagucuugcgcucuguu

SEQ ID NO: 280132 - RNA, 32 nt, Human
uuuguuuuugagauggagucuugcucuguugc

SEQ ID NO: 280133 - RNA, 32 nt, Human
uuuguuuuugagauggagucuuguucugucac

SEQ ID NO: 280134 - RNA, 32 nt, Human
uuuguuuuugagauguaauauugcucuguugc

SEQ ID NO: 280135 - RNA, 32 nt, Human
  misc_feature (4)..(4): n is a, c, g or u
uuunuccagcagcaccagcagaugaugcgcug

SEQ ID NO: 280136 - RNA, 32 nt, Human
uuuuaaaaacacucuuaucagccugggcaaca

SEQ ID NO: 280137 - RNA, 32 nt, Human
uuuuaaaaaccagcuuauaauuccucguuaug

SEQ ID NO: 280138 - RNA, 32 nt, Human
uuuuaaaaacuagagcacagaaggaauaaggu

SEQ ID NO: 280139 - RNA, 32 nt, Human
uuuuaaaaacugcuccuuguggagcaggacua

SEQ ID NO: 280140 - RNA, 32 nt, Human
uuuuaaaaagagacuguauacacuugauuugc

SEQ ID NO: 280141 - RNA, 32 nt, Human
uuuuaaaaagcagacaucucacuguggucuac

SEQ ID NO: 280142 - RNA, 32 nt, Human
uuuuaaaaauaaagggcuuucacugggcauga

SEQ ID NO: 280143 - RNA, 32 nt, Human
uuuuaaaaauaacaauaaaguuuuaaauaagu

SEQ ID NO: 280144 - RNA, 32 nt, Human
uuuuaaaaauuagccaagcaugguggcaugug

SEQ ID NO: 280145 - RNA, 32 nt, Human
uuuuaaaaauuagcugggcaugguggugcaug

SEQ ID NO: 280146 - RNA, 32 nt, Human
uuuuaaaaauuagcugggugugguggugugcg

SEQ ID NO: 280147 - RNA, 32 nt, Human
uuuuaaaaauuauuucaaauggaacugaaaga

SEQ ID NO: 280148 - RNA, 32 nt, Human
uuuuaaaaauuuccuuucgcuuucauuauuuu

SEQ ID NO: 280149 - RNA, 32 nt, Human
uuuuaaaacagcccaguauuccuuuguauccu

SEQ ID NO: 280150 - RNA, 32 nt, Human
uuuuaaaacauaggaaaguagaaugguugagu

SEQ ID NO: 280151 - RNA, 32 nt, Human
uuuuaaaacaugcauauuccaaaaagaauuca

SEQ ID NO: 280152 - RNA, 32 nt, Human
uuuuaaaacauguuugacucaaagaugaauuu

SEQ ID NO: 280153 - RNA, 32 nt, Human
uuuuaaaacugguggcugggcgugguggcuca

SEQ ID NO: 280154 - RNA, 32 nt, Human
uuuuaaaacuuugccauuucaucuguuuacac

SEQ ID NO: 280155 - RNA, 32 nt, Human
uuuuaaaagaagggaugugggaucaaggagga

SEQ ID NO: 280156 - RNA, 32 nt, Human
uuuuaaaagagcguguuucuucggggcuugcc

SEQ ID NO: 280157 - RNA, 32 nt, Human
uuuuaaaaggaaacuauguggaggacgaugca

SEQ ID NO: 280158 - RNA, 32 nt, Human
uuuuaaaaggagagaggaggggugauggcagg

SEQ ID NO: 280159 - RNA, 32 nt, Human
uuuuaaaaguagugucuggaguuuguaaugag

SEQ ID NO: 280160 - RNA, 32 nt, Human
uuuuaaaagugcucugcccuaccuaccuugcc

SEQ ID NO: 280161 - RNA, 32 nt, Human
uuuuaaaaguucauggaaaauggaauuaaaag

SEQ ID NO: 280162 - RNA, 32 nt, Human
uuuuaaaaguuuaaaacagaagccugaugcug

SEQ ID NO: 280163 - RNA, 18 nt, Human
uuuuaaaaguuucucacu

SEQ ID NO: 280164 - RNA, 32 nt, Human
uuuuaaaauaagaguuuagagcaguaaacauu

SEQ ID NO: 280165 - RNA, 23 nt, Human
uuuuaaaauauuuguaauaugga

SEQ ID NO: 280166 - RNA, 32 nt, Human
uuuuaaaaucagcuugucuuguuccacaaacu

SEQ ID NO: 280167 - RNA, 32 nt, Human
uuuuaaaaucuuuacaguucucaccauuucac

SEQ ID NO: 280168 - RNA, 32 nt, Human
uuuuaaaaugaaccaggagucuggcuggccag

SEQ ID NO: 280169 - RNA, 32 nt, Human
uuuuaaaaugaguacuaauuuucacugcuaau

SEQ ID NO: 280170 - RNA, 32 nt, Human
uuuuaaaaugauuugcacuuuuucacugcaug

SEQ ID NO: 280171 - RNA, 32 nt, Human
uuuuaaaauguguaauuguuccagcauuccaa

SEQ ID NO: 280172 - RNA, 32 nt, Human
uuuuaaaauguucauggacuauuccauauuaa

SEQ ID NO: 280173 - RNA, 32 nt, Human
uuuuaaaauuauacuucagaagagaaagaaau

SEQ ID NO: 280174 - RNA, 26 nt, Human
uuuuaaacaaaguuuucuccugcagu

SEQ ID NO: 280175 - RNA, 22 nt, Human
uuuuaaacaaaucguccuguca

SEQ ID NO: 280176 - RNA, 32 nt, Human
uuuuaaacaaauucugauacaggcgacauccu

SEQ ID NO: 280177 - RNA, 32 nt, Human
uuuuaaacaaauucugaugcccagguugcacc

SEQ ID NO: 280178 - RNA, 32 nt, Human
uuuuaaacaacaauucacccaucuuccuggcu

SEQ ID NO: 280179 - RNA, 32 nt, Human
uuuuaaacacaaaugugaagaacuuguauaua

SEQ ID NO: 280180 - RNA, 23 nt, Human
uuuuaaacagguacauuuuuaca

SEQ ID NO: 280181 - RNA, 32 nt, Human
uuuuaaacaguaacauccagagugacaaauug

SEQ ID NO: 280182 - RNA, 32 nt, Human
uuuuaaacauuucucaccaacuuucuuaugug

SEQ ID NO: 280183 - RNA, 32 nt, Human
uuuuaaaccaaacuuuuaaacggacuggugaa

SEQ ID NO: 280184 - RNA, 32 nt, Human
uuuuaaaccaagggacugaaauagcauugaga

SEQ ID NO: 280185 - RNA, 32 nt, Human
uuuuaaaccaaguaaugcaaaaauuuagugua

SEQ ID NO: 280186 - RNA, 32 nt, Human
uuuuaaacccuuuccuccucccauuuugacau

SEQ ID NO: 280187 - RNA, 32 nt, Human
uuuuaaaccucuaggaccagagcauagucaga

SEQ ID NO: 280188 - RNA, 32 nt, Human
uuuuaaacgcaguauugcuguaaacuggacag

SEQ ID NO: 280189 - RNA, 32 nt, Human
uuuuaaacuacaaaugauagaaaggcaaguaa

SEQ ID NO: 280190 - RNA, 32 nt, Human
uuuuaaacucuuuuccugaaacuuuuuaugaa

SEQ ID NO: 280191 - RNA, 32 nt, Human
uuuuaaacugucuuuagcauuuucccucuucc

SEQ ID NO: 280192 - RNA, 32 nt, Human
uuuuaaacuuaccauuggugcauauguuccag

SEQ ID NO: 280193 - RNA, 32 nt, Human
uuuuaaagaaaaucgucuuuugaaggguaauu

SEQ ID NO: 280194 - RNA, 32 nt, Human
uuuuaaagaaaaucuguauuucaaagaaucuu

SEQ ID NO: 280195 - RNA, 32 nt, Human
uuuuaaagaaacaggcuucacugcaucuaaaa

SEQ ID NO: 280196 - RNA, 32 nt, Human
uuuuaaagaaauaagcuggcugcauuuauaga

SEQ ID NO: 280197 - RNA, 32 nt, Human
uuuuaaagaaggaggucguuuaugugugcaga

SEQ ID NO: 280198 - RNA, 32 nt, Human
uuuuaaagacagagucucgcucuguugcccag

SEQ ID NO: 280199 - RNA, 32 nt, Human
uuuuaaagagacaguguuagggaucuuggaag

SEQ ID NO: 280200 - RNA, 32 nt, Human
uuuuaaagauggggucuuguuauauugccuag

SEQ ID NO: 280201 - RNA, 32 nt, Human
uuuuaaagcaaaugauuuccauauuccagauu

SEQ ID NO: 280202 - RNA, 32 nt, Human
uuuuaaagcagagagacagggcauugagcuga

SEQ ID NO: 280203 - RNA, 32 nt, Human
uuuuaaagcauagaaguaguaugugggucuuu

SEQ ID NO: 280204 - RNA, 32 nt, Human
uuuuaaagccuauuugccuuugccguuaccca

SEQ ID NO: 280205 - RNA, 32 nt, Human
uuuuaaagccuuccacgauccuucccugaaca

SEQ ID NO: 280206 - RNA, 32 nt, Human
uuuuaaagcugaugucauguuauugauguagu

SEQ ID NO: 280207 - RNA, 32 nt, Human
uuuuaaagcugcagggaagugaaggaaucauc

SEQ ID NO: 280208 - RNA, 23 nt, Human
uuuuaaaggaaaaaugacuuuca

SEQ ID NO: 280209 - RNA, 22 nt, Human
uuuuaaaggcaccuacuuguua

SEQ ID NO: 280210 - RNA, 32 nt, Human
uuuuaaaggcucuguuugccuggagaagcaag

SEQ ID NO: 280211 - RNA, 27 nt, Human
uuuuaaagggacaguuuguaacuuggg

SEQ ID NO: 280212 - RNA, 32 nt, Human
uuuuaaagggucuacaacugaaugagcucacc

SEQ ID NO: 280213 - RNA, 30 nt, Human
uuuuaaaguacacaaagggcacaaucaaaa

SEQ ID NO: 280214 - RNA, 22 nt, Human
uuuuaaauaaaguguuucugua

SEQ ID NO: 280215 - RNA, 32 nt, Human
uuuuaaauaauucaguuaaacacugcugcaau

SEQ ID NO: 280216 - RNA, 32 nt, Human
uuuuaaauacuuagaacuuagcacuuguguua

SEQ ID NO: 280217 - RNA, 22 nt, Human
uuuuaaaucaaccuuauuugga

SEQ ID NO: 280218 - RNA, 32 nt, Human
uuuuaaauccugagaaaugugugcuuuuguuu

SEQ ID NO: 280219 - RNA, 32 nt, Human
uuuuaaauccugcuuaugaauuuuagcuuuuu

SEQ ID NO: 280220 - RNA, 32 nt, Human
uuuuaaaucuccaacuugcuguuuccaaaaag

SEQ ID NO: 280221 - RNA, 32 nt, Human
uuuuaaaucuggcagagccucagcuguacgaa

SEQ ID NO: 280222 - RNA, 32 nt, Human
uuuuaaaugaaaacuaauacuauucaugaugu

SEQ ID NO: 280223 - RNA, 32 nt, Human
uuuuaaaugagcaaugcaugaggggaaugcag

SEQ ID NO: 280224 - RNA, 32 nt, Human
uuuuaaaugcauaauaucaaagagaaucauag

SEQ ID NO: 280225 - RNA, 32 nt, Human
uuuuaaaugcuugacccucuugcuuggaguuc

SEQ ID NO: 280226 - RNA, 32 nt, Human
uuuuaaauggcuaaacuacuagccuuaaaacu

SEQ ID NO: 280227 - RNA, 22 nt, Human
uuuuaaauggucuguaucugga

SEQ ID NO: 280228 - RNA, 32 nt, Human
uuuuaaauguguuuuguugagcuuauacuguu

SEQ ID NO: 280229 - RNA, 32 nt, Human
uuuuaaauguuuucacucagaugaacaauuug

SEQ ID NO: 280230 - RNA, 32 nt, Human
uuuuaaauuaacauacacauuuuucucuuuaa

SEQ ID NO: 280231 - RNA, 32 nt, Human
uuuuaaauuagcugggugugguggcaccuggg

SEQ ID NO: 280232 - RNA, 32 nt, Human
uuuuaaauuauaacuuaaaauauuuuauaauu

SEQ ID NO: 280233 - RNA, 32 nt, Human
uuuuaaauuaugcaagcaaacuaggaggagaa

SEQ ID NO: 280234 - RNA, 32 nt, Human
uuuuaaauuauuuucuuuaucuuguuacaaaa

SEQ ID NO: 280235 - RNA, 32 nt, Human
uuuuaaauucauaacauaaugacuucauuguu

SEQ ID NO: 280236 - RNA, 32 nt, Human
uuuuaaauugaauguuccuuaaagguuaacau

SEQ ID NO: 280237 - RNA, 23 nt, Human
uuuuaaauuggagaaaucucugc

SEQ ID NO: 280238 - RNA, 21 nt, Human
uuuuaaauuggugaccuaggg

SEQ ID NO: 280239 - RNA, 23 nt, Human
uuuuaaauuguuuguaacuugga

SEQ ID NO: 280240 - RNA, 24 nt, Human
uuuuaaauuuaacaucuggcugga

SEQ ID NO: 280241 - RNA, 22 nt, Human
uuuuaaauuuccuuaaauugga

SEQ ID NO: 280242 - RNA, 32 nt, Human
uuuuaaauuuuaaugaaaucuaauucaucaaa

SEQ ID NO: 280243 - RNA, 32 nt, Human
uuuuaaauuuucauuguacaguuuacaaauau

SEQ ID NO: 280244 - RNA, 32 nt, Human
uuuuaacaaaaguuacauuccucuccacaaug

SEQ ID NO: 280245 - RNA, 32 nt, Human
uuuuaacaaucaguuugagcugcugcuguuau

SEQ ID NO: 280246 - RNA, 32 nt, Human
uuuuaacaccccugcaaaacccccacccuccc

SEQ ID NO: 280247 - RNA, 32 nt, Human
uuuuaacacgugaagaacaugagaucggaaga

SEQ ID NO: 280248 - RNA, 32 nt, Human
uuuuaacagagaagaaagugacaggaaugugc

SEQ ID NO: 280249 - RNA, 32 nt, Human
uuuuaacagauagugggcaaagaaaaauucca

SEQ ID NO: 280250 - RNA, 32 nt, Human
uuuuaacaguuccucuacuuggcucuccucca

SEQ ID NO: 280251 - RNA, 32 nt, Human
uuuuaacauaaauaaacaaaucguaucagugu

SEQ ID NO: 280252 - RNA, 32 nt, Human
uuuuaacauaguuucacauguucucagaacug

SEQ ID NO: 280253 - RNA, 32 nt, Human
uuuuaacauuauagcaaauuugugucuggggg

SEQ ID NO: 280254 - RNA, 32 nt, Human
uuuuaaccaaccaccaccaccaccaaaaccag

SEQ ID NO: 280255 - RNA, 32 nt, Human
uuuuaaccaucuuuuccuugcugucucccuuc

SEQ ID NO: 280256 - RNA, 32 nt, Human
uuuuaacccaaaaggcggagguugcagugagc

SEQ ID NO: 280257 - RNA, 32 nt, Human
uuuuaaccccuaugaaaauuugacuuaaacua

SEQ ID NO: 280258 - RNA, 32 nt, Human
uuuuaacgauuuuauccucucuccuuaaaugu

SEQ ID NO: 280259 - RNA, 32 nt, Human
uuuuaacuaggaccaggugcagcaugcuaguc

SEQ ID NO: 280260 - RNA, 32 nt, Human
uuuuaacucaugcacaugugcucuuuguacag

SEQ ID NO: 280261 - RNA, 32 nt, Human
uuuuaacuccacugcuuaccuacuuucuucag

SEQ ID NO: 280262 - RNA, 32 nt, Human
uuuuaacuccugccuccacacauguucuugac

SEQ ID NO: 280263 - RNA, 32 nt, Human
uuuuaacugcacucauagggugcucugagguc

SEQ ID NO: 280264 - RNA, 22 nt, Human
uuuuaacugcacuuucuuuaua

SEQ ID NO: 280265 - RNA, 25 nt, Human
uuuuaacugcugcaaacauuguaca

SEQ ID NO: 280266 - RNA, 21 nt, Human
uuuuaacugcugcuaucugca

SEQ ID NO: 280267 - RNA, 21 nt, Human
uuuuaacugcuguuuccuaca

SEQ ID NO: 280268 - RNA, 32 nt, Human
uuuuaacuggcaugucauuugcacacaaaaau

SEQ ID NO: 280269 - RNA, 32 nt, Human
uuuuaacugucaccugucuguguguguucaag

SEQ ID NO: 280270 - RNA, 32 nt, Human
uuuuaacuguuuuggggagggagggagugaua

SEQ ID NO: 280271 - RNA, 32 nt, Human
uuuuaacuucuauuccauuuuaauuguaggau

SEQ ID NO: 280272 - RNA, 32 nt, Human
uuuuaacuuuucuguagagguggagucuugcu

SEQ ID NO: 280273 - RNA, 32 nt, Human
uuuuaacuuuuucuaagcuguuucuugauggg

SEQ ID NO: 280274 - RNA, 32 nt, Human
uuuuaacuuuuugugacaugcuaacacauuuu

SEQ ID NO: 280275 - RNA, 32 nt, Human
uuuuaagaaaguaauuuaauuuguaaaacuuc

SEQ ID NO: 280276 - RNA, 32 nt, Human
uuuuaagaaauaaccucuuacaguuguaacca

SEQ ID NO: 280277 - RNA, 32 nt, Human
uuuuaagaaauccuacaccaacaguucuucuc

SEQ ID NO: 280278 - RNA, 32 nt, Human
uuuuaagaacaacagcccuucaggcggcgaaa

SEQ ID NO: 280279 - RNA, 31 nt, Human
uuuuaagaacaaugcaaauguacuuauugau

SEQ ID NO: 280280 - RNA, 32 nt, Human
uuuuaagacaagaguuucucucuguugcccag

SEQ ID NO: 280281 - RNA, 32 nt, Human
uuuuaagaccagccugaccaacauggugaaac

SEQ ID NO: 280282 - RNA, 23 nt, Human
uuuuaagacggagucucacucug

SEQ ID NO: 280283 - RNA, 23 nt, Human
uuuuaagacugaggcugcucugc

SEQ ID NO: 280284 - RNA, 32 nt, Human
uuuuaagagacagaguuucgcuuguugcccag

SEQ ID NO: 280285 - RNA, 32 nt, Human
uuuuaagagacagggucuugcucugucaccca

SEQ ID NO: 280286 - RNA, 32 nt, Human
uuuuaagagacagggucuugcucuguugucca

SEQ ID NO: 280287 - RNA, 32 nt, Human
uuuuaagagacaggucucccuacguagcccaa

SEQ ID NO: 280288 - RNA, 32 nt, Human
uuuuaagagcuucuuucgaaaguuucuuguuc

SEQ ID NO: 280289 - RNA, 32 nt, Human
uuuuaagaggcagggucucacucugugccccc

SEQ ID NO: 280290 - RNA, 32 nt, Human
uuuuaagaguuucaguuaccauuguaugcaag

SEQ ID NO: 280291 - RNA, 32 nt, Human
uuuuaagaguuucuuuaagaaacuucaucaga

SEQ ID NO: 280292 - RNA, 32 nt, Human
uuuuaagaugcugauugggagccgcuuguggc

SEQ ID NO: 280293 - RNA, 32 nt, Human
uuuuaagauggaacuccacucuuugcuugguu

SEQ ID NO: 280294 - RNA, 32 nt, Human
uuuuaagauggaaucuugcucugucgcccacg

SEQ ID NO: 280295 - RNA, 32 nt, Human
uuuuaagcaaguaaguguccuccaucaguucu

SEQ ID NO: 280296 - RNA, 32 nt, Human
uuuuaagcaaucguguugaauuaggaguauac

SEQ ID NO: 280297 - RNA, 24 nt, Human
uuuuaagcacauccugugacugga

SEQ ID NO: 280298 - RNA, 32 nt, Human
uuuuaagcagaaccaugaaaaccucugugaca

SEQ ID NO: 280299 - RNA, 20 nt, Human
uuuuaagcagacagacucug

SEQ ID NO: 280300 - RNA, 32 nt, Human
uuuuaagcagaggccucggcuccgcaacugcc

SEQ ID NO: 280301 - RNA, 32 nt, Human
uuuuaagcagugaguuauggugguggucucau

SEQ ID NO: 280302 - RNA, 32 nt, Human
uuuuaagcaguuuacauuuauuaucucauuua

SEQ ID NO: 280303 - RNA, 32 nt, Human
uuuuaagcauccugacaggaaauguuuucuuc

SEQ ID NO: 280304 - RNA, 32 nt, Human
uuuuaagcauuggaaauagcaaaaagacauuu

SEQ ID NO: 280305 - RNA, 22 nt, Human
uuuuaagccugaaauugucugc

SEQ ID NO: 280306 - RNA, 25 nt, Human
uuuuaagcuaaagccugaauuuggg

SEQ ID NO: 280307 - RNA, 32 nt, Human
uuuuaagcuacaccuuucugcaccugauguaa

SEQ ID NO: 280308 - RNA, 32 nt, Human
uuuuaagcuacccugaauuuccagaaugcagg

SEQ ID NO: 280309 - RNA, 19 nt, Human
uuuuaagcuuaaagaacuc

SEQ ID NO: 280310 - RNA, 32 nt, Human
uuuuaaggaauacaaauuuucuccuucaucac

SEQ ID NO: 280311 - RNA, 32 nt, Human
uuuuaaggacccaggagguggggcagaagaga

SEQ ID NO: 280312 - RNA, 22 nt, Human
uuuuaaggagaaagaacucuau

SEQ ID NO: 280313 - RNA, 32 nt, Human
uuuuaaggagacagaauccaacagggcuggga

SEQ ID NO: 280314 - RNA, 32 nt, Human
uuuuaaggauaccacuucacagccuuuaggau

SEQ ID NO: 280315 - RNA, 32 nt, Human
uuuuaaggcuuagaggaacuugaguuaggauc

SEQ ID NO: 280316 - RNA, 32 nt, Human
uuuuaagggaaacacucugcuccuggguguga

SEQ ID NO: 280317 - RNA, 32 nt, Human
uuuuaagggaaagaaauguuucaggagggaua

SEQ ID NO: 280318 - RNA, 32 nt, Human
uuuuaagggagauguaguaaaagggaaaaugu

SEQ ID NO: 280319 - RNA, 32 nt, Human
uuuuaagggcccuuuuucaauaacuggaacac

SEQ ID NO: 280320 - RNA, 32 nt, Human
uuuuaaggguauaugcaaaaacaggcaccauu

SEQ ID NO: 280321 - RNA, 32 nt, Human
uuuuaagguagaaauauguucccuauuguuug

SEQ ID NO: 280322 - RNA, 32 nt, Human
uuuuaagguuggcuucagaggugcaaguauau

SEQ ID NO: 280323 - RNA, 23 nt, Human
uuuuaaguaaaaccauucucagu

SEQ ID NO: 280324 - RNA, 32 nt, Human
uuuuaaguaaagcuuuuuauauguagauauuu

SEQ ID NO: 280325 - RNA, 32 nt, Human
uuuuaaguaacauugaacauuuuaucauuaau

SEQ ID NO: 280326 - RNA, 32 nt, Human
uuuuaaguacauugauguugauguuccaccag

SEQ ID NO: 280327 - RNA, 20 nt, Human
uuuuaaguaccuucuacagu

SEQ ID NO: 280328 - RNA, 32 nt, Human
uuuuaaguagagauggaguuucacucuguuuc

SEQ ID NO: 280329 - RNA, 25 nt, Human
uuuuaaguaugugaagaaaaucuac

SEQ ID NO: 280330 - RNA, 32 nt, Human
uuuuaagucaucugggggaaaaccuguuuauc

SEQ ID NO: 280331 - RNA, 32 nt, Human
uuuuaaguccuuucguauaagaauuaaugaga

SEQ ID NO: 280332 - RNA, 25 nt, Human
uuuuaagucuaugaaaaugcuuuau

SEQ ID NO: 280333 - RNA, 21 nt, Human
uuuuaagucuccaauccuggg

SEQ ID NO: 280334 - RNA, 32 nt, Human
uuuuaagugaaaagcagagaauuuuauuuaua

SEQ ID NO: 280335 - RNA, 32 nt, Human
uuuuaagugcccagugaacacaguuccauuua

SEQ ID NO: 280336 - RNA, 32 nt, Human
uuuuaaguggucauugaugacaucccacuccu

SEQ ID NO: 280337 - RNA, 32 nt, Human
uuuuaagugugacugaugacgaagggaacagg

SEQ ID NO: 280338 - RNA, 32 nt, Human
uuuuaaguuaacacccuccuuuacccccagca

SEQ ID NO: 280339 - RNA, 32 nt, Human
uuuuaaguucuuuuauucuccuuucccugaga

SEQ ID NO: 280340 - RNA, 22 nt, Human
uuuuaaguuuccuacaccugga

SEQ ID NO: 280341 - RNA, 32 nt, Human
uuuuaaguuuccuuccagcccagaaagucucu

SEQ ID NO: 280342 - RNA, 23 nt, Human
uuuuaaguuuggaaaugccucua

SEQ ID NO: 280343 - RNA, 32 nt, Human
uuuuaauaaccagcucucacugaacuaauaga

SEQ ID NO: 280344 - RNA, 32 nt, Human
uuuuaauacaauauuuuauuuuaauauaaaca

SEQ ID NO: 280345 - RNA, 32 nt, Human
uuuuaauacaccacuucuuucuuucugccuuu

SEQ ID NO: 280346 - RNA, 32 nt, Human
uuuuaauacaugugacuucuagugagacacau

SEQ ID NO: 280347 - RNA, 32 nt, Human
uuuuaauagaguuaauuguaauaaaagaugaa

SEQ ID NO: 280348 - RNA, 32 nt, Human
uuuuaauaggagauauuugagaggcauugagg

SEQ ID NO: 280349 - RNA, 32 nt, Human
uuuuaauaguacaucuagugguucuuuccaaa

SEQ ID NO: 280350 - RNA, 32 nt, Human
uuuuaauauccuaccagcugcucuucagacac

SEQ ID NO: 280351 - RNA, 22 nt, Human
uuuuaauauccuugagccuggg

SEQ ID NO: 280352 - RNA, 32 nt, Human
uuuuaauauuaaaauacaguugauuagcaaca

SEQ ID NO: 280353 - RNA, 32 nt, Human
uuuuaauauuuuuaguagagaugggguuucac

SEQ ID NO: 280354 - RNA, 31 nt, Human
uuuuaaucaauaaaguaugucuguugaagca

SEQ ID NO: 280355 - RNA, 32 nt, Human
uuuuaaucacaguaggucugauagagaauugg

SEQ ID NO: 280356 - RNA, 32 nt, Human
uuuuaaucaguaaacccagcaaauaucaugau

SEQ ID NO: 280357 - RNA, 32 nt, Human
uuuuaaucauuuauuagaaauuucucaauauu

SEQ ID NO: 280358 - RNA, 32 nt, Human
uuuuaauccacaguauguuacaugcauucuac

SEQ ID NO: 280359 - RNA, 32 nt, Human
uuuuaauccgaucucacaaagcagcagaaugg

SEQ ID NO: 280360 - RNA, 32 nt, Human
uuuuaauccuuggagacagggaaagggacaga

SEQ ID NO: 280361 - RNA, 32 nt, Human
uuuuaaucuaagguugggugugguggcuuaca

SEQ ID NO: 280362 - RNA, 32 nt, Human
uuuuaaucucagaagaaacauaugugacaugg

SEQ ID NO: 280363 - RNA, 32 nt, Human
uuuuaaucuccaacgucccaaauagcuaucug

SEQ ID NO: 280364 - RNA, 32 nt, Human
uuuuaaucuccaccagucauuuuucagaccuu

SEQ ID NO: 280365 - RNA, 32 nt, Human
uuuuaaucugcugccauauuguagcucaauac

SEQ ID NO: 280366 - RNA, 32 nt, Human
uuuuaaugaacaaacagaaauuauggccccaa

SEQ ID NO: 280367 - RNA, 32 nt, Human
uuuuaaugacuggacagcgcucggugaaggcu

SEQ ID NO: 280368 - RNA, 32 nt, Human
uuuuaaugagacagagucucucucugucaccu

SEQ ID NO: 280369 - RNA, 32 nt, Human
uuuuaaugagauacuuugcuuccucauucaac

SEQ ID NO: 280370 - RNA, 32 nt, Human
uuuuaaugagcugguaaacacaaaucauguca

SEQ ID NO: 280371 - RNA, 32 nt, Human
uuuuaaugcuguagugacuuugcucacuuaca

SEQ ID NO: 280372 - RNA, 32 nt, Human
uuuuaaugcuguguguucuguuaaguucuuuc

SEQ ID NO: 280373 - RNA, 32 nt, Human
uuuuaaugcuuuaaucucauguaguuuguuuu

SEQ ID NO: 280374 - RNA, 32 nt, Human
uuuuaauggaaagagcauguuagagcaaacaa

SEQ ID NO: 280375 - RNA, 32 nt, Human
uuuuaaugggauuucaugggguuugguugugc

SEQ ID NO: 280376 - RNA, 32 nt, Human
uuuuaauggugacuuguccuggcuuacuggga

SEQ ID NO: 280377 - RNA, 32 nt, Human
uuuuaauguagccauuugggguuaucucuagu

SEQ ID NO: 280378 - RNA, 32 nt, Human
uuuuaauguguuuuuacccuugccucacugug

SEQ ID NO: 280379 - RNA, 22 nt, Human
uuuuaauguucacauuuuuaca

SEQ ID NO: 280380 - RNA, 32 nt, Human
uuuuaauguuguagcugagcacuuuaacaagu

SEQ ID NO: 280381 - RNA, 32 nt, Human
uuuuaauguuuuugguacacugggcagacuuc

SEQ ID NO: 280382 - RNA, 32 nt, Human
uuuuaauucaaaggaaaaguuuuaugugauuu

SEQ ID NO: 280383 - RNA, 31 nt, Human
uuuuaauuuaauaaauaaaaguuggauuuga

SEQ ID NO: 280384 - RNA, 32 nt, Human
uuuuaauuucucaugugagauaccagaaugga

SEQ ID NO: 280385 - RNA, 32 nt, Human
uuuuaauuugauuuuagaaucuggacacuuuc

SEQ ID NO: 280386 - RNA, 32 nt, Human
uuuuaauuuucacaauugaugacagggugagu

SEQ ID NO: 280387 - RNA, 32 nt, Human
uuuuaauuuuugaaagaugaacugcuuccuuu

SEQ ID NO: 280388 - RNA, 32 nt, Human
uuuuacaaacacaacaaaauguaguaacuuuu

SEQ ID NO: 280389 - RNA, 32 nt, Human
uuuuacaaacuccaagcaaaucugacccaaac

SEQ ID NO: 280390 - RNA, 32 nt, Human
uuuuacaaagagaauugcacuagauaaauuaa

SEQ ID NO: 280391 - RNA, 32 nt, Human
uuuuacaaucaccucacuccagcauggugucu

SEQ ID NO: 280392 - RNA, 32 nt, Human
uuuuacaaugcacuucaccaaugaaacagcua

SEQ ID NO: 280393 - RNA, 32 nt, Human
uuuuacaauggccauggaauaaaccauuuuua

SEQ ID NO: 280394 - RNA, 32 nt, Human
uuuuacacaacaucauuguguaauuuguaaag

SEQ ID NO: 280395 - RNA, 32 nt, Human
uuuuacacaccacugcauuaacuagaacugcu

SEQ ID NO: 280396 - RNA, 32 nt, Human
uuuuacacaguguagaguggccagcagugaac

SEQ ID NO: 280397 - RNA, 32 nt, Human
uuuuacaccaaggaagcagagcaguguuaacu

SEQ ID NO: 280398 - RNA, 32 nt, Human
uuuuacagaaacucacaaauggagauugcaaa

SEQ ID NO: 280399 - RNA, 32 nt, Human
uuuuacagaugaggagacugaggcucagaggg

SEQ ID NO: 280400 - RNA, 32 nt, Human
uuuuacagccuccugggugggucgucuugacc

SEQ ID NO: 280401 - RNA, 32 nt, Human
uuuuacagcuacaagaacuuucuugaaaaucu

SEQ ID NO: 280402 - RNA, 32 nt, Human
uuuuacaggggauuaugaucaaaagugauuuu

SEQ ID NO: 280403 - RNA, 32 nt, Human
uuuuacaguaacaugaauaaagccaaaccugc

SEQ ID NO: 280404 - RNA, 32 nt, Human
uuuuacaguauuccucacaaagggcuucaggu

SEQ ID NO: 280405 - RNA, 32 nt, Human
uuuuacagugagcuuucccauguuuuuauguc

SEQ ID NO: 280406 - RNA, 32 nt, Human
uuuuacauacaaaaauacuugggguuguuuau

SEQ ID NO: 280407 - RNA, 32 nt, Human
uuuuacauacaaauacccucaagaauaauaaa

SEQ ID NO: 280408 - RNA, 32 nt, Human
uuuuacauagcuaugaucguuguguacauucu

SEQ ID NO: 280409 - RNA, 32 nt, Human
uuuuacauaugaaagaguggauuuucagagac

SEQ ID NO: 280410 - RNA, 32 nt, Human
uuuuacaucuaguuaggagaagaaaaguaagu

SEQ ID NO: 280411 - RNA, 32 nt, Human
uuuuacaugaacuugcaaucauggacagcaac

SEQ ID NO: 280412 - RNA, 32 nt, Human
uuuuaccaaaaauauccagagguuacuggagu

SEQ ID NO: 280413 - RNA, 32 nt, Human
uuuuaccaccuauccugaucuuugaagguagg

SEQ ID NO: 280414 - RNA, 32 nt, Human
uuuuaccacugcacuccagcuugggcgacgga

SEQ ID NO: 280415 - RNA, 32 nt, Human
uuuuaccagucauuguuauauuacaaacagac

SEQ ID NO: 280416 - RNA, 32 nt, Human
uuuuaccauguuggccagagugguuuugaacu

SEQ ID NO: 280417 - RNA, 32 nt, Human
uuuuaccauguuggccaggcuggucuugaacu

SEQ ID NO: 280418 - RNA, 32 nt, Human
uuuuacccaccaccccucuaccucuucagagc

SEQ ID NO: 280419 - RNA, 32 nt, Human
uuuuacccagcaccuccggacacucaccuuca

SEQ ID NO: 280420 - RNA, 32 nt, Human
uuuuacccagcaccuguccagugaaacaacuu

SEQ ID NO: 280421 - RNA, 32 nt, Human
uuuuacccaggccagugcagagagguguuacc

SEQ ID NO: 280422 - RNA, 32 nt, Human
uuuuacccauuauuccuacucccuucauccug

SEQ ID NO: 280423 - RNA, 32 nt, Human
uuuuaccccaaaacucagacaggacuuucuau

SEQ ID NO: 280424 - RNA, 32 nt, Human
uuuuaccccgaaacaggaaggaacaggggucc

SEQ ID NO: 280425 - RNA, 32 nt, Human
uuuuaccccuacucucuacuuuuucacccaaa

SEQ ID NO: 280426 - RNA, 32 nt, Human
uuuuaccccuuucccugcaaccuccuugacuc

SEQ ID NO: 280427 - RNA, 20 nt, Human
uuuuacccuccccucguucc

SEQ ID NO: 280428 - RNA, 18 nt, Human
uuuuacccuggguugcug

SEQ ID NO: 280429 - RNA, 32 nt, Human
uuuuacccuguugccauguaugauuauuccuu

SEQ ID NO: 280430 - RNA, 32 nt, Human
uuuuacccuuuaaguagcuccucuucccucgc

SEQ ID NO: 280431 - RNA, 32 nt, Human
uuuuacccuuuagacuguagccuggauauuau

SEQ ID NO: 280432 - RNA, 32 nt, Human
uuuuaccgcccaggcuggagugcagugccaug

SEQ ID NO: 280433 - RNA, 32 nt, Human
uuuuaccucacacccaaagcauuuugccuacc

SEQ ID NO: 280434 - RNA, 21 nt, Human
uuuuaccuccucucccagaca

SEQ ID NO: 280435 - RNA, 32 nt, Human
uuuuaccugcucauuaugauuccuccuuuuag

SEQ ID NO: 280436 - RNA, 32 nt, Human
uuuuaccuggugucuguguauugccuguguuu

SEQ ID NO: 280437 - RNA, 32 nt, Human
uuuuaccuguuguucacaacuaguuuucuuau

SEQ ID NO: 280438 - RNA, 32 nt, Human
uuuuaccuuccagugcaaauccugcuccuuug

SEQ ID NO: 280439 - RNA, 32 nt, Human
uuuuaccuucccuuuuucauccugucuucaaa

SEQ ID NO: 280440 - RNA, 32 nt, Human
uuuuaccuuccugguuggcuguguucuuaggg

SEQ ID NO: 280441 - RNA, 32 nt, Human
uuuuaccuugacuuaccuucugucaccauauc

SEQ ID NO: 280442 - RNA, 32 nt, Human
uuuuaccuuguccuuguuaagaauuucuugaa

SEQ ID NO: 280443 - RNA, 32 nt, Human
uuuuacgacaacuacuuugaccugccaggagc

SEQ ID NO: 280444 - RNA, 32 nt, Human
uuuuacgucuuuggaggaacagcucccuagug

SEQ ID NO: 280445 - RNA, 32 nt, Human
uuuuacuagacaggguuucaccauguuggcua

SEQ ID NO: 280446 - RNA, 32 nt, Human
uuuuacuauauaccuuuccuuggccaccaagu

SEQ ID NO: 280447 - RNA, 32 nt, Human
uuuuacuauccucaggcauccauuccaaucaa

SEQ ID NO: 280448 - RNA, 32 nt, Human
uuuuacucaaagcucuagccuuuaggauaggu

SEQ ID NO: 280449 - RNA, 32 nt, Human
uuuuacucacacccuucucuccuuucucgucc

SEQ ID NO: 280450 - RNA, 32 nt, Human
uuuuacucagcuuuauaacaaauguggcucca

SEQ ID NO: 280451 - RNA, 32 nt, Human
uuuuacucuccucuugcauugauucaguuauu

SEQ ID NO: 280452 - RNA, 32 nt, Human
uuuuacucuguccuguguccugacugaagcga

SEQ ID NO: 280453 - RNA, 32 nt, Human
uuuuacucuugccugugaaccucaugcaugaa

SEQ ID NO: 280454 - RNA, 32 nt, Human
uuuuacugaaguauaccaugcauucaaaaagu

SEQ ID NO: 280455 - RNA, 32 nt, Human
uuuuacugagugcuaaggaagcauaucaauuc

SEQ ID NO: 280456 - RNA, 32 nt, Human
uuuuacugaugcugggauuauaggugugagcc

SEQ ID NO: 280457 - RNA, 32 nt, Human
uuuuacugcaucuauugagaugaucaauguuu

SEQ ID NO: 280458 - RNA, 32 nt, Human
uuuuacugccuuugcuaggcuuuugcuuagca

SEQ ID NO: 280459 - RNA, 32 nt, Human
uuuuacuggauuucuuuuucuccugauuuucg

SEQ ID NO: 280460 - RNA, 32 nt, Human
uuuuacuggcuuugacuggagguuguuuuugc

SEQ ID NO: 280461 - RNA, 32 nt, Human
uuuuacuggggaggaggaagcggacagaggaa

SEQ ID NO: 280462 - RNA, 32 nt, Human
uuuuacuggggugagaggggcaugaagagaaa

SEQ ID NO: 280463 - RNA, 32 nt, Human
uuuuacuguuucaauaaccucugccuccccca

SEQ ID NO: 280464 - RNA, 32 nt, Human
uuuuacuuaauuaagaaauggaauuuauauac

SEQ ID NO: 280465 - RNA, 32 nt, Human
uuuuacuuagagaaaugcugccuccaaagcac

SEQ ID NO: 280466 - RNA, 32 nt, Human
uuuuacuuagguuacaguuaucagaaagccag

SEQ ID NO: 280467 - RNA, 32 nt, Human
uuuuacuucagaaauccaaacauuagagaauu

SEQ ID NO: 280468 - RNA, 32 nt, Human
uuuuacuuccaaugcuagcugugaccccugua

SEQ ID NO: 280469 - RNA, 32 nt, Human
uuuuacuucucccuugaguccccaugcuuugu

SEQ ID NO: 280470 - RNA, 32 nt, Human
uuuuacuucuguguccuaaggguaauuucuca

SEQ ID NO: 280471 - RNA, 25 nt, Human
uuuuacuucuuaccucugacuugga

SEQ ID NO: 280472 - RNA, 32 nt, Human
uuuuacuugacaggguuucaccauguuggcua

SEQ ID NO: 280473 - RNA, 32 nt, Human
uuuuacuuuaauggagugacugugaagugguu

SEQ ID NO: 280474 - RNA, 32 nt, Human
uuuuacuuuagggguuguaaagcuacuuuauu

SEQ ID NO: 280475 - RNA, 32 nt, Human
uuuuacuuuccuguaacugcuuuugcuuuuaa

SEQ ID NO: 280476 - RNA, 32 nt, Human
uuuuacuuugcuuuuaacauuuccuuggggug

SEQ ID NO: 280477 - RNA, 32 nt, Human
uuuuacuuuguaaauguggugccaaaucccug

SEQ ID NO: 280478 - RNA, 32 nt, Human
uuuuacuuuugaaacaggaaugauuucuccuu

SEQ ID NO: 280479 - RNA, 32 nt, Human
uuuuacuuuuucucuuucuuccucccuuucuc

SEQ ID NO: 280480 - RNA, 32 nt, Human
uuuuagaaaaggauuuacuauacuucacucuu

SEQ ID NO: 280481 - RNA, 32 nt, Human
uuuuagaaacccacuguuaaaauuuaaaaagg

SEQ ID NO: 280482 - RNA, 32 nt, Human
uuuuagaaacuaagagaaugauaggcuuuugu

SEQ ID NO: 280483 - RNA, 32 nt, Human
uuuuagaaagcauuugaaugcauuuuguuugg

SEQ ID NO: 280484 - RNA, 32 nt, Human
uuuuagaaagucuauaccauguucuuucguua

SEQ ID NO: 280485 - RNA, 23 nt, Human
uuuuagaaaguucuauuuuucca

SEQ ID NO: 280486 - RNA, 23 nt, Human
uuuuagaaauuccauuucuucua

SEQ ID NO: 280487 - RNA, 32 nt, Human
uuuuagaaccaaagaacaucugagaugauucu

SEQ ID NO: 280488 - RNA, 32 nt, Human
uuuuagaacuaaacacaucuguaaaacuaaau

SEQ ID NO: 280489 - RNA, 32 nt, Human
uuuuagaacuuaagacauuagauguguggcua

SEQ ID NO: 280490 - RNA, 32 nt, Human
uuuuagaaggaaaagaaagaggauuaaagaga

SEQ ID NO: 280491 - RNA, 32 nt, Human
uuuuagaauaaggaggaggagggagaagagaa

SEQ ID NO: 280492 - RNA, 32 nt, Human
uuuuagacagggucucacuguugcccaggcug

SEQ ID NO: 280493 - RNA, 32 nt, Human
uuuuagaccaaaauaugaaagacuuacaggcc

SEQ ID NO: 280494 - RNA, 32 nt, Human
uuuuagaccaaagauuggguucuagaaaaugc

SEQ ID NO: 280495 - RNA, 32 nt, Human
uuuuagaccagccuggacaacauagcaagacc

SEQ ID NO: 280496 - RNA, 32 nt, Human
uuuuagaccagccuggccaacaugacgaaacc

SEQ ID NO: 280497 - RNA, 32 nt, Human
uuuuagaccagccugggcaacacaguaagacc

SEQ ID NO: 280498 - RNA, 32 nt, Human
uuuuagacuggcuucuuucacuuagcaauaug

SEQ ID NO: 280499 - RNA, 32 nt, Human
uuuuagacuucucccuccuuuuuguccccauc

SEQ ID NO: 280500 - RNA, 32 nt, Human
uuuuagagaaaagaccuuuguagauucaacaa

SEQ ID NO: 280501 - RNA, 32 nt, Human
uuuuagagacgggguuucaccauguuggccag

SEQ ID NO: 280502 - RNA, 32 nt, Human
uuuuagagacgggguuucacucugucacccag

SEQ ID NO: 280503 - RNA, 32 nt, Human
uuuuagagagugacgacauggaaaaugaauuu

SEQ ID NO: 280504 - RNA, 32 nt, Human
uuuuagagaugaguucuugcucugucaccuag

SEQ ID NO: 280505 - RNA, 32 nt, Human
uuuuagagaugggaucucaccauguugcccag

SEQ ID NO: 280506 - RNA, 32 nt, Human
uuuuagagauggggaucucacuguguuggcca

SEQ ID NO: 280507 - RNA, 32 nt, Human
uuuuagagauggggucuggcuauguugcccag

SEQ ID NO: 280508 - RNA, 32 nt, Human
uuuuagagauggggucuugcuauauugcccag

SEQ ID NO: 280509 - RNA, 32 nt, Human
uuuuagagauggguucuucugguugauacaga

SEQ ID NO: 280510 - RNA, 23 nt, Human
uuuuagaggaaauguaacuugga

SEQ ID NO: 280511 - RNA, 32 nt, Human
uuuuagaggagagaggaggaggaggaggcuga

SEQ ID NO: 280512 - RNA, 32 nt, Human
uuuuagaggagauugugugagaaacaaaggca

SEQ ID NO: 280513 - RNA, 32 nt, Human
uuuuagagucuugcuucccaaaccagaaaaag

SEQ ID NO: 280514 - RNA, 31 nt, Human
uuuuagagugagagaaugaagggggugaggc

SEQ ID NO: 280515 - RNA, 32 nt, Human
uuuuagagugucauucuaaaccccagauucaa

SEQ ID NO: 280516 - RNA, 32 nt, Human
uuuuagaguuauguuuguaaauuaccuggcac

SEQ ID NO: 280517 - RNA, 32 nt, Human
uuuuagaucccagagaaaucaggugugauuag

SEQ ID NO: 280518 - RNA, 32 nt, Human
uuuuagauggaguuuugcaguggugcaaucau

SEQ ID NO: 280519 - RNA, 18 nt, Human
uuuuagauucucagaaua

SEQ ID NO: 280520 - RNA, 32 nt, Human
uuuuagauuucaaacaguauaggauaaaauug

SEQ ID NO: 280521 - RNA, 32 nt, Human
uuuuagcaagguaacaguugcccagggcagua

SEQ ID NO: 280522 - RNA, 32 nt, Human
uuuuagcacauccauaucuuuucuacguugaa

SEQ ID NO: 280523 - RNA, 32 nt, Human
uuuuagcacccagauggcauugcagugccagu

SEQ ID NO: 280524 - RNA, 32 nt, Human
uuuuagcaccuuguuucacuccugccuccaaa

SEQ ID NO: 280525 - RNA, 32 nt, Human
uuuuagcagacaggguuucaccauguuggcca

SEQ ID NO: 280526 - RNA, 32 nt, Human
uuuuagcagagagagaaagagaugaaauacac

SEQ ID NO: 280527 - RNA, 32 nt, Human
uuuuagcaugacgacuuuggaccaugugauug

SEQ ID NO: 280528 - RNA, 32 nt, Human
uuuuagcaugaugauggauggauggacuggag

SEQ ID NO: 280529 - RNA, 32 nt, Human
uuuuagccaaaaaccuaggguucauuuucagg

SEQ ID NO: 280530 - RNA, 31 nt, Human
uuuuagccaguguccaggcuaucagcagaga

SEQ ID NO: 280531 - RNA, 32 nt, Human
uuuuagccuuaaauuuuugucauuuuaaaauc

SEQ ID NO: 280532 - RNA, 32 nt, Human
uuuuagccuucucuguucauuuccucaaaaag

SEQ ID NO: 280533 - RNA, 32 nt, Human
uuuuagcgauggcuucugcucucaacagcaaa

SEQ ID NO: 280534 - RNA, 32 nt, Human
uuuuagcggggagggggauaggaagacgcaga

SEQ ID NO: 280535 - RNA, 32 nt, Human
uuuuagcgucacugcgaacacuccuuugcaaa

SEQ ID NO: 280536 - RNA, 32 nt, Human
uuuuagcuaggaggacggaaguugcuggcagg

SEQ ID NO: 280537 - RNA, 32 nt, Human
uuuuagcucacuacaaccuccacuuuccaggu

SEQ ID NO: 280538 - RNA, 32 nt, Human
uuuuagcucuauacucucuggcuccccucauc

SEQ ID NO: 280539 - RNA, 32 nt, Human
uuuuagcucugugccugucuccagucaggcug

SEQ ID NO: 280540 - RNA, 32 nt, Human
uuuuagcugggcacaugacugcccucaauaaa

SEQ ID NO: 280541 - RNA, 32 nt, Human
uuuuagcuggugguagaaggcugccuacacug

SEQ ID NO: 280542 - RNA, 32 nt, Human
uuuuagcugucuugugugcauccacagucugc

SEQ ID NO: 280543 - RNA, 31 nt, Human
uuuuagcuguuucagcaucaauccaacuuaa

SEQ ID NO: 280544 - RNA, 32 nt, Human
uuuuagcuucaagguuucggagucuaaacaaa

SEQ ID NO: 280545 - RNA, 32 nt, Human
uuuuagcuuggaaacagucuuccacuaaccuu

SEQ ID NO: 280546 - RNA, 32 nt, Human
uuuuagcuuuuacucucaacuugcuguucucu

SEQ ID NO: 280547 - RNA, 32 nt, Human
uuuuaggacaucuuuugauaccuuuaaaagaa

SEQ ID NO: 280548 - RNA, 24 nt, Human
uuuuaggaccugaagaaucuuuau

SEQ ID NO: 280549 - RNA, 32 nt, Human
uuuuaggaggcugaggugggaggaucgcuuaa

SEQ ID NO: 280550 - RNA, 32 nt, Human
uuuuaggauaagaggugagaacugggcaaaag

SEQ ID NO: 280551 - RNA, 32 nt, Human
uuuuaggauccagcaaaguucagggacucugg

SEQ ID NO: 280552 - RNA, 32 nt, Human
uuuuaggcacccauagggauguuuuuaggaug

SEQ ID NO: 280553 - RNA, 32 nt, Human
uuuuaggcacugacuccgaacaggauucuuuc

SEQ ID NO: 280554 - RNA, 32 nt, Human
uuuuaggccaauuucuaaaaagacugaggccu

SEQ ID NO: 280555 - RNA, 27 nt, Human
uuuuaggccacaauggaacaacuuuac

SEQ ID NO: 280556 - RNA, 22 nt, Human
uuuuaggccaggaaucuucugc

SEQ ID NO: 280557 - RNA, 26 nt, Human
uuuuaggcuuagagacagaaacuuua

SEQ ID NO: 280558 - RNA, 32 nt, Human
uuuuagggaccuaggugcaagugcaaaggaaa

SEQ ID NO: 280559 - RNA, 32 nt, Human
uuuuagggacucaggagaaucuugaaacuuac

SEQ ID NO: 280560 - RNA, 32 nt, Human
uuuuagggcaaguauagguugcacugauccug

SEQ ID NO: 280561 - RNA, 32 nt, Human
uuuuagggcagugggaaccucugccuccacuu

SEQ ID NO: 280562 - RNA, 32 nt, Human
uuuuagggccuggcccuagacccacugaauca

SEQ ID NO: 280563 - RNA, 32 nt, Human
uuuuaggggaaggagagagggaagggucaggg

SEQ ID NO: 280564 - RNA, 32 nt, Human
uuuuaggguuuuaggguuguaggguuucuuuu

SEQ ID NO: 280565 - RNA, 32 nt, Human
uuuuagguagcugggagaagaggggcuucugg

SEQ ID NO: 280566 - RNA, 23 nt, Human
uuuuaggucugacuaauuucuau

SEQ ID NO: 280567 - RNA, 32 nt, Human
uuuuaggucugucaguacugcacugcaagaau

SEQ ID NO: 280568 - RNA, 32 nt, Human
uuuuagguugacuagugguuguaguugaaaau

SEQ ID NO: 280569 - RNA, 32 nt, Human
uuuuagguuuucccaggacaggacagucccca

SEQ ID NO: 280570 - RNA, 32 nt, Human
uuuuaguaacauccuuguuuagugucuucuca

SEQ ID NO: 280571 - RNA, 32 nt, Human
uuuuaguaaucacuacuauaucaugucuuuua

SEQ ID NO: 280572 - RNA, 32 nt, Human
uuuuaguagaagagaaagaugcaggcccauag

SEQ ID NO: 280573 - RNA, 32 nt, Human
uuuuaguagagaaacccuaugucuauuaaaaa

SEQ ID NO: 280574 - RNA, 32 nt, Human
uuuuaguagagacaggguuggccaggcugguc

SEQ ID NO: 280575 - RNA, 32 nt, Human
uuuuaguagagagguuucaccauguuggccag

SEQ ID NO: 280576 - RNA, 32 nt, Human
uuuuaguagagauguuucaccauguuggccag

SEQ ID NO: 280577 - RNA, 32 nt, Human
uuuuaguagcuucucaggugauucagaugcuc

SEQ ID NO: 280578 - RNA, 32 nt, Human
uuuuaguauuaaaauacauguaaagaucagga

SEQ ID NO: 280579 - RNA, 32 nt, Human
uuuuagucaaccuaaauuuuuccuacuuucuu

SEQ ID NO: 280580 - RNA, 32 nt, Human
uuuuagucauuucuuugcugucccaaaaaucu

SEQ ID NO: 280581 - RNA, 32 nt, Human
uuuuaguccuucccgcccuccugccucucccu

SEQ ID NO: 280582 - RNA, 32 nt, Human
uuuuagugaaggucagcaguuuucuaacuugu

SEQ ID NO: 280583 - RNA, 32 nt, Human
uuuuagugacauuuuaaaagcagucagauucu

SEQ ID NO: 280584 - RNA, 32 nt, Human
uuuuagugccuaaaguccuauuguuucucugu

SEQ ID NO: 280585 - RNA, 32 nt, Human
uuuuaguggacaggguuucaccauguuggcca

SEQ ID NO: 280586 - RNA, 32 nt, Human
uuuuagugggcccugauggucauuuuucuaaa

SEQ ID NO: 280587 - RNA, 32 nt, Human
uuuuaguguaguucccaccucauucaugaaaa

SEQ ID NO: 280588 - RNA, 32 nt, Human
uuuuagugucauucugccugugcucagagcuc

SEQ ID NO: 280589 - RNA, 32 nt, Human
uuuuaguguccuauaauaacaaaaccagacau

SEQ ID NO: 280590 - RNA, 32 nt, Human
uuuuagugugccaaguagcagugcaaaaugau

SEQ ID NO: 280591 - RNA, 32 nt, Human
uuuuagugugggcucuuauugccaggugaugc

SEQ ID NO: 280592 - RNA, 32 nt, Human
uuuuaguucacugcaacuuccgcuucccaggu

SEQ ID NO: 280593 - RNA, 32 nt, Human
uuuuaguuccaacaaagaaaggugccaugucu

SEQ ID NO: 280594 - RNA, 32 nt, Human
uuuuaguucuuauuccggagccucaaacaagc

SEQ ID NO: 280595 - RNA, 32 nt, Human
uuuuaguugacucacaggcccuggagaagcag

SEQ ID NO: 280596 - RNA, 32 nt, Human
uuuuaguugggcagugcucccacccacccucc

SEQ ID NO: 280597 - RNA, 32 nt, Human
uuuuaguuugcaccugaaucaggggcugucag

SEQ ID NO: 280598 - RNA, 32 nt, Human
uuuuaguuuucucuuagaacauuguauuacag

SEQ ID NO: 280599 - RNA, 32 nt, Human
uuuuauaaaauuauuugaauauuguuuaaugu

SEQ ID NO: 280600 - RNA, 32 nt, Human
uuuuauaaacaacaucaaaauggcagaaccau

SEQ ID NO: 280601 - RNA, 32 nt, Human
uuuuauaaacccagugaacuccugcacuggca

SEQ ID NO: 280602 - RNA, 32 nt, Human
uuuuauaacauacauuuuucugcuaauucauu

SEQ ID NO: 280603 - RNA, 32 nt, Human
uuuuauaaccaccaucauuccuugucucuuca

SEQ ID NO: 280604 - RNA, 22 nt, Human
uuuuauaacugaaauacuuuac

SEQ ID NO: 280605 - RNA, 22 nt, Human
uuuuauaacuguacauuuuaca

SEQ ID NO: 280606 - RNA, 32 nt, Human
uuuuauaagggguuacucuuucaagaguaaca

SEQ ID NO: 280607 - RNA, 32 nt, Human
uuuuauaauacugaaaaguuuugcaaauacaa

SEQ ID NO: 280608 - RNA, 32 nt, Human
uuuuauaaucaauaguagguugggucuuuagc

SEQ ID NO: 280609 - RNA, 32 nt, Human
uuuuauaaucugauuuguuuuccucuuaacgu

SEQ ID NO: 280610 - RNA, 32 nt, Human
uuuuauaaugcagagugagaacuuucccuacc

SEQ ID NO: 280611 - RNA, 32 nt, Human
uuuuauaaugcagagugagaacuuucccuucc

SEQ ID NO: 280612 - RNA, 32 nt, Human
uuuuauaaugucccugcccagggaccuguuag

SEQ ID NO: 280613 - RNA, 32 nt, Human
uuuuauaauguucuuguauagcagcucgguac

SEQ ID NO: 280614 - RNA, 22 nt, Human
uuuuauaauucauacaugagaa

SEQ ID NO: 280615 - RNA, 32 nt, Human
uuuuauacagcuuuccucuuuuucaucagguu

SEQ ID NO: 280616 - RNA, 32 nt, Human
uuuuauacaggcaacugccuuguugaaaauca

SEQ ID NO: 280617 - RNA, 32 nt, Human
uuuuauaccuaucugagugaauuacagacaac

SEQ ID NO: 280618 - RNA, 32 nt, Human
uuuuauacucagaaaaggaaaaagaagcaaaa

SEQ ID NO: 280619 - RNA, 32 nt, Human
uuuuauagaaaaucauuucagucuccugaggu

SEQ ID NO: 280620 - RNA, 32 nt, Human
uuuuauagaaauccagaggagugaagaggacu

SEQ ID NO: 280621 - RNA, 32 nt, Human
uuuuauagagggcugaccaagcugaaacucua

SEQ ID NO: 280622 - RNA, 32 nt, Human
uuuuauagcaaaagaccaaauuagcuguagag

SEQ ID NO: 280623 - RNA, 32 nt, Human
uuuuauagcaacuauagcaacagccaugagag

SEQ ID NO: 280624 - RNA, 30 nt, Human
uuuuauagcuugcagauaaagauccaacaa

SEQ ID NO: 280625 - RNA, 32 nt, Human
uuuuauagcuuuugagcuaacauaacuuuugu

SEQ ID NO: 280626 - RNA, 32 nt, Human
uuuuauaggugaggaaacugagcccagugaag

SEQ ID NO: 280627 - RNA, 32 nt, Human
uuuuauaguuuugccuuucacauuugucuuua

SEQ ID NO: 280628 - RNA, 32 nt, Human
uuuuauauacaaaggggaccagugccacagaa

SEQ ID NO: 280629 - RNA, 31 nt, Human
uuuuauauaguucuaugacuguugaaacauc

SEQ ID NO: 280630 - RNA, 32 nt, Human
uuuuauaucacagcagcuccugugcugaccuu

SEQ ID NO: 280631 - RNA, 32 nt, Human
uuuuauaucuuagaauuuuauauuuauuuaaa

SEQ ID NO: 280632 - RNA, 32 nt, Human
uuuuauaugagacucaagaacaggccucauuc

SEQ ID NO: 280633 - RNA, 32 nt, Human
uuuuauauucuagaaauuuauuuuggaaguac

SEQ ID NO: 280634 - RNA, 32 nt, Human
uuuuauauucuuuagaaugugccuucugaccu

SEQ ID NO: 280635 - RNA, 32 nt, Human
uuuuaucacagaaccaguaaguggaacauaau

SEQ ID NO: 280636 - RNA, 32 nt, Human
uuuuaucacaguuagacagagaauggucucuu

SEQ ID NO: 280637 - RNA, 32 nt, Human
uuuuaucacaugcuggcacuaaaaggcagaag

SEQ ID NO: 280638 - RNA, 32 nt, Human
uuuuaucacuuugagaauaaaaaguuacuaau

SEQ ID NO: 280639 - RNA, 32 nt, Human
uuuuaucagaauugcagaacuguaguaacagu

SEQ ID NO: 280640 - RNA, 32 nt, Human
uuuuaucagaugauuuuuaaacaaaaagaaaa

SEQ ID NO: 280641 - RNA, 32 nt, Human
uuuuaucaggcagccagagccugggagguggu

SEQ ID NO: 280642 - RNA, 32 nt, Human
uuuuaucaucccaaaaugaaacccuguagcca

SEQ ID NO: 280643 - RNA, 32 nt, Human
uuuuaucaugcuguugcuggggaauaugacua

SEQ ID NO: 280644 - RNA, 32 nt, Human
uuuuaucauuagcucauguauuugaggaagag

SEQ ID NO: 280645 - RNA, 32 nt, Human
uuuuaucauuuauaauuucauuuuucacuauu

SEQ ID NO: 280646 - RNA, 32 nt, Human
uuuuauccauuuucaucuucuuuaucuuuaua

SEQ ID NO: 280647 - RNA, 32 nt, Human
uuuuauccauuuucaucuuuauauucuguaac

SEQ ID NO: 280648 - RNA, 32 nt, Human
uuuuauccauuuuccuucuagucuuugaauuu

SEQ ID NO: 280649 - RNA, 32 nt, Human
uuuuaucccaggaggcaggacaacacugagac

SEQ ID NO: 280650 - RNA, 32 nt, Human
uuuuauccccuucaugucacuucuucggcauu

SEQ ID NO: 280651 - RNA, 32 nt, Human
uuuuauccuugugcacugcaggccugguacuc

SEQ ID NO: 280652 - RNA, 32 nt, Human
uuuuaucuauuuucucuacggcuuaggcuaug

SEQ ID NO: 280653 - RNA, 32 nt, Human
uuuuaucuccccuucacaugcaucaaguuauu

SEQ ID NO: 280654 - RNA, 32 nt, Human
uuuuaucuccugccuuucauucuauacccugc

SEQ ID NO: 280655 - RNA, 32 nt, Human
uuuuaucucuguccugaaguugcaucaggauc

SEQ ID NO: 280656 - RNA, 32 nt, Human
uuuuaucugcaugaaguuguugugcuuacgcc

SEQ ID NO: 280657 - RNA, 32 nt, Human
uuuuaucugguguuuuuacuucugccugcguu

SEQ ID NO: 280658 - RNA, 32 nt, Human
uuuuaucugguucuucguucucugucacucuu

SEQ ID NO: 280659 - RNA, 32 nt, Human
uuuuaucugugcaaagaagucuuccccagugc

SEQ ID NO: 280660 - RNA, 32 nt, Human
uuuuaucugugggggagggagggagacgugaa

SEQ ID NO: 280661 - RNA, 32 nt, Human
uuuuaucuugcccaaagagcucccucucaagg

SEQ ID NO: 280662 - RNA, 32 nt, Human
uuuuaugaaauguuagccgaaagaagagagga

SEQ ID NO: 280663 - RNA, 20 nt, Human
uuuuaugaacuccacaggaa

SEQ ID NO: 280664 - RNA, 32 nt, Human
uuuuaugaaggccauggaauaaaaggguccaa

SEQ ID NO: 280665 - RNA, 32 nt, Human
uuuuaugaauaauaugcagagaugcauauuag

SEQ ID NO: 280666 - RNA, 23 nt, Human
uuuuaugaauucucuacauguuu

SEQ ID NO: 280667 - RNA, 23 nt, Human
uuuuaugaauucucugcauguuu

SEQ ID NO: 280668 - RNA, 32 nt, Human
uuuuaugaauuuagugcagcuguuauggcuca

SEQ ID NO: 280669 - RNA, 32 nt, Human
uuuuaugacuaugccuaauguaaagaaaaugu

SEQ ID NO: 280670 - RNA, 32 nt, Human
uuuuaugagacagggucuugcucuguccccca

SEQ ID NO: 280671 - RNA, 32 nt, Human
uuuuaugagccccaguuuucugggcuuaguuu

SEQ ID NO: 280672 - RNA, 29 nt, Human
uuuuaugauauaauaaaugucuuaguacc

SEQ ID NO: 280673 - RNA, 32 nt, Human
uuuuaugauugcagcccucagccugggcugcc

SEQ ID NO: 280674 - RNA, 32 nt, Human
uuuuaugcaguaggcauuacuacaguacaugg

SEQ ID NO: 280675 - RNA, 32 nt, Human
uuuuaugccaucugucucaaaucaaagaguca

SEQ ID NO: 280676 - RNA, 32 nt, Human
uuuuaugccuuaaaauagguuucugauuacau

SEQ ID NO: 280677 - RNA, 32 nt, Human
uuuuauggagaaggagguggaggcaggauggg

SEQ ID NO: 280678 - RNA, 32 nt, Human
uuuuauggaugagcaaacugaggcagagugcu

SEQ ID NO: 280679 - RNA, 32 nt, Human
uuuuauggcaccuauuucuuucuuggagugcc

SEQ ID NO: 280680 - RNA, 32 nt, Human
uuuuauggcaguucuggugaauguucaauggg

SEQ ID NO: 280681 - RNA, 32 nt, Human
uuuuauggccuaaauauuugacaucucuuugg

SEQ ID NO: 280682 - RNA, 32 nt, Human
uuuuauggccuauccucaggaggacugcuaag

SEQ ID NO: 280683 - RNA, 32 nt, Human
uuuuauggcugcauaguauuucaugguguaua

SEQ ID NO: 280684 - RNA, 29 nt, Human
uuuuaugggagagagacucuuugagagug

SEQ ID NO: 280685 - RNA, 32 nt, Human
uuuuaugguagggagaguaagucagcaucggu

SEQ ID NO: 280686 - RNA, 32 nt, Human
uuuuaugguuccuuuaaaugcccuagaauucc

SEQ ID NO: 280687 - RNA, 32 nt, Human
uuuuaugguuccuuuaaaugcucuggcuauuc

SEQ ID NO: 280688 - RNA, 20 nt, Human
uuuuaugguuucuaauaugu

SEQ ID NO: 280689 - RNA, 32 nt, Human
uuuuauguaagcuuuuucacuuaguauuuuau

SEQ ID NO: 280690 - RNA, 32 nt, Human
uuuuauguauguuuacacugucaaacaucugg

SEQ ID NO: 280691 - RNA, 32 nt, Human
uuuuauguauuauguguguauguaugggacag

SEQ ID NO: 280692 - RNA, 32 nt, Human
uuuuauguauugagcccuguguuaacauuuca

SEQ ID NO: 280693 - RNA, 32 nt, Human
uuuuauguauuuuuauaaugccagauuucuuu

SEQ ID NO: 280694 - RNA, 32 nt, Human
uuuuaugucaacugaacacuguaggguaccuu

SEQ ID NO: 280695 - RNA, 32 nt, Human
uuuuaugucauuguuccauuaccuugaauguu

SEQ ID NO: 280696 - RNA, 32 nt, Human
uuuuaugugugugguucuccaucauauuuaac

SEQ ID NO: 280697 - RNA, 32 nt, Human
uuuuauguguuaaaauaaacauuguuuuugag

SEQ ID NO: 280698 - RNA, 32 nt, Human
uuuuauguucacaccaccacauucccauucac

SEQ ID NO: 280699 - RNA, 32 nt, Human
uuuuauguugacugaaaguaccaggaagauac

SEQ ID NO: 280700 - RNA, 32 nt, Human
uuuuauguugcagauacauaguugcucuagag

SEQ ID NO: 280701 - RNA, 32 nt, Human
uuuuauguugucuuaaagauuuuguccaugaa

SEQ ID NO: 280702 - RNA, 32 nt, Human
uuuuauguuuaggcuuauuuuuaaauuaacau

SEQ ID NO: 280703 - RNA, 32 nt, Human
uuuuauuaaagaaaaggauguuacacugaauc

SEQ ID NO: 280704 - RNA, 32 nt, Human
uuuuauuaagccaccacuccuggccaacugua

SEQ ID NO: 280705 - RNA, 32 nt, Human
uuuuauuagggauuuucaaaaggggagggagu

SEQ ID NO: 280706 - RNA, 32 nt, Human
uuuuauuaggugagcauuauuuauaaacuuug

SEQ ID NO: 280707 - RNA, 32 nt, Human
uuuuauuauacuuccagggaaggaaagagcug

SEQ ID NO: 280708 - RNA, 32 nt, Human
uuuuauucaagccaccagaguaagaauuuggg

SEQ ID NO: 280709 - RNA, 32 nt, Human
uuuuauucacagagaaaguuggcuuugauguc

SEQ ID NO: 280710 - RNA, 32 nt, Human
uuuuauucagguacuuuaugugcuacuaugcu

SEQ ID NO: 280711 - RNA, 32 nt, Human
uuuuauucauucuaaaucuuauuaaccggaau

SEQ ID NO: 280712 - RNA, 32 nt, Human
uuuuauucauucuguuugcuuaauucagagua

SEQ ID NO: 280713 - RNA, 32 nt, Human
uuuuauucuccuccucccuccccgcccucacc

SEQ ID NO: 280714 - RNA, 32 nt, Human
uuuuauucuccucuuccuuuuacccuagucuc

SEQ ID NO: 280715 - RNA, 32 nt, Human
uuuuauucuccuucagagcaacaucagaauug

SEQ ID NO: 280716 - RNA, 32 nt, Human
uuuuauucucuauucuauccugguucugccuc

SEQ ID NO: 280717 - RNA, 32 nt, Human
uuuuauucugacuuccucugauuuuggcaugu

SEQ ID NO: 280718 - RNA, 32 nt, Human
uuuuauucugauucuccucauucccuagacug

SEQ ID NO: 280719 - RNA, 20 nt, Human
uuuuauucuguuauauagug

SEQ ID NO: 280720 - RNA, 32 nt, Human
uuuuauucuucugagugucuauguuaacuucc

SEQ ID NO: 280721 - RNA, 32 nt, Human
uuuuauucuuuuuguggcaguugugaauggga

SEQ ID NO: 280722 - RNA, 32 nt, Human
uuuuauugaagaagccacagaggcugaaauuc

SEQ ID NO: 280723 - RNA, 32 nt, Human
uuuuauugcccaggcagugcucugggcaggaa

SEQ ID NO: 280724 - RNA, 32 nt, Human
uuuuauugcccaggcuggaguguaguggcgca

SEQ ID NO: 280725 - RNA, 32 nt, Human
uuuuauugcuauuucuaaauuuccuuggcuug

SEQ ID NO: 280726 - RNA, 32 nt, Human
uuuuauuguacucuuguucugcccuuguuuuu

SEQ ID NO: 280727 - RNA, 32 nt, Human
uuuuauuguauaaauauaucaccauuuacaug

SEQ ID NO: 280728 - RNA, 32 nt, Human
uuuuauuguuuuuaauugacaauguuuauggg

SEQ ID NO: 280729 - RNA, 32 nt, Human
uuuuauuuaagcuaagaaugcauauguaaccc

SEQ ID NO: 280730 - RNA, 32 nt, Human
uuuuauuuauuagcugaaauguaagcaggcau

SEQ ID NO: 280731 - RNA, 32 nt, Human
uuuuauuucaagaaucagcaguuuuagaauuu

SEQ ID NO: 280732 - RNA, 32 nt, Human
uuuuauuucacucacacuccaguuuguaauaa

SEQ ID NO: 280733 - RNA, 32 nt, Human
uuuuauuuccuggacauccucuucugcuuagg

SEQ ID NO: 280734 - RNA, 32 nt, Human
uuuuauuucuaaggaaagaaugucuucauauu

SEQ ID NO: 280735 - RNA, 32 nt, Human
uuuuauuucuacugauuuuauuuuggauacua

SEQ ID NO: 280736 - RNA, 32 nt, Human
uuuuauuucuggucauagagagagaaggaccu

SEQ ID NO: 280737 - RNA, 32 nt, Human
uuuuauuugguaucauuuucucuucucacaaa

SEQ ID NO: 280738 - RNA, 32 nt, Human
uuuuauuuguuggccgggcaugguggcucacg

SEQ ID NO: 280739 - RNA, 32 nt, Human
uuuuauuuuaaauugaacuuuacccuugucca

SEQ ID NO: 280740 - RNA, 32 nt, Human
uuuuauuuucacccucuguaccccaugaccuu

SEQ ID NO: 280741 - RNA, 32 nt, Human
uuuuauuuucaguucuggcuguguucaacauc

SEQ ID NO: 280742 - RNA, 32 nt, Human
uuuuauuuugagacagagucucacucucucgc

SEQ ID NO: 280743 - RNA, 32 nt, Human
uuuuauuuugagacagagucucacucugucac

SEQ ID NO: 280744 - RNA, 32 nt, Human
uuuuauuuugagacagagucucgcucugucac

SEQ ID NO: 280745 - RNA, 32 nt, Human
uuuuauuuugagacagagucuuggucuguuac

SEQ ID NO: 280746 - RNA, 32 nt, Human
uuuuauuuugagacagagugucacucuguccc

SEQ ID NO: 280747 - RNA, 32 nt, Human
uuuuauuuugagacggagucucauucugucac

SEQ ID NO: 280748 - RNA, 32 nt, Human
uuuuauuuugagacggaguuuugcucugucgc

SEQ ID NO: 280749 - RNA, 32 nt, Human
uuuuauuuugcacggcgcccucccucuaaaua

SEQ ID NO: 280750 - RNA, 32 nt, Human
uuuuauuuuuaauagaugaugccucacuauau

SEQ ID NO: 280751 - RNA, 32 nt, Human
uuuuauuuuugagacagagacuugcuuugucg

SEQ ID NO: 280752 - RNA, 32 nt, Human
uuuucaaaaauuacacuacaaguuuauaagcc

SEQ ID NO: 280753 - RNA, 32 nt, Human
uuuucaaaaggauuuacuuuuuguaaaaagcu

SEQ ID NO: 280754 - RNA, 32 nt, Human
uuuucaaaagugaacaauccugugauaaguug

SEQ ID NO: 280755 - RNA, 32 nt, Human
uuuucaaaaugagagaaguaugagacaucacu

SEQ ID NO: 280756 - RNA, 32 nt, Human
uuuucaaacugaggcucauuagggaaggaacu

SEQ ID NO: 280757 - RNA, 32 nt, Human
uuuucaaagaagcagguucuggugacauuauu

SEQ ID NO: 280758 - RNA, 32 nt, Human
uuuucaaagaagccguuuugauuuucaaagaa

SEQ ID NO: 280759 - RNA, 32 nt, Human
uuuucaaagaauuacuuucuuccauguucaaa

SEQ ID NO: 280760 - RNA, 32 nt, Human
uuuucaaaugauuuuauauucaguugcuacuu

SEQ ID NO: 280761 - RNA, 32 nt, Human
uuuucaaauuuccagccaaaaccaaagauuuc

SEQ ID NO: 280762 - RNA, 32 nt, Human
uuuucaacaauauuuuuccucauagauuuuuc

SEQ ID NO: 280763 - RNA, 32 nt, Human
uuuucaacacaugucucauucuaaauugacgu

SEQ ID NO: 280764 - RNA, 32 nt, Human
uuuucaacauagcagaauuaauguagggagcu

SEQ ID NO: 280765 - RNA, 32 nt, Human
uuuucaacauaugcuuugcuggaacacuguga

SEQ ID NO: 280766 - RNA, 32 nt, Human
uuuucaacuggauaaacuggccuuagucccgc

SEQ ID NO: 280767 - RNA, 32 nt, Human
uuuucaacuuauacugacuuuaauaaaauugu

SEQ ID NO: 280768 - RNA, 32 nt, Human
uuuucaacuuuaaaauggaaaacagucauaua

SEQ ID NO: 280769 - RNA, 32 nt, Human
uuuucaagagguaccccagacaccggccaccc

SEQ ID NO: 280770 - RNA, 32 nt, Human
uuuucaagagucgagggguagagugggguuag

SEQ ID NO: 280771 - RNA, 32 nt, Human
uuuucaaggacacuugcuggguugugcauuaa

SEQ ID NO: 280772 - RNA, 32 nt, Human
uuuucaagguaucagggcaaacaauuuccaaa

SEQ ID NO: 280773 - RNA, 32 nt, Human
uuuucaauaagaauuguaaacauugaacugaa

SEQ ID NO: 280774 - RNA, 32 nt, Human
uuuucaauagccacuaaccuugccugguacag

SEQ ID NO: 280775 - RNA, 32 nt, Human
uuuucaauagccacuaaccuugcuugguacag

SEQ ID NO: 280776 - RNA, 32 nt, Human
uuuucaauauuuuaaaaggagaauuuaaauac

SEQ ID NO: 280777 - RNA, 32 nt, Human
uuuucaaugcuccccuuuccuucuguuuauuu

SEQ ID NO: 280778 - RNA, 32 nt, Human
uuuucaauguagcccaggagguuuuuaaaggc

SEQ ID NO: 280779 - RNA, 32 nt, Human
uuuucaauugacuggugaagaggcccuugugu

SEQ ID NO: 280780 - RNA, 32 nt, Human
uuuucaauuugcuaacaggugcauaaucccug

SEQ ID NO: 280781 - RNA, 32 nt, Human
uuuucacaauguauguagcugaucucauguuc

SEQ ID NO: 280782 - RNA, 31 nt, Human
uuuucacacaaucucuuuacagcagaaucca

SEQ ID NO: 280783 - RNA, 32 nt, Human
uuuucacacagcaaucgagaugagacgccaug

SEQ ID NO: 280784 - RNA, 32 nt, Human
uuuucacacccacuccagcccucugccccagu

SEQ ID NO: 280785 - RNA, 32 nt, Human
uuuucacaccuccaacagacucucauuaagau

SEQ ID NO: 280786 - RNA, 32 nt, Human
uuuucacaccucccucccacacccagccuacu

SEQ ID NO: 280787 - RNA, 32 nt, Human
uuuucacacugggcgaagggaggacuccugag

SEQ ID NO: 280788 - RNA, 32 nt, Human
uuuucacacuucagaagagaauccuaaggacu

SEQ ID NO: 280789 - RNA, 32 nt, Human
uuuucacagccuuuguccagccuguguuacaa

SEQ ID NO: 280790 - RNA, 31 nt, Human
uuuucacaguuucagcacucaaccucaucau

SEQ ID NO: 280791 - RNA, 31 nt, Human
uuuucacaguuucauugauugacucuaccuc

SEQ ID NO: 280792 - RNA, 32 nt, Human
uuuucacauacuuuccaaaagaccaacaaaug

SEQ ID NO: 280793 - RNA, 32 nt, Human
uuuucacaucuuaaaggcucacagacccugcg

SEQ ID NO: 280794 - RNA, 32 nt, Human
uuuucacaucuucauucacugggauucuggac

SEQ ID NO: 280795 - RNA, 32 nt, Human
uuuucacaucuuccacaaacuccauuuaggga

SEQ ID NO: 280796 - RNA, 32 nt, Human
uuuucacauggguuuuucuccaaguuaauaca

SEQ ID NO: 280797 - RNA, 32 nt, Human
uuuucacauucugagcaagcaggugugagcac

SEQ ID NO: 280798 - RNA, 32 nt, Human
uuuucacauuuuaauuccuccuccugagaugc

SEQ ID NO: 280799 - RNA, 28 nt, Human
uuuucaccaaaaugagccucaucccuuu

SEQ ID NO: 280800 - RNA, 32 nt, Human
uuuucaccaccuuuaccaauuuccuauuugau

SEQ ID NO: 280801 - RNA, 32 nt, Human
uuuucaccacugcguuuuagguggugaucuua

SEQ ID NO: 280802 - RNA, 32 nt, Human
uuuucaccacuuuguuaccaguucucaaauua

SEQ ID NO: 280803 - RNA, 32 nt, Human
uuuucaccaucuuucccucaaucuccaggagc

SEQ ID NO: 280804 - RNA, 32 nt, Human
uuuucacccagagagugaagaucauggaggag

SEQ ID NO: 280805 - RNA, 21 nt, Human
uuuucacccagcauaaugacu

SEQ ID NO: 280806 - RNA, 32 nt, Human
uuuucacccauucuguauaauuagacaaauuc

SEQ ID NO: 280807 - RNA, 32 nt, Human
uuuucaccccacccuuccccuccuucucccuu

SEQ ID NO: 280808 - RNA, 32 nt, Human
uuuucaccccagcagaaccccugcaugcaggu

SEQ ID NO: 280809 - RNA, 32 nt, Human
uuuucacccguuucucuuuuuccacucucucu

SEQ ID NO: 280810 - RNA, 22 nt, Human
uuuucacccuaguccagcagcu

SEQ ID NO: 280811 - RNA, 32 nt, Human
uuuucacccugccuuuccacaggaagcacuca

SEQ ID NO: 280812 - RNA, 32 nt, Human
uuuucacccugggucuguuaccuguuugcugu

SEQ ID NO: 280813 - RNA, 32 nt, Human
uuuucaccuaucuccuuccugucaaggcaggc

SEQ ID NO: 280814 - RNA, 32 nt, Human
uuuucaccugccagcccugccuccuccuuucu

SEQ ID NO: 280815 - RNA, 32 nt, Human
uuuucaccugcucuucuaccauuugaauuugu

SEQ ID NO: 280816 - RNA, 32 nt, Human
uuuucacggauggggaaucugaggcccagaga

SEQ ID NO: 280817 - RNA, 32 nt, Human
uuuucacggugcuacuaauccugcuguauccc

SEQ ID NO: 280818 - RNA, 32 nt, Human
uuuucacucccccagcagugugugugaguucc

SEQ ID NO: 280819 - RNA, 32 nt, Human
uuuucacucucucuuccauggcugccaaccug

SEQ ID NO: 280820 - RNA, 32 nt, Human
uuuucacugaggaggugguggaaggugucgcc

SEQ ID NO: 280821 - RNA, 32 nt, Human
uuuucacugagggcaagaaccagcuggagauu

SEQ ID NO: 280822 - RNA, 32 nt, Human
uuuucacugauaguuuuuacaaaaagcuuggu

SEQ ID NO: 280823 - RNA, 32 nt, Human
uuuucacugcuggugcccuucucuucugaccu

SEQ ID NO: 280824 - RNA, 32 nt, Human
uuuucacugcuuuguguuaaugacuuugagcg

SEQ ID NO: 280825 - RNA, 32 nt, Human
uuuucacuguucuguacaaggcugcuuguuuu

SEQ ID NO: 280826 - RNA, 32 nt, Human
uuuucacuucauaugcuuucccugcacuaucu

SEQ ID NO: 280827 - RNA, 32 nt, Human
uuuucacuucuuuuguggaucuucaguugcuu

SEQ ID NO: 280828 - RNA, 32 nt, Human
uuuucacuuuguugcuaucauccuccuuucuc

SEQ ID NO: 280829 - RNA, 32 nt, Human
uuuucagaaaacugagugacaguggagagaaa

SEQ ID NO: 280830 - RNA, 32 nt, Human
uuuucagaauauuuugaacaaagaucuuuguc

SEQ ID NO: 280831 - RNA, 32 nt, Human
uuuucagaccuggacacggaggcacagggugc

SEQ ID NO: 280832 - RNA, 32 nt, Human
uuuucagacggagccuauuuugcugcaagcag

SEQ ID NO: 280833 - RNA, 23 nt, Human
uuuucagacugaagaaaacuuug

SEQ ID NO: 280834 - RNA, 22 nt, Human
uuuucagagacucuggagugga

SEQ ID NO: 280835 - RNA, 32 nt, Human
uuuucagaggcugagacaggugggccacauga

SEQ ID NO: 280836 - RNA, 32 nt, Human
uuuucagagucauggaggcgcuaauuccuguc

SEQ ID NO: 280837 - RNA, 32 nt, Human
uuuucagauaucuauuguggaucuuuuaaagg

SEQ ID NO: 280838 - RNA, 32 nt, Human
uuuucagauauuucaauaagguggugaauuug

SEQ ID NO: 280839 - RNA, 32 nt, Human
uuuucagaugccaauaaagagcacuuuaugag

SEQ ID NO: 280840 - RNA, 24 nt, Human
uuuucagauguggcuuggucugga

SEQ ID NO: 280841 - RNA, 32 nt, Human
uuuucagauugguugcucuggaaaggaaggcu

SEQ ID NO: 280842 - RNA, 32 nt, Human
uuuucagcaaaacuuuccaacugaguggaguc

SEQ ID NO: 280843 - RNA, 32 nt, Human
uuuucagcaaaccuucagagggugaaagggga

SEQ ID NO: 280844 - RNA, 32 nt, Human
uuuucagcaacagggacaacacuguagaggaa

SEQ ID NO: 280845 - RNA, 32 nt, Human
uuuucagcaccuuuuauauguaaggaaguacc

SEQ ID NO: 280846 - RNA, 32 nt, Human
uuuucagcagcugaggcuaaggggagaggaca

SEQ ID NO: 280847 - RNA, 32 nt, Human
uuuucagcaggaacucccucucuucucgguag

SEQ ID NO: 280848 - RNA, 32 nt, Human
uuuucagcaguaacaggaaaccacuuaucaca

SEQ ID NO: 280849 - RNA, 32 nt, Human
uuuucagcauauguaguacuucagaggaagaa

SEQ ID NO: 280850 - RNA, 32 nt, Human
uuuucagccauggccacaagugaacagaguau

SEQ ID NO: 280851 - RNA, 32 nt, Human
uuuucagccuagaaaugucuguguuaaguggu

SEQ ID NO: 280852 - RNA, 32 nt, Human
uuuucagccuccagaaccaugagaaauaaauu

SEQ ID NO: 280853 - RNA, 32 nt, Human
uuuucagccuguuacuguccugugccauuuuu

SEQ ID NO: 280854 - RNA, 32 nt, Human
uuuucagcuauuucuguuccccugaacuaauu

SEQ ID NO: 280855 - RNA, 32 nt, Human
uuuucagcuggugauugcucuggugagacuga

SEQ ID NO: 280856 - RNA, 32 nt, Human
uuuucagcuucuuuauuuccuccuaauggaaa

SEQ ID NO: 280857 - RNA, 32 nt, Human
uuuucagcuuugcaccuggaacucuguaguaa

SEQ ID NO: 280858 - RNA, 32 nt, Human
uuuucaggaggaacugauaucucuggcuaaau

SEQ ID NO: 280859 - RNA, 32 nt, Human
uuuucaggaucuccugagggcugugucacgga

SEQ ID NO: 280860 - RNA, 32 nt, Human
uuuucaggcauguagaauaagcauggagucau

SEQ ID NO: 280861 - RNA, 32 nt, Human
uuuucaggccauucaccugccuccugucagua

SEQ ID NO: 280862 - RNA, 32 nt, Human
uuuucaggcugaaaaugcccgucuugcugcug

SEQ ID NO: 280863 - RNA, 31 nt, Human
uuuucagggaaacugacugugcugcuauuug

SEQ ID NO: 280864 - RNA, 32 nt, Human
uuuucaggggcuuaugauucugcucuaaaaca

SEQ ID NO: 280865 - RNA, 32 nt, Human
uuuucagguacugggagccgggggcucacugc

SEQ ID NO: 280866 - RNA, 32 nt, Human
uuuucaggucauuuacaauugggagauuucag

SEQ ID NO: 280867 - RNA, 32 nt, Human
uuuucagguccuuugcuuaccaaaggaggccc

SEQ ID NO: 280868 - RNA, 32 nt, Human
uuuucaggugcacccuccuccuccaggaggca

SEQ ID NO: 280869 - RNA, 32 nt, Human
uuuucaggugggaagagagcaaaccaguugau

SEQ ID NO: 280870 - RNA, 32 nt, Human
uuuucaguaaagugguucucugccuuuuuacu

SEQ ID NO: 280871 - RNA, 32 nt, Human
uuuucaguaauauuuugcuguuuuuaagacuu

SEQ ID NO: 280872 - RNA, 32 nt, Human
uuuucaguauaaccuccccuaugcucaugccc

SEQ ID NO: 280873 - RNA, 32 nt, Human
uuuucaguauagcacauuauuuacugagugcc

SEQ ID NO: 280874 - RNA, 32 nt, Human
uuuucagucagcugccaccugcuucucauuuu

SEQ ID NO: 280875 - RNA, 32 nt, Human
uuuucagucagggugaugaucuucugaagcuc

SEQ ID NO: 280876 - RNA, 32 nt, Human
uuuucagucccagaucuugcucugccuugggg

SEQ ID NO: 280877 - RNA, 32 nt, Human
uuuucaguccgcgucccucccugggccgggcu

SEQ ID NO: 280878 - RNA, 32 nt, Human
uuuucagucuugcugagacucugucuggauuu

SEQ ID NO: 280879 - RNA, 32 nt, Human
uuuucagugcugggccuggaugugacauaaga

SEQ ID NO: 280880 - RNA, 23 nt, Human
uuuucaguggacaaugggaauaa

SEQ ID NO: 280881 - RNA, 31 nt, Human
uuuucaguuauuuucugagugugcagacagc

SEQ ID NO: 280882 - RNA, 32 nt, Human
uuuucaguucccaauuaaagucuagaaccuga

SEQ ID NO: 280883 - RNA, 32 nt, Human
uuuucaguugcgaacauccuuuuugacagaaa

SEQ ID NO: 280884 - RNA, 32 nt, Human
uuuucaguugggaagaaaggagagggguggcg

SEQ ID NO: 280885 - RNA, 24 nt, Human
uuuucauaaaagucaccagugacu

SEQ ID NO: 280886 - RNA, 31 nt, Human
uuuucauaauaaaaaguuaggagggaaacau

SEQ ID NO: 280887 - RNA, 32 nt, Human
uuuucauaccauuuuuagcuguguucacaggg

SEQ ID NO: 280888 - RNA, 32 nt, Human
uuuucauacuccucauguuuaaggaugcugaa

SEQ ID NO: 280889 - RNA, 17 nt, Human
uuuucauacucuuccca

SEQ ID NO: 280890 - RNA, 32 nt, Human
uuuucauagccuuccaugucauggaucaggga

SEQ ID NO: 280891 - RNA, 32 nt, Human
uuuucauagcuucuccaucacauucaagcugg

SEQ ID NO: 280892 - RNA, 32 nt, Human
uuuucauaguuucauuuguucuugcccacaag

SEQ ID NO: 280893 - RNA, 32 nt, Human
uuuucauauaaaagguaagacagaguuugcaa

SEQ ID NO: 280894 - RNA, 32 nt, Human
uuuucauauacugguaccuucuuuuuggcuga

SEQ ID NO: 280895 - RNA, 19 nt, Human
uuuucauauccauacuaua

SEQ ID NO: 280896 - RNA, 32 nt, Human
uuuucauaucccucagcuuugggggccccagg

SEQ ID NO: 280897 - RNA, 32 nt, Human
uuuucauaugaucccucccucacuuucacugu

SEQ ID NO: 280898 - RNA, 32 nt, Human
uuuucauaugugaauucagugcaagaaacuug

SEQ ID NO: 280899 - RNA, 32 nt, Human
uuuucauauuugcugcgugagcauuuuguaaa

SEQ ID NO: 280900 - RNA, 32 nt, Human
uuuucauauuuuuaguagagacaggguuuugc

SEQ ID NO: 280901 - RNA, 32 nt, Human
uuuucauauuuuuaguagagaugggguuucaa

SEQ ID NO: 280902 - RNA, 32 nt, Human
uuuucauauuuuuaguagagaugggguuucac

SEQ ID NO: 280903 - RNA, 32 nt, Human
uuuucaucacgguggaaaauucuggcugcuuc

SEQ ID NO: 280904 - RNA, 32 nt, Human
uuuucaucaucagcuacaggauuagaaaggag

SEQ ID NO: 280905 - RNA, 32 nt, Human
uuuucauccccagggauaagacacaaacaccu

SEQ ID NO: 280906 - RNA, 32 nt, Human
uuuucauccuaauucaguaaguucucaggcuu

SEQ ID NO: 280907 - RNA, 32 nt, Human
uuuucauccucuucucuuuccaccaacccucc

SEQ ID NO: 280908 - RNA, 32 nt, Human
uuuucauccuuccuccucucccuccucuguga

SEQ ID NO: 280909 - RNA, 32 nt, Human
uuuucaucuaggcuggagugcaaugguuugau

SEQ ID NO: 280910 - RNA, 32 nt, Human
uuuucaucugguugaauggcuuuucuuagugu

SEQ ID NO: 280911 - RNA, 32 nt, Human
uuuucaucuuauacugagcuccagaaaggacg

SEQ ID NO: 280912 - RNA, 32 nt, Human
uuuucaucuuuguucacuugaggcuuucccca

SEQ ID NO: 280913 - RNA, 31 nt, Human
uuuucaugccucucuuacugucucuuacugu

SEQ ID NO: 280914 - RNA, 32 nt, Human
uuuucaugcucucuccugccuucccuuguccu

SEQ ID NO: 280915 - RNA, 30 nt, Human
uuuucauggaguuuguuccugguggcucaa

SEQ ID NO: 280916 - RNA, 32 nt, Human
uuuucaugggguucuauaaggaggcaugcccu

SEQ ID NO: 280917 - RNA, 32 nt, Human
uuuucauguaaaccacuggucacaaaugaacu

SEQ ID NO: 280918 - RNA, 32 nt, Human
uuuucauguaaucuuuacuggcccaacuuggg

SEQ ID NO: 280919 - RNA, 32 nt, Human
uuuucauguauuaccuggucauuucaaacaaa

SEQ ID NO: 280920 - RNA, 32 nt, Human
uuuucaugugccagagccuguacuggaggccc

SEQ ID NO: 280921 - RNA, 32 nt, Human
uuuucauguuucuuucuguggccauggguaua

SEQ ID NO: 280922 - RNA, 32 nt, Human
uuuucauuaccugaguuauuuguacagaaggg

SEQ ID NO: 280923 - RNA, 32 nt, Human
uuuucauucaacuaacacugguugagaauaga

SEQ ID NO: 280924 - RNA, 32 nt, Human
uuuucauuccccacuucucucuucacaauugu

SEQ ID NO: 280925 - RNA, 32 nt, Human
uuuucauucucucuggaaacagacucagguuu

SEQ ID NO: 280926 - RNA, 32 nt, Human
uuuucauucuucuugcaguucugggaguaaag

SEQ ID NO: 280927 - RNA, 32 nt, Human
uuuucauugcagcagcaaauccuugaauagga

SEQ ID NO: 280928 - RNA, 32 nt, Human
uuuucauugccuccucaguauuggcuuugggu

SEQ ID NO: 280929 - RNA, 32 nt, Human
uuuucauuggcugcagugaauuuaguucccua

SEQ ID NO: 280930 - RNA, 32 nt, Human
uuuucauuggcuuagggcagauuuucaugcaa

SEQ ID NO: 280931 - RNA, 32 nt, Human
uuuucauugguggccucaauagggaaaccaau

SEQ ID NO: 280932 - RNA, 32 nt, Human
uuuucauuucacaggguucacaggguuucaca

SEQ ID NO: 280933 - RNA, 32 nt, Human
uuuucauuugagacggagucucgcucugucac

SEQ ID NO: 280934 - RNA, 32 nt, Human
uuuucauuugagagggagagcugugguacugg

SEQ ID NO: 280935 - RNA, 32 nt, Human
uuuucauuuguugggcagaggcccaauaaaug

SEQ ID NO: 280936 - RNA, 32 nt, Human
uuuucauuuuaaagcacaccugagaugauucu

SEQ ID NO: 280937 - RNA, 32 nt, Human
uuuucauuuucaaccaaaggcccuuuucaggg

SEQ ID NO: 280938 - RNA, 32 nt, Human
uuuucauuuugucuuauauaguccaguuuucc

SEQ ID NO: 280939 - RNA, 32 nt, Human
uuuucauuuuuaaaaauuuuaggaugaaggaa

SEQ ID NO: 280940 - RNA, 32 nt, Human
uuuuccaaaauacaaauuggaaaaauacucac

SEQ ID NO: 280941 - RNA, 32 nt, Human
uuuuccaaaauguaaguuaggaagucuccauu

SEQ ID NO: 280942 - RNA, 32 nt, Human
uuuuccaaagagcugggauuacaggcaugagc

SEQ ID NO: 280943 - RNA, 32 nt, Human
uuuuccaaaguggugugguggaggaggauaaa

SEQ ID NO: 280944 - RNA, 32 nt, Human
uuuuccaacaugagccucaugaagccaacuaa

SEQ ID NO: 280945 - RNA, 32 nt, Human
uuuuccaaccacaaaaccacacacauagacca

SEQ ID NO: 280946 - RNA, 32 nt, Human
uuuuccaagagguucaugggaggcggagguga

SEQ ID NO: 280947 - RNA, 32 nt, Human
uuuuccaagagugugaaggaaaauggggcaau

SEQ ID NO: 280948 - RNA, 32 nt, Human
uuuuccaagauggcucaagauucaguagaucu

SEQ ID NO: 280949 - RNA, 32 nt, Human
uuuuccaagggcccacguagcaccggcaaccg

SEQ ID NO: 280950 - RNA, 32 nt, Human
uuuuccaaggggaagcagcuccucaggaggau

SEQ ID NO: 280951 - RNA, 21 nt, Human
uuuuccaaguauuuacugaau

SEQ ID NO: 280952 - RNA, 32 nt, Human
uuuuccacaauccaagugauucugauacacac

SEQ ID NO: 280953 - RNA, 32 nt, Human
uuuuccacaggcaucucugcaugaauuucuuc

SEQ ID NO: 280954 - RNA, 32 nt, Human
uuuuccacaggugguuaccugggaggcaaugc

SEQ ID NO: 280955 - RNA, 30 nt, Human
uuuuccacauggcaaggggucuccuuggaa

SEQ ID NO: 280956 - RNA, 32 nt, Human
uuuuccaccuugggaguucaagcgauuuuccc

SEQ ID NO: 280957 - RNA, 32 nt, Human
uuuuccacuuaucuugaguucacuuugauguu

SEQ ID NO: 280958 - RNA, 32 nt, Human
uuuuccagaaaccauacugggcucagaucaga

SEQ ID NO: 280959 - RNA, 22 nt, Human
uuuuccagaccccucugcccag

SEQ ID NO: 280960 - RNA, 32 nt, Human
uuuuccagagcagcagagacagagccaggagc

SEQ ID NO: 280961 - RNA, 32 nt, Human
uuuuccagagcugaaggagugaagagcccuug

SEQ ID NO: 280962 - RNA, 32 nt, Human
uuuuccagauggcgaggucacagcagagagau

SEQ ID NO: 280963 - RNA, 32 nt, Human
uuuuccagccuagccugaacccugccagucca

SEQ ID NO: 280964 - RNA, 32 nt, Human
uuuuccagccugggcaauacagugagacccug

SEQ ID NO: 280965 - RNA, 32 nt, Human
uuuuccagcuaccugccacuugcccacccacu

SEQ ID NO: 280966 - RNA, 32 nt, Human
uuuuccagcuccauuauaaucuuauagaguca

SEQ ID NO: 280967 - RNA, 32 nt, Human
uuuuccagcuccauuauaaucuuaugugauca

SEQ ID NO: 280968 - RNA, 18 nt, Human
uuuuccagcuguacagug

SEQ ID NO: 280969 - RNA, 32 nt, Human
uuuuccagcuucuggaaggccauguucagauc

SEQ ID NO: 280970 - RNA, 32 nt, Human
uuuuccagcuuugccuguuaccccuguuucug

SEQ ID NO: 280971 - RNA, 32 nt, Human
uuuuccaggauaacccucccugauucuuauug

SEQ ID NO: 280972 - RNA, 32 nt, Human
uuuuccaggccaauggcucacuccaggugcca

SEQ ID NO: 280973 - RNA, 32 nt, Human
uuuuccaggggcagggcccaggagaccauucc

SEQ ID NO: 280974 - RNA, 32 nt, Human
uuuuccaggggcuaguuuggcuuuuccaagug

SEQ ID NO: 280975 - RNA, 32 nt, Human
uuuuccagucccauagcucauggaugccacca

SEQ ID NO: 280976 - RNA, 32 nt, Human
uuuuccagugaucuugggacaugaaguugcuu

SEQ ID NO: 280977 - RNA, 32 nt, Human
uuuuccaguuugauaauugauggucagagcca

SEQ ID NO: 280978 - RNA, 32 nt, Human
uuuuccauaagaauuguaaacauugaacugaa

SEQ ID NO: 280979 - RNA, 32 nt, Human
uuuuccauaagggacaugagcauuuuacuagg

SEQ ID NO: 280980 - RNA, 32 nt, Human
uuuuccauacaaaucaguugauuuaaaggagu

SEQ ID NO: 280981 - RNA, 32 nt, Human
uuuuccauccuguauucucccacaucacuacu

SEQ ID NO: 280982 - RNA, 32 nt, Human
uuuuccauccuuucaugaaacuccuuaaagau

SEQ ID NO: 280983 - RNA, 32 nt, Human
uuuuccaucucauuucccuuccaucugaaagu

SEQ ID NO: 280984 - RNA, 32 nt, Human
uuuuccaucugcccuccccaaacaucucccuc

SEQ ID NO: 280985 - RNA, 32 nt, Human
uuuuccaucugucaguuuuauuaguugucauu

SEQ ID NO: 280986 - RNA, 32 nt, Human
uuuuccaucuucucugucuuugguucagcagu

SEQ ID NO: 280987 - RNA, 32 nt, Human
uuuuccaugccaagcauccacccggcccacag

SEQ ID NO: 280988 - RNA, 31 nt, Human
uuuuccaugcucucuggcucauugugucauu

SEQ ID NO: 280989 - RNA, 32 nt, Human
uuuuccauuguuuucuccagagagaaugugcu

SEQ ID NO: 280990 - RNA, 24 nt, Human
uuuuccauuuguuuuuccugcuuu

SEQ ID NO: 280991 - RNA, 22 nt, Human
uuuucccaauaaauacuugccu

SEQ ID NO: 280992 - RNA, 22 nt, Human
uuuucccaaugagcagugucau

SEQ ID NO: 280993 - RNA, 32 nt, Human
uuuucccacaguucuagggacaggacucugag

SEQ ID NO: 280994 - RNA, 32 nt, Human
uuuucccacccacuggaaggcucacaggcaag

SEQ ID NO: 280995 - RNA, 32 nt, Human
uuuucccacugagguuuuagaagcuaggaggc

SEQ ID NO: 280996 - RNA, 32 nt, Human
uuuucccacugcacccccuccugcugcagagg

SEQ ID NO: 280997 - RNA, 32 nt, Human
uuuucccacuuuccuucugucucuccuuccuc

SEQ ID NO: 280998 - RNA, 32 nt, Human
uuuucccagccagagcccuggccacacggacu

SEQ ID NO: 280999 - RNA, 32 nt, Human
uuuucccagcuacuccggaggcugcgguggaa

SEQ ID NO: 281000 - RNA, 32 nt, Human
uuuucccaggaauaucccaaacuucggaaaca

SEQ ID NO: 281001 - RNA, 32 nt, Human
uuuucccaggagaccauuuguauuaccauuac

SEQ ID NO: 281002 - RNA, 32 nt, Human
uuuucccaggggacaggacccacugggagaca

SEQ ID NO: 281003 - RNA, 32 nt, Human
uuuucccauauacaaucuuccuuccuuaggua

SEQ ID NO: 281004 - RNA, 32 nt, Human
uuuucccaucucuuagcacagugccuugcaca

SEQ ID NO: 281005 - RNA, 32 nt, Human
uuuucccauuuagaauggugauuuuaaaugug

SEQ ID NO: 281006 - RNA, 32 nt, Human
uuuucccauuuuaaaaucuaaacuagacaucu

SEQ ID NO: 281007 - RNA, 32 nt, Human
uuuuccccaaaccauaaaacccuauacaaguu

SEQ ID NO: 281008 - RNA, 32 nt, Human
uuuuccccaaguacaaccacacccacacucag

SEQ ID NO: 281009 - RNA, 28 nt, Human
uuuuccccaagugcuuaguugccaucua

SEQ ID NO: 281010 - RNA, 32 nt, Human
uuuuccccacauauggggcacuggcuucaaac

SEQ ID NO: 281011 - RNA, 32 nt, Human
uuuuccccagaaccuccagggagaauauggca

SEQ ID NO: 281012 - RNA, 32 nt, Human
uuuuccccaguauaguggaaagacugaggcuu

SEQ ID NO: 281013 - RNA, 32 nt, Human
uuuuccccaugaacucugaaccaccuuugucu

SEQ ID NO: 281014 - RNA, 32 nt, Human
uuuuccccaugagcauaucaucagccuuggcc

SEQ ID NO: 281015 - RNA, 32 nt, Human
uuuucccccacccuccuuaccccgcugggcua

SEQ ID NO: 281016 - RNA, 32 nt, Human
uuuucccccaccgcaaccuccaucucccgggu

SEQ ID NO: 281017 - RNA, 32 nt, Human
uuuucccccauggucucugucucuauauccuc

SEQ ID NO: 281018 - RNA, 32 nt, Human
uuuucccccuccuuaccugacccccuacgagu

SEQ ID NO: 281019 - RNA, 32 nt, Human
uuuucccccucuuuggcugguggaggauaaag

SEQ ID NO: 281020 - RNA, 32 nt, Human
uuuucccccuuagaugccuggaagugguauuu

SEQ ID NO: 281021 - RNA, 32 nt, Human
uuuucccccuuuccucuuccuuucccuuccuu

SEQ ID NO: 281022 - RNA, 32 nt, Human
uuuucccccuuugaaugaggucuuccauguuu

SEQ ID NO: 281023 - RNA, 32 nt, Human
uuuuccccucacccuccagcccuggaggcuuu

SEQ ID NO: 281024 - RNA, 32 nt, Human
uuuuccccucacccucugcccuucuaagucau

SEQ ID NO: 281025 - RNA, 32 nt, Human
uuuuccccuccagugccucccggcugcuagcc

SEQ ID NO: 281026 - RNA, 32 nt, Human
uuuuccccuccccaccccucuuugcuuuucuc

SEQ ID NO: 281027 - RNA, 32 nt, Human
uuuuccccucuccaaaugcagcagugaauccc

SEQ ID NO: 281028 - RNA, 32 nt, Human
uuuuccccugcagggugggauuugagcuguga

SEQ ID NO: 281029 - RNA, 32 nt, Human
uuuuccccugcuccccugagaccacccccaaa

SEQ ID NO: 281030 - RNA, 32 nt, Human
uuuuccccuggaguuccaggaggaaccagccc

SEQ ID NO: 281031 - RNA, 32 nt, Human
uuuuccccuucccuccccuauggaugcuuuaa

SEQ ID NO: 281032 - RNA, 32 nt, Human
uuuucccgcacugucuccagucacgauccagc

SEQ ID NO: 281033 - RNA, 32 nt, Human
uuuucccuaagugucagccaacuugagaaaua

SEQ ID NO: 281034 - RNA, 32 nt, Human
uuuucccuaccucugucauuagcaaugguuga

SEQ ID NO: 281035 - RNA, 32 nt, Human
uuuucccucacagacauuucucuuucaugccu

SEQ ID NO: 281036 - RNA, 32 nt, Human
uuuucccucauagccucuagggagggagagug

SEQ ID NO: 281037 - RNA, 32 nt, Human
uuuucccuccacuccaucccucccucccgucc

SEQ ID NO: 281038 - RNA, 32 nt, Human
uuuucccuccacugcuguuaauuaaugucacu

SEQ ID NO: 281039 - RNA, 32 nt, Human
uuuucccuccauccuucuuuccuucauccuuu

SEQ ID NO: 281040 - RNA, 32 nt, Human
uuuucccuccccucaucuucaguggcuuggua

SEQ ID NO: 281041 - RNA, 32 nt, Human
uuuucccuccgagaccgauuccaucugcagag

SEQ ID NO: 281042 - RNA, 24 nt, Human
uuuucccuccuuagcagcauucca

SEQ ID NO: 281043 - RNA, 31 nt, Human
uuuucccucgaaaacucauguugaaacuuaa

SEQ ID NO: 281044 - RNA, 32 nt, Human
uuuucccucucaagcucugcccuucccagccc

SEQ ID NO: 281045 - RNA, 32 nt, Human
uuuucccucugggcccagccucuccccacccc

SEQ ID NO: 281046 - RNA, 32 nt, Human
uuuucccugacccccgaaccacccaaccacau

SEQ ID NO: 281047 - RNA, 32 nt, Human
uuuucccugaguaacugggauaaugggucacc

SEQ ID NO: 281048 - RNA, 32 nt, Human
uuuucccugcaacaucuccaccucccaauagu

SEQ ID NO: 281049 - RNA, 32 nt, Human
uuuucccugcauucaccugguucccauccaca

SEQ ID NO: 281050 - RNA, 32 nt, Human
uuuucccugggaacaugggagcacugacacag

SEQ ID NO: 281051 - RNA, 32 nt, Human
uuuucccuggguggagcaggacucccaccuaa

SEQ ID NO: 281052 - RNA, 32 nt, Human
uuuucccuguguauuauaauaaauuuguggua

SEQ ID NO: 281053 - RNA, 32 nt, Human
uuuucccuguucuacuuuuggccaaggacagu

SEQ ID NO: 281054 - RNA, 32 nt, Human
uuuucccuuaauaccuggguguuguauuagau

SEQ ID NO: 281055 - RNA, 32 nt, Human
uuuucccuuaugcuuuggcuuucaugccuccu

SEQ ID NO: 281056 - RNA, 32 nt, Human
uuuucccuuccucuguggugacaacggaggaa

SEQ ID NO: 281057 - RNA, 32 nt, Human
uuuucccuucuuuccuccugguuccggucagu

SEQ ID NO: 281058 - RNA, 32 nt, Human
uuuucccuuuccuggugauugauuuuacaaaa

SEQ ID NO: 281059 - RNA, 32 nt, Human
uuuucccuuugcagguugcacacaguuuuguu

SEQ ID NO: 281060 - RNA, 32 nt, Human
uuuucccuuuuuaaccauuccaaucggugugu

SEQ ID NO: 281061 - RNA, 32 nt, Human
uuuuccgcaugccuccugccuccugggcuauu

SEQ ID NO: 281062 - RNA, 32 nt, Human
uuuuccgcuuucugagcccuuuuauaccuuac

SEQ ID NO: 281063 - RNA, 18 nt, Human
uuuuccggauacauuaua

SEQ ID NO: 281064 - RNA, 32 nt, Human
uuuuccgguguccuuaagguucuuggacucug

SEQ ID NO: 281065 - RNA, 22 nt, Human
uuuuccguaguucuggcugccu

SEQ ID NO: 281066 - RNA, 32 nt, Human
uuuuccguauuuugagcucucuucccaauauu

SEQ ID NO: 281067 - RNA, 32 nt, Human
uuuuccguccugggaacugucagucugggaga

SEQ ID NO: 281068 - RNA, 32 nt, Human
uuuuccgucugggaacaguaccucugccccug

SEQ ID NO: 281069 - RNA, 32 nt, Human
uuuuccgugccucuccuccaccucucccuucu

SEQ ID NO: 281070 - RNA, 32 nt, Human
uuuuccuaaacacccacccaaugggagaggcu

SEQ ID NO: 281071 - RNA, 21 nt, Human
uuuuccuaaaugcauacugua

SEQ ID NO: 281072 - RNA, 32 nt, Human
uuuuccuaacacugauacuacaagucaccaau

SEQ ID NO: 281073 - RNA, 32 nt, Human
uuuuccuaaggguauaagcuucacucugccug

SEQ ID NO: 281074 - RNA, 32 nt, Human
uuuuccuaagugauuuugcucucuuccaaucu

SEQ ID NO: 281075 - RNA, 32 nt, Human
uuuuccuacaaaggaagcagucucuggaggcc

SEQ ID NO: 281076 - RNA, 32 nt, Human
uuuuccuacaaggauaugcauuagcaauucug

SEQ ID NO: 281077 - RNA, 32 nt, Human
uuuuccuacuucagugaagugcagucauacaa

SEQ ID NO: 281078 - RNA, 32 nt, Human
uuuuccuacuucuucuguacuuuuaccuguag

SEQ ID NO: 281079 - RNA, 32 nt, Human
uuuuccuagcuagagaaggugaugccuucuuc

SEQ ID NO: 281080 - RNA, 32 nt, Human
uuuuccuaggagaguuaugaaaaguugaaggc

SEQ ID NO: 281081 - RNA, 32 nt, Human
uuuuccuaggcagaggaccccacggccuuccg

SEQ ID NO: 281082 - RNA, 32 nt, Human
uuuuccuaggcagaggacccugaggccuucug

SEQ ID NO: 281083 - RNA, 32 nt, Human
uuuuccuaguacaacgaauaucugccaacucu

SEQ ID NO: 281084 - RNA, 32 nt, Human
uuuuccuauaucccgaguggggcacagacggu

SEQ ID NO: 281085 - RNA, 32 nt, Human
uuuuccuaugugcuuccucuggcauucacugu

SEQ ID NO: 281086 - RNA, 32 nt, Human
uuuuccucacuacauuguacaugugggaauua

SEQ ID NO: 281087 - RNA, 32 nt, Human
uuuuccucagggauccaccacagucuaggcca

SEQ ID NO: 281088 - RNA, 32 nt, Human
uuuuccucaggguguccugagguccaagauuc

SEQ ID NO: 281089 - RNA, 32 nt, Human
uuuuccucauugcuacagcaagccacagggua

SEQ ID NO: 281090 - RNA, 32 nt, Human
uuuuccuccagccugaagucuucggcaaauag

SEQ ID NO: 281091 - RNA, 32 nt, Human
uuuuccuccccugucccagccuucccacuuug

SEQ ID NO: 281092 - RNA, 32 nt, Human
uuuuccuccgccccucuccuaaagccugaggg

SEQ ID NO: 281093 - RNA, 32 nt, Human
uuuuccuccgucucccugcugucccuuacccu

SEQ ID NO: 281094 - RNA, 32 nt, Human
uuuuccuccuccucacagaggagauguguucg

SEQ ID NO: 281095 - RNA, 32 nt, Human
uuuuccuccucuaagaggagaugaugucugcu

SEQ ID NO: 281096 - RNA, 32 nt, Human
uuuuccuccucuuccuccuuccuccuuccucc

SEQ ID NO: 281097 - RNA, 32 nt, Human
uuuuccuccucuuccuuccuccuccagccgcc

SEQ ID NO: 281098 - RNA, 32 nt, Human
uuuuccuccuucucucuuucuugcuccaaucc

SEQ ID NO: 281099 - RNA, 32 nt, Human
uuuuccuccuuuccuuuuucuuucccuuuccc

SEQ ID NO: 281100 - RNA, 32 nt, Human
uuuuccucucaaugccucacauuaggaagcac

SEQ ID NO: 281101 - RNA, 32 nt, Human
uuuuccucucagcaucagagaaggcagaaagc

SEQ ID NO: 281102 - RNA, 32 nt, Human
uuuuccucuccaccuuugcuucucacaauucc

SEQ ID NO: 281103 - RNA, 21 nt, Human
uuuuccucuccagaggggccg

SEQ ID NO: 281104 - RNA, 32 nt, Human
uuuuccucuccucugacucuuaagcccuuucc

SEQ ID NO: 281105 - RNA, 32 nt, Human
uuuuccucucugucugucucucccccucuguc

SEQ ID NO: 281106 - RNA, 32 nt, Human
uuuuccucuggccccucuuuccucuuccuggu

SEQ ID NO: 281107 - RNA, 32 nt, Human
uuuuccucuguggggugggagucacagccuag

SEQ ID NO: 281108 - RNA, 32 nt, Human
uuuuccucuucccuaucuccccuccuccccuu

SEQ ID NO: 281109 - RNA, 32 nt, Human
uuuuccucuuggauggaagugucaaaggcaga

SEQ ID NO: 281110 - RNA, 32 nt, Human
uuuuccucuuucccaacucuuacuacauccuc

SEQ ID NO: 281111 - RNA, 32 nt, Human
uuuuccucuuuccuuuuuguuuguuuuaaugu

SEQ ID NO: 281112 - RNA, 32 nt, Human
uuuuccugaaaugcuucagggauuccauaaac

SEQ ID NO: 281113 - RNA, 18 nt, Human
uuuuccugacagauuaug

SEQ ID NO: 281114 - RNA, 32 nt, Human
uuuuccugagaucacacacagcauugcagugg

SEQ ID NO: 281115 - RNA, 32 nt, Human
uuuuccugagggcacugcaaagaggcuccuuu

SEQ ID NO: 281116 - RNA, 18 nt, Human
uuuuccugauggacugua

SEQ ID NO: 281117 - RNA, 19 nt, Human
uuuuccugauuuauauuua

SEQ ID NO: 281118 - RNA, 32 nt, Human
uuuuccugcaacucugccuucuugaguccaaa

SEQ ID NO: 281119 - RNA, 32 nt, Human
uuuuccugccagaggcagaaaccacaaaauua

SEQ ID NO: 281120 - RNA, 32 nt, Human
uuuuccugcccccagaggccagccucucccug

SEQ ID NO: 281121 - RNA, 32 nt, Human
uuuuccugccucagcuuccugaguacugggac

SEQ ID NO: 281122 - RNA, 32 nt, Human
uuuuccugccuccuucacauuuccuccccagc

SEQ ID NO: 281123 - RNA, 32 nt, Human
uuuuccugcguuuuggaauaaacaguaaaaau

SEQ ID NO: 281124 - RNA, 32 nt, Human
uuuuccugcuguggcuggcacauucuucugau

SEQ ID NO: 281125 - RNA, 32 nt, Human
uuuuccuggaagggaacagcugggcugcugga

SEQ ID NO: 281126 - RNA, 32 nt, Human
uuuuccuggagcugguauuuuugggguggagg

SEQ ID NO: 281127 - RNA, 32 nt, Human
uuuuccuggcacgggcaggcugugggaggcag

SEQ ID NO: 281128 - RNA, 19 nt, Human
uuuuccugggaagacugua

SEQ ID NO: 281129 - RNA, 32 nt, Human
uuuuccugggagggggccuuccagcauguggg

SEQ ID NO: 281130 - RNA, 32 nt, Human
uuuuccugggccagaaguagagggggugggug

SEQ ID NO: 281131 - RNA, 32 nt, Human
uuuuccugggccagaaguagaggggugggugc

SEQ ID NO: 281132 - RNA, 20 nt, Human
uuuuccuggugaacacuaua

SEQ ID NO: 281133 - RNA, 18 nt, Human
uuuuccugguggacugua

SEQ ID NO: 281134 - RNA, 19 nt, Human
uuuuccuguaauuacugua

SEQ ID NO: 281135 - RNA, 32 nt, Human
uuuuccuguaggaacacagaccaagaaguuua

SEQ ID NO: 281136 - RNA, 32 nt, Human
uuuuccuguaggaagaggaagacagagcucuu

SEQ ID NO: 281137 - RNA, 32 nt, Human
uuuuccugucuuuugugcaugggcgacccauu

SEQ ID NO: 281138 - RNA, 19 nt, Human
uuuuccugugacacuuaua

SEQ ID NO: 281139 - RNA, 32 nt, Human
uuuuccugugauuucuccucugggccacugau

SEQ ID NO: 281140 - RNA, 32 nt, Human
uuuuccugugguuagaaaaauuaagacagaag

SEQ ID NO: 281141 - RNA, 17 nt, Human
uuuuccugugugcagug

SEQ ID NO: 281142 - RNA, 32 nt, Human
uuuuccuguguguguggccuuugcaucauuua

SEQ ID NO: 281143 - RNA, 19 nt, Human
uuuuccuguucauacacua

SEQ ID NO: 281144 - RNA, 18 nt, Human
uuuuccuguuugcacuau

SEQ ID NO: 281145 - RNA, 32 nt, Human
uuuuccuuaccacucuucaucucccucguagu

SEQ ID NO: 281146 - RNA, 32 nt, Human
uuuuccuuaucuuccucuuucaagaccccuac

SEQ ID NO: 281147 - RNA, 32 nt, Human
uuuuccuuauuuguaaaacaaaaagggcacca

SEQ ID NO: 281148 - RNA, 32 nt, Human
uuuuccuucaucaaggugauguaagugacuca

SEQ ID NO: 281149 - RNA, 32 nt, Human
uuuuccuuccccaagacugauaggaugcaagc

SEQ ID NO: 281150 - RNA, 32 nt, Human
uuuuccuuccucccuuccuuccuuccuuccuu

SEQ ID NO: 281151 - RNA, 32 nt, Human
uuuuccuuccucuccuacaucucccuuuuccc

SEQ ID NO: 281152 - RNA, 32 nt, Human
uuuuccuuccugcccuguaccucucucugcuc

SEQ ID NO: 281153 - RNA, 32 nt, Human
uuuuccuuccuuggagcgucccugacggacaa

SEQ ID NO: 281154 - RNA, 32 nt, Human
uuuuccuucuacagcuuagcuccgucuuuuca

SEQ ID NO: 281155 - RNA, 32 nt, Human
uuuuccuucuccccaauuacuccccugaauca

SEQ ID NO: 281156 - RNA, 32 nt, Human
uuuuccuucucccuucccuuuggacaguguua

SEQ ID NO: 281157 - RNA, 32 nt, Human
uuuuccuucucuaucucucuuauuuagucuuc

SEQ ID NO: 281158 - RNA, 32 nt, Human
uuuuccuucucuuccucguuuugauugcaccg

SEQ ID NO: 281159 - RNA, 32 nt, Human
uuuuccuucugauuuucccuuuucaacauucc

SEQ ID NO: 281160 - RNA, 32 nt, Human
uuuuccuucugcagccccuccccaccagcucc

SEQ ID NO: 281161 - RNA, 32 nt, Human
uuuuccuucuggcuucuucuauuacagucucu

SEQ ID NO: 281162 - RNA, 32 nt, Human
uuuuccuugaauggagaacacuuuaaaaauaa

SEQ ID NO: 281163 - RNA, 21 nt, Human
uuuuccuugauuccuaccaua

SEQ ID NO: 281164 - RNA, 32 nt, Human
uuuuccuugcugucucccuucuuucuauuuga

SEQ ID NO: 281165 - RNA, 32 nt, Human
uuuuccuuggaauuccaacuguggaccuuuua

SEQ ID NO: 281166 - RNA, 32 nt, Human
uuuuccuuguuaaucugcuccaaccaccugaa

SEQ ID NO: 281167 - RNA, 32 nt, Human
uuuuccuuuaaaauuuuuaaacuuuuuaggua

SEQ ID NO: 281168 - RNA, 32 nt, Human
uuuuccuuucagaacauuuuccagauggcgag

SEQ ID NO: 281169 - RNA, 32 nt, Human
uuuuccuuucagggauuugcggggucagggag

SEQ ID NO: 281170 - RNA, 32 nt, Human
uuuuccuuucaucagacacugugaaaacauuc

SEQ ID NO: 281171 - RNA, 32 nt, Human
uuuuccuuuccugaaagccucaucuaccuuaa

SEQ ID NO: 281172 - RNA, 32 nt, Human
uuuuccuuucgaaaaagacuguucacauuugc

SEQ ID NO: 281173 - RNA, 32 nt, Human
uuuuccuuucuuuggguagaccuacagucaga

SEQ ID NO: 281174 - RNA, 32 nt, Human
uuuuccuuugaacuuugaagcuagugcauugg

SEQ ID NO: 281175 - RNA, 32 nt, Human
uuuuccuuugauauuccaccucccaggaagga

SEQ ID NO: 281176 - RNA, 32 nt, Human
uuuuccuuugcccucaugagcguguuuauaau

SEQ ID NO: 281177 - RNA, 32 nt, Human
uuuuccuuugcuacuugaauagcaauaaaagc

SEQ ID NO: 281178 - RNA, 23 nt, Human
uuuuccuuugcuucuugagaccg

SEQ ID NO: 281179 - RNA, 32 nt, Human
uuuuccuuuuaugugcccacuguggcuacuuu

SEQ ID NO: 281180 - RNA, 32 nt, Human
uuuuccuuuucccgagcugugugaucuugagc

SEQ ID NO: 281181 - RNA, 32 nt, Human
uuuuccuuuuccucuuugacugagcaccgagg

SEQ ID NO: 281182 - RNA, 32 nt, Human
uuuuccuuuucuuuuucuuuccuuccuuccuu

SEQ ID NO: 281183 - RNA, 32 nt, Human
uuuuccuuuugccauggaaucugggugggaga

SEQ ID NO: 281184 - RNA, 21 nt, Human
uuuuccuuuuuucacaguaua

SEQ ID NO: 281185 - RNA, 32 nt, Human
uuuucgaaagaaucucauugagcuggcagagc

SEQ ID NO: 281186 - RNA, 32 nt, Human
uuuucgacacagcagccagaaggauccuuuaa

SEQ ID NO: 281187 - RNA, 24 nt, Human
uuuucgagauggagucucacucug

SEQ ID NO: 281188 - RNA, 32 nt, Human
uuuucgagugcccagcccucugguucacauuc

SEQ ID NO: 281189 - RNA, 32 nt, Human
uuuucgcaacauaaucccagcacuuuggaacg

SEQ ID NO: 281190 - RNA, 32 nt, Human
uuuucgcaagccuuccagaaguuuucugugcu

SEQ ID NO: 281191 - RNA, 32 nt, Human
uuuucgcaucuauucgggagagacuagggcag

SEQ ID NO: 281192 - RNA, 32 nt, Human
uuuucgccaaucuacacugauuuuggacuguu

SEQ ID NO: 281193 - RNA, 32 nt, Human
uuuucgcccaacuuaucccccaccuccauccc

SEQ ID NO: 281194 - RNA, 32 nt, Human
uuuucgcccaggcugaguacaguggugcaauc

SEQ ID NO: 281195 - RNA, 32 nt, Human
uuuucgcucugcuucauuacugcuuccuuuag

SEQ ID NO: 281196 - RNA, 32 nt, Human
uuuucgcucugucucccagguuggagugcagu

SEQ ID NO: 281197 - RNA, 32 nt, Human
uuuucgcuucacccucuuuacagcagccuguc

SEQ ID NO: 281198 - RNA, 32 nt, Human
uuuucggagacagugacuggugccagugucau

SEQ ID NO: 281199 - RNA, 32 nt, Human
uuuucggaggccgaggagggcagaucacuuga

SEQ ID NO: 281200 - RNA, 32 nt, Human
uuuucggcagauuuuccucacccuaaacuaag

SEQ ID NO: 281201 - RNA, 32 nt, Human
uuuucggcggggcugggagacugaggcccgcg

SEQ ID NO: 281202 - RNA, 32 nt, Human
uuuucguauauuauuuccaauauuuggaaagc

SEQ ID NO: 281203 - RNA, 32 nt, Human
uuuucguauuuuuaguagagaugggguuucac

SEQ ID NO: 281204 - RNA, 32 nt, Human
uuuucuaaaaauacaaaaauuagccagguaug

SEQ ID NO: 281205 - RNA, 32 nt, Human
uuuucuaaagccuacuccuuccucacuuugaa

SEQ ID NO: 281206 - RNA, 32 nt, Human
uuuucuaaccuacagagugccucuguguucac

SEQ ID NO: 281207 - RNA, 32 nt, Human
uuuucuaacuaaaauugugauguuacagaaag

SEQ ID NO: 281208 - RNA, 32 nt, Human
uuuucuaacuggagaaaagagugaggaacaga

SEQ ID NO: 281209 - RNA, 32 nt, Human
uuuucuaaggauggacccacaccagaaggucc

SEQ ID NO: 281210 - RNA, 32 nt, Human
uuuucuaaggauguaugaaggaaaggcaucuc

SEQ ID NO: 281211 - RNA, 32 nt, Human
uuuucuaaugaggagagaaaauauauguauuu

SEQ ID NO: 281212 - RNA, 32 nt, Human
uuuucuaaugggaacagucacuucaaguccau

SEQ ID NO: 281213 - RNA, 32 nt, Human
uuuucuaauucuuaacacucauacuugaaauc

SEQ ID NO: 281214 - RNA, 32 nt, Human
uuuucuacaacccugagcauuugcuacauacu

SEQ ID NO: 281215 - RNA, 32 nt, Human
uuuucuacaaguuugaccuuagccaugguuug

SEQ ID NO: 281216 - RNA, 32 nt, Human
uuuucuacagccaguaaggcagcucugucgug

SEQ ID NO: 281217 - RNA, 32 nt, Human
uuuucuacaguacucuuccuuauugcaccauu

SEQ ID NO: 281218 - RNA, 32 nt, Human
uuuucuacaguugaugugacaguggcuccaaa

SEQ ID NO: 281219 - RNA, 32 nt, Human
uuuucuacauuugagcaaauacugagguucau

SEQ ID NO: 281220 - RNA, 32 nt, Human
uuuucuaccaagccacacagcugcagcaacug

SEQ ID NO: 281221 - RNA, 32 nt, Human
uuuucuacccagccauucuuggcauugcaacc

SEQ ID NO: 281222 - RNA, 32 nt, Human
uuuucuacccugccaccucuuuucagcaagcu

SEQ ID NO: 281223 - RNA, 32 nt, Human
uuuucuacugggcuauugcucucuucauaaug

SEQ ID NO: 281224 - RNA, 32 nt, Human
uuuucuagagacacauuggaccagaugaggau

SEQ ID NO: 281225 - RNA, 32 nt, Human
uuuucuagcuuccauccuuucucccucguuuc

SEQ ID NO: 281226 - RNA, 32 nt, Human
uuuucuagcuuuaaaugccugcuuuauuucuu

SEQ ID NO: 281227 - RNA, 19 nt, Human
uuuucuaggacgcacuaua

SEQ ID NO: 281228 - RNA, 32 nt, Human
uuuucuaggacucugugcaacugucguauaug

SEQ ID NO: 281229 - RNA, 32 nt, Human
uuuucuaggagagaaauuuuggguucagugag

SEQ ID NO: 281230 - RNA, 32 nt, Human
uuuucuaggauguggccuuagagcaagaacag

SEQ ID NO: 281231 - RNA, 32 nt, Human
uuuucuaggccuggggacggcuuuuacuuaaa

SEQ ID NO: 281232 - RNA, 32 nt, Human
uuuucuagugcuaaagaaaagauuuaagcacc

SEQ ID NO: 281233 - RNA, 23 nt, Human
uuuucuagugcuuccuucuguuu

SEQ ID NO: 281234 - RNA, 32 nt, Human
uuuucuaucaauuuucccccaucccaucccca

SEQ ID NO: 281235 - RNA, 21 nt, Human
uuuucuaucauuuuggaauaa

SEQ ID NO: 281236 - RNA, 32 nt, Human
uuuucuaucugccucucugaguuggagugagu

SEQ ID NO: 281237 - RNA, 32 nt, Human
uuuucuaucuugaugaaaauguugcacauucu

SEQ ID NO: 281238 - RNA, 21 nt, Human
uuuucuauuaaaagugggaau

SEQ ID NO: 281239 - RNA, 22 nt, Human
uuuucuauuaaggauccaaaaa

SEQ ID NO: 281240 - RNA, 32 nt, Human
uuuucucaacaugguacucuacuggcaggaug

SEQ ID NO: 281241 - RNA, 32 nt, Human
uuuucucaacccaagucaaacaacaguuugug

SEQ ID NO: 281242 - RNA, 32 nt, Human
uuuucucaagauggcagauucccacugaggcu

SEQ ID NO: 281243 - RNA, 32 nt, Human
uuuucucaauuuaagauacagaaauacagcaa

SEQ ID NO: 281244 - RNA, 32 nt, Human
uuuucucacaagaacccaguuagcugauguuu

SEQ ID NO: 281245 - RNA, 32 nt, Human
uuuucucacagaagaagaaccagcaagccaga

SEQ ID NO: 281246 - RNA, 23 nt, Human
uuuucucacagcccucuggcuuu

SEQ ID NO: 281247 - RNA, 23 nt, Human
uuuucucacgugguuucuagcuu

SEQ ID NO: 281248 - RNA, 32 nt, Human
uuuucucagacuuuuacgaguaugaaucugag

SEQ ID NO: 281249 - RNA, 30 nt, Human
uuuucucagcacucaaugcuccugugcgga

SEQ ID NO: 281250 - RNA, 23 nt, Human
uuuucucagcauuucucuucuuu

SEQ ID NO: 281251 - RNA, 32 nt, Human
uuuucucagcccccauccccagcacugugugu

SEQ ID NO: 281252 - RNA, 32 nt, Human
uuuucucagcuaaacuguagggaaaugcuaag

SEQ ID NO: 281253 - RNA, 32 nt, Human
uuuucucaggaggggaacauggaggaggaaga

SEQ ID NO: 281254 - RNA, 32 nt, Human
uuuucucaguccacuuuuucaucacucauucc

SEQ ID NO: 281255 - RNA, 24 nt, Human
uuuucucagugcuuuuucugcuuu

SEQ ID NO: 281256 - RNA, 32 nt, Human
uuuucucaucaaagcagaaugcuaucuugcgu

SEQ ID NO: 281257 - RNA, 32 nt, Human
uuuucucauccucaucugucuaucccagccgg

SEQ ID NO: 281258 - RNA, 19 nt, Human
uuuucucaucugugcagug

SEQ ID NO: 281259 - RNA, 32 nt, Human
uuuucucaugaucucaccuauacuuuggggau

SEQ ID NO: 281260 - RNA, 32 nt, Human
uuuucucaugaugccuuuuuauauuuaaaccc

SEQ ID NO: 281261 - RNA, 24 nt, Human
uuuucucauguucuuucucccuuu

SEQ ID NO: 281262 - RNA, 19 nt, Human
uuuucucauugcuuuugcu

SEQ ID NO: 281263 - RNA, 22 nt, Human
uuuucucauuucuuucuguuuu

SEQ ID NO: 281264 - RNA, 32 nt, Human
uuuucucauuugcccuuugagcacuuuuacuu

SEQ ID NO: 281265 - RNA, 19 nt, Human
uuuucuccaaguuuuuuca

SEQ ID NO: 281266 - RNA, 32 nt, Human
uuuucuccaauuugccugaauauuucaggagg

SEQ ID NO: 281267 - RNA, 18 nt, Human
uuuucuccacauacagug

SEQ ID NO: 281268 - RNA, 32 nt, Human
uuuucuccacaucuucugaggcuuuagaaaug

SEQ ID NO: 281269 - RNA, 22 nt, Human
uuuucuccagagaaggugcagg

SEQ ID NO: 281270 - RNA, 32 nt, Human
uuuucuccagaguccccaaagccacauggcau

SEQ ID NO: 281271 - RNA, 32 nt, Human
uuuucuccagcagguggagauuauggaaccua

SEQ ID NO: 281272 - RNA, 32 nt, Human
uuuucuccaguaugcuaccugauuuguuuggc

SEQ ID NO: 281273 - RNA, 32 nt, Human
uuuucuccaguauuugcaucacagaaauaauc

SEQ ID NO: 281274 - RNA, 32 nt, Human
uuuucuccagugaggagugaacagugggcacc

SEQ ID NO: 281275 - RNA, 32 nt, Human
uuuucuccaguucuguuacccaauuuagauua

SEQ ID NO: 281276 - RNA, 32 nt, Human
uuuucuccauagcacacaccucuauccagcau

SEQ ID NO: 281277 - RNA, 32 nt, Human
uuuucuccaucuuuuaagcagccucuguaacu

SEQ ID NO: 281278 - RNA, 18 nt, Human
uuuucuccaugcacugug

SEQ ID NO: 281279 - RNA, 22 nt, Human
uuuucuccauggaaaaggacag

SEQ ID NO: 281280 - RNA, 20 nt, Human
uuuucuccauggcaggacag

SEQ ID NO: 281281 - RNA, 32 nt, Human
uuuucucccaaacuuugagaaggucaccucug

SEQ ID NO: 281282 - RNA, 32 nt, Human
uuuucucccacauucaccccugcccagagauu

SEQ ID NO: 281283 - RNA, 27 nt, Human
uuuucucccccaugugggggugguggg

SEQ ID NO: 281284 - RNA, 32 nt, Human
uuuucuccccuaucauuuuucucccauaaugu

SEQ ID NO: 281285 - RNA, 32 nt, Human
uuuucuccccucuccgucuucuccccuccuuc

SEQ ID NO: 281286 - RNA, 32 nt, Human
uuuucucccuccaccucuccucuccuucccuu

SEQ ID NO: 281287 - RNA, 32 nt, Human
uuuucucccucuguucaguauuucaaggaaaa

SEQ ID NO: 281288 - RNA, 32 nt, Human
uuuucucccuuaaguuccccuguucaaggcau

SEQ ID NO: 281289 - RNA, 32 nt, Human
uuuucucccuucugaaaugagugagggaaguu

SEQ ID NO: 281290 - RNA, 32 nt, Human
uuuucucccuuuucccuccuguggcuugcacu

SEQ ID NO: 281291 - RNA, 17 nt, Human
uuuucuccucuccagug

SEQ ID NO: 281292 - RNA, 20 nt, Human
uuuucuccugcccgccggug

SEQ ID NO: 281293 - RNA, 32 nt, Human
uuuucuccugcuccuucuccagccuuauugca

SEQ ID NO: 281294 - RNA, 32 nt, Human
uuuucuccugcucucccccaccgccguccccu

SEQ ID NO: 281295 - RNA, 19 nt, Human
uuuucuccugcugauugug

SEQ ID NO: 281296 - RNA, 18 nt, Human
uuuucuccugcugcugug

SEQ ID NO: 281297 - RNA, 32 nt, Human
uuuucuccuguggagcccuagagcagguuacu

SEQ ID NO: 281298 - RNA, 32 nt, Human
uuuucuccuuaccccuuccuuugaucauuuca

SEQ ID NO: 281299 - RNA, 32 nt, Human
uuuucuccuucucuuauuccauuuaguuuuuc

SEQ ID NO: 281300 - RNA, 32 nt, Human
uuuucuccuuugcccaaguucccagauucuca

SEQ ID NO: 281301 - RNA, 32 nt, Human
uuuucucgggcagccagcuagguagguggguu

SEQ ID NO: 281302 - RNA, 25 nt, Human
uuuucucgucccccucccugcccaa

SEQ ID NO: 281303 - RNA, 32 nt, Human
uuuucucuauucuuauuauucacugcacuaua

SEQ ID NO: 281304 - RNA, 32 nt, Human
uuuucucucagcaugucuccuccaccacggga

SEQ ID NO: 281305 - RNA, 32 nt, Human
uuuucucuccacccacucauucauucaagcug

SEQ ID NO: 281306 - RNA, 32 nt, Human
uuuucucuccacugccaaugacagccuuuccu

SEQ ID NO: 281307 - RNA, 32 nt, Human
uuuucucuccccuggccuuugcugaagcucuu

SEQ ID NO: 281308 - RNA, 32 nt, Human
uuuucucucccuguuuugcagcaacaaauugc

SEQ ID NO: 281309 - RNA, 32 nt, Human
uuuucucuccgccuccccgucuccuccucagg

SEQ ID NO: 281310 - RNA, 32 nt, Human
uuuucucuccucccaucuccuccucuucccuc

SEQ ID NO: 281311 - RNA, 32 nt, Human
uuuucucucucccccucaccauccccaaauuu

SEQ ID NO: 281312 - RNA, 32 nt, Human
uuuucucucuccccuuccacuuuuaaggauuu

SEQ ID NO: 281313 - RNA, 32 nt, Human
uuuucucucugagauauaccucaaucacacac

SEQ ID NO: 281314 - RNA, 32 nt, Human
uuuucucucugccuccuuugugucuguuuuaa

SEQ ID NO: 281315 - RNA, 32 nt, Human
uuuucucucugccuucuucucucugucucuug

SEQ ID NO: 281316 - RNA, 32 nt, Human
uuuucucugaaauaugucaaccccauguuccc

SEQ ID NO: 281317 - RNA, 32 nt, Human
uuuucucugaagcuucucagcugcuguuacau

SEQ ID NO: 281318 - RNA, 32 nt, Human
uuuucucugaauccucuucacuggccaaaggu

SEQ ID NO: 281319 - RNA, 32 nt, Human
uuuucucugaccaccugcagccuguugaagga

SEQ ID NO: 281320 - RNA, 32 nt, Human
uuuucucugagaugauaccaaaauuccuuuug

SEQ ID NO: 281321 - RNA, 32 nt, Human
uuuucucugagugccccucacuuacauguuua

SEQ ID NO: 281322 - RNA, 32 nt, Human
uuuucucugagugccuuuuucuccuuaaggag

SEQ ID NO: 281323 - RNA, 32 nt, Human
uuuucucugcaacccaagcugauguggagggc

SEQ ID NO: 281324 - RNA, 32 nt, Human
uuuucucugcagcuuauucuugccaugcuuag

SEQ ID NO: 281325 - RNA, 32 nt, Human
uuuucucugcuauacaaaguuccucuuagggg

SEQ ID NO: 281326 - RNA, 32 nt, Human
uuuucucugcuggcguuucugcugugcccagc

SEQ ID NO: 281327 - RNA, 32 nt, Human
uuuucucuggcacuccaguccagcuugggccu

SEQ ID NO: 281328 - RNA, 32 nt, Human
uuuucucugggaauguucugagcucucccgca

SEQ ID NO: 281329 - RNA, 32 nt, Human
uuuucucugggagguuaagguuaucuguccau

SEQ ID NO: 281330 - RNA, 32 nt, Human
uuuucucuggguacugcuggccagaggacuuu

SEQ ID NO: 281331 - RNA, 32 nt, Human
uuuucucuguauccucauccuuagccacacac

SEQ ID NO: 281332 - RNA, 32 nt, Human
uuuucucugugagccgcugccuccagggccau

SEQ ID NO: 281333 - RNA, 32 nt, Human
uuuucucuucuccaguaauaaacaauuaccuu

SEQ ID NO: 281334 - RNA, 32 nt, Human
uuuucucuucuuucugcucuuccuccacugcu

SEQ ID NO: 281335 - RNA, 32 nt, Human
uuuucucuugagacggagucucgcucuguugc

SEQ ID NO: 281336 - RNA, 32 nt, Human
uuuucucuugagauggagucuuacucugucgc

SEQ ID NO: 281337 - RNA, 23 nt, Human
uuuucucuuuauuuucaugcuuu

SEQ ID NO: 281338 - RNA, 32 nt, Human
uuuucucuuucuuccucccuuucuccuucucc

SEQ ID NO: 281339 - RNA, 22 nt, Human
uuuucucuuuugcuuucuguuu

SEQ ID NO: 281340 - RNA, 32 nt, Human
uuuucugaacuccauuuuggauuuugaaucaa

SEQ ID NO: 281341 - RNA, 32 nt, Human
uuuucugaagaaacccacccacugugaucaau

SEQ ID NO: 281342 - RNA, 32 nt, Human
uuuucugaagacaggugcuugaacuugucagu

SEQ ID NO: 281343 - RNA, 32 nt, Human
uuuucugaagacagucuuuuucaaguuucugu

SEQ ID NO: 281344 - RNA, 32 nt, Human
uuuucugaccaagccuuguggcaccagcaauc

SEQ ID NO: 281345 - RNA, 32 nt, Human
uuuucugacugaucacagcauacgugugaccc

SEQ ID NO: 281346 - RNA, 32 nt, Human
uuuucugacuggcccugaaguugucaguggcu

SEQ ID NO: 281347 - RNA, 32 nt, Human
uuuucugagaaacauggagcagcgcacgccca

SEQ ID NO: 281348 - RNA, 32 nt, Human
uuuucugagacaggggucucccucugucaccc

SEQ ID NO: 281349 - RNA, 32 nt, Human
uuuucugagacagggucuuacucugucgccca

SEQ ID NO: 281350 - RNA, 32 nt, Human
uuuucugagauggagucucacucugucaccca

SEQ ID NO: 281351 - RNA, 32 nt, Human
uuuucugagauggagucucacucugucuccca

SEQ ID NO: 281352 - RNA, 32 nt, Human
uuuucugagcugucagacauuuuguuauugau

SEQ ID NO: 281353 - RNA, 32 nt, Human
uuuucugaggaaccacagcaaugaauggcuuu

SEQ ID NO: 281354 - RNA, 32 nt, Human
uuuucugagguuuggucauagcuuagaaagga

SEQ ID NO: 281355 - RNA, 23 nt, Human
uuuucugaguuucuucugcccaa

SEQ ID NO: 281356 - RNA, 32 nt, Human
uuuucugcaaacccauccuccuuuccuaauuu

SEQ ID NO: 281357 - RNA, 32 nt, Human
uuuucugcacacacgagguauuuuauacuggu

SEQ ID NO: 281358 - RNA, 19 nt, Human
uuuucugcacccucuucgc

SEQ ID NO: 281359 - RNA, 32 nt, Human
uuuucugcagcugcucccagauuacuccuucc

SEQ ID NO: 281360 - RNA, 32 nt, Human
uuuucugcaugccuggaagugcacaugcucau

SEQ ID NO: 281361 - RNA, 32 nt, Human
uuuucugccaaacccccacauuucucggguuu

SEQ ID NO: 281362 - RNA, 32 nt, Human
uuuucugccacccaggcuggaguacaguggca

SEQ ID NO: 281363 - RNA, 32 nt, Human
uuuucugcccacacccucacucacacucaguc

SEQ ID NO: 281364 - RNA, 32 nt, Human
uuuucugccccagccaaaauaaucuugugcca

SEQ ID NO: 281365 - RNA, 32 nt, Human
uuuucugccugagauucuuuaaggagauagac

SEQ ID NO: 281366 - RNA, 21 nt, Human
uuuucugcgccccuccaccaa

SEQ ID NO: 281367 - RNA, 32 nt, Human
uuuucugcuaaaggagugacugugcauauaag

SEQ ID NO: 281368 - RNA, 32 nt, Human
uuuucugcuaucaccuuccucuugucagaaug

SEQ ID NO: 281369 - RNA, 32 nt, Human
uuuucugcuccugcuucucucucuucauuggg

SEQ ID NO: 281370 - RNA, 32 nt, Human
uuuucugcugacuugcucggaaacccauugga

SEQ ID NO: 281371 - RNA, 32 nt, Human
uuuucugcuguugaaagauguccgcuuauccu

SEQ ID NO: 281372 - RNA, 32 nt, Human
uuuucugcuucuguucuguucuugcaauaaca

SEQ ID NO: 281373 - RNA, 31 nt, Human
uuuucuggacaaugccagcauuuggauuuuu

SEQ ID NO: 281374 - RNA, 24 nt, Human
uuuucuggagaagacagagacaaa

SEQ ID NO: 281375 - RNA, 32 nt, Human
uuuucuggagagacagcauugauaaguggcac

SEQ ID NO: 281376 - RNA, 32 nt, Human
uuuucuggaucauagcuaugccaagccuugga

SEQ ID NO: 281377 - RNA, 32 nt, Human
uuuucuggcaaaaucucucuuguuuuaguggg

SEQ ID NO: 281378 - RNA, 32 nt, Human
uuuucuggccagcuuuuccaggauuuauaaaa

SEQ ID NO: 281379 - RNA, 32 nt, Human
uuuucuggcuguagucccuggggcauucauuu

SEQ ID NO: 281380 - RNA, 32 nt, Human
uuuucugggaaaggaaaaccagacacaguagg

SEQ ID NO: 281381 - RNA, 32 nt, Human
uuuucugggagaagaggcuacaaggacuuagu

SEQ ID NO: 281382 - RNA, 32 nt, Human
uuuucugggccaguuucccugccuuauuuuac

SEQ ID NO: 281383 - RNA, 32 nt, Human
uuuucuggggaaggcaggaggcagaaagacgg

SEQ ID NO: 281384 - RNA, 32 nt, Human
uuuucuggggauguuaacaugggauucaggcu

SEQ ID NO: 281385 - RNA, 32 nt, Human
uuuucuggucucuucucuugacaucagccccu

SEQ ID NO: 281386 - RNA, 32 nt, Human
uuuucugguggagggaggugguggaggaacau

SEQ ID NO: 281387 - RNA, 23 nt, Human
uuuucugguguuuccugugcuuu

SEQ ID NO: 281388 - RNA, 32 nt, Human
uuuucugguugacaguguuucacaagugcugu

SEQ ID NO: 281389 - RNA, 32 nt, Human
uuuucuguaccuuucuaaaccucucuucccuc

SEQ ID NO: 281390 - RNA, 32 nt, Human
uuuucuguagagguggagucuugcuguguugc

SEQ ID NO: 281391 - RNA, 32 nt, Human
uuuucuguagcucaaagguggagggaguuuau

SEQ ID NO: 281392 - RNA, 32 nt, Human
uuuucuguaggcaacagagcaggcuuuucacu

SEQ ID NO: 281393 - RNA, 32 nt, Human
uuuucuguauguccuucuguucugccuuccgc

SEQ ID NO: 281394 - RNA, 32 nt, Human
uuuucuguauguuuguuuuucucuccacccac

SEQ ID NO: 281395 - RNA, 32 nt, Human
uuuucugucaccaaccaaccacauagccuugg

SEQ ID NO: 281396 - RNA, 32 nt, Human
uuuucugucagcagacaaaaucagccuaacag

SEQ ID NO: 281397 - RNA, 32 nt, Human
uuuucugucuccucuaaccucuuuccuuacuc

SEQ ID NO: 281398 - RNA, 32 nt, Human
uuuucugucugaugucacagaucauuguugca

SEQ ID NO: 281399 - RNA, 32 nt, Human
uuuucugugaaauaugaugcuguaugugguug

SEQ ID NO: 281400 - RNA, 21 nt, Human
uuuucugugacaccucuacau

SEQ ID NO: 281401 - RNA, 32 nt, Human
uuuucugugcuccuuucuacacaugccuuaaa

SEQ ID NO: 281402 - RNA, 32 nt, Human
uuuucugugcuggcugugccucuagucgcagc

SEQ ID NO: 281403 - RNA, 32 nt, Human
uuuucuguggaggacugcagcauuuugggcau

SEQ ID NO: 281404 - RNA, 32 nt, Human
uuuucuguguguggugcuaauuuccauuguga

SEQ ID NO: 281405 - RNA, 32 nt, Human
uuuucuguguuuaugugucucagcuuucucca

SEQ ID NO: 281406 - RNA, 32 nt, Human
uuuucuguuagcaaucaugguuauuuuaaaaa

SEQ ID NO: 281407 - RNA, 32 nt, Human
uuuucuguucgguacaucuggaaaugaagugc

SEQ ID NO: 281408 - RNA, 32 nt, Human
uuuucuguucuggaugucagugcagugcacug

SEQ ID NO: 281409 - RNA, 32 nt, Human
uuuucuguuuggccuggcucuuaauuugcuuu

SEQ ID NO: 281410 - RNA, 32 nt, Human
uuuucuguuuguagcugaggccacaggagcug

SEQ ID NO: 281411 - RNA, 29 nt, Human
uuuucuuaaauaaagaagccugggacaca

SEQ ID NO: 281412 - RNA, 32 nt, Human
uuuucuuaagagaacuuaaagaacuggugauu

SEQ ID NO: 281413 - RNA, 32 nt, Human
uuuucuuaagccccagaaagccaaaaagaaca

SEQ ID NO: 281414 - RNA, 32 nt, Human
uuuucuuaaugccaguuuacaugggaaugcau

SEQ ID NO: 281415 - RNA, 32 nt, Human
uuuucuuaccagaaaggaauggagucuguuua

SEQ ID NO: 281416 - RNA, 32 nt, Human
uuuucuuacccacuccuagcugcuaaugucua

SEQ ID NO: 281417 - RNA, 32 nt, Human
uuuucuuacccuuuuggacauuucuuuguugc

SEQ ID NO: 281418 - RNA, 32 nt, Human
uuuucuuacugcaaccuucgccucccgaguuc

SEQ ID NO: 281419 - RNA, 32 nt, Human
uuuucuuagaagcagaguuggaaccacugagg

SEQ ID NO: 281420 - RNA, 32 nt, Human
uuuucuuagcauuuucuuuguaaagaacuaca

SEQ ID NO: 281421 - RNA, 32 nt, Human
uuuucuuaguguuugcccuggggguuacgacu

SEQ ID NO: 281422 - RNA, 21 nt, Human
uuuucuuaguucuucugcuuu

SEQ ID NO: 281423 - RNA, 32 nt, Human
uuuucuuauaguauuggaacuacuucuaauuu

SEQ ID NO: 281424 - RNA, 32 nt, Human
uuuucuuaucuucuccgagcucuagacuggcu

SEQ ID NO: 281425 - RNA, 32 nt, Human
uuuucuuauuaaaaauauaucuuuaguuaauc

SEQ ID NO: 281426 - RNA, 32 nt, Human
uuuucuuauucaccuugcuugugcuuaaacac

SEQ ID NO: 281427 - RNA, 32 nt, Human
uuuucuuauugcacugaauucaacuccagaca

SEQ ID NO: 281428 - RNA, 32 nt, Human
uuuucuucaaaugauuacuguguuagcaaaag

SEQ ID NO: 281429 - RNA, 27 nt, Human
uuuucuucaacauguaaccaaucagua

SEQ ID NO: 281430 - RNA, 32 nt, Human
uuuucuucaauacaaggggaaaauauucuugc

SEQ ID NO: 281431 - RNA, 32 nt, Human
uuuucuucaaugcuugaugcacuaaugaagac

SEQ ID NO: 281432 - RNA, 24 nt, Human
uuuucuucacuagaggcaucucag

SEQ ID NO: 281433 - RNA, 31 nt, Human
uuuucuucacucaaauuuuggcgaaucucaa

SEQ ID NO: 281434 - RNA, 32 nt, Human
uuuucuucagggcugaguuugggucuucauuu

SEQ ID NO: 281435 - RNA, 32 nt, Human
uuuucuucaggggauuucucucugauuucuuc

SEQ ID NO: 281436 - RNA, 32 nt, Human
uuuucuucauauuaucacaaucaugcccuucc

SEQ ID NO: 281437 - RNA, 32 nt, Human
uuuucuucaugccugcucuagucucaucucau

SEQ ID NO: 281438 - RNA, 20 nt, Human
uuuucuucaugguugagcag

SEQ ID NO: 281439 - RNA, 32 nt, Human
uuuucuuccccauuccuuccucccccucggua

SEQ ID NO: 281440 - RNA, 32 nt, Human
uuuucuuccccuucuucuuuccuuccucccuc

SEQ ID NO: 281441 - RNA, 32 nt, Human
uuuucuucccuucccuucccuucccuuuccuu

SEQ ID NO: 281442 - RNA, 21 nt, Human
uuuucuuccgccugaggcauc

SEQ ID NO: 281443 - RNA, 24 nt, Human
uuuucuuccguuggaaccacccag

SEQ ID NO: 281444 - RNA, 32 nt, Human
uuuucuuccucuucccccaaccuaacuucugc

SEQ ID NO: 281445 - RNA, 32 nt, Human
uuuucuuccucuucuccuugggccaguuaaua

SEQ ID NO: 281446 - RNA, 32 nt, Human
uuuucuuccucuugcuuuuguuaucuccucuu

SEQ ID NO: 281447 - RNA, 32 nt, Human
uuuucuuccucuuuaccucuuaaaacagcaga

SEQ ID NO: 281448 - RNA, 32 nt, Human
uuuucuuccucuuuaucuaacuauauuacacu

SEQ ID NO: 281449 - RNA, 32 nt, Human
uuuucuuccucuuuuauaaaauaacccgguga

SEQ ID NO: 281450 - RNA, 32 nt, Human
uuuucuuccuucccuaauuuuaaugguauacu

SEQ ID NO: 281451 - RNA, 32 nt, Human
uuuucuuccuuugggauguggaagcuacagaa

SEQ ID NO: 281452 - RNA, 32 nt, Human
uuuucuuccuuuugcuuuaauauacugaacac

SEQ ID NO: 281453 - RNA, 32 nt, Human
uuuucuucuacuucauguccagaagaguaaga

SEQ ID NO: 281454 - RNA, 20 nt, Human
uuuucuucuaugggugauag

SEQ ID NO: 281455 - RNA, 32 nt, Human
uuuucuucucacuagcauguggcuccaugagg

SEQ ID NO: 281456 - RNA, 32 nt, Human
uuuucuucuccuccuccuccuuccuuccuccu

SEQ ID NO: 281457 - RNA, 32 nt, Human
uuuucuucucuccuggccucuggaagcaucuu

SEQ ID NO: 281458 - RNA, 32 nt, Human
uuuucuucucugcuuucuucuuucugccccuc

SEQ ID NO: 281459 - RNA, 32 nt, Human
uuuucuucucugcuuugucuguguuuugaguc

SEQ ID NO: 281460 - RNA, 32 nt, Human
uuuucuucucuucuccuccuccucuuucuuca

SEQ ID NO: 281461 - RNA, 32 nt, Human
uuuucuucugcaagcuccauguuuucacaucu

SEQ ID NO: 281462 - RNA, 22 nt, Human
uuuucuucugccucaggcucca

SEQ ID NO: 281463 - RNA, 32 nt, Human
uuuucuucugccucucuguguggguacugugu

SEQ ID NO: 281464 - RNA, 26 nt, Human
uuuucuucugcuacuuuggggaguug

SEQ ID NO: 281465 - RNA, 32 nt, Human
uuuucuucuuaacccagucuuaggcugguauu

SEQ ID NO: 281466 - RNA, 22 nt, Human
uuuucuucuuuaagccucauca

SEQ ID NO: 281467 - RNA, 32 nt, Human
uuuucuucuuuagauugcaugcuauuguaugu

SEQ ID NO: 281468 - RNA, 23 nt, Human
uuuucuucuuuagcuugguugug

SEQ ID NO: 281469 - RNA, 32 nt, Human
uuuucuucuuuccugacuuugacauuguagcu

SEQ ID NO: 281470 - RNA, 21 nt, Human
uuuucuucuuuguauacagua

SEQ ID NO: 281471 - RNA, 32 nt, Human
uuuucuucuuuguuuggauugcagcauucugc

SEQ ID NO: 281472 - RNA, 32 nt, Human
uuuucuugagcagagggauggaacagagggug

SEQ ID NO: 281473 - RNA, 32 nt, Human
uuuucuugcccauuuucugcucgacucgcccc

SEQ ID NO: 281474 - RNA, 32 nt, Human
uuuucuugccccauacauaccuugaggcgagc

SEQ ID NO: 281475 - RNA, 32 nt, Human
uuuucuugccgucccuccccugccuccagaau

SEQ ID NO: 281476 - RNA, 31 nt, Human
uuuucuugcuggcugauacacuuguaaacac

SEQ ID NO: 281477 - RNA, 30 nt, Human
uuuucuugcuugcaauagaaaugcaaugug

SEQ ID NO: 281478 - RNA, 32 nt, Human
uuuucuuggccucaugauuucucccucaccaa

SEQ ID NO: 281479 - RNA, 32 nt, Human
uuuucuuguacuuuagccuggcugaacaugaa

SEQ ID NO: 281480 - RNA, 32 nt, Human
uuuucuuguagagacgggguuuugccauguug

SEQ ID NO: 281481 - RNA, 32 nt, Human
uuuucuugucuccauaauccucccuuucaagg

SEQ ID NO: 281482 - RNA, 32 nt, Human
uuuucuuguuuaucacacauacaaguaucuuu

SEQ ID NO: 281483 - RNA, 32 nt, Human
uuuucuuuaaggcagcaccuggaguggagaga

SEQ ID NO: 281484 - RNA, 32 nt, Human
uuuucuuuacaguggcacucaggcuggcccag

SEQ ID NO: 281485 - RNA, 32 nt, Human
uuuucuuuaccucauuuaugaugcagagacau

SEQ ID NO: 281486 - RNA, 32 nt, Human
uuuucuuuagcuucaucaguccuuccuuccua

SEQ ID NO: 281487 - RNA, 32 nt, Human
uuuucuuuaucucccuuccccuuccuaagucc

SEQ ID NO: 281488 - RNA, 22 nt, Human
uuuucuuuauguguuugacggg

SEQ ID NO: 281489 - RNA, 32 nt, Human
uuuucuuucacgugauucauccuuccucauug

SEQ ID NO: 281490 - RNA, 22 nt, Human
uuuucuuucacguuucugcuuu

SEQ ID NO: 281491 - RNA, 23 nt, Human
uuuucuuucagauauuguuuugu

SEQ ID NO: 281492 - RNA, 32 nt, Human
uuuucuuucaggaauaauaaagagcaugauuc

SEQ ID NO: 281493 - RNA, 32 nt, Human
uuuucuuucagguugaucuucuauuaaaauga

SEQ ID NO: 281494 - RNA, 24 nt, Human
uuuucuuucagucauugucuuagu

SEQ ID NO: 281495 - RNA, 32 nt, Human
uuuucuuucaugagggagucaauauguagugg

SEQ ID NO: 281496 - RNA, 32 nt, Human
uuuucuuucaugguccgagggagcugcccuuc

SEQ ID NO: 281497 - RNA, 32 nt, Human
uuuucuuuccauccccaugccauuggacaccg

SEQ ID NO: 281498 - RNA, 32 nt, Human
uuuucuuucccucaccaaaacccagccuugcc

SEQ ID NO: 281499 - RNA, 32 nt, Human
uuuucuuucccuucuuuuucccuuuccuuucc

SEQ ID NO: 281500 - RNA, 32 nt, Human
uuuucuuucccuuuccccuuuuucuuucccuu

SEQ ID NO: 281501 - RNA, 32 nt, Human
uuuucuuuccuaggacuuguuguuaaacgcca

SEQ ID NO: 281502 - RNA, 24 nt, Human
uuuucuuuccugcauuguuuuagu

SEQ ID NO: 281503 - RNA, 22 nt, Human
uuuucuuuccuggugggguagu

SEQ ID NO: 281504 - RNA, 22 nt, Human
uuuucuuuccugguuuucuggu

SEQ ID NO: 281505 - RNA, 32 nt, Human
uuuucuuuccuguaaagaaacauuuccuuuga

SEQ ID NO: 281506 - RNA, 24 nt, Human
uuuucuuuccuuuuauuuuuuagu

SEQ ID NO: 281507 - RNA, 23 nt, Human
uuuucuuuccuuuuguuguuggu

SEQ ID NO: 281508 - RNA, 24 nt, Human
uuuucuuuccuuuuuguuuuuggu

SEQ ID NO: 281509 - RNA, 23 nt, Human
uuuucuuucuaugggguugcagg

SEQ ID NO: 281510 - RNA, 32 nt, Human
uuuucuuucucuuccuccuuccucuuccuuac

SEQ ID NO: 281511 - RNA, 32 nt, Human
uuuucuuucuucuuccuucuuucuuccuuuuu

SEQ ID NO: 281512 - RNA, 32 nt, Human
uuuucuuucuucuucuucuacaacuggaacca

SEQ ID NO: 281513 - RNA, 32 nt, Human
uuuucuuucuuucagccugaauucuaagcaac

SEQ ID NO: 281514 - RNA, 32 nt, Human
uuuucuuugcaaugcuaucuaaccagaauaca

SEQ ID NO: 281515 - RNA, 32 nt, Human
uuuucuuugcagaugguacaaacucucccgag

SEQ ID NO: 281516 - RNA, 32 nt, Human
uuuucuuugcugggaggggcuggugaggcugc

SEQ ID NO: 281517 - RNA, 32 nt, Human
uuuucuuugcuguucuucauccucguuguugc

SEQ ID NO: 281518 - RNA, 32 nt, Human
uuuucuuuggacaacaggaagugaaccuuaag

SEQ ID NO: 281519 - RNA, 22 nt, Human
uuuucuuugguuaaaccaaaaa

SEQ ID NO: 281520 - RNA, 32 nt, Human
uuuucuuugguuucuucuguuuuccaacuaaa

SEQ ID NO: 281521 - RNA, 24 nt, Human
uuuucuuuguguuuggaucaaaaa

SEQ ID NO: 281522 - RNA, 32 nt, Human
uuuucuuuguuucauaggagucuuguguuaua

SEQ ID NO: 281523 - RNA, 32 nt, Human
uuuucuuuuaauagauggugucagaaguggga

SEQ ID NO: 281524 - RNA, 32 nt, Human
uuuucuuuucaugucuuugaucugguuuuauu

SEQ ID NO: 281525 - RNA, 25 nt, Human
uuuucuuuuccccagaauuacuuag

SEQ ID NO: 281526 - RNA, 32 nt, Human
uuuucuuuuccccuggggaagcuuugguugaa

SEQ ID NO: 281527 - RNA, 32 nt, Human
uuuucuuuuccugcccuuugagaguuuaauaa

SEQ ID NO: 281528 - RNA, 18 nt, Human
uuuucuuuucuguuuggu

SEQ ID NO: 281529 - RNA, 32 nt, Human
uuuucuuuucuuucuuucuucgacagagucuc

SEQ ID NO: 281530 - RNA, 32 nt, Human
uuuucuuuucuuucuuucuuucuuucuuucuu

SEQ ID NO: 281531 - RNA, 32 nt, Human
uuuucuuuucuuucuuuuuagauuucugacuu

SEQ ID NO: 281532 - RNA, 32 nt, Human
uuuucuuuugagacagagucucacucucgucg

SEQ ID NO: 281533 - RNA, 32 nt, Human
uuuucuuuugagacagaguuucgcucuuguug

SEQ ID NO: 281534 - RNA, 32 nt, Human
uuuucuuuugagacagaguuucgcuuugucgc

SEQ ID NO: 281535 - RNA, 32 nt, Human
uuuucuuuugagacagggucuugcucuugccc

SEQ ID NO: 281536 - RNA, 32 nt, Human
uuuucuuuugagacgaaaucucgcucuaucac

SEQ ID NO: 281537 - RNA, 32 nt, Human
uuuucuuuugagaugaaguuuuacucuuguug

SEQ ID NO: 281538 - RNA, 32 nt, Human
uuuucuuuugagaugggggucuugcucuguug

SEQ ID NO: 281539 - RNA, 32 nt, Human
uuuucuuuugcugggggcaccucccacggguc

SEQ ID NO: 281540 - RNA, 32 nt, Human
uuuucuuuuggggaaagggaaggaaaaauuau

SEQ ID NO: 281541 - RNA, 32 nt, Human
uuuucuuuuguugcuuaugcuuuugcugucac

SEQ ID NO: 281542 - RNA, 32 nt, Human
uuuucuuuuguuucucucucccccuuucucuc

SEQ ID NO: 281543 - RNA, 25 nt, Human
uuuucuuuuguuuuuugaaguguug

SEQ ID NO: 281544 - RNA, 21 nt, Human
uuuucuuuuguuuuuugcuuu

SEQ ID NO: 281545 - RNA, 32 nt, Human
uuuucuuuuuaaaucacuuauuucagagugca

SEQ ID NO: 281546 - RNA, 32 nt, Human
uuuucuuuuuaagagaagguguauuucacugg

SEQ ID NO: 281547 - RNA, 32 nt, Human
uuuucuuuuuacucccccucuuaagggggccu

SEQ ID NO: 281548 - RNA, 22 nt, Human
uuuucuuuuuauucuacuuggu

SEQ ID NO: 281549 - RNA, 32 nt, Human
uuuucuuuuuccugaaacuuugaaucacccua

SEQ ID NO: 281550 - RNA, 32 nt, Human
uuuucuuuuucuccuuuauaugacuuucucug

SEQ ID NO: 281551 - RNA, 22 nt, Human
uuuucuuuuucuuuuucuguuu

SEQ ID NO: 281552 - RNA, 23 nt, Human
uuuucuuuuucuuuuucuucuuu

SEQ ID NO: 281553 - RNA, 32 nt, Human
uuuucuuuuugaaaauguuuuucuuugcaguc

SEQ ID NO: 281554 - RNA, 24 nt, Human
uuuucuuuuuugagcaacuuaagu

SEQ ID NO: 281555 - RNA, 32 nt, Human
uuuugaaaaaggcuuaaugaagagaauguugu

SEQ ID NO: 281556 - RNA, 32 nt, Human
uuuugaaaagacagacuccucaaggagagaua

SEQ ID NO: 281557 - RNA, 32 nt, Human
uuuugaaaaggacaauguguguauaaauaaaa

SEQ ID NO: 281558 - RNA, 32 nt, Human
uuuugaaaaguggggagauggcuuuguguaga

SEQ ID NO: 281559 - RNA, 32 nt, Human
uuuugaaacagaaaccuuagaauaggucauug

SEQ ID NO: 281560 - RNA, 32 nt, Human
uuuugaaacugcacuaaauuuuucuuaacauu

SEQ ID NO: 281561 - RNA, 32 nt, Human
uuuugaaagcaaagcucuggcucacaggcccc

SEQ ID NO: 281562 - RNA, 32 nt, Human
uuuugaaaggaaucccugucaaaugguuuagu

SEQ ID NO: 281563 - RNA, 32 nt, Human
uuuugaaaggguuucagcugaagaauuucuuc

SEQ ID NO: 281564 - RNA, 32 nt, Human
uuuugaaaguccugcccugccuuccuccugcc

SEQ ID NO: 281565 - RNA, 32 nt, Human
uuuugaaaguccuguucacaugaguuccuaug

SEQ ID NO: 281566 - RNA, 32 nt, Human
uuuugaaaguggagaucgugguccccauggaa

SEQ ID NO: 281567 - RNA, 32 nt, Human
uuuugaaauauguaguaauaagacuuaucucu

SEQ ID NO: 281568 - RNA, 32 nt, Human
uuuugaacaagaaauguuguguccuaaugugu

SEQ ID NO: 281569 - RNA, 32 nt, Human
uuuugaacacguaaacaacacagacuucaagc

SEQ ID NO: 281570 - RNA, 28 nt, Human
uuuugaacaggauuaccuggagccugga

SEQ ID NO: 281571 - RNA, 32 nt, Human
uuuugaacccaggaggcagagguugcagcgag

SEQ ID NO: 281572 - RNA, 32 nt, Human
uuuugaacccaggaguucagggucauagcaug

SEQ ID NO: 281573 - RNA, 21 nt, Human
uuuugaacuguacaucucaca

SEQ ID NO: 281574 - RNA, 32 nt, Human
uuuugaagacucagggauagcuguaaugcuuu

SEQ ID NO: 281575 - RNA, 23 nt, Human
uuuugaagauacuuguggcugga

SEQ ID NO: 281576 - RNA, 32 nt, Human
uuuugaagcacuuucaccucuggcccaggaga

SEQ ID NO: 281577 - RNA, 32 nt, Human
uuuugaagcugccuggcccccagggcgcuuga

SEQ ID NO: 281578 - RNA, 32 nt, Human
uuuugaagcuguuggugcuugcuuuacaucgc

SEQ ID NO: 281579 - RNA, 32 nt, Human
uuuugaaggaagacuuauuaacaacaguaauu

SEQ ID NO: 281580 - RNA, 32 nt, Human
uuuugaaggaagcacaauuuccaccuuauuuu

SEQ ID NO: 281581 - RNA, 32 nt, Human
uuuugaagggagaagacacugcagugaccacu

SEQ ID NO: 281582 - RNA, 32 nt, Human
uuuugaagguagcuauacuagcacuuuugauc

SEQ ID NO: 281583 - RNA, 31 nt, Human
uuuugaagucguauuauucacuuguaaaaau

SEQ ID NO: 281584 - RNA, 32 nt, Human
uuuugaagugugcagggcagccuggacacaag

SEQ ID NO: 281585 - RNA, 32 nt, Human
uuuugaaguuuucauaauaaaaaguuaggagg

SEQ ID NO: 281586 - RNA, 32 nt, Human
uuuugaaucuucauuuugcaugaguggcaaau

SEQ ID NO: 281587 - RNA, 22 nt, Human
uuuugaaugagaaagaggcaug

SEQ ID NO: 281588 - RNA, 32 nt, Human
uuuugaauguacaaagacccacacuauugaga

SEQ ID NO: 281589 - RNA, 32 nt, Human
uuuugaauguuuucucagagcuggagguugcu

SEQ ID NO: 281590 - RNA, 32 nt, Human
uuuugaauuggcuucuuucacuuagcaaugug

SEQ ID NO: 281591 - RNA, 32 nt, Human
uuuugaauuucguauucuuucauuccacugug

SEQ ID NO: 281592 - RNA, 32 nt, Human
uuuugacaacgaagacgaaaaugaguaagugu

SEQ ID NO: 281593 - RNA, 32 nt, Human
uuuugacacaucagugcugcaucuacuuuucu

SEQ ID NO: 281594 - RNA, 32 nt, Human
uuuugacaccucaauauucacacccauaaaca

SEQ ID NO: 281595 - RNA, 32 nt, Human
uuuugacacucccaagaccauucagggaaauu

SEQ ID NO: 281596 - RNA, 32 nt, Human
uuuugacagaguggcuggaggaaaaguggcaa

SEQ ID NO: 281597 - RNA, 32 nt, Human
uuuugacagauggcgggacggaaaugcaauag

SEQ ID NO: 281598 - RNA, 30 nt, Human
uuuugacaguuguagucagaaagcagaauu

SEQ ID NO: 281599 - RNA, 32 nt, Human
uuuugacauacagcuaaaagggacuaaauuug

SEQ ID NO: 281600 - RNA, 32 nt, Human
uuuugacauccagcaguccaagguauugagac

SEQ ID NO: 281601 - RNA, 32 nt, Human
uuuugacaucugugcuuguccaacacagggcu

SEQ ID NO: 281602 - RNA, 32 nt, Human
uuuugaccaugcuucuacacuggcucuguggc

SEQ ID NO: 281603 - RNA, 32 nt, Human
uuuugaccauuuuguuaugaggaauuauacau

SEQ ID NO: 281604 - RNA, 32 nt, Human
uuuugaccugagauguuugggaagagagugag

SEQ ID NO: 281605 - RNA, 32 nt, Human
uuuugaccugcaggcagugcucucuaacagga

SEQ ID NO: 281606 - RNA, 25 nt, Human
uuuugaccuggaguggaucuauuua

SEQ ID NO: 281607 - RNA, 32 nt, Human
uuuugacgcuggaagggcagauuuccugucug

SEQ ID NO: 281608 - RNA, 32 nt, Human
uuuugacucacugcaaccuccgccuccugggu

SEQ ID NO: 281609 - RNA, 32 nt, Human
uuuugacuccuggccuuucucuaggguuggga

SEQ ID NO: 281610 - RNA, 32 nt, Human
uuuugacugcaacucaucacaugaggucaggu

SEQ ID NO: 281611 - RNA, 32 nt, Human
uuuugacuguaaccacuuuccugagugcucuu

SEQ ID NO: 281612 - RNA, 22 nt, Human
uuuugacuucagauugaacuua

SEQ ID NO: 281613 - RNA, 32 nt, Human
uuuugacuugacuugaauugcuugauacuuug

SEQ ID NO: 281614 - RNA, 32 nt, Human
uuuugacuuggcuauugauauucauucuacuu

SEQ ID NO: 281615 - RNA, 32 nt, Human
uuuugagaaacacaggcuucuaugauuucagu

SEQ ID NO: 281616 - RNA, 32 nt, Human
uuuugagaaagccaacuaguguggaagcuugc

SEQ ID NO: 281617 - RNA, 32 nt, Human
uuuugagaacacaaacuuuucccccacggacc

SEQ ID NO: 281618 - RNA, 32 nt, Human
uuuugagaaccagauuugagagagggaccugg

SEQ ID NO: 281619 - RNA, 32 nt, Human
uuuugagaagcagugguuggggcauuuuuaag

SEQ ID NO: 281620 - RNA, 32 nt, Human
uuuugagacaaagucucacugugucaugcagg

SEQ ID NO: 281621 - RNA, 32 nt, Human
uuuugagacagaauuucacucuucucacccag

SEQ ID NO: 281622 - RNA, 32 nt, Human
uuuugagacagagccacauuauaaucuauuac

SEQ ID NO: 281623 - RNA, 32 nt, Human
uuuugagacagaguuuugcucuugccguccag

SEQ ID NO: 281624 - RNA, 32 nt, Human
uuuugagacaggcucucccuaugucaccgagg

SEQ ID NO: 281625 - RNA, 23 nt, Human
uuuugagacagggccucacucug

SEQ ID NO: 281626 - RNA, 32 nt, Human
uuuugagacaguuucgcucuguugcccaggcu

SEQ ID NO: 281627 - RNA, 32 nt, Human
uuuugagaccacacagcuguuuucuugguacc

SEQ ID NO: 281628 - RNA, 32 nt, Human
uuuugagaccagccugaccaacauggugaaac

SEQ ID NO: 281629 - RNA, 32 nt, Human
uuuugagaccagccuggccaacaugguaaaau

SEQ ID NO: 281630 - RNA, 32 nt, Human
uuuugagaccagccuggccaacauggugaaac

SEQ ID NO: 281631 - RNA, 32 nt, Human
uuuugagaccagccugggaaacaucugccucu

SEQ ID NO: 281632 - RNA, 32 nt, Human
uuuugagaccagccugggcaacaucaggagau

SEQ ID NO: 281633 - RNA, 32 nt, Human
uuuugagaccuagggcuggagugcaguugagc

SEQ ID NO: 281634 - RNA, 32 nt, Human
uuuugagacggagacucacucuguugcccaga

SEQ ID NO: 281635 - RNA, 32 nt, Human
uuuugagacggaguccagccugggcaacagag

SEQ ID NO: 281636 - RNA, 32 nt, Human
uuuugagacggagucucaacucuugucgccca

SEQ ID NO: 281637 - RNA, 32 nt, Human
uuuugagacucgcucugucucccaggcugaag

SEQ ID NO: 281638 - RNA, 32 nt, Human
uuuugagagacacuguucugcuccaugcaggg

SEQ ID NO: 281639 - RNA, 32 nt, Human
uuuugagagagacagcagggaggagguagaga

SEQ ID NO: 281640 - RNA, 32 nt, Human
uuuugagagcucuucagagaucauaagaacuu

SEQ ID NO: 281641 - RNA, 31 nt, Human
uuuugagaggagagagagcugagacuguugg

SEQ ID NO: 281642 - RNA, 32 nt, Human
uuuugagaggcuaacucucccaaaaaggacca

SEQ ID NO: 281643 - RNA, 32 nt, Human
uuuugagaggcugaaguagauguuucagcuga

SEQ ID NO: 281644 - RNA, 32 nt, Human
uuuugagaggcugaggcggguggaucaccuga

SEQ ID NO: 281645 - RNA, 32 nt, Human
uuuugagaggcugaggcggguggaucacuuga

SEQ ID NO: 281646 - RNA, 32 nt, Human
uuuugagaggcugagguggguggaucacuuga

SEQ ID NO: 281647 - RNA, 32 nt, Human
uuuugagaguaugaaagaaauuuuaaugccac

SEQ ID NO: 281648 - RNA, 32 nt, Human
uuuugagauaauuucacucuuguugcccaggc

SEQ ID NO: 281649 - RNA, 32 nt, Human
uuuugagauacagaggcaaaggcgcuagggaa

SEQ ID NO: 281650 - RNA, 22 nt, Human
uuuugagauagaaaguagacau

SEQ ID NO: 281651 - RNA, 32 nt, Human
uuuugagaucagccugggcaacauggugaaac

SEQ ID NO: 281652 - RNA, 20 nt, Human
uuuugagauccacacacaau

SEQ ID NO: 281653 - RNA, 32 nt, Human
uuuugagauggaaucucacucuguugcccagg

SEQ ID NO: 281654 - RNA, 32 nt, Human
uuuugagauggaaucucucucuguugcccagg

SEQ ID NO: 281655 - RNA, 32 nt, Human
uuuugagauggagacucacucuguugcccagg

SEQ ID NO: 281656 - RNA, 32 nt, Human
uuuugagauggaguccagccugggugacagag

SEQ ID NO: 281657 - RNA, 32 nt, Human
uuuugagauggagucucuacuaaaaauacaaa

SEQ ID NO: 281658 - RNA, 32 nt, Human
uuuugagauggggacucacucuguugcccagg

SEQ ID NO: 281659 - RNA, 32 nt, Human
uuuugagauguugagaggaacaagaaggugga

SEQ ID NO: 281660 - RNA, 32 nt, Human
uuuugagcaaaccacauaaucucucuaggucc

SEQ ID NO: 281661 - RNA, 32 nt, Human
uuuugagcaacugagucaucucaaguccugag

SEQ ID NO: 281662 - RNA, 31 nt, Human
uuuugagcacuuuucccguguagacucaaca

SEQ ID NO: 281663 - RNA, 32 nt, Human
uuuugagcagaggacccuccaacuuauggcau

SEQ ID NO: 281664 - RNA, 32 nt, Human
uuuugagcagcacaguccaauucuuuaacuaa

SEQ ID NO: 281665 - RNA, 32 nt, Human
uuuugagcagccucggguuucccaccaccucc

SEQ ID NO: 281666 - RNA, 32 nt, Human
uuuugagcauuuuguuacaugucauucacaac

SEQ ID NO: 281667 - RNA, 23 nt, Human
uuuugagccagggccucacucug

SEQ ID NO: 281668 - RNA, 32 nt, Human
uuuugagcccaggaauuugaggcugcagcgag

SEQ ID NO: 281669 - RNA, 32 nt, Human
uuuugagcccaggaggucgaggcugcaguggg

SEQ ID NO: 281670 - RNA, 32 nt, Human
uuuugagccugccuaaaggccagauccuauca

SEQ ID NO: 281671 - RNA, 32 nt, Human
uuuugagccuugccucaggccuggugaguggg

SEQ ID NO: 281672 - RNA, 31 nt, Human
uuuugagcgagggaagaaaaagcuguaugca

SEQ ID NO: 281673 - RNA, 32 nt, Human
uuuugagcuggagaaggacuauggcuguuccu

SEQ ID NO: 281674 - RNA, 32 nt, Human
uuuugagcuguugcugagucuggcuuuuguga

SEQ ID NO: 281675 - RNA, 32 nt, Human
uuuugagcuucucaaaagucuagagccaccgu

SEQ ID NO: 281676 - RNA, 32 nt, Human
uuuugagcuuucuauaagcuauagcuuuguuu

SEQ ID NO: 281677 - RNA, 32 nt, Human
uuuugaggaauguuguuaaaaaugucuuuagg

SEQ ID NO: 281678 - RNA, 32 nt, Human
uuuugaggagcuuuuccuaaaaggauuguaca

SEQ ID NO: 281679 - RNA, 32 nt, Human
uuuugaggaguuucccucugucacacaagcug

SEQ ID NO: 281680 - RNA, 32 nt, Human
uuuugaggcaaugucucacuguuauccaggcu

SEQ ID NO: 281681 - RNA, 32 nt, Human
uuuugaggccaguagcaacauccagagaucau

SEQ ID NO: 281682 - RNA, 32 nt, Human
uuuugaggcugacuggggagaaagcugccugg

SEQ ID NO: 281683 - RNA, 21 nt, Human
uuuugaggcugggugcagugg

SEQ ID NO: 281684 - RNA, 32 nt, Human
uuuugagggacauacugaagccagauaaccca

SEQ ID NO: 281685 - RNA, 32 nt, Human
uuuugaggggagggaaaggugagguuaggggu

SEQ ID NO: 281686 - RNA, 32 nt, Human
uuuugaggggcaccugguccucgguuggggcu

SEQ ID NO: 281687 - RNA, 32 nt, Human
uuuugagggugaggacaaggguuguggggagg

SEQ ID NO: 281688 - RNA, 32 nt, Human
uuuugagggugagggacagcacagcagaggug

SEQ ID NO: 281689 - RNA, 32 nt, Human
uuuugaggguuauuggaaaacagagcagugac

SEQ ID NO: 281690 - RNA, 32 nt, Human
uuuugaggguuucacugucagugagagucuca

SEQ ID NO: 281691 - RNA, 32 nt, Human
uuuugaggugugcugggaugaaaggcacccug

SEQ ID NO: 281692 - RNA, 32 nt, Human
uuuugagguuucaaacuuuccuucuggagaau

SEQ ID NO: 281693 - RNA, 32 nt, Human
uuuugaguacggcuauagccuggacuuuccug

SEQ ID NO: 281694 - RNA, 32 nt, Human
uuuugagucucaaccaacuagcagaaacuuug

SEQ ID NO: 281695 - RNA, 32 nt, Human
uuuugagucuccacuuuuacucacugucucug

SEQ ID NO: 281696 - RNA, 21 nt, Human
uuuugagucugccuccuagga

SEQ ID NO: 281697 - RNA, 32 nt, Human
uuuugagugagguauauacucaucucacaagu

SEQ ID NO: 281698 - RNA, 32 nt, Human
uuuugaguucuccaaaucuaaacaagauuuug

SEQ ID NO: 281699 - RNA, 20 nt, Human
uuuugaguuuaaaaccuggg

SEQ ID NO: 281700 - RNA, 32 nt, Human
uuuugaguuugaaaucucucccagaagacaaa

SEQ ID NO: 281701 - RNA, 25 nt, Human
uuuugaguuuggggguguacuuugc

SEQ ID NO: 281702 - RNA, 32 nt, Human
uuuugauaacauguuguucuguuuuguaaagu

SEQ ID NO: 281703 - RNA, 32 nt, Human
uuuugauacaucuugacacauauauacaccca

SEQ ID NO: 281704 - RNA, 32 nt, Human
uuuugauacauggauuuuacagugcaugcagg

SEQ ID NO: 281705 - RNA, 32 nt, Human
uuuugauaggaagugaguguuuuggguuguuu

SEQ ID NO: 281706 - RNA, 32 nt, Human
uuuugauaggguggucaggacaagaggaagca

SEQ ID NO: 281707 - RNA, 32 nt, Human
uuuugauaguaaaauuaauagccauaaagucc

SEQ ID NO: 281708 - RNA, 32 nt, Human
uuuugauauuaaaaagaacagagauggggucu

SEQ ID NO: 281709 - RNA, 32 nt, Human
uuuugauauuucuagcuuaucuacuuccaaac

SEQ ID NO: 281710 - RNA, 32 nt, Human
uuuugaucaauguuuguagauuucaagguaca

SEQ ID NO: 281711 - RNA, 32 nt, Human
uuuugaucauuucccaagauacuuucccaaaa

SEQ ID NO: 281712 - RNA, 24 nt, Human
uuuugauccaagcugguccacuca

SEQ ID NO: 281713 - RNA, 32 nt, Human
uuuugaucuccucuucuuggucagaacugcuc

SEQ ID NO: 281714 - RNA, 32 nt, Human
uuuugaucuugaccuccuggagcauuuucaug

SEQ ID NO: 281715 - RNA, 32 nt, Human
uuuugaugcaaaaggaaaauaugcugaauagu

SEQ ID NO: 281716 - RNA, 32 nt, Human
uuuugaugccaggugcaaucuacuggaaaugu

SEQ ID NO: 281717 - RNA, 32 nt, Human
uuuugaugccauauuuucaguguuacacuuuu

SEQ ID NO: 281718 - RNA, 32 nt, Human
uuuugaugcccuugaauagccugaagaugaag

SEQ ID NO: 281719 - RNA, 32 nt, Human
uuuugauggaguuucacuauuuugcccaggcu

SEQ ID NO: 281720 - RNA, 32 nt, Human
uuuugauggaguuuccucucauagugauuugc

SEQ ID NO: 281721 - RNA, 32 nt, Human
uuuugauggaguuucgcuguuguugcccaggc

SEQ ID NO: 281722 - RNA, 32 nt, Human
uuuugaugggagaaagcuggagaucugaaccc

SEQ ID NO: 281723 - RNA, 32 nt, Human
uuuugaugggagggaaagaguacugaaauguu

SEQ ID NO: 281724 - RNA, 32 nt, Human
uuuugauggugucugugacauuuccuguugug

SEQ ID NO: 281725 - RNA, 32 nt, Human
uuuugauuaagccuguuuguguugguuuucug

SEQ ID NO: 281726 - RNA, 32 nt, Human
uuuugauucaacaacaggagaauucuacuguu

SEQ ID NO: 281727 - RNA, 22 nt, Human
uuuugauucugaaaaacucugc

SEQ ID NO: 281728 - RNA, 32 nt, Human
uuuugauucugggcugaguuauuacaauuaug

SEQ ID NO: 281729 - RNA, 32 nt, Human
uuuugauuggaaggcugguugcugggacugua

SEQ ID NO: 281730 - RNA, 23 nt, Human
uuuugauugucacugaccacuca

SEQ ID NO: 281731 - RNA, 32 nt, Human
uuuugauuucccaacagagauacuucuggucu

SEQ ID NO: 281732 - RNA, 32 nt, Human
uuuugauuugguggaugugaugguugguuuua

SEQ ID NO: 281733 - RNA, 32 nt, Human
uuuugauuugugaacauacugccuuauuuaaa

SEQ ID NO: 281734 - RNA, 32 nt, Human
uuuugauuuuucuauuuccuccuaaagaaagu

SEQ ID NO: 281735 - RNA, 32 nt, Human
uuuugcaaaaggacucuaauaccuguuuaaua

SEQ ID NO: 281736 - RNA, 24 nt, Human
uuuugcaaauggccccuugcccca

SEQ ID NO: 281737 - RNA, 32 nt, Human
uuuugcaaauguuggacgguuucguuuggugg

SEQ ID NO: 281738 - RNA, 32 nt, Human
uuuugcaacugcacuccagccugggcuacaga

SEQ ID NO: 281739 - RNA, 32 nt, Human
uuuugcaaggcuuuuuguccagcuggggcugg

SEQ ID NO: 281740 - RNA, 32 nt, Human
uuuugcaaguagcuuuccagaaguaaaagucc

SEQ ID NO: 281741 - RNA, 31 nt, Human
uuuugcaauggccucccuugcugcagcaaau

SEQ ID NO: 281742 - RNA, 32 nt, Human
uuuugcacaagacagguugcugaggggucggc

SEQ ID NO: 281743 - RNA, 32 nt, Human
uuuugcacauuaaaaugcccuagcaguaucua

SEQ ID NO: 281744 - RNA, 23 nt, Human
uuuugcaccaauaaaacugugua

SEQ ID NO: 281745 - RNA, 32 nt, Human
uuuugcacucagcauuaagaggaaauauugaa

SEQ ID NO: 281746 - RNA, 32 nt, Human
uuuugcacuccucugcuuucucccugccuuga

SEQ ID NO: 281747 - RNA, 32 nt, Human
uuuugcacuuaucucgaauuugaagagauugc

SEQ ID NO: 281748 - RNA, 32 nt, Human
uuuugcagaccagccaauuaagaauugggagc

SEQ ID NO: 281749 - RNA, 32 nt, Human
uuuugcagagaaacguguacccauauauaauu

SEQ ID NO: 281750 - RNA, 32 nt, Human
uuuugcagagaugcagguauugucauguugcc

SEQ ID NO: 281751 - RNA, 32 nt, Human
uuuugcagagccgccuccaugugguuucggag

SEQ ID NO: 281752 - RNA, 32 nt, Human
uuuugcagaugaaguauguauguauguuacua

SEQ ID NO: 281753 - RNA, 22 nt, Human
uuuugcagaugagaaaacagac

SEQ ID NO: 281754 - RNA, 32 nt, Human
uuuugcagcccagagcagaacagggaaaaggu

SEQ ID NO: 281755 - RNA, 32 nt, Human
uuuugcagcccaggcuggagugcaguggcacc

SEQ ID NO: 281756 - RNA, 32 nt, Human
uuuugcagccuauaugacuugagauuggagcu

SEQ ID NO: 281757 - RNA, 32 nt, Human
uuuugcagccuauuuuuguauucuuaauuugg

SEQ ID NO: 281758 - RNA, 32 nt, Human
uuuugcagcgcuucaguguacguguuagagaa

SEQ ID NO: 281759 - RNA, 32 nt, Human
uuuugcaggauccggggguggggagggacaag

SEQ ID NO: 281760 - RNA, 32 nt, Human
uuuugcaggaucuggggguggggagggacaag

SEQ ID NO: 281761 - RNA, 32 nt, Human
uuuugcaggcgggccuggggucucaguggagg

SEQ ID NO: 281762 - RNA, 32 nt, Human
uuuugcagggagcauggcugugaggauggggu

SEQ ID NO: 281763 - RNA, 32 nt, Human
uuuugcaggggguggggguuggggaagacagc

SEQ ID NO: 281764 - RNA, 32 nt, Human
uuuugcaggugaggaaacaggggcagaguaau

SEQ ID NO: 281765 - RNA, 32 nt, Human
uuuugcaguguuuugcagugaugggcauucca

SEQ ID NO: 281766 - RNA, 32 nt, Human
uuuugcauaauguguuuccauuuucuguuuaa

SEQ ID NO: 281767 - RNA, 32 nt, Human
uuuugcaucccccgccccugcuauugcugcca

SEQ ID NO: 281768 - RNA, 32 nt, Human
uuuugcaucccucucucuuccuuuuccugccg

SEQ ID NO: 281769 - RNA, 32 nt, Human
uuuugcauccuucuguauccccaaaucugaaa

SEQ ID NO: 281770 - RNA, 32 nt, Human
uuuugcaugaaauuguaucucagucuaagguc

SEQ ID NO: 281771 - RNA, 23 nt, Human
uuuugcauguuuaauaauaugua

SEQ ID NO: 281772 - RNA, 32 nt, Human
uuuugcauuacuguaugucuucugccuccaca

SEQ ID NO: 281773 - RNA, 32 nt, Human
uuuugcauuuuuaguaaugacaggguuucacc

SEQ ID NO: 281774 - RNA, 32 nt, Human
uuuugccaacacagcagcuucccugcuauaua

SEQ ID NO: 281775 - RNA, 32 nt, Human
uuuugccaacugaagccuucuucugccacuuc

SEQ ID NO: 281776 - RNA, 32 nt, Human
uuuugccaagccuccuccaucucccaucagug

SEQ ID NO: 281777 - RNA, 32 nt, Human
uuuugccaccaugggaaaccugggacaucuga

SEQ ID NO: 281778 - RNA, 32 nt, Human
uuuugccaccuagagagagguggacucuaacc

SEQ ID NO: 281779 - RNA, 32 nt, Human
uuuugccaccugcucaccccacugccuguccu

SEQ ID NO: 281780 - RNA, 32 nt, Human
uuuugccaccugcucaccccacugccuguucu

SEQ ID NO: 281781 - RNA, 32 nt, Human
uuuugccacugcacuccugccugggugacaga

SEQ ID NO: 281782 - RNA, 31 nt, Human
uuuugccagagagauauucggaggaggggug

SEQ ID NO: 281783 - RNA, 32 nt, Human
uuuugccagcacuuuuucaguugggagaauca

SEQ ID NO: 281784 - RNA, 32 nt, Human
uuuugccagccugaacuauauuuaagagacuu

SEQ ID NO: 281785 - RNA, 32 nt, Human
uuuugccaggacuccaaagagccuugcuaaag

SEQ ID NO: 281786 - RNA, 32 nt, Human
uuuugccauagauuuccauauaacugaaaaac

SEQ ID NO: 281787 - RNA, 32 nt, Human
uuuugccauuguccccugaauguaguauuauc

SEQ ID NO: 281788 - RNA, 32 nt, Human
uuuugcccacaacagguacauucuuucugugg

SEQ ID NO: 281789 - RNA, 32 nt, Human
uuuugcccaggcuggauggagugcaguggcgu

SEQ ID NO: 281790 - RNA, 32 nt, Human
uuuugcccaguuuccuuaucacuugcuguaga

SEQ ID NO: 281791 - RNA, 20 nt, Human
uuuugcccauucaucccucu

SEQ ID NO: 281792 - RNA, 32 nt, Human
uuuugcccauucaucccucuucuuuucaagga

SEQ ID NO: 281793 - RNA, 32 nt, Human
uuuugccgcugcuuccucuaccccuguauuuc

SEQ ID NO: 281794 - RNA, 32 nt, Human
uuuugccuaucacucuggacuuuuggauuguu

SEQ ID NO: 281795 - RNA, 32 nt, Human
uuuugccucauggugggagugaaagugagaac

SEQ ID NO: 281796 - RNA, 32 nt, Human
uuuugccuccuggaguucagcaggugaggcug

SEQ ID NO: 281797 - RNA, 32 nt, Human
uuuugccucuccaaaaagagcuuccuuucgug

SEQ ID NO: 281798 - RNA, 32 nt, Human
uuuugccucucucacuggucauguauuuauuc

SEQ ID NO: 281799 - RNA, 22 nt, Human
uuuugccucuuugccauuuccu

SEQ ID NO: 281800 - RNA, 32 nt, Human
uuuugccugcuagcaucucccuguaacucucc

SEQ ID NO: 281801 - RNA, 32 nt, Human
uuuugccuguaaucccaacacuuugggaggac

SEQ ID NO: 281802 - RNA, 32 nt, Human
uuuugccugugcauaggagcaauuaggaucua

SEQ ID NO: 281803 - RNA, 32 nt, Human
uuuugccuguugugugggaccugcacugcccu

SEQ ID NO: 281804 - RNA, 32 nt, Human
uuuugccuguuguuggccucuaccucacagug

SEQ ID NO: 281805 - RNA, 32 nt, Human
uuuugccuuaauaccaggugauggguugguag

SEQ ID NO: 281806 - RNA, 32 nt, Human
uuuugccuucuguccuuggaacagucauaucu

SEQ ID NO: 281807 - RNA, 32 nt, Human
uuuugcgccacagcaggcugccucuugguccu

SEQ ID NO: 281808 - RNA, 32 nt, Human
uuuugcggcaggcagagacaauggaagaaaau

SEQ ID NO: 281809 - RNA, 32 nt, Human
uuuugcggccucccccuuuccucucuguuaca

SEQ ID NO: 281810 - RNA, 32 nt, Human
uuuugcggcugcagcgggcuuguagguguccg

SEQ ID NO: 281811 - RNA, 32 nt, Human
uuuugcgguuugggagggaggcugcgaggagg

SEQ ID NO: 281812 - RNA, 32 nt, Human
uuuugcgugaguguguuauauguaugugucaa

SEQ ID NO: 281813 - RNA, 32 nt, Human
uuuugcuaaacaguaggcuacuguaaguguuc

SEQ ID NO: 281814 - RNA, 32 nt, Human
uuuugcuaaauacuuuauacauuuuucauguu

SEQ ID NO: 281815 - RNA, 32 nt, Human
uuuugcuaauguuccagcaacacugcuauuau

SEQ ID NO: 281816 - RNA, 32 nt, Human
uuuugcuaauuuaaaaucaucaggcuggaaga

SEQ ID NO: 281817 - RNA, 32 nt, Human
uuuugcuacaaagaggagguggcaaugguaga

SEQ ID NO: 281818 - RNA, 32 nt, Human
uuuugcuacaguuuagacacugugguuuacaa

SEQ ID NO: 281819 - RNA, 32 nt, Human
uuuugcuacauuuuucuuuuagguaaugauaa

SEQ ID NO: 281820 - RNA, 32 nt, Human
uuuugcuagaaagcucacaacuuuaaaaccua

SEQ ID NO: 281821 - RNA, 31 nt, Human
uuuugcucaauaaaauuguucagaagaucaa

SEQ ID NO: 281822 - RNA, 32 nt, Human
uuuugcucagccagccagaaggagggaggcca

SEQ ID NO: 281823 - RNA, 32 nt, Human
uuuugcucaggucacgccaacagggaaaccuc

SEQ ID NO: 281824 - RNA, 32 nt, Human
uuuugcucaguaggagucuugauagaagauau

SEQ ID NO: 281825 - RNA, 32 nt, Human
uuuugcuccuccugaagugucuuugguccaac

SEQ ID NO: 281826 - RNA, 32 nt, Human
uuuugcuccuguuccuccuuuucucuagcugg

SEQ ID NO: 281827 - RNA, 32 nt, Human
uuuugcucggagacauccugaccugggcaagc

SEQ ID NO: 281828 - RNA, 32 nt, Human
uuuugcucgucacccaggcuggagugcaauug

SEQ ID NO: 281829 - RNA, 32 nt, Human
uuuugcucuauucaaagaaacggaaugggaua

SEQ ID NO: 281830 - RNA, 32 nt, Human
uuuugcucucuacaaauggauagaaaaguuua

SEQ ID NO: 281831 - RNA, 32 nt, Human
uuuugcucugcuuuggaagauuuucucgaauu

SEQ ID NO: 281832 - RNA, 32 nt, Human
uuuugcucuugcacuccauccuggacaacaga

SEQ ID NO: 281833 - RNA, 32 nt, Human
uuuugcucuuuucuccccuugagacccuaaua

SEQ ID NO: 281834 - RNA, 32 nt, Human
uuuugcucuuuucuuaugaauuuccuuucuuc

SEQ ID NO: 281835 - RNA, 32 nt, Human
uuuugcucuuuugaacacccuccccacugauc

SEQ ID NO: 281836 - RNA, 32 nt, Human
uuuugcugcacuccuagaccuggccuacuggu

SEQ ID NO: 281837 - RNA, 32 nt, Human
uuuugcugccagcccccaaaaagcaggcgaua

SEQ ID NO: 281838 - RNA, 32 nt, Human
uuuugcugcgccauggagacaggugugcgcau

SEQ ID NO: 281839 - RNA, 32 nt, Human
uuuugcugcuguggccccaacccuuccucccu

SEQ ID NO: 281840 - RNA, 32 nt, Human
uuuugcugcuucucaauaucauagacacagug

SEQ ID NO: 281841 - RNA, 32 nt, Human
uuuugcuggagccgccaccaugacaaagccau

SEQ ID NO: 281842 - RNA, 32 nt, Human
uuuugcuggagcugugcuaggcugagggaauu

SEQ ID NO: 281843 - RNA, 32 nt, Human
uuuugcugguggcagugacgggaccccgacuc

SEQ ID NO: 281844 - RNA, 32 nt, Human
uuuugcuguagcccuagagcacuuuguuugug

SEQ ID NO: 281845 - RNA, 32 nt, Human
uuuugcuguaugaaguagaugagggaagaauc

SEQ ID NO: 281846 - RNA, 32 nt, Human
uuuugcugucccuccccucagcgccgacacca

SEQ ID NO: 281847 - RNA, 32 nt, Human
uuuugcugucugauuaacuucucugccaaaua

SEQ ID NO: 281848 - RNA, 32 nt, Human
uuuugcuguuuuugauggacauggaggaauuc

SEQ ID NO: 281849 - RNA, 32 nt, Human
uuuugcuucaaaggagcucacaagcuaaguaa

SEQ ID NO: 281850 - RNA, 32 nt, Human
uuuugcuucacugcaauuuguuucugaucucc

SEQ ID NO: 281851 - RNA, 32 nt, Human
uuuugcuucauagcugguuccugcuagaaaug

SEQ ID NO: 281852 - RNA, 32 nt, Human
uuuugcuuccugcacuuugaagcuccuuuacg

SEQ ID NO: 281853 - RNA, 32 nt, Human
uuuugcuugagaggaggagaggggagaguaaa

SEQ ID NO: 281854 - RNA, 32 nt, Human
uuuugcuugccugucucuugcuuccuucuuaa

SEQ ID NO: 281855 - RNA, 32 nt, Human
uuuugcuuggggaugugcuuggagaggcagau

SEQ ID NO: 281856 - RNA, 32 nt, Human
uuuugcuugucacccaggcuggagugcaaugg

SEQ ID NO: 281857 - RNA, 32 nt, Human
uuuugcuuuccccuuccuccucccucucuccc

SEQ ID NO: 281858 - RNA, 32 nt, Human
uuuugcuuucgaucuggacuguucucaggcaa

SEQ ID NO: 281859 - RNA, 32 nt, Human
uuuugcuuugcuuaugaaaagcugugcuugag

SEQ ID NO: 281860 - RNA, 32 nt, Human
uuuugcuuuguacuucauugcugguaauaaaa

SEQ ID NO: 281861 - RNA, 32 nt, Human
uuuugcuuuuaaaacguggacauaacucauuu

SEQ ID NO: 281862 - RNA, 32 nt, Human
uuuugcuuuuucuuccuuugggauguggaagc

SEQ ID NO: 281863 - RNA, 32 nt, Human
uuuugcuuuuugaaaugcucuugguugcaaaa

SEQ ID NO: 281864 - RNA, 32 nt, Human
uuuuggaaaagaaacaaugaagacugaauuaa

SEQ ID NO: 281865 - RNA, 32 nt, Human
uuuuggaaaaggagcugcauggccucagugcc

SEQ ID NO: 281866 - RNA, 32 nt, Human
uuuuggaaacuuuaggucaggggccagcgacc

SEQ ID NO: 281867 - RNA, 32 nt, Human
uuuuggaaagaaugccgagaaacugcaccucu

SEQ ID NO: 281868 - RNA, 32 nt, Human
uuuuggaaauaaucauugcuggagauucuguu

SEQ ID NO: 281869 - RNA, 22 nt, Human
uuuuggaaaugaaacaaauaug

SEQ ID NO: 281870 - RNA, 32 nt, Human
uuuuggaacauacuuacaccuuuucuaagcac

SEQ ID NO: 281871 - RNA, 32 nt, Human
uuuuggaacgucacauaacaauggaacauaau

SEQ ID NO: 281872 - RNA, 32 nt, Human
uuuuggaacuacugguuagaaggugagugucc

SEQ ID NO: 281873 - RNA, 32 nt, Human
uuuuggaacugcuacaaacaaaauuagaagaa

SEQ ID NO: 281874 - RNA, 32 nt, Human
uuuuggaagagaguuuuucaucuuagagauug

SEQ ID NO: 281875 - RNA, 32 nt, Human
uuuuggaaggcugaggcaggaggaucacuuua

SEQ ID NO: 281876 - RNA, 23 nt, Human
uuuuggaauagaggacaaagaua

SEQ ID NO: 281877 - RNA, 32 nt, Human
uuuuggaauccagcagcaucauaagauaacca

SEQ ID NO: 281878 - RNA, 32 nt, Human
uuuuggagaacuugucuacaaccagggauuga

SEQ ID NO: 281879 - RNA, 32 nt, Human
uuuuggagacagagucucacucuguugcccag

SEQ ID NO: 281880 - RNA, 32 nt, Human
uuuuggagacagggucucucucuguggcccag

SEQ ID NO: 281881 - RNA, 32 nt, Human
uuuuggagauagagucucacucuguugcccag

SEQ ID NO: 281882 - RNA, 32 nt, Human
uuuuggagauagagucucgcucugucgcccag

SEQ ID NO: 281883 - RNA, 32 nt, Human
uuuuggagauagagucuugcucugucuccagg

SEQ ID NO: 281884 - RNA, 32 nt, Human
uuuuggagccucccuucugccuuggcuuggac

SEQ ID NO: 281885 - RNA, 32 nt, Human
uuuuggagccuguggcugcaaggaacccaggg

SEQ ID NO: 281886 - RNA, 32 nt, Human
uuuuggagcuccaggaagcgcccucaccccag

SEQ ID NO: 281887 - RNA, 32 nt, Human
uuuuggaggagaugagaucagaacucugggga

SEQ ID NO: 281888 - RNA, 32 nt, Human
uuuuggaggccgagacaggcagauugcuugag

SEQ ID NO: 281889 - RNA, 32 nt, Human
uuuuggaggguggaaguuaggagcagggagag

SEQ ID NO: 281890 - RNA, 32 nt, Human
uuuuggagggugggggacagaagauggggcua

SEQ ID NO: 281891 - RNA, 32 nt, Human
uuuuggagucuuuguugcuauauuuugugggg

SEQ ID NO: 281892 - RNA, 32 nt, Human
uuuuggauaguguuuugcuaacaaaaggagag

SEQ ID NO: 281893 - RNA, 32 nt, Human
uuuuggauauguaucuagaaauaagagugcug

SEQ ID NO: 281894 - RNA, 32 nt, Human
uuuuggaucucagagauucuccucugugggaa

SEQ ID NO: 281895 - RNA, 32 nt, Human
uuuuggaugccuggccuuaggcuguggcccag

SEQ ID NO: 281896 - RNA, 32 nt, Human
uuuuggauuccagauugcuauuguaaaaucuc

SEQ ID NO: 281897 - RNA, 32 nt, Human
uuuuggauucccaagucauuugcacauuaaca

SEQ ID NO: 281898 - RNA, 32 nt, Human
uuuuggauuuucuguuucuuccuuugucauuu

SEQ ID NO: 281899 - RNA, 32 nt, Human
uuuuggcaaccagaacuauaagacagaaaugg

SEQ ID NO: 281900 - RNA, 32 nt, Human
uuuuggcacaugacauagaaauggcuauguaa

SEQ ID NO: 281901 - RNA, 32 nt, Human
uuuuggcagguguggaagugaaacuuacccaa

SEQ ID NO: 281902 - RNA, 32 nt, Human
uuuuggcaguguuccucuuuacaugauauccu

SEQ ID NO: 281903 - RNA, 32 nt, Human
uuuuggcauagccuguguuugcagugagagug

SEQ ID NO: 281904 - RNA, 32 nt, Human
uuuuggcaucaaacuuaccaagaaauaucucu

SEQ ID NO: 281905 - RNA, 32 nt, Human
uuuuggcaucuuaggagggaaaaaggacaguu

SEQ ID NO: 281906 - RNA, 32 nt, Human
uuuuggcaugagaaagcccuaaaaagaucagu

SEQ ID NO: 281907 - RNA, 32 nt, Human
uuuuggcauggcugaccuucuguuggucauau

SEQ ID NO: 281908 - RNA, 32 nt, Human
uuuuggcauuauugcaagagcuugacuccugg

SEQ ID NO: 281909 - RNA, 32 nt, Human
uuuuggcauucauagauaaacagcucaggcau

SEQ ID NO: 281910 - RNA, 32 nt, Human
uuuuggcauucuugcugacucugacagaguga

SEQ ID NO: 281911 - RNA, 32 nt, Human
uuuuggccaauugaaaucagacauaugcgauc

SEQ ID NO: 281912 - RNA, 31 nt, Human
uuuuggccaauuucucccauuuguaacaagc

SEQ ID NO: 281913 - RNA, 21 nt, Human
uuuuggccacaaacaaacaua

SEQ ID NO: 281914 - RNA, 32 nt, Human
uuuuggccacugccuggacuagugaaagaaug

SEQ ID NO: 281915 - RNA, 32 nt, Human
uuuuggccaguguuuccaggaggcucugggcu

SEQ ID NO: 281916 - RNA, 32 nt, Human
uuuuggccauuuucucuuuacacuucguaugu

SEQ ID NO: 281917 - RNA, 21 nt, Human
uuuuggcccaagguccauuca

SEQ ID NO: 281918 - RNA, 32 nt, Human
uuuuggcccugagaucacgucuccuacugugu

SEQ ID NO: 281919 - RNA, 32 nt, Human
uuuuggcccugauuuuguauguggaccacugc

SEQ ID NO: 281920 - RNA, 32 nt, Human
uuuuggccuaaagcugccccagagugagggug

SEQ ID NO: 281921 - RNA, 26 nt, Human
uuuuggccucauaagaugguccacuc

SEQ ID NO: 281922 - RNA, 32 nt, Human
uuuuggccucauuccuuuaccacucccacacc

SEQ ID NO: 281923 - RNA, 32 nt, Human
uuuuggccuguuugcagccucuccuagccaca

SEQ ID NO: 281924 - RNA, 32 nt, Human
uuuuggccuuaacuauaacaaucuaauuauaa

SEQ ID NO: 281925 - RNA, 32 nt, Human
uuuuggccuuaacuaugccaaucuaauuauaa

SEQ ID NO: 281926 - RNA, 32 nt, Human
uuuuggccuuucucggcccuggacugaggcuc

SEQ ID NO: 281927 - RNA, 32 nt, Human
uuuuggcgacugaggguuuuucugccacagga

SEQ ID NO: 281928 - RNA, 32 nt, Human
uuuuggcgcaucuuuucccucuugucccgaag

SEQ ID NO: 281929 - RNA, 32 nt, Human
uuuuggcgcugcuucucauucauuuuaaggcu

SEQ ID NO: 281930 - RNA, 32 nt, Human
uuuuggcggggguaggugaggguuuggagcau

SEQ ID NO: 281931 - RNA, 32 nt, Human
uuuuggcuagcacauuucugcucugaauaaaa

SEQ ID NO: 281932 - RNA, 32 nt, Human
uuuuggcucaaugcaaccuccaccucccaggu

SEQ ID NO: 281933 - RNA, 32 nt, Human
uuuuggcucacugcaaccuccaccucccaggu

SEQ ID NO: 281934 - RNA, 32 nt, Human
uuuuggcucacugcaaccuccgccuccggggu

SEQ ID NO: 281935 - RNA, 32 nt, Human
uuuuggcucacugcaaccuccgccuucugggu

SEQ ID NO: 281936 - RNA, 32 nt, Human
uuuuggcucacugcaagcucugccucccgggu

SEQ ID NO: 281937 - RNA, 32 nt, Human
uuuuggcucacugcagccuccgccuucugggu

SEQ ID NO: 281938 - RNA, 32 nt, Human
uuuuggcucacugcagccucugccucccaggc

SEQ ID NO: 281939 - RNA, 32 nt, Human
uuuuggcucacuguauccuucgccucccuggc

SEQ ID NO: 281940 - RNA, 32 nt, Human
uuuuggcuccacccucuuuagcuguuaauuug

SEQ ID NO: 281941 - RNA, 32 nt, Human
uuuuggcucccugcaaccuccgccuccuggau

SEQ ID NO: 281942 - RNA, 32 nt, Human
uuuuggcuccuggggcaagcuuggggaaugaa

SEQ ID NO: 281943 - RNA, 32 nt, Human
uuuuggcucucucaccagcaccauggcuguug

SEQ ID NO: 281944 - RNA, 25 nt, Human
uuuuggcucugaagaagcaaacaug

SEQ ID NO: 281945 - RNA, 32 nt, Human
uuuuggcugaauuccccaccugccuuuggaug

SEQ ID NO: 281946 - RNA, 32 nt, Human
uuuuggcugccauuuuuagcuaccucaaagga

SEQ ID NO: 281947 - RNA, 32 nt, Human
uuuuggcugccucugucggucuguucaguuac

SEQ ID NO: 281948 - RNA, 32 nt, Human
uuuuggcugcugaggcucugggauuugguuua

SEQ ID NO: 281949 - RNA, 32 nt, Human
uuuuggcuguucugauuuguauccuuuugcua

SEQ ID NO: 281950 - RNA, 32 nt, Human
uuuuggcuuucucccugucccuuccuuucucc

SEQ ID NO: 281951 - RNA, 21 nt, Human
uuuugggaaagaugcaacaug

SEQ ID NO: 281952 - RNA, 24 nt, Human
uuuugggaaaguuacacaaaugua

SEQ ID NO: 281953 - RNA, 32 nt, Human
uuuugggaagauuuuuguucaaagcaauaguc

SEQ ID NO: 281954 - RNA, 32 nt, Human
uuuugggaagcgcuucacuccagguugguagc

SEQ ID NO: 281955 - RNA, 24 nt, Human
uuuugggaauagagaaucaacaua

SEQ ID NO: 281956 - RNA, 32 nt, Human
uuuugggacaagcuuuacauggguggggaggg

SEQ ID NO: 281957 - RNA, 32 nt, Human
uuuugggacuccgaggugggcagaucacuuga

SEQ ID NO: 281958 - RNA, 32 nt, Human
uuuugggacugaggcugcagcauuggaacaaa

SEQ ID NO: 281959 - RNA, 32 nt, Human
uuuugggagagggacugaguacagugcaacac

SEQ ID NO: 281960 - RNA, 32 nt, Human
uuuugggagcaucuugucucuaaccuuuaaaa

SEQ ID NO: 281961 - RNA, 32 nt, Human
uuuugggagccagcgguauggcgucgggcugc

SEQ ID NO: 281962 - RNA, 32 nt, Human
uuuugggagcuauagguugcuaaggaggggag

SEQ ID NO: 281963 - RNA, 32 nt, Human
uuuugggaggcagagaugggaggauacuugaa

SEQ ID NO: 281964 - RNA, 32 nt, Human
uuuugggaggcagaggcaggaggauugcuuaa

SEQ ID NO: 281965 - RNA, 32 nt, Human
uuuugggaggccaagacaggaggaucacuuca

SEQ ID NO: 281966 - RNA, 32 nt, Human
uuuugggaggccaagaugggcagaucaggagg

SEQ ID NO: 281967 - RNA, 32 nt, Human
uuuugggaggccaaggagggcagaucaccuaa

SEQ ID NO: 281968 - RNA, 32 nt, Human
uuuugggaggccaaggugggcagaucaccuga

SEQ ID NO: 281969 - RNA, 32 nt, Human
uuuugggaggcccagaugggagcccaggaguu

SEQ ID NO: 281970 - RNA, 32 nt, Human
uuuugggaggccgaggagagaggaucacuuaa

SEQ ID NO: 281971 - RNA, 32 nt, Human
uuuugggaggccgggguuggaggaucauuuga

SEQ ID NO: 281972 - RNA, 32 nt, Human
uuuugggaggcugaagcaggcgggucaccuga

SEQ ID NO: 281973 - RNA, 32 nt, Human
uuuugggaggcugaagugagagguuaauuuga

SEQ ID NO: 281974 - RNA, 32 nt, Human
uuuugggaggcugaggcaggaggaucacuuga

SEQ ID NO: 281975 - RNA, 32 nt, Human
uuuugggaggcugaggcaggcggaucaccuga

SEQ ID NO: 281976 - RNA, 32 nt, Human
uuuugggaggcugaggcaggcggaucgcuuga

SEQ ID NO: 281977 - RNA, 32 nt, Human
uuuugggaggcugaggcagguggaucaccuga

SEQ ID NO: 281978 - RNA, 32 nt, Human
uuuugggaggcugaggcagguggaucacuuga

SEQ ID NO: 281979 - RNA, 32 nt, Human
uuuugggaggcugaggcggaggaccgccugag

SEQ ID NO: 281980 - RNA, 32 nt, Human
uuuugggaggcugaggcggguggaucacuuga

SEQ ID NO: 281981 - RNA, 32 nt, Human
uuuugggaggcugaggugggcagaucacuuga

SEQ ID NO: 281982 - RNA, 32 nt, Human
uuuugggaggcugagguggguggaucacaagg

SEQ ID NO: 281983 - RNA, 32 nt, Human
uuuugggaggcugagguugggaguucaagacc

SEQ ID NO: 281984 - RNA, 32 nt, Human
uuuugggaggcugggugggcggaucacgaggu

SEQ ID NO: 281985 - RNA, 32 nt, Human
uuuugggagguccaggcaggaggaucacuugg

SEQ ID NO: 281986 - RNA, 32 nt, Human
uuuugggaguaaggacaaaccuggaauagaua

SEQ ID NO: 281987 - RNA, 32 nt, Human
uuuugggaugggggucucaccauguugcccag

SEQ ID NO: 281988 - RNA, 21 nt, Human
uuuugggauuugaacaacaug

SEQ ID NO: 281989 - RNA, 32 nt, Human
uuuugggcaaugcuuugugagcaaaacaaagu

SEQ ID NO: 281990 - RNA, 27 nt, Human
uuuugggcaucugaauggaagcuuuac

SEQ ID NO: 281991 - RNA, 32 nt, Human
uuuugggccacgugcagaaccuagccaagcag

SEQ ID NO: 281992 - RNA, 32 nt, Human
uuuugggccacugcaaagauuccagccugggu

SEQ ID NO: 281993 - RNA, 21 nt, Human
uuuugggcccugaggaucuau

SEQ ID NO: 281994 - RNA, 32 nt, Human
uuuugggcccuggaaucagaucauauucuaca

SEQ ID NO: 281995 - RNA, 32 nt, Human
uuuugggcucaaaugauccucccaccuuggcc

SEQ ID NO: 281996 - RNA, 32 nt, Human
uuuugggcucaagugauccucccaccucagcc

SEQ ID NO: 281997 - RNA, 32 nt, Human
uuuuggggaagcuggcucccuauucaugguau

SEQ ID NO: 281998 - RNA, 32 nt, Human
uuuuggggaaggcagguccugaggcaggcacu

SEQ ID NO: 281999 - RNA, 32 nt, Human
uuuuggggacaguagaugaugucuggaaagca

SEQ ID NO: 282000 - RNA, 32 nt, Human
uuuuggggaggaacacaacucccaucccaguc

SEQ ID NO: 282001 - RNA, 32 nt, Human
uuuugggggaacaggcuuuuggcccucuaaua

SEQ ID NO: 282002 - RNA, 32 nt, Human
uuuugggggaauggggcaaaggggugggcgau

SEQ ID NO: 282003 - RNA, 32 nt, Human
uuuugggggagagagcagggaguggcucaggg

SEQ ID NO: 282004 - RNA, 32 nt, Human
uuuugggggcagggagguugggugggcugaug

SEQ ID NO: 282005 - RNA, 23 nt, Human
uuuuggggggcugcuuccugucu

SEQ ID NO: 282006 - RNA, 32 nt, Human
uuuugggggugagggagcuuggguagaugagg

SEQ ID NO: 282007 - RNA, 21 nt, Human
uuuuggggugagagaccagca

SEQ ID NO: 282008 - RNA, 25 nt, Human
uuuugggguggagaagguggaugug

SEQ ID NO: 282009 - RNA, 21 nt, Human
uuuugggguuauguuuugcuu

SEQ ID NO: 282010 - RNA, 26 nt, Human
uuuugggguuguuuugcuuucuguuu

SEQ ID NO: 282011 - RNA, 22 nt, Human
uuuugggguuuggaaaaacaug

SEQ ID NO: 282012 - RNA, 32 nt, Human
uuuuggguauccacccaccuugguguaccaga

SEQ ID NO: 282013 - RNA, 21 nt, Human
uuuuggguauugugaccuggg

SEQ ID NO: 282014 - RNA, 32 nt, Human
uuuugggugaaauggauuuaugugagugcuuu

SEQ ID NO: 282015 - RNA, 32 nt, Human
uuuugggugagaagaaaaauguagcuaaggua

SEQ ID NO: 282016 - RNA, 32 nt, Human
uuuugggugcccaccccaauuuuuaccuuuua

SEQ ID NO: 282017 - RNA, 21 nt, Human
uuuuggguggcaauaaauaua

SEQ ID NO: 282018 - RNA, 32 nt, Human
uuuugggugggcaauuuccuucaacgaagccg

SEQ ID NO: 282019 - RNA, 31 nt, Human
uuuugggugucccuugucccugugucacugu

SEQ ID NO: 282020 - RNA, 27 nt, Human
uuuuggguuaauaaagcaaaauuuugc

SEQ ID NO: 282021 - RNA, 32 nt, Human
uuuuggguuggggguauuggggaaggcaggaa

SEQ ID NO: 282022 - RNA, 32 nt, Human
uuuuggguuuggauggcaagaucauggauaag

SEQ ID NO: 282023 - RNA, 32 nt, Human
uuuuggguuuuauuuuauuuuaauaguaguaa

SEQ ID NO: 282024 - RNA, 25 nt, Human
uuuuggguuuucucuucuccugcuu

SEQ ID NO: 282025 - RNA, 32 nt, Human
uuuuggguuuuguuuaggagggugggugggga

SEQ ID NO: 282026 - RNA, 32 nt, Human
uuuugguaaagaugacuucccuggugggguag

SEQ ID NO: 282027 - RNA, 32 nt, Human
uuuugguaccccuuuugggaaucuaauguauu

SEQ ID NO: 282028 - RNA, 32 nt, Human
uuuugguagcaaggguccagagaugagguguu

SEQ ID NO: 282029 - RNA, 32 nt, Human
uuuugguaggccgaggagggcagaucacuugg

SEQ ID NO: 282030 - RNA, 32 nt, Human
uuuugguaggcucauugagagauacagaagaa

SEQ ID NO: 282031 - RNA, 25 nt, Human
uuuugguagugaugaaauaaacaua

SEQ ID NO: 282032 - RNA, 32 nt, Human
uuuugguauaaacuuaacauuagccagggagg

SEQ ID NO: 282033 - RNA, 32 nt, Human
uuuugguauauuaacaauuacauguauuuugu

SEQ ID NO: 282034 - RNA, 32 nt, Human
uuuugguauuuuuaguagagacaggguuucac

SEQ ID NO: 282035 - RNA, 32 nt, Human
uuuuggucauaucauuucaaaacauuugcauc

SEQ ID NO: 282036 - RNA, 32 nt, Human
uuuuggucaucuuuauuuaguuugcaugaagu

SEQ ID NO: 282037 - RNA, 32 nt, Human
uuuuggucaugggcuggucuggucgguuuccc

SEQ ID NO: 282038 - RNA, 32 nt, Human
uuuugguccugauccaguggccacaccugucu

SEQ ID NO: 282039 - RNA, 32 nt, Human
uuuugguccuugcaacaguuugcugagaauga

SEQ ID NO: 282040 - RNA, 32 nt, Human
uuuuggucuaaauuaugagguaccaagauugu

SEQ ID NO: 282041 - RNA, 32 nt, Human
uuuuggucucaagugauucucuucauguuguc

SEQ ID NO: 282042 - RNA, 32 nt, Human
uuuuggucuccucuuccagagucaccuuuccc

SEQ ID NO: 282043 - RNA, 32 nt, Human
uuuuggucugacccacugcuuuuggucugugu

SEQ ID NO: 282044 - RNA, 32 nt, Human
uuuuggugaggaacucuuacucuuugcuaauc

SEQ ID NO: 282045 - RNA, 32 nt, Human
uuuuggugcacuuuuguuucaccaucugaaaa

SEQ ID NO: 282046 - RNA, 32 nt, Human
uuuuggugccagugaagaguugggcuugcugc

SEQ ID NO: 282047 - RNA, 32 nt, Human
uuuuggugcgggagcguuuugguuggggacag

SEQ ID NO: 282048 - RNA, 32 nt, Human
uuuugguggagcugacgauuuugagggcugag

SEQ ID NO: 282049 - RNA, 32 nt, Human
uuuuggugggcagggacugccuccucccggaa

SEQ ID NO: 282050 - RNA, 25 nt, Human
uuuuggugguuuuuguuuuuuguuu

SEQ ID NO: 282051 - RNA, 32 nt, Human
uuuugguguauguauguuuauguaugugugug

SEQ ID NO: 282052 - RNA, 32 nt, Human
uuuuggugugcugcuuuuccaggcucucuucu

SEQ ID NO: 282053 - RNA, 32 nt, Human
uuuugguguggagaaagaggccaguuuaaaua

SEQ ID NO: 282054 - RNA, 32 nt, Human
uuuugguguuaccugagugugacacaggcccu

SEQ ID NO: 282055 - RNA, 32 nt, Human
uuuugguuagcuuugccaguucugccuauuau

SEQ ID NO: 282056 - RNA, 32 nt, Human
uuuugguuaucgaggcagagacuguaggaaua

SEQ ID NO: 282057 - RNA, 32 nt, Human
uuuugguucagacaccuguucacagaaaaagc

SEQ ID NO: 282058 - RNA, 32 nt, Human
uuuugguuccacaccugucuucucaggcuuga

SEQ ID NO: 282059 - RNA, 21 nt, Human
uuuugguuccauaugaacuuu

SEQ ID NO: 282060 - RNA, 32 nt, Human
uuuugguuccuccacuggaauguaggcuccuc

SEQ ID NO: 282061 - RNA, 32 nt, Human
uuuugguuccuugaguucuccugucuccagau

SEQ ID NO: 282062 - RNA, 32 nt, Human
uuuugguucucuuuagcuucugguucuugaaa

SEQ ID NO: 282063 - RNA, 32 nt, Human
uuuugguuuccaugugauuuguuuucuucaau

SEQ ID NO: 282064 - RNA, 32 nt, Human
uuuugguuuccuucuaacuugcccacggcagc

SEQ ID NO: 282065 - RNA, 32 nt, Human
uuuugguuuggaaacauauuaccacgucuuaa

SEQ ID NO: 282066 - RNA, 32 nt, Human
uuuugguuuuggugguggcuuuugggcaagga

SEQ ID NO: 282067 - RNA, 24 nt, Human
uuuuguaaaacuuauucugcccca

SEQ ID NO: 282068 - RNA, 32 nt, Human
uuuuguaaagaugguuuuacacacuacagaug

SEQ ID NO: 282069 - RNA, 32 nt, Human
uuuuguaaauauguuacaacaaaaugugauug

SEQ ID NO: 282070 - RNA, 32 nt, Human
uuuuguaaaugauaaaaaugugucuaauucac

SEQ ID NO: 282071 - RNA, 32 nt, Human
uuuuguaaaugauucugugcccaggagcagcu

SEQ ID NO: 282072 - RNA, 32 nt, Human
uuuuguaacuccugauucuuccuuuucggaua

SEQ ID NO: 282073 - RNA, 32 nt, Human
uuuuguaacuuaguaaagguauuaacuuccuu

SEQ ID NO: 282074 - RNA, 32 nt, Human
uuuuguaaggcccagggguugcacugagucug

SEQ ID NO: 282075 - RNA, 32 nt, Human
uuuuguaauauuguccugggccuguguugggg

SEQ ID NO: 282076 - RNA, 32 nt, Human
uuuuguaaucagcuacuguauguuuuauuuua

SEQ ID NO: 282077 - RNA, 32 nt, Human
uuuuguaaugaccaugagcaauguuuuuacuu

SEQ ID NO: 282078 - RNA, 32 nt, Human
uuuuguacagcaguugggccaaccuuugcugg

SEQ ID NO: 282079 - RNA, 32 nt, Human
uuuuguacauacuguaagguugguuuguaaau

SEQ ID NO: 282080 - RNA, 32 nt, Human
uuuuguacauuguuuucccuuucuacauuuug

SEQ ID NO: 282081 - RNA, 32 nt, Human
uuuuguaccaguggcugggaugguggaauugg

SEQ ID NO: 282082 - RNA, 32 nt, Human
uuuuguaccauuuauuuuaugacauuuuacaa

SEQ ID NO: 282083 - RNA, 32 nt, Human
uuuuguaccuuaaauuguucgauuacgucauc

SEQ ID NO: 282084 - RNA, 32 nt, Human
uuuuguaccuuguuauuuccauguaccaaaau

SEQ ID NO: 282085 - RNA, 32 nt, Human
uuuuguacuggugacccaccucuuaggacuuu

SEQ ID NO: 282086 - RNA, 31 nt, Human
uuuuguacuuagcuguuacaugcagagcaau

SEQ ID NO: 282087 - RNA, 32 nt, Human
uuuuguagaaacgguuuugccauguugcccag

SEQ ID NO: 282088 - RNA, 32 nt, Human
uuuuguagaccugccuuaugcaccuuacugcc

SEQ ID NO: 282089 - RNA, 32 nt, Human
uuuuguagacuuugggcccacguguuuuaugg

SEQ ID NO: 282090 - RNA, 32 nt, Human
uuuuguagagagaaucucucucuguugcacag

SEQ ID NO: 282091 - RNA, 32 nt, Human
uuuuguagccagguccuuggugcaguauuuau

SEQ ID NO: 282092 - RNA, 32 nt, Human
uuuuguagccuuccuccacauccuuucuaaac

SEQ ID NO: 282093 - RNA, 32 nt, Human
uuuuguagcuguuucauaaaacuguugacuaa

SEQ ID NO: 282094 - RNA, 31 nt, Human
uuuuguaggaaacuuucaauuguuuuacuuu

SEQ ID NO: 282095 - RNA, 32 nt, Human
uuuuguaggcggggcucgguggcucaccccug

SEQ ID NO: 282096 - RNA, 32 nt, Human
uuuuguaggguuuguauaauuucuagaguucg

SEQ ID NO: 282097 - RNA, 32 nt, Human
uuuuguaguuugaauaugaaauuuggaccaaa

SEQ ID NO: 282098 - RNA, 32 nt, Human
uuuuguaguuuuaguagacacaggguuucacc

SEQ ID NO: 282099 - RNA, 32 nt, Human
uuuuguaguuuuauuagagacaggguuucuuc

SEQ ID NO: 282100 - RNA, 22 nt, Human
uuuuguauaggagccccaggca

SEQ ID NO: 282101 - RNA, 32 nt, Human
uuuuguauaguuacaguauacgaguugaguau

SEQ ID NO: 282102 - RNA, 31 nt, Human
uuuuguauauuuuuauugcauuuaaaauugc

SEQ ID NO: 282103 - RNA, 32 nt, Human
uuuuguauccagggaaaagcacccagagguca

SEQ ID NO: 282104 - RNA, 32 nt, Human
uuuuguauccuccauuguaucuucauacaaag

SEQ ID NO: 282105 - RNA, 32 nt, Human
uuuuguaucuguggauuuggauaagggagggg

SEQ ID NO: 282106 - RNA, 32 nt, Human
uuuuguaugugaacaaaucaaauugcuuaaaa

SEQ ID NO: 282107 - RNA, 32 nt, Human
uuuuguauucuuaguagagacaggguuucgcc

SEQ ID NO: 282108 - RNA, 32 nt, Human
uuuuguauuucucuggagugcaauggugcaau

SEQ ID NO: 282109 - RNA, 32 nt, Human
uuuuguauuugugcuuuccauccaucuucugu

SEQ ID NO: 282110 - RNA, 32 nt, Human
uuuuguauuuuagcagagacgggguuucacca

SEQ ID NO: 282111 - RNA, 32 nt, Human
uuuuguauuuucaguagagacaggguuucacc

SEQ ID NO: 282112 - RNA, 32 nt, Human
uuuuguauuuucaguagagacaggguuucgcc

SEQ ID NO: 282113 - RNA, 32 nt, Human
uuuuguauuuucuguacacacaggguuucauc

SEQ ID NO: 282114 - RNA, 32 nt, Human
uuuuguauuuuuaauagagaugggguuucacc

SEQ ID NO: 282115 - RNA, 32 nt, Human
uuuuguauuuuuaauagagaugggguuuugcc

SEQ ID NO: 282116 - RNA, 32 nt, Human
uuuuguauuuuuaguagagauagggauucacc

SEQ ID NO: 282117 - RNA, 32 nt, Human
uuuuguauuuuuaguagagauagggucucacc

SEQ ID NO: 282118 - RNA, 32 nt, Human
uuuuguauuuuuaguagagauaggguuucacc

SEQ ID NO: 282119 - RNA, 32 nt, Human
uuuuguauuuuuaguggagauaggguuucaca

SEQ ID NO: 282120 - RNA, 32 nt, Human
uuuuguauuuuuauuagagacaggguuucucc

SEQ ID NO: 282121 - RNA, 32 nt, Human
uuuuguauuuuuauuggagacaggguuucacc

SEQ ID NO: 282122 - RNA, 32 nt, Human
uuuuguauuuuucauagagacaggguuucacc

SEQ ID NO: 282123 - RNA, 32 nt, Human
uuuuguauuuuugguagagauaggguuucaca

SEQ ID NO: 282124 - RNA, 32 nt, Human
uuuugucaaaguguauccagaaugucagaauu

SEQ ID NO: 282125 - RNA, 32 nt, Human
uuuugucaacacugcauugucuuuugagcucu

SEQ ID NO: 282126 - RNA, 32 nt, Human
uuuugucaaucagcuggauaugcuguuuaguu

SEQ ID NO: 282127 - RNA, 32 nt, Human
uuuugucacaguuagagaaugagguugacuaa

SEQ ID NO: 282128 - RNA, 32 nt, Human
uuuugucacaguuggucccccuugccuucaca

SEQ ID NO: 282129 - RNA, 32 nt, Human
uuuugucacccaggcuggagugcaguggggca

SEQ ID NO: 282130 - RNA, 32 nt, Human
uuuugucacccaggcuggagugcaguggugug

SEQ ID NO: 282131 - RNA, 32 nt, Human
uuuugucacccaggcuggagugccauggcacg

SEQ ID NO: 282132 - RNA, 32 nt, Human
uuuugucaccgaggcuggagugcaauggcccg

SEQ ID NO: 282133 - RNA, 32 nt, Human
uuuugucaccuugcugagcuugcuuaucaguc

SEQ ID NO: 282134 - RNA, 32 nt, Human
uuuugucaggaauuauuguuauuuaauaaaua

SEQ ID NO: 282135 - RNA, 32 nt, Human
uuuugucauauccccucuccuuauuuuucuaa

SEQ ID NO: 282136 - RNA, 32 nt, Human
uuuuguccagaaggacaagccggacaaaugag

SEQ ID NO: 282137 - RNA, 23 nt, Human
uuuuguccauucccuaguaggcc

SEQ ID NO: 282138 - RNA, 32 nt, Human
uuuuguccauuuguguuucagaaucagcacag

SEQ ID NO: 282139 - RNA, 21 nt, Human
uuuuguccccagcaguggccu

SEQ ID NO: 282140 - RNA, 32 nt, Human
uuuugucccccaagcuggaguacaaugacagg

SEQ ID NO: 282141 - RNA, 32 nt, Human
uuuugucccugcacccuucacuggcauccuca

SEQ ID NO: 282142 - RNA, 21 nt, Human
uuuugucccuguagguggccc

SEQ ID NO: 282143 - RNA, 32 nt, Human
uuuugucccuuuccuucuaucacccuacauuc

SEQ ID NO: 282144 - RNA, 32 nt, Human
uuuuguccuagagugagaguuuggaagguguc

SEQ ID NO: 282145 - RNA, 32 nt, Human
uuuuguccuauuaccuccucugagcgcaaauc

SEQ ID NO: 282146 - RNA, 32 nt, Human
uuuuguccuccuaaacaguauaccaaaguuug

SEQ ID NO: 282147 - RNA, 32 nt, Human
uuuuguccugaugucuaaauugcagugauaag

SEQ ID NO: 282148 - RNA, 32 nt, Human
uuuugucgcccaggcuggagugcaguggcaug

SEQ ID NO: 282149 - RNA, 32 nt, Human
uuuugucgccugcacccacucccuucauacaa

SEQ ID NO: 282150 - RNA, 32 nt, Human
uuuugucgugugggaccuguucuggcugcucc

SEQ ID NO: 282151 - RNA, 32 nt, Human
uuuugucuaggucauaacauaccauuuguaag

SEQ ID NO: 282152 - RNA, 32 nt, Human
uuuugucuagucucccugucucuccugauuuc

SEQ ID NO: 282153 - RNA, 32 nt, Human
uuuugucucccuucccucccucccucccuccc

SEQ ID NO: 282154 - RNA, 32 nt, Human
uuuugucucuaucaucucaggcgucaaccaca

SEQ ID NO: 282155 - RNA, 32 nt, Human
uuuugucucugccuuuccauuuguuagauggg

SEQ ID NO: 282156 - RNA, 32 nt, Human
uuuugucugcacuugaguucacuugaguuuac

SEQ ID NO: 282157 - RNA, 32 nt, Human
uuuugucugcagcuguuuguugccccauuccu

SEQ ID NO: 282158 - RNA, 32 nt, Human
uuuugucugggaagcagggauugcugacaugu

SEQ ID NO: 282159 - RNA, 32 nt, Human
uuuugucuuccauccaacuccccaccaccccc

SEQ ID NO: 282160 - RNA, 32 nt, Human
uuuugucuucucauccaaacagucugccagug

SEQ ID NO: 282161 - RNA, 32 nt, Human
uuuugucuucugugaagacaggaccuaugcaa

SEQ ID NO: 282162 - RNA, 32 nt, Human
uuuugucuucuuucugauuuuucccuaggggu

SEQ ID NO: 282163 - RNA, 32 nt, Human
uuuugucuuuauggcgcuucccccucugaaau

SEQ ID NO: 282164 - RNA, 32 nt, Human
uuuugucuuuuuccuuuauucuuuuuguaaau

SEQ ID NO: 282165 - RNA, 32 nt, Human
uuuugugaacaucacugaagcucugaagcuuu

SEQ ID NO: 282166 - RNA, 32 nt, Human
uuuugugaacgcuucugccacaucuugucuuc

SEQ ID NO: 282167 - RNA, 32 nt, Human
uuuugugaagagacgaagacugagcgguugug

SEQ ID NO: 282168 - RNA, 32 nt, Human
uuuugugacaaaggcaagacccccaggucuac

SEQ ID NO: 282169 - RNA, 32 nt, Human
uuuugugagauggucagcuuuggugcucucca

SEQ ID NO: 282170 - RNA, 32 nt, Human
uuuugugaggccaaggcuuggaugcgugugua

SEQ ID NO: 282171 - RNA, 32 nt, Human
uuuugugagugcaagcuggcuuggggagcccu

SEQ ID NO: 282172 - RNA, 32 nt, Human
uuuugugauuauucuguaucagaaaugaaaca

SEQ ID NO: 282173 - RNA, 32 nt, Human
uuuugugauuuucauuuuuggcccaauuauua

SEQ ID NO: 282174 - RNA, 32 nt, Human
uuuugugccacaucuuccaacugagucucccc

SEQ ID NO: 282175 - RNA, 32 nt, Human
uuuugugcccacugugugggccuguguugugu

SEQ ID NO: 282176 - RNA, 32 nt, Human
uuuugugccuuuccuuucucagauccucuuau

SEQ ID NO: 282177 - RNA, 32 nt, Human
uuuugugcucgacuuuuccacccuuuuucccu

SEQ ID NO: 282178 - RNA, 32 nt, Human
uuuugugcugcggcuggggucuuucuggccgu

SEQ ID NO: 282179 - RNA, 32 nt, Human
uuuugugcuuugcagcauuccucaaauuguuu

SEQ ID NO: 282180 - RNA, 32 nt, Human
uuuuguggaaacgacagcaaugcuggaucuuc

SEQ ID NO: 282181 - RNA, 32 nt, Human
uuuuguggaaagacuggcaauuagagguagaa

SEQ ID NO: 282182 - RNA, 32 nt, Human
uuuuguggaaagcuuuagaaaugauauaauua

SEQ ID NO: 282183 - RNA, 25 nt, Human
uuuuguggaugaggaaacaagaaua

SEQ ID NO: 282184 - RNA, 32 nt, Human
uuuuguggcuauuucuggaggcccaggagugu

SEQ ID NO: 282185 - RNA, 32 nt, Human
uuuugugggaggcagcauggcaccguggaaag

SEQ ID NO: 282186 - RNA, 32 nt, Human
uuuugugggccuccagcuucucucagagucuc

SEQ ID NO: 282187 - RNA, 32 nt, Human
uuuuguggggcggggauaggggagggcauuga

SEQ ID NO: 282188 - RNA, 32 nt, Human
uuuugugguaucucccccuaccacaaaccagg

SEQ ID NO: 282189 - RNA, 32 nt, Human
uuuugugguguuuuguuuaauagagaauuuuu

SEQ ID NO: 282190 - RNA, 24 nt, Human
uuuugugguuuccugcacaucuuu

SEQ ID NO: 282191 - RNA, 22 nt, Human
uuuugugguuucucugaugguu

SEQ ID NO: 282192 - RNA, 25 nt, Human
uuuugugguuucugcuuucuugccu

SEQ ID NO: 282193 - RNA, 32 nt, Human
uuuuguguaaaugcugaccuccuugccuacau

SEQ ID NO: 282194 - RNA, 32 nt, Human
uuuuguguagaucuguuuuggaagauggcaug

SEQ ID NO: 282195 - RNA, 32 nt, Human
uuuuguguaggugucugccuucacaaauguca

SEQ ID NO: 282196 - RNA, 32 nt, Human
uuuugugucacugucugucugaaucugccucc

SEQ ID NO: 282197 - RNA, 32 nt, Human
uuuugugucuccagauccuaugauuucaugga

SEQ ID NO: 282198 - RNA, 32 nt, Human
uuuugugucugauaaucuuccuuuccucaaug

SEQ ID NO: 282199 - RNA, 32 nt, Human
uuuugugucuggcuucuucugagacaguagga

SEQ ID NO: 282200 - RNA, 32 nt, Human
uuuugugucugugaggggccagauaguaauua

SEQ ID NO: 282201 - RNA, 32 nt, Human
uuuugugucuucauuuuuccuccugucugcau

SEQ ID NO: 282202 - RNA, 32 nt, Human
uuuugugugacagaagucagcaaccaaauuuc

SEQ ID NO: 282203 - RNA, 32 nt, Human
uuuugugugggauuuguuuugcaguaucuccc

SEQ ID NO: 282204 - RNA, 32 nt, Human
uuuuguguguccugugucucagaagagaacug

SEQ ID NO: 282205 - RNA, 32 nt, Human
uuuugugugucugggcagucucucagccuccg

SEQ ID NO: 282206 - RNA, 32 nt, Human
uuuugugugucugguuucucccuuccuuuccu

SEQ ID NO: 282207 - RNA, 32 nt, Human
uuuuguguguguggagacaggguuuugccaug

SEQ ID NO: 282208 - RNA, 32 nt, Human
uuuuguguguuauauuggccucauguugagca

SEQ ID NO: 282209 - RNA, 31 nt, Human
uuuuguguuauuuucugacugcuggauucug

SEQ ID NO: 282210 - RNA, 32 nt, Human
uuuuguguuccaaggcaacuguaucauaggug

SEQ ID NO: 282211 - RNA, 32 nt, Human
uuuuguguuccuuaacuauuuugucugccaug

SEQ ID NO: 282212 - RNA, 32 nt, Human
uuuuguguucucccucuccacccccacuuucu

SEQ ID NO: 282213 - RNA, 31 nt, Human
uuuuguguuggguccucagccaacacucaag

SEQ ID NO: 282214 - RNA, 32 nt, Human
uuuuguguuuauguuaggaucugaaucauguu

SEQ ID NO: 282215 - RNA, 32 nt, Human
uuuuguguuuucaguagagacaggguuucacc

SEQ ID NO: 282216 - RNA, 32 nt, Human
uuuuguuaaagcaguagguuuuaaggauucuc

SEQ ID NO: 282217 - RNA, 32 nt, Human
uuuuguuaaggugucaucagccuucaaccucc

SEQ ID NO: 282218 - RNA, 32 nt, Human
uuuuguuacauacuuguacuucuaagaauugu

SEQ ID NO: 282219 - RNA, 32 nt, Human
uuuuguuagcacaccuagacuugcuguaacug

SEQ ID NO: 282220 - RNA, 31 nt, Human
uuuuguuaguuucaguaccucagcuaucaac

SEQ ID NO: 282221 - RNA, 31 nt, Human
uuuuguuaguuucaguuguauuuuauuuuua

SEQ ID NO: 282222 - RNA, 32 nt, Human
uuuuguuauagagagaaacaaggacauggaug

SEQ ID NO: 282223 - RNA, 32 nt, Human
uuuuguuauuuuuaauuaggguauaugaauau

SEQ ID NO: 282224 - RNA, 32 nt, Human
uuuuguuauuuuuacaaggcagaauggggugu

SEQ ID NO: 282225 - RNA, 32 nt, Human
uuuuguucaaucucucaccacaacuggaagug

SEQ ID NO: 282226 - RNA, 32 nt, Human
uuuuguucacuacuguauacucagcaccuaau

SEQ ID NO: 282227 - RNA, 32 nt, Human
uuuuguucacugcaaccucugccuuccaagau

SEQ ID NO: 282228 - RNA, 32 nt, Human
uuuuguucagaagaaagugcugaacaucguuc

SEQ ID NO: 282229 - RNA, 32 nt, Human
uuuuguucagcuaagaauuggaaaaguauuug

SEQ ID NO: 282230 - RNA, 32 nt, Human
uuuuguucauucucuagacaaaauccaucagg

SEQ ID NO: 282231 - RNA, 32 nt, Human
uuuuguucauuucauccuuucacuucuuuccc

SEQ ID NO: 282232 - RNA, 32 nt, Human
uuuuguucauuuccccucccuuagcuaccuuc

SEQ ID NO: 282233 - RNA, 32 nt, Human
uuuuguucauuucguucuuacuucccugaagc

SEQ ID NO: 282234 - RNA, 32 nt, Human
uuuuguucccauccucuucuuuuagcaguaaa

SEQ ID NO: 282235 - RNA, 32 nt, Human
uuuuguuccccuccuccacucucccccacccc

SEQ ID NO: 282236 - RNA, 32 nt, Human
uuuuguuccugagggccccuuaguaggcaggg

SEQ ID NO: 282237 - RNA, 32 nt, Human
uuuuguuccuuaauguggaccagaaugucagg

SEQ ID NO: 282238 - RNA, 32 nt, Human
uuuuguucuaacagacauuuagguuaauugua

SEQ ID NO: 282239 - RNA, 32 nt, Human
uuuuguucuauguaacaguauugccacaaaac

SEQ ID NO: 282240 - RNA, 32 nt, Human
uuuuguucucaaggacuugggcuguuugacuu

SEQ ID NO: 282241 - RNA, 32 nt, Human
uuuuguucucucucuggucacugcccuuaccu

SEQ ID NO: 282242 - RNA, 32 nt, Human
uuuuguucugcgguucccauugcagugcugug

SEQ ID NO: 282243 - RNA, 32 nt, Human
uuuuguucuugagaggggucagucuagaagcu

SEQ ID NO: 282244 - RNA, 32 nt, Human
uuuuguucuuuguuaugcugucuaucucuguu

SEQ ID NO: 282245 - RNA, 32 nt, Human
uuuuguugaagaaugaaaggcaaugacaaguu

SEQ ID NO: 282246 - RNA, 22 nt, Human
uuuuguugagaagauaaaugug

SEQ ID NO: 282247 - RNA, 32 nt, Human
uuuuguugauccagcauuugagugacacuguu

SEQ ID NO: 282248 - RNA, 32 nt, Human
uuuuguugcccaggcuggagugcaacggcgcg

SEQ ID NO: 282249 - RNA, 32 nt, Human
uuuuguugcccaggcuggagugcaaugaugca

SEQ ID NO: 282250 - RNA, 32 nt, Human
uuuuguugcccaggcuggagugcaauggcgcg

SEQ ID NO: 282251 - RNA, 32 nt, Human
uuuuguugcccaggcuggagugcaauggugca

SEQ ID NO: 282252 - RNA, 32 nt, Human
uuuuguugcccaggcuggaguguaguggcgcg

SEQ ID NO: 282253 - RNA, 32 nt, Human
uuuuguugcccaggcuggaguucaguggcgug

SEQ ID NO: 282254 - RNA, 32 nt, Human
uuuuguugcccaggcuggucuccaauuucugg

SEQ ID NO: 282255 - RNA, 22 nt, Human
uuuuguugcccucuccuauccu

SEQ ID NO: 282256 - RNA, 32 nt, Human
uuuuguugccuaccucuuccuccacucauuug

SEQ ID NO: 282257 - RNA, 32 nt, Human
uuuuguugcgcaggcuggagugcaauggugca

SEQ ID NO: 282258 - RNA, 32 nt, Human
uuuuguuggggaggggaaugggaggggaaaug

SEQ ID NO: 282259 - RNA, 32 nt, Human
uuuuguugguguuggugcaagggcaauaggau

SEQ ID NO: 282260 - RNA, 32 nt, Human
uuuuguugguuuggcuguaggcuuuuauuucu

SEQ ID NO: 282261 - RNA, 32 nt, Human
uuuuguuguagaugcuaacgugucagaauccu

SEQ ID NO: 282262 - RNA, 32 nt, Human
uuuuguugucaaacauaagguaccaaauauga

SEQ ID NO: 282263 - RNA, 22 nt, Human
uuuuguuguguuuuucugcuuu

SEQ ID NO: 282264 - RNA, 32 nt, Human
uuuuguuguucuuuagucaaagauccaauucu

SEQ ID NO: 282265 - RNA, 32 nt, Human
uuuuguuuacaagaauaauuagcaauacugag

SEQ ID NO: 282266 - RNA, 32 nt, Human
uuuuguuuaccucccuccauucauucacaugc

SEQ ID NO: 282267 - RNA, 23 nt, Human
uuuuguuuacucaagaaugaagu

SEQ ID NO: 282268 - RNA, 32 nt, Human
uuuuguuuagauaccaaucuuuuaaauucuug

SEQ ID NO: 282269 - RNA, 32 nt, Human
uuuuguuuagggacuguaguggauuauggcca

SEQ ID NO: 282270 - RNA, 32 nt, Human
uuuuguuuauucacauuaaccuuuauucuauc

SEQ ID NO: 282271 - RNA, 32 nt, Human
uuuuguuuauugcuggcacauuucuuuuucuu

SEQ ID NO: 282272 - RNA, 32 nt, Human
uuuuguuucaaaauacaggaaaaacauuccua

SEQ ID NO: 282273 - RNA, 32 nt, Human
uuuuguuuccauugcuuuugguguuuuagaca

SEQ ID NO: 282274 - RNA, 32 nt, Human
uuuuguuuccauuuucuucaucucgaagguga

SEQ ID NO: 282275 - RNA, 32 nt, Human
uuuuguuucccccaccaccaucacugccaccu

SEQ ID NO: 282276 - RNA, 32 nt, Human
uuuuguuuccccucagugucuguaacccuuag

SEQ ID NO: 282277 - RNA, 32 nt, Human
uuuuguuuccuacuuaagcucaggacuugaua

SEQ ID NO: 282278 - RNA, 32 nt, Human
uuuuguuucugaagggaaugccucuaagauuu

SEQ ID NO: 282279 - RNA, 32 nt, Human
uuuuguuucugagacggagucucagucuguca

SEQ ID NO: 282280 - RNA, 32 nt, Human
uuuuguuucugugucccuaccagacacaaaga

SEQ ID NO: 282281 - RNA, 32 nt, Human
uuuuguuucuuaccuuugauguuuucaaacca

SEQ ID NO: 282282 - RNA, 32 nt, Human
uuuuguuucuuuccucccuucccuuucacucu

SEQ ID NO: 282283 - RNA, 32 nt, Human
uuuuguuucuuuccuuccuuccuuccuuccuu

SEQ ID NO: 282284 - RNA, 32 nt, Human
uuuuguuugcugaauuaaaguacucugacauu

SEQ ID NO: 282285 - RNA, 32 nt, Human
uuuuguuugcugcacaccucauuggcuugcuu

SEQ ID NO: 282286 - RNA, 32 nt, Human
uuuuguuugggaacucggaggcccucccccuc

SEQ ID NO: 282287 - RNA, 32 nt, Human
uuuuguuuguuuccuuuguucuuaccuguaug

SEQ ID NO: 282288 - RNA, 32 nt, Human
uuuuguuuguuuucugagacagagucucacuc

SEQ ID NO: 282289 - RNA, 32 nt, Human
uuuuguuuuaaucuuuuguugccagugaugau

SEQ ID NO: 282290 - RNA, 32 nt, Human
uuuuguuuucaaugcuaguguuuaauccugua

SEQ ID NO: 282291 - RNA, 32 nt, Human
uuuuguuuucagagagaaauaggaguagggcg

SEQ ID NO: 282292 - RNA, 32 nt, Human
uuuuguuuuccacugugcuauuacaaauuuuc

SEQ ID NO: 282293 - RNA, 32 nt, Human
uuuuguuuucuuuccaaagcucaccucgggga

SEQ ID NO: 282294 - RNA, 32 nt, Human
uuuuguuuucuuuugaccuguaaaauaccuca

SEQ ID NO: 282295 - RNA, 32 nt, Human
uuuuguuuugagacagagucucacucuguguc

SEQ ID NO: 282296 - RNA, 32 nt, Human
uuuuguuuugagacagagucucgcucugucuc

SEQ ID NO: 282297 - RNA, 32 nt, Human
uuuuguuuugagacagaguuucccucugucgc

SEQ ID NO: 282298 - RNA, 32 nt, Human
uuuuguuuugagacagggccucacucuguugc

SEQ ID NO: 282299 - RNA, 32 nt, Human
uuuuguuuugagacagggucucacucuguugc

SEQ ID NO: 282300 - RNA, 32 nt, Human
uuuuguuuugagacauggucuugcucuauugc

SEQ ID NO: 282301 - RNA, 32 nt, Human
uuuuguuuugagacgaagacucacucuguccg

SEQ ID NO: 282302 - RNA, 32 nt, Human
uuuuguuuugagacggagucuugcucugucac

SEQ ID NO: 282303 - RNA, 32 nt, Human
uuuuguuuugagagaagucucguucuuguccc

SEQ ID NO: 282304 - RNA, 32 nt, Human
uuuuguuuugagagggagucucgcuguguugu

SEQ ID NO: 282305 - RNA, 32 nt, Human
uuuuguuuugagauggagucuuacucugucgc

SEQ ID NO: 282306 - RNA, 32 nt, Human
uuuuguuuugagauggagucuugcucuguugc

SEQ ID NO: 282307 - RNA, 32 nt, Human
uuuuguuuugcaccugccauucauuugcuaau

SEQ ID NO: 282308 - RNA, 32 nt, Human
uuuuguuuuguuuguuuugcuuugccaugugu

SEQ ID NO: 282309 - RNA, 32 nt, Human
uuuuguuuuuaagguuggcuucagaggugcaa

SEQ ID NO: 282310 - RNA, 31 nt, Human
uuuuguuuuucaguccagguuggagaucgua

SEQ ID NO: 282311 - RNA, 32 nt, Human
uuuuguuuuuccucuucugucaauggucuacu

SEQ ID NO: 282312 - RNA, 32 nt, Human
uuuuguuuuugacagagucucagucugucacc

SEQ ID NO: 282313 - RNA, 22 nt, Human
uuuuguuuuuguuuucuuucca

SEQ ID NO: 282314 - RNA, 32 nt, Human
uuuuguuuuuguuuugagacucgcucugucuc

SEQ ID NO: 282315 - RNA, 23 nt, Human
uuuuguuuuuuguuucuggcccc

SEQ ID NO: 282316 - RNA, 32 nt, Human
uuuuuaaaaagcagauauuuugucaaggggcu

SEQ ID NO: 282317 - RNA, 32 nt, Human
uuuuuaaaaagcuuaacuaggaaucuuucuga

SEQ ID NO: 282318 - RNA, 32 nt, Human
uuuuuaaaaauacauucauugucuucagucau

SEQ ID NO: 282319 - RNA, 32 nt, Human
uuuuuaaaaaugcagcagcauaggagugaaca

SEQ ID NO: 282320 - RNA, 32 nt, Human
uuuuuaaaaauuaaagaagaagaaaaguaaaa

SEQ ID NO: 282321 - RNA, 32 nt, Human
uuuuuaaaaauuauuaucaggggagaaaaauu

SEQ ID NO: 282322 - RNA, 32 nt, Human
uuuuuaaaacagcaauaauuagccauuuuaaa

SEQ ID NO: 282323 - RNA, 32 nt, Human
uuuuuaaaagaaugauggcaaaaugugcauaa

SEQ ID NO: 282324 - RNA, 32 nt, Human
uuuuuaaaaguggggagaauguuuggggaugu

SEQ ID NO: 282325 - RNA, 32 nt, Human
uuuuuaaaauuaguauuucauuacaaaugucu

SEQ ID NO: 282326 - RNA, 32 nt, Human
uuuuuaaaauuuaaaaacaaaggacuauuuaa

SEQ ID NO: 282327 - RNA, 32 nt, Human
uuuuuaaacaaaacaugacaaccuuggcuuuu

SEQ ID NO: 282328 - RNA, 32 nt, Human
uuuuuaaacagauggaguuacugugaagaagu

SEQ ID NO: 282329 - RNA, 32 nt, Human
uuuuuaaacccgucaggcugcugguaaggcag

SEQ ID NO: 282330 - RNA, 32 nt, Human
uuuuuaaagagccugcaucauuugguucccuc

SEQ ID NO: 282331 - RNA, 32 nt, Human
uuuuuaaagcagauuagauaacaggaacagaa

SEQ ID NO: 282332 - RNA, 32 nt, Human
uuuuuaaagcuauguuaguacacagaacacuu

SEQ ID NO: 282333 - RNA, 32 nt, Human
uuuuuaaagcucugacagucacauauagauug

SEQ ID NO: 282334 - RNA, 32 nt, Human
uuuuuaaaggaaaugcagccuagucuugagaa

SEQ ID NO: 282335 - RNA, 32 nt, Human
uuuuuaaaggaaugccugccugacugaagcuu

SEQ ID NO: 282336 - RNA, 32 nt, Human
uuuuuaaaucaaaaacuuuucauuucagauuu

SEQ ID NO: 282337 - RNA, 32 nt, Human
uuuuuaaauuccaggaacggguagucugacac

SEQ ID NO: 282338 - RNA, 32 nt, Human
uuuuuaaauuucccagggaaggagaccgucag

SEQ ID NO: 282339 - RNA, 32 nt, Human
uuuuuaacaacuaaucaagagugagugaacaa

SEQ ID NO: 282340 - RNA, 28 nt, Human
uuuuuaacaagugcuggguuauucugau

SEQ ID NO: 282341 - RNA, 32 nt, Human
uuuuuaacacauuuaugauucugugauaauau

SEQ ID NO: 282342 - RNA, 32 nt, Human
uuuuuaacaggcugaggcaacauggaucagug

SEQ ID NO: 282343 - RNA, 32 nt, Human
uuuuuaaccucauugcucacauguuaugauuc

SEQ ID NO: 282344 - RNA, 32 nt, Human
uuuuuaacuacccuuaaaaucuugucaaugac

SEQ ID NO: 282345 - RNA, 32 nt, Human
uuuuuaacuccugccuccacacauguucuuga

SEQ ID NO: 282346 - RNA, 32 nt, Human
uuuuuaacugauuuuaacuugauuuauuguaa

SEQ ID NO: 282347 - RNA, 32 nt, Human
uuuuuaacuucuguuccuuuccguaaguggau

SEQ ID NO: 282348 - RNA, 32 nt, Human
uuuuuaacuuugacaacugacuucuguuuccu

SEQ ID NO: 282349 - RNA, 32 nt, Human
uuuuuaagaaacuuaucuguauguuagaaaug

SEQ ID NO: 282350 - RNA, 32 nt, Human
uuuuuaagaaaugccagcugcuguagacccca

SEQ ID NO: 282351 - RNA, 32 nt, Human
uuuuuaagaacacacauugccauggcaggauu

SEQ ID NO: 282352 - RNA, 32 nt, Human
aaaaauacagaauuagccgggcauggugcaug

SEQ ID NO: 282353 - RNA, 32 nt, Human
aaaaauacagaauuagucaggcgugguggugg

SEQ ID NO: 282354 - RNA, 32 nt, Human
aaaaauacagcagaggaaggagaacggcuagc

SEQ ID NO: 282355 - RNA, 32 nt, Human
aaaaauacaucucccucugaccacagacuccu

SEQ ID NO: 282356 - RNA, 32 nt, Human
aaaaauaccuaaaaggaagcuuagaugggcug

SEQ ID NO: 282357 - RNA, 32 nt, Human
aaaaauacugcacuuguagccagauuagcaaa

SEQ ID NO: 282358 - RNA, 32 nt, Human
aaaaauacuuagcacuuggccugagaugccug

SEQ ID NO: 282359 - RNA, 32 nt, Human
aaaaauagaaacuccccacacuguggguaaaa

SEQ ID NO: 282360 - RNA, 32 nt, Human
aaaaauagacuuguuucugcucucauuuuugu

SEQ ID NO: 282361 - RNA, 32 nt, Human
aaaaauagagcugaugcccaaagaugagaaaa

SEQ ID NO: 282362 - RNA, 20 nt, Human
aaaaauagagcugggacuga

SEQ ID NO: 282363 - RNA, 32 nt, Human
aaaaauagagguuguuuacagcacucaguuug

SEQ ID NO: 282364 - RNA, 32 nt, Human
aaaaauagauuugcaaaaagugaacagauugc

SEQ ID NO: 282365 - RNA, 18 nt, Human
aaaaauagcagcugcuga

SEQ ID NO: 282366 - RNA, 32 nt, Human
aaaaauagcuaaaauaugauuguaccacugca

SEQ ID NO: 282367 - RNA, 32 nt, Human
aaaaauaggaagugucagccgggcgcggugcc

SEQ ID NO: 282368 - RNA, 23 nt, Human
aaaaauaggucagcagagauuuc

SEQ ID NO: 282369 - RNA, 23 nt, Human
aaaaauagguuggcagagauuuc

SEQ ID NO: 282370 - RNA, 32 nt, Human
aaaaauaguaaugggcugggcuugguggcuca

SEQ ID NO: 282371 - RNA, 32 nt, Human
aaaaauaguaugagugugaguacuaggaagga

SEQ ID NO: 282372 - RNA, 32 nt, Human
aaaaauauaaaaaguagccaggcgugguggug

SEQ ID NO: 282373 - RNA, 32 nt, Human
aaaaauauacauuuacaaauugugagauuuuu

SEQ ID NO: 282374 - RNA, 32 nt, Human
aaaaauauagcaaaugcagaaccacaaacaau

SEQ ID NO: 282375 - RNA, 32 nt, Human
aaaaauaucaguuccugucacucuuccacccc

SEQ ID NO: 282376 - RNA, 32 nt, Human
aaaaauaucugucuccuuuucacuuucuucag

SEQ ID NO: 282377 - RNA, 32 nt, Human
aaaaauaugaaauuuucaccucuugggguauu

SEQ ID NO: 282378 - RNA, 32 nt, Human
aaaaauaugaccacacuccagcugggaucaca

SEQ ID NO: 282379 - RNA, 32 nt, Human
aaaaauaugguuuccagagaaaaggccaauac

SEQ ID NO: 282380 - RNA, 32 nt, Human
aaaaauaugguuuuucaccaucaaagauuuua

SEQ ID NO: 282381 - RNA, 32 nt, Human
aaaaauauguguaaaauagggaagaaaguuag

SEQ ID NO: 282382 - RNA, 21 nt, Human
aaaaauauugcagugacuuuu

SEQ ID NO: 282383 - RNA, 32 nt, Human
aaaaauauuucaaauaugcagaaaaauaauaa

SEQ ID NO: 282384 - RNA, 32 nt, Human
aaaaaucaaaccaagaaaauagugaguuaaaa

SEQ ID NO: 282385 - RNA, 32 nt, Human
aaaaaucaacagcaaacaaaaccacacaaacc

SEQ ID NO: 282386 - RNA, 32 nt, Human
aaaaaucaacccagcaccagcagcuaccaacc

SEQ ID NO: 282387 - RNA, 32 nt, Human
aaaaaucaaugaaugaagagcucacaggacaa

SEQ ID NO: 282388 - RNA, 32 nt, Human
aaaaaucaauuagaucuaaacaguuauuucug

SEQ ID NO: 282389 - RNA, 32 nt, Human
aaaaaucacacaggcugggugcaguggcucau

SEQ ID NO: 282390 - RNA, 31 nt, Human
aaaaaucacagcuguuggaaaacugaaaagc

SEQ ID NO: 282391 - RNA, 32 nt, Human
aaaaaucacccaugugacacugggugacaugg

SEQ ID NO: 282392 - RNA, 32 nt, Human
aaaaaucacuguuaacagaccuccaggugauu

SEQ ID NO: 282393 - RNA, 32 nt, Human
aaaaaucagccugucugcucuccccacauuag

SEQ ID NO: 282394 - RNA, 32 nt, Human
aaaaaucagccugucugcucucuccuugcuca

SEQ ID NO: 282395 - RNA, 32 nt, Human
aaaaaucaggaaaauguccaagggugggagcc

SEQ ID NO: 282396 - RNA, 32 nt, Human
aaaaaucaguuguagacaccacccucagagau

SEQ ID NO: 282397 - RNA, 31 nt, Human
aaaaaucaguuucauuuucauauuucauaga

SEQ ID NO: 282398 - RNA, 32 nt, Human
aaaaaucauaugaucagcucaauagaugcaaa

SEQ ID NO: 282399 - RNA, 32 nt, Human
aaaaaucaucuacucuaugcaggagauauguu

SEQ ID NO: 282400 - RNA, 32 nt, Human
aaaaaucauucuugagcuccagccuggcuauc

SEQ ID NO: 282401 - RNA, 32 nt, Human
aaaaauccaacuuuauuuuuaguuguaacugc

SEQ ID NO: 282402 - RNA, 32 nt, Human
aaaaauccacugcaccuccacuuggugacuga

SEQ ID NO: 282403 - RNA, 32 nt, Human
aaaaauccagaagagaagaaagacauggcuga

SEQ ID NO: 282404 - RNA, 32 nt, Human
aaaaauccagagagguagugaggugucagagc

SEQ ID NO: 282405 - RNA, 32 nt, Human
aaaaauccagcagaaacagaagaacugugggu

SEQ ID NO: 282406 - RNA, 32 nt, Human
aaaaaucccaggagaaaccuaagaggucuuau

SEQ ID NO: 282407 - RNA, 32 nt, Human
aaaaaucccugagggacauuuugaggcaugaa

SEQ ID NO: 282408 - RNA, 31 nt, Human
aaaaauccgcuuuucugccacagaaacaaaa

SEQ ID NO: 282409 - RNA, 32 nt, Human
aaaaauccuggugaugcuuuucuggauuaaaa

SEQ ID NO: 282410 - RNA, 32 nt, Human
aaaaauccuuaaaucacuuuuguaauccagga

SEQ ID NO: 282411 - RNA, 32 nt, Human
aaaaaucgaggcaagccucuggaacacagcca

SEQ ID NO: 282412 - RNA, 31 nt, Human
aaaaaucgguaaggaacuagcccucaaacuu

SEQ ID NO: 282413 - RNA, 31 nt, Human
aaaaaucuauaaagcauguguugaaaauccu

SEQ ID NO: 282414 - RNA, 32 nt, Human
aaaaaucuauagacuccagcugcuacauuaga

SEQ ID NO: 282415 - RNA, 32 nt, Human
aaaaaucucagcugccaggcugccuuuagggu

SEQ ID NO: 282416 - RNA, 32 nt, Human
aaaaaucucaucuucuuuuccaguagaaaaua

SEQ ID NO: 282417 - RNA, 32 nt, Human
aaaaaucucauggagagggucuguggcagcuu

SEQ ID NO: 282418 - RNA, 32 nt, Human
aaaaaucucuccccaaugcucuccuuaaccuu

SEQ ID NO: 282419 - RNA, 32 nt, Human
aaaaaucucugcugagauguguucuguccagc

SEQ ID NO: 282420 - RNA, 32 nt, Human
aaaaaucugaaauuuccaucuggggauuaacu

SEQ ID NO: 282421 - RNA, 32 nt, Human
aaaaaucugcacuaaaauccccaaacugacag

SEQ ID NO: 282422 - RNA, 32 nt, Human
aaaaaucuggaaagcuuagaggaagcuaagga

SEQ ID NO: 282423 - RNA, 31 nt, Human
aaaaaucuggauuucugaugccaaaggguua

SEQ ID NO: 282424 - RNA, 32 nt, Human
aaaaaucuggguuugacugauuccccuaccuu

SEQ ID NO: 282425 - RNA, 32 nt, Human
aaaaaucuuacuuuucuuguuacuacacaaag

SEQ ID NO: 282426 - RNA, 32 nt, Human
aaaaaucuucgauuucauaaaaggacacacac

SEQ ID NO: 282427 - RNA, 32 nt, Human
aaaaaucuuuccuguuacuuucaccucagguc

SEQ ID NO: 282428 - RNA, 32 nt, Human
aaaaaucuuuugguggaggugccuucagggaa

SEQ ID NO: 282429 - RNA, 29 nt, Human
aaaaaugaacuugccaaaauuggcaguag

SEQ ID NO: 282430 - RNA, 32 nt, Human
aaaaaugaaugagaaaaggaaaagggaagagg

SEQ ID NO: 282431 - RNA, 29 nt, Human
aaaaaugacacuccaaugggcugcagugg

SEQ ID NO: 282432 - RNA, 25 nt, Human
aaaaaugaccaaaacaugucuuucu

SEQ ID NO: 282433 - RNA, 32 nt, Human
aaaaaugacuaaaucugagugguagggaguca

SEQ ID NO: 282434 - RNA, 32 nt, Human
aaaaaugacucauuccagagcuggcgcagaga

SEQ ID NO: 282435 - RNA, 32 nt, Human
aaaaaugacugcccuggcugggcauggcugcc

SEQ ID NO: 282436 - RNA, 32 nt, Human
aaaaaugacuuguuucuguuguacuugagucu

SEQ ID NO: 282437 - RNA, 32 nt, Human
aaaaaugagacaauauauccauaaauucauag

SEQ ID NO: 282438 - RNA, 32 nt, Human
aaaaaugagaccacagggaggggccagcugug

SEQ ID NO: 282439 - RNA, 32 nt, Human
aaaaaugagagagaaaauuaaugugacaaaau

SEQ ID NO: 282440 - RNA, 32 nt, Human
aaaaaugagcugguucagaaggccgaacuggc

SEQ ID NO: 282441 - RNA, 32 nt, Human
aaaaaugaggccauuuucaauccagaggaaga

SEQ ID NO: 282442 - RNA, 32 nt, Human
aaaaaugaugcaaaaucaaaaugaguggcuaa

SEQ ID NO: 282443 - RNA, 32 nt, Human
aaaaaugauggggacuuuucaaagggagccaa

SEQ ID NO: 282444 - RNA, 32 nt, Human
aaaaaugauuuaaaacauuuuaccucagacua

SEQ ID NO: 282445 - RNA, 32 nt, Human
aaaaaugauuuguagagcuaacaugugaaauu

SEQ ID NO: 282446 - RNA, 32 nt, Human
aaaaaugcaaacacccugaggauucagagaac

SEQ ID NO: 282447 - RNA, 22 nt, Human
aaaaaugcaccacaguauuucu

SEQ ID NO: 282448 - RNA, 32 nt, Human
aaaaaugcacuguuacuuacaguuuguuuccu

SEQ ID NO: 282449 - RNA, 32 nt, Human
aaaaaugcagccaggccgggcacgguggcuca

SEQ ID NO: 282450 - RNA, 32 nt, Human
aaaaaugcagcuuuuccaggguugcuggacug

SEQ ID NO: 282451 - RNA, 32 nt, Human
aaaaaugcauaccaaaugaagacugccuauca

SEQ ID NO: 282452 - RNA, 32 nt, Human
aaaaaugcauuuccuguaucauccuuuucaau

SEQ ID NO: 282453 - RNA, 32 nt, Human
aaaaaugccccaggagaauaggcaccggcugg

SEQ ID NO: 282454 - RNA, 32 nt, Human
aaaaaugccccugacacugcaggaugacgguc

SEQ ID NO: 282455 - RNA, 32 nt, Human
aaaaaugccuguuggcuuuucagucuauauuu

SEQ ID NO: 282456 - RNA, 32 nt, Human
aaaaaugcuacaaaugugaaaaacguggcaga

SEQ ID NO: 282457 - RNA, 24 nt, Human
aaaaaugcuagcgacagucuuucu

SEQ ID NO: 282458 - RNA, 32 nt, Human
aaaaaugcuguuuuuggcugggcgcgguggcu

SEQ ID NO: 282459 - RNA, 32 nt, Human
aaaaaugcuugaaaccucuauauuucuuucgu

SEQ ID NO: 282460 - RNA, 32 nt, Human
aaaaaugcuuugcccaucuguagguagacaca

SEQ ID NO: 282461 - RNA, 32 nt, Human
aaaaauggaaaugcucugaagcauuuugggag

SEQ ID NO: 282462 - RNA, 29 nt, Human
aaaaauggagccacuucagcagcagcagc

SEQ ID NO: 282463 - RNA, 32 nt, Human
aaaaauggagugacaccccagacucagucagg

SEQ ID NO: 282464 - RNA, 32 nt, Human
aaaaauggcaaaagccuagauuuacaauuuga

SEQ ID NO: 282465 - RNA, 32 nt, Human
aaaaauggcuuccuggccgggcgugguggcuc

SEQ ID NO: 282466 - RNA, 32 nt, Human
aaaaaugggaaaauaacuugaggccaggagua

SEQ ID NO: 282467 - RNA, 32 nt, Human
aaaaaugggacuuuuugucucagucccaguga

SEQ ID NO: 282468 - RNA, 19 nt, Human
aaaaaugguaacugucaug

SEQ ID NO: 282469 - RNA, 32 nt, Human
aaaaaugguaaguucuaaguuucuccauuaau

SEQ ID NO: 282470 - RNA, 32 nt, Human
aaaaaugguagaaaguacucuuugauguuucu

SEQ ID NO: 282471 - RNA, 32 nt, Human
aaaaauggucaagguucagcauauucuauaug

SEQ ID NO: 282472 - RNA, 32 nt, Human
aaaaaugguggguuugggggaagggagguaag

SEQ ID NO: 282473 - RNA, 32 nt, Human
aaaaauguacaccaggcugggugcgguggcuc

SEQ ID NO: 282474 - RNA, 32 nt, Human
aaaaauguaccugauugcucccaauuaugaga

SEQ ID NO: 282475 - RNA, 22 nt, Human
aaaaauguauggacaguuuuuc

SEQ ID NO: 282476 - RNA, 32 nt, Human
aaaaaugucaaggaacagcaaugucaacagga

SEQ ID NO: 282477 - RNA, 32 nt, Human
aaaaaugucacucaaaacauguaguuuggaaa

SEQ ID NO: 282478 - RNA, 32 nt, Human
aaaaaugucuuauggcugggugcaguggcuca

SEQ ID NO: 282479 - RNA, 32 nt, Human
aaaaaugugaagaaggaggagaagaggaaggc

SEQ ID NO: 282480 - RNA, 32 nt, Human
aaaaaugugcauaccuggauuuccuuggcuuc

SEQ ID NO: 282481 - RNA, 32 nt, Human
aaaaaugugcuagaauccaucuguggccugaa

SEQ ID NO: 282482 - RNA, 32 nt, Human
aaaaauguguacaaaguuaauuuauugcauua

SEQ ID NO: 282483 - RNA, 32 nt, Human
aaaaauguguccguauauuucuguaccugcag

SEQ ID NO: 282484 - RNA, 32 nt, Human
aaaaauguguugaaggaucucucucaguggcu

SEQ ID NO: 282485 - RNA, 32 nt, Human
aaaaauguguuuuguacaugaaguaggaaucg

SEQ ID NO: 282486 - RNA, 32 nt, Human
aaaaauguuauuuuccuccucuuccaacauuu

SEQ ID NO: 282487 - RNA, 32 nt, Human
aaaaauguugcaaauguuaacaugugucacaa

SEQ ID NO: 282488 - RNA, 21 nt, Human
aaaaauuaacugggcauggua

SEQ ID NO: 282489 - RNA, 32 nt, Human
aaaaauuaaggggagagaggaaaacaaaacca

SEQ ID NO: 282490 - RNA, 32 nt, Human
aaaaauuaaucaaguuuucugccugacaagau

SEQ ID NO: 282491 - RNA, 32 nt, Human
aaaaauuacccaggcgugguggugggugacuc

SEQ ID NO: 282492 - RNA, 32 nt, Human
aaaaauuaccucuucaguguuuucucaugcaa

SEQ ID NO: 282493 - RNA, 32 nt, Human
aaaaauuaccugcagguauuuucuuuuuauga

SEQ ID NO: 282494 - RNA, 32 nt, Human
aaaaauuacuaaaaaugacaaguagaagacuu

SEQ ID NO: 282495 - RNA, 23 nt, Human
aaaaauuagagcauucccucuga

SEQ ID NO: 282496 - RNA, 32 nt, Human
aaaaauuagauucuuaaaguguggcaaacaua

SEQ ID NO: 282497 - RNA, 32 nt, Human
aaaaauuagcagccaggugcaguggcucacgc

SEQ ID NO: 282498 - RNA, 23 nt, Human
aaaaauuagccaggcucguggca

SEQ ID NO: 282499 - RNA, 21 nt, Human
aaaaauuagccgggcguggua

SEQ ID NO: 282500 - RNA, 32 nt, Human
aaaaauuauaaucacuaaucuugguucuuuuu

SEQ ID NO: 282501 - RNA, 32 nt, Human
aaaaauuauccccucaccugucucuauucuuu

SEQ ID NO: 282502 - RNA, 32 nt, Human
aaaaauuaucuauuucuccauuacccacugua

SEQ ID NO: 282503 - RNA, 32 nt, Human
aaaaauuauuaaacauuuaaaaauuaguuuau

SEQ ID NO: 282504 - RNA, 32 nt, Human
aaaaauuauuauacacacugucucucagcuca

SEQ ID NO: 282505 - RNA, 32 nt, Human
aaaaauuauucuaugucuuuguccucaaucua

SEQ ID NO: 282506 - RNA, 32 nt, Human
aaaaauuauuuuuguggacuuggguaucaaug

SEQ ID NO: 282507 - RNA, 32 nt, Human
aaaaauucaaccacagauuuauacaaggguua

SEQ ID NO: 282508 - RNA, 32 nt, Human
aaaaauucaagcacuucuucccuccacccuca

SEQ ID NO: 282509 - RNA, 32 nt, Human
aaaaauucaccuuugauugcauaaggcaauua

SEQ ID NO: 282510 - RNA, 32 nt, Human
aaaaauucagcaaaccauuuuuaaaguagaag

SEQ ID NO: 282511 - RNA, 32 nt, Human
aaaaauucagggauauggccauguguuccagg

SEQ ID NO: 282512 - RNA, 32 nt, Human
aaaaauucaguccaaaacuccuuggggagaug

SEQ ID NO: 282513 - RNA, 31 nt, Human
aaaaauucaguguccuccaugccaagcagaa

SEQ ID NO: 282514 - RNA, 32 nt, Human
aaaaauucaguuaaccuauuuugugucuguag

SEQ ID NO: 282515 - RNA, 32 nt, Human
aaaaauuccaucuucauuacugccuuaugaca

SEQ ID NO: 282516 - RNA, 32 nt, Human
aaaaauuccugcuugccugccugccugccaau

SEQ ID NO: 282517 - RNA, 32 nt, Human
aaaaauucuaaccacuguaacaacaguuuuug

SEQ ID NO: 282518 - RNA, 32 nt, Human
aaaaauucuaagaaauccacuagaaaacuauu

SEQ ID NO: 282519 - RNA, 32 nt, Human
aaaaauucucaccucauuuaugguuuaaaacu

SEQ ID NO: 282520 - RNA, 32 nt, Human
aaaaauucuccaggaauuucauaguuuggacc

SEQ ID NO: 282521 - RNA, 32 nt, Human
aaaaauucugcugcacucugcuugggccuuga

SEQ ID NO: 282522 - RNA, 32 nt, Human
aaaaauucuugaguaugcauuaaccuugcucu

SEQ ID NO: 282523 - RNA, 32 nt, Human
aaaaauugaacaaaacaggguaccagcacgga

SEQ ID NO: 282524 - RNA, 32 nt, Human
aaaaauugaauccauucugcugacuucuuccu

SEQ ID NO: 282525 - RNA, 32 nt, Human
aaaaauugacauccuuuguacuuucuuuaauc

SEQ ID NO: 282526 - RNA, 32 nt, Human
aaaaauugaccaaaguaagaaaaugcaaguuc

SEQ ID NO: 282527 - RNA, 32 nt, Human
aaaaauuggaagccaaaccaguucuuaaaugc

SEQ ID NO: 282528 - RNA, 32 nt, Human
aaaaauuggcaucaaaaaggaaguucuuauga

SEQ ID NO: 282529 - RNA, 32 nt, Human
aaaaauuguagaaauauagacugugaaaaaga

SEQ ID NO: 282530 - RNA, 32 nt, Human
aaaaauugucccacaucucccgaaccucucca

SEQ ID NO: 282531 - RNA, 32 nt, Human
aaaaauuguugacugcaguuucggaaguuuga

SEQ ID NO: 282532 - RNA, 32 nt, Human
aaaaauuguuuuucaaaugucaccaauaaaag

SEQ ID NO: 282533 - RNA, 32 nt, Human
aaaaauuuaaacaugaagcacacacacaaaaa

SEQ ID NO: 282534 - RNA, 32 nt, Human
aaaaauuuaaaccaaagaaaucuuaaaaucag

SEQ ID NO: 282535 - RNA, 32 nt, Human
aaaaauuuacgcaccuuuaaucuuggguguuc

SEQ ID NO: 282536 - RNA, 32 nt, Human
aaaaauuuacgucucauuauuuugccaucuca

SEQ ID NO: 282537 - RNA, 32 nt, Human
aaaaauuuagcuggguguaguggugcacaccu

SEQ ID NO: 282538 - RNA, 32 nt, Human
aaaaauuucagagagaaucaagauaccuuuuu

SEQ ID NO: 282539 - RNA, 32 nt, Human
aaaaauuucauagccuguaucuaucauuuaaa

SEQ ID NO: 282540 - RNA, 32 nt, Human
aaaaauuugaacgaggcuagugcaauguuuug

SEQ ID NO: 282541 - RNA, 32 nt, Human
aaaaauuugggucuggugcuguucauugaguc

SEQ ID NO: 282542 - RNA, 32 nt, Human
aaaaauuuuaagaaguuuuccuuguggggcug

SEQ ID NO: 282543 - RNA, 32 nt, Human
aaaaauuuuguccuaauucccaauuucagagu

SEQ ID NO: 282544 - RNA, 32 nt, Human
aaaaauuuuuaaguucacaauucagugguauu

SEQ ID NO: 282545 - RNA, 32 nt, Human
aaaaauuuuucccaguguucugauaugugacu

SEQ ID NO: 282546 - RNA, 18 nt, Human
aaaacaaaaaacaaaaca

SEQ ID NO: 282547 - RNA, 23 nt, Human
aaaacaaaaaacaaaacaaaaca

SEQ ID NO: 282548 - RNA, 23 nt, Human
aaaacaaaaacaaaaacaaaaca

SEQ ID NO: 282549 - RNA, 22 nt, Human
aaaacaaaaacaaaacaaaaca

SEQ ID NO: 282550 - RNA, 23 nt, Human
aaaacaaaaacaaaacaacaaca

SEQ ID NO: 282551 - RNA, 32 nt, Human
aaaacaaaaacacacccaaacacaccacauug

SEQ ID NO: 282552 - RNA, 19 nt, Human
aaaacaaaacaaaacaaaa

SEQ ID NO: 282553 - RNA, 20 nt, Human
aaaacaaaacaaaacaaaac

SEQ ID NO: 282554 - RNA, 21 nt, Human
aaaacaaaacaaaacaaaaca

SEQ ID NO: 282555 - RNA, 20 nt, Human
aaaacaaaacaaaacaaaca

SEQ ID NO: 282556 - RNA, 22 nt, Human
aaaacaaaacaaaacaaacaca

SEQ ID NO: 282557 - RNA, 22 nt, Human
aaaacaaaacaaaacaacaaca

SEQ ID NO: 282558 - RNA, 21 nt, Human
aaaacaaaacaaaauaaaaca

SEQ ID NO: 282559 - RNA, 20 nt, Human
aaaacaaaacaaacaaaaca

SEQ ID NO: 282560 - RNA, 19 nt, Human
aaaacaaaacaaacaaaca

SEQ ID NO: 282561 - RNA, 32 nt, Human
aaaacaaaaccagccaaccuauguuacacgug

SEQ ID NO: 282562 - RNA, 32 nt, Human
aaaacaaaacuaaaaacuacucauaaucuuac

SEQ ID NO: 282563 - RNA, 32 nt, Human
aaaacaaaagccccagcccugccgaggccugg

SEQ ID NO: 282564 - RNA, 32 nt, Human
aaaacaaaagccuucuuuggaauagauggauu

SEQ ID NO: 282565 - RNA, 32 nt, Human
aaaacaaaaugccaguugcauugguuuccccu

SEQ ID NO: 282566 - RNA, 32 nt, Human
aaaacaaaauuagcugagcaugguggugugug

SEQ ID NO: 282567 - RNA, 32 nt, Human
aaaacaaacaaaaaccuguuguguacacacac

SEQ ID NO: 282568 - RNA, 19 nt, Human
aaaacaaacuagugccaag

SEQ ID NO: 282569 - RNA, 32 nt, Human
aaaacaaacugcuugacccaggaacaaguggc

SEQ ID NO: 282570 - RNA, 32 nt, Human
aaaacaaagauccugcccuuguggaccuuaug

SEQ ID NO: 282571 - RNA, 32 nt, Human
aaaacaaagcuacaauuugcccucauacacac

SEQ ID NO: 282572 - RNA, 32 nt, Human
aaaacaaagcuguauagggauccucucucucu

SEQ ID NO: 282573 - RNA, 32 nt, Human
aaaacaaaggccagauucugccacugcauccu

SEQ ID NO: 282574 - RNA, 32 nt, Human
aaaacaaaggccugugcuccacccaggaggug

SEQ ID NO: 282575 - RNA, 32 nt, Human
aaaacaaaguucaauuuagcuggauuucugaa

SEQ ID NO: 282576 - RNA, 32 nt, Human
aaaacaaauagaagaaaaugaggguuacagua

SEQ ID NO: 282577 - RNA, 32 nt, Human
aaaacaaauggcucuuucacaugugcuuuauu

SEQ ID NO: 282578 - RNA, 32 nt, Human
aaaacaaaugugaaggggagagacaggggcca

SEQ ID NO: 282579 - RNA, 32 nt, Human
aaaacaaaugugaaggggagagacaggggccg

SEQ ID NO: 282580 - RNA, 19 nt, Human
aaaacaacaaaacaaaaca

SEQ ID NO: 282581 - RNA, 32 nt, Human
aaaacaacaaacauucauucucucacacaguc

SEQ ID NO: 282582 - RNA, 20 nt, Human
aaaacaacaacaacaaaaca

SEQ ID NO: 282583 - RNA, 32 nt, Human
aaaacaacaacaacaaaacaacacauuggucu

SEQ ID NO: 282584 - RNA, 32 nt, Human
aaaacaacaacaacaaaacaccucugucaaug

SEQ ID NO: 282585 - RNA, 32 nt, Human
aaaacaacaacaacaacaaaaacccuauuccu

SEQ ID NO: 282586 - RNA, 32 nt, Human
aaaacaacaacaacacuauccuauaaacuaga

SEQ ID NO: 282587 - RNA, 32 nt, Human
aaaacaacaacaggcugggcgcaguggcucac

SEQ ID NO: 282588 - RNA, 32 nt, Human
aaaacaacacaaaaucauuaucuuacaguucu

SEQ ID NO: 282589 - RNA, 32 nt, Human
aaaacaacagaaggaggggaucaaagauagcu

SEQ ID NO: 282590 - RNA, 18 nt, Human
aaaacaacagcaaacaaa

SEQ ID NO: 282591 - RNA, 32 nt, Human
aaaacaacaggaagcagcuuacaaacucggug

SEQ ID NO: 282592 - RNA, 19 nt, Human
aaaacaaccaagugccaag

SEQ ID NO: 282593 - RNA, 32 nt, Human
aaaacaaccagcucucgacucacuaacucaaa

SEQ ID NO: 282594 - RNA, 32 nt, Human
aaaacaaccugaucucuucccucucucccagc

SEQ ID NO: 282595 - RNA, 32 nt, Human
aaaacaacuaugaagaucugcagcuauucuuu

SEQ ID NO: 282596 - RNA, 32 nt, Human
aaaacaacuguccuuuucuccccaccaccccu

SEQ ID NO: 282597 - RNA, 32 nt, Human
aaaacaacuuuugacagaggcccaucaaaccc

SEQ ID NO: 282598 - RNA, 32 nt, Human
aaaacaagagcagcagcugucaggcccagcug

SEQ ID NO: 282599 - RNA, 32 nt, Human
aaaacaagaugaaacacagaaaaguugaaacc

SEQ ID NO: 282600 - RNA, 20 nt, Human
aaaacaagcaaaacaaaaca

SEQ ID NO: 282601 - RNA, 32 nt, Human
aaaacaagcagaagccaagggaaagugggcug

SEQ ID NO: 282602 - RNA, 32 nt, Human
aaaacaagcccgggcuuggaggccuguacuga

SEQ ID NO: 282603 - RNA, 32 nt, Human
aaaacaaguaaguaugaucuguuaucaaugca

SEQ ID NO: 282604 - RNA, 32 nt, Human
aaaacaagugccucucacugggcuuugucaac

SEQ ID NO: 282605 - RNA, 19 nt, Human
aaaacaaguugaguagaga

SEQ ID NO: 282606 - RNA, 19 nt, Human
aaaacaauaaaacaaaaca

SEQ ID NO: 282607 - RNA, 18 nt, Human
aaaacaaugcaguacagg

SEQ ID NO: 282608 - RNA, 18 nt, Human
aaaacaaugcuuaguaca

SEQ ID NO: 282609 - RNA, 32 nt, Human
aaaacaauguaaguaaaggauauuucugaauc

SEQ ID NO: 282610 - RNA, 32 nt, Human
aaaacaauucggcggccaguguuuccacccag

SEQ ID NO: 282611 - RNA, 32 nt, Human
aaaacaauucuccaauccccucuccuuugguc

SEQ ID NO: 282612 - RNA, 32 nt, Human
aaaacacaaaugaaaacucacacccacccacc

SEQ ID NO: 282613 - RNA, 32 nt, Human
aaaacacaaugagggagugaaauguuacccaa

SEQ ID NO: 282614 - RNA, 32 nt, Human
aaaacacacagaacugcauuuguagcucugua

SEQ ID NO: 282615 - RNA, 32 nt, Human
aaaacacacagcugaguucuuagaguugauuc

SEQ ID NO: 282616 - RNA, 32 nt, Human
aaaacacacaguuaccugguucacagauagcu

SEQ ID NO: 282617 - RNA, 32 nt, Human
aaaacacacuucuccagcaacacuccaucagc

SEQ ID NO: 282618 - RNA, 32 nt, Human
aaaacacagaagcaugaguggcaaguggcggg

SEQ ID NO: 282619 - RNA, 32 nt, Human
aaaacacagagguguucugaccugcaacuuga

SEQ ID NO: 282620 - RNA, 32 nt, Human
aaaacacagcaucucuucuaggccaacuccag

SEQ ID NO: 282621 - RNA, 19 nt, Human
aaaacacagccagcccaag

SEQ ID NO: 282622 - RNA, 32 nt, Human
aaaacacagugauguucagaacagaacacaag

SEQ ID NO: 282623 - RNA, 32 nt, Human
aaaacacaguguuggucaaagacaucacuggc

SEQ ID NO: 282624 - RNA, 32 nt, Human
aaaacacauaaauaaaacuacaugcaccauca

SEQ ID NO: 282625 - RNA, 32 nt, Human
aaaacacaucuucuuaacggauggugaccuau

SEQ ID NO: 282626 - RNA, 32 nt, Human
aaaacacaugcagagucacauccucauccuag

SEQ ID NO: 282627 - RNA, 32 nt, Human
aaaacaccaaagauuucucugaagcagaucuc

SEQ ID NO: 282628 - RNA, 32 nt, Human
aaaacaccaagugccuggaaucaguuguuugu

SEQ ID NO: 282629 - RNA, 32 nt, Human
aaaacaccacugcuuccuacccagguggcgac

SEQ ID NO: 282630 - RNA, 32 nt, Human
aaaacacccuugaaaauauaugacuuugaaua

SEQ ID NO: 282631 - RNA, 32 nt, Human
aaaacaccucaagcagcacugcagucucccau

SEQ ID NO: 282632 - RNA, 32 nt, Human
aaaacacgacuccugaaucauguuccauuacu

SEQ ID NO: 282633 - RNA, 32 nt, Human
aaaacacgacuggccgggcucccugccuucuc

SEQ ID NO: 282634 - RNA, 32 nt, Human
aaaacacgguaccuccagaacacuucagcucc

SEQ ID NO: 282635 - RNA, 32 nt, Human
aaaacacuauaaaugugaaaacuacaaggaag

SEQ ID NO: 282636 - RNA, 32 nt, Human
aaaacacucagcugcaaguccaaagccacaag

SEQ ID NO: 282637 - RNA, 32 nt, Human
aaaacacuccaaaauacugacuccuuuucucc

SEQ ID NO: 282638 - RNA, 32 nt, Human
aaaacacucuugguggugucuuggggauuugg

SEQ ID NO: 282639 - RNA, 32 nt, Human
aaaacacucuuuaacaucacagucacagauuu

SEQ ID NO: 282640 - RNA, 32 nt, Human
aaaacacugaaauugagucugaccucaggagu

SEQ ID NO: 282641 - RNA, 32 nt, Human
aaaacacugaggauuuuaguuuugaaaucaaa

SEQ ID NO: 282642 - RNA, 32 nt, Human
aaaacacuggaaacaagcuaaauguucauuau

SEQ ID NO: 282643 - RNA, 32 nt, Human
aaaacacuuccucuugguuauucugagaacua

SEQ ID NO: 282644 - RNA, 32 nt, Human
aaaacacuuuggggucacaaugcccaggaccg

SEQ ID NO: 282645 - RNA, 23 nt, Human
aaaacagaaacaaaaucaaaaca

SEQ ID NO: 282646 - RNA, 32 nt, Human
aaaacagaaacacauaguauuugcacuuugua

SEQ ID NO: 282647 - RNA, 32 nt, Human
aaaacagaaauggcaugcuuuacccaucuuac

SEQ ID NO: 282648 - RNA, 22 nt, Human
aaaacagaacaaaaacaaaaca

SEQ ID NO: 282649 - RNA, 21 nt, Human
aaaacagaacaaaacaaaaca

SEQ ID NO: 282650 - RNA, 32 nt, Human
aaaacagaacaacaguggacuuuuuaugauau

SEQ ID NO: 282651 - RNA, 32 nt, Human
aaaacagaagugaagaguuucagagcaucaga

SEQ ID NO: 282652 - RNA, 32 nt, Human
aaaacagaauacccugcaggaagaaugggaug

SEQ ID NO: 282653 - RNA, 19 nt, Human
aaaacagaauaucuacaga

SEQ ID NO: 282654 - RNA, 32 nt, Human
aaaacagaaugaccggauggccaucuguccug

SEQ ID NO: 282655 - RNA, 20 nt, Human
aaaacagacagaacuacaga

SEQ ID NO: 282656 - RNA, 22 nt, Human
aaaacagacaguuuaguucaga

SEQ ID NO: 282657 - RNA, 19 nt, Human
aaaacagaccaggcacaga

SEQ ID NO: 282658 - RNA, 18 nt, Human
aaaacagaccuggacaga

SEQ ID NO: 282659 - RNA, 32 nt, Human
aaaacagacgcuggagcuccagccuccuggcg

SEQ ID NO: 282660 - RNA, 20 nt, Human
aaaacagagccaaagacaga

SEQ ID NO: 282661 - RNA, 19 nt, Human
aaaacagagccaacaacag

SEQ ID NO: 282662 - RNA, 18 nt, Human
aaaacagagccuccuaga

SEQ ID NO: 282663 - RNA, 32 nt, Human
aaaacagagccugccuaaccaggcccagccag

SEQ ID NO: 282664 - RNA, 19 nt, Human
aaaacagagcucagcugca

SEQ ID NO: 282665 - RNA, 20 nt, Human
aaaacagagcugaaaacgga

SEQ ID NO: 282666 - RNA, 19 nt, Human
aaaacagagcugggcaagg

SEQ ID NO: 282667 - RNA, 32 nt, Human
aaaacagaggguggaggaacccugaaggacaa

SEQ ID NO: 282668 - RNA, 32 nt, Human
aaaacagauaaggcucuuccuggcagaguuua

SEQ ID NO: 282669 - RNA, 32 nt, Human
aaaacagaugcccccagaaggggccagugcgg

SEQ ID NO: 282670 - RNA, 18 nt, Human
aaaacagauuucuacaga

SEQ ID NO: 282671 - RNA, 32 nt, Human
aaaacagcaaggaaauggacucuccccagagc

SEQ ID NO: 282672 - RNA, 32 nt, Human
aaaacagcagaaguccaagaauacagcuguag

SEQ ID NO: 282673 - RNA, 32 nt, Human
aaaacagcagcucccuguggagcugaagggcg

SEQ ID NO: 282674 - RNA, 32 nt, Human
aaaacagcaguuuuacuuuucucacaaaaacu

SEQ ID NO: 282675 - RNA, 32 nt, Human
aaaacagcaucugcuuuccucuuggccaugag

SEQ ID NO: 282676 - RNA, 32 nt, Human
aaaacagcauuuucaguuccuucuucaauuag

SEQ ID NO: 282677 - RNA, 32 nt, Human
aaaacagccaaagaaggaagaggaggaaaagg

SEQ ID NO: 282678 - RNA, 32 nt, Human
aaaacagccagccuggccaccaguuguaccuu

SEQ ID NO: 282679 - RNA, 32 nt, Human
aaaacagcccggagccugcagcccagccccac

SEQ ID NO: 282680 - RNA, 32 nt, Human
aaaacagccuccagccucucccuccagcacaa

SEQ ID NO: 282681 - RNA, 32 nt, Human
aaaacagccuccaggaaaugcaaucccagaga

SEQ ID NO: 282682 - RNA, 32 nt, Human
aaaacagccugaaaguguaugcauguaccaua

SEQ ID NO: 282683 - RNA, 32 nt, Human
aaaacagcgaauguccaucaacaggaaucgga

SEQ ID NO: 282684 - RNA, 32 nt, Human
aaaacagcuaaguaccuagaagagcucccugc

SEQ ID NO: 282685 - RNA, 32 nt, Human
aaaacagcuccucuauauuuccaccucuuucu

SEQ ID NO: 282686 - RNA, 18 nt, Human
aaaacagcugaggacaga

SEQ ID NO: 282687 - RNA, 32 nt, Human
aaaacagcugcaaccucggauaccagcacggg

SEQ ID NO: 282688 - RNA, 32 nt, Human
aaaacagcuucugcuacuaaaauguucucauc

SEQ ID NO: 282689 - RNA, 32 nt, Human
aaaacaggaaauaugggcugggcacagugucc

SEQ ID NO: 282690 - RNA, 32 nt, Human
aaaacaggaacccaccaaaccaaccaaucaac

SEQ ID NO: 282691 - RNA, 32 nt, Human
aaaacaggacucaagauuguagggaauggaag

SEQ ID NO: 282692 - RNA, 26 nt, Human
aaaacaggagguggagguugcaguga

SEQ ID NO: 282693 - RNA, 32 nt, Human
aaaacaggagguggagguugcagugagccgag

SEQ ID NO: 282694 - RNA, 18 nt, Human
aaaacaggcagguacagg

SEQ ID NO: 282695 - RNA, 32 nt, Human
aaaacaggccaggacuugucucugugcugaaa

SEQ ID NO: 282696 - RNA, 32 nt, Human
aaaacaggccuccccucccucucucggcacca

SEQ ID NO: 282697 - RNA, 19 nt, Human
aaaacaggcuggcacuaga

SEQ ID NO: 282698 - RNA, 18 nt, Human
aaaacaggggcacacaga

SEQ ID NO: 282699 - RNA, 32 nt, Human
aaaacagggggagcggaagggagccacuggcc

SEQ ID NO: 282700 - RNA, 19 nt, Human
aaaacagguccagaacaga

SEQ ID NO: 282701 - RNA, 20 nt, Human
aaaacagguugcaguaaaga

SEQ ID NO: 282702 - RNA, 32 nt, Human
aaaacagucaucuagaauucacugaguuuugu

SEQ ID NO: 282703 - RNA, 32 nt, Human
aaaacagucccaaagcuauuauagauguuaau

SEQ ID NO: 282704 - RNA, 32 nt, Human
aaaacagucuucuccccucccucgccuuccau

SEQ ID NO: 282705 - RNA, 32 nt, Human
aaaacagugaacacacgcuuucugguucuagu

SEQ ID NO: 282706 - RNA, 32 nt, Human
aaaacagugccaaaccuccacagcucauuucu

SEQ ID NO: 282707 - RNA, 25 nt, Human
aaaacagugucauuguguguguucc

SEQ ID NO: 282708 - RNA, 31 nt, Human
aaaacaguugagagaggaagaauuugaagag

SEQ ID NO: 282709 - RNA, 18 nt, Human
aaaacaguuuggugcaga

SEQ ID NO: 282710 - RNA, 32 nt, Human
aaaacauaaaguggagaaaggaaacccuauuc

SEQ ID NO: 282711 - RNA, 32 nt, Human
aaaacauaaccagccauuggcuauuuaaacuu

SEQ ID NO: 282712 - RNA, 32 nt, Human
aaaacauaaucccaacugggugcaguggcuca

SEQ ID NO: 282713 - RNA, 32 nt, Human
aaaacauaaugaauggggucaccuguaagaaa

SEQ ID NO: 282714 - RNA, 32 nt, Human
aaaacauaccuggaucuugcuaucugucaggg

SEQ ID NO: 282715 - RNA, 32 nt, Human
aaaacauaugauccauuaaguuggaguguuua

SEQ ID NO: 282716 - RNA, 32 nt, Human
aaaacaucaacacuaagguuugaugucaugug

SEQ ID NO: 282717 - RNA, 32 nt, Human
aaaacaucacagucuuaucauuuuaggguaaa

SEQ ID NO: 282718 - RNA, 32 nt, Human
aaaacaucagcucgcaagaggcugaggcagga

SEQ ID NO: 282719 - RNA, 32 nt, Human
aaaacaucauguuucaggaaggaacugaaccc

SEQ ID NO: 282720 - RNA, 32 nt, Human
aaaacaucccagagaagggaaauccucuugcu

SEQ ID NO: 282721 - RNA, 32 nt, Human
aaaacaucuuuuccugauggcuggcaggcagu

SEQ ID NO: 282722 - RNA, 32 nt, Human
aaaacaugaaugacugugucugccugucccca

SEQ ID NO: 282723 - RNA, 32 nt, Human
aaaacaugaccuuccacaauccuuagaaucug

SEQ ID NO: 282724 - RNA, 32 nt, Human
aaaacaugcagccuuaagccucagcaaagagc

SEQ ID NO: 282725 - RNA, 32 nt, Human
aaaacaugccuguuguccuggcuuuuuaucca

SEQ ID NO: 282726 - RNA, 32 nt, Human
aaaacaugcuucagaagaacuggcaccccuug

SEQ ID NO: 282727 - RNA, 32 nt, Human
aaaacauggacugaugggucugcuccaggcca

SEQ ID NO: 282728 - RNA, 32 nt, Human
aaaacauggagugcagagacaccaccagguac

SEQ ID NO: 282729 - RNA, 32 nt, Human
aaaacauggccugcuggcuggggagugggaac

SEQ ID NO: 282730 - RNA, 32 nt, Human
aaaacaugucaaaaucaugaccucuuugaaug

SEQ ID NO: 282731 - RNA, 32 nt, Human
aaaacauguuuucuggugcucaucucacaugc

SEQ ID NO: 282732 - RNA, 32 nt, Human
aaaacauuauaggcugggcaugguggcuuacg

SEQ ID NO: 282733 - RNA, 32 nt, Human
aaaacauucaauaacauaccucacccgagagc

SEQ ID NO: 282734 - RNA, 32 nt, Human
aaaacauuccaucuuguaggcaguguuccuca

SEQ ID NO: 282735 - RNA, 32 nt, Human
aaaacauucuucuuuuccugcuggugucaccc

SEQ ID NO: 282736 - RNA, 22 nt, Human
aaaacauugaccuguguguuuu

SEQ ID NO: 282737 - RNA, 32 nt, Human
aaaacauuuaacauaaugguugugaaauguaa

SEQ ID NO: 282738 - RNA, 32 nt, Human
aaaacauuugcugccauuacagagguauuaaa

SEQ ID NO: 282739 - RNA, 32 nt, Human
aaaaccaaaaggauuggguuugauugagcuuc

SEQ ID NO: 282740 - RNA, 32 nt, Human
aaaaccaaacaugcuuauaacauuaagaaaaa

SEQ ID NO: 282741 - RNA, 32 nt, Human
aaaaccaaaccacaagacagacuugcaaaaga

SEQ ID NO: 282742 - RNA, 32 nt, Human
aaaaccaaagauuuccucugagcaacuuucaa

SEQ ID NO: 282743 - RNA, 32 nt, Human
aaaaccaaauguuacugcucaacugaaauaug

SEQ ID NO: 282744 - RNA, 32 nt, Human
aaaaccaagauggggagaagaaaacagcacaa

SEQ ID NO: 282745 - RNA, 32 nt, Human
aaaaccaagcccaggccgggggcgguggcuca

SEQ ID NO: 282746 - RNA, 32 nt, Human
aaaaccaaucaauuacuagaugaguggaugga

SEQ ID NO: 282747 - RNA, 32 nt, Human
aaaaccaauguucuacaacuuggaaaguuuuc

SEQ ID NO: 282748 - RNA, 32 nt, Human
aaaaccacaaaugacaaaaacaaaacggacuc

SEQ ID NO: 282749 - RNA, 32 nt, Human
aaaaccacaaccaccagaaaacaaauaacaaa

SEQ ID NO: 282750 - RNA, 32 nt, Human
aaaaccacauagaaggguaaucccggaaaugc

SEQ ID NO: 282751 - RNA, 32 nt, Human
aaaaccaccaaaaggccagugccucaacucuu

SEQ ID NO: 282752 - RNA, 32 nt, Human
aaaaccaccacccuccagccugggcaacguag

SEQ ID NO: 282753 - RNA, 32 nt, Human
aaaaccacucgccagagcuguggugucagaaa

SEQ ID NO: 282754 - RNA, 32 nt, Human
aaaaccacuguacauuuuuauacagugauaaa

SEQ ID NO: 282755 - RNA, 32 nt, Human
aaaaccacuuuuuccuccugggccucugggcc

SEQ ID NO: 282756 - RNA, 32 nt, Human
aaaaccagaacaagggcucugagauagggucc

SEQ ID NO: 282757 - RNA, 22 nt, Human
aaaaccagagauccaguacaga

SEQ ID NO: 282758 - RNA, 32 nt, Human
aaaaccagccaagaucuguucacacaccucug

SEQ ID NO: 282759 - RNA, 32 nt, Human
aaaaccagccaggcagagguuuuaaugucugu

SEQ ID NO: 282760 - RNA, 23 nt, Human
aaaaccagcccggcgcuggcgga

SEQ ID NO: 282761 - RNA, 32 nt, Human
aaaaccagccugaccaacguggagaaaccucg

SEQ ID NO: 282762 - RNA, 32 nt, Human
aaaaccagccugggcaacauagcaagacccca

SEQ ID NO: 282763 - RNA, 32 nt, Human
aaaaccagccugggcaauauagugagaccgua

SEQ ID NO: 282764 - RNA, 19 nt, Human
aaaaccagcucccuuugga

SEQ ID NO: 282765 - RNA, 32 nt, Human
aaaaccagcuuauuuuccuucuuacggacuca

SEQ ID NO: 282766 - RNA, 22 nt, Human
aaaaccagcuucuggaccugga

SEQ ID NO: 282767 - RNA, 32 nt, Human
aaaaccaggaagagcuuaagagcauauuaaaa

SEQ ID NO: 282768 - RNA, 32 nt, Human
aaaaccaggccuccucacagacugccaagucc

SEQ ID NO: 282769 - RNA, 32 nt, Human
aaaaccaggcugggacagcccccuguuccuga

SEQ ID NO: 282770 - RNA, 32 nt, Human
aaaaccaguuuucugcaacauucaggagccaa

SEQ ID NO: 282771 - RNA, 32 nt, Human
aaaaccauaaacaucaguucuaugggacaauu

SEQ ID NO: 282772 - RNA, 32 nt, Human
aaaaccauaugauugggcugggcauagugguu

SEQ ID NO: 282773 - RNA, 32 nt, Human
aaaaccauccaggucacggggcaccaaauuug

SEQ ID NO: 282774 - RNA, 32 nt, Human
aaaaccaucuguagucagcagcauccuggugg

SEQ ID NO: 282775 - RNA, 32 nt, Human
aaaaccaucuguccucuuugcaauaccacuga

SEQ ID NO: 282776 - RNA, 32 nt, Human
aaaaccaugaaaccacccacacuggagagccg

SEQ ID NO: 282777 - RNA, 32 nt, Human
aaaaccaugaacauuggcuaugaugaagauua

SEQ ID NO: 282778 - RNA, 32 nt, Human
aaaacccaaagaucucacagguccagccacug

SEQ ID NO: 282779 - RNA, 32 nt, Human
aaaacccaccagcccuuugcuuccugcuuccu

SEQ ID NO: 282780 - RNA, 32 nt, Human
aaaacccacuccucccagaauaugcuuagagg

SEQ ID NO: 282781 - RNA, 32 nt, Human
aaaacccagaacucaaguagggcagaaggugg

SEQ ID NO: 282782 - RNA, 32 nt, Human
aaaacccaggaggcagagcuugcagugagccg

SEQ ID NO: 282783 - RNA, 32 nt, Human
aaaacccaggccgauggcugggcacgguggcu

SEQ ID NO: 282784 - RNA, 32 nt, Human
aaaaccccaagugccuggagacccgagcccca

SEQ ID NO: 282785 - RNA, 32 nt, Human
aaaaccccaauacuguuuucugaucuauguac

SEQ ID NO: 282786 - RNA, 32 nt, Human
aaaaccccacaaaaucagcugcaaguaaaucc

SEQ ID NO: 282787 - RNA, 32 nt, Human
aaaaccccaccauucagccuagucaacaacaa

SEQ ID NO: 282788 - RNA, 32 nt, Human
aaaacccccagcucugugccccaugcuccuug

SEQ ID NO: 282789 - RNA, 32 nt, Human
aaaacccccuagucucagcccagaagcuccuu

SEQ ID NO: 282790 - RNA, 32 nt, Human
aaaaccccugcucugcuuuuggccuuggauau

SEQ ID NO: 282791 - RNA, 32 nt, Human
aaaaccccuuccagaaaacauggaugcauuug

SEQ ID NO: 282792 - RNA, 32 nt, Human
aaaacccgaagaggaggcggaccaggagaaga

SEQ ID NO: 282793 - RNA, 32 nt, Human
aaaacccgacuugccccugccugaugcaugua

SEQ ID NO: 282794 - RNA, 29 nt, Human
aaaacccgucuuuaugugccuggaauccc

SEQ ID NO: 282795 - RNA, 32 nt, Human
aaaacccuaacgagguaggagauguuucccug

SEQ ID NO: 282796 - RNA, 32 nt, Human
aaaacccuaccccucucucucccucucucaau

SEQ ID NO: 282797 - RNA, 32 nt, Human
aaaacccuccauccucaagcagucucuucuuu

SEQ ID NO: 282798 - RNA, 32 nt, Human
aaaacccucccgcugccugugucgaaguguag

SEQ ID NO: 282799 - RNA, 32 nt, Human
aaaacccucuacuguggguagugaaccuaggu

SEQ ID NO: 282800 - RNA, 32 nt, Human
aaaacccugacuuuaguuguaaaacaauaaaa

SEQ ID NO: 282801 - RNA, 32 nt, Human
aaaacccugcgcugcccccuuuacagaggcac

SEQ ID NO: 282802 - RNA, 21 nt, Human
aaaacccuucaaggauuacug

SEQ ID NO: 282803 - RNA, 22 nt, Human
aaaacccuucacugauggaugc

SEQ ID NO: 282804 - RNA, 32 nt, Human
aaaacccuuggcucugagucuuguugugaaua

SEQ ID NO: 282805 - RNA, 20 nt, Human
aaaacccuuguagaucugcu

SEQ ID NO: 282806 - RNA, 32 nt, Human
aaaacccuuuccauuggcagaaucuccuuuuu

SEQ ID NO: 282807 - RNA, 22 nt, Human
aaaacccuuugccaaaucugcu

SEQ ID NO: 282808 - RNA, 32 nt, Human
aaaaccgagcuggggcugggagaggacaguua

SEQ ID NO: 282809 - RNA, 32 nt, Human
aaaaccggaauggugaaggugacagcagucgg

SEQ ID NO: 282810 - RNA, 32 nt, Human
aaaaccguccaggaagggaggcugcagccccg

SEQ ID NO: 282811 - RNA, 32 nt, Human
aaaaccgucuccucuaaaaauaccaaaauuag

SEQ ID NO: 282812 - RNA, 32 nt, Human
aaaaccuaacagaaaaacuaaaauuagaggac

SEQ ID NO: 282813 - RNA, 32 nt, Human
aaaaccuaacuuaauaguaugcaccuguaaca

SEQ ID NO: 282814 - RNA, 32 nt, Human
aaaaccuaauccgguuuaagcacagcagguuu

SEQ ID NO: 282815 - RNA, 32 nt, Human
aaaaccuaggaaauaguccacuugcuccuaua

SEQ ID NO: 282816 - RNA, 32 nt, Human
aaaaccuaguugggagugcgaggcagagaacg

SEQ ID NO: 282817 - RNA, 32 nt, Human
aaaaccuaguuucacuccuccccuucuuccau

SEQ ID NO: 282818 - RNA, 32 nt, Human
aaaaccuaucggaagaaggcaagccuccccaa

SEQ ID NO: 282819 - RNA, 32 nt, Human
aaaaccuauguccacacaacacaugaauguga

SEQ ID NO: 282820 - RNA, 32 nt, Human
aaaaccucaaaccggcgccccuugggggccgg

SEQ ID NO: 282821 - RNA, 32 nt, Human
aaaaccucacucuuuccccucccuucuccccu

SEQ ID NO: 282822 - RNA, 32 nt, Human
aaaaccucagaagggaaaacuccaaaccaguu

SEQ ID NO: 282823 - RNA, 32 nt, Human
aaaaccuccaucuggacaccagacaccgcagc

SEQ ID NO: 282824 - RNA, 32 nt, Human
aaaaccuccaucugguaacaaacagcagcuac

SEQ ID NO: 282825 - RNA, 32 nt, Human
aaaaccuccauucugucagggcagaacagagc

SEQ ID NO: 282826 - RNA, 32 nt, Human
aaaaccuccuagaaguuagauuauuugcuacu

SEQ ID NO: 282827 - RNA, 32 nt, Human
aaaaccucgaagauggguauggcacaguucau

SEQ ID NO: 282828 - RNA, 32 nt, Human
aaaaccucucuaaccagcuccccaccucaacc

SEQ ID NO: 282829 - RNA, 32 nt, Human
aaaaccucucucugugacaggaacaguccaaa

SEQ ID NO: 282830 - RNA, 32 nt, Human
aaaaccucucuugccagggaaugggggaaggg

SEQ ID NO: 282831 - RNA, 32 nt, Human
aaaaccugaaaauuaauucagggugaaaaugu

SEQ ID NO: 282832 - RNA, 32 nt, Human
aaaaccugaagggcaggcagagcugcucccga

SEQ ID NO: 282833 - RNA, 32 nt, Human
aaaaccugagacauagucauuccugacauucu

SEQ ID NO: 282834 - RNA, 32 nt, Human
aaaaccugagaggaaggggacaaguagccacc

SEQ ID NO: 282835 - RNA, 32 nt, Human
aaaaccugagcagcaacugugucuuuagagcu

SEQ ID NO: 282836 - RNA, 32 nt, Human
aaaaccugaugcuggggacacagcaucagcuc

SEQ ID NO: 282837 - RNA, 32 nt, Human
aaaaccugcacccauuucaugggugaguuacu

SEQ ID NO: 282838 - RNA, 31 nt, Human
aaaaccugcagaagaacuggcuucgggaauu

SEQ ID NO: 282839 - RNA, 32 nt, Human
aaaaccugccugccugguugggccuucagcug

SEQ ID NO: 282840 - RNA, 31 nt, Human
aaaaccugcgagacagggccugugcacgagu

SEQ ID NO: 282841 - RNA, 32 nt, Human
aaaaccugcuccauguauggaccuggaaggcc

SEQ ID NO: 282842 - RNA, 32 nt, Human
aaaaccugcugggugggcucuuuccccgcgag

SEQ ID NO: 282843 - RNA, 20 nt, Human
aaaaccugcuucucuucuca

SEQ ID NO: 282844 - RNA, 32 nt, Human
aaaaccugcuuugcacaauccuauuugaugcc

SEQ ID NO: 282845 - RNA, 32 nt, Human
aaaaccuuaaaguugugcuguuccuaaacuag

SEQ ID NO: 282846 - RNA, 32 nt, Human
aaaaccuuccagccuugccugcuuggugucca

SEQ ID NO: 282847 - RNA, 32 nt, Human
aaaaccuuccuugagcugccaugcuuuucccc

SEQ ID NO: 282848 - RNA, 32 nt, Human
aaaaccuuucaucacagagauucaucucagca

SEQ ID NO: 282849 - RNA, 32 nt, Human
aaaaccuuugagguagaccaggauuucuaauc

SEQ ID NO: 282850 - RNA, 32 nt, Human
aaaaccuuugcaucuucugauagucuagccaa

SEQ ID NO: 282851 - RNA, 32 nt, Human
aaaaccuuugucaggcugggcgcgguggcuca

SEQ ID NO: 282852 - RNA, 24 nt, Human
aaaaccuuugucccucaguuccag

SEQ ID NO: 282853 - RNA, 32 nt, Human
aaaaccuuuuacuauaugaaacuuuacaacac

SEQ ID NO: 282854 - RNA, 32 nt, Human
aaaacgaaaagcuucuuccuccaagagcccau

SEQ ID NO: 282855 - RNA, 32 nt, Human
aaaacgaaaagcuugaaggacugggagaugug

SEQ ID NO: 282856 - RNA, 32 nt, Human
aaaacgaaccaacagaccaggcaucagcacaa

SEQ ID NO: 282857 - RNA, 32 nt, Human
aaaacgaacgaaggacaacaagaaguggauga

SEQ ID NO: 282858 - RNA, 32 nt, Human
aaaacgaccacugaaaacaaugccgguggcaa

SEQ ID NO: 282859 - RNA, 32 nt, Human
aaaacgacuguggcuugauguugauacacauu

SEQ ID NO: 282860 - RNA, 32 nt, Human
aaaacgaucccaaggaaagaugauuuguaugu

SEQ ID NO: 282861 - RNA, 32 nt, Human
aaaacgauucuagcucuggcucugucauuggc

SEQ ID NO: 282862 - RNA, 32 nt, Human
aaaacgcaaaccuaacuugcucugcuuguuuu

SEQ ID NO: 282863 - RNA, 32 nt, Human
aaaacgcaagggaaguuucauuccauuuauac

SEQ ID NO: 282864 - RNA, 32 nt, Human
aaaacgcacaugcucugccauccacaccgccu

SEQ ID NO: 282865 - RNA, 32 nt, Human
aaaacgcagucacugguguuucuugaauugcu

SEQ ID NO: 282866 - RNA, 32 nt, Human
aaaacgcucagaauuucacacugugaauccac

SEQ ID NO: 282867 - RNA, 32 nt, Human
aaaacgcugcuggcuggagccaccucccuccc

SEQ ID NO: 282868 - RNA, 32 nt, Human
aaaacgcuuccaucuuuauccagagguaauca

SEQ ID NO: 282869 - RNA, 32 nt, Human
aaaacgcuuccucuugcagugcagaugggaug

SEQ ID NO: 282870 - RNA, 32 nt, Human
aaaacggaaagugccucccggacccccagagg

SEQ ID NO: 282871 - RNA, 32 nt, Human
aaaacggcggguggguggaggaugcggugcgc

SEQ ID NO: 282872 - RNA, 32 nt, Human
aaaacgggagcuauuucacagagcugagcuuc

SEQ ID NO: 282873 - RNA, 32 nt, Human
aaaacggggcacccacucccaccuccaucugu

SEQ ID NO: 282874 - RNA, 32 nt, Human
aaaacggggugagcugaguagcuggguuucug

SEQ ID NO: 282875 - RNA, 32 nt, Human
aaaacggucaugcugucccaggagaggauccu

SEQ ID NO: 282876 - RNA, 32 nt, Human
aaaacguacuuucuccccacuaguuuacacca

SEQ ID NO: 282877 - RNA, 32 nt, Human
aaaacguccugauauuuaaagaacaaagcauc

SEQ ID NO: 282878 - RNA, 32 nt, Human
aaaacgugaagagcgagagaucaaagaaagaa

SEQ ID NO: 282879 - RNA, 32 nt, Human
aaaacguuucuucaccuuuuauuuaccauuca

SEQ ID NO: 282880 - RNA, 32 nt, Human
aaaacuaaaaaccaaacacaccaccuuccuug

SEQ ID NO: 282881 - RNA, 32 nt, Human
aaaacuaaaaauaggcugggcgugguggcuca

SEQ ID NO: 282882 - RNA, 32 nt, Human
aaaacuaacaaccaaccaaccaaccaaccaac

SEQ ID NO: 282883 - RNA, 32 nt, Human
aaaacuaagaaauaacugaaugcugaaaaaua

SEQ ID NO: 282884 - RNA, 32 nt, Human
aaaacuaauuuccaaaauauaagcuguuuuca

SEQ ID NO: 282885 - RNA, 32 nt, Human
aaaacuaauuuuucugccuuuuaccaaaaaua

SEQ ID NO: 282886 - RNA, 32 nt, Human
aaaacuacaauucccagcauuccuguggugcc

SEQ ID NO: 282887 - RNA, 32 nt, Human
aaaacuacacgggcuucagagcaggguucaag

SEQ ID NO: 282888 - RNA, 32 nt, Human
aaaacuacauacuuggacaucuguaaaucuuu

SEQ ID NO: 282889 - RNA, 32 nt, Human
aaaacuaccagaccugaauuugcucaugugua

SEQ ID NO: 282890 - RNA, 32 nt, Human
aaaacuagagccuuugccagugcuaaaagucu

SEQ ID NO: 282891 - RNA, 32 nt, Human
aaaacuaggguuuuaaaaguaucuucuaaaaa

SEQ ID NO: 282892 - RNA, 23 nt, Human
aaaacuaguuuccaagugccaag

SEQ ID NO: 282893 - RNA, 32 nt, Human
aaaacuauacauuuagaauggagcaguuuaau

SEQ ID NO: 282894 - RNA, 32 nt, Human
aaaacuauagggaugaagaacagaucaguugu

SEQ ID NO: 282895 - RNA, 32 nt, Human
aaaacuauaguccuauacaaaaauuagcuggg

SEQ ID NO: 282896 - RNA, 32 nt, Human
aaaacuaugaugucacucaccauucugauaau

SEQ ID NO: 282897 - RNA, 32 nt, Human
aaaacuauggagaugguaaaaagagaaaagga

SEQ ID NO: 282898 - RNA, 32 nt, Human
aaaacuauuaguaauagcuauuugggaccaga

SEQ ID NO: 282899 - RNA, 32 nt, Human
aaaacuauugcagaaaauaguggauuuuggau

SEQ ID NO: 282900 - RNA, 32 nt, Human
aaaacuauugguuuguuauucuguguuuuccu

SEQ ID NO: 282901 - RNA, 32 nt, Human
aaaacuauuuuggaucccagcacuuugggaag

SEQ ID NO: 282902 - RNA, 32 nt, Human
aaaacucaacaucaaaugcucugaugugcuau

SEQ ID NO: 282903 - RNA, 32 nt, Human
aaaacucaagcuuggcucuaaguguuuccuug

SEQ ID NO: 282904 - RNA, 32 nt, Human
aaaacucaaguuagaagcauaccauuuuccuu

SEQ ID NO: 282905 - RNA, 32 nt, Human
aaaacucacagaacuauguacuuuaaaaagau

SEQ ID NO: 282906 - RNA, 32 nt, Human
aaaacucaccuuaaaauuugagcaggucguug

SEQ ID NO: 282907 - RNA, 32 nt, Human
aaaacucacgccccaaacaaaacgcaaggaga

SEQ ID NO: 282908 - RNA, 32 nt, Human
aaaacucacuauggcaugcuucccuccuggug

SEQ ID NO: 282909 - RNA, 32 nt, Human
aaaacucaggaguucaagaccagccuaggcaa

SEQ ID NO: 282910 - RNA, 32 nt, Human
aaaacuccaugggggcugggcgugguggcuca

SEQ ID NO: 282911 - RNA, 32 nt, Human
aaaacuccucaaguagcuuccuuaaaauguca

SEQ ID NO: 282912 - RNA, 32 nt, Human
aaaacuccucuuuugggggcucaggggcagga

SEQ ID NO: 282913 - RNA, 32 nt, Human
aaaacuccugaaguuuugcuuccccuucuaua

SEQ ID NO: 282914 - RNA, 32 nt, Human
aaaacuccuguaucuaaagaaauacgguuggg

SEQ ID NO: 282915 - RNA, 32 nt, Human
aaaacuccuugcaaguguucgagcuuuggauc

SEQ ID NO: 282916 - RNA, 32 nt, Human
aaaacucgcugcugccccaaccuggcuugaca

SEQ ID NO: 282917 - RNA, 32 nt, Human
aaaacucguagaugccagagacaggagucgaa

SEQ ID NO: 282918 - RNA, 32 nt, Human
aaaacucuaggaacagauggcuucacugaagu

SEQ ID NO: 282919 - RNA, 32 nt, Human
aaaacucucaguuguuuauuauccugaucaag

SEQ ID NO: 282920 - RNA, 32 nt, Human
aaaacucuccacucuccuccccuagaugccau

SEQ ID NO: 282921 - RNA, 32 nt, Human
aaaacucugaggaaggagauucugcuaguaaa

SEQ ID NO: 282922 - RNA, 32 nt, Human
aaaacucugcagcauuaaacaacguguaugca

SEQ ID NO: 282923 - RNA, 32 nt, Human
aaaacucuucccuuggagagucacuguucacc

SEQ ID NO: 282924 - RNA, 32 nt, Human
aaaacucuuggcuaauugacccacguugcuua

SEQ ID NO: 282925 - RNA, 32 nt, Human
aaaacucuuucauuuaauucaaaugcuauuuu

SEQ ID NO: 282926 - RNA, 32 nt, Human
aaaacugaaagccacuggauccuggucuagcu

SEQ ID NO: 282927 - RNA, 32 nt, Human
aaaacugaaauucccuguucuaguuccuaaca

SEQ ID NO: 282928 - RNA, 32 nt, Human
aaaacugaagacauagaggacucagaucaaag

SEQ ID NO: 282929 - RNA, 32 nt, Human
aaaacugaagauggaaguuuuggccggugcuc

SEQ ID NO: 282930 - RNA, 32 nt, Human
aaaacugaauuugcuuaacacugcuacauaau

SEQ ID NO: 282931 - RNA, 32 nt, Human
aaaacugacagagaaguaauaaaccuauugau

SEQ ID NO: 282932 - RNA, 32 nt, Human
aaaacugacauagagaaaaggcuggagagaga

SEQ ID NO: 282933 - RNA, 32 nt, Human
aaaacugacguccacaugaaaccugcaggcca

SEQ ID NO: 282934 - RNA, 32 nt, Human
aaaacugagacucagacaggaaagggaaggcc

SEQ ID NO: 282935 - RNA, 32 nt, Human
aaaacugagacucucacuuugugaauucacug

SEQ ID NO: 282936 - RNA, 32 nt, Human
aaaacugaggccaccugguucaacaucaccuu

SEQ ID NO: 282937 - RNA, 32 nt, Human
aaaacugagguggucagguucaucucuucaaa

SEQ ID NO: 282938 - RNA, 32 nt, Human
aaaacugauggugacagaggaauauauugacu

SEQ ID NO: 282939 - RNA, 32 nt, Human
aaaacugcaacuuguaaaugugguaaagaguu

SEQ ID NO: 282940 - RNA, 32 nt, Human
aaaacugcaaugcugggaaaagaaggaaacau

SEQ ID NO: 282941 - RNA, 32 nt, Human
aaaacugcagugagccaugguugcaccacugc

SEQ ID NO: 282942 - RNA, 32 nt, Human
aaaacugcccugcuggagugguucugaaccug

SEQ ID NO: 282943 - RNA, 32 nt, Human
aaaacugccucaccugagacaagugccugcug

SEQ ID NO: 282944 - RNA, 32 nt, Human
aaaacugccuuaaaauauucauaguuaauaca

SEQ ID NO: 282945 - RNA, 32 nt, Human
aaaacugcuagugccaguuuucuuguuugccu

SEQ ID NO: 282946 - RNA, 32 nt, Human
aaaacugcuaguggagucacagacacacucug

SEQ ID NO: 282947 - RNA, 32 nt, Human
aaaacugcuaucucuaauacgguaccaauccu

SEQ ID NO: 282948 - RNA, 32 nt, Human
aaaacugcugacuguuuucucuugagagggug

SEQ ID NO: 282949 - RNA, 32 nt, Human
aaaacugcugcggccuuccaacuccugguauc

SEQ ID NO: 282950 - RNA, 32 nt, Human
aaaacugcuggguuuuguauuaauuaaauuau

SEQ ID NO: 282951 - RNA, 32 nt, Human
aaaacugcuugccugugguagacaccugcaug

SEQ ID NO: 282952 - RNA, 32 nt, Human
aaaacuggaaacaucugauuucugaacuauca

SEQ ID NO: 282953 - RNA, 32 nt, Human
aaaacuggaacggugaaggugacagcagucgg

SEQ ID NO: 282954 - RNA, 32 nt, Human
aaaacuggaagagaccagauagguacagaacu

SEQ ID NO: 282955 - RNA, 32 nt, Human
aaaacuggacaggccaggcaugguggcucaug

SEQ ID NO: 282956 - RNA, 32 nt, Human
aaaacuggaccuguaauuuggccaugggaaga

SEQ ID NO: 282957 - RNA, 32 nt, Human
aaaacuggagaaacaaauauccugccaccucu

SEQ ID NO: 282958 - RNA, 32 nt, Human
aaaacugggggugggaguagggagcuaguuug

SEQ ID NO: 282959 - RNA, 32 nt, Human
aaaacugguaacaggcugggugcaauggcuca

SEQ ID NO: 282960 - RNA, 32 nt, Human
aaaacuggucauuuuucucaaacuacagagug

SEQ ID NO: 282961 - RNA, 32 nt, Human
aaaacugguguuuucuaaagaaacaggauagg

SEQ ID NO: 282962 - RNA, 32 nt, Human
aaaacuguagaggcacgaaacagauucauggu

SEQ ID NO: 282963 - RNA, 24 nt, Human
aaaacuguccugcucagugccaag

SEQ ID NO: 282964 - RNA, 32 nt, Human
aaaacugugauccaguugagccacuuuguccc

SEQ ID NO: 282965 - RNA, 32 nt, Human
aaaacuguggcaagaaaaauguaaugagcaau

SEQ ID NO: 282966 - RNA, 32 nt, Human
aaaacuguuacccguggugugcagagcguccu

SEQ ID NO: 282967 - RNA, 32 nt, Human
aaaacuguugcugcacacaucuguacucguca

SEQ ID NO: 282968 - RNA, 32 nt, Human
aaaacuguuucuucuauuccugguucauagga

SEQ ID NO: 282969 - RNA, 32 nt, Human
aaaacuguuuuuaucuaagauauuugacuuaa

SEQ ID NO: 282970 - RNA, 32 nt, Human
aaaacuuaaagaaaggaaggcugggcauuguu

SEQ ID NO: 282971 - RNA, 32 nt, Human
aaaacuuaacauauuuacuaagccacaagaaa

SEQ ID NO: 282972 - RNA, 32 nt, Human
aaaacuuacaagucaagccuagccugauaauc

SEQ ID NO: 282973 - RNA, 32 nt, Human
aaaacuuaccucuugcacuaucaugccuugaa

SEQ ID NO: 282974 - RNA, 32 nt, Human
aaaacuuaggacaggauguccccaaauuaaga

SEQ ID NO: 282975 - RNA, 32 nt, Human
aaaacuuaguccuaaucccagcacuuugggag

SEQ ID NO: 282976 - RNA, 32 nt, Human
aaaacuuaguccucucaguuccccagaaucau

SEQ ID NO: 282977 - RNA, 32 nt, Human
aaaacuuaguguggcaucagcaccaacagcac

SEQ ID NO: 282978 - RNA, 32 nt, Human
aaaacuuauuccagguauuaaagguuaaauug

SEQ ID NO: 282979 - RNA, 32 nt, Human
aaaacuucacacuuguuaccauuuagaaguuu

SEQ ID NO: 282980 - RNA, 32 nt, Human
aaaacuucacuugcuuggauuaggcaaggcuc

SEQ ID NO: 282981 - RNA, 32 nt, Human
aaaacuucagcacagaaauagauguggacuuu

SEQ ID NO: 282982 - RNA, 32 nt, Human
aaaacuucaguuauagaaguguuucaaggcua

SEQ ID NO: 282983 - RNA, 32 nt, Human
aaaacuuccccugacagaggguggcagcccca

SEQ ID NO: 282984 - RNA, 32 nt, Human
aaaacuuccuuucugagaaguuaguguuaagg

SEQ ID NO: 282985 - RNA, 32 nt, Human
aaaacuucucucuguuugccugccuccaacag

SEQ ID NO: 282986 - RNA, 31 nt, Human
aaaacuugacauaccuaacauuuaaaauugu

SEQ ID NO: 282987 - RNA, 32 nt, Human
aaaacuugacccugccugcaccaaaggauucu

SEQ ID NO: 282988 - RNA, 32 nt, Human
aaaacuugauguaaauuguaccaaugaauacg

SEQ ID NO: 282989 - RNA, 32 nt, Human
aaaacuuggauggccucaaaagguucuugaac

SEQ ID NO: 282990 - RNA, 32 nt, Human
aaaacuuggucaucuucacuguguuaucuuua

SEQ ID NO: 282991 - RNA, 32 nt, Human
aaaacuuguaacagcagcaucuugccugcaaa

SEQ ID NO: 282992 - RNA, 22 nt, Human
aaaacuuguguuuguguguuuu

SEQ ID NO: 282993 - RNA, 24 nt, Human
aaaacuuuaauacuaaaagcacuu

SEQ ID NO: 282994 - RNA, 32 nt, Human
aaaacuuuagaugauaaaauuagccgggcgug

SEQ ID NO: 282995 - RNA, 32 nt, Human
aaaacuuuaguaaacccuaaguaaagucaaaa

SEQ ID NO: 282996 - RNA, 31 nt, Human
aaaacuuuaguacuuuuccaugcagauuugu

SEQ ID NO: 282997 - RNA, 32 nt, Human
aaaacuuuccuacugcuucaguugaaggaaaa

SEQ ID NO: 282998 - RNA, 32 nt, Human
aaaacuuucuauaaugccuuauuugaauguua

SEQ ID NO: 282999 - RNA, 19 nt, Human
aaaacuuugggagucccag

SEQ ID NO: 283000 - RNA, 32 nt, Human
aaaacuuuuugaagaagcaccccucuuucaug

SEQ ID NO: 283001 - RNA, 32 nt, Human
aaaagaaaaagaaagaaagaaagaaaaagaaa

SEQ ID NO: 283002 - RNA, 32 nt, Human
aaaagaaaaaucaagacacaucauaggacuaa

SEQ ID NO: 283003 - RNA, 32 nt, Human
aaaagaaaaauguaggcaucauagccauucag

SEQ ID NO: 283004 - RNA, 32 nt, Human
aaaagaaaacucaggaaacagaucuuggggga

SEQ ID NO: 283005 - RNA, 32 nt, Human
aaaagaaaagaaaagaaagagaaaagaaaaga

SEQ ID NO: 283006 - RNA, 32 nt, Human
aaaagaaaauagaauguggccacuucacuauc

SEQ ID NO: 283007 - RNA, 32 nt, Human
aaaagaaacugaaagugucugccugggauaaa

SEQ ID NO: 283008 - RNA, 32 nt, Human
aaaagaaacugacaugguaauuuggauagggu

SEQ ID NO: 283009 - RNA, 32 nt, Human
aaaagaaacuuaggaauacagaguaagcauuu

SEQ ID NO: 283010 - RNA, 32 nt, Human
aaaagaaagaagccagaaaauauuaucaaccc

SEQ ID NO: 283011 - RNA, 32 nt, Human
aaaagaaagauaaaacacaggucaccaauuuu

SEQ ID NO: 283012 - RNA, 32 nt, Human
aaaagaaagcagcuuguuuugaaagaagaaac

SEQ ID NO: 283013 - RNA, 32 nt, Human
aaaagaaagcaggaagguggguaaauaaaaau

SEQ ID NO: 283014 - RNA, 32 nt, Human
aaaagaaagccaaaccacuguacuuauauuug

SEQ ID NO: 283015 - RNA, 32 nt, Human
aaaagaaaggaaagcugccuuggcagaaggau

SEQ ID NO: 283016 - RNA, 32 nt, Human
aaaagaaaugaaguacucacacaugccacaac

SEQ ID NO: 283017 - RNA, 32 nt, Human
aaaagaaaugaguaugcuacuauagggagagu

SEQ ID NO: 283018 - RNA, 32 nt, Human
aaaagaaauucacugucuuuuaauagugauuu

SEQ ID NO: 283019 - RNA, 32 nt, Human
aaaagaacaaagauaaaccagccucaaucccg

SEQ ID NO: 283020 - RNA, 32 nt, Human
aaaagaacagaacuuugcccacugcacacuug

SEQ ID NO: 283021 - RNA, 32 nt, Human
aaaagaacagcaggugcagccagcucuagaca

SEQ ID NO: 283022 - RNA, 32 nt, Human
aaaagaacaggcugggauuacaggcgugagcc

SEQ ID NO: 283023 - RNA, 32 nt, Human
aaaagaacauuagaguauagaucaugugaaau

SEQ ID NO: 283024 - RNA, 32 nt, Human
aaaagaaccagcugccuccaggcagccagccc

SEQ ID NO: 283025 - RNA, 32 nt, Human
aaaagaaccaucaacacaagugacaugucaua

SEQ ID NO: 283026 - RNA, 32 nt, Human
aaaagaacugcaaucacuacuccaaacuuuaa

SEQ ID NO: 283027 - RNA, 32 nt, Human
aaaagaagaaagacacaaagaaaauaaucuaa

SEQ ID NO: 283028 - RNA, 32 nt, Human
aaaagaagaaguagaugaugaggcagauagca

SEQ ID NO: 283029 - RNA, 32 nt, Human
aaaagaagaccagcauggcugaagcgagcccu

SEQ ID NO: 283030 - RNA, 32 nt, Human
aaaagaagacccagagagugucacuccucuuu

SEQ ID NO: 283031 - RNA, 32 nt, Human
aaaagaagagacauuaagaguuccugaaauuu

SEQ ID NO: 283032 - RNA, 32 nt, Human
aaaagaagagagggaggaagaaagggagagag

SEQ ID NO: 283033 - RNA, 32 nt, Human
aaaagaagagcaagagaaagagaaacaaaaau

SEQ ID NO: 283034 - RNA, 32 nt, Human
aaaagaagagccucuuucugcagccgacuuag

SEQ ID NO: 283035 - RNA, 32 nt, Human
aaaagaagaggaggaggagagcgacgggacgg

SEQ ID NO: 283036 - RNA, 32 nt, Human
aaaagaagagggcucaggacaaggcccugagg

SEQ ID NO: 283037 - RNA, 32 nt, Human
aaaagaagauucaggcccugagaggucucagc

SEQ ID NO: 283038 - RNA, 32 nt, Human
aaaagaagccugggcggagagcagagcccgac

SEQ ID NO: 283039 - RNA, 32 nt, Human
aaaagaagcugguuuucaucugcuguaugugc

SEQ ID NO: 283040 - RNA, 32 nt, Human
aaaagaaggaaaaugaguuucccuugaggcaa

SEQ ID NO: 283041 - RNA, 31 nt, Human
aaaagaaggaagagagaaggaagaauggcaa

SEQ ID NO: 283042 - RNA, 32 nt, Human
aaaagaaggaagagagaaggaagaauggcaaa

SEQ ID NO: 283043 - RNA, 32 nt, Human
aaaagaaggagggagagagggaggaaggaaga

SEQ ID NO: 283044 - RNA, 32 nt, Human
aaaagaagguaccagaucugugcacuggggcg

SEQ ID NO: 283045 - RNA, 32 nt, Human
aaaagaaguauguaacccacugugcugucaag

SEQ ID NO: 283046 - RNA, 32 nt, Human
aaaagaaguucagacacuucuggaaaugaagc

SEQ ID NO: 283047 - RNA, 32 nt, Human
aaaagaaguuuggaaucggauucacaggaucu

SEQ ID NO: 283048 - RNA, 32 nt, Human
aaaagaaguuuucaguucugaagaagucauuu

SEQ ID NO: 283049 - RNA, 32 nt, Human
aaaagaauaaagacauuccuggaaucacuccu

SEQ ID NO: 283050 - RNA, 32 nt, Human
aaaagaauaucugaccaucacagagauccaga

SEQ ID NO: 283051 - RNA, 32 nt, Human
aaaagaauauugaggcugggugcaaugcauca

SEQ ID NO: 283052 - RNA, 32 nt, Human
aaaagaaucugcauccuggaaaccagaagaaa

SEQ ID NO: 283053 - RNA, 32 nt, Human
aaaagaaugaaggauauauacacaucaaaugu

SEQ ID NO: 283054 - RNA, 32 nt, Human
aaaagaaugauggcaaaaugugcauaacauua

SEQ ID NO: 283055 - RNA, 32 nt, Human
aaaagaauggugacucauuuggacucuuaucu

SEQ ID NO: 283056 - RNA, 32 nt, Human
aaaagaauugaaugaaaagucaggagaucaga

SEQ ID NO: 283057 - RNA, 32 nt, Human
aaaagacacauuccagaagcucaccaggcuac

SEQ ID NO: 283058 - RNA, 32 nt, Human
aaaagacaccaucuaugaaccaggaagcaggg

SEQ ID NO: 283059 - RNA, 32 nt, Human
aaaagacagaggagagaagcaagagacaaccc

SEQ ID NO: 283060 - RNA, 32 nt, Human
aaaagacagcgugggcugggcgugguggcuca

SEQ ID NO: 283061 - RNA, 32 nt, Human
aaaagacagggugggagggaggagggagugcu

SEQ ID NO: 283062 - RNA, 24 nt, Human
aaaagacaguugugaaucuaauca

SEQ ID NO: 283063 - RNA, 32 nt, Human
aaaagacaguuuaaaaggcauggauuuuggua

SEQ ID NO: 283064 - RNA, 32 nt, Human
aaaagacaucggucaguaacgagcacgaugug

SEQ ID NO: 283065 - RNA, 32 nt, Human
aaaagacaucggucaguacgagcacgaugugg

SEQ ID NO: 283066 - RNA, 32 nt, Human
aaaagaccaacuuuauuuuaacaaugucauau

SEQ ID NO: 283067 - RNA, 32 nt, Human
aaaagaccaagggccagcauugcuacuuuugu

SEQ ID NO: 283068 - RNA, 32 nt, Human
aaaagaccacauacccagcacccaugaaauaa

SEQ ID NO: 283069 - RNA, 32 nt, Human
aaaagaccaccuuucuccccugagaggagcuu

SEQ ID NO: 283070 - RNA, 32 nt, Human
aaaagaccagcuggucccagauucgcugcugg

SEQ ID NO: 283071 - RNA, 32 nt, Human
aaaagacccuuuccucucagguuucuuuuaaa

SEQ ID NO: 283072 - RNA, 32 nt, Human
aaaagaccucagggaaccucucccuggaaaga

SEQ ID NO: 283073 - RNA, 32 nt, Human
aaaagaccuuaguaguuugcaggcuggaccuu

SEQ ID NO: 283074 - RNA, 32 nt, Human
aaaagaccuuuggagcaaagcugaugacaacu

SEQ ID NO: 283075 - RNA, 29 nt, Human
aaaagacgcuuuccucuccuccuuuagag

SEQ ID NO: 283076 - RNA, 32 nt, Human
aaaagacgugccuuaaggaacccgccgcgugc

SEQ ID NO: 283077 - RNA, 32 nt, Human
aaaagacuagacaauuacuauguggucauucu

SEQ ID NO: 283078 - RNA, 32 nt, Human
aaaagacucaaagggacagagcacagacuggc

SEQ ID NO: 283079 - RNA, 32 nt, Human
aaaagacucaccaaguaaaaucgcguuucuga

SEQ ID NO: 283080 - RNA, 32 nt, Human
aaaagacucagaaaauuccccucgcaugacau

SEQ ID NO: 283081 - RNA, 32 nt, Human
aaaagacucagaggagagagauaaggaaggaa

SEQ ID NO: 283082 - RNA, 32 nt, Human
aaaagacucagcccugccuccgggaacucaca

SEQ ID NO: 283083 - RNA, 24 nt, Human
aaaagacucaguuccacccagcca

SEQ ID NO: 283084 - RNA, 22 nt, Human
aaaagacuccaggaccccgcca

SEQ ID NO: 283085 - RNA, 32 nt, Human
aaaagacucccugugguguucagaaucacucc

SEQ ID NO: 283086 - RNA, 32 nt, Human
aaaagacuccuacgaagaacuguuuuuguuuu

SEQ ID NO: 283087 - RNA, 32 nt, Human
aaaagacuccugguuccccuguugauuuguga

SEQ ID NO: 283088 - RNA, 32 nt, Human
aaaagacucuuauuucggcuuuaaucacagaa

SEQ ID NO: 283089 - RNA, 32 nt, Human
aaaagacugcagcugcugaaguucugagccgg

SEQ ID NO: 283090 - RNA, 32 nt, Human
aaaagacuggaaggggaaaggaagggaaggga

SEQ ID NO: 283091 - RNA, 32 nt, Human
aaaagacugugcaaccugaaacccaggaaagc

SEQ ID NO: 283092 - RNA, 32 nt, Human
aaaagacuuggccuuggcugggcaugguggcu

SEQ ID NO: 283093 - RNA, 32 nt, Human
aaaagagaaaacaggcugggcccgguggcuca

SEQ ID NO: 283094 - RNA, 32 nt, Human
aaaagagaaagaggagaagaagaaugaugagc

SEQ ID NO: 283095 - RNA, 32 nt, Human
aaaagagaaagcccacagaagaggugcuccac

SEQ ID NO: 283096 - RNA, 32 nt, Human
aaaagagaaaugcaggaagcucagggggcagu

SEQ ID NO: 283097 - RNA, 32 nt, Human
aaaagagaagagucacaggaagcucaucuccu

SEQ ID NO: 283098 - RNA, 32 nt, Human
aaaagagaagauguuugacuugcucaaaguca

SEQ ID NO: 283099 - RNA, 32 nt, Human
aaaagagaaggggagagcgaggggacgagagc

SEQ ID NO: 283100 - RNA, 32 nt, Human
aaaagagaagugaagcagugucucacaggguc

SEQ ID NO: 283101 - RNA, 32 nt, Human
aaaagagaaucucauuggcccaccucaucgcu

SEQ ID NO: 283102 - RNA, 32 nt, Human
aaaagagaaugagccaguggcaugagaucagu

SEQ ID NO: 283103 - RNA, 32 nt, Human
aaaagagacaaaugaagccacagggaaaguga

SEQ ID NO: 283104 - RNA, 32 nt, Human
aaaagagacuagaggagcaggagaaggagcag

SEQ ID NO: 283105 - RNA, 32 nt, Human
aaaagagagaaaaggaacagcaggaagagaag

SEQ ID NO: 283106 - RNA, 32 nt, Human
aaaagagagaaagagaaaggaaugcugguuua

SEQ ID NO: 283107 - RNA, 32 nt, Human
aaaagagagagggagaggaagggcugaaagcc

SEQ ID NO: 283108 - RNA, 32 nt, Human
aaaagagagaugggaucccacuauauugcaca

SEQ ID NO: 283109 - RNA, 32 nt, Human
aaaagagagcacgccuuccgaagaacccucau

SEQ ID NO: 283110 - RNA, 32 nt, Human
aaaagagagcauugucguucucagccaugugc

SEQ ID NO: 283111 - RNA, 32 nt, Human
aaaagagaggaagugagaaaaggggugaggaa

SEQ ID NO: 283112 - RNA, 32 nt, Human
aaaagagaggggaacaggaguccccaggugag

SEQ ID NO: 283113 - RNA, 32 nt, Human
aaaagagaugggaacgaggcagaggaaauaga

SEQ ID NO: 283114 - RNA, 32 nt, Human
aaaagagcaaacacuggggaucaaauuauuuu

SEQ ID NO: 283115 - RNA, 23 nt, Human
aaaagagcacuucccugcugggg

SEQ ID NO: 283116 - RNA, 32 nt, Human
aaaagagcaguuuuaauaacuuuaaaaguacu

SEQ ID NO: 283117 - RNA, 32 nt, Human
aaaagagccacaacuuccccagcuucuccagc

SEQ ID NO: 283118 - RNA, 32 nt, Human
aaaagagccagccucuucccccugggcuucgg

SEQ ID NO: 283119 - RNA, 32 nt, Human
aaaagagcccaugaagaugacaucaccgggga

SEQ ID NO: 283120 - RNA, 32 nt, Human
aaaagagccugggaccuuucucccguuucccu

SEQ ID NO: 283121 - RNA, 32 nt, Human
aaaagagcuacuuaugaguaucaaguauggaa

SEQ ID NO: 283122 - RNA, 32 nt, Human
aaaagagcugccaucauggcccagggaggcgg

SEQ ID NO: 283123 - RNA, 32 nt, Human
aaaagaggaaaucuuucaaacauggcugaagc

SEQ ID NO: 283124 - RNA, 32 nt, Human
aaaagaggagcagacaggguucccugggccca

SEQ ID NO: 283125 - RNA, 32 nt, Human
aaaagaggaggaggaggaggaagaaagaaaac

SEQ ID NO: 283126 - RNA, 32 nt, Human
aaaagaggaguccaugauggaggcagagguaa

SEQ ID NO: 283127 - RNA, 32 nt, Human
aaaagaggauugugauguaucacuggacccag

SEQ ID NO: 283128 - RNA, 32 nt, Human
aaaagaggcaccguguaaagaaaauggcaaaa

SEQ ID NO: 283129 - RNA, 32 nt, Human
aaaagaggcgauuccccagacacccagugaga

SEQ ID NO: 283130 - RNA, 32 nt, Human
aaaagaggcugcuagugguggagaugaagugu

SEQ ID NO: 283131 - RNA, 32 nt, Human
aaaagaggcuuuuauucuuuuccauaguuuag

SEQ ID NO: 283132 - RNA, 32 nt, Human
aaaagagggagcugccuucaauguauaaagua

SEQ ID NO: 283133 - RNA, 31 nt, Human
aaaagagggguaccuguuuucauuugaaaac

SEQ ID NO: 283134 - RNA, 32 nt, Human
aaaagaggugugaggcagcuguucagcccuuc

SEQ ID NO: 283135 - RNA, 20 nt, Human
aaaagagguguuuuguacuu

SEQ ID NO: 283136 - RNA, 32 nt, Human
aaaagagguuuccaggaugcagauuaggucau

SEQ ID NO: 283137 - RNA, 32 nt, Human
aaaagagguuuuggucauuugcuuuauuuuau

SEQ ID NO: 283138 - RNA, 32 nt, Human
aaaagaguaggaaaagacaaaggguggaaagc

SEQ ID NO: 283139 - RNA, 32 nt, Human
aaaagagucaucuguauuuuaaugccacuggu

SEQ ID NO: 283140 - RNA, 32 nt, Human
aaaagaguccaggacauugucugucugccuuc

SEQ ID NO: 283141 - RNA, 32 nt, Human
aaaagaguccuuaccaauagcaggggcugcag

SEQ ID NO: 283142 - RNA, 32 nt, Human
aaaagagugccuuugguuaaugguuagcaagc

SEQ ID NO: 283143 - RNA, 32 nt, Human
aaaagaguggguggaugaaaagggcccuuuuu

SEQ ID NO: 283144 - RNA, 32 nt, Human
aaaagagugggugggaagacuagugaaaccca

SEQ ID NO: 283145 - RNA, 32 nt, Human
aaaagauaaacaguuuagcccaucucuccaga

SEQ ID NO: 283146 - RNA, 32 nt, Human
aaaagauaaguucugcaaucuucuuucucuua

SEQ ID NO: 283147 - RNA, 32 nt, Human
aaaagauaaucuaucuugaauauuucauaugu

SEQ ID NO: 283148 - RNA, 32 nt, Human
aaaagauacagauuuggugaauuuguuacugu

SEQ ID NO: 283149 - RNA, 32 nt, Human
aaaagauaccauugaucauacauuuucucaac

SEQ ID NO: 283150 - RNA, 32 nt, Human
aaaagauacgugccggggccaggugugguggc

SEQ ID NO: 283151 - RNA, 32 nt, Human
aaaagauacugaugcauugaccucauuucaaa

SEQ ID NO: 283152 - RNA, 32 nt, Human
aaaagaucagccaugucacugaagagcuggag

SEQ ID NO: 283153 - RNA, 32 nt, Human
aaaagaucagggguggaggggcuuccaggcug

SEQ ID NO: 283154 - RNA, 32 nt, Human
aaaagauccuuccagcccuggccaucuuggac

SEQ ID NO: 283155 - RNA, 32 nt, Human
aaaagaucuggaagucacccuccucuggccca

SEQ ID NO: 283156 - RNA, 32 nt, Human
aaaagaucuuuguugguaugcauauguuuugu

SEQ ID NO: 283157 - RNA, 32 nt, Human
aaaagaugaaguuucuaucauccaaaguaugg

SEQ ID NO: 283158 - RNA, 32 nt, Human
aaaagaugcagaaaagguagacuggggccacu

SEQ ID NO: 283159 - RNA, 32 nt, Human
aaaagaugccagcaaggccacaggggguguga

SEQ ID NO: 283160 - RNA, 32 nt, Human
aaaagaugcuuauguacuaauaguugaaaucu

SEQ ID NO: 283161 - RNA, 32 nt, Human
aaaagauggaaagaggcagaucaggcuggugc

SEQ ID NO: 283162 - RNA, 30 nt, Human
aaaagauggaacugagaaagaaaaggauau

SEQ ID NO: 283163 - RNA, 32 nt, Human
aaaagauggcaggguggggauuugaacccagg

SEQ ID NO: 283164 - RNA, 32 nt, Human
aaaagauguaacacuuauuugcugucaaauuc

SEQ ID NO: 283165 - RNA, 30 nt, Human
aaaagauguggagugggcugcuaccuccug

SEQ ID NO: 283166 - RNA, 32 nt, Human
aaaagauuaaggcuguuauuaccaggaggaag

SEQ ID NO: 283167 - RNA, 32 nt, Human
aaaagauuagacacaaaauguguaaaagacgu

SEQ ID NO: 283168 - RNA, 32 nt, Human
aaaagauucccuuauuuauccagcacauagau

SEQ ID NO: 283169 - RNA, 32 nt, Human
aaaagauuggaggugauuuacagugaaagaca

SEQ ID NO: 283170 - RNA, 32 nt, Human
aaaagauuucccuugacuuugagaaacgauau

SEQ ID NO: 283171 - RNA, 32 nt, Human
aaaagauuuggacagaaacagaaagauuggag

SEQ ID NO: 283172 - RNA, 32 nt, Human
aaaagcaaaaagaauaucuucuaaagauuucu

SEQ ID NO: 283173 - RNA, 32 nt, Human
aaaagcaaaaccauuguuaugugugacucuug

SEQ ID NO: 283174 - RNA, 32 nt, Human
aaaagcaaaaggaaaauucuuaacuuacuaaa

SEQ ID NO: 283175 - RNA, 32 nt, Human
aaaagcaaaaggcauuucccacccugaacaac

SEQ ID NO: 283176 - RNA, 32 nt, Human
aaaagcaaacccaggaaacccaccucacaugg

SEQ ID NO: 283177 - RNA, 32 nt, Human
aaaagcaaagccagcuaacaccuucauucauc

SEQ ID NO: 283178 - RNA, 32 nt, Human
aaaagcaaaguguucaccacuaaagcuaacca

SEQ ID NO: 283179 - RNA, 32 nt, Human
aaaagcaacauucaaaaugcaggagauuuugu

SEQ ID NO: 283180 - RNA, 32 nt, Human
aaaagcaaccuugaguguaacuuuaaaaauuu

SEQ ID NO: 283181 - RNA, 32 nt, Human
aaaagcaagaauucuguuuccuaggcaaacau

SEQ ID NO: 283182 - RNA, 21 nt, Human
aaaagcaagcaagcaaacaaa

SEQ ID NO: 283183 - RNA, 32 nt, Human
aaaagcaaguagugguuugguuucuaucauau

SEQ ID NO: 283184 - RNA, 32 nt, Human
aaaagcaagugagacuuucuguuucccauugu

SEQ ID NO: 283185 - RNA, 32 nt, Human
aaaagcaaguguccuacagcauuucccaaaug

SEQ ID NO: 283186 - RNA, 24 nt, Human
aaaagcaaguuugaagagaccaca

SEQ ID NO: 283187 - RNA, 32 nt, Human
aaaagcaauagaagaccgugugugggccauga

SEQ ID NO: 283188 - RNA, 32 nt, Human
aaaagcaauaguugcuugaauuaugaucaucu

SEQ ID NO: 283189 - RNA, 32 nt, Human
aaaagcaauuuccaaaaaugaaacccauucau

SEQ ID NO: 283190 - RNA, 32 nt, Human
aaaagcacaaauaggcuggacaugguggcuca

SEQ ID NO: 283191 - RNA, 32 nt, Human
aaaagcacaggcaugcacacacacagaacccc

SEQ ID NO: 283192 - RNA, 32 nt, Human
aaaagcaccagacaccaugcagcugggcccca

SEQ ID NO: 283193 - RNA, 32 nt, Human
aaaagcaccagagaaaaucaaaugcuuccuac

SEQ ID NO: 283194 - RNA, 32 nt, Human
aaaagcaccguugagguugcagugagccgaga

SEQ ID NO: 283195 - RNA, 32 nt, Human
aaaagcacuaugucuguguauguauguauaua

SEQ ID NO: 283196 - RNA, 20 nt, Human
aaaagcacucuccacccagc

SEQ ID NO: 283197 - RNA, 32 nt, Human
aaaagcacugguuacugguuuccugcuggguc

SEQ ID NO: 283198 - RNA, 32 nt, Human
aaaagcagaagagagugaaguggugcgagagg

SEQ ID NO: 283199 - RNA, 32 nt, Human
aaaagcagaccagcaaccagccucgccauaaa

SEQ ID NO: 283200 - RNA, 32 nt, Human
aaaagcagauacaagauuccagcuuucgucug

SEQ ID NO: 283201 - RNA, 32 nt, Human
aaaagcagauggagagugcuagugaggcggcc

SEQ ID NO: 283202 - RNA, 32 nt, Human
aaaagcagcauggaucugccuguggaugaaug

SEQ ID NO: 283203 - RNA, 22 nt, Human
aaaagcagccauagacaacaca

SEQ ID NO: 283204 - RNA, 32 nt, Human
aaaagcagccucccuucuccucucccuccacu

SEQ ID NO: 283205 - RNA, 32 nt, Human
aaaagcagccugauucggaggaacggguugcu

SEQ ID NO: 283206 - RNA, 32 nt, Human
aaaagcagcugcugccucucuccugggaccgu

SEQ ID NO: 283207 - RNA, 32 nt, Human
aaaagcaggaaggaagaggguugugccaaggu

SEQ ID NO: 283208 - RNA, 32 nt, Human
aaaagcaggcuggacacaguggcucaugccug

SEQ ID NO: 283209 - RNA, 32 nt, Human
aaaagcaguaguucagauucaucagacagcga

SEQ ID NO: 283210 - RNA, 32 nt, Human
aaaagcaguauagacuccaccuuccaggaugu

SEQ ID NO: 283211 - RNA, 32 nt, Human
aaaagcagucagauggaauggaagaauacaaa

SEQ ID NO: 283212 - RNA, 32 nt, Human
aaaagcagucauccuguggcucuggcuccaga

SEQ ID NO: 283213 - RNA, 32 nt, Human
aaaagcaguuugcaggaaggucauguggugug

SEQ ID NO: 283214 - RNA, 32 nt, Human
aaaagcauaaaugcaaacacacaaagguauaa

SEQ ID NO: 283215 - RNA, 19 nt, Human
aaaagcauaacgauucaag

SEQ ID NO: 283216 - RNA, 32 nt, Human
aaaagcauagucuuauuaaccaugucuguugg

SEQ ID NO: 283217 - RNA, 32 nt, Human
aaaagcaucuuggacuuuguuuucccuuccaa

SEQ ID NO: 283218 - RNA, 32 nt, Human
aaaagcauggugccguagggcugcuaugguuu

SEQ ID NO: 283219 - RNA, 32 nt, Human
aaaagcauucuagccaugugcaaccaaacacc

SEQ ID NO: 283220 - RNA, 32 nt, Human
aaaagcauuugauauuguaacuucuuuguuuu

SEQ ID NO: 283221 - RNA, 32 nt, Human
aaaagcauuuuaaaaguuugaggaaucuuuug

SEQ ID NO: 283222 - RNA, 32 nt, Human
aaaagccaaaacuggaaugugcagaaaguagg

SEQ ID NO: 283223 - RNA, 32 nt, Human
aaaagccaagucagaagaaucauuuguauuaa

SEQ ID NO: 283224 - RNA, 32 nt, Human
aaaagccacauauccacaucucuuucauuuuc

SEQ ID NO: 283225 - RNA, 32 nt, Human
aaaagccacuaugagccuacugcuggcucagg

SEQ ID NO: 283226 - RNA, 32 nt, Human
aaaagccacucaugcuuuggcuuaaacuguaa

SEQ ID NO: 283227 - RNA, 32 nt, Human
aaaagccacugcagugugcagugagaaacucc

SEQ ID NO: 283228 - RNA, 32 nt, Human
aaaagccacuggcucccaggaugcaccucuaa

SEQ ID NO: 283229 - RNA, 32 nt, Human
aaaagccacuucucuucuuccugagcagaugg

SEQ ID NO: 283230 - RNA, 31 nt, Human
aaaagccagagaggcuggugagggagcagga

SEQ ID NO: 283231 - RNA, 32 nt, Human
aaaagccagagguaucacauugccagacuuca

SEQ ID NO: 283232 - RNA, 32 nt, Human
aaaagccagccaagugcuucugaauaaagauc

SEQ ID NO: 283233 - RNA, 32 nt, Human
aaaagccaggaagaaagcucaggcccauuagu

SEQ ID NO: 283234 - RNA, 32 nt, Human
aaaagccaggccaguacugacugugugguggu

SEQ ID NO: 283235 - RNA, 32 nt, Human
aaaagccagguuuuggggaugugucuuacugu

SEQ ID NO: 283236 - RNA, 32 nt, Human
aaaagccaucagaucugacuuucauggaagug

SEQ ID NO: 283237 - RNA, 32 nt, Human
aaaagccauccaugcucaggaaacauugggcu

SEQ ID NO: 283238 - RNA, 32 nt, Human
aaaagcccaaacuccuuccacccuccagguuc

SEQ ID NO: 283239 - RNA, 32 nt, Human
aaaagcccaaauggaagauggccaggcuguug

SEQ ID NO: 283240 - RNA, 32 nt, Human
aaaagcccaauuagaggaaggagugaugggau

SEQ ID NO: 283241 - RNA, 31 nt, Human
aaaagcccacuuuucugugaccagcagaccu

SEQ ID NO: 283242 - RNA, 32 nt, Human
aaaagcccauagggaagagagagaggauauag

SEQ ID NO: 283243 - RNA, 32 nt, Human
aaaagcccaucucgucauguacagggacucau

SEQ ID NO: 283244 - RNA, 32 nt, Human
aaaagccccaacacaugacgccaucugaagac

SEQ ID NO: 283245 - RNA, 32 nt, Human
aaaagccccuugccccuccccuagggcuacca

SEQ ID NO: 283246 - RNA, 32 nt, Human
aaaagcccgcggcgucuucuccacccaccugc

SEQ ID NO: 283247 - RNA, 32 nt, Human
aaaagcccuccugaguucaugggcuguaccua

SEQ ID NO: 283248 - RNA, 32 nt, Human
aaaagcccugaccccagggaaggaggcugcuc

SEQ ID NO: 283249 - RNA, 32 nt, Human
aaaagcccugcugagcaucacaugcuggacuc

SEQ ID NO: 283250 - RNA, 32 nt, Human
aaaagcccuuugacuuuuucccccucucccuc

SEQ ID NO: 283251 - RNA, 32 nt, Human
aaaagccgagaccaggaggcuggggcacaucg

SEQ ID NO: 283252 - RNA, 32 nt, Human
aaaagccgaguccucugauggcucccuuaggu

SEQ ID NO: 283253 - RNA, 32 nt, Human
aaaagccgcgaguguggccccagauccuggcg

SEQ ID NO: 283254 - RNA, 22 nt, Human
aaaagccguggguggaaccagg

SEQ ID NO: 283255 - RNA, 32 nt, Human
aaaagccuauauucuccuccauuuuuguacca

SEQ ID NO: 283256 - RNA, 32 nt, Human
aaaagccuccaggaaaucuugagagccugucu

SEQ ID NO: 283257 - RNA, 22 nt, Human
aaaagccucuccugcugauggg

SEQ ID NO: 283258 - RNA, 32 nt, Human
aaaagccucugaauccuggcagaaggaacacc

SEQ ID NO: 283259 - RNA, 32 nt, Human
aaaagccucugggagcacauucugcugucauc

SEQ ID NO: 283260 - RNA, 32 nt, Human
aaaagccugaguguauugcaucucuugauuua

SEQ ID NO: 283261 - RNA, 32 nt, Human
aaaagccugcuguuguuccacaucucguugcu

SEQ ID NO: 283262 - RNA, 32 nt, Human
aaaagccuuagcuaaacuuugaugaguaaagc

SEQ ID NO: 283263 - RNA, 32 nt, Human
aaaagccuuggcuauucaucagacauuuguua

SEQ ID NO: 283264 - RNA, 32 nt, Human
aaaagcgaaugagacagagaucagaauacauu

SEQ ID NO: 283265 - RNA, 32 nt, Human
aaaagcgacacugccaucaucaucccaaggca

SEQ ID NO: 283266 - RNA, 32 nt, Human
aaaagcgagagggagagcgagcaaaaggcgcg

SEQ ID NO: 283267 - RNA, 32 nt, Human
aaaagcggagagaacacagaguggaaucagcc

SEQ ID NO: 283268 - RNA, 32 nt, Human
aaaagcggcggccguuggagguggcugcggca

SEQ ID NO: 283269 - RNA, 32 nt, Human
aaaagcuagaucuggcaacagcgggcuuucau

SEQ ID NO: 283270 - RNA, 32 nt, Human
aaaagcuaggcuccuccuagaagccuguggac

SEQ ID NO: 283271 - RNA, 32 nt, Human
aaaagcuaucccagauacucccccuugaggag

SEQ ID NO: 283272 - RNA, 32 nt, Human
aaaagcuaugggaaaauugugaagauaaauga

SEQ ID NO: 283273 - RNA, 32 nt, Human
aaaagcucagggcggucgagugcaguggcucg

SEQ ID NO: 283274 - RNA, 32 nt, Human
aaaagcucaguucuagagacauacuauuacuu

SEQ ID NO: 283275 - RNA, 32 nt, Human
aaaagcuccuuauagagaagcuuggaacuuuc

SEQ ID NO: 283276 - RNA, 32 nt, Human
aaaagcucgcccagggcugggugcaguggcuc

SEQ ID NO: 283277 - RNA, 32 nt, Human
aaaagcucucaggaagccgaggcgugguuguu

SEQ ID NO: 283278 - RNA, 32 nt, Human
aaaagcucuggcccaagcuucuacacagcaaa

SEQ ID NO: 283279 - RNA, 23 nt, Human
aaaagcucugucucccuaacuca

SEQ ID NO: 283280 - RNA, 21 nt, Human
aaaagcucuguguaaaucuaa

SEQ ID NO: 283281 - RNA, 32 nt, Human
aaaagcucuuaauuuucuacuagcaguauaua

SEQ ID NO: 283282 - RNA, 21 nt, Human
aaaagcucuuggacauaauca

SEQ ID NO: 283283 - RNA, 32 nt, Human
aaaagcucuuggauucaucucaucucauggaa

SEQ ID NO: 283284 - RNA, 32 nt, Human
aaaagcugacccuucccugaguaagagagaau

SEQ ID NO: 283285 - RNA, 32 nt, Human
aaaagcugagcuggcugaagaucagggccagc

SEQ ID NO: 283286 - RNA, 32 nt, Human
aaaagcugagucuggguccauuauuuuggcag

SEQ ID NO: 283287 - RNA, 32 nt, Human
aaaagcugcaccuaaugugcuauccauucaga

SEQ ID NO: 283288 - RNA, 32 nt, Human
aaaagcugcagccccacccaggagcagggugg

SEQ ID NO: 283289 - RNA, 32 nt, Human
aaaagcugcaggcagaggcguugaggacaucu

SEQ ID NO: 283290 - RNA, 32 nt, Human
aaaagcugccuuggcccugcuuggcugaguca

SEQ ID NO: 283291 - RNA, 32 nt, Human
aaaagcuggaacccugccccuuuggaggggga

SEQ ID NO: 283292 - RNA, 24 nt, Human
aaaagcuggaagcauuccccuuga

SEQ ID NO: 283293 - RNA, 32 nt, Human
aaaagcuggagagagagugaagugaaugcaag

SEQ ID NO: 283294 - RNA, 32 nt, Human
aaaagcugggaugcuugaggguauccaaguug

SEQ ID NO: 283295 - RNA, 32 nt, Human
aaaagcugggauuacaggcgugagccaccgcg

SEQ ID NO: 283296 - RNA, 32 nt, Human
aaaagcugggauuacagggcccugccaccaag

SEQ ID NO: 283297 - RNA, 32 nt, Human
aaaagcuggggccagccagggcaggagaggug

SEQ ID NO: 283298 - RNA, 32 nt, Human
aaaagcuggguccucuggaggaggggcgagcu

SEQ ID NO: 283299 - RNA, 32 nt, Human
aaaagcugugcaugaagaacugccuucuucua

SEQ ID NO: 283300 - RNA, 32 nt, Human
aaaagcuguguuuucuuuggucagaggucaaa

SEQ ID NO: 283301 - RNA, 32 nt, Human
aaaagcuuaaaacuuugaaguuagcuuuaacu

SEQ ID NO: 283302 - RNA, 32 nt, Human
aaaagcuugaaggacugggagauguggagcga

SEQ ID NO: 283303 - RNA, 32 nt, Human
aaaagcuuguuucuacaguuugcaguggaucu

SEQ ID NO: 283304 - RNA, 32 nt, Human
aaaagcuuuacaugaauguuucuguauguaau

SEQ ID NO: 283305 - RNA, 32 nt, Human
aaaagcuuucagauggacauuuucuaguucag

SEQ ID NO: 283306 - RNA, 32 nt, Human
aaaagcuuucuacugcuuugcggugaaggcaa

SEQ ID NO: 283307 - RNA, 32 nt, Human
aaaaggaaaaacagacaaaaauuuaauuuuag

SEQ ID NO: 283308 - RNA, 32 nt, Human
aaaaggaaaaccagaagcccugcugucugucu

SEQ ID NO: 283309 - RNA, 32 nt, Human
aaaaggaaagaaugauucaaagcagaggaauu

SEQ ID NO: 283310 - RNA, 32 nt, Human
aaaaggaaagcaacuaagacacuggacuaucc

SEQ ID NO: 283311 - RNA, 32 nt, Human
aaaaggaaagcagaagugaucaaggagagcgc

SEQ ID NO: 283312 - RNA, 32 nt, Human
aaaaggaaauaacaagagcacuuacuuuauaa

SEQ ID NO: 283313 - RNA, 32 nt, Human
aaaaggaaauuuucugggaaaugguucauauu

SEQ ID NO: 283314 - RNA, 32 nt, Human
aaaaggaaccaaguuacugagauacugcugcu

SEQ ID NO: 283315 - RNA, 32 nt, Human
aaaaggaacugggaucgcgccgcggcgguucc

SEQ ID NO: 283316 - RNA, 32 nt, Human
aaaaggaagacagauugugguacaggauugua

SEQ ID NO: 283317 - RNA, 32 nt, Human
aaaaggaagacaucguggaagugaagaagauc

SEQ ID NO: 283318 - RNA, 32 nt, Human
aaaaggaagaugaguugaaaagcaaggggaga

SEQ ID NO: 283319 - RNA, 32 nt, Human
aaaaggaagcuggaucauuuugcuuaacacug

SEQ ID NO: 283320 - RNA, 32 nt, Human
aaaaggaagguauuggcugaacugaauagagg

SEQ ID NO: 283321 - RNA, 32 nt, Human
aaaaggaaguauuagaaaugagcugaagacca

SEQ ID NO: 283322 - RNA, 32 nt, Human
aaaaggaauacuccuuuuccuuuuggaucaua

SEQ ID NO: 283323 - RNA, 32 nt, Human
aaaaggaauacuuauaaugugaagguuuguaa

SEQ ID NO: 283324 - RNA, 32 nt, Human
aaaaggaauccuauucagcugugaugauuagc

SEQ ID NO: 283325 - RNA, 32 nt, Human
aaaaggaaugugccagaaugcugaaccuucuu

SEQ ID NO: 283326 - RNA, 32 nt, Human
aaaaggaauuguuuccuucacagcuaugaaua

SEQ ID NO: 283327 - RNA, 32 nt, Human
aaaaggacagagcucuaauugauaacucugua

SEQ ID NO: 283328 - RNA, 32 nt, Human
aaaaggaccagccugaccagcguggagaaacu

SEQ ID NO: 283329 - RNA, 32 nt, Human
aaaaggacccugagaaggagguugcggcuaaa

SEQ ID NO: 283330 - RNA, 32 nt, Human
aaaaggacuuuucuaaggacugaagauuggca

SEQ ID NO: 283331 - RNA, 20 nt, Human
aaaaggagacgauugcuccu

SEQ ID NO: 283332 - RNA, 32 nt, Human
aaaaggagagacacuugugaacauucaaguga

SEQ ID NO: 283333 - RNA, 32 nt, Human
aaaaggagagacuggccuagccucccagccua

SEQ ID NO: 283334 - RNA, 32 nt, Human
aaaaggagagauuggccuagccucccagccua

SEQ ID NO: 283335 - RNA, 32 nt, Human
aaaaggagaggguaacagaaaaagaggaaaga

SEQ ID NO: 283336 - RNA, 32 nt, Human
aaaaggagaugggguuuugccauguugcgcaa

SEQ ID NO: 283337 - RNA, 32 nt, Human
aaaaggagaugugagagaggguauugagucug

SEQ ID NO: 283338 - RNA, 32 nt, Human
aaaaggagcacauagagauagaggaggaggcc

SEQ ID NO: 283339 - RNA, 32 nt, Human
aaaaggagcagcuucaauuucauugaggugaa

SEQ ID NO: 283340 - RNA, 21 nt, Human
aaaaggagccacuguacuuua

SEQ ID NO: 283341 - RNA, 32 nt, Human
aaaaggagcugcaugcuucacuggaguugagg

SEQ ID NO: 283342 - RNA, 21 nt, Human
aaaaggagcugcauggccuca

SEQ ID NO: 283343 - RNA, 32 nt, Human
aaaaggagcuuuucagcagccacccugcagca

SEQ ID NO: 283344 - RNA, 32 nt, Human
aaaaggaggaggaagggcuggggagaagagcg

SEQ ID NO: 283345 - RNA, 32 nt, Human
aaaaggaggaguugcuaaucuaauuucagaca

SEQ ID NO: 283346 - RNA, 32 nt, Human
aaaaggaggcuggaaaucaauacugcacacug

SEQ ID NO: 283347 - RNA, 22 nt, Human
aaaaggaggcuuugaccaggga

SEQ ID NO: 283348 - RNA, 32 nt, Human
aaaaggagggaauaggaggagggcagggugag

SEQ ID NO: 283349 - RNA, 32 nt, Human
aaaaggagggacaaccugcacuccagggagcc

SEQ ID NO: 283350 - RNA, 32 nt, Human
aaaaggagucugcucuccugccacuuugcucu

SEQ ID NO: 283351 - RNA, 32 nt, Human
aaaaggagugaugguaccacacaaaauaguaa

SEQ ID NO: 283352 - RNA, 32 nt, Human
aaaaggagugcaaaucauaaauaugcaucuug

SEQ ID NO: 283353 - RNA, 32 nt, Human
aaaaggaguuaggagaaagaagagcagcugaa

SEQ ID NO: 283354 - RNA, 32 nt, Human
aaaaggauauuugccaagauguuaacagauua

SEQ ID NO: 283355 - RNA, 32 nt, Human
aaaaggaucgagguauuuccaauccccgucga

SEQ ID NO: 283356 - RNA, 31 nt, Human
aaaaggaugagugagagggucgagcggaacu

SEQ ID NO: 283357 - RNA, 32 nt, Human
aaaaggauggacccagcacuccagggagaaaa

SEQ ID NO: 283358 - RNA, 32 nt, Human
aaaaggauuucugcuuucaaauccgcuguuuc

SEQ ID NO: 283359 - RNA, 32 nt, Human
aaaaggcaaaacugaccagggcugggaugggu

SEQ ID NO: 283360 - RNA, 32 nt, Human
aaaaggcaaaaguuugcagcacccucuagcaa

SEQ ID NO: 283361 - RNA, 23 nt, Human
aaaaggcaaauagcuauuaggga

SEQ ID NO: 283362 - RNA, 20 nt, Human
aaaaggcaaauuucaaggga

SEQ ID NO: 283363 - RNA, 32 nt, Human
aaaaggcaauagaacccaggggucugagcaug

SEQ ID NO: 283364 - RNA, 32 nt, Human
aaaaggcagaaggagggagaccccaaaaagag

SEQ ID NO: 283365 - RNA, 32 nt, Human
aaaaggcagcagcuccgaauugaaugaauuga

SEQ ID NO: 283366 - RNA, 32 nt, Human
aaaaggcagccaccuccucucccuggcugaac

SEQ ID NO: 283367 - RNA, 32 nt, Human
aaaaggcagcugcauguuauaaacaauauuac

SEQ ID NO: 283368 - RNA, 32 nt, Human
aaaaggcagugacuucagucacacagcaagca

SEQ ID NO: 283369 - RNA, 32 nt, Human
aaaaggcaguuugucuacuacagcagaaggcu

SEQ ID NO: 283370 - RNA, 32 nt, Human
aaaaggcauaugcaauauuuacauuuuuaauu

SEQ ID NO: 283371 - RNA, 32 nt, Human
aaaaggccacaggauggggaggcugcgggguc

SEQ ID NO: 283372 - RNA, 32 nt, Human
aaaaggccaccugugcuucaccaugcuccauc

SEQ ID NO: 283373 - RNA, 32 nt, Human
aaaaggccauggucauauagcccaaggaaauu

SEQ ID NO: 283374 - RNA, 32 nt, Human
aaaaggcccagccugucaaagugucugagaug

SEQ ID NO: 283375 - RNA, 32 nt, Human
aaaaggcccuggauauuuuaaguggccauuuu

SEQ ID NO: 283376 - RNA, 32 nt, Human
aaaaggccuauaaauaaacagggcuggcuguu

SEQ ID NO: 283377 - RNA, 32 nt, Human
aaaaggccucaaggaguacguguucaguaugc

SEQ ID NO: 283378 - RNA, 32 nt, Human
aaaaggccuccaccagccucucaccagaagag

SEQ ID NO: 283379 - RNA, 32 nt, Human
aaaaggccugccaccaaagcaggaagcugcac

SEQ ID NO: 283380 - RNA, 32 nt, Human
aaaaggccuggccugcugccucuucucuugca

SEQ ID NO: 283381 - RNA, 32 nt, Human
aaaaggccuggggaggugaaggaagagagacu

SEQ ID NO: 283382 - RNA, 32 nt, Human
aaaaggcggauucauucauagagcagaaagaa

SEQ ID NO: 283383 - RNA, 32 nt, Human
aaaaggcggcugagauuggcagagugaaauau

SEQ ID NO: 283384 - RNA, 32 nt, Human
aaaaggcgugagccaccgcgccuggccugaug

SEQ ID NO: 283385 - RNA, 32 nt, Human
aaaaggcuaaagauuugcaguuugacagccca

SEQ ID NO: 283386 - RNA, 32 nt, Human
aaaaggcuccaggcaggagaccuguguuccug

SEQ ID NO: 283387 - RNA, 32 nt, Human
aaaaggcuccuguaacccuccuccaggaugaa

SEQ ID NO: 283388 - RNA, 32 nt, Human
aaaaggcugaaccagcucuauuauuauccuau

SEQ ID NO: 283389 - RNA, 32 nt, Human
aaaaggcugacuuuggaaucuuuuuccuuuuu

SEQ ID NO: 283390 - RNA, 32 nt, Human
aaaaggcugcuugugaauuuucugagacggau

SEQ ID NO: 283391 - RNA, 32 nt, Human
aaaaggcugggaaacgggagcagaggaagcac

SEQ ID NO: 283392 - RNA, 32 nt, Human
aaaaggcugguaauacuagcacuugguaugcc

SEQ ID NO: 283393 - RNA, 32 nt, Human
aaaaggcuuaccaggcugcuauggucaacucu

SEQ ID NO: 283394 - RNA, 32 nt, Human
aaaaggcuucuccagagccuccagauaagagg

SEQ ID NO: 283395 - RNA, 32 nt, Human
aaaagggaaagccacggaaugugugugaagcc

SEQ ID NO: 283396 - RNA, 32 nt, Human
aaaagggaagaauguguaggcacgggaagggc

SEQ ID NO: 283397 - RNA, 32 nt, Human
aaaagggaagcagaaacaaaugaaguugcagc

SEQ ID NO: 283398 - RNA, 32 nt, Human
aaaagggaaugaccccucagaaacccacauua

SEQ ID NO: 283399 - RNA, 32 nt, Human
aaaagggacaaucgcuugcaguugguagaucu

SEQ ID NO: 283400 - RNA, 32 nt, Human
aaaagggacuguaacuccugucucaggaaugg

SEQ ID NO: 283401 - RNA, 32 nt, Human
aaaagggagaggugggcucuucugccaguucu

SEQ ID NO: 283402 - RNA, 32 nt, Human
aaaagggagcagccuuaggaggcacaucagau

SEQ ID NO: 283403 - RNA, 32 nt, Human
aaaagggagcccagaaauggaggacauuucau

SEQ ID NO: 283404 - RNA, 32 nt, Human
aaaagggaggcagaggaggcagaggcagaggc

SEQ ID NO: 283405 - RNA, 32 nt, Human
aaaagggaugcaaagaggucccagggaccugc

SEQ ID NO: 283406 - RNA, 32 nt, Human
aaaagggcaaagcucaccagcucucaacuuuu

SEQ ID NO: 283407 - RNA, 32 nt, Human
aaaagggcaggcaggggcaggcugaggaguug

SEQ ID NO: 283408 - RNA, 32 nt, Human
aaaagggcagggggcacuugagcugggcuggg

SEQ ID NO: 283409 - RNA, 32 nt, Human
aaaagggccacccuggccaaaagcggucaaaa

SEQ ID NO: 283410 - RNA, 32 nt, Human
aaaagggccagaaaaauuuggcaccaggcaaa

SEQ ID NO: 283411 - RNA, 32 nt, Human
aaaagggccaggagcaucuacugggauggauu

SEQ ID NO: 283412 - RNA, 32 nt, Human
aaaagggccagugccaaggggcaccaagaacc

SEQ ID NO: 283413 - RNA, 32 nt, Human
aaaagggccccuuuuuacuuuaauaguuuagu

SEQ ID NO: 283414 - RNA, 32 nt, Human
aaaagggccucugcuaaugguggagagaucaa

SEQ ID NO: 283415 - RNA, 32 nt, Human
aaaagggcucagagcugcugagcaggaaccgg

SEQ ID NO: 283416 - RNA, 32 nt, Human
aaaagggcucuuuagccaguuguugccaaccu

SEQ ID NO: 283417 - RNA, 32 nt, Human
aaaagggcuugggcccccagccccagaagaug

SEQ ID NO: 283418 - RNA, 32 nt, Human
aaaaggggaacagaaucaggagagugggcaaa

SEQ ID NO: 283419 - RNA, 32 nt, Human
aaaaggggaccugccaagaggccacugaggug

SEQ ID NO: 283420 - RNA, 32 nt, Human
aaaaggggaggaaaggcuccucucuuuaguca

SEQ ID NO: 283421 - RNA, 22 nt, Human
aaaaggggcagaaaucaucacu

SEQ ID NO: 283422 - RNA, 32 nt, Human
aaaaggggcuacacaccuggcuuccgggagcu

SEQ ID NO: 283423 - RNA, 32 nt, Human
aaaaggggcuggaggaagauccggagggcagg

SEQ ID NO: 283424 - RNA, 32 nt, Human
aaaaggggcugggaagaagggggaccaguuug

SEQ ID NO: 283425 - RNA, 32 nt, Human
aaaagggggagggaagggggaggaaggagucg

SEQ ID NO: 283426 - RNA, 32 nt, Human
aaaagggggugguggggaggcuuggggagauu

SEQ ID NO: 283427 - RNA, 32 nt, Human
aaaaggguaaaacaugacuacacagaaauuua

SEQ ID NO: 283428 - RNA, 21 nt, Human
aaaaggguaagagcacccuua

SEQ ID NO: 283429 - RNA, 32 nt, Human
aaaaggguaagcuagagagaaaaagaaagaac

SEQ ID NO: 283430 - RNA, 32 nt, Human
aaaaggguauuucuuuucucucuucagccccc

SEQ ID NO: 283431 - RNA, 32 nt, Human
aaaagggugaaaauagaugacacagaaugugc

SEQ ID NO: 283432 - RNA, 20 nt, Human
aaaagggugaagccaccucu

SEQ ID NO: 283433 - RNA, 32 nt, Human
aaaagggugggggugggaggggcagaggccaa

SEQ ID NO: 283434 - RNA, 31 nt, Human
aaaaggguguuaaaagagucaguguaagcau

SEQ ID NO: 283435 - RNA, 32 nt, Human
aaaaggguuauagaaaucuggaaauaagaaag

SEQ ID NO: 283436 - RNA, 32 nt, Human
aaaaggguuugauuugauucucagccugguag

SEQ ID NO: 283437 - RNA, 32 nt, Human
aaaagguaauuuuucccuucuucuacuugauu

SEQ ID NO: 283438 - RNA, 32 nt, Human
aaaagguacagucaggggaaaauagaucuagg

SEQ ID NO: 283439 - RNA, 32 nt, Human
aaaagguacagugauucagccauuuccauuug

SEQ ID NO: 283440 - RNA, 32 nt, Human
aaaagguacuggugagggcaagaggugccugg

SEQ ID NO: 283441 - RNA, 32 nt, Human
aaaaggucaagaaguaaaagauguuagaaagc

SEQ ID NO: 283442 - RNA, 32 nt, Human
aaaaggugacccuucugucuguaagauuuuau

SEQ ID NO: 283443 - RNA, 32 nt, Human
aaaagguggccaaaaaccugccugccugguug

SEQ ID NO: 283444 - RNA, 24 nt, Human
aaaagguggcguuuuuguacuuua

SEQ ID NO: 283445 - RNA, 32 nt, Human
aaaaggugggcugguuuuaguacucugaagga

SEQ ID NO: 283446 - RNA, 31 nt, Human
aaaaggugggugguagguguggggagagcug

SEQ ID NO: 283447 - RNA, 32 nt, Human
aaaagguuaguguuugggggccgggggaggac

SEQ ID NO: 283448 - RNA, 32 nt, Human
aaaagguuaucugcucuuggccaucugguggu

SEQ ID NO: 283449 - RNA, 32 nt, Human
aaaagguuccauccuaucucccuuagagagaa

SEQ ID NO: 283450 - RNA, 32 nt, Human
aaaagguugaggccgggugcauugguucaugc

SEQ ID NO: 283451 - RNA, 32 nt, Human
aaaagguuggccuuaguagucaaaaacaaagc

SEQ ID NO: 283452 - RNA, 32 nt, Human
aaaagguuugccaagcucagugguguuguauu

SEQ ID NO: 283453 - RNA, 32 nt, Human
aaaaguaaaguuauaaaaggaaaagaaaacag

SEQ ID NO: 283454 - RNA, 32 nt, Human
aaaaguaacuaaagacagauguagguguaaau

SEQ ID NO: 283455 - RNA, 32 nt, Human
aaaaguaacugaagaggccaggcgugguggcu

SEQ ID NO: 283456 - RNA, 32 nt, Human
aaaaguaagacccacaaggauauuccuuugcc

SEQ ID NO: 283457 - RNA, 30 nt, Human
aaaaguaagccauggauauuacuguucuga

SEQ ID NO: 283458 - RNA, 32 nt, Human
aaaaguaagcuguguggucaaaaucaauauga

SEQ ID NO: 283459 - RNA, 32 nt, Human
aaaaguaauggaagacaggaagaaaagaagag

SEQ ID NO: 283460 - RNA, 32 nt, Human
aaaaguaauuaauaguguuggaagauguaggu

SEQ ID NO: 283461 - RNA, 32 nt, Human
aaaaguacagugaugagcaugccuaaauccau

SEQ ID NO: 283462 - RNA, 32 nt, Human
aaaaguacagugguguacacaaaaagaagcag

SEQ ID NO: 283463 - RNA, 32 nt, Human
aaaaguacauagugaauuuuaaaauguagaag

SEQ ID NO: 283464 - RNA, 32 nt, Human
aaaaguacaugaaaggauucacucuggagaga

SEQ ID NO: 283465 - RNA, 32 nt, Human
aaaaguaccacauuccaugacgcaggagcugu

SEQ ID NO: 283466 - RNA, 32 nt, Human
aaaaguacuaccuguuaacaauugggaaaagg

SEQ ID NO: 283467 - RNA, 32 nt, Human
aaaaguacuagaugguguauaacucuagaguu

SEQ ID NO: 283468 - RNA, 32 nt, Human
aaaaguacuucaggcugggcacaguggcucau

SEQ ID NO: 283469 - RNA, 32 nt, Human
aaaaguagaaaugcaacaauucccaguuuuug

SEQ ID NO: 283470 - RNA, 22 nt, Human
aaaaguagaaucauaaggacug

SEQ ID NO: 283471 - RNA, 32 nt, Human
aaaaguagacaugggcugggugcaguggcuca

SEQ ID NO: 283472 - RNA, 32 nt, Human
aaaaguagagagaagugaaaguagagucuggg

SEQ ID NO: 283473 - RNA, 23 nt, Human
aaaaguagauuagcacaaugcac

SEQ ID NO: 283474 - RNA, 32 nt, Human
aaaaguagcaagaaauggccaugcugccuucu

SEQ ID NO: 283475 - RNA, 32 nt, Human
aaaaguaggagugauagagaacaaaaauacuc

SEQ ID NO: 283476 - RNA, 32 nt, Human
aaaaguauacagaucaaagcaaaaagaagcca

SEQ ID NO: 283477 - RNA, 32 nt, Human
aaaaguauaucuauccaauaaguuguggaaag

SEQ ID NO: 283478 - RNA, 32 nt, Human
aaaaguauccacugguccccaggguuucaguc

SEQ ID NO: 283479 - RNA, 32 nt, Human
aaaaguaucucuuaaagcaaaacaucucagaa

SEQ ID NO: 283480 - RNA, 32 nt, Human
aaaaguaugaaugagugugaaguguaugugag

SEQ ID NO: 283481 - RNA, 23 nt, Human
aaaaguauguguaauaugaagua

SEQ ID NO: 283482 - RNA, 32 nt, Human
aaaaguauuaauucucuuuccauccuccuccu

SEQ ID NO: 283483 - RNA, 32 nt, Human
aaaaguauuuaucuugggcuuaucugaaugau

SEQ ID NO: 283484 - RNA, 32 nt, Human
aaaaguauuuuguaacugaggaauuuugauaa

SEQ ID NO: 283485 - RNA, 32 nt, Human
aaaagucaaauacaauacugguccuuaccaca

SEQ ID NO: 283486 - RNA, 32 nt, Human
aaaagucaacaaauacauacuuagugguaacu

SEQ ID NO: 283487 - RNA, 32 nt, Human
aaaagucaccugccuacaaauguacaaaaggc

SEQ ID NO: 283488 - RNA, 32 nt, Human
aaaagucagaugcuucuauccauugcuuucug

SEQ ID NO: 283489 - RNA, 32 nt, Human
aaaagucagggaaaggggcacugaccuguagu

SEQ ID NO: 283490 - RNA, 32 nt, Human
aaaagucaguuuaggcugggcgcaguggcuca

SEQ ID NO: 283491 - RNA, 32 nt, Human
aaaagucaguuuaggcugggcgcgguggcuca

SEQ ID NO: 283492 - RNA, 32 nt, Human
aaaagucauagaauaucuaugauacauugaaa

SEQ ID NO: 283493 - RNA, 32 nt, Human
aaaagucaucaccauucucucgucucaauaaa

SEQ ID NO: 283494 - RNA, 32 nt, Human
aaaaguccagacacacuguauugugaaaacug

SEQ ID NO: 283495 - RNA, 32 nt, Human
aaaaguccaugaaaggauucacucuggagaga

SEQ ID NO: 283496 - RNA, 32 nt, Human
aaaaguccauuucucccuucugcaaugcaccc

SEQ ID NO: 283497 - RNA, 32 nt, Human
aaaagucccaccaacuaccagaccagaacacg

SEQ ID NO: 283498 - RNA, 32 nt, Human
aaaagucggcagcagagggaacagggaagaaa

SEQ ID NO: 283499 - RNA, 32 nt, Human
aaaagucuaagccaaagguucucaggggagaa

SEQ ID NO: 283500 - RNA, 32 nt, Human
aaaagucuaggcagaagauaaugcaaccaaca

SEQ ID NO: 283501 - RNA, 32 nt, Human
aaaagucucaaaauaccuguaaucccagcacu

SEQ ID NO: 283502 - RNA, 32 nt, Human
aaaagucucaacaagaagucuguggaguugag

SEQ ID NO: 283503 - RNA, 32 nt, Human
aaaagucucacaugguggcuguacaugcacaa

SEQ ID NO: 283504 - RNA, 32 nt, Human
aaaagucucuuauguagggauccuccuugugu

SEQ ID NO: 283505 - RNA, 32 nt, Human
aaaagucugacuguugagaaacugacgaucca

SEQ ID NO: 283506 - RNA, 32 nt, Human
aaaagucugucugauuccaggguguuuuuccu

SEQ ID NO: 283507 - RNA, 32 nt, Human
aaaagucuguucuggugucggugucagagguc

SEQ ID NO: 283508 - RNA, 32 nt, Human
aaaagucuguugcuuugguucucaguccuggg

SEQ ID NO: 283509 - RNA, 32 nt, Human
aaaagucuuagcaacaguccucuggucccaca

SEQ ID NO: 283510 - RNA, 32 nt, Human
aaaagugaaaggcaauggaaggguuccauaga

SEQ ID NO: 283511 - RNA, 32 nt, Human
aaaagugaaggccagacagacaaggacaagga

SEQ ID NO: 283512 - RNA, 32 nt, Human
aaaagugacacagcagcuucaccagagcauuu

SEQ ID NO: 283513 - RNA, 21 nt, Human
aaaagugacuuacuggucuca

SEQ ID NO: 283514 - RNA, 32 nt, Human
aaaagugagaggaggcggaggagagagccugc

SEQ ID NO: 283515 - RNA, 32 nt, Human
aaaagugagccucuucaucugcaccuguaaua

SEQ ID NO: 283516 - RNA, 32 nt, Human
aaaagugaggggacggaggcgcccaagcaacg

SEQ ID NO: 283517 - RNA, 32 nt, Human
aaaagugagugugagaucacccagggaagcag

SEQ ID NO: 283518 - RNA, 32 nt, Human
aaaagugccaagcagaacauaaaacauccuua

SEQ ID NO: 283519 - RNA, 21 nt, Human
aaaagugccacccuggcuuca

SEQ ID NO: 283520 - RNA, 32 nt, Human
aaaagugccugccugugcucucucccucuccu

SEQ ID NO: 283521 - RNA, 32 nt, Human
aaaagugccugggauauuuuccuccuuggccc

SEQ ID NO: 283522 - RNA, 32 nt, Human
aaaagugcuacuugagagugggggagaauggc

SEQ ID NO: 283523 - RNA, 32 nt, Human
aaaagugcuagaagaaaaaggaugcccaguug

SEQ ID NO: 283524 - RNA, 23 nt, Human
aaaagugcucacgugcagcucca

SEQ ID NO: 283525 - RNA, 32 nt, Human
aaaagugcucacugcagcucagaucaguccuc

SEQ ID NO: 283526 - RNA, 32 nt, Human
aaaagugcugaggaugcuggccagcagacccu

SEQ ID NO: 283527 - RNA, 20 nt, Human
aaaagugcuucaugagccca

SEQ ID NO: 283528 - RNA, 32 nt, Human
aaaaguggacaaguccgcuuugugagaugaau

SEQ ID NO: 283529 - RNA, 32 nt, Human
aaaaguggacugcaucuauccaucuuuacugu

SEQ ID NO: 283530 - RNA, 32 nt, Human
aaaaguggacugcuuuucaaagugccacuguu

SEQ ID NO: 283531 - RNA, 32 nt, Human
aaaaguggagaaugaggccaggcgugguggcu

SEQ ID NO: 283532 - RNA, 32 nt, Human
aaaaguggauccugccacguucggagcucccu

SEQ ID NO: 283533 - RNA, 32 nt, Human
aaaaguggcaaagcuuugcuuaucucagcaaa

SEQ ID NO: 283534 - RNA, 32 nt, Human
aaaaguggccagacuguuaccuggguucccau

SEQ ID NO: 283535 - RNA, 32 nt, Human
aaaaguggcgagagccaccucggcgcuugggc

SEQ ID NO: 283536 - RNA, 32 nt, Human
aaaaguggcuguccuaaauuucaucacucaau

SEQ ID NO: 283537 - RNA, 32 nt, Human
aaaaguggcuugaugguuaagacagguuuauu

SEQ ID NO: 283538 - RNA, 31 nt, Human
aaaagugggcauuuuguaacauuccuucagg

SEQ ID NO: 283539 - RNA, 32 nt, Human
aaaaguggguucuaaaugccuggcugcaucug

SEQ ID NO: 283540 - RNA, 32 nt, Human
aaaagugguagggaaauuguucccucuccacu

SEQ ID NO: 283541 - RNA, 32 nt, Human
aaaaguggucuaauuuuuacaacaguagaacu

SEQ ID NO: 283542 - RNA, 32 nt, Human
aaaaguggucucaaccuaacaucagaaguguu

SEQ ID NO: 283543 - RNA, 29 nt, Human
aaaaguguaugagaugugccuggauguuc

SEQ ID NO: 283544 - RNA, 32 nt, Human
aaaagugucaccuuuucuugccugaucaacaa

SEQ ID NO: 283545 - RNA, 24 nt, Human
aaaagugucuaccuugguacgcag

SEQ ID NO: 283546 - RNA, 20 nt, Human
aaaagugucuuucagcacca

SEQ ID NO: 283547 - RNA, 32 nt, Human
aaaaguguggccuuugggcucugccaucuggg

SEQ ID NO: 283548 - RNA, 32 nt, Human
aaaagugugguuuuacuauuuuugccuuauca

SEQ ID NO: 283549 - RNA, 23 nt, Human
aaaaguguguauaauguaaagua

SEQ ID NO: 283550 - RNA, 32 nt, Human
aaaaguguugcaaauguaaaacauugccaucu

SEQ ID NO: 283551 - RNA, 24 nt, Human
aaaaguguuuaucuucagcaccaa

SEQ ID NO: 283552 - RNA, 32 nt, Human
aaaaguuaaacuuuuguuaugacuguguuuuu

SEQ ID NO: 283553 - RNA, 32 nt, Human
aaaaguuaaauggugaaugcuagcaugaaucu

SEQ ID NO: 283554 - RNA, 32 nt, Human
aaaaguuaauuuuaaucucacagucuacauug

SEQ ID NO: 283555 - RNA, 32 nt, Human
aaaaguuaauuuugggcugagugcaguggcuu

SEQ ID NO: 283556 - RNA, 32 nt, Human
aaaaguuaccucauucuucuagcuagcugauu

SEQ ID NO: 283557 - RNA, 32 nt, Human
aaaaguuaucucccucucccugugaugccuug

SEQ ID NO: 283558 - RNA, 32 nt, Human
aaaaguucagaaucuccagagcagagcccagg

SEQ ID NO: 283559 - RNA, 32 nt, Human
aaaaguucaugucuucucaaaauaugaaauau

SEQ ID NO: 283560 - RNA, 32 nt, Human
aaaaguuccaagcuguuacuuaccuuaacaug

SEQ ID NO: 283561 - RNA, 32 nt, Human
aaaaguucccaccuugcaguucaucagagaau

SEQ ID NO: 283562 - RNA, 32 nt, Human
aaaaguucuagguucaguugaaguucugauga

SEQ ID NO: 283563 - RNA, 32 nt, Human
aaaaguucucucugaugcaugaaaacucagag

SEQ ID NO: 283564 - RNA, 32 nt, Human
aaaaguucugaccuucuguuauagucaaggag

SEQ ID NO: 283565 - RNA, 32 nt, Human
aaaaguugaaggaggcagaagggagagugaug

SEQ ID NO: 283566 - RNA, 32 nt, Human
aaaaguugaucuguauagucaacaucuugaac

SEQ ID NO: 283567 - RNA, 32 nt, Human
aaaaguugcugcugacacacugggugaagaau

SEQ ID NO: 283568 - RNA, 32 nt, Human
aaaaguuggccucccaaaauuucuguauuugg

SEQ ID NO: 283569 - RNA, 32 nt, Human
aaaaguugugaugugacaugauauaaaggauc

SEQ ID NO: 283570 - RNA, 32 nt, Human
aaaaguuguggguaggaaaaugaaucauuugg

SEQ ID NO: 283571 - RNA, 32 nt, Human
aaaaguuuagcguuaagcaccuuuaucuucau

SEQ ID NO: 283572 - RNA, 32 nt, Human
aaaaguuuaucagccaaaaguguaaauaaguu

SEQ ID NO: 283573 - RNA, 32 nt, Human
aaaaguuucaagaagcaggaagaaaagacuca

SEQ ID NO: 283574 - RNA, 32 nt, Human
aaaaguuucagaaugaguuuaggauaauuaua

SEQ ID NO: 283575 - RNA, 32 nt, Human
aaaaguuucuccccaguucucucugauaguua

SEQ ID NO: 283576 - RNA, 32 nt, Human
aaaaguuugagaccagccugggcaacauagca

SEQ ID NO: 283577 - RNA, 32 nt, Human
aaaaguuugccucgucuccacaagucugucuc

SEQ ID NO: 283578 - RNA, 32 nt, Human
aaaaguuugguucuuccaugugccuugguucc

SEQ ID NO: 283579 - RNA, 32 nt, Human
aaaaguuuuauucuguguuguuuacugguaag

SEQ ID NO: 283580 - RNA, 31 nt, Human
aaaaguuuuuaauaaauguguugaaaaucaa

SEQ ID NO: 283581 - RNA, 32 nt, Human
aaaaguuuuucuuccucucuucagagccaaaa

SEQ ID NO: 283582 - RNA, 32 nt, Human
aaaauaaaaacacagacaucugcacucaauaa

SEQ ID NO: 283583 - RNA, 32 nt, Human
aaaauaaaaagaaacacagacgcccagguguc

SEQ ID NO: 283584 - RNA, 32 nt, Human
aaaauaaaaagcuguucuacagaacaaccacu

SEQ ID NO: 283585 - RNA, 26 nt, Human
aaaauaaaaagcuuucuggaagaccc

SEQ ID NO: 283586 - RNA, 32 nt, Human
aaaauaaaaaggauuuauugguucauguaacu

SEQ ID NO: 283587 - RNA, 32 nt, Human
aaaauaaaacaaggaauuagugucuuuuaagu

SEQ ID NO: 283588 - RNA, 32 nt, Human
aaaauaaaacaccuccuguuguggauggugag

SEQ ID NO: 283589 - RNA, 32 nt, Human
aaaauaaaagagaaucuuuucuucccuacccc

SEQ ID NO: 283590 - RNA, 32 nt, Human
aaaauaaaaguacaggguuugaaggaacaaga

SEQ ID NO: 283591 - RNA, 32 nt, Human
aaaauaaaauuagcugggcaugguggcgcuug

SEQ ID NO: 283592 - RNA, 32 nt, Human
aaaauaaaccaaucccuaacacgugguauggg

SEQ ID NO: 283593 - RNA, 32 nt, Human
aaaauaaaggcuguaucuaaaauaucaaaggu

SEQ ID NO: 283594 - RNA, 32 nt, Human
aaaauaaauacugaugaggcaugcagcuuuca

SEQ ID NO: 283595 - RNA, 32 nt, Human
aaaauaaauagcugggauuacaggugccugcc

SEQ ID NO: 283596 - RNA, 32 nt, Human
aaaauaaaugaauuuucacuguuggcacauau

SEQ ID NO: 283597 - RNA, 32 nt, Human
aaaauaaaugauuuuuaaguuaugucuauuaa

SEQ ID NO: 283598 - RNA, 32 nt, Human
aaaauaaauguuccugcagccugagauuucag

SEQ ID NO: 283599 - RNA, 32 nt, Human
aaaauaaauguuucaggcuuugugguccugau

SEQ ID NO: 283600 - RNA, 22 nt, Human
aaaauaacauuucagaagagca

SEQ ID NO: 283601 - RNA, 32 nt, Human
aaaauaaccaugagcuguaucaugcuacuuag

SEQ ID NO: 283602 - RNA, 32 nt, Human
aaaauaaccgaagaaagagaggaccaaccaga

SEQ ID NO: 283603 - RNA, 32 nt, Human
aaaauaaccuauacgguaguugcuuuaggggg

SEQ ID NO: 283604 - RNA, 18 nt, Human
aaaauaaccugaaaccau

SEQ ID NO: 283605 - RNA, 32 nt, Human
aaaauaaccugaccaguaaucacccacugauu

SEQ ID NO: 283606 - RNA, 32 nt, Human
aaaauaaccuugagagaguccauccaucuaac

SEQ ID NO: 283607 - RNA, 19 nt, Human
aaaauaacugacaaaccau

SEQ ID NO: 283608 - RNA, 32 nt, Human
aaaauaacuuauuuugaugaucagaggucuug

SEQ ID NO: 283609 - RNA, 32 nt, Human
aaaauaacuucguugagauacaauucacagaa

SEQ ID NO: 283610 - RNA, 32 nt, Human
aaaauaagaaaagguuuucuucauucauggcu

SEQ ID NO: 283611 - RNA, 32 nt, Human
aaaauaagaaaauguuggguucucagcacuuc

SEQ ID NO: 283612 - RNA, 32 nt, Human
aaaauaagacaggccacaggagggcagagugg

SEQ ID NO: 283613 - RNA, 32 nt, Human
aaaauaagacauuaacuuuaucuuaaguuaca

SEQ ID NO: 283614 - RNA, 32 nt, Human
aaaauaagagacuagagauucacuggacgcuu

SEQ ID NO: 283615 - RNA, 32 nt, Human
aaaauaaggcccagaggugcaguccaggagua

SEQ ID NO: 283616 - RNA, 32 nt, Human
aaaauaaggcuuuaacugcaccagaggaacac

SEQ ID NO: 283617 - RNA, 32 nt, Human
aaaauaaggucuaaaggaaaguagcacauuag

SEQ ID NO: 283618 - RNA, 32 nt, Human
aaaauaauaacaggcugggugcaauggcucac

SEQ ID NO: 283619 - RNA, 32 nt, Human
aaaauaauacuucuuuuccacccgucuuuggu

SEQ ID NO: 283620 - RNA, 32 nt, Human
aaaauaaucaguaggcaagaggaacauuuuuc

SEQ ID NO: 283621 - RNA, 32 nt, Human
aaaauaaugcuguccuuuaguagcaaguaaaa

SEQ ID NO: 283622 - RNA, 32 nt, Human
aaaauaauguauauaagcagacuugcacaauu

SEQ ID NO: 283623 - RNA, 32 nt, Human
aaaauaauuacugcuauuuuaaaauuucuuga

SEQ ID NO: 283624 - RNA, 32 nt, Human
aaaauaauuccuuggacugccuggugguuaaa

SEQ ID NO: 283625 - RNA, 32 nt, Human
aaaauaauugauuucauuuacucccauauucu

SEQ ID NO: 283626 - RNA, 32 nt, Human
aaaauaauuggcagagugagaagaaacauaaa

SEQ ID NO: 283627 - RNA, 22 nt, Human
aaaauaauuuuuuagaaaagca

SEQ ID NO: 283628 - RNA, 32 nt, Human
aaaauacaaaaacaaaaauuagccaggggugg

SEQ ID NO: 283629 - RNA, 32 nt, Human
aaaauacaaaaauauaugaaaucucacauaga

SEQ ID NO: 283630 - RNA, 22 nt, Human
aaaauacaaaaauuacccaggc

SEQ ID NO: 283631 - RNA, 23 nt, Human
aaaauacaaaaauuacccaggca

SEQ ID NO: 283632 - RNA, 23 nt, Human
aaaauacaaaaauugcccaggca

SEQ ID NO: 283633 - RNA, 32 nt, Human
aaaauacaaacaaaauuagcugggcauggugg

SEQ ID NO: 283634 - RNA, 32 nt, Human
aaaauacaaacuuggcugggcuuaguggugca

SEQ ID NO: 283635 - RNA, 32 nt, Human
aaaauacaacaacaacaaaauuagcugggcau

SEQ ID NO: 283636 - RNA, 32 nt, Human
aaaauacaacccaguaucuaaaaaguguuaac

SEQ ID NO: 283637 - RNA, 32 nt, Human
aaaauacacauacauacauacauauguauaca

SEQ ID NO: 283638 - RNA, 32 nt, Human
aaaauacacaucugucuucugggaaagaggag

SEQ ID NO: 283639 - RNA, 32 nt, Human
aaaauacacuaguggaaaacacucugauguaa

SEQ ID NO: 283640 - RNA, 32 nt, Human
aaaauacagacacuugacccuugguguagcuu

SEQ ID NO: 283641 - RNA, 31 nt, Human
aaaauacagagagugaguguguggaagagag

SEQ ID NO: 283642 - RNA, 32 nt, Human
aaaauacagagugcucuaagagagaauaacaa

SEQ ID NO: 283643 - RNA, 32 nt, Human
aaaauacaggagaaacagucucaguggaaugu

SEQ ID NO: 283644 - RNA, 32 nt, Human
aaaauacaggccaggggcugggcacgguaccu

SEQ ID NO: 283645 - RNA, 32 nt, Human
aaaauacagugaugaagagacaaaggaugcca

SEQ ID NO: 283646 - RNA, 32 nt, Human
aaaauacaguugaggcacucucugcccagacu

SEQ ID NO: 283647 - RNA, 32 nt, Human
aaaauacauaaauaacauuguaucacacuuuu

SEQ ID NO: 283648 - RNA, 32 nt, Human
aaaauacauacucugaaagauaaggcaauuuu

SEQ ID NO: 283649 - RNA, 31 nt, Human
aaaauacauacuucuucauucggagagacaa

SEQ ID NO: 283650 - RNA, 32 nt, Human
aaaauacauauauacaaaaauuagcugggcau

SEQ ID NO: 283651 - RNA, 32 nt, Human
aaaauacauauguaucuauauaagcauaugug

SEQ ID NO: 283652 - RNA, 32 nt, Human
aaaauacaugcugacuuucuaaaauaguguaa

SEQ ID NO: 283653 - RNA, 32 nt, Human
aaaauacauucucugaccacagucuccuccuu

SEQ ID NO: 283654 - RNA, 32 nt, Human
aaaauaccaaacaugucuuuguaucaaggaac

SEQ ID NO: 283655 - RNA, 32 nt, Human
aaaauaccauaaaaauacauaaaaucugauga

SEQ ID NO: 283656 - RNA, 32 nt, Human
aaaauacccagggguuaagaccacagaaggcu

SEQ ID NO: 283657 - RNA, 32 nt, Human
aaaauaccguguuacacacauuugcucuuaug

SEQ ID NO: 283658 - RNA, 32 nt, Human
aaaauaccuguaaucccagcacuuugggaggc

SEQ ID NO: 283659 - RNA, 32 nt, Human
aaaauaccuuguuuggucaaugacuuuacugg

SEQ ID NO: 283660 - RNA, 23 nt, Human
aaaauacgaaaauuaaccaggca

SEQ ID NO: 283661 - RNA, 32 nt, Human
aaaauacgcucaggugguugugguguagacug

SEQ ID NO: 283662 - RNA, 32 nt, Human
aaaauacggaacucuaacuccuugccacucaa

SEQ ID NO: 283663 - RNA, 32 nt, Human
aaaauacgugcucuccucucuccuugucagcu

SEQ ID NO: 283664 - RNA, 32 nt, Human
aaaauacuaaggauuuuucuagaaacucuuaa

SEQ ID NO: 283665 - RNA, 32 nt, Human
aaaauacuagaacguuugcugcgauaaaucuu

SEQ ID NO: 283666 - RNA, 32 nt, Human
aaaauacucaacuaaauucauuucuacuccag

SEQ ID NO: 283667 - RNA, 32 nt, Human
aaaauacuccauccuuauggguuuacaugcau

SEQ ID NO: 283668 - RNA, 21 nt, Human
aaaauacucuacaccuuuggg

SEQ ID NO: 283669 - RNA, 32 nt, Human
aaaauacucuggcuggucucaguggcucaugu

SEQ ID NO: 283670 - RNA, 32 nt, Human
aaaauacugcucaagugggggcuuccucacag

SEQ ID NO: 283671 - RNA, 32 nt, Human
aaaauacuggcacaccuguguucacaggggcu

SEQ ID NO: 283672 - RNA, 32 nt, Human
aaaauacuguaaucucagcauuuugggagacc

SEQ ID NO: 283673 - RNA, 32 nt, Human
aaaauacugugagccgggcaugguggcuuaca

SEQ ID NO: 283674 - RNA, 32 nt, Human
aaaauacuguggaauaagcccaggaagguuag

SEQ ID NO: 283675 - RNA, 20 nt, Human
aaaauacuguuacacugggu

SEQ ID NO: 283676 - RNA, 32 nt, Human
aaaauacuucugaaguguucugcuccaaucag

SEQ ID NO: 283677 - RNA, 32 nt, Human
aaaauacuugcaaaucauauaucugauaaagg

SEQ ID NO: 283678 - RNA, 32 nt, Human
aaaauacuuuucuucuucuuacuaauucuuuu

SEQ ID NO: 283679 - RNA, 32 nt, Human
aaaauagaaaaaucgcgcacuugcgcgucccc

SEQ ID NO: 283680 - RNA, 32 nt, Human
aaaauagaaauauagcauauuauucaagggca

SEQ ID NO: 283681 - RNA, 32 nt, Human
aaaauagaaauccugacaucucauuucuauuu

SEQ ID NO: 283682 - RNA, 32 nt, Human
aaaauagaaaugucaguagaacucauugaggg

SEQ ID NO: 283683 - RNA, 32 nt, Human
aaaauagaagaaaaauaaaagugaaggucaag

SEQ ID NO: 283684 - RNA, 32 nt, Human
aaaauagaagaaugugauuugguagaguaggg

SEQ ID NO: 283685 - RNA, 21 nt, Human
aaaauagaaucucacugauag

SEQ ID NO: 283686 - RNA, 32 nt, Human
aaaauagacagaaaugggcugcacaccagaau

SEQ ID NO: 283687 - RNA, 32 nt, Human
aaaauagagaagaaaggaaccaugaagaaaca

SEQ ID NO: 283688 - RNA, 32 nt, Human
aaaauagagagagggaaaaauccuuguuuucu

SEQ ID NO: 283689 - RNA, 32 nt, Human
aaaauagagcaucucagagaaggaggugaguu

SEQ ID NO: 283690 - RNA, 32 nt, Human
aaaauagagccaagaccucuggucucaaauau

SEQ ID NO: 283691 - RNA, 32 nt, Human
aaaauagaggagagaaagagagcaugagaggg

SEQ ID NO: 283692 - RNA, 32 nt, Human
aaaauagagucccuuccccaaacaucugacau

SEQ ID NO: 283693 - RNA, 32 nt, Human
aaaauagaucaguguuaaacuagauuguauuc

SEQ ID NO: 283694 - RNA, 32 nt, Human
aaaauagaugugguauugcucugaggaccagg

SEQ ID NO: 283695 - RNA, 32 nt, Human
aaaauagcaaaguggcugggcaugguggcuca

SEQ ID NO: 283696 - RNA, 32 nt, Human
aaaauagcacaauuguaccuccccuuuguugg

SEQ ID NO: 283697 - RNA, 32 nt, Human
aaaauagcacuuccuugauggaacauacauuu

SEQ ID NO: 283698 - RNA, 32 nt, Human
aaaauagcagagccaggggaacagacgcaugu

SEQ ID NO: 283699 - RNA, 32 nt, Human
aaaauagccagguguagcgacacacaccugua

SEQ ID NO: 283700 - RNA, 32 nt, Human
aaaauagccagguguagcgacacacaccugug

SEQ ID NO: 283701 - RNA, 32 nt, Human
aaaauagccccaaacugcaauuccauaugacu

SEQ ID NO: 283702 - RNA, 32 nt, Human
aaaauagccccuccugaagauaaaaucauuca

SEQ ID NO: 283703 - RNA, 32 nt, Human
aaaauagccugccuugggacagguguguaaug

SEQ ID NO: 283704 - RNA, 32 nt, Human
aaaauagcguggccagauuggagagagaaguu

SEQ ID NO: 283705 - RNA, 32 nt, Human
aaaauagcuccugcccaguggcucuugguucc

SEQ ID NO: 283706 - RNA, 32 nt, Human
aaaauaggacugaccaagaagcagaaaagcaa

SEQ ID NO: 283707 - RNA, 32 nt, Human
aaaauaggcacuuugggccaaaagcucuaaug

SEQ ID NO: 283708 - RNA, 32 nt, Human
aaaauaggcaggaggaagaugcggaggagggu

SEQ ID NO: 283709 - RNA, 32 nt, Human
aaaauagggauaguuauaccuaccacacaacc

SEQ ID NO: 283710 - RNA, 32 nt, Human
aaaauagggcuggaucuuaucacugcccuguc

SEQ ID NO: 283711 - RNA, 32 nt, Human
aaaauagguaucaaauuuuggaaaagagauuu

SEQ ID NO: 283712 - RNA, 32 nt, Human
aaaauagguguccaaguagucacacugagacu

SEQ ID NO: 283713 - RNA, 32 nt, Human
aaaauaguaaaggucuugaagaaugccagcga

SEQ ID NO: 283714 - RNA, 32 nt, Human
aaaauaguaggccacuuggcucacacagaaga

SEQ ID NO: 283715 - RNA, 21 nt, Human
aaaauaguauagaaaaaagua

SEQ ID NO: 283716 - RNA, 32 nt, Human
aaaauaguccugccugagguugcagugagccg

SEQ ID NO: 283717 - RNA, 32 nt, Human
aaaauaguccugcuuaaauucacauggugugg

SEQ ID NO: 283718 - RNA, 32 nt, Human
aaaauagucuagaccagcuagugcuuccacag

SEQ ID NO: 283719 - RNA, 32 nt, Human
aaaauagucugagucacuuucacuuucagccu

SEQ ID NO: 283720 - RNA, 32 nt, Human
aaaauagucugcaguuuaaucucuccaaagcu

SEQ ID NO: 283721 - RNA, 32 nt, Human
aaaauaguggugagcuggaggcuacuuccgcc

SEQ ID NO: 283722 - RNA, 32 nt, Human
aaaauaguggugcuucuuucugaucucuagug

SEQ ID NO: 283723 - RNA, 32 nt, Human
aaaauauaacaaagggcaucauuaaguagacc

SEQ ID NO: 283724 - RNA, 32 nt, Human
aaaauauaacaauacuaaauaucacacuguga

SEQ ID NO: 283725 - RNA, 21 nt, Human
aaaauauaacuucuugauuua

SEQ ID NO: 283726 - RNA, 32 nt, Human
aaaauauaagagaacauagggccaggcacugu

SEQ ID NO: 283727 - RNA, 32 nt, Human
aaaauauaaggaaaaagaauauagacaagcau

SEQ ID NO: 283728 - RNA, 32 nt, Human
aaaauauacauacuaguaccauuaucuucuuu

SEQ ID NO: 283729 - RNA, 32 nt, Human
aaaauauacaugucaccgaagcaaguguaccc

SEQ ID NO: 283730 - RNA, 32 nt, Human
aaaauauagcauuaaaccacuaaagcuaagga

SEQ ID NO: 283731 - RNA, 32 nt, Human
aaaauauaguccugaaaauuuuccuuaucgcc

SEQ ID NO: 283732 - RNA, 32 nt, Human
aaaauauauccaggugcuaaauaggcagcaga

SEQ ID NO: 283733 - RNA, 32 nt, Human
aaaauauauuccccaaacacccauaagaauuc

SEQ ID NO: 283734 - RNA, 32 nt, Human
aaaauauauuuuuaugagcugguacugacagu

SEQ ID NO: 283735 - RNA, 32 nt, Human
aaaauaucaauggugcugagguugagaaaacc

SEQ ID NO: 283736 - RNA, 32 nt, Human
aaaauaucagcuuuaaaauaugaaagugcuag

SEQ ID NO: 283737 - RNA, 32 nt, Human
aaaauaucauuaguccugagguugagaaaccc

SEQ ID NO: 283738 - RNA, 32 nt, Human
aaaauaucauucuucuuuuuauuuguuuucac

SEQ ID NO: 283739 - RNA, 32 nt, Human
aaaauaucucuaacaaaguuuuacucuucuau

SEQ ID NO: 283740 - RNA, 32 nt, Human
aaaauaucuugcaagcuccaccuucacuuugc

SEQ ID NO: 283741 - RNA, 32 nt, Human
aaaauaucuuuguuuugcuuucauucacaaag

SEQ ID NO: 283742 - RNA, 32 nt, Human
aaaauaugaccacacuccagcugggaucacau

SEQ ID NO: 283743 - RNA, 32 nt, Human
aaaauaugaguauuuugauaccuuuucuuuac

SEQ ID NO: 283744 - RNA, 32 nt, Human
aaaauaugcuauuguuuagacuuuccauccuu

SEQ ID NO: 283745 - RNA, 32 nt, Human
aaaauauguaugaagaaaagguguacaaaaau

SEQ ID NO: 283746 - RNA, 32 nt, Human
aaaauaugugcacauauggauguauguugaaa

SEQ ID NO: 283747 - RNA, 32 nt, Human
aaaauauguguaucuucuuaauguguucaugu

SEQ ID NO: 283748 - RNA, 32 nt, Human
aaaauauguucauuuccaccuuccucagaugg

SEQ ID NO: 283749 - RNA, 32 nt, Human
aaaauauuaaauuggugcaaaaguaauugccg

SEQ ID NO: 283750 - RNA, 32 nt, Human
aaaauauuacaaaucccaagucccagauugua

SEQ ID NO: 283751 - RNA, 32 nt, Human
aaaauauuagccauuugagaugagaugagacu

SEQ ID NO: 283752 - RNA, 32 nt, Human
aaaauauuauuaaaauacaggaguuuaccuua

SEQ ID NO: 283753 - RNA, 32 nt, Human
aaaauauucaaaagccauucagugcugguuuu

SEQ ID NO: 283754 - RNA, 32 nt, Human
aaaauauugaaaugcuucucuagauuaugcuu

SEQ ID NO: 283755 - RNA, 32 nt, Human
aaaauauugacauugaauggaucaauacacac

SEQ ID NO: 283756 - RNA, 32 nt, Human
aaaauauugaugaucaggcagauuugaaaaca

SEQ ID NO: 283757 - RNA, 32 nt, Human
aaaauauugguaacagugggccccaguaugga

SEQ ID NO: 283758 - RNA, 32 nt, Human
aaaauauuugagaaaaauaaaguacaaguuuu

SEQ ID NO: 283759 - RNA, 32 nt, Human
aaaauauuuuaaaagauauuguauuuauguug

SEQ ID NO: 283760 - RNA, 32 nt, Human
aaaauauuuuaagagauuuauucugagccaaa

SEQ ID NO: 283761 - RNA, 32 nt, Human
aaaauauuuucaucuuucccccaaaccuccuu

SEQ ID NO: 283762 - RNA, 23 nt, Human
aaaauauuuugagcuccuucagc

SEQ ID NO: 283763 - RNA, 32 nt, Human
aaaauauuuugugaaaagcuguauuuauuaua

SEQ ID NO: 283764 - RNA, 32 nt, Human
aaaaucaaaaacaaauguccccggaucuuucg

SEQ ID NO: 283765 - RNA, 32 nt, Human
aaaaucaaaauggauuuagagaaaaauuaucc

SEQ ID NO: 283766 - RNA, 32 nt, Human
aaaaucaacacuaaugauaaaugaaguauaua

SEQ ID NO: 283767 - RNA, 32 nt, Human
aaaaucaacccagcaccagcagcuaccaacca

SEQ ID NO: 283768 - RNA, 32 nt, Human
aaaaucaacccauaucccagacugcuuugccu

SEQ ID NO: 283769 - RNA, 32 nt, Human
aaaaucaacuuccagcccuaucuacugucugg

SEQ ID NO: 283770 - RNA, 32 nt, Human
aaaaucaagaaggcaugacugugcacaguucu

SEQ ID NO: 283771 - RNA, 32 nt, Human
aaaaucaagacaccuuccagcccuaccaucag

SEQ ID NO: 283772 - RNA, 32 nt, Human
aaaaucaagguacaggaaaacuccuuguuauc

SEQ ID NO: 283773 - RNA, 32 nt, Human
aaaaucaagguuuggcuucaguuuaaaucacu

SEQ ID NO: 283774 - RNA, 32 nt, Human
aaaaucaagucaccacacuccagccuggguga

SEQ ID NO: 283775 - RNA, 32 nt, Human
aaaaucacaaaccuugaaaaauuuuacaucag

SEQ ID NO: 283776 - RNA, 32 nt, Human
aaaaucaccaaggagacuuugcauuaaguuca

SEQ ID NO: 283777 - RNA, 32 nt, Human
aaaaucacccagccgauuggggguuucccauc

SEQ ID NO: 283778 - RNA, 32 nt, Human
aaaaucacgccacugcacuccagccugggcaa

SEQ ID NO: 283779 - RNA, 32 nt, Human
aaaaucagaggaaaggaggcugccauucccuu

SEQ ID NO: 283780 - RNA, 32 nt, Human
aaaaucagagggcugaaagagacacuucuaua

SEQ ID NO: 283781 - RNA, 32 nt, Human
aaaaucagagguggaggucaggggguuagguc

SEQ ID NO: 283782 - RNA, 32 nt, Human
aaaaucagcacugccugaguaguuuugaucag

SEQ ID NO: 283783 - RNA, 32 nt, Human
aaaaucagccaaggacuaagcuuccauagaaa

SEQ ID NO: 283784 - RNA, 32 nt, Human
aaaaucagccugggguauauagcgagacgcca

SEQ ID NO: 283785 - RNA, 32 nt, Human
aaaaucagccugucugcucucuccuugcucaa

SEQ ID NO: 283786 - RNA, 32 nt, Human
aaaaucagcucucauaacuaaguuaauuuagu

SEQ ID NO: 283787 - RNA, 32 nt, Human
aaaaucagcugguucugcugcuugguuucaac

SEQ ID NO: 283788 - RNA, 32 nt, Human
aaaaucagcuuuguaacuguuuucaaggaggu

SEQ ID NO: 283789 - RNA, 32 nt, Human
aaaaucaggaagguaaagcaaaucucuggagg

SEQ ID NO: 283790 - RNA, 32 nt, Human
aaaaucaggccagaggacaacaggcuggcguu

SEQ ID NO: 283791 - RNA, 32 nt, Human
aaaaucaggcuacagcacuccagccugggcaa

SEQ ID NO: 283792 - RNA, 32 nt, Human
aaaaucaggcuggacguggugguucaugccua

SEQ ID NO: 283793 - RNA, 32 nt, Human
aaaaucaggcuugagugcaguggcgcaaucgu

SEQ ID NO: 283794 - RNA, 32 nt, Human
aaaaucagguauaaaguucagaugagauuccc

SEQ ID NO: 283795 - RNA, 32 nt, Human
aaaaucagguggaccuuccuggacauauccug

SEQ ID NO: 283796 - RNA, 32 nt, Human
aaaaucaggugggugggaaucucuuggagaac

SEQ ID NO: 283797 - RNA, 32 nt, Human
aaaaucagugacaucugauuggcagaugagcu

SEQ ID NO: 283798 - RNA, 32 nt, Human
aaaaucagugauguauaaacuaguucaugagu

SEQ ID NO: 283799 - RNA, 32 nt, Human
aaaaucaguucuguaggaaucccuuuccccuc

SEQ ID NO: 283800 - RNA, 32 nt, Human
aaaaucauaggcuuuuucugugcauugaacuu

SEQ ID NO: 283801 - RNA, 32 nt, Human
aaaaucauaggcuuuuucugugcauugaauuu

SEQ ID NO: 283802 - RNA, 32 nt, Human
aaaaucaucuaagaaaucguucacucuugcua

SEQ ID NO: 283803 - RNA, 32 nt, Human
aaaaucaugauauuuaaaaauggucaaauauu

SEQ ID NO: 283804 - RNA, 32 nt, Human
aaaaucaugccacugcacuccagccugggcaa

SEQ ID NO: 283805 - RNA, 32 nt, Human
aaaaucaugccauugcacuccagccuggguga

SEQ ID NO: 283806 - RNA, 32 nt, Human
aaaaucaugggacuugccauuuaggaggauaa

SEQ ID NO: 283807 - RNA, 32 nt, Human
aaaaucauggugguaggcaaaugaggagcagu

SEQ ID NO: 283808 - RNA, 32 nt, Human
aaaaucauuaccuguggaaugacuaggaauau

SEQ ID NO: 283809 - RNA, 32 nt, Human
aaaaucauuaccuguggaauggcuaggaauau

SEQ ID NO: 283810 - RNA, 31 nt, Human
aaaaucauugucgcuggaccugugucugcac

SEQ ID NO: 283811 - RNA, 32 nt, Human
aaaaucauuucagucuccugaggucucaugcu

SEQ ID NO: 283812 - RNA, 32 nt, Human
aaaauccaaauggacaucaacagcuuucauca

SEQ ID NO: 283813 - RNA, 32 nt, Human
aaaauccacaauauuccaaguacaacucuuca

SEQ ID NO: 283814 - RNA, 32 nt, Human
aaaauccacagcuauauccugaugcuggaugg

SEQ ID NO: 283815 - RNA, 32 nt, Human
aaaauccaccugucucccaucuggggcucuuu

SEQ ID NO: 283816 - RNA, 32 nt, Human
aaaauccacugcaccuccacuuggugacugac

SEQ ID NO: 283817 - RNA, 32 nt, Human
aaaauccagaacuuggacuccaucguuaaaau

SEQ ID NO: 283818 - RNA, 32 nt, Human
aaaauccagaagcaagauuccguaagcugaga

SEQ ID NO: 283819 - RNA, 32 nt, Human
aaaauccagcagguggagguugcagugagcca

SEQ ID NO: 283820 - RNA, 32 nt, Human
aaaauccagccugggagccccuggaguggcag

SEQ ID NO: 283821 - RNA, 32 nt, Human
aaaauccaggucaugcaguuccuggcccauca

SEQ ID NO: 283822 - RNA, 32 nt, Human
aaaauccagucuuucaggaagaacaaacugac

SEQ ID NO: 283823 - RNA, 32 nt, Human
aaaauccagugcacucccuaggaaauccggga

SEQ ID NO: 283824 - RNA, 32 nt, Human
aaaauccaguugaccuggacaguauuauaugu

SEQ ID NO: 283825 - RNA, 32 nt, Human
aaaaucccaaagugccuucugagcugucuaaa

SEQ ID NO: 283826 - RNA, 32 nt, Human
aaaaucccaagaagauggagaagugcaucccu

SEQ ID NO: 283827 - RNA, 32 nt, Human
aaaaucccaagugacccacagaagcuguccua

SEQ ID NO: 283828 - RNA, 32 nt, Human
aaaaucccaccacugcacuccagccuggguga

SEQ ID NO: 283829 - RNA, 32 nt, Human
aaaaucccacccauguuguaccaccuugguga

SEQ ID NO: 283830 - RNA, 32 nt, Human
aaaaucccacugaugcccaucaugcccucaga

SEQ ID NO: 283831 - RNA, 32 nt, Human
aaaauccccaacaaaagccuguuucucuagac

SEQ ID NO: 283832 - RNA, 32 nt, Human
aaaauccccagcagcugggacugaagggaagc

SEQ ID NO: 283833 - RNA, 32 nt, Human
aaaaucccucaaaucacaaauagcugaagcca

SEQ ID NO: 283834 - RNA, 32 nt, Human
aaaauccucacugcacuccagcagaggcuaga

SEQ ID NO: 283835 - RNA, 32 nt, Human
aaaauccucugaacagaacuuggccuuuuguu

SEQ ID NO: 283836 - RNA, 32 nt, Human
aaaauccugcagcguucaaguuugaugcugcc

SEQ ID NO: 283837 - RNA, 32 nt, Human
aaaauccuguucuagugaaugucaugcagaua

SEQ ID NO: 283838 - RNA, 32 nt, Human
aaaauccuuaagagacugcuuucuugauucag

SEQ ID NO: 283839 - RNA, 32 nt, Human
aaaauccuucaccaauuuuuccacauacuuuc

SEQ ID NO: 283840 - RNA, 32 nt, Human
aaaauccuuggaaauacaaugagacucaucag

SEQ ID NO: 283841 - RNA, 32 nt, Human
aaaauccuuggcuguucagucacugcggucuu

SEQ ID NO: 283842 - RNA, 32 nt, Human
aaaaucgcacagacacugcgugcaauguuguu

SEQ ID NO: 283843 - RNA, 32 nt, Human
aaaaucgcauuuuccuuauuucugcuuuuaua

SEQ ID NO: 283844 - RNA, 32 nt, Human
aaaaucgccacacuuggaaaaguuucaucagu

SEQ ID NO: 283845 - RNA, 32 nt, Human
aaaaucgcgucacugcacuccagccugaguga

SEQ ID NO: 283846 - RNA, 32 nt, Human
aaaaucgcugggaucuggagaggaagacucag

SEQ ID NO: 283847 - RNA, 32 nt, Human
aaaaucgcuugaaccugggagguggaaguugc

SEQ ID NO: 283848 - RNA, 32 nt, Human
aaaaucgugguugaguuucacugcagcaggcu

SEQ ID NO: 283849 - RNA, 32 nt, Human
aaaaucuaaaaauucuugcaaugaguaguaua

SEQ ID NO: 283850 - RNA, 32 nt, Human
aaaaucuaaguugccauggaagaaauaccagu

SEQ ID NO: 283851 - RNA, 32 nt, Human
aaaaucuacuaaaaugaggauuaguaauauaa

SEQ ID NO: 283852 - RNA, 32 nt, Human
aaaaucuagaggaaaagaaagaaguuauuuuc

SEQ ID NO: 283853 - RNA, 32 nt, Human
aaaaucuaggccgggugcaguggcucaugccu

SEQ ID NO: 283854 - RNA, 32 nt, Human
aaaaucuaguuucuuccugaaggaggaucccu

SEQ ID NO: 283855 - RNA, 32 nt, Human
aaaaucuaucuucccaucuccuaaaacucaga

SEQ ID NO: 283856 - RNA, 32 nt, Human
aaaaucuauucucucccccuuucucccuggau

SEQ ID NO: 283857 - RNA, 32 nt, Human
aaaaucucaagaaaacagaaauggcaugcuuu

SEQ ID NO: 283858 - RNA, 32 nt, Human
aaaaucucagaagaaugauuaggggcacccaa

SEQ ID NO: 283859 - RNA, 32 nt, Human
aaaaucucagaggaagcuacuuaggacaucau

SEQ ID NO: 283860 - RNA, 32 nt, Human
aaaaucuccaucagagcaaggcagccagagaa

SEQ ID NO: 283861 - RNA, 32 nt, Human
aaaaucuccaucucaaaaauaaugcauaaacu

SEQ ID NO: 283862 - RNA, 32 nt, Human
aaaaucucguuuucucuucuuccuucuuuuaa

SEQ ID NO: 283863 - RNA, 32 nt, Human
aaaaucucugcagucaauuuuuaucuccucug

SEQ ID NO: 283864 - RNA, 32 nt, Human
aaaaucucuguaaccauuucuuuuauguacau

SEQ ID NO: 283865 - RNA, 32 nt, Human
aaaaucucuucucccuucucccuccaucaucg

SEQ ID NO: 283866 - RNA, 32 nt, Human
aaaaucugaacagggccaggugcaguggcuca

SEQ ID NO: 283867 - RNA, 32 nt, Human
aaaaucugaagaguccauaaacuuuugaaaau

SEQ ID NO: 283868 - RNA, 32 nt, Human
aaaaucugacacucaagaaggucgauugacac

SEQ ID NO: 283869 - RNA, 32 nt, Human
aaaaucugcaaagucuuuccagccugguccag

SEQ ID NO: 283870 - RNA, 32 nt, Human
aaaaucugcacuggggucgggcacaguggcuc

SEQ ID NO: 283871 - RNA, 32 nt, Human
aaaaucugcagcagccucugauagcaggaaga

SEQ ID NO: 283872 - RNA, 32 nt, Human
aaaaucugcauugccauugaugcauaugcacc

SEQ ID NO: 283873 - RNA, 32 nt, Human
aaaaucugcucacaguuuguucuggaggucac

SEQ ID NO: 283874 - RNA, 32 nt, Human
aaaaucugcuuuucacacugggugauaauaac

SEQ ID NO: 283875 - RNA, 32 nt, Human
aaaaucuggaaccuuacuucucugggaaucuu

SEQ ID NO: 283876 - RNA, 32 nt, Human
aaaaucugggaaauacagucucugcuugggcg

SEQ ID NO: 283877 - RNA, 32 nt, Human
aaaaucugggcuguggggagagagaauugugu

SEQ ID NO: 283878 - RNA, 32 nt, Human
aaaaucugguucacaucauaaagaacuugauu

SEQ ID NO: 283879 - RNA, 32 nt, Human
aaaaucuguauauucagcuauuuggagaacuc

SEQ ID NO: 283880 - RNA, 32 nt, Human
aaaaucugucucaggcugguaguuagcaguug

SEQ ID NO: 283881 - RNA, 32 nt, Human
aaaaucugugaagaaagagguuaggaguagau

SEQ ID NO: 283882 - RNA, 32 nt, Human
aaaaucugugucucaaaaacaaaacaaaacaa

SEQ ID NO: 283883 - RNA, 32 nt, Human
aaaaucuguucagguugguguaccguguaaag

SEQ ID NO: 283884 - RNA, 32 nt, Human
aaaaucuuacuuccucuauucucugagccgcu

SEQ ID NO: 283885 - RNA, 32 nt, Human
aaaaucuuaggccagugcaguggcucacaccu

SEQ ID NO: 283886 - RNA, 32 nt, Human
aaaaucuuauuccuccucuucuccccucacuu

SEQ ID NO: 283887 - RNA, 32 nt, Human
aaaaucuucacaaggauucaugacauucgugc

SEQ ID NO: 283888 - RNA, 32 nt, Human
aaaaucuucccugaguucugaacccagcacca

SEQ ID NO: 283889 - RNA, 32 nt, Human
aaaaucuucccuuuguugacuggccuucacag

SEQ ID NO: 283890 - RNA, 32 nt, Human
aaaaucuugccuuucgagaauccgaguccuga

SEQ ID NO: 283891 - RNA, 32 nt, Human
aaaaucuuugucgucugcaucuggaaccaaaa

SEQ ID NO: 283892 - RNA, 32 nt, Human
aaaaugaaaaguccccagagaaaccccacagu

SEQ ID NO: 283893 - RNA, 32 nt, Human
aaaaugaaaauguauagauuacacagccagga

SEQ ID NO: 283894 - RNA, 25 nt, Human
aaaaugaaacucuuuguuuucuucu

SEQ ID NO: 283895 - RNA, 32 nt, Human
aaaaugaaagccucagaagcaaaagugaccuu

SEQ ID NO: 283896 - RNA, 31 nt, Human
aaaaugaaaguauuuggacaugcagacagaa

SEQ ID NO: 283897 - RNA, 32 nt, Human
aaaaugaaauauuuuaacauuuuaugggucag

SEQ ID NO: 283898 - RNA, 27 nt, Human
aaaaugaacaccagauuauuaucuucu

SEQ ID NO: 283899 - RNA, 32 nt, Human
aaaaugaacagcuucaacuucuugccgaugag

SEQ ID NO: 283900 - RNA, 32 nt, Human
aaaaugaacuaggcaggugaggugguguuugc

SEQ ID NO: 283901 - RNA, 32 nt, Human
aaaaugaagagagaggguuuuaccauccugag

SEQ ID NO: 283902 - RNA, 32 nt, Human
aaaaugaagaggagcaaggagugaaggagugg

SEQ ID NO: 283903 - RNA, 21 nt, Human
aaaaugaagcaaaacaaaaca

SEQ ID NO: 283904 - RNA, 32 nt, Human
aaaaugaagcccagagagguuaagugacuugc

SEQ ID NO: 283905 - RNA, 19 nt, Human
aaaaugaaguggcuuuuca

SEQ ID NO: 283906 - RNA, 32 nt, Human
aaaaugaauaccucuaguuguuuugaggauua

SEQ ID NO: 283907 - RNA, 28 nt, Human
aaaaugaaucuuauugugaaacuucgga

SEQ ID NO: 283908 - RNA, 28 nt, Human
aaaaugacaaagcauccaccuaacagac

SEQ ID NO: 283909 - RNA, 32 nt, Human
aaaaugacacuaugaguuggccagucuaggau

SEQ ID NO: 283910 - RNA, 28 nt, Human
aaaaugacagaucucguagcuguuuggg

SEQ ID NO: 283911 - RNA, 32 nt, Human
aaaaugacauggacaaaagcaucucuaaucac

SEQ ID NO: 283912 - RNA, 28 nt, Human
aaaaugaccacauucaaggagggacuga

SEQ ID NO: 283913 - RNA, 31 nt, Human
aaaaugaccucaccauuuuuguucuagggau

SEQ ID NO: 283914 - RNA, 32 nt, Human
aaaaugacuauugguggggagguguaaauaag

SEQ ID NO: 283915 - RNA, 32 nt, Human
aaaaugacuccuaguuguguuuggaaagggag

SEQ ID NO: 283916 - RNA, 32 nt, Human
aaaaugacugccucauguuacaugugucaaac

SEQ ID NO: 283917 - RNA, 32 nt, Human
aaaaugacuucauuccagaggcuucucagagu

SEQ ID NO: 283918 - RNA, 24 nt, Human
aaaaugacuugguucuuuucuucu

SEQ ID NO: 283919 - RNA, 32 nt, Human
aaaaugacuuuuaggcugggugcaguggcuca

SEQ ID NO: 283920 - RNA, 21 nt, Human
aaaaugagaaaaagcuuuccu

SEQ ID NO: 283921 - RNA, 23 nt, Human
aaaaugagaaagaauacaagaaa

SEQ ID NO: 283922 - RNA, 32 nt, Human
aaaaugagaaauuaaaccugcaagugaaacau

SEQ ID NO: 283923 - RNA, 32 nt, Human
aaaaugagaacauguuaguauuuaucuauugu

SEQ ID NO: 283924 - RNA, 32 nt, Human
aaaaugagaacauguugguauuuaucuauugu

SEQ ID NO: 283925 - RNA, 32 nt, Human
aaaaugagagacagaagccacaggggaagcaa

SEQ ID NO: 283926 - RNA, 32 nt, Human
aaaaugagagagaaaauuaaugugacaaaaug

SEQ ID NO: 283927 - RNA, 28 nt, Human
aaaaugagaucgaggcaccaguggaagg

SEQ ID NO: 283928 - RNA, 32 nt, Human
aaaaugagauggaggaaggaaaaagggagaag

SEQ ID NO: 283929 - RNA, 32 nt, Human
aaaaugagauuugaagaggagcaacaguccaa

SEQ ID NO: 283930 - RNA, 32 nt, Human
aaaaugagcacacccuucacacuguuaucacc

SEQ ID NO: 283931 - RNA, 32 nt, Human
aaaaugagcauacaucuuaaaucuuuucaauu

SEQ ID NO: 283932 - RNA, 32 nt, Human
aaaaugagccaggcauguggugguguaugccu

SEQ ID NO: 283933 - RNA, 32 nt, Human
aaaaugagcccccauuccacagacacuggagu

SEQ ID NO: 283934 - RNA, 21 nt, Human
aaaaugagcguguuuucucuc

SEQ ID NO: 283935 - RNA, 32 nt, Human
aaaaugaggaaccaagugaaacuacggauaua

SEQ ID NO: 283936 - RNA, 32 nt, Human
aaaaugaggcacaggcuuguuugccgagugga

SEQ ID NO: 283937 - RNA, 32 nt, Human
aaaaugagggccugaagcaaugcuuacaauag

SEQ ID NO: 283938 - RNA, 32 nt, Human
aaaaugagguuuugcuuucaggauuuggcgua

SEQ ID NO: 283939 - RNA, 32 nt, Human
aaaaugaguaaaccagcgaggugucacgccug

SEQ ID NO: 283940 - RNA, 32 nt, Human
aaaaugaguccaggccaagcaaauggagcaga

SEQ ID NO: 283941 - RNA, 32 nt, Human
aaaaugaucacaccaacucugccuacacacuu

SEQ ID NO: 283942 - RNA, 32 nt, Human
aaaaugaucagccaugugaagauucgaaacuu

SEQ ID NO: 283943 - RNA, 32 nt, Human
aaaaugauccagaaaaaugcaagcaaguccac

SEQ ID NO: 283944 - RNA, 32 nt, Human
aaaaugaucuguccauacccacugccuggaga

SEQ ID NO: 283945 - RNA, 32 nt, Human
aaaaugaucuuucuguccuuuuccuagauaca

SEQ ID NO: 283946 - RNA, 32 nt, Human
aaaaugaugcuggucaucccagcuucagcauc

SEQ ID NO: 283947 - RNA, 32 nt, Human
aaaaugaugcuggucaucgcagcuucagcauc

SEQ ID NO: 283948 - RNA, 32 nt, Human
aaaaugauggaagaggcggagguggaggcgac

SEQ ID NO: 283949 - RNA, 32 nt, Human
aaaaugauggccugggcuuucugaggccuuau

SEQ ID NO: 283950 - RNA, 32 nt, Human
aaaaugaugucuacccgccuugcugaugagua

SEQ ID NO: 283951 - RNA, 32 nt, Human
aaaaugaugucuaccugccuugcugaugagua

SEQ ID NO: 283952 - RNA, 32 nt, Human
aaaaugauuuauagauccagcugugcuuaaga

SEQ ID NO: 283953 - RNA, 32 nt, Human
aaaaugauuuccaaagcagaacauggaacuuc

SEQ ID NO: 283954 - RNA, 32 nt, Human
aaaaugcaaaagaccauagaauuuguauuucu

SEQ ID NO: 283955 - RNA, 32 nt, Human
aaaaugcaaaauauagcaccccugccacuuug

SEQ ID NO: 283956 - RNA, 32 nt, Human
aaaaugcaaagucaaauaaaaggugucuuggu

SEQ ID NO: 283957 - RNA, 32 nt, Human
aaaaugcaaauagcugaaggggaaggaaaagu

SEQ ID NO: 283958 - RNA, 32 nt, Human
aaaaugcaacaacauguauaauauuuuuaauu

SEQ ID NO: 283959 - RNA, 28 nt, Human
aaaaugcacaugacaguacuuauuccuc

SEQ ID NO: 283960 - RNA, 32 nt, Human
aaaaugcaccacugcacuccagcaugggcaac

SEQ ID NO: 283961 - RNA, 19 nt, Human
aaaaugcaccuuucugaca

SEQ ID NO: 283962 - RNA, 32 nt, Human
aaaaugcagaacuuaaucuggacacacuguua

SEQ ID NO: 283963 - RNA, 32 nt, Human
aaaaugcagauagagaaaaagaagaaaauaaa

SEQ ID NO: 283964 - RNA, 32 nt, Human
aaaaugcagcagcauaggagugaacaacagca

SEQ ID NO: 283965 - RNA, 32 nt, Human
aaaaugcagccaucggcccucagguggccucu

SEQ ID NO: 283966 - RNA, 32 nt, Human
aaaaugcagggugacugaguucccugcccagc

SEQ ID NO: 283967 - RNA, 28 nt, Human
aaaaugcaguauucgcaccacugugagc

SEQ ID NO: 283968 - RNA, 32 nt, Human
aaaaugcagucuuuauggcaaaaagcuuguga

SEQ ID NO: 283969 - RNA, 32 nt, Human
aaaaugcauaugcacgugcaauuugcacggca

SEQ ID NO: 283970 - RNA, 32 nt, Human
aaaaugcauauuaauuucuucccccaaagccg

SEQ ID NO: 283971 - RNA, 32 nt, Human
aaaaugcauggagaaaaggaauuuguuuaaau

SEQ ID NO: 283972 - RNA, 32 nt, Human
aaaaugcauuaucuccccagaccagagacagu

SEQ ID NO: 283973 - RNA, 32 nt, Human
aaaaugccaaauuuauuaaggugguggagcca

SEQ ID NO: 283974 - RNA, 32 nt, Human
aaaaugccacagcccagaauucugggcaaguc

SEQ ID NO: 283975 - RNA, 31 nt, Human
aaaaugccacuuuucuguuccugaagaggcc

SEQ ID NO: 283976 - RNA, 31 nt, Human
aaaaugccacuuuucuguuccugaagaggcu

SEQ ID NO: 283977 - RNA, 32 nt, Human
aaaaugccaugcagacuuuaaagagaauggcc

SEQ ID NO: 283978 - RNA, 32 nt, Human
aaaaugccccagacuuuuucccaaaccucaaa

SEQ ID NO: 283979 - RNA, 32 nt, Human
aaaaugccugucccagccuccuggccccaucc

SEQ ID NO: 283980 - RNA, 32 nt, Human
aaaaugccuuauugaaaaacuaaagcaaauuc

SEQ ID NO: 283981 - RNA, 32 nt, Human
aaaaugccuuucuccucccugaauggagggcu

SEQ ID NO: 283982 - RNA, 32 nt, Human
aaaaugcuagggaccagaaagguuucagauuu

SEQ ID NO: 283983 - RNA, 32 nt, Human
aaaaugcucaaggaauuagcucugggaauaug

SEQ ID NO: 283984 - RNA, 32 nt, Human
aaaaugcucagaauuucacacugugaauccac

SEQ ID NO: 283985 - RNA, 32 nt, Human
aaaaugcucuuauuucaucauucacuucacug

SEQ ID NO: 283986 - RNA, 24 nt, Human
aaaaugcugacagucugacaccaa

SEQ ID NO: 283987 - RNA, 21 nt, Human
aaaaugcugacauaacaccaa

SEQ ID NO: 283988 - RNA, 32 nt, Human
aaaaugcugaggaaaaugugacggcaggugcc

SEQ ID NO: 283989 - RNA, 32 nt, Human
aaaaugcugagugaguggaggucugggaauga

SEQ ID NO: 283990 - RNA, 32 nt, Human
aaaaugcugauaagcacaguuaauucuaaaau

SEQ ID NO: 283991 - RNA, 32 nt, Human
aaaaugcuggcugaagaccccugcugaaaaca

SEQ ID NO: 283992 - RNA, 32 nt, Human
aaaaugcugguaacugcauuacugcaguuuuu

SEQ ID NO: 283993 - RNA, 32 nt, Human
aaaaugcugucaguucugaccuccgggcaggg

SEQ ID NO: 283994 - RNA, 32 nt, Human
aaaaugcugucuccagcucacacagcaccaca

SEQ ID NO: 283995 - RNA, 32 nt, Human
aaaaugcuguuuaggcugggcuugguggcuca

SEQ ID NO: 283996 - RNA, 32 nt, Human
aaaauggaaaccagacugucuucaaauucuuc

SEQ ID NO: 283997 - RNA, 32 nt, Human
aaaauggaagcgguuggacugauggugucuga

SEQ ID NO: 283998 - RNA, 28 nt, Human
aaaauggaagugagcaaggguccuauga

SEQ ID NO: 283999 - RNA, 32 nt, Human
aaaauggaauagggacucagggugggucaggu

SEQ ID NO: 284000 - RNA, 32 nt, Human
aaaauggaaugacugcuuaguccuuucucaga

SEQ ID NO: 284001 - RNA, 32 nt, Human
aaaauggacacacaauccuccuccagggacug

SEQ ID NO: 284002 - RNA, 32 nt, Human
aaaauggaccaaucagugcucuguaaaaugga

SEQ ID NO: 284003 - RNA, 32 nt, Human
aaaauggaccauaucgggucucagggccauuu

SEQ ID NO: 284004 - RNA, 20 nt, Human
aaaauggacucaugcacaga

SEQ ID NO: 284005 - RNA, 32 nt, Human
aaaauggacuccuucuuccuaucagcucuaga

SEQ ID NO: 284006 - RNA, 31 nt, Human
aaaauggacuguuucugaccagagacacuua

SEQ ID NO: 284007 - RNA, 32 nt, Human
aaaauggagauggcaucaaacuaguggucaag

SEQ ID NO: 284008 - RNA, 32 nt, Human
aaaauggaggcagcgggggcggcggcgugaag

SEQ ID NO: 284009 - RNA, 32 nt, Human
aaaauggauccaguaagaagagucaaggcuuu

SEQ ID NO: 284010 - RNA, 32 nt, Human
aaaauggauggacugaaccaauuagaauugau

SEQ ID NO: 284011 - RNA, 32 nt, Human
aaaauggauucuguggccauccaagggaugua

SEQ ID NO: 284012 - RNA, 32 nt, Human
aaaauggcaaaaacauuugcauuuacaaacaa

SEQ ID NO: 284013 - RNA, 32 nt, Human
aaaauggcaauccaguguugacuguucccuaa

SEQ ID NO: 284014 - RNA, 32 nt, Human
aaaauggcaauuuuugagugccaagucagaaa

SEQ ID NO: 284015 - RNA, 31 nt, Human
aaaauggcacccuucugacauucugaggcag

SEQ ID NO: 284016 - RNA, 31 nt, Human
aaaauggcacuuuugauaugagacaauguag

SEQ ID NO: 284017 - RNA, 32 nt, Human
aaaauggcagggccaggcgagaaccugggaca

SEQ ID NO: 284018 - RNA, 32 nt, Human
aaaauggcagucucaauccuacugucauucuu

SEQ ID NO: 284019 - RNA, 32 nt, Human
aaaauggcaugcaaaugaggccuggugccuuu

SEQ ID NO: 284020 - RNA, 28 nt, Human
aaaauggcgcgggugcugaaggcugcag

SEQ ID NO: 284021 - RNA, 28 nt, Human
aaaauggcuaaacuauacaugguuucag

SEQ ID NO: 284022 - RNA, 32 nt, Human
aaaauggcuuucccaguccuugcuggcuuucc

SEQ ID NO: 284023 - RNA, 32 nt, Human
aaaaugggacuuuuugucucagucccagugaa

SEQ ID NO: 284024 - RNA, 30 nt, Human
aaaaugggaggaaacaccuuuucuagcuag

SEQ ID NO: 284025 - RNA, 32 nt, Human
aaaaugggcagagagagaugaccucggaagca

SEQ ID NO: 284026 - RNA, 32 nt, Human
aaaaugggcaguaggggaaauggaguugcuuc

SEQ ID NO: 284027 - RNA, 32 nt, Human
aaaaugggcauccuggccaggcgcgguggcuc

SEQ ID NO: 284028 - RNA, 18 nt, Human
aaaaugggcucaaccaga

SEQ ID NO: 284029 - RNA, 32 nt, Human
aaaauggggaguuccauuuucuuaauuuuuca

SEQ ID NO: 284030 - RNA, 32 nt, Human
aaaauggggaucuccuccaaagagcagauuuc

SEQ ID NO: 284031 - RNA, 32 nt, Human
aaaauggggcagaagagaaaggacucagugug

SEQ ID NO: 284032 - RNA, 32 nt, Human
aaaauggggccaaugacaccuaccucacuggg

SEQ ID NO: 284033 - RNA, 32 nt, Human
aaaaugggggaugauagucaacaacauauuug

SEQ ID NO: 284034 - RNA, 32 nt, Human
aaaaugggguuacuacuggcccuaccucauau

SEQ ID NO: 284035 - RNA, 32 nt, Human
aaaauggguaagcauagccacuggugggauau

SEQ ID NO: 284036 - RNA, 32 nt, Human
aaaaugggucucuuggugcuaguguuuuacau

SEQ ID NO: 284037 - RNA, 28 nt, Human
aaaaugggugaugucaaagagaacuauc

SEQ ID NO: 284038 - RNA, 32 nt, Human
aaaaugggugauuucuuucuguucauuucaua

SEQ ID NO: 284039 - RNA, 32 nt, Human
aaaaugggugcaaaugaaaacacucucuugcu

SEQ ID NO: 284040 - RNA, 32 nt, Human
aaaauggugcccuauaugggguauuggacaua

SEQ ID NO: 284041 - RNA, 32 nt, Human
aaaauggugguuuuccacacucuaccuuuagu

SEQ ID NO: 284042 - RNA, 32 nt, Human
aaaaugguguaggccgggcaugguggcucacg

SEQ ID NO: 284043 - RNA, 32 nt, Human
aaaaugguuagaagaaagauuuggaauguucc

SEQ ID NO: 284044 - RNA, 20 nt, Human
aaaaugguuuccauaaaaaa

SEQ ID NO: 284045 - RNA, 32 nt, Human
aaaauguaacaucauaauuacauuccuaacua

SEQ ID NO: 284046 - RNA, 32 nt, Human
aaaauguaagugaagauggaaggcuggagaga

SEQ ID NO: 284047 - RNA, 32 nt, Human
aaaauguacaccaggcugggugcgguggcuca

SEQ ID NO: 284048 - RNA, 32 nt, Human
aaaauguagccccagguuggagcugggaacac

SEQ ID NO: 284049 - RNA, 32 nt, Human
aaaauguagcuucucaggggaggcaggaagaa

SEQ ID NO: 284050 - RNA, 32 nt, Human
aaaauguaguuucaguuucuuaaauuauaagc

SEQ ID NO: 284051 - RNA, 32 nt, Human
aaaauguauaucugacuagugggaaacuucau

SEQ ID NO: 284052 - RNA, 32 nt, Human
aaaauguauguucagaaaagcauuuuaucaac

SEQ ID NO: 284053 - RNA, 32 nt, Human
aaaauguauuagacauuaccccugugauuuca

SEQ ID NO: 284054 - RNA, 32 nt, Human
aaaauguauuuauggcugggcgugguggcuca

SEQ ID NO: 284055 - RNA, 32 nt, Human
aaaauguauuuuuagcaagauaacuuggguaa

SEQ ID NO: 284056 - RNA, 32 nt, Human
aaaaugucaaauaccaaugcuuuauaucgacg

SEQ ID NO: 284057 - RNA, 32 nt, Human
aaaaugucacacuugccugugacccccaccug

SEQ ID NO: 284058 - RNA, 32 nt, Human
aaaaugucacauuuuuagcaaagauuacauga

SEQ ID NO: 284059 - RNA, 32 nt, Human
aaaaugucagacugguuuauuguuaaguugca

SEQ ID NO: 284060 - RNA, 32 nt, Human
aaaaugucauuagugcugagguugagaaauac

SEQ ID NO: 284061 - RNA, 32 nt, Human
aaaauguccagaaagccauguuccuguuuccu

SEQ ID NO: 284062 - RNA, 32 nt, Human
aaaauguccuguggugacaggcccaguggaac

SEQ ID NO: 284063 - RNA, 32 nt, Human
aaaaugucucaaaucuccaggaguaucuggaa

SEQ ID NO: 284064 - RNA, 28 nt, Human
aaaaugucucagagcaaccgggagcugg

SEQ ID NO: 284065 - RNA, 32 nt, Human
aaaaugugaagagugagagaucaaagaaagaa

SEQ ID NO: 284066 - RNA, 32 nt, Human
aaaaugugaagugaaugaaacacucaguuguu

SEQ ID NO: 284067 - RNA, 32 nt, Human
aaaaugugaaucuuaccagcaguuccagccaa

SEQ ID NO: 284068 - RNA, 32 nt, Human
aaaaugugagaaaccuuugugagacagagaac

SEQ ID NO: 284069 - RNA, 32 nt, Human
aaaaugugagaguauucugguacucuguguuc

SEQ ID NO: 284070 - RNA, 32 nt, Human
aaaaugugcccacucauucauucuuuguccau

SEQ ID NO: 284071 - RNA, 32 nt, Human
aaaauguggcuccucuggagcuuggcagacca

SEQ ID NO: 284072 - RNA, 32 nt, Human
aaaaugugggcauguggagagggguauuugcc

SEQ ID NO: 284073 - RNA, 32 nt, Human
aaaaugugguuggggccaggugcaguggcuca

SEQ ID NO: 284074 - RNA, 32 nt, Human
aaaauguguaaauauauuaguaaauguuaaua

SEQ ID NO: 284075 - RNA, 32 nt, Human
aaaauguguaauucaaaagauuaauguguauu

SEQ ID NO: 284076 - RNA, 32 nt, Human
aaaauguguaucuucagaaggagagaagauug

SEQ ID NO: 284077 - RNA, 32 nt, Human
aaaaugugucugcugggcaaugcugagcaaaa

SEQ ID NO: 284078 - RNA, 32 nt, Human
aaaauguuagugggauggcaaacacugugaac

SEQ ID NO: 284079 - RNA, 32 nt, Human
aaaauguuaugauuucagaaauguuauauaaa

SEQ ID NO: 284080 - RNA, 28 nt, Human
aaaauguucacccuccuggacgugguga

SEQ ID NO: 284081 - RNA, 32 nt, Human
aaaauguuggccuggguauuucaaaggguaua

SEQ ID NO: 284082 - RNA, 32 nt, Human
aaaauguuuaucaugccuaagggagacauuua

SEQ ID NO: 284083 - RNA, 32 nt, Human
aaaauguuuccaagguuguguguuuauacugu

SEQ ID NO: 284084 - RNA, 32 nt, Human
aaaauguuucucucauuuacuccuuaaacaaa

SEQ ID NO: 284085 - RNA, 32 nt, Human
aaaauguuugcuacuuguuaagggagucagau

SEQ ID NO: 284086 - RNA, 32 nt, Human
aaaauguuuuauccucccuuugguaccuuaau

SEQ ID NO: 284087 - RNA, 32 nt, Human
aaaauguuuucaaggcugcaaaaaguguacag

SEQ ID NO: 284088 - RNA, 32 nt, Human
aaaauguuuuccccuaauuuuccagagaagcc

SEQ ID NO: 284089 - RNA, 32 nt, Human
aaaauguuuucccugauuucacaaacaaggau

SEQ ID NO: 284090 - RNA, 32 nt, Human
aaaauguuuucuuuccccuuggugaucuuugu

SEQ ID NO: 284091 - RNA, 32 nt, Human
aaaauuaaauuagcuggggugguggcacacgu

SEQ ID NO: 284092 - RNA, 32 nt, Human
aaaauuaagacagaaguaagcuauuaacggua

SEQ ID NO: 284093 - RNA, 32 nt, Human
aaaauuaagguguuugaaaauaguuuauuuua

SEQ ID NO: 284094 - RNA, 32 nt, Human
aaaauuaaucuuucccuguuaggcugauuuca

SEQ ID NO: 284095 - RNA, 32 nt, Human
aaaauuaaugugcucaccucggcagcacauau

SEQ ID NO: 284096 - RNA, 32 nt, Human
aaaauuaauugggaagguacugguuuuaagug

SEQ ID NO: 284097 - RNA, 32 nt, Human
aaaauuacacaaaaugaaaagucacuauauua

SEQ ID NO: 284098 - RNA, 32 nt, Human
aaaauuacagaagaagcuccugaaucccuuuc

SEQ ID NO: 284099 - RNA, 32 nt, Human
aaaauuacauagguggcuugucaaauucaauu

SEQ ID NO: 284100 - RNA, 32 nt, Human
aaaauuacccaggagugguggugugcaccugu

SEQ ID NO: 284101 - RNA, 32 nt, Human
aaaauuacgccacugcacuccagccugggcaa

SEQ ID NO: 284102 - RNA, 32 nt, Human
aaaauuacuaaaaaugacaaguagaagacuug

SEQ ID NO: 284103 - RNA, 32 nt, Human
aaaauuacuauuaccccaccuacuucugaaaa

SEQ ID NO: 284104 - RNA, 32 nt, Human
aaaauuagaauuaugcugccuaccucacagag

SEQ ID NO: 284105 - RNA, 32 nt, Human
aaaauuagacacacuuuaaaccuucaaacagg

SEQ ID NO: 284106 - RNA, 32 nt, Human
aaaauuagccaaaugaaucauuucuuauaucu

SEQ ID NO: 284107 - RNA, 32 nt, Human
aaaauuagccacaccacaggaaacccacauuu

SEQ ID NO: 284108 - RNA, 32 nt, Human
aaaauuagccaggcacguuccaggcaccugug

SEQ ID NO: 284109 - RNA, 32 nt, Human
aaaauuagggggaagcagggggcaguuucugu

SEQ ID NO: 284110 - RNA, 32 nt, Human
aaaauuaguuucagugagucccagggacuaau

SEQ ID NO: 284111 - RNA, 32 nt, Human
aaaauuauacacuaaacuuucucuccaaaaua

SEQ ID NO: 284112 - RNA, 32 nt, Human
aaaauuaucuuucaacuucugugaaagccaac

SEQ ID NO: 284113 - RNA, 21 nt, Human
aaaauuauggaugauuuucca

SEQ ID NO: 284114 - RNA, 22 nt, Human
aaaauuauguaacucuuaucca

SEQ ID NO: 284115 - RNA, 32 nt, Human
aaaauuauucuuccucucaaacauagggguga

SEQ ID NO: 284116 - RNA, 32 nt, Human
aaaauuauuuaaaagaagucaaugagccaaaa

SEQ ID NO: 284117 - RNA, 32 nt, Human
aaaauucaacaucacuucaaguuaaagacacu

SEQ ID NO: 284118 - RNA, 32 nt, Human
aaaauucaagaguuccagccagaagcuacagc

SEQ ID NO: 284119 - RNA, 32 nt, Human
aaaauucaagcauuuaggaaugugaccuuuaa

SEQ ID NO: 284120 - RNA, 32 nt, Human
aaaauucaauuacugucaucuaaugccagcug

SEQ ID NO: 284121 - RNA, 32 nt, Human
aaaauucacaguaggaaugauuguuaagagag

SEQ ID NO: 284122 - RNA, 32 nt, Human
aaaauucacaugccccuaacccucagauaaug

SEQ ID NO: 284123 - RNA, 32 nt, Human
aaaauucacuuacaccuccugccuuuguaguu

SEQ ID NO: 284124 - RNA, 32 nt, Human
aaaauucagcaacagacaccugcccacaaauc

SEQ ID NO: 284125 - RNA, 32 nt, Human
aaaauucagcaacucgcuugaaaggaagacug

SEQ ID NO: 284126 - RNA, 32 nt, Human
aaaauucagcuuuuauacagucaacauucuuu

SEQ ID NO: 284127 - RNA, 32 nt, Human
aaaauucaugcugaaaaacugagugaauauga

SEQ ID NO: 284128 - RNA, 32 nt, Human
aaaauucauuaaauuuggcugccuuauccuuu

SEQ ID NO: 284129 - RNA, 32 nt, Human
aaaauucauuccgcuguaauguuuucacaaua

SEQ ID NO: 284130 - RNA, 32 nt, Human
aaaauucauucuaugugccguuuuguuguuau

SEQ ID NO: 284131 - RNA, 32 nt, Human
aaaauuccaaaagaaagacuagaacaaauugg

SEQ ID NO: 284132 - RNA, 32 nt, Human
aaaauuccaccaggauuaaucucuaaaauucu

SEQ ID NO: 284133 - RNA, 32 nt, Human
aaaauuccagugaauugugcagaaaugcuggu

SEQ ID NO: 284134 - RNA, 32 nt, Human
aaaauuccauaauggccagagaggagaguucg

SEQ ID NO: 284135 - RNA, 32 nt, Human
aaaauuccaucaaguaguucugacuuccugcu

SEQ ID NO: 284136 - RNA, 32 nt, Human
aaaauuccauuacaggggcagugccuuuguag

SEQ ID NO: 284137 - RNA, 32 nt, Human
aaaauuccuaugggccugucuccugggggccu

SEQ ID NO: 284138 - RNA, 32 nt, Human
aaaauuccucuuccuuggucuacauaaagaag

SEQ ID NO: 284139 - RNA, 32 nt, Human
aaaauuccugaacaauauagauuuuaucguua

SEQ ID NO: 284140 - RNA, 32 nt, Human
aaaauuccugcacuuuaacccuuuggaaacua

SEQ ID NO: 284141 - RNA, 32 nt, Human
aaaauuccuuagcuuagaccucagccugugcu

SEQ ID NO: 284142 - RNA, 32 nt, Human
aaaauuccuucugcacaugaggccaguauagg

SEQ ID NO: 284143 - RNA, 32 nt, Human
aaaauuccuuuucaaagaaacaaaaagaagaa

SEQ ID NO: 284144 - RNA, 32 nt, Human
aaaauucgugauauaaucauacaaucggauac

SEQ ID NO: 284145 - RNA, 32 nt, Human
aaaauucuaaaggugccugucaucucagagag

SEQ ID NO: 284146 - RNA, 32 nt, Human
aaaauucuaacccagguauccaaaaaugugua

SEQ ID NO: 284147 - RNA, 32 nt, Human
aaaauucucacccucagcuauuuugugggcag

SEQ ID NO: 284148 - RNA, 32 nt, Human
aaaauucuccacaauccuccaccuccgcucuu

SEQ ID NO: 284149 - RNA, 32 nt, Human
aaaauucuccaggaauuucauaguuuggaccu

SEQ ID NO: 284150 - RNA, 32 nt, Human
aaaauucuccaucaggaggccugugguggugg

SEQ ID NO: 284151 - RNA, 32 nt, Human
aaaauucucuuucuaaacacagaguguugggc

SEQ ID NO: 284152 - RNA, 32 nt, Human
aaaauucugcagcaucuuacuacauaauccca

SEQ ID NO: 284153 - RNA, 32 nt, Human
aaaauucugcugcucaccaggacccagcucug

SEQ ID NO: 284154 - RNA, 32 nt, Human
aaaauucugggaguugcauaccggccagucuu

SEQ ID NO: 284155 - RNA, 32 nt, Human
aaaauucuguguuuuaaaugcuuacuggagag

SEQ ID NO: 284156 - RNA, 32 nt, Human
aaaauugaaacuaagaaaggcuguaaucagca

SEQ ID NO: 284157 - RNA, 32 nt, Human
aaaauugaaauaaauaugaaaauaucaaguuc

SEQ ID NO: 284158 - RNA, 32 nt, Human
aaaauugaacauccuagauucacacucccaag

SEQ ID NO: 284159 - RNA, 32 nt, Human
aaaauugagccagggucuugcuauguggcuca

SEQ ID NO: 284160 - RNA, 32 nt, Human
aaaauugcaacaacacuuuacuaccuaacgga

SEQ ID NO: 284161 - RNA, 32 nt, Human
aaaauugcaagacggaaaaguguauaaguggg

SEQ ID NO: 284162 - RNA, 32 nt, Human
aaaauugcaccacugcacacugcacuccaucc

SEQ ID NO: 284163 - RNA, 32 nt, Human
aaaauugcaccacugcacuccagccugggaaa

SEQ ID NO: 284164 - RNA, 32 nt, Human
aaaauugcaccacugcacuccagccugggaga

SEQ ID NO: 284165 - RNA, 32 nt, Human
aaaauugcaccacugcacuccauccugggcaa

SEQ ID NO: 284166 - RNA, 32 nt, Human
aaaauugcaccacugcacugcagccugggaaa

SEQ ID NO: 284167 - RNA, 31 nt, Human
aaaauugcacuuucugggcaagacuccuaua

SEQ ID NO: 284168 - RNA, 32 nt, Human
aaaauugcagagcuaauaaaaggcagcuaaca

SEQ ID NO: 284169 - RNA, 32 nt, Human
aaaauugccuaaagaggaaggaccaaggagau

SEQ ID NO: 284170 - RNA, 32 nt, Human
aaaauugccugcggaaugugugcaguaucuag

SEQ ID NO: 284171 - RNA, 32 nt, Human
aaaauugcgaaggcuuuugccucccaguaaau

SEQ ID NO: 284172 - RNA, 32 nt, Human
aaaauugcuugaaccugggaggcggagguugc

SEQ ID NO: 284173 - RNA, 32 nt, Human
aaaauugcuugcuauauuuacaccuucuuucc

SEQ ID NO: 284174 - RNA, 32 nt, Human
aaaauuggaagagaacgcgcuugauggauaga

SEQ ID NO: 284175 - RNA, 32 nt, Human
aaaauuggaagagacuucaaagacugucaagu

SEQ ID NO: 284176 - RNA, 32 nt, Human
aaaauuggcaagguugaaggucaccagcacau

SEQ ID NO: 284177 - RNA, 32 nt, Human
aaaauuggccgggcaugguggaaugugccugu

SEQ ID NO: 284178 - RNA, 32 nt, Human
aaaauuggccugccaccuucuuuaagcucagu

SEQ ID NO: 284179 - RNA, 32 nt, Human
aaaauugggaaaggaguagaaaaagcaguaac

SEQ ID NO: 284180 - RNA, 32 nt, Human
aaaauugggcugggaucacguccuguuuugua

SEQ ID NO: 284181 - RNA, 32 nt, Human
aaaauuggugccaagacugggugagaaaugua

SEQ ID NO: 284182 - RNA, 32 nt, Human
aaaauuggugcuuucugcuguggccuuaguuu

SEQ ID NO: 284183 - RNA, 32 nt, Human
aaaauugguguuugggugaucagaagcaggua

SEQ ID NO: 284184 - RNA, 22 nt, Human
aaaauuguaccaugaaaaagca

SEQ ID NO: 284185 - RNA, 31 nt, Human
aaaauuguagagaccagcucacuggaauguu

SEQ ID NO: 284186 - RNA, 32 nt, Human
aaaauuguccucaagucagccucuccagggcc

SEQ ID NO: 284187 - RNA, 32 nt, Human
aaaauugugaaaggaagguggggacagagcuu

SEQ ID NO: 284188 - RNA, 32 nt, Human
aaaauuguuacagauaccuagcucuucacaga

SEQ ID NO: 284189 - RNA, 32 nt, Human
aaaauuguuuagaaaucagcuugacugagaac

SEQ ID NO: 284190 - RNA, 32 nt, Human
aaaauuguuugcaaauggaagagagggaccua

SEQ ID NO: 284191 - RNA, 32 nt, Human
aaaauuguuugcuuacauuuuuacuuauaauu

SEQ ID NO: 284192 - RNA, 32 nt, Human
aaaauuuaacagcaaucagcuaacaggcaaau

SEQ ID NO: 284193 - RNA, 32 nt, Human
aaaauuuaagaggaacuuuuccucacuggaac

SEQ ID NO: 284194 - RNA, 32 nt, Human
aaaauuuaauuuucuagcuggcuccaauucaa

SEQ ID NO: 284195 - RNA, 32 nt, Human
aaaauuuagaaaauauaucauuuccuggccca

SEQ ID NO: 284196 - RNA, 32 nt, Human
aaaauuuagagaaaaagaaagauacauagaag

SEQ ID NO: 284197 - RNA, 32 nt, Human
aaaauuuagucugggccuagugcaguggcuca

SEQ ID NO: 284198 - RNA, 32 nt, Human
aaaauuuauagcgcucacagaaacccuggagg

SEQ ID NO: 284199 - RNA, 32 nt, Human
aaaauuuaucccaccagccuucacaaauguca

SEQ ID NO: 284200 - RNA, 32 nt, Human
aaaauuuaucucaccuuuaauacugugaauac

SEQ ID NO: 284201 - RNA, 32 nt, Human
aaaauuuaugucugucucauguguaaaagaca

SEQ ID NO: 284202 - RNA, 32 nt, Human
aaaauuuauuaucuuaaccauuuuugagugaa

SEQ ID NO: 284203 - RNA, 32 nt, Human
aaaauuucaaaaggaaguagauacacuaggga

SEQ ID NO: 284204 - RNA, 32 nt, Human
aaaauuucacacauuugucaagcacaguugua

SEQ ID NO: 284205 - RNA, 32 nt, Human
aaaauuucacuacaagguaauuuuugcuuagu

SEQ ID NO: 284206 - RNA, 32 nt, Human
aaaauuucaggcuuuuucuccacacuuguaug

SEQ ID NO: 284207 - RNA, 32 nt, Human
aaaauuucaguagacaguucaacagaaugaga

SEQ ID NO: 284208 - RNA, 32 nt, Human
aaaauuucaucuaggcuaggugcaguggcuug

SEQ ID NO: 284209 - RNA, 32 nt, Human
aaaauuuccaauucuccuacacucugucagaa

SEQ ID NO: 284210 - RNA, 32 nt, Human
aaaauuucuaguaucuuacagaacagcggugg

SEQ ID NO: 284211 - RNA, 32 nt, Human
aaaauuucuccuccuccugugcccucuucgcc

SEQ ID NO: 284212 - RNA, 32 nt, Human
aaaauuucuggaagccuccugaucucaccaug

SEQ ID NO: 284213 - RNA, 32 nt, Human
aaaauuugaagaggagaggcugagggaacagc

SEQ ID NO: 284214 - RNA, 32 nt, Human
aaaauuugaaggucugacagaaacuuuaaaug

SEQ ID NO: 284215 - RNA, 32 nt, Human
aaaauuugcauuucuaacacauucucagcuga

SEQ ID NO: 284216 - RNA, 32 nt, Human
aaaauuugccuuugccccggcuugccuguaau

SEQ ID NO: 284217 - RNA, 32 nt, Human
aaaauuugguagggauuuuaaaaaggucaccc

SEQ ID NO: 284218 - RNA, 32 nt, Human
aaaauuugugugcuguguacacaaaaacauaa

SEQ ID NO: 284219 - RNA, 32 nt, Human
aaaauuuuaaaaccaaaccucguuuaggauuu

SEQ ID NO: 284220 - RNA, 32 nt, Human
aaaauuuuaagcuuuuaaaaauguagauuuuu

SEQ ID NO: 284221 - RNA, 32 nt, Human
aaaauuuuaauuggcuagcucuugcccuuaua

SEQ ID NO: 284222 - RNA, 32 nt, Human
aaaauuuuagaaacagucuuuguggguggaug

SEQ ID NO: 284223 - RNA, 32 nt, Human
aaaauuuuaguguggcaugguggugggugccu

SEQ ID NO: 284224 - RNA, 27 nt, Human
aaaauuuucaaacuuuguacuguuaaa

SEQ ID NO: 284225 - RNA, 32 nt, Human
aaaauuuucuaauauuugagaauuucacaggg

SEQ ID NO: 284226 - RNA, 32 nt, Human
aaaauuuucuaucaaauggagccacauucggg

SEQ ID NO: 284227 - RNA, 32 nt, Human
aaaauuuucuuuuuacaaagagauuuacaagu

SEQ ID NO: 284228 - RNA, 32 nt, Human
aaaauuuugaugggguggaggaaugaauugcc

SEQ ID NO: 284229 - RNA, 32 nt, Human
aaaauuuuggaccugagacacuguggcugucu

SEQ ID NO: 284230 - RNA, 32 nt, Human
aaaauuuuggcuggaugcaauggcucacgccu

SEQ ID NO: 284231 - RNA, 24 nt, Human
aaaauuuuucccaguguucugaua

SEQ ID NO: 284232 - RNA, 32 nt, Human
aaaauuuuuggcaauucuuucagccauguaau

SEQ ID NO: 284233 - RNA, 32 nt, Human
aaacaaaaacaaaaacaucaaugaguaggcau

SEQ ID NO: 284234 - RNA, 32 nt, Human
aaacaaaaacagaaaggaucugagggaagaag

SEQ ID NO: 284235 - RNA, 32 nt, Human
aaacaaaaaccaaccaaccaaccaaccaacca

SEQ ID NO: 284236 - RNA, 32 nt, Human
aaacaaaaacuaggcgguugaaugagagguuc

SEQ ID NO: 284237 - RNA, 20 nt, Human
aaacaaaaagaaacaacccu

SEQ ID NO: 284238 - RNA, 17 nt, Human
aaacaaaaagcaagccu

SEQ ID NO: 284239 - RNA, 32 nt, Human
aaacaaaaagggcaaaccuaggaagcuaacgg

SEQ ID NO: 284240 - RNA, 32 nt, Human
aaacaaaaauuagccaggcaugguggcaccug

SEQ ID NO: 284241 - RNA, 32 nt, Human
aaacaaaaauuagguauuuuguccuaaaacac

SEQ ID NO: 284242 - RNA, 19 nt, Human
aaacaaaacaaaacaaaac

SEQ ID NO: 284243 - RNA, 20 nt, Human
aaacaaaacaaaacaaaaca

SEQ ID NO: 284244 - RNA, 19 nt, Human
aaacaaaacaccagggaca

SEQ ID NO: 284245 - RNA, 32 nt, Human
aaacaaaacauaccuguauacacacacauuca

SEQ ID NO: 284246 - RNA, 32 nt, Human
aaacaaaaccagccagaauaacagacucucug

SEQ ID NO: 284247 - RNA, 32 nt, Human
aaacaaaacccaauuuaacugauaacuaacca

SEQ ID NO: 284248 - RNA, 32 nt, Human
aaacaaaacuggcuagccugagcugcugguuc

SEQ ID NO: 284249 - RNA, 32 nt, Human
aaacaaaacuucaggagaugcaaauggagaga

SEQ ID NO: 284250 - RNA, 32 nt, Human
aaacaaaagcauuuugcuaaggagaagcuaau

SEQ ID NO: 284251 - RNA, 32 nt, Human
aaacaaaagguuaagaaauguggauaaagcuu

SEQ ID NO: 284252 - RNA, 32 nt, Human
aaacaaaauauaaaucacagauuuccaaaagu

SEQ ID NO: 284253 - RNA, 32 nt, Human
aaacaaaauccuucauauacaaaaagaacuuu

SEQ ID NO: 284254 - RNA, 32 nt, Human
aaacaaaaugcacagccugaauggacguagca

SEQ ID NO: 284255 - RNA, 32 nt, Human
aaacaaaaugccaggccucugcucugaagagc

SEQ ID NO: 284256 - RNA, 19 nt, Human
aaacaaacaaaacaaaaca

SEQ ID NO: 284257 - RNA, 32 nt, Human
aaacaaacaaaaccagccagaauaacagacuc

SEQ ID NO: 284258 - RNA, 32 nt, Human
aaacaaacaacaaaagcagcuugccuuauauc

SEQ ID NO: 284259 - RNA, 17 nt, Human
aaacaaacaacaucaag

SEQ ID NO: 284260 - RNA, 32 nt, Human
aaacaaacaacugcuucaaacugugaauucug

SEQ ID NO: 284261 - RNA, 32 nt, Human
aaacaaacacaaagccuuaagcucuuugagua

SEQ ID NO: 284262 - RNA, 32 nt, Human
aaacaaacagccuuguuucucuagucacauca

SEQ ID NO: 284263 - RNA, 32 nt, Human
aaacaaacaggagaugcuaucaccugaugacc

SEQ ID NO: 284264 - RNA, 32 nt, Human
aaacaaacagugccuucugcccucugcccaga

SEQ ID NO: 284265 - RNA, 32 nt, Human
aaacaaaccacccucuggggguaguuuacaga

SEQ ID NO: 284266 - RNA, 32 nt, Human
aaacaaaccagcucgucucagaggccagcaag

SEQ ID NO: 284267 - RNA, 32 nt, Human
aaacaaacccaauaugaugcauuuuaaggugg

SEQ ID NO: 284268 - RNA, 32 nt, Human
aaacaaacccuugaagacauuucagggccaug

SEQ ID NO: 284269 - RNA, 32 nt, Human
aaacaaacucggcgucugcacuggcuucccgu

SEQ ID NO: 284270 - RNA, 32 nt, Human
aaacaaagaaauguggucacuaaaaauaaaag

SEQ ID NO: 284271 - RNA, 32 nt, Human
aaacaaagauagguuccucaggugaccaaaac

SEQ ID NO: 284272 - RNA, 32 nt, Human
aaacaaagauucugccaacuguggaaacuuca

SEQ ID NO: 284273 - RNA, 20 nt, Human
aaacaaagcaggacuggaga

SEQ ID NO: 284274 - RNA, 32 nt, Human
aaacaaagcaggcucuaaggcacacaacauug

SEQ ID NO: 284275 - RNA, 19 nt, Human
aaacaaagccaaacagccu

SEQ ID NO: 284276 - RNA, 32 nt, Human
aaacaaagcuguuugcugcuuuaugcaggugc

SEQ ID NO: 284277 - RNA, 32 nt, Human
aaacaaaggaagagcuuaccgagcauauuaaa

SEQ ID NO: 284278 - RNA, 32 nt, Human
aaacaaaggaggaggagucauagggaagagaa

SEQ ID NO: 284279 - RNA, 32 nt, Human
aaacaaaggagguuugagagaggcgggaucug

SEQ ID NO: 284280 - RNA, 32 nt, Human
aaacaaaggccaaagguguauagauugcuuga

SEQ ID NO: 284281 - RNA, 31 nt, Human
aaacaaagugagauugaagagaaugaaaaca

SEQ ID NO: 284282 - RNA, 32 nt, Human
aaacaaauagguccuuugcugaaaagagggua

SEQ ID NO: 284283 - RNA, 32 nt, Human
aaacaaauauacauuuguuucauuucuugacu

SEQ ID NO: 284284 - RNA, 32 nt, Human
aaacaaaucaaggagcacuagagcuuuagugu

SEQ ID NO: 284285 - RNA, 32 nt, Human
aaacaaauccuggcccuggacucgguuuccca

SEQ ID NO: 284286 - RNA, 32 nt, Human
aaacaaaucucuaggagauucugccaaaggau

SEQ ID NO: 284287 - RNA, 32 nt, Human
aaacaaaugccacacaucacccuuaccaugug

SEQ ID NO: 284288 - RNA, 32 nt, Human
aaacaaaugcggaggcugggcacgguggcuca

SEQ ID NO: 284289 - RNA, 32 nt, Human
aaacaaaugggauacgcaguauucuggauggu

SEQ ID NO: 284290 - RNA, 32 nt, Human
aaacaaaugucaacauaauaaaaucucaguua

SEQ ID NO: 284291 - RNA, 32 nt, Human
aaacaacaaauuacagcccaaguuuauaucaa

SEQ ID NO: 284292 - RNA, 32 nt, Human
aaacaacaacaacaacuuauuuaguuugggga

SEQ ID NO: 284293 - RNA, 32 nt, Human
aaacaacaacacaaaccacacacacucgcaca

SEQ ID NO: 284294 - RNA, 32 nt, Human
aaacaacaagcaggccaggcacgguggcucac

SEQ ID NO: 284295 - RNA, 32 nt, Human
aaacaacacaggcugggcgcgguggcucacac

SEQ ID NO: 284296 - RNA, 32 nt, Human
aaacaacacaugcuauucuaaaaagccgcauu

SEQ ID NO: 284297 - RNA, 32 nt, Human
aaacaacacaugcuuauuaucucauagauucu

SEQ ID NO: 284298 - RNA, 32 nt, Human
aaacaacacugacccgaugcugggugaggacc

SEQ ID NO: 284299 - RNA, 32 nt, Human
aaacaacacugcaauuugucuccuugcaccgu

SEQ ID NO: 284300 - RNA, 32 nt, Human
aaacaacacuggagagcagaggcuguggcuug

SEQ ID NO: 284301 - RNA, 32 nt, Human
aaacaacagcuccccuguauucccccaucuag

SEQ ID NO: 284302 - RNA, 32 nt, Human
aaacaacaguagugccugugguuuagcccacc

SEQ ID NO: 284303 - RNA, 32 nt, Human
aaacaacauagugaaacccugucucuauuaaa

SEQ ID NO: 284304 - RNA, 32 nt, Human
aaacaaccggaaccggcggcaccagcucggag

SEQ ID NO: 284305 - RNA, 32 nt, Human
aaacaacgagcaggccaggcacgguggcucac

SEQ ID NO: 284306 - RNA, 32 nt, Human
aaacaacucagcugccaucuggccucucugag

SEQ ID NO: 284307 - RNA, 32 nt, Human
aaacaacuccccaggcuggccgggcaguacac

SEQ ID NO: 284308 - RNA, 32 nt, Human
aaacaacuguaauccgagcuacuagggaggcu

SEQ ID NO: 284309 - RNA, 32 nt, Human
aaacaacugugaaagaaauacuugaggcaugu

SEQ ID NO: 284310 - RNA, 32 nt, Human
aaacaacuguuuccacacuugcaccugaucaa

SEQ ID NO: 284311 - RNA, 32 nt, Human
aaacaacuuagcaaaugugccauuuucacaca

SEQ ID NO: 284312 - RNA, 32 nt, Human
aaacaagaaaacaaaccacauacuuuugaagc

SEQ ID NO: 284313 - RNA, 32 nt, Human
aaacaagaaaacaaaccacauacuuuugaagu

SEQ ID NO: 284314 - RNA, 32 nt, Human
aaacaagaaauguaaugcaaaggacucauuuu

SEQ ID NO: 284315 - RNA, 31 nt, Human
aaacaagaacaauuacucuuuuggcagaaag

SEQ ID NO: 284316 - RNA, 32 nt, Human
aaacaagaacagcagucagauccauuacaaag

SEQ ID NO: 284317 - RNA, 32 nt, Human
aaacaagacaacauucaauuugauagaaaucu

SEQ ID NO: 284318 - RNA, 32 nt, Human
aaacaagacuuuacuuucuucugcccccuaag

SEQ ID NO: 284319 - RNA, 32 nt, Human
aaacaagagaagcaggcaagaagcggaggcag

SEQ ID NO: 284320 - RNA, 32 nt, Human
aaacaagaggacuuggaggaaaagagcuacua

SEQ ID NO: 284321 - RNA, 32 nt, Human
aaacaagauaucuucuguccgccuuacauaua

SEQ ID NO: 284322 - RNA, 32 nt, Human
aaacaagccaagguuuuccauuaccuuacaau

SEQ ID NO: 284323 - RNA, 32 nt, Human
aaacaagccauggcuuuagggaggggugcagg

SEQ ID NO: 284324 - RNA, 32 nt, Human
aaacaagcgcuggccucacaguauuaaaacaa

SEQ ID NO: 284325 - RNA, 32 nt, Human
aaacaagcuaggugugguggcucaugccugua

SEQ ID NO: 284326 - RNA, 32 nt, Human
aaacaagcucacuguguuucuuuucuuuucuu

SEQ ID NO: 284327 - RNA, 32 nt, Human
aaacaagcucugggugcugcuuuguucucagg

SEQ ID NO: 284328 - RNA, 32 nt, Human
aaacaagcuuaggcuucucccaacuuaacaaa

SEQ ID NO: 284329 - RNA, 32 nt, Human
aaacaagcuucccauccucguuuuacuuuuug

SEQ ID NO: 284330 - RNA, 32 nt, Human
aaacaaggaaaucacacauaugcacacauaca

SEQ ID NO: 284331 - RNA, 32 nt, Human
aaacaaggacaguugggugugacagugacaau

SEQ ID NO: 284332 - RNA, 32 nt, Human
aaacaaggagaaggugcaagacuguccgugug

SEQ ID NO: 284333 - RNA, 32 nt, Human
aaacaaggaggaaggcaaccagcuguuagggg

SEQ ID NO: 284334 - RNA, 32 nt, Human
aaacaaggaggcacuuccuguaggagcacuga

SEQ ID NO: 284335 - RNA, 32 nt, Human
aaacaaggcccaggcuggggccagggccagag

SEQ ID NO: 284336 - RNA, 32 nt, Human
aaacaaggccuuucucuaucuuccuacugcca

SEQ ID NO: 284337 - RNA, 32 nt, Human
aaacaaggcuguauccacaugguacaagccuu

SEQ ID NO: 284338 - RNA, 24 nt, Human
aaacaaggugucagagguuuugaa

SEQ ID NO: 284339 - RNA, 32 nt, Human
aaacaagguuaccuaccucaggaggcugcuug

SEQ ID NO: 284340 - RNA, 32 nt, Human
aaacaaguacaucuguacaugacuguauaauu

SEQ ID NO: 284341 - RNA, 32 nt, Human
aaacaaguccucacgaccacuucucaguuuuc

SEQ ID NO: 284342 - RNA, 32 nt, Human
aaacaagugggagagccaggagccaaacuauc

SEQ ID NO: 284343 - RNA, 32 nt, Human
aaacaaguguccaucacuaggacacuaguuaa

SEQ ID NO: 284344 - RNA, 32 nt, Human
aaacaauacaaagcccagaaauucuuuucggg

SEQ ID NO: 284345 - RNA, 32 nt, Human
aaacaauaccugcucauuuacacugaggauuc

SEQ ID NO: 284346 - RNA, 32 nt, Human
aaacaauaggacagcugcucuuccauaaacag

SEQ ID NO: 284347 - RNA, 32 nt, Human
aaacaauauaaaguuguccagaauguauguca

SEQ ID NO: 284348 - RNA, 32 nt, Human
aaacaauaugaacuccuuuuucguauugccau

SEQ ID NO: 284349 - RNA, 32 nt, Human
aaacaaucacuacaguuuggcuuucaggaagc

SEQ ID NO: 284350 - RNA, 32 nt, Human
aaacaaucagauaacaccuguuuccuccagga

SEQ ID NO: 284351 - RNA, 32 nt, Human
aaacaaucagcauguuucuucuguaaauauga

SEQ ID NO: 284352 - RNA, 32 nt, Human
aaacaaucagguuucuucaggcugaggaggac

SEQ ID NO: 284353 - RNA, 32 nt, Human
aaacaauccuuacuaaguaggugaugaguuug

SEQ ID NO: 284354 - RNA, 32 nt, Human
aaacaaucuccugguccaaggugcuugagugg

SEQ ID NO: 284355 - RNA, 32 nt, Human
aaacaaucuucacacgaaaccaaaaauagcau

SEQ ID NO: 284356 - RNA, 32 nt, Human
aaacaaugaaaguggggugagugccucuuauu

SEQ ID NO: 284357 - RNA, 32 nt, Human
aaacaaugaauucuucaacagggaaaacagcu

SEQ ID NO: 284358 - RNA, 32 nt, Human
aaacaaugagcugggcauggaacucacaccuc

SEQ ID NO: 284359 - RNA, 32 nt, Human
aaacaaugcugauuuuugaauucaugauuagu

SEQ ID NO: 284360 - RNA, 32 nt, Human
aaacaaugcuuaucacuggcuugcugucaaua

SEQ ID NO: 284361 - RNA, 32 nt, Human
aaacaaugguccccaucuccccagaagccuuu

SEQ ID NO: 284362 - RNA, 32 nt, Human
aaacaaugguuccuuaguuuugcacugggaag

SEQ ID NO: 284363 - RNA, 32 nt, Human
aaacaaugugaaaaacagaacuuguucuguug

SEQ ID NO: 284364 - RNA, 32 nt, Human
aaacaauguguauugaaguaccuagauuuguu

SEQ ID NO: 284365 - RNA, 32 nt, Human
aaacaauguuggccugugggccgcccacaaca

SEQ ID NO: 284366 - RNA, 32 nt, Human
aaacaauuauucaccauggauugcccaacuuu

SEQ ID NO: 284367 - RNA, 32 nt, Human
aaacaauugaaggauggauaccauggcauaug

SEQ ID NO: 284368 - RNA, 32 nt, Human
aaacaauugccuggaagcuggaagauaauaug

SEQ ID NO: 284369 - RNA, 32 nt, Human
aaacaauuuauuggaguguuuuuguuucuguu

SEQ ID NO: 284370 - RNA, 32 nt, Human
aaacaauuucagaaaguguuagaagaauucua

SEQ ID NO: 284371 - RNA, 32 nt, Human
aaacaauuuucccacuuuaguucuuuagugac

SEQ ID NO: 284372 - RNA, 32 nt, Human
aaacaauuuucuugaagaauccgauuuugugc

SEQ ID NO: 284373 - RNA, 32 nt, Human
aaacacaaagucuugcucugucgcccaggcug

SEQ ID NO: 284374 - RNA, 32 nt, Human
aaacacaaauacucucacggggcauggagguu

SEQ ID NO: 284375 - RNA, 32 nt, Human
aaacacaacaaaaccacaugucauagcccuug

SEQ ID NO: 284376 - RNA, 32 nt, Human
aaacacaacaguauuuauaaaugaguaaauaa

SEQ ID NO: 284377 - RNA, 32 nt, Human
aaacacaaccacagaaacaaacaaauaaugga

SEQ ID NO: 284378 - RNA, 32 nt, Human
aaacacaacccccucuguucccucucuucgcg

SEQ ID NO: 284379 - RNA, 32 nt, Human
aaacacaagguacuuuucuguccucuuaaaau

SEQ ID NO: 284380 - RNA, 32 nt, Human
aaacacacaacaaaacaucugcuguccugggu

SEQ ID NO: 284381 - RNA, 32 nt, Human
aaacacacaugcugucugcagccacuguuugg

SEQ ID NO: 284382 - RNA, 32 nt, Human
aaacacacauuacacacacaucacaaugacaa

SEQ ID NO: 284383 - RNA, 32 nt, Human
aaacacaccacugugggaguuguuugcuugga

SEQ ID NO: 284384 - RNA, 32 nt, Human
aaacacaccucuccuuuacauaguugggaacc

SEQ ID NO: 284385 - RNA, 32 nt, Human
aaacacacucagaaagcagagaaaaaggacaa

SEQ ID NO: 284386 - RNA, 32 nt, Human
aaacacacugacugugggacugugccaggaug

SEQ ID NO: 284387 - RNA, 32 nt, Human
aaacacacugccucgugucuuuguagcugauu

SEQ ID NO: 284388 - RNA, 32 nt, Human
aaacacacuuccugcugcgaaagacccacaug

SEQ ID NO: 284389 - RNA, 32 nt, Human
aaacacacuugcccucaugccucccagaauau

SEQ ID NO: 284390 - RNA, 32 nt, Human
aaacacagaaccacacagccagucccaggagc

SEQ ID NO: 284391 - RNA, 32 nt, Human
aaacacagagagagguguccuccugaccaccc

SEQ ID NO: 284392 - RNA, 32 nt, Human
aaacacagagcaggaguccacaggggaaccug

SEQ ID NO: 284393 - RNA, 32 nt, Human
aaacacagaggcuggaguuaaucugagagcac

SEQ ID NO: 284394 - RNA, 32 nt, Human
aaacacagaugggaccaugaacuccggacaca

SEQ ID NO: 284395 - RNA, 32 nt, Human
aaacacagcagccuccucucuuccugccugag

SEQ ID NO: 284396 - RNA, 32 nt, Human
aaacacagccagagaacugugacccugguguu

SEQ ID NO: 284397 - RNA, 32 nt, Human
aaacacaggagaguucauacuggagaaaggac

SEQ ID NO: 284398 - RNA, 32 nt, Human
aaacacagggagcugguggguugggugggggc

SEQ ID NO: 284399 - RNA, 31 nt, Human
aaacacagugagaggucugaaggcuggcuuc

SEQ ID NO: 284400 - RNA, 32 nt, Human
aaacacagugauggggcgaauauuuauguucu

SEQ ID NO: 284401 - RNA, 32 nt, Human
aaacacagugccuucuacauugcaggcgcuga

SEQ ID NO: 284402 - RNA, 32 nt, Human
aaacacaguuuauguacagggaaaaggauuuu

SEQ ID NO: 284403 - RNA, 32 nt, Human
aaacacauaaaacuguagcuccugccucugua

SEQ ID NO: 284404 - RNA, 32 nt, Human
aaacacauaaacuguuuucuuuuucuuucuua

SEQ ID NO: 284405 - RNA, 32 nt, Human
aaacacauauuuuuaaaauucccucuccucuu

SEQ ID NO: 284406 - RNA, 32 nt, Human
aaacacauccugcuucugcaauuccagagagu

SEQ ID NO: 284407 - RNA, 32 nt, Human
aaacacaucuucagccuccuccugggccagcu

SEQ ID NO: 284408 - RNA, 32 nt, Human
aaacacaugguacgcuccauacccacacagca

SEQ ID NO: 284409 - RNA, 32 nt, Human
aaacacauguaaacuuugucagagauaauugg

SEQ ID NO: 284410 - RNA, 32 nt, Human
aaacacaugugucacaugggcauuucagauga

SEQ ID NO: 284411 - RNA, 19 nt, Human
aaacacauuuagccuuaua

SEQ ID NO: 284412 - RNA, 32 nt, Human
aaacaccaaaccugccuaugugccaucucaca

SEQ ID NO: 284413 - RNA, 32 nt, Human
aaacaccaacuguaucuugcagucuccccagg

SEQ ID NO: 284414 - RNA, 32 nt, Human
aaacaccaaggaguggaggucagagugucacu

SEQ ID NO: 284415 - RNA, 32 nt, Human
aaacaccaagguaaaagggcccccaagguggu

SEQ ID NO: 284416 - RNA, 32 nt, Human
aaacaccacagcuggagaguccuggcugagcc

SEQ ID NO: 284417 - RNA, 32 nt, Human
aaacaccaccaaguuccuccagcaggguaugg

SEQ ID NO: 284418 - RNA, 32 nt, Human
aaacaccacugccugcaggagccugggcugac

SEQ ID NO: 284419 - RNA, 32 nt, Human
aaacaccagccuguugcuguacuuuucugcuu

SEQ ID NO: 284420 - RNA, 32 nt, Human
aaacaccaggaugcaugcuccuuguccccucc

SEQ ID NO: 284421 - RNA, 32 nt, Human
aaacaccauuuagggcuaccaucccccaaaaa

SEQ ID NO: 284422 - RNA, 32 nt, Human
aaacacccaaguggcccccacccucagcccgc

SEQ ID NO: 284423 - RNA, 32 nt, Human
aaacacccagcugggugcaguggcucgcaccu

SEQ ID NO: 284424 - RNA, 32 nt, Human
aaacacccaucccucaaaaaggccaagguccc

SEQ ID NO: 284425 - RNA, 32 nt, Human
aaacacccaucucugaugccuaaggaaccaca

SEQ ID NO: 284426 - RNA, 32 nt, Human
aaacacccaucuugucugucuccacucucauu

SEQ ID NO: 284427 - RNA, 32 nt, Human
aaacacccugguggaaaccuguugacagaccu

SEQ ID NO: 284428 - RNA, 32 nt, Human
aaacacccuucccuccuucugccauuacuaug

SEQ ID NO: 284429 - RNA, 32 nt, Human
aaacaccgaaauucagauagcucagggacugc

SEQ ID NO: 284430 - RNA, 21 nt, Human
aaacaccuauauuaugaguca

SEQ ID NO: 284431 - RNA, 19 nt, Human
aaacaccucaccccugccu

SEQ ID NO: 284432 - RNA, 32 nt, Human
aaacaccuccacuaccucacugacuucauaau

SEQ ID NO: 284433 - RNA, 32 nt, Human
aaacaccugaaugccaggaaacaggaagauua

SEQ ID NO: 284434 - RNA, 32 nt, Human
aaacaccugagaugaauuggugugaacgaauu

SEQ ID NO: 284435 - RNA, 32 nt, Human
aaacaccugcaagaaagagcacaguacuucac

SEQ ID NO: 284436 - RNA, 20 nt, Human
aaacaccugccagugucaag

SEQ ID NO: 284437 - RNA, 32 nt, Human
aaacaccuguagcauugaggugacugaaugcc

SEQ ID NO: 284438 - RNA, 32 nt, Human
aaacaccuuugggaacaaacucuuccuuugau

SEQ ID NO: 284439 - RNA, 32 nt, Human
aaacacgaacccaggagugugggccagugcug

SEQ ID NO: 284440 - RNA, 32 nt, Human
aaacacgacuccugaaucauguuccauuacuu

SEQ ID NO: 284441 - RNA, 32 nt, Human
aaacacgcacacacaaauggauaaaacagcac

SEQ ID NO: 284442 - RNA, 19 nt, Human
aaacacgcacacccugccc

SEQ ID NO: 284443 - RNA, 32 nt, Human
aaacacgccuuguuccugcucuucccaguuca

SEQ ID NO: 284444 - RNA, 32 nt, Human
aaacacggaagaggaagaggaaagcaaaggag

SEQ ID NO: 284445 - RNA, 22 nt, Human
aaacacguaagacucugucccc

SEQ ID NO: 284446 - RNA, 32 nt, Human
aaacacgugugugguuguguaaaccagacccc

SEQ ID NO: 284447 - RNA, 32 nt, Human
aaacacuaccacccuuuccugucccucucucc

SEQ ID NO: 284448 - RNA, 20 nt, Human
aaacacuacucaaguacaga

SEQ ID NO: 284449 - RNA, 32 nt, Human
aaacacuacucagcucucuugcacugaggaaa

SEQ ID NO: 284450 - RNA, 32 nt, Human
aaacacuagaccuggucgauucuaucaagaac

SEQ ID NO: 284451 - RNA, 32 nt, Human
aaacacuaggauucaggaagguaggcaggacg

SEQ ID NO: 284452 - RNA, 18 nt, Human
aaacacuaugucuguaca

SEQ ID NO: 284453 - RNA, 32 nt, Human
aaacacucacacuuggucaauuuguggcaggu

SEQ ID NO: 284454 - RNA, 32 nt, Human
aaacacucacuggauuuguuauaauccguguu

SEQ ID NO: 284455 - RNA, 21 nt, Human
aaacacucagacuuccuuacc

SEQ ID NO: 284456 - RNA, 32 nt, Human
aaacacucaucagaaauuaagugcagucuagu

SEQ ID NO: 284457 - RNA, 32 nt, Human
aaacacuccaaagggggugcugaucuggagac

SEQ ID NO: 284458 - RNA, 32 nt, Human
aaacacucucacuaugcugcuauggacgaccu

SEQ ID NO: 284459 - RNA, 32 nt, Human
aaacacucucccugauuccuggacuucgggua

SEQ ID NO: 284460 - RNA, 32 nt, Human
aaacacucugaacccugccaucuugcuccugg

SEQ ID NO: 284461 - RNA, 32 nt, Human
aaacacucugauguaauuucugcccagucagc

SEQ ID NO: 284462 - RNA, 32 nt, Human
aaacacugagacagggguauggggaagagcug

SEQ ID NO: 284463 - RNA, 21 nt, Human
aaacacugauuuucuccugua

SEQ ID NO: 284464 - RNA, 32 nt, Human
aaacacugcuaucucccaccucuaacacugga

SEQ ID NO: 284465 - RNA, 21 nt, Human
aaacacugcucuuccucaccu

SEQ ID NO: 284466 - RNA, 32 nt, Human
aaacacugcuuugaauuauaggaggagaacaa

SEQ ID NO: 284467 - RNA, 32 nt, Human
aaacacuggagacagugucaggccaggcaugg

SEQ ID NO: 284468 - RNA, 32 nt, Human
aaacacuggaggacuuguccagccuugaaaga

SEQ ID NO: 284469 - RNA, 29 nt, Human
aaacacuggcugcuggcauuccaccaagu

SEQ ID NO: 284470 - RNA, 32 nt, Human
aaacacugggcuguuugcacagcuccaacugu

SEQ ID NO: 284471 - RNA, 22 nt, Human
aaacacugguauguuccuuccu

SEQ ID NO: 284472 - RNA, 24 nt, Human
aaacacuggugggacuuccuuccu

SEQ ID NO: 284473 - RNA, 32 nt, Human
aaacacugguuuccuagcuauccucugaaaac

SEQ ID NO: 284474 - RNA, 32 nt, Human
aaacacugugauuagaccacagaacaauaaau

SEQ ID NO: 284475 - RNA, 32 nt, Human
aaacacugugcugcugaguucaucucaaacau

SEQ ID NO: 284476 - RNA, 32 nt, Human
aaacacuguuccugaaagcuucugucacucaa

SEQ ID NO: 284477 - RNA, 32 nt, Human
aaacacuuacuugauguuuuauuugaacuuuu

SEQ ID NO: 284478 - RNA, 32 nt, Human
aaacacuuauuuaggaaaauguuucucaacaa

SEQ ID NO: 284479 - RNA, 32 nt, Human
aaacacuuccaaugccaguuugauucugaggg

SEQ ID NO: 284480 - RNA, 32 nt, Human
aaacacuuuacaaccugcucucucucugaagu

SEQ ID NO: 284481 - RNA, 25 nt, Human
aaacacuuucaggaccuuccuuccu

SEQ ID NO: 284482 - RNA, 32 nt, Human
aaacacuuuucuuccucccuguaacuuaaccu

SEQ ID NO: 284483 - RNA, 32 nt, Human
aaacagaaacaaugugcuagcagaaugugcua

SEQ ID NO: 284484 - RNA, 32 nt, Human
aaacagaaagcaguggagguggggguugcugu

SEQ ID NO: 284485 - RNA, 32 nt, Human
aaacagaaaggaguuauuaaaguaauuuacaa

SEQ ID NO: 284486 - RNA, 32 nt, Human
aaacagaaauagcaggaccuggaguugcauag

SEQ ID NO: 284487 - RNA, 32 nt, Human
aaacagaacagcuuucaccaaaguggguagua

SEQ ID NO: 284488 - RNA, 32 nt, Human
aaacagaacaucaguguuuugagaaccuugga

SEQ ID NO: 284489 - RNA, 32 nt, Human
aaacagaaccuccucaggggccagaccuugcc

SEQ ID NO: 284490 - RNA, 32 nt, Human
aaacagaacggugggagcugauggcuccgagu

SEQ ID NO: 284491 - RNA, 32 nt, Human
aaacagaagaagaagaggcaccucugguacug

SEQ ID NO: 284492 - RNA, 32 nt, Human
aaacagaagaugauaguaaaagugauccuaag

SEQ ID NO: 284493 - RNA, 32 nt, Human
aaacagaaucuuggaacugguuuaguacaauc

SEQ ID NO: 284494 - RNA, 32 nt, Human
aaacagaaugagauuccuugugugaaaauagc

SEQ ID NO: 284495 - RNA, 32 nt, Human
aaacagaauucauaacacuuggcacuuguucu

SEQ ID NO: 284496 - RNA, 32 nt, Human
aaacagacaaaagguaugcuugcuuuggaaug

SEQ ID NO: 284497 - RNA, 32 nt, Human
aaacagacccugaagauucaagauacugugau

SEQ ID NO: 284498 - RNA, 32 nt, Human
aaacagacucacaaggggcuucuuggccugca

SEQ ID NO: 284499 - RNA, 32 nt, Human
aaacagacugauuugaucugauuaaugugaag

SEQ ID NO: 284500 - RNA, 32 nt, Human
aaacagacuucucaagaaauggauagaauugu

SEQ ID NO: 284501 - RNA, 24 nt, Human
aaacagagaacgggaugcuuugaa

SEQ ID NO: 284502 - RNA, 32 nt, Human
aaacagagacaggcccaagagaugaagaguga

SEQ ID NO: 284503 - RNA, 31 nt, Human
aaacagagacuucucucugccauggcccuuc

SEQ ID NO: 284504 - RNA, 32 nt, Human
aaacagagagaaacgacgaggagcaguucgaa

SEQ ID NO: 284505 - RNA, 32 nt, Human
aaacagagagaaacgaugaggagcaguucgaa

SEQ ID NO: 284506 - RNA, 32 nt, Human
aaacagagagaagguaaagcuaccugaggcag

SEQ ID NO: 284507 - RNA, 32 nt, Human
aaacagagauagagucuugcuauguuguccag

SEQ ID NO: 284508 - RNA, 32 nt, Human
aaacagagauggggucuuacuauguugcccag

SEQ ID NO: 284509 - RNA, 32 nt, Human
aaacagagcccuccuuccccaguagcucagug

SEQ ID NO: 284510 - RNA, 32 nt, Human
aaacagagccugggcaacaagagcgaaacucc

SEQ ID NO: 284511 - RNA, 31 nt, Human
aaacagagccuuuucuguccuguagauaauc

SEQ ID NO: 284512 - RNA, 22 nt, Human
aaacagagcugguagacuugaa

SEQ ID NO: 284513 - RNA, 32 nt, Human
aaacagagcuucuuccuaauaacggcggcggu

SEQ ID NO: 284514 - RNA, 32 nt, Human
aaacagaggacugucuuauuccacucuucggu

SEQ ID NO: 284515 - RNA, 32 nt, Human
aaacagaggagaaagggaaagaguacaaagcc

SEQ ID NO: 284516 - RNA, 32 nt, Human
aaacagaggaggaggagggaggggagugcgug

SEQ ID NO: 284517 - RNA, 32 nt, Human
aaacagaggccuugccaugccguggcugcgug

SEQ ID NO: 284518 - RNA, 32 nt, Human
aaacagaggcucagagagguucagcaacuucu

SEQ ID NO: 284519 - RNA, 32 nt, Human
aaacagagggauuuaaaagaagauagaauggu

SEQ ID NO: 284520 - RNA, 32 nt, Human
aaacagagggcaggacacagggacagguggug

SEQ ID NO: 284521 - RNA, 32 nt, Human
aaacagagggccugaggcuugcauggcuuaac

SEQ ID NO: 284522 - RNA, 25 nt, Human
aaacagaggguggaggaacccugaa

SEQ ID NO: 284523 - RNA, 32 nt, Human
aaacagagguccaguuuauucuaacaucuugc

SEQ ID NO: 284524 - RNA, 32 nt, Human
aaacagagugauugguugcauccaggccuuuu

SEQ ID NO: 284525 - RNA, 32 nt, Human
aaacagauauuuuuaugagucuuccuauucau

SEQ ID NO: 284526 - RNA, 32 nt, Human
aaacagaugauggaauuagagaggugggcuca

SEQ ID NO: 284527 - RNA, 32 nt, Human
aaacagaugcagaagaacccagaaaggagcag

SEQ ID NO: 284528 - RNA, 32 nt, Human
aaacagauggagcucuugggcccagccagcug

SEQ ID NO: 284529 - RNA, 32 nt, Human
aaacagauucaugcuuguaucuugcauucaga

SEQ ID NO: 284530 - RNA, 22 nt, Human
aaacagcaaauggaggcuugaa

SEQ ID NO: 284531 - RNA, 32 nt, Human
aaacagcaacacaaagacauguuaagcauguu

SEQ ID NO: 284532 - RNA, 21 nt, Human
aaacagcaagcauuaugguca

SEQ ID NO: 284533 - RNA, 32 nt, Human
aaacagcaaggaaauggacucuccccagagcc

SEQ ID NO: 284534 - RNA, 32 nt, Human
aaacagcacacagcaagcaaccacaaaaccag

SEQ ID NO: 284535 - RNA, 32 nt, Human
aaacagcaccuuccaggccucugugagcacac

SEQ ID NO: 284536 - RNA, 32 nt, Human
aaacagcacuauauuucugaucugucacuguu

SEQ ID NO: 284537 - RNA, 32 nt, Human
aaacagcagacaccuccacgcuuuguuuucca

SEQ ID NO: 284538 - RNA, 32 nt, Human
aaacagcagcagcaaacaaauaaaaugaaaua

SEQ ID NO: 284539 - RNA, 32 nt, Human
aaacagcagcagucacguuccucggccgccac

SEQ ID NO: 284540 - RNA, 32 nt, Human
aaacagcagccuguuugauaauaacugcuuua

SEQ ID NO: 284541 - RNA, 32 nt, Human
aaacagccaacagagacaaaggaaaaguguuu

SEQ ID NO: 284542 - RNA, 32 nt, Human
aaacagccaccaggaaagcagccggagagccg

SEQ ID NO: 284543 - RNA, 32 nt, Human
aaacagccauaggcccuuucaguggccgggcu

SEQ ID NO: 284544 - RNA, 32 nt, Human
aaacagccauguccaaguucuucaccucuauc

SEQ ID NO: 284545 - RNA, 32 nt, Human
aaacagcccugaucaguagugaagagcaacau

SEQ ID NO: 284546 - RNA, 32 nt, Human
aaacagccuccaagcaucagcagagcccagau

SEQ ID NO: 284547 - RNA, 32 nt, Human
aaacagccuccaccaccgccauaaauuuacau

SEQ ID NO: 284548 - RNA, 32 nt, Human
aaacagccucucuguuucccuccuucuuggaa

SEQ ID NO: 284549 - RNA, 18 nt, Human
aaacagccucuguacaga

SEQ ID NO: 284550 - RNA, 32 nt, Human
aaacagccugagcaaaaagaccagccuuccca

SEQ ID NO: 284551 - RNA, 32 nt, Human
aaacagccugggagccacugugccugugcuuc

SEQ ID NO: 284552 - RNA, 32 nt, Human
aaacagccuggguugacuggccugguaacugc

SEQ ID NO: 284553 - RNA, 32 nt, Human
aaacagccuuuccuccauuuucuguguauugg

SEQ ID NO: 284554 - RNA, 31 nt, Human
aaacagcgaauguccaucaacaggaaucgga

SEQ ID NO: 284555 - RNA, 32 nt, Human
aaacagcgauaacagugauaguuuuuaacucu

SEQ ID NO: 284556 - RNA, 32 nt, Human
aaacagcgauggagaugaaaacuguugauuug

SEQ ID NO: 284557 - RNA, 32 nt, Human
aaacagcgucagguggccucagccuggcccag

SEQ ID NO: 284558 - RNA, 21 nt, Human
aaacagcuaauaaugaaguua

SEQ ID NO: 284559 - RNA, 32 nt, Human
aaacagcucacuguccucuggaucugcugcgu

SEQ ID NO: 284560 - RNA, 32 nt, Human
aaacagcucagauuugaccaagaucacacaag

SEQ ID NO: 284561 - RNA, 32 nt, Human
aaacagcuccucuauauuuccaccucuuucua

SEQ ID NO: 284562 - RNA, 32 nt, Human
aaacagcucuaguaugaagcaagaguaaagac

SEQ ID NO: 284563 - RNA, 32 nt, Human
aaacagcugcaaccucggauaccagcacggga

SEQ ID NO: 284564 - RNA, 24 nt, Human
aaacagcugccuuagcuucaggaa

SEQ ID NO: 284565 - RNA, 32 nt, Human
aaacagcuucaucucugccucucuccacccca

SEQ ID NO: 284566 - RNA, 32 nt, Human
aaacagcuuguuauuuaaauauuggacaaaau

SEQ ID NO: 284567 - RNA, 32 nt, Human
aaacagcuuuaaccuggauguggaggaggaug

SEQ ID NO: 284568 - RNA, 32 nt, Human
aaacagcuuucaggcguaaauccagagaagug

SEQ ID NO: 284569 - RNA, 32 nt, Human
aaacaggaagugagcaaggggccacuuccuac

SEQ ID NO: 284570 - RNA, 32 nt, Human
aaacaggacaauauaagaagaaaccucuaugu

SEQ ID NO: 284571 - RNA, 32 nt, Human
aaacaggacucugcugggagcuacugugccuu

SEQ ID NO: 284572 - RNA, 32 nt, Human
aaacaggagaggagaggccaggagaucagcag

SEQ ID NO: 284573 - RNA, 32 nt, Human
aaacaggagcaggaaauguacacacagauucc

SEQ ID NO: 284574 - RNA, 32 nt, Human
aaacaggagcccauuucucuucugcuggaguu

SEQ ID NO: 284575 - RNA, 32 nt, Human
aaacaggagguggagguugcagugagccgaga

SEQ ID NO: 284576 - RNA, 32 nt, Human
aaacaggcaaaccagaaucacugugaaucaag

SEQ ID NO: 284577 - RNA, 32 nt, Human
aaacaggcacacaccaucacucgcagcuaagu

SEQ ID NO: 284578 - RNA, 32 nt, Human
aaacaggcacauggaggagcugccuuggagac

SEQ ID NO: 284579 - RNA, 32 nt, Human
aaacaggcacugggacaucacaggcuucagua

SEQ ID NO: 284580 - RNA, 32 nt, Human
aaacaggcagaagaaaaggcagcuguggugug

SEQ ID NO: 284581 - RNA, 32 nt, Human
aaacaggcagcagaggaacccaaaggcaguaa

SEQ ID NO: 284582 - RNA, 32 nt, Human
aaacaggcaggcaguggagcuaacagcuuagu

SEQ ID NO: 284583 - RNA, 32 nt, Human
aaacaggcaguggaucuaaaucuucccaaugu

SEQ ID NO: 284584 - RNA, 32 nt, Human
aaacaggcaguuggccagagagccuggugcug

SEQ ID NO: 284585 - RNA, 32 nt, Human
aaacaggcaugcuguugugacccuaagauggc

SEQ ID NO: 284586 - RNA, 19 nt, Human
aaacaggccaaggcucccu

SEQ ID NO: 284587 - RNA, 32 nt, Human
aaacaggccagccugcuugggcgcucggucuc

SEQ ID NO: 284588 - RNA, 32 nt, Human
aaacaggccaggacaguggugcaugccaguca

SEQ ID NO: 284589 - RNA, 32 nt, Human
aaacaggcggcaggcugggguugguggggcuu

SEQ ID NO: 284590 - RNA, 32 nt, Human
aaacaggcuguuccuuguccagcacuagucau

SEQ ID NO: 284591 - RNA, 32 nt, Human
aaacaggcuucaggaggcaauggugccucuug

SEQ ID NO: 284592 - RNA, 32 nt, Human
aaacagggagcuaugagagauguguccaugug

SEQ ID NO: 284593 - RNA, 32 nt, Human
aaacagggagggcugauaccuccuugcucuuc

SEQ ID NO: 284594 - RNA, 18 nt, Human
aaacagggccagcacaga

SEQ ID NO: 284595 - RNA, 32 nt, Human
aaacaggggaaaggacaaaggaaaccuuaagu

SEQ ID NO: 284596 - RNA, 32 nt, Human
aaacaggguuuuccuuaugaacaaaccuuaca

SEQ ID NO: 284597 - RNA, 32 nt, Human
aaacagguaaggaugggaauauuuuguuauac

SEQ ID NO: 284598 - RNA, 32 nt, Human
aaacagguauaugaaaaggugcucaacaucau

SEQ ID NO: 284599 - RNA, 32 nt, Human
aaacaggucagcauggcagacagcgaggcgaa

SEQ ID NO: 284600 - RNA, 32 nt, Human
aaacaggugaagccugcaguccaaggugccug

SEQ ID NO: 284601 - RNA, 23 nt, Human
aaacagguguccuaacacuguga

SEQ ID NO: 284602 - RNA, 32 nt, Human
aaacaggugugaugaguuaacaagaaauaaca

SEQ ID NO: 284603 - RNA, 32 nt, Human
aaacaguaaaaauacuaauagauuagcugggu

SEQ ID NO: 284604 - RNA, 32 nt, Human
aaacaguaacaaccacuucagagugucaccgc

SEQ ID NO: 284605 - RNA, 32 nt, Human
aaacaguacuguucacaccuuucuucacugag

SEQ ID NO: 284606 - RNA, 32 nt, Human
aaacaguagccaaagauauuugaagaucaugu

SEQ ID NO: 284607 - RNA, 32 nt, Human
aaacaguaguuaggauggcugaaggggauacu

SEQ ID NO: 284608 - RNA, 23 nt, Human
aaacagucaccaccaacaucaaa

SEQ ID NO: 284609 - RNA, 32 nt, Human
aaacagucaguggaguggaggcuccagucaga

SEQ ID NO: 284610 - RNA, 32 nt, Human
aaacagucugaaacucuucuaaaaagcaaaac

SEQ ID NO: 284611 - RNA, 32 nt, Human
aaacagugcaacugaaacuuuugcauuacuau

SEQ ID NO: 284612 - RNA, 32 nt, Human
aaacagugcccaccccucccacaccgucagcc

SEQ ID NO: 284613 - RNA, 32 nt, Human
aaacagugcuccauuuuauuuuguugguguuu

SEQ ID NO: 284614 - RNA, 32 nt, Human
aaacagugcuuggaaggacauuacacaagaaa

SEQ ID NO: 284615 - RNA, 24 nt, Human
aaacagugcuuuggaggcucugga

SEQ ID NO: 284616 - RNA, 32 nt, Human
aaacagugugcauauucugcugagcuuccccc

SEQ ID NO: 284617 - RNA, 32 nt, Human
aaacaguguuccugcauuuaccauaauuuaau

SEQ ID NO: 284618 - RNA, 32 nt, Human
aaacaguugccuuuuccucucacagaaggaag

SEQ ID NO: 284619 - RNA, 21 nt, Human
aaacauaaaugauuguucucc

SEQ ID NO: 284620 - RNA, 32 nt, Human
aaacauaagacauacaucacauuauacacaaa

SEQ ID NO: 284621 - RNA, 32 nt, Human
aaacauaagguaauucauacuggagaaaagcc

SEQ ID NO: 284622 - RNA, 32 nt, Human
aaacauaagguaauucauacuggagagaaacc

SEQ ID NO: 284623 - RNA, 32 nt, Human
aaacauaauagaacuacaacaccgaaggaaau

SEQ ID NO: 284624 - RNA, 32 nt, Human
aaacauaauucuuguccucugagagcauaaaa

SEQ ID NO: 284625 - RNA, 32 nt, Human
aaacauacaaauucugauauagagccucugug

SEQ ID NO: 284626 - RNA, 32 nt, Human
aaacauacaguguucaugguucuugaguucau

SEQ ID NO: 284627 - RNA, 32 nt, Human
aaacauaccauggagaaugaccucagccuucu

SEQ ID NO: 284628 - RNA, 20 nt, Human
aaacauacccaccucugccc

SEQ ID NO: 284629 - RNA, 32 nt, Human
aaacauaccccugcgugucuguccuuaacacc

SEQ ID NO: 284630 - RNA, 32 nt, Human
aaacauacccuaguccuucagccuggggcucu

SEQ ID NO: 284631 - RNA, 32 nt, Human
aaacauacccugggaugcuuucccucuguggu

SEQ ID NO: 284632 - RNA, 32 nt, Human
aaacauacuaugaagccucugauacuuaaaca

SEQ ID NO: 284633 - RNA, 32 nt, Human
aaacauagucugcagagcaauacugauaugaa

SEQ ID NO: 284634 - RNA, 32 nt, Human
aaacauauauacugcuguaucaugccaggauu

SEQ ID NO: 284635 - RNA, 32 nt, Human
aaacauauuccucaauucugugguguucuugg

SEQ ID NO: 284636 - RNA, 32 nt, Human
aaacaucaaaugaguccuccaagcagaaggaa

SEQ ID NO: 284637 - RNA, 32 nt, Human
aaacaucaaauuagguuuggagggaaacuuga

SEQ ID NO: 284638 - RNA, 32 nt, Human
aaacaucaagccuugggauucuuggagcaagc

SEQ ID NO: 284639 - RNA, 32 nt, Human
aaacaucaagcuaaaagacaagaaaugaggcg

SEQ ID NO: 284640 - RNA, 32 nt, Human
aaacaucacauacauucuuggaacuucccagu

SEQ ID NO: 284641 - RNA, 32 nt, Human
aaacaucacguugggagaacagccucgguuuu

SEQ ID NO: 284642 - RNA, 32 nt, Human
aaacaucacuuacguucucccacccauagaca

SEQ ID NO: 284643 - RNA, 32 nt, Human
aaacaucagaugcagaaaaagcccuggacuug

SEQ ID NO: 284644 - RNA, 32 nt, Human
aaacaucaguaguggccagauacuucugaguc

SEQ ID NO: 284645 - RNA, 32 nt, Human
aaacaucaguuuccuguaccaaagucaaaaug

SEQ ID NO: 284646 - RNA, 32 nt, Human
aaacaucaucucccuucucuuucucgcauaac

SEQ ID NO: 284647 - RNA, 32 nt, Human
aaacauccaagcacuuuaauuccaauguacca

SEQ ID NO: 284648 - RNA, 32 nt, Human
aaacauccacuguaauguuacaugcaccuuuu

SEQ ID NO: 284649 - RNA, 32 nt, Human
aaacauccaucuuucuccacuucccccagguc

SEQ ID NO: 284650 - RNA, 32 nt, Human
aaacaucccucagccccacaggcacgaucugu

SEQ ID NO: 284651 - RNA, 32 nt, Human
aaacaucccucccgaguugacccccugggguu

SEQ ID NO: 284652 - RNA, 32 nt, Human
aaacauccuaacuauccuaacucucucacgag

SEQ ID NO: 284653 - RNA, 32 nt, Human
aaacauccucugcaaaugcaacuauuuuaaug

SEQ ID NO: 284654 - RNA, 32 nt, Human
aaacaucguauaacagagaagacuucauuuuu

SEQ ID NO: 284655 - RNA, 32 nt, Human
aaacaucuacuuucuccacauaccuuugagag

SEQ ID NO: 284656 - RNA, 32 nt, Human
aaacaucuaugcaaauguauugcuuuguaauu

SEQ ID NO: 284657 - RNA, 31 nt, Human
aaacaucucaauaaaaccauuuuaguugaaa

SEQ ID NO: 284658 - RNA, 32 nt, Human
aaacaucucccagcaaaagugccgguuaguca

SEQ ID NO: 284659 - RNA, 32 nt, Human
aaacaucugaauaacaacgaugaaugggaaac

SEQ ID NO: 284660 - RNA, 32 nt, Human
aaacaucugggaauuugaaucacuccugaaua

SEQ ID NO: 284661 - RNA, 32 nt, Human
aaacaucuuuauuuucuuuaugucgaccuuuc

SEQ ID NO: 284662 - RNA, 32 nt, Human
aaacaugaaaacagcaaucuucuuaugcuucu

SEQ ID NO: 284663 - RNA, 32 nt, Human
aaacaugaaaucugcuucuuagagaggcuaua

SEQ ID NO: 284664 - RNA, 32 nt, Human
aaacaugaacuuauugcauaaaacuuuucuag

SEQ ID NO: 284665 - RNA, 32 nt, Human
aaacaugaagagaaaaugcucuuuaccaguua

SEQ ID NO: 284666 - RNA, 32 nt, Human
aaacaugaaguaagauuacagcagagcagaag

SEQ ID NO: 284667 - RNA, 32 nt, Human
aaacaugaagugacugcccagagguagaguua

SEQ ID NO: 284668 - RNA, 19 nt, Human
aaacaugacauaaacaaua

SEQ ID NO: 284669 - RNA, 32 nt, Human
aaacaugaccagaaaucaaagaugucagagcc

SEQ ID NO: 284670 - RNA, 32 nt, Human
aaacaugagcaucuaaccccuccuuucuuagg

SEQ ID NO: 284671 - RNA, 32 nt, Human
aaacaugagcuucaacuccaccuccagcucug

SEQ ID NO: 284672 - RNA, 32 nt, Human
aaacaugagugggaggggaggaagcacacaga

SEQ ID NO: 284673 - RNA, 32 nt, Human
aaacaugaugcacacuauucuguaacagaaag

SEQ ID NO: 284674 - RNA, 32 nt, Human
aaacaugcacacacgcaugcacacacacaaag

SEQ ID NO: 284675 - RNA, 32 nt, Human
aaacaugcacuaauauuaccucccucuuccaa

SEQ ID NO: 284676 - RNA, 32 nt, Human
aaacaugcagucucagugugcucucgcaugua

SEQ ID NO: 284677 - RNA, 32 nt, Human
aaacaugccuauuugaccauuuccuuuaaagc

SEQ ID NO: 284678 - RNA, 32 nt, Human
aaacaugccuccaggguuaaugugugaaauaa

SEQ ID NO: 284679 - RNA, 32 nt, Human
aaacaugccuccaggguuggugugugaaauaa

SEQ ID NO: 284680 - RNA, 32 nt, Human
aaacaugcguuugccuuggaucguuugaaauu

SEQ ID NO: 284681 - RNA, 32 nt, Human
aaacaugcuaaaggagguaucuuggcuuaaua

SEQ ID NO: 284682 - RNA, 20 nt, Human
aaacaugcucacucccaccc

SEQ ID NO: 284683 - RNA, 32 nt, Human
aaacauggaacugugcccacugccuuuuccuu

SEQ ID NO: 284684 - RNA, 32 nt, Human
aaacauggaccugccggcugggcgcaguggcu

SEQ ID NO: 284685 - RNA, 32 nt, Human
aaacauggacugaugggucugcuccaggccac

SEQ ID NO: 284686 - RNA, 32 nt, Human
aaacauggaucagacacaaaauaagccuacuc

SEQ ID NO: 284687 - RNA, 32 nt, Human
aaacauggcaaaccaggcugucucauuccacu

SEQ ID NO: 284688 - RNA, 32 nt, Human
aaacauggcaagcagauuacaucugagccguu

SEQ ID NO: 284689 - RNA, 32 nt, Human
aaacauggcuaacauggugaaaccccaucucu

SEQ ID NO: 284690 - RNA, 29 nt, Human
aaacauggcugaagcaaagacccacuggc

SEQ ID NO: 284691 - RNA, 32 nt, Human
aaacaugggaggcggagguugcagugagccga

SEQ ID NO: 284692 - RNA, 32 nt, Human
aaacauggguggcugccugccugccugccugc

SEQ ID NO: 284693 - RNA, 32 nt, Human
aaacaugguaggcuuccccaaggcaucugcag

SEQ ID NO: 284694 - RNA, 32 nt, Human
aaacauguagcugucuuuguucuauagaaaug

SEQ ID NO: 284695 - RNA, 29 nt, Human
aaacauguauggaaauuauucucacuuca

SEQ ID NO: 284696 - RNA, 32 nt, Human
aaacaugucccugaguguucuuuaagaacauu

SEQ ID NO: 284697 - RNA, 29 nt, Human
aaacaugucucgaagauaugacuccagga

SEQ ID NO: 284698 - RNA, 24 nt, Human
aaacaugucucggccccugucccc

SEQ ID NO: 284699 - RNA, 32 nt, Human
aaacauguguuuauuuccacauagauguuaau

SEQ ID NO: 284700 - RNA, 32 nt, Human
aaacauguuuuauuucaagguucugcaaaauu

SEQ ID NO: 284701 - RNA, 32 nt, Human
aaacauguuuugagucuuacucugugccugac

SEQ ID NO: 284702 - RNA, 32 nt, Human
aaacauuaacaaacaugaacagggcauuggcc

SEQ ID NO: 284703 - RNA, 32 nt, Human
aaacauuaacuuaagcagaccaaaaauucuga

SEQ ID NO: 284704 - RNA, 17 nt, Human
aaacauuaauacuuuca

SEQ ID NO: 284705 - RNA, 32 nt, Human
aaacauuacagccuggcauccccagucuuugc

SEQ ID NO: 284706 - RNA, 32 nt, Human
aaacauuagcaguccgggcaugguggcugaag

SEQ ID NO: 284707 - RNA, 32 nt, Human
aaacauuauauguauacaucaguauaguguuu

SEQ ID NO: 284708 - RNA, 32 nt, Human
aaacauucauucucucacacagucucugcagg

SEQ ID NO: 284709 - RNA, 32 nt, Human
aaacauucauucucugcaaaaccuacucuaau

SEQ ID NO: 284710 - RNA, 32 nt, Human
aaacauucauuucaccugcuugcuaaugugua

SEQ ID NO: 284711 - RNA, 32 nt, Human
aaacauuccuauuaccuuucugaggcuggcuu

SEQ ID NO: 284712 - RNA, 32 nt, Human
aaacauucucaaaacaucacaucacauuagca

SEQ ID NO: 284713 - RNA, 22 nt, Human
aaacauucuggaccuucuuccu

SEQ ID NO: 284714 - RNA, 32 nt, Human
aaacauugcugccuaaagaaacucagcagccu

SEQ ID NO: 284715 - RNA, 32 nt, Human
aaacauuggaauugacugaucucugugguuug

SEQ ID NO: 284716 - RNA, 32 nt, Human
aaacauuguagccucuuuauggucucugagaa

SEQ ID NO: 284717 - RNA, 32 nt, Human
aaacauuguccucagaggaguaggaaagugga

SEQ ID NO: 284718 - RNA, 32 nt, Human
aaacauugugcagcuuugcuagggaagaaagu

SEQ ID NO: 284719 - RNA, 22 nt, Human
aaacauuguggcuguuccugua

SEQ ID NO: 284720 - RNA, 32 nt, Human
aaacauuguguaucuauacauauggcucuuga

SEQ ID NO: 284721 - RNA, 32 nt, Human
aaacauuguucagauccugcauuaagaaauuc

SEQ ID NO: 284722 - RNA, 32 nt, Human
aaacauuuaccugaauguugucugaggacuga

SEQ ID NO: 284723 - RNA, 32 nt, Human
aaacauuucacucugcugugccgucucuucau

SEQ ID NO: 284724 - RNA, 32 nt, Human
aaacauuugugaaaccagugagagaaggcuug

SEQ ID NO: 284725 - RNA, 32 nt, Human
aaacauuuucauucuuaaaauuauacucaugg

SEQ ID NO: 284726 - RNA, 32 nt, Human
aaacauuuuccucuuuuccacagagggcuuaa

SEQ ID NO: 284727 - RNA, 32 nt, Human
aaacauuuucucuuucacccuaacuccuaaac

SEQ ID NO: 284728 - RNA, 32 nt, Human
aaacauuuuugaagauuuauucuuuuuguguu

SEQ ID NO: 284729 - RNA, 32 nt, Human
aaaccaaaaagcuggguccucuggaggagggg

SEQ ID NO: 284730 - RNA, 32 nt, Human
aaaccaaacauguuauccaguaauggagccuc

SEQ ID NO: 284731 - RNA, 32 nt, Human
aaaccaaacuaggagaugaaacugguuccuac

SEQ ID NO: 284732 - RNA, 32 nt, Human
aaaccaaacucauaugaucccgaugaaagagg

SEQ ID NO: 284733 - RNA, 32 nt, Human
aaaccaaagaagcacaaaucacugccugucac

SEQ ID NO: 284734 - RNA, 32 nt, Human
aaaccaaagacuugccccagcacugcugugga

SEQ ID NO: 284735 - RNA, 31 nt, Human
aaaccaaagagaccguucguggagucuaaug

SEQ ID NO: 284736 - RNA, 32 nt, Human
aaaccaaaggaaaaguguugcuagagaaaauu

SEQ ID NO: 284737 - RNA, 32 nt, Human
aaaccaaauauacauacuuauuuucuauggac

SEQ ID NO: 284738 - RNA, 32 nt, Human
aaaccaaaugguuacauugugcugcuagaaau

SEQ ID NO: 284739 - RNA, 32 nt, Human
aaaccaacaaagcccacaaguccugauuuccc

SEQ ID NO: 284740 - RNA, 32 nt, Human
aaaccaacaacaauuagccauaguucugaaug

SEQ ID NO: 284741 - RNA, 31 nt, Human
aaaccaacaacauauacacauuuaaaaauag

SEQ ID NO: 284742 - RNA, 32 nt, Human
aaaccaacagucugucaguguacagcagcagu

SEQ ID NO: 284743 - RNA, 32 nt, Human
aaaccaaccaacaaauacaacacaaagcaauu

SEQ ID NO: 284744 - RNA, 32 nt, Human
aaaccaaccaaccaaccaaccaaccaacaaac

SEQ ID NO: 284745 - RNA, 32 nt, Human
aaaccaaccagcguucaaaggaaccucccauc

SEQ ID NO: 284746 - RNA, 32 nt, Human
aaaccaacccuugaagacauuucagggccaug

SEQ ID NO: 284747 - RNA, 32 nt, Human
aaaccaaccuacucugaaagccuucagacauu

SEQ ID NO: 284748 - RNA, 32 nt, Human
aaaccaaccucaggcugaccuaggccgguaau

SEQ ID NO: 284749 - RNA, 32 nt, Human
aaaccaaccuugagcugggagguacgugcucu

SEQ ID NO: 284750 - RNA, 32 nt, Human
aaaccaacucgcacccucaaagcuccggaagc

SEQ ID NO: 284751 - RNA, 32 nt, Human
aaaccaacugaauuuuaauaaaggaagcuuua

SEQ ID NO: 284752 - RNA, 32 nt, Human
aaaccaagaagugagaagcauuucaggggaug

SEQ ID NO: 284753 - RNA, 32 nt, Human
aaaccaagauagagcuacaaacucagcuguac

SEQ ID NO: 284754 - RNA, 32 nt, Human
aaaccaagaucacgccacuacacuccagccug

SEQ ID NO: 284755 - RNA, 32 nt, Human
aaaccaagcaaaucagauggcccagggccaca

SEQ ID NO: 284756 - RNA, 32 nt, Human
aaaccaagccauagcaugaaacagcgagcuug

SEQ ID NO: 284757 - RNA, 21 nt, Human
aaaccaagcccaggccggggg

SEQ ID NO: 284758 - RNA, 32 nt, Human
aaaccaagcccaggccgggggcgguggcucac

SEQ ID NO: 284759 - RNA, 21 nt, Human
aaaccaagcuacaauuagaga

SEQ ID NO: 284760 - RNA, 32 nt, Human
aaaccaagcuguugcaaccucaccagaacagc

SEQ ID NO: 284761 - RNA, 32 nt, Human
aaaccaagcuuuacacgagcaggauggggaug

SEQ ID NO: 284762 - RNA, 32 nt, Human
aaaccaaggaagaggaaugggagccacgcgcg

SEQ ID NO: 284763 - RNA, 24 nt, Human
aaaccaaggauccuguccuagaga

SEQ ID NO: 284764 - RNA, 32 nt, Human
aaaccaaggcacuccagccugggugacagagu

SEQ ID NO: 284765 - RNA, 32 nt, Human
aaaccaagggagcuggaggcagaggaagagaa

SEQ ID NO: 284766 - RNA, 32 nt, Human
aaaccaaggucugaccuaggguucccucccag

SEQ ID NO: 284767 - RNA, 32 nt, Human
aaaccaaggugaggccuugagcucuuuguuuu

SEQ ID NO: 284768 - RNA, 23 nt, Human
aaaccaaguaugccuccgggagg

SEQ ID NO: 284769 - RNA, 32 nt, Human
aaaccaaucugugguuuuaaaagaaguaaggu

SEQ ID NO: 284770 - RNA, 32 nt, Human
aaaccaaugaaaacaagagggaaagugagaaa

SEQ ID NO: 284771 - RNA, 32 nt, Human
aaaccaauuucuuccuuccacaguuaucuuag

SEQ ID NO: 284772 - RNA, 32 nt, Human
aaaccacaacagcagcaacuuauugccaaagc

SEQ ID NO: 284773 - RNA, 32 nt, Human
aaaccacacaaaccaaaccgucaacagcauaa

SEQ ID NO: 284774 - RNA, 32 nt, Human
aaaccacaccucagucacuaaaggucuguuua

SEQ ID NO: 284775 - RNA, 32 nt, Human
aaaccacacuccuuuagauugggggccgagag

SEQ ID NO: 284776 - RNA, 32 nt, Human
aaaccacacuggcuccaacuuccuccucaugg

SEQ ID NO: 284777 - RNA, 32 nt, Human
aaaccacagaugccauacagaccuccugugcu

SEQ ID NO: 284778 - RNA, 32 nt, Human
aaaccacagcuagaauuccuccaccuaggauu

SEQ ID NO: 284779 - RNA, 32 nt, Human
aaaccacagcuguuggcaggguccccagcuca

SEQ ID NO: 284780 - RNA, 32 nt, Human
aaaccacaggagaaacucaaauuguuccuggg

SEQ ID NO: 284781 - RNA, 31 nt, Human
aaaccacaguuucauuauucucauaauccuu

SEQ ID NO: 284782 - RNA, 32 nt, Human
aaaccacauacagaucaccuggaguugauuau

SEQ ID NO: 284783 - RNA, 23 nt, Human
aaaccacaugggaaaacucagca

SEQ ID NO: 284784 - RNA, 32 nt, Human
aaaccacauuacuucugucacuucagggcauc

SEQ ID NO: 284785 - RNA, 32 nt, Human
aaaccaccaaaccaucaccagcuccuagaagc

SEQ ID NO: 284786 - RNA, 21 nt, Human
aaaccaccagcugcccggaga

SEQ ID NO: 284787 - RNA, 32 nt, Human
aaaccaccauggcucuaaacccugccacacug

SEQ ID NO: 284788 - RNA, 32 nt, Human
aaaccacccuaucaucaguuaggauuagguuu

SEQ ID NO: 284789 - RNA, 32 nt, Human
aaaccaccuaggaaccugcuguugcucuaagg

SEQ ID NO: 284790 - RNA, 32 nt, Human
aaaccaccucacccucuccaacuuccugccug

SEQ ID NO: 284791 - RNA, 32 nt, Human
aaaccaccuucccucaucuuucaucaaucauu

SEQ ID NO: 284792 - RNA, 32 nt, Human
aaaccaccuuccuauguuuguaaaauauuuaa

SEQ ID NO: 284793 - RNA, 32 nt, Human
aaaccaccuuuaauuauccagaaugaauagau

SEQ ID NO: 284794 - RNA, 32 nt, Human
aaaccacggaguucugcucuuguugcccaggu

SEQ ID NO: 284795 - RNA, 32 nt, Human
aaaccacguggacgcgucugggcugcuggagg

SEQ ID NO: 284796 - RNA, 32 nt, Human
aaaccacuaaaauacauagacugauugauuau

SEQ ID NO: 284797 - RNA, 32 nt, Human
aaaccacucacuggguaccccaccuccucucu

SEQ ID NO: 284798 - RNA, 32 nt, Human
aaaccacucccaguuccucauuaauagcacca

SEQ ID NO: 284799 - RNA, 32 nt, Human
aaaccacucccuugagagucuggaccugacuc

SEQ ID NO: 284800 - RNA, 32 nt, Human
aaaccacugaacauuugcuuuguuuucuaaag

SEQ ID NO: 284801 - RNA, 32 nt, Human
aaaccacugcaauccagccugggcaacgagca

SEQ ID NO: 284802 - RNA, 32 nt, Human
aaaccacugcagcucucucccaccccugcugu

SEQ ID NO: 284803 - RNA, 32 nt, Human
aaaccacugccuuggccccaggaaggggccau

SEQ ID NO: 284804 - RNA, 32 nt, Human
aaaccacuggagccuugggagcucuuuggccu

SEQ ID NO: 284805 - RNA, 32 nt, Human
aaaccacuguaguccagccugagugacagagu

SEQ ID NO: 284806 - RNA, 31 nt, Human
aaaccacuucaaagauuuuguugaaaguuuu

SEQ ID NO: 284807 - RNA, 32 nt, Human
aaaccacuuccagagucuaaagcagcucagau

SEQ ID NO: 284808 - RNA, 32 nt, Human
aaaccacuugacuuugcuaauggcuauucucc

SEQ ID NO: 284809 - RNA, 32 nt, Human
aaaccacuuuaaucauauccaggaguuugcaa

SEQ ID NO: 284810 - RNA, 32 nt, Human
aaaccacuuucuucucccuuggcuuauaucuc

SEQ ID NO: 284811 - RNA, 32 nt, Human
aaaccacuuuuugcagcuuucucuaguucaag

SEQ ID NO: 284812 - RNA, 32 nt, Human
aaaccagaaaguaccuuuuacuguugauacaa

SEQ ID NO: 284813 - RNA, 32 nt, Human
aaaccagaacuagggccucugcuccaaacuga

SEQ ID NO: 284814 - RNA, 32 nt, Human
aaaccagaagaauuccucugaccacuuacaau

SEQ ID NO: 284815 - RNA, 32 nt, Human
aaaccagaagguggagguggcagugagccgag

SEQ ID NO: 284816 - RNA, 32 nt, Human
aaaccagaauauguucagcuguguuacuaauu

SEQ ID NO: 284817 - RNA, 32 nt, Human
aaaccagaaugggaguuugaaagagagaucau

SEQ ID NO: 284818 - RNA, 32 nt, Human
aaaggguaacacagcccuggauucucccagau

SEQ ID NO: 284819 - RNA, 32 nt, Human
aaaggguagauccagaauagcuggcuucuuuc

SEQ ID NO: 284820 - RNA, 32 nt, Human
aaaggguaguugugguuggcucugccuuugcu

SEQ ID NO: 284821 - RNA, 32 nt, Human
aaaggguauuucuuuucucucuucagccccca

SEQ ID NO: 284822 - RNA, 32 nt, Human
aaaggguccauacauggagaacccuauugcug

SEQ ID NO: 284823 - RNA, 32 nt, Human
aaagggucucacuauguugcccaggcuggucu

SEQ ID NO: 284824 - RNA, 32 nt, Human
aaagggucuuuaagaaccuacuuccuaaucuc

SEQ ID NO: 284825 - RNA, 32 nt, Human
aaagggugaagggcacguucccacaggauuca

SEQ ID NO: 284826 - RNA, 32 nt, Human
aaaggguggauguucaacaugugccuucaaau

SEQ ID NO: 284827 - RNA, 32 nt, Human
aaagggugggagggaggaagaacggaagggag

SEQ ID NO: 284828 - RNA, 32 nt, Human
aaaggguggggaugauaagaaaugcuaauaua

SEQ ID NO: 284829 - RNA, 32 nt, Human
aaagggugguccuucuugaauucauguacaug

SEQ ID NO: 284830 - RNA, 32 nt, Human
aaaggguggugguggugguggaggugcagaag

SEQ ID NO: 284831 - RNA, 32 nt, Human
aaaggguguggaggaagggagggccuugccua

SEQ ID NO: 284832 - RNA, 32 nt, Human
aaaggguugccucaucaagcagcucaguguaa

SEQ ID NO: 284833 - RNA, 32 nt, Human
aaaggguuucacugucaccaaggcuuagugca

SEQ ID NO: 284834 - RNA, 32 nt, Human
aaagguaaaauaaucaggaauauuucuauagu

SEQ ID NO: 284835 - RNA, 32 nt, Human
aaagguaaagcccaucacuucuagagggagaa

SEQ ID NO: 284836 - RNA, 32 nt, Human
aaagguaacuuauuucucuucugcacagagca

SEQ ID NO: 284837 - RNA, 32 nt, Human
aaagguaauaaauauucaaagcauaucacuuc

SEQ ID NO: 284838 - RNA, 32 nt, Human
aaagguacaaaaacaaacuaaccacaguugaa

SEQ ID NO: 284839 - RNA, 32 nt, Human
aaagguacaccacuacacuccagccugggcaa

SEQ ID NO: 284840 - RNA, 32 nt, Human
aaagguacauaguguuucaagugcaugguagu

SEQ ID NO: 284841 - RNA, 32 nt, Human
aaagguacauguuuacaaagagguuuuaugaa

SEQ ID NO: 284842 - RNA, 32 nt, Human
aaagguacuuccugaaacuuuugauucaauaa

SEQ ID NO: 284843 - RNA, 32 nt, Human
aaagguagaugagucugaauuuugaaguaacg

SEQ ID NO: 284844 - RNA, 32 nt, Human
aaagguagauuauccaggugugccugauuuga

SEQ ID NO: 284845 - RNA, 32 nt, Human
aaagguagccauggaagagaauauggaagagg

SEQ ID NO: 284846 - RNA, 32 nt, Human
aaagguagcucaguaucucugccuucucucca

SEQ ID NO: 284847 - RNA, 32 nt, Human
aaagguagucugccccuuccuuccucucucuu

SEQ ID NO: 284848 - RNA, 32 nt, Human
aaagguaucugugguauuggcaggauagggaa

SEQ ID NO: 284849 - RNA, 32 nt, Human
aaagguauugaauaucuguuaugaaagguucu

SEQ ID NO: 284850 - RNA, 32 nt, Human
aaagguauuuggaacuuuuuacaggaauuaaa

SEQ ID NO: 284851 - RNA, 31 nt, Human
aaaggucacagcugagugagagaguugguaa

SEQ ID NO: 284852 - RNA, 32 nt, Human
aaaggucacaggaaucgugaaggagcugagaa

SEQ ID NO: 284853 - RNA, 21 nt, Human
aaaggucacaguauucaugac

SEQ ID NO: 284854 - RNA, 32 nt, Human
aaaggucagaacaguuaaacacugccuuuccu

SEQ ID NO: 284855 - RNA, 32 nt, Human
aaaggucagaucuauuggaaaugacagcccga

SEQ ID NO: 284856 - RNA, 32 nt, Human
aaaggucagcaaaugaguucucuggcauuugg

SEQ ID NO: 284857 - RNA, 32 nt, Human
aaaggucaggaguucaagacaagaccagccug

SEQ ID NO: 284858 - RNA, 32 nt, Human
aaaggucaggguggcugugguuggaaccucca

SEQ ID NO: 284859 - RNA, 32 nt, Human
aaaggucagggugggcgggggccugggaauac

SEQ ID NO: 284860 - RNA, 32 nt, Human
aaaggucaguacacaaacaugcgugccauuaa

SEQ ID NO: 284861 - RNA, 32 nt, Human
aaaggucauccucugcucuauuuguuaccuug

SEQ ID NO: 284862 - RNA, 32 nt, Human
aaaggucauguagagguuguaguagaauggcu

SEQ ID NO: 284863 - RNA, 32 nt, Human
aaaggucauuguggcuaucugcauuuauaaau

SEQ ID NO: 284864 - RNA, 32 nt, Human
aaagguccaacaaugaaacagaacagauauau

SEQ ID NO: 284865 - RNA, 32 nt, Human
aaagguccacgaugggcuuucccaacagcucc

SEQ ID NO: 284866 - RNA, 32 nt, Human
aaagguccaguucucaguaccaugugaguuaa

SEQ ID NO: 284867 - RNA, 32 nt, Human
aaagguccaucaucaaaacaccaaagacucaa

SEQ ID NO: 284868 - RNA, 19 nt, Human
aaaggucguucccagcaga

SEQ ID NO: 284869 - RNA, 32 nt, Human
aaaggucuaauauccagcaucuauaaagaacu

SEQ ID NO: 284870 - RNA, 32 nt, Human
aaaggucuacagcuucacucccgaagccagcg

SEQ ID NO: 284871 - RNA, 32 nt, Human
aaaggucuacagcuucauuccugaagcccgcg

SEQ ID NO: 284872 - RNA, 32 nt, Human
aaaggucucagccuguagcuuaaacuuauaga

SEQ ID NO: 284873 - RNA, 32 nt, Human
aaaggucuccaaugcguaugaccucaucuucc

SEQ ID NO: 284874 - RNA, 32 nt, Human
aaaggucucgcaaaguucaugcggcggcugcg

SEQ ID NO: 284875 - RNA, 32 nt, Human
aaaggucucuugcuaaauauugcuggaugaag

SEQ ID NO: 284876 - RNA, 32 nt, Human
aaaggucugaaauccagcaucuauacguaauu

SEQ ID NO: 284877 - RNA, 32 nt, Human
aaaggucugcaacuucacuucugaggccagcc

SEQ ID NO: 284878 - RNA, 32 nt, Human
aaaggucugccucacacaggccuucccugcag

SEQ ID NO: 284879 - RNA, 32 nt, Human
aaaggucugugggccaaagaacagguguauau

SEQ ID NO: 284880 - RNA, 32 nt, Human
aaaggucuguuaaugucauggccuugaaacag

SEQ ID NO: 284881 - RNA, 32 nt, Human
aaaggucuuaucucccagcucgcccaggccca

SEQ ID NO: 284882 - RNA, 32 nt, Human
aaaggucuucaaggaguugguccagguagcaa

SEQ ID NO: 284883 - RNA, 32 nt, Human
aaaggucuugaccugaaugauggccggggaag

SEQ ID NO: 284884 - RNA, 20 nt, Human
aaaggucuuggggaauucug

SEQ ID NO: 284885 - RNA, 31 nt, Human
aaaggucuuuaguagaucacagcagaguuac

SEQ ID NO: 284886 - RNA, 32 nt, Human
aaaggugaagcagcggcguuuucggcgacuuu

SEQ ID NO: 284887 - RNA, 21 nt, Human
aaaggugaagcugccuugagg

SEQ ID NO: 284888 - RNA, 32 nt, Human
aaaggugaaggaggucagaaagagauagaauu

SEQ ID NO: 284889 - RNA, 32 nt, Human
aaaggugacaagccuggguuucucccaggaua

SEQ ID NO: 284890 - RNA, 32 nt, Human
aaaggugacagcagaagcagauagcaguaguc

SEQ ID NO: 284891 - RNA, 32 nt, Human
aaaggugacaggcacaagccuaggcaaauaga

SEQ ID NO: 284892 - RNA, 32 nt, Human
aaaggugacucugucccuggacacugccuccg

SEQ ID NO: 284893 - RNA, 32 nt, Human
aaaggugagacccucucccaagaggagcagag

SEQ ID NO: 284894 - RNA, 32 nt, Human
aaaggugagaggaggagaguggcauuaucccu

SEQ ID NO: 284895 - RNA, 20 nt, Human
aaaggugcacugcuuuggga

SEQ ID NO: 284896 - RNA, 32 nt, Human
aaaggugcagagaugaaaagauuuugaaggac

SEQ ID NO: 284897 - RNA, 32 nt, Human
aaaggugcccaccacuauacccggcuaauuuu

SEQ ID NO: 284898 - RNA, 32 nt, Human
aaaggugcccaucuucucucuccuagagccca

SEQ ID NO: 284899 - RNA, 32 nt, Human
aaaggugccugagaugaaacuuccugagauga

SEQ ID NO: 284900 - RNA, 32 nt, Human
aaaggugcuaccccaauuuggugaaauugaca

SEQ ID NO: 284901 - RNA, 19 nt, Human
aaaggugcugaccuuggga

SEQ ID NO: 284902 - RNA, 32 nt, Human
aaaggugcuuuaagguugcccucugccgauac

SEQ ID NO: 284903 - RNA, 32 nt, Human
aaagguggaaggacagagugcuggggacaaga

SEQ ID NO: 284904 - RNA, 32 nt, Human
aaagguggacuugucucccagucgaggcuggu

SEQ ID NO: 284905 - RNA, 32 nt, Human
aaagguggauaccuccuucacaugguguuugc

SEQ ID NO: 284906 - RNA, 32 nt, Human
aaagguggcagcaguugaaggaagagauugag

SEQ ID NO: 284907 - RNA, 32 nt, Human
aaagguggcccgaggcagccgggaugacagcu

SEQ ID NO: 284908 - RNA, 32 nt, Human
aaagguggccgcgcugucaguaccaaguagcu

SEQ ID NO: 284909 - RNA, 32 nt, Human
aaaggugggaggaucauuugagcucaggaguu

SEQ ID NO: 284910 - RNA, 32 nt, Human
aaaggugggauuuuagugugcacugugugaug

SEQ ID NO: 284911 - RNA, 32 nt, Human
aaaggugggcugccuuuuccccuuguccuuau

SEQ ID NO: 284912 - RNA, 32 nt, Human
aaaggugggugagggaagcagagagaaaucau

SEQ ID NO: 284913 - RNA, 32 nt, Human
aaagguggucuggagccccuucccucucccug

SEQ ID NO: 284914 - RNA, 32 nt, Human
aaaggugguggauuuauuuugccugcaguaaa

SEQ ID NO: 284915 - RNA, 32 nt, Human
aaaggugucagucccuguggccuuccuugggg

SEQ ID NO: 284916 - RNA, 32 nt, Human
aaagguguccaagucacacagagccacggaau

SEQ ID NO: 284917 - RNA, 32 nt, Human
aaaggugucccaaggcuccugaccagugaaca

SEQ ID NO: 284918 - RNA, 32 nt, Human
aaaggugugucccaguuaaguacugucaaauc

SEQ ID NO: 284919 - RNA, 32 nt, Human
aaagguguguuccagagaacaagccuucagac

SEQ ID NO: 284920 - RNA, 32 nt, Human
aaagguguuuucaaaagcacacacugacugug

SEQ ID NO: 284921 - RNA, 32 nt, Human
aaagguguuuuuaaugagauaaucuuuuugau

SEQ ID NO: 284922 - RNA, 32 nt, Human
aaagguuaagaugauucucccuccugcagccu

SEQ ID NO: 284923 - RNA, 32 nt, Human
aaagguuacaaacccacaccaauacuauuuua

SEQ ID NO: 284924 - RNA, 32 nt, Human
aaagguuacacaugaucauggcacagaagaua

SEQ ID NO: 284925 - RNA, 19 nt, Human
aaagguuagacuuuugaga

SEQ ID NO: 284926 - RNA, 32 nt, Human
aaagguuauggaagaaugguuuaugaacuucc

SEQ ID NO: 284927 - RNA, 32 nt, Human
aaagguucaaucaauaaaaauauuuuauucaa

SEQ ID NO: 284928 - RNA, 32 nt, Human
aaagguuccucgaacucugcaccuuccuccac

SEQ ID NO: 284929 - RNA, 32 nt, Human
aaagguuccuguggagccucaggccggugugc

SEQ ID NO: 284930 - RNA, 32 nt, Human
aaagguucgcccuggugcugagcuccaugaac

SEQ ID NO: 284931 - RNA, 32 nt, Human
aaagguucuugcaaaaccaugaaucuugcuuu

SEQ ID NO: 284932 - RNA, 32 nt, Human
aaagguuuccacauaggguuaccccuuaauag

SEQ ID NO: 284933 - RNA, 19 nt, Human
aaagguuugcacuuugaga

SEQ ID NO: 284934 - RNA, 32 nt, Human
aaagguuuguguauauuucugaugcaaauguc

SEQ ID NO: 284935 - RNA, 24 nt, Human
aaagguuuuaaccgcacaugcaca

SEQ ID NO: 284936 - RNA, 22 nt, Human
aaagguuuucuucauucauggc

SEQ ID NO: 284937 - RNA, 32 nt, Human
aaagguuuugacuguguugggguggggguugg

SEQ ID NO: 284938 - RNA, 32 nt, Human
aaagguuuuggaaggaaaaaugaccugaaauc

SEQ ID NO: 284939 - RNA, 21 nt, Human
aaagguuuuguccuguaggac

SEQ ID NO: 284940 - RNA, 32 nt, Human
aaagguuuuguuuugcuuugcuuguugugaau

SEQ ID NO: 284941 - RNA, 32 nt, Human
aaaguaaaacaauuucccaaucccaggccuug

SEQ ID NO: 284942 - RNA, 32 nt, Human
aaaguaaaaccagcucagaaucuugccagagu

SEQ ID NO: 284943 - RNA, 32 nt, Human
aaaguaaacaguucauccaugaucucacuuaa

SEQ ID NO: 284944 - RNA, 32 nt, Human
aaaguaaaucuuuggggacaguguagcccauc

SEQ ID NO: 284945 - RNA, 32 nt, Human
aaaguaacaagcuguuccuuguuucugauaca

SEQ ID NO: 284946 - RNA, 32 nt, Human
aaaguaaccccgaggaaagguaugaaacacca

SEQ ID NO: 284947 - RNA, 32 nt, Human
aaaguaacuaaaacaaagaaagcugagccagc

SEQ ID NO: 284948 - RNA, 32 nt, Human
aaaguaacuauuucucagacuuuuggggagaa

SEQ ID NO: 284949 - RNA, 32 nt, Human
aaaguaacugaauuauuucaggaaggucuuca

SEQ ID NO: 284950 - RNA, 32 nt, Human
aaaguaacuguuuucuucuuggugcuaugaca

SEQ ID NO: 284951 - RNA, 32 nt, Human
aaaguaagaccuagaccuggaucuucuaacuc

SEQ ID NO: 284952 - RNA, 32 nt, Human
aaaguaagagggaaaggaaaagagguaucaag

SEQ ID NO: 284953 - RNA, 32 nt, Human
aaaguaagcucccuccuggaaugcuucauuca

SEQ ID NO: 284954 - RNA, 32 nt, Human
aaaguaaggaagcaacagcugcugcagcugag

SEQ ID NO: 284955 - RNA, 32 nt, Human
aaaguaaguaucaucuggaauguaauauguaa

SEQ ID NO: 284956 - RNA, 32 nt, Human
aaaguaauaauauaaggaaaaagggaaaguaa

SEQ ID NO: 284957 - RNA, 32 nt, Human
aaaguaaugaauucuggccagguacaguggcu

SEQ ID NO: 284958 - RNA, 32 nt, Human
aaaguaauguuauuuccaagaaaauguuacuc

SEQ ID NO: 284959 - RNA, 18 nt, Human
aaaguaauugccugugua

SEQ ID NO: 284960 - RNA, 32 nt, Human
aaaguacaaagaagaaaaguaaaaguacccau

SEQ ID NO: 284961 - RNA, 32 nt, Human
aaaguacaaggccggccgggugcaguggcuca

SEQ ID NO: 284962 - RNA, 32 nt, Human
aaaguacaagggcugagauucuucguguauag

SEQ ID NO: 284963 - RNA, 32 nt, Human
aaaguacaccuacacuaauagucugucucaac

SEQ ID NO: 284964 - RNA, 32 nt, Human
aaaguacagugaccccagcaaggggaaaaggu

SEQ ID NO: 284965 - RNA, 32 nt, Human
aaaguacauccuuggaaucuuuguccacacag

SEQ ID NO: 284966 - RNA, 32 nt, Human
aaaguacaugacacaguaguugcuugauaaua

SEQ ID NO: 284967 - RNA, 32 nt, Human
aaaguaccaccugcuacucagaaagcuaaauc

SEQ ID NO: 284968 - RNA, 32 nt, Human
aaaguacgcuuuguuggcugggcacggcgacu

SEQ ID NO: 284969 - RNA, 32 nt, Human
aaaguacuggacugccugguucagggcugaac

SEQ ID NO: 284970 - RNA, 32 nt, Human
aaaguacuucacuuauucuuuuuaacuacuga

SEQ ID NO: 284971 - RNA, 32 nt, Human
aaaguacuucagaaugaaacuggauacaguau

SEQ ID NO: 284972 - RNA, 32 nt, Human
aaaguacuuggccuccccacucccuccccacu

SEQ ID NO: 284973 - RNA, 32 nt, Human
aaaguagaauacaguggugugacgcuacccac

SEQ ID NO: 284974 - RNA, 32 nt, Human
aaaguagaauuuaaaacagaggauacaguuaa

SEQ ID NO: 284975 - RNA, 32 nt, Human
aaaguagagacaggauuucacuguguuagcca

SEQ ID NO: 284976 - RNA, 32 nt, Human
aaaguagagcucaugaacucugugcugucuuc

SEQ ID NO: 284977 - RNA, 32 nt, Human
aaaguagaugaaaaaguccuccccuauucuaa

SEQ ID NO: 284978 - RNA, 32 nt, Human
aaaguagauguggacucaaguggaaagaaaug

SEQ ID NO: 284979 - RNA, 32 nt, Human
aaaguagcaaaaggugucugcauucugagccu

SEQ ID NO: 284980 - RNA, 32 nt, Human
aaaguagcaagugaccagaaucugccauggca

SEQ ID NO: 284981 - RNA, 32 nt, Human
aaaguagcccagcaaaugaugaggcuugaacc

SEQ ID NO: 284982 - RNA, 32 nt, Human
aaaguagccgggaggugcagggcagcaggggg

SEQ ID NO: 284983 - RNA, 32 nt, Human
aaaguagccuggugccuguaaucccagcuacu

SEQ ID NO: 284984 - RNA, 32 nt, Human
aaaguaggaucccagugcauuaggcagccagu

SEQ ID NO: 284985 - RNA, 32 nt, Human
aaaguaggccagagccgaacucucuuccugcc

SEQ ID NO: 284986 - RNA, 32 nt, Human
aaaguagggaaagaaggagagaggaagcaagg

SEQ ID NO: 284987 - RNA, 32 nt, Human
aaaguagggagggcauccaacauauuauagau

SEQ ID NO: 284988 - RNA, 32 nt, Human
aaaguagggugcgguggccaggagggccccug

SEQ ID NO: 284989 - RNA, 32 nt, Human
aaaguaguucucugucauguguguucccugcc

SEQ ID NO: 284990 - RNA, 32 nt, Human
aaaguauaaccagucacaccaaagagaggcag

SEQ ID NO: 284991 - RNA, 32 nt, Human
aaaguauaggagaaacugaagaauguacacuu

SEQ ID NO: 284992 - RNA, 32 nt, Human
aaaguauauaaauggcucuuaugcuuuugagg

SEQ ID NO: 284993 - RNA, 32 nt, Human
aaaguaucagucuucugaauucugaguuuuga

SEQ ID NO: 284994 - RNA, 29 nt, Human
aaaguauccuuaauauuuuaugacauucu

SEQ ID NO: 284995 - RNA, 32 nt, Human
aaaguaucuccuccaaccaaaacaucucaaua

SEQ ID NO: 284996 - RNA, 32 nt, Human
aaaguaugaacccaaacaggaaagggcugagg

SEQ ID NO: 284997 - RNA, 32 nt, Human
aaaguauuacuuuuacgacaacuacuuugacc

SEQ ID NO: 284998 - RNA, 32 nt, Human
aaaguauuauauccucaccccacccgugccug

SEQ ID NO: 284999 - RNA, 32 nt, Human
aaaguauuccugaacuuuccuuagcuccuugg

SEQ ID NO: 285000 - RNA, 32 nt, Human
aaaguauucuaaaagaguaggaagagagaaau

SEQ ID NO: 285001 - RNA, 32 nt, Human
aaaguauugggguggagguugcagugagcaga

SEQ ID NO: 285002 - RNA, 32 nt, Human
aaaguauugggguggagguugcagugagcgga

SEQ ID NO: 285003 - RNA, 32 nt, Human
aaaguauuggugcuugcuaccuugugaauucu

SEQ ID NO: 285004 - RNA, 23 nt, Human
aaaguauuuguguuugguuucag

SEQ ID NO: 285005 - RNA, 32 nt, Human
aaaguauuuuuaagucucaccaaaaaggugga

SEQ ID NO: 285006 - RNA, 32 nt, Human
aaagucaaacuucugcauccucuugugaugag

SEQ ID NO: 285007 - RNA, 32 nt, Human
aaagucaacgacaccauuaucuugucaagauc

SEQ ID NO: 285008 - RNA, 32 nt, Human
aaagucaagagcuaaggagggagggagagggu

SEQ ID NO: 285009 - RNA, 32 nt, Human
aaagucaagcccuuucuuuguucauugcucag

SEQ ID NO: 285010 - RNA, 32 nt, Human
aaagucacaagggggccugagugcaguggcuc

SEQ ID NO: 285011 - RNA, 32 nt, Human
aaagucacaggcaucuggaaguguggcccaag

SEQ ID NO: 285012 - RNA, 32 nt, Human
aaagucacagucagguuccagacuguuaagag

SEQ ID NO: 285013 - RNA, 32 nt, Human
aaagucacugguccuuucucagccucucucgu

SEQ ID NO: 285014 - RNA, 32 nt, Human
aaagucacuuuccuauuagacuucuugaaaaa

SEQ ID NO: 285015 - RNA, 32 nt, Human
aaagucagaaaccacauuuucuccucagaagu

SEQ ID NO: 285016 - RNA, 32 nt, Human
aaagucagaaaugcuacugcuuuuuccaagaa

SEQ ID NO: 285017 - RNA, 32 nt, Human
aaagucagaacaggccaggcccgguggcucac

SEQ ID NO: 285018 - RNA, 32 nt, Human
aaagucagaugccaccuaccagggucuacagu

SEQ ID NO: 285019 - RNA, 32 nt, Human
aaagucagaugugccacugaacuugacagaca

SEQ ID NO: 285020 - RNA, 32 nt, Human
aaagucagcauuuuccuugagcuaaauaccua

SEQ ID NO: 285021 - RNA, 32 nt, Human
aaagucagcucucauaacuaaguuaauuuagu

SEQ ID NO: 285022 - RNA, 32 nt, Human
aaagucagcuucuuggauacagacacacccag

SEQ ID NO: 285023 - RNA, 32 nt, Human
aaagucagcuuggagaggagaucaugaucuuu

SEQ ID NO: 285024 - RNA, 32 nt, Human
aaagucaggauggggagacagaagacuucugu

SEQ ID NO: 285025 - RNA, 31 nt, Human
aaagucaggcucggaguuggcauucaucauu

SEQ ID NO: 285026 - RNA, 32 nt, Human
aaagucagggaaaggggagaagaaagaaaaac

SEQ ID NO: 285027 - RNA, 32 nt, Human
aaagucagggagcugggggagcuguucacuuu

SEQ ID NO: 285028 - RNA, 32 nt, Human
aaagucagucagggugaaagagaauugguugc

SEQ ID NO: 285029 - RNA, 32 nt, Human
aaagucagugugaagggcagcugugugcgggc

SEQ ID NO: 285030 - RNA, 32 nt, Human
aaagucaguucugguggcccuggacuuuggag

SEQ ID NO: 285031 - RNA, 32 nt, Human
aaagucaguuuaggcugggcgcaguggcucac

SEQ ID NO: 285032 - RNA, 32 nt, Human
aaagucaguuuaggcugggcgcgguggcucac

SEQ ID NO: 285033 - RNA, 32 nt, Human
aaagucauaagaaucuaucacuaaguaaugua

SEQ ID NO: 285034 - RNA, 32 nt, Human
aaagucaucaagggcugggaggauggaaugcu

SEQ ID NO: 285035 - RNA, 32 nt, Human
aaagucaugcaaaggcugggaccacgugagau

SEQ ID NO: 285036 - RNA, 32 nt, Human
aaagucauggggcaaugaaggacuuggccaag

SEQ ID NO: 285037 - RNA, 32 nt, Human
aaagucauggugccugcaucccugccaagccc

SEQ ID NO: 285038 - RNA, 32 nt, Human
aaagucauuuggguccugggaagcacugggaa

SEQ ID NO: 285039 - RNA, 32 nt, Human
aaaguccacgaaagaccuacucuuucagaagc

SEQ ID NO: 285040 - RNA, 32 nt, Human
aaaguccacugcagccuaggaggguguuuccc

SEQ ID NO: 285041 - RNA, 32 nt, Human
aaaguccagaaacuguucccaccugcuggagu

SEQ ID NO: 285042 - RNA, 32 nt, Human
aaaguccagaucuccaucuccaaaaagaaguc

SEQ ID NO: 285043 - RNA, 32 nt, Human
aaaguccagcucccaaguuuuccuucuccuac

SEQ ID NO: 285044 - RNA, 32 nt, Human
aaaguccaggccuuugggggaggcugggagag

SEQ ID NO: 285045 - RNA, 32 nt, Human
aaaguccaggguaaagcuaaaaguugauaagu

SEQ ID NO: 285046 - RNA, 32 nt, Human
aaagucccaccaacuaccagaccagaacacga

SEQ ID NO: 285047 - RNA, 32 nt, Human
aaagucccagagccagcagagcaggcugacga

SEQ ID NO: 285048 - RNA, 32 nt, Human
aaagucccaggcugcccaacccucucugggac

SEQ ID NO: 285049 - RNA, 32 nt, Human
aaaguccccugcucccuggacuucuccugggu

SEQ ID NO: 285050 - RNA, 32 nt, Human
aaagucccugccuuccacaccucucucuaguc

SEQ ID NO: 285051 - RNA, 32 nt, Human
aaaguccuagaagaaagagcagagagggagac

SEQ ID NO: 285052 - RNA, 32 nt, Human
aaaguccuccagggccucugaggaugggggca

SEQ ID NO: 285053 - RNA, 32 nt, Human
aaaguccucuuccuggcucauccuggcucaaa

SEQ ID NO: 285054 - RNA, 32 nt, Human
aaaguccuggccaccuguuaugugccacauug

SEQ ID NO: 285055 - RNA, 32 nt, Human
aaaguccugugcugauucauugcaaugaugac

SEQ ID NO: 285056 - RNA, 32 nt, Human
aaaguccuugcuccuggugaauucgguaacca

SEQ ID NO: 285057 - RNA, 32 nt, Human
aaaguccuuugagcuccugggaacagguggug

SEQ ID NO: 285058 - RNA, 31 nt, Human
aaaguccuuugguaaaugcuguugaauugga

SEQ ID NO: 285059 - RNA, 32 nt, Human
aaagucgagguuucccuguguugcccaggcug

SEQ ID NO: 285060 - RNA, 32 nt, Human
aaagucgccugacaguuaaagcagaggacuac

SEQ ID NO: 285061 - RNA, 32 nt, Human
aaagucggcaccagaugaagaaaaugaaucac

SEQ ID NO: 285062 - RNA, 32 nt, Human
aaagucggcugccacaccaugcccucggcagu

SEQ ID NO: 285063 - RNA, 32 nt, Human
aaagucggcugugaccuccuguccccagagcu

SEQ ID NO: 285064 - RNA, 32 nt, Human
aaagucuacaguuccaaagaacaaaagauucc

SEQ ID NO: 285065 - RNA, 32 nt, Human
aaagucuagccuugcccgagcuuuccuuacaa

SEQ ID NO: 285066 - RNA, 32 nt, Human
aaagucucaagcacagcuucaagugaaguuaa

SEQ ID NO: 285067 - RNA, 32 nt, Human
aaagucucagcaggccccugagggagggagcu

SEQ ID NO: 285068 - RNA, 32 nt, Human
aaagucucagcccaguucaauucaguugaucu

SEQ ID NO: 285069 - RNA, 32 nt, Human
aaagucucauaguguuaacacugguucugcaa

SEQ ID NO: 285070 - RNA, 32 nt, Human
aaagucuccagaagucuaaccccagauaaaua

SEQ ID NO: 285071 - RNA, 32 nt, Human
aaagucucuccacugaucugucuuccaguccu

SEQ ID NO: 285072 - RNA, 32 nt, Human
aaagucucuccccaagggcagccuuuguuacu

SEQ ID NO: 285073 - RNA, 32 nt, Human
aaagucucugaacaauucucucuaauacauau

SEQ ID NO: 285074 - RNA, 32 nt, Human
aaagucucugcucucucuuccuaugaucacag

SEQ ID NO: 285075 - RNA, 32 nt, Human
aaagucucugugcaguggaagcaaaacugagu

SEQ ID NO: 285076 - RNA, 32 nt, Human
aaagucucuucugccacugacgcccccaucag

SEQ ID NO: 285077 - RNA, 22 nt, Human
aaagucugaacugaacagaaca

SEQ ID NO: 285078 - RNA, 32 nt, Human
aaagucugagccaccagccacaccugacaggg

SEQ ID NO: 285079 - RNA, 19 nt, Human
aaagucugagcccggaaca

SEQ ID NO: 285080 - RNA, 23 nt, Human
aaagucugaguucuguggacaua

SEQ ID NO: 285081 - RNA, 32 nt, Human
aaagucugauucagaccagggacucuauuuua

SEQ ID NO: 285082 - RNA, 32 nt, Human
aaagucugcugugggugaggagguagguaggu

SEQ ID NO: 285083 - RNA, 32 nt, Human
aaagucugcuguucuucccccugggcccccuu

SEQ ID NO: 285084 - RNA, 32 nt, Human
aaagucuggggagccacaggagagggaccuug

SEQ ID NO: 285085 - RNA, 32 nt, Human
aaagucuguaugacacaagaagagucaccuaa

SEQ ID NO: 285086 - RNA, 32 nt, Human
aaagucugucauggggaagcuauauuuuugag

SEQ ID NO: 285087 - RNA, 32 nt, Human
aaagucuucaagaagugcaauggcuacuucua

SEQ ID NO: 285088 - RNA, 32 nt, Human
aaagucuucagaccaggcaugguggcucaugc

SEQ ID NO: 285089 - RNA, 32 nt, Human
aaagucuuccucuggaaauacauaucacugca

SEQ ID NO: 285090 - RNA, 32 nt, Human
aaagucuucugacuuccagucuuucaccagau

SEQ ID NO: 285091 - RNA, 32 nt, Human
aaagucuugaccuucauggggucugggacaau

SEQ ID NO: 285092 - RNA, 32 nt, Human
aaagucuuguguuuaaggagcaagacaggaag

SEQ ID NO: 285093 - RNA, 32 nt, Human
aaagucuuucaucaccagauuucacagguguu

SEQ ID NO: 285094 - RNA, 32 nt, Human
aaagucuuugcugcugugcugggcaccaccca

SEQ ID NO: 285095 - RNA, 31 nt, Human
aaagugaaagcaauggaaaaagagaugaaau

SEQ ID NO: 285096 - RNA, 32 nt, Human
aaagugaacacccugaacugggauuaucugca

SEQ ID NO: 285097 - RNA, 21 nt, Human
aaagugaacggaucacugggg

SEQ ID NO: 285098 - RNA, 32 nt, Human
aaagugaagagagguucguacuucucauaauu

SEQ ID NO: 285099 - RNA, 32 nt, Human
aaagugaaggcagagugagcagguaagagagg

SEQ ID NO: 285100 - RNA, 32 nt, Human
aaagugaaggggagcuccggaagaaccuggag

SEQ ID NO: 285101 - RNA, 20 nt, Human
aaagugaagggguuaauucc

SEQ ID NO: 285102 - RNA, 24 nt, Human
aaagugaagguguagauaauaccu

SEQ ID NO: 285103 - RNA, 32 nt, Human
aaagugaaucagagaagagcagagggagugcu

SEQ ID NO: 285104 - RNA, 32 nt, Human
aaagugaccagaagauuguacuuccuagagau

SEQ ID NO: 285105 - RNA, 32 nt, Human
aaagugaccuggacaaggcugaccucagugcc

SEQ ID NO: 285106 - RNA, 31 nt, Human
aaagugacugagagagggcugauaaacuagg

SEQ ID NO: 285107 - RNA, 32 nt, Human
aaagugagaagccacagaaauggagaguggaa

SEQ ID NO: 285108 - RNA, 32 nt, Human
aaagugagagaagagagagaugucccagagac

SEQ ID NO: 285109 - RNA, 31 nt, Human
aaagugagagugaaccuaaaggguaucugga

SEQ ID NO: 285110 - RNA, 32 nt, Human
aaagugagaugggggaugggagagggguccca

SEQ ID NO: 285111 - RNA, 32 nt, Human
aaagugagcuggaucuuugaagcacaaaugca

SEQ ID NO: 285112 - RNA, 32 nt, Human
aaagugaggagaagcugcaagggaaaagggag

SEQ ID NO: 285113 - RNA, 32 nt, Human
aaagugaggccaacacacagggcaaguggugu

SEQ ID NO: 285114 - RNA, 17 nt, Human
aaagugauccaguucaa

SEQ ID NO: 285115 - RNA, 32 nt, Human
aaagugaucuccuagcuuguaagcaaacugag

SEQ ID NO: 285116 - RNA, 19 nt, Human
aaagugaucucuuaaugua

SEQ ID NO: 285117 - RNA, 32 nt, Human
aaagugaugacauagcaguuacagagggugau

SEQ ID NO: 285118 - RNA, 32 nt, Human
aaagugaugaggaggaagaagagggcuguggu

SEQ ID NO: 285119 - RNA, 32 nt, Human
aaagugaugcagcucacuuccacccacauucg

SEQ ID NO: 285120 - RNA, 32 nt, Human
aaagugauuacaaauauuaccuccaggguuca

SEQ ID NO: 285121 - RNA, 32 nt, Human
aaagugcaauauuugaguaucacugcgagaug

SEQ ID NO: 285122 - RNA, 32 nt, Human
aaagugcacugaggaagguggccccaagagaa

SEQ ID NO: 285123 - RNA, 32 nt, Human
aaagugcagcauggaggaaaaucugaacucua

SEQ ID NO: 285124 - RNA, 32 nt, Human
aaagugcagguguguaaggaaauagaacaguc

SEQ ID NO: 285125 - RNA, 32 nt, Human
aaagugcagguguguaggaaauagaacagucu

SEQ ID NO: 285126 - RNA, 32 nt, Human
aaagugcauacauuuauauaaucuaaucuugg

SEQ ID NO: 285127 - RNA, 32 nt, Human
aaagugcaucagugaagagaugcaagacuuuc

SEQ ID NO: 285128 - RNA, 32 nt, Human
aaagugcaugagccaccaugccuggccuguuu

SEQ ID NO: 285129 - RNA, 32 nt, Human
aaagugcauguauuuuccuuguaaacaccaug

SEQ ID NO: 285130 - RNA, 32 nt, Human
aaagugccaucuuuugaacaguguccccgggg

SEQ ID NO: 285131 - RNA, 32 nt, Human
aaagugccugccugugcucucucccucuccuc

SEQ ID NO: 285132 - RNA, 32 nt, Human
aaagugccuuagcccagguuccugggcuucug

SEQ ID NO: 285133 - RNA, 32 nt, Human
aaagugccuuaggauagcuugggaugagaugu

SEQ ID NO: 285134 - RNA, 32 nt, Human
aaagugcuagauuacaggcgugggccaugacc

SEQ ID NO: 285135 - RNA, 32 nt, Human
aaagugcucaagacaaucaaucaggucucgag

SEQ ID NO: 285136 - RNA, 32 nt, Human
aaagugcucacugcagcucagaucaguccuca

SEQ ID NO: 285137 - RNA, 22 nt, Human
aaagugcuggaauuacaggcgu

SEQ ID NO: 285138 - RNA, 32 nt, Human
aaagugcuggauuacaggcgugagccaccaca

SEQ ID NO: 285139 - RNA, 32 nt, Human
aaagugcuggauuacaggcgugagccaccgug

SEQ ID NO: 285140 - RNA, 32 nt, Human
aaagugcuggauuacaggcgugagccacugag

SEQ ID NO: 285141 - RNA, 21 nt, Human
aaagugcuggauuacagggau

SEQ ID NO: 285142 - RNA, 32 nt, Human
aaagugcuggauuacagggaugagccaccaua

SEQ ID NO: 285143 - RNA, 32 nt, Human
aaagugcuggauuacaggugugagccaccacg

SEQ ID NO: 285144 - RNA, 32 nt, Human
aaagugcuggauuacaggugugagccacccug

SEQ ID NO: 285145 - RNA, 32 nt, Human
aaagugcugggaucacaggugggagccacugu

SEQ ID NO: 285146 - RNA, 22 nt, Human
aaagugcugggauuacaggcau

SEQ ID NO: 285147 - RNA, 22 nt, Human
aaagugcugggauuacaggcgu

SEQ ID NO: 285148 - RNA, 32 nt, Human
aaagugcugggauuacaggugggagccacaac

SEQ ID NO: 285149 - RNA, 32 nt, Human
aaagugcugggauuacaggugggagccaccgc

SEQ ID NO: 285150 - RNA, 32 nt, Human
aaagugcugggauuacaggugggagccacuac

SEQ ID NO: 285151 - RNA, 22 nt, Human
aaagugcugggauuacaggugu

SEQ ID NO: 285152 - RNA, 21 nt, Human
aaagugcugggauuacuagca

SEQ ID NO: 285153 - RNA, 32 nt, Human
aaagugcugggauuacuuuacaggcgugagcc

SEQ ID NO: 285154 - RNA, 32 nt, Human
aaagugcugggauuaggugugagccaccgcac

SEQ ID NO: 285155 - RNA, 32 nt, Human
aaagugcugggauuccaggugggagccacugc

SEQ ID NO: 285156 - RNA, 32 nt, Human
aaagugcugggauugcaggugugaacugccac

SEQ ID NO: 285157 - RNA, 22 nt, Human
aaagugcuggguuuacaggcau

SEQ ID NO: 285158 - RNA, 32 nt, Human
aaagugcugucucuucaagucaucuuuugcag

SEQ ID NO: 285159 - RNA, 32 nt, Human
aaagugcuuguuuuaucauacuuccugccucu

SEQ ID NO: 285160 - RNA, 32 nt, Human
aaagugcuuucccagaauacaggauuuaauac

SEQ ID NO: 285161 - RNA, 32 nt, Human
aaagugcuuugacuucuugcuucagucaucag

SEQ ID NO: 285162 - RNA, 32 nt, Human
aaagugcuuuugcccuacuuguguucuaguuu

SEQ ID NO: 285163 - RNA, 32 nt, Human
aaaguggaaccagcugucccuccagcaaaaac

SEQ ID NO: 285164 - RNA, 32 nt, Human
aaaguggaacugcuuuuuacaguuaaagggcu

SEQ ID NO: 285165 - RNA, 32 nt, Human
aaaguggaagauguggccaagaugcauguuuu

SEQ ID NO: 285166 - RNA, 32 nt, Human
aaaguggaccaauagggcugagcucucugugg

SEQ ID NO: 285167 - RNA, 32 nt, Human
aaaguggagauuuggacacagaaagacacaaa

SEQ ID NO: 285168 - RNA, 32 nt, Human
aaaguggauccagugucagcuccagccuauuc

SEQ ID NO: 285169 - RNA, 32 nt, Human
aaaguggaugaucagcucacuaccacaucaaa

SEQ ID NO: 285170 - RNA, 32 nt, Human
aaaguggaugccugcugcaucuucccacagug

SEQ ID NO: 285171 - RNA, 21 nt, Human
aaaguggauggguucuggggu

SEQ ID NO: 285172 - RNA, 32 nt, Human
aaaguggcaaaagcuaaaaguaaggauuuauc

SEQ ID NO: 285173 - RNA, 32 nt, Human
aaaguggccauccugaaaccuaguguugcugu

SEQ ID NO: 285174 - RNA, 32 nt, Human
aaaguggcgaugauaguaccuaccucacucug

SEQ ID NO: 285175 - RNA, 32 nt, Human
aaaguggcgcaaccucugccucccaggucaaa

SEQ ID NO: 285176 - RNA, 32 nt, Human
aaaguggcuaugggcaggucucuccuucccua

SEQ ID NO: 285177 - RNA, 32 nt, Human
aaaguggcuugguuccccaucuccucgccagc

SEQ ID NO: 285178 - RNA, 32 nt, Human
aaagugggaaauaugagauaguauuuagaauu

SEQ ID NO: 285179 - RNA, 32 nt, Human
aaagugggagagauaggaggagggaaugacag

SEQ ID NO: 285180 - RNA, 32 nt, Human
aaagugggccucugcacaaggcugcuuggaug

SEQ ID NO: 285181 - RNA, 32 nt, Human
aaagugggccugggcagucaggcuccagggcc

SEQ ID NO: 285182 - RNA, 23 nt, Human
aaagugggcggaucaccugaggc

SEQ ID NO: 285183 - RNA, 23 nt, Human
aaagugggcggaucaccugaggu

SEQ ID NO: 285184 - RNA, 32 nt, Human
aaagugggggccggggaucugcaucuagccug

SEQ ID NO: 285185 - RNA, 32 nt, Human
aaagugggggcugcuaccucacuacuuugaug

SEQ ID NO: 285186 - RNA, 32 nt, Human
aaaguggggugagggcuucgccgcuaggaaca

SEQ ID NO: 285187 - RNA, 32 nt, Human
aaaguggguacuuggaagggcaaaaaucaucc

SEQ ID NO: 285188 - RNA, 32 nt, Human
aaagugggucagcgggcacagaauggcccaau

SEQ ID NO: 285189 - RNA, 23 nt, Human
aaaguggguggaucaccugaggu

SEQ ID NO: 285190 - RNA, 32 nt, Human
aaagugguccaugucugugcuggcuggaagag

SEQ ID NO: 285191 - RNA, 32 nt, Human
aaaguggucugcauuucuacuguaaaaugcaa

SEQ ID NO: 285192 - RNA, 32 nt, Human
aaaguggucuucuccagcuagcccuuaugaau

SEQ ID NO: 285193 - RNA, 32 nt, Human
aaaguggugaugucucgggaacccaccccacc

SEQ ID NO: 285194 - RNA, 32 nt, Human
aaagugguuagguuuggaaaagagaugaugau

SEQ ID NO: 285195 - RNA, 32 nt, Human
aaagugguucccugcccugccugcuccuggcc

SEQ ID NO: 285196 - RNA, 32 nt, Human
aaaguguagcagccuccugccugcuccaagaa

SEQ ID NO: 285197 - RNA, 32 nt, Human
aaaguguaucugcugcuccuagggccaugcuu

SEQ ID NO: 285198 - RNA, 32 nt, Human
aaagugucaccuaugacaagagcagugaaggu

SEQ ID NO: 285199 - RNA, 32 nt, Human
aaagugucauauucucagacuugugaggcggu

SEQ ID NO: 285200 - RNA, 22 nt, Human
aaagugucauguucagcaccaa

SEQ ID NO: 285201 - RNA, 32 nt, Human
aaagugucuaacuucauggcuauggccuuuug

SEQ ID NO: 285202 - RNA, 32 nt, Human
aaagugucugggauguucucuccucuguacug

SEQ ID NO: 285203 - RNA, 32 nt, Human
aaagugucuucccaucagucccugcacuggga

SEQ ID NO: 285204 - RNA, 32 nt, Human
aaagugugcagagggcucagcagagaacagua

SEQ ID NO: 285205 - RNA, 32 nt, Human
aaaguguggaauuggggugaggggagcaaggg

SEQ ID NO: 285206 - RNA, 32 nt, Human
aaaguguggacagaaggagcuacugaaggcaa

SEQ ID NO: 285207 - RNA, 32 nt, Human
aaaguguggccuuugggcucugccaucugggg

SEQ ID NO: 285208 - RNA, 32 nt, Human
aaagugugggauuauagugugagccaccgcgu

SEQ ID NO: 285209 - RNA, 32 nt, Human
aaaguguguacagggccgggugcaguggcuca

SEQ ID NO: 285210 - RNA, 32 nt, Human
aaagugugucuuuccagcucugauuuauucaa

SEQ ID NO: 285211 - RNA, 32 nt, Human
aaaguguguuuaauaaauuacuuccugcuggu

SEQ ID NO: 285212 - RNA, 32 nt, Human
aaaguguuaaagauuaggauugaagucacuga

SEQ ID NO: 285213 - RNA, 32 nt, Human
aaaguguuaccaguuuacaaaaauaagucuuu

SEQ ID NO: 285214 - RNA, 32 nt, Human
aaaguguuccagcauaguccuguggauaaccc

SEQ ID NO: 285215 - RNA, 32 nt, Human
aaaguguucugaggcacauagcagaggagcug

SEQ ID NO: 285216 - RNA, 32 nt, Human
aaaguguuggauuacaggugugagccaccaca

SEQ ID NO: 285217 - RNA, 32 nt, Human
aaaguguuuagcacagugucuuucauaaaaau

SEQ ID NO: 285218 - RNA, 32 nt, Human
aaaguguuugccaaagcucaggagagacacag

SEQ ID NO: 285219 - RNA, 32 nt, Human
aaaguuaaaaacaaacauaggaaaugugaaaa

SEQ ID NO: 285220 - RNA, 32 nt, Human
aaaguuaaacagcauucuucacugcaggacau

SEQ ID NO: 285221 - RNA, 32 nt, Human
aaaguuaaaugagaucauuacugugaacccug

SEQ ID NO: 285222 - RNA, 32 nt, Human
aaaguuaaccaccaccaucucucuccucuuca

SEQ ID NO: 285223 - RNA, 32 nt, Human
aaaguuaacuguuuggaaaaacauuucucuuu

SEQ ID NO: 285224 - RNA, 24 nt, Human
aaaguuaagacagauuuuugcuaa

SEQ ID NO: 285225 - RNA, 32 nt, Human
aaaguuaagagguucaccagggccaagccacg

SEQ ID NO: 285226 - RNA, 32 nt, Human
aaaguuaagcauuaaucagauauuucauuuuu

SEQ ID NO: 285227 - RNA, 32 nt, Human
aaaguuaaggaacuagggaaaagagauggaaa

SEQ ID NO: 285228 - RNA, 32 nt, Human
aaaguuaaggaagggggugaggauguggguug

SEQ ID NO: 285229 - RNA, 32 nt, Human
aaaguuaaguacuguaaguguucuuaaaaccu

SEQ ID NO: 285230 - RNA, 32 nt, Human
aaaguuacaaguguccaagccagaaccugaug

SEQ ID NO: 285231 - RNA, 32 nt, Human
aaaguuacacagaacuccuggcugaucucuuu

SEQ ID NO: 285232 - RNA, 32 nt, Human
aaaguuaccugacacacauauaaacacaagga

SEQ ID NO: 285233 - RNA, 32 nt, Human
aaaguuacgcuccuaugcaacaucugauuggu

SEQ ID NO: 285234 - RNA, 32 nt, Human
aaaguuagaagaaaggauugauucaagaaaga

SEQ ID NO: 285235 - RNA, 22 nt, Human
aaaguuagaagacauuugcuaa

SEQ ID NO: 285236 - RNA, 32 nt, Human
aaaguuagccuauauuuugccugagggaugug

SEQ ID NO: 285237 - RNA, 19 nt, Human
aaaguuauacuccugugua

SEQ ID NO: 285238 - RNA, 32 nt, Human
aaaguuaucucuucccaggagaggcuagaagu

SEQ ID NO: 285239 - RNA, 32 nt, Human
aaaguuaugaagcucaucacagcgaaccaggu

SEQ ID NO: 285240 - RNA, 32 nt, Human
aaaguuaugcuaacaugcuaacuuuccacaca

SEQ ID NO: 285241 - RNA, 32 nt, Human
aaaguuauggagcaugaaaagacugaagggcc

SEQ ID NO: 285242 - RNA, 32 nt, Human
aaaguuauggugcugaugguacucucugcugg

SEQ ID NO: 285243 - RNA, 32 nt, Human
aaaguuauucagaugguuuucccaggcuaaag

SEQ ID NO: 285244 - RNA, 32 nt, Human
aaaguuauuugcucacuauccccagccucaag

SEQ ID NO: 285245 - RNA, 32 nt, Human
aaaguucaauugagugguuacagucuagggca

SEQ ID NO: 285246 - RNA, 32 nt, Human
aaaguucagaggaggccugagaagaagguccu

SEQ ID NO: 285247 - RNA, 32 nt, Human
aaaguucagccuggauccccagccucugccaa

SEQ ID NO: 285248 - RNA, 32 nt, Human
aaaguucagcuaaccuuugacacugcuagugc

SEQ ID NO: 285249 - RNA, 32 nt, Human
aaaguucagcuuccuuccccaggucucugugc

SEQ ID NO: 285250 - RNA, 32 nt, Human
aaaguucauaucuggagccugaugucuuaacg

SEQ ID NO: 285251 - RNA, 32 nt, Human
aaaguucauuguuguaauuuccuggccuaauu

SEQ ID NO: 285252 - RNA, 32 nt, Human
aaaguuccaagaaacacaagcgacgcagguau

SEQ ID NO: 285253 - RNA, 32 nt, Human
aaaguuccaagugcaaaauuacaguguguuag

SEQ ID NO: 285254 - RNA, 32 nt, Human
aaaguucccagugcuuugaggcuucuucaaaa

SEQ ID NO: 285255 - RNA, 32 nt, Human
aaaguuccuugccuccugccccucucugcuuu

SEQ ID NO: 285256 - RNA, 32 nt, Human
aaaguucgguguugggaggagccccggugaca

SEQ ID NO: 285257 - RNA, 32 nt, Human
aaaguucucaacugcaaaguuugcuguccggc

SEQ ID NO: 285258 - RNA, 32 nt, Human
aaaguucucccuucccuuugcaggagccugaa

SEQ ID NO: 285259 - RNA, 32 nt, Human
aaaguucuccggcagcccugagaucucaagag

SEQ ID NO: 285260 - RNA, 32 nt, Human
aaaguucuccugggacaucuucugcucuucug

SEQ ID NO: 285261 - RNA, 32 nt, Human
aaaguucucuauccucccuccuggcuggaguu

SEQ ID NO: 285262 - RNA, 32 nt, Human
aaaguucugaagugccuugagaacaugugggu

SEQ ID NO: 285263 - RNA, 32 nt, Human
aaaguugaaagaauaaaucuagaaauaaaaau

SEQ ID NO: 285264 - RNA, 32 nt, Human
aaaguugaagauuauaaauaccucuggagagc

SEQ ID NO: 285265 - RNA, 32 nt, Human
aaaguugagaacugcuuucucuaccuuuugca

SEQ ID NO: 285266 - RNA, 31 nt, Human
aaaguugcacuuuucaagaugugagaaggua

SEQ ID NO: 285267 - RNA, 32 nt, Human
aaaguugccuucagaaggugggaagaucauug

SEQ ID NO: 285268 - RNA, 24 nt, Human
aaaguugccuucugaaagggcaca

SEQ ID NO: 285269 - RNA, 22 nt, Human
aaaguugcugcaaggcugcagg

SEQ ID NO: 285270 - RNA, 32 nt, Human
aaaguuggaaacacagaucugugcaguucuac

SEQ ID NO: 285271 - RNA, 32 nt, Human
aaaguuggauacugacagucucuaauaguuua

SEQ ID NO: 285272 - RNA, 32 nt, Human
aaaguuggccaagauaccaagaagguggcuug

SEQ ID NO: 285273 - RNA, 32 nt, Human
aaaguuggcgguuaucaccagacugugaguuu

SEQ ID NO: 285274 - RNA, 32 nt, Human
aaaguugggagcauggcagacagggaagggaa

SEQ ID NO: 285275 - RNA, 32 nt, Human
aaaguugguagaaacuuauuuuugcuuuguau

SEQ ID NO: 285276 - RNA, 32 nt, Human
aaaguugguccucuuuccccagacccuguggg

SEQ ID NO: 285277 - RNA, 32 nt, Human
aaaguugguguuuuugguugaugagaauuuac

SEQ ID NO: 285278 - RNA, 31 nt, Human
aaaguuguaacauacauacauuuaaaaugga

SEQ ID NO: 285279 - RNA, 32 nt, Human
aaaguugucaucucucuguaauagauaauggc

SEQ ID NO: 285280 - RNA, 32 nt, Human
aaaguugucuucuguccacgagcaccacaguc

SEQ ID NO: 285281 - RNA, 32 nt, Human
aaaguuguuaucuuuaaauacauguacaaauc

SEQ ID NO: 285282 - RNA, 32 nt, Human
aaaguuguugaauauaauccuuagugaagaca

SEQ ID NO: 285283 - RNA, 21 nt, Human
aaaguuuaaagauuuuugcua

SEQ ID NO: 285284 - RNA, 32 nt, Human
aaaguuuaaugaagaggcuagaggaggagaua

SEQ ID NO: 285285 - RNA, 32 nt, Human
aaaguuuacagaaccauaaacauucucaauuu

SEQ ID NO: 285286 - RNA, 32 nt, Human
aaaguuuacugauuccuggugaguauauuaaa

SEQ ID NO: 285287 - RNA, 32 nt, Human
aaaguuuaucuugggaguugaguugucaagag

SEQ ID NO: 285288 - RNA, 32 nt, Human
aaaguuucacauuuaguuagaagaacuuuaaa

SEQ ID NO: 285289 - RNA, 32 nt, Human
aaaguuucagcuuuuugcuucugugaugaacu

SEQ ID NO: 285290 - RNA, 32 nt, Human
aaaguuucauucacggauguuuguugaaugcu

SEQ ID NO: 285291 - RNA, 32 nt, Human
aaaguuuccagccugggccccucuugggccuu

SEQ ID NO: 285292 - RNA, 32 nt, Human
aaaguuucuugcuucuccuuuuuaauuucuaa

SEQ ID NO: 285293 - RNA, 32 nt, Human
aaaguuuggaauauuuguguuauacuuaccag

SEQ ID NO: 285294 - RNA, 32 nt, Human
aaaguuuggacaguauuuaaauauugcaaaua

SEQ ID NO: 285295 - RNA, 32 nt, Human
aaaguuuggaggagggaggcaggaggugaggu

SEQ ID NO: 285296 - RNA, 32 nt, Human
aaaguuugggcagagggaaccaggcacguuaa

SEQ ID NO: 285297 - RNA, 32 nt, Human
aaaguuugucauucaccucaguggagugacuu

SEQ ID NO: 285298 - RNA, 32 nt, Human
aaaguuuuccaaauucaugcauuucaguuauc

SEQ ID NO: 285299 - RNA, 32 nt, Human
aaaguuuuccaaguaauacuggagguccguca

SEQ ID NO: 285300 - RNA, 32 nt, Human
aaaguuuuccuuucaucuuugacuguaagaug

SEQ ID NO: 285301 - RNA, 32 nt, Human
aaaguuuucuuggcugggaaugguggcucaua

SEQ ID NO: 285302 - RNA, 32 nt, Human
aaaguuuuuagaauguugaaaaguaauugaaa

SEQ ID NO: 285303 - RNA, 32 nt, Human
aaauaaaaacaguaucucgcuucuggcucauu

SEQ ID NO: 285304 - RNA, 32 nt, Human
aaauaaaaacuaaauuguaaacuccugaaaaa

SEQ ID NO: 285305 - RNA, 32 nt, Human
aaauaaaaagacgaggaggagaagaaacuuug

SEQ ID NO: 285306 - RNA, 32 nt, Human
aaauaaaaagcccaucuucugauaacugcgug

SEQ ID NO: 285307 - RNA, 32 nt, Human
aaauaaaaaugacuucaccauuuucaccacac

SEQ ID NO: 285308 - RNA, 32 nt, Human
aaauaaaaauuagccaggcaugguggcacacg

SEQ ID NO: 285309 - RNA, 32 nt, Human
aaauaaaaauuagcugggcaauuggcgggcau

SEQ ID NO: 285310 - RNA, 32 nt, Human
aaauaaaaauuagcugggcaugguggcacgug

SEQ ID NO: 285311 - RNA, 20 nt, Human
aaauaaaacaaaacaaaaca

SEQ ID NO: 285312 - RNA, 32 nt, Human
aaauaaaacaacaacaaaaugcaucagagagc

SEQ ID NO: 285313 - RNA, 32 nt, Human
aaauaaaacaaggucauuguguuugcaauuga

SEQ ID NO: 285314 - RNA, 32 nt, Human
aaauaaaaccaaaaauagacaacuuuuucuuc

SEQ ID NO: 285315 - RNA, 28 nt, Human
aaauaaaacuauuuaaaauuggcaccau

SEQ ID NO: 285316 - RNA, 32 nt, Human
aaauaaaacuauuuaaaauuggcaccauaaaa

SEQ ID NO: 285317 - RNA, 32 nt, Human
aaauaaaaggauuguugggagguggagggaaa

SEQ ID NO: 285318 - RNA, 32 nt, Human
aaauaaaagguguccuugaauuacugaccacc

SEQ ID NO: 285319 - RNA, 32 nt, Human
aaauaaaagugcagaaaacaaacccaggcgau

SEQ ID NO: 285320 - RNA, 32 nt, Human
aaauaaaaguuuacccuguggcauuuucaaaa

SEQ ID NO: 285321 - RNA, 32 nt, Human
aaauaaaauaaaaauggcuuucccaguccuug

SEQ ID NO: 285322 - RNA, 32 nt, Human
aaauaaaauaaaauguuaaagcaaauucagga

SEQ ID NO: 285323 - RNA, 32 nt, Human
aaauaaaaugcacauaaauuuggaaggaggaa

SEQ ID NO: 285324 - RNA, 32 nt, Human
aaauaaaauguuuuucaggaaacuucguaucu

SEQ ID NO: 285325 - RNA, 32 nt, Human
aaauaaaauuccauuucauugugaccuacucc

SEQ ID NO: 285326 - RNA, 32 nt, Human
aaauaaacaaauacaaagagaaacccacguua

SEQ ID NO: 285327 - RNA, 32 nt, Human
aaauaaacacacacauuaaggagagauuaaac

SEQ ID NO: 285328 - RNA, 32 nt, Human
aaauaaaccuaaacaaugucugacucugaaag

SEQ ID NO: 285329 - RNA, 32 nt, Human
aaauaaaccugacuguaugaagucaauuuaag

SEQ ID NO: 285330 - RNA, 32 nt, Human
aaauaaaccuuaauauuucuucaaauaucucu

SEQ ID NO: 285331 - RNA, 32 nt, Human
aaauaaacugcaaaaaggauucccaggaaacc

SEQ ID NO: 285332 - RNA, 32 nt, Human
aaauaaagaaaagaggaggaggaggaggaaga

SEQ ID NO: 285333 - RNA, 32 nt, Human
aaauaaagaaggauuuggcucuaggaaggcuu

SEQ ID NO: 285334 - RNA, 32 nt, Human
aaauaaagacauucagcacacugugaaaaugu

SEQ ID NO: 285335 - RNA, 32 nt, Human
aaauaaagagcagacugcgauauaguccauuu

SEQ ID NO: 285336 - RNA, 22 nt, Human
aaauaaagcuauuagugucauu

SEQ ID NO: 285337 - RNA, 31 nt, Human
aaauaaaggaaaggaaccggcauuucuggau

SEQ ID NO: 285338 - RNA, 32 nt, Human
aaauaaaggaaaucaguauaucaaagagauau

SEQ ID NO: 285339 - RNA, 32 nt, Human
aaauaaaggauagggauaaaagaggcacccca

SEQ ID NO: 285340 - RNA, 32 nt, Human
aaauaaaggcaaaaucacgacucucgugcaau

SEQ ID NO: 285341 - RNA, 32 nt, Human
aaauaaauaaauaaauacauagccaggcgugg

SEQ ID NO: 285342 - RNA, 32 nt, Human
aaauaaauaacuuaugguaaucuggaauugua

SEQ ID NO: 285343 - RNA, 32 nt, Human
aaauaaauaauacaaaaauuagccgggcaugg

SEQ ID NO: 285344 - RNA, 32 nt, Human
aaauaaauaggcagagcuaaacuaaccccagu

SEQ ID NO: 285345 - RNA, 32 nt, Human
aaauaaaucaaacccaaagaaaguuuauucaa

SEQ ID NO: 285346 - RNA, 32 nt, Human
aaauaaaucacugccaggcuucauucuuccau

SEQ ID NO: 285347 - RNA, 32 nt, Human
aaauaaaugaguauucagcgaggcagauaaca

SEQ ID NO: 285348 - RNA, 32 nt, Human
aaauaaauguacaauuguuuacauaacagaaa

SEQ ID NO: 285349 - RNA, 32 nt, Human
aaauaaauguucuuaaggaaacaacuuaugua

SEQ ID NO: 285350 - RNA, 24 nt, Human
aaauaaauguucuuccucuuuuca

SEQ ID NO: 285351 - RNA, 32 nt, Human
aaauaaauuagccuggcgugguggugugccug

SEQ ID NO: 285352 - RNA, 28 nt, Human
aaauaaauucugauucuucuaaauuaaa

SEQ ID NO: 285353 - RNA, 32 nt, Human
aaauaaauugccucccuuccuccgcuccccuu

SEQ ID NO: 285354 - RNA, 25 nt, Human
aaauaacacacauauaaacaucaca

SEQ ID NO: 285355 - RNA, 32 nt, Human
aaauaacacagcagaggaauagcucagccuga

SEQ ID NO: 285356 - RNA, 32 nt, Human
aaauaacagaugcuggugagguuguggagaaa

SEQ ID NO: 285357 - RNA, 32 nt, Human
aaauaacagcagcagagggaggugggggagag

SEQ ID NO: 285358 - RNA, 32 nt, Human
aaauaacagcagcgucaaggauacaguggcca

SEQ ID NO: 285359 - RNA, 32 nt, Human
aaauaacaggaagauuccaaagacguuuacca

SEQ ID NO: 285360 - RNA, 32 nt, Human
aaauaacaggaguucguucagagaccauuucu

SEQ ID NO: 285361 - RNA, 32 nt, Human
aaauaacagugaaugugcuccugguguauaug

SEQ ID NO: 285362 - RNA, 32 nt, Human
aaauaacaugacgcucguccaaggccacuucc

SEQ ID NO: 285363 - RNA, 32 nt, Human
aaauaacaugaguuuccucuucccucuuugaa

SEQ ID NO: 285364 - RNA, 32 nt, Human
aaauaacauuucagaagagcacaauaugcaua

SEQ ID NO: 285365 - RNA, 32 nt, Human
aaauaacauuuggauuuagguuccuucacuga

SEQ ID NO: 285366 - RNA, 32 nt, Human
aaauaaccaacaaccucuuccaguuugaauuc

SEQ ID NO: 285367 - RNA, 32 nt, Human
aaauaaccaaucuacaaucucccuucacaagu

SEQ ID NO: 285368 - RNA, 32 nt, Human
aaauaaccaccccugaauucccagagaaaagu

SEQ ID NO: 285369 - RNA, 32 nt, Human
aaauaacccauucauagcauagcuagagauug

SEQ ID NO: 285370 - RNA, 32 nt, Human
aaauaaccggaggcaggcugggugcaguggcu

SEQ ID NO: 285371 - RNA, 32 nt, Human
aaauaacuccuccauugaaauaacuccucccc

SEQ ID NO: 285372 - RNA, 32 nt, Human
aaauaacugucugccaaaaugucauuacacag

SEQ ID NO: 285373 - RNA, 32 nt, Human
aaauaacuuauugaugaaauauacaaauauuu

SEQ ID NO: 285374 - RNA, 32 nt, Human
aaauaacuucuuuccauuccuguucauugaua

SEQ ID NO: 285375 - RNA, 32 nt, Human
aaauaacuugcuggcuauauaggaaaaugcug

SEQ ID NO: 285376 - RNA, 32 nt, Human
aaauaacuuggcagccugaggcucuggagugc

SEQ ID NO: 285377 - RNA, 32 nt, Human
aaauaagaaaugcucagucaauaguggcucuc

SEQ ID NO: 285378 - RNA, 32 nt, Human
aaauaagaacacuugggcugggcaugguggcu

SEQ ID NO: 285379 - RNA, 32 nt, Human
aaauaagaaccagcucaaguacaugguuucau

SEQ ID NO: 285380 - RNA, 32 nt, Human
aaauaagaaggagaauaaaacuuagagaaaaa

SEQ ID NO: 285381 - RNA, 21 nt, Human
aaauaagaauauacaugcaca

SEQ ID NO: 285382 - RNA, 32 nt, Human
aaauaagaccuaauauuugauagcacaacagu

SEQ ID NO: 285383 - RNA, 32 nt, Human
aaauaagaccuaguauuugauagcacaaccgg

SEQ ID NO: 285384 - RNA, 32 nt, Human
aaauaagagacacaucgcuccaaaacauuuuu

SEQ ID NO: 285385 - RNA, 31 nt, Human
aaauaagagacuagagauucacuggacgcuu

SEQ ID NO: 285386 - RNA, 32 nt, Human
aaauaagagcuuuuucauuucauuccaucuuu

SEQ ID NO: 285387 - RNA, 32 nt, Human
aaauaagaugacgcuacuccucauagcaccac

SEQ ID NO: 285388 - RNA, 32 nt, Human
aaauaagcaacuugaaagugccuggaaaauug

SEQ ID NO: 285389 - RNA, 32 nt, Human
aaauaagcacugaggaagauucagagacgugu

SEQ ID NO: 285390 - RNA, 32 nt, Human
aaauaagcacugggagauuggaagcacugcua

SEQ ID NO: 285391 - RNA, 32 nt, Human
aaauaagccaggagaggaaggagcggcgggca

SEQ ID NO: 285392 - RNA, 32 nt, Human
aaauaagccugaugaacagaccugccauaaca

SEQ ID NO: 285393 - RNA, 32 nt, Human
aaauaagcugacuguucucucuugagaaccug

SEQ ID NO: 285394 - RNA, 32 nt, Human
aaauaaggagaaaggaaacgcagggagacugu

SEQ ID NO: 285395 - RNA, 32 nt, Human
aaauaaggagccagaggaguuaccuguguccu

SEQ ID NO: 285396 - RNA, 32 nt, Human
aaauaaggagggacaugauggggaaggaguac

SEQ ID NO: 285397 - RNA, 32 nt, Human
aaauaaggaguaaaaaugcauuaccauuuguu

SEQ ID NO: 285398 - RNA, 32 nt, Human
aaauaaggcaucuucuugcugugccuucacuu

SEQ ID NO: 285399 - RNA, 32 nt, Human
aaauaaggccuuguucauggguacugggguua

SEQ ID NO: 285400 - RNA, 32 nt, Human
aaauaaggcuguccccuacaaccuucuuaguc

SEQ ID NO: 285401 - RNA, 32 nt, Human
aaauaagggacugauguucuguuucuuguaau

SEQ ID NO: 285402 - RNA, 32 nt, Human
aaauaagggcaccaacacuccccagccuugcu

SEQ ID NO: 285403 - RNA, 32 nt, Human
aaauaagggcugguauuucuccucuguccuug

SEQ ID NO: 285404 - RNA, 32 nt, Human
aaauaaguaccucaaaugcaugcauuugcacu

SEQ ID NO: 285405 - RNA, 32 nt, Human
aaauaaguagaaaauauaaauuucaucacuaa

SEQ ID NO: 285406 - RNA, 32 nt, Human
aaauaagucaucugaugagaacaagcuauuug

SEQ ID NO: 285407 - RNA, 32 nt, Human
aaauaagucucacauccagccauuccccugag

SEQ ID NO: 285408 - RNA, 22 nt, Human
aaauaagucucauuucuuuuca

SEQ ID NO: 285409 - RNA, 22 nt, Human
aaauaagugaaacuucuuuuua

SEQ ID NO: 285410 - RNA, 32 nt, Human
aaauaagugauuaaaggccucugccucacaac

SEQ ID NO: 285411 - RNA, 32 nt, Human
aaauaagugcaaggaagcagucucuuugguca

SEQ ID NO: 285412 - RNA, 32 nt, Human
aaauaagugcauuccagaagagccgcagcccc

SEQ ID NO: 285413 - RNA, 32 nt, Human
aaauaaguguagacugcugucaaggaggcuuc

SEQ ID NO: 285414 - RNA, 32 nt, Human
aaauaaguuacaccuuaguaucagauauuaau

SEQ ID NO: 285415 - RNA, 32 nt, Human
aaauaaguuucgaacucuggcaccuuucaauu

SEQ ID NO: 285416 - RNA, 32 nt, Human
aaauaauaaaacacaaagagccaggcuuugag

SEQ ID NO: 285417 - RNA, 32 nt, Human
aaauaauaaagugacugaaucagggaggaaaa

SEQ ID NO: 285418 - RNA, 32 nt, Human
aaauaauaacaggcugggugcaauggcucaca

SEQ ID NO: 285419 - RNA, 32 nt, Human
aaauaauaagccaucuaaguguaaaaguggcu

SEQ ID NO: 285420 - RNA, 32 nt, Human
aaauaauagggagguuggggaaguggguuggg

SEQ ID NO: 285421 - RNA, 32 nt, Human
aaauaauaguacacuucugaauuuuuauauaa

SEQ ID NO: 285422 - RNA, 32 nt, Human
aaauaauagugcccuucccauggggucaugug

SEQ ID NO: 285423 - RNA, 32 nt, Human
aaauaaucaucuuuagcucuccucucaguuga

SEQ ID NO: 285424 - RNA, 32 nt, Human
aaauaauccaagacuucucacuggggaauaag

SEQ ID NO: 285425 - RNA, 32 nt, Human
aaauaauccaauggacagaagccccaggaagg

SEQ ID NO: 285426 - RNA, 32 nt, Human
aaauaaucuccccguccaaggagcuuguggaa

SEQ ID NO: 285427 - RNA, 32 nt, Human
aaauaaucugcacuuccagagcucggggccuu

SEQ ID NO: 285428 - RNA, 32 nt, Human
aaauaaucuguagaaucaauugaaguuuaaag

SEQ ID NO: 285429 - RNA, 32 nt, Human
aaauaaucuguguaacaaacccccaugacaca

SEQ ID NO: 285430 - RNA, 32 nt, Human
aaauaaugaaauccaccccugccugcuagaua

SEQ ID NO: 285431 - RNA, 32 nt, Human
aaauaaugaacaaaugaaaguguucauccaga

SEQ ID NO: 285432 - RNA, 32 nt, Human
aaauaaugaacuguuuuccuggcaucuuucaa

SEQ ID NO: 285433 - RNA, 32 nt, Human
aaauaaugaagcagcaugaggggaagguauuu

SEQ ID NO: 285434 - RNA, 32 nt, Human
aaauaaugaauuugaacaccagguuggguuaa

SEQ ID NO: 285435 - RNA, 32 nt, Human
aaauaaugacaccccacugucuccuugcccuc

SEQ ID NO: 285436 - RNA, 32 nt, Human
aaauaaugacaugcucaaccuuccucaucaug

SEQ ID NO: 285437 - RNA, 32 nt, Human
aaauaaugcuuaucacuggcuugcugucaaua

SEQ ID NO: 285438 - RNA, 32 nt, Human
aaauaaugugucacagugcaugguggcccccg

SEQ ID NO: 285439 - RNA, 32 nt, Human
aaauaaugugucacagugcaugguggccucug

SEQ ID NO: 285440 - RNA, 32 nt, Human
aaauaauuauggaacagcucucuggccagcuu

SEQ ID NO: 285441 - RNA, 32 nt, Human
aaauaauuccaacucuuacacacacauuuaau

SEQ ID NO: 285442 - RNA, 32 nt, Human
aaauaauuguucugcugaucuguagugguugc

SEQ ID NO: 285443 - RNA, 32 nt, Human
aaauaauuuauuuuacaaaugagauuauauuu

SEQ ID NO: 285444 - RNA, 32 nt, Human
aaauaauuugcuucuagaccagccucugucua

SEQ ID NO: 285445 - RNA, 32 nt, Human
aaauaauuuuacgaagaaaaacucagcuucug

SEQ ID NO: 285446 - RNA, 32 nt, Human
aaauaauuuuacucaacuauguuuucaacaag

SEQ ID NO: 285447 - RNA, 32 nt, Human
aaauacaaaaauuggcugggcgcgguggugca

SEQ ID NO: 285448 - RNA, 32 nt, Human
aaauacaaaacaauuagcugggugugguggca

SEQ ID NO: 285449 - RNA, 32 nt, Human
aaauacaaaauaaagaucacacaucaagacua

SEQ ID NO: 285450 - RNA, 32 nt, Human
aaauacaaacacaacauggaagugggugugaa

SEQ ID NO: 285451 - RNA, 32 nt, Human
aaauacaaagagaacuuauuuacacagggaag

SEQ ID NO: 285452 - RNA, 32 nt, Human
aaauacaaauccucaggccccaccucagaccu

SEQ ID NO: 285453 - RNA, 32 nt, Human
aaauacaaauguuaauaugugagaaccuagga

SEQ ID NO: 285454 - RNA, 32 nt, Human
aaauacaacgacuucaucgaggccaacugcau

SEQ ID NO: 285455 - RNA, 32 nt, Human
aaauacaagaagcagcugaggaaagggagaca

SEQ ID NO: 285456 - RNA, 32 nt, Human
aaauacaagcuauguuaggaccaaaugcucuu

SEQ ID NO: 285457 - RNA, 32 nt, Human
aaauacaaugacuucaucgaggccaacugcau

SEQ ID NO: 285458 - RNA, 32 nt, Human
aaauacacaaaugaaaaugacaaauuugcuuc

SEQ ID NO: 285459 - RNA, 32 nt, Human
aaauacacaaauuagcuaggcaugguggacuc

SEQ ID NO: 285460 - RNA, 32 nt, Human
aaauacacaauacccauaaugugcacagaaau

SEQ ID NO: 285461 - RNA, 32 nt, Human
aaauacacagcaaugaauggcacacaaguaau

SEQ ID NO: 285462 - RNA, 32 nt, Human
aaauacacagcaugcagacugggaguugcuag

SEQ ID NO: 285463 - RNA, 32 nt, Human
aaauacacaugaaagccagccucggcgggcag

SEQ ID NO: 285464 - RNA, 32 nt, Human
aaauacacgcggguaaacgcugggugacuccg

SEQ ID NO: 285465 - RNA, 32 nt, Human
aaauacacuguggugaaaugcuuccaccucuu

SEQ ID NO: 285466 - RNA, 32 nt, Human
aaauacagagaaggacaagaagcccucaugca

SEQ ID NO: 285467 - RNA, 32 nt, Human
aaauacagagagaaccucuuccacuuuuacuu

SEQ ID NO: 285468 - RNA, 21 nt, Human
aaauacagagugugugucauu

SEQ ID NO: 285469 - RNA, 32 nt, Human
aaauacagauuuggaagaaaugagcugaguag

SEQ ID NO: 285470 - RNA, 32 nt, Human
aaauacagcagaaaaucuacucuuuagcaaua

SEQ ID NO: 285471 - RNA, 32 nt, Human
aaauacagccugucacugugugacacagauug

SEQ ID NO: 285472 - RNA, 32 nt, Human
aaauacagccuuucuggcagguccuccccucu

SEQ ID NO: 285473 - RNA, 32 nt, Human
aaauacaggaaacaguugcauguaguaacacu

SEQ ID NO: 285474 - RNA, 32 nt, Human
aaauacaggagagacacucaagacagaaauaa

SEQ ID NO: 285475 - RNA, 32 nt, Human
aaauacaggcaugauuucuuugccaaguuaau

SEQ ID NO: 285476 - RNA, 32 nt, Human
aaauacaguaacacuaaugauagcuguugaac

SEQ ID NO: 285477 - RNA, 32 nt, Human
aaauacaguagagacagaaacgaagcccagaa

SEQ ID NO: 285478 - RNA, 32 nt, Human
aaauacaguauuuucauuuaaauucucugaug

SEQ ID NO: 285479 - RNA, 32 nt, Human
aaauacaguucugcucugguuguuucuguucc

SEQ ID NO: 285480 - RNA, 32 nt, Human
aaauacaguugcaaucugcaaucugcuguuga

SEQ ID NO: 285481 - RNA, 32 nt, Human
aaauacaguuuuauuucaugaagagaaaugaa

SEQ ID NO: 285482 - RNA, 32 nt, Human
aaauacauacugauaauacauaccucaugaaa

SEQ ID NO: 285483 - RNA, 32 nt, Human
aaauacauccauuccaaaugggagaaauuggc

SEQ ID NO: 285484 - RNA, 32 nt, Human
aaauacaucggagacacaacaaauguggccau

SEQ ID NO: 285485 - RNA, 25 nt, Human
aaauacaugaagcaaaaacugaaag

SEQ ID NO: 285486 - RNA, 32 nt, Human
aaauacauguauaauuguuuacauacuuaaaa

SEQ ID NO: 285487 - RNA, 32 nt, Human
aaauacauguguacagaugagaaacugcaaca

SEQ ID NO: 285488 - RNA, 32 nt, Human
aaauacauucuuccugggguccagagucccca

SEQ ID NO: 285489 - RNA, 32 nt, Human
aaauacauuuccuggguaacuuaggaaauuaa

SEQ ID NO: 285490 - RNA, 32 nt, Human
aaauacauuugaucagacuaggaacaaguuga

SEQ ID NO: 285491 - RNA, 32 nt, Human
aaauacauuuuuccagguugugagugaaaaua

SEQ ID NO: 285492 - RNA, 32 nt, Human
aaauaccaaaaauuucaggcauagcugcugga

SEQ ID NO: 285493 - RNA, 32 nt, Human
aaauaccaaagcaaugaagugcauuggucuua

SEQ ID NO: 285494 - RNA, 32 nt, Human
aaauaccacauggcuucucccgcauaucguca

SEQ ID NO: 285495 - RNA, 32 nt, Human
aaauaccacguucuauuugugcaugggagcua

SEQ ID NO: 285496 - RNA, 32 nt, Human
aaauaccagaaacauacccuaaguccccagaa

SEQ ID NO: 285497 - RNA, 32 nt, Human
aaauaccaggagcagaggugccccagagugcu

SEQ ID NO: 285498 - RNA, 32 nt, Human
aaauaccaguuuuccaaguaaggaguugaugu

SEQ ID NO: 285499 - RNA, 32 nt, Human
aaauaccaucauccucaucauucucuguagcc

SEQ ID NO: 285500 - RNA, 32 nt, Human
aaauaccauguucauuccucuggcucaguuug

SEQ ID NO: 285501 - RNA, 32 nt, Human
aaauaccauuucaggaaugaaaaagaaggaau

SEQ ID NO: 285502 - RNA, 32 nt, Human
aaauaccccacacauuccccagccucucugcc

SEQ ID NO: 285503 - RNA, 32 nt, Human
aaauaccccaggaagguggccuuuguuucaga

SEQ ID NO: 285504 - RNA, 32 nt, Human
aaauacccccucaugccacccaccccagacag

SEQ ID NO: 285505 - RNA, 32 nt, Human
aaauacccuaaccuuuaacugucuugaauuau

SEQ ID NO: 285506 - RNA, 32 nt, Human
aaauacccuuaaggagguucaagcagagugag

SEQ ID NO: 285507 - RNA, 32 nt, Human
aaauacccuuccaccuggaggcucccuugucu

SEQ ID NO: 285508 - RNA, 32 nt, Human
aaauacccuuuauuuucccuuaacuauugaau

SEQ ID NO: 285509 - RNA, 32 nt, Human
aaauaccguguguauauguauguauguguguu

SEQ ID NO: 285510 - RNA, 32 nt, Human
aaauaccucacagauuagaugaaaagaugguu

SEQ ID NO: 285511 - RNA, 32 nt, Human
aaauaccuguaaucccagcacuuugggaggcc

SEQ ID NO: 285512 - RNA, 32 nt, Human
aaauaccuguaccauucccacuugcucuuuga

SEQ ID NO: 285513 - RNA, 32 nt, Human
aaauaccugugugacacagacccacuucagug

SEQ ID NO: 285514 - RNA, 32 nt, Human
aaauaccuuaagaguggauuacaggcaugagc

SEQ ID NO: 285515 - RNA, 32 nt, Human
aaauacgagguuuggccgggugcaguggcuca

SEQ ID NO: 285516 - RNA, 32 nt, Human
aaauacgauuccucaggccgggcacaguggcu

SEQ ID NO: 285517 - RNA, 32 nt, Human
aaauacgccuucuuugcugugugggcuuccag

SEQ ID NO: 285518 - RNA, 32 nt, Human
aaauacgggacccggucucugccuccuggcug

SEQ ID NO: 285519 - RNA, 32 nt, Human
aaauacguacccuuugaaauaccaccuagagg

SEQ ID NO: 285520 - RNA, 32 nt, Human
aaauacguuuuuggcugcgggugcaaagggga

SEQ ID NO: 285521 - RNA, 32 nt, Human
aaauacuaauuauuucuuuguaguguguaaag

SEQ ID NO: 285522 - RNA, 32 nt, Human
aaauacucaaauauauguuuucauuauauaca

SEQ ID NO: 285523 - RNA, 32 nt, Human
aaauacucaccaggacgaggaagaggacuuug

SEQ ID NO: 285524 - RNA, 32 nt, Human
aaauacucauuucuacuuucugcccucaaauu

SEQ ID NO: 285525 - RNA, 32 nt, Human
aaauacucucucuaccuaauaauaacaucaac

SEQ ID NO: 285526 - RNA, 32 nt, Human
aaauacugaaugaggccgggugcaauggcuua

SEQ ID NO: 285527 - RNA, 32 nt, Human
aaauacugagauuacaggugugagccaccaca

SEQ ID NO: 285528 - RNA, 32 nt, Human
aaauacugagccaguccaugugcauuauuuca

SEQ ID NO: 285529 - RNA, 32 nt, Human
aaauacugagucuccacaaccuucuuuggaaa

SEQ ID NO: 285530 - RNA, 32 nt, Human
aaauacugauauuuuaaaugguugacaucauc

SEQ ID NO: 285531 - RNA, 32 nt, Human
aaauacugcaacauguccaguuggccagauca

SEQ ID NO: 285532 - RNA, 32 nt, Human
aaauacugcuggauaaauacugcuggauuuau

SEQ ID NO: 285533 - RNA, 32 nt, Human
aaauacuggccuggccugugccgccccugccc

SEQ ID NO: 285534 - RNA, 32 nt, Human
aaauacugggaguuugcaguuuaucuggaaga

SEQ ID NO: 285535 - RNA, 32 nt, Human
aaauacugggauuacaggcuugagccuccaug

SEQ ID NO: 285536 - RNA, 32 nt, Human
aaauacugggauuacaggggugagucaccaca

SEQ ID NO: 285537 - RNA, 32 nt, Human
aaauacuggggucaucgggaaaggcaaagaaa

SEQ ID NO: 285538 - RNA, 32 nt, Human
aaauacuucagaucacaugaaaaugcugauuu

SEQ ID NO: 285539 - RNA, 32 nt, Human
aaauacuucauuccuuaacucucccucauuug

SEQ ID NO: 285540 - RNA, 31 nt, Human
aaauacuucuuauuuauacauuuaggaaagc

SEQ ID NO: 285541 - RNA, 32 nt, Human
aaauacuugcaaagcauggcacuguggcucug

SEQ ID NO: 285542 - RNA, 32 nt, Human
aaauacuuucacucccuucacuuuacagcaag

SEQ ID NO: 285543 - RNA, 32 nt, Human
aaauacuuuguagcgccagaagccaggagcgg

SEQ ID NO: 285544 - RNA, 32 nt, Human
aaauacuuuuauuuugaauuuaagucuuugca

SEQ ID NO: 285545 - RNA, 32 nt, Human
aaauacuuuucaucaccaauugcccaauucau

SEQ ID NO: 285546 - RNA, 32 nt, Human
aaauagaaaauguaauaacuuucuuaccauua

SEQ ID NO: 285547 - RNA, 32 nt, Human
aaauagaaaaugugaagagugacuauuuacau

SEQ ID NO: 285548 - RNA, 32 nt, Human
aaauagaacuggcggaagcacaagcacaccgu

SEQ ID NO: 285549 - RNA, 32 nt, Human
aaauagacaaagugcuuggagagcauugagaa

SEQ ID NO: 285550 - RNA, 32 nt, Human
aaauagacaucuugccuccucaaguagcuuca

SEQ ID NO: 285551 - RNA, 32 nt, Human
aaauagacggcuagggacugggcacaguggcu

SEQ ID NO: 285552 - RNA, 32 nt, Human
aaauagacucuuccucccuccucuuucacaua

SEQ ID NO: 285553 - RNA, 32 nt, Human
aaauagagaagagcaagagcaacaacaggcac

SEQ ID NO: 285554 - RNA, 32 nt, Human
aaauagagacgggguuucacuguguuggccag

SEQ ID NO: 285555 - RNA, 32 nt, Human
aaauagagauggggucucaccauguuacccag

SEQ ID NO: 285556 - RNA, 32 nt, Human
aaauagagaugggguuucacuauguugccuag

SEQ ID NO: 285557 - RNA, 32 nt, Human
aaauagagcccugggggcagagcuccuggcca

SEQ ID NO: 285558 - RNA, 32 nt, Human
aaauagaggaagaguaagcaaagcaugucaag

SEQ ID NO: 285559 - RNA, 32 nt, Human
aaauagaggagagaaagagagcaugagaggga

SEQ ID NO: 285560 - RNA, 30 nt, Human
aaauagaggcucuccuugcuccuggccuug

SEQ ID NO: 285561 - RNA, 32 nt, Human
aaauagaguauuagucuuuaugucaucauugu

SEQ ID NO: 285562 - RNA, 32 nt, Human
aaauagagucucaacucacucuagccugggug

SEQ ID NO: 285563 - RNA, 32 nt, Human
aaauagauaaaacagaccagaggcucuccuua

SEQ ID NO: 285564 - RNA, 32 nt, Human
aaauagauacaagccuaggagccccagccccc

SEQ ID NO: 285565 - RNA, 32 nt, Human
aaauagauuccaggagcuccaucuauaagcau

SEQ ID NO: 285566 - RNA, 32 nt, Human
aaauagcaaugccucccuaucccucacacauc

SEQ ID NO: 285567 - RNA, 32 nt, Human
aaauagcaauuucgccguugaagaggaagggc

SEQ ID NO: 285568 - RNA, 32 nt, Human
aaauagcacaugggcaauuggcaccaucuuua

SEQ ID NO: 285569 - RNA, 32 nt, Human
aaauagcaccucaagugggguuuaguuuuauu

SEQ ID NO: 285570 - RNA, 32 nt, Human
aaauagcagcaacccaucuuugcaaagaagcu

SEQ ID NO: 285571 - RNA, 32 nt, Human
aaauagcagcagcagaagaaagggacaauggc

SEQ ID NO: 285572 - RNA, 22 nt, Human
aaauagcagcuuuugugucauu

SEQ ID NO: 285573 - RNA, 32 nt, Human
aaauagcaggguggguugggcagcacgugggg

SEQ ID NO: 285574 - RNA, 32 nt, Human
aaauagcagguguuagacgaaagaacagaugu

SEQ ID NO: 285575 - RNA, 32 nt, Human
aaauagcagucauuauucuguccccuucuccc

SEQ ID NO: 285576 - RNA, 32 nt, Human
aaauagcaguuucugcaauucuguugaauaug

SEQ ID NO: 285577 - RNA, 32 nt, Human
aaauagcauaagagcauuuuggaacacaucca

SEQ ID NO: 285578 - RNA, 32 nt, Human
aaauagcauagaaaucacagugugcaaauauc

SEQ ID NO: 285579 - RNA, 32 nt, Human
aaauagcauuauucaagacacagaaagaaagc

SEQ ID NO: 285580 - RNA, 32 nt, Human
aaauagccacauuuaacuccagccuuggguuu

SEQ ID NO: 285581 - RNA, 32 nt, Human
aaauagcccuaauuuacuuauucuuuaaugau

SEQ ID NO: 285582 - RNA, 32 nt, Human
aaauagccuagucuggggagucuuccauaaag

SEQ ID NO: 285583 - RNA, 32 nt, Human
aaauagccucuauuuuguuaagcuacugcugu

SEQ ID NO: 285584 - RNA, 32 nt, Human
aaauagccuggggugucugggcucaggguugg

SEQ ID NO: 285585 - RNA, 32 nt, Human
aaauagccuuucuccugcaaauuuuccuaguc

SEQ ID NO: 285586 - RNA, 32 nt, Human
aaauagcuauugcacuccagccuuggcaacau

SEQ ID NO: 285587 - RNA, 32 nt, Human
aaauagcucagauuugaacagauggauggaaa

SEQ ID NO: 285588 - RNA, 32 nt, Human
aaauagcucucauagucugcuccaucuugaua

SEQ ID NO: 285589 - RNA, 20 nt, Human
aaauagcucugugugucauu

SEQ ID NO: 285590 - RNA, 32 nt, Human
aaauagcugaggggcggccgggccagaacggc

SEQ ID NO: 285591 - RNA, 32 nt, Human
aaauagcuguuuaggaaggugaaauacauuca

SEQ ID NO: 285592 - RNA, 32 nt, Human
aaauagcuuccaggagcuccagcuauaagcuu

SEQ ID NO: 285593 - RNA, 32 nt, Human
aaauagcuucuugucaccuuaaacuaaagcag

SEQ ID NO: 285594 - RNA, 32 nt, Human
aaauaggaagacagaaugucuugucaaggguc

SEQ ID NO: 285595 - RNA, 19 nt, Human
aaauaggaagcugugucau

SEQ ID NO: 285596 - RNA, 32 nt, Human
aaauaggacugaccaagaagcagaaaagcaag

SEQ ID NO: 285597 - RNA, 32 nt, Human
aaauaggagcugcaaaagcaaaaagaauaucu

SEQ ID NO: 285598 - RNA, 32 nt, Human
aaauaggauaagacaaugccagaggaaggaua

SEQ ID NO: 285599 - RNA, 32 nt, Human
aaauaggauaggcuucccuugugcagagggag

SEQ ID NO: 285600 - RNA, 32 nt, Human
aaauaggaugaaacucaaucuuuuucuauugu

SEQ ID NO: 285601 - RNA, 32 nt, Human
aaauaggaugauguuugugagcaccagacuca

SEQ ID NO: 285602 - RNA, 32 nt, Human
aaauaggcagaagucccuugagccacagcaug

SEQ ID NO: 285603 - RNA, 32 nt, Human
aaauaggcaugaugauaagcuaugcagauuau

SEQ ID NO: 285604 - RNA, 32 nt, Human
aaauaggcccacaggccaggugcagacguuua

SEQ ID NO: 285605 - RNA, 32 nt, Human
aaauaggcuauauuucacaauagcccuguuaa

SEQ ID NO: 285606 - RNA, 32 nt, Human
aaauagggaagauggagacaccucuggggguc

SEQ ID NO: 285607 - RNA, 32 nt, Human
aaauagggcugugccaaaggcaagugacaacc

SEQ ID NO: 285608 - RNA, 32 nt, Human
aaauagggcuuuuaaauaaauagauguucugu

SEQ ID NO: 285609 - RNA, 32 nt, Human
aaauaggggcgggcgaagcaucagggcgaauc

SEQ ID NO: 285610 - RNA, 32 nt, Human
aaauaggggugauggagggggagaagcccagg

SEQ ID NO: 285611 - RNA, 19 nt, Human
aaauagggucuuugcagau

SEQ ID NO: 285612 - RNA, 32 nt, Human
aaauagggugggcuccuuuccucagguagagu

SEQ ID NO: 285613 - RNA, 22 nt, Human
aaauaggguuaugugugucauu

SEQ ID NO: 285614 - RNA, 32 nt, Human
aaauagguacgguuuuaaaauauuuuauauag

SEQ ID NO: 285615 - RNA, 32 nt, Human
aaauagguagcucuugggcucauguccugggu

SEQ ID NO: 285616 - RNA, 16 nt, Human
aaauagguggcagcuu

SEQ ID NO: 285617 - RNA, 32 nt, Human
aaauaguaauaauacaaaaauuagcugggcgu

SEQ ID NO: 285618 - RNA, 32 nt, Human
aaauaguacuuuuagcauaagcacuuucugug

SEQ ID NO: 285619 - RNA, 32 nt, Human
aaauaguagaggaggggagagaggcaccuggc

SEQ ID NO: 285620 - RNA, 32 nt, Human
aaauaguccugccugagguugcagugagccga

SEQ ID NO: 285621 - RNA, 32 nt, Human
aaauagugaaggaggccaaggugggcggauca

SEQ ID NO: 285622 - RNA, 32 nt, Human
aaauagugacaacuucucaacuguagaauaga

SEQ ID NO: 285623 - RNA, 32 nt, Human
aaauaguggaacaaaauugaaggguggucagu

SEQ ID NO: 285624 - RNA, 32 nt, Human
aaauagugucauucccauuugagagacagaca

SEQ ID NO: 285625 - RNA, 22 nt, Human
aaauaguuauaugugugucauu

SEQ ID NO: 285626 - RNA, 32 nt, Human
aaauaguucacguuuggagaauucuuuuguac

SEQ ID NO: 285627 - RNA, 32 nt, Human
aaauaguucccaggaagccacauucagacugc

SEQ ID NO: 285628 - RNA, 32 nt, Human
aaauaguucuuuaaaaauauuucucuacuuuu

SEQ ID NO: 285629 - RNA, 32 nt, Human
aaauaguugaaggcaacugagaaaaggugaag

SEQ ID NO: 285630 - RNA, 32 nt, Human
aaauaguugguugaagaagaugaggcacuugu

SEQ ID NO: 285631 - RNA, 32 nt, Human
aaauauaaacaugccauaguuaacaaaugaua

SEQ ID NO: 285632 - RNA, 32 nt, Human
aaauauaaagaaaugugacaaagcuuuuuaag

SEQ ID NO: 285633 - RNA, 32 nt, Human
aaauauaaagagaggcauccucuggaguaccu

SEQ ID NO: 285634 - RNA, 32 nt, Human
aaauauaacaucacuauuuggcuuuuguuuug

SEQ ID NO: 285635 - RNA, 21 nt, Human
aaauauaagagcaccauuggc

SEQ ID NO: 285636 - RNA, 32 nt, Human
aaauauaagccaaggguaauuucagcggaugc

SEQ ID NO: 285637 - RNA, 32 nt, Human
aaauauaagccuuuuauacugauuauucuuuu

SEQ ID NO: 285638 - RNA, 31 nt, Human
aaauauaauggcuagaauacaaagcuaauac

SEQ ID NO: 285639 - RNA, 32 nt, Human
aaauauacaaauuuagucacaagacacuuuac

SEQ ID NO: 285640 - RNA, 32 nt, Human
aaauauacaguaucugcuauuauaggaaacau

SEQ ID NO: 285641 - RNA, 32 nt, Human
aaauauacauauauuuguuuuuccauuguaug

SEQ ID NO: 285642 - RNA, 32 nt, Human
aaauauacauucuuuucucaucauguuggaca

SEQ ID NO: 285643 - RNA, 32 nt, Human
aaauauaccugacagagcagagguuauaacuu

SEQ ID NO: 285644 - RNA, 32 nt, Human
aaauauacucuuuugucuuucucuuuauuccc

SEQ ID NO: 285645 - RNA, 32 nt, Human
aaauauacugauuuugaaaaguaucaggaaua

SEQ ID NO: 285646 - RNA, 32 nt, Human
aaauauacugcagcaugcuauaugaggcuccu

SEQ ID NO: 285647 - RNA, 32 nt, Human
aaauauagaagcccucuuuaccaaaaucauca

SEQ ID NO: 285648 - RNA, 32 nt, Human
aaauauagaggcagugacaacacacacucggc

SEQ ID NO: 285649 - RNA, 32 nt, Human
aaauauagauucuaaauaaauaggggcuuaua

SEQ ID NO: 285650 - RNA, 32 nt, Human
aaauauagcucucauggucugcuccaacugcc

SEQ ID NO: 285651 - RNA, 32 nt, Human
aaauauaggugaggauucaggagaaggcaaaa

SEQ ID NO: 285652 - RNA, 32 nt, Human
aaauauauacugauacuauaacuuucuuaugg

SEQ ID NO: 285653 - RNA, 32 nt, Human
aaauauaucaaaacauguaaacgcccaccuua

SEQ ID NO: 285654 - RNA, 32 nt, Human
aaauauaucuuccuccugagucuggguaauua

SEQ ID NO: 285655 - RNA, 22 nt, Human
aaauauaugaaauuacuauaca

SEQ ID NO: 285656 - RNA, 32 nt, Human
aaauauaugauggcuaacuguucaaaugcuaa

SEQ ID NO: 285657 - RNA, 32 nt, Human
aaauauauguacaaagaacuaugcugucuuau

SEQ ID NO: 285658 - RNA, 32 nt, Human
aaauauaugucgcaauacuuacugcaaagaaa

SEQ ID NO: 285659 - RNA, 32 nt, Human
aaauauauucaggaguuggaauguuguaguua

SEQ ID NO: 285660 - RNA, 32 nt, Human
aaauauauuccaugcuaucagcuuuuuagaau

SEQ ID NO: 285661 - RNA, 32 nt, Human
aaauauauuucaccugaguagggaagaaaaac

SEQ ID NO: 285662 - RNA, 32 nt, Human
aaauaucaaggaugagaauggcacuggcuguc

SEQ ID NO: 285663 - RNA, 32 nt, Human
aaauaucagugcagccuggcauuuggggccac

SEQ ID NO: 285664 - RNA, 32 nt, Human
aaauaucauauaguaaaugcaaacaugccaag

SEQ ID NO: 285665 - RNA, 32 nt, Human
aaauauccaaagaugccuuuugaauuucaaag

SEQ ID NO: 285666 - RNA, 32 nt, Human
aaauauccugguuuuccagcauguuuacccac

SEQ ID NO: 285667 - RNA, 32 nt, Human
aaauauccuguguaacacuuggcucuugguac

SEQ ID NO: 285668 - RNA, 32 nt, Human
aaauauccuucugucuccuccccaccuugcaa

SEQ ID NO: 285669 - RNA, 29 nt, Human
aaauaucggcugcagccaucccccucauu

SEQ ID NO: 285670 - RNA, 20 nt, Human
aaauaucuaauaaagcuuuu

SEQ ID NO: 285671 - RNA, 32 nt, Human
aaauaucucaugaagaccaaaaagcagaaauc

SEQ ID NO: 285672 - RNA, 32 nt, Human
aaauaucugaaaucucaguacgacaugaaaga

SEQ ID NO: 285673 - RNA, 32 nt, Human
aaauaucugacaucuauugucauuccauugcu

SEQ ID NO: 285674 - RNA, 32 nt, Human
aaauaucuuuguucuuguuugcugcuauuuuc

SEQ ID NO: 285675 - RNA, 32 nt, Human
aaauaugagauguugucaaaaugaugcaguaa

SEQ ID NO: 285676 - RNA, 32 nt, Human
aaauaugaggaaagcuuuucaguuuuuaaaau

SEQ ID NO: 285677 - RNA, 32 nt, Human
aaauaugaucacuucauacuucuaaaucagaa

SEQ ID NO: 285678 - RNA, 32 nt, Human
aaauaugauuguaccacugcacuccagccugg

SEQ ID NO: 285679 - RNA, 32 nt, Human
aaauaugcaagacacagaaguguauaugguug

SEQ ID NO: 285680 - RNA, 31 nt, Human
aaauaugcacuuuuccuaggcagagcuaucc

SEQ ID NO: 285681 - RNA, 32 nt, Human
aaauaugcaucucuauccccagccucuauuuu

SEQ ID NO: 285682 - RNA, 32 nt, Human
aaauaugccccuuaguccacucagccugcaac

SEQ ID NO: 285683 - RNA, 29 nt, Human
aaauaugcucugcugucucccugcugcug

SEQ ID NO: 285684 - RNA, 32 nt, Human
aaauaugcugauuuuaaagaguguuagaaagc

SEQ ID NO: 285685 - RNA, 32 nt, Human
aaauaugcuucaaaccaugaguacacuauuag

SEQ ID NO: 285686 - RNA, 32 nt, Human
aaauauggaagcacagaaaugggaguggaugc

SEQ ID NO: 285687 - RNA, 32 nt, Human
aaauauggagucucgcuguauugcccaggcug

SEQ ID NO: 285688 - RNA, 32 nt, Human
aaauauggcaauacuugcuucuucccaauugc

SEQ ID NO: 285689 - RNA, 32 nt, Human
aaauauggccuccagcugccugccuucagcaa

SEQ ID NO: 285690 - RNA, 32 nt, Human
aaauaugggacuguuuacaaaugagugauucc

SEQ ID NO: 285691 - RNA, 32 nt, Human
aaauaugggauggauucuagaaaugggguauc

SEQ ID NO: 285692 - RNA, 32 nt, Human
aaauaugggcugggcacagugucccacacucu

SEQ ID NO: 285693 - RNA, 32 nt, Human
aaauauggggauguagaaaagcagauaguuca

SEQ ID NO: 285694 - RNA, 32 nt, Human
aaauauguacuuguagccuggauagcagacug

SEQ ID NO: 285695 - RNA, 32 nt, Human
aaauauguauaugauacauguaaauguacaaa

SEQ ID NO: 285696 - RNA, 32 nt, Human
aaauaugucucgcuagugauguuuuuaugaua

SEQ ID NO: 285697 - RNA, 32 nt, Human
aaauaugucuucauaaauuacgcacaguaaaa

SEQ ID NO: 285698 - RNA, 32 nt, Human
aaauauguguaacacaggcuuguaggagcaca

SEQ ID NO: 285699 - RNA, 32 nt, Human
aaauauguuacaucaggacaacuuugagaaaa

SEQ ID NO: 285700 - RNA, 31 nt, Human
aaauauguuguucaaauuaugaguacuauuu

SEQ ID NO: 285701 - RNA, 32 nt, Human
aaauauguuuaaucucauuucucccucauuaa

SEQ ID NO: 285702 - RNA, 32 nt, Human
aaauauguuugaugcuauuuuguauuuuuaca

SEQ ID NO: 285703 - RNA, 32 nt, Human
aaauauuaaagccaaacuugaaugaagagaca

SEQ ID NO: 285704 - RNA, 32 nt, Human
aaauauuaagcaugacagaaaauauguauuaa

SEQ ID NO: 285705 - RNA, 32 nt, Human
aaauauuaagcuauucugagggagaggccaca

SEQ ID NO: 285706 - RNA, 32 nt, Human
aaauauuacaaacccuaagauagcuaauaaau

SEQ ID NO: 285707 - RNA, 32 nt, Human
aaauauuacagagaaaaucacauaucacaugg

SEQ ID NO: 285708 - RNA, 32 nt, Human
aaauauuaggagacacagggaaguggggagag

SEQ ID NO: 285709 - RNA, 32 nt, Human
aaauauuauuaaaauacaggaguuuaccuuaa

SEQ ID NO: 285710 - RNA, 21 nt, Human
aaauauucacaaacgugcaca

SEQ ID NO: 285711 - RNA, 32 nt, Human
aaauauucaguuaugguacuauguuugcaacu

SEQ ID NO: 285712 - RNA, 32 nt, Human
aaauauucauaaguagaaucacugacaguggc

SEQ ID NO: 285713 - RNA, 32 nt, Human
aaauauuccauucagcauuacaaagauggaug

SEQ ID NO: 285714 - RNA, 32 nt, Human
aaauauucccaaaaggcaggugcaaugaugca

SEQ ID NO: 285715 - RNA, 32 nt, Human
aaauauuccuuuuucuccuagaggaaaucccu

SEQ ID NO: 285716 - RNA, 32 nt, Human
aaauauucucucuuuggcuggaaugacaaaaa

SEQ ID NO: 285717 - RNA, 32 nt, Human
aaauauucugacaacauuaaaagacucuaccc

SEQ ID NO: 285718 - RNA, 32 nt, Human
aaauauucuuucuguaaagucaaacaggauuc

SEQ ID NO: 285719 - RNA, 32 nt, Human
aaauauugacacuugagggucacugguggacc

SEQ ID NO: 285720 - RNA, 32 nt, Human
aaauauugauccuucccuuggaccaccuucau

SEQ ID NO: 285721 - RNA, 32 nt, Human
aaauauugauuucugccuuccuugcuaaugca

SEQ ID NO: 285722 - RNA, 32 nt, Human
aaauauugauuuuagagacuguauuuuuauuu

SEQ ID NO: 285723 - RNA, 32 nt, Human
aaauauugcaaacccacagaguuuaggcuggu

SEQ ID NO: 285724 - RNA, 32 nt, Human
aaauauugcucaggcugguugcaaacuccuug

SEQ ID NO: 285725 - RNA, 32 nt, Human
aaauauuggccaaaucagaauucuuguuucua

SEQ ID NO: 285726 - RNA, 32 nt, Human
aaauauuggcuacugguguauguagcaguucu

SEQ ID NO: 285727 - RNA, 32 nt, Human
aaauauugggauuacagacaugagccaugaga

SEQ ID NO: 285728 - RNA, 31 nt, Human
aaauauuguacuuaccaacauuuaaagcuua

SEQ ID NO: 285729 - RNA, 32 nt, Human
aaauauuguuauguaucauaucaaagagaaac

SEQ ID NO: 285730 - RNA, 32 nt, Human
aaauauuuaaagcucaagaagaacacagaagc

SEQ ID NO: 285731 - RNA, 21 nt, Human
aaauauuuaacauauuugggu

SEQ ID NO: 285732 - RNA, 32 nt, Human
aaauauuuacauaugaaauuuaauauagcuau

SEQ ID NO: 285733 - RNA, 32 nt, Human
aaauauuuacuuuugcacuuggagcugcuuuu

SEQ ID NO: 285734 - RNA, 19 nt, Human
aaauauuuauucucucagc

SEQ ID NO: 285735 - RNA, 32 nt, Human
aaauauuucaggcugggcgugguggcucacgc

SEQ ID NO: 285736 - RNA, 32 nt, Human
aaauauuucauauuuuucugaguaaauaugau

SEQ ID NO: 285737 - RNA, 32 nt, Human
aaauauuucauuuugugcgugugaaagggaaa

SEQ ID NO: 285738 - RNA, 32 nt, Human
aaauauuuccaaguaggcaauguaguacuuuu

SEQ ID NO: 285739 - RNA, 32 nt, Human
aaauauuuccucaagccuauuucaugagaucu

SEQ ID NO: 285740 - RNA, 32 nt, Human
aaauauuucuauaauaguuucacauuuauauu

SEQ ID NO: 285741 - RNA, 32 nt, Human
aaauauuucuguaucuuuuggguuuugacagu

SEQ ID NO: 285742 - RNA, 32 nt, Human
aaauauuucuuuguuuuuccuuuuggaaacuu

SEQ ID NO: 285743 - RNA, 32 nt, Human
aaauauuugaaacuuguggucucugaagcucg

SEQ ID NO: 285744 - RNA, 32 nt, Human
aaauauuugcagaaugaguaggcucauaagug

SEQ ID NO: 285745 - RNA, 32 nt, Human
aaauauuugcuuguaaaugaaaacuuagcuag

SEQ ID NO: 285746 - RNA, 32 nt, Human
aaauauuugggaccaagcugaagcacuaaucc

SEQ ID NO: 285747 - RNA, 32 nt, Human
aaauauuuuccugccacuguguaacauagcug

SEQ ID NO: 285748 - RNA, 32 nt, Human
aaauauuuugguuuguucugugccuucaguuu

SEQ ID NO: 285749 - RNA, 32 nt, Human
aaauauuuuuagauccauuuaaggaguuuuga

SEQ ID NO: 285750 - RNA, 32 nt, Human
aaauauuuuuauuuucuuccuugucucauaac

SEQ ID NO: 285751 - RNA, 32 nt, Human
aaaucaaacaacaaccauuuccuggguguccu

SEQ ID NO: 285752 - RNA, 32 nt, Human
aaaucaaagaugaucucuaucacuuugccacc

SEQ ID NO: 285753 - RNA, 32 nt, Human
aaaucaaagugaaacccaggaggagagccucc

SEQ ID NO: 285754 - RNA, 32 nt, Human
aaaucaaauguuccuucaguacagguaacuuc

SEQ ID NO: 285755 - RNA, 23 nt, Human
aaaucaacaacuacagaaagauu

SEQ ID NO: 285756 - RNA, 32 nt, Human
aaaucaacagaauauacauucuucucagcacc

SEQ ID NO: 285757 - RNA, 32 nt, Human
aaaucaacauaguugcugcaggcggaacugag

SEQ ID NO: 285758 - RNA, 32 nt, Human
aaaucaacaucuguauacccccuucccagggg

SEQ ID NO: 285759 - RNA, 32 nt, Human
aaaucaacuaaaauucagacuuuuagcaggac

SEQ ID NO: 285760 - RNA, 32 nt, Human
aaaucaacucaauauaucauacauuuacacuu

SEQ ID NO: 285761 - RNA, 32 nt, Human
aaaucaacucacugcauaugcacaucaacuca

SEQ ID NO: 285762 - RNA, 24 nt, Human
aaaucaacugacaaauggcagauu

SEQ ID NO: 285763 - RNA, 32 nt, Human
aaaucaagaaggacacaagcgaagaaauggca

SEQ ID NO: 285764 - RNA, 32 nt, Human
aaaucaagggauuagugcaaccaguagaaggc

SEQ ID NO: 285765 - RNA, 21 nt, Human
aaaucaagggccagcuggagg

SEQ ID NO: 285766 - RNA, 32 nt, Human
aaaucaagggccugaauuuuauggcuuaguau

SEQ ID NO: 285767 - RNA, 22 nt, Human
aaaucaaggucucccagaauca

SEQ ID NO: 285768 - RNA, 32 nt, Human
aaaucaagucaccacacuccagccugggugac

SEQ ID NO: 285769 - RNA, 32 nt, Human
aaaucaagucagcuuggaucauucaccuuaac

SEQ ID NO: 285770 - RNA, 29 nt, Human
aaaucaagucuauguaagcuuacuugaaa

SEQ ID NO: 285771 - RNA, 32 nt, Human
aaaucaaguggcuaagucagauuuaggaagug

SEQ ID NO: 285772 - RNA, 32 nt, Human
aaaucaauaaucacaaaccccaaaacgggaga

SEQ ID NO: 285773 - RNA, 32 nt, Human
aaaucaauaauguugugaaguaaaacaaucag

SEQ ID NO: 285774 - RNA, 32 nt, Human
aaaucaauaguuuuaaccauuguuaaaaugca

SEQ ID NO: 285775 - RNA, 32 nt, Human
aaaucaauccuguuaagagauaauucuuaaaa

SEQ ID NO: 285776 - RNA, 32 nt, Human
aaaucaaucuuggcugggcacgguggcuccug

SEQ ID NO: 285777 - RNA, 32 nt, Human
aaaucacaaguccuaccacuccugccuuccaa

SEQ ID NO: 285778 - RNA, 32 nt, Human
aaaucacaaucagugaguaaauagacagccuu

SEQ ID NO: 285779 - RNA, 32 nt, Human
aaaucacacaggcugggugcaguggcucaugc

SEQ ID NO: 285780 - RNA, 32 nt, Human
aaaucacacauaugcacacauacauauuuaug

SEQ ID NO: 285781 - RNA, 32 nt, Human
aaaucacaccacuacacuccagccaaagcaac

SEQ ID NO: 285782 - RNA, 32 nt, Human
aaaucacaccacugcacucuagccugggcaac

SEQ ID NO: 285783 - RNA, 32 nt, Human
aaaucacaccacuguacuccagccuggugaca

SEQ ID NO: 285784 - RNA, 32 nt, Human
aaaucacaccauugcacuccagcuugggcaac

SEQ ID NO: 285785 - RNA, 32 nt, Human
aaaucacagaccaaggagccacccugauugca

SEQ ID NO: 285786 - RNA, 32 nt, Human
aaaucacagacuauugaaccuggaacuggcuu

SEQ ID NO: 285787 - RNA, 32 nt, Human
aaaucacagaugcuggugagguuguggagaaa

SEQ ID NO: 285788 - RNA, 32 nt, Human
aaaucacaggcuucugagcacagcugcauuaa

SEQ ID NO: 285789 - RNA, 32 nt, Human
aaaucacaguguugugcaccaggaacacaaag

SEQ ID NO: 285790 - RNA, 32 nt, Human
aaaucacauaaauguacugugugugacagagg

SEQ ID NO: 285791 - RNA, 32 nt, Human
aaaucaccaccaccaguguuaagugcuucugg

SEQ ID NO: 285792 - RNA, 32 nt, Human
aaaucaccaucccgcggaugcugugaccuccc

SEQ ID NO: 285793 - RNA, 32 nt, Human
aaaucacccucuacuuguucuccugugacccu

SEQ ID NO: 285794 - RNA, 32 nt, Human
aaaucaccuuucccuuguuaaaguguucuuuu

SEQ ID NO: 285795 - RNA, 32 nt, Human
aaaucacgccacuacacuccagccugggcaac

SEQ ID NO: 285796 - RNA, 32 nt, Human
aaaucacgccacugcacuccagccugggcaac

SEQ ID NO: 285797 - RNA, 32 nt, Human
aaaucacgugccugaaacugugcuuaaguuuu

SEQ ID NO: 285798 - RNA, 32 nt, Human
aaaucacucccaagagcuuacuguuuaaucac

SEQ ID NO: 285799 - RNA, 32 nt, Human
aaaucacugaaccaugucuccgcacauuuccc

SEQ ID NO: 285800 - RNA, 32 nt, Human
aaaucacugaaccucucaggaucaaugacccc

SEQ ID NO: 285801 - RNA, 32 nt, Human
aaaucacugugaucauuaaggauagaaaucaa

SEQ ID NO: 285802 - RNA, 32 nt, Human
aaaucacuugagcucaggaguuugagaccagc

SEQ ID NO: 285803 - RNA, 32 nt, Human
aaaucacuuguuuuauugacugucuuuccuau

SEQ ID NO: 285804 - RNA, 32 nt, Human
aaaucacuuugccaucuguaccucucaauuau

SEQ ID NO: 285805 - RNA, 32 nt, Human
aaaucagaacaauugagcucauggacacagag

SEQ ID NO: 285806 - RNA, 21 nt, Human
aaaucagaaguauaccucuga

SEQ ID NO: 285807 - RNA, 32 nt, Human
aaaucagagaacacugggugguuugaagggug

SEQ ID NO: 285808 - RNA, 32 nt, Human
aaaucagagaaggaaaguugacuuguagagug

SEQ ID NO: 285809 - RNA, 32 nt, Human
aaaucagagcauuagcugcucuccccaugauu

SEQ ID NO: 285810 - RNA, 32 nt, Human
aaaucagagcugaguggggaggugcuucagca

SEQ ID NO: 285811 - RNA, 32 nt, Human
aaaucagagggaagaaugugacuguggcuccc

SEQ ID NO: 285812 - RNA, 32 nt, Human
aaaucagagucaccuccucugcccagagcugu

SEQ ID NO: 285813 - RNA, 32 nt, Human
aaaucagagugguccucacaccuagaggacgg

SEQ ID NO: 285814 - RNA, 32 nt, Human
aaaucagaguugcccgggcaugguggcucacg

SEQ ID NO: 285815 - RNA, 32 nt, Human
aaaucagauauaccuucucuugucugcaugac

SEQ ID NO: 285816 - RNA, 32 nt, Human
aaaucagauuuacaaucuccauuuucauuaac

SEQ ID NO: 285817 - RNA, 32 nt, Human
aaaucagcaagccugcuuaccuccagagacac

SEQ ID NO: 285818 - RNA, 19 nt, Human
aaaucagcacacaaaucca

SEQ ID NO: 285819 - RNA, 18 nt, Human
aaaucagcacauuccucc

SEQ ID NO: 285820 - RNA, 32 nt, Human
aaaucagcaucaaaacauuccuaguguucaaa

SEQ ID NO: 285821 - RNA, 26 nt, Human
aaaucagccggcugcaccuguucucu

SEQ ID NO: 285822 - RNA, 32 nt, Human
aaaucagccuggcuugggaaauucauguuguu

SEQ ID NO: 285823 - RNA, 32 nt, Human
aaaucagccugggaagcaucuuuucgcucagc

SEQ ID NO: 285824 - RNA, 32 nt, Human
aaaucagcuguccgcccugccugccugccugu

SEQ ID NO: 285825 - RNA, 32 nt, Human
aaaucagcuugguaccaccagacugggcugca

SEQ ID NO: 285826 - RNA, 32 nt, Human
aaaucaggaaugaccugaaucucaacccaaau

SEQ ID NO: 285827 - RNA, 32 nt, Human
aaaucaggacaguggcaguucggauuguggca

SEQ ID NO: 285828 - RNA, 32 nt, Human
aaaucaggauuuuagugcuugccaccaccaga

SEQ ID NO: 285829 - RNA, 32 nt, Human
aaaucaggcagccacugacucccuucauuaug

SEQ ID NO: 285830 - RNA, 22 nt, Human
aaaucaggcaggucucaagggg

SEQ ID NO: 285831 - RNA, 32 nt, Human
aaaucaggccagaggacaacaggcuggcguuu

SEQ ID NO: 285832 - RNA, 21 nt, Human
aaaucaggcgaucuccggaga

SEQ ID NO: 285833 - RNA, 23 nt, Human
aaaucaggcggucaaacuuagag

SEQ ID NO: 285834 - RNA, 32 nt, Human
aaaucaggcuacagcacuccagccugggcaac

SEQ ID NO: 285835 - RNA, 32 nt, Human
aaaucaggcugcaguacuuugcacggggccug

SEQ ID NO: 285836 - RNA, 32 nt, Human
aaaucagggaugguuggcauccuaacuggcag

SEQ ID NO: 285837 - RNA, 32 nt, Human
aaaucagggcuucucucauccaugcuggaauu

SEQ ID NO: 285838 - RNA, 32 nt, Human
aaaucagguccagcaaaagucaguagggacau

SEQ ID NO: 285839 - RNA, 32 nt, Human
aaaucaguaucaauuccucccauuucaauuca

SEQ ID NO: 285840 - RNA, 32 nt, Human
aaaucaguccauaacauuaagaugagcccuaa

SEQ ID NO: 285841 - RNA, 32 nt, Human
aaaucagucuccccaaguggauugcaguuuuu

SEQ ID NO: 285842 - RNA, 32 nt, Human
aaaucagucucccugagcauuugggguaagag

SEQ ID NO: 285843 - RNA, 32 nt, Human
aaaucagucugcugggggaaccuuucagaugu

SEQ ID NO: 285844 - RNA, 21 nt, Human
aaaucagucuuccuuguggaa

SEQ ID NO: 285845 - RNA, 32 nt, Human
aaaucagucuuguuacuugauagccaugcccc

SEQ ID NO: 285846 - RNA, 32 nt, Human
aaaucagugggccauggaagaaaccucauaua

SEQ ID NO: 285847 - RNA, 32 nt, Human
aaaucagugugagaugggcaugguagcuuacg

SEQ ID NO: 285848 - RNA, 32 nt, Human
aaaucaguuuuuaaaagauauacuuucucuuu

SEQ ID NO: 285849 - RNA, 32 nt, Human
aaaucauaacacugcacuccaggcuggacaac

SEQ ID NO: 285850 - RNA, 32 nt, Human
aaaucauaacuugguaagaaacuccuaauuaa

SEQ ID NO: 285851 - RNA, 32 nt, Human
aaaucauagccugggugcaguggcucacgccu

SEQ ID NO: 285852 - RNA, 32 nt, Human
aaaucauagcugguucacacugaccaagauac

SEQ ID NO: 285853 - RNA, 32 nt, Human
aaaucauaguuucuuaauggcuaccaauaagg

SEQ ID NO: 285854 - RNA, 22 nt, Human
aaaucauauuucaaaauccagu

SEQ ID NO: 285855 - RNA, 32 nt, Human
aaaucauauuuuauacauauuuagcauuauaa

SEQ ID NO: 285856 - RNA, 32 nt, Human
aaaucaucagcccuguuuggugcagucucaug

SEQ ID NO: 285857 - RNA, 32 nt, Human
aaaucaucauaauugugcuuucacuucccagg

SEQ ID NO: 285858 - RNA, 32 nt, Human
aaaucaucauucucaguaaacuaucgcaagga

SEQ ID NO: 285859 - RNA, 32 nt, Human
aaaucauccagaaaacccccuacccccacccc

SEQ ID NO: 285860 - RNA, 32 nt, Human
aaaucauccucccacaccuucuccccgacuuu

SEQ ID NO: 285861 - RNA, 32 nt, Human
aaaucaucgauauuugaaacugggauacgcuu

SEQ ID NO: 285862 - RNA, 19 nt, Human
aaaucaucggagucagcca

SEQ ID NO: 285863 - RNA, 32 nt, Human
aaaucaucuccauauucucaggcacagagaaa

SEQ ID NO: 285864 - RNA, 31 nt, Human
aaaucaugaauacauuuacauuuaaauaaaa

SEQ ID NO: 285865 - RNA, 32 nt, Human
aaaucaugacaccuucaauuugccaucaugac

SEQ ID NO: 285866 - RNA, 32 nt, Human
aaaucaugagacaacucacacuggagagaagc

SEQ ID NO: 285867 - RNA, 32 nt, Human
aaaucaugauuucccuguagaaagugaggcuc

SEQ ID NO: 285868 - RNA, 32 nt, Human
aaaucaugccacugcacccuagcuuggguggc

SEQ ID NO: 285869 - RNA, 32 nt, Human
aaaucaugccacugcacuccagccugggcaac

SEQ ID NO: 285870 - RNA, 32 nt, Human
aaaucaugccauugcacuccagccugggugac

SEQ ID NO: 285871 - RNA, 32 nt, Human
aaaucaugcucaauaggauuacgcugaggccc

SEQ ID NO: 285872 - RNA, 32 nt, Human
aaaucaugcuccugaaccuucugaacgcauuu

SEQ ID NO: 285873 - RNA, 32 nt, Human
aaaucauggaaagacucuuaaugcagacucuu

SEQ ID NO: 285874 - RNA, 32 nt, Human
aaaucaugggcaaggcuggcccccaggcccug

SEQ ID NO: 285875 - RNA, 32 nt, Human
aaaucauggucugccuggaccuagccaggcuc

SEQ ID NO: 285876 - RNA, 32 nt, Human
aaaucauguaauccaggcuggggaagauggcg

SEQ ID NO: 285877 - RNA, 32 nt, Human
aaaucauguacauuugaaaauauuugcacaca

SEQ ID NO: 285878 - RNA, 32 nt, Human
aaaucaugucaccaagcuucaagccauggagg

SEQ ID NO: 285879 - RNA, 32 nt, Human
aaaucauuacucuguaaaauaaauaagcagau

SEQ ID NO: 285880 - RNA, 32 nt, Human
aaaucauucaaguuucacugugccuacaguga

SEQ ID NO: 285881 - RNA, 32 nt, Human
aaaucauucccaccaucacuuaacgccgggau

SEQ ID NO: 285882 - RNA, 32 nt, Human
aaaucauugagucccccgccuucagaagaggg

SEQ ID NO: 285883 - RNA, 32 nt, Human
aaaucauuguagccuugaacucccgggcucaa

SEQ ID NO: 285884 - RNA, 32 nt, Human
aaaucauuucggaauagaguuuugccaguuaa

SEQ ID NO: 285885 - RNA, 32 nt, Human
aaaucauuuucauuaagaagcucucucagcau

SEQ ID NO: 285886 - RNA, 32 nt, Human
aaaucauuuucuuugucugagucucugguucu

SEQ ID NO: 285887 - RNA, 32 nt, Human
aaauccaaaggcuauuguugcauuguacagca

SEQ ID NO: 285888 - RNA, 32 nt, Human
aaauccaacaauuucugaagcuuaguguaauu

SEQ ID NO: 285889 - RNA, 32 nt, Human
aaauccaacuccaggagcuauggcaguguuaa

SEQ ID NO: 285890 - RNA, 32 nt, Human
aaauccaacucugcuuuuggucuugcuucuau

SEQ ID NO: 285891 - RNA, 32 nt, Human
aaauccaagaagauacaggaauucuguguaug

SEQ ID NO: 285892 - RNA, 32 nt, Human
aaauccaaggggaugcuucccucugcccucuu

SEQ ID NO: 285893 - RNA, 32 nt, Human
aaauccacaaaucugagccuccuucacuccag

SEQ ID NO: 285894 - RNA, 32 nt, Human
aaauccacccaccaaucuuaggcaucauaaug

SEQ ID NO: 285895 - RNA, 32 nt, Human
aaauccaccuguccuucaauaaaguacuaaau

SEQ ID NO: 285896 - RNA, 32 nt, Human
aaauccacugcaccuccacuuggugacugacg

SEQ ID NO: 285897 - RNA, 21 nt, Human
aaauccagaagucagagccaa

SEQ ID NO: 285898 - RNA, 32 nt, Human
aaauccagacauucucacccccagcggaugca

SEQ ID NO: 285899 - RNA, 32 nt, Human
aaauccagagcuguagaaugagaaaaauguaa

SEQ ID NO: 285900 - RNA, 32 nt, Human
aaauccagaggaagcaaggaggagggaggugg

SEQ ID NO: 285901 - RNA, 32 nt, Human
aaauccagcagguggagguugcagugagccaa

SEQ ID NO: 285902 - RNA, 32 nt, Human
aaauccagcaguagaggaagggaccacccaag

SEQ ID NO: 285903 - RNA, 32 nt, Human
aaauccagccuuuuaccagaagccucuccgag

SEQ ID NO: 285904 - RNA, 32 nt, Human
aaauccagcuccuuguccuagcagguucucag

SEQ ID NO: 285905 - RNA, 32 nt, Human
aaauccaggaaaugcagaagaggaaugugcaa

SEQ ID NO: 285906 - RNA, 32 nt, Human
aaauccaggagcaacgccaguggcaacguagu

SEQ ID NO: 285907 - RNA, 30 nt, Human
aaauccaggagccacaggaagcagugagcu

SEQ ID NO: 285908 - RNA, 32 nt, Human
aaauccaggaggcaaagguugcagugagccaa

SEQ ID NO: 285909 - RNA, 32 nt, Human
aaauccaggaggcggagguugcagugagccaa

SEQ ID NO: 285910 - RNA, 31 nt, Human
aaauccaggcacuuccugcuucuucaggccu

SEQ ID NO: 285911 - RNA, 32 nt, Human
aaauccaggcggggccuguugggcccaggucu

SEQ ID NO: 285912 - RNA, 32 nt, Human
aaauccagucaacucauaucuuccugucuuuc

SEQ ID NO: 285913 - RNA, 32 nt, Human
aaauccagugucacaugggccugagauuuuau

SEQ ID NO: 285914 - RNA, 32 nt, Human
aaauccaguguucaguguaguggugcaaaccu

SEQ ID NO: 285915 - RNA, 32 nt, Human
aaauccaguuucucuugaugaagaagaagaug

SEQ ID NO: 285916 - RNA, 16 nt, Human
aaauccauaaucugcu

SEQ ID NO: 285917 - RNA, 32 nt, Human
aaauccaugaacacuaaaggacuucauugauu

SEQ ID NO: 285918 - RNA, 32 nt, Human
aaauccaugccaagaugccugccuuccuuggu

SEQ ID NO: 285919 - RNA, 16 nt, Human
aaauccaugccugugu

SEQ ID NO: 285920 - RNA, 32 nt, Human
aaauccaugcuccugacaucaacugaaggggc

SEQ ID NO: 285921 - RNA, 32 nt, Human
aaauccaugcugcaauacaauucuggaauaag

SEQ ID NO: 285922 - RNA, 32 nt, Human
aaauccauggcuuagaaguuccagcccuccau

SEQ ID NO: 285923 - RNA, 32 nt, Human
aaauccauucacugcaaaccucguuccccauu

SEQ ID NO: 285924 - RNA, 32 nt, Human
aaauccauuucccacguuuucccuucagugca

SEQ ID NO: 285925 - RNA, 32 nt, Human
aaaucccaccacugcacuccagccugggugac

SEQ ID NO: 285926 - RNA, 32 nt, Human
aaaucccacuacuuugggaggcugaggcugga

SEQ ID NO: 285927 - RNA, 32 nt, Human
aaaucccagcacuuugggaaggccgaguuggu

SEQ ID NO: 285928 - RNA, 32 nt, Human
aaaucccagcacuuugggaggccgaggcagga

SEQ ID NO: 285929 - RNA, 32 nt, Human
aaaucccagcacuuugggaggccgaggcaggc

SEQ ID NO: 285930 - RNA, 32 nt, Human
aaaucccagcacuuugggaggccgaggcaggu

SEQ ID NO: 285931 - RNA, 32 nt, Human
aaaucccagcuacucaagaggcugaggcagga

SEQ ID NO: 285932 - RNA, 32 nt, Human
aaaucccagcuacugaagaggcugagguggga

SEQ ID NO: 285933 - RNA, 32 nt, Human
aaaucccagcuacuugggaggcugaggcagga

SEQ ID NO: 285934 - RNA, 32 nt, Human
aaaucccagcuaucaggaggcugaggcagaga

SEQ ID NO: 285935 - RNA, 32 nt, Human
aaaucccagcuauuugggaggcugaggcagga

SEQ ID NO: 285936 - RNA, 32 nt, Human
aaaucccagcugggcuggacuguugccaacau

SEQ ID NO: 285937 - RNA, 32 nt, Human
aaaucccaggacccacccauguuuucacuauc

SEQ ID NO: 285938 - RNA, 32 nt, Human
aaaucccaggagaaaccuaagaggucuuaugg

SEQ ID NO: 285939 - RNA, 32 nt, Human
aaaucccagguacucaggaggcugaggcagga

SEQ ID NO: 285940 - RNA, 32 nt, Human
aaaucccaguggaggguggaaggaaccguuug

SEQ ID NO: 285941 - RNA, 32 nt, Human
aaaucccaguuggcacagccugggcaagcgcc

SEQ ID NO: 285942 - RNA, 32 nt, Human
aaaucccaucucuacaacaaaaauacaaaaau

SEQ ID NO: 285943 - RNA, 32 nt, Human
aaauccccaagggcacugccacugugcucgga

SEQ ID NO: 285944 - RNA, 32 nt, Human
aaauccccaagugcuagagaaaagaaugugga

SEQ ID NO: 285945 - RNA, 32 nt, Human
aaauccccagaaacaggaaggucuccaagugu

SEQ ID NO: 285946 - RNA, 32 nt, Human
aaauccccagccugugagucucagccucuuuc

SEQ ID NO: 285947 - RNA, 32 nt, Human
aaauccccauuccauucaacaggcacauguuu

SEQ ID NO: 285948 - RNA, 32 nt, Human
aaaucccccaccccuggcugggcucaguggcu

SEQ ID NO: 285949 - RNA, 26 nt, Human
aaauccccgcuggccuccgccucccc

SEQ ID NO: 285950 - RNA, 21 nt, Human
aaauccccggcuccagcuccc

SEQ ID NO: 285951 - RNA, 32 nt, Human
aaauccccguuccauucaacaggcacauguuu

SEQ ID NO: 285952 - RNA, 19 nt, Human
aaauccccucccccugccc

SEQ ID NO: 285953 - RNA, 32 nt, Human
aaauccccugcaccucacucugggcagcucua

SEQ ID NO: 285954 - RNA, 32 nt, Human
aaauccccugcucuuugccgaccuucccuuau

SEQ ID NO: 285955 - RNA, 32 nt, Human
aaauccccuugaggcuggggagcuccacuccu

SEQ ID NO: 285956 - RNA, 32 nt, Human
aaaucccggccccacuccugaccucagacuca

SEQ ID NO: 285957 - RNA, 32 nt, Human
aaaucccggggccugggcuucucuauucuugg

SEQ ID NO: 285958 - RNA, 32 nt, Human
aaaucccuaaaacuuccagccucacauagcac

SEQ ID NO: 285959 - RNA, 32 nt, Human
aaaucccuaggccagaccucacagcagugccc

SEQ ID NO: 285960 - RNA, 32 nt, Human
aaaucccucaucagacugugacuuuaacauua

SEQ ID NO: 285961 - RNA, 18 nt, Human
aaaucccugcccuuaugg

SEQ ID NO: 285962 - RNA, 32 nt, Human
aaaucccugcuucuuuugggugcaguggcuca

SEQ ID NO: 285963 - RNA, 32 nt, Human
aaaucccuguuuaguguuacaugggaauaagg

SEQ ID NO: 285964 - RNA, 32 nt, Human
aaaucccuuccuguucccuccugguccuggac

SEQ ID NO: 285965 - RNA, 32 nt, Human
aaaucccuuucccuagaaauuggcucaccuug

SEQ ID NO: 285966 - RNA, 32 nt, Human
aaaucccuuugcauucuuucuggaccuuaaau

SEQ ID NO: 285967 - RNA, 32 nt, Human
aaauccuaaucaggaaaaagacucaucuagua

SEQ ID NO: 285968 - RNA, 32 nt, Human
aaauccuaguuauuaguggcccaggagaggag

SEQ ID NO: 285969 - RNA, 32 nt, Human
aaauccuauuaaaauaugcaaaaauaagucag

SEQ ID NO: 285970 - RNA, 32 nt, Human
aaauccucaaagcuuucagaagcauccagaau

SEQ ID NO: 285971 - RNA, 32 nt, Human
aaauccucagccacucaucuuauccuuaacaa

SEQ ID NO: 285972 - RNA, 32 nt, Human
aaauccucgcacacacuggcugguggagaacu

SEQ ID NO: 285973 - RNA, 32 nt, Human
aaauccucucguaucucaccccaaaccccaaa

SEQ ID NO: 285974 - RNA, 32 nt, Human
aaauccucucugcuguucacauuauccuuugu

SEQ ID NO: 285975 - RNA, 32 nt, Human
aaauccugaccucaagucaucugcuggccuug

SEQ ID NO: 285976 - RNA, 32 nt, Human
aaauccugcacucaggccugguggugaagaag

SEQ ID NO: 285977 - RNA, 32 nt, Human
aaauccugcagcguucaaguuugaugcugcca

SEQ ID NO: 285978 - RNA, 32 nt, Human
aaauccugccacccucacuucuccccuuccca

SEQ ID NO: 285979 - RNA, 32 nt, Human
aaauccugccacugcacaccagccugggugac

SEQ ID NO: 285980 - RNA, 32 nt, Human
aaauccugggguccuugagacagaggcaggac

SEQ ID NO: 285981 - RNA, 32 nt, Human
aaauccugucuggagcgacacgggcacagcca

SEQ ID NO: 285982 - RNA, 32 nt, Human
aaauccugugcugcuguuccucgugguaauag

SEQ ID NO: 285983 - RNA, 32 nt, Human
aaauccuguguuagaagcagcugugggggucc

SEQ ID NO: 285984 - RNA, 20 nt, Human
aaauccuguuuaggaucuga

SEQ ID NO: 285985 - RNA, 32 nt, Human
aaauccuuagcagucagaacacuugcuucacu

SEQ ID NO: 285986 - RNA, 32 nt, Human
aaauccuucagcugauucucagucuaguaaac

SEQ ID NO: 285987 - RNA, 32 nt, Human
aaauccuuccugggauucccccaaacccacac

SEQ ID NO: 285988 - RNA, 32 nt, Human
aaauccuugaagcccaggcugaugcuugaagu

SEQ ID NO: 285989 - RNA, 32 nt, Human
aaauccuugacuuuaaaauaaauuuaaagugu

SEQ ID NO: 285990 - RNA, 32 nt, Human
aaauccuugcaccaugggauuaauauccaauu

SEQ ID NO: 285991 - RNA, 32 nt, Human
aaauccuugcaguggugaaaacugacauggca

SEQ ID NO: 285992 - RNA, 32 nt, Human
aaauccuuguuuucucuuuucgguuuugagag

SEQ ID NO: 285993 - RNA, 32 nt, Human
aaauccuuuaagagauauuagagcaaguauuu

SEQ ID NO: 285994 - RNA, 32 nt, Human
aaauccuuugccaaaauaagggauggucaaau

SEQ ID NO: 285995 - RNA, 32 nt, Human
aaaucgacaagaaaaccuugacuuuacagagc

SEQ ID NO: 285996 - RNA, 32 nt, Human
aaaucgacgucucucucaccaggauuuggugu

SEQ ID NO: 285997 - RNA, 32 nt, Human
aaaucgacuucaaauacuugaaggcucccacc

SEQ ID NO: 285998 - RNA, 32 nt, Human
aaaucgagcagugagccaaggagcagcauaua

SEQ ID NO: 285999 - RNA, 32 nt, Human
aaaucgagccccggagagaugaaaggcauauu

SEQ ID NO: 286000 - RNA, 32 nt, Human
aaaucgagccccggagcgaugaaaggcauauu

SEQ ID NO: 286001 - RNA, 32 nt, Human
aaaucgaggaagcaccucucagccccucagag

SEQ ID NO: 286002 - RNA, 31 nt, Human
aaaucgauggcagaagcagcggcugccagau

SEQ ID NO: 286003 - RNA, 32 nt, Human
aaaucgcaccacugcacuccagccugggcgac

SEQ ID NO: 286004 - RNA, 32 nt, Human
aaaucgcaccgcugcacuccagccuggcaaca

SEQ ID NO: 286005 - RNA, 32 nt, Human
aaaucgcagaacuugaauccaggcugcugcuc

SEQ ID NO: 286006 - RNA, 32 nt, Human
aaaucgcagcagaggagauggagcagcuucgu

SEQ ID NO: 286007 - RNA, 32 nt, Human
aaaucgcaguuugacauaagggucccacaggc

SEQ ID NO: 286008 - RNA, 32 nt, Human
aaaucgcauucauaaaacaauuggaagugaaa

SEQ ID NO: 286009 - RNA, 32 nt, Human
aaaucgccacacuuggaaaaguuucaucaguu

SEQ ID NO: 286010 - RNA, 19 nt, Human
aaaucgcccaaauuuggaa

SEQ ID NO: 286011 - RNA, 32 nt, Human
aaaucgcgccacugcacuccagccugggugac

SEQ ID NO: 286012 - RNA, 32 nt, Human
aaaucgcguaccacacuccagccugggugaca

SEQ ID NO: 286013 - RNA, 32 nt, Human
aaaucgcgucacugcacuccagccugagugac

SEQ ID NO: 286014 - RNA, 32 nt, Human
aaaucgcucauuuugagguugcuuuauuuuuc

SEQ ID NO: 286015 - RNA, 32 nt, Human
aaaucgcugucucucugucucuuugcuuugua

SEQ ID NO: 286016 - RNA, 32 nt, Human
aaaucgcuguguuggggagcagcaggcucucc

SEQ ID NO: 286017 - RNA, 32 nt, Human
aaaucggccucaagugugagacgcauguugaa

SEQ ID NO: 286018 - RNA, 32 nt, Human
aaaucgggaaagucagcuggcuuuuuaucacu

SEQ ID NO: 286019 - RNA, 32 nt, Human
aaaucgggccaggccaaguacucagcugucuu

SEQ ID NO: 286020 - RNA, 32 nt, Human
aaaucggggacccccggcgcgccgacgggcag

SEQ ID NO: 286021 - RNA, 32 nt, Human
aaaucggggcuggaggugcagacggugucuga

SEQ ID NO: 286022 - RNA, 32 nt, Human
aaaucgguugugauuggcauguuccuuaagcg

SEQ ID NO: 286023 - RNA, 32 nt, Human
aaaucgucuccaagaccuacacagucagcuaa

SEQ ID NO: 286024 - RNA, 32 nt, Human
aaaucgugguugaguuucacugcagcaggcug

SEQ ID NO: 286025 - RNA, 32 nt, Human
aaaucguugggacucucagaugaaacaggaug

SEQ ID NO: 286026 - RNA, 32 nt, Human
aaaucguuguggaaggugauuaaaaaucaaaa

SEQ ID NO: 286027 - RNA, 32 nt, Human
aaaucuaaaauguaaaauuuugaacacaacac

SEQ ID NO: 286028 - RNA, 32 nt, Human
aaaucuacaagaacagagaauucuuccaaauc

SEQ ID NO: 286029 - RNA, 32 nt, Human
aaaucuacaggccucagggugggagaugaagg

SEQ ID NO: 286030 - RNA, 32 nt, Human
aaaucuacauuuaaaaggcaaagcuuuaaaag

SEQ ID NO: 286031 - RNA, 32 nt, Human
aaaucuaccacuuuccacaguagccccagauc

SEQ ID NO: 286032 - RNA, 32 nt, Human
aaaucuaccaggccaucuccccaguuucccag

SEQ ID NO: 286033 - RNA, 32 nt, Human
aaaucuagaaaaucagucuugacagaaaaugu

SEQ ID NO: 286034 - RNA, 32 nt, Human
aaaucuagaugagagaaaguauuugaaaauga

SEQ ID NO: 286035 - RNA, 32 nt, Human
aaaucuagcaccuugcaugcuggaucugggcu

SEQ ID NO: 286036 - RNA, 32 nt, Human
aaaucuauacugccacaauaugcagcuuacuc

SEQ ID NO: 286037 - RNA, 32 nt, Human
aaaucuauacuggacaguuacaagaaauuacc

SEQ ID NO: 286038 - RNA, 32 nt, Human
aaaucuauagccacagccugaagcuuugacca

SEQ ID NO: 286039 - RNA, 32 nt, Human
aaaucuauauuggacaguuacaagaaauuacu

SEQ ID NO: 286040 - RNA, 32 nt, Human
aaaucuaucauuauacagcacagaguggagcc

SEQ ID NO: 286041 - RNA, 32 nt, Human
aaaucuaucucuaauuuagagugcgguacaua

SEQ ID NO: 286042 - RNA, 32 nt, Human
aaaucuaucuucccaucuccuaaaacucagaa

SEQ ID NO: 286043 - RNA, 18 nt, Human
aaaucuaugcacuuaacc

SEQ ID NO: 286044 - RNA, 32 nt, Human
aaaucucaaaaacacaauaagugaagaaagua

SEQ ID NO: 286045 - RNA, 32 nt, Human
aaaucucaagucaaacacuggaaaagauguca

SEQ ID NO: 286046 - RNA, 32 nt, Human
aaaucucaauugcuagugaggaauucuuuucc

SEQ ID NO: 286047 - RNA, 32 nt, Human
aaaucucaccuucccuuccucaguuaaggaca

SEQ ID NO: 286048 - RNA, 32 nt, Human
aaaucucagcuaaucaggaggcugaggcagag

SEQ ID NO: 286049 - RNA, 32 nt, Human
aaaucuccacguccucccucuucccagccugg

SEQ ID NO: 286050 - RNA, 32 nt, Human
aaaucuccaggcugcugggcagcugggcagag

SEQ ID NO: 286051 - RNA, 32 nt, Human
aaaucucccuucaggcggagguugcagugagc

SEQ ID NO: 286052 - RNA, 32 nt, Human
aaaucucccuuucucuucaguuccuuccuugu

SEQ ID NO: 286053 - RNA, 32 nt, Human
aaaucucuacccuuccccaacccuccauaaaa

SEQ ID NO: 286054 - RNA, 32 nt, Human
aaaucucuacuuucuccacaugucacuugacu

SEQ ID NO: 286055 - RNA, 32 nt, Human
aaaucucuccacccuuauauaaucauugucaa

SEQ ID NO: 286056 - RNA, 32 nt, Human
aaaucucucucccuaaacuuucuguugcagau

SEQ ID NO: 286057 - RNA, 32 nt, Human
aaaucucugagaaccuucaagagcccaaaaac

SEQ ID NO: 286058 - RNA, 32 nt, Human
aaaucucugucuccacugcuuuccuuuuccug

SEQ ID NO: 286059 - RNA, 32 nt, Human
aaaucucuucuaaacgauggcauucuauguaa

SEQ ID NO: 286060 - RNA, 32 nt, Human
aaaucucuuugcaguggccucucuccaaauuu

SEQ ID NO: 286061 - RNA, 32 nt, Human
aaaucugaucauaucuacauguaugaacuuaa

SEQ ID NO: 286062 - RNA, 32 nt, Human
aaaucugauucugcuuuaacccggcuacagga

SEQ ID NO: 286063 - RNA, 32 nt, Human
aaaucugcaaaaagagcugacauuccagcugc

SEQ ID NO: 286064 - RNA, 31 nt, Human
aaaucugcaaugucucaguuaagaaagaaag

SEQ ID NO: 286065 - RNA, 32 nt, Human
aaaucugcagcaaccaucagcucucuuuucuu

SEQ ID NO: 286066 - RNA, 32 nt, Human
aaaucugcauaaggaagcccacuuuaucuaaa

SEQ ID NO: 286067 - RNA, 32 nt, Human
aaaucugccaaagaaguaagagauaaauuguu

SEQ ID NO: 286068 - RNA, 32 nt, Human
aaaucugccagccuaggcaacauagcaagguc

SEQ ID NO: 286069 - RNA, 32 nt, Human
aaaucugccuuuuucucauucaagaaggcaua

SEQ ID NO: 286070 - RNA, 32 nt, Human
aaaucugcucauauuagaacacaguauaauuc

SEQ ID NO: 286071 - RNA, 32 nt, Human
aaaucugcugggggugcugugauucauguuug

SEQ ID NO: 286072 - RNA, 32 nt, Human
aaaucugcugugcauccagagagcaaaguggg

SEQ ID NO: 286073 - RNA, 32 nt, Human
aaaucuggaaacaguugcagguguugggagga

SEQ ID NO: 286074 - RNA, 23 nt, Human
aaaucuggcuccuuuacaaaaga

SEQ ID NO: 286075 - RNA, 32 nt, Human
aaaucuggcuucucccuuccucccgacaucug

SEQ ID NO: 286076 - RNA, 32 nt, Human
aaaucuggcuucuccgccuuguggaacuugca

SEQ ID NO: 286077 - RNA, 32 nt, Human
aaaucugggguuuuauauuuugauuagccuaa

SEQ ID NO: 286078 - RNA, 32 nt, Human
aaaucuggguucaaccagccccugccauuucu

SEQ ID NO: 286079 - RNA, 32 nt, Human
aaaucugguagauccuauuacacuucuguuua

SEQ ID NO: 286080 - RNA, 32 nt, Human
aaaucuguaaagggacagaugcaccaucuuua

SEQ ID NO: 286081 - RNA, 32 nt, Human
aaaucugucacuguguauccucagccagaacu

SEQ ID NO: 286082 - RNA, 32 nt, Human
aaaucuguccccagaacuggagaguaagaaug

SEQ ID NO: 286083 - RNA, 32 nt, Human
aaaucuguccucuguguaacugaggccagcaa

SEQ ID NO: 286084 - RNA, 32 nt, Human
aaaucugucucaggcugguaguuagcaguugu

SEQ ID NO: 286085 - RNA, 32 nt, Human
aaaucugucuccaggcuggagaggcaggagcc

SEQ ID NO: 286086 - RNA, 31 nt, Human
aaaucugucuuugcggggccugucucaguga

SEQ ID NO: 286087 - RNA, 32 nt, Human
aaaucugugaacuuuggagaggggacaguugu

SEQ ID NO: 286088 - RNA, 32 nt, Human
aaaucugugagggucugacuugcucaaaccag

SEQ ID NO: 286089 - RNA, 32 nt, Human
aaaucugugucucaaaaacaaaacaaaacaaa

SEQ ID NO: 286090 - RNA, 32 nt, Human
aaaucugugugacuugcuuuauugcagcauuu

SEQ ID NO: 286091 - RNA, 32 nt, Human
aaaucuguguuugcuuucugcuugcuacauuu

SEQ ID NO: 286092 - RNA, 32 nt, Human
aaaucuguuacucaggcugguagcauuaaauu

SEQ ID NO: 286093 - RNA, 32 nt, Human
aaaucuguuuuuaaaaugucuuauaugaacau

SEQ ID NO: 286094 - RNA, 32 nt, Human
aaaucuuaaagccaaaauuagaaaaauaacuc

SEQ ID NO: 286095 - RNA, 32 nt, Human
aaaucuuagcacuucgggaggcugaggcaggu

SEQ ID NO: 286096 - RNA, 32 nt, Human
aaaucuuaugaaucauacauacacucaacaaa

SEQ ID NO: 286097 - RNA, 32 nt, Human
aaaucuucaaaacaaauuuaccuucauauagc

SEQ ID NO: 286098 - RNA, 32 nt, Human
aaaucuucaagguggcuaucccuucuccccuc

SEQ ID NO: 286099 - RNA, 32 nt, Human
aaaucuucaccuaugauccaggcacagaugug

SEQ ID NO: 286100 - RNA, 32 nt, Human
aaaucuucccaaauguuguggaaaacuggaau

SEQ ID NO: 286101 - RNA, 25 nt, Human
aaaucuuccuaacucuaggaucuga

SEQ ID NO: 286102 - RNA, 32 nt, Human
aaaucuuccuguacaaaacaucuuuaaaaaua

SEQ ID NO: 286103 - RNA, 32 nt, Human
aaaucuucucaccaaguggcugcaaucaguaa

SEQ ID NO: 286104 - RNA, 32 nt, Human
aaaucuucucucccucuccuacagccacuuuc

SEQ ID NO: 286105 - RNA, 19 nt, Human
aaaucuugaaaaggacuga

SEQ ID NO: 286106 - RNA, 32 nt, Human
aaaucuugaucucucuccuauuuccuuucuac

SEQ ID NO: 286107 - RNA, 32 nt, Human
aaaucuugcacuguuuugaaugcaucugcuau

SEQ ID NO: 286108 - RNA, 32 nt, Human
aaaucuugcaguugggauuuugcaguuggaua

SEQ ID NO: 286109 - RNA, 21 nt, Human
aaaucuugccuuggguccuga

SEQ ID NO: 286110 - RNA, 22 nt, Human
aaaucuugcucaguggcucuga

SEQ ID NO: 286111 - RNA, 21 nt, Human
aaaucuugggucuuggggacu

SEQ ID NO: 286112 - RNA, 32 nt, Human
aaaucuuguucuaacugugccuggugagagac

SEQ ID NO: 286113 - RNA, 32 nt, Human
aaaucuuguuuuaaaaauacauauuucuaccu

SEQ ID NO: 286114 - RNA, 32 nt, Human
aaaucuuucagccugcuucuuccccaggguuc

SEQ ID NO: 286115 - RNA, 22 nt, Human
aaaucuuuccaauaaauccaag

SEQ ID NO: 286116 - RNA, 21 nt, Human
aaaucuuucccuaaaucuaag

SEQ ID NO: 286117 - RNA, 32 nt, Human
aaaucuuuccgaguuuccccagaagagaauau

SEQ ID NO: 286118 - RNA, 32 nt, Human
aaaucuuucuggacagccaugacuguagcaag

SEQ ID NO: 286119 - RNA, 32 nt, Human
aaaucuuugguuguguggaugccuguguucag

SEQ ID NO: 286120 - RNA, 32 nt, Human
aaaucuuugugugaaggauuggaaaaggcuau

SEQ ID NO: 286121 - RNA, 32 nt, Human
aaaucuuuguguuugccuaucuguaaagguaa

SEQ ID NO: 286122 - RNA, 32 nt, Human
aaaucuuuuccauuccucuuucauacauucca

SEQ ID NO: 286123 - RNA, 32 nt, Human
aaaucuuuuucaaaacacuaguagaagaguaa

SEQ ID NO: 286124 - RNA, 32 nt, Human
aaaugaaaaagcagggacaacaggaggaaaug

SEQ ID NO: 286125 - RNA, 32 nt, Human
aaaugaaaaagguauuucuaacaacaaccaca

SEQ ID NO: 286126 - RNA, 32 nt, Human
aaaugaaaaaucucaauugaaagcuuuuaaaa

SEQ ID NO: 286127 - RNA, 32 nt, Human
aaaugaaaaaugaaaacauuucaaccaucuaa

SEQ ID NO: 286128 - RNA, 32 nt, Human
aaaugaaaaauggacccuuuaaaaauuauuuu

SEQ ID NO: 286129 - RNA, 32 nt, Human
aaaugaaacaaugcaacauuucacuuugauuu

SEQ ID NO: 286130 - RNA, 32 nt, Human
aaaugaaacaggcuucucagggacauauccac

SEQ ID NO: 286131 - RNA, 32 nt, Human
aaaugaaaccgcauuuugggugccauuaaaua

SEQ ID NO: 286132 - RNA, 29 nt, Human
aaaugaaagaaaaagaaagagaggaaagg

SEQ ID NO: 286133 - RNA, 32 nt, Human
aaaugaaagccaucugacaguuggcucacauu

SEQ ID NO: 286134 - RNA, 32 nt, Human
aaaugaaagccuuuuugcauguacuugauacu

SEQ ID NO: 286135 - RNA, 32 nt, Human
aaaugaaagguuuuuaccuagauacuguaagu

SEQ ID NO: 286136 - RNA, 32 nt, Human
aaaugaaaguaaacaugguuacauuugaaucu

SEQ ID NO: 286137 - RNA, 32 nt, Human
aaaugaaaucacacuuggauauauuguuaaac

SEQ ID NO: 286138 - RNA, 32 nt, Human
aaaugaaaucauucacaaacuuuugguauaug

SEQ ID NO: 286139 - RNA, 32 nt, Human
aaaugaaauguuugaaagugaguggucaaaag

SEQ ID NO: 286140 - RNA, 32 nt, Human
aaaugaaauuucuccacaagaaauacucucag

SEQ ID NO: 286141 - RNA, 32 nt, Human
aaaugaacaaagcaaaggauacagagguaugu

SEQ ID NO: 286142 - RNA, 27 nt, Human
aaaugaacacagaagcggagcaacagc

SEQ ID NO: 286143 - RNA, 32 nt, Human
aaaugaaccacucaagugguagugacuccagc

SEQ ID NO: 286144 - RNA, 27 nt, Human
aaaugaacgagacuauauuuugcuugg

SEQ ID NO: 286145 - RNA, 32 nt, Human
aaaugaacuaggcaggugaggugguguuugcc

SEQ ID NO: 286146 - RNA, 32 nt, Human
aaaugaacuauucuccuuguaaagcuaaauuc

SEQ ID NO: 286147 - RNA, 32 nt, Human
aaaugaacucacugcauuucugugcucccucc

SEQ ID NO: 286148 - RNA, 32 nt, Human
aaaugaacugaaguuucacaugagcuauuucc

SEQ ID NO: 286149 - RNA, 32 nt, Human
aaaugaagaauagggcugggcacaguggcuca

SEQ ID NO: 286150 - RNA, 32 nt, Human
aaaugaagacacgcccgacucucuccaucaga

SEQ ID NO: 286151 - RNA, 32 nt, Human
aaaugaagacugccugccccagccccucccgc

SEQ ID NO: 286152 - RNA, 32 nt, Human
aaaugaagagaggcacgccaaccacuccaaaa

SEQ ID NO: 286153 - RNA, 32 nt, Human
aaaugaagaggaacucccucuuucuacagcuc

SEQ ID NO: 286154 - RNA, 32 nt, Human
aaaugaagauacacauuacagccagguguggu

SEQ ID NO: 286155 - RNA, 32 nt, Human
aaaugaagaugaugcacauggcccacugcgug

SEQ ID NO: 286156 - RNA, 32 nt, Human
aaaugaagcagaaaccaagaaaagcaaauaug

SEQ ID NO: 286157 - RNA, 32 nt, Human
aaaugaagcccccuccuguggggacagcucag

SEQ ID NO: 286158 - RNA, 32 nt, Human
aaaugaaggaguaaguuaucaggccuuauuua

SEQ ID NO: 286159 - RNA, 32 nt, Human
aaaugaaggcaugagaggaaguaaguagcaag

SEQ ID NO: 286160 - RNA, 32 nt, Human
aaaugaaggcccggagaagggaagggacuuga

SEQ ID NO: 286161 - RNA, 32 nt, Human
aaaugaagggucuauaugacagcaaccauugu

SEQ ID NO: 286162 - RNA, 27 nt, Human
aaaugaaguacagagagcaaggcuccg

SEQ ID NO: 286163 - RNA, 32 nt, Human
aaaugaaguuuauauuaucaaggggacuaaag

SEQ ID NO: 286164 - RNA, 32 nt, Human
aaaugaauaugcugggcugugccagagaauaa

SEQ ID NO: 286165 - RNA, 32 nt, Human
aaaugaaucaagcucauuaugaaaccaguaaa

SEQ ID NO: 286166 - RNA, 32 nt, Human
aaaugaaucacaaacagagcaccaagaaaaag

SEQ ID NO: 286167 - RNA, 32 nt, Human
aaaugaaucuucuacccuucucccacaaugua

SEQ ID NO: 286168 - RNA, 32 nt, Human
aaaugaaugaacauguggugguuacaggcaaa

SEQ ID NO: 286169 - RNA, 32 nt, Human
aaaugaaugcagauugcgaaggucccugcaaa

SEQ ID NO: 286170 - RNA, 32 nt, Human
aaaugaauguaccauugacaaugguggcuguc

SEQ ID NO: 286171 - RNA, 32 nt, Human
aaaugaaugucuuguuccugugcauugguggc

SEQ ID NO: 286172 - RNA, 32 nt, Human
aaaugaauguguuuguugagauauuacaguaa

SEQ ID NO: 286173 - RNA, 32 nt, Human
aaaugaauugcaaguugccacaaccuauggug

SEQ ID NO: 286174 - RNA, 32 nt, Human
aaaugaauuuccuauaaauuaucauuggucag

SEQ ID NO: 286175 - RNA, 32 nt, Human
aaaugaauuugcauccugaggaagucucuucu

SEQ ID NO: 286176 - RNA, 32 nt, Human
aaaugacacaccuacucccaggaacagcagag

SEQ ID NO: 286177 - RNA, 32 nt, Human
aaaugacacagaacuauauacacacauuguac

SEQ ID NO: 286178 - RNA, 32 nt, Human
aaaugacacagaacuguauacacacauuguac

SEQ ID NO: 286179 - RNA, 32 nt, Human
aaaugacacagaacuuuguacuuuucagcucu

SEQ ID NO: 286180 - RNA, 32 nt, Human
aaaugacaccauaucaggguucugguucccua

SEQ ID NO: 286181 - RNA, 32 nt, Human
aaaugacaccccaguaaucuagaacauucuca

SEQ ID NO: 286182 - RNA, 31 nt, Human
aaaugacagugaauugacccauguucccuuu

SEQ ID NO: 286183 - RNA, 20 nt, Human
aaaugacagugugacagcuu

SEQ ID NO: 286184 - RNA, 32 nt, Human
aaaugacaguuugcuaaugauggucacuuccu

SEQ ID NO: 286185 - RNA, 32 nt, Human
aaaugacaucucucagcccucucagcugcacc

SEQ ID NO: 286186 - RNA, 32 nt, Human
aaaugacauguuuguauguaacuuacccacau

SEQ ID NO: 286187 - RNA, 27 nt, Human
aaaugaccaagucccuggaaucagugu

SEQ ID NO: 286188 - RNA, 32 nt, Human
aaaugaccaauacuuuuugaaauugauguacu

SEQ ID NO: 286189 - RNA, 32 nt, Human
aaaugaccaguggugugaucauagcucauagc

SEQ ID NO: 286190 - RNA, 32 nt, Human
aaaugaccaugaggaggaggaggggaaagcgc

SEQ ID NO: 286191 - RNA, 32 nt, Human
aaaugacccauucccugcccaccagaaacuca

SEQ ID NO: 286192 - RNA, 23 nt, Human
aaaugacccuuagggccaggaaa

SEQ ID NO: 286193 - RNA, 32 nt, Human
aaaugaccuaugcccaaagaacaaauacuuaa

SEQ ID NO: 286194 - RNA, 32 nt, Human
aaaugaccuguuugagaaaacucuuucugagu

SEQ ID NO: 286195 - RNA, 32 nt, Human
aaaugacgccauugcacuccagccuaggcaau

SEQ ID NO: 286196 - RNA, 32 nt, Human
aaaugacgggaguguacucagcuuugagccua

SEQ ID NO: 286197 - RNA, 32 nt, Human
aaaugacucagagugugcuuguccuucccuaa

SEQ ID NO: 286198 - RNA, 32 nt, Human
aaaugacugcaauaacaaugauucauucauua

SEQ ID NO: 286199 - RNA, 32 nt, Human
aaaugacuggcuuagaggcagcagcacuuggu

SEQ ID NO: 286200 - RNA, 32 nt, Human
aaaugacuggugcccaggaagcucugggcaua

SEQ ID NO: 286201 - RNA, 32 nt, Human
aaaugacuuccaggaaaggaagcaugguauau

SEQ ID NO: 286202 - RNA, 32 nt, Human
aaaugacuuccccacauugacauuugugcgcc

SEQ ID NO: 286203 - RNA, 32 nt, Human
aaaugacuuuggguuuugaacucuccaucuag

SEQ ID NO: 286204 - RNA, 32 nt, Human
aaaugacuuuuaggcugggugcaguggcucac

SEQ ID NO: 286205 - RNA, 32 nt, Human
aaaugacuuuugugccuuucugcuccagucuc

SEQ ID NO: 286206 - RNA, 25 nt, Human
aaaugacuuuuugucaguuguuuug

SEQ ID NO: 286207 - RNA, 32 nt, Human
aaaugagaaaaaugcccauuugugcacaagaa

SEQ ID NO: 286208 - RNA, 32 nt, Human
aaaugagaaggcagccaccagcgaaugcuagg

SEQ ID NO: 286209 - RNA, 32 nt, Human
aaaugagaaguaaaggcagaugaaaagaaaaa

SEQ ID NO: 286210 - RNA, 32 nt, Human
aaaugagagacaacaguccugugcaucuucag

SEQ ID NO: 286211 - RNA, 32 nt, Human
aaaugagagaugcagaauucuaaggcuaaaua

SEQ ID NO: 286212 - RNA, 23 nt, Human
aaaugagaggaggaaagacaucc

SEQ ID NO: 286213 - RNA, 32 nt, Human
aaaugagaggccucaauaaagacaucuggggc

SEQ ID NO: 286214 - RNA, 32 nt, Human
aaaugagaggugagcucauucuucugaaaugg

SEQ ID NO: 286215 - RNA, 32 nt, Human
aaaugagaguaaucaugcccacccucauuguc

SEQ ID NO: 286216 - RNA, 32 nt, Human
aaaugagauagaagaaaaguaagaaccaagau

SEQ ID NO: 286217 - RNA, 32 nt, Human
aaaugagaucaggcucugccucaccuuggggc

SEQ ID NO: 286218 - RNA, 32 nt, Human
aaaugagauccaggcuggagcggcugugccag

SEQ ID NO: 286219 - RNA, 32 nt, Human
aaaugagauggcacuuuaaucuuuauugauua

SEQ ID NO: 286220 - RNA, 32 nt, Human
aaaugagcaaaagaugaguccuugcuucccuc

SEQ ID NO: 286221 - RNA, 32 nt, Human
aaaugagcacacugcuggcccaugcgccucgg

SEQ ID NO: 286222 - RNA, 32 nt, Human
aaaugagcacugaccugaguuugaguugacuu

SEQ ID NO: 286223 - RNA, 32 nt, Human
aaaugagccaguuaucaaagaagaacuaguuc

SEQ ID NO: 286224 - RNA, 32 nt, Human
aaaugagccaguuaucaaagaagaacuaguuu

SEQ ID NO: 286225 - RNA, 32 nt, Human
aaaugagcucgggugacugcagauuaugaugg

SEQ ID NO: 286226 - RNA, 32 nt, Human
aaaugagcucucugccaagguuuuaagauaau

SEQ ID NO: 286227 - RNA, 32 nt, Human
aaaugagcugcuugccuuuccaccuccagggc

SEQ ID NO: 286228 - RNA, 32 nt, Human
aaaugaggaaacugaggcuuggugaaguuacg

SEQ ID NO: 286229 - RNA, 32 nt, Human
aaaugaggaaaucaaauuaaugaguugacaaa

SEQ ID NO: 286230 - RNA, 32 nt, Human
aaaugaggaagugacgcccagcaagguucaga

SEQ ID NO: 286231 - RNA, 32 nt, Human
aaaugaggagcuuggaagauccggaaaaugag

SEQ ID NO: 286232 - RNA, 32 nt, Human
aaaugaggaggcuguuuuccucugauucuccu

SEQ ID NO: 286233 - RNA, 27 nt, Human
aaaugaggcaacaugaugugcaggaac

SEQ ID NO: 286234 - RNA, 32 nt, Human
aaaugaggcaugaguuacugugcauugggauu

SEQ ID NO: 286235 - RNA, 32 nt, Human
aaaugaggcuaacagaccagacugcagcaagu

SEQ ID NO: 286236 - RNA, 32 nt, Human
aaaugaggcuuucugggucugccuguaugucu

SEQ ID NO: 286237 - RNA, 32 nt, Human
aaaugagggagagagaaaggguggccacuuuc

SEQ ID NO: 286238 - RNA, 32 nt, Human
aaaugagguaacugaggcucagggaggcacug

SEQ ID NO: 286239 - RNA, 20 nt, Human
aaaugaggugauaauagcuu

SEQ ID NO: 286240 - RNA, 32 nt, Human
aaaugaguaaauucagcacugguaccuuauua

SEQ ID NO: 286241 - RNA, 32 nt, Human
aaaugaguauucacauauaagagaugaacauc

SEQ ID NO: 286242 - RNA, 32 nt, Human
aaaugagucaguuagguagucuggaagagaga

SEQ ID NO: 286243 - RNA, 32 nt, Human
aaaugagucauuuuggaaaugauucuuauguu

SEQ ID NO: 286244 - RNA, 32 nt, Human
aaaugagucucaugccuguaaucccagcacuu

SEQ ID NO: 286245 - RNA, 32 nt, Human
aaaugagugagcugggaaguguuuccaaauac

SEQ ID NO: 286246 - RNA, 32 nt, Human
aaaugagugagggaaguucauaagguaaaucc

SEQ ID NO: 286247 - RNA, 32 nt, Human
aaaugagugauugauuuuaaugaggauugcua

SEQ ID NO: 286248 - RNA, 32 nt, Human
aaaugagugcagguugaaagaaaacaggugaa

SEQ ID NO: 286249 - RNA, 21 nt, Human
aaaugaguggccagcgccagg

SEQ ID NO: 286250 - RNA, 32 nt, Human
aaaugagugggcuaggaggacaaggaccgucu

SEQ ID NO: 286251 - RNA, 32 nt, Human
aaaugaguggggcggugaggggaaggaggagg

SEQ ID NO: 286252 - RNA, 32 nt, Human
aaaugagugugaagggggaacaagucaaaaua

SEQ ID NO: 286253 - RNA, 32 nt, Human
aaaugaguguucccuggaacaaggaggugggg

SEQ ID NO: 286254 - RNA, 32 nt, Human
aaaugaguuuacugcauuuuucaauccagauu

SEQ ID NO: 286255 - RNA, 32 nt, Human
aaaugaguuugggcugggcaugguggcucaca

SEQ ID NO: 286256 - RNA, 32 nt, Human
aaaugaguuuuuaauuaauaaauccuacagua

SEQ ID NO: 286257 - RNA, 32 nt, Human
aaaugauaaaaauuaagaaagagauuuugaag

SEQ ID NO: 286258 - RNA, 32 nt, Human
aaaugauaagcaaaauccucuuauuuucuaua

SEQ ID NO: 286259 - RNA, 32 nt, Human
aaaugauacaggguugguucucauuucgugcc

SEQ ID NO: 286260 - RNA, 32 nt, Human
aaaugauagcagccccgcacuugcuguaggaa

SEQ ID NO: 286261 - RNA, 32 nt, Human
aaaugaucagccaugccacugaagagcuggag

SEQ ID NO: 286262 - RNA, 32 nt, Human
aaaugaucagucucugucuccugggcccugcu

SEQ ID NO: 286263 - RNA, 32 nt, Human
aaaugauccuaccagugauuaguggcuauuga

SEQ ID NO: 286264 - RNA, 32 nt, Human
aaaugaucguucucacacucauauuagcucau

SEQ ID NO: 286265 - RNA, 32 nt, Human
aaaugaucucugaaagcauugccagcagccag

SEQ ID NO: 286266 - RNA, 32 nt, Human
aaaugaucugugcugaucuguucucuagugug

SEQ ID NO: 286267 - RNA, 32 nt, Human
aaaugaucuugaaugagugaaaaaucaguuug

SEQ ID NO: 286268 - RNA, 32 nt, Human
aaaugaucuuucaaguuucauaccuuuuggac

SEQ ID NO: 286269 - RNA, 32 nt, Human
aaaugaugaaauuuccagacagaaagagcccu

SEQ ID NO: 286270 - RNA, 32 nt, Human
aaaugaugaauaaccaguaccaguuccaguuc

SEQ ID NO: 286271 - RNA, 32 nt, Human
aaaugaugacacagcaguugccaucuugaaaa

SEQ ID NO: 286272 - RNA, 32 nt, Human
aaaugaugaccagcuaauuaaagaagauauuu

SEQ ID NO: 286273 - RNA, 32 nt, Human
aaaugaugaguuuuuaugguuccaaugaaaua

SEQ ID NO: 286274 - RNA, 27 nt, Human
aaaugauggcaagacugcuaagaacau

SEQ ID NO: 286275 - RNA, 32 nt, Human
aaaugaugugccagcuaaaauugugugccauu

SEQ ID NO: 286276 - RNA, 32 nt, Human
aaaugauguggaccuugcuggaaacaaaggcu

SEQ ID NO: 286277 - RNA, 32 nt, Human
aaaugauguuggcgggcuacaccccauucaca

SEQ ID NO: 286278 - RNA, 32 nt, Human
aaaugauuacuacccaugagauauauuuuuaa

SEQ ID NO: 286279 - RNA, 32 nt, Human
aaaugauuacuuucauccauccauuauaacaa

SEQ ID NO: 286280 - RNA, 32 nt, Human
aaaugauuagaaguaccuaauaguuugaacag

SEQ ID NO: 286281 - RNA, 32 nt, Human
aaaugauucacccaucccaagacuuucucacc

SEQ ID NO: 286282 - RNA, 32 nt, Human
aaaugauucauacaggcuguuuaaguacugca

SEQ ID NO: 286283 - RNA, 31 nt, Human
aaaugauugauucucccuggacaaagcagga

SEQ ID NO: 286284 - RNA, 32 nt, Human
aaaugauugcauucucauugagcaugaaaguc

SEQ ID NO: 286285 - RNA, 32 nt, Human
aaaugauuucuucagaucucaaaggagucuga

SEQ ID NO: 286286 - RNA, 32 nt, Human
aaaugauuugguagugaagccaggacaucuac

SEQ ID NO: 286287 - RNA, 32 nt, Human
aaaugcaaacacacaaagguauaauuuuauga

SEQ ID NO: 286288 - RNA, 32 nt, Human
aaaugcaaagaauaaagaacugagggaguuac

SEQ ID NO: 286289 - RNA, 32 nt, Human
aaaugcaaaugagacuccuggaaacugggugg

SEQ ID NO: 286290 - RNA, 32 nt, Human
aaaugcaaccaacugcugcugugcacauuuau

SEQ ID NO: 286291 - RNA, 32 nt, Human
aaaugcaacuguugauuuccucaacauggcuc

SEQ ID NO: 286292 - RNA, 32 nt, Human
aaaugcaagagggagaggggaaggagcuggua

SEQ ID NO: 286293 - RNA, 32 nt, Human
aaaugcaagaucaaggcuuggcccagaaacga

SEQ ID NO: 286294 - RNA, 32 nt, Human
aaaugcaaugacuggcugggugcaguggcuca

SEQ ID NO: 286295 - RNA, 25 nt, Human
aaaugcacacacaugcacacacaca

SEQ ID NO: 286296 - RNA, 32 nt, Human
aaaugcacacacaugcacacacacauuucagg

SEQ ID NO: 286297 - RNA, 32 nt, Human
aaaugcacagggcauaucuuuguuaaaguaga

SEQ ID NO: 286298 - RNA, 32 nt, Human
aaaugcaccacugcacuccagcaugggcaaca

SEQ ID NO: 286299 - RNA, 32 nt, Human
aaaugcacgaugaggagugcacugccucggga

SEQ ID NO: 286300 - RNA, 32 nt, Human
aaaugcacgcaagccauuaucucuccauggga

SEQ ID NO: 286301 - RNA, 32 nt, Human
aaaugcacuguucucagcccagcuggguucca

SEQ ID NO: 286302 - RNA, 31 nt, Human
aaaugcacuucucccucaaggagugggcuug

SEQ ID NO: 286303 - RNA, 32 nt, Human
aaaugcagaauuaaagagucauggcagggugu

SEQ ID NO: 286304 - RNA, 32 nt, Human
aaaugcagacgaagcauguaagaaauauuuag

SEQ ID NO: 286305 - RNA, 32 nt, Human
aaaugcagacuggccaggcacaguggcucaca

SEQ ID NO: 286306 - RNA, 32 nt, Human
aaaugcagagguaucaucuuucuuggaaacca

SEQ ID NO: 286307 - RNA, 32 nt, Human
aaaugcagccaagaagaggagaccgucggcaa

SEQ ID NO: 286308 - RNA, 32 nt, Human
aaaugcagcccaggcagaggacggugcagcca

SEQ ID NO: 286309 - RNA, 31 nt, Human
aaaugcagccucucucggggccucaucucag

SEQ ID NO: 286310 - RNA, 32 nt, Human
aaaugcagcuagauucaaaugggcugauaacc

SEQ ID NO: 286311 - RNA, 32 nt, Human
aaaugcagcucccuguccaagugccuuggaga

SEQ ID NO: 286312 - RNA, 32 nt, Human
aaaugcagcuuuuccaggguugcuggacuggg

SEQ ID NO: 286313 - RNA, 32 nt, Human
aaaugcaggaaggcugucucgccauccucaag

SEQ ID NO: 286314 - RNA, 32 nt, Human
aaaugcaggaggggugcuugccuccaaauagu

SEQ ID NO: 286315 - RNA, 32 nt, Human
aaaugcaggcugggcgcgguggcucacgccug

SEQ ID NO: 286316 - RNA, 32 nt, Human
aaaugcagggaggggaggcagauggagcccau

SEQ ID NO: 286317 - RNA, 32 nt, Human
aaaugcagguccaccagggagggagacacaca

SEQ ID NO: 286318 - RNA, 32 nt, Human
aaaugcaggugagaugcaagguuuucuaagug

SEQ ID NO: 286319 - RNA, 32 nt, Human
aaaugcaguacauuugaaaauuuuuagauuau

SEQ ID NO: 286320 - RNA, 32 nt, Human
aaaugcagugccuagagagagaguauugucuc

SEQ ID NO: 286321 - RNA, 32 nt, Human
aaaugcagugucugccuguuacagcaaaagaa

SEQ ID NO: 286322 - RNA, 32 nt, Human
aaaugcaguuauggauuucgcaguucaacucu

SEQ ID NO: 286323 - RNA, 32 nt, Human
aaaugcauaagguuaguacaagaucaguagag

SEQ ID NO: 286324 - RNA, 25 nt, Human
aaaugcauacacauacaugcacaca

SEQ ID NO: 286325 - RNA, 32 nt, Human
aaaugcauaugagauuauuaccaaugacaccg

SEQ ID NO: 286326 - RNA, 32 nt, Human
aaaugcaucaccuuugaaaauauuucacauau

SEQ ID NO: 286327 - RNA, 32 nt, Human
aaaugcaucacugugggugugaccucggcgug

SEQ ID NO: 286328 - RNA, 32 nt, Human
aaaugcaucauugcacuccagccugggugaca

SEQ ID NO: 286329 - RNA, 32 nt, Human
aaaugcaucccuuucuauuucucuccggauau

SEQ ID NO: 286330 - RNA, 27 nt, Human
aaaugcaucuuccuucuguucucucca

SEQ ID NO: 286331 - RNA, 32 nt, Human
aaaugcaucuuugccagcugaacuugucaugc

SEQ ID NO: 286332 - RNA, 32 nt, Human
aaaugcaucuuuucauguguccuuccugagca

SEQ ID NO: 286333 - RNA, 32 nt, Human
aaaugcaugacuucccuccaccccuacucuau

SEQ ID NO: 286334 - RNA, 32 nt, Human
aaaugcauggggugggacagguaggaguggcu

SEQ ID NO: 286335 - RNA, 32 nt, Human
aaaugcauguauuuuaaauacugguuaaaucu

SEQ ID NO: 286336 - RNA, 32 nt, Human
aaaugcauuuauguaagaucugugaguacuua

SEQ ID NO: 286337 - RNA, 32 nt, Human
aaaugccaaaaacauggaaugcuggaagccaa

SEQ ID NO: 286338 - RNA, 28 nt, Human
aaaugccaaaaaugugccucauuaagag

SEQ ID NO: 286339 - RNA, 32 nt, Human
aaaugccaaaguagcugauguauuggacguuc

SEQ ID NO: 286340 - RNA, 32 nt, Human
aaaugccaaauuugaaaggccuguacugcaau

SEQ ID NO: 286341 - RNA, 30 nt, Human
aaaugccaacuaaacaugaaacuauugauc

SEQ ID NO: 286342 - RNA, 32 nt, Human
aaaugccaaucaggagacaaacacuuguuuau

SEQ ID NO: 286343 - RNA, 32 nt, Human
aaaugccacuagagagagagugaugcaagcug

SEQ ID NO: 286344 - RNA, 32 nt, Human
aaaugccacuagcaccuggugugguacaggag

SEQ ID NO: 286345 - RNA, 32 nt, Human
aaaugccacuucugaggaauggaccuggugua

SEQ ID NO: 286346 - RNA, 32 nt, Human
aaaugccauuggauagaaggggacuguucuuc

SEQ ID NO: 286347 - RNA, 32 nt, Human
aaaugcccaagccaugguuaaaguucaauaaa

SEQ ID NO: 286348 - RNA, 32 nt, Human
aaaugcccagauguagaaauucaucagugccu

SEQ ID NO: 286349 - RNA, 32 nt, Human
aaaugcccagccugccccaaaugccucuaagc

SEQ ID NO: 286350 - RNA, 27 nt, Human
aaaugcccaggaggaagcaggagcagc

SEQ ID NO: 286351 - RNA, 32 nt, Human
aaaugcccaguaacuuuacagagcaaaauuuu

SEQ ID NO: 286352 - RNA, 32 nt, Human
aaaugcccauuuguaaaugagaaaaaugccca

SEQ ID NO: 286353 - RNA, 32 nt, Human
aaaugccccuacugaagacugggcucaaagga

SEQ ID NO: 286354 - RNA, 32 nt, Human
aaaugcccuggguucuuuagucuuccaaggga

SEQ ID NO: 286355 - RNA, 32 nt, Human
aaaugcccuuaaauuucaccauuugucuuuca

SEQ ID NO: 286356 - RNA, 32 nt, Human
aaaugccgcuucacugcugaagacaccaucug

SEQ ID NO: 286357 - RNA, 32 nt, Human
aaaugccgggauuacaggcaugagccaccgcu

SEQ ID NO: 286358 - RNA, 32 nt, Human
aaaugccguucccggcucggcucuggcagccc

SEQ ID NO: 286359 - RNA, 32 nt, Human
aaaugccuauaaucccagcuacucgggaggcu

SEQ ID NO: 286360 - RNA, 32 nt, Human
aaaugccuauguuucaggcaugauacuaggca

SEQ ID NO: 286361 - RNA, 32 nt, Human
aaaugccucacucuccugagaaacccagaaag

SEQ ID NO: 286362 - RNA, 32 nt, Human
aaaugccucuacuacucagccccuuucugcac

SEQ ID NO: 286363 - RNA, 32 nt, Human
aaaugccucucccauccucucucaggaagcuu

SEQ ID NO: 286364 - RNA, 32 nt, Human
aaaugccucuuaucccugaauucagagugaua

SEQ ID NO: 286365 - RNA, 32 nt, Human
aaaugccugcaacccagggcagggggcugaga

SEQ ID NO: 286366 - RNA, 32 nt, Human
aaaugccugcagcuuccagcuccuucgucccu

SEQ ID NO: 286367 - RNA, 32 nt, Human
aaaugccugcccaccugccccucuuccaucca

SEQ ID NO: 286368 - RNA, 32 nt, Human
aaaugccugccucuggccuuggcuguaggcca

SEQ ID NO: 286369 - RNA, 32 nt, Human
aaaugccuggagagccgaguugcagugcugga

SEQ ID NO: 286370 - RNA, 32 nt, Human
aaaugccuguaauaccagcuacucaggagcug

SEQ ID NO: 286371 - RNA, 32 nt, Human
aaaugccuguaaucccagcacuuugggaggcc

SEQ ID NO: 286372 - RNA, 32 nt, Human
aaaugccuguaaucccaguacuuugggaggcu

SEQ ID NO: 286373 - RNA, 32 nt, Human
aaaugccuguauuugaagucucuccccuuccu

SEQ ID NO: 286374 - RNA, 32 nt, Human
aaaugccuguccugccauccucccagguaguc

SEQ ID NO: 286375 - RNA, 27 nt, Human
aaaugccugucuggggagguggaaaca

SEQ ID NO: 286376 - RNA, 32 nt, Human
aaaugccuguguacaacaaugcuuugauaaaa

SEQ ID NO: 286377 - RNA, 32 nt, Human
aaaugccuguuucauaggaccuucugaaauga

SEQ ID NO: 286378 - RNA, 32 nt, Human
aaaugccuucuaagcugggggaggcgguaccu

SEQ ID NO: 286379 - RNA, 32 nt, Human
aaaugccuugacuuugugacugauugugcaag

SEQ ID NO: 286380 - RNA, 32 nt, Human
aaaugccuuucuguguuucugaaucagaagca

SEQ ID NO: 286381 - RNA, 32 nt, Human
aaaugccuuuggaugacccagcacuuuaaucu

SEQ ID NO: 286382 - RNA, 32 nt, Human
aaaugccuuuuugggcugggcacaguggcuua

SEQ ID NO: 286383 - RNA, 32 nt, Human
aaaugcgcaugaguccccaaccccuuguuucu

SEQ ID NO: 286384 - RNA, 32 nt, Human
aaaugcggaagaguuagccaggcgugguggca

SEQ ID NO: 286385 - RNA, 32 nt, Human
aaaugcggagugaaagagcaggagccagacac

SEQ ID NO: 286386 - RNA, 32 nt, Human
aaaugcgggcugggccuacccccugguggcca

SEQ ID NO: 286387 - RNA, 32 nt, Human
aaaugcuaaaggaaggucuucaaucagaaaca

SEQ ID NO: 286388 - RNA, 32 nt, Human
aaaugcuacagcugugagagcuuguuucugau

SEQ ID NO: 286389 - RNA, 32 nt, Human
aaaugcuacgccauuauaagccaguggaguaa

SEQ ID NO: 286390 - RNA, 32 nt, Human
aaaugcuagccuuugugcugggcagcaaagca

SEQ ID NO: 286391 - RNA, 32 nt, Human
aaaugcucaacuuguaucagguaauguuagca

SEQ ID NO: 286392 - RNA, 31 nt, Human
aaaugcucaaugucugaugcuaagugggaga

SEQ ID NO: 286393 - RNA, 32 nt, Human
aaaugcucaguuacaauuuccugcagaugaac

SEQ ID NO: 286394 - RNA, 32 nt, Human
aaaugcucccagagagcugcaugugacucccu

SEQ ID NO: 286395 - RNA, 32 nt, Human
aaaugcucucacugcccuacgcauuacaugcu

SEQ ID NO: 286396 - RNA, 32 nt, Human
aaaugcucucauaagaauuauugcauaccauc

SEQ ID NO: 286397 - RNA, 32 nt, Human
aaaugcucuguuacugauuagucuuaucaucc

SEQ ID NO: 286398 - RNA, 32 nt, Human
aaaugcucuuccuugagccuguuuccacaccu

SEQ ID NO: 286399 - RNA, 32 nt, Human
aaaugcugagaucugaggggacaaggcucuac

SEQ ID NO: 286400 - RNA, 32 nt, Human
aaaugcugagauuacaggugugagccaccaug

SEQ ID NO: 286401 - RNA, 32 nt, Human
aaaugcugagauuacaggugugagccacugca

SEQ ID NO: 286402 - RNA, 32 nt, Human
aaaugcugagauuacaggugugagugcccaug

SEQ ID NO: 286403 - RNA, 32 nt, Human
aaaugcugcucauugagccaaagagaagaaau

SEQ ID NO: 286404 - RNA, 32 nt, Human
aaaugcuggaagguggggcuuagugaugaaac

SEQ ID NO: 286405 - RNA, 21 nt, Human
aaaugcugggauuacagacau

SEQ ID NO: 286406 - RNA, 32 nt, Human
aaaugcugggauuacagacaugaaccaccacg

SEQ ID NO: 286407 - RNA, 32 nt, Human
aaaugcugggauuacagaugugagccaccaca

SEQ ID NO: 286408 - RNA, 32 nt, Human
aaaugcugggauuacaggagugagccaccaug

SEQ ID NO: 286409 - RNA, 32 nt, Human
aaaugcugggauuacaggcauaagccaccgug

SEQ ID NO: 286410 - RNA, 32 nt, Human
aaaugcugggauuacaggcaugagccaccaca

SEQ ID NO: 286411 - RNA, 32 nt, Human
aaaugcugggauuacaggcaugagccaccgcg

SEQ ID NO: 286412 - RNA, 32 nt, Human
aaaugcugggauuacaggcaugagccaccgug

SEQ ID NO: 286413 - RNA, 32 nt, Human
aaaugcugggauuacaggcaugagccaccugc

SEQ ID NO: 286414 - RNA, 32 nt, Human
aaaugcugggauuacaggcaugagccacugcg

SEQ ID NO: 286415 - RNA, 32 nt, Human
aaaugcugggauuacaggcaugagccacugua

SEQ ID NO: 286416 - RNA, 32 nt, Human
aaaugcugggauuacaggccugagccacugcg

SEQ ID NO: 286417 - RNA, 32 nt, Human
aaaugcugggauuacaggcguaagccacuauc

SEQ ID NO: 286418 - RNA, 32 nt, Human
aaaugcugggauuacaggcguaagccacugca

SEQ ID NO: 286419 - RNA, 32 nt, Human
aaaugcugggauuacaggcgugagccaccacg

SEQ ID NO: 286420 - RNA, 32 nt, Human
aaaugcugggauuacaggcgugagccaccaug

SEQ ID NO: 286421 - RNA, 32 nt, Human
aaaugcugggauuacaggcgugagccaccgag

SEQ ID NO: 286422 - RNA, 32 nt, Human
aaaugcugggauuacaggcgugagccaccgcg

SEQ ID NO: 286423 - RNA, 32 nt, Human
aaaugcugggauuacaggcgugagccacggca

SEQ ID NO: 286424 - RNA, 32 nt, Human
aaaugcugggauuacaggcgugagccacugca

SEQ ID NO: 286425 - RNA, 32 nt, Human
aaaugcugggauuacaggcgugagccacuggc

SEQ ID NO: 286426 - RNA, 32 nt, Human
aaaugcugggauuacaggcuugagccacugcu

SEQ ID NO: 286427 - RNA, 32 nt, Human
aaaugcugggauuacagggguaagccacugug

SEQ ID NO: 286428 - RNA, 32 nt, Human
aaaugcugggauuacaggggugagccaccgug

SEQ ID NO: 286429 - RNA, 32 nt, Human
aaaugcugggauuacaggugugagccacaguu

SEQ ID NO: 286430 - RNA, 32 nt, Human
aaaugcugggauuacaggugugagccaccgcg

SEQ ID NO: 286431 - RNA, 32 nt, Human
aaaugcugggauuacaggugugagccaccgug

SEQ ID NO: 286432 - RNA, 32 nt, Human
aaaugcugggauuacaggugugagccacugcg

SEQ ID NO: 286433 - RNA, 32 nt, Human
aaaugcugggauuacaggugugagccacugug

SEQ ID NO: 286434 - RNA, 32 nt, Human
aaaugcugucacagacccaucccuguggcauc

SEQ ID NO: 286435 - RNA, 32 nt, Human
aaaugcuuacagggaaaggggaaaguggauca

SEQ ID NO: 286436 - RNA, 32 nt, Human
aaaugcuuccuucacauccucugugaugauca

SEQ ID NO: 286437 - RNA, 32 nt, Human
aaaugcuucucaacuuugaugauggcuccagu

SEQ ID NO: 286438 - RNA, 32 nt, Human
aaaugcuugcuuuuuguucccuaguuggucua

SEQ ID NO: 286439 - RNA, 32 nt, Human
aaaugcuuuaccccacgccuguuuguauuggg

SEQ ID NO: 286440 - RNA, 32 nt, Human
aaaugcuuuauaacaagaaucuucuucaucuu

SEQ ID NO: 286441 - RNA, 32 nt, Human
aaaugcuuucaucuauguuuaucacauuuuaa

SEQ ID NO: 286442 - RNA, 32 nt, Human
aaaugcuuuguuggcaccucagauuaaucaua

SEQ ID NO: 286443 - RNA, 32 nt, Human
aaauggaaaagaaacuuggauuaaaugagugu

SEQ ID NO: 286444 - RNA, 32 nt, Human
aaauggaaaaggagaggcuacuucaaguggug

SEQ ID NO: 286445 - RNA, 32 nt, Human
aaauggaacagcucuuagcagcugugguuuuu

SEQ ID NO: 286446 - RNA, 32 nt, Human
aaauggaacggcuucucaucuuucugccguuu

SEQ ID NO: 286447 - RNA, 32 nt, Human
aaauggaagagcaggucacugaagaagauccu

SEQ ID NO: 286448 - RNA, 32 nt, Human
aaauggaagauggagucagcuauugaaguggu

SEQ ID NO: 286449 - RNA, 32 nt, Human
aaauggaagcacauggcacugggaaauaggag

SEQ ID NO: 286450 - RNA, 32 nt, Human
aaauggaaggaaugugcuugccugucaggugc

SEQ ID NO: 286451 - RNA, 32 nt, Human
aaauggaaggaucgcuugaggcccagagucug

SEQ ID NO: 286452 - RNA, 32 nt, Human
aaauggaagguaaacugcauagcccagagaaa

SEQ ID NO: 286453 - RNA, 32 nt, Human
aaauggaaguaccagcagaagguuagagaaaa

SEQ ID NO: 286454 - RNA, 20 nt, Human
aaauggaaugauaauagcuu

SEQ ID NO: 286455 - RNA, 32 nt, Human
aaauggaauguucacccuacuaccaaugggga

SEQ ID NO: 286456 - RNA, 32 nt, Human
aaauggacaacuugguuguccagacagguuga

SEQ ID NO: 286457 - RNA, 32 nt, Human
aaauggacagacaacauggaauauaauaacau

SEQ ID NO: 286458 - RNA, 27 nt, Human
aaauggaccagccagguuugcauagca

SEQ ID NO: 286459 - RNA, 32 nt, Human
aaauggacccuuuaaaaauuauuuuuaccuga

SEQ ID NO: 286460 - RNA, 32 nt, Human
aaauggaccugacagcccaaacugucagagag

SEQ ID NO: 286461 - RNA, 27 nt, Human
aaauggacucacugucaucuuccuuca

SEQ ID NO: 286462 - RNA, 32 nt, Human
aaauggacuuuuauuuucucucuguuuggugc

SEQ ID NO: 286463 - RNA, 32 nt, Human
aaauggagagaaggaaacaucuccagauuuug

SEQ ID NO: 286464 - RNA, 32 nt, Human
aaauggagagcguuuucgcaccccagggacug

SEQ ID NO: 286465 - RNA, 32 nt, Human
aaauggagagugaggaaugggagaggcccaga

SEQ ID NO: 286466 - RNA, 32 nt, Human
aaauggagauaaugguuacaaaugucucuucc

SEQ ID NO: 286467 - RNA, 32 nt, Human
aaauggagauggcaaaugaagcacagaaaucu

SEQ ID NO: 286468 - RNA, 32 nt, Human
aaauggagaugggaucacuauguugcccaugc

SEQ ID NO: 286469 - RNA, 32 nt, Human
aaauggagccccuccaugcagagauccugagg

SEQ ID NO: 286470 - RNA, 32 nt, Human
aaauggagcuguagaagaggcauguuuaacug

SEQ ID NO: 286471 - RNA, 32 nt, Human
aaauggaggaagaaaacaaagaaucuaguagc

SEQ ID NO: 286472 - RNA, 32 nt, Human
aaauggaggacagaggugacaaacuucaguuu

SEQ ID NO: 286473 - RNA, 32 nt, Human
aaauggaggcaacaggagcacaaggacccagc

SEQ ID NO: 286474 - RNA, 32 nt, Human
aaauggaggcucagagagguuaagugaauuga

SEQ ID NO: 286475 - RNA, 32 nt, Human
aaauggagggggaagagaggaggggagaggag

SEQ ID NO: 286476 - RNA, 32 nt, Human
aaauggagguccuggagguuacaugacuagcc

SEQ ID NO: 286477 - RNA, 32 nt, Human
aaauggaggugguccagagagggucugggauu

SEQ ID NO: 286478 - RNA, 30 nt, Human
aaauggagguugcaaucagccgagauggug

SEQ ID NO: 286479 - RNA, 32 nt, Human
aaauggauaaugaagccucuugggaggcccua

SEQ ID NO: 286480 - RNA, 32 nt, Human
aaauggauacuacaucuuuaaacaguauuuca

SEQ ID NO: 286481 - RNA, 32 nt, Human
aaauggaucaggcaggccagaggggcaguuca

SEQ ID NO: 286482 - RNA, 32 nt, Human
aaauggaugaaugagagagggagggaacagug

SEQ ID NO: 286483 - RNA, 32 nt, Human
aaauggaugcagacuccagcagccuggucucc

SEQ ID NO: 286484 - RNA, 23 nt, Human
aaauggauucuuaggagcauuuu

SEQ ID NO: 286485 - RNA, 32 nt, Human
aaauggcaaaagaaaugcagauuucccaguua

SEQ ID NO: 286486 - RNA, 32 nt, Human
aaauggcaaaaucuuaacgugggugaaagagc

SEQ ID NO: 286487 - RNA, 32 nt, Human
aaauggcaaacuacuacuacuacuguucaguu

SEQ ID NO: 286488 - RNA, 32 nt, Human
aaauggcaaaggaagguggauggccccagcac

SEQ ID NO: 286489 - RNA, 32 nt, Human
aaauggcaacacagaugguagcugcacagcuu

SEQ ID NO: 286490 - RNA, 32 nt, Human
aaauggcaaucagucgagccucugacuggcug

SEQ ID NO: 286491 - RNA, 32 nt, Human
aaauggcacagcaaggguguuugcaccagaag

SEQ ID NO: 286492 - RNA, 32 nt, Human
aaauggcagagccaggaguuggaccuagguuu

SEQ ID NO: 286493 - RNA, 27 nt, Human
aaauggcagagguggaggagacacuga

SEQ ID NO: 286494 - RNA, 32 nt, Human
aaauggcagcacuuaaagacuuuuggugaaaa

SEQ ID NO: 286495 - RNA, 32 nt, Human
aaauggcaguacugcuccacuucaccuuccua

SEQ ID NO: 286496 - RNA, 32 nt, Human
aaauggcauuuagccaaaggccuuuucagcca

SEQ ID NO: 286497 - RNA, 32 nt, Human
aaauggccagcuccuucugggguggccggauu

SEQ ID NO: 286498 - RNA, 32 nt, Human
aaauggccaucaucuaguaauaccuguguuug

SEQ ID NO: 286499 - RNA, 32 nt, Human
aaauggccaugcugccuucugggcaggacacg

SEQ ID NO: 286500 - RNA, 32 nt, Human
aaauggccauugagcuguuuccucacaauugg

SEQ ID NO: 286501 - RNA, 32 nt, Human
aaauggcccacaacacugaguuaguggacacc

SEQ ID NO: 286502 - RNA, 32 nt, Human
aaauggccuuagcuguuucuccagacucccuu

SEQ ID NO: 286503 - RNA, 32 nt, Human
aaauggccuugcagcaguuccaaaaggguggg

SEQ ID NO: 286504 - RNA, 32 nt, Human
aaauggcgacacugcacugcaggcugggcuac

SEQ ID NO: 286505 - RNA, 32 nt, Human
aaauggcgaugguggaggugauagggacuuca

SEQ ID NO: 286506 - RNA, 32 nt, Human
aaauggcgccacugcacuccagccuggguaac

SEQ ID NO: 286507 - RNA, 32 nt, Human
aaauggcgccgggcagcuucauccccuccccc

SEQ ID NO: 286508 - RNA, 32 nt, Human
aaauggcggcgccggcggcgugaccgggcccu

SEQ ID NO: 286509 - RNA, 32 nt, Human
aaauggcgucuggaaguccaauguggcaagga

SEQ ID NO: 286510 - RNA, 32 nt, Human
aaauggcuaaaaagaucccaggcuuacucuga

SEQ ID NO: 286511 - RNA, 32 nt, Human
aaauggcuaaggucaaguaaagcacaacauua

SEQ ID NO: 286512 - RNA, 32 nt, Human
aaauggcuccaauguauagucuguguaugcgu

SEQ ID NO: 286513 - RNA, 27 nt, Human
aaauggcucggaggcaggaagagcaga

SEQ ID NO: 286514 - RNA, 27 nt, Human
aaauggcugauaguggcuuagauaaaa

SEQ ID NO: 286515 - RNA, 27 nt, Human
aaauggcugcagcuccucaagcaccgg

SEQ ID NO: 286516 - RNA, 32 nt, Human
aaauggcugcucccuccugccugcuauccaag

SEQ ID NO: 286517 - RNA, 32 nt, Human
aaauggcuggaggaaggagggaagaaauuagg

SEQ ID NO: 286518 - RNA, 22 nt, Human
aaauggcuggugagauugcaga

SEQ ID NO: 286519 - RNA, 32 nt, Human
aaauggcuguccuggauuguguuaacaugggu

SEQ ID NO: 286520 - RNA, 32 nt, Human
aaauggcuucuucccagcccugccuacaaguu

SEQ ID NO: 286521 - RNA, 32 nt, Human
aaaugggaaaggauucuuuuaauuguggauua

SEQ ID NO: 286522 - RNA, 15 nt, Human
aaaugggaacaguuu

SEQ ID NO: 286523 - RNA, 24 nt, Human
aaaugggaagggaagaaaacacca

SEQ ID NO: 286524 - RNA, 32 nt, Human
aaaugggaagggagaauggacagguaggaagg

SEQ ID NO: 286525 - RNA, 32 nt, Human
aaaugggaaugggagagggcagcucuacaaag

SEQ ID NO: 286526 - RNA, 32 nt, Human
aaaugggacaacaucugccagcaacgcgagag

SEQ ID NO: 286527 - RNA, 32 nt, Human
aaaugggacagaguccugagccccagauucca

SEQ ID NO: 286528 - RNA, 32 nt, Human
aaaugggagcaguauuugcugcauaggguggu

SEQ ID NO: 286529 - RNA, 32 nt, Human
aaaugggagcaguccauggugcagcccucaug

SEQ ID NO: 286530 - RNA, 32 nt, Human
aaaugggaggaaagacaagaagaaauagaagc

SEQ ID NO: 286531 - RNA, 32 nt, Human
aaaugggaggcaucauaauuguauauuauuca

SEQ ID NO: 286532 - RNA, 32 nt, Human
aaaugggaggcgggaaagugaggccggagacu

SEQ ID NO: 286533 - RNA, 32 nt, Human
aaaugggagguggaggguuguacugugaccau

SEQ ID NO: 286534 - RNA, 32 nt, Human
aaaugggauggacugacggacaguuccagaag

SEQ ID NO: 286535 - RNA, 32 nt, Human
aaaugggauuccagguuuaagauagcuccuuu

SEQ ID NO: 286536 - RNA, 32 nt, Human
aaaugggauugugaggaugaaagggaagaguu

SEQ ID NO: 286537 - RNA, 32 nt, Human
aaaugggcaaggacgcccugcccucacugggc

SEQ ID NO: 286538 - RNA, 32 nt, Human
aaaugggcaaggcagaguaagcaggggagaca

SEQ ID NO: 286539 - RNA, 32 nt, Human
aaaugggcaagggagagcggguggagggcccu

SEQ ID NO: 286540 - RNA, 32 nt, Human
aaaugggcacaucugcuauauucacuuucauu

SEQ ID NO: 286541 - RNA, 18 nt, Human
aaaugggcauaauaguuu

SEQ ID NO: 286542 - RNA, 32 nt, Human
aaaugggcauacugcccaaagcaauuuauaga

SEQ ID NO: 286543 - RNA, 32 nt, Human
aaaugggcugugucugugccucucucucuuuc

SEQ ID NO: 286544 - RNA, 32 nt, Human
aaaugggcuuccugccugguuuuucucuucuc

SEQ ID NO: 286545 - RNA, 19 nt, Human
aaauggggaaauugcagau

SEQ ID NO: 286546 - RNA, 32 nt, Human
aaauggggaagggggccuggagaggggaggca

SEQ ID NO: 286547 - RNA, 32 nt, Human
aaauggggaauauuugaaacaugcauuuuuaa

SEQ ID NO: 286548 - RNA, 32 nt, Human
aaauggggaggaacccucaguuccaggaauug

SEQ ID NO: 286549 - RNA, 32 nt, Human
aaauggggaggcuaggcucuccccagcccuau

SEQ ID NO: 286550 - RNA, 32 nt, Human
aaauggggauggcuggggcucucuccauccuc

SEQ ID NO: 286551 - RNA, 32 nt, Human
aaauggggauggugaucccugcccuuucuacc

SEQ ID NO: 286552 - RNA, 32 nt, Human
aaauggggccaguccccaugcccugcuguccu

SEQ ID NO: 286553 - RNA, 32 nt, Human
aaauggggcccagagagaugggcugaggucac

SEQ ID NO: 286554 - RNA, 23 nt, Human
aaauggggcccagauugcagaug

SEQ ID NO: 286555 - RNA, 19 nt, Human
aaauggggccuuuguguca

SEQ ID NO: 286556 - RNA, 17 nt, Human
aaauggggcuccacaga

SEQ ID NO: 286557 - RNA, 20 nt, Human
aaauggggcugugucagaug

SEQ ID NO: 286558 - RNA, 32 nt, Human
aaaugggggaagggggcugaggcguggaggaa

SEQ ID NO: 286559 - RNA, 32 nt, Human
aaauggggguacccagggaugggcaggcuuug

SEQ ID NO: 286560 - RNA, 32 nt, Human
aaaugggguuguggggcagagcaggguuagga

SEQ ID NO: 286561 - RNA, 18 nt, Human
aaauggguaguacuguuu

SEQ ID NO: 286562 - RNA, 32 nt, Human
aaauggguaugcuucacuacuauccacagugu

SEQ ID NO: 286563 - RNA, 32 nt, Human
aaaugggucccaaaggauauguuuggauauuu

SEQ ID NO: 286564 - RNA, 32 nt, Human
aaaugggucuuuucagugcaaugugguuauga

SEQ ID NO: 286565 - RNA, 22 nt, Human
aaaugggugcuuuuggcaguuu

SEQ ID NO: 286566 - RNA, 17 nt, Human
aaauggguggauaucuu

SEQ ID NO: 286567 - RNA, 18 nt, Human
aaauggguguaauucagc

SEQ ID NO: 286568 - RNA, 32 nt, Human
aaauggguuuuuaacaaaugccucauuaguac

SEQ ID NO: 286569 - RNA, 32 nt, Human
aaaugguacagcaggugcacuguuaacagugu

SEQ ID NO: 286570 - RNA, 32 nt, Human
aaaugguagggagcgcuguggagacagcaucc

SEQ ID NO: 286571 - RNA, 32 nt, Human
aaauggucaaaggggcugggcaugguggcuca

SEQ ID NO: 286572 - RNA, 32 nt, Human
aaauggucaaggaauucauuuggcuccuugau

SEQ ID NO: 286573 - RNA, 32 nt, Human
aaauggucauuucccuguucacuuacugacau

SEQ ID NO: 286574 - RNA, 32 nt, Human
aaauggucauuuuucugaagagaauauuuugc

SEQ ID NO: 286575 - RNA, 32 nt, Human
aaaugguccaggaaugaacguggagaaaagaa

SEQ ID NO: 286576 - RNA, 32 nt, Human
aaauggugauauagaccucagagcuguuaucu

SEQ ID NO: 286577 - RNA, 32 nt, Human
aaauggugccacugcacuccagucugggcaac

SEQ ID NO: 286578 - RNA, 32 nt, Human
aaauggugccauugaagccacaaagccgguaa

SEQ ID NO: 286579 - RNA, 32 nt, Human
aaauggugccuguaaagcucucagcauuggcu

SEQ ID NO: 286580 - RNA, 32 nt, Human
aaauggugggauuacaggugugugggccaccg

SEQ ID NO: 286581 - RNA, 32 nt, Human
aaauggugucauuuaugaacaauguuuaauua

SEQ ID NO: 286582 - RNA, 32 nt, Human
aaaugguuaggauauaacucaugguguggcua

SEQ ID NO: 286583 - RNA, 32 nt, Human
aaaugguuccaucagcucaggccaaguggaaa

SEQ ID NO: 286584 - RNA, 32 nt, Human
aaaugguucuacugcauccuuuggcugggccu

SEQ ID NO: 286585 - RNA, 32 nt, Human
aaaugguucugagagaaugagcuaauagagca

SEQ ID NO: 286586 - RNA, 32 nt, Human
aaaugguuguaagacuuugggcucagauaagu

SEQ ID NO: 286587 - RNA, 31 nt, Human
aaaugguuucucaaggagauuggggacgcca

SEQ ID NO: 286588 - RNA, 32 nt, Human
aaaugguuuuaaguuuauggagaguuuagucc

SEQ ID NO: 286589 - RNA, 32 nt, Human
aaauguaaaugucuguugaauuucugaaguug

SEQ ID NO: 286590 - RNA, 32 nt, Human
aaauguaaccaccucccugccuagaauacaca

SEQ ID NO: 286591 - RNA, 32 nt, Human
aaauguaaccucuauguaaggagguguuuuuc

SEQ ID NO: 286592 - RNA, 32 nt, Human
aaauguaagaaaagauuuuucacuggagcagc

SEQ ID NO: 286593 - RNA, 32 nt, Human
aaauguaaggagccuacuuagagcagaagaaa

SEQ ID NO: 286594 - RNA, 32 nt, Human
aaauguaaugauuucuucuuuuccuauugacc

SEQ ID NO: 286595 - RNA, 32 nt, Human
aaauguaauguuauauaagaugaucaugugau

SEQ ID NO: 286596 - RNA, 32 nt, Human
aaauguaauugggggcggcgggggaggagagg

SEQ ID NO: 286597 - RNA, 32 nt, Human
aaauguacaauaaauguguaaugaguaaccag

SEQ ID NO: 286598 - RNA, 32 nt, Human
aaauguacaccaggcugggugcgguggcucac

SEQ ID NO: 286599 - RNA, 32 nt, Human
aaauguacagaagaaagcauagcaggaaauca

SEQ ID NO: 286600 - RNA, 32 nt, Human
aaauguacauucucaggcuccacagcaggccg

SEQ ID NO: 286601 - RNA, 32 nt, Human
aaauguacucaucaucuguaauaaaagaaaaa

SEQ ID NO: 286602 - RNA, 32 nt, Human
aaauguacuugcucagcucaacugcauuucag

SEQ ID NO: 286603 - RNA, 32 nt, Human
aaauguacuuuagacaugaaugcaacuauuua

SEQ ID NO: 286604 - RNA, 32 nt, Human
aaauguagaaaaucauugaguucucucagguc

SEQ ID NO: 286605 - RNA, 32 nt, Human
aaauguagacuguccuuagacuccugagguuu

SEQ ID NO: 286606 - RNA, 32 nt, Human
aaauguagagcaccauuuuucucaaugaguuu

SEQ ID NO: 286607 - RNA, 32 nt, Human
aaauguagauuguaacagccuccuuggacaac

SEQ ID NO: 286608 - RNA, 32 nt, Human
aaauguagcauuagcucucacaaaagaggacc

SEQ ID NO: 286609 - RNA, 32 nt, Human
aaauguagccucauaacugugcaccugaggag

SEQ ID NO: 286610 - RNA, 32 nt, Human
aaauguagcuggugggagacuuuguagauguu

SEQ ID NO: 286611 - RNA, 32 nt, Human
aaauguaguuugaauauuuuccacaagaugcu

SEQ ID NO: 286612 - RNA, 32 nt, Human
aaauguaucccucguuuaucauccccuuuguu

SEQ ID NO: 286613 - RNA, 17 nt, Human
aaauguaugagcagcuu

SEQ ID NO: 286614 - RNA, 32 nt, Human
aaauguauuauugccaaccaagucgucaaauc

SEQ ID NO: 286615 - RNA, 32 nt, Human
aaauguauucuacuuguucuaaaacaaucugu

SEQ ID NO: 286616 - RNA, 21 nt, Human
aaauguauucuguaccauuua

SEQ ID NO: 286617 - RNA, 32 nt, Human
aaauguauuuccaaauaccaccaccuuaaggg

SEQ ID NO: 286618 - RNA, 32 nt, Human
aaauguauuuggaauuuuauuugaaauggaga

SEQ ID NO: 286619 - RNA, 32 nt, Human
aaauguauuuguccuucucaaagcaaaccaga

SEQ ID NO: 286620 - RNA, 32 nt, Human
aaaugucagcccacagagcuaauaauaccuca

SEQ ID NO: 286621 - RNA, 32 nt, Human
aaaugucaggcaggauaggucugauugauggu

SEQ ID NO: 286622 - RNA, 32 nt, Human
aaaugucaucuucuccccagacgcuggcuugc

SEQ ID NO: 286623 - RNA, 32 nt, Human
aaaugucaugguauaaacuagacaucuuauau

SEQ ID NO: 286624 - RNA, 32 nt, Human
aaauguccacugcuucuugaaaaaucucuuag

SEQ ID NO: 286625 - RNA, 32 nt, Human
aaauguccagaugccagccucauaguugaacu

SEQ ID NO: 286626 - RNA, 32 nt, Human
aaauguccaucuuucucagacggggcucuguc

SEQ ID NO: 286627 - RNA, 32 nt, Human
aaaugucccuuucuucucccccauccuacgag

SEQ ID NO: 286628 - RNA, 32 nt, Human
aaaugucucuuauuccagaaaugugcauuuug

SEQ ID NO: 286629 - RNA, 32 nt, Human
aaaugucugccucuccagacauuucuuaauga

SEQ ID NO: 286630 - RNA, 32 nt, Human
aaaugucuggaaaguauguggauuggacacau

SEQ ID NO: 286631 - RNA, 32 nt, Human
aaaugucugggcaccccaugcccagucaaguu

SEQ ID NO: 286632 - RNA, 32 nt, Human
aaaugucugucucucucuuuuuguuuuguuug

SEQ ID NO: 286633 - RNA, 32 nt, Human
aaaugucugugaauauuucuugagugcagaug

SEQ ID NO: 286634 - RNA, 32 nt, Human
aaaugucugugccaaaauuuuguauuuuauuu

SEQ ID NO: 286635 - RNA, 32 nt, Human
aaaugugaaaggagguuucuuacuggacagca

SEQ ID NO: 286636 - RNA, 32 nt, Human
aaaugugaagaaacuccuuucaucucagcagg

SEQ ID NO: 286637 - RNA, 32 nt, Human
aaaugugaccauaaaauuagggcugcugcuuu

SEQ ID NO: 286638 - RNA, 32 nt, Human
aaaugugaccuucccuacuggccaggugagca

SEQ ID NO: 286639 - RNA, 32 nt, Human
aaaugugagagcccagaacaugcauauaaagc

SEQ ID NO: 286640 - RNA, 32 nt, Human
aaaugugagagcccagaacaugcauauaaagg

SEQ ID NO: 286641 - RNA, 32 nt, Human
aaaugugagaguguuuaacuggacagcccaga

SEQ ID NO: 286642 - RNA, 32 nt, Human
aaaugugagcauuaagcacuccaggcuuucau

SEQ ID NO: 286643 - RNA, 32 nt, Human
aaaugugagccccaggcugcagaaggaagagu

SEQ ID NO: 286644 - RNA, 32 nt, Human
aaaugugagccuugcuuuuuaugaaaagcugu

SEQ ID NO: 286645 - RNA, 32 nt, Human
aaaugugaucacugagacagccacuugguuuu

SEQ ID NO: 286646 - RNA, 32 nt, Human
aaaugugaucauugauuucaguguucaagaca

SEQ ID NO: 286647 - RNA, 32 nt, Human
aaaugugcaaaacuggagaaucuggugcugau

SEQ ID NO: 286648 - RNA, 32 nt, Human
aaaugugcaaaccucuguggauaccauuucau

SEQ ID NO: 286649 - RNA, 32 nt, Human
aaaugugcaaaccuguucaucuugccaagaaa

SEQ ID NO: 286650 - RNA, 32 nt, Human
aaaugugcagaacuguagaaacuuuagaggca

SEQ ID NO: 286651 - RNA, 32 nt, Human
aaaugugcaucaagaaagacuacugaaaagua

SEQ ID NO: 286652 - RNA, 18 nt, Human
aaaugugccccccuaccc

SEQ ID NO: 286653 - RNA, 20 nt, Human
aaaugugcccuuuuggccgg

SEQ ID NO: 286654 - RNA, 32 nt, Human
aaaugugcuuucuaauagccauugccuuccau

SEQ ID NO: 286655 - RNA, 32 nt, Human
aaaugugcuuugauguuuaaagccacuguacc

SEQ ID NO: 286656 - RNA, 32 nt, Human
aaauguggcaaagagaagaaaggcccaagagc

SEQ ID NO: 286657 - RNA, 32 nt, Human
aaauguggcuccaagcucaggugccuuugagu

SEQ ID NO: 286658 - RNA, 32 nt, Human
aaauguggcuuuugaaguaccuaguuaccuug

SEQ ID NO: 286659 - RNA, 27 nt, Human
aaaugugggaagagagaagcaaauuaa

SEQ ID NO: 286660 - RNA, 32 nt, Human
aaaugugggaauuaagcaaaaucaagcaagcc

SEQ ID NO: 286661 - RNA, 31 nt, Human
aaauguggugagagaggaauugaauugaaau

SEQ ID NO: 286662 - RNA, 32 nt, Human
aaaugugguguuugcuguaaauuggauugaau

SEQ ID NO: 286663 - RNA, 32 nt, Human
aaauguguaauaccuucuuuuucuauuauguu

SEQ ID NO: 286664 - RNA, 32 nt, Human
aaauguguacuauguaccuaugaugugucaua

SEQ ID NO: 286665 - RNA, 32 nt, Human
aaaugugucaacugccugucagccuggauuca

SEQ ID NO: 286666 - RNA, 32 nt, Human
aaaugugugucuucagugcuuucucuaaaaac

SEQ ID NO: 286667 - RNA, 32 nt, Human
aaauguguucacaggcaaugggggugguccug

SEQ ID NO: 286668 - RNA, 32 nt, Human
aaauguguucaucaaaucuggucaagggacua

SEQ ID NO: 286669 - RNA, 32 nt, Human
aaauguguucuacuuguucuaaaacaaucugu

SEQ ID NO: 286670 - RNA, 32 nt, Human
aaauguguucuccuauuccucauaaagcuugu

SEQ ID NO: 286671 - RNA, 32 nt, Human
aaauguguucucucuggacucuugccuagcuc

SEQ ID NO: 286672 - RNA, 32 nt, Human
aaauguguuguugcuguguccuggaggagaca

SEQ ID NO: 286673 - RNA, 32 nt, Human
aaauguuacaaauucccgaaagaagggaauuu

SEQ ID NO: 286674 - RNA, 32 nt, Human
aaauguuagcuccaugaggguaggggugugua

SEQ ID NO: 286675 - RNA, 32 nt, Human
aaauguuaugaucacuuucacccaugauauaa

SEQ ID NO: 286676 - RNA, 32 nt, Human
aaauguuauucuauguaaauacagaugcacaa

SEQ ID NO: 286677 - RNA, 32 nt, Human
aaauguucaaucuuuccucuagcuucuugaau

SEQ ID NO: 286678 - RNA, 32 nt, Human
aaauguucacagaaccugcagugcugacuuca

SEQ ID NO: 286679 - RNA, 32 nt, Human
aaauguucagcccuccuaguuauguuccugau

SEQ ID NO: 286680 - RNA, 32 nt, Human
aaauguucaugaaaauccacuucucuacuagu

SEQ ID NO: 286681 - RNA, 32 nt, Human
aaauguucauucuucaucagcuuugcuaauuc

SEQ ID NO: 286682 - RNA, 32 nt, Human
aaauguucauucuuucaggaauacaaguuugu

SEQ ID NO: 286683 - RNA, 32 nt, Human
aaauguuccaagcuguuacuuaccuuaacaug

SEQ ID NO: 286684 - RNA, 32 nt, Human
aaauguuccugauugcuggaagcugcggcuca

SEQ ID NO: 286685 - RNA, 32 nt, Human
aaauguucucuuacaauauauuuuggagguuu

SEQ ID NO: 286686 - RNA, 32 nt, Human
aaauguucuggguggggguagaaugagguggg

SEQ ID NO: 286687 - RNA, 32 nt, Human
aaauguucuuccaguuacuuuccaauucuccu

SEQ ID NO: 286688 - RNA, 32 nt, Human
aaauguugaaaaggaagguggaaaaccaagaa

SEQ ID NO: 286689 - RNA, 32 nt, Human
aaauguugaaccuggguguugcuuccgggcca

SEQ ID NO: 286690 - RNA, 32 nt, Human
aaauguugacaccuuaaucggucccagguaug

SEQ ID NO: 286691 - RNA, 32 nt, Human
aaauguugcaauuacaggcaugagcacugugc

SEQ ID NO: 286692 - RNA, 32 nt, Human
aaauguugccaagucugugguccaugggcuuu

SEQ ID NO: 286693 - RNA, 27 nt, Human
aaauguugcccaggaaggacaggugug

SEQ ID NO: 286694 - RNA, 32 nt, Human
aaauguugcccaguaugugcgcauugccagug

SEQ ID NO: 286695 - RNA, 23 nt, Human
aaauguugccuuuuagcauucca

SEQ ID NO: 286696 - RNA, 31 nt, Human
aaauguuggaaacugccuauccuggugacuc

SEQ ID NO: 286697 - RNA, 32 nt, Human
aaauguuggaaccauuucucucuuggucucug

SEQ ID NO: 286698 - RNA, 32 nt, Human
aaauguuggacaagcagacacacucacacucg

SEQ ID NO: 286699 - RNA, 32 nt, Human
aaauguugggauuacaggcaugagccacugca

SEQ ID NO: 286700 - RNA, 32 nt, Human
aaauguugggauuacaggcgugagccaccgug

SEQ ID NO: 286701 - RNA, 21 nt, Human
aaauguugggcuucugugccu

SEQ ID NO: 286702 - RNA, 32 nt, Human
aaauguuguccacuucccuuuuccacaggccu

SEQ ID NO: 286703 - RNA, 32 nt, Human
aaauguuguccuguacuuacuaggcaaaacgu

SEQ ID NO: 286704 - RNA, 32 nt, Human
aaauguuguuacuaugcauguauauggaugga

SEQ ID NO: 286705 - RNA, 32 nt, Human
aaauguuuaaauuggcugggcacagugucuca

SEQ ID NO: 286706 - RNA, 32 nt, Human
aaauguuuacagacaaauaauuuugggagcug

SEQ ID NO: 286707 - RNA, 32 nt, Human
aaauguuuagacaggauauuuucuugaugaag

SEQ ID NO: 286708 - RNA, 32 nt, Human
aaauguuuauucaugucuuuugcccacuuuuu

SEQ ID NO: 286709 - RNA, 32 nt, Human
aaauguuuccagagaaauauccaggacuuuua

SEQ ID NO: 286710 - RNA, 32 nt, Human
aaauguuugaaagccacugagauagaaggacc

SEQ ID NO: 286711 - RNA, 32 nt, Human
aaauguuugccugucugaacugugaagacacu

SEQ ID NO: 286712 - RNA, 32 nt, Human
aaauguuugccuuggucguuguggaccuccuu

SEQ ID NO: 286713 - RNA, 32 nt, Human
aaauguuuguaaucucauaagcacuuuauaaa

SEQ ID NO: 286714 - RNA, 32 nt, Human
aaauguuuguucugcauguguuccaugccagu

SEQ ID NO: 286715 - RNA, 32 nt, Human
aaauguuuuaaucacucuugccauuaccuaca

SEQ ID NO: 286716 - RNA, 32 nt, Human
aaauguuuuaaugccagggccugcugaguugc

SEQ ID NO: 286717 - RNA, 32 nt, Human
aaauguuuuaauucacaaauggagauuuguau

SEQ ID NO: 286718 - RNA, 32 nt, Human
aaauguuuuacugucuaucaccaccaucuaua

SEQ ID NO: 286719 - RNA, 32 nt, Human
aaauguuuucuaacucaacuggccggcuuccu

SEQ ID NO: 286720 - RNA, 32 nt, Human
aaauguuuucuuugguucauccuucuuuaaca

SEQ ID NO: 286721 - RNA, 32 nt, Human
aaauguuuugagacagggucucauucugaugc

SEQ ID NO: 286722 - RNA, 32 nt, Human
aaauguuuuguaacucaacuggccugcuuccu

SEQ ID NO: 286723 - RNA, 32 nt, Human
aaauguuuuuaaaaauugaaagccugaaugug

SEQ ID NO: 286724 - RNA, 32 nt, Human
aaauguuuuucaaauaugugaaaugugaaacu

SEQ ID NO: 286725 - RNA, 32 nt, Human
aaauguuuuucuuccucuuuaucuaacuauau

SEQ ID NO: 286726 - RNA, 22 nt, Human
aaauguuuuuguuuuuguuuua

SEQ ID NO: 286727 - RNA, 32 nt, Human
aaauuaaaagccuuaggaggcuuguucugugu

SEQ ID NO: 286728 - RNA, 32 nt, Human
aaauuaaaauauuucuacauuuuauugaaaaa

SEQ ID NO: 286729 - RNA, 32 nt, Human
aaauuaaaauuaaaaacuaauucacucugggc

SEQ ID NO: 286730 - RNA, 32 nt, Human
aaauuaaaccaccauugccagacuacaagccc

SEQ ID NO: 286731 - RNA, 31 nt, Human
aaauuaaagaaaagugguuguaggggauguu

SEQ ID NO: 286732 - RNA, 32 nt, Human
aaauuaaaucauagccugggugcaguggcuca

SEQ ID NO: 286733 - RNA, 32 nt, Human
aaauuaaaucuaguucaccuugcucacccugc

SEQ ID NO: 286734 - RNA, 32 nt, Human
aaauuaaauuaguucagccauuguggaagaca

SEQ ID NO: 286735 - RNA, 20 nt, Human
aaauuaaauucugaguguga

SEQ ID NO: 286736 - RNA, 22 nt, Human
aaauuaaauucuugaugcugac

SEQ ID NO: 286737 - RNA, 32 nt, Human
aaauuaacagaaaaacagaacaaguuuauucu

SEQ ID NO: 286738 - RNA, 32 nt, Human
aaauuaacagcaguucacuuuauugugagucu

SEQ ID NO: 286739 - RNA, 32 nt, Human
aaauuaaccuaccuggccaggcacaguggcuc

SEQ ID NO: 286740 - RNA, 32 nt, Human
aaauuaacgugacuuggcugggcgcaguggcu

SEQ ID NO: 286741 - RNA, 32 nt, Human
aaauuaacuguacagguuuguuaucacaaugu

SEQ ID NO: 286742 - RNA, 32 nt, Human
aaauuaagaacugcacuuuauugacuucgaua

SEQ ID NO: 286743 - RNA, 32 nt, Human
aaauuaagaacuuacaucacaaaccaacccca

SEQ ID NO: 286744 - RNA, 32 nt, Human
aaauuaagaagaaccccuccagugugaaguuu

SEQ ID NO: 286745 - RNA, 32 nt, Human
aaauuaagagaagagagggagugaaggguggc

SEQ ID NO: 286746 - RNA, 32 nt, Human
aaauuaagcuaacagaacaggagcucagcugg

SEQ ID NO: 286747 - RNA, 32 nt, Human
aaauuaaggagagccaauaaaugaguauagga

SEQ ID NO: 286748 - RNA, 32 nt, Human
aaauuaaggcuuaaagaaugagcauggccaca

SEQ ID NO: 286749 - RNA, 32 nt, Human
aaauuaagggaacagugucuguuugcauguaa

SEQ ID NO: 286750 - RNA, 32 nt, Human
aaauuaagggucucgcucugucacccaagcug

SEQ ID NO: 286751 - RNA, 27 nt, Human
aaauuaaguaucauggaacuuuagaga

SEQ ID NO: 286752 - RNA, 32 nt, Human
aaauuaagucaacagcaggagucaguuugucc

SEQ ID NO: 286753 - RNA, 32 nt, Human
aaauuaaucaacuagagaggugcaaaacguuc

SEQ ID NO: 286754 - RNA, 32 nt, Human
aaauuaaugaugguuauuucuguuuuaguggu

SEQ ID NO: 286755 - RNA, 32 nt, Human
aaauuaauuaauauaucuuuaaagauaucaua

SEQ ID NO: 286756 - RNA, 32 nt, Human
aaauuaauuagcuuuccucugcuuuaugacca

SEQ ID NO: 286757 - RNA, 23 nt, Human
aaauuaauucagccauuguggaa

SEQ ID NO: 286758 - RNA, 32 nt, Human
aaauuaauuccuguggacaaugcccagucucu

SEQ ID NO: 286759 - RNA, 32 nt, Human
aaauuaauuuagaucucgcugggaaacguagc

SEQ ID NO: 286760 - RNA, 32 nt, Human
aaauuacaaaaaugaacccaagucuguuuuaa

SEQ ID NO: 286761 - RNA, 32 nt, Human
aaauuacaagccacagucuaauaugucuuauu

SEQ ID NO: 286762 - RNA, 32 nt, Human
aaauuacacuucagaaaagacaucaaaggcaa

SEQ ID NO: 286763 - RNA, 32 nt, Human
aaauuacagacgugugccaccaugcuuggcua

SEQ ID NO: 286764 - RNA, 32 nt, Human
aaauuacaggguuagcaaaaagagccugggcu

SEQ ID NO: 286765 - RNA, 32 nt, Human
aaauuacauggugugaacggcaugucugugga

SEQ ID NO: 286766 - RNA, 32 nt, Human
aaauuaccauugcuuccuccagcuugucagaa

SEQ ID NO: 286767 - RNA, 32 nt, Human
aaauuacccaggagugguggugugcaccugua

SEQ ID NO: 286768 - RNA, 32 nt, Human
aaauuaccuaauucugguaauaggcuucagca

SEQ ID NO: 286769 - RNA, 32 nt, Human
aaauuaccuaggguaaaggauagcugcaacaa

SEQ ID NO: 286770 - RNA, 32 nt, Human
aaauuaccugacacauaccacgcuuaaaccaa

SEQ ID NO: 286771 - RNA, 32 nt, Human
aaauuaccugagacccagaggguguaggaaug

SEQ ID NO: 286772 - RNA, 32 nt, Human
aaauuaccuggagugaggauuacuuguaauua

SEQ ID NO: 286773 - RNA, 32 nt, Human
aaauuacgccacugcacuccagccugggcaac

SEQ ID NO: 286774 - RNA, 32 nt, Human
aaauuacgggaguguacucagcuuugagccua

SEQ ID NO: 286775 - RNA, 32 nt, Human
aaauuacucuucgggucccaagguuuggcuuu

SEQ ID NO: 286776 - RNA, 32 nt, Human
aaauuacugaaacuauuuuacugugaaacagu

SEQ ID NO: 286777 - RNA, 32 nt, Human
aaauuacugaagauaggccacagggaguaggg

SEQ ID NO: 286778 - RNA, 32 nt, Human
aaauuacugccccucacugggucucugucuac

SEQ ID NO: 286779 - RNA, 32 nt, Human
aaauuacugcccuauguugucuauaagaccaa

SEQ ID NO: 286780 - RNA, 32 nt, Human
aaauuacuuaguccuuaggccaaccaauuuaa

SEQ ID NO: 286781 - RNA, 32 nt, Human
aaauuacuucagcuuuggaaauacucaggcug

SEQ ID NO: 286782 - RNA, 32 nt, Human
aaauuacuugaacccagcaguucgagacuugc

SEQ ID NO: 286783 - RNA, 32 nt, Human
aaauuacuuuucaccagcaucuuuacuauaau

SEQ ID NO: 286784 - RNA, 32 nt, Human
aaauuacuuuuguaauuauuugcaauuaauug

SEQ ID NO: 286785 - RNA, 32 nt, Human
aaauuagaaacucagaaauggaaagggaacaa

SEQ ID NO: 286786 - RNA, 32 nt, Human
aaauuagaaaugucaauaagaacccauggaca

SEQ ID NO: 286787 - RNA, 32 nt, Human
aaauuagaaugacaguguuggaauuuggaggc

SEQ ID NO: 286788 - RNA, 31 nt, Human
aaauuagaauuaugcugccuaccucacagag

SEQ ID NO: 286789 - RNA, 32 nt, Human
aaauuagacaguguuuaauuuucgaaaacuuc

SEQ ID NO: 286790 - RNA, 32 nt, Human
aaauuagacgauuucaagaauuggagcugaau

SEQ ID NO: 286791 - RNA, 32 nt, Human
aaauuagagaacacugggugguuugaagggug

SEQ ID NO: 286792 - RNA, 32 nt, Human
aaauuagaguucuucagaaaaccaaugggaug

SEQ ID NO: 286793 - RNA, 32 nt, Human
aaauuagauacccaacuuaaaccaaaggcaug

SEQ ID NO: 286794 - RNA, 32 nt, Human
aaauuagauuuucuuuaauaaaaugccauuug

SEQ ID NO: 286795 - RNA, 31 nt, Human
aaauuagcacuuuuggggccaauggagaaau

SEQ ID NO: 286796 - RNA, 32 nt, Human
aaauuagcagcccucugcauaauguagcugcc

SEQ ID NO: 286797 - RNA, 32 nt, Human
aaauuagccagccacggggccugcacuuccag

SEQ ID NO: 286798 - RNA, 32 nt, Human
aaauuagccaggugugguggcuugugcuuguu

SEQ ID NO: 286799 - RNA, 32 nt, Human
aaauuagcccagcuaauuuuuguauuuuuagu

SEQ ID NO: 286800 - RNA, 32 nt, Human
aaauuagccgggcauugugguggugcaugccu

SEQ ID NO: 286801 - RNA, 32 nt, Human
aaauuagcuccccauccucccuccucacuccc

SEQ ID NO: 286802 - RNA, 32 nt, Human
aaauuagcucugauuagcuuucacuuccugua

SEQ ID NO: 286803 - RNA, 19 nt, Human
aaauuagcugggcuuggug

SEQ ID NO: 286804 - RNA, 32 nt, Human
aaauuagcuggguuugguggcgcaugcuugua

SEQ ID NO: 286805 - RNA, 32 nt, Human
aaauuagcuucaaacacauuguauagcuguac

SEQ ID NO: 286806 - RNA, 32 nt, Human
aaauuagcuuggugugguggugcauugccugu

SEQ ID NO: 286807 - RNA, 32 nt, Human
aaauuaggaaaugcugauagcucauauuauaa

SEQ ID NO: 286808 - RNA, 32 nt, Human
aaauuaggaugcaggcuggguaugguggcuca

SEQ ID NO: 286809 - RNA, 21 nt, Human
aaauuaggcugaauguacuuc

SEQ ID NO: 286810 - RNA, 32 nt, Human
aaauuagggcugggcccauuagcucacaccug

SEQ ID NO: 286811 - RNA, 32 nt, Human
aaauuagguuuacuucuugucucuccaagugg

SEQ ID NO: 286812 - RNA, 32 nt, Human
aaauuaguaacugguggggucgugggguguga

SEQ ID NO: 286813 - RNA, 32 nt, Human
aaauuaguaagaaccugcauccaaagcaaugu

SEQ ID NO: 286814 - RNA, 32 nt, Human
aaauuaguaguuaccuguaaauggcagaucuu

SEQ ID NO: 286815 - RNA, 23 nt, Human
aaauuaguauuuucccuuuggaa

SEQ ID NO: 286816 - RNA, 32 nt, Human
aaauuagucaccugaguaacuuggccacuaau

SEQ ID NO: 286817 - RNA, 32 nt, Human
aaauuagucacggcacugcagccugggcaaca

SEQ ID NO: 286818 - RNA, 32 nt, Human
aaauuagugucaggcaguucccagaaagagac

SEQ ID NO: 286819 - RNA, 22 nt, Human
aaauuaguucaaccacugcgga

SEQ ID NO: 286820 - RNA, 24 nt, Human
aaauuaguucaaccacugcggaag

SEQ ID NO: 286821 - RNA, 22 nt, Human
aaauuaguucaaccauugugga

SEQ ID NO: 286822 - RNA, 24 nt, Human
aaauuaguucaaccauuguggaag

SEQ ID NO: 286823 - RNA, 22 nt, Human
aaauuaguucagccauugugga

SEQ ID NO: 286824 - RNA, 24 nt, Human
aaauuaguucagccauuguggaag

SEQ ID NO: 286825 - RNA, 32 nt, Human
aaauuaguucuuccuccucaacucauaggagu

SEQ ID NO: 286826 - RNA, 32 nt, Human
aaauuauaaaaauugaggcaaagagagcccca

SEQ ID NO: 286827 - RNA, 32 nt, Human
aaauuauaaaacaugaaaaucgcuuugaggug

SEQ ID NO: 286828 - RNA, 32 nt, Human
aaauuauaccucaauguccccaacaagauugc

SEQ ID NO: 286829 - RNA, 32 nt, Human
aaauuauaucgcugauuuuaagcccuuuugca

SEQ ID NO: 286830 - RNA, 32 nt, Human
aaauuauauuuuaagcuuauuucuucaaaauu

SEQ ID NO: 286831 - RNA, 32 nt, Human
aaauuaucaaagaacauuaacuggaaggucag

SEQ ID NO: 286832 - RNA, 32 nt, Human
aaauuaucuguugucuacaugguacaaggccc

SEQ ID NO: 286833 - RNA, 32 nt, Human
aaauuaucuucaaugacuugucuuguucauau

SEQ ID NO: 286834 - RNA, 32 nt, Human
aaauuaugccacugcacuccagccugggcaac

SEQ ID NO: 286835 - RNA, 32 nt, Human
aaauuaugucaaaaugaaaacuguuuguuuca

SEQ ID NO: 286836 - RNA, 32 nt, Human
aaauuaugugaauagagaccauuuuucaaaac

SEQ ID NO: 286837 - RNA, 32 nt, Human
aaauuaugugccagcgccugcuggaccccaaa

SEQ ID NO: 286838 - RNA, 32 nt, Human
aaauuauguuaauaaauauucccacauaauac

SEQ ID NO: 286839 - RNA, 32 nt, Human
aaauuauguuguuacacaacaaauuguggggc

SEQ ID NO: 286840 - RNA, 32 nt, Human
aaauuauguuugcaguucauguagcaggcaug

SEQ ID NO: 286841 - RNA, 32 nt, Human
aaauuauucagauguacacccacccacauauc

SEQ ID NO: 286842 - RNA, 32 nt, Human
aaauuauucccugaauuguuugauauugucac

SEQ ID NO: 286843 - RNA, 32 nt, Human
aaauuauuccuugcuuucaucacuaccuuuau

SEQ ID NO: 286844 - RNA, 32 nt, Human
aaauuauucuccuguugagguccguggauggc

SEQ ID NO: 286845 - RNA, 32 nt, Human
aaauuauucucuuuugaaccuuccuuaccaaa

SEQ ID NO: 286846 - RNA, 32 nt, Human
aaauuauucuggucagaaaaccuguguguuuc

SEQ ID NO: 286847 - RNA, 32 nt, Human
aaauuauucuuagaaacugauuuggacuguua

SEQ ID NO: 286848 - RNA, 32 nt, Human
aaauuauucuuguaacacuucugguuuuguug

SEQ ID NO: 286849 - RNA, 32 nt, Human
aaauuauuucagucuuccauuaguucauuuca

SEQ ID NO: 286850 - RNA, 32 nt, Human
aaauuauuugcuuaagaagaauggucuuaacc

SEQ ID NO: 286851 - RNA, 32 nt, Human
aaauuauuuuccgaaggagguggguugggaga

SEQ ID NO: 286852 - RNA, 32 nt, Human
aaauuauuuuuacaguguguuugaggcuacaa

SEQ ID NO: 286853 - RNA, 32 nt, Human
aaauuauuuuuauggucccuuuaacgaggacc

SEQ ID NO: 286854 - RNA, 32 nt, Human
aaauucaaaguugcacuuuucaagaugugaga

SEQ ID NO: 286855 - RNA, 32 nt, Human
aaauucaaccucuguuccucaugggagucuga

SEQ ID NO: 286856 - RNA, 32 nt, Human
aaauucaaggagaaggaaugaggaguuaggga

SEQ ID NO: 286857 - RNA, 32 nt, Human
aaauucaauuaauuuuuggugcugcuauugca

SEQ ID NO: 286858 - RNA, 32 nt, Human
aaauucacaaauaacccuccauuuuucaauau

SEQ ID NO: 286859 - RNA, 32 nt, Human
aaauucaccucucucacugacuauuacaguug

SEQ ID NO: 286860 - RNA, 32 nt, Human
aaauucacucccuuggccauuaggcagggcuu

SEQ ID NO: 286861 - RNA, 32 nt, Human
aaauucagaauagauuaccauuaccuuccugc

SEQ ID NO: 286862 - RNA, 32 nt, Human
aaauucagcaacagacaccugcccacaaauca

SEQ ID NO: 286863 - RNA, 32 nt, Human
aaauucaggacaggagugaacucaaggccaug

SEQ ID NO: 286864 - RNA, 32 nt, Human
aaauucaggcugggugcaguggcucacacuug

SEQ ID NO: 286865 - RNA, 32 nt, Human
aaauucaggugccacugaaagccagauuuaua

SEQ ID NO: 286866 - RNA, 32 nt, Human
aaauucaggugugauccaagaggcucaugaaa

SEQ ID NO: 286867 - RNA, 32 nt, Human
aaauucagucaccacuguuauauuaccuucuc

SEQ ID NO: 286868 - RNA, 32 nt, Human
aaauucaguuuauuuggugaaaagaggaaaac

SEQ ID NO: 286869 - RNA, 32 nt, Human
aaauucauagagaggcacuguaugacaauuac

SEQ ID NO: 286870 - RNA, 32 nt, Human
aaauucauggccaccagcucaaguggacacuu

SEQ ID NO: 286871 - RNA, 32 nt, Human
aaauuccaaacagaaccagugacuuugcugcu

SEQ ID NO: 286872 - RNA, 32 nt, Human
aaauuccaaacaggccaacaagcagguaaauu

SEQ ID NO: 286873 - RNA, 32 nt, Human
aaauuccaaagagucaucagaagaggaaaaau

SEQ ID NO: 286874 - RNA, 32 nt, Human
aaauuccaagagccccagcccuaagggaaccc

SEQ ID NO: 286875 - RNA, 32 nt, Human
aaauuccaagaguuacaaucuggacuugguac

SEQ ID NO: 286876 - RNA, 32 nt, Human
aaauuccaaugcccacauguggcacagccuuc

SEQ ID NO: 286877 - RNA, 32 nt, Human
aaauuccacaacugccuuuagccuucuggaua

SEQ ID NO: 286878 - RNA, 32 nt, Human
aaauuccacacagauaagaggcaggauauaua

SEQ ID NO: 286879 - RNA, 32 nt, Human
aaauuccagaugagucagucucuugggaagug

SEQ ID NO: 286880 - RNA, 32 nt, Human
aaauuccagccaaccucaccuccucgggccca

SEQ ID NO: 286881 - RNA, 32 nt, Human
aaauuccagccagaugguagaagcgaugaauc

SEQ ID NO: 286882 - RNA, 32 nt, Human
aaauucccaguaaagaaugugaaagcaagcau

SEQ ID NO: 286883 - RNA, 32 nt, Human
aaauuccccuaccccuguuuaaagcugaaaaa

SEQ ID NO: 286884 - RNA, 32 nt, Human
aaauuccuaaacucccuucccucucucccauu

SEQ ID NO: 286885 - RNA, 32 nt, Human
aaauuccuaucaccuggugacaucaucacaug

SEQ ID NO: 286886 - RNA, 32 nt, Human
aaauuccucaacugcuauuuauuuauuccagc

SEQ ID NO: 286887 - RNA, 32 nt, Human
aaauuccuccucuaauuucagaauaaucacug

SEQ ID NO: 286888 - RNA, 32 nt, Human
aaauuccugcucaguuucacugcagcccuaau

SEQ ID NO: 286889 - RNA, 32 nt, Human
aaauuccugcuuguaauuuauauccauguuua

SEQ ID NO: 286890 - RNA, 32 nt, Human
aaauucgagacccagucucagagccaucggug

SEQ ID NO: 286891 - RNA, 32 nt, Human
aaauucgaggaaauguuuaaugagaauugcuu

SEQ ID NO: 286892 - RNA, 32 nt, Human
aaauucgaugaauacauuuucuucauaaccca

SEQ ID NO: 286893 - RNA, 32 nt, Human
aaauucgcccuuuaacagcuugcucuggcaac

SEQ ID NO: 286894 - RNA, 32 nt, Human
aaauucggacaauggauuauugguuacacaug

SEQ ID NO: 286895 - RNA, 32 nt, Human
aaauucggacuuguaggcgaucagggcugaag

SEQ ID NO: 286896 - RNA, 32 nt, Human
aaauucguugccaaagauuggacagagacacc

SEQ ID NO: 286897 - RNA, 32 nt, Human
aaauucuaaaggauuucugugcuauuauaauu

SEQ ID NO: 286898 - RNA, 32 nt, Human
aaauucuaguaaaaauaucucuaaguaaacuu

SEQ ID NO: 286899 - RNA, 32 nt, Human
aaauucucacucagguacacagugccaacaag

SEQ ID NO: 286900 - RNA, 32 nt, Human
aaauucucagccacccagacuuccugcaucag

SEQ ID NO: 286901 - RNA, 32 nt, Human
aaauucucaugauaugcuaaaauaucauuagc

SEQ ID NO: 286902 - RNA, 32 nt, Human
aaauucucuugugucucuuuccagucaauuuc

SEQ ID NO: 286903 - RNA, 32 nt, Human
aaauucucuuucucccucucuucuccaaucaa

SEQ ID NO: 286904 - RNA, 32 nt, Human
aaauucugaauagaauugcacucagaacuuau

SEQ ID NO: 286905 - RNA, 32 nt, Human
aaauucugacaugcugcaauauggaugaagcu

SEQ ID NO: 286906 - RNA, 32 nt, Human
aaauucugagccuuccucuggacccaggcagg

SEQ ID NO: 286907 - RNA, 19 nt, Human
aaauucugaguaucuacug

SEQ ID NO: 286908 - RNA, 32 nt, Human
aaauucugcagcugucugcugcucuaaagagu

SEQ ID NO: 286909 - RNA, 32 nt, Human
aaauucugccacuccagcuccuggguuagggg

SEQ ID NO: 286910 - RNA, 31 nt, Human
aaauucugccucucuggaucugcuuccugau

SEQ ID NO: 286911 - RNA, 32 nt, Human
aaauucugcugaccccagcuuuaggaaagauc

SEQ ID NO: 286912 - RNA, 32 nt, Human
aaauucuggaaggaauggaggagucucaacau

SEQ ID NO: 286913 - RNA, 29 nt, Human
aaauucuggcugcuucaucuccaucucua

SEQ ID NO: 286914 - RNA, 32 nt, Human
aaauucuggcugcuucaucuccaucucuagag

SEQ ID NO: 286915 - RNA, 32 nt, Human
aaauucugggagaaggggaugccagaccccuc

SEQ ID NO: 286916 - RNA, 32 nt, Human
aaauucugggauuacaggcauaagccaaugug

SEQ ID NO: 286917 - RNA, 32 nt, Human
aaauucugggauuacaggcaugagccaccaug

SEQ ID NO: 286918 - RNA, 32 nt, Human
aaauucugggcugucauauguaggauagccac

SEQ ID NO: 286919 - RNA, 32 nt, Human
aaauucuguccucaguggagagggagaaccgc

SEQ ID NO: 286920 - RNA, 32 nt, Human
aaauucuguuagcugcucacuuaaacaauguc

SEQ ID NO: 286921 - RNA, 32 nt, Human
aaauucuuaucaauuuggcaagcuacuuauca

SEQ ID NO: 286922 - RNA, 32 nt, Human
aaauucuuaugagccacucacagcaggcagca

SEQ ID NO: 286923 - RNA, 32 nt, Human
aaauucuucaugaacauaacucugcugaaugu

SEQ ID NO: 286924 - RNA, 32 nt, Human
aaauucuugccuggaaacuuuggagcaauuaa

SEQ ID NO: 286925 - RNA, 32 nt, Human
aaauucuuguaagcucugcgucgggugaaacc

SEQ ID NO: 286926 - RNA, 32 nt, Human
aaauucuuucaugagcuugccuaaaauucgga

SEQ ID NO: 286927 - RNA, 32 nt, Human
aaauugaaaacacacucaaaagacaaacaugc

SEQ ID NO: 286928 - RNA, 32 nt, Human
aaauugaaaaugugcauguuuuggugcacaaa

SEQ ID NO: 286929 - RNA, 32 nt, Human
aaauugaaaugagaaucuguggauaaguguuu

SEQ ID NO: 286930 - RNA, 32 nt, Human
aaauugaaccagccuggagucuuauucuccac

SEQ ID NO: 286931 - RNA, 32 nt, Human
aaauugaagcccagggaagggaagggaccggu

SEQ ID NO: 286932 - RNA, 32 nt, Human
aaauugaaggagaaaauuuaagugagucuuua

SEQ ID NO: 286933 - RNA, 32 nt, Human
aaauugaagucaggauaaggaggacgacucag

SEQ ID NO: 286934 - RNA, 32 nt, Human
aaauugaaguugagcaagcuuuccacucgaug

SEQ ID NO: 286935 - RNA, 32 nt, Human
aaauugacauauuuuuauguaaaguuuuucua

SEQ ID NO: 286936 - RNA, 32 nt, Human
aaauugaccacugucuaaggagccuaguaauc

SEQ ID NO: 286937 - RNA, 32 nt, Human
aaauugacuaccuggaggaaugauuaggaauc

SEQ ID NO: 286938 - RNA, 32 nt, Human
aaauugacugccaggcugggugcaguggcuca

SEQ ID NO: 286939 - RNA, 32 nt, Human
aaauugacuguacuguuuaacugucaauucuc

SEQ ID NO: 286940 - RNA, 32 nt, Human
aaauugagaaggcugcccgcaccagcugggaa

SEQ ID NO: 286941 - RNA, 32 nt, Human
aaauugagcagcuucagaaaauccugcgaagu

SEQ ID NO: 286942 - RNA, 32 nt, Human
aaauugaggaaaucacuauuucucacuucugu

SEQ ID NO: 286943 - RNA, 32 nt, Human
aaauugagguccagagaggucacagucacgaa

SEQ ID NO: 286944 - RNA, 32 nt, Human
aaauugaggucucaaggggaaaagccaccugc

SEQ ID NO: 286945 - RNA, 32 nt, Human
aaauugagguggauaaauacaaaaagguagug

SEQ ID NO: 286946 - RNA, 31 nt, Human
aaauugaguauuuucugacauaagaauauau

SEQ ID NO: 286947 - RNA, 32 nt, Human
aaauugauaccuguuagcauucacugccacca

SEQ ID NO: 286948 - RNA, 32 nt, Human
aaauugauauuagcugggcaugguagcucaug

SEQ ID NO: 286949 - RNA, 32 nt, Human
aaauugauauucucaugggcuuugcugagagu

SEQ ID NO: 286950 - RNA, 32 nt, Human
aaauugaucuuaauaacucucccuucauaucu

SEQ ID NO: 286951 - RNA, 32 nt, Human
aaauugauuaccugaagcauaguacuagaaag

SEQ ID NO: 286952 - RNA, 32 nt, Human
aaauugcaaaacuggcuugauuuggaauguuu

SEQ ID NO: 286953 - RNA, 32 nt, Human
aaauugcaaaguacaauuaacauuugagucug

SEQ ID NO: 286954 - RNA, 32 nt, Human
aaauugcaaccauuucacaccauuguaaaguc

SEQ ID NO: 286955 - RNA, 32 nt, Human
aaauugcaagccacacuucuagagauuuuguu

SEQ ID NO: 286956 - RNA, 32 nt, Human
aaauugcaccacugcacacugcacuccauccu

SEQ ID NO: 286957 - RNA, 32 nt, Human
aaauugcaccacugcacuccagccugggaaac

SEQ ID NO: 286958 - RNA, 32 nt, Human
aaauugcaccacugcacuccagccugggagac

SEQ ID NO: 286959 - RNA, 32 nt, Human
aaauugcaccacugcacuccauccugggcaac

SEQ ID NO: 286960 - RNA, 32 nt, Human
aaauugcaccacugcacugcagccugggaaac

SEQ ID NO: 286961 - RNA, 32 nt, Human
aaauugcaccauugcacuccagccugggcaau

SEQ ID NO: 286962 - RNA, 32 nt, Human
aaauugcagaagcaggaaggugacucugaccu

SEQ ID NO: 286963 - RNA, 32 nt, Human
aaauugcagggaggggagggagcgagggccaa

SEQ ID NO: 286964 - RNA, 32 nt, Human
aaauugcaggggagguggaggccagaggacag

SEQ ID NO: 286965 - RNA, 32 nt, Human
aaauugcaguguccauaaguaaaguuuuauug

SEQ ID NO: 286966 - RNA, 32 nt, Human
aaauugcagugucuauccugcugccaucagcc

SEQ ID NO: 286967 - RNA, 32 nt, Human
aaauugcaguguucugucaccuaggcaucauc

SEQ ID NO: 286968 - RNA, 32 nt, Human
aaauugcauguucuaauuccacguauuuucca

SEQ ID NO: 286969 - RNA, 32 nt, Human
aaauugcauuuauaaaugaucuguauuagaau

SEQ ID NO: 286970 - RNA, 32 nt, Human
aaauugcauuuauaaaugaucuguauuauaau

SEQ ID NO: 286971 - RNA, 32 nt, Human
aaauugcauuuuguuuacauguggugaacaug

SEQ ID NO: 286972 - RNA, 32 nt, Human
aaauugccaagugccuaugcaaaccagcuuua

SEQ ID NO: 286973 - RNA, 32 nt, Human
aaauugcccagccucagguauucuuuauagca

SEQ ID NO: 286974 - RNA, 32 nt, Human
aaauugccccaguaacuucacacacauuuaau

SEQ ID NO: 286975 - RNA, 32 nt, Human
aaauugccccauccagaccuggcuccacucuu

SEQ ID NO: 286976 - RNA, 32 nt, Human
aaauugcccugcaggcuggagugcagcggcau

SEQ ID NO: 286977 - RNA, 32 nt, Human
aaauugccuguuuuucucgcaggcucuauucc

SEQ ID NO: 286978 - RNA, 32 nt, Human
aaauugccuuucucuauuuguuaagaauuuuu

SEQ ID NO: 286979 - RNA, 32 nt, Human
aaauugcugacuugcagaaucaugagaaaaac

SEQ ID NO: 286980 - RNA, 32 nt, Human
aaauugcugccguggagaagacuggaggaaac

SEQ ID NO: 286981 - RNA, 32 nt, Human
aaauugcugccugggugaaugcugcuuguucu

SEQ ID NO: 286982 - RNA, 32 nt, Human
aaauugcuggaaggcugcgucucugcuguggu

SEQ ID NO: 286983 - RNA, 32 nt, Human
aaauugcuggcugggugcaguggcuuaugccc

SEQ ID NO: 286984 - RNA, 32 nt, Human
aaauugcuuacuuuggaauacauuucuccuuu

SEQ ID NO: 286985 - RNA, 32 nt, Human
aaauugcuuaggaugaucucagacagugacug

SEQ ID NO: 286986 - RNA, 32 nt, Human
aaauugcuuaucucuagguaguuuaaagaaaa

SEQ ID NO: 286987 - RNA, 32 nt, Human
aaauugcuuccucuggggaggcgaauacggcu

SEQ ID NO: 286988 - RNA, 32 nt, Human
aaauugcuuguuucuuuuucuuggacuacuuu

SEQ ID NO: 286989 - RNA, 32 nt, Human
aaauuggaaagcagagguugcagugagcugag

SEQ ID NO: 286990 - RNA, 32 nt, Human
aaauuggaaauguuggcuucaccagaaccuaa

SEQ ID NO: 286991 - RNA, 32 nt, Human
aaauuggaccuacaggcugacguuccgggcaa

SEQ ID NO: 286992 - RNA, 32 nt, Human
aaauuggaccucaaaggguuuccuuguguuuu

SEQ ID NO: 286993 - RNA, 32 nt, Human
aaauuggagaccgucagccagaaaaccacccu

SEQ ID NO: 286994 - RNA, 32 nt, Human
aaauuggagacugauagguugaucagaaacuc

SEQ ID NO: 286995 - RNA, 32 nt, Human
aaauuggagcugcuuaaucauauugauaucua

SEQ ID NO: 286996 - RNA, 32 nt, Human
aaauuggagggguaguuaaggggguuugauuc

SEQ ID NO: 286997 - RNA, 32 nt, Human
aaauuggauugaauuauuuuucucagagccuu

SEQ ID NO: 286998 - RNA, 32 nt, Human
aaauuggcaaauggguugggugcaauggcuca

SEQ ID NO: 286999 - RNA, 32 nt, Human
aaauuggccaaaacaaagggguuacagggucc

SEQ ID NO: 287000 - RNA, 32 nt, Human
aaauuggccaaaacaaauucugauggaucuuc

SEQ ID NO: 287001 - RNA, 32 nt, Human
aaauuggccaagcucuggaaugagggucuggg

SEQ ID NO: 287002 - RNA, 32 nt, Human
aaauuggccacugguaaaacucugcagcuuca

SEQ ID NO: 287003 - RNA, 32 nt, Human
aaauuggccauggaggcacaccaaagcuucaa

SEQ ID NO: 287004 - RNA, 32 nt, Human
aaauuggccugagcauaagaagaaaaaguauc

SEQ ID NO: 287005 - RNA, 31 nt, Human
aaauuggccuguauuuuuacauucuuguaau

SEQ ID NO: 287006 - RNA, 32 nt, Human
aaauuggcuuuucccguuggggccgaagguac

SEQ ID NO: 287007 - RNA, 32 nt, Human
aaauugggcuuggaacccgggagccagaucuu

SEQ ID NO: 287008 - RNA, 32 nt, Human
aaauuggggaaagugguaaaaugaguaauuca

SEQ ID NO: 287009 - RNA, 32 nt, Human
aaauuggggaggggaugcugggugggaaacag

SEQ ID NO: 287010 - RNA, 27 nt, Human
aaauugggguucaggcccacccagggg

SEQ ID NO: 287011 - RNA, 32 nt, Human
aaauuggguccagaaagggaagugaggagaau

SEQ ID NO: 287012 - RNA, 23 nt, Human
aaauugguccaaccacuguggaa

SEQ ID NO: 287013 - RNA, 32 nt, Human
aaauugguccaauaaugcacgugcuuugcccu

SEQ ID NO: 287014 - RNA, 32 nt, Human
aaauuggugaccaccagucaugccuaggaccu

SEQ ID NO: 287015 - RNA, 32 nt, Human
aaauugguugucuuguaaauaucuuauaaaga

SEQ ID NO: 287016 - RNA, 32 nt, Human
aaauuguaagaucagucugguacugaauaaaa

SEQ ID NO: 287017 - RNA, 32 nt, Human
aaauuguaaugcguuugucuguuguugacaug

SEQ ID NO: 287018 - RNA, 32 nt, Human
aaauuguaaugugguugcugcugaaggaggag

SEQ ID NO: 287019 - RNA, 32 nt, Human
aaauuguacucagaagaauucugcaaggcuug

SEQ ID NO: 287020 - RNA, 32 nt, Human
aaauuguacuuggucacuuuugugcuugagga

SEQ ID NO: 287021 - RNA, 32 nt, Human
aaauuguagaaaacugaaagaaaacaagacaa

SEQ ID NO: 287022 - RNA, 32 nt, Human
aaauuguagggagaggaauaugguaaagccaa

SEQ ID NO: 287023 - RNA, 32 nt, Human
aaauuguagggaggcagaugagaguugcaauu

SEQ ID NO: 287024 - RNA, 32 nt, Human
aaauuguauaaauauucaaaauuuuauuagga

SEQ ID NO: 287025 - RNA, 32 nt, Human
aaauuguauacuuuaccaguaaguuuucagag

SEQ ID NO: 287026 - RNA, 32 nt, Human
aaauuguauaggacuugaaaaggaagcccuac

SEQ ID NO: 287027 - RNA, 32 nt, Human
aaauugucagcagccucauggggaggaaaaag

SEQ ID NO: 287028 - RNA, 32 nt, Human
aaauugucaguaccuuugcucaugccaugccc

SEQ ID NO: 287029 - RNA, 32 nt, Human
aaauugucagugcuugaagcuguuuccuuuac

SEQ ID NO: 287030 - RNA, 32 nt, Human
aaauugucauauucaaaacaaauguggauaca

SEQ ID NO: 287031 - RNA, 32 nt, Human
aaauugucaugagauucugaacacuaguauug

SEQ ID NO: 287032 - RNA, 32 nt, Human
aaauuguccagcugccuggcucuuuugcaaua

SEQ ID NO: 287033 - RNA, 32 nt, Human
aaauuguccaguugucaggagcagcgaaacag

SEQ ID NO: 287034 - RNA, 32 nt, Human
aaauuguccuuccauucacccuucucauaaag

SEQ ID NO: 287035 - RNA, 32 nt, Human
aaauugucugguaucaugaauuuggaacacca

SEQ ID NO: 287036 - RNA, 32 nt, Human
aaauugucuuugaagucgugugcauugcacgu

SEQ ID NO: 287037 - RNA, 32 nt, Human
aaauugugaacucauugcucccuaagacugug

SEQ ID NO: 287038 - RNA, 32 nt, Human
aaauugugagguggaugggggagugaaaucuc

SEQ ID NO: 287039 - RNA, 32 nt, Human
aaauugugcauuccuuccggggccaucgucuu

SEQ ID NO: 287040 - RNA, 32 nt, Human
aaauugugccacuaguacuccagccuggguga

SEQ ID NO: 287041 - RNA, 32 nt, Human
aaauugugccacugcacuccagacugggugac

SEQ ID NO: 287042 - RNA, 32 nt, Human
aaauugugccacugcacuuuucagccugggug

SEQ ID NO: 287043 - RNA, 32 nt, Human
aaauugugcuauugcacuccagccugggugac

SEQ ID NO: 287044 - RNA, 32 nt, Human
aaauugugcuuccgaugggguggggacugaga

SEQ ID NO: 287045 - RNA, 32 nt, Human
aaauuguguaugaauuucccaguuuuugcacc

SEQ ID NO: 287046 - RNA, 32 nt, Human
aaauugugugaaggcugaaaaggggcuuggag

SEQ ID NO: 287047 - RNA, 32 nt, Human
aaauuguguuaugccacuacucauguugucuu

SEQ ID NO: 287048 - RNA, 32 nt, Human
aaauuguguuugcuuugguuauaguuacuccu

SEQ ID NO: 287049 - RNA, 32 nt, Human
aaauuguucacccaaaugauucucuuauaaac

SEQ ID NO: 287050 - RNA, 32 nt, Human
aaauuguucccaaaugaaaacuuguuuuaagu

SEQ ID NO: 287051 - RNA, 32 nt, Human
aaauuguuccuauccagguucagggccuucag

SEQ ID NO: 287052 - RNA, 32 nt, Human
aaauuguuuagacacagauauuuggaauuagc

SEQ ID NO: 287053 - RNA, 32 nt, Human
aaauuguuuucagcucuuggauauagcagcaa

SEQ ID NO: 287054 - RNA, 32 nt, Human
aaauuuaaacuaauaugcuguguccuuuaauc

SEQ ID NO: 287055 - RNA, 32 nt, Human
aaauuuaaaucccacauuguaaaguuuguaca

SEQ ID NO: 287056 - RNA, 32 nt, Human
aaauuuaaugcaauugaaaaaguuuucaaauu

SEQ ID NO: 287057 - RNA, 32 nt, Human
aaauuuaauucaaaaugguggcuauaaucacu

SEQ ID NO: 287058 - RNA, 32 nt, Human
aaauuuacacccaagagggacaacccugagca

SEQ ID NO: 287059 - RNA, 32 nt, Human
aaauuuacaccccucacguuucccucucccuu

SEQ ID NO: 287060 - RNA, 32 nt, Human
aaauuuacagcuaaugauccaagcagauagaa

SEQ ID NO: 287061 - RNA, 32 nt, Human
aaauuuacaucacucauaggugcucaaaaguc

SEQ ID NO: 287062 - RNA, 32 nt, Human
aaauuuaccagaacaguuuagccuggggguua

SEQ ID NO: 287063 - RNA, 24 nt, Human
aaauuuaccucacuccuuacuuug

SEQ ID NO: 287064 - RNA, 22 nt, Human
aaauuuaccuuuuguuacuuua

SEQ ID NO: 287065 - RNA, 19 nt, Human
aaauuuacgcuucuuaacc

SEQ ID NO: 287066 - RNA, 32 nt, Human
aaauuuacggcugggugcaguggcucacaccu

SEQ ID NO: 287067 - RNA, 32 nt, Human
aaauuuacguuucucucugaguccuguaacug

SEQ ID NO: 287068 - RNA, 32 nt, Human
aaauuuacuaagcuuaacuacaugucacacau

SEQ ID NO: 287069 - RNA, 32 nt, Human
aaauuuagaaaauccaauuuuucuuaagcauu

SEQ ID NO: 287070 - RNA, 32 nt, Human
aaauuuagaaauggcaugcaucacacauuuau

SEQ ID NO: 287071 - RNA, 32 nt, Human
aaauuuagacuauguaguaugugacagaauuu

SEQ ID NO: 287072 - RNA, 21 nt, Human
aaauuuagauuccuuauacuu

SEQ ID NO: 287073 - RNA, 32 nt, Human
aaauuuaggaaucauugccccaaaaaguggcc

SEQ ID NO: 287074 - RNA, 32 nt, Human
aaauuuagggugacuguguggcugacuauucu

SEQ ID NO: 287075 - RNA, 32 nt, Human
aaauuuaguuuucaucccaagaugucuuuucu

SEQ ID NO: 287076 - RNA, 32 nt, Human
aaauuuaucucagcuucuguuagcuuauccuc

SEQ ID NO: 287077 - RNA, 32 nt, Human
aaauuuaugaaagaaaauugggaguaggaaug

SEQ ID NO: 287078 - RNA, 32 nt, Human
aaauuuaugugugguuuuaaagucauuccagu

SEQ ID NO: 287079 - RNA, 32 nt, Human
aaauuuauugagguauuugguuaucaaagaua

SEQ ID NO: 287080 - RNA, 24 nt, Human
aaauuuauuuauuuuuuccuuccu

SEQ ID NO: 287081 - RNA, 32 nt, Human
aaauuuauuuucuuccuaguucuggaggcugg

SEQ ID NO: 287082 - RNA, 32 nt, Human
aaauuucaaagcagacuucuugaauuguuuac

SEQ ID NO: 287083 - RNA, 32 nt, Human
aaauuucaacaucuagaucaucauggaguggg

SEQ ID NO: 287084 - RNA, 32 nt, Human
aaauuucaaccagcucauuccccgagcacucc

SEQ ID NO: 287085 - RNA, 32 nt, Human
aaauuucaauaugucaguauagaggcucuacu

SEQ ID NO: 287086 - RNA, 32 nt, Human
aaauuucacuaaauccagugugagggauguuc

SEQ ID NO: 287087 - RNA, 32 nt, Human
aaauuucacuaagacuuuuggaauucuugugu

SEQ ID NO: 287088 - RNA, 32 nt, Human
aaauuucagaacuuucaggagggcaagagaau

SEQ ID NO: 287089 - RNA, 32 nt, Human
aaauuucagcacaucacaaucucucugaagau

SEQ ID NO: 287090 - RNA, 32 nt, Human
aaauuucagcagcgggagaagauggacaagag

SEQ ID NO: 287091 - RNA, 24 nt, Human
aaauuucagccuccaaagguagga

SEQ ID NO: 287092 - RNA, 31 nt, Human
aaauuucaggccuucuuuaugucaccuaaaa

SEQ ID NO: 287093 - RNA, 32 nt, Human
aaauuucauaaagggacaugcauuuuacuggg

SEQ ID NO: 287094 - RNA, 32 nt, Human
aaauuucaugcucuccccaaauucugucugau

SEQ ID NO: 287095 - RNA, 32 nt, Human
aaauuucauuccucaaaccuuucaggaggggu

SEQ ID NO: 287096 - RNA, 32 nt, Human
aaauuuccaaaccucuuuucuuauuggaaauu

SEQ ID NO: 287097 - RNA, 32 nt, Human
aaauuuccagaacaggccaaucugaagagaug

SEQ ID NO: 287098 - RNA, 32 nt, Human
aaauuuccagugagcuuaucaugcugucuuua

SEQ ID NO: 287099 - RNA, 32 nt, Human
aaauuuccauuuuaugaagaaaggaaccaaau

SEQ ID NO: 287100 - RNA, 32 nt, Human
aaauuucccagggaaggagaccgucaggccgc

SEQ ID NO: 287101 - RNA, 32 nt, Human
aaauuucccauuucucaagaaauguucauauu

SEQ ID NO: 287102 - RNA, 32 nt, Human
aaauuuccuaacucccugugcugcaguuucuu

SEQ ID NO: 287103 - RNA, 32 nt, Human
aaauuuccucucucccccuucuuacccugucu

SEQ ID NO: 287104 - RNA, 32 nt, Human
aaauuucguaacuggucacagcucauucauaa

SEQ ID NO: 287105 - RNA, 19 nt, Human
aaauuucuagcucccaacc

SEQ ID NO: 287106 - RNA, 32 nt, Human
aaauuucuauauagauuuuauaccucaguggg

SEQ ID NO: 287107 - RNA, 32 nt, Human
aaauuucucauauauccccugcccucacacau

SEQ ID NO: 287108 - RNA, 32 nt, Human
aaauuucucuccagcagaaugcagccccucaa

SEQ ID NO: 287109 - RNA, 32 nt, Human
aaauuucucuucuuccuguuauugguaguucu

SEQ ID NO: 287110 - RNA, 32 nt, Human
aaauuucugggagucugaggaguacugacaua

SEQ ID NO: 287111 - RNA, 32 nt, Human
aaauuucuguaucugcugaauuauuaaugcca

SEQ ID NO: 287112 - RNA, 32 nt, Human
aaauuucugucugcuuuccuucccaagguagg

SEQ ID NO: 287113 - RNA, 32 nt, Human
aaauuucugugguuuguggcuuuuucuuccau

SEQ ID NO: 287114 - RNA, 32 nt, Human
aaauuucuuuaaaagacauaugggugggauga

SEQ ID NO: 287115 - RNA, 32 nt, Human
aaauuucuuucacaaaugagagcuagggaaag

SEQ ID NO: 287116 - RNA, 32 nt, Human
aaauuucuuuuguuccagagauuguuuaaaaa

SEQ ID NO: 287117 - RNA, 32 nt, Human
aaauuugaaaccugcauuucucccacagcaau

SEQ ID NO: 287118 - RNA, 32 nt, Human
aaauuugaaagaaaagccuauaaaagugcaca

SEQ ID NO: 287119 - RNA, 32 nt, Human
aaauuugaaaugcagggcaugaaggcuuaaag

SEQ ID NO: 287120 - RNA, 32 nt, Human
aaauuugaacauuugaugauuuuugcaggaga

SEQ ID NO: 287121 - RNA, 32 nt, Human
aaauuugaagugaauagugaaccaacaucucu

SEQ ID NO: 287122 - RNA, 32 nt, Human
aaauuugagaugguugaaugagggccggaggc

SEQ ID NO: 287123 - RNA, 32 nt, Human
aaauuugagucucccugccucucccaaauaua

SEQ ID NO: 287124 - RNA, 32 nt, Human
aaauuugcacacaaaacaucuuaggcacuuuu

SEQ ID NO: 287125 - RNA, 32 nt, Human
aaauuugcacacaauguucauagcagcauuau

SEQ ID NO: 287126 - RNA, 32 nt, Human
aaauuugcccagcugucgucuaagcccucuug

SEQ ID NO: 287127 - RNA, 32 nt, Human
aaauuugccugacuucuuaagaacaaaacccc

SEQ ID NO: 287128 - RNA, 32 nt, Human
aaauuugcgccacugcauucuagccugaguga

SEQ ID NO: 287129 - RNA, 24 nt, Human
aaauuugcuagaagaaauagcaaa

SEQ ID NO: 287130 - RNA, 32 nt, Human
aaauuugcuaucuaccuauuuacuaacauaaa

SEQ ID NO: 287131 - RNA, 32 nt, Human
aaauuuggaaacagaguaaugaagaaauaaua

SEQ ID NO: 287132 - RNA, 32 nt, Human
aaauuuggaauuucugauaccuccagugggcc

SEQ ID NO: 287133 - RNA, 32 nt, Human
aaauuuggacuggccauuuccucgcugaguga

SEQ ID NO: 287134 - RNA, 32 nt, Human
aaauuuggacuguuguucugcuuuuccuggca

SEQ ID NO: 287135 - RNA, 32 nt, Human
aaauuuggcuguucucuggagcuaaaccauua

SEQ ID NO: 287136 - RNA, 32 nt, Human
aaauuugggaagagaaucugugcuaugcaaug

SEQ ID NO: 287137 - RNA, 31 nt, Human
aaauuugggaggccaagaugggaggaucacu

SEQ ID NO: 287138 - RNA, 32 nt, Human
aaauuuggguauagacaauaaagaacugaagu

SEQ ID NO: 287139 - RNA, 32 nt, Human
aaauuugguguuagguccuuggcacuuuccuu

SEQ ID NO: 287140 - RNA, 22 nt, Human
aaauuugguucugggaaacuga

SEQ ID NO: 287141 - RNA, 32 nt, Human
aaauuuguagugaauuuguucuugccauuauu

SEQ ID NO: 287142 - RNA, 32 nt, Human
aaauuuguaucuuuacuagaacaugagaaucu

SEQ ID NO: 287143 - RNA, 32 nt, Human
aaauuugucaggcugggugcaguggcucaugc

SEQ ID NO: 287144 - RNA, 32 nt, Human
aaauuugugcauuauaaaugcaauaucacugu

SEQ ID NO: 287145 - RNA, 32 nt, Human
aaauuuuaaacugcucucaacguaggaaucuu

SEQ ID NO: 287146 - RNA, 32 nt, Human
aaauuuuaaagaaaauaugaggaaguggcuau

SEQ ID NO: 287147 - RNA, 32 nt, Human
aaauuuuaaccagcauuaacaugguagagugg

SEQ ID NO: 287148 - RNA, 32 nt, Human
aaauuuuaaggauugugacacacuccuacuau

SEQ ID NO: 287149 - RNA, 32 nt, Human
aaauuuuaaucacacacacauucuuuuggggg

SEQ ID NO: 287150 - RNA, 32 nt, Human
aaauuuuaauuagcugggugugguggcucaag

SEQ ID NO: 287151 - RNA, 32 nt, Human
aaauuuuacaguuuauacuucugugauguugu

SEQ ID NO: 287152 - RNA, 32 nt, Human
aaauuuuagaaaauauguuuugucacccuguu

SEQ ID NO: 287153 - RNA, 32 nt, Human
aaauuuuauucagcaauuaauagugauuucag

SEQ ID NO: 287154 - RNA, 32 nt, Human
aaauuuuauuuuacagaauuuaccuucucugu

SEQ ID NO: 287155 - RNA, 32 nt, Human
aaauuuucaaaugaguaagcagugccaccaac

SEQ ID NO: 287156 - RNA, 32 nt, Human
aaauuuucacauaucacauccauucucaaggu

SEQ ID NO: 287157 - RNA, 32 nt, Human
aaauuuucauucuuaccaaaacaguuaacucu

SEQ ID NO: 287158 - RNA, 32 nt, Human
aaauuuuccagccccuugccucccagaacccc

SEQ ID NO: 287159 - RNA, 32 nt, Human
aaauuuucucaaauggccaagcucugaugguc

SEQ ID NO: 287160 - RNA, 32 nt, Human
aaauuuucugcaagaaagaaugaauuucagga

SEQ ID NO: 287161 - RNA, 32 nt, Human
aaauuuucuguuuuauuucuuuacagauucca

SEQ ID NO: 287162 - RNA, 32 nt, Human
aaauuuucuuuuccaagaagcuuuugaauaag

SEQ ID NO: 287163 - RNA, 32 nt, Human
aaauuuugaaucugaaagccaccaaauguauc

SEQ ID NO: 287164 - RNA, 32 nt, Human
aaauuuugacuugcacuucagauuuccuuuuu

SEQ ID NO: 287165 - RNA, 32 nt, Human
aaauuuugacuuguaacaccauuucaauauaa

SEQ ID NO: 287166 - RNA, 32 nt, Human
aaauuuugagaggguauagaaaaugacuuuag

SEQ ID NO: 287167 - RNA, 32 nt, Human
aaauuuugcccagguggauaaauguguacaug

SEQ ID NO: 287168 - RNA, 32 nt, Human
aaauuuugcuaccaaagaaugcauguucugug

SEQ ID NO: 287169 - RNA, 32 nt, Human
aaauuuugcuucugaaauaugguagcuuucca

SEQ ID NO: 287170 - RNA, 32 nt, Human
aaauuuuggacgggagagaggggcuauuccau

SEQ ID NO: 287171 - RNA, 32 nt, Human
aaauuuugguacaguguacauugaaaaccaug

SEQ ID NO: 287172 - RNA, 32 nt, Human
aaauuuugugguggugccaugcaauccccuuu

SEQ ID NO: 287173 - RNA, 32 nt, Human
aaauuuuguuaccucuauccuggcuugccuga

SEQ ID NO: 287174 - RNA, 32 nt, Human
aaauuuuuaaacuucacaaaaguuucugaaaa

SEQ ID NO: 287175 - RNA, 32 nt, Human
aaauuuuuaaagaaauuauauugcauggaugu

SEQ ID NO: 287176 - RNA, 32 nt, Human
aaauuuuuaauuucuuucuucccuuucuugcu

SEQ ID NO: 287177 - RNA, 32 nt, Human
aaauuuuuacaucucucucacccuucuacuuc

SEQ ID NO: 287178 - RNA, 32 nt, Human
aaauuuuuagaucaaaaaggcaaaugauuuua

SEQ ID NO: 287179 - RNA, 32 nt, Human
aaauuuuucugcuacauugucugcucagcucg

SEQ ID NO: 287180 - RNA, 32 nt, Human
aaauuuuugugucugugaggggccagauagua

SEQ ID NO: 287181 - RNA, 32 nt, Human
aacaaaaacaaauggcaaguuucacuuaaggg

SEQ ID NO: 287182 - RNA, 32 nt, Human
aacaaaaacagcuucaacuguucgaauuuuau

SEQ ID NO: 287183 - RNA, 22 nt, Human
aacaaaaaccacaaaaauuccc

SEQ ID NO: 287184 - RNA, 32 nt, Human
aacaaaaaccacgaaagcacacacaaaauaaa

SEQ ID NO: 287185 - RNA, 32 nt, Human
aacaaaaagaaccaaguagagagaguggagcu

SEQ ID NO: 287186 - RNA, 32 nt, Human
aacaaaaagaauugcccacgcuguggaagaua

SEQ ID NO: 287187 - RNA, 32 nt, Human
aacaaaaagaugaccuuugucucaccucauag

SEQ ID NO: 287188 - RNA, 32 nt, Human
aacaaaaagccacagaggcagagcaagcauuc

SEQ ID NO: 287189 - RNA, 32 nt, Human
aacaaaaaggaaaugaggagagaaaguuacug

SEQ ID NO: 287190 - RNA, 32 nt, Human
aacaaaaaggcugggugcaguggcucacaccu

SEQ ID NO: 287191 - RNA, 32 nt, Human
aacaaaaaguccauauguguugugcuaaucca

SEQ ID NO: 287192 - RNA, 32 nt, Human
aacaaaaaguuuggcaccagccaccugggacc

SEQ ID NO: 287193 - RNA, 32 nt, Human
aacaaaacaaaaggcucauaacaacaagaacg

SEQ ID NO: 287194 - RNA, 32 nt, Human
aacaaaacaaacaacaaaagcagcuugccuua

SEQ ID NO: 287195 - RNA, 32 nt, Human
aacaaaacaacaaaaggaacagauccuugacc

SEQ ID NO: 287196 - RNA, 32 nt, Human
aacaaaacaccacaaaacagacuucacuaaca

SEQ ID NO: 287197 - RNA, 19 nt, Human
aacaaaacagaacaaaaca

SEQ ID NO: 287198 - RNA, 32 nt, Human
aacaaaacauaaaaagccauuuuggagacagu

SEQ ID NO: 287199 - RNA, 32 nt, Human
aacaaaacauaccuguauacacacacauucac

SEQ ID NO: 287200 - RNA, 19 nt, Human
aacaaaacaucucaggaca

SEQ ID NO: 287201 - RNA, 32 nt, Human
aacaaaaccaagcucccuucccuuccuccccc

SEQ ID NO: 287202 - RNA, 32 nt, Human
aacaaaacccagcuccugagucuccagauguu

SEQ ID NO: 287203 - RNA, 32 nt, Human
aacaaaacccaguguuugcacacacacaaaau

SEQ ID NO: 287204 - RNA, 32 nt, Human
aacaaaacccucccaguguguguccgucucuc

SEQ ID NO: 287205 - RNA, 32 nt, Human
aacaaaacccuuggccacauguugacuugauu

SEQ ID NO: 287206 - RNA, 32 nt, Human
aacaaaaccucagagcccgggucaucuucugc

SEQ ID NO: 287207 - RNA, 32 nt, Human
aacaaaacuaaguugugaaggaagggagggaa

SEQ ID NO: 287208 - RNA, 32 nt, Human
aacaaaacuacagcaagacacagaaaggugug

SEQ ID NO: 287209 - RNA, 32 nt, Human
aacaaaacuauacaaucauauuuucucuucua

SEQ ID NO: 287210 - RNA, 32 nt, Human
aacaaaacuauacuugaacaaaagggucagag

SEQ ID NO: 287211 - RNA, 32 nt, Human
aacaaaacugugccaacuacuacuggugaugc

SEQ ID NO: 287212 - RNA, 32 nt, Human
aacaaaacuucuauuauccagagucaugggag

SEQ ID NO: 287213 - RNA, 32 nt, Human
aacaaaagaacuaguccucuuagaauuucuug

SEQ ID NO: 287214 - RNA, 32 nt, Human
aacaaaagaagaagaaaaagaaaaacaaccac

SEQ ID NO: 287215 - RNA, 32 nt, Human
aacaaaagaccagaaaagcacucuccacccag

SEQ ID NO: 287216 - RNA, 32 nt, Human
aacaaaagagccucugacauuacugucucuca

SEQ ID NO: 287217 - RNA, 32 nt, Human
aacaaaagagucaguaagagaaaauuuauccc

SEQ ID NO: 287218 - RNA, 32 nt, Human
aacaaaagcagguugagauggggaagaugaca

SEQ ID NO: 287219 - RNA, 32 nt, Human
aacaaaaggaaguaguuaaaugcuuugguuca

SEQ ID NO: 287220 - RNA, 32 nt, Human
aacaaaagggagagccccacaaaacuuugggg

SEQ ID NO: 287221 - RNA, 32 nt, Human
aacaaaaguacuguacucacacacauaaggua

SEQ ID NO: 287222 - RNA, 32 nt, Human
aacaaaagugcuaaacauuuccuugaauauau

SEQ ID NO: 287223 - RNA, 32 nt, Human
aacaaaauacaaaaacccuuaggacuucucau

SEQ ID NO: 287224 - RNA, 32 nt, Human
aacaaaauacccuuuuucuuuuaguaugguuu

SEQ ID NO: 287225 - RNA, 32 nt, Human
aacaaaauaguguuugucaucagguugguacu

SEQ ID NO: 287226 - RNA, 31 nt, Human
aacaaaaugaacaagguagaucagaaguucc

SEQ ID NO: 287227 - RNA, 32 nt, Human
aacaaaaugaggacaaaaauauggacugaugu

SEQ ID NO: 287228 - RNA, 32 nt, Human
aacaaaaugauucucucccaaagaaagacaca

SEQ ID NO: 287229 - RNA, 32 nt, Human
aacaaaauucuuaucuuccauggaugcuuuaa

SEQ ID NO: 287230 - RNA, 22 nt, Human
aacaaacaaacaaaaaacaaga

SEQ ID NO: 287231 - RNA, 22 nt, Human
aacaaacaaacaaaaaaccaga

SEQ ID NO: 287232 - RNA, 20 nt, Human
aacaaacaaacaaaaacaga

SEQ ID NO: 287233 - RNA, 24 nt, Human
aacaaacaaacaaaaagcggcagg

SEQ ID NO: 287234 - RNA, 20 nt, Human
aacaaacaaacaaaaauugc

SEQ ID NO: 287235 - RNA, 21 nt, Human
aacaaacaaacaaaacaaaga

SEQ ID NO: 287236 - RNA, 25 nt, Human
aacaaacaaacaaaacuaagcaaga

SEQ ID NO: 287237 - RNA, 22 nt, Human
aacaaacaaacaaacuguugca

SEQ ID NO: 287238 - RNA, 21 nt, Human
aacaaacaaacaaagcuugca

SEQ ID NO: 287239 - RNA, 32 nt, Human
aacaaacaaacagugaccuucuccauggguca

SEQ ID NO: 287240 - RNA, 32 nt, Human
aacaaacaaagcaaaccaaagccccggcccuc

SEQ ID NO: 287241 - RNA, 32 nt, Human
aacaaacaacuccgggcacaccaccuuuaaga

SEQ ID NO: 287242 - RNA, 32 nt, Human
aacaaacaaugccaucacuggaauuucccacc

SEQ ID NO: 287243 - RNA, 32 nt, Human
aacaaacacaaagccuuaagcucuuugaguac

SEQ ID NO: 287244 - RNA, 32 nt, Human
aacaaacacagugaaaccccgucucuacuaaa

SEQ ID NO: 287245 - RNA, 26 nt, Human
aacaaacaccaaaaaccagagugcau

SEQ ID NO: 287246 - RNA, 24 nt, Human
aacaaacacuugagggccuguaug

SEQ ID NO: 287247 - RNA, 22 nt, Human
aacaaacaggccugcugcuaga

SEQ ID NO: 287248 - RNA, 32 nt, Human
aacaaacauuacaaggcaguuaucucauugcu

SEQ ID NO: 287249 - RNA, 32 nt, Human
aacaaaccaaaccaaccagcucuuggauguga

SEQ ID NO: 287250 - RNA, 32 nt, Human
aacaaaccacagaacuuagagugugcugguua

SEQ ID NO: 287251 - RNA, 20 nt, Human
aacaaacccaacuaaagugc

SEQ ID NO: 287252 - RNA, 32 nt, Human
aacaaacccaggaaagcgaaacugcagaacag

SEQ ID NO: 287253 - RNA, 32 nt, Human
aacaaaccccaaccuucucuccuugccaccca

SEQ ID NO: 287254 - RNA, 32 nt, Human
aacaaacccuuuccuuucauuuuagacuaccu

SEQ ID NO: 287255 - RNA, 32 nt, Human
aacaaaccgaaggccuuaaacgauggggaugg

SEQ ID NO: 287256 - RNA, 32 nt, Human
aacaaaccguggggcucucuggggucuggggg

SEQ ID NO: 287257 - RNA, 32 nt, Human
aacaaaccugcacuuguaccccugaacuuaaa

SEQ ID NO: 287258 - RNA, 32 nt, Human
aacaaaccugcacuuguaucccagaauuuaaa

SEQ ID NO: 287259 - RNA, 32 nt, Human
aacaaacugaacacuuccaaaggaggcagucc

SEQ ID NO: 287260 - RNA, 24 nt, Human
aacaaacuguucggcuacuggaca

SEQ ID NO: 287261 - RNA, 32 nt, Human
aacaaacuuccucucuggccucucaggaauca

SEQ ID NO: 287262 - RNA, 32 nt, Human
aacaaacuucucucagcuucuugaaguuguuc

SEQ ID NO: 287263 - RNA, 32 nt, Human
aacaaagaacuggguguugaguauucaucaac

SEQ ID NO: 287264 - RNA, 24 nt, Human
aacaaagacccacacuacuggaca

SEQ ID NO: 287265 - RNA, 32 nt, Human
aacaaagaccgagcaaaagacgagugaugcca

SEQ ID NO: 287266 - RNA, 32 nt, Human
aacaaagaguuuuugcuuaaaguguuuuggug

SEQ ID NO: 287267 - RNA, 32 nt, Human
aacaaagauagaauuugauggggguggacgag

SEQ ID NO: 287268 - RNA, 32 nt, Human
aacaaagcaaagcauaucuuuagacaacagug

SEQ ID NO: 287269 - RNA, 32 nt, Human
aacaaagcagaucccagaucugaaaagcaggc

SEQ ID NO: 287270 - RNA, 32 nt, Human
aacaaagcagguuuuacugcuuuuccagacac

SEQ ID NO: 287271 - RNA, 22 nt, Human
aacaaaggaaacagccaagaga

SEQ ID NO: 287272 - RNA, 32 nt, Human
aacaaaggaagcacuugggcugugcugggggc

SEQ ID NO: 287273 - RNA, 32 nt, Human
aacaaaggacagaguaugaacaccugggcuua

SEQ ID NO: 287274 - RNA, 32 nt, Human
aacaaaggacuugccaugguucacagcaaugu

SEQ ID NO: 287275 - RNA, 32 nt, Human
aacaaaggagaaaaggaagugauuggagaauu

SEQ ID NO: 287276 - RNA, 32 nt, Human
aacccggcgggcagagguugcaguaagcagag

SEQ ID NO: 287277 - RNA, 32 nt, Human
aacccgggaagcagagguugcagugacagaga

SEQ ID NO: 287278 - RNA, 32 nt, Human
aacccgggaagcagagguugcagugagcugag

SEQ ID NO: 287279 - RNA, 32 nt, Human
aacccgggaagcagagguugcggugagccgag

SEQ ID NO: 287280 - RNA, 32 nt, Human
aacccgggaagcagagguugcggugagcugag

SEQ ID NO: 287281 - RNA, 32 nt, Human
aacccgggaagcagagucugcagugagccaag

SEQ ID NO: 287282 - RNA, 32 nt, Human
aacccgggaagcggagcuugcagugagccgag

SEQ ID NO: 287283 - RNA, 32 nt, Human
aacccgggaagcggagguugcagggagccgag

SEQ ID NO: 287284 - RNA, 32 nt, Human
aacccgggaagcggagguugcagugagccaag

SEQ ID NO: 287285 - RNA, 32 nt, Human
aacccgggaagcggagguugcagugagccgag

SEQ ID NO: 287286 - RNA, 32 nt, Human
aacccgggaaggcggaaguugcagugagccga

SEQ ID NO: 287287 - RNA, 23 nt, Human
aacccgggaaguggagguugcag

SEQ ID NO: 287288 - RNA, 32 nt, Human
aacccgggaaguggagguugcagugagccaag

SEQ ID NO: 287289 - RNA, 32 nt, Human
aacccgggaaguggagguugccgugagucgag

SEQ ID NO: 287290 - RNA, 32 nt, Human
aacccgggacgcagagguuacagugaaccgag

SEQ ID NO: 287291 - RNA, 32 nt, Human
aacccgggacgcagggguugcagugagcggag

SEQ ID NO: 287292 - RNA, 23 nt, Human
aacccgggagacggagguugcag

SEQ ID NO: 287293 - RNA, 32 nt, Human
aacccgggagacggagguugcagugagcugag

SEQ ID NO: 287294 - RNA, 32 nt, Human
aacccgggagacggcgcuugcagugagccgag

SEQ ID NO: 287295 - RNA, 32 nt, Human
aacccgggagacgggagguuguggugagcuga

SEQ ID NO: 287296 - RNA, 32 nt, Human
aacccgggagaugaagguugcagugagcugag

SEQ ID NO: 287297 - RNA, 32 nt, Human
aacccgggagauggcgcuugcagugagcugag

SEQ ID NO: 287298 - RNA, 32 nt, Human
aacccgggagcagagacugcagugagcugaga

SEQ ID NO: 287299 - RNA, 32 nt, Human
aacccgggagcggagguugcagugagcugaga

SEQ ID NO: 287300 - RNA, 32 nt, Human
aacccgggaggaagagcuugcagugagccgag

SEQ ID NO: 287301 - RNA, 32 nt, Human
aacccgggaggacuucagggagaaccuguccg

SEQ ID NO: 287302 - RNA, 32 nt, Human
aacccgggaggaggagcuugcagugagccgag

SEQ ID NO: 287303 - RNA, 32 nt, Human
aacccgggaggaggagguugcacugagccgag

SEQ ID NO: 287304 - RNA, 32 nt, Human
aacccgggaggcaaagguugcagugagcugag

SEQ ID NO: 287305 - RNA, 32 nt, Human
aacccgggaggcaaagguugcgguaagcugcg

SEQ ID NO: 287306 - RNA, 32 nt, Human
aacccgggaggcaaagguuuuagugagccgag

SEQ ID NO: 287307 - RNA, 32 nt, Human
aacccgggaggcacagguuccagugggccaag

SEQ ID NO: 287308 - RNA, 32 nt, Human
aacccgggaggcagaaguugcagugaacugaa

SEQ ID NO: 287309 - RNA, 32 nt, Human
aacccgggaggcagaccuugcagugagccaag

SEQ ID NO: 287310 - RNA, 32 nt, Human
aacccgggaggcagacuuugcagugagcugag

SEQ ID NO: 287311 - RNA, 32 nt, Human
aacccgggaggcagagauagcagugaacugag

SEQ ID NO: 287312 - RNA, 32 nt, Human
aacccgggaggcagagauugcaguaagcugag

SEQ ID NO: 287313 - RNA, 32 nt, Human
aacccgggaggcagagcuugcaguaagccgag

SEQ ID NO: 287314 - RNA, 32 nt, Human
aacccgggaggcagagcuugcagugagcagag

SEQ ID NO: 287315 - RNA, 32 nt, Human
aacccgggaggcagagcuugcagugagccaag

SEQ ID NO: 287316 - RNA, 32 nt, Human
aacccgggaggcagagcuugcagugagccgag

SEQ ID NO: 287317 - RNA, 32 nt, Human
aacccgggaggcagagcuugcagugagcugag

SEQ ID NO: 287318 - RNA, 32 nt, Human
aacccgggaggcagagcuugcagugagucgag

SEQ ID NO: 287319 - RNA, 32 nt, Human
aacccgggaggcagagcuugcggugagccgag

SEQ ID NO: 287320 - RNA, 32 nt, Human
aacccgggaggcagagcuuguggugagccgag

SEQ ID NO: 287321 - RNA, 32 nt, Human
aacccgggaggcagaggcugcagagagccaag

SEQ ID NO: 287322 - RNA, 32 nt, Human
aacccgggaggcagaggcugcagugagccgag

SEQ ID NO: 287323 - RNA, 32 nt, Human
aacccgggaggcagaggcugcagugagcugag

SEQ ID NO: 287324 - RNA, 32 nt, Human
aacccgggaggcagaggcuguagugagccaag

SEQ ID NO: 287325 - RNA, 32 nt, Human
aacccgggaggcagagggugcaguaagccgag

SEQ ID NO: 287326 - RNA, 32 nt, Human
aacccgggaggcagagguaguagugagcugaa

SEQ ID NO: 287327 - RNA, 32 nt, Human
aacccgggaggcagagguggcugugagccgag

SEQ ID NO: 287328 - RNA, 32 nt, Human
aacccgggaggcagagguuacagugagccaag

SEQ ID NO: 287329 - RNA, 32 nt, Human
aacccgggaggcagagguuaucgugagcugac

SEQ ID NO: 287330 - RNA, 32 nt, Human
aacccgggaggcagagguugaagugagcugag

SEQ ID NO: 287331 - RNA, 32 nt, Human
aacccgggaggcagagguugcacugagcugag

SEQ ID NO: 287332 - RNA, 23 nt, Human
aacccgggaggcagagguugcag

SEQ ID NO: 287333 - RNA, 32 nt, Human
aacccgggaggcagagguugcagccggcugag

SEQ ID NO: 287334 - RNA, 32 nt, Human
aacccgggaggcagagguugcaguaagcagag

SEQ ID NO: 287335 - RNA, 32 nt, Human
aacccgggaggcagagguugcagugaacccag

SEQ ID NO: 287336 - RNA, 32 nt, Human
aacccgggaggcagagguugcagugacccaag

SEQ ID NO: 287337 - RNA, 32 nt, Human
aacccgggaggcagagguugcagugagccaag

SEQ ID NO: 287338 - RNA, 32 nt, Human
aacccgggaggcagagguugcagugagccgac

SEQ ID NO: 287339 - RNA, 32 nt, Human
aacccgggaggcagagguugcagugagccgag

SEQ ID NO: 287340 - RNA, 32 nt, Human
aacccgggaggcagagguugcagugagcugag

SEQ ID NO: 287341 - RNA, 32 nt, Human
aacccgggaggcagagguugcagugaggugag

SEQ ID NO: 287342 - RNA, 32 nt, Human
aacccgggaggcagagguugcagugagucgag

SEQ ID NO: 287343 - RNA, 32 nt, Human
aacccgggaggcagagguugcagugaguggag

SEQ ID NO: 287344 - RNA, 32 nt, Human
aacccgggaggcagagguugcaguguggugag

SEQ ID NO: 287345 - RNA, 32 nt, Human
aacccgggaggcagagguugcauugagccgag

SEQ ID NO: 287346 - RNA, 32 nt, Human
aacccgggaggcagagguugcggugagccaag

SEQ ID NO: 287347 - RNA, 32 nt, Human
aacccgggaggcagagguugcggugagccgag

SEQ ID NO: 287348 - RNA, 32 nt, Human
aacccgggaggcagagguugcuguaagcugag

SEQ ID NO: 287349 - RNA, 32 nt, Human
aacccgggaggcagagguuguagugagcccag

SEQ ID NO: 287350 - RNA, 32 nt, Human
aacccgggaggcagagguugugagcugagauc

SEQ ID NO: 287351 - RNA, 32 nt, Human
aacccgggaggcagagguuguguugagccaag

SEQ ID NO: 287352 - RNA, 32 nt, Human
aacccgggaggcagcaguugcagugagcugag

SEQ ID NO: 287353 - RNA, 32 nt, Human
aacccgggaggcauagcuugcagugagccgag

SEQ ID NO: 287354 - RNA, 32 nt, Human
aacccgggaggcgagcuugcagugagccgaga

SEQ ID NO: 287355 - RNA, 32 nt, Human
aacccgggaggcggaacuugcagugagccaag

SEQ ID NO: 287356 - RNA, 32 nt, Human
aacccgggaggcggaacuugcggugagccgag

SEQ ID NO: 287357 - RNA, 32 nt, Human
aacccgggaggcggaaguuucagcgagccgag

SEQ ID NO: 287358 - RNA, 32 nt, Human
aacccgggaggcggagauugcagugagccaag

SEQ ID NO: 287359 - RNA, 32 nt, Human
aacccgggaggcggagauugcagugagcugag

SEQ ID NO: 287360 - RNA, 32 nt, Human
aacccgggaggcggagauugcggugagccgag

SEQ ID NO: 287361 - RNA, 32 nt, Human
aacccgggaggcggagcuuacagugagcugag

SEQ ID NO: 287362 - RNA, 23 nt, Human
aacccgggaggcggagcuugcag

SEQ ID NO: 287363 - RNA, 32 nt, Human
aacccgggaggcggagcuugcagugaaccgag

SEQ ID NO: 287364 - RNA, 32 nt, Human
aacccgggaggcggagcuugcagugagccaag

SEQ ID NO: 287365 - RNA, 32 nt, Human
aacccgggaggcggagcuugcagugagcccag

SEQ ID NO: 287366 - RNA, 32 nt, Human
aacccgggaggcggagcuugcagugagccgaa

SEQ ID NO: 287367 - RNA, 32 nt, Human
aacccgggaggcggagcuugcagugagccgag

SEQ ID NO: 287368 - RNA, 32 nt, Human
aacccgggaggcggagcuugcagugagccuug

SEQ ID NO: 287369 - RNA, 32 nt, Human
aacccgggaggcggagcuugcagugagcggag

SEQ ID NO: 287370 - RNA, 32 nt, Human
aacccgggaggcggagcuugcagugagcugag

SEQ ID NO: 287371 - RNA, 32 nt, Human
aacccgggaggcggagcuuguagugagccgag

SEQ ID NO: 287372 - RNA, 32 nt, Human
aacccgggaggcggaggcugcagugagccgag

SEQ ID NO: 287373 - RNA, 32 nt, Human
aacccgggaggcggaggcugcagugagucgag

SEQ ID NO: 287374 - RNA, 32 nt, Human
aacccgggaggcggaggcugcagugggccggg

SEQ ID NO: 287375 - RNA, 32 nt, Human
aacccgggaggcggagguuacagugagccgag

SEQ ID NO: 287376 - RNA, 32 nt, Human
aacccgggaggcggagguuacagugagccuuu

SEQ ID NO: 287377 - RNA, 32 nt, Human
aacccgggaggcggagguuacagugagcugag

SEQ ID NO: 287378 - RNA, 32 nt, Human
aacccgggaggcggagguuauggagagccaag

SEQ ID NO: 287379 - RNA, 32 nt, Human
aacccgggaggcggagguuccagugagccgag

SEQ ID NO: 287380 - RNA, 23 nt, Human
aacccgggaggcggagguugcag

SEQ ID NO: 287381 - RNA, 32 nt, Human
aacccgggaggcggagguugcaguaagccgag

SEQ ID NO: 287382 - RNA, 32 nt, Human
aacccgggaggcggagguugcagucagccgag

SEQ ID NO: 287383 - RNA, 26 nt, Human
aacccgggaggcggagguugcaguga

SEQ ID NO: 287384 - RNA, 32 nt, Human
aacccgggaggcggagguugcagugagccaag

SEQ ID NO: 287385 - RNA, 32 nt, Human
aacccgggaggcggagguugcagugagccgaa

SEQ ID NO: 287386 - RNA, 32 nt, Human
aacccgggaggcggagguugcagugagccgag

SEQ ID NO: 287387 - RNA, 32 nt, Human
aacccgggaggcggagguugcagugagccugg

SEQ ID NO: 287388 - RNA, 32 nt, Human
aacccgggaggcggagguugcagugagcuaag

SEQ ID NO: 287389 - RNA, 32 nt, Human
aacccgggaggcggagguugcagugagcugag

SEQ ID NO: 287390 - RNA, 32 nt, Human
aacccgggaggcggagguugcagugagguaag

SEQ ID NO: 287391 - RNA, 32 nt, Human
aacccgggaggcggagguugcagugagucaag

SEQ ID NO: 287392 - RNA, 32 nt, Human
aacccgggaggcggagguugcaguuagccaag

SEQ ID NO: 287393 - RNA, 32 nt, Human
aacccgggaggcggagguugcaugagcugaga

SEQ ID NO: 287394 - RNA, 32 nt, Human
aacccgggaggcggagguugccgugagucgag

SEQ ID NO: 287395 - RNA, 26 nt, Human
aacccgggaggcggagguugcgguga

SEQ ID NO: 287396 - RNA, 32 nt, Human
aacccgggaggcggagguugcggugagccaag

SEQ ID NO: 287397 - RNA, 32 nt, Human
aacccgggaggcggagguugcggugagccgag

SEQ ID NO: 287398 - RNA, 26 nt, Human
aacccgggaggcggagguuguaguga

SEQ ID NO: 287399 - RNA, 32 nt, Human
aacccgggaggcggagguuguagugagccgag

SEQ ID NO: 287400 - RNA, 26 nt, Human
aacccgggaggcggagguugugguga

SEQ ID NO: 287401 - RNA, 32 nt, Human
aacccgggaggcggagguuguggugagccaag

SEQ ID NO: 287402 - RNA, 32 nt, Human
aacccgggaggcggagguuguggugagccgag

SEQ ID NO: 287403 - RNA, 32 nt, Human
aacccgggaggcggagguuguggugagcugaa

SEQ ID NO: 287404 - RNA, 32 nt, Human
aacccgggaggcggagguuguggugagcugag

SEQ ID NO: 287405 - RNA, 32 nt, Human
aacccgggaggcggagguuucagugagccgag

SEQ ID NO: 287406 - RNA, 32 nt, Human
aacccgggaggcggaguugcggugagccgaga

SEQ ID NO: 287407 - RNA, 32 nt, Human
aacccgggaggcggaguuugcagugagccaag

SEQ ID NO: 287408 - RNA, 32 nt, Human
aacccgggaggcggaucuugcagugagcggag

SEQ ID NO: 287409 - RNA, 32 nt, Human
aacccgggaggcggaucuugcauugagccaag

SEQ ID NO: 287410 - RNA, 32 nt, Human
aacccgggaggcggauguugcggugagccgaa

SEQ ID NO: 287411 - RNA, 32 nt, Human
aacccgggaggcuaagguugcagugagccgag

SEQ ID NO: 287412 - RNA, 32 nt, Human
aacccgggaggcugagguugcagugaguggag

SEQ ID NO: 287413 - RNA, 32 nt, Human
aacccgggagggagagguugcagugagccaag

SEQ ID NO: 287414 - RNA, 32 nt, Human
aacccgggagguagagcuugcagugaaccgag

SEQ ID NO: 287415 - RNA, 32 nt, Human
aacccgggagguagaggcugcagugagccgag

SEQ ID NO: 287416 - RNA, 32 nt, Human
aacccgggagguagagguugcagugagccgag

SEQ ID NO: 287417 - RNA, 32 nt, Human
aacccgggaggugaaggaugcagugagccaag

SEQ ID NO: 287418 - RNA, 32 nt, Human
aacccgggaggugcagguugcagugagccaag

SEQ ID NO: 287419 - RNA, 32 nt, Human
aacccgggagguggaacuugcagugagccgag

SEQ ID NO: 287420 - RNA, 32 nt, Human
aacccgggagguggagauugcagugagcccag

SEQ ID NO: 287421 - RNA, 32 nt, Human
aacccgggagguggagauugcagugagcugag

SEQ ID NO: 287422 - RNA, 32 nt, Human
aacccgggagguggagccuacagugagucaac

SEQ ID NO: 287423 - RNA, 32 nt, Human
aacccgggagguggagcuuccagugagccgag

SEQ ID NO: 287424 - RNA, 23 nt, Human
aacccgggagguggagcuugcag

SEQ ID NO: 287425 - RNA, 32 nt, Human
aacccgggagguggagcuugcagugagccaag

SEQ ID NO: 287426 - RNA, 32 nt, Human
aacccgggagguggagcuugcagugagccgag

SEQ ID NO: 287427 - RNA, 32 nt, Human
aacccgggagguggagcuugcagugagcggag

SEQ ID NO: 287428 - RNA, 32 nt, Human
aacccgggagguggagcuugcagugagcugag

SEQ ID NO: 287429 - RNA, 32 nt, Human
aacccgggagguggagcuugcagugagcuggg

SEQ ID NO: 287430 - RNA, 32 nt, Human
aacccgggagguggagcuugcaguggguggag

SEQ ID NO: 287431 - RNA, 32 nt, Human
aacccgggagguggagcuugcggugagcugag

SEQ ID NO: 287432 - RNA, 32 nt, Human
aacccgggagguggagcuuguagugaggcgag

SEQ ID NO: 287433 - RNA, 32 nt, Human
aacccgggagguggaggcugcaaugagcugag

SEQ ID NO: 287434 - RNA, 32 nt, Human
aacccgggagguggaggcugcagcgagccaag

SEQ ID NO: 287435 - RNA, 32 nt, Human
aacccgggagguggaggcugcagugagccgag

SEQ ID NO: 287436 - RNA, 32 nt, Human
aacccgggagguggaggcugcagugaguuaag

SEQ ID NO: 287437 - RNA, 32 nt, Human
aacccgggagguggaggcugcggugagccaag

SEQ ID NO: 287438 - RNA, 32 nt, Human
aacccgggagguggaggucgcggugagccgag

SEQ ID NO: 287439 - RNA, 32 nt, Human
aacccgggagguggagguggcagugagccgag

SEQ ID NO: 287440 - RNA, 32 nt, Human
aacccgggagguggagguuacagugagccgag

SEQ ID NO: 287441 - RNA, 32 nt, Human
aacccgggagguggagguuacagugagcugag

SEQ ID NO: 287442 - RNA, 32 nt, Human
aacccgggagguggagguucuagugagccgag

SEQ ID NO: 287443 - RNA, 32 nt, Human
aacccgggagguggagguugcaaugagccaag

SEQ ID NO: 287444 - RNA, 32 nt, Human
aacccgggagguggagguugcagcaagccgag

SEQ ID NO: 287445 - RNA, 32 nt, Human
aacccgggagguggagguugcagggagccgag

SEQ ID NO: 287446 - RNA, 32 nt, Human
aacccgggagguggagguugcaguaagccgag

SEQ ID NO: 287447 - RNA, 26 nt, Human
aacccgggagguggagguugcaguga

SEQ ID NO: 287448 - RNA, 32 nt, Human
aacccgggagguggagguugcagugaaccaag

SEQ ID NO: 287449 - RNA, 32 nt, Human
aacccgggagguggagguugcagugagccaag

SEQ ID NO: 287450 - RNA, 32 nt, Human
aacccgggagguggagguugcagugagccgag

SEQ ID NO: 287451 - RNA, 32 nt, Human
aacccgggagguggagguugcagugagcuaag

SEQ ID NO: 287452 - RNA, 32 nt, Human
aacccgggagguggagguugcagugagcugag

SEQ ID NO: 287453 - RNA, 32 nt, Human
aacccgggagguggagguugcagugaggugag

SEQ ID NO: 287454 - RNA, 32 nt, Human
aacccgggagguggagguugccgugagccaag

SEQ ID NO: 287455 - RNA, 32 nt, Human
aacccgggagguggagguugccgugagcugag

SEQ ID NO: 287456 - RNA, 32 nt, Human
aacccgggagguggagguugccgugaguugag

SEQ ID NO: 287457 - RNA, 32 nt, Human
aacccgggagguggagguugcgaugagcugag

SEQ ID NO: 287458 - RNA, 26 nt, Human
aacccgggagguggagguugcgguga

SEQ ID NO: 287459 - RNA, 32 nt, Human
aacccgggagguggagguugcggugagccaag

SEQ ID NO: 287460 - RNA, 32 nt, Human
aacccgggagguggagguugcggugagcugag

SEQ ID NO: 287461 - RNA, 32 nt, Human
aacccgggagguggagguuguagcgagcugag

SEQ ID NO: 287462 - RNA, 26 nt, Human
aacccgggagguggagguuguaguga

SEQ ID NO: 287463 - RNA, 32 nt, Human
aacccgggagguggagguuguagugagcugag

SEQ ID NO: 287464 - RNA, 32 nt, Human
aacccgggagguggagguuguggugagcugag

SEQ ID NO: 287465 - RNA, 32 nt, Human
aacccgggagguguagguugcagugagccgag

SEQ ID NO: 287466 - RNA, 23 nt, Human
aacccgggagucagaggcugcag

SEQ ID NO: 287467 - RNA, 32 nt, Human
aacccgggaguuaaagguugcagugagccgag

SEQ ID NO: 287468 - RNA, 32 nt, Human
aacccgggaguuggagguugcagugagccaag

SEQ ID NO: 287469 - RNA, 32 nt, Human
aacccgggaugcagagguugcagugagcugag

SEQ ID NO: 287470 - RNA, 32 nt, Human
aacccgggcagcggagguugcagugagccgag

SEQ ID NO: 287471 - RNA, 32 nt, Human
aacccgggcccgguggaggcugcagugagacg

SEQ ID NO: 287472 - RNA, 32 nt, Human
aacccgggcggcggaaguugcagugagccgag

SEQ ID NO: 287473 - RNA, 32 nt, Human
aacccgggcggcggagauugcagugagccgag

SEQ ID NO: 287474 - RNA, 32 nt, Human
aacccgggcgguggagcuugcagugagccgag

SEQ ID NO: 287475 - RNA, 26 nt, Human
aacccgggcgguggagguuguaguga

SEQ ID NO: 287476 - RNA, 32 nt, Human
aacccgggcgguggagguuguagugagccaag

SEQ ID NO: 287477 - RNA, 25 nt, Human
aacccggggacggagguugcaguga

SEQ ID NO: 287478 - RNA, 32 nt, Human
aacccggggacggagguugcagugaaccgaga

SEQ ID NO: 287479 - RNA, 32 nt, Human
aacccgggggcagaggcugcagugagccgaga

SEQ ID NO: 287480 - RNA, 26 nt, Human
aacccggggggcggagguugcaguga

SEQ ID NO: 287481 - RNA, 32 nt, Human
aacccgggugcuggggucaugcugccuccgug

SEQ ID NO: 287482 - RNA, 32 nt, Human
aacccggguggcagagguugcagugagccgaa

SEQ ID NO: 287483 - RNA, 32 nt, Human
aacccggguggcagagguugcagugagcugag

SEQ ID NO: 287484 - RNA, 32 nt, Human
aacccggguggcggcgcuugcagugagcugag

SEQ ID NO: 287485 - RNA, 32 nt, Human
aacccgguagaggcggagguugcagugagccg

SEQ ID NO: 287486 - RNA, 32 nt, Human
aacccgguaggcagagguugcagugagccgag

SEQ ID NO: 287487 - RNA, 32 nt, Human
aacccgguaggcggagcuugcagugagcugag

SEQ ID NO: 287488 - RNA, 32 nt, Human
aacccgguaggggagcuugcagugagcccaga

SEQ ID NO: 287489 - RNA, 32 nt, Human
aacccgguagguggagguugcagugagccgag

SEQ ID NO: 287490 - RNA, 32 nt, Human
aacccggugaagaaaucuuauugaugaauaaa

SEQ ID NO: 287491 - RNA, 32 nt, Human
aacccgguuguagaggaugauggcgccuuugg

SEQ ID NO: 287492 - RNA, 32 nt, Human
aacccgucacccuuggguuaggaugcgauuuc

SEQ ID NO: 287493 - RNA, 32 nt, Human
aacccgucagagaccugggagcaggggcaaug

SEQ ID NO: 287494 - RNA, 32 nt, Human
aacccgugacuguauucucucccuuggauacc

SEQ ID NO: 287495 - RNA, 32 nt, Human
aacccgugaggcagagguugcagugaaccgag

SEQ ID NO: 287496 - RNA, 32 nt, Human
aacccgugaggcagagguugcagugagccgag

SEQ ID NO: 287497 - RNA, 32 nt, Human
aacccgugaggcggagguuguagugagccaag

SEQ ID NO: 287498 - RNA, 32 nt, Human
aacccguguggcagagguugcggugaguguag

SEQ ID NO: 287499 - RNA, 32 nt, Human
aacccguugcccgggcaaccagcuuugcucuu

SEQ ID NO: 287500 - RNA, 32 nt, Human
aacccuaaaagaaccaaaaaucugccacagcc

SEQ ID NO: 287501 - RNA, 32 nt, Human
aacccuaaaggcagagguugcagugagccgag

SEQ ID NO: 287502 - RNA, 32 nt, Human
aacccuaagcccaggcuuuucucuccacugac

SEQ ID NO: 287503 - RNA, 32 nt, Human
aacccuacaaaugcaaugaaugugguaaagcc

SEQ ID NO: 287504 - RNA, 32 nt, Human
aacccuaccuucggcccggccugggugccccu

SEQ ID NO: 287505 - RNA, 25 nt, Human
aacccuacugggaucaaacuggaau

SEQ ID NO: 287506 - RNA, 32 nt, Human
aacccuagaaauauauccuguguaccucacug

SEQ ID NO: 287507 - RNA, 32 nt, Human
aacccuagaggcggaguuugcagugagccgag

SEQ ID NO: 287508 - RNA, 32 nt, Human
aacccuaggccugccaucugucagccggguga

SEQ ID NO: 287509 - RNA, 32 nt, Human
aacccuagucuuccauuuccucccgccagucu

SEQ ID NO: 287510 - RNA, 32 nt, Human
aacccuauccacccucuggaucccaauauuga

SEQ ID NO: 287511 - RNA, 32 nt, Human
aacccuaugaauguaaugaauguagaaaaacc

SEQ ID NO: 287512 - RNA, 32 nt, Human
aacccuaugaauguaaugaaugugaaaaaucc

SEQ ID NO: 287513 - RNA, 32 nt, Human
aacccuaugaauguaaugaaugugggagaucu

SEQ ID NO: 287514 - RNA, 32 nt, Human
aacccuauuuucuuuucuccaagaccaugguu

SEQ ID NO: 287515 - RNA, 32 nt, Human
aacccucagccguuccuccaccucucagccau

SEQ ID NO: 287516 - RNA, 32 nt, Human
aacccucccaccucggccugaaaaagugcuag

SEQ ID NO: 287517 - RNA, 19 nt, Human
aacccuccccagaccccca

SEQ ID NO: 287518 - RNA, 19 nt, Human
aacccucccccugcccgca

SEQ ID NO: 287519 - RNA, 32 nt, Human
aacccucccuccucuucuugcuggaggaccug

SEQ ID NO: 287520 - RNA, 32 nt, Human
aacccuccucugaauccuccuaauuccuuaag

SEQ ID NO: 287521 - RNA, 32 nt, Human
aacccuccuggacuaggcugcucuuguuaauc

SEQ ID NO: 287522 - RNA, 32 nt, Human
aacccuccuugcuagcguugcaaagaagggcc

SEQ ID NO: 287523 - RNA, 32 nt, Human
aacccucggaagaugggauugccagucagccc

SEQ ID NO: 287524 - RNA, 32 nt, Human
aacccucggucauggacuggauccugcggaca

SEQ ID NO: 287525 - RNA, 32 nt, Human
aacccucuaucucuccggcauccuggcaauca

SEQ ID NO: 287526 - RNA, 32 nt, Human
aacccucugccuccuuccuucuuucucuucaa

SEQ ID NO: 287527 - RNA, 32 nt, Human
aacccucugcuccccuguggcucucucuauuu

SEQ ID NO: 287528 - RNA, 32 nt, Human
aacccucugcucccguuucucccucugguuca

SEQ ID NO: 287529 - RNA, 23 nt, Human
aacccucugcuuaccuaccagcu

SEQ ID NO: 287530 - RNA, 32 nt, Human
aacccucuggagagcaaguggagccagucccc

SEQ ID NO: 287531 - RNA, 32 nt, Human
aacccucugggaccccucaccccacugcuuca

SEQ ID NO: 287532 - RNA, 32 nt, Human
aacccugaaauacaaaaauuagucaggcaugg

SEQ ID NO: 287533 - RNA, 32 nt, Human
aacccugacaccaguacugagaucggacgugc

SEQ ID NO: 287534 - RNA, 32 nt, Human
aacccugaccuuccugucccugccuucgaccu

SEQ ID NO: 287535 - RNA, 32 nt, Human
aacccugagcaguuccuggaggcugcggccac

SEQ ID NO: 287536 - RNA, 32 nt, Human
aacccugagcccagagagcuugggucacuguc

SEQ ID NO: 287537 - RNA, 32 nt, Human
aacccugagcgggcugccggccuccaaguucc

SEQ ID NO: 287538 - RNA, 32 nt, Human
aacccugaggucuuugaggccaauauuaaaca

SEQ ID NO: 287539 - RNA, 32 nt, Human
aacccugaguggacacagcacauguuucagag

SEQ ID NO: 287540 - RNA, 32 nt, Human
aacccugaguucuacuuuaauucuugggcauu

SEQ ID NO: 287541 - RNA, 32 nt, Human
aacccugcacucuccccugagcacccacagag

SEQ ID NO: 287542 - RNA, 32 nt, Human
aacccugcaggaaggggaagccagcaggggag

SEQ ID NO: 287543 - RNA, 32 nt, Human
aacccugccagcugagcccugugcaucuacua

SEQ ID NO: 287544 - RNA, 32 nt, Human
aacccugccccaggaagcccacagccucaccu

SEQ ID NO: 287545 - RNA, 32 nt, Human
aacccugcccucuccccuccugcugcuguaga

SEQ ID NO: 287546 - RNA, 32 nt, Human
aacccugcucccaggcugaagccuggagucug

SEQ ID NO: 287547 - RNA, 32 nt, Human
aacccugcucuaugcugacccuugucacugaa

SEQ ID NO: 287548 - RNA, 32 nt, Human
aacccuggaagcaggaaggauugccagauagu

SEQ ID NO: 287549 - RNA, 32 nt, Human
aacccuggaaguggagguugcagugagccugu

SEQ ID NO: 287550 - RNA, 31 nt, Human
aacccuggacaguuggcucuaccucaguaac

SEQ ID NO: 287551 - RNA, 32 nt, Human
aacccuggagcaggcuuccaugcugcuguggg

SEQ ID NO: 287552 - RNA, 32 nt, Human
aacccuggaggcagaggugguagugagccgag

SEQ ID NO: 287553 - RNA, 32 nt, Human
aacccuggaggcagagguugcaaugagccgag

SEQ ID NO: 287554 - RNA, 26 nt, Human
aacccuggaggcagagguugcaguga

SEQ ID NO: 287555 - RNA, 32 nt, Human
aacccuggaggcagagguugcagugagccaag

SEQ ID NO: 287556 - RNA, 32 nt, Human
aacccuggaggcagagguuguagugagucgug

SEQ ID NO: 287557 - RNA, 26 nt, Human
aacccuggaggcagagguugugguga

SEQ ID NO: 287558 - RNA, 32 nt, Human
aacccuggaggcagagguuguggugagcugag

SEQ ID NO: 287559 - RNA, 32 nt, Human
aacccuggaggcagagguuguggugagucgag

SEQ ID NO: 287560 - RNA, 26 nt, Human
aacccuggaggcggaaguugcaguga

SEQ ID NO: 287561 - RNA, 32 nt, Human
aacccuggaggcggaaguugcagugagccgag

SEQ ID NO: 287562 - RNA, 32 nt, Human
aacccuggaggcggagauugaagugagcugag

SEQ ID NO: 287563 - RNA, 32 nt, Human
aacccuggaggcggagguuacaguuauccgag

SEQ ID NO: 287564 - RNA, 32 nt, Human
aacccuggaggcggagguuccagugagcugag

SEQ ID NO: 287565 - RNA, 26 nt, Human
aacccuggaggcggagguugcaguga

SEQ ID NO: 287566 - RNA, 32 nt, Human
aacccuggaggcggagguugcagugagccgag

SEQ ID NO: 287567 - RNA, 32 nt, Human
aacccuggaggcggagguugcagugaguggag

SEQ ID NO: 287568 - RNA, 26 nt, Human
aacccuggaggcggagguugccguga

SEQ ID NO: 287569 - RNA, 32 nt, Human
aacccuggaggcggagguugccgugagccaag

SEQ ID NO: 287570 - RNA, 32 nt, Human
aacccuggagggugguccccaccagcucuuug

SEQ ID NO: 287571 - RNA, 32 nt, Human
aacccuggagguagaaguugcagugagccaag

SEQ ID NO: 287572 - RNA, 26 nt, Human
aacccuggagguggagguugcaguga

SEQ ID NO: 287573 - RNA, 32 nt, Human
aacccuggagguggagguugcagugagccgag

SEQ ID NO: 287574 - RNA, 32 nt, Human
aacccuggagguggagguugcagugagcugag

SEQ ID NO: 287575 - RNA, 26 nt, Human
aacccuggagguggcgguugcaguga

SEQ ID NO: 287576 - RNA, 32 nt, Human
aacccuggagguggcgguugcagugagcacag

SEQ ID NO: 287577 - RNA, 32 nt, Human
aacccuggagguugagguugcagugagcugag

SEQ ID NO: 287578 - RNA, 32 nt, Human
aacccuggccucggcccugcccugucccugcc

SEQ ID NO: 287579 - RNA, 32 nt, Human
aacccuggcucugccauuagcuaggaccuaag

SEQ ID NO: 287580 - RNA, 32 nt, Human
aacccugggaaaagugaaguauggcuguaagu

SEQ ID NO: 287581 - RNA, 32 nt, Human
aacccugggacucuggucugcccagcccaccc

SEQ ID NO: 287582 - RNA, 32 nt, Human
aacccugggagcggagauugcagugagcugag

SEQ ID NO: 287583 - RNA, 32 nt, Human
aacccugggaggcagagguugcagugagucga

SEQ ID NO: 287584 - RNA, 32 nt, Human
aacccugggaugaaguaucugugaacuauuuu

SEQ ID NO: 287585 - RNA, 32 nt, Human
aacccugggccucuuaaccacugaucuuugaa

SEQ ID NO: 287586 - RNA, 32 nt, Human
aacccuggggcuggcuuaggaggcaagaaaac

SEQ ID NO: 287587 - RNA, 32 nt, Human
aacccugguggacugcagccuucaucuuuauu

SEQ ID NO: 287588 - RNA, 32 nt, Human
aacccuguacacaccugguucauaauccucau

SEQ ID NO: 287589 - RNA, 32 nt, Human
aacccuguacugauaguacuucccaguaugau

SEQ ID NO: 287590 - RNA, 32 nt, Human
aacccuguaggggacugguuacagaggaccuc

SEQ ID NO: 287591 - RNA, 32 nt, Human
aacccuguauuccgucgcgcugggcucuccga

SEQ ID NO: 287592 - RNA, 32 nt, Human
aacccugucccugggccagcugcaucacugcc

SEQ ID NO: 287593 - RNA, 32 nt, Human
aacccugucuaguuguucagagacauaggcca

SEQ ID NO: 287594 - RNA, 32 nt, Human
aacccuguggcucaggccgcugagcuuccuug

SEQ ID NO: 287595 - RNA, 32 nt, Human
aacccuguggcugcccuucacacuuacaggcc

SEQ ID NO: 287596 - RNA, 32 nt, Human
aacccuguggugagcaagacgaucagguccau

SEQ ID NO: 287597 - RNA, 32 nt, Human
aacccuguucuccaaaacccugccccaggcua

SEQ ID NO: 287598 - RNA, 32 nt, Human
aacccuuaaaugccaucguagacuucauaccg

SEQ ID NO: 287599 - RNA, 23 nt, Human
aacccuuaccccuuagccucccu

SEQ ID NO: 287600 - RNA, 32 nt, Human
aacccuucaaagaagcaggcugugaacauugg

SEQ ID NO: 287601 - RNA, 32 nt, Human
aacccuucaccccuccuggaaagcaggccuga

SEQ ID NO: 287602 - RNA, 32 nt, Human
aacccuucugaccauccaaaggcaagcacaau

SEQ ID NO: 287603 - RNA, 32 nt, Human
aacccuucuggcccucgcaccacugugacucu

SEQ ID NO: 287604 - RNA, 32 nt, Human
aacccuucuuuggcuuuccuugcccauugcaa

SEQ ID NO: 287605 - RNA, 32 nt, Human
aacccuugauaggcaagccucaguuucuccac

SEQ ID NO: 287606 - RNA, 32 nt, Human
aacccuugcccaguuuggaucccuucaagacu

SEQ ID NO: 287607 - RNA, 21 nt, Human
aacccuugccccaguccugcc

SEQ ID NO: 287608 - RNA, 32 nt, Human
aacccuugcccuuucaagccaucagcuccugc

SEQ ID NO: 287609 - RNA, 31 nt, Human
aacccuugcuuuccugggccuuugcaagaug

SEQ ID NO: 287610 - RNA, 32 nt, Human
aacccuuggagccaauggagacugucucaaga

SEQ ID NO: 287611 - RNA, 32 nt, Human
aacccuuggcagggcaucgacugugugcgagg

SEQ ID NO: 287612 - RNA, 32 nt, Human
aacccuugucguccuugggaaaugggggaggg

SEQ ID NO: 287613 - RNA, 32 nt, Human
aacccuuucauuccucccugggaaucagggua

SEQ ID NO: 287614 - RNA, 32 nt, Human
aacccuuucauucugguacaagagucgggggu

SEQ ID NO: 287615 - RNA, 32 nt, Human
aacccuuuccagaacugcuguuugguucuucu

SEQ ID NO: 287616 - RNA, 32 nt, Human
aacccuuuccuucucuaugccugggccuggga

SEQ ID NO: 287617 - RNA, 32 nt, Human
aacccuuucucauccagcagaccaacaggcag

SEQ ID NO: 287618 - RNA, 18 nt, Human
aacccuuucugggucuga

SEQ ID NO: 287619 - RNA, 32 nt, Human
aacccuuuggaagagccuggagauuggacugg

SEQ ID NO: 287620 - RNA, 32 nt, Human
aacccuuuucacucugggcuucucccaaaacc

SEQ ID NO: 287621 - RNA, 32 nt, Human
aaccgaaaucuaccacagcagagaugccgccg

SEQ ID NO: 287622 - RNA, 32 nt, Human
aaccgaaggcucggucuuaauucccccaccug

SEQ ID NO: 287623 - RNA, 32 nt, Human
aaccgacccuggcucaggagguugaugccaug

SEQ ID NO: 287624 - RNA, 32 nt, Human
aaccgacucccagaacuccggacgugugcggc

SEQ ID NO: 287625 - RNA, 32 nt, Human
aaccgagacagcugucuuauaucugcaugccu

SEQ ID NO: 287626 - RNA, 32 nt, Human
aaccgagagggcccugagguacaggaaccgga

SEQ ID NO: 287627 - RNA, 32 nt, Human
aaccgagcagugacgccagcccugccagggaa

SEQ ID NO: 287628 - RNA, 23 nt, Human
aaccgagcgggccugcggccuca

SEQ ID NO: 287629 - RNA, 25 nt, Human
aaccgaggacccaugaaacagcagc

SEQ ID NO: 287630 - RNA, 32 nt, Human
aaccgaggaggcagagcuugcagugagccaag

SEQ ID NO: 287631 - RNA, 32 nt, Human
aaccgaggaggcgaagguugcagugagccgag

SEQ ID NO: 287632 - RNA, 32 nt, Human
aaccgaguggcugucaucagccuguguaggca

SEQ ID NO: 287633 - RNA, 32 nt, Human
aaccgaguggcugucaucggccuguguaggca

SEQ ID NO: 287634 - RNA, 32 nt, Human
aaccgaguucuaguucccugaggucuuuaaaa

SEQ ID NO: 287635 - RNA, 32 nt, Human
aaccgaucucagaaugaacucuggaguaugaa

SEQ ID NO: 287636 - RNA, 32 nt, Human
aaccgaucuuccccugacuccccaccgaggag

SEQ ID NO: 287637 - RNA, 32 nt, Human
aaccgauucaucucucagaagggaggcugggg

SEQ ID NO: 287638 - RNA, 32 nt, Human
aaccgcacaagcuaccaaauauauaaaaggca

SEQ ID NO: 287639 - RNA, 32 nt, Human
aaccgcacugaagaacucuuguccucacuggc

SEQ ID NO: 287640 - RNA, 32 nt, Human
aaccgcagacacauccccgcgccccagagccc

SEQ ID NO: 287641 - RNA, 32 nt, Human
aaccgcauucacccucucucuucauagcucag

SEQ ID NO: 287642 - RNA, 32 nt, Human
aaccgccaccgggcugacuuccaccucccagu

SEQ ID NO: 287643 - RNA, 32 nt, Human
aaccgccauuguauuuucuguccuucugaauu

SEQ ID NO: 287644 - RNA, 32 nt, Human
aaccgcccagagaagaauuaauggaggacaca

SEQ ID NO: 287645 - RNA, 32 nt, Human
aaccgccccucagcagggcagggccaguccug

SEQ ID NO: 287646 - RNA, 32 nt, Human
aaccgcccuccugauuaaggcguggcuucugc

SEQ ID NO: 287647 - RNA, 32 nt, Human
aaccgcccugcagcaucccucagccuguaccg

SEQ ID NO: 287648 - RNA, 32 nt, Human
aaccgccucaucugagggcccaacugauauga

SEQ ID NO: 287649 - RNA, 32 nt, Human
aaccgccugcggcugcucacagagcacguguu

SEQ ID NO: 287650 - RNA, 26 nt, Human
aaccgcgagggcgaggggagaaaguc

SEQ ID NO: 287651 - RNA, 32 nt, Human
aaccgcgggggugagagggcgcgguggcugug

SEQ ID NO: 287652 - RNA, 32 nt, Human
aaccgcgguccccacaggaguuuguaggauuu

SEQ ID NO: 287653 - RNA, 32 nt, Human
aaccgcuaccggcgaugcuacugcugugggug

SEQ ID NO: 287654 - RNA, 29 nt, Human
aaccgcuggcugcuguugugccucaucuc

SEQ ID NO: 287655 - RNA, 32 nt, Human
aaccgcuguaugcccuuuuuccuucuaaguca

SEQ ID NO: 287656 - RNA, 32 nt, Human
aaccggaaagauggcggccugccccaucuauu

SEQ ID NO: 287657 - RNA, 32 nt, Human
aaccggaaggagaaaggccucaaggagaguuu

SEQ ID NO: 287658 - RNA, 32 nt, Human
aaccggaaggcagagguugcagugagccaaga

SEQ ID NO: 287659 - RNA, 32 nt, Human
aaccggacaagugucauguuaaaagacagaug

SEQ ID NO: 287660 - RNA, 32 nt, Human
aaccggacccucuccaugcugcaccugcagaa

SEQ ID NO: 287661 - RNA, 32 nt, Human
aaccggaccuucuguggaacucccgugucccu

SEQ ID NO: 287662 - RNA, 32 nt, Human
aaccggcaccugccagacagagcugguucuaa

SEQ ID NO: 287663 - RNA, 31 nt, Human
aaccggcagaggaucuacucacuggagcagc

SEQ ID NO: 287664 - RNA, 32 nt, Human
aaccggcgccgcuuccuggccuugggaggugg

SEQ ID NO: 287665 - RNA, 32 nt, Human
aaccggcuagaugaccaucacacagcaaagga

SEQ ID NO: 287666 - RNA, 32 nt, Human
aaccggcuccaucacauccucaggucucggga

SEQ ID NO: 287667 - RNA, 32 nt, Human
aaccggcuccuugguccaguucugcaccgggg

SEQ ID NO: 287668 - RNA, 22 nt, Human
aaccgggacauuuuacagaaaa

SEQ ID NO: 287669 - RNA, 32 nt, Human
aaccgggaggcagaaguugcagugagccgaga

SEQ ID NO: 287670 - RNA, 25 nt, Human
aaccgggaggcggaaguugcaguga

SEQ ID NO: 287671 - RNA, 32 nt, Human
aaccgggaggcggaaguugcagugagccaaga

SEQ ID NO: 287672 - RNA, 25 nt, Human
aaccgggaggcggagguugagguga

SEQ ID NO: 287673 - RNA, 32 nt, Human
aaccgggaggcggagguugaggugagccgaaa

SEQ ID NO: 287674 - RNA, 25 nt, Human
aaccgggaggcggagguugcaguga

SEQ ID NO: 287675 - RNA, 32 nt, Human
aaccgggaggcggagguugcagugagccgaga

SEQ ID NO: 287676 - RNA, 32 nt, Human
aaccgggcacagugacacagucacguguccca

SEQ ID NO: 287677 - RNA, 32 nt, Human
aaccgggcacucaagaaggaaaaagaggaucc

SEQ ID NO: 287678 - RNA, 32 nt, Human
aaccgggcacucaugaaggaaaaagaggaucc

SEQ ID NO: 287679 - RNA, 32 nt, Human
aaccgggcacucaugaaggaaaaaggggaucc

SEQ ID NO: 287680 - RNA, 32 nt, Human
aaccgggcagcuggacgugguggugcaggucu

SEQ ID NO: 287681 - RNA, 26 nt, Human
aaccggggagacggagguugcaguga

SEQ ID NO: 287682 - RNA, 32 nt, Human
aaccggggagacggagguugcagugagccgag

SEQ ID NO: 287683 - RNA, 32 nt, Human
aaccggggagcagcaaagaggcaguagggggc

SEQ ID NO: 287684 - RNA, 32 nt, Human
aaccggggaggcagagguugcagugagcugag

SEQ ID NO: 287685 - RNA, 32 nt, Human
aaccggggaggcagagguugcaguuaagccga

SEQ ID NO: 287686 - RNA, 32 nt, Human
aaccggggaggcggagcuugcagugagccaag

SEQ ID NO: 287687 - RNA, 32 nt, Human
aaccggggaggcggaggguguggugagccggg

SEQ ID NO: 287688 - RNA, 26 nt, Human
aaccggggaggcggagguuacaguga

SEQ ID NO: 287689 - RNA, 32 nt, Human
aaccggggaggcggagguuacagugagccgag

SEQ ID NO: 287690 - RNA, 26 nt, Human
aaccggggaggcggggguugcaauga

SEQ ID NO: 287691 - RNA, 32 nt, Human
aaccggggaggcggggguugcaaugagcuaag

SEQ ID NO: 287692 - RNA, 26 nt, Human
aaccggggagguggaggcugcaguga

SEQ ID NO: 287693 - RNA, 32 nt, Human
aaccggggagguggaggcugcagugagccgag

SEQ ID NO: 287694 - RNA, 26 nt, Human
aaccggggagguggagguugcaguga

SEQ ID NO: 287695 - RNA, 32 nt, Human
aaccggggagguggagguugcagugagcugag

SEQ ID NO: 287696 - RNA, 26 nt, Human
aaccggggaguuggagguugcaguga

SEQ ID NO: 287697 - RNA, 32 nt, Human
aaccggggaguuggagguugcagugagccgag

SEQ ID NO: 287698 - RNA, 32 nt, Human
aaccgguggaaucugaucuugaaaaucugagu

SEQ ID NO: 287699 - RNA, 32 nt, Human
aaccgguuaaagcucauagcugucagcucuga

SEQ ID NO: 287700 - RNA, 32 nt, Human
aaccguaaaagauggacuuuccaguuuaaaag

SEQ ID NO: 287701 - RNA, 32 nt, Human
aaccguagcaccagagcccauucuuccuuguc

SEQ ID NO: 287702 - RNA, 32 nt, Human
aaccguagugggguggaggcugcuggaggugg

SEQ ID NO: 287703 - RNA, 32 nt, Human
aaccguaugaaugugaugaaugugggaaagcc

SEQ ID NO: 287704 - RNA, 32 nt, Human
aaccgucaacagcauaauaaaaucccaacaac

SEQ ID NO: 287705 - RNA, 32 nt, Human
aaccgucaacaucaguguuguaaauuugcuaa

SEQ ID NO: 287706 - RNA, 32 nt, Human
aaccguccuagcagcuccuuccucgcuaacgu

SEQ ID NO: 287707 - RNA, 32 nt, Human
aaccgucucuccccagcccuauccggcgagga

SEQ ID NO: 287708 - RNA, 32 nt, Human
aaccgucuuuucucucagaggguggggaggga

SEQ ID NO: 287709 - RNA, 23 nt, Human
aaccgugagaaguaaauuucugu

SEQ ID NO: 287710 - RNA, 32 nt, Human
aaccguggagaugcggaaggaaaccccacccc

SEQ ID NO: 287711 - RNA, 32 nt, Human
aaccguggccacuuugcuauagggguuacaua

SEQ ID NO: 287712 - RNA, 19 nt, Human
aaccguguuaagacccagc

SEQ ID NO: 287713 - RNA, 32 nt, Human
aaccguuguuuaaggaugcuauucugaaaaga

SEQ ID NO: 287714 - RNA, 32 nt, Human
aaccguuuauaaucagugcuuucccaacucuu

SEQ ID NO: 287715 - RNA, 32 nt, Human
aaccuaaaacucaucagaucacuguauccaga

SEQ ID NO: 287716 - RNA, 32 nt, Human
aaccuaacgaaauuuccaugaagaaccaaguc

SEQ ID NO: 287717 - RNA, 32 nt, Human
aaccuaagcaugccuucuuuauuccagcuccu

SEQ ID NO: 287718 - RNA, 32 nt, Human
aaccuaaggaacaacaugaggaacgugcagau

SEQ ID NO: 287719 - RNA, 32 nt, Human
aaccuaaggacagcuacaaaggaaagacaacu

SEQ ID NO: 287720 - RNA, 32 nt, Human
aaccuaaguggcagagguugcagugagcugag

SEQ ID NO: 287721 - RNA, 32 nt, Human
aaccuacaaaccuguauggcauauuacuguac

SEQ ID NO: 287722 - RNA, 32 nt, Human
aaccuacaaaugggauaguauugcaagguucu

SEQ ID NO: 287723 - RNA, 32 nt, Human
aaccuacaagcaguuggacaguucuggaggcu

SEQ ID NO: 287724 - RNA, 32 nt, Human
aaccuacacugucuaugacagcucuaguugua

SEQ ID NO: 287725 - RNA, 32 nt, Human
aaccuacagcacagauuaugcccugcccacuu

SEQ ID NO: 287726 - RNA, 32 nt, Human
aaccuacaggaaaguuguaaggccagaacaau

SEQ ID NO: 287727 - RNA, 32 nt, Human
aaccuacauuuugccuucuuaauaucgacuuu

SEQ ID NO: 287728 - RNA, 32 nt, Human
aaccuaccuccacccucccccuagccagccag

SEQ ID NO: 287729 - RNA, 32 nt, Human
aaccuaccuucuuuccagaggaugucuuucuc

SEQ ID NO: 287730 - RNA, 32 nt, Human
aaccuacuaagcugcaagcacaggccauuucu

SEQ ID NO: 287731 - RNA, 32 nt, Human
aaccuacuaaguagcuggaacuauaggggcau

SEQ ID NO: 287732 - RNA, 32 nt, Human
aaccuacucaacacagcacucuaggcagccac

SEQ ID NO: 287733 - RNA, 32 nt, Human
aaccuacucaugucccugauaaagcuaaauuu

SEQ ID NO: 287734 - RNA, 32 nt, Human
aaccuacuccaaugcuaaaacuaaucguccca

SEQ ID NO: 287735 - RNA, 32 nt, Human
aaccuacuccaaugcuaaacuaaucgucccaa

SEQ ID NO: 287736 - RNA, 32 nt, Human
aaccuacuugcuuacucaaugccuuuaagcca

SEQ ID NO: 287737 - RNA, 32 nt, Human
aaccuagaaacacacauuucuuugaauuuagg

SEQ ID NO: 287738 - RNA, 32 nt, Human
aaccuagaagagaggggauaccagguucccca

SEQ ID NO: 287739 - RNA, 26 nt, Human
aaccuagaagguggagguugcaguga

SEQ ID NO: 287740 - RNA, 32 nt, Human
aaccuagaagguggagguugcagugagcggag

SEQ ID NO: 287741 - RNA, 32 nt, Human
aaccuagacuucagagagaaugagcagagagc

SEQ ID NO: 287742 - RNA, 32 nt, Human
aaccuagagcagcaaggagcagggcuuggagc

SEQ ID NO: 287743 - RNA, 32 nt, Human
aaccuagaucccucgcaugcgcaguucacaau

SEQ ID NO: 287744 - RNA, 32 nt, Human
aaccuagcauuuccucuccugaagaauaaaug

SEQ ID NO: 287745 - RNA, 32 nt, Human
aaccuagccauccuccugccucagccuccuga

SEQ ID NO: 287746 - RNA, 32 nt, Human
aaccuagcuagcaacauuuguuuuagucugaa

SEQ ID NO: 287747 - RNA, 32 nt, Human
aaccuagcucaaggauuugcaaaguuaggaag

SEQ ID NO: 287748 - RNA, 32 nt, Human
aaccuaggaggcagaaguugcagugagcagag

SEQ ID NO: 287749 - RNA, 26 nt, Human
aaccuaggaggcagagguugcaguga

SEQ ID NO: 287750 - RNA, 32 nt, Human
aaccuaggaggcagagguugcagugaaccgag

SEQ ID NO: 287751 - RNA, 32 nt, Human
aaccuaggaggcagagguugcagugagccaag

SEQ ID NO: 287752 - RNA, 32 nt, Human
aaccuaggaggcagaguuugcagugagcugag

SEQ ID NO: 287753 - RNA, 26 nt, Human
aaccuaggaggcggacguugcaguga

SEQ ID NO: 287754 - RNA, 26 nt, Human
aaccuaggaggcggagguugcaguga

SEQ ID NO: 287755 - RNA, 32 nt, Human
aaccuaggaggcggagguugcagugagccaag

SEQ ID NO: 287756 - RNA, 32 nt, Human
aaccuaggaggcggagguugcagugagucaag

SEQ ID NO: 287757 - RNA, 32 nt, Human
aaccuaggaggcugagauugcagugagccgaa

SEQ ID NO: 287758 - RNA, 32 nt, Human
aaccuaggaggggaagguugcagugagccgag

SEQ ID NO: 287759 - RNA, 32 nt, Human
aaccuaggaggucgaggcugcagugagccaag

SEQ ID NO: 287760 - RNA, 32 nt, Human
aaccuaggagguggaggcugcagcgagcugag

SEQ ID NO: 287761 - RNA, 32 nt, Human
aaccuaggagguggagguugcagugagccgag

SEQ ID NO: 287762 - RNA, 32 nt, Human
aaccuaggagguggagguugcagugagcugag

SEQ ID NO: 287763 - RNA, 32 nt, Human
aaccuagggaggcagagguuguagugagccaa

SEQ ID NO: 287764 - RNA, 32 nt, Human
aaccuaucugcuuucaagcuggucaucaugau

SEQ ID NO: 287765 - RNA, 32 nt, Human
aaccuaugagccuucaauggggaagaccagaa

SEQ ID NO: 287766 - RNA, 32 nt, Human
aaccuauguuauaugauacaagcacaacuuga

SEQ ID NO: 287767 - RNA, 32 nt, Human
aaccuauuacagccugcagcugugagcugagc

SEQ ID NO: 287768 - RNA, 32 nt, Human
aaccuauucaaccagaaaugaauggagcucga

SEQ ID NO: 287769 - RNA, 32 nt, Human
aaccuauuuauuuuguauuuauuugaacagag

SEQ ID NO: 287770 - RNA, 32 nt, Human
aaccuauuugauuucuugacaagaccacaauc

SEQ ID NO: 287771 - RNA, 32 nt, Human
aaccuauuuucacaucauaaaacaucuauuac

SEQ ID NO: 287772 - RNA, 23 nt, Human
aaccucaaacucccaggcucaag

SEQ ID NO: 287773 - RNA, 31 nt, Human
aaccucaagccuaaauaccuguuaggauugg

SEQ ID NO: 287774 - RNA, 32 nt, Human
aaccucaauauuaggucagcaugugaaauguu

SEQ ID NO: 287775 - RNA, 32 nt, Human
aaccucaccccaaauuggagauaggcacuccu

SEQ ID NO: 287776 - RNA, 32 nt, Human
aaccucacgaggagcugggauugcaggcgccc

SEQ ID NO: 287777 - RNA, 32 nt, Human
aaccucacugccccgucacucccuucaaaggc

SEQ ID NO: 287778 - RNA, 32 nt, Human
aaccucacuucgccuuacaggucuccauuuug

SEQ ID NO: 287779 - RNA, 32 nt, Human
aaccucacuuuguaggcucugccuauguaccu

SEQ ID NO: 287780 - RNA, 32 nt, Human
aaccucagagagcacuuuuccccaaguucuug

SEQ ID NO: 287781 - RNA, 22 nt, Human
aaccucagaggcagagguugca

SEQ ID NO: 287782 - RNA, 32 nt, Human
aaccucagaggcagagguugcaaugaagcgga

SEQ ID NO: 287783 - RNA, 32 nt, Human
aaccucagaggcagcuucaagugccuuuugcu

SEQ ID NO: 287784 - RNA, 32 nt, Human
aaccucagagggcccuugaaaacccaccgagg

SEQ ID NO: 287785 - RNA, 32 nt, Human
aaccucagagggcgaaaaccucucuucacugc

SEQ ID NO: 287786 - RNA, 32 nt, Human
aaccucagcaacuucagaaacugccccugaua

SEQ ID NO: 287787 - RNA, 32 nt, Human
aaccucagcccagcccagcccagcuccagcuc

SEQ ID NO: 287788 - RNA, 32 nt, Human
aaccucagccucccagguucaagagauucucc

SEQ ID NO: 287789 - RNA, 32 nt, Human
aaccucagccuccugaguagcuaggacuauag

SEQ ID NO: 287790 - RNA, 32 nt, Human
aaccucagcgacuccggcugcucugcggacug

SEQ ID NO: 287791 - RNA, 32 nt, Human
aaccucagcggcggagguugcagugagucgag

SEQ ID NO: 287792 - RNA, 32 nt, Human
aaccucagcuacuugggaggcugaggcaggag

SEQ ID NO: 287793 - RNA, 32 nt, Human
aaccucaggagguuguacuuaauuuuguuugu

SEQ ID NO: 287794 - RNA, 24 nt, Human
aaccucaguuuccuugucugugaa

SEQ ID NO: 287795 - RNA, 32 nt, Human
aaccucaucacucgaacuccagcuucaagaau

SEQ ID NO: 287796 - RNA, 32 nt, Human
aaccucauccauucaaggaagcagaaaugguc

SEQ ID NO: 287797 - RNA, 22 nt, Human
aaccucaucucuucccuguaga

SEQ ID NO: 287798 - RNA, 24 nt, Human
aaccucaugcaugaaagcagcaca

SEQ ID NO: 287799 - RNA, 32 nt, Human
aaccucauuacacugaacaagaucccaaacgu

SEQ ID NO: 287800 - RNA, 32 nt, Human
aaccucauucaucauaggcucagucugacagg

SEQ ID NO: 287801 - RNA, 32 nt, Human
aaccuccaacagcuuucccugccacugugggu

SEQ ID NO: 287802 - RNA, 32 nt, Human
aaccuccaacaggaagguuauucuucccacgg

SEQ ID NO: 287803 - RNA, 32 nt, Human
aaccuccaaccugcaccccucccuucuccauc

SEQ ID NO: 287804 - RNA, 32 nt, Human
aaccuccaccagcaaccuggacugccucagca

SEQ ID NO: 287805 - RNA, 32 nt, Human
aaccuccaccuccagguucaagcgauucuccu

SEQ ID NO: 287806 - RNA, 32 nt, Human
aaccuccaccucccgggucaagcaauucuccu

SEQ ID NO: 287807 - RNA, 32 nt, Human
aaccuccaccuccggguucaagcgauucuugu

SEQ ID NO: 287808 - RNA, 32 nt, Human
aaccuccaccuccugguucaagcgauucucag

SEQ ID NO: 287809 - RNA, 32 nt, Human
aaccuccaccugccgggucccagugauucucc

SEQ ID NO: 287810 - RNA, 32 nt, Human
aaccuccacuacugcuugacccugccgggauu

SEQ ID NO: 287811 - RNA, 32 nt, Human
aaccuccagacacaagaaaacuucuagcaaau

SEQ ID NO: 287812 - RNA, 32 nt, Human
aaccuccagcacuagcggcuguuucugugucu

SEQ ID NO: 287813 - RNA, 31 nt, Human
aaccuccagucucagcaccaugaaucaaacu

SEQ ID NO: 287814 - RNA, 32 nt, Human
aaccuccagugaccccagagacuuugcuguaa

SEQ ID NO: 287815 - RNA, 32 nt, Human
aaccuccaucuucucccacacugauggcgagc

SEQ ID NO: 287816 - RNA, 32 nt, Human
aaccucccaaagcacuaggauuacaggcauga

SEQ ID NO: 287817 - RNA, 32 nt, Human
aaccucccaaagcgcugggauuacaggcguga

SEQ ID NO: 287818 - RNA, 32 nt, Human
aaccucccaaagugcugagauuacaggcguga

SEQ ID NO: 287819 - RNA, 32 nt, Human
aaccucccaaagugcugggauuacaggcauga

SEQ ID NO: 287820 - RNA, 32 nt, Human
aaccucccaaagugcugggauuacaggcguga

SEQ ID NO: 287821 - RNA, 32 nt, Human
aaccucccaaagugcugggauuacagguguga

SEQ ID NO: 287822 - RNA, 32 nt, Human
aaccucccaaagugcugggauugcaggcguga

SEQ ID NO: 287823 - RNA, 32 nt, Human
aaccucccaaauaguugggauuacaggcacau

SEQ ID NO: 287824 - RNA, 32 nt, Human
aaccucccaacauuuuucuuauggcuguugaa

SEQ ID NO: 287825 - RNA, 22 nt, Human
aaccucccaagaacuaggaccc

SEQ ID NO: 287826 - RNA, 32 nt, Human
aaccucccaaguaacugggacaacauguccau

SEQ ID NO: 287827 - RNA, 32 nt, Human
aaccucccaaguagcgggacugcagggugaag

SEQ ID NO: 287828 - RNA, 32 nt, Human
aaccucccaaguagcuagaccuauaggcgccu

SEQ ID NO: 287829 - RNA, 32 nt, Human
aaccucccaaguagcugagauuacaggcgcac

SEQ ID NO: 287830 - RNA, 32 nt, Human
aaccucccaaguagcugggacuacaggcauau

SEQ ID NO: 287831 - RNA, 32 nt, Human
aaccucccaaguagcugggauuacagaaagcc

SEQ ID NO: 287832 - RNA, 32 nt, Human
aaccucccaaguaguugggauugcaggcacgc

SEQ ID NO: 287833 - RNA, 18 nt, Human
aaccucccaccccugucc

SEQ ID NO: 287834 - RNA, 32 nt, Human
aaccucccacugcuggagugcgagugggaauc

SEQ ID NO: 287835 - RNA, 32 nt, Human
aaccucccagacaaggaagaauaaccaacaua

SEQ ID NO: 287836 - RNA, 18 nt, Human
aaccucccaucccugccc

SEQ ID NO: 287837 - RNA, 21 nt, Human
aaccucccccuccuguccccu

SEQ ID NO: 287838 - RNA, 32 nt, Human
aaccucccgaguaacugggauuacaggugugu

SEQ ID NO: 287839 - RNA, 32 nt, Human
aaccucccgaguagcugggacuacagguaccc

SEQ ID NO: 287840 - RNA, 32 nt, Human
aaccucccgaguaguuaaaauuacaggagucu

SEQ ID NO: 287841 - RNA, 32 nt, Human
aaccucccggauagcugggauuacaggcgugc

SEQ ID NO: 287842 - RNA, 32 nt, Human
aaccucccgucuguaaccugcaccugcaguuc

SEQ ID NO: 287843 - RNA, 24 nt, Human
aaccucccguugcgucaagucuaa

SEQ ID NO: 287844 - RNA, 32 nt, Human
aaccucccuaguagcugggauuacaggugcac

SEQ ID NO: 287845 - RNA, 32 nt, Human
aaccucccuuccgaccuccacccggaccccga

SEQ ID NO: 287846 - RNA, 32 nt, Human
aaccuccgccuccuggguucaagagauucucc

SEQ ID NO: 287847 - RNA, 32 nt, Human
aaccuccuacagccugaugcuuaacccuuucc

SEQ ID NO: 287848 - RNA, 32 nt, Human
aaccuccugaguagcugggacuacaggcaccu

SEQ ID NO: 287849 - RNA, 32 nt, Human
aaccuccugaguagcugggacugcaggcacgc

SEQ ID NO: 287850 - RNA, 32 nt, Human
aaccuccugaguagcugggauuacaggagugu

SEQ ID NO: 287851 - RNA, 32 nt, Human
aaccuccugcccuaggccuggagcacaacaug

SEQ ID NO: 287852 - RNA, 32 nt, Human
aaccuccugccuaggauuuguacagcauuugg

SEQ ID NO: 287853 - RNA, 32 nt, Human
aaccuccugccugggcccucugcuucucacag

SEQ ID NO: 287854 - RNA, 18 nt, Human
aaccuccuuagagaugaa

SEQ ID NO: 287855 - RNA, 32 nt, Human
aaccuccuuaguagcugggauuacaggcaugu

SEQ ID NO: 287856 - RNA, 32 nt, Human
aaccuccuuccacagccgcaucuucucaugac

SEQ ID NO: 287857 - RNA, 32 nt, Human
aaccuccuuccucugguuuugaaaagcaguuc

SEQ ID NO: 287858 - RNA, 32 nt, Human
aaccuccuuggggcugaggccagcacagcgca

SEQ ID NO: 287859 - RNA, 32 nt, Human
aaccuccuugucccucuccagucaccucccuc

SEQ ID NO: 287860 - RNA, 24 nt, Human
aaccuccuuguuuuagacacacua

SEQ ID NO: 287861 - RNA, 32 nt, Human
aaccucgacuucucagccuccugggguuccgc

SEQ ID NO: 287862 - RNA, 32 nt, Human
aaccucgaugccucugagccucgggaccgcuc

SEQ ID NO: 287863 - RNA, 32 nt, Human
aaccucgcaaguagcuugggacuacaggcgug

SEQ ID NO: 287864 - RNA, 32 nt, Human
aaccucgccucccugguucaagcaauucuccu

SEQ ID NO: 287865 - RNA, 32 nt, Human
aaccucgccuggcuaguuuuuguauuuuuagc

SEQ ID NO: 287866 - RNA, 32 nt, Human
aaccucggaggcggagguugcagugagccaag

SEQ ID NO: 287867 - RNA, 32 nt, Human
aaccucggaggcugaaguugcagugagccaag

SEQ ID NO: 287868 - RNA, 32 nt, Human
aaccucggcucacugcaaccuccgccucccag

SEQ ID NO: 287869 - RNA, 32 nt, Human
aaccucggggugggggugggcagugagugcag

SEQ ID NO: 287870 - RNA, 32 nt, Human
aaccucgucaucauccccacuuuaaaccccag

SEQ ID NO: 287871 - RNA, 31 nt, Human
aaccucguccacucggaaaccaaagcagaac

SEQ ID NO: 287872 - RNA, 32 nt, Human
aaccucgucuggaguugaagagaggaugcucc

SEQ ID NO: 287873 - RNA, 22 nt, Human
aaccucgugauccacccaccuc

SEQ ID NO: 287874 - RNA, 32 nt, Human
aaccucuaccagcacauuaaaagugauuguuu

SEQ ID NO: 287875 - RNA, 32 nt, Human
aaccucuacuaaaaauacaaaaauuagccagg

SEQ ID NO: 287876 - RNA, 32 nt, Human
aaccucuagaauagcugggacugcaggugcau

SEQ ID NO: 287877 - RNA, 32 nt, Human
aaccucuagaguagcugggauuacaggcgcau

SEQ ID NO: 287878 - RNA, 32 nt, Human
aaccucucaccaucugaagagcauuaaaagca

SEQ ID NO: 287879 - RNA, 32 nt, Human
aaccucucagagugcugggauuauaggugugc

SEQ ID NO: 287880 - RNA, 32 nt, Human
aaccucucagucuaccuccucuuuucugccuc

SEQ ID NO: 287881 - RNA, 32 nt, Human
aaccucuccacauacauuuguauuaagcucau

SEQ ID NO: 287882 - RNA, 31 nt, Human
aaccucuccagcuagaugucccacaggcaac

SEQ ID NO: 287883 - RNA, 32 nt, Human
aaccucuccaggcaaguggcccccgcggcggc

SEQ ID NO: 287884 - RNA, 32 nt, Human
aaccucucccucuucuuccucuaauugugacc

SEQ ID NO: 287885 - RNA, 22 nt, Human
aaccucuccucaugucuccuca

SEQ ID NO: 287886 - RNA, 32 nt, Human
aaccucuccugugccucuaccuagcucccauc

SEQ ID NO: 287887 - RNA, 32 nt, Human
aaccucucucccacucagcuaugcuagggcuu

SEQ ID NO: 287888 - RNA, 32 nt, Human
aaccucucuccucagccuuccaccuccaagag

SEQ ID NO: 287889 - RNA, 32 nt, Human
aaccucucuccucucucuuuucugugucaguu

SEQ ID NO: 287890 - RNA, 32 nt, Human
aaccucucucucuuccucugucucucccucuc

SEQ ID NO: 287891 - RNA, 32 nt, Human
aaccucucugcucucugcuggccuacagcuug

SEQ ID NO: 287892 - RNA, 32 nt, Human
aaccucugccucccggguucaaguguucuacu

SEQ ID NO: 287893 - RNA, 32 nt, Human
aaccucugccuccggguucaagcaauucuccu

SEQ ID NO: 287894 - RNA, 32 nt, Human
aaccucugccuccugggcucaagccuuccucc

SEQ ID NO: 287895 - RNA, 32 nt, Human
aaccucugccuccuggguucaagaaauucucc

SEQ ID NO: 287896 - RNA, 32 nt, Human
aaccucugccuccugguucaagcgauuauugu

SEQ ID NO: 287897 - RNA, 32 nt, Human
aaccucugcugccagcccuuccucacuuuugg

SEQ ID NO: 287898 - RNA, 32 nt, Human
aaccucuggggaccccaaccucagaggcagcu

SEQ ID NO: 287899 - RNA, 32 nt, Human
aaccucugguauacuguuauguucuggagaaa

SEQ ID NO: 287900 - RNA, 32 nt, Human
aaccucuggugccguccaaggacucugacccc

SEQ ID NO: 287901 - RNA, 32 nt, Human
aaccucuguaugaagagaagauuucucccagg

SEQ ID NO: 287902 - RNA, 24 nt, Human
aaccucuuacggagcuucuccuca

SEQ ID NO: 287903 - RNA, 32 nt, Human
aaccucuuccccacaagccagauuguuucuga

SEQ ID NO: 287904 - RNA, 32 nt, Human
aaccucuuccuccugguucaagcgauucucau

SEQ ID NO: 287905 - RNA, 32 nt, Human
aaccucuucuguccucaaagaggccaaacgca

SEQ ID NO: 287906 - RNA, 32 nt, Human
aaccucuucuugcccuuaagggucuuuuaccu

SEQ ID NO: 287907 - RNA, 32 nt, Human
aaccucuugauaagcucucugccuccuccucc

SEQ ID NO: 287908 - RNA, 32 nt, Human
aaccucuuggugcuucaguuuccucaucugug

SEQ ID NO: 287909 - RNA, 32 nt, Human
aaccucuuuaaugccugaaaucauaagaauaa

SEQ ID NO: 287910 - RNA, 32 nt, Human
aaccucuuugagcaguuccaggaaguugccaa

SEQ ID NO: 287911 - RNA, 32 nt, Human
aaccucuuuuccaccaauaccaugaagcucug

SEQ ID NO: 287912 - RNA, 32 nt, Human
aaccugaacuucugugugguggcaguacugug

SEQ ID NO: 287913 - RNA, 32 nt, Human
aaccugaagaugagggagaagaugaugacuaa

SEQ ID NO: 287914 - RNA, 32 nt, Human
aaccugaaggccauccucuuucugcugugugu

SEQ ID NO: 287915 - RNA, 32 nt, Human
aaccugaauccaucccccuccugaccugugac

SEQ ID NO: 287916 - RNA, 31 nt, Human
aaccugaauggaacaaccuguugagagagca

SEQ ID NO: 287917 - RNA, 32 nt, Human
aaccugaauuuugcucuccucuucuaugcauu

SEQ ID NO: 287918 - RNA, 31 nt, Human
aaccugacucuuuucugaaacauucagagca

SEQ ID NO: 287919 - RNA, 22 nt, Human
aaccugacuuccuaccaacuca

SEQ ID NO: 287920 - RNA, 32 nt, Human
aaccugagaaaagccuuagaccugcagggaau

SEQ ID NO: 287921 - RNA, 32 nt, Human
aaccugagaaguggagguuguggugagcugag

SEQ ID NO: 287922 - RNA, 32 nt, Human
aaccugagagacggagguugcagggagccgag

SEQ ID NO: 287923 - RNA, 32 nt, Human
aaccugagagauggagguugaugugagcugag

SEQ ID NO: 287924 - RNA, 32 nt, Human
aaccugagaggauggcuucagauggagcaucu

SEQ ID NO: 287925 - RNA, 23 nt, Human
aaccugagaggcagagguuacag

SEQ ID NO: 287926 - RNA, 32 nt, Human
aaccugagaggcagagguuacagugagccaag

SEQ ID NO: 287927 - RNA, 32 nt, Human
aaccugagaggcagagguuacagugagcugag

SEQ ID NO: 287928 - RNA, 32 nt, Human
aaccugagaggcagagguugcagugagccaag

SEQ ID NO: 287929 - RNA, 32 nt, Human
aaccugagaggcagagguugcagugagccgag

SEQ ID NO: 287930 - RNA, 26 nt, Human
aaccugagaggcggagguugcaguga

SEQ ID NO: 287931 - RNA, 32 nt, Human
aaccugagaggcggagguugcagugagccaaa

SEQ ID NO: 287932 - RNA, 32 nt, Human
aaccugagaggcggagguugcagugagccaag

SEQ ID NO: 287933 - RNA, 32 nt, Human
aaccugagaggcggagguugcagugagccgag

SEQ ID NO: 287934 - RNA, 32 nt, Human
aaccugagaggugagguugcagugagccgaga

SEQ ID NO: 287935 - RNA, 23 nt, Human
aaccugagagguggagguuacag

SEQ ID NO: 287936 - RNA, 32 nt, Human
aaccugagagguggagguuacagugaguugag

SEQ ID NO: 287937 - RNA, 23 nt, Human
aaccugagagguggagguugcag

SEQ ID NO: 287938 - RNA, 26 nt, Human
aaccugagagguggagguugcaguga

SEQ ID NO: 287939 - RNA, 32 nt, Human
aaccugagagguggagguugcagugagccgag

SEQ ID NO: 287940 - RNA, 32 nt, Human
aaccugagagguggagguugcaguugagccaa

SEQ ID NO: 287941 - RNA, 32 nt, Human
aaccugagagguggagguuucagugagccgag

SEQ ID NO: 287942 - RNA, 32 nt, Human
aaccugagccuccugugugguauuagaaagua

SEQ ID NO: 287943 - RNA, 32 nt, Human
aaccugagcugcuggaaccucuucccuaugaa

SEQ ID NO: 287944 - RNA, 32 nt, Human
aaccugagcuuccaagaagucagguugccaaa

SEQ ID NO: 287945 - RNA, 32 nt, Human
aaccugaggcacugugcucggaaguuagaccc

SEQ ID NO: 287946 - RNA, 32 nt, Human
aaccugagggagacaacggcagagggagugag

SEQ ID NO: 287947 - RNA, 32 nt, Human
aaccugagggagcauuugcugagggaauaguc

SEQ ID NO: 287948 - RNA, 32 nt, Human
aaccugagucuagccaugaggggcuuaugcuc

SEQ ID NO: 287949 - RNA, 32 nt, Human
aaccugagugcgcugggcuuggggaagucgga

SEQ ID NO: 287950 - RNA, 32 nt, Human
aaccugagugucucccagccugccucgguucu

SEQ ID NO: 287951 - RNA, 32 nt, Human
aaccugaguuugaagugacaacgugcugugga

SEQ ID NO: 287952 - RNA, 32 nt, Human
aaccugauaaaauaauucaggccaggcgaggu

SEQ ID NO: 287953 - RNA, 32 nt, Human
aaccugaucaucaauccucuaauucaucccga

SEQ ID NO: 287954 - RNA, 32 nt, Human
aaccugauccccaacagcuuuugagguuguuu

SEQ ID NO: 287955 - RNA, 32 nt, Human
aaccugaucucacucucaacaggcgauggugc

SEQ ID NO: 287956 - RNA, 32 nt, Human
aaccugaucucucaucagagcuggcagcaacu

SEQ ID NO: 287957 - RNA, 31 nt, Human
aaccugaugaccacagcagaaacccccugca

SEQ ID NO: 287958 - RNA, 32 nt, Human
aaccugauuuagaagaacagaaaacaaaacua

SEQ ID NO: 287959 - RNA, 32 nt, Human
aaccugcaaagcaacaggggcggagcugccca

SEQ ID NO: 287960 - RNA, 32 nt, Human
aaccugcaaccguuuccgccuccugcuagagc

SEQ ID NO: 287961 - RNA, 32 nt, Human
aaccugcaccuugcacuuuuggguucuggccu

SEQ ID NO: 287962 - RNA, 32 nt, Human
aaccugcacuucugccaaggccagggccagca

SEQ ID NO: 287963 - RNA, 32 nt, Human
aaccugcagaagaaagcuagaaaaucagaaga

SEQ ID NO: 287964 - RNA, 32 nt, Human
aaccugcagcuuuaucggagugauggcaaugc

SEQ ID NO: 287965 - RNA, 32 nt, Human
aaccugcaggcagaaccugaaagggcauuuug

SEQ ID NO: 287966 - RNA, 32 nt, Human
aaccugcaugaucuguuucuacuauggauugg

SEQ ID NO: 287967 - RNA, 32 nt, Human
aaccugccaacaccuacugacacucacucauc

SEQ ID NO: 287968 - RNA, 32 nt, Human
aaccugccaggcaugguggcacaugccuguga

SEQ ID NO: 287969 - RNA, 32 nt, Human
aaccugcccacagcaaccccacagagccacau

SEQ ID NO: 287970 - RNA, 32 nt, Human
aaccugcccagccggugcccggccacugcgca

SEQ ID NO: 287971 - RNA, 32 nt, Human
aaccugcccccaggcuuccuccagcaaaaggc

SEQ ID NO: 287972 - RNA, 32 nt, Human
aaccugcccugccucaguaaaaauacaguguu

SEQ ID NO: 287973 - RNA, 32 nt, Human
aaccugccucauucggccugaccgguagaggc

SEQ ID NO: 287974 - RNA, 32 nt, Human
aaccugccucccacuacugagcacuuaccgaa

SEQ ID NO: 287975 - RNA, 31 nt, Human
aaccugccucuugcugggccuuuguuccuug

SEQ ID NO: 287976 - RNA, 32 nt, Human
aaccugccuuuauugcccuccugccacacugc

SEQ ID NO: 287977 - RNA, 32 nt, Human
aaccugcgaggcagagauugcagugagccaag

SEQ ID NO: 287978 - RNA, 32 nt, Human
aaccugcucacccuguggcucuucuccaacaa

SEQ ID NO: 287979 - RNA, 32 nt, Human
aaccugcucacuguucuaucuccaaaugagac

SEQ ID NO: 287980 - RNA, 32 nt, Human
aaccugcucugcugaguccccugggccauccc

SEQ ID NO: 287981 - RNA, 32 nt, Human
aaccugcugcagcucucuuuuacuacagacuu

SEQ ID NO: 287982 - RNA, 32 nt, Human
aaccugcuguuuucagggugggugauguaaau

SEQ ID NO: 287983 - RNA, 32 nt, Human
aaccugcuuagaaccaggugugaacugguggc

SEQ ID NO: 287984 - RNA, 32 nt, Human
aaccugcuuccucucccuuccaaagacaguga

SEQ ID NO: 287985 - RNA, 32 nt, Human
aaccuggaaaucggcugggcauggaagcacau

SEQ ID NO: 287986 - RNA, 32 nt, Human
aaccuggaacgcggagguugcaaugagccgag

SEQ ID NO: 287987 - RNA, 32 nt, Human
aaccuggaacuggaguuggcaauaccuaguuc

SEQ ID NO: 287988 - RNA, 32 nt, Human
aaccuggaagcugguguucaccagagaggacu

SEQ ID NO: 287989 - RNA, 32 nt, Human
aaccuggaaggaagagguugcagugagccaag

SEQ ID NO: 287990 - RNA, 32 nt, Human
aaccuggaaggcagaaguugcagugagcugag

SEQ ID NO: 287991 - RNA, 32 nt, Human
aaccuggaaggcagagauugcagugagcugag

SEQ ID NO: 287992 - RNA, 32 nt, Human
aaccuggaaggcagggguugcagugaccugag

SEQ ID NO: 287993 - RNA, 32 nt, Human
aaccuggaaggcggagcuugcagugagcugag

SEQ ID NO: 287994 - RNA, 26 nt, Human
aaccuggaaggcggagguugcaguga

SEQ ID NO: 287995 - RNA, 32 nt, Human
aaccuggaaggcggagguugcagugagcagag

SEQ ID NO: 287996 - RNA, 32 nt, Human
aaccuggaaggcggagguugcagugagccaag

SEQ ID NO: 287997 - RNA, 32 nt, Human
aaccuggaaggcggagguugcagugagccgag

SEQ ID NO: 287998 - RNA, 32 nt, Human
aaccuggaagguggagcuugcagugagcugag

SEQ ID NO: 287999 - RNA, 32 nt, Human
aaccuggaauacagagguuucagugagcugag

SEQ ID NO: 288000 - RNA, 32 nt, Human
aaccuggacauugccaagacagcuuccucagg

SEQ ID NO: 288001 - RNA, 32 nt, Human
aaccuggacuaggccagcuggaaagaggacau

SEQ ID NO: 288002 - RNA, 32 nt, Human
aaccuggagacagagguugcagugagcugaga

SEQ ID NO: 288003 - RNA, 32 nt, Human
aaccuggaggcagagauugcagugagccgaga

SEQ ID NO: 288004 - RNA, 32 nt, Human
aaccuggaggcagagguugcagugagucgagg

SEQ ID NO: 288005 - RNA, 32 nt, Human
aaccuggaggcuaaacccccagcuuucuaugc

SEQ ID NO: 288006 - RNA, 25 nt, Human
aaccuggagguggagguugcaguga

SEQ ID NO: 288007 - RNA, 32 nt, Human
aaccuggagguggagguugcagugagccgagg

SEQ ID NO: 288008 - RNA, 32 nt, Human
aaccuggaguccauuuacucugaccucucuuu

SEQ ID NO: 288009 - RNA, 32 nt, Human
aaccuggauacagaguuuccacccucaguucc

SEQ ID NO: 288010 - RNA, 32 nt, Human
aaccuggaucccuuccuuacaccuuauacaaa

SEQ ID NO: 288011 - RNA, 32 nt, Human
aaccuggcaaguguagguugcagugagcugag

SEQ ID NO: 288012 - RNA, 32 nt, Human
aaccuggcaggcagagguugcagugagccaag

SEQ ID NO: 288013 - RNA, 32 nt, Human
aaccuggcaggcagaguuugcagugaaccaag

SEQ ID NO: 288014 - RNA, 26 nt, Human
aaccuggcaggcggagguugcaguga

SEQ ID NO: 288015 - RNA, 32 nt, Human
aaccuggcaggcggagguugcagugagccgag

SEQ ID NO: 288016 - RNA, 32 nt, Human
aaccuggcaggggcgguucaaguggccgggga

SEQ ID NO: 288017 - RNA, 32 nt, Human
aaccuggcagguggagguuacagugagccaag

SEQ ID NO: 288018 - RNA, 32 nt, Human
aaccuggcagguggagguugcagugaguggag

SEQ ID NO: 288019 - RNA, 32 nt, Human
aaccuggcaguuuuagugccucugguuuucuu

SEQ ID NO: 288020 - RNA, 32 nt, Human
aaccuggccugacagacaagcagaugaccuca

SEQ ID NO: 288021 - RNA, 32 nt, Human
aaccuggccuggagaccucaaagugguccaua

SEQ ID NO: 288022 - RNA, 32 nt, Human
aaccuggcuaaguuuagccaguaggacuguua

SEQ ID NO: 288023 - RNA, 32 nt, Human
aaccuggcucccggcaaccucaggugccuucc

SEQ ID NO: 288024 - RNA, 32 nt, Human
aaccuggcuguggcugcucagguuccccuccu

SEQ ID NO: 288025 - RNA, 32 nt, Human
aaccuggcuuuucccaucuccccagcauaacc

SEQ ID NO: 288026 - RNA, 32 nt, Human
aaccugggaagcagagguugcagugagccgag

SEQ ID NO: 288027 - RNA, 32 nt, Human
aaccugggaagcagaguuugcagugagccaag

SEQ ID NO: 288028 - RNA, 32 nt, Human
aaccugggaagccgaaguagcagugagccgag

SEQ ID NO: 288029 - RNA, 32 nt, Human
aaccugggaagcggagcucgcagugagccgag

SEQ ID NO: 288030 - RNA, 32 nt, Human
aaccugggaagugcagguugcagugagccaag

SEQ ID NO: 288031 - RNA, 32 nt, Human
aaccugggaaguggaagcugcagugagccgag

SEQ ID NO: 288032 - RNA, 32 nt, Human
aaccugggaaguggaggcugcagugagcccag

SEQ ID NO: 288033 - RNA, 32 nt, Human
aaccugggaaguggaggcugcagugagccgag

SEQ ID NO: 288034 - RNA, 32 nt, Human
aaccugggaccaagcaggggaaagcagcugca

SEQ ID NO: 288035 - RNA, 32 nt, Human
aaccugggacugaccguucccuggggauccga

SEQ ID NO: 288036 - RNA, 32 nt, Human
aaccugggagacagaaguuugcagugauccga

SEQ ID NO: 288037 - RNA, 32 nt, Human
aaccugggagacagagguugcaaugaaccgag

SEQ ID NO: 288038 - RNA, 32 nt, Human
aaccugggagacagagguugcagugagccaag

SEQ ID NO: 288039 - RNA, 32 nt, Human
aaccugggagacggagcuugcagugagcugag

SEQ ID NO: 288040 - RNA, 23 nt, Human
aaccugggagacggagguugcag

SEQ ID NO: 288041 - RNA, 32 nt, Human
aaccugggagacggagguugcagugagccaag

SEQ ID NO: 288042 - RNA, 32 nt, Human
aaccugggagacggagguugcagugagccaug

SEQ ID NO: 288043 - RNA, 32 nt, Human
aaccugggagauggaaguugcagugaaccaag

SEQ ID NO: 288044 - RNA, 32 nt, Human
aaccugggagauggagauugcagugagcagag

SEQ ID NO: 288045 - RNA, 32 nt, Human
aaccugggagauggagguugcagagagccaag

SEQ ID NO: 288046 - RNA, 32 nt, Human
aaccugggagauggagguugcagugagccgag

SEQ ID NO: 288047 - RNA, 32 nt, Human
aaccugggagcaggagguugcagugagccgag

SEQ ID NO: 288048 - RNA, 32 nt, Human
aaccugggagccggaggcugcagugagccaag

SEQ ID NO: 288049 - RNA, 32 nt, Human
aaccugggagccugagguugcagugagccaag

SEQ ID NO: 288050 - RNA, 32 nt, Human
aaccugggagcuggugaucaccagagaggacu

SEQ ID NO: 288051 - RNA, 32 nt, Human
aaccugggaggagaagguugcagugagcugag

SEQ ID NO: 288052 - RNA, 32 nt, Human
aaccugggaggaggagguugcagugagcugag

SEQ ID NO: 288053 - RNA, 32 nt, Human
aaccugggaggcaaagguugcagugagcugag

SEQ ID NO: 288054 - RNA, 32 nt, Human
aaccugggaggcaaagguugcggugaacugag

SEQ ID NO: 288055 - RNA, 32 nt, Human
aaccugggaggcaagaccaagcccagaaaacc

SEQ ID NO: 288056 - RNA, 32 nt, Human
aaccugggaggcaagaccaagcccagacaacc

SEQ ID NO: 288057 - RNA, 32 nt, Human
aaccugggaggcaagaccaagcccagauaacc

SEQ ID NO: 288058 - RNA, 32 nt, Human
aaccugggaggcagaaguugcagugaaacaag

SEQ ID NO: 288059 - RNA, 32 nt, Human
aaccugggaggcagaaguugcagugagccgag

SEQ ID NO: 288060 - RNA, 32 nt, Human
aaccugggaggcagaaguugcagugagcugag

SEQ ID NO: 288061 - RNA, 32 nt, Human
aaccugggaggcagaaguuguggugagccgag

SEQ ID NO: 288062 - RNA, 32 nt, Human
aaccugggaggcagagauugcagugagccaag

SEQ ID NO: 288063 - RNA, 32 nt, Human
aaccugggaggcagagauugcagugagccgag

SEQ ID NO: 288064 - RNA, 32 nt, Human
aaccugggaggcagagauugcagugagcugag

SEQ ID NO: 288065 - RNA, 32 nt, Human
aaccugggaggcagagcuugcaguaagccgag

SEQ ID NO: 288066 - RNA, 32 nt, Human
aaccugggaggcagagcuugcagugagccaag

SEQ ID NO: 288067 - RNA, 32 nt, Human
aaccugggaggcagagcuugcagugagccgag

SEQ ID NO: 288068 - RNA, 32 nt, Human
aaccugggaggcagagcuugcagugagccuag

SEQ ID NO: 288069 - RNA, 32 nt, Human
aaccugggaggcagagcuugcagugagcugag

SEQ ID NO: 288070 - RNA, 32 nt, Human
aaccugggaggcagagcuugcagugaguggag

SEQ ID NO: 288071 - RNA, 32 nt, Human
aaccugggaggcagagcuugcagugauuggag

SEQ ID NO: 288072 - RNA, 32 nt, Human
aaccugggaggcagagggugcaguaagcugag

SEQ ID NO: 288073 - RNA, 32 nt, Human
aaccugggaggcagaggugagcugagaucgcg

SEQ ID NO: 288074 - RNA, 32 nt, Human
aaccugggaggcagagguuacaaugagccgag

SEQ ID NO: 288075 - RNA, 32 nt, Human
aaccugggaggcagagguuacagugagccgag

SEQ ID NO: 288076 - RNA, 32 nt, Human
aaccugggaggcagagguugcaaugagccaag

SEQ ID NO: 288077 - RNA, 32 nt, Human
aaccugggaggcagagguugcaaugagcugag

SEQ ID NO: 288078 - RNA, 32 nt, Human
aaccugggaggcagagguugcagggaaccuag

SEQ ID NO: 288079 - RNA, 32 nt, Human
aaccugggaggcagagguugcaguaagccaag

SEQ ID NO: 288080 - RNA, 32 nt, Human
aaccugggaggcagagguugcaguaagcuaag

SEQ ID NO: 288081 - RNA, 32 nt, Human
aaccugggaggcagagguugcaguaagcugag

SEQ ID NO: 288082 - RNA, 32 nt, Human
aaccugggaggcagagguugcagugaacagag

SEQ ID NO: 288083 - RNA, 32 nt, Human
aaccugggaggcagagguugcagugaaccaag

SEQ ID NO: 288084 - RNA, 32 nt, Human
aaccugggaggcagagguugcagugaaccuag

SEQ ID NO: 288085 - RNA, 32 nt, Human
aaccugggaggcagagguugcagugaacugau

SEQ ID NO: 288086 - RNA, 32 nt, Human
aaccugggaggcagagguugcagugagccaag

SEQ ID NO: 288087 - RNA, 32 nt, Human
aaccugggaggcagagguugcagugagccaau

SEQ ID NO: 288088 - RNA, 32 nt, Human
aaccugggaggcagagguugcagugagccgag

SEQ ID NO: 288089 - RNA, 32 nt, Human
aaccugggaggcagagguugcagugagccgau

SEQ ID NO: 288090 - RNA, 32 nt, Human
aaccugggaggcagagguugcagugagcuaag

SEQ ID NO: 288091 - RNA, 32 nt, Human
aaccugggaggcagagguugcagugagcucag

SEQ ID NO: 288092 - RNA, 32 nt, Human
aaccugggaggcagagguugcagugagcugag

SEQ ID NO: 288093 - RNA, 32 nt, Human
aaccugggaggcagagguugcagugaggugac

SEQ ID NO: 288094 - RNA, 32 nt, Human
aaccugggaggcagagguugcagugauccaag

SEQ ID NO: 288095 - RNA, 32 nt, Human
aaccugggaggcagagguugcagugauccgag

SEQ ID NO: 288096 - RNA, 32 nt, Human
aaccugggaggcagagguugccgugagcugag

SEQ ID NO: 288097 - RNA, 32 nt, Human
aaccugggaggcagagguugcgguaagccgag

SEQ ID NO: 288098 - RNA, 32 nt, Human
aaccugggaggcagagguuguagcgagccaag

SEQ ID NO: 288099 - RNA, 32 nt, Human
aaccugggaggcagagguuguagugagcugag

SEQ ID NO: 288100 - RNA, 32 nt, Human
aaccugggaggcagagguuguggugagccaac

SEQ ID NO: 288101 - RNA, 32 nt, Human
aaccugggaggcagagguuguggugagcuaag

SEQ ID NO: 288102 - RNA, 32 nt, Human
aaccugggaggcagagguuguggugagcugag

SEQ ID NO: 288103 - RNA, 32 nt, Human
aaccugggaggcagagguuucagugagccaag

SEQ ID NO: 288104 - RNA, 32 nt, Human
aaccugggaggcagagucugcagugagccgag

SEQ ID NO: 288105 - RNA, 32 nt, Human
aaccugggaggcagaguuuacagugagccgag

SEQ ID NO: 288106 - RNA, 32 nt, Human
aaccugggaggcagaguuugcagugagccgag

SEQ ID NO: 288107 - RNA, 32 nt, Human
aaccugggaggcagaguuugcagugagcggag

SEQ ID NO: 288108 - RNA, 32 nt, Human
aaccugggaggcagauguugcagugagccgag

SEQ ID NO: 288109 - RNA, 32 nt, Human
aaccugggaggcagauguuguggugagccgag

SEQ ID NO: 288110 - RNA, 32 nt, Human
aaccugggaggcagcgguugcaguaagccaag

SEQ ID NO: 288111 - RNA, 32 nt, Human
aaccugggaggcagggguugcagugagcugag

SEQ ID NO: 288112 - RNA, 32 nt, Human
aaccugggaggcaguuugcagugagcugagau

SEQ ID NO: 288113 - RNA, 32 nt, Human
aaccugggaggccaagguugcagugagccgag

SEQ ID NO: 288114 - RNA, 23 nt, Human
aaccugggaggcgaagauugcag

SEQ ID NO: 288115 - RNA, 32 nt, Human
aaccugggaggcgaagauugcagugagcugaa

SEQ ID NO: 288116 - RNA, 32 nt, Human
aaccugggaggcgaagguugcagugagccaag

SEQ ID NO: 288117 - RNA, 32 nt, Human
aaccugggaggcgaagguugcagugagcugag

SEQ ID NO: 288118 - RNA, 32 nt, Human
aaccugggaggcgcagguugcagggaggcgga

SEQ ID NO: 288119 - RNA, 32 nt, Human
aaccugggaggcggaaguugcagugagccaag

SEQ ID NO: 288120 - RNA, 32 nt, Human
aaccugggaggcggaaguugcagugagccgag

SEQ ID NO: 288121 - RNA, 32 nt, Human
aaccugggaggcggaaguugcagugagcugag

SEQ ID NO: 288122 - RNA, 32 nt, Human
aaccugggaggcggagaguacagugagccaag

SEQ ID NO: 288123 - RNA, 32 nt, Human
aaccugggaggcggagauugcagugaaccaag

SEQ ID NO: 288124 - RNA, 32 nt, Human
aaccugggaggcggagcuuacagugaaccgag

SEQ ID NO: 288125 - RNA, 32 nt, Human
aaccugggaggcggagcuugcaaugaacugag

SEQ ID NO: 288126 - RNA, 32 nt, Human
aaccugggaggcggagcuugcaguaagccgag

SEQ ID NO: 288127 - RNA, 32 nt, Human
aaccugggaggcggagcuugcagugagccaag

SEQ ID NO: 288128 - RNA, 32 nt, Human
aaccugggaggcggagcuugcagugagcccag

SEQ ID NO: 288129 - RNA, 32 nt, Human
aaccugggaggcggagcuugcagugagccgag

SEQ ID NO: 288130 - RNA, 32 nt, Human
aaccugggaggcggagcuugcagugagcugag

SEQ ID NO: 288131 - RNA, 32 nt, Human
aaccugggaggcggaggagguugcagugaacu

SEQ ID NO: 288132 - RNA, 32 nt, Human
aaccugggaggcggaggcugcagugagccgag

SEQ ID NO: 288133 - RNA, 32 nt, Human
aaccugggaggcggaggcugcagugagcuggg

SEQ ID NO: 288134 - RNA, 32 nt, Human
aaccugggaggcggagguuccagagagccaag

SEQ ID NO: 288135 - RNA, 32 nt, Human
aaccugggaggcggagguugcaaugagccgag

SEQ ID NO: 288136 - RNA, 32 nt, Human
aaccugggaggcggagguugcagggagcugag

SEQ ID NO: 288137 - RNA, 32 nt, Human
aaccugggaggcggagguugcaguaagcccag

SEQ ID NO: 288138 - RNA, 32 nt, Human
aaccugggaggcggagguugcagucagccaag

SEQ ID NO: 288139 - RNA, 26 nt, Human
aaccugggaggcggagguugcaguga

SEQ ID NO: 288140 - RNA, 32 nt, Human
aaccugggaggcggagguugcagugaaccaag

SEQ ID NO: 288141 - RNA, 32 nt, Human
aaccugggaggcggagguugcagugagccaaa

SEQ ID NO: 288142 - RNA, 32 nt, Human
aaccugggaggcggagguugcagugagccaag

SEQ ID NO: 288143 - RNA, 32 nt, Human
aaccugggaggcggagguugcagugagccacu

SEQ ID NO: 288144 - RNA, 32 nt, Human
aaccugggaggcggagguugcagugagccgag

SEQ ID NO: 288145 - RNA, 32 nt, Human
aaccugggaggcggagguugcagugagccgcg

SEQ ID NO: 288146 - RNA, 32 nt, Human
aaccugggaggcggagguugcagugagcgaga

SEQ ID NO: 288147 - RNA, 32 nt, Human
aaccugggaggcggagguugcagugagcggag

SEQ ID NO: 288148 - RNA, 32 nt, Human
aaccugggaggcggagguugcagugagcuaag

SEQ ID NO: 288149 - RNA, 32 nt, Human
aaccugggaggcggagguugcagugagcugaa

SEQ ID NO: 288150 - RNA, 32 nt, Human
aaccugggaggcggagguugcagugagcugag

SEQ ID NO: 288151 - RNA, 32 nt, Human
aaccugggaggcggagguugcagugagcuuag

SEQ ID NO: 288152 - RNA, 32 nt, Human
aaccugggaggcggagguugcagugagucgag

SEQ ID NO: 288153 - RNA, 32 nt, Human
aaccugggaggcggagguugcagugaguugag

SEQ ID NO: 288154 - RNA, 32 nt, Human
aaccugggaggcggagguugcaguggccgaga

SEQ ID NO: 288155 - RNA, 32 nt, Human
aaccugggaggcggagguugccgugagccgag

SEQ ID NO: 288156 - RNA, 32 nt, Human
aaccugggaggcggagguugcggucagcugag

SEQ ID NO: 288157 - RNA, 26 nt, Human
aaccugggaggcggagguugcgguga

SEQ ID NO: 288158 - RNA, 32 nt, Human
aaccugggaggcggagguugcggugagcugag

SEQ ID NO: 288159 - RNA, 32 nt, Human
aaccugggaggcggagguugcugugagcugag

SEQ ID NO: 288160 - RNA, 26 nt, Human
aaccugggaggcggagguuguaguga

SEQ ID NO: 288161 - RNA, 32 nt, Human
aaccugggaggcggagguuguagugagccaag

SEQ ID NO: 288162 - RNA, 32 nt, Human
aaccugggaggcggagguuguagugagccgag

SEQ ID NO: 288163 - RNA, 32 nt, Human
aaccugggaggcggagguugugaugagccaag

SEQ ID NO: 288164 - RNA, 26 nt, Human
aaccugggaggcggagguugugguga

SEQ ID NO: 288165 - RNA, 32 nt, Human
aaccugggaggcggagguuguggugagccaag

SEQ ID NO: 288166 - RNA, 32 nt, Human
aaccugggaggcggagguuguggugagccgag

SEQ ID NO: 288167 - RNA, 32 nt, Human
aaccugggaggcggauguugaagugagcugag

SEQ ID NO: 288168 - RNA, 32 nt, Human
aaccugggaggcggggguuguggugagccgug

SEQ ID NO: 288169 - RNA, 32 nt, Human
aaccugggaggcugaaguugcagugagccgag

SEQ ID NO: 288170 - RNA, 32 nt, Human
aaccugggaggcugagcuugcagugagcugag

SEQ ID NO: 288171 - RNA, 32 nt, Human
aaccugggagggcggagguugcagugagccag

SEQ ID NO: 288172 - RNA, 32 nt, Human
aaccugggagggggagguugccgugagcugag

SEQ ID NO: 288173 - RNA, 32 nt, Human
aaccugggagguacagguugcagugagcccag

SEQ ID NO: 288174 - RNA, 32 nt, Human
aaccugggagguagaaguugcagugagccaaa

SEQ ID NO: 288175 - RNA, 32 nt, Human
aaccugggagguagagguugcacugagccgag

SEQ ID NO: 288176 - RNA, 32 nt, Human
aaccugggagguagagguugcagugagccaau

SEQ ID NO: 288177 - RNA, 32 nt, Human
aaccugggagguagagguugcagugagccgag

SEQ ID NO: 288178 - RNA, 32 nt, Human
aaccugggaggucaaagcggcagugagcuaaa

SEQ ID NO: 288179 - RNA, 32 nt, Human
aaccugggaggucaagauugcagugagcuaug

SEQ ID NO: 288180 - RNA, 32 nt, Human
aaccugggagguggaagcugcagugagccaag

SEQ ID NO: 288181 - RNA, 32 nt, Human
aaccugggagguggaaguugcagugagccaag

SEQ ID NO: 288182 - RNA, 32 nt, Human
aaccugggagguggaaguugcagugagccgag

SEQ ID NO: 288183 - RNA, 32 nt, Human
aaccugggagguggaaguugcagugagcugag

SEQ ID NO: 288184 - RNA, 32 nt, Human
aaccugggagguggagacugcagugagccgag

SEQ ID NO: 288185 - RNA, 32 nt, Human
aaccugggagguggagauugcagugagcccag

SEQ ID NO: 288186 - RNA, 32 nt, Human
aaccugggagguggagauugcagugagucaag

SEQ ID NO: 288187 - RNA, 32 nt, Human
aaccugggagguggagcuugcagugaaccgag

SEQ ID NO: 288188 - RNA, 32 nt, Human
aaccugggagguggagcuugcagugagccgag

SEQ ID NO: 288189 - RNA, 32 nt, Human
aaccugggagguggagcuugcagugagcggac

SEQ ID NO: 288190 - RNA, 32 nt, Human
aaccugggagguggagcuugcagugagcugag

SEQ ID NO: 288191 - RNA, 32 nt, Human
  misc_feature (23)..(23): n is a, c, g or u
aaccugggagguggagcuugcanugagccaag

SEQ ID NO: 288192 - RNA, 32 nt, Human
aaccugggagguggaggcagugagcugagauc

SEQ ID NO: 288193 - RNA, 32 nt, Human
aaccugggagguggaggcuacagugagcugag

SEQ ID NO: 288194 - RNA, 32 nt, Human
aaccugggagguggaggcugcagugaaccgag

SEQ ID NO: 288195 - RNA, 32 nt, Human
aaccugggagguggagguuacagugagccgag

SEQ ID NO: 288196 - RNA, 32 nt, Human
aaccugggagguggagguuauagugagccuag

SEQ ID NO: 288197 - RNA, 32 nt, Human
aaccugggagguggagguugaggugagcucag

SEQ ID NO: 288198 - RNA, 32 nt, Human
aaccugggagguggagguugcagcgagccaag

SEQ ID NO: 288199 - RNA, 32 nt, Human
aaccugggagguggagguugcaguaagccaag

SEQ ID NO: 288200 - RNA, 32 nt, Human
aaccugggagguggagguugcaguaagcugag

SEQ ID NO: 288201 - RNA, 26 nt, Human
aaccugggagguggagguugcaguga

SEQ ID NO: 288202 - RNA, 32 nt, Human
aaccugggagguggagguugcagugacccgag

SEQ ID NO: 288203 - RNA, 32 nt, Human
aaccugggagguggagguugcagugagcagag

SEQ ID NO: 288204 - RNA, 32 nt, Human
aaccugggagguggagguugcagugagccaag

SEQ ID NO: 288205 - RNA, 32 nt, Human
aaccugggagguggagguugcagugagccgag

SEQ ID NO: 288206 - RNA, 32 nt, Human
aaccugggagguggagguugcagugagcugag

SEQ ID NO: 288207 - RNA, 32 nt, Human
aaccugggagguggagguugcagugagcugug

SEQ ID NO: 288208 - RNA, 32 nt, Human
aaccugggagguggagguugcagugagucgag

SEQ ID NO: 288209 - RNA, 32 nt, Human
aaccugggagguggagguugcagugaguugag

SEQ ID NO: 288210 - RNA, 26 nt, Human
aaccugggagguggagguugcagugg

SEQ ID NO: 288211 - RNA, 32 nt, Human
aaccugggagguggagguugcagugggccaag

SEQ ID NO: 288212 - RNA, 32 nt, Human
aaccugggagguggagguugcagugggcuaag

SEQ ID NO: 288213 - RNA, 32 nt, Human
aaccugggagguggagguugcagugggcugag

SEQ ID NO: 288214 - RNA, 32 nt, Human
aaccugggagguggagguugcauugagccaag

SEQ ID NO: 288215 - RNA, 32 nt, Human
aaccugggagguggagguugcauugagcugag

SEQ ID NO: 288216 - RNA, 32 nt, Human
aaccugggagguggagguugcgagaucacacc

SEQ ID NO: 288217 - RNA, 26 nt, Human
aaccugggagguggagguugcgguga

SEQ ID NO: 288218 - RNA, 32 nt, Human
aaccugggagguggagguugcggugagccaag

SEQ ID NO: 288219 - RNA, 32 nt, Human
aaccugggagguggagguugcggugagccgag

SEQ ID NO: 288220 - RNA, 32 nt, Human
aaccugggagguggagguugcggugagcugag

SEQ ID NO: 288221 - RNA, 32 nt, Human
aaccugggagguggagguugcugugagcugac

SEQ ID NO: 288222 - RNA, 32 nt, Human
aaccugggagguggagguugcugugagcugag

SEQ ID NO: 288223 - RNA, 26 nt, Human
aaccugggagguggagguugugguga

SEQ ID NO: 288224 - RNA, 32 nt, Human
aaccugggagguggagguuguggugagccaau

SEQ ID NO: 288225 - RNA, 32 nt, Human
aaccugggagguggagguuguggugaggcgag

SEQ ID NO: 288226 - RNA, 32 nt, Human
aaccugggagguggagguuucagugagccaag

SEQ ID NO: 288227 - RNA, 32 nt, Human
aaccugggagguggaguugcagugagccgaga

SEQ ID NO: 288228 - RNA, 32 nt, Human
aaccugggagguggauguugcagugagcugag

SEQ ID NO: 288229 - RNA, 32 nt, Human
aaccugggagguggugguugcagugagcugag

SEQ ID NO: 288230 - RNA, 32 nt, Human
aaccugggagguugaggcugcagugagcugug

SEQ ID NO: 288231 - RNA, 32 nt, Human
aaccugggaguuagagguugcagugagcugag

SEQ ID NO: 288232 - RNA, 32 nt, Human
aaccugggaguuggagguugcagugaaacgag

SEQ ID NO: 288233 - RNA, 32 nt, Human
aaccugggaguuugaagcugcagugagccaug

SEQ ID NO: 288234 - RNA, 23 nt, Human
aaccugggauguggagguugcag

SEQ ID NO: 288235 - RNA, 32 nt, Human
aaccugggauguggagguugcagugaacugag

SEQ ID NO: 288236 - RNA, 32 nt, Human
aaccugggauguggagguugcagugagccaag

SEQ ID NO: 288237 - RNA, 32 nt, Human
aaccugggcagcagagcaagacucugucucaa

SEQ ID NO: 288238 - RNA, 32 nt, Human
aaccugggcaggcgagaguaguacuggagggc

SEQ ID NO: 288239 - RNA, 32 nt, Human
aaccugggcggcagagguugcagugagucaag

SEQ ID NO: 288240 - RNA, 32 nt, Human
aaccugggggaggaugcaggaggcugaaggga

SEQ ID NO: 288241 - RNA, 32 nt, Human
aaccugggggauggucagagcccagucgagac

SEQ ID NO: 288242 - RNA, 32 nt, Human
aaccugggggccugaggugccaggguucacag

SEQ ID NO: 288243 - RNA, 32 nt, Human
aaccugggggcgauggaauccgggagcggugg

SEQ ID NO: 288244 - RNA, 32 nt, Human
aaccuggguagguggguaggggccacaguugc

SEQ ID NO: 288245 - RNA, 32 nt, Human
aaccugggucagcaucccuagguugagaaggg

SEQ ID NO: 288246 - RNA, 32 nt, Human
aaccuggguccccaggccauaaggugggcaca

SEQ ID NO: 288247 - RNA, 32 nt, Human
aaccugggugacagagugagacuccaucucaa

SEQ ID NO: 288248 - RNA, 32 nt, Human
aaccugggugauagagcaagucucugucuuua

SEQ ID NO: 288249 - RNA, 32 nt, Human
aaccuggguggucgaggcugcagugagccgag

SEQ ID NO: 288250 - RNA, 32 nt, Human
aaccugguaggcagagguugcagugagccgag

SEQ ID NO: 288251 - RNA, 32 nt, Human
aaccugguaggcagagguuguagugagccgag

SEQ ID NO: 288252 - RNA, 32 nt, Human
aaccugguagguggagguuucauugagccacg

SEQ ID NO: 288253 - RNA, 22 nt, Human
aaccugguaugggagccaggag

SEQ ID NO: 288254 - RNA, 32 nt, Human
aaccuggucccacugggaacagacucagaguu

SEQ ID NO: 288255 - RNA, 32 nt, Human
aaccuggugcccagguggaggugcaguggggg

SEQ ID NO: 288256 - RNA, 32 nt, Human
aaccugguggugcccucugccuguagggaaca

SEQ ID NO: 288257 - RNA, 32 nt, Human
aaccugguggugcuggccagggaggaugcugg

SEQ ID NO: 288258 - RNA, 32 nt, Human
aaccugguuuauacaacaucugccuucuccaa

SEQ ID NO: 288259 - RNA, 32 nt, Human
aaccuguaaggcggagguugcagugagccgag

SEQ ID NO: 288260 - RNA, 32 nt, Human
aaccuguagaaaacaagugcuuuuuaucuuga

SEQ ID NO: 288261 - RNA, 32 nt, Human
aaccuguagacagaggccaccagcucaaaacc

SEQ ID NO: 288262 - RNA, 32 nt, Human
aaccuguauagcauguuacuauccugaaguca

SEQ ID NO: 288263 - RNA, 32 nt, Human
aaccugucaaugauacagucccuaaagaaaaa

SEQ ID NO: 288264 - RNA, 32 nt, Human
aaccuguccucccuuucuccccaacuaugcau

SEQ ID NO: 288265 - RNA, 32 nt, Human
aaccuguccugucugacacgucucacagccuu

SEQ ID NO: 288266 - RNA, 32 nt, Human
aaccugucuaacuggaugcucauugccugggc

SEQ ID NO: 288267 - RNA, 32 nt, Human
aaccugucuccaccccuguauuucaagaucau

SEQ ID NO: 288268 - RNA, 32 nt, Human
aaccugucugccucuguggauccacagccugg

SEQ ID NO: 288269 - RNA, 32 nt, Human
aaccugucuggcaagggacaggaagcugauag

SEQ ID NO: 288270 - RNA, 32 nt, Human
aaccugugacccuuuucuacuggaauagaaau

SEQ ID NO: 288271 - RNA, 32 nt, Human
aaccugugaggaagagguugcagugagcugag

SEQ ID NO: 288272 - RNA, 32 nt, Human
aaccugugaggcagagguugcagugagccaag

SEQ ID NO: 288273 - RNA, 32 nt, Human
aaccugugaggcggagcuugcagggagucgag

SEQ ID NO: 288274 - RNA, 32 nt, Human
aaccugugagguggagcuugcagugagccaag

SEQ ID NO: 288275 - RNA, 32 nt, Human
aaccugugcugcagguuggaguggcaggaacg

SEQ ID NO: 288276 - RNA, 32 nt, Human
aaccugugggcaagucuuuacccuucaguagu

SEQ ID NO: 288277 - RNA, 31 nt, Human
aaccugugggugggguugggguggagaagua

SEQ ID NO: 288278 - RNA, 32 nt, Human
aaccugugugccagacauuugugcauuguugc

SEQ ID NO: 288279 - RNA, 32 nt, Human
aaccuguuauaauugccagcugucuacacaaa

SEQ ID NO: 288280 - RNA, 20 nt, Human
aaccuguuauauacucagug

SEQ ID NO: 288281 - RNA, 32 nt, Human
aaccuguucaaaacaaagaaggcauagaauau

SEQ ID NO: 288282 - RNA, 32 nt, Human
aaccuguucucagcucugccuccccuggccag

SEQ ID NO: 288283 - RNA, 32 nt, Human
aaccuguucucuuucccuucuugucuuuaaaa

SEQ ID NO: 288284 - RNA, 32 nt, Human
aaccuguugggccaaugagaaaagaaccacac

SEQ ID NO: 288285 - RNA, 32 nt, Human
aaccuguuuaaaucacacacccgcacagaacu

SEQ ID NO: 288286 - RNA, 32 nt, Human
aaccuguuuaacugcuuagugugaacucuagu

SEQ ID NO: 288287 - RNA, 32 nt, Human
aaccuguuugacuugauagaugccauugcccu

SEQ ID NO: 288288 - RNA, 32 nt, Human
aaccuuaaaguucuguugguaucacagaagac

SEQ ID NO: 288289 - RNA, 32 nt, Human
aaccuuaauggccugaggugggcagaggggug

SEQ ID NO: 288290 - RNA, 32 nt, Human
aaccuuaaugugacaccugagaccuuuagaca

SEQ ID NO: 288291 - RNA, 32 nt, Human
aaccuuacaaaugcaaugaaugugguaaagcc

SEQ ID NO: 288292 - RNA, 32 nt, Human
aaccuuacaaguguaaugaaugcagcaggacc

SEQ ID NO: 288293 - RNA, 32 nt, Human
aaccuuagccccaaacauaagauagcuauguc

SEQ ID NO: 288294 - RNA, 32 nt, Human
aaccuuaggccuggcccuggucuccgagcgcg

SEQ ID NO: 288295 - RNA, 32 nt, Human
aaccuuagguucuauguaucagcugugucuua

SEQ ID NO: 288296 - RNA, 32 nt, Human
aaccuuagugagguggacaggaggggaccucg

SEQ ID NO: 288297 - RNA, 32 nt, Human
aaccuuaucuaagguuuuccaggauuuaaaca

SEQ ID NO: 288298 - RNA, 32 nt, Human
aaccuuaugaauguaaugaaugugggaaguca

SEQ ID NO: 288299 - RNA, 32 nt, Human
aaccuucaaaaacaaguggaggaaaggcauca

SEQ ID NO: 288300 - RNA, 32 nt, Human
aaccuucaaacuggcgaugucaaggguuccaa

SEQ ID NO: 288301 - RNA, 31 nt, Human
aaccuucacagcuggagggauagaccauggc

SEQ ID NO: 288302 - RNA, 32 nt, Human
aaccuucacagcuggagggauagaccauggcc

SEQ ID NO: 288303 - RNA, 32 nt, Human
aaccuucacaugcggauccacacuggagaaaa

SEQ ID NO: 288304 - RNA, 32 nt, Human
aaccuucaccuccagguucaagugauucuccu

SEQ ID NO: 288305 - RNA, 32 nt, Human
aaccuucacugcauccuugccccauucagccc

SEQ ID NO: 288306 - RNA, 32 nt, Human
aaccuucagagggugaaaggggaaguuuucuu

SEQ ID NO: 288307 - RNA, 32 nt, Human
aaccuucagaguguaucaaagaauucagacag

SEQ ID NO: 288308 - RNA, 32 nt, Human
aaccuucagaucucaugagaccggcucacuau

SEQ ID NO: 288309 - RNA, 32 nt, Human
aaccuucagccaaguucugccugcuguguauc

SEQ ID NO: 288310 - RNA, 32 nt, Human
aaccuucagccugucuggcugcuggaccugga

SEQ ID NO: 288311 - RNA, 32 nt, Human
aaccuucagguccagcccuggagcuggaggag

SEQ ID NO: 288312 - RNA, 32 nt, Human
aaccuucagugacucaccuuuaccucaggaac

SEQ ID NO: 288313 - RNA, 32 nt, Human
aaccuucauccagcauccacuuccaggggaca

SEQ ID NO: 288314 - RNA, 32 nt, Human
aaccuucauuugggccuuccuuccucaugucu

SEQ ID NO: 288315 - RNA, 32 nt, Human
aaccuuccaaugcuucuguugaucucaguauu

SEQ ID NO: 288316 - RNA, 32 nt, Human
aaccuuccacugagaagccacuucaagaggcu

SEQ ID NO: 288317 - RNA, 32 nt, Human
aaccuucccaaaaugccccuugcucagaagaa

SEQ ID NO: 288318 - RNA, 32 nt, Human
aaccuucccacacucccugcuccaggagggaa

SEQ ID NO: 288319 - RNA, 32 nt, Human
aaccuuccgaauagcugggacuacaggcgcac

SEQ ID NO: 288320 - RNA, 32 nt, Human
aaccuuccucauaugaauaaccauuuauaugu

SEQ ID NO: 288321 - RNA, 32 nt, Human
aaccuuccuucuuccucauuguggacuuggau

SEQ ID NO: 288322 - RNA, 32 nt, Human
aaccuucgaccuuggacuucucagccuccaga

SEQ ID NO: 288323 - RNA, 32 nt, Human
aaccuucgccucuggguucaagugauucuccu

SEQ ID NO: 288324 - RNA, 32 nt, Human
aaccuucggaguagcugggaucacagcugcag

SEQ ID NO: 288325 - RNA, 32 nt, Human
aaccuucgucuuuuuaaaugugucauuucaca

SEQ ID NO: 288326 - RNA, 32 nt, Human
aaccuucucccagguaggggcaggaggagcca

SEQ ID NO: 288327 - RNA, 32 nt, Human
aaccuucugcaaagauggugugguguacgugg

SEQ ID NO: 288328 - RNA, 32 nt, Human
aaccuucuggaaggcugcuggcaguuuuuccu

SEQ ID NO: 288329 - RNA, 32 nt, Human
aaccuugaaucacuugagcauguaauaacuaa

SEQ ID NO: 288330 - RNA, 32 nt, Human
aaccuugacaccuguaaggacaggaucugccc

SEQ ID NO: 288331 - RNA, 32 nt, Human
aaccuugagauaggcugggugcgguggcucac

SEQ ID NO: 288332 - RNA, 31 nt, Human
aaccuugauucucucccuugaaaaacaggga

SEQ ID NO: 288333 - RNA, 32 nt, Human
aaccuugcagguuguaacaacagcugcacucu

SEQ ID NO: 288334 - RNA, 31 nt, Human
aaccuugccacaccugcaccuguguccuccc

SEQ ID NO: 288335 - RNA, 32 nt, Human
aaccuugccugguacaguaugggggcuguaaa

SEQ ID NO: 288336 - RNA, 32 nt, Human
aaccuugccugguacaguauggggguuguaaa

SEQ ID NO: 288337 - RNA, 32 nt, Human
aaccuugcucuccucaucuccaaggcagggac

SEQ ID NO: 288338 - RNA, 32 nt, Human
aaccuugcuuccuagcuuauuuauuucccaaa

SEQ ID NO: 288339 - RNA, 32 nt, Human
aaccuugcuuugccuuggcuucaaacuaguuc

SEQ ID NO: 288340 - RNA, 32 nt, Human
aaccuuggaggcagagguugcagugagcugag

SEQ ID NO: 288341 - RNA, 26 nt, Human
aaccuuggaggcggagguugcauuga

SEQ ID NO: 288342 - RNA, 32 nt, Human
aaccuuggaggcggagguugcauugagcugag

SEQ ID NO: 288343 - RNA, 26 nt, Human
aaccuuggagguggagguugugguga

SEQ ID NO: 288344 - RNA, 32 nt, Human
aaccuuggagguggagguuguggugagccaug

SEQ ID NO: 288345 - RNA, 32 nt, Human
aaccuuggagugaauucgucggcgggugccaa

SEQ ID NO: 288346 - RNA, 32 nt, Human
aaccuuggagugagagcccagggacagguccc

SEQ ID NO: 288347 - RNA, 32 nt, Human
aaccuuggcauuuucaccagacaugcagauuu

SEQ ID NO: 288348 - RNA, 32 nt, Human
aaccuugggcugggucuauguacguucuuccg

SEQ ID NO: 288349 - RNA, 32 nt, Human
aaccuuggggagaccuggaggaacagugcagu

SEQ ID NO: 288350 - RNA, 32 nt, Human
aaccuugguggcacagugagaaccugacucuu

SEQ ID NO: 288351 - RNA, 25 nt, Human
aaccuugguuucuccauccuuguga

SEQ ID NO: 288352 - RNA, 32 nt, Human
aaccuuguaaauccaaaccccauaaaagagag

SEQ ID NO: 288353 - RNA, 32 nt, Human
aaccuuguaugcgggcaggcccagggagcagg

SEQ ID NO: 288354 - RNA, 32 nt, Human
aaccuugucuccuccagcaccacagggaagac

SEQ ID NO: 288355 - RNA, 32 nt, Human
aaccuugugccuuggaaaugcaaacucaccgc

SEQ ID NO: 288356 - RNA, 32 nt, Human
aaccuuguggauggcuucuaggaacagagcug

SEQ ID NO: 288357 - RNA, 32 nt, Human
aaccuuguggcagaaggcaagagcggcaagau

SEQ ID NO: 288358 - RNA, 32 nt, Human
aaccuuguuauuucucagacuuuggaaaaugc

SEQ ID NO: 288359 - RNA, 32 nt, Human
aaccuuuagggaggauaguggagaagccgcag

SEQ ID NO: 288360 - RNA, 28 nt, Human
aaccuuucaagugcuacguccauuugug

SEQ ID NO: 288361 - RNA, 32 nt, Human
aaccuuucaccuuuguguauuuuucaauaaua

SEQ ID NO: 288362 - RNA, 32 nt, Human
aaccuuucagccugugagccucugcacaaagc

SEQ ID NO: 288363 - RNA, 32 nt, Human
aaccuuucauuuccuacuucauuccagcagga

SEQ ID NO: 288364 - RNA, 32 nt, Human
aaccuuuccaauaaucccuuaaucagaucaca

SEQ ID NO: 288365 - RNA, 32 nt, Human
aaccuuuccagguucucuuagagccauaugcc

SEQ ID NO: 288366 - RNA, 32 nt, Human
aaccuuucucauauuuucucaugaccauugcc

SEQ ID NO: 288367 - RNA, 32 nt, Human
aaccuuucuuugucuuucuuauggggguuacc

SEQ ID NO: 288368 - RNA, 32 nt, Human
aaccuuucuuuuucucuacuuuaauuuuucua

SEQ ID NO: 288369 - RNA, 32 nt, Human
aaccuuugaggaaaggaggaaggaagaaaugc

SEQ ID NO: 288370 - RNA, 32 nt, Human
aaccuuugcucugaaauuccauuuuucccucu

SEQ ID NO: 288371 - RNA, 32 nt, Human
aaccuuuggugccuuuucucucuucuuuaccu

SEQ ID NO: 288372 - RNA, 32 nt, Human
aaccuuuggugugccaagaggagguggguaga

SEQ ID NO: 288373 - RNA, 32 nt, Human
aaccuuuucacucacgucagaagagguugggg

SEQ ID NO: 288374 - RNA, 32 nt, Human
aaccuuuuggagccuuagucucccagacugaa

SEQ ID NO: 288375 - RNA, 32 nt, Human
aaccuuuuuaucuguucucuccaccuucaguu

SEQ ID NO: 288376 - RNA, 32 nt, Human
aaccuuuuucuuccuuucccucuuuucuaugu

SEQ ID NO: 288377 - RNA, 32 nt, Human
aacgaaaauugaaccugucugccugugcugug

SEQ ID NO: 288378 - RNA, 32 nt, Human
aacgaaacaaaggagcauucguucucuguugu

SEQ ID NO: 288379 - RNA, 32 nt, Human
aacgaaaccaacagcaguccaagcucagucag

SEQ ID NO: 288380 - RNA, 32 nt, Human
aacgaaagugcuucucaucaaugauauguaag

SEQ ID NO: 288381 - RNA, 31 nt, Human
aacgaaaugggaagaagauggguggagcuau

SEQ ID NO: 288382 - RNA, 32 nt, Human
aacgaaauuuccauucccaaaauaacugagaa

SEQ ID NO: 288383 - RNA, 32 nt, Human
aacgaacacucgccuggccugggaaacugcau

SEQ ID NO: 288384 - RNA, 32 nt, Human
aacgaacccaacaaugaagauacaguucuguc

SEQ ID NO: 288385 - RNA, 32 nt, Human
aacgaagaauaaagucuguguugcaguccugu

SEQ ID NO: 288386 - RNA, 32 nt, Human
aacgaagacuaaccucaccagccagucaucua

SEQ ID NO: 288387 - RNA, 32 nt, Human
aacgaagcagcucccuucccaccccaacugca

SEQ ID NO: 288388 - RNA, 32 nt, Human
aacgaagccagccuggaccauacacugccugg

SEQ ID NO: 288389 - RNA, 32 nt, Human
aacgaagcuacagaagaauggaagaagacagc

SEQ ID NO: 288390 - RNA, 32 nt, Human
aacgaagcugucuuagagugggaccaacuucc

SEQ ID NO: 288391 - RNA, 32 nt, Human
aacgaaggggaugagaagagaggcagagcugg

SEQ ID NO: 288392 - RNA, 32 nt, Human
aacgaaguaagcacccaucccucccagcucac

SEQ ID NO: 288393 - RNA, 32 nt, Human
aacgaauaugcccaugcugcuaccacauccuc

SEQ ID NO: 288394 - RNA, 32 nt, Human
aacgaauccauagcugacaaauucacucagug

SEQ ID NO: 288395 - RNA, 32 nt, Human
aacgaauguguauugaccaucuccucuugcca

SEQ ID NO: 288396 - RNA, 32 nt, Human
aacgaauuguauuuucucucuccuggacaacu

SEQ ID NO: 288397 - RNA, 32 nt, Human
aacgacaaagggaugaauuccuuacuuuaauc

SEQ ID NO: 288398 - RNA, 32 nt, Human
aacgacacaccagcuccugggaucagacuuuc

SEQ ID NO: 288399 - RNA, 32 nt, Human
aacgacacgagagcuaaugcugcaugcccguu

SEQ ID NO: 288400 - RNA, 32 nt, Human
aacgacagccguugugccccaggcucuccaug

SEQ ID NO: 288401 - RNA, 32 nt, Human
aacgacaggcgaggccgcggccccagaguccc

SEQ ID NO: 288402 - RNA, 21 nt, Human
aacgaccccacaggucaggug

SEQ ID NO: 288403 - RNA, 32 nt, Human
aacgacccuggccuugaacgucagagccgggg

SEQ ID NO: 288404 - RNA, 32 nt, Human
aacgaccucuuugaauacaaguuugcaacugg

SEQ ID NO: 288405 - RNA, 32 nt, Human
aacgacggaggaaggggcggagagggaccucu

SEQ ID NO: 288406 - RNA, 32 nt, Human
aacgacucagguaagccauuccuggauaccug

SEQ ID NO: 288407 - RNA, 32 nt, Human
aacgacugcacuccagccuggaugacagaaca

SEQ ID NO: 288408 - RNA, 32 nt, Human
aacgacugggaaaguuugggaaagucagcaaa

SEQ ID NO: 288409 - RNA, 32 nt, Human
aacgacuguguggaguccagacaggaagccac

SEQ ID NO: 288410 - RNA, 32 nt, Human
aacgacuuccacugcugaagccuguaggcucu

SEQ ID NO: 288411 - RNA, 32 nt, Human
aacgagaaaccaggucuucucagcuccuguca

SEQ ID NO: 288412 - RNA, 32 nt, Human
aacgagacacauugccuucuggagcuaggaga

SEQ ID NO: 288413 - RNA, 32 nt, Human
aacgagagcaagaaaaagaugauguagauguu

SEQ ID NO: 288414 - RNA, 32 nt, Human
aacgagagcacacauuaaagagagaguaaauu

SEQ ID NO: 288415 - RNA, 32 nt, Human
aacgagagccagcaagcugagcacagaccagc

SEQ ID NO: 288416 - RNA, 32 nt, Human
aacgagaggaacgccuuagaaaagaauuugag

SEQ ID NO: 288417 - RNA, 32 nt, Human
aacgagaggggugggagauccacaggaccaaa

SEQ ID NO: 288418 - RNA, 32 nt, Human
aacgagaucuccacaaauaaaaggacaagugu

SEQ ID NO: 288419 - RNA, 32 nt, Human
aacgagcaaucaaguucuccacuguguacaga

SEQ ID NO: 288420 - RNA, 31 nt, Human
aacgagcacagcuaagaacagagugagagag

SEQ ID NO: 288421 - RNA, 32 nt, Human
aacgagcagccugcccuguguccccucauacu

SEQ ID NO: 288422 - RNA, 32 nt, Human
aacgagcccucgggggccgaagcccaugcccg

SEQ ID NO: 288423 - RNA, 32 nt, Human
aacgagcccuggcagugcgcaccucuggugcc

SEQ ID NO: 288424 - RNA, 32 nt, Human
aacgagcucccagguguuucguagaugcauua

SEQ ID NO: 288425 - RNA, 32 nt, Human
aacgagcugaagcuuuacaggcugccaggagc

SEQ ID NO: 288426 - RNA, 32 nt, Human
aacgagcuuugcccugaucagcauuuuguaug

SEQ ID NO: 288427 - RNA, 32 nt, Human
aacgagcuuugcucggggcucuugauuggagc

SEQ ID NO: 288428 - RNA, 32 nt, Human
aacgaggacuccaagccaugaauugcccugcu

SEQ ID NO: 288429 - RNA, 32 nt, Human
aacgaggcauuccaaguuugacagcauggaac

SEQ ID NO: 288430 - RNA, 32 nt, Human
aacgagggccugcuggcugagauauggggcug

SEQ ID NO: 288431 - RNA, 32 nt, Human
aacgaggggacuguuucucuuccacuccuauc

SEQ ID NO: 288432 - RNA, 32 nt, Human
aacgaguccucccucugggagugcagccuugg

SEQ ID NO: 288433 - RNA, 32 nt, Human
aacgagucgaccaggaaagaacagugaguucu

SEQ ID NO: 288434 - RNA, 32 nt, Human
aacgauaggacgcucagcaucucaggugggcc

SEQ ID NO: 288435 - RNA, 32 nt, Human
aacgauaguucugcagucugcgccuuuccacg

SEQ ID NO: 288436 - RNA, 29 nt, Human
aacgauaguuuguggaugccuggagcuac

SEQ ID NO: 288437 - RNA, 32 nt, Human
aacgaucagguuggagacuugggaaacccagg

SEQ ID NO: 288438 - RNA, 32 nt, Human
aacgaucccucuccuauacuugaugaaacuug

SEQ ID NO: 288439 - RNA, 32 nt, Human
aacgaucuaaagguaggcagacccuggaccca

SEQ ID NO: 288440 - RNA, 32 nt, Human
aacgaucuuuuaagggucccuuuugcugcauu

SEQ ID NO: 288441 - RNA, 32 nt, Human
aacgauggagucucgcucugucacccaggcug

SEQ ID NO: 288442 - RNA, 29 nt, Human
aacgauggguggaagagagcaacgccaga

SEQ ID NO: 288443 - RNA, 32 nt, Human
aacgauugcaggagaaauaaugaggauguaau

SEQ ID NO: 288444 - RNA, 32 nt, Human
aacgcaagcagcagagaacaggaaaaggaaau

SEQ ID NO: 288445 - RNA, 32 nt, Human
aacgcacacacugaagguggcucauguuugcu

SEQ ID NO: 288446 - RNA, 32 nt, Human
aacgcacacgugugggacagauagaugaauau

SEQ ID NO: 288447 - RNA, 32 nt, Human
aacgcacagcccaucugcuguauuacugccga

SEQ ID NO: 288448 - RNA, 32 nt, Human
aacgcacccccaccuucucuccucgcuucuuc

SEQ ID NO: 288449 - RNA, 32 nt, Human
aacgcaccugcuccuggucagacaggaggggc

SEQ ID NO: 288450 - RNA, 32 nt, Human
aacgcaccuggccucugcuccaccucaacagc

SEQ ID NO: 288451 - RNA, 32 nt, Human
aacgcacugcagccucuaccuccugggcucaa

SEQ ID NO: 288452 - RNA, 24 nt, Human
aacgcagacucccagaggaggcag

SEQ ID NO: 288453 - RNA, 32 nt, Human
aacgcagcacuagcaagcagguucaggacagc

SEQ ID NO: 288454 - RNA, 32 nt, Human
aacgcagcccgcugccccuuugcucgcuuccc

SEQ ID NO: 288455 - RNA, 32 nt, Human
aacgcagcccugcuuugggcugcccuggugcu

SEQ ID NO: 288456 - RNA, 32 nt, Human
aacgcagccucccggcucagccugggaagaug

SEQ ID NO: 288457 - RNA, 32 nt, Human
aacgcagcgccagcagcaucucaucuacccuc

SEQ ID NO: 288458 - RNA, 32 nt, Human
aacgcaggaggcugaggcugcagugaguugug

SEQ ID NO: 288459 - RNA, 32 nt, Human
aacgcaggaucccaugagguuggggcagggca

SEQ ID NO: 288460 - RNA, 24 nt, Human
aacgcagggaacagagucuuaaag

SEQ ID NO: 288461 - RNA, 32 nt, Human
aacgcagggcuggagaguauuuggugccagau

SEQ ID NO: 288462 - RNA, 32 nt, Human
aacgcaugcccuuuuggaucuacuguuucuac

SEQ ID NO: 288463 - RNA, 32 nt, Human
aacgcauggggcgagcuucagugucgccagca

SEQ ID NO: 288464 - RNA, 32 nt, Human
aacgccacgccuggcccggucagugcugcaug

SEQ ID NO: 288465 - RNA, 32 nt, Human
aacgccacugcacuccaguguaggcaacagag

SEQ ID NO: 288466 - RNA, 32 nt, Human
aacgccacuuucucagaccuguccccuuugug

SEQ ID NO: 288467 - RNA, 32 nt, Human
aacgccagagggagggagggaggcaagaaggg

SEQ ID NO: 288468 - RNA, 32 nt, Human
aacgccagccuggagugagggagcaggaucug

SEQ ID NO: 288469 - RNA, 32 nt, Human
aacgccagcgccgccucucgcucgccgagcuc

SEQ ID NO: 288470 - RNA, 29 nt, Human
aacgccaggcugcuauuuaucucccuauc

SEQ ID NO: 288471 - RNA, 32 nt, Human
aacgccaguuuucucaagcucucauuuaacgu

SEQ ID NO: 288472 - RNA, 32 nt, Human
aacgccauccaggcugggaggggaagagugcu

SEQ ID NO: 288473 - RNA, 32 nt, Human
aacgccauugccugguuacuuguuuuaugcug

SEQ ID NO: 288474 - RNA, 32 nt, Human
aacgcccaagcccagcccuaggaggggguggg

SEQ ID NO: 288475 - RNA, 24 nt, Human
aacgcccacauuuccaccaacuca

SEQ ID NO: 288476 - RNA, 32 nt, Human
aacgcccaucugcucacccaugcccacccagc

SEQ ID NO: 288477 - RNA, 25 nt, Human
aacgccccuccccccaccaagcuca

SEQ ID NO: 288478 - RNA, 32 nt, Human
aacgcccuccacccucagcucccugcacaauu

SEQ ID NO: 288479 - RNA, 32 nt, Human
aacgccgggggcugcggagugcaucagcgcgg

SEQ ID NO: 288480 - RNA, 32 nt, Human
aacgccgggugaggcgggauggaggaguuuac

SEQ ID NO: 288481 - RNA, 32 nt, Human
aacgccgugcagcugcccaucgaccagcccaa

SEQ ID NO: 288482 - RNA, 32 nt, Human
aacgccuccuggacuccagcgccuggaggagg

SEQ ID NO: 288483 - RNA, 32 nt, Human
aacgccucuccucaaugcugggcccucuuauc

SEQ ID NO: 288484 - RNA, 32 nt, Human
aacgccucugcagcugcagcccucguucucuu

SEQ ID NO: 288485 - RNA, 23 nt, Human
aacgccugaccucaaguaaucca

SEQ ID NO: 288486 - RNA, 32 nt, Human
aacgccugggagaagagggcuggaguucuagg

SEQ ID NO: 288487 - RNA, 32 nt, Human
aacgcgagaggaagcgaugcagagggguggaa

SEQ ID NO: 288488 - RNA, 32 nt, Human
aacgcgaugagugcccuuacacaaaagccugg

SEQ ID NO: 288489 - RNA, 32 nt, Human
aacgcgcagugaccugggaugcagcccucagg

SEQ ID NO: 288490 - RNA, 32 nt, Human
aacgcgccccaucccuuccgccgccuccuuuc

SEQ ID NO: 288491 - RNA, 32 nt, Human
aacgcgcugcugcugcugcucuaucggccgcc

SEQ ID NO: 288492 - RNA, 32 nt, Human
aacgcggaaccacccuccuuccugaggcaaau

SEQ ID NO: 288493 - RNA, 32 nt, Human
aacgcggcagcggggcugggccugugcggcgg

SEQ ID NO: 288494 - RNA, 32 nt, Human
aacgcggccgcuuuguucuucgcuucucggcu

SEQ ID NO: 288495 - RNA, 32 nt, Human
aacgcggcuggcugcaccccuuccuaccaccc

SEQ ID NO: 288496 - RNA, 32 nt, Human
aacgcgggaggcagagacugcagugagccgag

SEQ ID NO: 288497 - RNA, 32 nt, Human
aacgcgggagguggaggauacaaugaacccga

SEQ ID NO: 288498 - RNA, 32 nt, Human
aacgcgggaucgaacucuugcugcaggguuuc

SEQ ID NO: 288499 - RNA, 32 nt, Human
aacgcggguuccugccggagcagcccucccaa

SEQ ID NO: 288500 - RNA, 32 nt, Human
aacgcgucuuccugaguggugccaaacaaaaa

SEQ ID NO: 288501 - RNA, 32 nt, Human
aacgcgugaugaagacagaaggcuccggggug

SEQ ID NO: 288502 - RNA, 32 nt, Human
aacgcuaacuuuuguacagaucgauuugauaa

SEQ ID NO: 288503 - RNA, 32 nt, Human
aacgcuaguauuaagugcacuggccuuuaguc

SEQ ID NO: 288504 - RNA, 32 nt, Human
aacgcuaucaaacccaaaggcucuuuucagag

SEQ ID NO: 288505 - RNA, 32 nt, Human
aacgcucauggacaccugcacacuccacagaa

SEQ ID NO: 288506 - RNA, 32 nt, Human
aacgcucauucuacccccaacccuugucucca

SEQ ID NO: 288507 - RNA, 32 nt, Human
aacgcuccucuucuccccuccuccuccugccg

SEQ ID NO: 288508 - RNA, 32 nt, Human
aacgcucuuagcuuucucagggggucagcaga

SEQ ID NO: 288509 - RNA, 32 nt, Human
aacgcugagaugggaaggucacuugagcccag

SEQ ID NO: 288510 - RNA, 32 nt, Human
aacgcugagcucugggagccacugccugaggg

SEQ ID NO: 288511 - RNA, 32 nt, Human
aacgcugcagagcccagggagccuggcgcuag

SEQ ID NO: 288512 - RNA, 32 nt, Human
aacgcugcagugagcuaugauugcaccacugc

SEQ ID NO: 288513 - RNA, 32 nt, Human
aacgcugccugcacuacaacagaggcaagaag

SEQ ID NO: 288514 - RNA, 32 nt, Human
aacgcugccugccucugccgcuccuccacauc

SEQ ID NO: 288515 - RNA, 32 nt, Human
aacgcuggaaaggccgagaaccucuuuuaugc

SEQ ID NO: 288516 - RNA, 32 nt, Human
aacgcuggagccagacaacuccagaaaucucu

SEQ ID NO: 288517 - RNA, 32 nt, Human
aacgcuggagccagagagguagaggcugcagu

SEQ ID NO: 288518 - RNA, 32 nt, Human
aacgcuggaucgcagugcgcccagggaaggcc

SEQ ID NO: 288519 - RNA, 32 nt, Human
aacgcugggauuacagucaugagccaccgugc

SEQ ID NO: 288520 - RNA, 32 nt, Human
aacgcugggauuccggggaaguggaggcagag

SEQ ID NO: 288521 - RNA, 32 nt, Human
aacgcugggcaacauggugaaaccccgucucu

SEQ ID NO: 288522 - RNA, 32 nt, Human
aacgcuguagccaggcaggaccagccucuucu

SEQ ID NO: 288523 - RNA, 32 nt, Human
aacgcuucauuuccuuggggcugcaguuuugu

SEQ ID NO: 288524 - RNA, 32 nt, Human
aacgcuugaaccugggaggcugagcuugcagu

SEQ ID NO: 288525 - RNA, 32 nt, Human
aacgcuuuucaaaucaaaagcgccugacgcuu

SEQ ID NO: 288526 - RNA, 32 nt, Human
aacggaaaagccucuuaggcuguugucagugg

SEQ ID NO: 288527 - RNA, 32 nt, Human
aacggaagccauuauccaauggcuccacagcc

SEQ ID NO: 288528 - RNA, 32 nt, Human
aacggaauggaagugacucugccccuuauugg

SEQ ID NO: 288529 - RNA, 32 nt, Human
aacggaauugcaaacaugguacccacaacuuu

SEQ ID NO: 288530 - RNA, 32 nt, Human
aacggacacaccuugcuccuuucugagcccgu

SEQ ID NO: 288531 - RNA, 32 nt, Human
aacggacacccaccccagaugcaugggccaga

SEQ ID NO: 288532 - RNA, 32 nt, Human
aacggacagaggcgaguggcaaacuucagacg

SEQ ID NO: 288533 - RNA, 32 nt, Human
aacggacugcuuccggccagaggucccgggcg

SEQ ID NO: 288534 - RNA, 32 nt, Human
aacggagacgcuggucaggacguucccaccuc

SEQ ID NO: 288535 - RNA, 32 nt, Human
aacggagcggcggggcaggagcuguucugggc

SEQ ID NO: 288536 - RNA, 32 nt, Human
aacggagcugggacugagcagauuaagggagu

SEQ ID NO: 288537 - RNA, 32 nt, Human
aacggaggaggaggaggguuugcuugagguug

SEQ ID NO: 288538 - RNA, 32 nt, Human
aacggaggcccagggaggcugugcagcgcgcc

SEQ ID NO: 288539 - RNA, 32 nt, Human
aacggaggcuaagaaaggagaauaaacuuguc

SEQ ID NO: 288540 - RNA, 32 nt, Human
aacggauaccugcugcuagaccugauggaaug

SEQ ID NO: 288541 - RNA, 32 nt, Human
aacggaucauaacaaagaggagaucaaauuua

SEQ ID NO: 288542 - RNA, 32 nt, Human
aacggaucuggguggcgaggugggaaagcuca

SEQ ID NO: 288543 - RNA, 32 nt, Human
aacggaugaagaagcugggaaaguggcacauu

SEQ ID NO: 288544 - RNA, 32 nt, Human
aacggaugccugugauucccugguauuuauag

SEQ ID NO: 288545 - RNA, 32 nt, Human
aacggauguuguguggaguccuggcuggaggu

SEQ ID NO: 288546 - RNA, 32 nt, Human
aacggcaaaggcagccuuuuucuggccuugac

SEQ ID NO: 288547 - RNA, 19 nt, Human
aacggcaccugcaggacag

SEQ ID NO: 288548 - RNA, 32 nt, Human
aacggcagacacacuucuuaagaccucggcca

SEQ ID NO: 288549 - RNA, 32 nt, Human
aacggcagagagacugggguugcagacacaua

SEQ ID NO: 288550 - RNA, 32 nt, Human
aacggccacuguguguggcugcucugagugag

SEQ ID NO: 288551 - RNA, 32 nt, Human
aacggccagaaccaccaccgcgccgcgcucca

SEQ ID NO: 288552 - RNA, 32 nt, Human
aacggccaguucagcaagaaguguugagugug

SEQ ID NO: 288553 - RNA, 32 nt, Human
aacggccccaggagauaaguacuaacuuucuu

SEQ ID NO: 288554 - RNA, 32 nt, Human
aacggcccuccccugcaacauccgucuuggag

SEQ ID NO: 288555 - RNA, 32 nt, Human
aacggcccuggccucugcacugugauagcucc

SEQ ID NO: 288556 - RNA, 32 nt, Human
aacggccugcaucauucuuucugcuauauuag

SEQ ID NO: 288557 - RNA, 20 nt, Human
aacggcgacagcagccucuu

SEQ ID NO: 288558 - RNA, 32 nt, Human
aacggcggguggguggaggaugcggugcgcgg

SEQ ID NO: 288559 - RNA, 32 nt, Human
aacggcgucacuucucagacacugaagaacuc

SEQ ID NO: 288560 - RNA, 32 nt, Human
aacggcuaugcuucaaccagccuaagucuacu

SEQ ID NO: 288561 - RNA, 32 nt, Human
aacggcuccagggaucaccauggagaucacca

SEQ ID NO: 288562 - RNA, 32 nt, Human
aacggcuucacaccuuccccugcugcaugugg

SEQ ID NO: 288563 - RNA, 32 nt, Human
aacggcuucuacuccggcccccagugugacua

SEQ ID NO: 288564 - RNA, 32 nt, Human
aacgggaaagagaaagagacauucacuuggag

SEQ ID NO: 288565 - RNA, 32 nt, Human
aacgggaacagcccuggcugagggagcugcag

SEQ ID NO: 288566 - RNA, 32 nt, Human
aacgggagcuguagacggauguggcuucccag

SEQ ID NO: 288567 - RNA, 32 nt, Human
aacgggaggcggagguugcagugagccgaaau

SEQ ID NO: 288568 - RNA, 32 nt, Human
aacgggaggcucuuugcaaaccccagagacuc

SEQ ID NO: 288569 - RNA, 32 nt, Human
aacgggaugccaagcccugccugauguggcuc

SEQ ID NO: 288570 - RNA, 32 nt, Human
aacgggcccauaccacacagacugcucuccaa

SEQ ID NO: 288571 - RNA, 32 nt, Human
aacgggcuguuuugcuccagccacuuuucuug

SEQ ID NO: 288572 - RNA, 32 nt, Human
aacggggcaggcaaggucacugcucagucacg

SEQ ID NO: 288573 - RNA, 32 nt, Human
aacggggcaggcccuagguggggugggcugcc

SEQ ID NO: 288574 - RNA, 32 nt, Human
aacggggccauggagaagcugcggcgaguccu

SEQ ID NO: 288575 - RNA, 32 nt, Human
aacggggccucuuccaccuccuggugcagaaa

SEQ ID NO: 288576 - RNA, 32 nt, Human
aacggggcucuucucauuucaccccucccuuu

SEQ ID NO: 288577 - RNA, 32 nt, Human
aacggggcugccacugcgccuaagccuuuccc

SEQ ID NO: 288578 - RNA, 32 nt, Human
aacggggcuguggcaaaagaacugaguggacu

SEQ ID NO: 288579 - RNA, 32 nt, Human
aacgggggaagugagaggaaagaggcgggggc

SEQ ID NO: 288580 - RNA, 32 nt, Human
aacgggggauagagagaaggaguggcaggccu

SEQ ID NO: 288581 - RNA, 32 nt, Human
aacggggguggggagugagcaggaccccagac

SEQ ID NO: 288582 - RNA, 32 nt, Human
aacgggguccccggacuggagaagacgcgggu

SEQ ID NO: 288583 - RNA, 32 nt, Human
aacggguaggugagguguugggcaguuguggg

SEQ ID NO: 288584 - RNA, 32 nt, Human
aacgggugcauuuucauucauaugaaagacuu

SEQ ID NO: 288585 - RNA, 32 nt, Human
aacgggugcccaugggacaccagccugcgaga

SEQ ID NO: 288586 - RNA, 32 nt, Human
aacgggugugagccacggcgcccagcccagga

SEQ ID NO: 288587 - RNA, 32 nt, Human
aacgguaagaccugcaauggccagcgugggaa

SEQ ID NO: 288588 - RNA, 32 nt, Human
aacgguagagugcuuggcugggcgcaguggcu

SEQ ID NO: 288589 - RNA, 32 nt, Human
aacggucuguuuagggacuggugcaaaggaug

SEQ ID NO: 288590 - RNA, 32 nt, Human
aacggugcccccggaagagaaacaaagcagca

SEQ ID NO: 288591 - RNA, 32 nt, Human
aacggugccucccaggcauucucagugccagg

SEQ ID NO: 288592 - RNA, 32 nt, Human
aacggugcugucaccucugccugggccucacu

SEQ ID NO: 288593 - RNA, 32 nt, Human
aacgguggaggcagaggugacaguucccagag

SEQ ID NO: 288594 - RNA, 32 nt, Human
aacgguggcuccugccuguaaucgcagcacuu

SEQ ID NO: 288595 - RNA, 32 nt, Human
aacggugggaagucuguauaagcaaugccauc

SEQ ID NO: 288596 - RNA, 32 nt, Human
aacggugggacccagccuucucccggcgucuc

SEQ ID NO: 288597 - RNA, 32 nt, Human
aacggugggcagagagccuacuaggaaaugug

SEQ ID NO: 288598 - RNA, 29 nt, Human
aacgguucuuuucauccccuagaugugcu

SEQ ID NO: 288599 - RNA, 32 nt, Human
aacgguuucccucuccccuugccccgaccccc

SEQ ID NO: 288600 - RNA, 32 nt, Human
aacgguuuuuggaucuggcauugaaaugccuc

SEQ ID NO: 288601 - RNA, 32 nt, Human
aacguaaaaccaaaaacuauaaaaacccuaga

SEQ ID NO: 288602 - RNA, 32 nt, Human
aacguaaaagugggcacagauccagagaggua

SEQ ID NO: 288603 - RNA, 32 nt, Human
aacguacaaucagccaauuagaauuugccuga

SEQ ID NO: 288604 - RNA, 32 nt, Human
aacguaccaacacuuucugauuucuucuacag

SEQ ID NO: 288605 - RNA, 32 nt, Human
aacguacuuuguuggucagcacugggcugaca

SEQ ID NO: 288606 - RNA, 32 nt, Human
aacguaggccuaaucacagcacuuugggaggc

SEQ ID NO: 288607 - RNA, 32 nt, Human
aacguaucacccaaagcauguaugugaucuuu

SEQ ID NO: 288608 - RNA, 30 nt, Human
aacguaugaacacaucagguugcucagcaa

SEQ ID NO: 288609 - RNA, 32 nt, Human
aacgucagccugagaacugaguagcuguacug

SEQ ID NO: 288610 - RNA, 32 nt, Human
aacgucagguaagaggggaacagcugcuguac

SEQ ID NO: 288611 - RNA, 32 nt, Human
aacgucagugggccaccaugugccaugauggc

SEQ ID NO: 288612 - RNA, 32 nt, Human
aacgucaucggcuacagaaacagccuaaguuu

SEQ ID NO: 288613 - RNA, 32 nt, Human
aacgucaugugacagaucuaacagggcaagug

SEQ ID NO: 288614 - RNA, 32 nt, Human
aacguccaaugucuuucugacggauaccaucc

SEQ ID NO: 288615 - RNA, 32 nt, Human
aacguccaccaaccaggaaacaccugccucca

SEQ ID NO: 288616 - RNA, 32 nt, Human
aacguccagcuguauuuacuucuggcugugcc

SEQ ID NO: 288617 - RNA, 32 nt, Human
aacgucccagaggcggggccggagucggcggu

SEQ ID NO: 288618 - RNA, 32 nt, Human
aacgucccgcagucuucgccagccagccgucc

SEQ ID NO: 288619 - RNA, 32 nt, Human
aacgucccuguggagccagccagccagccacc

SEQ ID NO: 288620 - RNA, 32 nt, Human
aacguccugaggacaguucugugaacugaaug

SEQ ID NO: 288621 - RNA, 26 nt, Human
aacguccugcagcuucggggcaagug

SEQ ID NO: 288622 - RNA, 32 nt, Human
aacguccuugacuuuauaaaagccccgaauuc

SEQ ID NO: 288623 - RNA, 32 nt, Human
aacgucgaaucagcuauuuacugccaaaggga

SEQ ID NO: 288624 - RNA, 32 nt, Human
aacgucgagagggagccgcugccgcguuaguu

SEQ ID NO: 288625 - RNA, 32 nt, Human
aacgucgcacagguauacacaugugggaugag

SEQ ID NO: 288626 - RNA, 32 nt, Human
aacgucggagagaaggaauuggggagaaaggu

SEQ ID NO: 288627 - RNA, 32 nt, Human
aacgucgucccccagcugucggguccaguuca

SEQ ID NO: 288628 - RNA, 32 nt, Human
aacgucucagcccuucaguuuggucugcuccg

SEQ ID NO: 288629 - RNA, 32 nt, Human
aacgucuucccaccuuuuucuccccucuccgu

SEQ ID NO: 288630 - RNA, 32 nt, Human
aacgucuugcauucuagugaaaugagacccau

SEQ ID NO: 288631 - RNA, 32 nt, Human
aacgucuugccugugcaucuagaaagguaccu

SEQ ID NO: 288632 - RNA, 32 nt, Human
aacgucuugggaaaggggagagcuugaccucc

SEQ ID NO: 288633 - RNA, 32 nt, Human
aacgugaaaggcuguggcaucaggguagggga

SEQ ID NO: 288634 - RNA, 32 nt, Human
aacgugaagacuguuggcaguguuaguaugcu

SEQ ID NO: 288635 - RNA, 32 nt, Human
aacgugaauaaauuaugaagcauacuaaugag

SEQ ID NO: 288636 - RNA, 32 nt, Human
aacgugagccacugugcuuggccacacacaua

SEQ ID NO: 288637 - RNA, 32 nt, Human
aacgugaucuuggcugucugucauguguugaa

SEQ ID NO: 288638 - RNA, 32 nt, Human
aacgugaugucagacaccaucuguagugagca

SEQ ID NO: 288639 - RNA, 32 nt, Human
aacgugcacauccaggaguccuuuggacagug

SEQ ID NO: 288640 - RNA, 32 nt, Human
aacgugcagagugagagugguaugaauuuucc

SEQ ID NO: 288641 - RNA, 32 nt, Human
aacgugcagguuuguuacauagguauacacgu

SEQ ID NO: 288642 - RNA, 32 nt, Human
aacgugcagguuuguuacauagguauacaugu

SEQ ID NO: 288643 - RNA, 32 nt, Human
aacgugcagguuuguuacauagguauauacau

SEQ ID NO: 288644 - RNA, 32 nt, Human
aacgugcauuuuuacucaacuaccucagguau

SEQ ID NO: 288645 - RNA, 32 nt, Human
aacgugccaagccagcauaggggagcuagaag

SEQ ID NO: 288646 - RNA, 32 nt, Human
aacgugccagcgagggagagaccuuuccacug

SEQ ID NO: 288647 - RNA, 20 nt, Human
aacgugccaggcaggaggcc

SEQ ID NO: 288648 - RNA, 32 nt, Human
aacgugccggagugcuugggugccaucagcua

SEQ ID NO: 288649 - RNA, 32 nt, Human
aacgugccucuccuggcccuagaguucuugga

SEQ ID NO: 288650 - RNA, 32 nt, Human
aacguggaagacaaggcagaagaggcuggcca

SEQ ID NO: 288651 - RNA, 32 nt, Human
aacguggagaaaugccaucucuacuaaagaug

SEQ ID NO: 288652 - RNA, 32 nt, Human
aacguggagauggaggucaggcugcagugcga

SEQ ID NO: 288653 - RNA, 32 nt, Human
aacguggaggcagagguugcagugagccgaga

SEQ ID NO: 288654 - RNA, 32 nt, Human
aacguggauacagagccacgaguuuggauguu

SEQ ID NO: 288655 - RNA, 32 nt, Human
aacguggaucucccccucauccaacuccgaaa

SEQ ID NO: 288656 - RNA, 32 nt, Human
aacguggcaacugccgaauaaacacaccaacc

SEQ ID NO: 288657 - RNA, 32 nt, Human
aacguggcaugaucucagcucacugcaaccuc

SEQ ID NO: 288658 - RNA, 32 nt, Human
aacguggcccugcuucaggugauccgcgggag

SEQ ID NO: 288659 - RNA, 32 nt, Human
aacguggccuuugaguucaguuguuauaaacc

SEQ ID NO: 288660 - RNA, 32 nt, Human
aacguggcucaagugcuggcucaccuucuagc

SEQ ID NO: 288661 - RNA, 32 nt, Human
aacgugggaggcagaaguugcagugagccaag

SEQ ID NO: 288662 - RNA, 26 nt, Human
aacgugggaggcagagguugcaguga

SEQ ID NO: 288663 - RNA, 32 nt, Human
aacgugggaggcagagguugcagugagccgag

SEQ ID NO: 288664 - RNA, 32 nt, Human
aacgugggaggcagagguugcagugaguggag

SEQ ID NO: 288665 - RNA, 26 nt, Human
aacgugggaggcggagguugcagcga

SEQ ID NO: 288666 - RNA, 32 nt, Human
aacgugggaggcggagguugcagcgagcugag

SEQ ID NO: 288667 - RNA, 32 nt, Human
aacgugggaggcggagguugcagugagcugag

SEQ ID NO: 288668 - RNA, 32 nt, Human
aacgugggaggcggagguuguagugagccagg

SEQ ID NO: 288669 - RNA, 32 nt, Human
aacgugggccugauccaacagcagaaaacuuu

SEQ ID NO: 288670 - RNA, 32 nt, Human
aacguggggcagccccucccacgacccccacc

SEQ ID NO: 288671 - RNA, 32 nt, Human
aacguggggugagggaucacugccaaaauggu

SEQ ID NO: 288672 - RNA, 32 nt, Human
aacgugggugcaaaagugaugagaccccacac

SEQ ID NO: 288673 - RNA, 32 nt, Human
aacguguaagcacaugcuuuccuucuaucaac

SEQ ID NO: 288674 - RNA, 32 nt, Human
aacguguacagauggaaacuucauuuaaaaau

SEQ ID NO: 288675 - RNA, 32 nt, Human
aacguguagcuguugagagguggacucuguua

SEQ ID NO: 288676 - RNA, 32 nt, Human
aacguguauuccugaaacuuuuugacuuacuu

SEQ ID NO: 288677 - RNA, 31 nt, Human
aacgugucacuucuccucccagaggcaguac

SEQ ID NO: 288678 - RNA, 32 nt, Human
aacgugucagagacaguggacagggaagcguu

SEQ ID NO: 288679 - RNA, 32 nt, Human
aacgugucauguaaccucguguuagucacuca

SEQ ID NO: 288680 - RNA, 32 nt, Human
aacgugugcccuuuuauauuauuuaugccuua

SEQ ID NO: 288681 - RNA, 32 nt, Human
aacguguuagccaggauggucucagucuccag

SEQ ID NO: 288682 - RNA, 32 nt, Human
aacguguugagcaaacacaguacuuucuguga

SEQ ID NO: 288683 - RNA, 22 nt, Human
aacguuaacuugcaggccacgu

SEQ ID NO: 288684 - RNA, 32 nt, Human
aacguuaagaccucuuucacagccucuccuuc

SEQ ID NO: 288685 - RNA, 32 nt, Human
aacguucaaaggacggggaagggagagugagc

SEQ ID NO: 288686 - RNA, 32 nt, Human
aacguuccccuccugguuuugccuuuucaggg

SEQ ID NO: 288687 - RNA, 19 nt, Human
aacguucggggguugcuca

SEQ ID NO: 288688 - RNA, 32 nt, Human
aacguugagacaaucuaaauguuuaucagugg

SEQ ID NO: 288689 - RNA, 32 nt, Human
aacguugcaaugcacccagcagcuccuggcuc

SEQ ID NO: 288690 - RNA, 32 nt, Human
aacguuggcugcagcggagauggcugcucccc

SEQ ID NO: 288691 - RNA, 32 nt, Human
aacguugugggguccaagccacaaguuaacuu

SEQ ID NO: 288692 - RNA, 32 nt, Human
aacguuuagggugaagugccuuggcacgggau

SEQ ID NO: 288693 - RNA, 32 nt, Human
aacguuuaguuucagcucagugaucagcuacc

SEQ ID NO: 288694 - RNA, 32 nt, Human
aacguuucaguuccuuucauucauuccugggu

SEQ ID NO: 288695 - RNA, 32 nt, Human
aacguuucuucacuuuugcaagguuccacaga

SEQ ID NO: 288696 - RNA, 32 nt, Human
aacguuuuggagauugugcuuguugcuuugcu

SEQ ID NO: 288697 - RNA, 32 nt, Human
aacuaaaaagagacugugccauggugagaaaa

SEQ ID NO: 288698 - RNA, 32 nt, Human
aacuaaaacaggauaguagcugcuggaaauga

SEQ ID NO: 288699 - RNA, 32 nt, Human
aacuaaaauuucaggaaaccuguuuaauuucu

SEQ ID NO: 288700 - RNA, 32 nt, Human
aacuaaacaggcaaggaggcuuugagucacau

SEQ ID NO: 288701 - RNA, 32 nt, Human
aacuaaaccacagucuguaaucccaggagaau

SEQ ID NO: 288702 - RNA, 32 nt, Human
aacuaaagagaugggaguucaccugagggcaa

SEQ ID NO: 288703 - RNA, 32 nt, Human
aacuaaagccucaagaggaagagacucauggu

SEQ ID NO: 288704 - RNA, 32 nt, Human
aacuaaaggcagacuuucaguaccaagaguca

SEQ ID NO: 288705 - RNA, 32 nt, Human
aacuaaagggaaagcuuugccugagaccaucg

SEQ ID NO: 288706 - RNA, 32 nt, Human
aacuaaaugaacaggccacaggucagaagugg

SEQ ID NO: 288707 - RNA, 32 nt, Human
aacuaaaugcugaacuaagccugguugagaug

SEQ ID NO: 288708 - RNA, 32 nt, Human
aacuaaauguaaagugguuggagcgaggugag

SEQ ID NO: 288709 - RNA, 32 nt, Human
aacuaacaaaggauuugcuuuagagauaauua

SEQ ID NO: 288710 - RNA, 32 nt, Human
aacuaacaaccaaccaaccaaccaaccaacca

SEQ ID NO: 288711 - RNA, 32 nt, Human
aacuaacaacuccagacgcaccaccuuuauga

SEQ ID NO: 288712 - RNA, 32 nt, Human
aacuaacaugaaauauguguuguuuucauuug

SEQ ID NO: 288713 - RNA, 32 nt, Human
aacuaaccuaccccaacucugcccuucuccca

SEQ ID NO: 288714 - RNA, 32 nt, Human
aacuaaccuaguucaggguucucaggcaggca

SEQ ID NO: 288715 - RNA, 32 nt, Human
aacuaacucauggagauauuuugaacuauuau

SEQ ID NO: 288716 - RNA, 32 nt, Human
aacuaacuccaaagcuugaaggacuuuuucuc

SEQ ID NO: 288717 - RNA, 32 nt, Human
aacuaacucucggggguguucugcucaccaca

SEQ ID NO: 288718 - RNA, 32 nt, Human
aacuaagaagaaggaggaagaaagaaggagaa

SEQ ID NO: 288719 - RNA, 32 nt, Human
aacuaagaaguguuaucuuuguuaucagggga

SEQ ID NO: 288720 - RNA, 32 nt, Human
aacuaagaauuuuccccacagaggugaacagg

SEQ ID NO: 288721 - RNA, 31 nt, Human
aacuaagacacaaaggaggugggagacugcc

SEQ ID NO: 288722 - RNA, 31 nt, Human
aacuaagacacaaaggaggugggagacugcg

SEQ ID NO: 288723 - RNA, 32 nt, Human
aacuaagauaacuuuuagcacaugcuuaaaua

SEQ ID NO: 288724 - RNA, 32 nt, Human
aacuaagcaagguauggaacacugaagugccu

SEQ ID NO: 288725 - RNA, 32 nt, Human
aacuaagcagaggcucuccucaccacgcagag

SEQ ID NO: 288726 - RNA, 32 nt, Human
aacuaagcauugacagaauaucuuaaaauggu

SEQ ID NO: 288727 - RNA, 32 nt, Human
aacuaagccuugcucugucucccaggcuggag

SEQ ID NO: 288728 - RNA, 32 nt, Human
aacuaagcgcaaagccgcccgaauccaucucc

SEQ ID NO: 288729 - RNA, 32 nt, Human
aacuaagcucacaaccaaaacugcacuucagc

SEQ ID NO: 288730 - RNA, 32 nt, Human
aacuaagcucacugcugucucacccucaccag

SEQ ID NO: 288731 - RNA, 32 nt, Human
aacuaagcuguccucagauuuuaacuugacuc

SEQ ID NO: 288732 - RNA, 32 nt, Human
aacuaaggagcagcauuugaguagauuucuga

SEQ ID NO: 288733 - RNA, 32 nt, Human
aacuaaggggagguaaaggcagucuccuguuu

SEQ ID NO: 288734 - RNA, 32 nt, Human
aacuaaguacugcaaucuccuccuauaagugc

SEQ ID NO: 288735 - RNA, 32 nt, Human
aacuaagugggacuacaggcacgugccaccau

SEQ ID NO: 288736 - RNA, 32 nt, Human
aacuaauaauaauacaaaaauuagcugggcgu

SEQ ID NO: 288737 - RNA, 32 nt, Human
aacuaauacagcugcuaaaaugaucccugucu

SEQ ID NO: 288738 - RNA, 32 nt, Human
aacuaauagaaguugaggauuguugaaucuau

SEQ ID NO: 288739 - RNA, 32 nt, Human
aacuaaucaauaccgauugcaccaccaaacuc

SEQ ID NO: 288740 - RNA, 32 nt, Human
aacuaaucucagaaaaauuuuuggugcccaug

SEQ ID NO: 288741 - RNA, 32 nt, Human
aacuaaucugaaccagauaaugccauaaguag

SEQ ID NO: 288742 - RNA, 32 nt, Human
aacuaaugacucugcugccuucuccuuugucu

SEQ ID NO: 288743 - RNA, 32 nt, Human
aacuaauggaguuucauuguaacuguccuuug

SEQ ID NO: 288744 - RNA, 16 nt, Human
aacuaaugucagcaca

SEQ ID NO: 288745 - RNA, 32 nt, Human
aacuaaugucccuccccucucccugccaaaag

SEQ ID NO: 288746 - RNA, 32 nt, Human
aacuaauugccucacauugucacugcaaaucg

SEQ ID NO: 288747 - RNA, 32 nt, Human
aacuaauuguauagcuuuuagaacaaaauaca

SEQ ID NO: 288748 - RNA, 32 nt, Human
aacuacaaaaccagguggcagguugcugcucu

SEQ ID NO: 288749 - RNA, 32 nt, Human
aacuacaaaugccaccauuaccacuuaaaacu

SEQ ID NO: 288750 - RNA, 32 nt, Human
aacuacacacaaaaagcauacuugcauuauuu

SEQ ID NO: 288751 - RNA, 32 nt, Human
aacuacacacccccaagccacagggaagcaug

SEQ ID NO: 288752 - RNA, 20 nt, Human
aacuacacagaccaguggga

SEQ ID NO: 288753 - RNA, 32 nt, Human
aacuacacuguugccuugcuaggauccacccu

SEQ ID NO: 288754 - RNA, 32 nt, Human
aacuacagacacaugccccaauacucagcuaa

SEQ ID NO: 288755 - RNA, 32 nt, Human
aacuacagcugcagaccaguacacaucaagca

SEQ ID NO: 288756 - RNA, 32 nt, Human
aacuacaggaauagcuacagauuggaaacaac

SEQ ID NO: 288757 - RNA, 32 nt, Human
aacuacaguuuucaccauuuguccucagucuc

SEQ ID NO: 288758 - RNA, 32 nt, Human
aacuacaugagcuuuggcauggggauagagag

SEQ ID NO: 288759 - RNA, 21 nt, Human
aacuaccagaaucugggccac

SEQ ID NO: 288760 - RNA, 32 nt, Human
aacuaccaguccaagaaucuguuuaaauucag

SEQ ID NO: 288761 - RNA, 32 nt, Human
aacuaccaugaccugcacaaaaccccugccuc

SEQ ID NO: 288762 - RNA, 32 nt, Human
aacuaccccagcccaggcucucaccaucucca

SEQ ID NO: 288763 - RNA, 32 nt, Human
aacuaccccuaaaagcaacaaugggaauggaa

SEQ ID NO: 288764 - RNA, 32 nt, Human
aacuaccccuaaaagccaaaaugggaaaggaa

SEQ ID NO: 288765 - RNA, 32 nt, Human
aacuacccugagccaccacccucagccuuggu

SEQ ID NO: 288766 - RNA, 32 nt, Human
aacuaccuaccaugccuguugugcucaggugu

SEQ ID NO: 288767 - RNA, 32 nt, Human
aacuaccucauggggguucacccccauggccu

SEQ ID NO: 288768 - RNA, 32 nt, Human
aacuaccucccaggguuauugcaaggauucau

SEQ ID NO: 288769 - RNA, 32 nt, Human
aacuaccugaugccaggagcuuagggcuuugc

SEQ ID NO: 288770 - RNA, 32 nt, Human
aacuacgccuccaaaaguuucagucuauugca

SEQ ID NO: 288771 - RNA, 32 nt, Human
aacuacgccuuccugugggauguggccguggu

SEQ ID NO: 288772 - RNA, 32 nt, Human
aacuacguauucccucuugacacucacaaucu

SEQ ID NO: 288773 - RNA, 32 nt, Human
aacuacuagaugugaacuugaagaagguuguc

SEQ ID NO: 288774 - RNA, 32 nt, Human
aacuacuagccaaggagacauucagcaauuaa

SEQ ID NO: 288775 - RNA, 32 nt, Human
aacuacuagggaggcugaggcaggagaaucac

SEQ ID NO: 288776 - RNA, 32 nt, Human
aacuacuagggaggcugaggugggaggaucac

SEQ ID NO: 288777 - RNA, 32 nt, Human
aacuacucacccugccacuccagcucauaccc

SEQ ID NO: 288778 - RNA, 32 nt, Human
aacuacucagcuuuuccaaugaggcuugaauc

SEQ ID NO: 288779 - RNA, 32 nt, Human
aacuacucccuaauccuugaaaauccccaguc

SEQ ID NO: 288780 - RNA, 32 nt, Human
aacuacucuggcccauaccuuuccugguugug

SEQ ID NO: 288781 - RNA, 32 nt, Human
aacuacucuuuggagcucugagaugacaucuu

SEQ ID NO: 288782 - RNA, 32 nt, Human
aacuacuggaugguuaggccugguuuaacuau

SEQ ID NO: 288783 - RNA, 32 nt, Human
aacuacuggggcaaugaaugcuuuuaggcagu

SEQ ID NO: 288784 - RNA, 32 nt, Human
aacuacuguaugaaucguaaauguucugaaga

SEQ ID NO: 288785 - RNA, 21 nt, Human
aacuacugugaaugcuaugag

SEQ ID NO: 288786 - RNA, 32 nt, Human
aacuacuucagacucagcccuccuggaggcug

SEQ ID NO: 288787 - RNA, 32 nt, Human
aacuacuucucccuccuuguccagcacuuuuc

SEQ ID NO: 288788 - RNA, 32 nt, Human
aacuacuuucaugagcaguuguagcaggccug

SEQ ID NO: 288789 - RNA, 32 nt, Human
aacuagaaaaugugacaaucacauuuccucuu

SEQ ID NO: 288790 - RNA, 32 nt, Human
aacuagaagguagguuuaagccaucaccaggc

SEQ ID NO: 288791 - RNA, 21 nt, Human
aacuagaaggugcuucagaug

SEQ ID NO: 288792 - RNA, 32 nt, Human
aacuagaaugguguauaccacuuuaagaugua

SEQ ID NO: 288793 - RNA, 32 nt, Human
aacuagacaacuaaugugggaccauggcacug

SEQ ID NO: 288794 - RNA, 32 nt, Human
aacuagacagacacaucaccuaugcugcucuu

SEQ ID NO: 288795 - RNA, 32 nt, Human
aacuagacauaugagaaacauaccucagaaua

SEQ ID NO: 288796 - RNA, 32 nt, Human
aacuagaccaauauaaagauuuuggauuucac

SEQ ID NO: 288797 - RNA, 32 nt, Human
aacuagacucccccucuccccugucuaaacca

SEQ ID NO: 288798 - RNA, 32 nt, Human
aacuagaggaagcaaggaggcagagaccaaga

SEQ ID NO: 288799 - RNA, 32 nt, Human
aacuagaggauucuggacaaagacgaggacag

SEQ ID NO: 288800 - RNA, 32 nt, Human
aacuagagugugaagggacuggauuccugccc

SEQ ID NO: 288801 - RNA, 32 nt, Human
aacuagauaauuugcaaaguacccuugagauu

SEQ ID NO: 288802 - RNA, 32 nt, Human
aacuagcaauggcugcuguuaucucgcagagc

SEQ ID NO: 288803 - RNA, 32 nt, Human
aacuagcagggcugaaagagguguaacauaaa

SEQ ID NO: 288804 - RNA, 32 nt, Human
aacuagcaggguauuugaauaccauuuacaac

SEQ ID NO: 288805 - RNA, 32 nt, Human
aacuagccccuggggguacagggagaacagca

SEQ ID NO: 288806 - RNA, 32 nt, Human
aacuagcuauuuuugaccuccugaucaggaac

SEQ ID NO: 288807 - RNA, 32 nt, Human
aacuagcuccacccucuaacccccacuccagc

SEQ ID NO: 288808 - RNA, 32 nt, Human
aacuagcuccggcugaucggggguagaaaacg

SEQ ID NO: 288809 - RNA, 32 nt, Human
aacuagcucugcccuuagcccccuguaugacc

SEQ ID NO: 288810 - RNA, 32 nt, Human
aacuagcugggcauuguggcacaugccugcaa

SEQ ID NO: 288811 - RNA, 32 nt, Human
aacuagcuggggagagaaaagguggcaaugug

SEQ ID NO: 288812 - RNA, 22 nt, Human
aacuagcuuauaguuuaacuua

SEQ ID NO: 288813 - RNA, 32 nt, Human
aacuaggacuacaggcaugugccaccacgccu

SEQ ID NO: 288814 - RNA, 32 nt, Human
aacuaggagagaaagggcagcucccucuuccu

SEQ ID NO: 288815 - RNA, 32 nt, Human
aacuaggaggcagagguugcagugagccgaga

SEQ ID NO: 288816 - RNA, 32 nt, Human
aacuaggauacuuucuacuuuuucuagcuaca

SEQ ID NO: 288817 - RNA, 21 nt, Human
aacuaggaucuuccucagaug

SEQ ID NO: 288818 - RNA, 32 nt, Human
aacuaggauuguagucccaaagaggcuacugu

SEQ ID NO: 288819 - RNA, 26 nt, Human
aacuagggaagcggagguugcaguga

SEQ ID NO: 288820 - RNA, 32 nt, Human
aacuagggcaagucagaaauagccaggcucgc

SEQ ID NO: 288821 - RNA, 32 nt, Human
aacuagggcagccuggaaacauauggacuaua

SEQ ID NO: 288822 - RNA, 32 nt, Human
aacuagggcguugggaccuguugcccacacag

SEQ ID NO: 288823 - RNA, 32 nt, Human
aacuaggggaccccacacacauguggcuacca

SEQ ID NO: 288824 - RNA, 32 nt, Human
aacuagggggauaagagagaagaaaagaagaa

SEQ ID NO: 288825 - RNA, 32 nt, Human
aacuagguugaguuuucuccucugcuaagagg

SEQ ID NO: 288826 - RNA, 32 nt, Human
aacuagguuuugagccacgggucagggugcca

SEQ ID NO: 288827 - RNA, 32 nt, Human
aacuaguaaugucuuuuccugaaaagggcaaa

SEQ ID NO: 288828 - RNA, 32 nt, Human
aacuaguagaucuuuccuugguaaaguuugac

SEQ ID NO: 288829 - RNA, 32 nt, Human
aacuaguaucucuggccuccuggggcccauuc

SEQ ID NO: 288830 - RNA, 24 nt, Human
aacuaguauucaacaaaccuugua

SEQ ID NO: 288831 - RNA, 31 nt, Human
aacuagugacgagaaccuugccauagccauu

SEQ ID NO: 288832 - RNA, 32 nt, Human
aacuagugcucagaccaaagaguucacaccca

SEQ ID NO: 288833 - RNA, 21 nt, Human
aacuaguuggaggucuagaug

SEQ ID NO: 288834 - RNA, 32 nt, Human
aacuaguuggugcauaagaaggccccacuugg

SEQ ID NO: 288835 - RNA, 32 nt, Human
aacuaguuuuaaacuacuuuguguacaaauaa

SEQ ID NO: 288836 - RNA, 32 nt, Human
aacuauaaaauuacagaaaauauuuaaaugca

SEQ ID NO: 288837 - RNA, 31 nt, Human
aacuauaauuacuuggcuguuggagauuugu

SEQ ID NO: 288838 - RNA, 32 nt, Human
aacuauagcugaugcagaaaguccagccaguu

SEQ ID NO: 288839 - RNA, 32 nt, Human
aacuauauggaggagggugcagaggagggaau

SEQ ID NO: 288840 - RNA, 32 nt, Human
aacuaucaccugggcuggagugcgauggcaug

SEQ ID NO: 288841 - RNA, 32 nt, Human
aacuaucacuucaguaaagaaguuaaacagua

SEQ ID NO: 288842 - RNA, 32 nt, Human
aacuauccauugcuugcuguucuuuuucauaa

SEQ ID NO: 288843 - RNA, 32 nt, Human
aacuaucccuuuccugagcucuuuaccucuua

SEQ ID NO: 288844 - RNA, 19 nt, Human
aacuauccucacccugccc

SEQ ID NO: 288845 - RNA, 32 nt, Human
aacuauccugcggguuuuaauuuauuucaucc

SEQ ID NO: 288846 - RNA, 32 nt, Human
aacuaucuccaaaauagaaauguuuucauaua

SEQ ID NO: 288847 - RNA, 32 nt, Human
aacuaucuccccucuugcugaaguucuuugua

SEQ ID NO: 288848 - RNA, 32 nt, Human
aacuaucuguucccuuccucugugccacgcuc

SEQ ID NO: 288849 - RNA, 32 nt, Human
aacuaucuucaccacacucacuauuucaaagu

SEQ ID NO: 288850 - RNA, 32 nt, Human
aacuaugaaagauuuagucaacagaaacuauu

SEQ ID NO: 288851 - RNA, 32 nt, Human
aacuaugaaguaagcaacaaggaugacaagaa

SEQ ID NO: 288852 - RNA, 23 nt, Human
aacuaugagaaauaaaauucugu

SEQ ID NO: 288853 - RNA, 21 nt, Human
aacuaugagaaauaaauuucu

SEQ ID NO: 288854 - RNA, 32 nt, Human
aacuaugaggcaggcauugucucauuuuucaa

SEQ ID NO: 288855 - RNA, 32 nt, Human
aacuaugauaguaccacugcacuccagccugg

SEQ ID NO: 288856 - RNA, 32 nt, Human
aacuaugaucaaaagguugagaugucucugca

SEQ ID NO: 288857 - RNA, 32 nt, Human
aacuaugauugcaucacugcacugcagccugg

SEQ ID NO: 288858 - RNA, 32 nt, Human
aacuaugauuuuaccacugcacuccagcuugg

SEQ ID NO: 288859 - RNA, 32 nt, Human
aacuaugcaggucagagucacacugcucugga

SEQ ID NO: 288860 - RNA, 32 nt, Human
aacuaugccaagcauuaagauaaacaaauaug

SEQ ID NO: 288861 - RNA, 32 nt, Human
aacuaugcccccgaugaggaccaagggcaccu

SEQ ID NO: 288862 - RNA, 32 nt, Human
aacuaugccugguacaagcuggcagaggaggu

SEQ ID NO: 288863 - RNA, 32 nt, Human
aacuaugcuuugagaaccacugccuugaaaaa

SEQ ID NO: 288864 - RNA, 32 nt, Human
aacuauggaaagaggcagaguuugcuugccca

SEQ ID NO: 288865 - RNA, 29 nt, Human
aacuauggaagauuauaccaaaauagaga

SEQ ID NO: 288866 - RNA, 32 nt, Human
aacuauggaguuaccaauauugccaaguagac

SEQ ID NO: 288867 - RNA, 32 nt, Human
aacuauggcaaugaagucaguagauaggaaac

SEQ ID NO: 288868 - RNA, 21 nt, Human
aacuaugggaaaauaaauuuc

SEQ ID NO: 288869 - RNA, 32 nt, Human
aacuaugggaaccuggccucacuaggugaggg

SEQ ID NO: 288870 - RNA, 32 nt, Human
aacuaugggaugggagaacuugagggugaucg

SEQ ID NO: 288871 - RNA, 32 nt, Human
aacuaugucucugacaugcacauacacugcuu

SEQ ID NO: 288872 - RNA, 32 nt, Human
aacuaugugcaucugccucucucugccugaga

SEQ ID NO: 288873 - RNA, 32 nt, Human
aacuauuauugaguagaggccuaaagaggacu

SEQ ID NO: 288874 - RNA, 32 nt, Human
aacuauucagggacauuuuuccauuuccaaaa

SEQ ID NO: 288875 - RNA, 32 nt, Human
aacuauugaaaauauauuuucucucuccagaa

SEQ ID NO: 288876 - RNA, 32 nt, Human
aacuauuggccacuuuuguauguugccagcau

SEQ ID NO: 288877 - RNA, 32 nt, Human
aacuauuggugcgcuccagccgggcagguuuu

SEQ ID NO: 288878 - RNA, 32 nt, Human
aacuauuuaugcugguaaaacaaaugcuguua

SEQ ID NO: 288879 - RNA, 32 nt, Human
aacuauuuauuuccuccuccccuaccccuagu

SEQ ID NO: 288880 - RNA, 32 nt, Human
aacuauuucccuccaggccagaaaguuuucuu

SEQ ID NO: 288881 - RNA, 24 nt, Human
aacuauuucuaucaauugggccac

SEQ ID NO: 288882 - RNA, 32 nt, Human
aacuauuugcauagauagcucaguuaaacuua

SEQ ID NO: 288883 - RNA, 32 nt, Human
aacuauuuucuuucuguuuucuuuuacucugc

SEQ ID NO: 288884 - RNA, 32 nt, Human
aacucaaaaggucaggacagacuuccaagcac

SEQ ID NO: 288885 - RNA, 32 nt, Human
aacucaaacuuuuuguggacauucuuuucaaa

SEQ ID NO: 288886 - RNA, 32 nt, Human
aacucaaagagaccaccaccacuacuacauuu

SEQ ID NO: 288887 - RNA, 32 nt, Human
aacucaaagcaagcucuucuccucagcuuggg

SEQ ID NO: 288888 - RNA, 32 nt, Human
aacucaaagccguccguggagccccagacgag

SEQ ID NO: 288889 - RNA, 32 nt, Human
aacucaaaguacaguguuuucaaucuaaaaag

SEQ ID NO: 288890 - RNA, 32 nt, Human
aacucaaaugcuuggcuucucauacguccacc

SEQ ID NO: 288891 - RNA, 20 nt, Human
aacucaaauuacuucguguu

SEQ ID NO: 288892 - RNA, 32 nt, Human
aacucaacagccgcccaagccgccuuccggcu

SEQ ID NO: 288893 - RNA, 32 nt, Human
aacucaacauggcaugccuuucucuccguaaa

SEQ ID NO: 288894 - RNA, 32 nt, Human
aacucaacccuuggggugacuggccaugguga

SEQ ID NO: 288895 - RNA, 32 nt, Human
aacucaacuucccacaccaccaugucucucac

SEQ ID NO: 288896 - RNA, 32 nt, Human
aacucaagccaggguggaaagacacugcauac

SEQ ID NO: 288897 - RNA, 23 nt, Human
aacucaagcccauccaugagaca

SEQ ID NO: 288898 - RNA, 32 nt, Human
aacucaagcucagcuucugccuccugucuccu

SEQ ID NO: 288899 - RNA, 32 nt, Human
aacucaagcuccugaacucaagcaauucuccu

SEQ ID NO: 288900 - RNA, 32 nt, Human
aacucaagggccugaagcucccagaagcuucc

SEQ ID NO: 288901 - RNA, 32 nt, Human
aacucaaggugguggcuggagauggcugcugc

SEQ ID NO: 288902 - RNA, 32 nt, Human
aacucaaguaauccaccuuggccucccaaagu

SEQ ID NO: 288903 - RNA, 32 nt, Human
aacucaagugacuaggugggcccagcuggcuu

SEQ ID NO: 288904 - RNA, 19 nt, Human
aacucaauaacuguuugaa

SEQ ID NO: 288905 - RNA, 19 nt, Human
aacucaauaucugugugaa

SEQ ID NO: 288906 - RNA, 32 nt, Human
aacucaauccagcauuuguagcagguuuugaa

SEQ ID NO: 288907 - RNA, 19 nt, Human
aacucaaucuucuguugga

SEQ ID NO: 288908 - RNA, 32 nt, Human
aacucaaugugguccuuucaagaauuagccau

SEQ ID NO: 288909 - RNA, 32 nt, Human
aacucaauuauguuggagcuguguggcauuuu

SEQ ID NO: 288910 - RNA, 32 nt, Human
aacucacaacagcauggauaaaucuuacagac

SEQ ID NO: 288911 - RNA, 32 nt, Human
aacucacagcacaaacccugcaaacccaaaga

SEQ ID NO: 288912 - RNA, 32 nt, Human
aacucacagcguucuucucucccuuuuucccc

SEQ ID NO: 288913 - RNA, 32 nt, Human
aacucacagucucaaagccuguccuccuccag

SEQ ID NO: 288914 - RNA, 31 nt, Human
aacucacaguuucaacaaugacccacaaaaa

SEQ ID NO: 288915 - RNA, 15 nt, Human
aacucaccaagcaca

SEQ ID NO: 288916 - RNA, 32 nt, Human
aacucaccacccaggcuuuaucagcccagaac

SEQ ID NO: 288917 - RNA, 32 nt, Human
aacucaccaggguuuaguuugcauuuaagaau

SEQ ID NO: 288918 - RNA, 32 nt, Human
aacucaccauugcacuccagccuggaugacag

SEQ ID NO: 288919 - RNA, 32 nt, Human
aacucacccaggaagugcaagggguuugggga

SEQ ID NO: 288920 - RNA, 32 nt, Human
aacucaccgcaaccuccgccucccggguucaa

SEQ ID NO: 288921 - RNA, 32 nt, Human
aacucaccgcaaccuccuccucuuggguucaa

SEQ ID NO: 288922 - RNA, 32 nt, Human
aacucaccugcauuuuuaaaugugguagagac

SEQ ID NO: 288923 - RNA, 32 nt, Human
aacucaccuugucucaugacuuuugguuaagg

SEQ ID NO: 288924 - RNA, 32 nt, Human
aacucacgaagcagaggcugggcgugguggcu

SEQ ID NO: 288925 - RNA, 32 nt, Human
aacucacgaccugauaguugaccugggagauc

SEQ ID NO: 288926 - RNA, 32 nt, Human
aacucacgccuguaaucccagcacuuaggaag

SEQ ID NO: 288927 - RNA, 32 nt, Human
aacucacuaaauauuuauauaacuuugauaua

SEQ ID NO: 288928 - RNA, 32 nt, Human
aacucacuacagccucgaacuccuaggcucaa

SEQ ID NO: 288929 - RNA, 32 nt, Human
aacucacucacacugaggccuuggggacugag

SEQ ID NO: 288930 - RNA, 32 nt, Human
aacucacucucagccacagggagcugcaugca

SEQ ID NO: 288931 - RNA, 32 nt, Human
aacucacugcaaccccugcucucagguucaag

SEQ ID NO: 288932 - RNA, 32 nt, Human
aacucacugcaaccuccacccgccgggucccu

SEQ ID NO: 288933 - RNA, 32 nt, Human
aacucacugcaaccuccgcucccgguuugagu

SEQ ID NO: 288934 - RNA, 32 nt, Human
aacucacugcaaccuccgcuucccagguaaua

SEQ ID NO: 288935 - RNA, 32 nt, Human
aacucacugcaaccucugcccuucagguucaa

SEQ ID NO: 288936 - RNA, 32 nt, Human
aacucacugcaagcuccgccuccuggguucac

SEQ ID NO: 288937 - RNA, 32 nt, Human
aacucacugccuuauaaaggcuuucaugaugu

SEQ ID NO: 288938 - RNA, 32 nt, Human
aacucacugcucagacuuaguuuccccagaag

SEQ ID NO: 288939 - RNA, 32 nt, Human
aacucacuguaaccuccgccucccggauacuc

SEQ ID NO: 288940 - RNA, 32 nt, Human
aacucacuguucucuugcuuccuuccacccug

SEQ ID NO: 288941 - RNA, 32 nt, Human
aacucacuuccaccccagaggagucuucuguc

SEQ ID NO: 288942 - RNA, 32 nt, Human
aacucagaagacagagcugaaaaagaaaacug

SEQ ID NO: 288943 - RNA, 32 nt, Human
aacucagaaggcggaggcugcagugagccgag

SEQ ID NO: 288944 - RNA, 32 nt, Human
aacucagaaggcggagguuccagugagccauc

SEQ ID NO: 288945 - RNA, 32 nt, Human
aacucagaaggugcauuuaagagagagaccug

SEQ ID NO: 288946 - RNA, 26 nt, Human
aacucagaagguggagguugcaguga

SEQ ID NO: 288947 - RNA, 32 nt, Human
aacucagaagguggagguugcagugaggcgag

SEQ ID NO: 288948 - RNA, 32 nt, Human
aacucagacugucuggagcuugcugaguacaa

SEQ ID NO: 288949 - RNA, 32 nt, Human
aacucagagaaggcagagggagagggagagag

SEQ ID NO: 288950 - RNA, 32 nt, Human
aacucagagccagcuuguggcaagcaguuggg

SEQ ID NO: 288951 - RNA, 32 nt, Human
aacucagaggaaauuugcacagaugcugcuuu

SEQ ID NO: 288952 - RNA, 32 nt, Human
aacucagaggaagaggaaagaaagaagaggag

SEQ ID NO: 288953 - RNA, 32 nt, Human
aacucagaggagaaagccugagugaguaacac

SEQ ID NO: 288954 - RNA, 32 nt, Human
aacucagauccagaccuccugagcccacuuuc

SEQ ID NO: 288955 - RNA, 32 nt, Human
aacucagauccagggacagaggcccagccucc

SEQ ID NO: 288956 - RNA, 32 nt, Human
aacucagcaaugacacaagaagagagugacac

SEQ ID NO: 288957 - RNA, 32 nt, Human
aacucagcagcaacaccaaauccuggaccagg

SEQ ID NO: 288958 - RNA, 18 nt, Human
aacucagcaucaagcaca

SEQ ID NO: 288959 - RNA, 16 nt, Human
aacucagccaagcaca

SEQ ID NO: 288960 - RNA, 32 nt, Human
aacucagccagccuugccagaccugcuuaaug

SEQ ID NO: 288961 - RNA, 32 nt, Human
aacucagcccuucugaacuccugggcucaagc

SEQ ID NO: 288962 - RNA, 32 nt, Human
aacucagcccuucuuggaauacagccuuucaa

SEQ ID NO: 288963 - RNA, 32 nt, Human
aacucagcucacugcaaccucugccuccugga

SEQ ID NO: 288964 - RNA, 32 nt, Human
aacucagcugugcacugauugccaaguuggaa

SEQ ID NO: 288965 - RNA, 32 nt, Human
aacucaggacacugucaucugcauuuaaucaa

SEQ ID NO: 288966 - RNA, 32 nt, Human
aacucaggagacggagguuacagugagucgag

SEQ ID NO: 288967 - RNA, 32 nt, Human
aacucaggagauggagguuucagugagccaag

SEQ ID NO: 288968 - RNA, 32 nt, Human
aacucaggaggcagaaguugcgguuagccgag

SEQ ID NO: 288969 - RNA, 32 nt, Human
aacucaggaggcagagguugcaaugagccaag

SEQ ID NO: 288970 - RNA, 32 nt, Human
aacucaggaggcagagguugcagugagccaag

SEQ ID NO: 288971 - RNA, 26 nt, Human
aacucaggaggcggaaguugcgguga

SEQ ID NO: 288972 - RNA, 32 nt, Human
aacucaggaggcggaaguugcggugagccaag

SEQ ID NO: 288973 - RNA, 32 nt, Human
aacucaggaggcggagcuugcagugagccgag

SEQ ID NO: 288974 - RNA, 32 nt, Human
aacucaggaggcggagguugcggugagccgag

SEQ ID NO: 288975 - RNA, 32 nt, Human
aacucaggaggcggagguugcggugagcugag

SEQ ID NO: 288976 - RNA, 26 nt, Human
aacucaggagguggagguugcaguga

SEQ ID NO: 288977 - RNA, 32 nt, Human
aacucaggagguggagguugcagugagcugag

SEQ ID NO: 288978 - RNA, 32 nt, Human
aacucaggagguggagguugcggugagccaag

SEQ ID NO: 288979 - RNA, 32 nt, Human
aacucaggcccagaauugcaguucagaauggc

SEQ ID NO: 288980 - RNA, 32 nt, Human
aacucagggacccccucgauccacggcgugag

SEQ ID NO: 288981 - RNA, 32 nt, Human
aacucagggaugacauuucccauagccuugac

SEQ ID NO: 288982 - RNA, 32 nt, Human
aacucaggggaggcagcagggugcgggccuug

SEQ ID NO: 288983 - RNA, 26 nt, Human
aacucaggggguggagguugcaguga

SEQ ID NO: 288984 - RNA, 32 nt, Human
aacucaggggguggagguugcagugaguugag

SEQ ID NO: 288985 - RNA, 32 nt, Human
aacucaggguaaccucauuacuacucagugug

SEQ ID NO: 288986 - RNA, 32 nt, Human
aacucaggguccuccugccugcccugagccac

SEQ ID NO: 288987 - RNA, 32 nt, Human
aacucagguggcagagguugcagugagccgag

SEQ ID NO: 288988 - RNA, 32 nt, Human
aacucaguauuuaaaccacuaaccagaaacau

SEQ ID NO: 288989 - RNA, 32 nt, Human
aacucagucuaggacagccauggaugcagugu

SEQ ID NO: 288990 - RNA, 32 nt, Human
aacucagugaagaagacagaacgaggcugaug

SEQ ID NO: 288991 - RNA, 32 nt, Human
aacucagugugacaccgccagguccagcaccc

SEQ ID NO: 288992 - RNA, 32 nt, Human
aacucaguguuaggaacuuuggcaucuguagc

SEQ ID NO: 288993 - RNA, 32 nt, Human
aacucaguuaaggccuucuacggucccaggcu

SEQ ID NO: 288994 - RNA, 32 nt, Human
aacucauaagccaucuuuaagaauuucuuaca

SEQ ID NO: 288995 - RNA, 32 nt, Human
aacucauacaaaccaauagaauuucaacaugu

SEQ ID NO: 288996 - RNA, 32 nt, Human
aacucauaugcuguuaucacugugauuuuacu

SEQ ID NO: 288997 - RNA, 32 nt, Human
aacucaucaccaggacaguuggaggggguagg

SEQ ID NO: 288998 - RNA, 32 nt, Human
aacucaucacugggaaagaacucccccugcaa

SEQ ID NO: 288999 - RNA, 32 nt, Human
aacucauccaggagaaaaaggcaggagcagca

SEQ ID NO: 289000 - RNA, 32 nt, Human
aacucaucccgcaguuagaauuuuguuuggag

SEQ ID NO: 289001 - RNA, 32 nt, Human
aacucauccuguucaagaaacaaccuuucaug

SEQ ID NO: 289002 - RNA, 32 nt, Human
aacucaugccugacaucucagcacuucaggag

SEQ ID NO: 289003 - RNA, 32 nt, Human
aacucaugcucacggcuaguucugggguuggc

SEQ ID NO: 289004 - RNA, 32 nt, Human
aacucaugcugugccaucaugugugcagccug

SEQ ID NO: 289005 - RNA, 32 nt, Human
aacucauguucauucccaacagacucaucccu

SEQ ID NO: 289006 - RNA, 19 nt, Human
aacucauguuuguguagaa

SEQ ID NO: 289007 - RNA, 32 nt, Human
aacucauuacuuuuccauucccaaucuagugc

SEQ ID NO: 289008 - RNA, 32 nt, Human
aacucauuagcagauauguagugcagugauuu

SEQ ID NO: 289009 - RNA, 32 nt, Human
aacucauucuagaccagcucaaagauuccaug

SEQ ID NO: 289010 - RNA, 20 nt, Human
aacucauucuguguguugaa

SEQ ID NO: 289011 - RNA, 32 nt, Human
aacucauugcaaccuccaccugccggguccca

SEQ ID NO: 289012 - RNA, 32 nt, Human
aacucauugcagccucgaacuccugggcuuaa

SEQ ID NO: 289013 - RNA, 32 nt, Human
aacucauugccuguaaucccagcacuuuggga

SEQ ID NO: 289014 - RNA, 32 nt, Human
aacucauuuucucuucccaaaaaguguuaucu

SEQ ID NO: 289015 - RNA, 32 nt, Human
aacuccaaaccugagaaaagccuuagaccugc

SEQ ID NO: 289016 - RNA, 22 nt, Human
aacuccaaagguuugguuucag

SEQ ID NO: 289017 - RNA, 32 nt, Human
aacuccaaauggagaaguagucacuguagacu

SEQ ID NO: 289018 - RNA, 32 nt, Human
aacuccaaccugcacuccagccugggcaacag

SEQ ID NO: 289019 - RNA, 32 nt, Human
aacuccaaccuguaucagaugcagcccccaag

SEQ ID NO: 289020 - RNA, 32 nt, Human
aacuccaaggugccauggcagagaaggugcug

SEQ ID NO: 289021 - RNA, 32 nt, Human
aacuccaagugggaggaggggugccaguccuc

SEQ ID NO: 289022 - RNA, 32 nt, Human
aacuccacaucggcaacuucagccuggauugg

SEQ ID NO: 289023 - RNA, 32 nt, Human
aacuccaccucccagguucaaggaauuccugu

SEQ ID NO: 289024 - RNA, 32 nt, Human
aacuccacgccaccugguuugcucaacagcaa

SEQ ID NO: 289025 - RNA, 32 nt, Human
aacuccacuguacacuuauagaaugaagaagg

SEQ ID NO: 289026 - RNA, 32 nt, Human
aacuccagaacuaacaaugaacuccuauguug

SEQ ID NO: 289027 - RNA, 32 nt, Human
aacuccagaaugaguguugaccacugaagcau

SEQ ID NO: 289028 - RNA, 32 nt, Human
aacuccagagagaagcauccccuggcccggug

SEQ ID NO: 289029 - RNA, 22 nt, Human
aacuccagaggugaagagggca

SEQ ID NO: 289030 - RNA, 32 nt, Human
aacuccagccugggcaacagagugagacccua

SEQ ID NO: 289031 - RNA, 32 nt, Human
aacuccagccugggcaacagagugagauucug

SEQ ID NO: 289032 - RNA, 32 nt, Human
aacuccagccugggcaacaggugagauucugu

SEQ ID NO: 289033 - RNA, 32 nt, Human
aacuccagccugggccacauagcaagacccug

SEQ ID NO: 289034 - RNA, 32 nt, Human
aacuccagccugggcgacaagagggagacuuc

SEQ ID NO: 289035 - RNA, 32 nt, Human
aacuccagccugggcgacagagggagacucug

SEQ ID NO: 289036 - RNA, 32 nt, Human
aacuccagccugggugacagagcaagagucug

SEQ ID NO: 289037 - RNA, 32 nt, Human
aacuccagccugggugacagagugagacucuu

SEQ ID NO: 289038 - RNA, 32 nt, Human
aacuccagccuggguuacagagcgagacccug

SEQ ID NO: 289039 - RNA, 32 nt, Human
aacuccagccugguggcuuugccagaagggag

SEQ ID NO: 289040 - RNA, 32 nt, Human
aacuccagcuacuugggaggcugaggcaggag

SEQ ID NO: 289041 - RNA, 32 nt, Human
aacuccagcuggugcccccagacagcugcuca

SEQ ID NO: 289042 - RNA, 32 nt, Human
aacuccagcuugggugacagagugagaccguc

SEQ ID NO: 289043 - RNA, 32 nt, Human
aacuccaggaggcggaggaggcuaguggcagu

SEQ ID NO: 289044 - RNA, 32 nt, Human
aacuccaggcuuggaugguguuacagguuuaa

SEQ ID NO: 289045 - RNA, 32 nt, Human
aacuccaguaacucaaauggccucugugucau

SEQ ID NO: 289046 - RNA, 32 nt, Human
aacuccagugggcugaaacuaguagcucuuug

SEQ ID NO: 289047 - RNA, 32 nt, Human
aacuccaguguggaugacagagcgagacccug

SEQ ID NO: 289048 - RNA, 32 nt, Human
aacuccaguuccuuuccucucuugccucuucc

SEQ ID NO: 289049 - RNA, 32 nt, Human
aacuccaguucugaggggucuugaaggcccug

SEQ ID NO: 289050 - RNA, 32 nt, Human
aacuccauccucacacacucagccucugccuc

SEQ ID NO: 289051 - RNA, 32 nt, Human
aacuccauccuuggaggauuccccaccacaag

SEQ ID NO: 289052 - RNA, 32 nt, Human
aacuccaucuuggugagagaugaauuuggaua

SEQ ID NO: 289053 - RNA, 32 nt, Human
aacuccaugcaacuauccgucucgaauaccag

SEQ ID NO: 289054 - RNA, 32 nt, Human
aacuccauggucuuucugggccuuacugugcu

SEQ ID NO: 289055 - RNA, 32 nt, Human
aacuccauguaacagaacagacccaggacagg

SEQ ID NO: 289056 - RNA, 32 nt, Human
aacuccauguagauaagagcaaguguaggcaa

SEQ ID NO: 289057 - RNA, 32 nt, Human
aacuccauugcaaauucagcugugaggagauu

SEQ ID NO: 289058 - RNA, 21 nt, Human
aacuccauugcuuaagaaaca

SEQ ID NO: 289059 - RNA, 32 nt, Human
aacuccauuguuuccagguguugugacccugg

SEQ ID NO: 289060 - RNA, 32 nt, Human
aacuccauuucauuggacuaaauaacaaaagg

SEQ ID NO: 289061 - RNA, 32 nt, Human
aacuccauuuguaauaaagcccuagcacucug

SEQ ID NO: 289062 - RNA, 22 nt, Human
aacucccaaccucaagugaucc

SEQ ID NO: 289063 - RNA, 23 nt, Human
aacucccaaccucaagugaucca

SEQ ID NO: 289064 - RNA, 23 nt, Human
aacucccaaccucaggugaucca

SEQ ID NO: 289065 - RNA, 22 nt, Human
aacucccaaccucaggugaucu

SEQ ID NO: 289066 - RNA, 22 nt, Human
aacucccaacuucaggugaucc

SEQ ID NO: 289067 - RNA, 32 nt, Human
aacucccaccuaaaggaacaccagagaguuca

SEQ ID NO: 289068 - RNA, 32 nt, Human
aacucccagcggagagcaagguuuucuucugu

SEQ ID NO: 289069 - RNA, 32 nt, Human
aacucccagcuuucggacaucuggcacacggg

SEQ ID NO: 289070 - RNA, 32 nt, Human
aacucccagggcccuucacagaaccuuggagg

SEQ ID NO: 289071 - RNA, 32 nt, Human
aacucccaguacagugucugccgauuccacau

SEQ ID NO: 289072 - RNA, 32 nt, Human
aacucccaucaccucuaacacgcacagcugaa

SEQ ID NO: 289073 - RNA, 32 nt, Human
aacucccauccuuagggauucaccauccagua

SEQ ID NO: 289074 - RNA, 32 nt, Human
aacuccccagaacucucggggaaaggcccgag

SEQ ID NO: 289075 - RNA, 32 nt, Human
aacuccccagaggaggagguagugcgaggcgc

SEQ ID NO: 289076 - RNA, 32 nt, Human
aacuccccaucuggcccugcuguugcuaguac

SEQ ID NO: 289077 - RNA, 32 nt, Human
aacuccccgcgccgggcgcccagccugagcgu

SEQ ID NO: 289078 - RNA, 32 nt, Human
aacuccccuccccguuccccuuccccucucgg

SEQ ID NO: 289079 - RNA, 32 nt, Human
aacuccccuucccagccccagccaaacugagc

SEQ ID NO: 289080 - RNA, 22 nt, Human
aacucccgaccucaagugaucu

SEQ ID NO: 289081 - RNA, 22 nt, Human
aacucccgaccucaggugaucc

SEQ ID NO: 289082 - RNA, 23 nt, Human
aacucccgaccucaggugaucca

SEQ ID NO: 289083 - RNA, 22 nt, Human
aacucccgaccucaggugaucu

SEQ ID NO: 289084 - RNA, 23 nt, Human
aacucccgaccucaggugaucua

SEQ ID NO: 289085 - RNA, 23 nt, Human
aacucccgaccuuaggugaugca

SEQ ID NO: 289086 - RNA, 22 nt, Human
aacucccgacuucaggugaucc

SEQ ID NO: 289087 - RNA, 32 nt, Human
aacucccuccacuaccgcuauuucuccuugga

SEQ ID NO: 289088 - RNA, 32 nt, Human
aacucccuccauccugacucacguggacuuag

SEQ ID NO: 289089 - RNA, 32 nt, Human
aacucccucccuacugcuuccuaggagcuucc

SEQ ID NO: 289090 - RNA, 32 nt, Human
aacucccucccucccugcaauccuuccuucuu

SEQ ID NO: 289091 - RNA, 32 nt, Human
aacucccuccugucuuccacagucuccuacaa

SEQ ID NO: 289092 - RNA, 32 nt, Human
aacucccugaggccuccccucccuucagggca

SEQ ID NO: 289093 - RNA, 32 nt, Human
aacuccgaggcugagacuaggguuuuagcgga

SEQ ID NO: 289094 - RNA, 32 nt, Human
aacuccgaugcugcuucaacacuuucuugaug

SEQ ID NO: 289095 - RNA, 32 nt, Human
aacuccgcaagcaaaugaaaaacauccuggaa

SEQ ID NO: 289096 - RNA, 32 nt, Human
aacuccgcagcccagcccagaggagugucacc

SEQ ID NO: 289097 - RNA, 32 nt, Human
aacuccgccucccagguucacgccauucuccu

SEQ ID NO: 289098 - RNA, 32 nt, Human
aacuccgccucccggguucaagcgauucucgu

SEQ ID NO: 289099 - RNA, 32 nt, Human
aacuccgccuccuggguucaagugauucuucu

SEQ ID NO: 289100 - RNA, 32 nt, Human
aacuccgcucccaccgugucuucaagaagaac

SEQ ID NO: 289101 - RNA, 32 nt, Human
aacuccgcugccgacccugccugagcgcggga

SEQ ID NO: 289102 - RNA, 32 nt, Human
aacuccggccugggugacagaaggaggcucug

SEQ ID NO: 289103 - RNA, 32 nt, Human
aacuccggucgggcucucuccugggcucagca

SEQ ID NO: 289104 - RNA, 32 nt, Human
aacuccgugccuggccugucagcucccugcua

SEQ ID NO: 289105 - RNA, 23 nt, Human
aacuccuaaccucaagugaucca

SEQ ID NO: 289106 - RNA, 24 nt, Human
aacuccuaaccucaagugauccuc

SEQ ID NO: 289107 - RNA, 23 nt, Human
aacuccuaaccucaggugaucca

SEQ ID NO: 289108 - RNA, 23 nt, Human
aacuccuaaccuccagugaucca

SEQ ID NO: 289109 - RNA, 23 nt, Human
aacuccuaaccucgggugaucca

SEQ ID NO: 289110 - RNA, 20 nt, Human
aacuccuaaccuugugaucc

SEQ ID NO: 289111 - RNA, 24 nt, Human
aacuccuagacucaagugauccuc

SEQ ID NO: 289112 - RNA, 24 nt, Human
aacuccuagccucaagugauccuc

SEQ ID NO: 289113 - RNA, 20 nt, Human
aacuccuaggcucaagugau

SEQ ID NO: 289114 - RNA, 24 nt, Human
aacuccuaggcucaagugauccuc

SEQ ID NO: 289115 - RNA, 32 nt, Human
aacuccucaacagcaacaucucaucagagaag

SEQ ID NO: 289116 - RNA, 32 nt, Human
aacuccucaagcaaaauuucuguucauuuuac

SEQ ID NO: 289117 - RNA, 32 nt, Human
aacuccucagccaggugagacaaugggcuggu

SEQ ID NO: 289118 - RNA, 32 nt, Human
aacuccucaugauaacugcacacaaucugaaa

SEQ ID NO: 289119 - RNA, 32 nt, Human
aacuccuccaaaccccaaaccccaaacggaaa

SEQ ID NO: 289120 - RNA, 23 nt, Human
aacuccuccacucaggugaucca

SEQ ID NO: 289121 - RNA, 32 nt, Human
aacuccucccuuuucccucuccugggcccuuc

SEQ ID NO: 289122 - RNA, 32 nt, Human
aacuccucgcuucacuucaccugugccucccu

SEQ ID NO: 289123 - RNA, 32 nt, Human
aacuccucucucucuuucucugccucagaugg

SEQ ID NO: 289124 - RNA, 22 nt, Human
aacuccugaacgcaagugaucc

SEQ ID NO: 289125 - RNA, 22 nt, Human
aacuccugaacucaagugaucc

SEQ ID NO: 289126 - RNA, 22 nt, Human
aacuccugaacucaggugaucc

SEQ ID NO: 289127 - RNA, 24 nt, Human
aacuccugaacucaggugauccuc

SEQ ID NO: 289128 - RNA, 24 nt, Human
aacuccugaacuuaggugauucuc

SEQ ID NO: 289129 - RNA, 22 nt, Human
aacuccugacagcaucauccuc

SEQ ID NO: 289130 - RNA, 24 nt, Human
aacuccugacaucaagugaucuuc

SEQ ID NO: 289131 - RNA, 20 nt, Human
aacuccugaccaagugaucc

SEQ ID NO: 289132 - RNA, 23 nt, Human
aacuccugaccccaaguuaucca

SEQ ID NO: 289133 - RNA, 20 nt, Human
aacuccugacccugugaucc

SEQ ID NO: 289134 - RNA, 22 nt, Human
aacuccugaccgcaagugaucc

SEQ ID NO: 289135 - RNA, 23 nt, Human
aacuccugaccgcaagugaucca

SEQ ID NO: 289136 - RNA, 23 nt, Human
aacuccugaccgcagguaaucca

SEQ ID NO: 289137 - RNA, 23 nt, Human
aacuccugaccgcaggugaucca

SEQ ID NO: 289138 - RNA, 20 nt, Human
aacuccugaccuagugaucc

SEQ ID NO: 289139 - RNA, 21 nt, Human
aacuccugaccuagugaucca

SEQ ID NO: 289140 - RNA, 21 nt, Human
aacuccugaccuagugaugca

SEQ ID NO: 289141 - RNA, 24 nt, Human
aacuccugaccucaaaugagccuc

SEQ ID NO: 289142 - RNA, 22 nt, Human
aacuccugaccucaaaugaucc

SEQ ID NO: 289143 - RNA, 23 nt, Human
aacuccugaccucaaaugaucca

SEQ ID NO: 289144 - RNA, 23 nt, Human
aacuccugaccucaagcgaucca

SEQ ID NO: 289145 - RNA, 21 nt, Human
aacuccugaccucaaggaucu

SEQ ID NO: 289146 - RNA, 23 nt, Human
aacuccugaccucaaguaaucca

SEQ ID NO: 289147 - RNA, 23 nt, Human
aacuccugaccucaagugaccca

SEQ ID NO: 289148 - RNA, 22 nt, Human
aacuccugaccucaagugagcu

SEQ ID NO: 289149 - RNA, 20 nt, Human
aacuccugaccucaagugau

SEQ ID NO: 289150 - RNA, 22 nt, Human
aacuccugaccucaagugaucc

SEQ ID NO: 289151 - RNA, 23 nt, Human
aacuccugaccucaagugaucca

SEQ ID NO: 289152 - RNA, 24 nt, Human
aacuccugaccucaagugauccuc

SEQ ID NO: 289153 - RNA, 22 nt, Human
aacuccugaccucaagugaucu

SEQ ID NO: 289154 - RNA, 23 nt, Human
aacuccugaccucaagugaucua

SEQ ID NO: 289155 - RNA, 24 nt, Human
aacuccugaccucaagugaucuuc

SEQ ID NO: 289156 - RNA, 23 nt, Human
aacuccugaccucagauaaucca

SEQ ID NO: 289157 - RNA, 23 nt, Human
aacuccugaccucagaugaccca

SEQ ID NO: 289158 - RNA, 22 nt, Human
aacuccugaccucagaugaucc

SEQ ID NO: 289159 - RNA, 23 nt, Human
aacuccugaccucagaugaucca

SEQ ID NO: 289160 - RNA, 23 nt, Human
aacuccugaccucagaugaucua

SEQ ID NO: 289161 - RNA, 23 nt, Human
aacuccugaccucagaugauuca

SEQ ID NO: 289162 - RNA, 23 nt, Human
aacuccugaccucagauggucca

SEQ ID NO: 289163 - RNA, 22 nt, Human
aacuccugaccucaggcaaucu

SEQ ID NO: 289164 - RNA, 22 nt, Human
aacuccugaccucaggcgaucc

SEQ ID NO: 289165 - RNA, 23 nt, Human
aacuccugaccucaggcgaucca

SEQ ID NO: 289166 - RNA, 23 nt, Human
aacuccugaccucaggcgaucua

SEQ ID NO: 289167 - RNA, 23 nt, Human
aacuccugaccucaggggaucca

SEQ ID NO: 289168 - RNA, 21 nt, Human
aacuccugaccucagguaauc

SEQ ID NO: 289169 - RNA, 22 nt, Human
aacuccugaccucagguaaucc

SEQ ID NO: 289170 - RNA, 23 nt, Human
aacuccugaccucagguaaucca

SEQ ID NO: 289171 - RNA, 24 nt, Human
aacuccugaccucagguaauccuc

SEQ ID NO: 289172 - RNA, 18 nt, Human
aacuccugaccucaggug

SEQ ID NO: 289173 - RNA, 23 nt, Human
aacuccugaccucaggugagcca

SEQ ID NO: 289174 - RNA, 21 nt, Human
aacuccugaccucaggugauc

SEQ ID NO: 289175 - RNA, 22 nt, Human
aacuccugaccucaggugaucc

SEQ ID NO: 289176 - RNA, 23 nt, Human
aacuccugaccucaggugaucca

SEQ ID NO: 289177 - RNA, 24 nt, Human
aacuccugaccucaggugauccuc

SEQ ID NO: 289178 - RNA, 22 nt, Human
aacuccugaccucaggugaucu

SEQ ID NO: 289179 - RNA, 23 nt, Human
aacuccugaccucaggugaucua

SEQ ID NO: 289180 - RNA, 23 nt, Human
aacuccugaccucaggugaugca

SEQ ID NO: 289181 - RNA, 23 nt, Human
aacuccugaccucaggugcucca

SEQ ID NO: 289182 - RNA, 23 nt, Human
aacuccugaccucaguugaucca

SEQ ID NO: 289183 - RNA, 21 nt, Human
aacuccugaccucaugaucca

SEQ ID NO: 289184 - RNA, 23 nt, Human
aacuccugaccucauguaaucca

SEQ ID NO: 289185 - RNA, 23 nt, Human
aacuccugaccuccagugaucca

SEQ ID NO: 289186 - RNA, 21 nt, Human
aacuccugaccucguaaucca

SEQ ID NO: 289187 - RNA, 32 nt, Human
aacuccugaccucgugauacucagccucccaa

SEQ ID NO: 289188 - RNA, 20 nt, Human
aacuccugaccucgugaucc

SEQ ID NO: 289189 - RNA, 21 nt, Human
aacuccugaccucgugaucca

SEQ ID NO: 289190 - RNA, 21 nt, Human
aacuccugaccucgugaugca

SEQ ID NO: 289191 - RNA, 20 nt, Human
aacuccugaccucuugaucc

SEQ ID NO: 289192 - RNA, 24 nt, Human
aacuccugaccugaagcgauccuc

SEQ ID NO: 289193 - RNA, 22 nt, Human
aacuccugaccugaagugaucc

SEQ ID NO: 289194 - RNA, 22 nt, Human
aacuccugaccuggugauccuc

SEQ ID NO: 289195 - RNA, 32 nt, Human
aacuccugaccuuaaaugauuugccugccucg

SEQ ID NO: 289196 - RNA, 22 nt, Human
aacuccugaccuuaagugaucc

SEQ ID NO: 289197 - RNA, 23 nt, Human
aacuccugaccuuaagugaucca

SEQ ID NO: 289198 - RNA, 23 nt, Human
aacuccugaccuuaggugaucca

SEQ ID NO: 289199 - RNA, 20 nt, Human
aacuccugaccuuauaaucc

SEQ ID NO: 289200 - RNA, 24 nt, Human
aacuccugaccuucaggugaucca

SEQ ID NO: 289201 - RNA, 23 nt, Human
aacuccugaccuuggguaaucca

SEQ ID NO: 289202 - RNA, 22 nt, Human
aacuccugaccuuggugaucca

SEQ ID NO: 289203 - RNA, 20 nt, Human
aacuccugaccuugugaucc

SEQ ID NO: 289204 - RNA, 21 nt, Human
aacuccugaccuugugaucca

SEQ ID NO: 289205 - RNA, 32 nt, Human
aacuccugaccuugugaucugccugccucggc

SEQ ID NO: 289206 - RNA, 22 nt, Human
aacuccugaccuugugaugcuc

SEQ ID NO: 289207 - RNA, 32 nt, Human
aacuccugaccuugugauuugcccgccucagc

SEQ ID NO: 289208 - RNA, 21 nt, Human
aacuccugaccuuguggucca

SEQ ID NO: 289209 - RNA, 20 nt, Human
aacuccugacgucgugaucc

SEQ ID NO: 289210 - RNA, 22 nt, Human
aacuccugacucgaagugaucc

SEQ ID NO: 289211 - RNA, 22 nt, Human
aacuccugacuucaaaugaucc

SEQ ID NO: 289212 - RNA, 23 nt, Human
aacuccugacuucaaaugaucca

SEQ ID NO: 289213 - RNA, 22 nt, Human
aacuccugacuucaagugaucc

SEQ ID NO: 289214 - RNA, 22 nt, Human
aacuccugacuucaggugaucc

SEQ ID NO: 289215 - RNA, 21 nt, Human
aacuccugacuuugugaucca

SEQ ID NO: 289216 - RNA, 22 nt, Human
aacuccugagcccaggugaucc

SEQ ID NO: 289217 - RNA, 24 nt, Human
aacuccugagcccaggugauccuc

SEQ ID NO: 289218 - RNA, 24 nt, Human
aacuccugagcucaagcaauccuc

SEQ ID NO: 289219 - RNA, 22 nt, Human
aacuccugagcucaagcgaucc

SEQ ID NO: 289220 - RNA, 24 nt, Human
aacuccugagcucaagcgauccuc

SEQ ID NO: 289221 - RNA, 24 nt, Human
aacuccugagcucaaguaaucuuc

SEQ ID NO: 289222 - RNA, 22 nt, Human
aacuccugagcucaagugaucc

SEQ ID NO: 289223 - RNA, 23 nt, Human
aacuccugagcucaagugaucca

SEQ ID NO: 289224 - RNA, 24 nt, Human
aacuccugagcucaagugauccuc

SEQ ID NO: 289225 - RNA, 24 nt, Human
aacuccugagcucaagugaucuuc

SEQ ID NO: 289226 - RNA, 20 nt, Human
aacuccugagcucaggugau

SEQ ID NO: 289227 - RNA, 22 nt, Human
aacuccugagcucaggugaucc

SEQ ID NO: 289228 - RNA, 23 nt, Human
aacuccugagcucaggugaucca

SEQ ID NO: 289229 - RNA, 23 nt, Human
aacuccugagucaagugauccuc

SEQ ID NO: 289230 - RNA, 23 nt, Human
aacuccugaucucaggcaaucca

SEQ ID NO: 289231 - RNA, 20 nt, Human
aacuccugcaacaagugucc

SEQ ID NO: 289232 - RNA, 32 nt, Human
aacuccugcauuccaaccagccugggugacag

SEQ ID NO: 289233 - RNA, 22 nt, Human
aacuccugcccucaagugaucc

SEQ ID NO: 289234 - RNA, 23 nt, Human
aacuccugcccucaagugaucca

SEQ ID NO: 289235 - RNA, 32 nt, Human
aacuccugccugcccuccagacugucugccca

SEQ ID NO: 289236 - RNA, 32 nt, Human
aacuccugcuccugaaucuucugaugggcccc

SEQ ID NO: 289237 - RNA, 22 nt, Human
aacuccugcucucaagugaucc

SEQ ID NO: 289238 - RNA, 24 nt, Human
aacuccugcucucaagugauccuc

SEQ ID NO: 289239 - RNA, 32 nt, Human
aacuccugcuuauaguauacuacacaguucaa

SEQ ID NO: 289240 - RNA, 32 nt, Human
aacuccuggacaacauacuaugcuauuugaau

SEQ ID NO: 289241 - RNA, 24 nt, Human
aacuccuggacccaagccauccuc

SEQ ID NO: 289242 - RNA, 24 nt, Human
aacuccuggacccaagcgauccuc

SEQ ID NO: 289243 - RNA, 24 nt, Human
aacuccuggacucaagcaauccuc

SEQ ID NO: 289244 - RNA, 24 nt, Human
aacuccuggacucaagcaguccuc

SEQ ID NO: 289245 - RNA, 24 nt, Human
aacuccuggacucaagcgaucuuc

SEQ ID NO: 289246 - RNA, 20 nt, Human
aacuccuggacucaagugau

SEQ ID NO: 289247 - RNA, 21 nt, Human
aacuccuggacucaagugauc

SEQ ID NO: 289248 - RNA, 24 nt, Human
aacuccuggacucaagugauccuc

SEQ ID NO: 289249 - RNA, 24 nt, Human
aacuccuggacucaugggauccuc

SEQ ID NO: 289250 - RNA, 24 nt, Human
aacuccuggacugaagcgguccuc

SEQ ID NO: 289251 - RNA, 24 nt, Human
aacuccuggacuuagacgauccuc

SEQ ID NO: 289252 - RNA, 24 nt, Human
aacuccuggcaucaagcgauccuc

SEQ ID NO: 289253 - RNA, 24 nt, Human
aacuccuggccucaaaugaucuuc

SEQ ID NO: 289254 - RNA, 24 nt, Human
aacuccuggccucaagcaauccuc

SEQ ID NO: 289255 - RNA, 24 nt, Human
aacuccuggccucaagcaauccuu

SEQ ID NO: 289256 - RNA, 24 nt, Human
aacuccuggccucaagcaguccuc

SEQ ID NO: 289257 - RNA, 24 nt, Human
aacuccuggccucaagccauccuc

SEQ ID NO: 289258 - RNA, 24 nt, Human
aacuccuggccucaagcgauccuc

SEQ ID NO: 289259 - RNA, 24 nt, Human
aacuccuggccucaagggauccuc

SEQ ID NO: 289260 - RNA, 22 nt, Human
aacuccuggccucaagugaucc

SEQ ID NO: 289261 - RNA, 24 nt, Human
aacuccuggccucaagugauccuc

SEQ ID NO: 289262 - RNA, 24 nt, Human
aacuccuggccucaagugauccuu

SEQ ID NO: 289263 - RNA, 24 nt, Human
aacuccuggccucaagugaucguc

SEQ ID NO: 289264 - RNA, 21 nt, Human
aacuccuggccucaagugauu

SEQ ID NO: 289265 - RNA, 24 nt, Human
aacuccuggccucaagugauucuc

SEQ ID NO: 289266 - RNA, 24 nt, Human
aacuccuggccucaagugguccuc

SEQ ID NO: 289267 - RNA, 23 nt, Human
aacuccuggccucaggcgaucca

SEQ ID NO: 289268 - RNA, 22 nt, Human
aacuccuggccucaggugaccc

SEQ ID NO: 289269 - RNA, 24 nt, Human
aacuccuggccuccagugauccuc

SEQ ID NO: 289270 - RNA, 24 nt, Human
aacuccuggccuuaagugauccuc

SEQ ID NO: 289271 - RNA, 22 nt, Human
aacuccuggcuacaagugaucc

SEQ ID NO: 289272 - RNA, 23 nt, Human
aacuccuggcucaagugaucucc

SEQ ID NO: 289273 - RNA, 23 nt, Human
aacuccuggcucaaucgauccuc

SEQ ID NO: 289274 - RNA, 24 nt, Human
aacuccuggcuucaagcaauccuu

SEQ ID NO: 289275 - RNA, 24 nt, Human
aacuccuggcuucaagcaguccuc

SEQ ID NO: 289276 - RNA, 24 nt, Human
aacuccuggcuucaagcgauccuc

SEQ ID NO: 289277 - RNA, 24 nt, Human
aacuccuggcuucaagcgauucuc

SEQ ID NO: 289278 - RNA, 24 nt, Human
aacuccuggcuucaagcuauccuc

SEQ ID NO: 289279 - RNA, 22 nt, Human
aacuccuggcuucaagugaucc

SEQ ID NO: 289280 - RNA, 24 nt, Human
aacuccuggcuucaagugauccuc

SEQ ID NO: 289281 - RNA, 32 nt, Human
aacuccuggcuuccgguaucaggcuggguuga

SEQ ID NO: 289282 - RNA, 22 nt, Human
aacuccuggcuucgggugaucc

SEQ ID NO: 289283 - RNA, 24 nt, Human
aacuccugggaucaaaugguccuc

SEQ ID NO: 289284 - RNA, 24 nt, Human
aacuccugggaucaagugauccuc

SEQ ID NO: 289285 - RNA, 22 nt, Human
aacuccugggcacaagcaaucc

SEQ ID NO: 289286 - RNA, 24 nt, Human
aacuccugggcacaagugauccuc

SEQ ID NO: 289287 - RNA, 23 nt, Human
aacuccugggcccaagcaauccu

SEQ ID NO: 289288 - RNA, 24 nt, Human
aacuccugggcccaagcaauccuc

SEQ ID NO: 289289 - RNA, 24 nt, Human
aacuccugggcccaagcaaucuuc

SEQ ID NO: 289290 - RNA, 24 nt, Human
aacuccugggcccaagugauccuc

SEQ ID NO: 289291 - RNA, 23 nt, Human
aacuccugggcccaucaguccuc

SEQ ID NO: 289292 - RNA, 22 nt, Human
aacuccugggcuaaggauccuc

SEQ ID NO: 289293 - RNA, 24 nt, Human
aacuccugggcuacaguuacccuc

SEQ ID NO: 289294 - RNA, 23 nt, Human
aacuccugggcucaaagauccuc

SEQ ID NO: 289295 - RNA, 24 nt, Human
aacuccugggcucaagagauccuc

SEQ ID NO: 289296 - RNA, 32 nt, Human
aacuccugggcucaagagggaggaucacauuu

SEQ ID NO: 289297 - RNA, 24 nt, Human
aacuccugggcucaagcaauccuc

SEQ ID NO: 289298 - RNA, 24 nt, Human
aacuccugggcucaagcaaugcuc

SEQ ID NO: 289299 - RNA, 24 nt, Human
aacuccugggcucaagcaguccuc

SEQ ID NO: 289300 - RNA, 24 nt, Human
aacuccugggcucaagccauccuc

SEQ ID NO: 289301 - RNA, 24 nt, Human
aacuccugggcucaagcgagccuc

SEQ ID NO: 289302 - RNA, 24 nt, Human
aacuccugggcucaagcgauacuc

SEQ ID NO: 289303 - RNA, 22 nt, Human
aacuccugggcucaagcgaucc

SEQ ID NO: 289304 - RNA, 23 nt, Human
aacuccugggcucaagcgauccu

SEQ ID NO: 289305 - RNA, 24 nt, Human
aacuccugggcucaagcgauccuc

SEQ ID NO: 289306 - RNA, 24 nt, Human
aacuccugggcucaagcgauccuu

SEQ ID NO: 289307 - RNA, 24 nt, Human
aacuccugggcucaagcgaucuuc

SEQ ID NO: 289308 - RNA, 24 nt, Human
aacuccugggcucaagcuauccuc

SEQ ID NO: 289309 - RNA, 24 nt, Human
aacuccugggcucaaggcauccuc

SEQ ID NO: 289310 - RNA, 24 nt, Human
aacuccugggcucaaguaauccuc

SEQ ID NO: 289311 - RNA, 24 nt, Human
aacuccugggcucaagugaaccuc

SEQ ID NO: 289312 - RNA, 22 nt, Human
aacuccugggcucaagugaucc

SEQ ID NO: 289313 - RNA, 24 nt, Human
aacuccugggcucaagugauccuc

SEQ ID NO: 289314 - RNA, 24 nt, Human
aacuccugggcucaagugauccuu

SEQ ID NO: 289315 - RNA, 24 nt, Human
aacuccugggcucaagugaucuuc

SEQ ID NO: 289316 - RNA, 24 nt, Human
aacuccugggcucaagugaugcuc

SEQ ID NO: 289317 - RNA, 21 nt, Human
aacuccugggcucaagugauu

SEQ ID NO: 289318 - RNA, 24 nt, Human
aacuccugggcucaagugauucuc

SEQ ID NO: 289319 - RNA, 23 nt, Human
aacuccugggcucaaugauccuc

SEQ ID NO: 289320 - RNA, 22 nt, Human
aacuccugggcucagaugaucc

SEQ ID NO: 289321 - RNA, 23 nt, Human
aacuccugggcucagaugaucca

SEQ ID NO: 289322 - RNA, 24 nt, Human
aacuccugggcucagaugauccuc

SEQ ID NO: 289323 - RNA, 24 nt, Human
aacuccugggcucaggccauccuc

SEQ ID NO: 289324 - RNA, 22 nt, Human
aacuccugggcucaggcgaucc

SEQ ID NO: 289325 - RNA, 23 nt, Human
aacuccugggcucaggcgaucca

SEQ ID NO: 289326 - RNA, 23 nt, Human
aacuccugggcucagugauccuc

SEQ ID NO: 289327 - RNA, 24 nt, Human
aacuccugggcucaugcaauccuc

SEQ ID NO: 289328 - RNA, 24 nt, Human
aacuccugggcuccagugacccuc

SEQ ID NO: 289329 - RNA, 24 nt, Human
aacuccugggcuccagugauccuc

SEQ ID NO: 289330 - RNA, 24 nt, Human
aacuccugggcucgaaugauccuc

SEQ ID NO: 289331 - RNA, 24 nt, Human
aacuccugggcucgggugauccuc

SEQ ID NO: 289332 - RNA, 24 nt, Human
aacuccugggcugaaacaauccuc

SEQ ID NO: 289333 - RNA, 24 nt, Human
aacuccugggcugaagcaguccuc

SEQ ID NO: 289334 - RNA, 24 nt, Human
aacuccugggcuuaagugacccuc

SEQ ID NO: 289335 - RNA, 24 nt, Human
aacuccuggggucaagcaacccuc

SEQ ID NO: 289336 - RNA, 23 nt, Human
aacuccuggguucaagagaucca

SEQ ID NO: 289337 - RNA, 24 nt, Human
aacuccuggguucaagcaguccuc

SEQ ID NO: 289338 - RNA, 24 nt, Human
aacuccuggucacaaguaauccuc

SEQ ID NO: 289339 - RNA, 22 nt, Human
aacuccuggucucaagugaucc

SEQ ID NO: 289340 - RNA, 24 nt, Human
aacuccuggucucaagugauccuc

SEQ ID NO: 289341 - RNA, 24 nt, Human
aacuccuggucuccagugauccuc

SEQ ID NO: 289342 - RNA, 32 nt, Human
aacuccugguuguuugcuggggugggggagca

SEQ ID NO: 289343 - RNA, 24 nt, Human
aacuccugguuucaagcgauccuc

SEQ ID NO: 289344 - RNA, 32 nt, Human
aacuccugguuugaggguuuuaauaccuguag

SEQ ID NO: 289345 - RNA, 29 nt, Human
aacuccugucugcuaucgagcccuggugc

SEQ ID NO: 289346 - RNA, 24 nt, Human
aacuccugugcucaagugacccuc

SEQ ID NO: 289347 - RNA, 22 nt, Human
aacuccugugcucaagugaucc

SEQ ID NO: 289348 - RNA, 32 nt, Human
aacuccuguuuaccuuucagacaaacccuaaa

SEQ ID NO: 289349 - RNA, 32 nt, Human
aacuccuucagcagguguucuucaccauucgu

SEQ ID NO: 289350 - RNA, 32 nt, Human
aacuccuucccaacccuccccuccagggacga

SEQ ID NO: 289351 - RNA, 32 nt, Human
aacuccuuccccaacaccuccuucccaaacau

SEQ ID NO: 289352 - RNA, 32 nt, Human
aacuccuugaggggaaggugggugaagaacaa

SEQ ID NO: 289353 - RNA, 32 nt, Human
aacuccuuggggugcugaucucgaguguuauu

SEQ ID NO: 289354 - RNA, 32 nt, Human
aacuccuuuauggugugacugugucuuauucc

SEQ ID NO: 289355 - RNA, 32 nt, Human
aacuccuuucagccacaugccccaggcucucg

SEQ ID NO: 289356 - RNA, 32 nt, Human
aacuccuuugcucugcugucauccuguguacc

SEQ ID NO: 289357 - RNA, 32 nt, Human
aacucgaggagaacccagaccaggacagggag

SEQ ID NO: 289358 - RNA, 32 nt, Human
aacucgagguggggcaggauggguagggagug

SEQ ID NO: 289359 - RNA, 32 nt, Human
aacucgauagagcaaggaaaccagaaaggugu

SEQ ID NO: 289360 - RNA, 32 nt, Human
aacucgcacaucucuccugucuguuaguaaua

SEQ ID NO: 289361 - RNA, 32 nt, Human
aacucgcagacccucuggggguaggggcuguu

SEQ ID NO: 289362 - RNA, 32 nt, Human
aacucgcagccuguggcugugguccucuuaua

SEQ ID NO: 289363 - RNA, 32 nt, Human
aacucgcaguccucuagaacagcuucagauua

SEQ ID NO: 289364 - RNA, 32 nt, Human
aacucgccgcucccugggucccuucccagugg

SEQ ID NO: 289365 - RNA, 32 nt, Human
aacucgcgagccccagagcucgcucagccgcc

SEQ ID NO: 289366 - RNA, 32 nt, Human
aacucgcuagguuaaaucugcaucaaaaucua

SEQ ID NO: 289367 - RNA, 32 nt, Human
aacucggaagaaaagagaggaggaaaaggacu

SEQ ID NO: 289368 - RNA, 32 nt, Human
aacucggacaucacccuccugaggcccucagc

SEQ ID NO: 289369 - RNA, 32 nt, Human
aacucggauucccagccucacucccucugugu

SEQ ID NO: 289370 - RNA, 32 nt, Human
aacucggcccucaaacccucucccucucugcc

SEQ ID NO: 289371 - RNA, 32 nt, Human
aacucggcucaagugaucuaccugccucugcc

SEQ ID NO: 289372 - RNA, 32 nt, Human
aacucgggagacuguaggugccgugagccgag

SEQ ID NO: 289373 - RNA, 32 nt, Human
aacucgggaggaagagguugcagugagcugag

SEQ ID NO: 289374 - RNA, 32 nt, Human
aacucgggaggcagagguugcagugagcugag

SEQ ID NO: 289375 - RNA, 32 nt, Human
aacucgggaggcagagguugucaugagcugag

SEQ ID NO: 289376 - RNA, 32 nt, Human
aacucgggaggcagagguuucagggagccaag

SEQ ID NO: 289377 - RNA, 32 nt, Human
aacucgggaggcgaagguugcagugagccgag

SEQ ID NO: 289378 - RNA, 32 nt, Human
aacucgggaggcggagguugcagugagccgag

SEQ ID NO: 289379 - RNA, 32 nt, Human
aacucgggaggcggauguugcagugagccaau

SEQ ID NO: 289380 - RNA, 23 nt, Human
aacucgggagguagagguugcag

SEQ ID NO: 289381 - RNA, 32 nt, Human
aacucgggagguagagguugcagugagccaag

SEQ ID NO: 289382 - RNA, 32 nt, Human
aacucgggaggugaaaguugcagugagccgag

SEQ ID NO: 289383 - RNA, 32 nt, Human
aacucgggagguggagguggcagugagccgag

SEQ ID NO: 289384 - RNA, 32 nt, Human
aacucgggagguggagguugcagucagccaag

SEQ ID NO: 289385 - RNA, 26 nt, Human
aacucgggagguggagguugcaguga

SEQ ID NO: 289386 - RNA, 32 nt, Human
aacucgggagguggagguugcagugagcugag

SEQ ID NO: 289387 - RNA, 32 nt, Human
aacucgggcugccggggcaagugucuucauga

SEQ ID NO: 289388 - RNA, 32 nt, Human
aacucggggccaccuccacuccaugugcccag

SEQ ID NO: 289389 - RNA, 32 nt, Human
aacucgggugggggagguugcaaugagccgag

SEQ ID NO: 289390 - RNA, 32 nt, Human
aacucguagagauguucucagcaggaagacag

SEQ ID NO: 289391 - RNA, 32 nt, Human
aacucgucauuuacauuagauauuucuccuaa

SEQ ID NO: 289392 - RNA, 32 nt, Human
aacucgugguugcuuuggacaggugugauuug

SEQ ID NO: 289393 - RNA, 24 nt, Human
aacucguguccuuauaaaaagcag

SEQ ID NO: 289394 - RNA, 32 nt, Human
aacucuaauagcuguuucccuuucuauucuga

SEQ ID NO: 289395 - RNA, 32 nt, Human
aacucuaauccauccagcaccauggagcagcc

SEQ ID NO: 289396 - RNA, 32 nt, Human
aacucuaaugggaaacugggccugucuaccuu

SEQ ID NO: 289397 - RNA, 22 nt, Human
aacucuaccaccugggcuggaa

SEQ ID NO: 289398 - RNA, 32 nt, Human
aacucuaccucccucacucagcuccuuucccc

SEQ ID NO: 289399 - RNA, 32 nt, Human
aacucuacuguaacuguuuucuugaaaugaag

SEQ ID NO: 289400 - RNA, 32 nt, Human
aacucuagccuggguaacagagugagacucca

SEQ ID NO: 289401 - RNA, 32 nt, Human
aacucuagcuguaucauccucucaccugucau

SEQ ID NO: 289402 - RNA, 32 nt, Human
aacucuaggaaggggaaauaucugugucuuga

SEQ ID NO: 289403 - RNA, 32 nt, Human
aacucuauguaguuauagaaagugaauaugca

SEQ ID NO: 289404 - RNA, 32 nt, Human
aacucucaagcagacgugagugugacuuuuug

SEQ ID NO: 289405 - RNA, 32 nt, Human
aacucucaccaggucaguugugcaucaaggcu

SEQ ID NO: 289406 - RNA, 32 nt, Human
aacucucaccggcuccccaagcccuccccacc

SEQ ID NO: 289407 - RNA, 32 nt, Human
aacucucagaagcagaggaggcaggugggugg

SEQ ID NO: 289408 - RNA, 32 nt, Human
aacucucagcauauggacggccagcuguggcc

SEQ ID NO: 289409 - RNA, 32 nt, Human
aacucuccaccuuccagcaccauuaucagagg

SEQ ID NO: 289410 - RNA, 32 nt, Human
aacucuccagaagaaggguuuugaucauucca

SEQ ID NO: 289411 - RNA, 32 nt, Human
aacucuccauucucuuauccccucaagcccug

SEQ ID NO: 289412 - RNA, 32 nt, Human
aacucucccacuccaaacuguguauagucaac

SEQ ID NO: 289413 - RNA, 32 nt, Human
aacucuccccacugcucuuggcuuugacagua

SEQ ID NO: 289414 - RNA, 32 nt, Human
aacucucccugcagccacauguuucccaugac

SEQ ID NO: 289415 - RNA, 32 nt, Human
aacucucccuuucccuaccuaccuuccuuuua

SEQ ID NO: 289416 - RNA, 32 nt, Human
aacucuccgaggaggaggaggaggagggagga

SEQ ID NO: 289417 - RNA, 32 nt, Human
aacucuccgaucagaaucaucugggaagcauu

SEQ ID NO: 289418 - RNA, 32 nt, Human
aacucuccuggccuggccaucucccuccccag

SEQ ID NO: 289419 - RNA, 32 nt, Human
aacucuccuugcaaaauacugcacucugcugu

SEQ ID NO: 289420 - RNA, 19 nt, Human
aacucucgucuugguugaa

SEQ ID NO: 289421 - RNA, 32 nt, Human
aacucucuaaugcaccugccucagagauuccc

SEQ ID NO: 289422 - RNA, 32 nt, Human
aacucucucacucagugaccucagucaccaac

SEQ ID NO: 289423 - RNA, 32 nt, Human
aacucucucccaggaccucggaugaccauacu

SEQ ID NO: 289424 - RNA, 32 nt, Human
aacucucuccuggucgcuuugccaucaagaaa

SEQ ID NO: 289425 - RNA, 32 nt, Human
aacucucuuccagcccuuuccucugcccccac

SEQ ID NO: 289426 - RNA, 32 nt, Human
aacucugaaaaaugaagaaaagaaggaaacug

SEQ ID NO: 289427 - RNA, 32 nt, Human
aacucugaacaacccacggcagcuucuagccc

SEQ ID NO: 289428 - RNA, 32 nt, Human
aacucugaaugauggcuggagauugucuauca

SEQ ID NO: 289429 - RNA, 32 nt, Human
aacucugagcccccggcuccgagcucccucga

SEQ ID NO: 289430 - RNA, 32 nt, Human
aacucugaguuaagcacgaacuccuuucuuuu

SEQ ID NO: 289431 - RNA, 19 nt, Human
aacucugcaaccacacuca

SEQ ID NO: 289432 - RNA, 32 nt, Human
aacucugcaccuuccuccaccaggagccuggg

SEQ ID NO: 289433 - RNA, 32 nt, Human
aacucugcagagugccuucucccgcagcccua

SEQ ID NO: 289434 - RNA, 32 nt, Human
aacucugcagcaggcuggugcuguguaguggc

SEQ ID NO: 289435 - RNA, 32 nt, Human
aacucugcaggagaaaggcagcaugguacaug

SEQ ID NO: 289436 - RNA, 32 nt, Human
aacucugccaucuucccucccacaauuagagu

SEQ ID NO: 289437 - RNA, 32 nt, Human
aacucugcccuggcuucucugguucuucccug

SEQ ID NO: 289438 - RNA, 32 nt, Human
aacucugccuaccagguucaagcgauucuccu

SEQ ID NO: 289439 - RNA, 32 nt, Human
aacucugccucccagguucacgccauccuccu

SEQ ID NO: 289440 - RNA, 32 nt, Human
aacucugccucccggguucaagcaauucuccu

SEQ ID NO: 289441 - RNA, 32 nt, Human
aacucugcucacugcaaccuccgccucccagg

SEQ ID NO: 289442 - RNA, 32 nt, Human
aacucugcucuuccugucagucucaaagcaca

SEQ ID NO: 289443 - RNA, 32 nt, Human
aacucugcugcauggcagaugccuagguggaa

SEQ ID NO: 289444 - RNA, 32 nt, Human
aacucugcuugauuuuugccucuuccagucuu

SEQ ID NO: 289445 - RNA, 32 nt, Human
aacucuggaguccgagguaacagaacaccugu

SEQ ID NO: 289446 - RNA, 32 nt, Human
aacucuggagugagaggaugccagaggaucaa

SEQ ID NO: 289447 - RNA, 32 nt, Human
aacucuggcucugccaccugcugcuccuguga

SEQ ID NO: 289448 - RNA, 32 nt, Human
aacucugggaccccucugaugucuuggagcac

SEQ ID NO: 289449 - RNA, 32 nt, Human
aacucuggggucagggagagacccuaccccca

SEQ ID NO: 289450 - RNA, 32 nt, Human
aacucuggucucacugccuuaucucacaccaa

SEQ ID NO: 289451 - RNA, 32 nt, Human
aacucuggugaaugaaaaaugcuauuaauaua

SEQ ID NO: 289452 - RNA, 32 nt, Human
aacucuggugaccugggcugcccucucagaaa

SEQ ID NO: 289453 - RNA, 18 nt, Human
aacucuguacccauugaa

SEQ ID NO: 289454 - RNA, 32 nt, Human
aacucuguauucucccuugucauuccaaccaa

SEQ ID NO: 289455 - RNA, 32 nt, Human
aacucugucacccagacuggagugcaguggca

SEQ ID NO: 289456 - RNA, 32 nt, Human
aacucugucugcuuccugaagaugcucauaga

SEQ ID NO: 289457 - RNA, 32 nt, Human
aacucugugaggugaaugcacacaucacaaag

SEQ ID NO: 289458 - RNA, 32 nt, Human
aacucugugcaggggugggggcgggucuaacu

SEQ ID NO: 289459 - RNA, 32 nt, Human
aacucugugcugcuggguggaagcuuuauagu

SEQ ID NO: 289460 - RNA, 32 nt, Human
aacucuguggaagggaagggguugccucaaaa

SEQ ID NO: 289461 - RNA, 32 nt, Human
aacucugugguuucaucauuccuucuuaguug

SEQ ID NO: 289462 - RNA, 32 nt, Human
aacucuguuacccaggcuggagugcaguggug

SEQ ID NO: 289463 - RNA, 32 nt, Human
aacucuguucucccccuuccccuagacuuuuc

SEQ ID NO: 289464 - RNA, 32 nt, Human
aacucuguucugaucagugggugggugaggua

SEQ ID NO: 289465 - RNA, 32 nt, Human
aacucuuaagguuaaugccaaaauggaucaag

SEQ ID NO: 289466 - RNA, 32 nt, Human
aacucuuaccccaacagaaauguacccgaaga

SEQ ID NO: 289467 - RNA, 32 nt, Human
aacucuuacucugugauucugaugcaaacaua

SEQ ID NO: 289468 - RNA, 32 nt, Human
aacucuuagauacuuugcguccuuccuauuug

SEQ ID NO: 289469 - RNA, 32 nt, Human
aacucuucacucugcugaagcuccuaauggaa

SEQ ID NO: 289470 - RNA, 32 nt, Human
aacucuucagcccuguguucugcuggggccau

SEQ ID NO: 289471 - RNA, 32 nt, Human
aacucuucagguaccagcaccaggaagacuga

SEQ ID NO: 289472 - RNA, 32 nt, Human
aacucuuccacuuuuacauguugacuguguca

SEQ ID NO: 289473 - RNA, 32 nt, Human
aacucuuccugagaccaaacacucgucaucca

SEQ ID NO: 289474 - RNA, 32 nt, Human
aacucuucuaugccuggaugugguguucagga

SEQ ID NO: 289475 - RNA, 22 nt, Human
aacucuucucccccuugucaaa

SEQ ID NO: 289476 - RNA, 32 nt, Human
aacucuucucuuccgcuccugccuccugucgg

SEQ ID NO: 289477 - RNA, 23 nt, Human
aacucuugaccucaaaugaucca

SEQ ID NO: 289478 - RNA, 23 nt, Human
aacucuugacuucaagugaucca

SEQ ID NO: 289479 - RNA, 32 nt, Human
aacucuugauaaagggcuguuuugccauggaa

SEQ ID NO: 289480 - RNA, 32 nt, Human
aacucuugauucuaucacaaaacacugcaccc

SEQ ID NO: 289481 - RNA, 32 nt, Human
aacucuugcacgccaucauagacuucauacug

SEQ ID NO: 289482 - RNA, 32 nt, Human
aacucuugcagaggaaggauuuggaauauuuc

SEQ ID NO: 289483 - RNA, 32 nt, Human
aacucuugccccuccuccucugggcacagggu

SEQ ID NO: 289484 - RNA, 32 nt, Human
aacucuugcuccccaagaaagcuguaucccca

SEQ ID NO: 289485 - RNA, 21 nt, Human
aacucuugcuucauccaggca

SEQ ID NO: 289486 - RNA, 32 nt, Human
aacucuugcuuuaugccggccuucccacacca

SEQ ID NO: 289487 - RNA, 32 nt, Human
aacucuugggcaucccccucaccagcugacug

SEQ ID NO: 289488 - RNA, 32 nt, Human
aacucuugguaucuuuacugcaucauagucaa

SEQ ID NO: 289489 - RNA, 32 nt, Human
aacucuuguccaggcuggaggagugcagucgu

SEQ ID NO: 289490 - RNA, 32 nt, Human
aacucuugugaugaugucauugccauguagug

SEQ ID NO: 289491 - RNA, 32 nt, Human
aacucuuucaugccaggagaagccuccuuaaa

SEQ ID NO: 289492 - RNA, 32 nt, Human
aacucuuucuagaaagcucuuugaggccacug

SEQ ID NO: 289493 - RNA, 32 nt, Human
aacucuuugagaaacaacaauuucuacuuuga

SEQ ID NO: 289494 - RNA, 32 nt, Human
aacucuuugcugcugcccauguuucaaauacu

SEQ ID NO: 289495 - RNA, 32 nt, Human
aacucuuuguuauuugaaaacauguuuauuuu

SEQ ID NO: 289496 - RNA, 32 nt, Human
aacugaaaaaggacuuuucuaccagguaugac

SEQ ID NO: 289497 - RNA, 32 nt, Human
aacugaaaacaaccuggaaguccagugauggg

SEQ ID NO: 289498 - RNA, 32 nt, Human
aacugaaaacuuuuuggcugggcacggugccu

SEQ ID NO: 289499 - RNA, 32 nt, Human
aacugaaaagacuauguagugaaauguauuuu

SEQ ID NO: 289500 - RNA, 28 nt, Human
aacugaaaucggcuagcagcacugugag

SEQ ID NO: 289501 - RNA, 28 nt, Human
aacugaaaucugcuagcagcacugugag

SEQ ID NO: 289502 - RNA, 32 nt, Human
aacugaaauucauguaagcucucagauguuuu

SEQ ID NO: 289503 - RNA, 32 nt, Human
aacugaaauuccaggguagacccuaaggccgg

SEQ ID NO: 289504 - RNA, 32 nt, Human
aacugaacaaagccuuaauuuucucccaagcu

SEQ ID NO: 289505 - RNA, 32 nt, Human
aacugaacaggaacagaagagauuacacuaca

SEQ ID NO: 289506 - RNA, 32 nt, Human
aacugaacauggccacacaggccucacagcug

SEQ ID NO: 289507 - RNA, 32 nt, Human
aacugaaccagcucucagaauauuuccuuacc

SEQ ID NO: 289508 - RNA, 32 nt, Human
aacugaacccgggaggcggaggcugcaguggg

SEQ ID NO: 289509 - RNA, 32 nt, Human
aacugaacucaagacauggcugcccagugugu

SEQ ID NO: 289510 - RNA, 32 nt, Human
aacugaacuguagaagcagagcagcagcaguu

SEQ ID NO: 289511 - RNA, 32 nt, Human
aacugaagaaaauaucuugcuaauuuuaccua

SEQ ID NO: 289512 - RNA, 32 nt, Human
aacugaagaagaugccucaagggucaucccua

SEQ ID NO: 289513 - RNA, 32 nt, Human
aacugaagaguguuugaguuucauucacacaa

SEQ ID NO: 289514 - RNA, 32 nt, Human
aacugaagcaggugggagaagugaggcuguga

SEQ ID NO: 289515 - RNA, 32 nt, Human
aacugaagccaaaaugaccuucaagggauuuc

SEQ ID NO: 289516 - RNA, 32 nt, Human
aacugaagcgcccugaaccccagccuguccgu

SEQ ID NO: 289517 - RNA, 32 nt, Human
aacugaaggaacuagguaggagaggaaggauu

SEQ ID NO: 289518 - RNA, 32 nt, Human
aacugaaggaaugagacauaggacagauaagu

SEQ ID NO: 289519 - RNA, 32 nt, Human
aacugaaggagaaaggaauaagcucucuguga

SEQ ID NO: 289520 - RNA, 32 nt, Human
aacugaaggcaauaauguuggcuuuuggaagg

SEQ ID NO: 289521 - RNA, 32 nt, Human
aacugaaucccuccucccuccacuccuuggga

SEQ ID NO: 289522 - RNA, 32 nt, Human
aacugaaucuaaaagaaaacuauuuugaagau

SEQ ID NO: 289523 - RNA, 32 nt, Human
aacugaaugcuuugaucagcauugaggugaug

SEQ ID NO: 289524 - RNA, 32 nt, Human
aacugaaugucuccguauaaagcccgauugua

SEQ ID NO: 289525 - RNA, 32 nt, Human
aacugaauucuuaugcagaauuuccuagccca

SEQ ID NO: 289526 - RNA, 32 nt, Human
aacugaauugguagagguaaaaggggaacgga

SEQ ID NO: 289527 - RNA, 32 nt, Human
aacugaauuuuguauaauacuaguuuuauaug

SEQ ID NO: 289528 - RNA, 32 nt, Human
aacugacaacucugaaugcaagccgugguaac

SEQ ID NO: 289529 - RNA, 32 nt, Human
aacugacaccacucaacugccuggcacugaaa

SEQ ID NO: 289530 - RNA, 32 nt, Human
aacugacagaacuaaucuaucauauuagaaau

SEQ ID NO: 289531 - RNA, 32 nt, Human
aacugacagcugucuuccacagccucugaugu

SEQ ID NO: 289532 - RNA, 32 nt, Human
aacugacaguggcugccuucucugggccaugg

SEQ ID NO: 289533 - RNA, 32 nt, Human
aacugacauagagaaaaggcuggagagagauu

SEQ ID NO: 289534 - RNA, 28 nt, Human
aacugaccaaaugcugccuuguuuggcc

SEQ ID NO: 289535 - RNA, 32 nt, Human
aacugaccaaguaacacagaaguugggguaug

SEQ ID NO: 289536 - RNA, 32 nt, Human
aacugaccaguucuguccuuggcuggggaccc

SEQ ID NO: 289537 - RNA, 32 nt, Human
aacugacccagccaugggcacagggcucagcc

SEQ ID NO: 289538 - RNA, 32 nt, Human
aacugacccaggcuggacuugcggggaggaaa

SEQ ID NO: 289539 - RNA, 32 nt, Human
aacugacccuuguguaucagcagcauuucuga

SEQ ID NO: 289540 - RNA, 32 nt, Human
aacugaccgaguaccugcuccaucaugcuuga

SEQ ID NO: 289541 - RNA, 32 nt, Human
aacugaccucaagugaucugccugccucagcu

SEQ ID NO: 289542 - RNA, 32 nt, Human
aacugaccucaggccucugagucacugaaugu

SEQ ID NO: 289543 - RNA, 24 nt, Human
aacugaccuggaucucagaugcua

SEQ ID NO: 289544 - RNA, 22 nt, Human
aacugaccuuuccccguacuaa

SEQ ID NO: 289545 - RNA, 32 nt, Human
aacugacgggcuuucauuuccauuucacacac

SEQ ID NO: 289546 - RNA, 32 nt, Human
aacugacucauaccuguuuccggcugcaucac

SEQ ID NO: 289547 - RNA, 32 nt, Human
aacugacucaucugcaacauucacaccauugc

SEQ ID NO: 289548 - RNA, 32 nt, Human
aacugacuccgaggguugggagagcgcguugg

SEQ ID NO: 289549 - RNA, 32 nt, Human
aacugacucugacuuccaucuucugcaggguu

SEQ ID NO: 289550 - RNA, 32 nt, Human
aacugacucuguuauugaucccuucuccugcc

SEQ ID NO: 289551 - RNA, 32 nt, Human
aacugacucuuuucuacccccuucccucuguu

SEQ ID NO: 289552 - RNA, 32 nt, Human
aacugacugaacuagagcuugcagugaagugu

SEQ ID NO: 289553 - RNA, 32 nt, Human
aacugacugacggccucucacucucaucuccu

SEQ ID NO: 289554 - RNA, 32 nt, Human
aacugacugccccuccccuccucacggcuucu

SEQ ID NO: 289555 - RNA, 32 nt, Human
aacugacuucagcagcuaccccaaaccaauca

SEQ ID NO: 289556 - RNA, 32 nt, Human
aacugacuugucagaagucagagcaagguauu

SEQ ID NO: 289557 - RNA, 32 nt, Human
aacugacuuucugcuuucaccuuugcuuguca

SEQ ID NO: 289558 - RNA, 32 nt, Human
aacugacuuuggacugcuucagucucugccau

SEQ ID NO: 289559 - RNA, 32 nt, Human
aacugagaaauaccucuacagagaugugaugc

SEQ ID NO: 289560 - RNA, 32 nt, Human
aacugagaaauguucagaauguacggaaagau

SEQ ID NO: 289561 - RNA, 32 nt, Human
aacugagagaaaagggauggagaagagaauac

SEQ ID NO: 289562 - RNA, 32 nt, Human
aacugagagcaauuucaaaaggcugcugaugu

SEQ ID NO: 289563 - RNA, 32 nt, Human
aacugagaggaaaaggagguaguauagauagu

SEQ ID NO: 289564 - RNA, 32 nt, Human
aacugagaguggugagaucaagucgguagauc

SEQ ID NO: 289565 - RNA, 32 nt, Human
aacugagauaaaugcuauuuaaauaaagugua

SEQ ID NO: 289566 - RNA, 32 nt, Human
aacugagaucacgucacugaacuccagucuga

SEQ ID NO: 289567 - RNA, 32 nt, Human
aacugagaucagugaaauacuuguugcuaauc

SEQ ID NO: 289568 - RNA, 32 nt, Human
aacugagaucauaccacuucauuccagccugg

SEQ ID NO: 289569 - RNA, 32 nt, Human
aacugagauccuuccuuuugagggagcaaguc

SEQ ID NO: 289570 - RNA, 32 nt, Human
aacugagaucguacccagccugggcaacagug

SEQ ID NO: 289571 - RNA, 32 nt, Human
aacugagauuacaggcacccaccaccaugccc

SEQ ID NO: 289572 - RNA, 31 nt, Human
aacugagcacauuucugaccauuuccagaaa

SEQ ID NO: 289573 - RNA, 32 nt, Human
aacugagcaguagggauagaaggugugaaccu

SEQ ID NO: 289574 - RNA, 32 nt, Human
aacugagcaugcuggggaggugaaugccacau

SEQ ID NO: 289575 - RNA, 32 nt, Human
aacugagcauuuucucaacucgacucucauuu

SEQ ID NO: 289576 - RNA, 32 nt, Human
aacugagccagccagcaccccaccuucgucuu

SEQ ID NO: 289577 - RNA, 32 nt, Human
aacugagccauucacaggacuugaccccgagg

SEQ ID NO: 289578 - RNA, 32 nt, Human
aacugaggaagcuacaacacagugaagaccca

SEQ ID NO: 289579 - RNA, 32 nt, Human
aacugaggagaugaagguuacagugagccaag

SEQ ID NO: 289580 - RNA, 32 nt, Human
aacugaggagguggagguugcagugagccgag

SEQ ID NO: 289581 - RNA, 32 nt, Human
aacugaggccagaccacccaggaagagcccca

SEQ ID NO: 289582 - RNA, 32 nt, Human
aacugaggcccagagagcugaaguacugcacc

SEQ ID NO: 289583 - RNA, 21 nt, Human
aacugaggcccagaggggcag

SEQ ID NO: 289584 - RNA, 32 nt, Human
aacugaggccuggagaguuuaaguaauguguc

SEQ ID NO: 289585 - RNA, 32 nt, Human
aacugaggcucaaggagguuaaguaacauuuc

SEQ ID NO: 289586 - RNA, 32 nt, Human
aacugaggcucagagacaaaguaacuuuguca

SEQ ID NO: 289587 - RNA, 23 nt, Human
aacugaggggaguaugugacuaa

SEQ ID NO: 289588 - RNA, 32 nt, Human
aacugaggucugauuauccagagcuaacaggc

SEQ ID NO: 289589 - RNA, 32 nt, Human
aacugaggugugacuguuuggacccaggccuc

SEQ ID NO: 289590 - RNA, 32 nt, Human
aacugaguaguagcugggucugauggcagcag

SEQ ID NO: 289591 - RNA, 32 nt, Human
aacugagucgcccuccugccuccagcucucug

SEQ ID NO: 289592 - RNA, 32 nt, Human
aacugauaguacauugccaucuccaggaagac

SEQ ID NO: 289593 - RNA, 32 nt, Human
aacugauauuacucaauuucagucuggacacu

SEQ ID NO: 289594 - RNA, 32 nt, Human
aacugaucaaaccaaaggaaaaguguugcuag

SEQ ID NO: 289595 - RNA, 32 nt, Human
aacugauccagcaguuccacuccuggguaugu

SEQ ID NO: 289596 - RNA, 32 nt, Human
aacugauccauagccucuucagauuccuuaua

SEQ ID NO: 289597 - RNA, 32 nt, Human
aacugaucgaauauaucaguaauuucagaauc

SEQ ID NO: 289598 - RNA, 32 nt, Human
aacugaucuccugccccacuaaccuuaacgac

SEQ ID NO: 289599 - RNA, 32 nt, Human
aacugaugaaaggaggaagaagaaagggacuu

SEQ ID NO: 289600 - RNA, 32 nt, Human
aacugaugcaggagggugcagcuuuggaguca

SEQ ID NO: 289601 - RNA, 32 nt, Human
aacugaugcucacacugggacuccucacuguc

SEQ ID NO: 289602 - RNA, 32 nt, Human
aacugauggcaaaggaagggcuggguuuucag

SEQ ID NO: 289603 - RNA, 30 nt, Human
aacugauggguuuaguaaucuggucauuuc

SEQ ID NO: 289604 - RNA, 32 nt, Human
aacugauucaugcaaacaacaaaaaugaaccc

SEQ ID NO: 289605 - RNA, 32 nt, Human
aacugauugauugugcaaacuacuuuuuauga

SEQ ID NO: 289606 - RNA, 32 nt, Human
aacugauuggcaccaagcaagaagaacagcac

SEQ ID NO: 289607 - RNA, 19 nt, Human
aacugauugucccaacuca

SEQ ID NO: 289608 - RNA, 32 nt, Human
aacugauuucacuccagacugguguggccacc

SEQ ID NO: 289609 - RNA, 32 nt, Human
aacugauuuuaaaggguuuagauuuuaagaau

SEQ ID NO: 289610 - RNA, 32 nt, Human
aacugcaaacuaaaacgacagugagauaccau

SEQ ID NO: 289611 - RNA, 32 nt, Human
aacugcaaagcaguuugaugacacuguuuuaa

SEQ ID NO: 289612 - RNA, 32 nt, Human
aacugcaaaggauuuacgguuugugaaaaaug

SEQ ID NO: 289613 - RNA, 32 nt, Human
aacugcaaauugguaagcagcaccuuaauacc

SEQ ID NO: 289614 - RNA, 32 nt, Human
aacugcaacagaacaggagauggaauuccagg

SEQ ID NO: 289615 - RNA, 32 nt, Human
aacugcaacuuccaccuccuggguucaagcaa

SEQ ID NO: 289616 - RNA, 32 nt, Human
aacugcaaggacucaguacaucccuggcacag

SEQ ID NO: 289617 - RNA, 32 nt, Human
aacugcaaguuccuaggcagaggggaagcccc

SEQ ID NO: 289618 - RNA, 32 nt, Human
aacugcacacuauuucccucuacugaguaaac

SEQ ID NO: 289619 - RNA, 32 nt, Human
aacugcacagccgccucugaaagguacgucca

SEQ ID NO: 289620 - RNA, 32 nt, Human
aacugcacgugccuucugucauugggaaugaa

SEQ ID NO: 289621 - RNA, 32 nt, Human
aacugcacuggguggcgggcagaugguggaag

SEQ ID NO: 289622 - RNA, 32 nt, Human
aacugcacuugucucucucauuuccuucaaau

SEQ ID NO: 289623 - RNA, 32 nt, Human
aacugcagacacagcuguucucucccucucuc

SEQ ID NO: 289624 - RNA, 32 nt, Human
aacugcagaggggagccuucuggagaagcugc

SEQ ID NO: 289625 - RNA, 19 nt, Human
aacugcagauguuauugaa

SEQ ID NO: 289626 - RNA, 32 nt, Human
aacugcagauugugaauuucacugccuuauau

SEQ ID NO: 289627 - RNA, 32 nt, Human
aacugcagcauuccagucugggcuguguccca

SEQ ID NO: 289628 - RNA, 32 nt, Human
aacugcaggaagcugccaccucuggggucaga

SEQ ID NO: 289629 - RNA, 32 nt, Human
aacugcaggaaggucugugcucuggagccagg

SEQ ID NO: 289630 - RNA, 32 nt, Human
aacugcaggaaguggcagcauucugggccaag

SEQ ID NO: 289631 - RNA, 32 nt, Human
aacugcaggcuggaucaguaguucaacagcua

SEQ ID NO: 289632 - RNA, 32 nt, Human
aacugcagggucuaggguguuguuggaguggc

SEQ ID NO: 289633 - RNA, 32 nt, Human
aacugcaguacccucugaucucuggcuuucuu

SEQ ID NO: 289634 - RNA, 32 nt, Human
aacugcagucacugaaugaccaagagcagcac

SEQ ID NO: 289635 - RNA, 32 nt, Human
aacugcagugaucuaggcacuuccuccagccu

SEQ ID NO: 289636 - RNA, 32 nt, Human
aacugcagugcuggguggaguguccuguggcc

SEQ ID NO: 289637 - RNA, 32 nt, Human
aacugcauaaacacugcacacuaggcuacaau

SEQ ID NO: 289638 - RNA, 32 nt, Human
aacugcauccaaucacugucucuuguaccaau

SEQ ID NO: 289639 - RNA, 32 nt, Human
aacugcaucuucuccccuugccaccccauggc

SEQ ID NO: 289640 - RNA, 32 nt, Human
aacugcauuaaccagucacaggcucagacugu

SEQ ID NO: 289641 - RNA, 32 nt, Human
aacugcauuggcuuuggguugcaggaccucag

SEQ ID NO: 289642 - RNA, 32 nt, Human
aacugcauuugcuuuugacuccuggccuuucu

SEQ ID NO: 289643 - RNA, 32 nt, Human
aacugccaaaccuccugucagugaggacucuu

SEQ ID NO: 289644 - RNA, 22 nt, Human
aacugccaaccacaggaaacag

SEQ ID NO: 289645 - RNA, 32 nt, Human
aacugccaaccacaggaaacagccuggcaaag

SEQ ID NO: 289646 - RNA, 22 nt, Human
aacugccaaccaguaggaagca

SEQ ID NO: 289647 - RNA, 21 nt, Human
aacugccaacggaggaaacag

SEQ ID NO: 289648 - RNA, 22 nt, Human
aacugccaaggcagccuccaga

SEQ ID NO: 289649 - RNA, 21 nt, Human
aacugccacucauugggccac

SEQ ID NO: 289650 - RNA, 32 nt, Human
aacugccacugcaacucugcacguccaggagg

SEQ ID NO: 289651 - RNA, 32 nt, Human
aacugccagacaccugagccgacugguaguag

SEQ ID NO: 289652 - RNA, 24 nt, Human
aacugccagccucagaggaggcag

SEQ ID NO: 289653 - RNA, 32 nt, Human
aacugccaggaaaauagcaaaggaaaucacug

SEQ ID NO: 289654 - RNA, 32 nt, Human
aacugccaggcagagcaugagaacaaacauuc

SEQ ID NO: 289655 - RNA, 31 nt, Human
aacugccagucccagcaccuccugaaagccc

SEQ ID NO: 289656 - RNA, 32 nt, Human
aacugccagugaggcuggaggcuggaggugga

SEQ ID NO: 289657 - RNA, 32 nt, Human
aacugccauacauggguacaagcuauaacaca

SEQ ID NO: 289658 - RNA, 32 nt, Human
aacugccauauccuagggggcuuggaguaccc

SEQ ID NO: 289659 - RNA, 32 nt, Human
aacugccaugcucagagaauccuagagauacu

SEQ ID NO: 289660 - RNA, 32 nt, Human
aacugccauugcacagaugaggaaauugaaac

SEQ ID NO: 289661 - RNA, 32 nt, Human
aacugccauugcacagaugaggaaauugaaag

SEQ ID NO: 289662 - RNA, 32 nt, Human
aacugcccaaguuugacuaauugcuuggccug

SEQ ID NO: 289663 - RNA, 32 nt, Human
aacugcccacucugauaugccugggugagccu

SEQ ID NO: 289664 - RNA, 32 nt, Human
aacugcccagcugacccacugacuugugagug

SEQ ID NO: 289665 - RNA, 32 nt, Human
aacugcccaucuuuacugaaucuucuugacug

SEQ ID NO: 289666 - RNA, 32 nt, Human
aacugcccauuuucuggaucuucccucucaau

SEQ ID NO: 289667 - RNA, 32 nt, Human
aacugcccccuccagcccauuuucugccguga

SEQ ID NO: 289668 - RNA, 32 nt, Human
aacugccccggaagauccucagcuggugcagg

SEQ ID NO: 289669 - RNA, 23 nt, Human
aacugcccgcagccugcucugag

SEQ ID NO: 289670 - RNA, 32 nt, Human
aacugcccgcuggaccccagacucagucuguc

SEQ ID NO: 289671 - RNA, 24 nt, Human
aacugcccguccaacagcuguggg

SEQ ID NO: 289672 - RNA, 32 nt, Human
aacugcccugcucuccucauacucaccgguuu

SEQ ID NO: 289673 - RNA, 32 nt, Human
aacugccggaaggugaaaguguucugugaugu

SEQ ID NO: 289674 - RNA, 32 nt, Human
aacugccggcuaaugcuugcucucccaagauc

SEQ ID NO: 289675 - RNA, 32 nt, Human
aacugccuacaggacaucuccaccuggauguc

SEQ ID NO: 289676 - RNA, 22 nt, Human
aacugccucagagaguugugag

SEQ ID NO: 289677 - RNA, 32 nt, Human
aacugccucaguaaauucuuagggauggaagu

SEQ ID NO: 289678 - RNA, 32 nt, Human
aacugccuccuugccagccccacccccagguu

SEQ ID NO: 289679 - RNA, 32 nt, Human
aacugccucuggucuugauagcauuaagcccu

SEQ ID NO: 289680 - RNA, 19 nt, Human
aacugccugacuuaggcca

SEQ ID NO: 289681 - RNA, 32 nt, Human
aacugccugaguagcugggacuacaggcaugc

SEQ ID NO: 289682 - RNA, 32 nt, Human
aacugccugccugggcacguugcuguugcugc

SEQ ID NO: 289683 - RNA, 19 nt, Human
aacugccugccuuagggua

SEQ ID NO: 289684 - RNA, 21 nt, Human
aacugccugcugcccugugag

SEQ ID NO: 289685 - RNA, 27 nt, Human
aacugccugggaacuaggaugcuagag

SEQ ID NO: 289686 - RNA, 32 nt, Human
aacugccuguagucccagcuauuccagggggc

SEQ ID NO: 289687 - RNA, 32 nt, Human
aacugccugucgggggcccagagcagccccag

SEQ ID NO: 289688 - RNA, 23 nt, Human
aacugccugucuggccgggccgc

SEQ ID NO: 289689 - RNA, 20 nt, Human
aacugccuucgggcuccaga

SEQ ID NO: 289690 - RNA, 25 nt, Human
aacugccuugcaggaaggcugugag

SEQ ID NO: 289691 - RNA, 32 nt, Human
aacugccuuuuuggugugcacacacauuucau

SEQ ID NO: 289692 - RNA, 32 nt, Human
aacugcggcaggccgggugcagugucucaagc

SEQ ID NO: 289693 - RNA, 32 nt, Human
aacugcggucacccugcuaaagucggggcggg

SEQ ID NO: 289694 - RNA, 32 nt, Human
aacugcgucuucucucagcccuccacacacac

SEQ ID NO: 289695 - RNA, 32 nt, Human
aacugcgucuucucucagcccuccacacacgc

SEQ ID NO: 289696 - RNA, 32 nt, Human
aacugcuaauuauccaacagaaaccccuaggu

SEQ ID NO: 289697 - RNA, 32 nt, Human
aacugcuacuuggagcucagaagccacuuuau

SEQ ID NO: 289698 - RNA, 32 nt, Human
aacugcuaugcaaggcugggugcuguggcuca

SEQ ID NO: 289699 - RNA, 23 nt, Human
aacugcuauuucagaagaggcag

SEQ ID NO: 289700 - RNA, 32 nt, Human
aacugcucagaggcaaaagcuacaagaggcac

SEQ ID NO: 289701 - RNA, 22 nt, Human
aacugcucagcaguugggccac

SEQ ID NO: 289702 - RNA, 32 nt, Human
aacugcucaguauuuugaucacuuugggcuua

SEQ ID NO: 289703 - RNA, 20 nt, Human
aacugcuccagacuauugaa

SEQ ID NO: 289704 - RNA, 23 nt, Human
aacugcucgcagggugcugcgag

SEQ ID NO: 289705 - RNA, 23 nt, Human
aacugcucgccggccuacauggg

SEQ ID NO: 289706 - RNA, 32 nt, Human
aacugcucucagagaaaguagcuuugugacau

SEQ ID NO: 289707 - RNA, 32 nt, Human
aacugcucucccucagcugggcuggggucucc

SEQ ID NO: 289708 - RNA, 32 nt, Human
aacugcucuuucuuggugcccuuacugcuccu

SEQ ID NO: 289709 - RNA, 32 nt, Human
aacugcugaaaaagcugggugcagugaaauga

SEQ ID NO: 289710 - RNA, 21 nt, Human
aacugcugaacuaguuccuca

SEQ ID NO: 289711 - RNA, 23 nt, Human
aacugcugacuucaggugaucca

SEQ ID NO: 289712 - RNA, 32 nt, Human
aacugcugcacucuaggaccacccgcaaugga

SEQ ID NO: 289713 - RNA, 18 nt, Human
aacugcugcaggaugccu

SEQ ID NO: 289714 - RNA, 18 nt, Human
aacugcugcccccagaga

SEQ ID NO: 289715 - RNA, 32 nt, Human
aacugcugcccccucccuaccucuacucccca

SEQ ID NO: 289716 - RNA, 32 nt, Human
aacugcugcccucccuuccuucuacuuaacuc

SEQ ID NO: 289717 - RNA, 32 nt, Human
aacugcugcccuuccaagacuugcucccgaga

SEQ ID NO: 289718 - RNA, 32 nt, Human
aacugcugcugaggcuccuguuaaauuuucug

SEQ ID NO: 289719 - RNA, 32 nt, Human
aacugcugcuguugcuuucuacauacaccuua

SEQ ID NO: 289720 - RNA, 32 nt, Human
aacugcuggaacccaacucuuuuuauuaauau

SEQ ID NO: 289721 - RNA, 32 nt, Human
aacugcuggagggugaggagauccggcugugu

SEQ ID NO: 289722 - RNA, 32 nt, Human
aacugcuggagugcaguggcaugaugucggcu

SEQ ID NO: 289723 - RNA, 32 nt, Human
aacugcuggcuggccaagcacgcgcuggaaaa

SEQ ID NO: 289724 - RNA, 32 nt, Human
aacugcugggauuacaggcacgcgccaccacg

SEQ ID NO: 289725 - RNA, 32 nt, Human
aacugcugggauuacaggcgugaaccacugca

SEQ ID NO: 289726 - RNA, 32 nt, Human
aacugcugggauuacaggcgugagccaccaca

SEQ ID NO: 289727 - RNA, 32 nt, Human
aacugcugggauuacaggcgugagccaccgca

SEQ ID NO: 289728 - RNA, 32 nt, Human
aacugcugggauuacaggcgugagccaccgcg

SEQ ID NO: 289729 - RNA, 32 nt, Human
aacugcugggauuacaggcgugagccacucug

SEQ ID NO: 289730 - RNA, 32 nt, Human
aacugcugggauuacaggcgugugccaccaug

SEQ ID NO: 289731 - RNA, 32 nt, Human
aacugcugggauuacaggugugagccaccaug

SEQ ID NO: 289732 - RNA, 32 nt, Human
aacugcugggauuacaggugugagccaccgug

SEQ ID NO: 289733 - RNA, 32 nt, Human
aacugcugguggacugaugugguucugggggu

SEQ ID NO: 289734 - RNA, 32 nt, Human
aacugcugguucugcuggugccucugccccug

SEQ ID NO: 289735 - RNA, 32 nt, Human
aacugcuguaggggcaggauggaaaggaugau

SEQ ID NO: 289736 - RNA, 32 nt, Human
aacugcuguauuuaacaucugccugcaaaugg

SEQ ID NO: 289737 - RNA, 32 nt, Human
aacugcugucauggacuauugauuguauugag

SEQ ID NO: 289738 - RNA, 24 nt, Human
aacugcugucgaagaaaaucaggc

SEQ ID NO: 289739 - RNA, 32 nt, Human
aacugcuguucccccaccuccacauaucugca

SEQ ID NO: 289740 - RNA, 32 nt, Human
aacugcuuaucagcuauucagacaucuccaug

SEQ ID NO: 289741 - RNA, 32 nt, Human
aacugcuucauggguaccauaaguacagagaa

SEQ ID NO: 289742 - RNA, 32 nt, Human
aacugcuuccuauccuccuccuggagagccca

SEQ ID NO: 289743 - RNA, 32 nt, Human
aacugcuugcaggggcugggcgugguggcuca

SEQ ID NO: 289744 - RNA, 32 nt, Human
aacugcuugcccagggugcagugugaguguga

SEQ ID NO: 289745 - RNA, 32 nt, Human
aacugcuuuaccuccccuccuacugagucagg

SEQ ID NO: 289746 - RNA, 32 nt, Human
aacugcuuuguauccaugaggguuucauugug

SEQ ID NO: 289747 - RNA, 32 nt, Human
aacugcuuuucaagcaucaugcugcuauuccu

SEQ ID NO: 289748 - RNA, 32 nt, Human
aacugcuuuucugccgugccucucuucccuac

SEQ ID NO: 289749 - RNA, 32 nt, Human
aacuggaacauaguucuccuucaaguguuggc

SEQ ID NO: 289750 - RNA, 32 nt, Human
aacuggaacugugccuuuucucuugucaaggu

SEQ ID NO: 289751 - RNA, 32 nt, Human
aacuggaagaaagagacagagaaggaguguca

SEQ ID NO: 289752 - RNA, 32 nt, Human
aacuggaagacagcucgagauccagaagggaa

SEQ ID NO: 289753 - RNA, 32 nt, Human
aacuggaagcccccucugccucccagcugggg

SEQ ID NO: 289754 - RNA, 32 nt, Human
aacuggaaggagagcuuccagaugggaagcaa

SEQ ID NO: 289755 - RNA, 32 nt, Human
aacuggaaggcagagguugcagugagccaaga

SEQ ID NO: 289756 - RNA, 32 nt, Human
aacuggaaggcagagguugcagugagccgaga

SEQ ID NO: 289757 - RNA, 32 nt, Human
aacuggaaucccagauaugguugcacaaaacc

SEQ ID NO: 289758 - RNA, 32 nt, Human
aacuggaaugagcagcuuuagcaaagaacucu

SEQ ID NO: 289759 - RNA, 32 nt, Human
aacuggaauugcaggucagagcagagcauggc

SEQ ID NO: 289760 - RNA, 32 nt, Human
aacuggacacuggaccggcagcgccaugagac

SEQ ID NO: 289761 - RNA, 32 nt, Human
aacuggacccacccaccacagcccaucacccu

SEQ ID NO: 289762 - RNA, 32 nt, Human
aacuggacuauccaauagguugccaccagcca

SEQ ID NO: 289763 - RNA, 32 nt, Human
aacuggagaaagggaaccacagagccaggagg

SEQ ID NO: 289764 - RNA, 32 nt, Human
aacuggagagucagugcaguccagagaauugu

SEQ ID NO: 289765 - RNA, 32 nt, Human
aacuggagagugaaggcauggagugaagacac

SEQ ID NO: 289766 - RNA, 32 nt, Human
aacuggagcaagaaggaaggaggcagacugau

SEQ ID NO: 289767 - RNA, 32 nt, Human
aacuggagcuccaucuuugcugcuaagaaggc

SEQ ID NO: 289768 - RNA, 32 nt, Human
aacuggagcuccaucuuugcugcuaggaaggc

SEQ ID NO: 289769 - RNA, 32 nt, Human
aacuggaggaagaaauaugaagccuuagcggc

SEQ ID NO: 289770 - RNA, 32 nt, Human
aacuggaggagugggcugcaagacugagccua

SEQ ID NO: 289771 - RNA, 32 nt, Human
aacuggaggauaagcaggaccagaugauacca

SEQ ID NO: 289772 - RNA, 32 nt, Human
aacuggaggcaagucaagucaccuguggccug

SEQ ID NO: 289773 - RNA, 32 nt, Human
aagaucacaccacugcacuccagccagggcaa

SEQ ID NO: 289774 - RNA, 32 nt, Human
aagaucacaccacugcacuccagccuaggcaa

SEQ ID NO: 289775 - RNA, 32 nt, Human
aagaucacaccacugcacuccagccuggcaac

SEQ ID NO: 289776 - RNA, 32 nt, Human
aagaucacaccacugcacuccagccugggcaa

SEQ ID NO: 289777 - RNA, 32 nt, Human
aagaucacaccacugcacuccagccugggcga

SEQ ID NO: 289778 - RNA, 32 nt, Human
aagaucacaccacugcacuccagccuggguga

SEQ ID NO: 289779 - RNA, 32 nt, Human
aagaucacaccacugcacuccagccuuggcga

SEQ ID NO: 289780 - RNA, 32 nt, Human
aagaucacaccacugcgcucuagccugggcaa

SEQ ID NO: 289781 - RNA, 32 nt, Human
aagaucacaccacuggcacuccagccugggca

SEQ ID NO: 289782 - RNA, 32 nt, Human
aagaucacaccacuguaccacagccugagcaa

SEQ ID NO: 289783 - RNA, 32 nt, Human
aagaucacaccagugcacuccagccugggcga

SEQ ID NO: 289784 - RNA, 32 nt, Human
aagaucacaccauugcacuccagccuagauaa

SEQ ID NO: 289785 - RNA, 32 nt, Human
aagaucacaccauugcacuccagccuaggcau

SEQ ID NO: 289786 - RNA, 32 nt, Human
aagaucacaccauugcacuccagccugagcaa

SEQ ID NO: 289787 - RNA, 32 nt, Human
aagaucacaccauugcacuccagccugggaaa

SEQ ID NO: 289788 - RNA, 32 nt, Human
aagaucacaccauugcacuccagccugggcaa

SEQ ID NO: 289789 - RNA, 32 nt, Human
aagaucacaccauugcacuccagccugggcga

SEQ ID NO: 289790 - RNA, 32 nt, Human
aagaucacaccgcugcacucaagccuggguga

SEQ ID NO: 289791 - RNA, 32 nt, Human
aagaucacacuacugcacuccagccugggcaa

SEQ ID NO: 289792 - RNA, 32 nt, Human
aagaucacacuauugcacuccagccugggcga

SEQ ID NO: 289793 - RNA, 32 nt, Human
aagaucacagcacugcacugcugccugggcga

SEQ ID NO: 289794 - RNA, 32 nt, Human
aagaucacaucacugcacuccagccuggguaa

SEQ ID NO: 289795 - RNA, 32 nt, Human
aagaucaccacacauaccuugguucugauggc

SEQ ID NO: 289796 - RNA, 32 nt, Human
aagaucaccccauacuccagccucuuuccucc

SEQ ID NO: 289797 - RNA, 32 nt, Human
aagaucacgacacugcacuccagccugggcaa

SEQ ID NO: 289798 - RNA, 32 nt, Human
aagaucacgccacuacacuccagccugggcga

SEQ ID NO: 289799 - RNA, 32 nt, Human
aagaucacgccacugaacuccagccugggaga

SEQ ID NO: 289800 - RNA, 32 nt, Human
aagaucacgccacugcacuacagccuggacga

SEQ ID NO: 289801 - RNA, 32 nt, Human
aagaucacgccacugcacuccagcacccuggg

SEQ ID NO: 289802 - RNA, 32 nt, Human
aagaucacgccacugcacuccagccucgguga

SEQ ID NO: 289803 - RNA, 32 nt, Human
aagaucacgccacugcacuccagccugaguga

SEQ ID NO: 289804 - RNA, 32 nt, Human
aagaucacgccacugcacuccagccugcggac

SEQ ID NO: 289805 - RNA, 32 nt, Human
aagaucacgccacugcacuccagccuggacaa

SEQ ID NO: 289806 - RNA, 32 nt, Human
aagaucacgccacugcacuccagccugggcaa

SEQ ID NO: 289807 - RNA, 32 nt, Human
aagaucacgccacugcacuccagccugggcca

SEQ ID NO: 289808 - RNA, 32 nt, Human
aagaucacgccacugcacuccagccugggcga

SEQ ID NO: 289809 - RNA, 32 nt, Human
aagaucacgccacugcacuccagccuggguga

SEQ ID NO: 289810 - RNA, 32 nt, Human
aagaucacgccacugcacuccagccuggugac

SEQ ID NO: 289811 - RNA, 32 nt, Human
aagaucacgccacugcacucuagccugggcaa

SEQ ID NO: 289812 - RNA, 32 nt, Human
aagaucacgccacugcauuacagccuggugca

SEQ ID NO: 289813 - RNA, 32 nt, Human
aagaucacgccacugcauuccagccuggugac

SEQ ID NO: 289814 - RNA, 32 nt, Human
aagaucacgccacuguacuccagccuggauga

SEQ ID NO: 289815 - RNA, 32 nt, Human
aagaucacgccauuacacuccagccuggcuga

SEQ ID NO: 289816 - RNA, 32 nt, Human
aagaucacgccauugcacuccagccuaggcaa

SEQ ID NO: 289817 - RNA, 32 nt, Human
aagaucacgccauugcacuccagccugggcaa

SEQ ID NO: 289818 - RNA, 32 nt, Human
aagaucacgccauugcacuccagccuggggga

SEQ ID NO: 289819 - RNA, 32 nt, Human
aagaucacgccauugcacuccagccuggguga

SEQ ID NO: 289820 - RNA, 32 nt, Human
aagaucacgccauuguacuccagccuggcaac

SEQ ID NO: 289821 - RNA, 32 nt, Human
aagaucacgucacuguacuccagccuggguga

SEQ ID NO: 289822 - RNA, 32 nt, Human
aagaucacgucauugcacuccagccuggucaa

SEQ ID NO: 289823 - RNA, 32 nt, Human
aagaucacguucagaagaauggaaggaaagcu

SEQ ID NO: 289824 - RNA, 32 nt, Human
aagaucacuccacugcacuccagccugggcga

SEQ ID NO: 289825 - RNA, 32 nt, Human
aagaucacucccaauuuuucuacuuuccucau

SEQ ID NO: 289826 - RNA, 32 nt, Human
aagaucacuggagccugggaggcagagguugc

SEQ ID NO: 289827 - RNA, 32 nt, Human
aagaucacuuuccuucacugugcugagaauuu

SEQ ID NO: 289828 - RNA, 32 nt, Human
aagaucagaacaguuguccucacuuuuguucu

SEQ ID NO: 289829 - RNA, 32 nt, Human
aagaucagaccacugcccuccagccugggcaa

SEQ ID NO: 289830 - RNA, 32 nt, Human
aagaucagcacauuugguggcugaugcuguuc

SEQ ID NO: 289831 - RNA, 32 nt, Human
aagaucagccuggccaacauaaggagaccuaa

SEQ ID NO: 289832 - RNA, 32 nt, Human
aagaucagccugggaaacauagugagaccccg

SEQ ID NO: 289833 - RNA, 32 nt, Human
aagaucagccugggcaacauagugagaccucc

SEQ ID NO: 289834 - RNA, 32 nt, Human
aagaucagccugggcaguauagcaagacccca

SEQ ID NO: 289835 - RNA, 32 nt, Human
aagaucaggaggaggaggaagaagaggaaaaa

SEQ ID NO: 289836 - RNA, 18 nt, Human
aagaucaggcaacuuggc

SEQ ID NO: 289837 - RNA, 32 nt, Human
aagaucagggcugaggguaaggaaaagaagag

SEQ ID NO: 289838 - RNA, 32 nt, Human
aagaucagguacugugucagcauugauuucuu

SEQ ID NO: 289839 - RNA, 32 nt, Human
aagaucauaccacggcacuccagccuggguga

SEQ ID NO: 289840 - RNA, 32 nt, Human
aagaucauaccacugcacugcagccugaguga

SEQ ID NO: 289841 - RNA, 32 nt, Human
aagaucauaccauugcacuccagccugggcaa

SEQ ID NO: 289842 - RNA, 32 nt, Human
aagaucauacuacugcacuccagccugggcga

SEQ ID NO: 289843 - RNA, 32 nt, Human
aagaucauaggcuaggaaguggcagagccagg

SEQ ID NO: 289844 - RNA, 32 nt, Human
aagaucauaucacugcacuccagccuggcuga

SEQ ID NO: 289845 - RNA, 32 nt, Human
aagaucauauguccuagcacuuuugggggccg

SEQ ID NO: 289846 - RNA, 32 nt, Human
aagaucauauucuuccuccuguacaugaugua

SEQ ID NO: 289847 - RNA, 32 nt, Human
aagaucaugcagcugcuguuccugccucuaaa

SEQ ID NO: 289848 - RNA, 32 nt, Human
aagaucaugccacaucacuccagccugggcaa

SEQ ID NO: 289849 - RNA, 32 nt, Human
aagaucaugccacuccacuccagucugggcga

SEQ ID NO: 289850 - RNA, 32 nt, Human
aagaucaugccacugaacuccagccuggguga

SEQ ID NO: 289851 - RNA, 32 nt, Human
aagaucaugccacugcaccccagccugggcaa

SEQ ID NO: 289852 - RNA, 32 nt, Human
aagaucaugccacugcacuccagccugggcaa

SEQ ID NO: 289853 - RNA, 32 nt, Human
aagaucaugccacugcacuccagccugggcga

SEQ ID NO: 289854 - RNA, 32 nt, Human
aagaucaugccacugcacuccagccugggcgg

SEQ ID NO: 289855 - RNA, 32 nt, Human
aagaucaugccacugcacuccagccuggguga

SEQ ID NO: 289856 - RNA, 32 nt, Human
aagaucaugccacuggacuccagccuggguga

SEQ ID NO: 289857 - RNA, 32 nt, Human
aagaucaugccauuauacuccagccuggguga

SEQ ID NO: 289858 - RNA, 32 nt, Human
aagaucaugccauugcacuccagccugggcaa

SEQ ID NO: 289859 - RNA, 32 nt, Human
aagaucaugccauugcacuccagccugggcga

SEQ ID NO: 289860 - RNA, 32 nt, Human
aagaucaugccauugcacuccagccuggguga

SEQ ID NO: 289861 - RNA, 32 nt, Human
aagaucaugccuacugcacuccagccugggca

SEQ ID NO: 289862 - RNA, 32 nt, Human
aagaucaugcuacugcacuccagccuggguga

SEQ ID NO: 289863 - RNA, 32 nt, Human
aagaucauugagcucaggaguuugaaaccagu

SEQ ID NO: 289864 - RNA, 32 nt, Human
aagaucauuugagcccaggaggcugaggcugc

SEQ ID NO: 289865 - RNA, 32 nt, Human
aagauccacacacauccucaccccacagaaac

SEQ ID NO: 289866 - RNA, 32 nt, Human
aagauccacagcuuuuccuccaugucuguuac

SEQ ID NO: 289867 - RNA, 32 nt, Human
aagauccacuggcuuggaauucucccugccag

SEQ ID NO: 289868 - RNA, 31 nt, Human
aagauccagagagugggggugaggggugggc

SEQ ID NO: 289869 - RNA, 32 nt, Human
aagauccaggggcuggagcccaaugccaagcc

SEQ ID NO: 289870 - RNA, 32 nt, Human
aagaucccacacccgacaugacauaaauaaaa

SEQ ID NO: 289871 - RNA, 32 nt, Human
aagaucccagggucaggagagaccccucugua

SEQ ID NO: 289872 - RNA, 32 nt, Human
aagaucccagugcuugcccugccugccaggaa

SEQ ID NO: 289873 - RNA, 32 nt, Human
aagauccccaggggacugggugcaguggcuca

SEQ ID NO: 289874 - RNA, 32 nt, Human
aagaucccgaaaggaggaagagguggcgaaaa

SEQ ID NO: 289875 - RNA, 32 nt, Human
aagauccucacagcacgggagcagggagaggc

SEQ ID NO: 289876 - RNA, 32 nt, Human
aagauccuccacugcugcucugcugccugccc

SEQ ID NO: 289877 - RNA, 32 nt, Human
aagauccugaaggaauggguauucuugaaggc

SEQ ID NO: 289878 - RNA, 18 nt, Human
aagauccugagaacuugg

SEQ ID NO: 289879 - RNA, 32 nt, Human
aagauccugccacugcacuccagccugggcaa

SEQ ID NO: 289880 - RNA, 32 nt, Human
aagauccugccucugcugaguguaccugacag

SEQ ID NO: 289881 - RNA, 32 nt, Human
aagauccugggacagcuggaacaggcauggcc

SEQ ID NO: 289882 - RNA, 32 nt, Human
aagauccuugguguguaguucagucuugcagu

SEQ ID NO: 289883 - RNA, 32 nt, Human
aagaucgagccacugcacuccagccugggcag

SEQ ID NO: 289884 - RNA, 32 nt, Human
aagaucgagccauugcacuccagccugggcaa

SEQ ID NO: 289885 - RNA, 32 nt, Human
aagaucgcaacacugcccuccagccugggcaa

SEQ ID NO: 289886 - RNA, 32 nt, Human
aagaucgcaacauugcacuccaggcugggcag

SEQ ID NO: 289887 - RNA, 32 nt, Human
aagaucgcaccacugaacuccagccugggcga

SEQ ID NO: 289888 - RNA, 32 nt, Human
aagaucgcaccacugcaccccagccugggcaa

SEQ ID NO: 289889 - RNA, 32 nt, Human
aagaucgcaccacugcaccccagcgugggcaa

SEQ ID NO: 289890 - RNA, 32 nt, Human
aagaucgcaccacugcacgcacuccagccugg

SEQ ID NO: 289891 - RNA, 32 nt, Human
aagaucgcaccacugcacuacagccugggcga

SEQ ID NO: 289892 - RNA, 32 nt, Human
aagaucgcaccacugcacucaagccugggcga

SEQ ID NO: 289893 - RNA, 32 nt, Human
aagaucgcaccacugcacuccaaccugggcaa

SEQ ID NO: 289894 - RNA, 32 nt, Human
aagaucgcaccacugcacuccagccuggaaga

SEQ ID NO: 289895 - RNA, 32 nt, Human
aagaucgcaccacugcacuccagccugggaga

SEQ ID NO: 289896 - RNA, 32 nt, Human
aagaucgcaccacugcacuccagccugggcaa

SEQ ID NO: 289897 - RNA, 32 nt, Human
aagaucgcaccacugcacuccagccugggcga

SEQ ID NO: 289898 - RNA, 32 nt, Human
aagaucgcaccacugcacuccagccuggguga

SEQ ID NO: 289899 - RNA, 32 nt, Human
aagaucgcaccacugcacuccagccuggucga

SEQ ID NO: 289900 - RNA, 32 nt, Human
aagaucgcaccacugcauuccagccuaagcaa

SEQ ID NO: 289901 - RNA, 32 nt, Human
aagaucgcaccacugcucuccagccuggcgac

SEQ ID NO: 289902 - RNA, 32 nt, Human
aagaucgcaccacuguacuccagccugggcaa

SEQ ID NO: 289903 - RNA, 32 nt, Human
aagaucgcaccacuugcacugcagccugagag

SEQ ID NO: 289904 - RNA, 32 nt, Human
aagaucgcaccauugcacuccagccuaggcaa

SEQ ID NO: 289905 - RNA, 32 nt, Human
aagaucgcaccauugcacuccagccuggauga

SEQ ID NO: 289906 - RNA, 32 nt, Human
aagaucgcaccauugcacuccagccugggcaa

SEQ ID NO: 289907 - RNA, 32 nt, Human
aagaucgcaccauugcacuccagccugugcaa

SEQ ID NO: 289908 - RNA, 32 nt, Human
aagaucgcaccauugcacuccagcugggagac

SEQ ID NO: 289909 - RNA, 32 nt, Human
aagaucgcaccauuguacuccagccugggcaa

SEQ ID NO: 289910 - RNA, 32 nt, Human
aagaucgcaccgcugcacuccagccuggguga

SEQ ID NO: 289911 - RNA, 32 nt, Human
aagaucgcacuacugcacuccagccuggguga

SEQ ID NO: 289912 - RNA, 32 nt, Human
aagaucgcagaucauaaagcaagcucugcuuu

SEQ ID NO: 289913 - RNA, 32 nt, Human
aagaucgcaguggacugugugauugaccugac

SEQ ID NO: 289914 - RNA, 32 nt, Human
aagaucgcccacugcacuccagguugggcuac

SEQ ID NO: 289915 - RNA, 32 nt, Human
aagaucgccccacugcacuccagccuggcaau

SEQ ID NO: 289916 - RNA, 32 nt, Human
aagaucgccccacugcacuccagccugggcga

SEQ ID NO: 289917 - RNA, 32 nt, Human
aagaucgcccugcugcacuccagccugggcaa

SEQ ID NO: 289918 - RNA, 32 nt, Human
aagaucgcgccacugcacuccacccuggguaa

SEQ ID NO: 289919 - RNA, 32 nt, Human
aagaucgcgccacugcacuccagccucagcaa

SEQ ID NO: 289920 - RNA, 32 nt, Human
aagaucgcgccacugcacuccagccucggcaa

SEQ ID NO: 289921 - RNA, 32 nt, Human
aagaucgcgccacugcacuccagccuggcgac

SEQ ID NO: 289922 - RNA, 32 nt, Human
aagaucgcgccacugcacuccagccugggcaa

SEQ ID NO: 289923 - RNA, 32 nt, Human
aagaucgcgccacugcacuccagccugggcga

SEQ ID NO: 289924 - RNA, 32 nt, Human
aagaucgcgccacugcacuccagccuggguga

SEQ ID NO: 289925 - RNA, 32 nt, Human
aagaucgcgccacugcacuccagccuggugac

SEQ ID NO: 289926 - RNA, 32 nt, Human
aagaucgcgccacugcacuccagucugggcaa

SEQ ID NO: 289927 - RNA, 32 nt, Human
aagaucgcgccacugcacuccggccugaugac

SEQ ID NO: 289928 - RNA, 32 nt, Human
aagaucgcgccacugcaguccagccugggcaa

SEQ ID NO: 289929 - RNA, 32 nt, Human
aagaucgcgccacuguacuccagccuggacaa

SEQ ID NO: 289930 - RNA, 32 nt, Human
aagaucgcgccacuguacuccagccugggcaa

SEQ ID NO: 289931 - RNA, 32 nt, Human
aagaucgcgccaucgcacuccagccugggcaa

SEQ ID NO: 289932 - RNA, 32 nt, Human
aagaucgcgccauucuacuccagccugggcca

SEQ ID NO: 289933 - RNA, 32 nt, Human
aagaucgcgccauugcacuccaaccuggacga

SEQ ID NO: 289934 - RNA, 32 nt, Human
aagaucgcgccauugcacuccagccuggacaa

SEQ ID NO: 289935 - RNA, 32 nt, Human
aagaucgcgccauugcacuccagccugggcaa

SEQ ID NO: 289936 - RNA, 32 nt, Human
aagaucgcgccauugcacuccagccugggcgg

SEQ ID NO: 289937 - RNA, 32 nt, Human
aagaucgcgccauugcacuccagccuggggga

SEQ ID NO: 289938 - RNA, 32 nt, Human
aagaucgcgccccugcacuccagccuggguga

SEQ ID NO: 289939 - RNA, 32 nt, Human
aagaucgcgccguugcacuccagccugggcaa

SEQ ID NO: 289940 - RNA, 32 nt, Human
aagaucgcgcuacugcacuccagccugggcga

SEQ ID NO: 289941 - RNA, 32 nt, Human
aagaucgcgcuauugcacuccagccuggguga

SEQ ID NO: 289942 - RNA, 32 nt, Human
aagaucgcggcgcugcacucuagccuggguga

SEQ ID NO: 289943 - RNA, 32 nt, Human
aagaucgcuccauugcacuccagccuggguga

SEQ ID NO: 289944 - RNA, 32 nt, Human
aagaucgcucccacugcacuccagccugggcg

SEQ ID NO: 289945 - RNA, 32 nt, Human
aagaucgcuugagcccaggaggcugaggcugc

SEQ ID NO: 289946 - RNA, 32 nt, Human
aagaucgggccacugcacuccagcuuggguga

SEQ ID NO: 289947 - RNA, 32 nt, Human
aagaucgggccgcugcacuccagccuggggga

SEQ ID NO: 289948 - RNA, 32 nt, Human
aagaucguaccacugcacuccagccugggcga

SEQ ID NO: 289949 - RNA, 32 nt, Human
aagaucguaccacugcacuccagccuggguga

SEQ ID NO: 289950 - RNA, 32 nt, Human
aagaucguaccacugcacuccagucugggcga

SEQ ID NO: 289951 - RNA, 32 nt, Human
aagaucguaccacugcacucuggccugggcaa

SEQ ID NO: 289952 - RNA, 32 nt, Human
aagaucguaccgcugcacuccagccuggguga

SEQ ID NO: 289953 - RNA, 32 nt, Human
aagaucguauuuucaccugucuucauuacuuu

SEQ ID NO: 289954 - RNA, 32 nt, Human
aagaucgugacacugcacuccagccugggcga

SEQ ID NO: 289955 - RNA, 32 nt, Human
aagaucgugcaacugcacuccagccugggcaa

SEQ ID NO: 289956 - RNA, 32 nt, Human
aagaucgugccaaugcacuccauccugggcaa

SEQ ID NO: 289957 - RNA, 32 nt, Human
aagaucgugccacuacacuccagccugggcaa

SEQ ID NO: 289958 - RNA, 32 nt, Human
aagaucgugccacuacacuccagccuggggga

SEQ ID NO: 289959 - RNA, 32 nt, Human
aagaucgugccacugcacaccauccuggauga

SEQ ID NO: 289960 - RNA, 32 nt, Human
aagaucgugccacugcaccguagccuggguga

SEQ ID NO: 289961 - RNA, 32 nt, Human
aagaucgugccacugcacuccagacuggggga

SEQ ID NO: 289962 - RNA, 32 nt, Human
aagaucgugccacugcacuccagcccaggcaa

SEQ ID NO: 289963 - RNA, 32 nt, Human
aagaucgugccacugcacuccagccuggacaa

SEQ ID NO: 289964 - RNA, 32 nt, Human
aagaucgugccacugcacuccagccuggcgac

SEQ ID NO: 289965 - RNA, 32 nt, Human
aagaucgugccacugcacuccagccugggaga

SEQ ID NO: 289966 - RNA, 32 nt, Human
aagaucgugccacugcacuccagccugggcga

SEQ ID NO: 289967 - RNA, 32 nt, Human
aagaucgugccacugcacuccagccugggcua

SEQ ID NO: 289968 - RNA, 32 nt, Human
aagaucgugccacugcacuccagccuggggaa

SEQ ID NO: 289969 - RNA, 32 nt, Human
aagaucgugccacugcacuccagccuggguga

SEQ ID NO: 289970 - RNA, 32 nt, Human
aagaucgugccacugcacuccagccugguuga

SEQ ID NO: 289971 - RNA, 32 nt, Human
aagaucgugccacugcacuccagccuugagac

SEQ ID NO: 289972 - RNA, 32 nt, Human
aagaucgugccacugcacuccagccuugguga

SEQ ID NO: 289973 - RNA, 32 nt, Human
aagaucgugccacugcacuccagucuggguga

SEQ ID NO: 289974 - RNA, 32 nt, Human
aagaucgugccacugcacuccggccuggguga

SEQ ID NO: 289975 - RNA, 32 nt, Human
aagaucgugccacugcacucuagccugggcga

SEQ ID NO: 289976 - RNA, 32 nt, Human
aagaucgugccacugcacucuagccuggguga

SEQ ID NO: 289977 - RNA, 32 nt, Human
aagaucgugccacugcacucuauccuggguaa

SEQ ID NO: 289978 - RNA, 32 nt, Human
aagaucgugccacugcacuucagccuggguga

SEQ ID NO: 289979 - RNA, 32 nt, Human
aagaucgugccacugcauuccagccugggcga

SEQ ID NO: 289980 - RNA, 32 nt, Human
aagaucgugccacugcauuccagccugguuga

SEQ ID NO: 289981 - RNA, 32 nt, Human
aagaucgugccacuucacuccagccugggcaa

SEQ ID NO: 289982 - RNA, 32 nt, Human
aagaucgugccagugcacuccagccuggguga

SEQ ID NO: 289983 - RNA, 32 nt, Human
aagaucgugccauuccacuccagccugagcaa

SEQ ID NO: 289984 - RNA, 32 nt, Human
aagaucgugccauuccacuccagccugggcaa

SEQ ID NO: 289985 - RNA, 32 nt, Human
aagaucgugccauugcacuccagccuaggcaa

SEQ ID NO: 289986 - RNA, 32 nt, Human
aagaucgugccauugcacuccagccuggcgac

SEQ ID NO: 289987 - RNA, 32 nt, Human
aagaucgugccauugcacuccagccugggcaa

SEQ ID NO: 289988 - RNA, 32 nt, Human
aagaucgugccauugcacuccagccuggguga

SEQ ID NO: 289989 - RNA, 32 nt, Human
aagaucgugccguugcacuccagccugggcaa

SEQ ID NO: 289990 - RNA, 32 nt, Human
aagaucgugccucugcacuccaaccuggguga

SEQ ID NO: 289991 - RNA, 32 nt, Human
aagaucgugucacugcacuccagccuggugac

SEQ ID NO: 289992 - RNA, 32 nt, Human
aagaucuaagaacuagagucacccuaaauccu

SEQ ID NO: 289993 - RNA, 32 nt, Human
aagaucuaauuuccccacccuacuuuugacuc

SEQ ID NO: 289994 - RNA, 32 nt, Human
aagaucuagccccauugacucuucuagaaaug

SEQ ID NO: 289995 - RNA, 32 nt, Human
aagaucuauguuuauaaaccagcacuuggcca

SEQ ID NO: 289996 - RNA, 32 nt, Human
aagaucucaaagcuaaagugccaauuuuuacu

SEQ ID NO: 289997 - RNA, 32 nt, Human
aagaucucaccacugaacuccagccugggcga

SEQ ID NO: 289998 - RNA, 32 nt, Human
aagaucucacucuauugcucaggcuggagugu

SEQ ID NO: 289999 - RNA, 32 nt, Human
aagaucucagucuucuuuccaccaaugacccc

SEQ ID NO: 290000 - RNA, 32 nt, Human
aagaucucauagggcaggugcaaaauaggaau

SEQ ID NO: 290001 - RNA, 32 nt, Human
aagaucuccguggagaaugaaaggcacagucg

SEQ ID NO: 290002 - RNA, 32 nt, Human
aagaucucgccacugcacuccaggcugggcga

SEQ ID NO: 290003 - RNA, 32 nt, Human
aagaucucuaaaucugaauuuacgcucuguag

SEQ ID NO: 290004 - RNA, 32 nt, Human
aagaucucuaaggucacaugcuuuuaaaauag

SEQ ID NO: 290005 - RNA, 32 nt, Human
aagaucucugcucaauguccauacaaggagga

SEQ ID NO: 290006 - RNA, 22 nt, Human
aagaucugaaagaaauggcaua

SEQ ID NO: 290007 - RNA, 32 nt, Human
aagaucugaauagacauuucucaaaagaagac

SEQ ID NO: 290008 - RNA, 32 nt, Human
aagaucugaaucuaagaaggaauuaccuuuga

SEQ ID NO: 290009 - RNA, 32 nt, Human
aagaucugaggcucuggugcucagggggaugg

SEQ ID NO: 290010 - RNA, 32 nt, Human
aagaucugcagccucagagccucugggagguc

SEQ ID NO: 290011 - RNA, 32 nt, Human
aagaucugccuccccaccgccuuuucucacuc

SEQ ID NO: 290012 - RNA, 32 nt, Human
aagaucuggccucuguccugugcccacuuuag

SEQ ID NO: 290013 - RNA, 32 nt, Human
aagaucugggcucuagugggaaaccucaggua

SEQ ID NO: 290014 - RNA, 32 nt, Human
aagaucuguccucaguguuggcaggagccguc

SEQ ID NO: 290015 - RNA, 32 nt, Human
aagaucugugacucugaaauauccuccaaaag

SEQ ID NO: 290016 - RNA, 32 nt, Human
aagaucugugcagccccgccuccaggccacau

SEQ ID NO: 290017 - RNA, 32 nt, Human
aagaucuuaccuuuuucuaucuuguuacucug

SEQ ID NO: 290018 - RNA, 32 nt, Human
aagaucuucccauccagcugucuuguagcugc

SEQ ID NO: 290019 - RNA, 32 nt, Human
aagaucuucuguacuucugucuuccauaggac

SEQ ID NO: 290020 - RNA, 32 nt, Human
aagaucuugaaccugacaaagaggaggagcug

SEQ ID NO: 290021 - RNA, 32 nt, Human
aagaucuugagagcugcugagggaccuuggag

SEQ ID NO: 290022 - RNA, 32 nt, Human
aagaucuugccacuguacuccagccugaagag

SEQ ID NO: 290023 - RNA, 32 nt, Human
aagaucuuugacauagguucuucuauagugau

SEQ ID NO: 290024 - RNA, 17 nt, Human
aagaugaaaaacauggc

SEQ ID NO: 290025 - RNA, 32 nt, Human
aagaugaaaucagcuauuacaccugcuguaca

SEQ ID NO: 290026 - RNA, 18 nt, Human
aagaugaaccaacuuagu

SEQ ID NO: 290027 - RNA, 19 nt, Human
aagaugaacuguauuuugc

SEQ ID NO: 290028 - RNA, 17 nt, Human
aagaugaagaagcuggc

SEQ ID NO: 290029 - RNA, 21 nt, Human
aagaugaagacaaaauuuggc

SEQ ID NO: 290030 - RNA, 32 nt, Human
aagaugaagaggaggaagagggagaagggaga

SEQ ID NO: 290031 - RNA, 32 nt, Human
aagaugaagauauucaaacagaaagaauaaga

SEQ ID NO: 290032 - RNA, 32 nt, Human
aagaugaagaugugggagaggagcagccccca

SEQ ID NO: 290033 - RNA, 32 nt, Human
aagaugaagcuauuccagguugagggauuuuu

SEQ ID NO: 290034 - RNA, 19 nt, Human
aagaugaaguggagcuggc

SEQ ID NO: 290035 - RNA, 32 nt, Human
aagaugaaguuaaacuccucuacuuaugugcc

SEQ ID NO: 290036 - RNA, 19 nt, Human
aagaugaauaaaacuuagc

SEQ ID NO: 290037 - RNA, 32 nt, Human
aagaugaaucaugcuaagaacacuucugcuuu

SEQ ID NO: 290038 - RNA, 32 nt, Human
aagaugaaugggagggagagauuugaguccaa

SEQ ID NO: 290039 - RNA, 17 nt, Human
aagaugaauggucuggc

SEQ ID NO: 290040 - RNA, 18 nt, Human
aagaugaauuccuauggc

SEQ ID NO: 290041 - RNA, 32 nt, Human
aagaugaauuugagaaaaauugaaagaaauua

SEQ ID NO: 290042 - RNA, 32 nt, Human
aagaugacacaacugcacuccagcuugggcaa

SEQ ID NO: 290043 - RNA, 32 nt, Human
aagaugacacaguugccuucucuccgaggaac

SEQ ID NO: 290044 - RNA, 23 nt, Human
aagaugacacugugggcgaucca

SEQ ID NO: 290045 - RNA, 32 nt, Human
aagaugacaggagauggagaagcaccagcuga

SEQ ID NO: 290046 - RNA, 32 nt, Human
aagaugacccaacuugaaauaaaaccugaaga

SEQ ID NO: 290047 - RNA, 28 nt, Human
aagaugacuauggagaagcagaaggaca

SEQ ID NO: 290048 - RNA, 32 nt, Human
aagaugacucacuaccaccauguccaaccucc

SEQ ID NO: 290049 - RNA, 32 nt, Human
aagaugacugaggauggagacaagugaguugg

SEQ ID NO: 290050 - RNA, 32 nt, Human
aagaugacuuuggugaaaccccgucucuacua

SEQ ID NO: 290051 - RNA, 18 nt, Human
aagaugagauaaacuggc

SEQ ID NO: 290052 - RNA, 32 nt, Human
aagaugagauuugguugggaacacagccaaac

SEQ ID NO: 290053 - RNA, 32 nt, Human
aagaugagccugggcucauagugagaacccgu

SEQ ID NO: 290054 - RNA, 18 nt, Human
aagaugagcucaccaggc

SEQ ID NO: 290055 - RNA, 32 nt, Human
aagaugagcuggcacucugcaaacuucuuuaa

SEQ ID NO: 290056 - RNA, 32 nt, Human
aagaugagcugggaacaagggaagagagagca

SEQ ID NO: 290057 - RNA, 32 nt, Human
aagaugaggaagagauauuuuuaguauaugaa

SEQ ID NO: 290058 - RNA, 32 nt, Human
aagaugaggacuuugacuggaaccugaaagcu

SEQ ID NO: 290059 - RNA, 32 nt, Human
aagaugaggaugaaugugauguuuauauucug

SEQ ID NO: 290060 - RNA, 28 nt, Human
aagaugaggcuguccccggcgccccuga

SEQ ID NO: 290061 - RNA, 32 nt, Human
aagaugaggcuucugcugcuucuccuaguggc

SEQ ID NO: 290062 - RNA, 32 nt, Human
aagaugagguggggagucuguacugagaugga

SEQ ID NO: 290063 - RNA, 28 nt, Human
aagaugaguaaaagcaaagaugaugcuc

SEQ ID NO: 290064 - RNA, 32 nt, Human
aagaugagucuaauccgcagcacuucgaucac

SEQ ID NO: 290065 - RNA, 20 nt, Human
aagaugagucugacuauggc

SEQ ID NO: 290066 - RNA, 17 nt, Human
aagaugagugagcuggc

SEQ ID NO: 290067 - RNA, 32 nt, Human
aagaugaguuauucuaggggacucauuccagu

SEQ ID NO: 290068 - RNA, 32 nt, Human
aagaugaguucucuguaagacugugguggagu

SEQ ID NO: 290069 - RNA, 31 nt, Human
aagaugauaacagcccuuugccaaagcagac

SEQ ID NO: 290070 - RNA, 32 nt, Human
aagaugauaccugaagcugucaccucuugauu

SEQ ID NO: 290071 - RNA, 32 nt, Human
aagaugauccugcugcugaugauaccagugcu

SEQ ID NO: 290072 - RNA, 32 nt, Human
aagaugaugaacaccaguaugucagacaauga

SEQ ID NO: 290073 - RNA, 17 nt, Human
aagaugaugaacuuagg

SEQ ID NO: 290074 - RNA, 32 nt, Human
aagaugaugacugcacugccaucgugggcaga

SEQ ID NO: 290075 - RNA, 32 nt, Human
aagaugaugaggauaccagagaggcauugguc

SEQ ID NO: 290076 - RNA, 32 nt, Human
aagaugaugaugaugaugaagaggaggaagga

SEQ ID NO: 290077 - RNA, 32 nt, Human
aagaugaugccacugcacuccagccugggcua

SEQ ID NO: 290078 - RNA, 32 nt, Human
aagaugaugccauugcacuccagccugggcaa

SEQ ID NO: 290079 - RNA, 32 nt, Human
aagaugauguuaucuacugaacuccggguuau

SEQ ID NO: 290080 - RNA, 32 nt, Human
aagaugauguuuccagauuacacuccagccug

SEQ ID NO: 290081 - RNA, 32 nt, Human
aagaugauuucccauucacugcagucaucuga

SEQ ID NO: 290082 - RNA, 32 nt, Human
aagaugcaagaacaggaggagaagaugcggag

SEQ ID NO: 290083 - RNA, 32 nt, Human
aagaugcacaacacuccuccagucuugugggg

SEQ ID NO: 290084 - RNA, 32 nt, Human
aagaugcaccacugcaccccagccugggcgac

SEQ ID NO: 290085 - RNA, 32 nt, Human
aagaugcacugcaccccagccugggcgacaga

SEQ ID NO: 290086 - RNA, 23 nt, Human
aagaugcagauuacaggugugag

SEQ ID NO: 290087 - RNA, 32 nt, Human
aagaugcagcauuggccgagugcaguggcuca

SEQ ID NO: 290088 - RNA, 32 nt, Human
aagaugcaggaacaccaggagcaccuggaagc

SEQ ID NO: 290089 - RNA, 27 nt, Human
aagaugcaggagagaggaagccuugca

SEQ ID NO: 290090 - RNA, 28 nt, Human
aagaugcaggccugcauggugccggggc

SEQ ID NO: 290091 - RNA, 32 nt, Human
aagaugcaggggugugguaucccuggguccag

SEQ ID NO: 290092 - RNA, 32 nt, Human
aagaugcagggugguuggggccaggaguuugg

SEQ ID NO: 290093 - RNA, 32 nt, Human
aagaugcaguuccaccucccagauucccuagu

SEQ ID NO: 290094 - RNA, 32 nt, Human
aagaugcauccauguuuccugaugcuuguuuu

SEQ ID NO: 290095 - RNA, 32 nt, Human
aagaugccaauagcucuucacauuauaaacaa

SEQ ID NO: 290096 - RNA, 32 nt, Human
aagaugccaccaccccagaggaugugagccca

SEQ ID NO: 290097 - RNA, 32 nt, Human
aagaugccaggauauuggggcugaggggaguu

SEQ ID NO: 290098 - RNA, 32 nt, Human
aagaugccauugcacuccagccugggcaacag

SEQ ID NO: 290099 - RNA, 32 nt, Human
aagaugccauuuugaccccaguggcagcuucc

SEQ ID NO: 290100 - RNA, 28 nt, Human
aagaugcccaacaacagcacugcucugu

SEQ ID NO: 290101 - RNA, 32 nt, Human
aagaugcccccuucauucaucaguuacuugua

SEQ ID NO: 290102 - RNA, 28 nt, Human
aagaugcccuggcagagcucagaucugg

SEQ ID NO: 290103 - RNA, 32 nt, Human
aagaugccgcacacaaacaaugcaaacggggc

SEQ ID NO: 290104 - RNA, 32 nt, Human
aagaugccugagcauuugaaaaccugaauaua

SEQ ID NO: 290105 - RNA, 32 nt, Human
aagaugccuggaaagguugcaaagggagcaua

SEQ ID NO: 290106 - RNA, 32 nt, Human
aagaugccuuaaauucuaagauuccuuccagc

SEQ ID NO: 290107 - RNA, 32 nt, Human
aagaugccuuucuuccuguuugguucauugua

SEQ ID NO: 290108 - RNA, 32 nt, Human
aagaugcgaugggcaaucaagaggccugaauc

SEQ ID NO: 290109 - RNA, 32 nt, Human
aagaugcggagcugugugcgucucccuagguc

SEQ ID NO: 290110 - RNA, 32 nt, Human
aagaugcuaaaucuugcuuugcuuucaauaaa

SEQ ID NO: 290111 - RNA, 32 nt, Human
aagaugcuggcagauucaacuccuggggaagg

SEQ ID NO: 290112 - RNA, 32 nt, Human
aagaugcuggugaagcaggugcagugaggauc

SEQ ID NO: 290113 - RNA, 32 nt, Human
aagaugcugguuugugugugaacggacacuga

SEQ ID NO: 290114 - RNA, 32 nt, Human
aagaugcugugagccgagauugcgccauugca

SEQ ID NO: 290115 - RNA, 31 nt, Human
aagaugcuuaguaaaagcuguugaaaggaua

SEQ ID NO: 290116 - RNA, 32 nt, Human
aagaugcuugccauacaguagggacucaacca

SEQ ID NO: 290117 - RNA, 32 nt, Human
aagauggaaagccacaggaaggaagcggcacc

SEQ ID NO: 290118 - RNA, 32 nt, Human
aagauggaaggaaggaaggaaaaagaaagaga

SEQ ID NO: 290119 - RNA, 32 nt, Human
aagauggacagagagacaggagaugguccuuu

SEQ ID NO: 290120 - RNA, 32 nt, Human
aagauggacucggccccacauacacauuuuug

SEQ ID NO: 290121 - RNA, 32 nt, Human
aagauggagaagagguacaugaaggggauauu

SEQ ID NO: 290122 - RNA, 32 nt, Human
aagauggagagaagacugcagugagcggagug

SEQ ID NO: 290123 - RNA, 32 nt, Human
aagauggagaggaagaaacgcuaauucagcau

SEQ ID NO: 290124 - RNA, 32 nt, Human
aagauggagaugaaccucuaacacaguggaaa

SEQ ID NO: 290125 - RNA, 32 nt, Human
aagauggagaugccagcuccagugaaggcgag

SEQ ID NO: 290126 - RNA, 32 nt, Human
aagauggagccagcacagcacucauugcaguu

SEQ ID NO: 290127 - RNA, 32 nt, Human
aagauggaggcugaaauuaaagagaaagaucc

SEQ ID NO: 290128 - RNA, 32 nt, Human
aagauggaggggcugguuuccuuccacucucc

SEQ ID NO: 290129 - RNA, 19 nt, Human
aagauggaguuaacuuggc

SEQ ID NO: 290130 - RNA, 32 nt, Human
aagauggauaaucagugaaacuacuuaacaca

SEQ ID NO: 290131 - RNA, 32 nt, Human
aagauggaugcuacagagagagagggggacuu

SEQ ID NO: 290132 - RNA, 32 nt, Human
aagauggaugugaaucuuacauuccuuuucau

SEQ ID NO: 290133 - RNA, 32 nt, Human
aagauggauucucagccccaccagccugaucu

SEQ ID NO: 290134 - RNA, 32 nt, Human
aagauggcaacuuugagagccuuguguugaag

SEQ ID NO: 290135 - RNA, 28 nt, Human
aagauggcaauguugccucccccaggac

SEQ ID NO: 290136 - RNA, 32 nt, Human
aagauggcaccacuacacuccagcccgggcga

SEQ ID NO: 290137 - RNA, 32 nt, Human
aagauggcaccacuacauuucagccugggcga

SEQ ID NO: 290138 - RNA, 32 nt, Human
aagauggcaccacugcacuccagccuagguga

SEQ ID NO: 290139 - RNA, 32 nt, Human
aagauggcaccacugcacuccagccuggguga

SEQ ID NO: 290140 - RNA, 32 nt, Human
aagauggcaccacugcacuccauccuggguga

SEQ ID NO: 290141 - RNA, 32 nt, Human
aagauggcaccauuacacuccagccugggcaa

SEQ ID NO: 290142 - RNA, 28 nt, Human
aagauggcagaagaaguggugguaguag

SEQ ID NO: 290143 - RNA, 28 nt, Human
aagauggcagaggagagcagcuguacca

SEQ ID NO: 290144 - RNA, 28 nt, Human
aagauggcagaggcaccggcuuccccgg

SEQ ID NO: 290145 - RNA, 32 nt, Human
aagauggcaggcaaggguacccuuggccagga

SEQ ID NO: 290146 - RNA, 32 nt, Human
aagauggcauggcuggcguggccacacugcug

SEQ ID NO: 290147 - RNA, 32 nt, Human
aagauggccagccugaaacuguuggccagggc

SEQ ID NO: 290148 - RNA, 28 nt, Human
aagauggcccaggaauuugaggcuacag

SEQ ID NO: 290149 - RNA, 32 nt, Human
aagauggcccugcuccuuuucugcugaacauu

SEQ ID NO: 290150 - RNA, 32 nt, Human
aagauggccuguaaucccagcacuuugggagg

SEQ ID NO: 290151 - RNA, 32 nt, Human
aagauggccuucucccccgacccgaccuccuu

SEQ ID NO: 290152 - RNA, 32 nt, Human
aagauggcgccacuacacuccagccugggcaa

SEQ ID NO: 290153 - RNA, 32 nt, Human
aagauggcgccacuacacuccagccugggcga

SEQ ID NO: 290154 - RNA, 32 nt, Human
aagauggcgccacugcacuccagccuggguga

SEQ ID NO: 290155 - RNA, 32 nt, Human
aagauggcgccacugcacuccagucugggcga

SEQ ID NO: 290156 - RNA, 32 nt, Human
aagauggcgccacugcauuccagccugggcaa

SEQ ID NO: 290157 - RNA, 32 nt, Human
aagauggcgccauugcacuccagccuggguga

SEQ ID NO: 290158 - RNA, 32 nt, Human
aagauggcgggcgggcugcucugaagagaccc

SEQ ID NO: 290159 - RNA, 32 nt, Human
aagauggcgugcacaggacacagcgugggcgg

SEQ ID NO: 290160 - RNA, 32 nt, Human
aagauggcucagcagacaggccagcccagcuc

SEQ ID NO: 290161 - RNA, 32 nt, Human
aagauggcugcugccugcucauggcccucgga

SEQ ID NO: 290162 - RNA, 32 nt, Human
aagauggcugggaagagaggaggaguggcaga

SEQ ID NO: 290163 - RNA, 32 nt, Human
aagauggcuguggagcugggcgugcugcucgu

SEQ ID NO: 290164 - RNA, 32 nt, Human
aagaugggaagaucacuugagcucaggaguau

SEQ ID NO: 290165 - RNA, 32 nt, Human
aagaugggacagcaacaaaaucauggcuuagg

SEQ ID NO: 290166 - RNA, 28 nt, Human
aagaugggaggcaagcucagcaagaaga

SEQ ID NO: 290167 - RNA, 32 nt, Human
aagaugggagucucccuauguugcccaggcug

SEQ ID NO: 290168 - RNA, 32 nt, Human
aagaugggcacccacccccaccaagggaagac

SEQ ID NO: 290169 - RNA, 23 nt, Human
aagaugggcggaucaccugaggu

SEQ ID NO: 290170 - RNA, 32 nt, Human
aagaugggcguucacuccccacggccaccaag

SEQ ID NO: 290171 - RNA, 20 nt, Human
aagauggggagcguuggaga

SEQ ID NO: 290172 - RNA, 32 nt, Human
aagauggggauaauguggaaauggcaguuguc

SEQ ID NO: 290173 - RNA, 32 nt, Human
aagaugggggcuaugacagugauguuacaagg

SEQ ID NO: 290174 - RNA, 32 nt, Human
aagaugggguacuaacaccacccccaccgccc

SEQ ID NO: 290175 - RNA, 32 nt, Human
aagaugggucucaaccccuccccaccacguca

SEQ ID NO: 290176 - RNA, 23 nt, Human
aagauggguggaucaccugaggu

SEQ ID NO: 290177 - RNA, 32 nt, Human
aagauggguucugcauggagccacuccaggga

SEQ ID NO: 290178 - RNA, 32 nt, Human
aagauggguuuauucacugaacucuagugcgg

SEQ ID NO: 290179 - RNA, 32 nt, Human
aagaugguaacguagagaagaauugguucuca

SEQ ID NO: 290180 - RNA, 32 nt, Human
aagaugguacaguucuacaucugcaccugccc

SEQ ID NO: 290181 - RNA, 28 nt, Human
aagauggucgccaagcaaaggauccgua

SEQ ID NO: 290182 - RNA, 32 nt, Human
aagauggucucaagcuccugaccucgugaucc

SEQ ID NO: 290183 - RNA, 32 nt, Human
aagauggucucgaucuccugaccucgugaucc

SEQ ID NO: 290184 - RNA, 32 nt, Human
aagauggucucgaucuccugaccucgugaucu

SEQ ID NO: 290185 - RNA, 32 nt, Human
aagauggucucgaucuccugaccucgugauuc

SEQ ID NO: 290186 - RNA, 32 nt, Human
aagauggugaugguagagaagcugcccggaau

SEQ ID NO: 290187 - RNA, 32 nt, Human
aagaugguggccugaggccaggaggcugcagc

SEQ ID NO: 290188 - RNA, 32 nt, Human
aagaugguggugagcugcaaaauagcuggaug

SEQ ID NO: 290189 - RNA, 32 nt, Human
aagaugguguaugacagagcauuggccuugac

SEQ ID NO: 290190 - RNA, 32 nt, Human
aagaugguuacuggagcucuagcugccuauuu

SEQ ID NO: 290191 - RNA, 21 nt, Human
aagauguaaacagcccagagg

SEQ ID NO: 290192 - RNA, 32 nt, Human
aagauguaacacagcagaaaagucuugucgga

SEQ ID NO: 290193 - RNA, 32 nt, Human
aagaugucaaauugaauaaaaaucacagcaau

SEQ ID NO: 290194 - RNA, 32 nt, Human
aagaugucauuuccaccagcaguucccuuagg

SEQ ID NO: 290195 - RNA, 32 nt, Human
aagauguccacucaugcccacccaugagaggg

SEQ ID NO: 290196 - RNA, 32 nt, Human
aagauguccaggagcccacugccuuagaaagc

SEQ ID NO: 290197 - RNA, 32 nt, Human
aagaugucugaccuccuucauaugcaaaaaua

SEQ ID NO: 290198 - RNA, 32 nt, Human
aagaugucuguacuaacaggugcuguaacacu

SEQ ID NO: 290199 - RNA, 32 nt, Human
aagaugucuuccucucggacccucugcugccc

SEQ ID NO: 290200 - RNA, 32 nt, Human
aagaugugaacuguuucucuucugcagaaaaa

SEQ ID NO: 290201 - RNA, 32 nt, Human
aagaugugaauggcagaacaauuacacacagu

SEQ ID NO: 290202 - RNA, 32 nt, Human
aagaugugcccaggagguggcgguggcgcaca

SEQ ID NO: 290203 - RNA, 32 nt, Human
aagauguggaccaaggccuguggguacuccag

SEQ ID NO: 290204 - RNA, 32 nt, Human
aagauguggagguggaagacagugauauugug

SEQ ID NO: 290205 - RNA, 32 nt, Human
aagauguggauuauuguuagaaucugugacuu

SEQ ID NO: 290206 - RNA, 32 nt, Human
aagauguggccaaagggcuagagccaggaauu

SEQ ID NO: 290207 - RNA, 32 nt, Human
aagaugugggagcaggaagugaggcugcggca

SEQ ID NO: 290208 - RNA, 32 nt, Human
aagaugugguuacugagauuugggaagaagca

SEQ ID NO: 290209 - RNA, 32 nt, Human
aagaugugugugugagaguauguaugugugug

SEQ ID NO: 290210 - RNA, 32 nt, Human
aagauguuagccaguuucagagcuguguacuc

SEQ ID NO: 290211 - RNA, 32 nt, Human
aagauguuccagucaggauucaauccuugaua

SEQ ID NO: 290212 - RNA, 32 nt, Human
aagauguugagugguggggcuggagggcuggg

SEQ ID NO: 290213 - RNA, 32 nt, Human
aagauguugcccuuucuaaugcuaguuaacag

SEQ ID NO: 290214 - RNA, 32 nt, Human
aagauguuugaguccgaguccuagccacucgc

SEQ ID NO: 290215 - RNA, 30 nt, Human
aagauuaaaaacaaaugcuuacugaauuug

SEQ ID NO: 290216 - RNA, 32 nt, Human
aagauuaaaaacaaaugcuuacugaauuugaa

SEQ ID NO: 290217 - RNA, 20 nt, Human
aagauuaaaaauaacuuggc

SEQ ID NO: 290218 - RNA, 32 nt, Human
aagauuaaaaggauuuuguugguaccugguuu

SEQ ID NO: 290219 - RNA, 32 nt, Human
aagauuaacaagucagagucugugguguaugu

SEQ ID NO: 290220 - RNA, 32 nt, Human
aagauuaacagcuaucucucucauuuccuacu

SEQ ID NO: 290221 - RNA, 32 nt, Human
aagauuaaugguagaacaaccugaaggauuua

SEQ ID NO: 290222 - RNA, 22 nt, Human
aagauuaauuuuguggcaguuu

SEQ ID NO: 290223 - RNA, 32 nt, Human
aagauuacaaguggacaccugagucagcagga

SEQ ID NO: 290224 - RNA, 32 nt, Human
aagauuacagaagugcugaagcagaccauucu

SEQ ID NO: 290225 - RNA, 32 nt, Human
aagauuacaggaagggcauuacaaaucugguc

SEQ ID NO: 290226 - RNA, 32 nt, Human
aagauuaccauggucaauacagucuuucucca

SEQ ID NO: 290227 - RNA, 32 nt, Human
aagauuacgccacugcacuaaugucuggugac

SEQ ID NO: 290228 - RNA, 32 nt, Human
aagauuacgccacugcacuccagccuggguga

SEQ ID NO: 290229 - RNA, 32 nt, Human
aagauuacgucacugcauuccagccuggguga

SEQ ID NO: 290230 - RNA, 32 nt, Human
aagauuagccaggcauaguagcacuugccugu

SEQ ID NO: 290231 - RNA, 32 nt, Human
aagauuagcuaggagacuggaaaaagaccagg

SEQ ID NO: 290232 - RNA, 32 nt, Human
aagauuaggacuccugaguugcccaugauuuc

SEQ ID NO: 290233 - RNA, 32 nt, Human
aagauuaugccacugcacuccagccuggguga

SEQ ID NO: 290234 - RNA, 32 nt, Human
aagauuaugccacugcacuucagccuggguga

SEQ ID NO: 290235 - RNA, 32 nt, Human
aagauuaugccauugcacuccagccuggguga

SEQ ID NO: 290236 - RNA, 32 nt, Human
aagauuauguacugagagaauccugaagaaug

SEQ ID NO: 290237 - RNA, 32 nt, Human
aagauuaugucacugcacuccauccuggguga

SEQ ID NO: 290238 - RNA, 32 nt, Human
aagauuauuuaaauuauguuucccucugauuu

SEQ ID NO: 290239 - RNA, 32 nt, Human
aagauucaagacccuucucuugcuugucaccc

SEQ ID NO: 290240 - RNA, 32 nt, Human
aagauucaagucagaaaucacagggaaaauuc

SEQ ID NO: 290241 - RNA, 32 nt, Human
aagauucacgcuucugcauccaccucugcccu

SEQ ID NO: 290242 - RNA, 32 nt, Human
aagauucaggagucauuagcagugaugauuuu

SEQ ID NO: 290243 - RNA, 32 nt, Human
aagauucagggaaagacuaacugugaaaagga

SEQ ID NO: 290244 - RNA, 32 nt, Human
aagauucauacuccugaugcuacugacaacgu

SEQ ID NO: 290245 - RNA, 32 nt, Human
aagauucaugccaucaggggcaccuugucacu

SEQ ID NO: 290246 - RNA, 32 nt, Human
aagauucauuaaguucuugucauuucaaauuu

SEQ ID NO: 290247 - RNA, 32 nt, Human
aagauuccaauuaaauuuaugccuuauaaaau

SEQ ID NO: 290248 - RNA, 32 nt, Human
aagauuccauugugcagaacuggagucuuuac

SEQ ID NO: 290249 - RNA, 32 nt, Human
aagauuccccuccagaaaaauacguauguuua

SEQ ID NO: 290250 - RNA, 32 nt, Human
aagauuccucugcuuuuccuccuuuuuaccau

SEQ ID NO: 290251 - RNA, 32 nt, Human
aagauuccuuucccugccuucucccauacauu

SEQ ID NO: 290252 - RNA, 32 nt, Human
aagauuccuuuccuauccauccuuccauccag

SEQ ID NO: 290253 - RNA, 23 nt, Human
aagauuccuuuugugaaaaguuu

SEQ ID NO: 290254 - RNA, 32 nt, Human
aagauucuagaguuggccggaggcagaacaug

SEQ ID NO: 290255 - RNA, 32 nt, Human
aagauucuauucugcuggccaguggaacagag

SEQ ID NO: 290256 - RNA, 18 nt, Human
aagauucugaagcuuggc

SEQ ID NO: 290257 - RNA, 32 nt, Human
aagauucuggggaaggggaaaggcaggcccac

SEQ ID NO: 290258 - RNA, 32 nt, Human
aagauucuucaucgguuucuccaucucugaag

SEQ ID NO: 290259 - RNA, 32 nt, Human
aagauucuugggguaacagauucuucuggggc

SEQ ID NO: 290260 - RNA, 32 nt, Human
aagauugaaaggagauauuuuaucaaguggca

SEQ ID NO: 290261 - RNA, 32 nt, Human
aagauugaagaaaaauaagaagaagaagacag

SEQ ID NO: 290262 - RNA, 32 nt, Human
aagauugacucaugggaccugaagggugacau

SEQ ID NO: 290263 - RNA, 19 nt, Human
aagauugagccacugcacu

SEQ ID NO: 290264 - RNA, 32 nt, Human
aagauugagccacugcacuccagccuggguga

SEQ ID NO: 290265 - RNA, 32 nt, Human
aagauugagccauugcucuccagccuggguga

SEQ ID NO: 290266 - RNA, 32 nt, Human
aagauugagcugucuuuuauuuggaggauaaa

SEQ ID NO: 290267 - RNA, 32 nt, Human
aagauugagcuuguuuucucucaguguguucu

SEQ ID NO: 290268 - RNA, 32 nt, Human
aagauugcaauuauuuguuuuucuacuuugaa

SEQ ID NO: 290269 - RNA, 32 nt, Human
aagauugcacacugcacuccagccugggugac

SEQ ID NO: 290270 - RNA, 32 nt, Human
aagauugcaccaccacacuccagccuggguga

SEQ ID NO: 290271 - RNA, 32 nt, Human
aagauugcaccacugcacuacagcuuggguga

SEQ ID NO: 290272 - RNA, 32 nt, Human
aagauugcaccacugcacuccaaccuggguga

SEQ ID NO: 290273 - RNA, 32 nt, Human
aagauugcaccacugcacuccagccgggguga

SEQ ID NO: 290274 - RNA, 32 nt, Human
aagauugcaccacugcacuccagccugggcaa

SEQ ID NO: 290275 - RNA, 32 nt, Human
aagauugcaccacugcacuccagccugggcga

SEQ ID NO: 290276 - RNA, 32 nt, Human
aagauugcaccacugcauuccagcauggccac

SEQ ID NO: 290277 - RNA, 32 nt, Human
aagauugcaccacugcucuccagccuggggaa

SEQ ID NO: 290278 - RNA, 32 nt, Human
aagauugcaccacuguacuccagccugggcaa

SEQ ID NO: 290279 - RNA, 32 nt, Human
aagauugcaccacuguacuccagccuggguga

SEQ ID NO: 290280 - RNA, 32 nt, Human
aagauugcaccauugaacuccagccugggcaa

SEQ ID NO: 290281 - RNA, 32 nt, Human
aagauugcaccauugcacuccagccuggcgac

SEQ ID NO: 290282 - RNA, 32 nt, Human
aagauugcaccauugcacuccagccuggguga

SEQ ID NO: 290283 - RNA, 32 nt, Human
aagauugcaccauugcauuccagccuggguga

SEQ ID NO: 290284 - RNA, 32 nt, Human
aagauugcacccugcacucuagccugggcaac

SEQ ID NO: 290285 - RNA, 32 nt, Human
aagauugcacuacuacacuccagccuggugac

SEQ ID NO: 290286 - RNA, 32 nt, Human
aagauugcacuacugcacuccagccuggguga

SEQ ID NO: 290287 - RNA, 32 nt, Human
aagauugcagcccaguuuucuucagaaaccau

SEQ ID NO: 290288 - RNA, 32 nt, Human
aagauugcagugagccaagaucacgccauugc

SEQ ID NO: 290289 - RNA, 32 nt, Human
aagauugcagugagcuaugaacaccacugcac

SEQ ID NO: 290290 - RNA, 32 nt, Human
aagauugcagugagcuaugaucaugccacugc

SEQ ID NO: 290291 - RNA, 32 nt, Human
aagauugcagugagcugaaaucacaccacuac

SEQ ID NO: 290292 - RNA, 32 nt, Human
aagauugcagugagcugauaucgcaccauugu

SEQ ID NO: 290293 - RNA, 32 nt, Human
aagauugcaucacugcacuccagcuuggguga

SEQ ID NO: 290294 - RNA, 32 nt, Human
aagauugccccacugcacuccacccugggcaa

SEQ ID NO: 290295 - RNA, 32 nt, Human
aagauugcgccacugcacuccacccuggguga

SEQ ID NO: 290296 - RNA, 32 nt, Human
aagauugcgccacugcacuccagccagggcga

SEQ ID NO: 290297 - RNA, 32 nt, Human
aagauugcgccacugcacuccagccugacgac

SEQ ID NO: 290298 - RNA, 32 nt, Human
aagauugcgccacugcacuccagccugggcaa

SEQ ID NO: 290299 - RNA, 32 nt, Human
aagauugcgccacugcacuccagccuggguga

SEQ ID NO: 290300 - RNA, 32 nt, Human
aagauugcgccacuguacuccagcuugggcaa

SEQ ID NO: 290301 - RNA, 32 nt, Human
aagauugcgccauugcacuccagccugggcaa

SEQ ID NO: 290302 - RNA, 32 nt, Human
aagauugcgccauugcauuccagccugggcaa

SEQ ID NO: 290303 - RNA, 32 nt, Human
aagauugcgcccccugcacuccagccugggcu

SEQ ID NO: 290304 - RNA, 32 nt, Human
aagauugcgccgcuacauuccagccugggcaa

SEQ ID NO: 290305 - RNA, 32 nt, Human
aagauugcgccguuguacuccagccugggcaa

SEQ ID NO: 290306 - RNA, 32 nt, Human
aagauugcgucacugcacugcagccuggguga

SEQ ID NO: 290307 - RNA, 32 nt, Human
aagauuggaaacacuuucugaaaaagaaagca

SEQ ID NO: 290308 - RNA, 32 nt, Human
aagauuggccgggaauuugaggcugcaaggau

SEQ ID NO: 290309 - RNA, 32 nt, Human
aagauuggcucccaugguacuacagguugagu

SEQ ID NO: 290310 - RNA, 32 nt, Human
aagauuggcuuacaaucuuacucuugucauuc

SEQ ID NO: 290311 - RNA, 32 nt, Human
aagauuggcuucaagaauggaggggaaaugca

SEQ ID NO: 290312 - RNA, 32 nt, Human
aagauugggaaaaagacaggaaugagagggga

SEQ ID NO: 290313 - RNA, 32 nt, Human
aagauugggcuccuaagcuccugcucugcugg

SEQ ID NO: 290314 - RNA, 32 nt, Human
aagauuguaccacugcacuccaaccuggguua

SEQ ID NO: 290315 - RNA, 32 nt, Human
aagauuguaccacugcacuccagccugggcaa

SEQ ID NO: 290316 - RNA, 32 nt, Human
aagauuguaccacugcacuccaguuuggcaac

SEQ ID NO: 290317 - RNA, 32 nt, Human
aagauuguaccacuguacuccagccugggcug

SEQ ID NO: 290318 - RNA, 32 nt, Human
aagauugucuguccuucaggacuuccaaggcu

SEQ ID NO: 290319 - RNA, 32 nt, Human
aagauugugacacugcacuccagccugggcaa

SEQ ID NO: 290320 - RNA, 32 nt, Human
aagauugugcacugcacucuagccugggggaa

SEQ ID NO: 290321 - RNA, 32 nt, Human
aagauugugccaccacacuccagccugggcga

SEQ ID NO: 290322 - RNA, 32 nt, Human
aagauugugccacggcacuccagccugggcag

SEQ ID NO: 290323 - RNA, 32 nt, Human
aagauugugccacuacacuccagccugggaga

SEQ ID NO: 290324 - RNA, 19 nt, Human
aagauugugccacugcacu

SEQ ID NO: 290325 - RNA, 32 nt, Human
aagauugugccacugcacuccacccugggcaa

SEQ ID NO: 290326 - RNA, 32 nt, Human
aagauugugccacugcacuccagccugagcaa

SEQ ID NO: 290327 - RNA, 32 nt, Human
aagauugugccacugcacuccagccugggcaa

SEQ ID NO: 290328 - RNA, 32 nt, Human
aagauugugccacugcacuccagccugggcga

SEQ ID NO: 290329 - RNA, 32 nt, Human
aagauugugccacugcacuccagccuggguaa

SEQ ID NO: 290330 - RNA, 32 nt, Human
aagauugugccacugcacuccagccuggguga

SEQ ID NO: 290331 - RNA, 32 nt, Human
aagauugugccacugcacuccagcgugggcaa

SEQ ID NO: 290332 - RNA, 32 nt, Human
aagauugugccacugcacucuagccuaggugg

SEQ ID NO: 290333 - RNA, 32 nt, Human
aagauugugccacugcacucuagccugggcaa

SEQ ID NO: 290334 - RNA, 32 nt, Human
aagauugugccacugcacugcaggcuggguga

SEQ ID NO: 290335 - RNA, 32 nt, Human
aagauugugccacuguacuccagccuggguga

SEQ ID NO: 290336 - RNA, 32 nt, Human
aagauugugccauugcacuccagccugggcaa

SEQ ID NO: 290337 - RNA, 32 nt, Human
aagauugugccauugcacuccagccuggguga

SEQ ID NO: 290338 - RNA, 32 nt, Human
aagauuguucaagagcagucugggcaacaugg

SEQ ID NO: 290339 - RNA, 32 nt, Human
aagauuguuucagacuuuuguuugugugcuug

SEQ ID NO: 290340 - RNA, 22 nt, Human
aagauuuacaucuauaacuaga

SEQ ID NO: 290341 - RNA, 24 nt, Human
aagauuuaugccagagccuugcag

SEQ ID NO: 290342 - RNA, 32 nt, Human
aagauuuaugccagagccuugcaggauggagc

SEQ ID NO: 290343 - RNA, 32 nt, Human
aagauuuauguuaauguaugugcuccaaaacc

SEQ ID NO: 290344 - RNA, 32 nt, Human
aagauuucaagcuaaagaugguggugaugaac

SEQ ID NO: 290345 - RNA, 32 nt, Human
aagauuuccccagcuuucuagguaacugugcu

SEQ ID NO: 290346 - RNA, 32 nt, Human
aagauuucuacacugaaaauguuaauauuauu

SEQ ID NO: 290347 - RNA, 32 nt, Human
aagauuucucaucuucucaucccuaggacaag

SEQ ID NO: 290348 - RNA, 32 nt, Human
aagauuucugacuuugccacuguaaaugccuu

SEQ ID NO: 290349 - RNA, 32 nt, Human
aagauuucuggcucagcucucugaauuugcca

SEQ ID NO: 290350 - RNA, 32 nt, Human
aagauuugaaguuuagacuaaagagcugggaa

SEQ ID NO: 290351 - RNA, 32 nt, Human
aagauuugaaucugauaucuccaccaaagccu

SEQ ID NO: 290352 - RNA, 32 nt, Human
aagauuuggaaggagaucaucacagcuaaugu

SEQ ID NO: 290353 - RNA, 32 nt, Human
aagauuuggagaccugggcuugaguuccagcu

SEQ ID NO: 290354 - RNA, 32 nt, Human
aagauuuggccaggggcagcugugcuggcuua

SEQ ID NO: 290355 - RNA, 32 nt, Human
aagauuuggggaggggaggguagccacagaaa

SEQ ID NO: 290356 - RNA, 32 nt, Human
aagauuuggugccugcagccucuugucugguu

SEQ ID NO: 290357 - RNA, 32 nt, Human
aagauuuguauuugaaucaucuguaaagucgc

SEQ ID NO: 290358 - RNA, 32 nt, Human
aagauuuguuuuggugucaaaauaacaugaaa

SEQ ID NO: 290359 - RNA, 32 nt, Human
aagauuuuaggugguucaguccuucaccuggu

SEQ ID NO: 290360 - RNA, 32 nt, Human
aagauuuucccaagguugaucuggaggugacg

SEQ ID NO: 290361 - RNA, 32 nt, Human
aagauuuucucaaacuccuuuuuaagccaauu

SEQ ID NO: 290362 - RNA, 32 nt, Human
aagauuuucuugggcaucucccggaaagugcg

SEQ ID NO: 290363 - RNA, 24 nt, Human
aagauuuugcugcuuuugccugaa

SEQ ID NO: 290364 - RNA, 32 nt, Human
aagauuuugucccauuuucccaugaagcuaca

SEQ ID NO: 290365 - RNA, 20 nt, Human
aagcaaaaaagggucccaga

SEQ ID NO: 290366 - RNA, 26 nt, Human
aagcaaaaacaaaaaagcuauccaga

SEQ ID NO: 290367 - RNA, 32 nt, Human
aagcaaaaacuaguaaagacauaggaacaugu

SEQ ID NO: 290368 - RNA, 32 nt, Human
aagcaaaaaggucaagaguaccaccugaccca

SEQ ID NO: 290369 - RNA, 32 nt, Human
aagcaaaaaugagauccaggcuggagcggcug

SEQ ID NO: 290370 - RNA, 32 nt, Human
aagcaaaaccacaugggaaaacucagcacugg

SEQ ID NO: 290371 - RNA, 32 nt, Human
aagcaaaagaagagaugagaagaggcacaaga

SEQ ID NO: 290372 - RNA, 32 nt, Human
aagcaaaagaccuacaauaggugguggaauua

SEQ ID NO: 290373 - RNA, 32 nt, Human
aagcaaaauagaagaaagcuauaccauuacca

SEQ ID NO: 290374 - RNA, 32 nt, Human
aagcaaaauguccuacauuagagaucaccaag

SEQ ID NO: 290375 - RNA, 32 nt, Human
aagcaaaauuggucucuuuagagaccaauuug

SEQ ID NO: 290376 - RNA, 32 nt, Human
aagcaaacauccauaguaaaacaaauaaucuu

SEQ ID NO: 290377 - RNA, 32 nt, Human
aagcaaaccuaccccggaucucuggcuucagc

SEQ ID NO: 290378 - RNA, 32 nt, Human
aagcaaacgagcugcccacaguucucugcccu

SEQ ID NO: 290379 - RNA, 32 nt, Human
aagcaaacuaaccuggaaucccuucaccuaga

SEQ ID NO: 290380 - RNA, 32 nt, Human
aagcaaacucaccuuaaauaaucuggauuuuc

SEQ ID NO: 290381 - RNA, 32 nt, Human
aagcaaacuggagauuccucagccucucgugg

SEQ ID NO: 290382 - RNA, 32 nt, Human
aagcaaagaaucacaaggaaccucuggcuagg

SEQ ID NO: 290383 - RNA, 32 nt, Human
aagcaaagacuagggacaggcaaagauaauuu

SEQ ID NO: 290384 - RNA, 32 nt, Human
aagcaaagaggaaggaagggaggucugugguc

SEQ ID NO: 290385 - RNA, 32 nt, Human
aagcaaagagucacugcaucaaugaaaguuca

SEQ ID NO: 290386 - RNA, 32 nt, Human
aagcaaagagugagaaagaauaggggcugaag

SEQ ID NO: 290387 - RNA, 32 nt, Human
aagcaaagauaagcaugaaaacuugacaauga

SEQ ID NO: 290388 - RNA, 26 nt, Human
aagcaaagcagcccccaaagcauauu

SEQ ID NO: 290389 - RNA, 23 nt, Human
aagcaaagcaggagcaggcacau

SEQ ID NO: 290390 - RNA, 32 nt, Human
aagcaaagccgccaccacagagcccgaaacaa

SEQ ID NO: 290391 - RNA, 32 nt, Human
aagcaaaggaaaaggggauggcaaacagaaau

SEQ ID NO: 290392 - RNA, 32 nt, Human
aagcaaaggagagcuuggggguggggagaaaa

SEQ ID NO: 290393 - RNA, 31 nt, Human
aagcaaaggcacuucugagcacgucuucucc

SEQ ID NO: 290394 - RNA, 32 nt, Human
aagcaaaggcagaaacggcaucaggagagaca

SEQ ID NO: 290395 - RNA, 32 nt, Human
aagcaaaggcauagaagggauauuuuugugua

SEQ ID NO: 290396 - RNA, 32 nt, Human
aagcaaaggcuucccacccaagucccccaucu

SEQ ID NO: 290397 - RNA, 32 nt, Human
aagcaaaguacugaugaauucaguaaacaaga

SEQ ID NO: 290398 - RNA, 32 nt, Human
aagcaaaguguucaccacuaaagcuaaccauu

SEQ ID NO: 290399 - RNA, 32 nt, Human
aagcaaauaagaaucucagagacucgcagcau

SEQ ID NO: 290400 - RNA, 32 nt, Human
aagcaaaugauuugggucucaacugaagauga

SEQ ID NO: 290401 - RNA, 25 nt, Human
aagcaaauuaaaguaaacugagaua

SEQ ID NO: 290402 - RNA, 32 nt, Human
aagcaaauugaaaacaggacucugcugggagc

SEQ ID NO: 290403 - RNA, 32 nt, Human
aagcaaauugcaggguuugcugccuggcagag

SEQ ID NO: 290404 - RNA, 32 nt, Human
aagcaaauuguacaaaguauguaggauguuuu

SEQ ID NO: 290405 - RNA, 32 nt, Human
aagcaacaacagcaaucaacaccaagaucuuc

SEQ ID NO: 290406 - RNA, 22 nt, Human
aagcaacaagguucugcuccau

SEQ ID NO: 290407 - RNA, 31 nt, Human
aagcaacaagugugggguuaagcagggagaa

SEQ ID NO: 290408 - RNA, 32 nt, Human
aagcaacacagaaaaaguuccuaagugguccc

SEQ ID NO: 290409 - RNA, 32 nt, Human
aagcaacaccccucuggagccagcacagugcu

SEQ ID NO: 290410 - RNA, 32 nt, Human
aagcaacagaagcaacuuuucccaucuggaau

SEQ ID NO: 290411 - RNA, 32 nt, Human
aagcaacagcagggguaauggaggaagugugg

SEQ ID NO: 290412 - RNA, 32 nt, Human
aagcaacagcagggguaguggaggaagugugg

SEQ ID NO: 290413 - RNA, 32 nt, Human
aagcaacauagugaaaccccaucuccaaaaau

SEQ ID NO: 290414 - RNA, 32 nt, Human
aagcaacauccuguucagcuguaugggcacua

SEQ ID NO: 290415 - RNA, 32 nt, Human
aagcaacauggcauuaggcugcauggguagaa

SEQ ID NO: 290416 - RNA, 32 nt, Human
aagcaaccucuccugccacccagaucccaucu

SEQ ID NO: 290417 - RNA, 32 nt, Human
aagcaacgggagguggaggauccuggaggugu

SEQ ID NO: 290418 - RNA, 32 nt, Human
aagcaacuagugccauugcagguggcuuucuc

SEQ ID NO: 290419 - RNA, 32 nt, Human
aagcaacuccugccucccuuccucacccuguc

SEQ ID NO: 290420 - RNA, 32 nt, Human
aagcaacuggauuuacagauuuauugugagac

SEQ ID NO: 290421 - RNA, 32 nt, Human
aagcaacuguuaaggccagcccuugccccuca

SEQ ID NO: 290422 - RNA, 32 nt, Human
aagcaacuuagcaaggcuucuuuucauuauuu

SEQ ID NO: 290423 - RNA, 32 nt, Human
aagcaacuugacuucagagggauggcucaaug

SEQ ID NO: 290424 - RNA, 32 nt, Human
aagcaagaaaggaucugcaugauaacuuugca

SEQ ID NO: 290425 - RNA, 32 nt, Human
aagcaagaaggaugagaauuuuagaucuggaa

SEQ ID NO: 290426 - RNA, 32 nt, Human
aagcaagaaguggucuucuggccuggcaaccc

SEQ ID NO: 290427 - RNA, 32 nt, Human
aagcaagaaguuaaagagugaacaugguggaa

SEQ ID NO: 290428 - RNA, 32 nt, Human
aagcaagacccugugugaaauuaaaaggaggu

SEQ ID NO: 290429 - RNA, 32 nt, Human
aagcaagacguggagguuuuaccagggguuag

SEQ ID NO: 290430 - RNA, 32 nt, Human
aagcaagacucaaccaggucuucugcugucaa

SEQ ID NO: 290431 - RNA, 32 nt, Human
aagcaagagaugguccaugcuuuucugacguu

SEQ ID NO: 290432 - RNA, 32 nt, Human
aagcaagaugcaaauauaauguucucauuagu

SEQ ID NO: 290433 - RNA, 32 nt, Human
aagcaagauggguaacaucacaguagauucgu

SEQ ID NO: 290434 - RNA, 32 nt, Human
aagcaagcagagaccauaaaagaggcacuaau

SEQ ID NO: 290435 - RNA, 32 nt, Human
aagcaagcaucuggcuucuguggaguuguugg

SEQ ID NO: 290436 - RNA, 32 nt, Human
aagcaagcauucagaagaaaaagaagcaaccu

SEQ ID NO: 290437 - RNA, 32 nt, Human
aagcaagccggcagaaauagcuauggaagguc

SEQ ID NO: 290438 - RNA, 32 nt, Human
aagcaagccuggaggccaggagccuaggaggg

SEQ ID NO: 290439 - RNA, 32 nt, Human
aagcaagcggccacaagggacugaggcaagca

SEQ ID NO: 290440 - RNA, 32 nt, Human
aagcaagcucugcacguggccuagaguaugac

SEQ ID NO: 290441 - RNA, 32 nt, Human
aagcaagcuguucuccuggcaagccaggcgaa

SEQ ID NO: 290442 - RNA, 32 nt, Human
aagcaaggaaagugccugguaggacugacggc

SEQ ID NO: 290443 - RNA, 32 nt, Human
aagcaaggaggagggaggugggguagggagga

SEQ ID NO: 290444 - RNA, 32 nt, Human
aagcaaggagggagcgugaggagcagccaggu

SEQ ID NO: 290445 - RNA, 32 nt, Human
aagcaaggaguauguuaaaaugaccagacacc

SEQ ID NO: 290446 - RNA, 32 nt, Human
aagcaaggaugcuuuggacacugugcguggcg

SEQ ID NO: 290447 - RNA, 32 nt, Human
aagcaaggcaugaccucagcuccacuuuugag

SEQ ID NO: 290448 - RNA, 32 nt, Human
aagcaaggcccaggcuggcccagaugggacac

SEQ ID NO: 290449 - RNA, 22 nt, Human
aagcaaggcucuuaguuuguaa

SEQ ID NO: 290450 - RNA, 32 nt, Human
aagcaagggaaagaggaaguggagucauuuug

SEQ ID NO: 290451 - RNA, 32 nt, Human
aagcaagggaaagaggaggagaucaaucuaga

SEQ ID NO: 290452 - RNA, 32 nt, Human
aagcaagggaaugaaguauaccaacuucuuug

SEQ ID NO: 290453 - RNA, 21 nt, Human
aagcaaguaaccagcuucuca

SEQ ID NO: 290454 - RNA, 32 nt, Human
aagcaaguauauacucaguucucuccacacuu

SEQ ID NO: 290455 - RNA, 32 nt, Human
aagcaagucaccaagggaccucaaacuuccuu

SEQ ID NO: 290456 - RNA, 32 nt, Human
aagcaaguccacauggagauuuggaggacacu

SEQ ID NO: 290457 - RNA, 32 nt, Human
aagcaagucuuuacguagccccaaaccuacuc

SEQ ID NO: 290458 - RNA, 32 nt, Human
aagcaagugaaaacaauuagggccagugguau

SEQ ID NO: 290459 - RNA, 32 nt, Human
aagcaagugaacacaaacacauuuaaguguau

SEQ ID NO: 290460 - RNA, 32 nt, Human
aagcaaguggcugcagaagaugguaacguaga

SEQ ID NO: 290461 - RNA, 32 nt, Human
aagcaagugucuuuuagcauucaugccagcuu

SEQ ID NO: 290462 - RNA, 32 nt, Human
aagcaaguucuuuagaagauaaauccucucga

SEQ ID NO: 290463 - RNA, 32 nt, Human
aagcaauaauaucucuguuuucauuucagaac

SEQ ID NO: 290464 - RNA, 22 nt, Human
aagcaauaauuucuccacaaca

SEQ ID NO: 290465 - RNA, 32 nt, Human
aagcaauagauuuugcuuggguuuucuuucuu

SEQ ID NO: 290466 - RNA, 32 nt, Human
aagcaaucauuuccccucccgucuuccuccuc

SEQ ID NO: 290467 - RNA, 32 nt, Human
aagcaauccuaaaugaaaguguguaaauuaua

SEQ ID NO: 290468 - RNA, 19 nt, Human
aagcaauccucccaccuca

SEQ ID NO: 290469 - RNA, 32 nt, Human
aagcaauccugccucaggcccccuaguagcug

SEQ ID NO: 290470 - RNA, 32 nt, Human
aagcaaucugugcuucagaagacagaggcucu

SEQ ID NO: 290471 - RNA, 32 nt, Human
aagcaaucuuuguuucugaguguuauuuuuau

SEQ ID NO: 290472 - RNA, 30 nt, Human
aagcaaugauuggccaaggaccuagcauaa

SEQ ID NO: 290473 - RNA, 30 nt, Human
aagcaaugggcauccugaagcugcaaguau

SEQ ID NO: 290474 - RNA, 32 nt, Human
aagcaaugguuauggggcaggcaaugugugcg

SEQ ID NO: 290475 - RNA, 23 nt, Human
aagcaauguaaaccucuccugga

SEQ ID NO: 290476 - RNA, 32 nt, Human
aagcaauuaaugaucagacauaggagaaaccc

SEQ ID NO: 290477 - RNA, 32 nt, Human
aagcaauuauuccuacauuccuaaguguucac

SEQ ID NO: 290478 - RNA, 26 nt, Human
aagcaauucacacagacaacacaacu

SEQ ID NO: 290479 - RNA, 32 nt, Human
aagcaauuccuuggaucuuaugcacagaacuu

SEQ ID NO: 290480 - RNA, 32 nt, Human
aagcaauucuaagaucuuccacaaaacaucua

SEQ ID NO: 290481 - RNA, 32 nt, Human
aagcaauucuccugccucagcuacucaagagg

SEQ ID NO: 290482 - RNA, 32 nt, Human
aagcaauuguccugccuccucaacuuccugac

SEQ ID NO: 290483 - RNA, 32 nt, Human
aagcaauuuauagauucagugcuauucccauu

SEQ ID NO: 290484 - RNA, 32 nt, Human
aagcaauuucaguaucucugugcaaggccugc

SEQ ID NO: 290485 - RNA, 32 nt, Human
aagcaauuuguaggacaguuugaauaauuuag

SEQ ID NO: 290486 - RNA, 32 nt, Human
aagcacaaagagauucaauuucccuggaggau

SEQ ID NO: 290487 - RNA, 32 nt, Human
aagcacaaagugcugggauuacaggcaugacc

SEQ ID NO: 290488 - RNA, 21 nt, Human
aagcacaaccagaccuucuca

SEQ ID NO: 290489 - RNA, 32 nt, Human
aagcacaagaagcagcugcagcugauggggag

SEQ ID NO: 290490 - RNA, 32 nt, Human
aagcacaagacugcguuuguggaacaccugaa

SEQ ID NO: 290491 - RNA, 32 nt, Human
aagcacaaguacaaaggcaucuuccggagcca

SEQ ID NO: 290492 - RNA, 32 nt, Human
aagcacaauaccuagguuaccacacaccacuu

SEQ ID NO: 290493 - RNA, 32 nt, Human
aagcacacacaaauagugccaggagucgaguu

SEQ ID NO: 290494 - RNA, 32 nt, Human
aagcacacagccgaccuacaaaccuccuguga

SEQ ID NO: 290495 - RNA, 32 nt, Human
aagcacacagggucugcuauuccugaggcugg

SEQ ID NO: 290496 - RNA, 32 nt, Human
aagcacaccagcuauuggcacagcgugggcag

SEQ ID NO: 290497 - RNA, 32 nt, Human
aagcacacgggaccaggcugggcgaagaacac

SEQ ID NO: 290498 - RNA, 32 nt, Human
aagcacacugaccuucuucaggcaaauacgca

SEQ ID NO: 290499 - RNA, 32 nt, Human
aagcacacugugggguggaggugcagagcuuu

SEQ ID NO: 290500 - RNA, 31 nt, Human
aagcacagaaccuggcauucacuggacugaa

SEQ ID NO: 290501 - RNA, 32 nt, Human
aagcacagaauuacucagucuuccauauugua

SEQ ID NO: 290502 - RNA, 32 nt, Human
aagcacagacagcagagagggccaggcagugc

SEQ ID NO: 290503 - RNA, 32 nt, Human
aagcacagcagagauaucuaagccauauuugu

SEQ ID NO: 290504 - RNA, 32 nt, Human
aagcacagcagcacaucgagacuugcuggaag

SEQ ID NO: 290505 - RNA, 32 nt, Human
aagcacagccaagcaugguggcucauguuugu

SEQ ID NO: 290506 - RNA, 32 nt, Human
aagcacagccucugcuccuccuggagccgguc

SEQ ID NO: 290507 - RNA, 32 nt, Human
aagcacagcugauccuggcccccaggucuggg

SEQ ID NO: 290508 - RNA, 32 nt, Human
aagcacaggcuaagcaguugaagguuccccac

SEQ ID NO: 290509 - RNA, 32 nt, Human
aagcacagugccugacacaaaacaggcaccca

SEQ ID NO: 290510 - RNA, 32 nt, Human
aagcacaucauugagcuugcuguucagaagga

SEQ ID NO: 290511 - RNA, 32 nt, Human
aagcacaucuccaucucuuccaccucaggcag

SEQ ID NO: 290512 - RNA, 32 nt, Human
aagcacaucuuucucacacuuugcucuuugga

SEQ ID NO: 290513 - RNA, 32 nt, Human
aagcacaugcaucugcuauuguguuggguugg

SEQ ID NO: 290514 - RNA, 32 nt, Human
aagcacaugccuauaaucccagcacuuuggga

SEQ ID NO: 290515 - RNA, 32 nt, Human
aagcacaugcugugccuuggaccugccuucug

SEQ ID NO: 290516 - RNA, 32 nt, Human
aagcacaugguacaguuuuccaaagaaauuag

SEQ ID NO: 290517 - RNA, 32 nt, Human
aagcacauguacauacauggaccucauucaga

SEQ ID NO: 290518 - RNA, 32 nt, Human
aagcacauuccucagcaggaucaagccaaaca

SEQ ID NO: 290519 - RNA, 32 nt, Human
aagcacauuguguacacaauaaaauuguagcc

SEQ ID NO: 290520 - RNA, 32 nt, Human
aagcaccaaauaaggaaaagcacuccggaaga

SEQ ID NO: 290521 - RNA, 32 nt, Human
aagcaccaauuacugcccucugccucagcagu

SEQ ID NO: 290522 - RNA, 32 nt, Human
aagcaccaccagaccagcaucacccaggacgu

SEQ ID NO: 290523 - RNA, 32 nt, Human
aagcaccaccuacuggugggccaucuguucuu

SEQ ID NO: 290524 - RNA, 32 nt, Human
aagcaccacuugcuguuuugaaugacucuacu

SEQ ID NO: 290525 - RNA, 32 nt, Human
aagcaccagagaauacauacaugaagggacaa

SEQ ID NO: 290526 - RNA, 32 nt, Human
aagcaccagcaacaccagagggguggagacuc

SEQ ID NO: 290527 - RNA, 32 nt, Human
aagcaccagccccucaacacugccauccaccu

SEQ ID NO: 290528 - RNA, 32 nt, Human
aagcaccagcuauguaaucacaugguuguucu

SEQ ID NO: 290529 - RNA, 32 nt, Human
aagcaccaggaggaagccgguucccgugagau

SEQ ID NO: 290530 - RNA, 32 nt, Human
aagcaccaggaggcccucgagguugcucugga

SEQ ID NO: 290531 - RNA, 32 nt, Human
aagcaccauuagcccauuucccccaaauuaaa

SEQ ID NO: 290532 - RNA, 32 nt, Human
aagcacccaaccacgcccagcuaauuuuugua

SEQ ID NO: 290533 - RNA, 32 nt, Human
aagcacccaccucccuuuucucagccuaacuc

SEQ ID NO: 290534 - RNA, 18 nt, Human
aagcacccagcccugccc

SEQ ID NO: 290535 - RNA, 32 nt, Human
aagcacccagccuggucaaggacagcagcaag

SEQ ID NO: 290536 - RNA, 32 nt, Human
aagcacccaucuucacuuggugcugccaucaa

SEQ ID NO: 290537 - RNA, 32 nt, Human
aagcaccccacaccaaggacaggcuggacggc

SEQ ID NO: 290538 - RNA, 32 nt, Human
aagcaccccuggagaggaagggagggucccca

SEQ ID NO: 290539 - RNA, 32 nt, Human
aagcaccccugguacucagcacacacaugcuu

SEQ ID NO: 290540 - RNA, 32 nt, Human
aagcacccucccucuagguccagggacuauca

SEQ ID NO: 290541 - RNA, 32 nt, Human
aagcacccugggaggccgaggcaggcagauua

SEQ ID NO: 290542 - RNA, 32 nt, Human
aagcaccgacacaaacuggagaauggucuggc

SEQ ID NO: 290543 - RNA, 32 nt, Human
aagcaccgucauaacaauugauugccauagca

SEQ ID NO: 290544 - RNA, 32 nt, Human
aagcaccgugcagcuuuggccugggcacagac

SEQ ID NO: 290545 - RNA, 32 nt, Human
aagcaccuacugggugcuggguucacuguguc

SEQ ID NO: 290546 - RNA, 32 nt, Human
aagcaccuccaccccuacccuagugauguccc

SEQ ID NO: 290547 - RNA, 32 nt, Human
aagcaccuccaggagguccccucuggaugucc

SEQ ID NO: 290548 - RNA, 32 nt, Human
aagcaccucucaucacagucgaguuccaagga

SEQ ID NO: 290549 - RNA, 32 nt, Human
aagcaccucucaucacagucuaguuccaagga

SEQ ID NO: 290550 - RNA, 32 nt, Human
aagcaccucugugucagggcucaccugggcau

SEQ ID NO: 290551 - RNA, 32 nt, Human
aagcaccugaaaucuggccggaugcgguggcu

SEQ ID NO: 290552 - RNA, 32 nt, Human
aagcaccugaggccuugguucaugcaguguuc

SEQ ID NO: 290553 - RNA, 32 nt, Human
aagcaccugccugccugcaucacugcacugaa

SEQ ID NO: 290554 - RNA, 32 nt, Human
aagcaccugcuccuuaagucuuccugcaacaa

SEQ ID NO: 290555 - RNA, 32 nt, Human
aagcaccugggcuaagggagaagcggaaggag

SEQ ID NO: 290556 - RNA, 32 nt, Human
aagcaccuuaaucccagcuacuugggaggcag

SEQ ID NO: 290557 - RNA, 32 nt, Human
aagcaccuucugcacacagucugcacacacug

SEQ ID NO: 290558 - RNA, 32 nt, Human
aagcaccuucuuuccugucucuugauuguuuu

SEQ ID NO: 290559 - RNA, 32 nt, Human
aagcaccuugggaauacccugaugucucagca

SEQ ID NO: 290560 - RNA, 32 nt, Human
aagcacgagauaaacaccagcugacuccacgg

SEQ ID NO: 290561 - RNA, 32 nt, Human
aagcacgagcggcagcgccgagcccagauacg

SEQ ID NO: 290562 - RNA, 32 nt, Human
aagcacgccagcagcgaacccagggggaccag

SEQ ID NO: 290563 - RNA, 32 nt, Human
aagcacggccuacugagcagguucugaaagca

SEQ ID NO: 290564 - RNA, 32 nt, Human
aagcacgggcugggccaagcuaagcugcucug

SEQ ID NO: 290565 - RNA, 18 nt, Human
aagcacguaugcuucagg

SEQ ID NO: 290566 - RNA, 32 nt, Human
aagcacguggugagaggagcaggccuacuugu

SEQ ID NO: 290567 - RNA, 32 nt, Human
aagcacuaauaacucggcaucuugacgauagu

SEQ ID NO: 290568 - RNA, 32 nt, Human
aagcacuacugcacuuaguagcuaugugauuu

SEQ ID NO: 290569 - RNA, 32 nt, Human
aagcacuaggauuacaggugugagccaccaug

SEQ ID NO: 290570 - RNA, 32 nt, Human
aagcacuauggaauuagguaacaggaagaguu

SEQ ID NO: 290571 - RNA, 32 nt, Human
aagcacuauuccaaggcuauggaguagcucua

SEQ ID NO: 290572 - RNA, 32 nt, Human
aagcacuauuucuuccuuuuccacuuaggccc

SEQ ID NO: 290573 - RNA, 31 nt, Human
aagcacucaauaaauguuuguuuaaugaaaa

SEQ ID NO: 290574 - RNA, 32 nt, Human
aagcacucacacacaugcaaugguauaugugc

SEQ ID NO: 290575 - RNA, 32 nt, Human
aagcacuccuuggcuguguccucucgcuuuuu

SEQ ID NO: 290576 - RNA, 32 nt, Human
aagcacucucuccagcacucaggaagcccggc

SEQ ID NO: 290577 - RNA, 32 nt, Human
aagcacucuuugucucccugagccccuuggca

SEQ ID NO: 290578 - RNA, 23 nt, Human
aagcacugagaaauucuuucuca

SEQ ID NO: 290579 - RNA, 32 nt, Human
aagcacugaggagguggauggaagggagcauc

SEQ ID NO: 290580 - RNA, 32 nt, Human
aagcacugcaggucaaggaagcaacacaauag

SEQ ID NO: 290581 - RNA, 32 nt, Human
aagcacugcccagccccugccuggcugcccuu

SEQ ID NO: 290582 - RNA, 31 nt, Human
aagcacugccucuacugggcgugcugccaag

SEQ ID NO: 290583 - RNA, 32 nt, Human
aagcacuggccuugccuccaggaccuugcuuc

SEQ ID NO: 290584 - RNA, 21 nt, Human
aagcacuggcuucgccccuca

SEQ ID NO: 290585 - RNA, 24 nt, Human
aagcacugggaucacaggugucag

SEQ ID NO: 290586 - RNA, 24 nt, Human
aagcacugggauuacaagcaugag

SEQ ID NO: 290587 - RNA, 24 nt, Human
aagcacugggauuacaggcaugag

SEQ ID NO: 290588 - RNA, 32 nt, Human
aagcacugggauuacaggcaugagccaccaug

SEQ ID NO: 290589 - RNA, 32 nt, Human
aagcacugggauuacaggcaugagccaccgcg

SEQ ID NO: 290590 - RNA, 24 nt, Human
aagcacugggauuacaggcgugag

SEQ ID NO: 290591 - RNA, 32 nt, Human
aagcacugggauuacaggcgugagccaccaca

SEQ ID NO: 290592 - RNA, 32 nt, Human
aagcacugggauuacaggcgugagccacccgg

SEQ ID NO: 290593 - RNA, 32 nt, Human
aagcacugggauuacaggcgugagccaccgcg

SEQ ID NO: 290594 - RNA, 24 nt, Human
aagcacugggauuacaggcuugag

SEQ ID NO: 290595 - RNA, 32 nt, Human
aagcacugggauuacaggcuugaggcacugca

SEQ ID NO: 290596 - RNA, 32 nt, Human
aagcacugggauuacaggugugaaccaccgua

SEQ ID NO: 290597 - RNA, 32 nt, Human
aagcacugggauuacaggugugagccaccgcg

SEQ ID NO: 290598 - RNA, 23 nt, Human
aagcacuggggugccuccucuca

SEQ ID NO: 290599 - RNA, 23 nt, Human
aagcacuggguucugcccuuuca

SEQ ID NO: 290600 - RNA, 32 nt, Human
aagcacuguggcugggaaacuucgaagcggac

SEQ ID NO: 290601 - RNA, 32 nt, Human
aagcacuguguggcugauaagcgguguucaug

SEQ ID NO: 290602 - RNA, 32 nt, Human
aagcacuguuaccaauuuagcauauguccuug

SEQ ID NO: 290603 - RNA, 32 nt, Human
aagcacuguuugucacuuuucagcuuugacgu

SEQ ID NO: 290604 - RNA, 32 nt, Human
aagcacuucuucuuguauuguuuuuaagguga

SEQ ID NO: 290605 - RNA, 22 nt, Human
aagcacuugaagcaacacaacu

SEQ ID NO: 290606 - RNA, 24 nt, Human
aagcacuuggauuacagaugugag

SEQ ID NO: 290607 - RNA, 32 nt, Human
aagcacuuguauuuuccagccuaggcuuugug

SEQ ID NO: 290608 - RNA, 32 nt, Human
aagcacuugugucugaaagaugcagauaauau

SEQ ID NO: 290609 - RNA, 32 nt, Human
aagcacuuuaauuccaauguaccaggugaacu

SEQ ID NO: 290610 - RNA, 32 nt, Human
aagcacuuucucucccugcuuccagcccuucu

SEQ ID NO: 290611 - RNA, 32 nt, Human
aagcacuuugggaggcagagaugggcggauca

SEQ ID NO: 290612 - RNA, 32 nt, Human
aagcacuuugggaggccgagauggaaggauca

SEQ ID NO: 290613 - RNA, 32 nt, Human
aagcacuuugggaggccgaggcagguagauca

SEQ ID NO: 290614 - RNA, 32 nt, Human
aagcacuuuuaauuuugagaauuucacauuua

SEQ ID NO: 290615 - RNA, 18 nt, Human
aagcacuuuugcacauuu

SEQ ID NO: 290616 - RNA, 32 nt, Human
aagcacuuuuucauacuuuugugaaaguauac

SEQ ID NO: 290617 - RNA, 32 nt, Human
aagcagaaaaacugagcuccaagugagcacau

SEQ ID NO: 290618 - RNA, 32 nt, Human
aagcagaaaaagaaaacuaagaccuucaaucc

SEQ ID NO: 290619 - RNA, 32 nt, Human
aagcagaaaaccagaagugcaugcugugaugc

SEQ ID NO: 290620 - RNA, 32 nt, Human
aagcagaaagagaaagaauuugcaaccaugag

SEQ ID NO: 290621 - RNA, 32 nt, Human
aagcagaaagagaaaugagacacucuaguugc

SEQ ID NO: 290622 - RNA, 32 nt, Human
aagcagaacuagccacgagcugccuuccuccc

SEQ ID NO: 290623 - RNA, 31 nt, Human
aagcagaagugaagagaaaagaggaggacug

SEQ ID NO: 290624 - RNA, 32 nt, Human
aagcagaauaaggcaaaagggaaaguguucua

SEQ ID NO: 290625 - RNA, 32 nt, Human
aagcagaauaaugacacuacguuucucucuca

SEQ ID NO: 290626 - RNA, 32 nt, Human
aagcagaauacuugagaugaaaguuggcauac

SEQ ID NO: 290627 - RNA, 32 nt, Human
aagcagaaugcaggguuuccugccugacaacc

SEQ ID NO: 290628 - RNA, 21 nt, Human
aagcagaauuuagaaaccaca

SEQ ID NO: 290629 - RNA, 32 nt, Human
aagcagacaauaacuucuuaaaggaauucuac

SEQ ID NO: 290630 - RNA, 32 nt, Human
aagcagaccagccugggggcuggcggcaggac

SEQ ID NO: 290631 - RNA, 32 nt, Human
aagcagacccccucccugucaucacccucucc

SEQ ID NO: 290632 - RNA, 32 nt, Human
aagcagaccugacacugauccagauuugcagu

SEQ ID NO: 290633 - RNA, 32 nt, Human
aagcagacgacugucuguccuguuuaugacaa

SEQ ID NO: 290634 - RNA, 32 nt, Human
aagcagacugaggagggaggagacgagguucu

SEQ ID NO: 290635 - RNA, 32 nt, Human
aagcagacuugggaaccuggaagcacucugga

SEQ ID NO: 290636 - RNA, 32 nt, Human
aagcagagaagaagaaaggagcugaggaggag

SEQ ID NO: 290637 - RNA, 32 nt, Human
aagcagagaauuuuauuuauagcuaauuuuag

SEQ ID NO: 290638 - RNA, 32 nt, Human
aagcagagacaacugccacccagccugggccu

SEQ ID NO: 290639 - RNA, 32 nt, Human
aagcagagaccaugagaaggagaguucagggg

SEQ ID NO: 290640 - RNA, 32 nt, Human
aagcagagagcugaagugaaggcuugagggga

SEQ ID NO: 290641 - RNA, 32 nt, Human
aagcagagagcugaggcauccaagaaauguuc

SEQ ID NO: 290642 - RNA, 32 nt, Human
aagcagagaugggggcucccuauguugcccag

SEQ ID NO: 290643 - RNA, 32 nt, Human
aagcagagcaagaagagaggaagcgggguagu

SEQ ID NO: 290644 - RNA, 32 nt, Human
aagcagagcagcgugaggaagauggugcucac

SEQ ID NO: 290645 - RNA, 32 nt, Human
aagcagagccacucgggaguggugaggcccgg

SEQ ID NO: 290646 - RNA, 19 nt, Human
aagcagagccuccugggaa

SEQ ID NO: 290647 - RNA, 31 nt, Human
aagcagagcgagagagaggaggcugcuggaa

SEQ ID NO: 290648 - RNA, 32 nt, Human
aagcagaggaagagauaacauggcaaugaaga

SEQ ID NO: 290649 - RNA, 32 nt, Human
aagcagaggaggaagaggaagaguggggaugg

SEQ ID NO: 290650 - RNA, 32 nt, Human
aagcagaggaggaggaagggccggccagaaga

SEQ ID NO: 290651 - RNA, 32 nt, Human
aagcagaggcaguucugaggcagcaggcagug

SEQ ID NO: 290652 - RNA, 32 nt, Human
aagcagagggaaaugggaggucuaaggaugag

SEQ ID NO: 290653 - RNA, 32 nt, Human
aagcagagggaaugugaaagaaaauaagagaa

SEQ ID NO: 290654 - RNA, 32 nt, Human
aagcagagggaccucagaagaaacugagccag

SEQ ID NO: 290655 - RNA, 21 nt, Human
aagcagagggcagccauugaa

SEQ ID NO: 290656 - RNA, 21 nt, Human
aagcagagggggcccauugga

SEQ ID NO: 290657 - RNA, 32 nt, Human
aagcagagucagcuugauuucaaggacucuau

SEQ ID NO: 290658 - RNA, 32 nt, Human
aagcagagugccaggcagcacauccuucuuca

SEQ ID NO: 290659 - RNA, 32 nt, Human
aagcagagugugaauagccuguggacuguaug

SEQ ID NO: 290660 - RNA, 32 nt, Human
aagcagaguugggggaggagggggagcccugg

SEQ ID NO: 290661 - RNA, 32 nt, Human
aagcagauacauaugaguguggaagccggagg

SEQ ID NO: 290662 - RNA, 32 nt, Human
aagcagauagaugguccagcaggcuugaagca

SEQ ID NO: 290663 - RNA, 20 nt, Human
aagcagauauccaaagggug

SEQ ID NO: 290664 - RNA, 18 nt, Human
aagcagaucguccagugc

SEQ ID NO: 290665 - RNA, 21 nt, Human
aagcagaugcccaguugcuca

SEQ ID NO: 290666 - RNA, 18 nt, Human
aagcagaugguauccaga

SEQ ID NO: 290667 - RNA, 22 nt, Human
aagcagauguucaccaauguca

SEQ ID NO: 290668 - RNA, 32 nt, Human
aagcagauguuuuugcccuuucugcuucacug

SEQ ID NO: 290669 - RNA, 32 nt, Human
aagcagauuacaucugagccguuugaauugug

SEQ ID NO: 290670 - RNA, 32 nt, Human
aagcagauucucugaucaggaauuugaaguga

SEQ ID NO: 290671 - RNA, 32 nt, Human
aagcagcaaaacgcuccuccaugucuggaugg

SEQ ID NO: 290672 - RNA, 32 nt, Human
aagcagcaacuucuuccuccuuauauucuuau

SEQ ID NO: 290673 - RNA, 32 nt, Human
aagcagcaacuugcaagggcggccuuucccac

SEQ ID NO: 290674 - RNA, 32 nt, Human
aagcagcaagccccgggcugugcucaagccac

SEQ ID NO: 290675 - RNA, 32 nt, Human
aagcagcacagaauguuauccuuacguccuga

SEQ ID NO: 290676 - RNA, 32 nt, Human
aagcagcacagcugagacugggcaccaggcca

SEQ ID NO: 290677 - RNA, 32 nt, Human
aagcagcacauagcacugggaacucuggcucc

SEQ ID NO: 290678 - RNA, 32 nt, Human
aagcagcacucaaaccuggagcugaggaaucu

SEQ ID NO: 290679 - RNA, 32 nt, Human
aagcagcagagcucuggggaccucaguggggg

SEQ ID NO: 290680 - RNA, 32 nt, Human
aagcagcagccccugcgcugccucaucuacau

SEQ ID NO: 290681 - RNA, 32 nt, Human
aagcagcagccccuguaagcacacgagacaau

SEQ ID NO: 290682 - RNA, 32 nt, Human
aagcagcagccgcggcggcggcggcggcugga

SEQ ID NO: 290683 - RNA, 32 nt, Human
aagcagcaggcagagacgauagacgccuggcu

SEQ ID NO: 290684 - RNA, 32 nt, Human
aagcagcagguucgagucuccacgccgucagc

SEQ ID NO: 290685 - RNA, 32 nt, Human
aagcagcagugaggaggaagguaaaggagaag

SEQ ID NO: 290686 - RNA, 32 nt, Human
aagcagcagugcgcuuccaccucggggccuug

SEQ ID NO: 290687 - RNA, 22 nt, Human
aagcagcaguguaccaguguca

SEQ ID NO: 290688 - RNA, 32 nt, Human
aagcagcaguuccacagcacagccuggucagu

SEQ ID NO: 290689 - RNA, 32 nt, Human
aagcagcauccugaccacagcuggcagucaag

SEQ ID NO: 290690 - RNA, 32 nt, Human
aagcagcaugaagugcucacuguggcuuuauu

SEQ ID NO: 290691 - RNA, 32 nt, Human
aagcagcauggcugagcuccuggagacgaggg

SEQ ID NO: 290692 - RNA, 32 nt, Human
aagcagcauuacagucccagaccugcggguuu

SEQ ID NO: 290693 - RNA, 32 nt, Human
aagcagcauuggaagaaaucacuccugaccaa

SEQ ID NO: 290694 - RNA, 32 nt, Human
aagcagcauuguccucugggcauguggcucag

SEQ ID NO: 290695 - RNA, 32 nt, Human
aagcagccaaccuaaccauccagaccccaccc

SEQ ID NO: 290696 - RNA, 32 nt, Human
aagcagccaccugagccaccaccgagccaugg

SEQ ID NO: 290697 - RNA, 32 nt, Human
aagcagccagcaaugagugcucuguuuugauc

SEQ ID NO: 290698 - RNA, 22 nt, Human
aagcagccagcgccugccugaa

SEQ ID NO: 290699 - RNA, 32 nt, Human
aagcagccagcuccccacaccuuccagggccc

SEQ ID NO: 290700 - RNA, 32 nt, Human
aagcagccaugaaaaagacuaugugcagcaag

SEQ ID NO: 290701 - RNA, 32 nt, Human
aagcagccaugaaccaggcuguccaggaaugg

SEQ ID NO: 290702 - RNA, 32 nt, Human
aagcagcccagggaauccucuggaccaucaga

SEQ ID NO: 290703 - RNA, 32 nt, Human
aagcagcccugaggaggaagaggaggcgaggg

SEQ ID NO: 290704 - RNA, 32 nt, Human
aagcagcccugccugcugauuuaacacacuuu

SEQ ID NO: 290705 - RNA, 32 nt, Human
aagcagccggaagugccuuaacuuguggaacc

SEQ ID NO: 290706 - RNA, 20 nt, Human
aagcagccguccccucugca

SEQ ID NO: 290707 - RNA, 32 nt, Human
aagcagcgacagcucaucagcagucuaacaac

SEQ ID NO: 290708 - RNA, 32 nt, Human
aagcagcgugucuccaucccccucucuagggg

SEQ ID NO: 290709 - RNA, 32 nt, Human
aagcagcguucagggauccucucagucccaga

SEQ ID NO: 290710 - RNA, 32 nt, Human
aagcagcuaggaguacaguugggagccacugu

SEQ ID NO: 290711 - RNA, 32 nt, Human
aagcagcuauacguggcauacauguauuuaaa

SEQ ID NO: 290712 - RNA, 31 nt, Human
aagcagcuaugauauauccuguugaaucaaa

SEQ ID NO: 290713 - RNA, 32 nt, Human
aagcagcucagguuguagugggccauuaggaa

SEQ ID NO: 290714 - RNA, 32 nt, Human
aagcagcucauuugugacaacauuucauauca

SEQ ID NO: 290715 - RNA, 32 nt, Human
aagcagcuccagcugcuccacucugacaccga

SEQ ID NO: 290716 - RNA, 32 nt, Human
aagcagcuccaggaguuagcugagacaccccc

SEQ ID NO: 290717 - RNA, 32 nt, Human
aagcagcuccugcugggagcauggccucagcc

SEQ ID NO: 290718 - RNA, 32 nt, Human
aagcagcugcugugacaggccaaucccaggcu

SEQ ID NO: 290719 - RNA, 32 nt, Human
aagcagcuggaggguuuuuggaucccuguccc

SEQ ID NO: 290720 - RNA, 32 nt, Human
aagcagcugggaaaagaugggaaaacuagaaa

SEQ ID NO: 290721 - RNA, 32 nt, Human
aagcagcugggagcuuggaaaccuggucucuu

SEQ ID NO: 290722 - RNA, 32 nt, Human
aagcagcuuggagccucuagguugagaagaga

SEQ ID NO: 290723 - RNA, 32 nt, Human
aagcagcuuuggaaacugugaaugaucuuuag

SEQ ID NO: 290724 - RNA, 32 nt, Human
aagcaggaaaaucgcuugaacugagagucaag

SEQ ID NO: 290725 - RNA, 32 nt, Human
aagcaggaaaccuucugcugggcauagcuugu

SEQ ID NO: 290726 - RNA, 32 nt, Human
aagcaggaaagggagacaaagacuggcuucug

SEQ ID NO: 290727 - RNA, 32 nt, Human
aagcaggaaauaggagaaaaguaaacaacuuu

SEQ ID NO: 290728 - RNA, 32 nt, Human
aagcaggaagauaugauaguucccugggcagc

SEQ ID NO: 290729 - RNA, 32 nt, Human
aagcaggaaggagccuguuacagucaagguga

SEQ ID NO: 290730 - RNA, 32 nt, Human
aagcaggaaguuaagagcaggaggaagcguug

SEQ ID NO: 290731 - RNA, 32 nt, Human
aagcaggaaucagagaccuuccagaaauacua

SEQ ID NO: 290732 - RNA, 32 nt, Human
aagcaggagaaggaggggaaaauuaccggccu

SEQ ID NO: 290733 - RNA, 32 nt, Human
aagcaggagagacaggggagacuggggaggcc

SEQ ID NO: 290734 - RNA, 32 nt, Human
aagcaggagagggggaggaaaaggagagggaa

SEQ ID NO: 290735 - RNA, 32 nt, Human
aagcaggagccgagaccccggagcagccacaa

SEQ ID NO: 290736 - RNA, 31 nt, Human
aagcaggagcuuucauuuacauugucuuguc

SEQ ID NO: 290737 - RNA, 32 nt, Human
aagcaggaggacugcuugaggccaggaauucg

SEQ ID NO: 290738 - RNA, 32 nt, Human
aagcaggaggagguggguggggugaaggagga

SEQ ID NO: 290739 - RNA, 32 nt, Human
aagcaggagggcuauguuccugggacucgggc

SEQ ID NO: 290740 - RNA, 32 nt, Human
aagcaggagguggagaagacccagugaagugc

SEQ ID NO: 290741 - RNA, 32 nt, Human
aagcaggauaccucuauaugucagccuugccu

SEQ ID NO: 290742 - RNA, 32 nt, Human
aagcaggauggagcuggagugagguggagggg

SEQ ID NO: 290743 - RNA, 32 nt, Human
aagcaggauguggcaguugcagugagaaagga

SEQ ID NO: 290744 - RNA, 18 nt, Human
aagcaggauugcuuucau

SEQ ID NO: 290745 - RNA, 32 nt, Human
aagcaggcaagaagcggaggcagugaguacag

SEQ ID NO: 290746 - RNA, 32 nt, Human
aagcaggcacauuaucauucucaggccacugc

SEQ ID NO: 290747 - RNA, 32 nt, Human
aagcaggcagaagaaaaggcagcuguggugug

SEQ ID NO: 290748 - RNA, 32 nt, Human
aagcaggcagagaagccaggggugugaggaag

SEQ ID NO: 290749 - RNA, 32 nt, Human
aagcaggcagauaaguuggagcagggguuggu

SEQ ID NO: 290750 - RNA, 32 nt, Human
aagcaggcaggaaaggcucaagugauccuccu

SEQ ID NO: 290751 - RNA, 32 nt, Human
aagcaggcagggcaaaggucaagacuguggua

SEQ ID NO: 290752 - RNA, 32 nt, Human
aagcaggcauguugaagaguugagugaucacg

SEQ ID NO: 290753 - RNA, 32 nt, Human
aagcaggccaggggucuccacagggagcugcu

SEQ ID NO: 290754 - RNA, 32 nt, Human
aagcaggccuguaaaguacucuaaaguacuuc

SEQ ID NO: 290755 - RNA, 32 nt, Human
aagcaggcugcugaucucagcaguugauaugg

SEQ ID NO: 290756 - RNA, 32 nt, Human
aagcaggcuuucuaaugggaggcuuuaaguau

SEQ ID NO: 290757 - RNA, 32 nt, Human
aagcagggacuggggcaggcgagcccggacag

SEQ ID NO: 290758 - RNA, 32 nt, Human
aagcagggagagacuggguaggguagggcggu

SEQ ID NO: 290759 - RNA, 32 nt, Human
aagcagggagagaugauuugcugguggggcug

SEQ ID NO: 290760 - RNA, 32 nt, Human
aagcagggagcacuucuggcugugcauaagag

SEQ ID NO: 290761 - RNA, 32 nt, Human
aagcagggaggauuugggagggcagagaugag

SEQ ID NO: 290762 - RNA, 32 nt, Human
aagcagggaguggggaaaaguauuuugagggg

SEQ ID NO: 290763 - RNA, 32 nt, Human
aagcagggauggccuguuccacugugaucuua

SEQ ID NO: 290764 - RNA, 32 nt, Human
aagcagggcaguugggcccaccccagagcagc

SEQ ID NO: 290765 - RNA, 20 nt, Human
aagcagggccgggccuuccu

SEQ ID NO: 290766 - RNA, 32 nt, Human
aagcaggggagacagguuuaaggguagcuggc

SEQ ID NO: 290767 - RNA, 32 nt, Human
aagcaggggccaggccaggccagugccuucgc

SEQ ID NO: 290768 - RNA, 18 nt, Human
aagcaggggccagggagg

SEQ ID NO: 290769 - RNA, 32 nt, Human
aagcaggggcggcagaggcucaacgggaugcu

SEQ ID NO: 290770 - RNA, 32 nt, Human
aagcagggggcuacuucucccuucccucgguu

SEQ ID NO: 290771 - RNA, 32 nt, Human
aagcagggggucuuuauauucccugcagaaac

SEQ ID NO: 290772 - RNA, 32 nt, Human
aagcaggguaagcaggcuggcccaggguaagg

SEQ ID NO: 290773 - RNA, 31 nt, Human
aagcagggucauaauuugugaucuguggugg

SEQ ID NO: 290774 - RNA, 31 nt, Human
aagcagggugagagauucuaacgacuggaug

SEQ ID NO: 290775 - RNA, 32 nt, Human
aagcaggguggaggggaagggugggucucagu

SEQ ID NO: 290776 - RNA, 32 nt, Human
aagcagggugggcagugagagcugcuauggaa

SEQ ID NO: 290777 - RNA, 32 nt, Human
aagcaggguuuugagccacugcugcugcugcc

SEQ ID NO: 290778 - RNA, 32 nt, Human
aagcaggucuaggacuccccugcaccuuugcc

SEQ ID NO: 290779 - RNA, 32 nt, Human
aagcaggucuccaacuccuggacucaagcgau

SEQ ID NO: 290780 - RNA, 32 nt, Human
aagcaggugacaccagaagacaaggacacugg

SEQ ID NO: 290781 - RNA, 32 nt, Human
aagcaggugcuggacgucagucaggagcugcu

SEQ ID NO: 290782 - RNA, 32 nt, Human
aagcagguggcagaagaaggaaacaaggucag

SEQ ID NO: 290783 - RNA, 32 nt, Human
aagcagguuucaaggaaguagaaacaaaauac

SEQ ID NO: 290784 - RNA, 32 nt, Human
aagcagguuucuguacuuaagagucccccaga

SEQ ID NO: 290785 - RNA, 32 nt, Human
aagcaguaaggguuuccaggguucucucuagc

SEQ ID NO: 290786 - RNA, 32 nt, Human
aagcaguagcacaaccaaagaaaaaguuggga

SEQ ID NO: 290787 - RNA, 32 nt, Human
aagcaguaugcugcugugguuagaagcagauu

SEQ ID NO: 290788 - RNA, 32 nt, Human
aagcagucauucuuucuacuaaauccauuuca

SEQ ID NO: 290789 - RNA, 32 nt, Human
aagcagucggaccuagucaagccggagcagcc

SEQ ID NO: 290790 - RNA, 32 nt, Human
aagcagucuaaauauaaucaacguacagugag

SEQ ID NO: 290791 - RNA, 21 nt, Human
aagcagucuuagagagugcuu

SEQ ID NO: 290792 - RNA, 32 nt, Human
aagcagugaaaacaggcuucuacucaagugaa

SEQ ID NO: 290793 - RNA, 32 nt, Human
aagcagugaaucugaaacaauuuucacacccu

SEQ ID NO: 290794 - RNA, 31 nt, Human
aagcagugacuucugccaacagagugugggg

SEQ ID NO: 290795 - RNA, 32 nt, Human
aagcagugagggcaguacauguucuuuuugca

SEQ ID NO: 290796 - RNA, 32 nt, Human
aagcagugagguccuaaaguguuacaagagua

SEQ ID NO: 290797 - RNA, 29 nt, Human
aagcagugcaaauaaauuacauuuuuccc

SEQ ID NO: 290798 - RNA, 32 nt, Human
aagcagugcuggauuccaggagucuuggcauc

SEQ ID NO: 290799 - RNA, 19 nt, Human
aagcaguggaccccaggag

SEQ ID NO: 290800 - RNA, 19 nt, Human
aagcaguggagcccaggag

SEQ ID NO: 290801 - RNA, 32 nt, Human
aagcaguggaggcucagccacugugaggaggu

SEQ ID NO: 290802 - RNA, 32 nt, Human
aagcaguggagguggggguugcuguugauuga

SEQ ID NO: 290803 - RNA, 32 nt, Human
aagcaguguaaugcauuuggcacuuuguuugg

SEQ ID NO: 290804 - RNA, 32 nt, Human
aagcagugucugcaaggacacaagcugagcuu

SEQ ID NO: 290805 - RNA, 32 nt, Human
aagcaguguguaauuuuggauugccugcccuu

SEQ ID NO: 290806 - RNA, 32 nt, Human
aagcaguuaccugaugccugcugcugaagagc

SEQ ID NO: 290807 - RNA, 32 nt, Human
aagcaguuagaggagaaaaaggaauggagcag

SEQ ID NO: 290808 - RNA, 32 nt, Human
aagcaguuaggucauuuuaacugacuugauua

SEQ ID NO: 290809 - RNA, 23 nt, Human
aagcaguucaacuucucaaguua

SEQ ID NO: 290810 - RNA, 31 nt, Human
aagcaguucaaguugacaacagcagaaacag

SEQ ID NO: 290811 - RNA, 32 nt, Human
aagcaguucccagaaaggccuguggagugaga

SEQ ID NO: 290812 - RNA, 32 nt, Human
aagcaguucucuuuccucagccuccugaguag

SEQ ID NO: 290813 - RNA, 32 nt, Human
aagcaguucugccucagccucccaaguagcug

SEQ ID NO: 290814 - RNA, 21 nt, Human
aagcaguugcucaaauguugu

SEQ ID NO: 290815 - RNA, 32 nt, Human
aagcaguuggaagugaaaucuaugaugugaaa

SEQ ID NO: 290816 - RNA, 32 nt, Human
aagcaguuggacucgggaagcugaggcaggag

SEQ ID NO: 290817 - RNA, 32 nt, Human
aagcaguuuagagacugggggaggccggaucu

SEQ ID NO: 290818 - RNA, 32 nt, Human
aagcauaaaucccuguuuaguguuacauggga

SEQ ID NO: 290819 - RNA, 32 nt, Human
aagcauaacauggguacagaggggacaacaau

SEQ ID NO: 290820 - RNA, 22 nt, Human
aagcauaaguaaaaacacaacu

SEQ ID NO: 290821 - RNA, 32 nt, Human
aagcauaaguguaacucccauccaccagggaa

SEQ ID NO: 290822 - RNA, 32 nt, Human
aagcauaauauaaaauuaguuagauuuugcaa

SEQ ID NO: 290823 - RNA, 32 nt, Human
aagcauacaagugcagguuucuuuuugauaua

SEQ ID NO: 290824 - RNA, 32 nt, Human
aagcauagaggcagaaagcagacuagugcugu

SEQ ID NO: 290825 - RNA, 32 nt, Human
aagcauagcuuucugcaaacuugucuuuaaug

SEQ ID NO: 290826 - RNA, 32 nt, Human
aagcauagugccugcaugcuucaugaucagua

SEQ ID NO: 290827 - RNA, 32 nt, Human
aagcauauauacuaccuauauguaugugcugu

SEQ ID NO: 290828 - RNA, 32 nt, Human
aagcauaucaucaaaaauaguaauagccuaca

SEQ ID NO: 290829 - RNA, 32 nt, Human
aagcauauccuugaagacaagaaugcacccuu

SEQ ID NO: 290830 - RNA, 32 nt, Human
aagcauaugcugagaauaaacauguuacacau

SEQ ID NO: 290831 - RNA, 32 nt, Human
aagcauauguggggaggcuggcugguugaguu

SEQ ID NO: 290832 - RNA, 32 nt, Human
aagcauauguuugaccacuuugcugacuguau

SEQ ID NO: 290833 - RNA, 32 nt, Human
aagcauauuaccaaaaugaaugaauaaaugaa

SEQ ID NO: 290834 - RNA, 32 nt, Human
aagcaucacaugaacuuguaaaggaauuuaaa

SEQ ID NO: 290835 - RNA, 32 nt, Human
aagcaucacccaggcuggcagaucaugguagc

SEQ ID NO: 290836 - RNA, 32 nt, Human
aagcaucaccucaggccaggugcaguggcuca

SEQ ID NO: 290837 - RNA, 32 nt, Human
aagcaucacuuacaggaccagagcaagcucag

SEQ ID NO: 290838 - RNA, 32 nt, Human
aagcaucagaucuuuguauaugcuaagauuua

SEQ ID NO: 290839 - RNA, 32 nt, Human
aagcaucagcuaggcuggagugauuuguuaca

SEQ ID NO: 290840 - RNA, 32 nt, Human
aagcaucagggaugcuaagugcagugaugagg

SEQ ID NO: 290841 - RNA, 32 nt, Human
aagcaucagguguggaauggaaaacgcagaag

SEQ ID NO: 290842 - RNA, 32 nt, Human
aagcaucaugauaagauaugugugaagcccac

SEQ ID NO: 290843 - RNA, 32 nt, Human
aagcauccaagauuuuggauccugggccucag

SEQ ID NO: 290844 - RNA, 32 nt, Human
aagcauccauuuucuauccuuuuagagucuua

SEQ ID NO: 290845 - RNA, 32 nt, Human
aagcaucccauaaccaaccuucagccccaccg

SEQ ID NO: 290846 - RNA, 32 nt, Human
aagcaucccccaucccuugcaggcugggggcu

SEQ ID NO: 290847 - RNA, 32 nt, Human
aagcauccccgguggucugcacacggcucagg

SEQ ID NO: 290848 - RNA, 32 nt, Human
aagcaucccuggagggcaaccuggcggagaca

SEQ ID NO: 290849 - RNA, 32 nt, Human
aagcauccucuaagacccacagaaggaaucaa

SEQ ID NO: 290850 - RNA, 32 nt, Human
aagcauccuuugcucucuuuccagaaaggaag

SEQ ID NO: 290851 - RNA, 32 nt, Human
aagcaucgcuggagggcagccugguggagacg

SEQ ID NO: 290852 - RNA, 32 nt, Human
aagcaucgcuggagggcagccugguggagaug

SEQ ID NO: 290853 - RNA, 32 nt, Human
aagcaucuaggcugccucuucacuuucuuuua

SEQ ID NO: 290854 - RNA, 32 nt, Human
aagcaucuaucuauucugaaucauguuuggaa

SEQ ID NO: 290855 - RNA, 32 nt, Human
aagcaucuccugcccucucuccuuccucccca

SEQ ID NO: 290856 - RNA, 32 nt, Human
aagcaucugggccuuucucuuccucuuggucc

SEQ ID NO: 290857 - RNA, 32 nt, Human
aagcaucugggcuggauggaauuuagcaucaa

SEQ ID NO: 290858 - RNA, 32 nt, Human
aagcaucugugccauuguggggacucccuggg

SEQ ID NO: 290859 - RNA, 32 nt, Human
aagcaucuucauuuugcuagcuuugcagaauc

SEQ ID NO: 290860 - RNA, 22 nt, Human
aagcaugaagauaaacacagcu

SEQ ID NO: 290861 - RNA, 32 nt, Human
aagcaugaaggagagaaaaaugggggucgugg

SEQ ID NO: 290862 - RNA, 32 nt, Human
aagcaugaaguuaaagagugaagggguuaugu

SEQ ID NO: 290863 - RNA, 32 nt, Human
aagcaugacagaaaauauguauuaacacuacu

SEQ ID NO: 290864 - RNA, 32 nt, Human
aagcaugaccgaugcaccauuuucuaguuuua

SEQ ID NO: 290865 - RNA, 32 nt, Human
aagcaugacucauccagguuccagagccaaag

SEQ ID NO: 290866 - RNA, 29 nt, Human
aagcaugagccaagcucccuacuguguca

SEQ ID NO: 290867 - RNA, 32 nt, Human
aagcaugauaagaggaggaagacauaaaguug

SEQ ID NO: 290868 - RNA, 32 nt, Human
aagcaugccacuauacuccagccugggcaaca

SEQ ID NO: 290869 - RNA, 31 nt, Human
aagcaugccguucugcaccuacccaguugcc

SEQ ID NO: 290870 - RNA, 32 nt, Human
aagcaugccuuaaacccagugaagcaacugag

SEQ ID NO: 290871 - RNA, 32 nt, Human
aagcaugcugccccuggccuuccaaaucucau

SEQ ID NO: 290872 - RNA, 32 nt, Human
aagcaugcuuugacgaagcuaucgguaacaca

SEQ ID NO: 290873 - RNA, 32 nt, Human
aagcauggaacagcagcugugcgagcucugcu

SEQ ID NO: 290874 - RNA, 32 nt, Human
aagcauggccccgugaggguuuugaaagagaa

SEQ ID NO: 290875 - RNA, 32 nt, Human
aagcauggccuccccagagcagccugcggccu

SEQ ID NO: 290876 - RNA, 32 nt, Human
aagcauggccugggagcuuggaagggaggggu

SEQ ID NO: 290877 - RNA, 32 nt, Human
aagcauggcugagagcaacugagggaaaggga

SEQ ID NO: 290878 - RNA, 29 nt, Human
aagcaugggaggaaggaagauggcgacag

SEQ ID NO: 290879 - RNA, 32 nt, Human
aagcaugggggagggggagagaggucaggcca

SEQ ID NO: 290880 - RNA, 32 nt, Human
aagcauggguagcugccaucugcaggcaaguu

SEQ ID NO: 290881 - RNA, 32 nt, Human
aagcauggugcugcugcuucugcugcuucucc

SEQ ID NO: 290882 - RNA, 32 nt, Human
aagcaugguucaucuucccauuuauuuacguc

SEQ ID NO: 290883 - RNA, 32 nt, Human
aagcaugguuccuuucuuaaagaaaucuucca

SEQ ID NO: 290884 - RNA, 32 nt, Human
aagcauguagcucagugguuuccaaauuuggc

SEQ ID NO: 290885 - RNA, 32 nt, Human
aagcauguagggucuucaugucuuuucucuga

SEQ ID NO: 290886 - RNA, 32 nt, Human
aagcaugucuagugucuccaaacugggaaagu

SEQ ID NO: 290887 - RNA, 32 nt, Human
aagcaugugaaagagacacacaaugaggaaau

SEQ ID NO: 290888 - RNA, 32 nt, Human
aagcaugugagccggggagcagcuguccucag

SEQ ID NO: 290889 - RNA, 32 nt, Human
aagcaugugagguucccaacacugucagcaaa

SEQ ID NO: 290890 - RNA, 17 nt, Human
aagcaugugccugugug

SEQ ID NO: 290891 - RNA, 32 nt, Human
aagcaugugggugcccccuuucugccagcagu

SEQ ID NO: 290892 - RNA, 32 nt, Human
aagcaugugggugcucccuuucugccagcagu

SEQ ID NO: 290893 - RNA, 32 nt, Human
aagcauuagucuuuguacuuugcuuacauucc

SEQ ID NO: 290894 - RNA, 32 nt, Human
aagcauucaaaaccaaaccaaacagcaguuca

SEQ ID NO: 290895 - RNA, 32 nt, Human
aagcauucaagcaacucuguauuuuccucaua

SEQ ID NO: 290896 - RNA, 32 nt, Human
aagcauucagaagaaaaagaagcaaccucagu

SEQ ID NO: 290897 - RNA, 32 nt, Human
aagcauucagaaugauguuucgguucuuugag

SEQ ID NO: 290898 - RNA, 32 nt, Human
aagcauuccaaagccucugauuguuguuuccu

SEQ ID NO: 290899 - RNA, 32 nt, Human
aagcauuccaguagcuaugaccugccgcccug

SEQ ID NO: 290900 - RNA, 32 nt, Human
aagcauuccucaggaagcgucucacucuggga

SEQ ID NO: 290901 - RNA, 32 nt, Human
aagcauucuggcaucccagugaagagcucagg

SEQ ID NO: 290902 - RNA, 32 nt, Human
aagcauugaaggggaccagccgcugaagggau

SEQ ID NO: 290903 - RNA, 32 nt, Human
aagcauugcacuguaccucucguaacacagca

SEQ ID NO: 290904 - RNA, 32 nt, Human
aagcauugccuggccuuccugucuagucucuc

SEQ ID NO: 290905 - RNA, 21 nt, Human
aagcauugccuuucuuguuug

SEQ ID NO: 290906 - RNA, 23 nt, Human
aagcauugcuaccaaccgccuca

SEQ ID NO: 290907 - RNA, 32 nt, Human
aagcauugcuacccauuuucagcuucucugcc

SEQ ID NO: 290908 - RNA, 32 nt, Human
aagcauugcuggagggcagccugguggagacg

SEQ ID NO: 290909 - RNA, 32 nt, Human
aagcauuggcaggcugggugaaaaugagaaag

SEQ ID NO: 290910 - RNA, 32 nt, Human
aagcauuggcauggucaugaaugguggcccag

SEQ ID NO: 290911 - RNA, 32 nt, Human
aagcauugggauuacaggcaucagccaccaca

SEQ ID NO: 290912 - RNA, 32 nt, Human
aagcauuggguguuuugcaauggcuacacaaa

SEQ ID NO: 290913 - RNA, 24 nt, Human
aagcauuuaccugccugucuguaa

SEQ ID NO: 290914 - RNA, 24 nt, Human
aagcauuuauccaaauucugcuca

SEQ ID NO: 290915 - RNA, 32 nt, Human
aagcauuuauucuuguguucuggauuuagagc

SEQ ID NO: 290916 - RNA, 32 nt, Human
aagcauuuccacagauggugucaggguuucaa

SEQ ID NO: 290917 - RNA, 32 nt, Human
aagcauuuccuugagcucuucugagaaaaacc

SEQ ID NO: 290918 - RNA, 32 nt, Human
aagcauuucuacugcggggaaggagagguaaa

SEQ ID NO: 290919 - RNA, 32 nt, Human
aagcauuugcuucuguuuucccuaccuagaau

SEQ ID NO: 290920 - RNA, 32 nt, Human
aagcauuuguguguuuuccuugaacugucugu

SEQ ID NO: 290921 - RNA, 32 nt, Human
aagcauuuuacucacacccacagcagcaagaa

SEQ ID NO: 290922 - RNA, 32 nt, Human
aagcauuuuccucuucccuuuucagggugaag

SEQ ID NO: 290923 - RNA, 32 nt, Human
aagccaaaaaccaaagcaagacuuacuaacgc

SEQ ID NO: 290924 - RNA, 32 nt, Human
aagccaaaacacacaagucgguggugaugaca

SEQ ID NO: 290925 - RNA, 32 nt, Human
aagccaaaacucaaggagaaggugcggccaga

SEQ ID NO: 290926 - RNA, 32 nt, Human
aagccaaaagcugggaauggccaucugagaaa

SEQ ID NO: 290927 - RNA, 32 nt, Human
aagccaaaagugggauccuggaggccgcuggc

SEQ ID NO: 290928 - RNA, 32 nt, Human
aagccaaaaugucuucuggaggaggauauugc

SEQ ID NO: 290929 - RNA, 32 nt, Human
aagccaaaauuagaaaaauaacucccuacuuu

SEQ ID NO: 290930 - RNA, 32 nt, Human
aagccaaagaggaggaggcaggagaagcaggc

SEQ ID NO: 290931 - RNA, 32 nt, Human
aagccaaaguucaacagaugagaggaggguag

SEQ ID NO: 290932 - RNA, 23 nt, Human
aagccaaauacugccauccgaga

SEQ ID NO: 290933 - RNA, 23 nt, Human
aagccaaaugcugccauccgaga

SEQ ID NO: 290934 - RNA, 32 nt, Human
aagccaaauggcugcacuggccgauucugguc

SEQ ID NO: 290935 - RNA, 32 nt, Human
aagccaaauuaaaaaucaaggauucagucaaa

SEQ ID NO: 290936 - RNA, 32 nt, Human
aagccaacaaccacagugccaccaagcucaca

SEQ ID NO: 290937 - RNA, 32 nt, Human
aagccaacacaaaaauaaagaacuucaaauag

SEQ ID NO: 290938 - RNA, 19 nt, Human
aagccaaccaacaaacaca

SEQ ID NO: 290939 - RNA, 32 nt, Human
aagccaaccagccuuuggguccugggcaggug

SEQ ID NO: 290940 - RNA, 32 nt, Human
aagccaaccuauacuaaaaauuaguuccauaa

SEQ ID NO: 290941 - RNA, 32 nt, Human
aagccaaccucuaaccuccugaccucaugcua

SEQ ID NO: 290942 - RNA, 32 nt, Human
aagccaaccugagcaaacacagcagcccgagu

SEQ ID NO: 290943 - RNA, 32 nt, Human
aagccaacugaaagaaucuggaagaggagcuc

SEQ ID NO: 290944 - RNA, 32 nt, Human
aagccaacuggaacugugccuuuucucuuguc

SEQ ID NO: 290945 - RNA, 32 nt, Human
aagccaacuguggagcucggcggagaccucuc

SEQ ID NO: 290946 - RNA, 32 nt, Human
aagccaagaagaggaaacaagauaauaaaugu

SEQ ID NO: 290947 - RNA, 24 nt, Human
aagccaagagaagccacauggaga

SEQ ID NO: 290948 - RNA, 32 nt, Human
aagccaagaugccacccaaauccacucugcag

SEQ ID NO: 290949 - RNA, 32 nt, Human
aagccaagauuguaccacugcacuccagccug

SEQ ID NO: 290950 - RNA, 22 nt, Human
aagccaagccacaugccagaga

SEQ ID NO: 290951 - RNA, 32 nt, Human
aagccaagccagcuaccaccaggccugagggg

SEQ ID NO: 290952 - RNA, 23 nt, Human
aagccaagcccuccgccuagagg

SEQ ID NO: 290953 - RNA, 32 nt, Human
aagccaagccuccugugguccugagcaugaag

SEQ ID NO: 290954 - RNA, 32 nt, Human
aagccaaggagaccauuggccauccaggaaau

SEQ ID NO: 290955 - RNA, 32 nt, Human
aagccaaggagugcugagggcuggagugggug

SEQ ID NO: 290956 - RNA, 32 nt, Human
aagccaaggcaagguagcccugggcagccuuu

SEQ ID NO: 290957 - RNA, 21 nt, Human
aagccaaguaaagcccagaga

SEQ ID NO: 290958 - RNA, 31 nt, Human
aagccaagugucugggagcacagugagacca

SEQ ID NO: 290959 - RNA, 32 nt, Human
aagccaaugcaugcugagcugaaggaauuugu

SEQ ID NO: 290960 - RNA, 21 nt, Human
aagccaaugucaccucagagg

SEQ ID NO: 290961 - RNA, 32 nt, Human
aagccaauguuaggaauguuuaaaggcagcug

SEQ ID NO: 290962 - RNA, 32 nt, Human
aagccaauuauaaacucauuacuccaaagaca

SEQ ID NO: 290963 - RNA, 32 nt, Human
aagccaauucuccguaguuuaacccuguguau

SEQ ID NO: 290964 - RNA, 22 nt, Human
aagccaauuggauuucaaguua

SEQ ID NO: 290965 - RNA, 32 nt, Human
aagccaauuuggaaacuuagguuagugacaaa

SEQ ID NO: 290966 - RNA, 32 nt, Human
aagccacaaaggcauucgaagagaaugaagug

SEQ ID NO: 290967 - RNA, 32 nt, Human
aagccacacaugcauguucgugcaucccccac

SEQ ID NO: 290968 - RNA, 32 nt, Human
aagccacacccacugcuggguggacacuuagg

SEQ ID NO: 290969 - RNA, 32 nt, Human
aagccacaccuggucuguuuucugugcacugu

SEQ ID NO: 290970 - RNA, 32 nt, Human
aagccacacuccucaagugccugaaauacccc

SEQ ID NO: 290971 - RNA, 32 nt, Human
aagccacagaagagacagagggaaaaagacag

SEQ ID NO: 290972 - RNA, 32 nt, Human
aagccacagccccugccugggucuccacaucc

SEQ ID NO: 290973 - RNA, 32 nt, Human
aagccacaggccccuuccccagccucaguuca

SEQ ID NO: 290974 - RNA, 31 nt, Human
aagccacagggucagcaccuucuggucacuc

SEQ ID NO: 290975 - RNA, 32 nt, Human
aagccacaggguggggcagccaaggcaggggc

SEQ ID NO: 290976 - RNA, 32 nt, Human
aagccacaguuucucugugcuguguuuucuaa

SEQ ID NO: 290977 - RNA, 32 nt, Human
aagccacaugccacuaaccacaagcaagcugg

SEQ ID NO: 290978 - RNA, 32 nt, Human
aagccacaugcuggauggcuacaaggggcuca

SEQ ID NO: 290979 - RNA, 32 nt, Human
aagccaccacuccuggccaacuguaguugaac

SEQ ID NO: 290980 - RNA, 32 nt, Human
aagccaccaugauuguguucucugccucuggu

SEQ ID NO: 290981 - RNA, 32 nt, Human
aagccaccaugccuggcuaaaauucuuuugua

SEQ ID NO: 290982 - RNA, 32 nt, Human
aagccaccccucuuuaaacaaauuuaaagauc

SEQ ID NO: 290983 - RNA, 32 nt, Human
aagccacccuucaccuggacaggaugagagug

SEQ ID NO: 290984 - RNA, 32 nt, Human
aagccaccgcacuccagccugggcgacagagc

SEQ ID NO: 290985 - RNA, 32 nt, Human
aagccaccgcagcugcugccacucugcugccu

SEQ ID NO: 290986 - RNA, 32 nt, Human
aagccaccucaaacuacaauuuucagaaucug

SEQ ID NO: 290987 - RNA, 32 nt, Human
aagccaccuccaccucuguccuggcugccuca

SEQ ID NO: 290988 - RNA, 32 nt, Human
aagccaccuccagggcagucccagggacugaa

SEQ ID NO: 290989 - RNA, 32 nt, Human
aagccaccucugcccuaacccuugccagagcu

SEQ ID NO: 290990 - RNA, 32 nt, Human
aagccaccugauuuuaaggcugacauuagguu

SEQ ID NO: 290991 - RNA, 32 nt, Human
aagccaccugcuaacucccugccugugugguc

SEQ ID NO: 290992 - RNA, 32 nt, Human
aagccaccuugcccgcagcccaggcuccuggg

SEQ ID NO: 290993 - RNA, 32 nt, Human
aagccacuaucacugcuccccugggcaacugc

SEQ ID NO: 290994 - RNA, 32 nt, Human
aagccacucaagaugugaaggaagagaaucau

SEQ ID NO: 290995 - RNA, 32 nt, Human
aagccacugaagauggaaaacgagacagucag

SEQ ID NO: 290996 - RNA, 32 nt, Human
aagccacugcacucaaacguggggaacaagag

SEQ ID NO: 290997 - RNA, 32 nt, Human
aagccacugcacuccagccugggcgacagagc

SEQ ID NO: 290998 - RNA, 32 nt, Human
aagccacugccuccccuggcugugccacagcg

SEQ ID NO: 290999 - RNA, 32 nt, Human
aagccacuguuuugaacacauuuccuugaaaa

SEQ ID NO: 291000 - RNA, 32 nt, Human
aagccacuuaagcagaacacuuucuucaucuc

SEQ ID NO: 291001 - RNA, 32 nt, Human
aagccacuuagcccucuccuguccugcaccau

SEQ ID NO: 291002 - RNA, 32 nt, Human
aagccacuuccugagcccuccugcugcuuugg

SEQ ID NO: 291003 - RNA, 32 nt, Human
aagccacuuuauuuuaaaauaucaugugacag

SEQ ID NO: 291004 - RNA, 32 nt, Human
aagccacuuugacaacguuucugagccagggg

SEQ ID NO: 291005 - RNA, 32 nt, Human
aagccacuuuucuauuacuuaaguaagaagga

SEQ ID NO: 291006 - RNA, 32 nt, Human
aagccagaaagagaugaagggcaggcucuggg

SEQ ID NO: 291007 - RNA, 32 nt, Human
aagccagaacuccaccccggcgcccgcgccau

SEQ ID NO: 291008 - RNA, 32 nt, Human
aagccagaagccaggggguggggaagagagac

SEQ ID NO: 291009 - RNA, 32 nt, Human
aagccagaagcccucuggguggcccucaggug

SEQ ID NO: 291010 - RNA, 32 nt, Human
aagccagaaggagagcccucaccagaaaccaa

SEQ ID NO: 291011 - RNA, 32 nt, Human
aagccagaaguggccccucugccccuccagac

SEQ ID NO: 291012 - RNA, 22 nt, Human
aagccagaccaccacuuagaga

SEQ ID NO: 291013 - RNA, 32 nt, Human
aagccagacuaauuuucaugccuccugacucc

SEQ ID NO: 291014 - RNA, 32 nt, Human
aagccagagccagccugcuggccucagcuccg

SEQ ID NO: 291015 - RNA, 32 nt, Human
aagccagaggagggucccccagcugggugggc

SEQ ID NO: 291016 - RNA, 21 nt, Human
aagccagaggauacccaggga

SEQ ID NO: 291017 - RNA, 32 nt, Human
aagccagaggcagagguugcaaugagccggga

SEQ ID NO: 291018 - RNA, 32 nt, Human
aagccagaggcagcuccagccugggggacagg

SEQ ID NO: 291019 - RNA, 32 nt, Human
aagccagaggccccaggcucugugcugaugaa

SEQ ID NO: 291020 - RNA, 32 nt, Human
aagccagagucuuaaagagguuagagaggugg

SEQ ID NO: 291021 - RNA, 32 nt, Human
aagccagagugcagcuuggagcaaagaagaug

SEQ ID NO: 291022 - RNA, 32 nt, Human
aagccagagugcagcuuggagcaaagaaguuu

SEQ ID NO: 291023 - RNA, 32 nt, Human
aagccagaguggaaaugugcagagcuuacugu

SEQ ID NO: 291024 - RNA, 32 nt, Human
aagccagaugaagcuacacaaaugugguauuu

SEQ ID NO: 291025 - RNA, 32 nt, Human
aagccagauggugaccagagcuugccucugaa

SEQ ID NO: 291026 - RNA, 32 nt, Human
aagccagauguccguguggaggggacauagac

SEQ ID NO: 291027 - RNA, 32 nt, Human
aagccagcaaagugugucagaccauggcgugg

SEQ ID NO: 291028 - RNA, 21 nt, Human
aagccagcaggagcucugacu

SEQ ID NO: 291029 - RNA, 32 nt, Human
aagccagcaguauuucaguaucacaguguuuc

SEQ ID NO: 291030 - RNA, 32 nt, Human
aagccagcaugggugcccaguucuccaagacc

SEQ ID NO: 291031 - RNA, 32 nt, Human
aagccagccagcccuuccuccuucccucacca

SEQ ID NO: 291032 - RNA, 32 nt, Human
aagccagccagcgugguggacaggagcggagc

SEQ ID NO: 291033 - RNA, 32 nt, Human
aagccagccaucacccuccggccagagcucaa

SEQ ID NO: 291034 - RNA, 32 nt, Human
aagccagcccaggaccugggcuucacacacca

SEQ ID NO: 291035 - RNA, 21 nt, Human
aagccagccccacuacuuccu

SEQ ID NO: 291036 - RNA, 32 nt, Human
aagccagcccccaagacccuggggguggacac

SEQ ID NO: 291037 - RNA, 32 nt, Human
aagccagcccggcgcccuagcagaugcacgug

SEQ ID NO: 291038 - RNA, 32 nt, Human
aagccagccugaccaacauggugaaaccccau

SEQ ID NO: 291039 - RNA, 32 nt, Human
aagccagccugggcaacaaagugagaccgagu

SEQ ID NO: 291040 - RNA, 31 nt, Human
aagccagccuuucagcaccccuuacccucca

SEQ ID NO: 291041 - RNA, 32 nt, Human
aagccagcgaccguucugccucccguggggga

SEQ ID NO: 291042 - RNA, 32 nt, Human
aagccagcgccucuacaccccagaucccuacc

SEQ ID NO: 291043 - RNA, 20 nt, Human
aagccagcgguuccugggaa

SEQ ID NO: 291044 - RNA, 23 nt, Human
aagccagcucuggccacuagggg

SEQ ID NO: 291045 - RNA, 32 nt, Human
aagccagcugcagcugggcugugugguugacu

SEQ ID NO: 291046 - RNA, 32 nt, Human
aagccagcugccaugcugucagcuggggagag

SEQ ID NO: 291047 - RNA, 32 nt, Human
aagccagcuuugaaaggcauuuggggucucag

SEQ ID NO: 291048 - RNA, 31 nt, Human
aagccaggaaaggaaagauggggaagcccag

SEQ ID NO: 291049 - RNA, 17 nt, Human
aagccaggaacagagaa

SEQ ID NO: 291050 - RNA, 32 nt, Human
aagccaggaagagggucuucaccagaacuuga

SEQ ID NO: 291051 - RNA, 32 nt, Human
aagccaggaaggcaggagaggccagggaagca

SEQ ID NO: 291052 - RNA, 32 nt, Human
aagccaggacacaccauccugccccaggccca

SEQ ID NO: 291053 - RNA, 22 nt, Human
aagccaggacagaggccaggag

SEQ ID NO: 291054 - RNA, 32 nt, Human
aagccaggaccaugaggaagggguaggggucu

SEQ ID NO: 291055 - RNA, 32 nt, Human
aagccaggacugacugugcaccagagaaucug

SEQ ID NO: 291056 - RNA, 32 nt, Human
aagccaggagaucaacuugucucagucaacaa

SEQ ID NO: 291057 - RNA, 32 nt, Human
aagccaggaggcagagguugcagugagccaag

SEQ ID NO: 291058 - RNA, 32 nt, Human
aagccaggaggcagagguugcaguuagcccag

SEQ ID NO: 291059 - RNA, 32 nt, Human
aagccaggaggcggagguugcagugagccgag

SEQ ID NO: 291060 - RNA, 21 nt, Human
aagccaggcagagcccacaga

SEQ ID NO: 291061 - RNA, 21 nt, Human
aagccaggcagagcccggggg

SEQ ID NO: 291062 - RNA, 32 nt, Human
aagccaggcagcgagccccgaggcucuucggg

SEQ ID NO: 291063 - RNA, 23 nt, Human
aagccaggcaggcugcccugaga

SEQ ID NO: 291064 - RNA, 22 nt, Human
aagccaggcagguagccagggg

SEQ ID NO: 291065 - RNA, 32 nt, Human
aagccaggccauagacaucaaugaaccaauag

SEQ ID NO: 291066 - RNA, 32 nt, Human
aagccaggcccaggugggcuguggcggcaucc

SEQ ID NO: 291067 - RNA, 32 nt, Human
aagccaggccucccaccucuugacucuuguga

SEQ ID NO: 291068 - RNA, 31 nt, Human
aagccaggcgcgcaaggaguuggagacccug

SEQ ID NO: 291069 - RNA, 32 nt, Human
aagccaggcgcgccucaggauccaggcucauu

SEQ ID NO: 291070 - RNA, 32 nt, Human
aagccaggcgucgcccccuccgggagcccugg

SEQ ID NO: 291071 - RNA, 25 nt, Human
aagccaggcgucgcccccucgggga

SEQ ID NO: 291072 - RNA, 21 nt, Human
aagccaggcuaaacccagaga

SEQ ID NO: 291073 - RNA, 32 nt, Human
aagccaggcucaacuucugggcucccagugcc

SEQ ID NO: 291074 - RNA, 22 nt, Human
aagccaggcugguucucugcau

SEQ ID NO: 291075 - RNA, 32 nt, Human
aagccaggcuuucuuagccauucuuugcagca

SEQ ID NO: 291076 - RNA, 32 nt, Human
aagccagggagggagacaggagggcaggagga

SEQ ID NO: 291077 - RNA, 32 nt, Human
aagccagggcuccuccuccugucgugggcuca

SEQ ID NO: 291078 - RNA, 32 nt, Human
aagccagggcuggaagcuacaggccugaccuu

SEQ ID NO: 291079 - RNA, 32 nt, Human
aagccagggcuggagggcaaaggucauaaccu

SEQ ID NO: 291080 - RNA, 32 nt, Human
aagccagggcugggacaauggcagugccuagu

SEQ ID NO: 291081 - RNA, 32 nt, Human
aagccaggggcagcugucaggccugaggaaga

SEQ ID NO: 291082 - RNA, 32 nt, Human
aagccaggggcagggugggauggggaagacca

SEQ ID NO: 291083 - RNA, 32 nt, Human
aagccaggguagcugcaugcacuggcauuuga

SEQ ID NO: 291084 - RNA, 32 nt, Human
aagccagggugcauccucagaaaccuacucaa

SEQ ID NO: 291085 - RNA, 21 nt, Human
aagccagggugugccaggaga

SEQ ID NO: 291086 - RNA, 22 nt, Human
aagccagguacaacaccagagg

SEQ ID NO: 291087 - RNA, 32 nt, Human
aagccagguccacggucuguucuugaagcagu

SEQ ID NO: 291088 - RNA, 32 nt, Human
aagccaguaacugagggcccacugccugcccg

SEQ ID NO: 291089 - RNA, 18 nt, Human
aagccaguagcuguuuga

SEQ ID NO: 291090 - RNA, 32 nt, Human
aagccagucaccagcccucugccugcagccau

SEQ ID NO: 291091 - RNA, 22 nt, Human
aagccagucaggugcccagagg

SEQ ID NO: 291092 - RNA, 32 nt, Human
aagccagugagcugggcuucaguuuuucccag

SEQ ID NO: 291093 - RNA, 32 nt, Human
aagccaguggagaccaacgguccugugccaau

SEQ ID NO: 291094 - RNA, 32 nt, Human
aagccaguguccuacugggagcucagucugua

SEQ ID NO: 291095 - RNA, 32 nt, Human
aagccaguguccuucgaggaacccacccggcu

SEQ ID NO: 291096 - RNA, 32 nt, Human
aagccaguucaucucagaguccaggccugacc

SEQ ID NO: 291097 - RNA, 32 nt, Human
aagccaguucuucucuuccagaagaauucaga

SEQ ID NO: 291098 - RNA, 32 nt, Human
aagccaguuucugccaccccacucuccaggcc

SEQ ID NO: 291099 - RNA, 32 nt, Human
aagccaguuugcuguucaggaagagaaaagua

SEQ ID NO: 291100 - RNA, 32 nt, Human
aagccaguuuucucagaaagccuuucugacug

SEQ ID NO: 291101 - RNA, 32 nt, Human
aagccauacacugaggcggaagaucgcaaguc

SEQ ID NO: 291102 - RNA, 32 nt, Human
aagccauagacccugaggcccugggcugggug

SEQ ID NO: 291103 - RNA, 32 nt, Human
aagccauaucucuuccuucuuuaugcacuuac

SEQ ID NO: 291104 - RNA, 32 nt, Human
aagccaucagaauuaucaguggagaagcaccu

SEQ ID NO: 291105 - RNA, 22 nt, Human
aagccaucaucuaacaccucug

SEQ ID NO: 291106 - RNA, 32 nt, Human
aagccauccagcccuucucccuguacccagua

SEQ ID NO: 291107 - RNA, 32 nt, Human
aagccauccagccucccugacccuccacacgg

SEQ ID NO: 291108 - RNA, 32 nt, Human
aagccauccuucagacagagagggagcggcug

SEQ ID NO: 291109 - RNA, 32 nt, Human
aagccauccuugcccaggguauccaggaaaau

SEQ ID NO: 291110 - RNA, 32 nt, Human
aagccaucgcuggcccccaccuccuguggacu

SEQ ID NO: 291111 - RNA, 32 nt, Human
aagccaucucuccccugugaggcacagguggc

SEQ ID NO: 291112 - RNA, 32 nt, Human
aagccaucugacagcaggccacuagugacagu

SEQ ID NO: 291113 - RNA, 32 nt, Human
aagccaucugccugccuccaccucccaaaaug

SEQ ID NO: 291114 - RNA, 32 nt, Human
aagccaucuguggagucaagcagucauggcuc

SEQ ID NO: 291115 - RNA, 32 nt, Human
aagccaucuuucuucuuacugccaauaaaaac

SEQ ID NO: 291116 - RNA, 32 nt, Human
aagccaugaauguucagacggucugggcaguc

SEQ ID NO: 291117 - RNA, 32 nt, Human
aagccaugcagcuguacaacaagguggacccu

SEQ ID NO: 291118 - RNA, 32 nt, Human
aagccaugccaauaaagugaccuguguucaaa

SEQ ID NO: 291119 - RNA, 32 nt, Human
aagccaugcucuuuugacucuggcuuccguca

SEQ ID NO: 291120 - RNA, 32 nt, Human
aagccauggaaauacaagucaaagggguaaaa

SEQ ID NO: 291121 - RNA, 32 nt, Human
aagccauggagacagguagcauuuguaagaug

SEQ ID NO: 291122 - RNA, 32 nt, Human
aagccaugggaggccaagaagcugcuguggcu

SEQ ID NO: 291123 - RNA, 32 nt, Human
aagccauguaucucccccacaccagggcccac

SEQ ID NO: 291124 - RNA, 32 nt, Human
aagccaugucagcaccacacacugcagcucuc

SEQ ID NO: 291125 - RNA, 32 nt, Human
aagccauguccagaggagcaggcugcaucuag

SEQ ID NO: 291126 - RNA, 32 nt, Human
aagccauucccuggaagagacaaguggaucug

SEQ ID NO: 291127 - RNA, 32 nt, Human
aagccauuccgagucugggaccugccccugug

SEQ ID NO: 291128 - RNA, 32 nt, Human
aagccauucucccaccucuguccuucagguag

SEQ ID NO: 291129 - RNA, 32 nt, Human
aagccauucucugccucagccuucccauuagc

SEQ ID NO: 291130 - RNA, 21 nt, Human
aagccauugaauuuguaccuc

SEQ ID NO: 291131 - RNA, 32 nt, Human
aagccauugcacuccagccugggcaacaagag

SEQ ID NO: 291132 - RNA, 32 nt, Human
aagccauugcagcaaccuuccuucucagccag

SEQ ID NO: 291133 - RNA, 32 nt, Human
aagccauuguacuccagccuggacaacaagag

SEQ ID NO: 291134 - RNA, 32 nt, Human
aagcccaaaaaggacaaaaaugggcuggccug

SEQ ID NO: 291135 - RNA, 32 nt, Human
aagcccaaagugguauagaaaugcugguuuuu

SEQ ID NO: 291136 - RNA, 19 nt, Human
aagcccaacagcaagggug

SEQ ID NO: 291137 - RNA, 19 nt, Human
aagcccaacauuaaagggu

SEQ ID NO: 291138 - RNA, 21 nt, Human
aagcccaacccaaauguguca

SEQ ID NO: 291139 - RNA, 23 nt, Human
aagcccaaccuccugaccuguca

SEQ ID NO: 291140 - RNA, 17 nt, Human
aagcccaagaacaaagg

SEQ ID NO: 291141 - RNA, 19 nt, Human
aagcccaagauacaaaugg

SEQ ID NO: 291142 - RNA, 21 nt, Human
aagcccaagaucaaagaugug

SEQ ID NO: 291143 - RNA, 18 nt, Human
aagcccaagauccgcagg

SEQ ID NO: 291144 - RNA, 18 nt, Human
aagcccaagauuccgaag

SEQ ID NO: 291145 - RNA, 32 nt, Human
aagcccaaggccugugcaggacacggggagaa

SEQ ID NO: 291146 - RNA, 19 nt, Human
aagcccaaggucaaagugu

SEQ ID NO: 291147 - RNA, 20 nt, Human
aagcccaagguugaaggggg

SEQ ID NO: 291148 - RNA, 20 nt, Human
aagcccaagucucaagaggu

SEQ ID NO: 291149 - RNA, 32 nt, Human
aagcccacagccccuaccgagaaaggagccau

SEQ ID NO: 291150 - RNA, 32 nt, Human
aagcccacagccccuacugagaaaggagccac

SEQ ID NO: 291151 - RNA, 32 nt, Human
aagcccacauaugguagcacaggcuggccugu

SEQ ID NO: 291152 - RNA, 32 nt, Human
aagcccacccuacuccaaaaguaaugugucac

SEQ ID NO: 291153 - RNA, 32 nt, Human
aagcccaccgcggccaggaccuaaggaugcag

SEQ ID NO: 291154 - RNA, 32 nt, Human
aagcccaccucuccuccccagcagcgugcagg

SEQ ID NO: 291155 - RNA, 32 nt, Human
aagcccaccugccucucuccugcugcuccucc

SEQ ID NO: 291156 - RNA, 32 nt, Human
aagcccaccugcugcagcccacugccuggcca

SEQ ID NO: 291157 - RNA, 32 nt, Human
aagcccacgugaggcuggagugauguggccac

SEQ ID NO: 291158 - RNA, 19 nt, Human
aagcccagaagacuucugu

SEQ ID NO: 291159 - RNA, 32 nt, Human
aagcccagaaggcagagguuguagugagcuga

SEQ ID NO: 291160 - RNA, 32 nt, Human
aagcccagaaggucgaggcugcagugagcuga

SEQ ID NO: 291161 - RNA, 32 nt, Human
aagcccagaagguugagacugcagugagccac

SEQ ID NO: 291162 - RNA, 20 nt, Human
aagcccagaauucccaaagg

SEQ ID NO: 291163 - RNA, 32 nt, Human
aagcccagacaacccuugcagagcgacccuga

SEQ ID NO: 291164 - RNA, 32 nt, Human
aagcccagacgaggaggacggggaaccggauu

SEQ ID NO: 291165 - RNA, 32 nt, Human
aagcccagagcaggaagccacagcugucucug

SEQ ID NO: 291166 - RNA, 32 nt, Human
aagcccagauugugccacugcacuccagccug

SEQ ID NO: 291167 - RNA, 32 nt, Human
aagcccagccuauuugucuugccugcuguauc

SEQ ID NO: 291168 - RNA, 32 nt, Human
aagcccagcuccccuugggucucagugccagu

SEQ ID NO: 291169 - RNA, 32 nt, Human
aagcccaggaaaggcuccaggagcagccacau

SEQ ID NO: 291170 - RNA, 32 nt, Human
aagcccaggagaagaaggaaugaaacccugca

SEQ ID NO: 291171 - RNA, 32 nt, Human
aagcccaggagacagagguugcagugagccaa

SEQ ID NO: 291172 - RNA, 32 nt, Human
aagcccaggagcuuaagaccagccugggcaac

SEQ ID NO: 291173 - RNA, 32 nt, Human
aagcccaggaggaggaagaggaggcugguugg

SEQ ID NO: 291174 - RNA, 32 nt, Human
aagcccaggaggccaagucugcagugagcuau

SEQ ID NO: 291175 - RNA, 32 nt, Human
aagcccaggaggcugaaaacgagggcccagga

SEQ ID NO: 291176 - RNA, 32 nt, Human
aagcccaggagucugagaccagccugggcaac

SEQ ID NO: 291177 - RNA, 32 nt, Human
aagcccaggaguucaagaccagccugggcaac

SEQ ID NO: 291178 - RNA, 32 nt, Human
aagcccaggaguucgagaucagccuggacaau

SEQ ID NO: 291179 - RNA, 32 nt, Human
aagcccaggaguuugaaguugcaaugagcuau

SEQ ID NO: 291180 - RNA, 32 nt, Human
aagcccaggaguuugaggcugcagugaguuau

SEQ ID NO: 291181 - RNA, 32 nt, Human
aagcccagggaugcaaagguugcagugaguug

SEQ ID NO: 291182 - RNA, 18 nt, Human
aagcccaguaccacuuua

SEQ ID NO: 291183 - RNA, 32 nt, Human
aagcccaguggaaauuguggauuucaccaaag

SEQ ID NO: 291184 - RNA, 32 nt, Human
aagcccaguggaggcaggaugggagagccccc

SEQ ID NO: 291185 - RNA, 32 nt, Human
aagcccaguguauuccgcugcaucgcucuucg

SEQ ID NO: 291186 - RNA, 32 nt, Human
aagcccauaagcugggucucaggcugggcuca

SEQ ID NO: 291187 - RNA, 32 nt, Human
aagcccauagggaagagagagaggauauaggg

SEQ ID NO: 291188 - RNA, 32 nt, Human
aagcccaucagaaggagaaggaaggagacuca

SEQ ID NO: 291189 - RNA, 32 nt, Human
aagcccaucauggagaagaccuucaauuacag

SEQ ID NO: 291190 - RNA, 32 nt, Human
aagcccaucccucgcccccagccugaggugau

SEQ ID NO: 291191 - RNA, 32 nt, Human
aagcccaucuaacaggaggacauugguuuggg

SEQ ID NO: 291192 - RNA, 21 nt, Human
aagcccaucuaauccaagggu

SEQ ID NO: 291193 - RNA, 32 nt, Human
aagcccaucucccacacguguguggagucaga

SEQ ID NO: 291194 - RNA, 32 nt, Human
aagcccaucuucagacgucacagucuggaagu

SEQ ID NO: 291195 - RNA, 25 nt, Human
aagcccaugaacuucccagagagug

SEQ ID NO: 291196 - RNA, 32 nt, Human
aagcccaugaggaccauuguguggauccaugg

SEQ ID NO: 291197 - RNA, 32 nt, Human
aagcccaugucacugcuuaguggagaggauug

SEQ ID NO: 291198 - RNA, 32 nt, Human
aagcccauuuucaugccccagcugugcugugg

SEQ ID NO: 291199 - RNA, 32 nt, Human
aagccccaaacaggucaugcuccaauaaaaau

SEQ ID NO: 291200 - RNA, 32 nt, Human
aagccccaacagggcacagcagucuucuggua

SEQ ID NO: 291201 - RNA, 32 nt, Human
aagccccaagccuugacagcuuccauguggug

SEQ ID NO: 291202 - RNA, 32 nt, Human
aagccccaauagcuggacagaccucagccucc

SEQ ID NO: 291203 - RNA, 21 nt, Human
aagccccaaucccugcuucau

SEQ ID NO: 291204 - RNA, 21 nt, Human
aagccccacccaccccugccc

SEQ ID NO: 291205 - RNA, 32 nt, Human
aagccccacugcaugaaggccugagugcaagc

SEQ ID NO: 291206 - RNA, 32 nt, Human
aagccccagaagcacaagggccagaggaggug

SEQ ID NO: 291207 - RNA, 32 nt, Human
aagccccagcagagaaggccggagggagggcu

SEQ ID NO: 291208 - RNA, 32 nt, Human
aagccccaggaggucgaggcugcagugagcca

SEQ ID NO: 291209 - RNA, 32 nt, Human
aagccccaggcaggcugugcgcugacaaccac

SEQ ID NO: 291210 - RNA, 32 nt, Human
aagccccaggugagaagaccugaguucaccug

SEQ ID NO: 291211 - RNA, 32 nt, Human
aagccccauauguauauaguauguuguacacu

SEQ ID NO: 291212 - RNA, 32 nt, Human
aagccccauuccauuccuacagaucucucagc

SEQ ID NO: 291213 - RNA, 19 nt, Human
aagcccccaagcucucagg

SEQ ID NO: 291214 - RNA, 32 nt, Human
aagcccccugaaauacggagaauaagaaucuu

SEQ ID NO: 291215 - RNA, 32 nt, Human
aagcccccugcucucccacccaagugccccca

SEQ ID NO: 291216 - RNA, 32 nt, Human
aagcccccugcucucuucugagccccuucccc

SEQ ID NO: 291217 - RNA, 32 nt, Human
aagccccggguggcaguggauugauguccagu

SEQ ID NO: 291218 - RNA, 20 nt, Human
aagccccgucccaagaagug

SEQ ID NO: 291219 - RNA, 32 nt, Human
aagccccuacucagcagggcucugggaaugug

SEQ ID NO: 291220 - RNA, 19 nt, Human
aagccccucagaacucaag

SEQ ID NO: 291221 - RNA, 32 nt, Human
aagccccucagccuguagaaacagcccucggc

SEQ ID NO: 291222 - RNA, 32 nt, Human
aagccccuccaaaagagggaacuuuuucucug

SEQ ID NO: 291223 - RNA, 32 nt, Human
aagccccucgaauucugugaaaaugaggguuu

SEQ ID NO: 291224 - RNA, 32 nt, Human
aagccccucguggaggaggacaaggcaagaag

SEQ ID NO: 291225 - RNA, 32 nt, Human
aagccccucugccugcaccucagcuucuucau

SEQ ID NO: 291226 - RNA, 32 nt, Human
aagccccugaagcccccgacuccucagaguuu

SEQ ID NO: 291227 - RNA, 32 nt, Human
aagccccugcagcucugcugcaccgcagcuuc

SEQ ID NO: 291228 - RNA, 32 nt, Human
aagccccugcucggcauaaugaccuuauuaag

SEQ ID NO: 291229 - RNA, 32 nt, Human
aagccccuggagcuccccuuuuucgggccccg

SEQ ID NO: 291230 - RNA, 32 nt, Human
aagccccugugccuccccugugccccugggga

SEQ ID NO: 291231 - RNA, 32 nt, Human
aagccccuguguagugucuguguuguuuuccc

SEQ ID NO: 291232 - RNA, 32 nt, Human
aagccccuuccucuuuggccucuuccagguca

SEQ ID NO: 291233 - RNA, 32 nt, Human
aagccccuugcucuccccugcccugcugccgc

SEQ ID NO: 291234 - RNA, 32 nt, Human
aagcccgacauggugcuaguuuccucucuugg

SEQ ID NO: 291235 - RNA, 32 nt, Human
aagcccgacaugucguguggcagcagcgaggu

SEQ ID NO: 291236 - RNA, 32 nt, Human
aagcccgagggaggaagagagggagggaggaa

SEQ ID NO: 291237 - RNA, 32 nt, Human
aagcccggcccagaaagcuuuggagucugguu

SEQ ID NO: 291238 - RNA, 32 nt, Human
aagcccggcuguucuagcagaggcucuauaaa

SEQ ID NO: 291239 - RNA, 32 nt, Human
aagcccgggaggcagaaccugcagugagccaa

SEQ ID NO: 291240 - RNA, 32 nt, Human
aagcccgggaggucgaggcugcugugagccgu

SEQ ID NO: 291241 - RNA, 32 nt, Human
aagcccgggagguggagguugcagugagccca

SEQ ID NO: 291242 - RNA, 32 nt, Human
aagcccgggcaggagagcacagagccggcgac

SEQ ID NO: 291243 - RNA, 32 nt, Human
aagcccggggaguuccucugaggcccaguccu

SEQ ID NO: 291244 - RNA, 32 nt, Human
aagcccggucggaaagcgaaaguggccucgcc

SEQ ID NO: 291245 - RNA, 32 nt, Human
aagcccgucaccccacacaggcugcggcauca

SEQ ID NO: 291246 - RNA, 32 nt, Human
aagcccuaauccccacugugcugguauuagga

SEQ ID NO: 291247 - RNA, 32 nt, Human
aagcccuacaucuaugcagguuucccaucccu

SEQ ID NO: 291248 - RNA, 32 nt, Human
aagcccuacaugaucacugcaggaugauccuc

SEQ ID NO: 291249 - RNA, 32 nt, Human
aagcccuacccuccagcacuccaaggcaggac

SEQ ID NO: 291250 - RNA, 31 nt, Human
aagcccucaauaaacauguaugaaggcuggg

SEQ ID NO: 291251 - RNA, 32 nt, Human
aagcccucacugcucucucagucuucuugauu

SEQ ID NO: 291252 - RNA, 32 nt, Human
aagcccucagcaggugcugacggguacaacuu

SEQ ID NO: 291253 - RNA, 32 nt, Human
aagcccucaguaaacucccgagggauugcaag

SEQ ID NO: 291254 - RNA, 32 nt, Human
aagcccucaucuucucuuucucuccucaguuu

SEQ ID NO: 291255 - RNA, 32 nt, Human
aagcccuccccaggcugagggccaggucauac

SEQ ID NO: 291256 - RNA, 32 nt, Human
aagcccucccugccucggcagcgcggcgcagu

SEQ ID NO: 291257 - RNA, 32 nt, Human
aagcccucggagugaccgugggugacagcggc

SEQ ID NO: 291258 - RNA, 32 nt, Human
aagcccucuccaccugugggucucaccuguca

SEQ ID NO: 291259 - RNA, 32 nt, Human
aagcccucucugcaaucucgcuucucgugucc

SEQ ID NO: 291260 - RNA, 21 nt, Human
aagcccucugguacccaggga

SEQ ID NO: 291261 - RNA, 32 nt, Human
aagcccugaagcauggggccagcugggacuug

SEQ ID NO: 291262 - RNA, 20 nt, Human
aagcccugacaacaacuauc

SEQ ID NO: 291263 - RNA, 32 nt, Human
aagcccugaccucuguggccucccugcccugg

SEQ ID NO: 291264 - RNA, 32 nt, Human
aagcccugaccuuugcagccucccugccuuag

SEQ ID NO: 291265 - RNA, 32 nt, Human
aagcccugagaugaacagguauuuacugagca

SEQ ID NO: 291266 - RNA, 32 nt, Human
aagcccugagcuaccuuggggucugggguggg

SEQ ID NO: 291267 - RNA, 32 nt, Human
aagcccugagggcagcuguucccacuggcucu

SEQ ID NO: 291268 - RNA, 32 nt, Human
aagcccugcacuccaaggcuccuggcaucgua

SEQ ID NO: 291269 - RNA, 32 nt, Human
aagcccugcagccuccgacuccugcuggcucc

SEQ ID NO: 291270 - RNA, 32 nt, Human
aagcccugcccuugccccugugcucaagcugu

SEQ ID NO: 291271 - RNA, 32 nt, Human
aagcccugcucgaugcucacagggcccccagc

SEQ ID NO: 291272 - RNA, 32 nt, Human
aagcccugcuggggcccugcuuguuggccuga

SEQ ID NO: 291273 - RNA, 32 nt, Human
aagcccuggaaguugaggccaagccugcugag

SEQ ID NO: 291274 - RNA, 32 nt, Human
aagcccuggagcuugccagagcagagcgagaa

SEQ ID NO: 291275 - RNA, 31 nt, Human
aagcccuggauacugccucagauucugaaug

SEQ ID NO: 291276 - RNA, 32 nt, Human
aagcccuggcccgucugugcacucuuggcucc

SEQ ID NO: 291277 - RNA, 29 nt, Human
aagcccuggcugcaggcagccuuccaggc

SEQ ID NO: 291278 - RNA, 32 nt, Human
aagcccugggaacccucauccaugagagcucg

SEQ ID NO: 291279 - RNA, 32 nt, Human
aagcccugggaggucaaggcugcagugagcug

SEQ ID NO: 291280 - RNA, 32 nt, Human
aagcccugggcacagcagaugagacccuuccu

SEQ ID NO: 291281 - RNA, 32 nt, Human
aagcccugggcacaucugccacccugacauca

SEQ ID NO: 291282 - RNA, 32 nt, Human
aagcccugggugagcgagaggcuggagaacac

SEQ ID NO: 291283 - RNA, 32 nt, Human
aagcccuguggcucuggggacuugggauccag

SEQ ID NO: 291284 - RNA, 32 nt, Human
aagcccuguucuucagaaggugaguggguuga

SEQ ID NO: 291285 - RNA, 32 nt, Human
aagcccuucaggcuggaguauaguggcaugau

SEQ ID NO: 291286 - RNA, 32 nt, Human
aagcccuuggggagggggaugccuucaugggg

SEQ ID NO: 291287 - RNA, 32 nt, Human
aagcccuugguaucgccucucccuucccacug

SEQ ID NO: 291288 - RNA, 32 nt, Human
aagcccuuuagcccgcuacucuugccuuccac

SEQ ID NO: 291289 - RNA, 32 nt, Human
aagcccuuucucugugccucacaacagucuug

SEQ ID NO: 291290 - RNA, 32 nt, Human
aagccgaaggcugcuggcugggcugccuagcc

SEQ ID NO: 291291 - RNA, 32 nt, Human
aagccgacacuggccauaaucauaacuauuuc

SEQ ID NO: 291292 - RNA, 32 nt, Human
aagccgacuccccuccccaucucccucucaac

SEQ ID NO: 291293 - RNA, 32 nt, Human
aagccgagaacccagggccagcaguggaagcc

SEQ ID NO: 291294 - RNA, 32 nt, Human
aagccgagaucaccuccagccuggacacucug

SEQ ID NO: 291295 - RNA, 32 nt, Human
aagccgagcagcuuuggccaaguaauuuuugc

SEQ ID NO: 291296 - RNA, 32 nt, Human
aagccgagccuugagaggagcagguggaggcg

SEQ ID NO: 291297 - RNA, 21 nt, Human
aagccgagcgagcuccggagg

SEQ ID NO: 291298 - RNA, 32 nt, Human
aagccgcaagcucucagcaagugcccagugga

SEQ ID NO: 291299 - RNA, 32 nt, Human
aagccgcaagggacccucggcgccucggccug

SEQ ID NO: 291300 - RNA, 32 nt, Human
aagccgcacuacuucaccuggccacccaaccu

SEQ ID NO: 291301 - RNA, 32 nt, Human
aagccgcagagggagagcgggagcggucguga

SEQ ID NO: 291302 - RNA, 32 nt, Human
aagccgcagggggcaccguggggaagcuaacc

SEQ ID NO: 291303 - RNA, 32 nt, Human
aagccgccacaucuuuucauuucuccaagagg

SEQ ID NO: 291304 - RNA, 32 nt, Human
aagccgcccaggaguccccacgucugcccugg

SEQ ID NO: 291305 - RNA, 32 nt, Human
aagccgcccagugcccugagcgucuccauggc

SEQ ID NO: 291306 - RNA, 32 nt, Human
aagccgcccucggggcgcucauggcgggacgc

SEQ ID NO: 291307 - RNA, 32 nt, Human
aagccgccgguauuucuccaucuggcucuccu

SEQ ID NO: 291308 - RNA, 32 nt, Human
aagccgccuccagguacagccacagccaggag

SEQ ID NO: 291309 - RNA, 21 nt, Human
aagccgcgaggcccucaggga

SEQ ID NO: 291310 - RNA, 32 nt, Human
aagccgcgccugccaaggaggccaccagaggg

SEQ ID NO: 291311 - RNA, 32 nt, Human
aagccgcguugaccuggagacuguggccuugg

SEQ ID NO: 291312 - RNA, 21 nt, Human
aagccgcugccaucccggagg

SEQ ID NO: 291313 - RNA, 32 nt, Human
aagccgcugccccuugcaccuccucgggccuc

SEQ ID NO: 291314 - RNA, 32 nt, Human
aagccgcugggccuuuuuaauugccaaacugc

SEQ ID NO: 291315 - RNA, 32 nt, Human
aagccggaccaggaggccgagccccaggaggc

SEQ ID NO: 291316 - RNA, 32 nt, Human
aagccggacuccaaguccaccucccuucagag

SEQ ID NO: 291317 - RNA, 32 nt, Human
aagccggacugccccagucuuugacugguuac

SEQ ID NO: 291318 - RNA, 32 nt, Human
aagccggagagcaagcccuggagguucacucu

SEQ ID NO: 291319 - RNA, 32 nt, Human
aagccggaggguguuuauguaagagcaccuuc

SEQ ID NO: 291320 - RNA, 32 nt, Human
aagccggcccaacccaaccacucggggccccc

SEQ ID NO: 291321 - RNA, 32 nt, Human
aagccggcgagggggagccagcagcggcgguc

SEQ ID NO: 291322 - RNA, 32 nt, Human
aagccggcuggucuucacccucccagacaagu

SEQ ID NO: 291323 - RNA, 32 nt, Human
aagccgggaggcaaguaggacagagagaugac

SEQ ID NO: 291324 - RNA, 26 nt, Human
aagccgggaggcggaaguugugguga

SEQ ID NO: 291325 - RNA, 32 nt, Human
aagccgggaggcggaaguuguggugagccgag

SEQ ID NO: 291326 - RNA, 32 nt, Human
aagccgggagguggggguugcagugagccgag

SEQ ID NO: 291327 - RNA, 24 nt, Human
aagccgggccuggccacccaaagg

SEQ ID NO: 291328 - RNA, 32 nt, Human
aagccggggcagcuccaccuccccagcccgcg

SEQ ID NO: 291329 - RNA, 32 nt, Human
aagccggggcucccccugccugccucucucuc

SEQ ID NO: 291330 - RNA, 32 nt, Human
aagccgggguaggaggaucaccagaggccagc

SEQ ID NO: 291331 - RNA, 32 nt, Human
aagccggguggcugagccaggcugugcacgga

SEQ ID NO: 291332 - RNA, 32 nt, Human
aagccggucucaaacuccugagcucaagugau

SEQ ID NO: 291333 - RNA, 32 nt, Human
aagccggucugcgcuguuccucgguggcgacc

SEQ ID NO: 291334 - RNA, 24 nt, Human
aagccggugccgggcgcccagggg

SEQ ID NO: 291335 - RNA, 32 nt, Human
aagccgguuacaucaugccacuuccuggaggu

SEQ ID NO: 291336 - RNA, 32 nt, Human
aagccguccaguuuugaagccacccagucugu

SEQ ID NO: 291337 - RNA, 32 nt, Human
aagccgucccugaccaggcuuaguugcuuccc

SEQ ID NO: 291338 - RNA, 32 nt, Human
aagccgugaggaugaggacaacuccacccucc

SEQ ID NO: 291339 - RNA, 32 nt, Human
aagccgugcucuccagccuggcugccagggag

SEQ ID NO: 291340 - RNA, 32 nt, Human
aagccgugcugcugauuccgucucacaguuua

SEQ ID NO: 291341 - RNA, 32 nt, Human
aagccguggaguaccugcuguugcucucaugc

SEQ ID NO: 291342 - RNA, 32 nt, Human
aagccguggcugccuuucaucugcugcguuuu

SEQ ID NO: 291343 - RNA, 32 nt, Human
aagccguguagccuguggcacuugguuauagc

SEQ ID NO: 291344 - RNA, 32 nt, Human
aagccguugcagccuccacuuggggaagcuga

SEQ ID NO: 291345 - RNA, 32 nt, Human
aagccuaacacaguuccuggcacacaacaggu

SEQ ID NO: 291346 - RNA, 32 nt, Human
aagccuaaguccucaauucauaaguuaucauu

SEQ ID NO: 291347 - RNA, 32 nt, Human
aagccuacagugagccaugaucucaccaugca

SEQ ID NO: 291348 - RNA, 32 nt, Human
aagccuacauguccuacuccagccuuauaaac

SEQ ID NO: 291349 - RNA, 32 nt, Human
aagccuacuuauuggguguuugcucacuaccc

SEQ ID NO: 291350 - RNA, 32 nt, Human
aagccuagagccaccagcccagcuuccuucuc

SEQ ID NO: 291351 - RNA, 31 nt, Human
aagccuaggaaacccucaggucugagauagg

SEQ ID NO: 291352 - RNA, 32 nt, Human
aagccuauaaugaagaaaaagaucuagaaacu

SEQ ID NO: 291353 - RNA, 32 nt, Human
aagccuauaguuaacaaccaccuggcuuuuau

SEQ ID NO: 291354 - RNA, 32 nt, Human
aagccuaucuggucuugggucuuugggaggau

SEQ ID NO: 291355 - RNA, 32 nt, Human
aagccuauguguccuuguguccugcagguauc

SEQ ID NO: 291356 - RNA, 21 nt, Human
aagccuauuucuuuauaggua

SEQ ID NO: 291357 - RNA, 32 nt, Human
aagccucaaauacaauacuuauuuuauuuauu

SEQ ID NO: 291358 - RNA, 32 nt, Human
aagccucaagccuuauguuucuccaauguuac

SEQ ID NO: 291359 - RNA, 32 nt, Human
aagccucacugcaagcacugcaugggcaagcu

SEQ ID NO: 291360 - RNA, 32 nt, Human
aagccucagagucugaaugccuccagucugcg

SEQ ID NO: 291361 - RNA, 32 nt, Human
aagccucagccaaagccuccagccuuucuccu

SEQ ID NO: 291362 - RNA, 32 nt, Human
aagccucaggagaaggaaggagaucccuuuuc

SEQ ID NO: 291363 - RNA, 32 nt, Human
aagccuccacugccauggagacugccuggcug

SEQ ID NO: 291364 - RNA, 32 nt, Human
aagccuccagaacugugagaauucuuuuguuu

SEQ ID NO: 291365 - RNA, 32 nt, Human
aagccuccagcaugggcacugcagugccgucc

SEQ ID NO: 291366 - RNA, 32 nt, Human
aagccuccaguggagaacugggcuugcucaga

SEQ ID NO: 291367 - RNA, 32 nt, Human
aagccucccacacaccuccccguggccuggga

SEQ ID NO: 291368 - RNA, 32 nt, Human
aagccucccacucugaacaucaccuccuguac

SEQ ID NO: 291369 - RNA, 32 nt, Human
aagccuccgccuggccugccccucugcagucc

SEQ ID NO: 291370 - RNA, 32 nt, Human
aagccuccucaacuaugaccucaaccggccag

SEQ ID NO: 291371 - RNA, 32 nt, Human
aagccuccucaccccuaucuucaucuccugug

SEQ ID NO: 291372 - RNA, 32 nt, Human
aagccuccuccaccuccaaacacccccaccuu

SEQ ID NO: 291373 - RNA, 32 nt, Human
aagccuccucuaacaagcccagaaggaguucu

SEQ ID NO: 291374 - RNA, 32 nt, Human
aagccuccucucucccccacuggucaagauuc

SEQ ID NO: 291375 - RNA, 32 nt, Human
aagccuccuuaaggagccacaggaugguaccu

SEQ ID NO: 291376 - RNA, 32 nt, Human
aagccuccuuccucguccccugccucaagaaa

SEQ ID NO: 291377 - RNA, 19 nt, Human
aagccuccuucugguucca

SEQ ID NO: 291378 - RNA, 32 nt, Human
aagccucgugccacacuggcuuugagguagca

SEQ ID NO: 291379 - RNA, 32 nt, Human
aagccucuauucaccccuucucaauccucaca

SEQ ID NO: 291380 - RNA, 32 nt, Human
aagccucucaacucaaaagcacaagauccuug

SEQ ID NO: 291381 - RNA, 32 nt, Human
aagccucucaucuggcucagggaugaccuugc

SEQ ID NO: 291382 - RNA, 32 nt, Human
aagccucuccacccuagagaaaugccucugua

SEQ ID NO: 291383 - RNA, 32 nt, Human
aagccucuccaccugucccaaccauaaaaagg

SEQ ID NO: 291384 - RNA, 32 nt, Human
aagccucuccagagaaguuugguuucuuugcu

SEQ ID NO: 291385 - RNA, 32 nt, Human
aagccucucucuccagccuuuccccaggcagg

SEQ ID NO: 291386 - RNA, 32 nt, Human
aagccucucuuucuguccgcagauccugacuu

SEQ ID NO: 291387 - RNA, 32 nt, Human
aagccucugcauaaggugugggaaacugagag

SEQ ID NO: 291388 - RNA, 32 nt, Human
aagccucugccuggagccgcuagccugugcug

SEQ ID NO: 291389 - RNA, 32 nt, Human
aagccucuucuccaugugugcacacaggguag

SEQ ID NO: 291390 - RNA, 32 nt, Human
aagccucuugagaaggcaccagacagugaacu

SEQ ID NO: 291391 - RNA, 32 nt, Human
aagccugaaaugccuuaauugugaacugauac

SEQ ID NO: 291392 - RNA, 32 nt, Human
aagccugaaaugccuuaauugugaacugauau

SEQ ID NO: 291393 - RNA, 32 nt, Human
aagccugaagacacugguagcuuuuaauaauu

SEQ ID NO: 291394 - RNA, 32 nt, Human
aagccugaaggauccuugcagagagauguucu

SEQ ID NO: 291395 - RNA, 32 nt, Human
aagccugaauccccagcaccuggcgaggccga

SEQ ID NO: 291396 - RNA, 32 nt, Human
aagccugaccaauauggagaaacccugucucu

SEQ ID NO: 291397 - RNA, 32 nt, Human
aagccugaccuagccagaagugccuguccgcu

SEQ ID NO: 291398 - RNA, 24 nt, Human
aagccugaccuuucaaauccauga

SEQ ID NO: 291399 - RNA, 32 nt, Human
aagccugacucugcucucgagagcuccagcag

SEQ ID NO: 291400 - RNA, 32 nt, Human
aagccugacuuaacgggggaagauggugagaa

SEQ ID NO: 291401 - RNA, 32 nt, Human
aagccugagagggagaggaaacaaaagcugug

SEQ ID NO: 291402 - RNA, 32 nt, Human
aagccugagcaacauaucaaaaccccaucucu

SEQ ID NO: 291403 - RNA, 32 nt, Human
aagccugagccaaaaccacuaguccaagaaaa

SEQ ID NO: 291404 - RNA, 32 nt, Human
aagccugagcggagcgguggagagggagaggc

SEQ ID NO: 291405 - RNA, 32 nt, Human
aagccugagcucgguggacagcucccucuccc

SEQ ID NO: 291406 - RNA, 32 nt, Human
aagccugaggggacagugagucuccaggucug

SEQ ID NO: 291407 - RNA, 32 nt, Human
aagccugagugcaaaugucauuucccucuacu

SEQ ID NO: 291408 - RNA, 32 nt, Human
aagccugaguuauuugcaaaagcaaacacaac

SEQ ID NO: 291409 - RNA, 32 nt, Human
aagccugaucccaggaggcccugcaguucccc

SEQ ID NO: 291410 - RNA, 32 nt, Human
aagccugaucuuccaggguggggaggagaaaa

SEQ ID NO: 291411 - RNA, 32 nt, Human
aagccugauuucccagccuccuggcuguaggc

SEQ ID NO: 291412 - RNA, 32 nt, Human
aagccugcagacugaauagcgcuguacugggc

SEQ ID NO: 291413 - RNA, 32 nt, Human
aagccugcagggaaagccacuggagaguuuua

SEQ ID NO: 291414 - RNA, 32 nt, Human
aagccugcagugagccaugacuguugcugcac

SEQ ID NO: 291415 - RNA, 32 nt, Human
aagccugcaguugggggccugcccugagucug

SEQ ID NO: 291416 - RNA, 32 nt, Human
aagccugcccugcugccuggacugggacuguu

SEQ ID NO: 291417 - RNA, 32 nt, Human
aagccugcgucucuugguuuucucaaguggcg

SEQ ID NO: 291418 - RNA, 32 nt, Human
aagccugcuaaguuaucccaggccugugcgug

SEQ ID NO: 291419 - RNA, 32 nt, Human
aagccugcuccuuccccucucagccgucucag

SEQ ID NO: 291420 - RNA, 32 nt, Human
aagccugcugcucucuccucuggcaccagcug

SEQ ID NO: 291421 - RNA, 32 nt, Human
aagccugcuucagggcugggcgcgguggcuaa

SEQ ID NO: 291422 - RNA, 32 nt, Human
aagccuggaaggaggcaauaagugggaaaggu

SEQ ID NO: 291423 - RNA, 32 nt, Human
aagccuggaaggucaagacugcagugagcugu

SEQ ID NO: 291424 - RNA, 32 nt, Human
aagccuggaagguggaaguugcagugagucga

SEQ ID NO: 291425 - RNA, 32 nt, Human
aagccuggagccaaagaugacacaaggggaag

SEQ ID NO: 291426 - RNA, 32 nt, Human
aagccuggagccaccacacagcagagaggagu

SEQ ID NO: 291427 - RNA, 32 nt, Human
aagccuggaggcggaggcugcacugagcugag

SEQ ID NO: 291428 - RNA, 32 nt, Human
aagccuggcacucacuggcacugucgauuccc

SEQ ID NO: 291429 - RNA, 32 nt, Human
aagccuggccaacauggugaaaccccaucucu

SEQ ID NO: 291430 - RNA, 32 nt, Human
aagccuggccaacauggugaaaccccgucucu

SEQ ID NO: 291431 - RNA, 32 nt, Human
aagccuggccacuguuggcugcagcaggacau

SEQ ID NO: 291432 - RNA, 32 nt, Human
aagccuggcccuggcccgcagcacacuggcca

SEQ ID NO: 291433 - RNA, 32 nt, Human
aagccuggcguugccuggaccugcugcugccu

SEQ ID NO: 291434 - RNA, 32 nt, Human
aagccuggcuccagcccugccugcugcuccuu

SEQ ID NO: 291435 - RNA, 32 nt, Human
aagccuggcuccucaugcucagugccaggggc

SEQ ID NO: 291436 - RNA, 32 nt, Human
aagccugggaagucaagccugcagugaaccau

SEQ ID NO: 291437 - RNA, 32 nt, Human
aagccugggaggacgguggcuugccggucugu

SEQ ID NO: 291438 - RNA, 32 nt, Human
aagccugggaggcagagguugcagugagccga

SEQ ID NO: 291439 - RNA, 32 nt, Human
aagccugggggcggugggugacccuggcucug

SEQ ID NO: 291440 - RNA, 32 nt, Human
aagccugggguaccuagucaccaggaucucca

SEQ ID NO: 291441 - RNA, 32 nt, Human
aagccugggguguccugaacucugccugcuuc

SEQ ID NO: 291442 - RNA, 32 nt, Human
aagccugggugaggaugggccaggucccaauu

SEQ ID NO: 291443 - RNA, 18 nt, Human
aagccuggucuccuccca

SEQ ID NO: 291444 - RNA, 32 nt, Human
aagccuguaggaugaaguuggaaguuccagag

SEQ ID NO: 291445 - RNA, 32 nt, Human
aagccugucacacuagagugugugugacaugu

SEQ ID NO: 291446 - RNA, 32 nt, Human
aagccuguccccaagaacaggagagccauggc

SEQ ID NO: 291447 - RNA, 32 nt, Human
aagccugugaggucaugguugcaaugagucau

SEQ ID NO: 291448 - RNA, 32 nt, Human
aagccugugauggcacugggcauagugccuau

SEQ ID NO: 291449 - RNA, 32 nt, Human
aagccugugauuaucaggcuugaaauacugca

SEQ ID NO: 291450 - RNA, 32 nt, Human
aagccugugcagaugcagucaccuggaaagaa

SEQ ID NO: 291451 - RNA, 32 nt, Human
aagccugugggcagcaugcccagauucccaga

SEQ ID NO: 291452 - RNA, 32 nt, Human
aagccuguggugugcggagucuccucucuugg

SEQ ID NO: 291453 - RNA, 32 nt, Human
aagccuguuguggcgucuucugggaaagccug

SEQ ID NO: 291454 - RNA, 32 nt, Human
aagccuuaaucuuugcgacaccugccagugag

SEQ ID NO: 291455 - RNA, 32 nt, Human
aagccuuaccuccauguaaagaacagcacguc

SEQ ID NO: 291456 - RNA, 32 nt, Human
aagccuuacuaguggaugcaaagugguaucuc

SEQ ID NO: 291457 - RNA, 32 nt, Human
aagccuuauccuacguccuucucuccaucuau

SEQ ID NO: 291458 - RNA, 32 nt, Human
aagccuuauuaaaauauaaauauuagaaaauu

SEQ ID NO: 291459 - RNA, 32 nt, Human
aagccuucaaagcuuuuugcuaccaaagccca

SEQ ID NO: 291460 - RNA, 32 nt, Human
aagccuucaauggauccagcuguggcucuggu

SEQ ID NO: 291461 - RNA, 32 nt, Human
aagccuucaaugugggcaccauguccacagaa

SEQ ID NO: 291462 - RNA, 32 nt, Human
aagccuucagcccucucucauugguuaccaca

SEQ ID NO: 291463 - RNA, 32 nt, Human
aagccuucagcucuccccugaacuccaucuua

SEQ ID NO: 291464 - RNA, 32 nt, Human
aagccuucaguagguaguaaagacuuaaugug

SEQ ID NO: 291465 - RNA, 32 nt, Human
aagccuucauuucuuccacugccauucguaga

SEQ ID NO: 291466 - RNA, 32 nt, Human
aagccuucauuucuuccgguagccuucgauau

SEQ ID NO: 291467 - RNA, 32 nt, Human
aagccuucauuuuugaccuccccuuacugaau

SEQ ID NO: 291468 - RNA, 32 nt, Human
aagccuuccagccugcggugcugucugcuggg

SEQ ID NO: 291469 - RNA, 32 nt, Human
aagccuuccaugucugacccugccucaugucu

SEQ ID NO: 291470 - RNA, 32 nt, Human
aagccuucccuaauuccaccccaaacccccac

SEQ ID NO: 291471 - RNA, 32 nt, Human
aagccuuccugcgugguggaggccagugcaga

SEQ ID NO: 291472 - RNA, 32 nt, Human
aagccuucucuuccuccugccuguaguguccc

SEQ ID NO: 291473 - RNA, 22 nt, Human
aagccuucuggccacccagaga

SEQ ID NO: 291474 - RNA, 32 nt, Human
aagccuucugugucucggcccugggcccaguc

SEQ ID NO: 291475 - RNA, 23 nt, Human
aagccuucuuagaacucugcuua

SEQ ID NO: 291476 - RNA, 32 nt, Human
aagccuucuuugccuuucuucuuugucuuauu

SEQ ID NO: 291477 - RNA, 32 nt, Human
aagccuugacagcuuccaugugguguugagac

SEQ ID NO: 291478 - RNA, 32 nt, Human
aagccuugacgcugugggcacugccucagccg

SEQ ID NO: 291479 - RNA, 32 nt, Human
aagccuugcaaucccaggcuggggucagccua

SEQ ID NO: 291480 - RNA, 32 nt, Human
aagccuugcacacucaccuccaccuucacagg

SEQ ID NO: 291481 - RNA, 21 nt, Human
aagccuugcacuagguugcag

SEQ ID NO: 291482 - RNA, 32 nt, Human
aagccuuggguagaaugggaauucuuuacccu

SEQ ID NO: 291483 - RNA, 32 nt, Human
aagccuugguaaaauaaucaguguuuccaauc

SEQ ID NO: 291484 - RNA, 32 nt, Human
aagccuugugcaagaaagaugcuuucaguaaa

SEQ ID NO: 291485 - RNA, 32 nt, Human
aagccuuguugacucugaugaugaggaucaga

SEQ ID NO: 291486 - RNA, 32 nt, Human
aagccuuuaacaagucuucaacuuuuucugca

SEQ ID NO: 291487 - RNA, 28 nt, Human
aagccuuuaagugcugcuucugucaguc

SEQ ID NO: 291488 - RNA, 32 nt, Human
aagccuuuacuucacauucucaccucauuaga

SEQ ID NO: 291489 - RNA, 24 nt, Human
aagccuuuauuagucgccaucagc

SEQ ID NO: 291490 - RNA, 32 nt, Human
aagccuuuccaaaauuaggugcuugguaauca

SEQ ID NO: 291491 - RNA, 32 nt, Human
aagccuuucccucccuaccugaucacugcuua

SEQ ID NO: 291492 - RNA, 32 nt, Human
aagccuuuccuaaacccugcugccuucccaaa

SEQ ID NO: 291493 - RNA, 32 nt, Human
aagccuuucgugggcagucagcacuuauuuac

SEQ ID NO: 291494 - RNA, 32 nt, Human
aagccuuucuccuagagaucugugccuccugg

SEQ ID NO: 291495 - RNA, 32 nt, Human
aagccuuucuccuuuucugucacuugcaaauu

SEQ ID NO: 291496 - RNA, 32 nt, Human
aagccuuucugauccaguuucauauaauuaug

SEQ ID NO: 291497 - RNA, 32 nt, Human
aagccuuucuucugccaaggucaccagcaccc

SEQ ID NO: 291498 - RNA, 32 nt, Human
aagccuuucuugcugugaacagcuucauucuc

SEQ ID NO: 291499 - RNA, 32 nt, Human
aagccuuugagaccgcagaagggaccuuguug

SEQ ID NO: 291500 - RNA, 32 nt, Human
aagccuuuggccuuucuccucccaggccucca

SEQ ID NO: 291501 - RNA, 32 nt, Human
aagccuuuguaaaacagugcauuuuucagauu

SEQ ID NO: 291502 - RNA, 32 nt, Human
aagccuuuuccccugggcuuuugauugugucu

SEQ ID NO: 291503 - RNA, 32 nt, Human
aagccuuuucucagaccuuaggcacagccucu

SEQ ID NO: 291504 - RNA, 23 nt, Human
aagccuuuuuagagaaccagggg

SEQ ID NO: 291505 - RNA, 32 nt, Human
aagcgaaacccuugccuuugagaguuuauggu

SEQ ID NO: 291506 - RNA, 32 nt, Human
aagcgaaccagaaaauccaggcccgugaccag

SEQ ID NO: 291507 - RNA, 32 nt, Human
aagcgaaccuccugccucagcaucccaaguag

SEQ ID NO: 291508 - RNA, 32 nt, Human
aagcgaagaagagaagagggauguguuccgca

SEQ ID NO: 291509 - RNA, 32 nt, Human
aagcgaagccagaucucaagggcugauaccug

SEQ ID NO: 291510 - RNA, 32 nt, Human
aagcgaaggaagcuacagaaacccagagaggc

SEQ ID NO: 291511 - RNA, 32 nt, Human
aagcgaaggaaggggaagaggaagggaaaagc

SEQ ID NO: 291512 - RNA, 32 nt, Human
aagcgaaggcaaaauuagaauuacugaugagg

SEQ ID NO: 291513 - RNA, 32 nt, Human
aagcgaaggcuuccccgguguaauuuccuggg

SEQ ID NO: 291514 - RNA, 32 nt, Human
aagcgaagucgaagcagagaggcgacggagcc

SEQ ID NO: 291515 - RNA, 32 nt, Human
aagcgaauggugaaagcuacugaaauaagcug

SEQ ID NO: 291516 - RNA, 31 nt, Human
aagcgacaaguguacccagaguagaaggccu

SEQ ID NO: 291517 - RNA, 32 nt, Human
aagcgacgcugcgcucgcugggcagucggagg

SEQ ID NO: 291518 - RNA, 32 nt, Human
aagcgagaaccccauucugccaccccaccagg

SEQ ID NO: 291519 - RNA, 32 nt, Human
aagcgagauggguaacaucacaguagauucgu

SEQ ID NO: 291520 - RNA, 32 nt, Human
aagcgagcgccaccuccucacacucaccacgg

SEQ ID NO: 291521 - RNA, 32 nt, Human
aagcgagcucagccucaauccccguccccacc

SEQ ID NO: 291522 - RNA, 32 nt, Human
aagcgaggguccaauccugcccugcgcuaguc

SEQ ID NO: 291523 - RNA, 32 nt, Human
aagcgagucuuuggaugggaggaggacgagga

SEQ ID NO: 291524 - RNA, 32 nt, Human
aagcgagugcgugugaccuauaaggaaagucu

SEQ ID NO: 291525 - RNA, 21 nt, Human
aagcgaguggcgcuuucaccu

SEQ ID NO: 291526 - RNA, 31 nt, Human
aagcgaucacucaagaaugguacagaugugu

SEQ ID NO: 291527 - RNA, 32 nt, Human
aagcgauccuacugcccuggucuuccaaaaua

SEQ ID NO: 291528 - RNA, 19 nt, Human
aagcgauccucccaccuca

SEQ ID NO: 291529 - RNA, 32 nt, Human
aagcgauccucccaccuuggccuaccaaagug

SEQ ID NO: 291530 - RNA, 32 nt, Human
aagcgauccuccugccucaaccuacuaaguag

SEQ ID NO: 291531 - RNA, 32 nt, Human
aagcgauccuccugccucagacaccagaguag

SEQ ID NO: 291532 - RNA, 32 nt, Human
aagcgaugcucccaccuccaccucccaaagug

SEQ ID NO: 291533 - RNA, 32 nt, Human
aagcgauuaaauuacuuccuccaaagucacac

SEQ ID NO: 291534 - RNA, 32 nt, Human
aagcgauuccucugccucagcacuuugggagg

SEQ ID NO: 291535 - RNA, 32 nt, Human
aagcgauucucccaccccagccucccaaguag

SEQ ID NO: 291536 - RNA, 32 nt, Human
aagcgauucuccugccucaggcucccaaggug

SEQ ID NO: 291537 - RNA, 32 nt, Human
aagcgauucuccugccucaggcucccaaguag

SEQ ID NO: 291538 - RNA, 32 nt, Human
aagcgauuugacuucacagcgugaccuuuuua

SEQ ID NO: 291539 - RNA, 32 nt, Human
aagcgcaagauccagguucugcagcagcaggc

SEQ ID NO: 291540 - RNA, 32 nt, Human
aagcgcacagcccgaggacugcgaggacgggg

SEQ ID NO: 291541 - RNA, 32 nt, Human
aagcgcacccugucguucagugacgucauucu

SEQ ID NO: 291542 - RNA, 32 nt, Human
aagcgcaggacggcaccgaggugguggugaaa

SEQ ID NO: 291543 - RNA, 32 nt, Human
aagcgcagucaacugcuggacccggccggugu

SEQ ID NO: 291544 - RNA, 32 nt, Human
aagcgcaguggcugucugauaagaacuggauu

SEQ ID NO: 291545 - RNA, 32 nt, Human
aagcgcaucuucuccacaugggcuucacgugg

SEQ ID NO: 291546 - RNA, 32 nt, Human
aagcgcauggcucucucaagccaugccacacu

SEQ ID NO: 291547 - RNA, 22 nt, Human
aagcgcauucuagguagaggag

SEQ ID NO: 291548 - RNA, 32 nt, Human
aagcgccacgauccuugacgggcacagccaga

SEQ ID NO: 291549 - RNA, 21 nt, Human
aagcgccagacaagcuggaga

SEQ ID NO: 291550 - RNA, 32 nt, Human
aagcgccauugcacuccagucugggugacaga

SEQ ID NO: 291551 - RNA, 32 nt, Human
aagcgcccuuccaacuuggggacgccuuaacc

SEQ ID NO: 291552 - RNA, 32 nt, Human
aagcgcccuuggguccagcuacucaggaggcc

SEQ ID NO: 291553 - RNA, 32 nt, Human
aagcgccgaucugggcacccgccaccagcaug

SEQ ID NO: 291554 - RNA, 32 nt, Human
aagcgccucacgcugcacacugcccaggcccu

SEQ ID NO: 291555 - RNA, 32 nt, Human
aagcgccugccucuccccuuccggugcucaca

SEQ ID NO: 291556 - RNA, 32 nt, Human
aagcgccuguagucccagcuacucuggaggcu

SEQ ID NO: 291557 - RNA, 32 nt, Human
aagcgcgagucugaguggaacccuggacgacu

SEQ ID NO: 291558 - RNA, 32 nt, Human
aagcgcgccgccuccccgcccucucucacucc

SEQ ID NO: 291559 - RNA, 32 nt, Human
aagcgcggagccgcagaucugguccgucgcuc

SEQ ID NO: 291560 - RNA, 32 nt, Human
aagcgcggcggcagcaagacgacuucuccgga

SEQ ID NO: 291561 - RNA, 32 nt, Human
aagcgcgggacaggcagaugcagugagugagg

SEQ ID NO: 291562 - RNA, 32 nt, Human
aagcgcgugccauuucacuccagccuggacaa

SEQ ID NO: 291563 - RNA, 24 nt, Human
aagcgcuaggauuacaagcaugag

SEQ ID NO: 291564 - RNA, 32 nt, Human
aagcgcuaggauuacagaugugagccaccgcg

SEQ ID NO: 291565 - RNA, 32 nt, Human
aagcgcuaggauuacaggugugagccacugcg

SEQ ID NO: 291566 - RNA, 24 nt, Human
aagcgcuaggauuagaggugugag

SEQ ID NO: 291567 - RNA, 24 nt, Human
aagcgcuaggauuccaggugugag

SEQ ID NO: 291568 - RNA, 32 nt, Human
aagcgcucgccugccccacagccugggccuug

SEQ ID NO: 291569 - RNA, 24 nt, Human
aagcgcugagauuacaggugugag

SEQ ID NO: 291570 - RNA, 32 nt, Human
aagcgcugagauuacaggugugagccaccgug

SEQ ID NO: 291571 - RNA, 32 nt, Human
aagcgcugagauuguaggcauaagccaccagg

SEQ ID NO: 291572 - RNA, 32 nt, Human
aagcgcugaucuucuauuuaauuccccaccca

SEQ ID NO: 291573 - RNA, 32 nt, Human
aagcgcugauggccuucucuccccucagaacu

SEQ ID NO: 291574 - RNA, 32 nt, Human
aagcgcugcccagguccuggggugguggcagc

SEQ ID NO: 291575 - RNA, 23 nt, Human
aagcgcuggauuacaggcaugag

SEQ ID NO: 291576 - RNA, 32 nt, Human
aagcgcuggauuacaggcaugagccacuacac

SEQ ID NO: 291577 - RNA, 32 nt, Human
aagcgcugggauuacaggcaggagccacugag

SEQ ID NO: 291578 - RNA, 32 nt, Human
aagcgcugggauuacaggcaugagccaccaug

SEQ ID NO: 291579 - RNA, 32 nt, Human
aagcgcugggauuacaggcaugagccaccgug

SEQ ID NO: 291580 - RNA, 24 nt, Human
aagcgcugggauuacaggcgugag

SEQ ID NO: 291581 - RNA, 32 nt, Human
aagcgcugggauuacaggcgugagccaccaca

SEQ ID NO: 291582 - RNA, 32 nt, Human
aagcgcugggauuacaggcgugagccaccgcg

SEQ ID NO: 291583 - RNA, 32 nt, Human
aagcgcugggauuacaggcgugagccaccucg

SEQ ID NO: 291584 - RNA, 24 nt, Human
aagcgcugggauuacaggugugag

SEQ ID NO: 291585 - RNA, 32 nt, Human
aagcgcugggauuacaggugugagccacugag

SEQ ID NO: 291586 - RNA, 32 nt, Human
aagcgcugggauuacaggugugagccacugug

SEQ ID NO: 291587 - RNA, 32 nt, Human
aagcgcuggggcccagcacggccaggcucuca

SEQ ID NO: 291588 - RNA, 32 nt, Human
aagcgcugguaggagaggcuuuaaggugguaa

SEQ ID NO: 291589 - RNA, 32 nt, Human
aagcgcuguaaacccugacggugggccuggca

SEQ ID NO: 291590 - RNA, 32 nt, Human
aagcgcuuccagcauccucuguucauccgggg

SEQ ID NO: 291591 - RNA, 32 nt, Human
aagcgcuucuacuggcccuccugcugccacca

SEQ ID NO: 291592 - RNA, 32 nt, Human
aagcggaagcaugagacccgcccacacuagcc

SEQ ID NO: 291593 - RNA, 32 nt, Human
aagcggacugagugcugggauccaaggcauuc

SEQ ID NO: 291594 - RNA, 32 nt, Human
aagcggagagucacagcggggccaggcccugg

SEQ ID NO: 291595 - RNA, 19 nt, Human
aagcggagcaagugccaag

SEQ ID NO: 291596 - RNA, 30 nt, Human
aagcggagccucuccgucucuuggcuccaa

SEQ ID NO: 291597 - RNA, 32 nt, Human
aagcggaggagggagagagccagcgaggcggc

SEQ ID NO: 291598 - RNA, 30 nt, Human
aagcggagguugcaaucagcugagaucaca

SEQ ID NO: 291599 - RNA, 32 nt, Human
aagcggcagcagaggcagcagcggcagaggca

SEQ ID NO: 291600 - RNA, 32 nt, Human
aagcggccacuucucccucccugagacccgag

SEQ ID NO: 291601 - RNA, 32 nt, Human
aagcggccugcucuagccguuugaaaccgcuu

SEQ ID NO: 291602 - RNA, 32 nt, Human
aagcggccuuugcucuucuuccuucuuccugc

SEQ ID NO: 291603 - RNA, 32 nt, Human
aagcggcucaggagaaccggggcuggaggagc

SEQ ID NO: 291604 - RNA, 32 nt, Human
aagcggcuucugguuccugcaaagggagagcc

SEQ ID NO: 291605 - RNA, 32 nt, Human
aagcggcuuggucggggguggucucguggggu

SEQ ID NO: 291606 - RNA, 32 nt, Human
aagcgggaagaaaaucagagggaagguuaagg

SEQ ID NO: 291607 - RNA, 32 nt, Human
aagcgggaggcugagcugcugaagcugcggcg

SEQ ID NO: 291608 - RNA, 32 nt, Human
aagcgggaggggccaugacuacgaggcccugg

SEQ ID NO: 291609 - RNA, 32 nt, Human
aagcgggccaaugccgguccacacaaccagua

SEQ ID NO: 291610 - RNA, 32 nt, Human
aagcggggaaggaaaggaaugagggaggaaau

SEQ ID NO: 291611 - RNA, 32 nt, Human
aagcggggagagagagggauagaaaacaagcg

SEQ ID NO: 291612 - RNA, 32 nt, Human
aagcggggagcuagcuuuguuuuuaaagacua

SEQ ID NO: 291613 - RNA, 32 nt, Human
aagcggggagcuagcuuuguuuuuaaagacuc

SEQ ID NO: 291614 - RNA, 32 nt, Human
aagcggggcaaaguucccugcccaccgacgcc

SEQ ID NO: 291615 - RNA, 32 nt, Human
aagcggggcuagugucagagaggugugccagg

SEQ ID NO: 291616 - RNA, 31 nt, Human
aagcgggucuguuucuuuacuuccuccacgg

SEQ ID NO: 291617 - RNA, 32 nt, Human
aagcgggucuuuggaugggaggaggacgagga

SEQ ID NO: 291618 - RNA, 32 nt, Human
aagcgggugcccauccagcccaggucccagga

SEQ ID NO: 291619 - RNA, 32 nt, Human
aagcgguaaggucacuguggaagaggaagcgu

SEQ ID NO: 291620 - RNA, 32 nt, Human
aagcgguauccgaaguggagcuucuagcgacc

SEQ ID NO: 291621 - RNA, 32 nt, Human
aagcgguauuagccucacuuaacagaugagga

SEQ ID NO: 291622 - RNA, 32 nt, Human
aagcggugcccaggccgguggugacaacuggg

SEQ ID NO: 291623 - RNA, 32 nt, Human
aagcgguucauugcuauuauugcagugucaug

SEQ ID NO: 291624 - RNA, 32 nt, Human
aagcguaaaggcaguggaggugaggagagaau

SEQ ID NO: 291625 - RNA, 32 nt, Human
aagcguagacauauauuuaugaaugugcauuu

SEQ ID NO: 291626 - RNA, 32 nt, Human
aagcgucaacucccagguaggggguaagggug

SEQ ID NO: 291627 - RNA, 32 nt, Human
aagcgucaggaaauagcaguugcugugauugg

SEQ ID NO: 291628 - RNA, 32 nt, Human
aagcgucaguggauauauuugaaagugguaau

SEQ ID NO: 291629 - RNA, 32 nt, Human
aagcguccagggcagauggcagaggaucugcc

SEQ ID NO: 291630 - RNA, 32 nt, Human
aagcguccuuucaacucuaagagaccagcaga

SEQ ID NO: 291631 - RNA, 32 nt, Human
aagcgucugaucuaaucccagcacuucuguaa

SEQ ID NO: 291632 - RNA, 32 nt, Human
aagcgugagacgccaccauuccuggaaaccac

SEQ ID NO: 291633 - RNA, 32 nt, Human
aagcgugagccacugcacccagccuguaaaau

SEQ ID NO: 291634 - RNA, 32 nt, Human
aagcgugcugccucucuucugugucguuuugu

SEQ ID NO: 291635 - RNA, 32 nt, Human
aagcguggcggccacagacuguggguaccggg

SEQ ID NO: 291636 - RNA, 32 nt, Human
aagcgugggcaagaugugcguggugcagcgcu

SEQ ID NO: 291637 - RNA, 32 nt, Human
aagcgugggcuguucuacccaccagaagucca

SEQ ID NO: 291638 - RNA, 32 nt, Human
aagcgugugggugcccccuuucugccagcagu

SEQ ID NO: 291639 - RNA, 32 nt, Human
aagcgugugggugcucccuuucugccagcagu

SEQ ID NO: 291640 - RNA, 32 nt, Human
aagcgugugugagauucagugguccaugcgug

SEQ ID NO: 291641 - RNA, 32 nt, Human
aagcguguuaucugcaaaauaccugugcagaa

SEQ ID NO: 291642 - RNA, 32 nt, Human
aagcguuccagguauuuuuguaaugcaaugga

SEQ ID NO: 291643 - RNA, 32 nt, Human
aagcguuccucuggggaccggcagcagaggca

SEQ ID NO: 291644 - RNA, 32 nt, Human
aagcguugagauuacaagcgugagccaccauu

SEQ ID NO: 291645 - RNA, 32 nt, Human
aagcguugggauuacaggcaugagccaccuca

SEQ ID NO: 291646 - RNA, 24 nt, Human
aagcguugggauuauaggcaugag

SEQ ID NO: 291647 - RNA, 32 nt, Human
aagcguuuacuucacauucacaccucaauaga

SEQ ID NO: 291648 - RNA, 32 nt, Human
aagcguuugcauuugcagugcaucagauaaau

SEQ ID NO: 291649 - RNA, 32 nt, Human
aagcuaaacaaccggauguggaagagauuuug

SEQ ID NO: 291650 - RNA, 32 nt, Human
aagcuaaagcaguggcuggggcuuuguuuuua

SEQ ID NO: 291651 - RNA, 32 nt, Human
aagcuaaaugaggggccaggugcaguggcuca

SEQ ID NO: 291652 - RNA, 32 nt, Human
aagcuaaccaaagaaaauggcuucaguaaguu

SEQ ID NO: 291653 - RNA, 32 nt, Human
aagcuaaccugcccaccucaccccugugauac

SEQ ID NO: 291654 - RNA, 32 nt, Human
aagcuaagcacauugcagaugaggcagauggg

SEQ ID NO: 291655 - RNA, 32 nt, Human
aagcuaagccagggcccagcugcguccaaccc

SEQ ID NO: 291656 - RNA, 32 nt, Human
aagcuaaggaaagagaaggcugcagauccaaa

SEQ ID NO: 291657 - RNA, 32 nt, Human
aagcuaagugagagagccagagggccuccuug

SEQ ID NO: 291658 - RNA, 32 nt, Human
aagcuaaucacuggcaggagccuggauggcug

SEQ ID NO: 291659 - RNA, 32 nt, Human
aagcuaaugcagcugccaugugugcuaaggcu

SEQ ID NO: 291660 - RNA, 32 nt, Human
aagcuaaugggugaaugggcagagggauuugg

SEQ ID NO: 291661 - RNA, 32 nt, Human
aagcuaaugucagagaaagaagcugagucuau

SEQ ID NO: 291662 - RNA, 32 nt, Human
aagcuaauucuuugaccuguugggagugagga

SEQ ID NO: 291663 - RNA, 32 nt, Human
aagcuaauuggaucccagcucagcuuuguggc

SEQ ID NO: 291664 - RNA, 32 nt, Human
aagcuacaaaccuaaaaugcugcugccccaaa

SEQ ID NO: 291665 - RNA, 32 nt, Human
aagcuacaaauagguuuucuuaaaccagagau

SEQ ID NO: 291666 - RNA, 32 nt, Human
aagcuacaacaagcccaaggucaaaguguauu

SEQ ID NO: 291667 - RNA, 25 nt, Human
aagcuacaagaggcacguucuggca

SEQ ID NO: 291668 - RNA, 32 nt, Human
aagcuacaagaggcacguucuggcaugaauga

SEQ ID NO: 291669 - RNA, 32 nt, Human
aagcuacacagcaacacguauaggagacucuc

SEQ ID NO: 291670 - RNA, 32 nt, Human
aagcuacaccugcagaauagcaugguuuuggc

SEQ ID NO: 291671 - RNA, 32 nt, Human
aagcuacacucugucagccucucuucgacagg

SEQ ID NO: 291672 - RNA, 32 nt, Human
aagcuacagucggcugcaggugcagugacuuu

SEQ ID NO: 291673 - RNA, 32 nt, Human
aagcuacagugaagucacagggucgaauacua

SEQ ID NO: 291674 - RNA, 32 nt, Human
aagcuaccagcaccuggggcccugccagccug

SEQ ID NO: 291675 - RNA, 32 nt, Human
aagcuaccaggaaggaaagggaagaagagauc

SEQ ID NO: 291676 - RNA, 32 nt, Human
aagcuacccaggagggcaccacgucgugugca

SEQ ID NO: 291677 - RNA, 32 nt, Human
aagcuaccccaccccuucccccaaacuaccuu

SEQ ID NO: 291678 - RNA, 32 nt, Human
aagcuacccugagauauagucagcugcccacc

SEQ ID NO: 291679 - RNA, 32 nt, Human
aagcuacccugccucgcugcuccgcuugccgc

SEQ ID NO: 291680 - RNA, 32 nt, Human
aagcuaccgucucugccgccuccuccuccucc

SEQ ID NO: 291681 - RNA, 32 nt, Human
aagcuaccuggaauggauuugugugcugauuu

SEQ ID NO: 291682 - RNA, 32 nt, Human
aagcuaccuuuuguaagugccauguuuauuau

SEQ ID NO: 291683 - RNA, 32 nt, Human
aagcuacgcaauugcagccacccggccgccaa

SEQ ID NO: 291684 - RNA, 32 nt, Human
aagcuacucgugccauccaggucuccgagccc

SEQ ID NO: 291685 - RNA, 32 nt, Human
aagcuacucuugaauuguugugcucaagugau

SEQ ID NO: 291686 - RNA, 32 nt, Human
aagcuacugagaugccuguucaucugcugacu

SEQ ID NO: 291687 - RNA, 32 nt, Human
aagcuacugaguuggagaauuaggggaugacu

SEQ ID NO: 291688 - RNA, 32 nt, Human
aagcuacugcuguuuucuuucuguuauuugca

SEQ ID NO: 291689 - RNA, 32 nt, Human
aagcuacugcuuauguccacagaccaggagga

SEQ ID NO: 291690 - RNA, 32 nt, Human
aagcuacuggacuaugcugaugggccagcagg

SEQ ID NO: 291691 - RNA, 32 nt, Human
aagcuacuucacuggcuaacagugaucauguu

SEQ ID NO: 291692 - RNA, 32 nt, Human
aagcuacuugggacauuauuagcaauaaaaau

SEQ ID NO: 291693 - RNA, 32 nt, Human
aagcuagaaagaaauaggaauuuaaguccaua

SEQ ID NO: 291694 - RNA, 32 nt, Human
aagcuagaagaaagcggugaggugagagagau

SEQ ID NO: 291695 - RNA, 32 nt, Human
aagcuagaagccaagaaaauggccagcuagaa

SEQ ID NO: 291696 - RNA, 32 nt, Human
aagcuagaagcgccccagcccggcaagcuggc

SEQ ID NO: 291697 - RNA, 20 nt, Human
aagcuagaaguguugggggg

SEQ ID NO: 291698 - RNA, 32 nt, Human
aagcuagacacaugaagguaaauaaaaagaaa

SEQ ID NO: 291699 - RNA, 32 nt, Human
aagcuagcuccccuccucuccccuccacuguc

SEQ ID NO: 291700 - RNA, 32 nt, Human
aagcuaggaaguccccucaccgcucagccagg

SEQ ID NO: 291701 - RNA, 32 nt, Human
aagcuaggacagagcaccugaccucaguuguc

SEQ ID NO: 291702 - RNA, 25 nt, Human
aagcuaggcagaugagcccagaaga

SEQ ID NO: 291703 - RNA, 32 nt, Human
aagcuaggggaauuaggccacaacacccccug

SEQ ID NO: 291704 - RNA, 32 nt, Human
aagcuaggguggcccuugcaguucagcaccac

SEQ ID NO: 291705 - RNA, 32 nt, Human
aagcuagucuugaauuccugaccucaggugau

SEQ ID NO: 291706 - RNA, 32 nt, Human
aagcuagugugcagcaggaguaucuggugcac

SEQ ID NO: 291707 - RNA, 32 nt, Human
aagcuaguuucuguucuguaaagugauaucuu

SEQ ID NO: 291708 - RNA, 32 nt, Human
aagcuauagguggagcaucagcagugagugag

SEQ ID NO: 291709 - RNA, 32 nt, Human
aagcuauauagagaaaaggaaaccacugaauc

SEQ ID NO: 291710 - RNA, 32 nt, Human
aagcuauaucauaaauacaagaguuucaaaac

SEQ ID NO: 291711 - RNA, 32 nt, Human
aagcuaucuaauaccuuggagguaggucaucc

SEQ ID NO: 291712 - RNA, 20 nt, Human
aagcuaucuugguaaauuuc

SEQ ID NO: 291713 - RNA, 32 nt, Human
aagcuaugagcauuuaaaaacuguuuacagcc

SEQ ID NO: 291714 - RNA, 22 nt, Human
aagcuaugcaagcucccagagg

SEQ ID NO: 291715 - RNA, 32 nt, Human
aagcuauguguuugaaggaaugaaucagugca

SEQ ID NO: 291716 - RNA, 32 nt, Human
aagcuauuccaaaaauauuguacuuaccaaca

SEQ ID NO: 291717 - RNA, 32 nt, Human
aagcuauucuacugccucagccucccaaguag

SEQ ID NO: 291718 - RNA, 32 nt, Human
aagcuauugcagcacuuucugaggcuuucacu

SEQ ID NO: 291719 - RNA, 32 nt, Human
aagcucaacaaauguuuggcuccuucacaauc

SEQ ID NO: 291720 - RNA, 32 nt, Human
aagcucaagauggaauggcuggagcuuggcug

SEQ ID NO: 291721 - RNA, 32 nt, Human
aagcucaagccuuugcgaagcuaaugaccugc

SEQ ID NO: 291722 - RNA, 32 nt, Human
aagcucaagugaggagggggaggcuggguuuu

SEQ ID NO: 291723 - RNA, 32 nt, Human
aagcucaaguggacgucccccuucaccugcca

SEQ ID NO: 291724 - RNA, 22 nt, Human
aagcucaaucuguuaucugcua

SEQ ID NO: 291725 - RNA, 32 nt, Human
aagcucaauuccucguugaauucgagucucaa

SEQ ID NO: 291726 - RNA, 32 nt, Human
aagcucacauuucuuucugucaccacagagau

SEQ ID NO: 291727 - RNA, 32 nt, Human
aagcucacccuccgaucucgguguguuguugu

SEQ ID NO: 291728 - RNA, 32 nt, Human
aagcucaccucccaccauggaggaggagcccu

SEQ ID NO: 291729 - RNA, 32 nt, Human
aagcucaccugccuuuucuguuggaagagauc

SEQ ID NO: 291730 - RNA, 32 nt, Human
aagcucacuauccugaaugaucgcggucaggg

SEQ ID NO: 291731 - RNA, 32 nt, Human
aagcucacuccugcuucucucugcacgucucc

SEQ ID NO: 291732 - RNA, 32 nt, Human
aagcucacugcaaccucugugcagguucaagu

SEQ ID NO: 291733 - RNA, 32 nt, Human
aagcucacuucacccucuccccaugccauccc

SEQ ID NO: 291734 - RNA, 32 nt, Human
aagcucacuucacugcacuccagucuggguga

SEQ ID NO: 291735 - RNA, 32 nt, Human
aagcucacuuccggcguagggaggcuuucuga

SEQ ID NO: 291736 - RNA, 32 nt, Human
aagcucagaaagcucauuaaaaacaacuaaaa

SEQ ID NO: 291737 - RNA, 20 nt, Human
aagcucagccucaggcccag

SEQ ID NO: 291738 - RNA, 32 nt, Human
aagcucagccugagcaggugggugcaaggcuc

SEQ ID NO: 291739 - RNA, 32 nt, Human
aagcucagccugggcggcacagccagaugcga

SEQ ID NO: 291740 - RNA, 32 nt, Human
aagcucagcuacuggguggaccggaggcgcaa

SEQ ID NO: 291741 - RNA, 32 nt, Human
aagcucagcucuucuuggucuuggcuagacug

SEQ ID NO: 291742 - RNA, 32 nt, Human
aagcucagcugaggccacccgagccccaggga

SEQ ID NO: 291743 - RNA, 32 nt, Human
aagcucagcugaugcaggccgguuggagugga

SEQ ID NO: 291744 - RNA, 32 nt, Human
aagcucagcuuacuguaaccucugccuccugg

SEQ ID NO: 291745 - RNA, 32 nt, Human
aagcucaggaguucaagaccagccuggccaac

SEQ ID NO: 291746 - RNA, 32 nt, Human
aagcucaggaguucaaggccagccugggcaac

SEQ ID NO: 291747 - RNA, 32 nt, Human
aagcucaggaguuugagaccagccugggcaac

SEQ ID NO: 291748 - RNA, 32 nt, Human
aagcucaggcugcauuagaguaugaauuuagc

SEQ ID NO: 291749 - RNA, 32 nt, Human
aagcucaggggugggaucggggagcaggaagc

SEQ ID NO: 291750 - RNA, 32 nt, Human
aagcucagugaggacgggacucuacugccgag

SEQ ID NO: 291751 - RNA, 32 nt, Human
aagcucaguuaaggagccaucagcaacacuga

SEQ ID NO: 291752 - RNA, 32 nt, Human
aagcucauagcaaauugaggggcagagauuuu

SEQ ID NO: 291753 - RNA, 25 nt, Human
aagcucaucacuggucauucagaga

SEQ ID NO: 291754 - RNA, 32 nt, Human
aagcucauucuucuucuuccucccagcagcuc

SEQ ID NO: 291755 - RNA, 32 nt, Human
aagcuccaaagaucccagcccgcaaggcuguc

SEQ ID NO: 291756 - RNA, 32 nt, Human
aagcuccaagagagucaguguagcugaaacuu

SEQ ID NO: 291757 - RNA, 32 nt, Human
aagcuccacaaacggggucacgucauccaggu

SEQ ID NO: 291758 - RNA, 32 nt, Human
aagcuccacggaggccaggaauuugccuauuu

SEQ ID NO: 291759 - RNA, 32 nt, Human
aagcuccacguuuuauuuucuucaaggcauuc

SEQ ID NO: 291760 - RNA, 32 nt, Human
aagcuccagguuucaccacaaugcccaucccu

SEQ ID NO: 291761 - RNA, 28 nt, Human
aagcucccaaguguugcuggaucucugc

SEQ ID NO: 291762 - RNA, 32 nt, Human
aagcucccacuacaugcccagccuggggcccu

SEQ ID NO: 291763 - RNA, 32 nt, Human
aagcucccagaacuucguacccuuugcacaca

SEQ ID NO: 291764 - RNA, 32 nt, Human
aagcucccagguagcugggauuacgggcgccc

SEQ ID NO: 291765 - RNA, 32 nt, Human
aagcuccccaccccagccugguggcagaggaa

SEQ ID NO: 291766 - RNA, 32 nt, Human
aagcuccccgucucugcaucccuucccagggg

SEQ ID NO: 291767 - RNA, 32 nt, Human
aagcucccgcggcacucuccuagguggcccga

SEQ ID NO: 291768 - RNA, 32 nt, Human
aagcucccuccagguaucuuggugcuuauacc

SEQ ID NO: 291769 - RNA, 32 nt, Human
aagcucccugccuauucccccaccuccgaggg

SEQ ID NO: 291770 - RNA, 32 nt, Human
aagcuccggccucagccucccuucccugcucc

SEQ ID NO: 291771 - RNA, 32 nt, Human
aagcuccuaaacuuggccauucccaggaggcu

SEQ ID NO: 291772 - RNA, 32 nt, Human
aagcuccuaggugagagacguagcagcugaca

SEQ ID NO: 291773 - RNA, 32 nt, Human
aagcuccuccccauucuccaucuugggggcuc

SEQ ID NO: 291774 - RNA, 32 nt, Human
aagcuccucuccuuccuuuuccuuccuaggca

SEQ ID NO: 291775 - RNA, 32 nt, Human
aagcuccucugcuccaccuugaaccugucacc

SEQ ID NO: 291776 - RNA, 32 nt, Human
aagcuccugcagcuucuguggccaagccccag

SEQ ID NO: 291777 - RNA, 32 nt, Human
aagcuccugccucaccgucugccuugcuccuc

SEQ ID NO: 291778 - RNA, 32 nt, Human
aagcuccugccucuuugugugcgucacuguga

SEQ ID NO: 291779 - RNA, 32 nt, Human
aagcuccugcuguggaagugccuuuugagugc

SEQ ID NO: 291780 - RNA, 32 nt, Human
aagcuccugggcggcccugccggaacccugcu

SEQ ID NO: 291781 - RNA, 32 nt, Human
aagcuccugggggcuugaggggguggcacagu

SEQ ID NO: 291782 - RNA, 32 nt, Human
aagcuccuucuguuggaaguugaguaccugug

SEQ ID NO: 291783 - RNA, 32 nt, Human
aagcuccuuucuucucuuucugcuucaguugc

SEQ ID NO: 291784 - RNA, 32 nt, Human
aagcucgcacucuugucuucuggucacuccuc

SEQ ID NO: 291785 - RNA, 32 nt, Human
aagcucgcuccuuggucugcaguccuuuaaac

SEQ ID NO: 291786 - RNA, 32 nt, Human
aagcucuagcuuuacccagcucugccuggaga

SEQ ID NO: 291787 - RNA, 31 nt, Human
aagcucucaauaacccuugaaaaaugacugg

SEQ ID NO: 291788 - RNA, 32 nt, Human
aagcucuccacucccacagaaaggacagggca

SEQ ID NO: 291789 - RNA, 32 nt, Human
aagcucuccagccagacugaggucacagaugu

SEQ ID NO: 291790 - RNA, 32 nt, Human
aagcucucccacccccagccucggcggcagag

SEQ ID NO: 291791 - RNA, 32 nt, Human
aagcucucuccugcuucaagaucuugccucuu

SEQ ID NO: 291792 - RNA, 32 nt, Human
aagcucucugcagcugucucauuccuucccaa

SEQ ID NO: 291793 - RNA, 32 nt, Human
aagcucugauaaagcacacaaggugcucaaac

SEQ ID NO: 291794 - RNA, 32 nt, Human
aagcucugccuucaacaauuaggagcaaaaug

SEQ ID NO: 291795 - RNA, 32 nt, Human
aagcucugccuugccagucuccuaaaucacaa

SEQ ID NO: 291796 - RNA, 32 nt, Human
aagcucugcuccuucagggccagugacuugcu

SEQ ID NO: 291797 - RNA, 32 nt, Human
aagcucugcugcgaugccucugccucaucuca

SEQ ID NO: 291798 - RNA, 24 nt, Human
aagcucugggaugacaggcgugag

SEQ ID NO: 291799 - RNA, 32 nt, Human
aagcucugggccccuccucccugcugccacuu

SEQ ID NO: 291800 - RNA, 32 nt, Human
aagcucuggggucaggggaggggccgggggca

SEQ ID NO: 291801 - RNA, 32 nt, Human
aagcucuguccuacuuacagcacuuuggauca

SEQ ID NO: 291802 - RNA, 32 nt, Human
aagcucugucugaauccucgcagccacaccua

SEQ ID NO: 291803 - RNA, 32 nt, Human
aagcucugucuucucccucugcccuccaacag

SEQ ID NO: 291804 - RNA, 32 nt, Human
aagcucuguuguugacauuuugcagugauaca

SEQ ID NO: 291805 - RNA, 32 nt, Human
aagcucuucaccguguuuccagccugggacca

SEQ ID NO: 291806 - RNA, 32 nt, Human
aagcucuuccacccuccuucaccuaucuuaau

SEQ ID NO: 291807 - RNA, 32 nt, Human
aagcucuucuccucagcuuggggcagccauug

SEQ ID NO: 291808 - RNA, 32 nt, Human
aagcucuucuucugaaaccuguaauuucaaug

SEQ ID NO: 291809 - RNA, 32 nt, Human
aagcucuucuucuuccuucauuggccucuccg

SEQ ID NO: 291810 - RNA, 24 nt, Human
aagcucuugcccagggguuggagg

SEQ ID NO: 291811 - RNA, 32 nt, Human
aagcucuuggcugcaaagagagaggaucccgg

SEQ ID NO: 291812 - RNA, 32 nt, Human
aagcucuugggcauuauacaacaaauaaucua

SEQ ID NO: 291813 - RNA, 32 nt, Human
aagcucuuguccugcacugucuuuagguauca

SEQ ID NO: 291814 - RNA, 32 nt, Human
aagcucuuguuuugaaaaacaguggggugggg

SEQ ID NO: 291815 - RNA, 32 nt, Human
aagcugaaaaacacagcccaagaauuucauga

SEQ ID NO: 291816 - RNA, 32 nt, Human
aagcugaacggaugccacacugugcuggggcc

SEQ ID NO: 291817 - RNA, 32 nt, Human
aagcugaagaaaaagcgccagugaagaaaucu

SEQ ID NO: 291818 - RNA, 32 nt, Human
aagcugaagagagcguauuauuauucgcccau

SEQ ID NO: 291819 - RNA, 32 nt, Human
aagcugaaggcagaaagagaugcagagaaagu

SEQ ID NO: 291820 - RNA, 32 nt, Human
aagcugaaguuaaaguuguggaagagaguggg

SEQ ID NO: 291821 - RNA, 32 nt, Human
aagcugaaguugucugccuagaauuccacugu

SEQ ID NO: 291822 - RNA, 32 nt, Human
aagcugacacagauuauugaggcugcuauagu

SEQ ID NO: 291823 - RNA, 32 nt, Human
aagcugacagcaggccagggaagcagugaggc

SEQ ID NO: 291824 - RNA, 32 nt, Human
aagcugacauuugcugcuaucauuccaacacu

SEQ ID NO: 291825 - RNA, 32 nt, Human
aagcugaccaaaacaugguccccaccuuuugg

SEQ ID NO: 291826 - RNA, 32 nt, Human
aagcugaccaacacuacagagaucccacacua

SEQ ID NO: 291827 - RNA, 32 nt, Human
aagcugaccagccugcucuguacagugacaau

SEQ ID NO: 291828 - RNA, 32 nt, Human
aagcugaccuaagaagugggacccuggccggg

SEQ ID NO: 291829 - RNA, 32 nt, Human
aagcugaccuggauggaaguugaacagugauc

SEQ ID NO: 291830 - RNA, 32 nt, Human
aagcugacuguggcuggcugagaucgcaggug

SEQ ID NO: 291831 - RNA, 32 nt, Human
aagcugacuguucacacugauugcccagcaca

SEQ ID NO: 291832 - RNA, 32 nt, Human
aagcugagaagaagcugaggauccucacagga

SEQ ID NO: 291833 - RNA, 32 nt, Human
aagcugagaagaggaagaugaagaggaggaag

SEQ ID NO: 291834 - RNA, 32 nt, Human
aagcugagaagaggaugcagaaugacaaggaa

SEQ ID NO: 291835 - RNA, 32 nt, Human
aagcugagaagucagggugaggcuggagggga

SEQ ID NO: 291836 - RNA, 32 nt, Human
aagcugagacccccauccccagcugcucugag

SEQ ID NO: 291837 - RNA, 32 nt, Human
aagcugagacgugacugucuaggaguaacacu

SEQ ID NO: 291838 - RNA, 19 nt, Human
aagcugagacuccugggga

SEQ ID NO: 291839 - RNA, 32 nt, Human
aagcugagagaugccuacagcugagagugaag

SEQ ID NO: 291840 - RNA, 32 nt, Human
aagcugagaucgcugcacuccagccugggcga

SEQ ID NO: 291841 - RNA, 32 nt, Human
aagcugagcugcugugacagaggggaacaaga

SEQ ID NO: 291842 - RNA, 21 nt, Human
aagcugagcuggcuucggaga

SEQ ID NO: 291843 - RNA, 32 nt, Human
aagcugaggaagaaagaagccaauaguagauc

SEQ ID NO: 291844 - RNA, 20 nt, Human
aagcugaggaggcuuuggaa

SEQ ID NO: 291845 - RNA, 32 nt, Human
aagcugaggcccagagaagcgaagcgacugug

SEQ ID NO: 291846 - RNA, 32 nt, Human
aagcugaggccgagcuugcaugucugacauaa

SEQ ID NO: 291847 - RNA, 32 nt, Human
aagcugaggcucagagagguuaagcaacuuag

SEQ ID NO: 291848 - RNA, 15 nt, Human
aagcugaggugggag

SEQ ID NO: 291849 - RNA, 19 nt, Human
aagcugaguccugcaggaa

SEQ ID NO: 291850 - RNA, 32 nt, Human
aagcugauaaaaucugcaacacuccugcuguu

SEQ ID NO: 291851 - RNA, 32 nt, Human
aagcugauaaccguccuucaucaccgaagugu

SEQ ID NO: 291852 - RNA, 32 nt, Human
aagcugauaucacccaggcuggagugcagugg

SEQ ID NO: 291853 - RNA, 32 nt, Human
aagcugauccuccagccccagucaaaccuuca

SEQ ID NO: 291854 - RNA, 32 nt, Human
aagcugauccugcugcaccacaagcacccaga

SEQ ID NO: 291855 - RNA, 32 nt, Human
aagcugaucucaaacuccugaccucaagugau

SEQ ID NO: 291856 - RNA, 32 nt, Human
aagcugaucuugaacuccuggccucaguugag

SEQ ID NO: 291857 - RNA, 32 nt, Human
aagcugaugaauuuucuuuucuguccaaacaa

SEQ ID NO: 291858 - RNA, 32 nt, Human
aagcugaugagguuaggauacccaggcccuuu

SEQ ID NO: 291859 - RNA, 32 nt, Human
aagcugaugcccugaggcugggcacaguggaa

SEQ ID NO: 291860 - RNA, 32 nt, Human
aagcugauggagcucagaauuccacugucaag

SEQ ID NO: 291861 - RNA, 19 nt, Human
aagcugauggcaacuuggc

SEQ ID NO: 291862 - RNA, 32 nt, Human
aagcugaugggagugagagaacucagcaagcc

SEQ ID NO: 291863 - RNA, 32 nt, Human
aagcugaugggauucugucucaucucauaccu

SEQ ID NO: 291864 - RNA, 32 nt, Human
aagcugauguggaaggaggggaagcacuguga

SEQ ID NO: 291865 - RNA, 32 nt, Human
aagcugauuucgagaacuuucaaaaucucaca

SEQ ID NO: 291866 - RNA, 32 nt, Human
aagcugcaaaggacucagcuggggcggcucca

SEQ ID NO: 291867 - RNA, 32 nt, Human
aagcugcaaggcguccagagugagugugaccu

SEQ ID NO: 291868 - RNA, 32 nt, Human
aagcugcaagguuguuuccagcacuuugggaa

SEQ ID NO: 291869 - RNA, 32 nt, Human
aagcugcaauuuuguacagauaccaacuucug

SEQ ID NO: 291870 - RNA, 32 nt, Human
aagcugcacugugagcuggcugugggauacuc

SEQ ID NO: 291871 - RNA, 32 nt, Human
aagcugcagaugggcuaaauaaaagccaaauu

SEQ ID NO: 291872 - RNA, 32 nt, Human
aagcugcagccaugauggaaguuugagaguug

SEQ ID NO: 291873 - RNA, 32 nt, Human
aagcugcagccugcccuggcccuggcucuggc

SEQ ID NO: 291874 - RNA, 32 nt, Human
aagcugcagccugggguccugagcuucccucg

SEQ ID NO: 291875 - RNA, 32 nt, Human
aagcugcagcuggucuguuuccaggucagaaa

SEQ ID NO: 291876 - RNA, 32 nt, Human
aagcugcaggcacugcagccucgggagaaguu

SEQ ID NO: 291877 - RNA, 32 nt, Human
aagcugcaggcagaggcguugaggacaucugu

SEQ ID NO: 291878 - RNA, 32 nt, Human
aagcugcagucagccaagaucuugccacugua

SEQ ID NO: 291879 - RNA, 32 nt, Human
aagcugcagugagccgagaucaggccauugca

SEQ ID NO: 291880 - RNA, 32 nt, Human
aagcugcagugccaccacuugccauuccuagc

SEQ ID NO: 291881 - RNA, 32 nt, Human
aagcugcagugggagcagccugggacccgaca

SEQ ID NO: 291882 - RNA, 32 nt, Human
aagcugcaucagccgcacucuccuggacgcca

SEQ ID NO: 291883 - RNA, 32 nt, Human
aagcugcaucgugcuccuccagccugcacugg

SEQ ID NO: 291884 - RNA, 32 nt, Human
aagcugcaugcaguuggaagggaucuucagau

SEQ ID NO: 291885 - RNA, 32 nt, Human
aagcugcauggccucucuccagcucucucuga

SEQ ID NO: 291886 - RNA, 32 nt, Human
aagcugccaaacauguuuauuuagcagauacu

SEQ ID NO: 291887 - RNA, 32 nt, Human
aagcugccaagguggagagagggauuacagaa

SEQ ID NO: 291888 - RNA, 32 nt, Human
aagcugccaauggaugaaaagccucagaaagc

SEQ ID NO: 291889 - RNA, 32 nt, Human
aagcugccaccagcccaggacccuccagaggc

SEQ ID NO: 291890 - RNA, 32 nt, Human
aagcugccacccuucaaggacagggaagagac

SEQ ID NO: 291891 - RNA, 32 nt, Human
aagcugccagaagcccaggggcucaggacagg

SEQ ID NO: 291892 - RNA, 32 nt, Human
aagcugcccagaagugccuuggcuccagcccu

SEQ ID NO: 291893 - RNA, 21 nt, Human
aagcugccccacccacucucc

SEQ ID NO: 291894 - RNA, 22 nt, Human
aagcugccccugucccaggaga

SEQ ID NO: 291895 - RNA, 32 nt, Human
aagcugcccgggagggugggugcagacacagg

SEQ ID NO: 291896 - RNA, 20 nt, Human
aagcugcccucucccucucc

SEQ ID NO: 291897 - RNA, 32 nt, Human
aagcugcccugagacggugucccgccgaaaga

SEQ ID NO: 291898 - RNA, 32 nt, Human
aagcugcccuugcuguccugugcagugaaggg

SEQ ID NO: 291899 - RNA, 32 nt, Human
aagcugccgucaacccugccucagccucccuc

SEQ ID NO: 291900 - RNA, 32 nt, Human
aagcugccuaugcguccccagccugggcugac

SEQ ID NO: 291901 - RNA, 32 nt, Human
aagcugccucccaucacugccugcuggcugcu

SEQ ID NO: 291902 - RNA, 32 nt, Human
aagcugccuccccuggcugauguucucuggga

SEQ ID NO: 291903 - RNA, 32 nt, Human
aagcugccugagccaaggugauuucuaggagu

SEQ ID NO: 291904 - RNA, 32 nt, Human
aagcugcguccgggcuggagcacuggaacccg

SEQ ID NO: 291905 - RNA, 32 nt, Human
aagcugcguccuggcgauuccaggagacccag

SEQ ID NO: 291906 - RNA, 32 nt, Human
aagcugcgugagcaagcaagccaacauggacc

SEQ ID NO: 291907 - RNA, 22 nt, Human
aagcugcguggagacccaggag

SEQ ID NO: 291908 - RNA, 24 nt, Human
aagcugcguguggccccuuagagg

SEQ ID NO: 291909 - RNA, 32 nt, Human
aagcugcuacuuuaacagagcaccuggcgugg

SEQ ID NO: 291910 - RNA, 32 nt, Human
aagcugcuauaaagccaguagauguuaaacug

SEQ ID NO: 291911 - RNA, 32 nt, Human
aagcugcucagaaucccauaaacaucugucuu

SEQ ID NO: 291912 - RNA, 32 nt, Human
aagcugcuccaccucauccuugcugagugggg

SEQ ID NO: 291913 - RNA, 32 nt, Human
aagcugcucccagucucccagaaccaagaguu

SEQ ID NO: 291914 - RNA, 32 nt, Human
aagcugcucucucuucccagugcagauccacu

SEQ ID NO: 291915 - RNA, 32 nt, Human
aagcugcugaagguaagauuaucaaaauuaua

SEQ ID NO: 291916 - RNA, 32 nt, Human
aagcugcugacaucauccacugccuucugcug

SEQ ID NO: 291917 - RNA, 20 nt, Human
aagcugcugaguguccugca

SEQ ID NO: 291918 - RNA, 32 nt, Human
aagcugcugccuggaccacuaaggaagcccag

SEQ ID NO: 291919 - RNA, 32 nt, Human
aagcugcugccuggccccuugcuguaaagugu

SEQ ID NO: 291920 - RNA, 32 nt, Human
aagcugcugcugugucggacacuugcucccau

SEQ ID NO: 291921 - RNA, 32 nt, Human
aagcugcugcuuccucuguuucauuggauugu

SEQ ID NO: 291922 - RNA, 32 nt, Human
aagcugcuggagcccgcacugucccaguagcc

SEQ ID NO: 291923 - RNA, 32 nt, Human
aagcugcugggcucuguaucucccacaagcug

SEQ ID NO: 291924 - RNA, 32 nt, Human
aagcugcuucagacugcuucaugaggagguua

SEQ ID NO: 291925 - RNA, 32 nt, Human
aagcugcuuccucugugagccuccauguggga

SEQ ID NO: 291926 - RNA, 32 nt, Human
aagcugcuuccuuuucccuccugcuucccuuc

SEQ ID NO: 291927 - RNA, 32 nt, Human
aagcugcuugcagagaaggggcugccucagga

SEQ ID NO: 291928 - RNA, 32 nt, Human
aagcugcuuuggugaugcuuugcucaucucag

SEQ ID NO: 291929 - RNA, 32 nt, Human
aagcugcuuuguccuacauuucuuucaucugg

SEQ ID NO: 291930 - RNA, 32 nt, Human
aagcuggaacccagagauggagcccagcaugc

SEQ ID NO: 291931 - RNA, 32 nt, Human
aagcuggaacgugagccaggaggcccggaccg

SEQ ID NO: 291932 - RNA, 32 nt, Human
aagcuggaagcugagacacagguuagguggcg

SEQ ID NO: 291933 - RNA, 32 nt, Human
aagcuggaauaagaaguggucauuucagaagu

SEQ ID NO: 291934 - RNA, 32 nt, Human
aagcuggaauaagcaguggucauuucagaagu

SEQ ID NO: 291935 - RNA, 32 nt, Human
aagcuggacacuuggaggccacuggagggagg

SEQ ID NO: 291936 - RNA, 32 nt, Human
aagcuggacugcaguggcaugaucucggcuca

SEQ ID NO: 291937 - RNA, 32 nt, Human
aagcuggagaaaggaagaauugugccuugcau

SEQ ID NO: 291938 - RNA, 32 nt, Human
aagcuggagauuccagcucuaagacaugcuau

SEQ ID NO: 291939 - RNA, 32 nt, Human
aagcuggagcacucccagcagaagugcaucgu

SEQ ID NO: 291940 - RNA, 31 nt, Human
aagcuggaggaggcagaaaaagcugcagaug

SEQ ID NO: 291941 - RNA, 32 nt, Human
aagcuggaggcagagauuggagugauacauug

SEQ ID NO: 291942 - RNA, 32 nt, Human
aagcuggaggcugggugcaguggcucaugcca

SEQ ID NO: 291943 - RNA, 32 nt, Human
aagcuggagggggaaugcugggggagcugggg

SEQ ID NO: 291944 - RNA, 32 nt, Human
aagcuggagugugaggcaggaggcuggaaacc

SEQ ID NO: 291945 - RNA, 32 nt, Human
aagcuggcacuugugcuggugccuggagcugu

SEQ ID NO: 291946 - RNA, 18 nt, Human
aagcuggcagaggcccug

SEQ ID NO: 291947 - RNA, 32 nt, Human
aagcuggcagcccuggaagugcaguguugggg

SEQ ID NO: 291948 - RNA, 32 nt, Human
aagcuggcaggcuugaggcccaggaagagcca

SEQ ID NO: 291949 - RNA, 32 nt, Human
aagcuggcaguguguaaagcacuggcaaguuu

SEQ ID NO: 291950 - RNA, 26 nt, Human
aagcuggccccuuggccuccuagaga

SEQ ID NO: 291951 - RNA, 32 nt, Human
aagcuggcccuauaccuggccgagguggagaa

SEQ ID NO: 291952 - RNA, 32 nt, Human
aagcuggcggaucgcuugaggcccagagucua

SEQ ID NO: 291953 - RNA, 32 nt, Human
aagcuggcgggggagagcuggggacccaguau

SEQ ID NO: 291954 - RNA, 32 nt, Human
aagcuggcucaagcuggccccucagcucugga

SEQ ID NO: 291955 - RNA, 32 nt, Human
aagcuggcucagaagaaaaagggcuucucucu

SEQ ID NO: 291956 - RNA, 32 nt, Human
aagcuggcuguuaucucaacaucuucaucagc

SEQ ID NO: 291957 - RNA, 23 nt, Human
aagcugggaauggccaucugaga

SEQ ID NO: 291958 - RNA, 32 nt, Human
aagcugggagaaaggaggucgaggaggaggug

SEQ ID NO: 291959 - RNA, 32 nt, Human
aagcugggagagagguaugggacagauucuuu

SEQ ID NO: 291960 - RNA, 32 nt, Human
aagcugggagcgugggcucagcagggcugguc

SEQ ID NO: 291961 - RNA, 32 nt, Human
aagcugggaggcagaguuuucagugagccaag

SEQ ID NO: 291962 - RNA, 32 nt, Human
aagcugggaggcagauagccuugggcaaauuu

SEQ ID NO: 291963 - RNA, 26 nt, Human
aagcugggaggcggagguugcaguga

SEQ ID NO: 291964 - RNA, 32 nt, Human
aagcugggaggcggagguugcagugagccaag

SEQ ID NO: 291965 - RNA, 32 nt, Human
aagcugggaucaaggauagggaguuguaacag

SEQ ID NO: 291966 - RNA, 32 nt, Human
aagcugggcagaagcaggaggaucauuugagc

SEQ ID NO: 291967 - RNA, 32 nt, Human
aagcuggggaggagcuuuguuuugggggucag

SEQ ID NO: 291968 - RNA, 32 nt, Human
aagcuggggauccacuccgcccuuuuagauga

SEQ ID NO: 291969 - RNA, 20 nt, Human
aagcuggggccccucgggaa

SEQ ID NO: 291970 - RNA, 32 nt, Human
aagcugggguagggugauggcagugcuccggg

SEQ ID NO: 291971 - RNA, 32 nt, Human
aagcuggguacacagugggcccaggacuaagc

SEQ ID NO: 291972 - RNA, 32 nt, Human
aagcuggucucaaacuccugaccucagguaau

SEQ ID NO: 291973 - RNA, 32 nt, Human
aagcuggucucaaacuccugaccucaggugau

SEQ ID NO: 291974 - RNA, 32 nt, Human
aagcuggucucaaacuccuggccucaagcagu

SEQ ID NO: 291975 - RNA, 32 nt, Human
aagcuggucucaaacuccugggcucaagcgau

SEQ ID NO: 291976 - RNA, 32 nt, Human
aagcuggucucgaacuccugaccucaggcgau

SEQ ID NO: 291977 - RNA, 32 nt, Human
aagcuggucucgaacuccugaccuuaaaugau

SEQ ID NO: 291978 - RNA, 32 nt, Human
aagcuggucucgaauuccugaccucaggugau

SEQ ID NO: 291979 - RNA, 32 nt, Human
aagcuggucuggaacuccugggcucaagcaau

SEQ ID NO: 291980 - RNA, 32 nt, Human
aagcuggucuuaaacuccuggccucaagcaau

SEQ ID NO: 291981 - RNA, 32 nt, Human
aagcuggucuugaacuccugaccucaagugau

SEQ ID NO: 291982 - RNA, 32 nt, Human
aagcuggucuugaacuccugaccucaggugau

SEQ ID NO: 291983 - RNA, 32 nt, Human
aagcuggucuugaacuccugaccucaugugau

SEQ ID NO: 291984 - RNA, 32 nt, Human
aagcuggucuugaacuccugacuucaugaucu

SEQ ID NO: 291985 - RNA, 32 nt, Human
aagcuggucuugaacuccuggccuccuugaac

SEQ ID NO: 291986 - RNA, 32 nt, Human
aagcuggucuugaacucuugaccucaagugau

SEQ ID NO: 291987 - RNA, 32 nt, Human
aagcugguggagcagaguguucccugacuccu

SEQ ID NO: 291988 - RNA, 32 nt, Human
aagcugguggaggaggaagccaacaucuuggg

SEQ ID NO: 291989 - RNA, 32 nt, Human
aagcugguggccucugcaggccuaggugcagc

SEQ ID NO: 291990 - RNA, 32 nt, Human
aagcugguggcucucuuuuaauucucuuguaa

SEQ ID NO: 291991 - RNA, 32 nt, Human
aagcuggugguguaggacuuaaccucauugga

SEQ ID NO: 291992 - RNA, 32 nt, Human
aagcugguguccaacagacaccaccugucaaa

SEQ ID NO: 291993 - RNA, 32 nt, Human
aagcugguucuacugucuguuuuccuuaauua

SEQ ID NO: 291994 - RNA, 32 nt, Human
aagcugguugaagcccuggaccuguuugagag

SEQ ID NO: 291995 - RNA, 32 nt, Human
aagcugguuuccuccuccccaggguuuugcug

SEQ ID NO: 291996 - RNA, 32 nt, Human
aagcugguuucgaauuccugaccucaggugau

SEQ ID NO: 291997 - RNA, 32 nt, Human
aagcugguuugcuucauaccauugggaucugc

SEQ ID NO: 291998 - RNA, 32 nt, Human
aagcugguuugugaagcaccugccaugaaauc

SEQ ID NO: 291999 - RNA, 32 nt, Human
aagcuguaggguuucagagagguuggcagugg

SEQ ID NO: 292000 - RNA, 32 nt, Human
aagcuguauguaauggaugacacccaggagcc

SEQ ID NO: 292001 - RNA, 32 nt, Human
aagcugucaaagaagucauucuuuugaacacc

SEQ ID NO: 292002 - RNA, 32 nt, Human
aagcugucacuaucacacauaagcaccauucc

SEQ ID NO: 292003 - RNA, 31 nt, Human
aagcugucacucagaccugguuugagauaga

SEQ ID NO: 292004 - RNA, 23 nt, Human
aagcugucaggggcccucagaga

SEQ ID NO: 292005 - RNA, 32 nt, Human
aagcugucucccuucugacauuuccuaggaag

SEQ ID NO: 292006 - RNA, 32 nt, Human
aagcugugaacaggcugggcugcuggaggugg

SEQ ID NO: 292007 - RNA, 32 nt, Human
aagcugugacaaccaggagcccugucuguggg

SEQ ID NO: 292008 - RNA, 32 nt, Human
aagcugugacauaggacuugaagaccaaagac

SEQ ID NO: 292009 - RNA, 32 nt, Human
aagcugugacuaacucuuuuuaucucucaaua

SEQ ID NO: 292010 - RNA, 32 nt, Human
aagcugugagccaguuaauagccgaugcuggg

SEQ ID NO: 292011 - RNA, 32 nt, Human
aagcugugcaauuacugccugcagagauauuu

SEQ ID NO: 292012 - RNA, 18 nt, Human
aagcugugcagcugugua

SEQ ID NO: 292013 - RNA, 32 nt, Human
aagcugugcccaggaaggggaguaacugugca

SEQ ID NO: 292014 - RNA, 22 nt, Human
aagcugugccuagaaauuucau

SEQ ID NO: 292015 - RNA, 32 nt, Human
aagcugugcuguagccuguaauuacugacaug

SEQ ID NO: 292016 - RNA, 31 nt, Human
aagcuguggacccucucagccaacgauaugg

SEQ ID NO: 292017 - RNA, 32 nt, Human
aagcuguggacccucucagccaacgauaugga

SEQ ID NO: 292018 - RNA, 32 nt, Human
aagcuguggcaacugcucgugugcacacggga

SEQ ID NO: 292019 - RNA, 18 nt, Human
aagcuguggcccugggag

SEQ ID NO: 292020 - RNA, 32 nt, Human
aagcuguggccugauggagcagccccauucca

SEQ ID NO: 292021 - RNA, 32 nt, Human
aagcugugggaggagcuggaggcuucaccgug

SEQ ID NO: 292022 - RNA, 32 nt, Human
aagcugugggcaagaggucagcaggacccgcc

SEQ ID NO: 292023 - RNA, 32 nt, Human
aagcugugggcuguggggaaguggcugcaucg

SEQ ID NO: 292024 - RNA, 32 nt, Human
aagcuguggggagacagccucaugguccagcc

SEQ ID NO: 292025 - RNA, 32 nt, Human
aagcuguguuacugaacagccuggugauaaua

SEQ ID NO: 292026 - RNA, 32 nt, Human
aagcuguuacacgggucugccauuccaaacaa

SEQ ID NO: 292027 - RNA, 32 nt, Human
aagcuguuccccagcugcagggagacuggagu

SEQ ID NO: 292028 - RNA, 30 nt, Human
aagcuguucugcagaucagaaagaaggggu

SEQ ID NO: 292029 - RNA, 32 nt, Human
aagcuguucugucaacuguaauuguucaaaga

SEQ ID NO: 292030 - RNA, 25 nt, Human
aagcuguuggacaccugccuucuca

SEQ ID NO: 292031 - RNA, 32 nt, Human
aagcuguuucaggcagguggagaggaugaggu

SEQ ID NO: 292032 - RNA, 32 nt, Human
aagcuguuuugaagccaagugaagaguguggu

SEQ ID NO: 292033 - RNA, 32 nt, Human
aagcuguuuuucuagcauguugcccuuuuuca

SEQ ID NO: 292034 - RNA, 32 nt, Human
aagcuguuuuucuccauugucauagugccuuc

SEQ ID NO: 292035 - RNA, 32 nt, Human
aagcuuaaagcaguuguaagauuuucagucca

SEQ ID NO: 292036 - RNA, 32 nt, Human
aagcuuacaauccaggagcucaccccuucaag

SEQ ID NO: 292037 - RNA, 32 nt, Human
aagcuuacaauuagucuucacaguuaugggau

SEQ ID NO: 292038 - RNA, 32 nt, Human
aagcuuacucuccccucaccuuuucuuuucac

SEQ ID NO: 292039 - RNA, 32 nt, Human
aagcuuagccuaccacacuaccagucauuccc

SEQ ID NO: 292040 - RNA, 18 nt, Human
aagcuuagucuccggggc

SEQ ID NO: 292041 - RNA, 32 nt, Human
aagcuuagugcuuggguucagacaguuguggg

SEQ ID NO: 292042 - RNA, 32 nt, Human
aagcuuauaguuuucugaucuguguuagaagu

SEQ ID NO: 292043 - RNA, 32 nt, Human
aagcuuauguaagagcuuuuccuucuaaacuu

SEQ ID NO: 292044 - RNA, 32 nt, Human
aagcuuauugcauuccacacugaucucuuggc

SEQ ID NO: 292045 - RNA, 32 nt, Human
aagcuuauugcucaaucaccagccuuugcgag

SEQ ID NO: 292046 - RNA, 31 nt, Human
aagcuuauuuguaaauaccuauuugaaugcu

SEQ ID NO: 292047 - RNA, 32 nt, Human
aagcuucaacucaguaaccaucuguugugggu

SEQ ID NO: 292048 - RNA, 32 nt, Human
aagcuucaccgggcccuccaggcacagagggg

SEQ ID NO: 292049 - RNA, 32 nt, Human
aagcuucacucugccuggggcuuuggcuguaa

SEQ ID NO: 292050 - RNA, 32 nt, Human
aagcuucacuucaacuucacuacuucuguagu

SEQ ID NO: 292051 - RNA, 32 nt, Human
aagcuucagaaguuuggcaauaguuugcauag

SEQ ID NO: 292052 - RNA, 32 nt, Human
aagcuucagccaauccuccuuguuuuauaucc

SEQ ID NO: 292053 - RNA, 32 nt, Human
aagcuucagccuuuaaccuauaccuuuguagu

SEQ ID NO: 292054 - RNA, 32 nt, Human
aagcuucaggaggugauauugauguguauagu

SEQ ID NO: 292055 - RNA, 30 nt, Human
aagcuucaggccccucugcuccugucugug

SEQ ID NO: 292056 - RNA, 32 nt, Human
aagcuucagucuuucaaagagaaaugugugau

SEQ ID NO: 292057 - RNA, 32 nt, Human
aagcuucagugguacagaugaaccagaaugaa

SEQ ID NO: 292058 - RNA, 32 nt, Human
aagcuuccacccuuuuauaauaggaaggguug

SEQ ID NO: 292059 - RNA, 32 nt, Human
aagcuuccaucucccggcugggcacgguggcu

SEQ ID NO: 292060 - RNA, 32 nt, Human
aagcuucccuccugccagcaacaagaaggcuu

SEQ ID NO: 292061 - RNA, 32 nt, Human
aagcuuccgacgcgcgaggccucgggaggagc

SEQ ID NO: 292062 - RNA, 32 nt, Human
aagcuuccuccaccccucucuuuauaggccua

SEQ ID NO: 292063 - RNA, 32 nt, Human
aagcuuccuccuccucuccagcugguagucac

SEQ ID NO: 292064 - RNA, 32 nt, Human
aagcuucguaccacugcuaucucccuuuuaca

SEQ ID NO: 292065 - RNA, 32 nt, Human
aagcuucguauuuuucuugguuucacacucag

SEQ ID NO: 292066 - RNA, 32 nt, Human
aagcuucucaaacuguuagcugcugucugacu

SEQ ID NO: 292067 - RNA, 32 nt, Human
aagcuucucccagggucagagguggaguuaga

SEQ ID NO: 292068 - RNA, 32 nt, Human
aagcuucucuagugaggcauucugagcagugg

SEQ ID NO: 292069 - RNA, 32 nt, Human
aagcuucugaguucugcagccucaccucugag

SEQ ID NO: 292070 - RNA, 32 nt, Human
aagcuucugcuccuuccuucccaauuucuccu

SEQ ID NO: 292071 - RNA, 32 nt, Human
aagcuucuguaacauaggcagcugcacugcgc

SEQ ID NO: 292072 - RNA, 32 nt, Human
aagcuucuuuaaaagcugcuauugauaacucu

SEQ ID NO: 292073 - RNA, 32 nt, Human
aagcuucuuuuggauuagagggggauuuuuga

SEQ ID NO: 292074 - RNA, 32 nt, Human
aagcuugaacccaggagguggagguugcagug

SEQ ID NO: 292075 - RNA, 32 nt, Human
aagcuugaacuuaagagugauaacuuagggua

SEQ ID NO: 292076 - RNA, 32 nt, Human
aagcuugaauacugcauaugccaaauagcuuu

SEQ ID NO: 292077 - RNA, 32 nt, Human
aagcuugaggacugcuggugaccugggaagaa

SEQ ID NO: 292078 - RNA, 32 nt, Human
aagcuugauggugguugugaaagugauuuagc

SEQ ID NO: 292079 - RNA, 32 nt, Human
aagcuugccacuuuccagccuguuuccccaau

SEQ ID NO: 292080 - RNA, 32 nt, Human
aagcuugcucagaaaggcagaaaucugagggu

SEQ ID NO: 292081 - RNA, 32 nt, Human
aagcuugcugugcaugaucaugguuaagccac

SEQ ID NO: 292082 - RNA, 32 nt, Human
aagcuuggagaaaacucugcauucccaugagg

SEQ ID NO: 292083 - RNA, 32 nt, Human
aagcuuggaggaaagcauacuggagaauaagc

SEQ ID NO: 292084 - RNA, 32 nt, Human
aagcuugggcugaagcacccagccuggucaag

SEQ ID NO: 292085 - RNA, 32 nt, Human
aagcuugggguuucuuugguguuaccauccca

SEQ ID NO: 292086 - RNA, 32 nt, Human
aagcuugguccccacaggaggaggucacugau

SEQ ID NO: 292087 - RNA, 32 nt, Human
aagcuuguccagguugaucuugaacuccugac

SEQ ID NO: 292088 - RNA, 32 nt, Human
aagcuugucuugaacuccuggccuuaagugau

SEQ ID NO: 292089 - RNA, 32 nt, Human
aagcuugugaaguuccaaucuaaugacaccug

SEQ ID NO: 292090 - RNA, 32 nt, Human
aagcuugugggugcucccuuucugccagcagu

SEQ ID NO: 292091 - RNA, 32 nt, Human
aagcuuguugacugcaaguuggccuggucagg

SEQ ID NO: 292092 - RNA, 32 nt, Human
aagcuuguuuaaguuuacacagcuaguaagag

SEQ ID NO: 292093 - RNA, 32 nt, Human
aagcuuuaaagugcuagaaaucuugugcccca

SEQ ID NO: 292094 - RNA, 32 nt, Human
aagcuuuacaucuucauuuugacuguuccaua

SEQ ID NO: 292095 - RNA, 32 nt, Human
aagcuuuacguucauguaaacagcaugacgug

SEQ ID NO: 292096 - RNA, 32 nt, Human
aagcuuuacguucauguaaacagcaugaugug

SEQ ID NO: 292097 - RNA, 32 nt, Human
aagcuuuaggcaggcuuccuggaacuacuguu

SEQ ID NO: 292098 - RNA, 32 nt, Human
aagcuuucagaauaugucagugcugauguagc

SEQ ID NO: 292099 - RNA, 32 nt, Human
aagcuuucagggacagcuaucaccugaggcgc

SEQ ID NO: 292100 - RNA, 32 nt, Human
aagcuuucaguauuuguuauugugaaagaagu

SEQ ID NO: 292101 - RNA, 32 nt, Human
aagcuuucauuuuucccccagugaaugauuua

SEQ ID NO: 292102 - RNA, 32 nt, Human
aagcuuuccccaauccccaggucucuagauca

SEQ ID NO: 292103 - RNA, 32 nt, Human
aagcuuucccgcuguuucccugccugcaaaag

SEQ ID NO: 292104 - RNA, 32 nt, Human
aagcuuucccuucuugguucagagaugcugua

SEQ ID NO: 292105 - RNA, 32 nt, Human
aagcuuuccuggugaagacccuugaucuuguc

SEQ ID NO: 292106 - RNA, 19 nt, Human
aagcuuucugugacaguuc

SEQ ID NO: 292107 - RNA, 32 nt, Human
aagcuuugagcagcaggauuagguguugcuuu

SEQ ID NO: 292108 - RNA, 32 nt, Human
aagcuuugaggugggaggggccauggagacug

SEQ ID NO: 292109 - RNA, 32 nt, Human
aagcuuugccugcuuacuuucugccauugggu

SEQ ID NO: 292110 - RNA, 32 nt, Human
aagcuuuggaguuuuccugugauuaguguuuu

SEQ ID NO: 292111 - RNA, 32 nt, Human
aagcuuuggaucugaaagagugguuccagccc

SEQ ID NO: 292112 - RNA, 32 nt, Human
aagcuuugggaaagcaguguauguggaaaagu

SEQ ID NO: 292113 - RNA, 32 nt, Human
aagcuuuguucugauuccucauggcccagcca

SEQ ID NO: 292114 - RNA, 32 nt, Human
aagcuuuuaaccaauccucauaccuuacuaua

SEQ ID NO: 292115 - RNA, 32 nt, Human
aagcuuuuaaccaauucucaaaccuuacuaaa

SEQ ID NO: 292116 - RNA, 32 nt, Human
aagcuuuuccaaaaucacaugccuucaucuca

SEQ ID NO: 292117 - RNA, 25 nt, Human
aagcuuuucggagaaaaaagacacu

SEQ ID NO: 292118 - RNA, 32 nt, Human
aagcuuuucucaugcuugugauuuggugacuc

SEQ ID NO: 292119 - RNA, 32 nt, Human
aagcuuuucuguucacccuccugccaggaaaa

SEQ ID NO: 292120 - RNA, 32 nt, Human
aagcuuuugccaguugaugggggaagaaagga

SEQ ID NO: 292121 - RNA, 32 nt, Human
aagcuuuuggaggucuuaaccaggacagcaca

SEQ ID NO: 292122 - RNA, 32 nt, Human
aagcuuuugggcauccuuccucggccuuucuu

SEQ ID NO: 292123 - RNA, 32 nt, Human
aagcuuuuucugauuuuuagaggaacagaaag

SEQ ID NO: 292124 - RNA, 32 nt, Human
aagcuuuuucuuucuuuucuuucuuucuuuuu

SEQ ID NO: 292125 - RNA, 32 nt, Human
aaggaaaaacaaaggagucaauggagcagaaa

SEQ ID NO: 292126 - RNA, 32 nt, Human
aaggaaaaaugagacacagguuuggggaccaa

SEQ ID NO: 292127 - RNA, 32 nt, Human
aaggaaaaaugcugcuucuccucccagcgugu

SEQ ID NO: 292128 - RNA, 32 nt, Human
aaggaaaaauguguguacagagacaggaaguc

SEQ ID NO: 292129 - RNA, 32 nt, Human
aaggaaaacacagcuccccagacuggaggcug

SEQ ID NO: 292130 - RNA, 32 nt, Human
aaggaaaacagcccgugaucuucuaccaauaa

SEQ ID NO: 292131 - RNA, 32 nt, Human
aaggaaaacagccggugaucuucuaccaauaa

SEQ ID NO: 292132 - RNA, 32 nt, Human
aaggaaaacugugaacuuucugcuucauguau

SEQ ID NO: 292133 - RNA, 32 nt, Human
aaggaaaagaagcagagcccagaagcagggcc

SEQ ID NO: 292134 - RNA, 32 nt, Human
aaggaaaagaggcgacagcggagcagcgugcg

SEQ ID NO: 292135 - RNA, 32 nt, Human
aaggaaaaggaaaugaaaugugaagaaacuca

SEQ ID NO: 292136 - RNA, 32 nt, Human
aaggaaaaggaggaggugucuggggugaggga

SEQ ID NO: 292137 - RNA, 32 nt, Human
aaggaaaaggcuguggcugcagcugcugcagc

SEQ ID NO: 292138 - RNA, 32 nt, Human
aaggaaaagguuuaagaaagaaaacaaaacca

SEQ ID NO: 292139 - RNA, 32 nt, Human
aaggaaaagugacgaagagagaggaggagggg

SEQ ID NO: 292140 - RNA, 32 nt, Human
aaggaaaauacugauagaggaugauguagaua

SEQ ID NO: 292141 - RNA, 32 nt, Human
aaggaaaaugggauaagucugggacacuguuu

SEQ ID NO: 292142 - RNA, 32 nt, Human
aaggaaaauuccauuuucuugggugagcauga

SEQ ID NO: 292143 - RNA, 32 nt, Human
aaggaaacacaaagucucaagugacagcaacc

SEQ ID NO: 292144 - RNA, 24 nt, Human
aaggaaacacaucugucauugucu

SEQ ID NO: 292145 - RNA, 32 nt, Human
aaggaaacaggcugugugguuaauauugagug

SEQ ID NO: 292146 - RNA, 32 nt, Human
aaggaaaccaguugaggaggaauugacucagg

SEQ ID NO: 292147 - RNA, 32 nt, Human
aaggaaacccaccccgacuccccauucuccua

SEQ ID NO: 292148 - RNA, 32 nt, Human
aaggaaacccucucuucguggggcacucugcc

SEQ ID NO: 292149 - RNA, 32 nt, Human
aaggaaaccuacaggaggaagaauggcugcag

SEQ ID NO: 292150 - RNA, 21 nt, Human
aaggaaaccucucuacugagu

SEQ ID NO: 292151 - RNA, 32 nt, Human
aaggaaacgagcuuucuguucuuucuggacac

SEQ ID NO: 292152 - RNA, 32 nt, Human
aaggaaacuauauuucuuacauugauggaaau

SEQ ID NO: 292153 - RNA, 32 nt, Human
aaggaaacuccaggacagcaccaccuccccua

SEQ ID NO: 292154 - RNA, 20 nt, Human
aaggaaacugcccagagcca

SEQ ID NO: 292155 - RNA, 23 nt, Human
aaggaaacuuccucgugacacgu

SEQ ID NO: 292156 - RNA, 24 nt, Human
aaggaaacuuuuaaucucugcagu

SEQ ID NO: 292157 - RNA, 32 nt, Human
aaggaaagaagagaggaaagaaaggagggaag

SEQ ID NO: 292158 - RNA, 32 nt, Human
aaggaaagagcugagccaaggaaaaucagcug

SEQ ID NO: 292159 - RNA, 31 nt, Human
aaggaaagagguuuguccucacuggaauaga

SEQ ID NO: 292160 - RNA, 32 nt, Human
aaggaaagcaccugggcuguguucacacaggc

SEQ ID NO: 292161 - RNA, 32 nt, Human
aaggaaagcaggagagagacugaguggcacau

SEQ ID NO: 292162 - RNA, 32 nt, Human
aaggaaagccaaaagaacacacagagccaaaa

SEQ ID NO: 292163 - RNA, 32 nt, Human
aaggaaagcuauaggcuacccauucagcuccc

SEQ ID NO: 292164 - RNA, 32 nt, Human
aaggaaagcuucacaaaagaucaaaggaaggg

SEQ ID NO: 292165 - RNA, 31 nt, Human
aaggaaaggaaacugccuuccccaugcaggu

SEQ ID NO: 292166 - RNA, 32 nt, Human
aaggaaaggaaaggaaaggccuggcaugggca

SEQ ID NO: 292167 - RNA, 21 nt, Human
aaggaaaggaggcacagccca

SEQ ID NO: 292168 - RNA, 32 nt, Human
aaggaaaggccuuuuggagugugucuuucugu

SEQ ID NO: 292169 - RNA, 32 nt, Human
aaggaaagguaacuuauuucucuucugcacag

SEQ ID NO: 292170 - RNA, 21 nt, Human
aaggaaauccuccuccaggga

SEQ ID NO: 292171 - RNA, 32 nt, Human
aaggaaaugaagucccagcugccgagagcaac

SEQ ID NO: 292172 - RNA, 32 nt, Human
aaggaaaugaggaaagaaauuagggccuccuc

SEQ ID NO: 292173 - RNA, 32 nt, Human
aaggaaauguucucaaggucucaggcuauuug

SEQ ID NO: 292174 - RNA, 32 nt, Human
aaggaaauugggcugauuuguacuggacaccg

SEQ ID NO: 292175 - RNA, 32 nt, Human
aaggaacaaacucuggacacacugccuuuaag

SEQ ID NO: 292176 - RNA, 32 nt, Human
aaggaacaaagaagggaaaagguauuuuuguu

SEQ ID NO: 292177 - RNA, 32 nt, Human
aaggaacaacagcaacaagaccaguaugauau

SEQ ID NO: 292178 - RNA, 32 nt, Human
aaggaacaagcccccagaaaagaaagggaaga

SEQ ID NO: 292179 - RNA, 31 nt, Human
aaggaacaaggugaggaaaaagagacugacc

SEQ ID NO: 292180 - RNA, 32 nt, Human
aaggaacaccacugcuuuucagcauuguacug

SEQ ID NO: 292181 - RNA, 32 nt, Human
aaggaacagcuguuugcugaagcaucaggugc

SEQ ID NO: 292182 - RNA, 32 nt, Human
aaggaacagggagcagagagacccaacuggga

SEQ ID NO: 292183 - RNA, 32 nt, Human
aaggaacaucgauuuggcaccgucuggucacu

SEQ ID NO: 292184 - RNA, 32 nt, Human
aaggaacaugcccagccugagaggagucaaga

SEQ ID NO: 292185 - RNA, 18 nt, Human
aaggaacauuguuuaacu

SEQ ID NO: 292186 - RNA, 32 nt, Human
aaggaaccaagcugacacaggccucacugcaa

SEQ ID NO: 292187 - RNA, 28 nt, Human
aaggaaccaagugcauuuuuaucuguga

SEQ ID NO: 292188 - RNA, 24 nt, Human
aaggaaccauuacauuuuguuuua

SEQ ID NO: 292189 - RNA, 32 nt, Human
aaggaacccaagaaauuccucucuuucucucu

SEQ ID NO: 292190 - RNA, 32 nt, Human
aaggaaccuacugucuaguuugagauauaauu

SEQ ID NO: 292191 - RNA, 32 nt, Human
aaggaacgaaugaaugacccuuuugccaggau

SEQ ID NO: 292192 - RNA, 32 nt, Human
aaggaacguaucaagcucucucaguguuucag

SEQ ID NO: 292193 - RNA, 32 nt, Human
aaggaacuaaaauuucaggaaaccuguuuaau

SEQ ID NO: 292194 - RNA, 32 nt, Human
aaggaacucuagaaguuucaaguggccaguga

SEQ ID NO: 292195 - RNA, 32 nt, Human
aaggaacugcauucugccaaaaaccuaaugaa

SEQ ID NO: 292196 - RNA, 18 nt, Human
aaggaacuggcaugcaca

SEQ ID NO: 292197 - RNA, 32 nt, Human
aaggaacuguacaaguguaaugaguguggcag

SEQ ID NO: 292198 - RNA, 32 nt, Human
aaggaacuuaugggcauauuacuggagcaucu

SEQ ID NO: 292199 - RNA, 32 nt, Human
aaggaacuuguaucuucuguuaacuccacugg

SEQ ID NO: 292200 - RNA, 32 nt, Human
aaggaacuuuuacacaguuugccuucagagac

SEQ ID NO: 292201 - RNA, 32 nt, Human
aaggaagaaaauaggagaaaaauaagugacca

SEQ ID NO: 292202 - RNA, 32 nt, Human
aaggaagaaagaaaagaaauaagaagagaagc

SEQ ID NO: 292203 - RNA, 32 nt, Human
aaggaagaagaagacgaaggaggaggacacac

SEQ ID NO: 292204 - RNA, 32 nt, Human
aaggaagaagacucaagauggaaagggagccg

SEQ ID NO: 292205 - RNA, 22 nt, Human
aaggaagaagcucacaggggac

SEQ ID NO: 292206 - RNA, 32 nt, Human
aaggaagaaggacaccaguaggagcuggauga

SEQ ID NO: 292207 - RNA, 32 nt, Human
aaggaagacaaaguuuaacaccuucacucaag

SEQ ID NO: 292208 - RNA, 32 nt, Human
aaggaagacaggaggaaguagaaaggaggaag

SEQ ID NO: 292209 - RNA, 32 nt, Human
aaggaagacccuccauccucugguauuaacgc

SEQ ID NO: 292210 - RNA, 32 nt, Human
aaggaagaccuccauagauccuucuccagaga

SEQ ID NO: 292211 - RNA, 32 nt, Human
aaggaagagaaagcccaugugugcacauacac

SEQ ID NO: 292212 - RNA, 17 nt, Human
aaggaagagaaggggag

SEQ ID NO: 292213 - RNA, 32 nt, Human
aaggaagagagggaggcgggcaagcaggcggg

SEQ ID NO: 292214 - RNA, 32 nt, Human
aaggaagagauuuagauucacugugaugaaaa

SEQ ID NO: 292215 - RNA, 16 nt, Human
aaggaagagcucaggg

SEQ ID NO: 292216 - RNA, 32 nt, Human
aaggaagaggaagaggaggagaggccggggac

SEQ ID NO: 292217 - RNA, 32 nt, Human
aaggaagaggaaggaaggaaauauuuugagaa

SEQ ID NO: 292218 - RNA, 32 nt, Human
aaggaagaggaccaguuuuuccccagcaccac

SEQ ID NO: 292219 - RNA, 32 nt, Human
aaggaagaggaugucugagcuggagaaggcca

SEQ ID NO: 292220 - RNA, 32 nt, Human
aaggaagaggcuggggaugcagcuaggugcug

SEQ ID NO: 292221 - RNA, 32 nt, Human
aaggaagagggaccuccagcuuccacaaacac

SEQ ID NO: 292222 - RNA, 32 nt, Human
aaggaagaggggcugcagacagaggaagaaag

SEQ ID NO: 292223 - RNA, 32 nt, Human
aaggaagagucucuagguaacaggagaauucg

SEQ ID NO: 292224 - RNA, 32 nt, Human
aaggaagagugggaggaggaggggaagcggcg

SEQ ID NO: 292225 - RNA, 32 nt, Human
aaggaagauggagauuggaagugagcaaaugu

SEQ ID NO: 292226 - RNA, 32 nt, Human
aaggaagauugugaauaaucccaaagcuucuu

SEQ ID NO: 292227 - RNA, 32 nt, Human
aaggaagcaacaacccggguuuucaaggcagu

SEQ ID NO: 292228 - RNA, 32 nt, Human
aaggaagcacgcugccugguguuugaaagcau

SEQ ID NO: 292229 - RNA, 32 nt, Human
aaggaagcagaagaccugggcuuuugucgaag

SEQ ID NO: 292230 - RNA, 32 nt, Human
aaggaagcagaggcugguugccagccaugugu

SEQ ID NO: 292231 - RNA, 32 nt, Human
aaggaagcagcauccuggacccuugaggcccu

SEQ ID NO: 292232 - RNA, 32 nt, Human
aaggaagcagcugggacagguggagaaggaag

SEQ ID NO: 292233 - RNA, 32 nt, Human
aaggaagcagggccuaggagacacgugaaaca

SEQ ID NO: 292234 - RNA, 32 nt, Human
aaggaagccaccaggugugcaggcugggaaga

SEQ ID NO: 292235 - RNA, 32 nt, Human
aaggaagccauggcugugguucagagagggug

SEQ ID NO: 292236 - RNA, 22 nt, Human
aaggaagcccccacccucugcc

SEQ ID NO: 292237 - RNA, 21 nt, Human
aaggaagcccuacuucuggga

SEQ ID NO: 292238 - RNA, 32 nt, Human
aaggaagccuaguuuccagaagccugacacag

SEQ ID NO: 292239 - RNA, 18 nt, Human
aaggaagcgccagaagcc

SEQ ID NO: 292240 - RNA, 32 nt, Human
aaggaagcggcaucacuuguuuuucauguccu

SEQ ID NO: 292241 - RNA, 32 nt, Human
aaggaagcggguucugguccagaagagcugga

SEQ ID NO: 292242 - RNA, 32 nt, Human
aaggaagcuccugggggcuugaggggguggca

SEQ ID NO: 292243 - RNA, 32 nt, Human
aaguccaggaguucaagaccagccuggguaac

SEQ ID NO: 292244 - RNA, 32 nt, Human
aaguccaggaguucgagaccagccugggcaac

SEQ ID NO: 292245 - RNA, 32 nt, Human
aaguccaggccacacaaccccaaaccaagguc

SEQ ID NO: 292246 - RNA, 32 nt, Human
aaguccagggcuagugugggggcuccggcggg

SEQ ID NO: 292247 - RNA, 24 nt, Human
aaguccaucuaaagugaccaggag

SEQ ID NO: 292248 - RNA, 32 nt, Human
aaguccaugugagaggcaacaaaaggaccggu

SEQ ID NO: 292249 - RNA, 32 nt, Human
aaguccauugugaggagggacagagcauauag

SEQ ID NO: 292250 - RNA, 32 nt, Human
aagucccacacccagaccccgcgagaagagau

SEQ ID NO: 292251 - RNA, 31 nt, Human
aagucccacagcuagaaaguagcagggcugg

SEQ ID NO: 292252 - RNA, 32 nt, Human
aagucccacccagucugcccugugccuauaua

SEQ ID NO: 292253 - RNA, 32 nt, Human
aagucccagcuacucaggaggcugaggcaaga

SEQ ID NO: 292254 - RNA, 32 nt, Human
aagucccagcuguuugggaggcugaggcagga

SEQ ID NO: 292255 - RNA, 32 nt, Human
aagucccaggacgguggaaacuagcuaguaga

SEQ ID NO: 292256 - RNA, 32 nt, Human
aagucccaggcagaggccaaggaugaggccug

SEQ ID NO: 292257 - RNA, 32 nt, Human
aaguccccagcacccaaugcacaaucuucccu

SEQ ID NO: 292258 - RNA, 32 nt, Human
aaguccccuccccauugcuccuucaagccaaa

SEQ ID NO: 292259 - RNA, 32 nt, Human
aaguccccugacagcucagcauguugucacac

SEQ ID NO: 292260 - RNA, 32 nt, Human
aaguccccugcucugugacucguuguuccuuu

SEQ ID NO: 292261 - RNA, 32 nt, Human
aagucccgccacugcacuccagccugggcaac

SEQ ID NO: 292262 - RNA, 32 nt, Human
aagucccucgugcacaggcagcucuugugccg

SEQ ID NO: 292263 - RNA, 32 nt, Human
aagucccucuccuggugcuccaagcaguuuga

SEQ ID NO: 292264 - RNA, 32 nt, Human
aagucccugcagguggaggccaugccugucuu

SEQ ID NO: 292265 - RNA, 32 nt, Human
aagucccuguuuuguuuacugccuccuguuca

SEQ ID NO: 292266 - RNA, 32 nt, Human
aagucccuucaaaugcagcccagguuucaccu

SEQ ID NO: 292267 - RNA, 32 nt, Human
aagucccuuccuauucuccugccaugggugca

SEQ ID NO: 292268 - RNA, 32 nt, Human
aaguccgacaacaccguguccaaaaagggcuu

SEQ ID NO: 292269 - RNA, 32 nt, Human
aaguccgccgcucugacccccggcagcaaguc

SEQ ID NO: 292270 - RNA, 32 nt, Human
aaguccuaaaaauuaguuuauccagaguuuau

SEQ ID NO: 292271 - RNA, 32 nt, Human
aaguccuagcaacccuaggagucagggaguca

SEQ ID NO: 292272 - RNA, 24 nt, Human
aaguccuaggagcacacaaagcaa

SEQ ID NO: 292273 - RNA, 24 nt, Human
aaguccuaggauuauaggcaugag

SEQ ID NO: 292274 - RNA, 32 nt, Human
aaguccucaccaggaucuacauuuccucgucg

SEQ ID NO: 292275 - RNA, 32 nt, Human
aaguccucauaucuaggaaagacacagaaacu

SEQ ID NO: 292276 - RNA, 32 nt, Human
aaguccuccaauuccagcauauccagugaguu

SEQ ID NO: 292277 - RNA, 32 nt, Human
aaguccucccaccuugaagagacaggcucuga

SEQ ID NO: 292278 - RNA, 32 nt, Human
aaguccucgcugcccucucuucucaccugcua

SEQ ID NO: 292279 - RNA, 32 nt, Human
aaguccucggauuacaggcaugagccaccaca

SEQ ID NO: 292280 - RNA, 32 nt, Human
aaguccucuacccccucacuuuuauggcccuu

SEQ ID NO: 292281 - RNA, 32 nt, Human
aaguccucucacuccuccagccuggaauguga

SEQ ID NO: 292282 - RNA, 32 nt, Human
aaguccucucuagcugcagaagccugagcuuc

SEQ ID NO: 292283 - RNA, 32 nt, Human
aaguccugaccccagugcacagacauagaggc

SEQ ID NO: 292284 - RNA, 32 nt, Human
aaguccugagccaccaugcugaccccgauggu

SEQ ID NO: 292285 - RNA, 32 nt, Human
aaguccugcaaagaaaaacagagcugggcaag

SEQ ID NO: 292286 - RNA, 32 nt, Human
aaguccugcaacacagguaucacugcacauuu

SEQ ID NO: 292287 - RNA, 32 nt, Human
aaguccugcaagcagagguggugauuuguuaa

SEQ ID NO: 292288 - RNA, 32 nt, Human
aaguccugcacuggagccugugcaguggcgcc

SEQ ID NO: 292289 - RNA, 32 nt, Human
aaguccugccaagugguuucuaugagcaucuc

SEQ ID NO: 292290 - RNA, 32 nt, Human
aaguccuggacuuuuaaaugaccaugaaguua

SEQ ID NO: 292291 - RNA, 32 nt, Human
aaguccugggagagaagugggugcgguccgcu

SEQ ID NO: 292292 - RNA, 32 nt, Human
aaguccugggauuacaggcgugagccacugug

SEQ ID NO: 292293 - RNA, 23 nt, Human
aaguccugggauuacaggcugag

SEQ ID NO: 292294 - RNA, 32 nt, Human
aaguccugggauuacaggcugagccaccgcga

SEQ ID NO: 292295 - RNA, 24 nt, Human
aaguccugggauuacaggugugag

SEQ ID NO: 292296 - RNA, 32 nt, Human
aaguccugggauuacaggugugagccaccaca

SEQ ID NO: 292297 - RNA, 32 nt, Human
aaguccugugacucccagcuuaacugaaauac

SEQ ID NO: 292298 - RNA, 32 nt, Human
aaguccugugugugugcccgaugccuguguug

SEQ ID NO: 292299 - RNA, 32 nt, Human
aaguccuucaccucacugaaaacaucuggaag

SEQ ID NO: 292300 - RNA, 32 nt, Human
aaguccuucuggcugcgguuaaaagggcucac

SEQ ID NO: 292301 - RNA, 32 nt, Human
aaguccuuggcugcugaguggugacaguagcc

SEQ ID NO: 292302 - RNA, 32 nt, Human
aaguccuuggcugggcagucacacaacaggca

SEQ ID NO: 292303 - RNA, 32 nt, Human
aaguccuugggcccaguugggagcucauaucu

SEQ ID NO: 292304 - RNA, 32 nt, Human
aaguccuuugucacuucucuugccuuagugug

SEQ ID NO: 292305 - RNA, 32 nt, Human
aaguccuuuuacaaucagugugucuccugaac

SEQ ID NO: 292306 - RNA, 32 nt, Human
aaguccuuuuccaacugggugugcaugcuaaa

SEQ ID NO: 292307 - RNA, 32 nt, Human
aagucgaauuccagcucgccuuguugacucgc

SEQ ID NO: 292308 - RNA, 32 nt, Human
aagucgagcuuggaggccagccuggaucuguc

SEQ ID NO: 292309 - RNA, 32 nt, Human
aagucgaggguccagccucuucugccaggaag

SEQ ID NO: 292310 - RNA, 32 nt, Human
aagucgcauaucuccccucugaggcuggaucc

SEQ ID NO: 292311 - RNA, 32 nt, Human
aagucgccauuuggaaaggcgaauaacguggc

SEQ ID NO: 292312 - RNA, 32 nt, Human
aagucgccccuccaaaacacgcccccauccca

SEQ ID NO: 292313 - RNA, 32 nt, Human
aagucgcgaaagugggccagagguucugcgac

SEQ ID NO: 292314 - RNA, 32 nt, Human
aagucgcucucaugccuugcuguccccucccc

SEQ ID NO: 292315 - RNA, 32 nt, Human
aagucggaggcaggggcuagggguggaggcca

SEQ ID NO: 292316 - RNA, 32 nt, Human
aagucggcucaacgcaaccuccgccucccagg

SEQ ID NO: 292317 - RNA, 32 nt, Human
aagucgggaugacagcagggacuucuggccag

SEQ ID NO: 292318 - RNA, 32 nt, Human
aagucggggcugggcagugagaagagugugac

SEQ ID NO: 292319 - RNA, 32 nt, Human
aagucggugagagcaaaaaugggucuaguaaa

SEQ ID NO: 292320 - RNA, 32 nt, Human
aagucgugcuggcuaauuuuuaguuuguauuc

SEQ ID NO: 292321 - RNA, 32 nt, Human
aagucuaaacauuuagggcacuuuaaaggaga

SEQ ID NO: 292322 - RNA, 32 nt, Human
aagucuaacacaugaggauacagaauugauuc

SEQ ID NO: 292323 - RNA, 32 nt, Human
aagucuaacacauucuuuaugacugugagcau

SEQ ID NO: 292324 - RNA, 32 nt, Human
aagucuaaccaucauaaagacacugccugucu

SEQ ID NO: 292325 - RNA, 32 nt, Human
aagucuaccccaccaccuccucaggaaacugc

SEQ ID NO: 292326 - RNA, 32 nt, Human
aagucuagacuuugagccagguacaguaagaa

SEQ ID NO: 292327 - RNA, 32 nt, Human
aagucuaggaaaaagguuugcagauggaccuu

SEQ ID NO: 292328 - RNA, 32 nt, Human
aagucuauaagccuggagagaccaucagcagu

SEQ ID NO: 292329 - RNA, 32 nt, Human
aagucuauuggucagcuuaucucagaagauuu

SEQ ID NO: 292330 - RNA, 32 nt, Human
aagucucaaguucauggcuuucugaauuuuga

SEQ ID NO: 292331 - RNA, 32 nt, Human
aagucucaaucgcccuuuuucuuccaaauggu

SEQ ID NO: 292332 - RNA, 32 nt, Human
aagucucacugcacucaggcuggagugcagug

SEQ ID NO: 292333 - RNA, 32 nt, Human
aagucucacuguguugcccagccuggguguca

SEQ ID NO: 292334 - RNA, 32 nt, Human
aagucucaggguauaugaaaguagcuggcuuc

SEQ ID NO: 292335 - RNA, 32 nt, Human
aagucucaggguggcugggugagcgcucauca

SEQ ID NO: 292336 - RNA, 32 nt, Human
aagucucaugcaccuggauuaacucagaaaaa

SEQ ID NO: 292337 - RNA, 32 nt, Human
aagucucaugcccuccugcucucccaugaggg

SEQ ID NO: 292338 - RNA, 32 nt, Human
aagucucaugcugaaguauaguuuuugggaaa

SEQ ID NO: 292339 - RNA, 32 nt, Human
aagucucaugugaacccagcaggcuuggaacc

SEQ ID NO: 292340 - RNA, 32 nt, Human
aagucuccaaaucagacagcugccucagcccc

SEQ ID NO: 292341 - RNA, 32 nt, Human
aagucuccaaggcccuagucugggcaaggcca

SEQ ID NO: 292342 - RNA, 32 nt, Human
aagucuccagucuggggcaggcgggagugggc

SEQ ID NO: 292343 - RNA, 32 nt, Human
aagucucccacuucggcagccaugaagcccac

SEQ ID NO: 292344 - RNA, 32 nt, Human
aagucuccccuuugaagacuuugaggccacag

SEQ ID NO: 292345 - RNA, 32 nt, Human
aagucucccucuuguuacccaggcuggagugc

SEQ ID NO: 292346 - RNA, 32 nt, Human
aagucuccuaaccuuccugggucuguuuucuu

SEQ ID NO: 292347 - RNA, 32 nt, Human
aagucucuacagcuaggacccuccuguccuga

SEQ ID NO: 292348 - RNA, 32 nt, Human
aagucucuccacugaucugucuuccaguccuc

SEQ ID NO: 292349 - RNA, 32 nt, Human
aagucucucuuccuccuucucaccccuggccu

SEQ ID NO: 292350 - RNA, 32 nt, Human
aagucucugaccugguccccucaggcccagcu

SEQ ID NO: 292351 - RNA, 32 nt, Human
aagucucugagguuccaccaaaauauggaacu

SEQ ID NO: 292352 - RNA, 32 nt, Human
aagucucugauuugaaggauuaguauccuuuc

SEQ ID NO: 292353 - RNA, 32 nt, Human
aagucucuuaugaaacagagaagaguuguuga

SEQ ID NO: 292354 - RNA, 32 nt, Human
aagucucuucccagccuuccucacaggcuucu

SEQ ID NO: 292355 - RNA, 32 nt, Human
aagucugaaggguuggccuagagccaguccag

SEQ ID NO: 292356 - RNA, 32 nt, Human
aagucugaagugaggagugagguccagaagca

SEQ ID NO: 292357 - RNA, 32 nt, Human
aagucugaauuugugaaaauuuccuuggguga

SEQ ID NO: 292358 - RNA, 32 nt, Human
aagucugaccaacauggagaaacccugucucu

SEQ ID NO: 292359 - RNA, 32 nt, Human
aagucugacuccaacaucuguguuccuaaaua

SEQ ID NO: 292360 - RNA, 32 nt, Human
aagucugaguggaugcugguauucuccucuuu

SEQ ID NO: 292361 - RNA, 22 nt, Human
aagucugauagcgucucugcac

SEQ ID NO: 292362 - RNA, 32 nt, Human
aagucugauucucuuuaacugugugaccagcg

SEQ ID NO: 292363 - RNA, 32 nt, Human
aagucugcagugagcuaugauugcaccacugc

SEQ ID NO: 292364 - RNA, 32 nt, Human
aagucugcagugagcuaugguaacaccacugc

SEQ ID NO: 292365 - RNA, 32 nt, Human
aagucugcauuacauuccuugauaauguugug

SEQ ID NO: 292366 - RNA, 32 nt, Human
aagucugccuuucccucuacuuucaccucuuu

SEQ ID NO: 292367 - RNA, 32 nt, Human
aagucuggaaagucaucugccuuuaauaacug

SEQ ID NO: 292368 - RNA, 32 nt, Human
aagucuggagugagcaaacaagagcaagaaac

SEQ ID NO: 292369 - RNA, 32 nt, Human
aagucuggcaggaagaggcaggaagggagaga

SEQ ID NO: 292370 - RNA, 32 nt, Human
aagucugggagguugaggcugcagugagcugu

SEQ ID NO: 292371 - RNA, 32 nt, Human
aagucugggguuccuuuccuuuccugcuucca

SEQ ID NO: 292372 - RNA, 32 nt, Human
aagucugguaggucacacagaggaccaagccc

SEQ ID NO: 292373 - RNA, 32 nt, Human
aagucugucccgcuuccaccaacauccagaau

SEQ ID NO: 292374 - RNA, 32 nt, Human
aagucuguuuugaagaaggaaaaagaaauacu

SEQ ID NO: 292375 - RNA, 31 nt, Human
aagucuuaggacuucuuugcagacaacugac

SEQ ID NO: 292376 - RNA, 32 nt, Human
aagucuuaguaaaaugugaaccuuuaaauaua

SEQ ID NO: 292377 - RNA, 32 nt, Human
aagucuucauggauguucugcaugucaugcgg

SEQ ID NO: 292378 - RNA, 32 nt, Human
aagucuucauggauguucugcaugucaugggg

SEQ ID NO: 292379 - RNA, 32 nt, Human
aagucuuccagaggaugcuugauuccaguggu

SEQ ID NO: 292380 - RNA, 32 nt, Human
aagucuucccccaaggagcagaagaaagaaug

SEQ ID NO: 292381 - RNA, 21 nt, Human
aagucuuccuacccucugcac

SEQ ID NO: 292382 - RNA, 32 nt, Human
aagucuuccuccucuucgagaccauguuauug

SEQ ID NO: 292383 - RNA, 32 nt, Human
aagucuucugaacaaggcagaccauccaaacg

SEQ ID NO: 292384 - RNA, 32 nt, Human
aagucuugaccccgcugccucagccucccaaa

SEQ ID NO: 292385 - RNA, 21 nt, Human
aagucuugacucccuacuucc

SEQ ID NO: 292386 - RNA, 32 nt, Human
aagucuugacucugugcuuucugcuuagagug

SEQ ID NO: 292387 - RNA, 32 nt, Human
aagucuugaucaaaugacauuuugacauugga

SEQ ID NO: 292388 - RNA, 32 nt, Human
aagucuugaugaaacaagauagcuguuuccaa

SEQ ID NO: 292389 - RNA, 20 nt, Human
aagucuugcaauaggcugca

SEQ ID NO: 292390 - RNA, 32 nt, Human
aagucuugcagucugcaggacaccgaggaauc

SEQ ID NO: 292391 - RNA, 32 nt, Human
aagucuugccaugcccuuuggccaaaggcaac

SEQ ID NO: 292392 - RNA, 32 nt, Human
aagucuugcugauuuucagacagggaagucuc

SEQ ID NO: 292393 - RNA, 32 nt, Human
aagucuuggcugcuuuuguuacuauacauuuu

SEQ ID NO: 292394 - RNA, 32 nt, Human
aagucuugggcugggugcaguggcucaugccu

SEQ ID NO: 292395 - RNA, 19 nt, Human
aagucuugguuuuaucuua

SEQ ID NO: 292396 - RNA, 32 nt, Human
aagucuuguacuuucuaugccucccagggagc

SEQ ID NO: 292397 - RNA, 32 nt, Human
aagucuuguugugugcucuuccuuccaggccc

SEQ ID NO: 292398 - RNA, 32 nt, Human
aagucuuuaaggcguacaaaguagaaucagua

SEQ ID NO: 292399 - RNA, 32 nt, Human
aagucuuucaguuacuuuggagugcagaacca

SEQ ID NO: 292400 - RNA, 32 nt, Human
aagucuuucccaagccauucuuugucugagca

SEQ ID NO: 292401 - RNA, 23 nt, Human
aagucuuuccuaucuucauugca

SEQ ID NO: 292402 - RNA, 32 nt, Human
aagucuuucucaucccuugggaagugcaaauu

SEQ ID NO: 292403 - RNA, 32 nt, Human
aagucuuuggaaacucuuguuuacuuaugagc

SEQ ID NO: 292404 - RNA, 20 nt, Human
aagucuuuggcauucacuug

SEQ ID NO: 292405 - RNA, 32 nt, Human
aagucuuuugugaacaaggcauuuguagccau

SEQ ID NO: 292406 - RNA, 32 nt, Human
aagugaaaaagcugcaucaagacccauuuggc

SEQ ID NO: 292407 - RNA, 32 nt, Human
aagugaaaaaggagagagacccuugaccacug

SEQ ID NO: 292408 - RNA, 32 nt, Human
aagugaaaagagccuuaacugaugacauucca

SEQ ID NO: 292409 - RNA, 32 nt, Human
aagugaaaagggccgguuccugccuuaacuga

SEQ ID NO: 292410 - RNA, 19 nt, Human
aagugaaaaguguaucccu

SEQ ID NO: 292411 - RNA, 32 nt, Human
aagugaaaaucugagaaagaguuaauugcaau

SEQ ID NO: 292412 - RNA, 32 nt, Human
aagugaaacccgccaccggguuaccccacaag

SEQ ID NO: 292413 - RNA, 32 nt, Human
aagugaaaggaaaaugaggggagaauucucau

SEQ ID NO: 292414 - RNA, 32 nt, Human
aagugaaaucagcagagccucuggguggaugu

SEQ ID NO: 292415 - RNA, 17 nt, Human
aagugaaaugagguucc

SEQ ID NO: 292416 - RNA, 32 nt, Human
aagugaacaaaggucucugauuuuccuaggca

SEQ ID NO: 292417 - RNA, 32 nt, Human
aagugaacaaaggucucugguuuuccuagcca

SEQ ID NO: 292418 - RNA, 32 nt, Human
aagugaacaaaggucucugguuuuccuaggca

SEQ ID NO: 292419 - RNA, 32 nt, Human
aagugaacaaaggucucugguuuuccuaggua

SEQ ID NO: 292420 - RNA, 32 nt, Human
aagugaacaaaggucucugguuuuccuaugca

SEQ ID NO: 292421 - RNA, 32 nt, Human
aagugaacaaauuggucaugacaaggggaccc

SEQ ID NO: 292422 - RNA, 32 nt, Human
aagugaacagcauuuguuggaaggugauggcu

SEQ ID NO: 292423 - RNA, 32 nt, Human
aagugaacgagcuucaggccuuugugaagaug

SEQ ID NO: 292424 - RNA, 32 nt, Human
aagugaacgagggugaggacuggagagcacca

SEQ ID NO: 292425 - RNA, 32 nt, Human
aagugaacuguuuccuguauaaaguucucauc

SEQ ID NO: 292426 - RNA, 22 nt, Human
aagugaacuuaacugagaucca

SEQ ID NO: 292427 - RNA, 31 nt, Human
aagugaagaaagagagaaaacugagugcaaa

SEQ ID NO: 292428 - RNA, 32 nt, Human
aagugaagaggaccuugugguagcagggacca

SEQ ID NO: 292429 - RNA, 32 nt, Human
aagugaagaggaggagaaagagucaaccaagg

SEQ ID NO: 292430 - RNA, 32 nt, Human
aagugaagcagugucucacagggucauuacag

SEQ ID NO: 292431 - RNA, 32 nt, Human
aagugaagcaugaagggaaucauaggaaaaau

SEQ ID NO: 292432 - RNA, 32 nt, Human
aagugaagccagcagaggagugauagcugcuc

SEQ ID NO: 292433 - RNA, 32 nt, Human
aagugaaggagaaagcagcugccucaccgccc

SEQ ID NO: 292434 - RNA, 32 nt, Human
aagugaaggccagacagacaaggacaaggagc

SEQ ID NO: 292435 - RNA, 32 nt, Human
aagugaaggucugagggacgggcccuggggcu

SEQ ID NO: 292436 - RNA, 32 nt, Human
aagugaaguaaagcccaaguguucuuuagcuu

SEQ ID NO: 292437 - RNA, 32 nt, Human
aagugaaguuaggaaauccuugaagaaaauca

SEQ ID NO: 292438 - RNA, 32 nt, Human
aagugaauauuuucccuucucccuuuacccuu

SEQ ID NO: 292439 - RNA, 31 nt, Human
aagugaaucucauaaggaaaagacugcuaaa

SEQ ID NO: 292440 - RNA, 32 nt, Human
aagugaaugccuuuagggguagcucugaaaga

SEQ ID NO: 292441 - RNA, 22 nt, Human
aagugaauguaagucugugccu

SEQ ID NO: 292442 - RNA, 32 nt, Human
aagugaauuaaauuuggaccuuauguuuuacu

SEQ ID NO: 292443 - RNA, 20 nt, Human
aagugaauuucgauguucca

SEQ ID NO: 292444 - RNA, 32 nt, Human
aagugaauuuucugagggugaugaaaguguug

SEQ ID NO: 292445 - RNA, 32 nt, Human
aagugacaaggcagaauucuuuaaaucaguaa

SEQ ID NO: 292446 - RNA, 32 nt, Human
aagugacaagggcagagaugauccaggacaac

SEQ ID NO: 292447 - RNA, 32 nt, Human
aagugacacauuaaugauaaacucagaucuga

SEQ ID NO: 292448 - RNA, 32 nt, Human
aagugacacuauguaggaauccuuccaaggaa

SEQ ID NO: 292449 - RNA, 32 nt, Human
aagugacagcaaagaagguggugaagguuuca

SEQ ID NO: 292450 - RNA, 32 nt, Human
aagugacagcauauccugaugugugugauggu

SEQ ID NO: 292451 - RNA, 32 nt, Human
aagugacagccaggaagagaccugaagguugg

SEQ ID NO: 292452 - RNA, 32 nt, Human
aagugacagcuuuucuuuaucugcuuuucuga

SEQ ID NO: 292453 - RNA, 32 nt, Human
aagugacaggaaauggagcuggggagacaaaa

SEQ ID NO: 292454 - RNA, 32 nt, Human
aagugacauccugucacuucugcucucacacu

SEQ ID NO: 292455 - RNA, 32 nt, Human
aagugacauuaugccaguuucuguucucucac

SEQ ID NO: 292456 - RNA, 32 nt, Human
aagugaccagaagauuguacuuccuagagaug

SEQ ID NO: 292457 - RNA, 32 nt, Human
aagugacccagcccuggcuguaggacagccau

SEQ ID NO: 292458 - RNA, 32 nt, Human
aagugacccuccugcaucagcuucccaaguag

SEQ ID NO: 292459 - RNA, 32 nt, Human
aagugaccuucagggucaucaggcugucccag

SEQ ID NO: 292460 - RNA, 32 nt, Human
aagugaccuugggagagguaagaugguguuuc

SEQ ID NO: 292461 - RNA, 32 nt, Human
aagugacgcucagacaugacugagaugucuug

SEQ ID NO: 292462 - RNA, 32 nt, Human
aagugacucaacaaagagccaaaguggagaga

SEQ ID NO: 292463 - RNA, 32 nt, Human
aagugacucagcacccugccucagcuucagca

SEQ ID NO: 292464 - RNA, 32 nt, Human
aagugacucagccaggcagacaugagacaugg

SEQ ID NO: 292465 - RNA, 32 nt, Human
aagugacuccuggggcccugagcccacaacag

SEQ ID NO: 292466 - RNA, 32 nt, Human
aagugacuggugucucgugugacagauugcuu

SEQ ID NO: 292467 - RNA, 32 nt, Human
aagugacuucucagaggggaaaagccaagcuc

SEQ ID NO: 292468 - RNA, 32 nt, Human
aagugacuugcugagcaaacccugccgagaag

SEQ ID NO: 292469 - RNA, 32 nt, Human
aagugagaacacuguauuccuacaauguacac

SEQ ID NO: 292470 - RNA, 32 nt, Human
aagugagaaucagcuauugauaauggccagag

SEQ ID NO: 292471 - RNA, 32 nt, Human
aagugagacagagacuugacuugauccucuga

SEQ ID NO: 292472 - RNA, 32 nt, Human
aagugagacaguguuuuugaaaauauguauuu

SEQ ID NO: 292473 - RNA, 32 nt, Human
aagugagacauacaagauuacucuacaagagg

SEQ ID NO: 292474 - RNA, 32 nt, Human
aagugagaccgaguagggggaacgagugguga

SEQ ID NO: 292475 - RNA, 32 nt, Human
aagugagacuccacccuccccaccuggcucau

SEQ ID NO: 292476 - RNA, 20 nt, Human
aagugagagaagcuguuggg

SEQ ID NO: 292477 - RNA, 32 nt, Human
aagugagagagacaaugucacacuucaaggag

SEQ ID NO: 292478 - RNA, 32 nt, Human
aagugagaggagacauuaagauuuucauucuu

SEQ ID NO: 292479 - RNA, 32 nt, Human
aagugagaggggagggagggaaguccugggag

SEQ ID NO: 292480 - RNA, 32 nt, Human
aagugagauccaggagaaguaaggcccuggag

SEQ ID NO: 292481 - RNA, 32 nt, Human
aagugagauugaagagaaugaaaacaaauuug

SEQ ID NO: 292482 - RNA, 32 nt, Human
aagugagcaaaaguuggucagcuuggcuaugg

SEQ ID NO: 292483 - RNA, 32 nt, Human
aagugagcaggacuguucuucccacugcaauc

SEQ ID NO: 292484 - RNA, 32 nt, Human
aagugagcaguguuggagugaggaccuguaag

SEQ ID NO: 292485 - RNA, 32 nt, Human
aagugagccaucugcuggucaggaaguccucc

SEQ ID NO: 292486 - RNA, 32 nt, Human
aagugagcccaggaguucaaggcugcaaugag

SEQ ID NO: 292487 - RNA, 32 nt, Human
aagugagcccaggaguucagggccagcuuuga

SEQ ID NO: 292488 - RNA, 32 nt, Human
aagugagccccagcuggacucauggaugugca

SEQ ID NO: 292489 - RNA, 32 nt, Human
aagugagccggggugagguggggaggaggaca

SEQ ID NO: 292490 - RNA, 32 nt, Human
aagugagcgcaagagguugaggcuccagugag

SEQ ID NO: 292491 - RNA, 32 nt, Human
aagugagcuaaguugggguggggugaguccaa

SEQ ID NO: 292492 - RNA, 32 nt, Human
aagugagcucaccuaccugccaccgcccagga

SEQ ID NO: 292493 - RNA, 32 nt, Human
aagugagcuggcuucauccucagaccuuuauu

SEQ ID NO: 292494 - RNA, 30 nt, Human
aagugaggaagccagguccacggucuguuc

SEQ ID NO: 292495 - RNA, 32 nt, Human
aagugaggcccuuagcccuggaagucaauagg

SEQ ID NO: 292496 - RNA, 32 nt, Human
aagugaggccggagaggaguucaggaacccuu

SEQ ID NO: 292497 - RNA, 32 nt, Human
aagugaggcugcugccccaguuucauggaugc

SEQ ID NO: 292498 - RNA, 32 nt, Human
aagugagggaggagacaggcccaaggcggagg

SEQ ID NO: 292499 - RNA, 32 nt, Human
aagugagggcucacucagccacccugaguugc

SEQ ID NO: 292500 - RNA, 32 nt, Human
aagugaggggagaagguuccccagggacagag

SEQ ID NO: 292501 - RNA, 32 nt, Human
aagugagguuacugguguguuggauguuuaau

SEQ ID NO: 292502 - RNA, 32 nt, Human
aagugaguccuccccacucugggcuugugcac

SEQ ID NO: 292503 - RNA, 32 nt, Human
aagugagucuccucucagauccugggccuugu

SEQ ID NO: 292504 - RNA, 32 nt, Human
aagugagucucggcuggagugcaguggugcag

SEQ ID NO: 292505 - RNA, 32 nt, Human
aagugagugacagccucacagccucaggccca

SEQ ID NO: 292506 - RNA, 32 nt, Human
aagugagugaggaggaggaggaggagaaggag

SEQ ID NO: 292507 - RNA, 32 nt, Human
aagugagugccuacagaaauuucuuggauucu

SEQ ID NO: 292508 - RNA, 32 nt, Human
aagugagugucugcaccugaggcccucugugg

SEQ ID NO: 292509 - RNA, 32 nt, Human
aagugauaaccagggucacggauuccaaacau

SEQ ID NO: 292510 - RNA, 20 nt, Human
aagugauaugaacugugaua

SEQ ID NO: 292511 - RNA, 32 nt, Human
aagugauauuuaaaaauauacacacauguaug

SEQ ID NO: 292512 - RNA, 32 nt, Human
aagugaucaaaugccagugucauuuuguacuu

SEQ ID NO: 292513 - RNA, 32 nt, Human
aagugaucacaaaagaaaucuucugagccgga

SEQ ID NO: 292514 - RNA, 32 nt, Human
aagugaucagcacagcugcuuccaaauaggag

SEQ ID NO: 292515 - RNA, 32 nt, Human
aagugauccaccagccuccaccucccgacgug

SEQ ID NO: 292516 - RNA, 32 nt, Human
aagugauccacccaucuccaccucccaaagug

SEQ ID NO: 292517 - RNA, 32 nt, Human
aagugauccucccaccucagccuaccaaguag

SEQ ID NO: 292518 - RNA, 32 nt, Human
aagugauccucccacuucaccuuccugagcag

SEQ ID NO: 292519 - RNA, 32 nt, Human
aagugauccuccugccacagccucccaaguag

SEQ ID NO: 292520 - RNA, 32 nt, Human
aagugauccuccugccccagcauuccaaagug

SEQ ID NO: 292521 - RNA, 32 nt, Human
aagugauccuccugccucagcaucccaaacuc

SEQ ID NO: 292522 - RNA, 32 nt, Human
aagugauccuccugccucagcuucccaaguag

SEQ ID NO: 292523 - RNA, 32 nt, Human
aagugauccuccugccugggccugccaaagug

SEQ ID NO: 292524 - RNA, 32 nt, Human
aagugauccuccugccuuagcuuccaagaaug

SEQ ID NO: 292525 - RNA, 32 nt, Human
aagugauccuccugcuuggaccucccaaagcg

SEQ ID NO: 292526 - RNA, 32 nt, Human
aagugauccuuccacuucagccucccaaguag

SEQ ID NO: 292527 - RNA, 32 nt, Human
aagugaucucuaggccccagccccaaauccgc

SEQ ID NO: 292528 - RNA, 32 nt, Human
aagugaucuuggagaugggugggcaggugauu

SEQ ID NO: 292529 - RNA, 32 nt, Human
aagugaugaccuuacaccacaaccagcuucuc

SEQ ID NO: 292530 - RNA, 32 nt, Human
aagugaugacucuaaucagccuaucucagcgu

SEQ ID NO: 292531 - RNA, 24 nt, Human
aagugaugagauuauaggcgugag

SEQ ID NO: 292532 - RNA, 32 nt, Human
aagugaugagauuauaggcgugagccaccgcg

SEQ ID NO: 292533 - RNA, 32 nt, Human
aagugaugagugcgggaguccugaggagaugu

SEQ ID NO: 292534 - RNA, 32 nt, Human
aagugaugcuuccaggauuuguuuucagaaac

SEQ ID NO: 292535 - RNA, 32 nt, Human
aagugaugcuuccccuggggcaguuuuacaau

SEQ ID NO: 292536 - RNA, 32 nt, Human
aagugauggaaugacuucugcaacuguagucc

SEQ ID NO: 292537 - RNA, 23 nt, Human
aagugauggaauuacagguguga

SEQ ID NO: 292538 - RNA, 31 nt, Human
aagugauggacaauagcucagaccaacaguc

SEQ ID NO: 292539 - RNA, 32 nt, Human
aagugauggauuaggguucuccagagaaacag

SEQ ID NO: 292540 - RNA, 24 nt, Human
aagugaugggauuacagaugugag

SEQ ID NO: 292541 - RNA, 32 nt, Human
aagugaugggauuacagaugugagccaccgug

SEQ ID NO: 292542 - RNA, 24 nt, Human
aagugaugggauuacaggcaugag

SEQ ID NO: 292543 - RNA, 32 nt, Human
aagugaugggauuacaggcaugagccaccgug

SEQ ID NO: 292544 - RNA, 32 nt, Human
aagugaugggauuacaggcgugagccaccgcg

SEQ ID NO: 292545 - RNA, 24 nt, Human
aagugaugggauuauaggcgugag

SEQ ID NO: 292546 - RNA, 24 nt, Human
aagugaugggcuggguuuccaccu

SEQ ID NO: 292547 - RNA, 32 nt, Human
aagugauguggaauuaaugggugcaacagcug

SEQ ID NO: 292548 - RNA, 32 nt, Human
aagugauguggacauaggaggcaaugugugag

SEQ ID NO: 292549 - RNA, 32 nt, Human
aagugauuaaaguaugcacaaccaaaggcagg

SEQ ID NO: 292550 - RNA, 32 nt, Human
aagugauucuccugccucagccuaccaaguag

SEQ ID NO: 292551 - RNA, 32 nt, Human
aagugauucuucucccuggcaaggcucuuccu

SEQ ID NO: 292552 - RNA, 18 nt, Human
aagugauucuucuugccu

SEQ ID NO: 292553 - RNA, 32 nt, Human
aagugcaacauucacucgcuguuuucauucuu

SEQ ID NO: 292554 - RNA, 32 nt, Human
aagugcaagaauugguugcuggugcuacaugg

SEQ ID NO: 292555 - RNA, 24 nt, Human
aagugcaauauuguauauuuuuaa

SEQ ID NO: 292556 - RNA, 32 nt, Human
aagugcaauauuuuagccaaugccuugggaga

SEQ ID NO: 292557 - RNA, 32 nt, Human
aagugcaaugagcagagggugugugacagagg

SEQ ID NO: 292558 - RNA, 32 nt, Human
aagugcacaggcauuuucaugcugaggauaaa

SEQ ID NO: 292559 - RNA, 32 nt, Human
aagugcaccgaggcacgcucugccccguguuu

SEQ ID NO: 292560 - RNA, 32 nt, Human
aagugcaccuuuuaacacuccuuuguccuugg

SEQ ID NO: 292561 - RNA, 32 nt, Human
aagugcacuacccuggagagugguggccacuc

SEQ ID NO: 292562 - RNA, 32 nt, Human
aagugcacuaugaagauuguucaccuuugcug

SEQ ID NO: 292563 - RNA, 32 nt, Human
aagugcacugcccggccaagccccagccucag

SEQ ID NO: 292564 - RNA, 32 nt, Human
aagugcagaaauuggcugggcaugguggugcg

SEQ ID NO: 292565 - RNA, 32 nt, Human
aagugcagagugggagacagagccggggucac

SEQ ID NO: 292566 - RNA, 32 nt, Human
aagugcagccugaugcaauuagcugagcgcag

SEQ ID NO: 292567 - RNA, 19 nt, Human
aagugcagggauuacaggc

SEQ ID NO: 292568 - RNA, 24 nt, Human
aagugcagggauuacaggcaugag

SEQ ID NO: 292569 - RNA, 32 nt, Human
aagugcagggauuacaggcaugagccaccaug

SEQ ID NO: 292570 - RNA, 32 nt, Human
aagugcaguauuuuucuacaucaugucgagaa

SEQ ID NO: 292571 - RNA, 32 nt, Human
aagugcaguucugugaucugggucucuaaucu

SEQ ID NO: 292572 - RNA, 32 nt, Human
aagugcauccucaggccugggcuguagcaagc

SEQ ID NO: 292573 - RNA, 32 nt, Human
aagugcaugggguggagaacagggaaggagaa

SEQ ID NO: 292574 - RNA, 32 nt, Human
aagugcauuuauugucuuuccacauauuggag

SEQ ID NO: 292575 - RNA, 24 nt, Human
aagugccaaaauuauaggcgugag

SEQ ID NO: 292576 - RNA, 25 nt, Human
aagugccaaaggccacaggcaugag

SEQ ID NO: 292577 - RNA, 24 nt, Human
aagugccaggauuacaggcaugag

SEQ ID NO: 292578 - RNA, 32 nt, Human
aagugccaggauuacaggcgugagccaaugug

SEQ ID NO: 292579 - RNA, 32 nt, Human
aagugccagggcugcccuccacccucacccuc

SEQ ID NO: 292580 - RNA, 32 nt, Human
aagugccagggugguuuucaggagcucuggug

SEQ ID NO: 292581 - RNA, 32 nt, Human
aagugccaguaaucccagcuacucuuggaggc

SEQ ID NO: 292582 - RNA, 21 nt, Human
aagugccaguucacacaggua

SEQ ID NO: 292583 - RNA, 32 nt, Human
aagugccaguuucuuuaauaugugaccaagaa

SEQ ID NO: 292584 - RNA, 20 nt, Human
aagugccauuuccucuccag

SEQ ID NO: 292585 - RNA, 32 nt, Human
aagugccauuucuguuacgucucccucucccc

SEQ ID NO: 292586 - RNA, 32 nt, Human
aagugcccagcgcuggagugcagcgugccacg

SEQ ID NO: 292587 - RNA, 32 nt, Human
aagugccccaacuccccucaccaggagaggca

SEQ ID NO: 292588 - RNA, 32 nt, Human
aagugccccacagggaccccagccuggguggu

SEQ ID NO: 292589 - RNA, 32 nt, Human
aagugccccagcugagagaagcccccaggcca

SEQ ID NO: 292590 - RNA, 32 nt, Human
aagugccccugccuggguucugucccagcucc

SEQ ID NO: 292591 - RNA, 32 nt, Human
aagugcccuacucuuucuccucccuuugguga

SEQ ID NO: 292592 - RNA, 32 nt, Human
aagugcccuccagccucagagcuagccacaaa

SEQ ID NO: 292593 - RNA, 32 nt, Human
aagugcccuccccacaaugcaggagaggcaca

SEQ ID NO: 292594 - RNA, 32 nt, Human
aagugcccuccccucacagugucacuuccggc

SEQ ID NO: 292595 - RNA, 32 nt, Human
aagugcccugcucuccaggugccuagaguauc

SEQ ID NO: 292596 - RNA, 32 nt, Human
aagugcccuggaccaggucagggccuacagcu

SEQ ID NO: 292597 - RNA, 32 nt, Human
aagugcccuuacuaagggcacaugucuuaauc

SEQ ID NO: 292598 - RNA, 24 nt, Human
aagugccgagauuacaggugugag

SEQ ID NO: 292599 - RNA, 32 nt, Human
aagugccgagauuacaggugugagccaccgcg

SEQ ID NO: 292600 - RNA, 32 nt, Human
aagugccgagauugcagccucugcccggcggc

SEQ ID NO: 292601 - RNA, 27 nt, Human
aagugccgccgggauuacaggcgugag

SEQ ID NO: 292602 - RNA, 20 nt, Human
aagugccggauuacaggugu

SEQ ID NO: 292603 - RNA, 32 nt, Human
aagugccggccgcggaggguccuggccauuuu

SEQ ID NO: 292604 - RNA, 32 nt, Human
aagugccgggaccaaauggauucacugaugug

SEQ ID NO: 292605 - RNA, 32 nt, Human
aagugccgggauuacagacgugagccacugug

SEQ ID NO: 292606 - RNA, 19 nt, Human
aagugccgggauuacaggc

SEQ ID NO: 292607 - RNA, 24 nt, Human
aagugccgggauuacaggcaugag

SEQ ID NO: 292608 - RNA, 32 nt, Human
aagugccgggauuacaggcaugagccacugca

SEQ ID NO: 292609 - RNA, 24 nt, Human
aagugccgggauuacaggcgugag

SEQ ID NO: 292610 - RNA, 32 nt, Human
aagugccgggauuacaggcgugagccaccgcg

SEQ ID NO: 292611 - RNA, 32 nt, Human
aagugccgggauuacaggcgugagccaccuug

SEQ ID NO: 292612 - RNA, 32 nt, Human
aagugccgggauuacaggcgugagccacugcg

SEQ ID NO: 292613 - RNA, 32 nt, Human
aagugccggugaggacguggggaaccagagcc

SEQ ID NO: 292614 - RNA, 31 nt, Human
aagugccucagugugcccuguugaaacuuag

SEQ ID NO: 292615 - RNA, 32 nt, Human
aagugccucccucccuccuccucuuuacugaa

SEQ ID NO: 292616 - RNA, 32 nt, Human
aagugccuccuucuucccaggaucaggaccuc

SEQ ID NO: 292617 - RNA, 32 nt, Human
aagugccugaaaucccagguacucaggaggcu

SEQ ID NO: 292618 - RNA, 32 nt, Human
aagugccugagugucugcuuucaccucagucu

SEQ ID NO: 292619 - RNA, 32 nt, Human
aagugccugcagcccacgccucugagacaggc

SEQ ID NO: 292620 - RNA, 32 nt, Human
aagugccugcccccucccagcagccagcccug

SEQ ID NO: 292621 - RNA, 32 nt, Human
aagugccugccugugcucucucccucuccucc

SEQ ID NO: 292622 - RNA, 32 nt, Human
aagugccuggggaccugaagagcaccggggaa

SEQ ID NO: 292623 - RNA, 32 nt, Human
aagugccuguagucccagcuacucuggaggcu

SEQ ID NO: 292624 - RNA, 32 nt, Human
aagugccuuagcaaauucuguuuuucuaggcc

SEQ ID NO: 292625 - RNA, 32 nt, Human
aagugccuuagcccagguuccugggcuucugc

SEQ ID NO: 292626 - RNA, 32 nt, Human
aagugccuucaaggagcuuacguucuaguuag

SEQ ID NO: 292627 - RNA, 32 nt, Human
aagugccuuccgcuuccaucugcuccgcccag

SEQ ID NO: 292628 - RNA, 32 nt, Human
aagugccuuuggggacuuuuccccauugccuu

SEQ ID NO: 292629 - RNA, 32 nt, Human
aagugcgagugggggaguccccucuccaacac

SEQ ID NO: 292630 - RNA, 32 nt, Human
aagugcgcuuuccguccuuucaaaggacaacu

SEQ ID NO: 292631 - RNA, 22 nt, Human
aagugcgggauuacaagcguga

SEQ ID NO: 292632 - RNA, 32 nt, Human
aagugcggggauuacaggcuugagccacugca

SEQ ID NO: 292633 - RNA, 24 nt, Human
aagugcuaagauuacaggcgugag

SEQ ID NO: 292634 - RNA, 32 nt, Human
aagugcuaagauuacaggcgugagccaccgcg

SEQ ID NO: 292635 - RNA, 32 nt, Human
aagugcuaagauuacaggcgugagccacugag

SEQ ID NO: 292636 - RNA, 32 nt, Human
aagugcuaagauuacaggcgugagccacugcg

SEQ ID NO: 292637 - RNA, 32 nt, Human
aagugcuacccaccccucugcagcaacaucuc

SEQ ID NO: 292638 - RNA, 24 nt, Human
aagugcuaggauaacaggugugag

SEQ ID NO: 292639 - RNA, 24 nt, Human
aagugcuaggauuacagacaugag

SEQ ID NO: 292640 - RNA, 32 nt, Human
aagugcuaggauuacagacaugagccacuacg

SEQ ID NO: 292641 - RNA, 21 nt, Human
aagugcuaggauuacagacgu

SEQ ID NO: 292642 - RNA, 24 nt, Human
aagugcuaggauuacagaugggag

SEQ ID NO: 292643 - RNA, 32 nt, Human
aagugcuaggauuacagaugggagccaccacg

SEQ ID NO: 292644 - RNA, 23 nt, Human
aagugcuaggauuacagauguga

SEQ ID NO: 292645 - RNA, 32 nt, Human
aagugcuaggauuacagaugugaaccacugug

SEQ ID NO: 292646 - RNA, 32 nt, Human
aagugcuaggauuacagaugugagccaccacg

SEQ ID NO: 292647 - RNA, 22 nt, Human
aagugcuaggauuacagcguga

SEQ ID NO: 292648 - RNA, 32 nt, Human
aagugcuaggauuacaggagugagccacugcg

SEQ ID NO: 292649 - RNA, 19 nt, Human
aagugcuaggauuacaggc

SEQ ID NO: 292650 - RNA, 23 nt, Human
aagugcuaggauuacaggcauga

SEQ ID NO: 292651 - RNA, 24 nt, Human
aagugcuaggauuacaggcaugag

SEQ ID NO: 292652 - RNA, 32 nt, Human
aagugcuaggauuacaggcaugagccacagca

SEQ ID NO: 292653 - RNA, 32 nt, Human
aagugcuaggauuacaggcaugagccaccaca

SEQ ID NO: 292654 - RNA, 32 nt, Human
aagugcuaggauuacaggcaugagccaccacg

SEQ ID NO: 292655 - RNA, 32 nt, Human
aagugcuaggauuacaggcaugagccaccaug

SEQ ID NO: 292656 - RNA, 32 nt, Human
aagugcuaggauuacaggcaugggccacugca

SEQ ID NO: 292657 - RNA, 24 nt, Human
aagugcuaggauuacaggcccgug

SEQ ID NO: 292658 - RNA, 21 nt, Human
aagugcuaggauuacaggcgu

SEQ ID NO: 292659 - RNA, 22 nt, Human
aagugcuaggauuacaggcgug

SEQ ID NO: 292660 - RNA, 24 nt, Human
aagugcuaggauuacaggcgugag

SEQ ID NO: 292661 - RNA, 32 nt, Human
aagugcuaggauuacaggcgugagccaccaac

SEQ ID NO: 292662 - RNA, 32 nt, Human
aagugcuaggauuacaggcgugagccaccaca

SEQ ID NO: 292663 - RNA, 32 nt, Human
aagugcuaggauuacaggcgugagccaccacg

SEQ ID NO: 292664 - RNA, 32 nt, Human
aagugcuaggauuacaggcgugagccaccaug

SEQ ID NO: 292665 - RNA, 32 nt, Human
aagugcuaggauuacaggcgugagccaccgua

SEQ ID NO: 292666 - RNA, 32 nt, Human
aagugcuaggauuacaggcgugagccaccgug

SEQ ID NO: 292667 - RNA, 32 nt, Human
aagugcuaggauuacaggcgugagccacugca

SEQ ID NO: 292668 - RNA, 32 nt, Human
aagugcuaggauuacaggcgugagccacuuac

SEQ ID NO: 292669 - RNA, 32 nt, Human
aagugcuaggauuacaggcgugugccaccgcg

SEQ ID NO: 292670 - RNA, 32 nt, Human
aagugcuaggauuacaggcuggagcuacagag

SEQ ID NO: 292671 - RNA, 24 nt, Human
aagugcuaggauuacagguaugag

SEQ ID NO: 292672 - RNA, 32 nt, Human
aagugcuaggauuacagguaugagccaccaug

SEQ ID NO: 292673 - RNA, 32 nt, Human
aagugcuaggauuacagguaugagccauugcg

SEQ ID NO: 292674 - RNA, 21 nt, Human
aagugcuaggauuacaggugu

SEQ ID NO: 292675 - RNA, 32 nt, Human
aagugcuaggauuacagguguaagccacugug

SEQ ID NO: 292676 - RNA, 24 nt, Human
aagugcuaggauuacaggugugag

SEQ ID NO: 292677 - RNA, 32 nt, Human
aagugcuaggauuacaggugugagccaccaca

SEQ ID NO: 292678 - RNA, 32 nt, Human
aagugcuaggauuacaggugugagccaccacg

SEQ ID NO: 292679 - RNA, 32 nt, Human
aagugcuaggauuacaggugugagccacugug

SEQ ID NO: 292680 - RNA, 32 nt, Human
aagugcuaggauuacaggugugagccauugug

SEQ ID NO: 292681 - RNA, 32 nt, Human
aagugcuaggauuacagguuugagccaccgug

SEQ ID NO: 292682 - RNA, 24 nt, Human
aagugcuaggauuacgggugugag

SEQ ID NO: 292683 - RNA, 24 nt, Human
aagugcuaggauuauaggcaugag

SEQ ID NO: 292684 - RNA, 23 nt, Human
aagugcuaggauuauaggcguga

SEQ ID NO: 292685 - RNA, 24 nt, Human
aagugcuaggauuauaggcuugag

SEQ ID NO: 292686 - RNA, 24 nt, Human
aagugcuaggauuccaggcgugag

SEQ ID NO: 292687 - RNA, 24 nt, Human
aagugcuaggauuccaggugugag

SEQ ID NO: 292688 - RNA, 32 nt, Human
aagugcuaggcccauguuccacucaggcuuca

SEQ ID NO: 292689 - RNA, 32 nt, Human
aagugcuaggggacauggugcccacaugaaca

SEQ ID NO: 292690 - RNA, 24 nt, Human
aagugcuaggguuacagacaugag

SEQ ID NO: 292691 - RNA, 24 nt, Human
aagugcuaggguuacaggcaugag

SEQ ID NO: 292692 - RNA, 24 nt, Human
aagugcuagguuuacaggcaugag

SEQ ID NO: 292693 - RNA, 24 nt, Human
aagugcuaugauuacagacgugag

SEQ ID NO: 292694 - RNA, 32 nt, Human
aagugcuauuuauagggugcccagggagccgc

SEQ ID NO: 292695 - RNA, 32 nt, Human
aagugcucaacuuagacucugggcaaaauucu

SEQ ID NO: 292696 - RNA, 31 nt, Human
aagugcucaauaaauacugagugaaauccuc

SEQ ID NO: 292697 - RNA, 21 nt, Human
aagugcucagagggccaggag

SEQ ID NO: 292698 - RNA, 25 nt, Human
aagugcucaggauuacaggcgugag

SEQ ID NO: 292699 - RNA, 32 nt, Human
aagugcucagggaaaugaagacaggagaacug

SEQ ID NO: 292700 - RNA, 32 nt, Human
aagugcuccccaaaaggaaggagaaugggauu

SEQ ID NO: 292701 - RNA, 32 nt, Human
aagugcucccucuuugggguucccaaggcacc

SEQ ID NO: 292702 - RNA, 32 nt, Human
aagugcuccugcagcuaucauucauccaguua

SEQ ID NO: 292703 - RNA, 24 nt, Human
aagugcucggauuacagacaugag

SEQ ID NO: 292704 - RNA, 24 nt, Human
aagugcucggauuacaggugugag

SEQ ID NO: 292705 - RNA, 32 nt, Human
aagugcucggauuacaggugugagccacugug

SEQ ID NO: 292706 - RNA, 22 nt, Human
aagugcugaaaucugcagugag

SEQ ID NO: 292707 - RNA, 24 nt, Human
aagugcugaaauuacaggcaugag

SEQ ID NO: 292708 - RNA, 32 nt, Human
aagugcugaaccugagagcagccccaguacac

SEQ ID NO: 292709 - RNA, 32 nt, Human
aagugcugaacugugaggagagaggcggacug

SEQ ID NO: 292710 - RNA, 32 nt, Human
aagugcugaagaaaaagaaagugaagaagucg

SEQ ID NO: 292711 - RNA, 21 nt, Human
aagugcugaauuacaauguga

SEQ ID NO: 292712 - RNA, 24 nt, Human
aagugcugacauuacaggccugag

SEQ ID NO: 292713 - RNA, 24 nt, Human
aagugcugagaugacaggcaugag

SEQ ID NO: 292714 - RNA, 23 nt, Human
aagugcugagauuacaagcguga

SEQ ID NO: 292715 - RNA, 32 nt, Human
aagugcugagauuacaagcgugaaccaccaug

SEQ ID NO: 292716 - RNA, 32 nt, Human
aagugcugagauuacagaagugagccacugug

SEQ ID NO: 292717 - RNA, 24 nt, Human
aagugcugagauuacagacaugag

SEQ ID NO: 292718 - RNA, 32 nt, Human
aagugcugagauuacagacaugagccuccgcg

SEQ ID NO: 292719 - RNA, 24 nt, Human
aagugcugagauuacagacgugag

SEQ ID NO: 292720 - RNA, 32 nt, Human
aagugcugagauuacagacgugagccacugcg

SEQ ID NO: 292721 - RNA, 32 nt, Human
aagugcugagauuacagacgugagccacugug

SEQ ID NO: 292722 - RNA, 24 nt, Human
aagugcugagauuacagaugugag

SEQ ID NO: 292723 - RNA, 32 nt, Human
aagugcugagauuacagaugugagccacugcg

SEQ ID NO: 292724 - RNA, 24 nt, Human
aagugcugagauuacaggagugag

SEQ ID NO: 292725 - RNA, 19 nt, Human
aagugcugagauuacaggc

SEQ ID NO: 292726 - RNA, 32 nt, Human
aagugcugagauuacaggcauaagccaccgcg

SEQ ID NO: 292727 - RNA, 23 nt, Human
aagugcugagauuacaggcauga

SEQ ID NO: 292728 - RNA, 32 nt, Human
aagugcugagauuacaggcaugaaccacugug

SEQ ID NO: 292729 - RNA, 32 nt, Human
aagugcugagauuacaggcaugacccaccgcg

SEQ ID NO: 292730 - RNA, 24 nt, Human
aagugcugagauuacaggcaugag

SEQ ID NO: 292731 - RNA, 32 nt, Human
aagugcugagauuacaggcaugagccaccaca

SEQ ID NO: 292732 - RNA, 32 nt, Human
aagugcugagauuacaggcaugagccaccacg

SEQ ID NO: 292733 - RNA, 32 nt, Human
aagugcugagauuacaggcaugagccaccaug

SEQ ID NO: 292734 - RNA, 32 nt, Human
aagugcugagauuacaggcaugagccaccgca

SEQ ID NO: 292735 - RNA, 32 nt, Human
aagugcugagauuacaggcaugagccacugca

SEQ ID NO: 292736 - RNA, 32 nt, Human
aagugcugagauuacaggcaugagccauugca

SEQ ID NO: 292737 - RNA, 32 nt, Human
aagugcugagauuacaggcaugagcuaccacg

SEQ ID NO: 292738 - RNA, 32 nt, Human
aagugcugagauuacaggcaugagucacuacg

SEQ ID NO: 292739 - RNA, 24 nt, Human
aagugcugagauuacaggcauggg

SEQ ID NO: 292740 - RNA, 32 nt, Human
aagugcugagauuacaggcaugggccaccacg

SEQ ID NO: 292741 - RNA, 24 nt, Human
aagugcugagauuacaggccugag

SEQ ID NO: 292742 - RNA, 32 nt, Human
aagugcugagauuacaggccugagccaccgug

SEQ ID NO: 292743 - RNA, 24 nt, Human
aagugcugagauuacaggcgugag

SEQ ID NO: 292744 - RNA, 32 nt, Human
aagugcugagauuacaggcgugagccaccaca

SEQ ID NO: 292745 - RNA, 32 nt, Human
aagugcugagauuacaggcgugagccaccgug

SEQ ID NO: 292746 - RNA, 32 nt, Human
aagugcugagauuacaggcgugagccacugug

SEQ ID NO: 292747 - RNA, 32 nt, Human
aagugcugagauuacaggcgugagcuaucaca

SEQ ID NO: 292748 - RNA, 32 nt, Human
aagugcugagauuacaggcgugaggcacugcg

SEQ ID NO: 292749 - RNA, 32 nt, Human
aagugcugagauuacaggcguggccaccaucc

SEQ ID NO: 292750 - RNA, 32 nt, Human
aagugcugagauuacaggcuugaaccacugua

SEQ ID NO: 292751 - RNA, 32 nt, Human
aagugcugagauuacaggcuugagccaccacg

SEQ ID NO: 292752 - RNA, 32 nt, Human
aagugcugagauuacaggggugagccacugcg

SEQ ID NO: 292753 - RNA, 32 nt, Human
aagugcugagauuacaggggugagucaccgcg

SEQ ID NO: 292754 - RNA, 21 nt, Human
aagugcugagauuacaggugu

SEQ ID NO: 292755 - RNA, 32 nt, Human
aagugcugagauuacagguguaagccacugag

SEQ ID NO: 292756 - RNA, 24 nt, Human
aagugcugagauuacaggugugag

SEQ ID NO: 292757 - RNA, 32 nt, Human
aagugcugagauuacaggugugagccaccagg

SEQ ID NO: 292758 - RNA, 32 nt, Human
aagugcugagauuacaggugugagccaccaug

SEQ ID NO: 292759 - RNA, 32 nt, Human
aagugcugagauuacaggugugagccaccgca

SEQ ID NO: 292760 - RNA, 32 nt, Human
aagugcugagauuacaggugugagccaccgug

SEQ ID NO: 292761 - RNA, 32 nt, Human
aagugcugagauuacaggugugagccacugug

SEQ ID NO: 292762 - RNA, 32 nt, Human
aagugcugagauuacaggugugagcuaccaug

SEQ ID NO: 292763 - RNA, 32 nt, Human
aagugcugagauuacaggugugagcuaccgca

SEQ ID NO: 292764 - RNA, 32 nt, Human
aagugcugagauuacaguugcgagccacugug

SEQ ID NO: 292765 - RNA, 32 nt, Human
aagugcugagauuacgggcaugagccaccgca

SEQ ID NO: 292766 - RNA, 24 nt, Human
aagugcugagauuacuggcuugag

SEQ ID NO: 292767 - RNA, 32 nt, Human
aagugcugagauuacuggcuugagccacugca

SEQ ID NO: 292768 - RNA, 32 nt, Human
aagugcugagauuaggcguuagccaccgcgcc

SEQ ID NO: 292769 - RNA, 24 nt, Human
aagugcugagauuauaggcacgag

SEQ ID NO: 292770 - RNA, 32 nt, Human
aagugcugagauuauaggcacgagccacuaca

SEQ ID NO: 292771 - RNA, 24 nt, Human
aagugcugagauuauaggcaugag

SEQ ID NO: 292772 - RNA, 32 nt, Human
aagugcugagauuauaggcaugagccaccacg

SEQ ID NO: 292773 - RNA, 32 nt, Human
aagugcugagauuauaggcaugagccacugug

SEQ ID NO: 292774 - RNA, 24 nt, Human
aagugcugagauuauaggcgugag

SEQ ID NO: 292775 - RNA, 24 nt, Human
aagugcugagauuauagggaugag

SEQ ID NO: 292776 - RNA, 32 nt, Human
aagugcugagauuaugggcgugagccaccgug

SEQ ID NO: 292777 - RNA, 24 nt, Human
aagugcugagauugcagaugugag

SEQ ID NO: 292778 - RNA, 32 nt, Human
aagugcugagauugcagaugugagccaccgug

SEQ ID NO: 292779 - RNA, 32 nt, Human
aagugcugauuccacagcaugcagccugguag

SEQ ID NO: 292780 - RNA, 24 nt, Human
aagugcugcaguuacaggcgugag

SEQ ID NO: 292781 - RNA, 24 nt, Human
aagugcugccauuacaggcgugag

SEQ ID NO: 292782 - RNA, 24 nt, Human
aagugcugcgauuacagacaugag

SEQ ID NO: 292783 - RNA, 24 nt, Human
aagugcugcgauuacaggcaugag

SEQ ID NO: 292784 - RNA, 32 nt, Human
aagugcugcgauuacaggcaugagccaccgcg

SEQ ID NO: 292785 - RNA, 32 nt, Human
aagugcugcgauuacaggcaugagccaucgcg

SEQ ID NO: 292786 - RNA, 24 nt, Human
aagugcugcgauuacaggcgugag

SEQ ID NO: 292787 - RNA, 32 nt, Human
aagugcugcgauuacaggcgugagccaccgca

SEQ ID NO: 292788 - RNA, 32 nt, Human
aagugcugcuuuggcaaucugggcugaccugg

SEQ ID NO: 292789 - RNA, 24 nt, Human
aagugcuggaaccacaggccugag

SEQ ID NO: 292790 - RNA, 24 nt, Human
aagugcuggaauaacaggugugag

SEQ ID NO: 292791 - RNA, 24 nt, Human
aagugcuggaaucacaggggugag

SEQ ID NO: 292792 - RNA, 24 nt, Human
aagugcuggaauuacaggcaugag

SEQ ID NO: 292793 - RNA, 24 nt, Human
aagugcuggaauuacaggccugag

SEQ ID NO: 292794 - RNA, 20 nt, Human
aagugcuggaauuacaggcg

SEQ ID NO: 292795 - RNA, 21 nt, Human
aagugcuggaauuacaggcgu

SEQ ID NO: 292796 - RNA, 24 nt, Human
aagugcuggaauuacaggcgugag

SEQ ID NO: 292797 - RNA, 24 nt, Human
aagugcuggaauuacaggugugag

SEQ ID NO: 292798 - RNA, 24 nt, Human
aagugcuggaauuacagucauggg

SEQ ID NO: 292799 - RNA, 24 nt, Human
aagugcuggaauuacaugggugag

SEQ ID NO: 292800 - RNA, 24 nt, Human
aagugcuggaauuacuggcaugag

SEQ ID NO: 292801 - RNA, 24 nt, Human
aagugcuggaauuauaggcaugag

SEQ ID NO: 292802 - RNA, 21 nt, Human
aagugcuggaauuauaggcgu

SEQ ID NO: 292803 - RNA, 23 nt, Human
aagugcuggaauuauaggcguga

SEQ ID NO: 292804 - RNA, 24 nt, Human
aagugcuggaauugcagacgugag

SEQ ID NO: 292805 - RNA, 24 nt, Human
aagugcuggaauugcagacuugag

SEQ ID NO: 292806 - RNA, 24 nt, Human
aagugcuggaauugcaggcaugag

SEQ ID NO: 292807 - RNA, 18 nt, Human
aagugcuggauuacaggc

SEQ ID NO: 292808 - RNA, 23 nt, Human
aagugcuggauuacaggcgugag

SEQ ID NO: 292809 - RNA, 32 nt, Human
aagugcuggauuacaggcgugagccaccacac

SEQ ID NO: 292810 - RNA, 32 nt, Human
aagugcuggauuacaggcgugagccaccgugc

SEQ ID NO: 292811 - RNA, 32 nt, Human
aagugcuggauuacaggcgugagccacugagc

SEQ ID NO: 292812 - RNA, 32 nt, Human
aagugcuggauuacaggcugagcuaccacccu

SEQ ID NO: 292813 - RNA, 23 nt, Human
aagugcuggauuacagggaugag

SEQ ID NO: 292814 - RNA, 32 nt, Human
aagugcuggauuacagggaugagccaccauac

SEQ ID NO: 292815 - RNA, 23 nt, Human
aagugcuggauuacaggugugag

SEQ ID NO: 292816 - RNA, 32 nt, Human
aagugcuggauuacaggugugagccaccacga

SEQ ID NO: 292817 - RNA, 32 nt, Human
aagugcuggauuacaggugugagccacccugc

SEQ ID NO: 292818 - RNA, 24 nt, Human
aagugcuggcacuacaggcaugag

SEQ ID NO: 292819 - RNA, 24 nt, Human
aagugcuggcauuacaggcgugag

SEQ ID NO: 292820 - RNA, 24 nt, Human
aagugcuggcauuacaggugugag

SEQ ID NO: 292821 - RNA, 24 nt, Human
aagugcuggcauuucaggcgugag

SEQ ID NO: 292822 - RNA, 32 nt, Human
aagugcuggccuuaauuugggguggggugggg

SEQ ID NO: 292823 - RNA, 32 nt, Human
aagugcuggcucugcuguccuugccuuccauu

SEQ ID NO: 292824 - RNA, 24 nt, Human
aagugcugggaauacaggcaugag

SEQ ID NO: 292825 - RNA, 23 nt, Human
aagugcugggaauacagguguga

SEQ ID NO: 292826 - RNA, 25 nt, Human
aagugcugggaauuacaggcgugag

SEQ ID NO: 292827 - RNA, 24 nt, Human
aagugcugggacuacaggccugag

SEQ ID NO: 292828 - RNA, 24 nt, Human
aagugcugggacuauaagugugag

SEQ ID NO: 292829 - RNA, 24 nt, Human
aagugcugggaucacagacgugag

SEQ ID NO: 292830 - RNA, 23 nt, Human
aagugcugggaucacaggcauga

SEQ ID NO: 292831 - RNA, 24 nt, Human
aagugcugggaucacaggcaugag

SEQ ID NO: 292832 - RNA, 20 nt, Human
aagugcugggaucacaggcg

SEQ ID NO: 292833 - RNA, 24 nt, Human
aagugcugggaucacaggcgugag

SEQ ID NO: 292834 - RNA, 32 nt, Human
aagugcugggaucacaggcgugagccacugcg

SEQ ID NO: 292835 - RNA, 32 nt, Human
aagugcugggaucacaggcgugagcuaccaag

SEQ ID NO: 292836 - RNA, 32 nt, Human
aagugcugggaucacaggcgugagcuaucaca

SEQ ID NO: 292837 - RNA, 24 nt, Human
aagugcugggaucacaggugggag

SEQ ID NO: 292838 - RNA, 20 nt, Human
aagugcugggaucuggcgug

SEQ ID NO: 292839 - RNA, 23 nt, Human
aagugcugggaugacagcgugag

SEQ ID NO: 292840 - RNA, 32 nt, Human
aagugcugggaugacagcgugagccaccacac

SEQ ID NO: 292841 - RNA, 23 nt, Human
aagugcugggaugacaggcauga

SEQ ID NO: 292842 - RNA, 24 nt, Human
aagugcugggaugacaggcaugag

SEQ ID NO: 292843 - RNA, 22 nt, Human
aagugcugggaugacaggcgug

SEQ ID NO: 292844 - RNA, 24 nt, Human
aagugcugggaugacaggcgugag

SEQ ID NO: 292845 - RNA, 24 nt, Human
aagugcugggaugacaggugugag

SEQ ID NO: 292846 - RNA, 32 nt, Human
aagugcugggaugacaggugugagccaccgcc

SEQ ID NO: 292847 - RNA, 24 nt, Human
aagugcugggaugauaggcgugag

SEQ ID NO: 292848 - RNA, 24 nt, Human
aagugcugggaugccaggcgugag

SEQ ID NO: 292849 - RNA, 24 nt, Human
aagugcugggauuaaagcugugag

SEQ ID NO: 292850 - RNA, 24 nt, Human
aagugcugggauuaaaggcgugag

SEQ ID NO: 292851 - RNA, 24 nt, Human
aagugcugggauuaaaggugugag

SEQ ID NO: 292852 - RNA, 23 nt, Human
aagugcugggauuaacagguaug

SEQ ID NO: 292853 - RNA, 25 nt, Human
aagugcugggauuaacgggugugag

SEQ ID NO: 292854 - RNA, 23 nt, Human
aagugcugggauuaaggcgugag

SEQ ID NO: 292855 - RNA, 32 nt, Human
aagugcugggauuaaggcgugagccacugcgc

SEQ ID NO: 292856 - RNA, 24 nt, Human
aagugcugggauuaauggcgugag

SEQ ID NO: 292857 - RNA, 24 nt, Human
aagugcugggauuacaagaaugag

SEQ ID NO: 292858 - RNA, 24 nt, Human
aagugcugggauuacaagcaugag

SEQ ID NO: 292859 - RNA, 24 nt, Human
aagugcugggauuacaagcgugag

SEQ ID NO: 292860 - RNA, 24 nt, Human
aagugcugggauuacaagggugag

SEQ ID NO: 292861 - RNA, 24 nt, Human
aagugcugggauuacaagugugag

SEQ ID NO: 292862 - RNA, 24 nt, Human
aagugcugggauuacaaguuugag

SEQ ID NO: 292863 - RNA, 24 nt, Human
aagugcugggauuacagaagugag

SEQ ID NO: 292864 - RNA, 32 nt, Human
aagugcugggauuacagaagugagccacugua

SEQ ID NO: 292865 - RNA, 24 nt, Human
aagugcugggauuacagacacgag

SEQ ID NO: 292866 - RNA, 32 nt, Human
aagugcugggauuacagacacgagccaccuca

SEQ ID NO: 292867 - RNA, 23 nt, Human
aagugcugggauuacagacauga

SEQ ID NO: 292868 - RNA, 32 nt, Human
aagugcugggauuacagacaugaacugccagg

SEQ ID NO: 292869 - RNA, 24 nt, Human
aagugcugggauuacagacaugag

SEQ ID NO: 292870 - RNA, 32 nt, Human
aagugcugggauuacagacaugagcagccaug

SEQ ID NO: 292871 - RNA, 32 nt, Human
aagugcugggauuacagacaugagccaccacg

SEQ ID NO: 292872 - RNA, 32 nt, Human
aagugcugggauuacagacaugagccaccaug

SEQ ID NO: 292873 - RNA, 32 nt, Human
aagugcugggauuacagacaugagccacugug

SEQ ID NO: 292874 - RNA, 32 nt, Human
aagugcugggauuacagaccugagccaccaca

SEQ ID NO: 292875 - RNA, 23 nt, Human
aagugcugggauuacagacguga

SEQ ID NO: 292876 - RNA, 32 nt, Human
aagugcugggauuacagacgugaaccacuggg

SEQ ID NO: 292877 - RNA, 24 nt, Human
aagugcugggauuacagacgugag

SEQ ID NO: 292878 - RNA, 32 nt, Human
aagugcugggauuacagacgugagccaccacg

SEQ ID NO: 292879 - RNA, 32 nt, Human
aagugcugggauuacagacgugagccaccacu

SEQ ID NO: 292880 - RNA, 32 nt, Human
aagugcugggauuacagacgugagccaccgug

SEQ ID NO: 292881 - RNA, 32 nt, Human
aagugcugggauuacagacgugagcuaccaca

SEQ ID NO: 292882 - RNA, 32 nt, Human
aagugcugggauuacagacgugagcuaucaug

SEQ ID NO: 292883 - RNA, 32 nt, Human
aagugcugggauuacagacgugaggcaccaca

SEQ ID NO: 292884 - RNA, 32 nt, Human
aagugcugggauuacagacgugauccaccagg

SEQ ID NO: 292885 - RNA, 32 nt, Human
aagugcugggauuacagagugugagccaccac

SEQ ID NO: 292886 - RNA, 32 nt, Human
aagugcugggauuacagaugauagccaccuca

SEQ ID NO: 292887 - RNA, 21 nt, Human
aagugcugggauuacagaugu

SEQ ID NO: 292888 - RNA, 32 nt, Human
aagugcugggauuacagauguaagucacuacc

SEQ ID NO: 292889 - RNA, 24 nt, Human
aagugcugggauuacagaugugag

SEQ ID NO: 292890 - RNA, 32 nt, Human
aagugcugggauuacagaugugagccaacgca

SEQ ID NO: 292891 - RNA, 32 nt, Human
aagugcugggauuacagaugugagccaccaca

SEQ ID NO: 292892 - RNA, 32 nt, Human
aagugcugggauuacagaugugagccaccacg

SEQ ID NO: 292893 - RNA, 32 nt, Human
aagugcugggauuacagaugugagccaccaug

SEQ ID NO: 292894 - RNA, 32 nt, Human
aagugcugggauuacagaugugagccaccgca

SEQ ID NO: 292895 - RNA, 32 nt, Human
aagugcugggauuacagaugugagccacugca

SEQ ID NO: 292896 - RNA, 32 nt, Human
aagugcugggauuacagaugugagccauggug

SEQ ID NO: 292897 - RNA, 32 nt, Human
aagugcugggauuacagaugugagccauugug

SEQ ID NO: 292898 - RNA, 32 nt, Human
aagugcugggauuacagaugugagccgccgcg

SEQ ID NO: 292899 - RNA, 32 nt, Human
aagugcugggauuacagcaucccagccaucac

SEQ ID NO: 292900 - RNA, 24 nt, Human
aagugcugggauuacagcccugag

SEQ ID NO: 292901 - RNA, 24 nt, Human
aagugcugggauuacagccgugag

SEQ ID NO: 292902 - RNA, 32 nt, Human
aagugcugggauuacagccgugagccacugca

SEQ ID NO: 292903 - RNA, 24 nt, Human
aagugcugggauuacagcgaagag

SEQ ID NO: 292904 - RNA, 32 nt, Human
aagugcugggauuacagcgaagagccacagca

SEQ ID NO: 292905 - RNA, 23 nt, Human
aagugcugggauuacagcgugag

SEQ ID NO: 292906 - RNA, 32 nt, Human
aagugcugggauuacagcgugagccaccgcac

SEQ ID NO: 292907 - RNA, 32 nt, Human
aagugcugggauuacagcgugagcuaccuggc

SEQ ID NO: 292908 - RNA, 24 nt, Human
aagugcugggauuacagcugugag

SEQ ID NO: 292909 - RNA, 32 nt, Human
aagugcugggauuacagcugugagccaccgug

SEQ ID NO: 292910 - RNA, 32 nt, Human
aagugcugggauuacagcugugagccacugca

SEQ ID NO: 292911 - RNA, 32 nt, Human
aagugcugggauuacagcugugagccauggca

SEQ ID NO: 292912 - RNA, 18 nt, Human
aagugcugggauuacagg

SEQ ID NO: 292913 - RNA, 32 nt, Human
aagugcugggauuacaggaaugagccacugug

SEQ ID NO: 292914 - RNA, 22 nt, Human
aagugcugggauuacaggagug

SEQ ID NO: 292915 - RNA, 32 nt, Human
aagugcugggauuacaggagugaaccaccaag

SEQ ID NO: 292916 - RNA, 32 nt, Human
aagugcugggauuacaggagugaaccaccaug

SEQ ID NO: 292917 - RNA, 24 nt, Human
aagugcugggauuacaggagugag

SEQ ID NO: 292918 - RNA, 32 nt, Human
aagugcugggauuacaggagugagccaccgug

SEQ ID NO: 292919 - RNA, 32 nt, Human
aagugcugggauuacaggagugagccacugcg

SEQ ID NO: 292920 - RNA, 32 nt, Human
aagugcugggauuacaggagugagccgcugcg

SEQ ID NO: 292921 - RNA, 32 nt, Human
aagugcugggauuacaggagugugccacugcg

SEQ ID NO: 292922 - RNA, 32 nt, Human
aagugcugggauuacaggaugagccacugagc

SEQ ID NO: 292923 - RNA, 19 nt, Human
aagugcugggauuacaggc

SEQ ID NO: 292924 - RNA, 32 nt, Human
aagugcugggauuacaggcaagagccaccaua

SEQ ID NO: 292925 - RNA, 24 nt, Human
aagugcugggauuacaggcacgag

SEQ ID NO: 292926 - RNA, 32 nt, Human
aagugcugggauuacaggcacgagccaccgca

SEQ ID NO: 292927 - RNA, 24 nt, Human
aagugcugggauuacaggcaggag

SEQ ID NO: 292928 - RNA, 32 nt, Human
aagugcugggauuacaggcaggagccaccgcg

SEQ ID NO: 292929 - RNA, 21 nt, Human
aagugcugggauuacaggcau

SEQ ID NO: 292930 - RNA, 32 nt, Human
aagugcugggauuacaggcauaagccacagca

SEQ ID NO: 292931 - RNA, 32 nt, Human
aagugcugggauuacaggcauaagccacugcg

SEQ ID NO: 292932 - RNA, 32 nt, Human
aagugcugggauuacaggcauaagccacugua

SEQ ID NO: 292933 - RNA, 32 nt, Human
aagugcugggauuacaggcauaagccacugug

SEQ ID NO: 292934 - RNA, 32 nt, Human
aagugcugggauuacaggcaucagccaccaca

SEQ ID NO: 292935 - RNA, 32 nt, Human
aagugcugggauuacaggcaucagccaccaug

SEQ ID NO: 292936 - RNA, 32 nt, Human
aagugcugggauuacaggcaucagccaccgca

SEQ ID NO: 292937 - RNA, 32 nt, Human
aagugcugggauuacaggcaucagccacuaug

SEQ ID NO: 292938 - RNA, 32 nt, Human
aagugcugggauuacaggcaucugccaccgca

SEQ ID NO: 292939 - RNA, 23 nt, Human
aagugcugggauuacaggcauga

SEQ ID NO: 292940 - RNA, 32 nt, Human
aagugcugggauuacaggcaugaaccacagcg

SEQ ID NO: 292941 - RNA, 32 nt, Human
aagugcugggauuacaggcaugaaccaccacg

SEQ ID NO: 292942 - RNA, 32 nt, Human
aagugcugggauuacaggcaugaaccaccaug

SEQ ID NO: 292943 - RNA, 32 nt, Human
aagugcugggauuacaggcaugaaccaccgcu

SEQ ID NO: 292944 - RNA, 32 nt, Human
aagugcugggauuacaggcaugaaccaccgug

SEQ ID NO: 292945 - RNA, 32 nt, Human
aagugcugggauuacaggcaugaaccacugug

SEQ ID NO: 292946 - RNA, 32 nt, Human
aagugcugggauuacaggcaugaaccaucaua

SEQ ID NO: 292947 - RNA, 32 nt, Human
aagugcugggauuacaggcaugaaccauggug

SEQ ID NO: 292948 - RNA, 32 nt, Human
aagugcugggauuacaggcaugaaccgccaug

SEQ ID NO: 292949 - RNA, 32 nt, Human
aagugcugggauuacaggcaugaaucaccaca

SEQ ID NO: 292950 - RNA, 32 nt, Human
aagugcugggauuacaggcaugaccaaaugug

SEQ ID NO: 292951 - RNA, 32 nt, Human
aagugcugggauuacaggcaugacccaccgcu

SEQ ID NO: 292952 - RNA, 24 nt, Human
aagugcugggauuacaggcaugag

SEQ ID NO: 292953 - RNA, 32 nt, Human
aagugcugggauuacaggcaugagccacagug

SEQ ID NO: 292954 - RNA, 32 nt, Human
aagugcugggauuacaggcaugagccaccaaa

SEQ ID NO: 292955 - RNA, 32 nt, Human
aagugcugggauuacaggcaugagccaccaca

SEQ ID NO: 292956 - RNA, 32 nt, Human
aagugcugggauuacaggcaugagccaccacg

SEQ ID NO: 292957 - RNA, 32 nt, Human
aagugcugggauuacaggcaugagccaccacu

SEQ ID NO: 292958 - RNA, 32 nt, Human
aagugcugggauuacaggcaugagccaccagg

SEQ ID NO: 292959 - RNA, 32 nt, Human
aagugcugggauuacaggcaugagccaccauc

SEQ ID NO: 292960 - RNA, 32 nt, Human
aagugcugggauuacaggcaugagccaccaug

SEQ ID NO: 292961 - RNA, 32 nt, Human
aagugcugggauuacaggcaugagccaccccg

SEQ ID NO: 292962 - RNA, 30 nt, Human
aagugcugggauuacaggcaugagccaccg

SEQ ID NO: 292963 - RNA, 32 nt, Human
aagugcugggauuacaggcaugagccaccgag

SEQ ID NO: 292964 - RNA, 32 nt, Human
aagugcugggauuacaggcaugagccaccgca

SEQ ID NO: 292965 - RNA, 32 nt, Human
aagugcugggauuacaggcaugagccaccgcg

SEQ ID NO: 292966 - RNA, 32 nt, Human
aagugcugggauuacaggcaugagccaccgcu

SEQ ID NO: 292967 - RNA, 32 nt, Human
aagugcugggauuacaggcaugagccaccgug

SEQ ID NO: 292968 - RNA, 32 nt, Human
aagugcugggauuacaggcaugagccaccuca

SEQ ID NO: 292969 - RNA, 32 nt, Human
aagugcugggauuacaggcaugagccaccucg

SEQ ID NO: 292970 - RNA, 32 nt, Human
aagugcugggauuacaggcaugagccacggca

SEQ ID NO: 292971 - RNA, 32 nt, Human
aagugcugggauuacaggcaugagccacggcg

SEQ ID NO: 292972 - RNA, 32 nt, Human
aagugcugggauuacaggcaugagccacugca

SEQ ID NO: 292973 - RNA, 32 nt, Human
aagugcugggauuacaggcaugagccacugcg

SEQ ID NO: 292974 - RNA, 32 nt, Human
aagugcugggauuacaggcaugagccacuggg

SEQ ID NO: 292975 - RNA, 32 nt, Human
aagugcugggauuacaggcaugagccacugug

SEQ ID NO: 292976 - RNA, 32 nt, Human
aagugcugggauuacaggcaugagccaucaca

SEQ ID NO: 292977 - RNA, 32 nt, Human
aagugcugggauuacaggcaugagccaucgcc

SEQ ID NO: 292978 - RNA, 32 nt, Human
aagugcugggauuacaggcaugagccaucgcg

SEQ ID NO: 292979 - RNA, 32 nt, Human
aagugcugggauuacaggcaugagccauugcg

SEQ ID NO: 292980 - RNA, 32 nt, Human
aagugcugggauuacaggcaugagccauugug

SEQ ID NO: 292981 - RNA, 32 nt, Human
aagugcugggauuacaggcaugagcuaccacg

SEQ ID NO: 292982 - RNA, 32 nt, Human
aagugcugggauuacaggcaugagcuaccgug

SEQ ID NO: 292983 - RNA, 32 nt, Human
aagugcugggauuacaggcaugagcuacugca

SEQ ID NO: 292984 - RNA, 32 nt, Human
aagugcugggauuacaggcaugagcuacugug

SEQ ID NO: 292985 - RNA, 32 nt, Human
aagugcugggauuacaggcaugagucaccaua

SEQ ID NO: 292986 - RNA, 32 nt, Human
aagugcugggauuacaggcaugagucauugcu

SEQ ID NO: 292987 - RNA, 23 nt, Human
aagugcugggauuacaggcaugg

SEQ ID NO: 292988 - RNA, 32 nt, Human
aagugcugggauuacaggcauggccaccacgc

SEQ ID NO: 292989 - RNA, 24 nt, Human
aagugcugggauuacaggcauggg

SEQ ID NO: 292990 - RNA, 24 nt, Human
aagugcugggauuacaggcccgag

SEQ ID NO: 292991 - RNA, 32 nt, Human
aagugcugggauuacaggcccgagccgccgca

SEQ ID NO: 292992 - RNA, 24 nt, Human
aagugcugggauuacaggccugag

SEQ ID NO: 292993 - RNA, 32 nt, Human
aagugcugggauuacaggccugagccaccaua

SEQ ID NO: 292994 - RNA, 32 nt, Human
aagugcugggauuacaggccugagccaccaug

SEQ ID NO: 292995 - RNA, 32 nt, Human
aagugcugggauuacaggccugagccaccgcg

SEQ ID NO: 292996 - RNA, 32 nt, Human
aagugcugggauuacaggccugagccaccgua

SEQ ID NO: 292997 - RNA, 32 nt, Human
aagugcugggauuacaggccugagccaccgug

SEQ ID NO: 292998 - RNA, 23 nt, Human
aagugcugggauuacaggccugg

SEQ ID NO: 292999 - RNA, 20 nt, Human
aagugcugggauuacaggcg

SEQ ID NO: 293000 - RNA, 32 nt, Human
aagugcugggauuacaggcgcaagccacccag

SEQ ID NO: 293001 - RNA, 32 nt, Human
aagugcugggauuacaggcgcaagccacuaca

SEQ ID NO: 293002 - RNA, 24 nt, Human
aagugcugggauuacaggcgcgag

SEQ ID NO: 293003 - RNA, 32 nt, Human
aagugcugggauuacaggcgcgagccaccaug

SEQ ID NO: 293004 - RNA, 32 nt, Human
aagugcugggauuacaggcgcgagccaccgcg

SEQ ID NO: 293005 - RNA, 32 nt, Human
aagugcugggauuacaggcgcgagccacggcg

SEQ ID NO: 293006 - RNA, 32 nt, Human
aagugcugggauuacaggcggccaggccuauu

SEQ ID NO: 293007 - RNA, 24 nt, Human
aagugcugggauuacaggcgggag

SEQ ID NO: 293008 - RNA, 32 nt, Human
aagugcugggauuacaggcgggagccaccaug

SEQ ID NO: 293009 - RNA, 21 nt, Human
aagugcugggauuacaggcgu

SEQ ID NO: 293010 - RNA, 32 nt, Human
aagugcugggauuacaggcguaagccaccaca

SEQ ID NO: 293011 - RNA, 32 nt, Human
aagugcugggauuacaggcguaagccacugcg

SEQ ID NO: 293012 - RNA, 24 nt, Human
aagugcugggauuacaggcgucag

SEQ ID NO: 293013 - RNA, 32 nt, Human
aagugcugggauuacaggcgucagccaccaug

SEQ ID NO: 293014 - RNA, 32 nt, Human
aagugcugggauuacaggcgucagccaccgcg

SEQ ID NO: 293015 - RNA, 22 nt, Human
aagugcugggauuacaggcgug

SEQ ID NO: 293016 - RNA, 23 nt, Human
aagugcugggauuacaggcguga

SEQ ID NO: 293017 - RNA, 32 nt, Human
aagugcugggauuacaggcgugaaacacugug

SEQ ID NO: 293018 - RNA, 32 nt, Human
aagugcugggauuacaggcgugaaccaccaau

SEQ ID NO: 293019 - RNA, 32 nt, Human
aagugcugggauuacaggcgugaaccacugca

SEQ ID NO: 293020 - RNA, 32 nt, Human
aagugcugggauuacaggcgugaaccacugug

SEQ ID NO: 293021 - RNA, 24 nt, Human
aagugcugggauuacaggcgugag

SEQ ID NO: 293022 - RNA, 32 nt, Human
aagugcugggauuacaggcgugagacacugcg

SEQ ID NO: 293023 - RNA, 32 nt, Human
aagugcugggauuacaggcgugagacaucgcg

SEQ ID NO: 293024 - RNA, 28 nt, Human
aagugcugggauuacaggcgugagccac

SEQ ID NO: 293025 - RNA, 32 nt, Human
aagugcugggauuacaggcgugagccacaaug

SEQ ID NO: 293026 - RNA, 32 nt, Human
aagugcugggauuacaggcgugagccacagcg

SEQ ID NO: 293027 - RNA, 32 nt, Human
aagugcugggauuacaggcgugagccacagug

SEQ ID NO: 293028 - RNA, 32 nt, Human
aagugcugggauuacaggcgugagccaccaca

SEQ ID NO: 293029 - RNA, 32 nt, Human
aagugcugggauuacaggcgugagccaccacc

SEQ ID NO: 293030 - RNA, 32 nt, Human
aagugcugggauuacaggcgugagccaccacg

SEQ ID NO: 293031 - RNA, 32 nt, Human
aagugcugggauuacaggcgugagccaccagc

SEQ ID NO: 293032 - RNA, 32 nt, Human
aagugcugggauuacaggcgugagccaccagg

SEQ ID NO: 293033 - RNA, 32 nt, Human
aagugcugggauuacaggcgugagccaccaua

SEQ ID NO: 293034 - RNA, 32 nt, Human
aagugcugggauuacaggcgugagccaccaug

SEQ ID NO: 293035 - RNA, 32 nt, Human
aagugcugggauuacaggcgugagccaccauu

SEQ ID NO: 293036 - RNA, 32 nt, Human
aagugcugggauuacaggcgugagccacccug

SEQ ID NO: 293037 - RNA, 32 nt, Human
aagugcugggauuacaggcgugagccaccgca

SEQ ID NO: 293038 - RNA, 32 nt, Human
aagugcugggauuacaggcgugagccaccgcc

SEQ ID NO: 293039 - RNA, 32 nt, Human
aagugcugggauuacaggcgugagccaccgcg

SEQ ID NO: 293040 - RNA, 32 nt, Human
aagugcugggauuacaggcgugagccaccgcu

SEQ ID NO: 293041 - RNA, 32 nt, Human
aagugcugggauuacaggcgugagccaccgug

SEQ ID NO: 293042 - RNA, 32 nt, Human
aagugcugggauuacaggcgugagccaccuca

SEQ ID NO: 293043 - RNA, 32 nt, Human
aagugcugggauuacaggcgugagccaccuug

SEQ ID NO: 293044 - RNA, 32 nt, Human
aagugcugggauuacaggcgugagccacggcg

SEQ ID NO: 293045 - RNA, 32 nt, Human
aagugcugggauuacaggcgugagccacuaca

SEQ ID NO: 293046 - RNA, 32 nt, Human
aagugcugggauuacaggcgugagccacucca

SEQ ID NO: 293047 - RNA, 32 nt, Human
aagugcugggauuacaggcgugagccacugag

SEQ ID NO: 293048 - RNA, 32 nt, Human
aagugcugggauuacaggcgugagccacugca

SEQ ID NO: 293049 - RNA, 32 nt, Human
aagugcugggauuacaggcgugagccacugcc

SEQ ID NO: 293050 - RNA, 32 nt, Human
aagugcugggauuacaggcgugagccacugcg

SEQ ID NO: 293051 - RNA, 32 nt, Human
aagugcugggauuacaggcgugagccacugcu

SEQ ID NO: 293052 - RNA, 32 nt, Human
aagugcugggauuacaggcgugagccacuggc

SEQ ID NO: 293053 - RNA, 32 nt, Human
aagugcugggauuacaggcgugagccacuggg

SEQ ID NO: 293054 - RNA, 32 nt, Human
aagugcugggauuacaggcgugagccacugug

SEQ ID NO: 293055 - RNA, 32 nt, Human
aagugcugggauuacaggcgugagccagugug

SEQ ID NO: 293056 - RNA, 32 nt, Human
aagugcugggauuacaggcgugagccaucgcu

SEQ ID NO: 293057 - RNA, 32 nt, Human
aagugcugggauuacaggcgugagccauggcg

SEQ ID NO: 293058 - RNA, 32 nt, Human
aagugcugggauuacaggcgugagccgaucgg

SEQ ID NO: 293059 - RNA, 32 nt, Human
aagugcugggauuacaggcgugagccgccgug

SEQ ID NO: 293060 - RNA, 32 nt, Human
aagugcugggauuacaggcgugagccgcugca

SEQ ID NO: 293061 - RNA, 32 nt, Human
aagugcugggauuacaggcgugagcuaccaag

SEQ ID NO: 293062 - RNA, 32 nt, Human
aagugcugggauuacaggcgugagcuaccacc

SEQ ID NO: 293063 - RNA, 32 nt, Human
aagugcugggauuacaggcgugagcuaccacg

SEQ ID NO: 293064 - RNA, 32 nt, Human
aagugcugggauuacaggcgugagcuaccgca

SEQ ID NO: 293065 - RNA, 32 nt, Human
aagugcugggauuacaggcgugagcuaccgcg

SEQ ID NO: 293066 - RNA, 32 nt, Human
aagugcugggauuacaggcgugagcuagaucu

SEQ ID NO: 293067 - RNA, 32 nt, Human
aagugcugggauuacaggcgugagcugugccu

SEQ ID NO: 293068 - RNA, 32 nt, Human
aagugcugggauuacaggcgugaggcaccgcg

SEQ ID NO: 293069 - RNA, 32 nt, Human
aagugcugggauuacaggcgugaggcaucaca

SEQ ID NO: 293070 - RNA, 32 nt, Human
aagugcugggauuacaggcgugagucacagcc

SEQ ID NO: 293071 - RNA, 32 nt, Human
aagugcugggauuacaggcgugagucaccaca

SEQ ID NO: 293072 - RNA, 32 nt, Human
aagugcugggauuacaggcgugagucaccgcg

SEQ ID NO: 293073 - RNA, 32 nt, Human
aagugcugggauuacaggcgugagucaccgug

SEQ ID NO: 293074 - RNA, 32 nt, Human
aagugcugggauuacaggcgugagucacugca

SEQ ID NO: 293075 - RNA, 32 nt, Human
aagugcugggauuacaggcgugagucacugcg

SEQ ID NO: 293076 - RNA, 32 nt, Human
aagugcugggauuacaggcgugauccaccaca

SEQ ID NO: 293077 - RNA, 32 nt, Human
aagugcugggauuacaggcgugaugcccgggc

SEQ ID NO: 293078 - RNA, 23 nt, Human
aagugcugggauuacaggcgugg

SEQ ID NO: 293079 - RNA, 32 nt, Human
aagugcugggauuacaggcguggccaccgcac

SEQ ID NO: 293080 - RNA, 32 nt, Human
aagugcugggauuacaggcguggccaccgcgc

SEQ ID NO: 293081 - RNA, 24 nt, Human
aagugcugggauuacaggcguggg

SEQ ID NO: 293082 - RNA, 32 nt, Human
aagugcugggauuacaggcgugggccacugcg

SEQ ID NO: 293083 - RNA, 32 nt, Human
aagugcugggauuacaggcgugggccgccgca

SEQ ID NO: 293084 - RNA, 32 nt, Human
aagugcugggauuacaggcgugugagccacca

SEQ ID NO: 293085 - RNA, 32 nt, Human
aagugcugggauuacaggcgugugccaccacc

SEQ ID NO: 293086 - RNA, 24 nt, Human
aagugcugggauuacaggcguuag

SEQ ID NO: 293087 - RNA, 32 nt, Human
aagugcugggauuacaggcguuagccacugcg

SEQ ID NO: 293088 - RNA, 22 nt, Human
aagugcugggauuacaggcugu

SEQ ID NO: 293089 - RNA, 32 nt, Human
aagugcugggauuacaggcuuaagccaccacg

SEQ ID NO: 293090 - RNA, 32 nt, Human
aagugcugggauuacaggcuuacgccaccaca

SEQ ID NO: 293091 - RNA, 32 nt, Human
aagugcugggauuacaggcuucagccaccaca

SEQ ID NO: 293092 - RNA, 23 nt, Human
aagugcugggauuacaggcuuga

SEQ ID NO: 293093 - RNA, 32 nt, Human
aagugcugggauuacaggcuugacccacugcg

SEQ ID NO: 293094 - RNA, 24 nt, Human
aagugcugggauuacaggcuugag

SEQ ID NO: 293095 - RNA, 32 nt, Human
aagugcugggauuacaggcuugagccaccaca

SEQ ID NO: 293096 - RNA, 32 nt, Human
aagugcugggauuacaggcuugagccaccacg

SEQ ID NO: 293097 - RNA, 32 nt, Human
aagugcugggauuacaggcuugagccaccgca

SEQ ID NO: 293098 - RNA, 32 nt, Human
aagugcugggauuacaggcuugagccaccgcg

SEQ ID NO: 293099 - RNA, 32 nt, Human
aagugcugggauuacaggcuugagccaccggg

SEQ ID NO: 293100 - RNA, 32 nt, Human
aagugcugggauuacaggcuugagccaccgug

SEQ ID NO: 293101 - RNA, 32 nt, Human
aagugcugggauuacaggcuugagccacugcu

SEQ ID NO: 293102 - RNA, 32 nt, Human
aagugcugggauuacaggcuugagccacugug

SEQ ID NO: 293103 - RNA, 32 nt, Human
aagugcugggauuacaggcuugagcuaccgcg

SEQ ID NO: 293104 - RNA, 24 nt, Human
aagugcugggauuacaggcuuggg

SEQ ID NO: 293105 - RNA, 32 nt, Human
aagugcugggauuacaggcuugggccaccgcg

SEQ ID NO: 293106 - RNA, 32 nt, Human
aagugcugggauuacagggauaagccaccaca

SEQ ID NO: 293107 - RNA, 24 nt, Human
aagugcugggauuacagggaugag

SEQ ID NO: 293108 - RNA, 32 nt, Human
aagugcugggauuacagggaugagccaccaug

SEQ ID NO: 293109 - RNA, 32 nt, Human
aagugcugggauuacagggaugagccaccgcg

SEQ ID NO: 293110 - RNA, 22 nt, Human
aagugcugggauuacaggggag

SEQ ID NO: 293111 - RNA, 32 nt, Human
aagugcugggauuacaggggagccacugcacu

SEQ ID NO: 293112 - RNA, 24 nt, Human
aagugcugggauuacaggggugag

SEQ ID NO: 293113 - RNA, 32 nt, Human
aagugcugggauuacaggggugagccaccacg

SEQ ID NO: 293114 - RNA, 32 nt, Human
aagugcugggauuacaggggugagccgcugug

SEQ ID NO: 293115 - RNA, 19 nt, Human
aagugcugggauuacaggu

SEQ ID NO: 293116 - RNA, 32 nt, Human
aagugcugggauuacagguacgagucaccaug

SEQ ID NO: 293117 - RNA, 32 nt, Human
aagugcugggauuacagguaucagccaccgug

SEQ ID NO: 293118 - RNA, 24 nt, Human
aagugcugggauuacagguaugag

SEQ ID NO: 293119 - RNA, 32 nt, Human
aagugcugggauuacagguaugagccacaacg

SEQ ID NO: 293120 - RNA, 32 nt, Human
aagugcugggauuacagguaugagccaccacg

SEQ ID NO: 293121 - RNA, 32 nt, Human
aagugcugggauuacagguaugagccaccgca

SEQ ID NO: 293122 - RNA, 20 nt, Human
aagugcugggauuacaggug

SEQ ID NO: 293123 - RNA, 24 nt, Human
aagugcugggauuacaggugcgag

SEQ ID NO: 293124 - RNA, 32 nt, Human
aagugcugggauuacaggugcgagccaccgug

SEQ ID NO: 293125 - RNA, 24 nt, Human
aagugcugggauuacaggugggag

SEQ ID NO: 293126 - RNA, 32 nt, Human
aagugcugggauuacaggugggagccacaaca

SEQ ID NO: 293127 - RNA, 32 nt, Human
aagugcugggauuacaggugggagccaccgca

SEQ ID NO: 293128 - RNA, 32 nt, Human
aagugcugggauuacaggugggagccacuaca

SEQ ID NO: 293129 - RNA, 21 nt, Human
aagugcugggauuacaggugu

SEQ ID NO: 293130 - RNA, 32 nt, Human
aagugcugggauuacagguguaagccaccccg

SEQ ID NO: 293131 - RNA, 32 nt, Human
aagugcugggauuacagguguaagccaccgca

SEQ ID NO: 293132 - RNA, 32 nt, Human
aagugcugggauuacagguguaagccaccgug

SEQ ID NO: 293133 - RNA, 32 nt, Human
aagugcugggauuacagguguaagccacugcg

SEQ ID NO: 293134 - RNA, 32 nt, Human
aagugcugggauuacagguguaagccacugug

SEQ ID NO: 293135 - RNA, 32 nt, Human
aagugcugggauuacagguguaagucacugua

SEQ ID NO: 293136 - RNA, 24 nt, Human
aagugcugggauuacaggugucag

SEQ ID NO: 293137 - RNA, 32 nt, Human
aagugcugggauuacaggugucagccaccacg

SEQ ID NO: 293138 - RNA, 32 nt, Human
aagugcugggauuacaggugucagccaccgca

SEQ ID NO: 293139 - RNA, 32 nt, Human
aagugcugggauuacaggugucagccacuaca

SEQ ID NO: 293140 - RNA, 22 nt, Human
aagugcugggauuacaggugug

SEQ ID NO: 293141 - RNA, 23 nt, Human
aagugcugggauuacagguguga

SEQ ID NO: 293142 - RNA, 32 nt, Human
aagugcugggauuacaggugugaaccaccaca

SEQ ID NO: 293143 - RNA, 32 nt, Human
aagugcugggauuacaggugugaaccacugcg

SEQ ID NO: 293144 - RNA, 32 nt, Human
aagugcugggauuacaggugugacccacugcg

SEQ ID NO: 293145 - RNA, 24 nt, Human
aagugcugggauuacaggugugag

SEQ ID NO: 293146 - RNA, 32 nt, Human
aagugcugggauuacaggugugagcaaccauu

SEQ ID NO: 293147 - RNA, 32 nt, Human
aagugcugggauuacaggugugagcauccagc

SEQ ID NO: 293148 - RNA, 32 nt, Human
aagugcugggauuacaggugugagccacagca

SEQ ID NO: 293149 - RNA, 32 nt, Human
aagugcugggauuacaggugugagccacagcg

SEQ ID NO: 293150 - RNA, 32 nt, Human
aagugcugggauuacaggugugagccacagug

SEQ ID NO: 293151 - RNA, 32 nt, Human
aagugcugggauuacaggugugagccaccaca

SEQ ID NO: 293152 - RNA, 32 nt, Human
aagugcugggauuacaggugugagccaccacg

SEQ ID NO: 293153 - RNA, 32 nt, Human
aagugcugggauuacaggugugagccaccagg

SEQ ID NO: 293154 - RNA, 32 nt, Human
aagugcugggauuacaggugugagccaccaug

SEQ ID NO: 293155 - RNA, 32 nt, Human
aagugcugggauuacaggugugagccaccgca

SEQ ID NO: 293156 - RNA, 32 nt, Human
aagugcugggauuacaggugugagccaccgcg

SEQ ID NO: 293157 - RNA, 32 nt, Human
aagugcugggauuacaggugugagccaccgug

SEQ ID NO: 293158 - RNA, 32 nt, Human
aagugcugggauuacaggugugagccaccucg

SEQ ID NO: 293159 - RNA, 32 nt, Human
aagugcugggauuacaggugugagccacggca

SEQ ID NO: 293160 - RNA, 32 nt, Human
aagugcugggauuacaggugugagccacuaca

SEQ ID NO: 293161 - RNA, 32 nt, Human
aagugcugggauuacaggugugagccacuaua

SEQ ID NO: 293162 - RNA, 32 nt, Human
aagugcugggauuacaggugugagccacuaug

SEQ ID NO: 293163 - RNA, 32 nt, Human
aagugcugggauuacaggugugagccacugag

SEQ ID NO: 293164 - RNA, 32 nt, Human
aagugcugggauuacaggugugagccacugca

SEQ ID NO: 293165 - RNA, 32 nt, Human
aagugcugggauuacaggugugagccacugcc

SEQ ID NO: 293166 - RNA, 32 nt, Human
aagugcugggauuacaggugugagccacugcg

SEQ ID NO: 293167 - RNA, 32 nt, Human
aagugcugggauuacaggugugagccacuggg

SEQ ID NO: 293168 - RNA, 32 nt, Human
aagugcugggauuacaggugugagccacugug

SEQ ID NO: 293169 - RNA, 32 nt, Human
aagugcugggauuacaggugugagccacuuca

SEQ ID NO: 293170 - RNA, 32 nt, Human
aagugcugggauuacaggugugagccaucaca

SEQ ID NO: 293171 - RNA, 32 nt, Human
aagugcugggauuacaggugugagccaucacg

SEQ ID NO: 293172 - RNA, 32 nt, Human
aagugcugggauuacaggugugagccauggca

SEQ ID NO: 293173 - RNA, 32 nt, Human
aagugcugggauuacaggugugagccgccaug

SEQ ID NO: 293174 - RNA, 32 nt, Human
aagugcugggauuacaggugugagccgcugcg

SEQ ID NO: 293175 - RNA, 32 nt, Human
aagugcugggauuacaggugugagccgcuggg

SEQ ID NO: 293176 - RNA, 32 nt, Human
aagugcugggauuacaggugugagccuccaca

SEQ ID NO: 293177 - RNA, 32 nt, Human
aagugcugggauuacaggugugagccuccaug

SEQ ID NO: 293178 - RNA, 32 nt, Human
aagugcugggauuacaggugugagcuaccgca

SEQ ID NO: 293179 - RNA, 32 nt, Human
aagugcugggauuacaggugugagcuaccgcg

SEQ ID NO: 293180 - RNA, 32 nt, Human
aagugcugggauuacaggugugagcuacugug

SEQ ID NO: 293181 - RNA, 32 nt, Human
aagugcugggauuacaggugugagcugccacg

SEQ ID NO: 293182 - RNA, 32 nt, Human
aagugcugggauuacaggugugagcugccgca

SEQ ID NO: 293183 - RNA, 32 nt, Human
aagugcugggauuacaggugugaggcaccgug

SEQ ID NO: 293184 - RNA, 32 nt, Human
aagugcugggauuacaggugugaggcacggug

SEQ ID NO: 293185 - RNA, 32 nt, Human
aagugcugggauuacaggugugagucaccaca

SEQ ID NO: 293186 - RNA, 32 nt, Human
aagugcugggauuacaggugugagucaccccg

SEQ ID NO: 293187 - RNA, 32 nt, Human
aagugcugggauuacaggugugagucaccgcg

SEQ ID NO: 293188 - RNA, 32 nt, Human
aagugcugggauuacaggugugagucaccgug

SEQ ID NO: 293189 - RNA, 32 nt, Human
aagugcugggauuacaggugugagucacugca

SEQ ID NO: 293190 - RNA, 32 nt, Human
aagugcugggauuacaggugugccaccgcgcc

SEQ ID NO: 293191 - RNA, 32 nt, Human
aagugcugggauuacaggugugcgccaccaug

SEQ ID NO: 293192 - RNA, 32 nt, Human
aagugcugggauuacagguguggccaccgcgc

SEQ ID NO: 293193 - RNA, 24 nt, Human
aagugcugggauuacagguguggg

SEQ ID NO: 293194 - RNA, 32 nt, Human
aagugcugggauuacaggugugggagccacca

SEQ ID NO: 293195 - RNA, 32 nt, Human
aagugcugggauuacagguguuccugauccaa

SEQ ID NO: 293196 - RNA, 32 nt, Human
aagugcugggauuacagguuugagccacugca

SEQ ID NO: 293197 - RNA, 24 nt, Human
aagugcugggauuacagucaugag

SEQ ID NO: 293198 - RNA, 32 nt, Human
aagugcugggauuacagucaugagccaccacu

SEQ ID NO: 293199 - RNA, 32 nt, Human
aagugcugggauuacagucaugagccaccaug

SEQ ID NO: 293200 - RNA, 32 nt, Human
aagugcugggauuacagucaugagucaccaug

SEQ ID NO: 293201 - RNA, 24 nt, Human
aagugcugggauuacagucgugag

SEQ ID NO: 293202 - RNA, 32 nt, Human
aagugcugggauuacagucgugagccacugua

SEQ ID NO: 293203 - RNA, 32 nt, Human
aagugcugggauuacagucuccgguaugucau

SEQ ID NO: 293204 - RNA, 32 nt, Human
aagugcugggauuacaguugcgagccaccgcg

SEQ ID NO: 293205 - RNA, 24 nt, Human
aagugcugggauuacaguugugag

SEQ ID NO: 293206 - RNA, 32 nt, Human
aagugcugggauuacaguugugagucacugug

SEQ ID NO: 293207 - RNA, 24 nt, Human
aagugcugggauuacaugcgugag

SEQ ID NO: 293208 - RNA, 24 nt, Human
aagugcugggauuaccggcaugag

SEQ ID NO: 293209 - RNA, 24 nt, Human
aagugcugggauuaccggcuugag

SEQ ID NO: 293210 - RNA, 23 nt, Human
aagugcugggauuaccgguauga

SEQ ID NO: 293211 - RNA, 24 nt, Human
aagugcugggauuacgagcgugag

SEQ ID NO: 293212 - RNA, 24 nt, Human
aagugcugggauuacggacgugag

SEQ ID NO: 293213 - RNA, 24 nt, Human
aagugcugggauuacgggcaugag

SEQ ID NO: 293214 - RNA, 24 nt, Human
aagugcugggauuacgggcgugag

SEQ ID NO: 293215 - RNA, 22 nt, Human
aagugcugggauuacuagacgu

SEQ ID NO: 293216 - RNA, 32 nt, Human
aagugcugggauuacuggcaggaaccaccagg

SEQ ID NO: 293217 - RNA, 24 nt, Human
aagugcugggauuacuggcaugag

SEQ ID NO: 293218 - RNA, 24 nt, Human
aagugcugggauuacuggcgugag

SEQ ID NO: 293219 - RNA, 24 nt, Human
aagugcugggauuagaagcgugag

SEQ ID NO: 293220 - RNA, 24 nt, Human
aagugcugggauuagaggcaugag

SEQ ID NO: 293221 - RNA, 24 nt, Human
aagugcugggauuagaggcgugag

SEQ ID NO: 293222 - RNA, 24 nt, Human
aagugcugggauuagaggcuugag

SEQ ID NO: 293223 - RNA, 21 nt, Human
aagugcugggauuaggcauga

SEQ ID NO: 293224 - RNA, 22 nt, Human
aagugcugggauuaggugugag

SEQ ID NO: 293225 - RNA, 22 nt, Human
aagugcugggauuauacguaug

SEQ ID NO: 293226 - RNA, 24 nt, Human
aagugcugggauuauagacaugag

SEQ ID NO: 293227 - RNA, 24 nt, Human
aagugcugggauuauagaugugag

SEQ ID NO: 293228 - RNA, 24 nt, Human
aagugcugggauuauagcugugag

SEQ ID NO: 293229 - RNA, 19 nt, Human
aagugcugggauuauaggc

SEQ ID NO: 293230 - RNA, 21 nt, Human
aagugcugggauuauaggcau

SEQ ID NO: 293231 - RNA, 23 nt, Human
aagugcugggauuauaggcauga

SEQ ID NO: 293232 - RNA, 24 nt, Human
aagugcugggauuauaggcaugag

SEQ ID NO: 293233 - RNA, 24 nt, Human
aagugcugggauuauaggccugag

SEQ ID NO: 293234 - RNA, 21 nt, Human
aagugcugggauuauaggcgu

SEQ ID NO: 293235 - RNA, 22 nt, Human
aagugcugggauuauaggcgug

SEQ ID NO: 293236 - RNA, 24 nt, Human
aagugcugggauuauaggcgugag

SEQ ID NO: 293237 - RNA, 24 nt, Human
aagugcugggauuauaggugugag

SEQ ID NO: 293238 - RNA, 28 nt, Human
aagugcugggauuaugggcgggugugag

SEQ ID NO: 293239 - RNA, 24 nt, Human
aagugcugggauuaugggcgugag

SEQ ID NO: 293240 - RNA, 23 nt, Human
aagugcugggauucaggugugag

SEQ ID NO: 293241 - RNA, 32 nt, Human
aagugcugggauucaggugugagccacugugc

SEQ ID NO: 293242 - RNA, 24 nt, Human
aagugcugggauuccagaugcgag

SEQ ID NO: 293243 - RNA, 32 nt, Human
aagugcugggauuccagaugcgagccaccgca

SEQ ID NO: 293244 - RNA, 24 nt, Human
aagugcugggauuccaggugugag

SEQ ID NO: 293245 - RNA, 32 nt, Human
aagugcugggauuccaggugugagccgcugcg

SEQ ID NO: 293246 - RNA, 24 nt, Human
aagugcugggauucugggugugag

SEQ ID NO: 293247 - RNA, 23 nt, Human
aagugcugggauugcagcgugag

SEQ ID NO: 293248 - RNA, 19 nt, Human
aagugcugggauugcaggc

SEQ ID NO: 293249 - RNA, 24 nt, Human
aagugcugggauugcaggcaugag

SEQ ID NO: 293250 - RNA, 24 nt, Human
aagugcugggauugcaggcgugag

SEQ ID NO: 293251 - RNA, 24 nt, Human
aagugcugggauugcaggggugag

SEQ ID NO: 293252 - RNA, 24 nt, Human
aagugcugggauugcaggugcgag

SEQ ID NO: 293253 - RNA, 32 nt, Human
aagugcugggauugcaggugcgagccaccggg

SEQ ID NO: 293254 - RNA, 23 nt, Human
aagugcugggauugcagguguga

SEQ ID NO: 293255 - RNA, 24 nt, Human
aagugcugggauugcaggugugag

SEQ ID NO: 293256 - RNA, 24 nt, Human
aagugcugggauugugggcaugag

SEQ ID NO: 293257 - RNA, 32 nt, Human
aagugcugggcuguggucgugcccugacagca

SEQ ID NO: 293258 - RNA, 24 nt, Human
aagugcugggcuuacaggccugag

SEQ ID NO: 293259 - RNA, 25 nt, Human
aagugcugggggcuacaggugugag

SEQ ID NO: 293260 - RNA, 24 nt, Human
aagugcugggguuacaggugugag

SEQ ID NO: 293261 - RNA, 32 nt, Human
aagugcugggguuacaggugugagccacugca

SEQ ID NO: 293262 - RNA, 32 nt, Human
aagugcugggguuacaggugugagccacugcg

SEQ ID NO: 293263 - RNA, 24 nt, Human
aagugcugggguuacagucaugag

SEQ ID NO: 293264 - RNA, 24 nt, Human
aagugcuggguuaacaggcaugag

SEQ ID NO: 293265 - RNA, 32 nt, Human
aagugcuggguuacaagcgugagccaccgugc

SEQ ID NO: 293266 - RNA, 24 nt, Human
aagugcuggguuuacaggcaugag

SEQ ID NO: 293267 - RNA, 24 nt, Human
aagugcuggguuuaccagcgugag

SEQ ID NO: 293268 - RNA, 23 nt, Human
aagugcugguauuacagauauga

SEQ ID NO: 293269 - RNA, 24 nt, Human
aagugcugguauuacagaugugag

SEQ ID NO: 293270 - RNA, 24 nt, Human
aagugcugguauuacaggcgugag

SEQ ID NO: 293271 - RNA, 22 nt, Human
aagugcuggugccaggccugag

SEQ ID NO: 293272 - RNA, 24 nt, Human
aagugcuguaauuacaggcaugag

SEQ ID NO: 293273 - RNA, 32 nt, Human
aagugcugugauuacagaugugagccacugca

SEQ ID NO: 293274 - RNA, 32 nt, Human
aagugcugugauuacaggccucagccaccaug

SEQ ID NO: 293275 - RNA, 32 nt, Human
aagugcugugauuacagggugugagccacugc

SEQ ID NO: 293276 - RNA, 23 nt, Human
aagugcugugauuacagguguga

SEQ ID NO: 293277 - RNA, 32 nt, Human
aagugcugugauuacaggugugaaccaccaug

SEQ ID NO: 293278 - RNA, 24 nt, Human
aagugcugugauuacaggugugag

SEQ ID NO: 293279 - RNA, 32 nt, Human
aagugcugugauuacaggugugagccacugca

SEQ ID NO: 293280 - RNA, 24 nt, Human
aagugcugugcauacaggcaugag

SEQ ID NO: 293281 - RNA, 32 nt, Human
aagugcuucaaaaggaagaguuguaggaccuu

SEQ ID NO: 293282 - RNA, 32 nt, Human
aagugcuucccugaugagcuguccucucugca

SEQ ID NO: 293283 - RNA, 32 nt, Human
aagugcuucccuuaagcuucugaagguuggcu

SEQ ID NO: 293284 - RNA, 32 nt, Human
aagugcuucgagcucaucaugagaugccaacg

SEQ ID NO: 293285 - RNA, 32 nt, Human
aagugcuucuaagucagaacagguucuccaag

SEQ ID NO: 293286 - RNA, 32 nt, Human
aagugcuucucccaccucagccucccaaguag

SEQ ID NO: 293287 - RNA, 32 nt, Human
aagugcuucucccuucuccaugaugugacuuc

SEQ ID NO: 293288 - RNA, 24 nt, Human
aagugcuugaauuacaggcgugag

SEQ ID NO: 293289 - RNA, 32 nt, Human
aagugcuugaauuuccuuuucauggaaccacc

SEQ ID NO: 293290 - RNA, 32 nt, Human
aagugcuuggaugacaggugcgagccacugca

SEQ ID NO: 293291 - RNA, 24 nt, Human
aagugcuuggauuacaggcaugag

SEQ ID NO: 293292 - RNA, 32 nt, Human
aagugcuuggauuacaggcaugagccaccgca

SEQ ID NO: 293293 - RNA, 21 nt, Human
aagugcuuggauuacaggugu

SEQ ID NO: 293294 - RNA, 32 nt, Human
aagugcuuggauuacagguguaagccaccgca

SEQ ID NO: 293295 - RNA, 24 nt, Human
aagugcuuggauuacaggugugag

SEQ ID NO: 293296 - RNA, 32 nt, Human
aagugcuuggauuacaggugugagccacugug

SEQ ID NO: 293297 - RNA, 32 nt, Human
aagugcuugguugggguggugagaugaugauu

SEQ ID NO: 293298 - RNA, 32 nt, Human
aagugcuuuacaugaugaugugaaaagcuguu

SEQ ID NO: 293299 - RNA, 32 nt, Human
aaguggaaacaugcugaaaucuauuaaaccau

SEQ ID NO: 293300 - RNA, 32 nt, Human
aaguggaaacuauucuaucauaacuacccaag

SEQ ID NO: 293301 - RNA, 32 nt, Human
aaguggaacuccccucuccacugauggcuggg

SEQ ID NO: 293302 - RNA, 32 nt, Human
aaguggaagcaacuaauucuggugcucaggcu

SEQ ID NO: 293303 - RNA, 32 nt, Human
aaguggaagcuauucuaucauaacuacccaag

SEQ ID NO: 293304 - RNA, 22 nt, Human
aaguggaauagugugcuaguua

SEQ ID NO: 293305 - RNA, 32 nt, Human
aaguggaaugugguugaagaaagugggccagg

SEQ ID NO: 293306 - RNA, 32 nt, Human
aaguggaauugcaacauauuucucagaaagau

SEQ ID NO: 293307 - RNA, 32 nt, Human
aaguggacagaggacuaaaaugaccaggcucu

SEQ ID NO: 293308 - RNA, 32 nt, Human
aaguggaccugugucugugucuguccugagaa

SEQ ID NO: 293309 - RNA, 32 nt, Human
aaguggaccuuuucuuucuucuugucccacgg

SEQ ID NO: 293310 - RNA, 31 nt, Human
aaguggacgauagaagaaaaagagcuguuug

SEQ ID NO: 293311 - RNA, 32 nt, Human
aaguggacuguucucaggcuugaccugcccca

SEQ ID NO: 293312 - RNA, 32 nt, Human
aaguggacuuugcaggaugcaacccuggugag

SEQ ID NO: 293313 - RNA, 32 nt, Human
aaguggagaaccugaaaaggaaccuggaaaga

SEQ ID NO: 293314 - RNA, 32 nt, Human
aaguggagagugacaugcaguuggauggcggu

SEQ ID NO: 293315 - RNA, 32 nt, Human
aaguggagaucugaauuuggagaggacauggg

SEQ ID NO: 293316 - RNA, 32 nt, Human
aaguggagccaucaucacaggguacgaaggga

SEQ ID NO: 293317 - RNA, 32 nt, Human
aaguggagcuaggaugggaggcguagccaacu

SEQ ID NO: 293318 - RNA, 32 nt, Human
aaguggaggaggaggaggagaaggaggagggc

SEQ ID NO: 293319 - RNA, 32 nt, Human
aaguggaggcugucugcauccaccuccccagc

SEQ ID NO: 293320 - RNA, 32 nt, Human
aaguggaguuuucaugaguuauaguaaauccc

SEQ ID NO: 293321 - RNA, 32 nt, Human
aaguggauaauagcguucagcagcacucaccu

SEQ ID NO: 293322 - RNA, 32 nt, Human
aaguggaucuuucugcaguggauccuugagau

SEQ ID NO: 293323 - RNA, 32 nt, Human
aaguggaugaagcacacacaucagcagcucag

SEQ ID NO: 293324 - RNA, 32 nt, Human
aaguggauggaaaugcugggagaaugggagac

SEQ ID NO: 293325 - RNA, 32 nt, Human
aaguggauuagaagcccagggaagaaagaacc

SEQ ID NO: 293326 - RNA, 32 nt, Human
aaguggauucacaagagauagaaacaaucaua

SEQ ID NO: 293327 - RNA, 32 nt, Human
aaguggauucgaguggaaggcgccaagucucc

SEQ ID NO: 293328 - RNA, 32 nt, Human
aaguggauuugcaggccagggagaaaaugucc

SEQ ID NO: 293329 - RNA, 32 nt, Human
aaguggcaaaggacacagcuagcaacgggcug

SEQ ID NO: 293330 - RNA, 32 nt, Human
aaguggcacguccuggagcugcagaggcgaac

SEQ ID NO: 293331 - RNA, 32 nt, Human
aaguggcagagccaggacuggagcuuagcccu

SEQ ID NO: 293332 - RNA, 32 nt, Human
aaguggcagccaucaguugcucuugcugaccc

SEQ ID NO: 293333 - RNA, 32 nt, Human
aaguggcagccuggccccugcugccggaccug

SEQ ID NO: 293334 - RNA, 32 nt, Human
aaguggcaggagcugagaaugccaguacgaga

SEQ ID NO: 293335 - RNA, 32 nt, Human
aaguggcagggggcggcugcagcugcugccuc

SEQ ID NO: 293336 - RNA, 32 nt, Human
aaguggcaguggcagagaauccaaacucaaca

SEQ ID NO: 293337 - RNA, 32 nt, Human
aaguggcaucuucucucccaccgggucuacac

SEQ ID NO: 293338 - RNA, 32 nt, Human
aaguggcauguuuuuguagcuuuuggaacaug

SEQ ID NO: 293339 - RNA, 32 nt, Human
aaguggccaccugaaaugacaacccugcuauc

SEQ ID NO: 293340 - RNA, 32 nt, Human
aaguggccagaagacaagagugugagccuucu

SEQ ID NO: 293341 - RNA, 32 nt, Human
aaguggccagggguguccuuccuccugggcaa

SEQ ID NO: 293342 - RNA, 32 nt, Human
aaguggccccagccaucuccucuagaccaagg

SEQ ID NO: 293343 - RNA, 32 nt, Human
aaguggccccuguucccaucucccgggccaga

SEQ ID NO: 293344 - RNA, 32 nt, Human
aaguggccuaucuaaaauucacagcccuuuua

SEQ ID NO: 293345 - RNA, 32 nt, Human
aaguggccugcaggggccacucucuacuggua

SEQ ID NO: 293346 - RNA, 32 nt, Human
aaguggccuguuggguggaggguggaaggucc

SEQ ID NO: 293347 - RNA, 31 nt, Human
aaguggcgaugauaguaccuaccucacucug

SEQ ID NO: 293348 - RNA, 32 nt, Human
aaguggcucuccccauuaccuucucaagaccu

SEQ ID NO: 293349 - RNA, 32 nt, Human
aaguggcugaguaaacagcgucagguggccuc

SEQ ID NO: 293350 - RNA, 32 nt, Human
aaguggcugcauggccauccuccagggcccag

SEQ ID NO: 293351 - RNA, 32 nt, Human
aaguggcuggaaggaccacagcuuuggaacug

SEQ ID NO: 293352 - RNA, 32 nt, Human
aaguggcuggcucauuuaagaugaggcuucug

SEQ ID NO: 293353 - RNA, 32 nt, Human
aaguggcuggcucugcagagugauggacagca

SEQ ID NO: 293354 - RNA, 19 nt, Human
aaguggcugggacugcagg

SEQ ID NO: 293355 - RNA, 21 nt, Human
aaguggcugggauuacaggcg

SEQ ID NO: 293356 - RNA, 25 nt, Human
aaguggcugggauugcaggcaugag

SEQ ID NO: 293357 - RNA, 32 nt, Human
aaguggcuguaucaguucaucgucccacaagc

SEQ ID NO: 293358 - RNA, 32 nt, Human
aaguggcuuaagggaagagucagucuauguuc

SEQ ID NO: 293359 - RNA, 32 nt, Human
aaguggcuucagagaugcagcccucagugcuu

SEQ ID NO: 293360 - RNA, 32 nt, Human
aaguggcuucucugugaauugccuguaacaca

SEQ ID NO: 293361 - RNA, 32 nt, Human
aaguggcuuguugagccagguacuuccuuagu

SEQ ID NO: 293362 - RNA, 32 nt, Human
aagugggaagagugagccaggcaagaaagaaa

SEQ ID NO: 293363 - RNA, 32 nt, Human
aagugggaagguuuugggggagggggaaauac

SEQ ID NO: 293364 - RNA, 32 nt, Human
aagugggacacugguuuuaccuccaggaaaca

SEQ ID NO: 293365 - RNA, 32 nt, Human
aagugggacuacaggcacgugccaccauacuc

SEQ ID NO: 293366 - RNA, 32 nt, Human
aagugggagagauaggaggagggaaugacaga

SEQ ID NO: 293367 - RNA, 32 nt, Human
aagugggagaggacugagagugaggcaaguuc

SEQ ID NO: 293368 - RNA, 32 nt, Human
aagugggagcacuaagggguggguggggaagu

SEQ ID NO: 293369 - RNA, 32 nt, Human
aagugggagcuucucccuuccuuccaucuucc

SEQ ID NO: 293370 - RNA, 32 nt, Human
aagugggaggaucgcuugagccugggaguuca

SEQ ID NO: 293371 - RNA, 32 nt, Human
aagugggagggagggggugacaagcacagccc

SEQ ID NO: 293372 - RNA, 32 nt, Human
aagugggagggaugugaugcuggagaaggcua

SEQ ID NO: 293373 - RNA, 32 nt, Human
aagugggaguuauauaauuggagagaaacaga

SEQ ID NO: 293374 - RNA, 32 nt, Human
aagugggaugauuagauauacacaacaccaag

SEQ ID NO: 293375 - RNA, 32 nt, Human
aagugggauuacaggcaccugucaccacgccu

SEQ ID NO: 293376 - RNA, 32 nt, Human
aagugggcaggagucggcaugugcccaucaga

SEQ ID NO: 293377 - RNA, 32 nt, Human
aagugggccagccuugcaccagccaggccaga

SEQ ID NO: 293378 - RNA, 32 nt, Human
aagugggcggcggagccagggucccuggaaug

SEQ ID NO: 293379 - RNA, 32 nt, Human
aagugggcugagaggugaaggaagaggaugag

SEQ ID NO: 293380 - RNA, 32 nt, Human
aagugggcugccgccgccucucuugggaccug

SEQ ID NO: 293381 - RNA, 32 nt, Human
aagugggcuggacuucagcugccuuucuaccc

SEQ ID NO: 293382 - RNA, 32 nt, Human
aaguggggaacucggaaggcugggcaguggag

SEQ ID NO: 293383 - RNA, 32 nt, Human
aaguggggaagcugggcagagagcagaggggg

SEQ ID NO: 293384 - RNA, 32 nt, Human
aaguggggacuggcccugguaccuggcuccag

SEQ ID NO: 293385 - RNA, 31 nt, Human
aaguggggacuucucccuacuugauuaaaga

SEQ ID NO: 293386 - RNA, 32 nt, Human
aaguggggagagugagccaggugagaaagaaa

SEQ ID NO: 293387 - RNA, 32 nt, Human
aaguggggaugagggagcagagucuagggcag

SEQ ID NO: 293388 - RNA, 32 nt, Human
aaguggggcagcagcaguggagagaugggaca

SEQ ID NO: 293389 - RNA, 32 nt, Human
aaguggggccuggauugugggccuugaacaug

SEQ ID NO: 293390 - RNA, 32 nt, Human
aaguggggcugggaccuggugggugaaccuga

SEQ ID NO: 293391 - RNA, 32 nt, Human
aagugggggaaucuuccugugcuucaaagagg

SEQ ID NO: 293392 - RNA, 32 nt, Human
aagugggggugaggagccugcggugcucccca

SEQ ID NO: 293393 - RNA, 32 nt, Human
aagugggggugagggccaaggggcuauuacug

SEQ ID NO: 293394 - RNA, 32 nt, Human
aagugggguguggucucucagcuguucugccc

SEQ ID NO: 293395 - RNA, 32 nt, Human
aaguggguccuuauguacacaccacguucaca

SEQ ID NO: 293396 - RNA, 32 nt, Human
aagugggucugagaacagucccugcccccaag

SEQ ID NO: 293397 - RNA, 22 nt, Human
aagugggugaaucaccugaggu

SEQ ID NO: 293398 - RNA, 32 nt, Human
aaguggguguccggggagagccuggccugcca

SEQ ID NO: 293399 - RNA, 32 nt, Human
aaguggguguuggccaggcacaucccaucuca

SEQ ID NO: 293400 - RNA, 32 nt, Human
aaguggguuccccaggcuuagagcaaaacccc

SEQ ID NO: 293401 - RNA, 32 nt, Human
aaguggguuuacuugaacuugaaggaaagaaa

SEQ ID NO: 293402 - RNA, 32 nt, Human
aaguggguuuaugucaccuucucaccuucuua

SEQ ID NO: 293403 - RNA, 32 nt, Human
aaguggguuuucuggauucaguagaacucggg

SEQ ID NO: 293404 - RNA, 32 nt, Human
aagugguacaaagacaacgcugagggguagug

SEQ ID NO: 293405 - RNA, 32 nt, Human
aagugguagcuggugugauaggugggccaagu

SEQ ID NO: 293406 - RNA, 32 nt, Human
aagugguaggauuacaggcgugagccacugca

SEQ ID NO: 293407 - RNA, 32 nt, Human
aagugguagguggccagcccuaccuccaaguu

SEQ ID NO: 293408 - RNA, 32 nt, Human
aagugguauuagccuagaauaucuaggaccca

SEQ ID NO: 293409 - RNA, 32 nt, Human
aagugguccaggaguccaaguaagcagucugg

SEQ ID NO: 293410 - RNA, 32 nt, Human
aagugguccaguuuuauaaauggucuuuauuu

SEQ ID NO: 293411 - RNA, 32 nt, Human
aaguggucccuuagggcugaaggacuucagac

SEQ ID NO: 293412 - RNA, 32 nt, Human
aaguggucuguacugcuuucauccuugccacu

SEQ ID NO: 293413 - RNA, 32 nt, Human
aaguggugaaaaguacaucccaccucauguga

SEQ ID NO: 293414 - RNA, 32 nt, Human
aaguggugaucuguuacagucacuauucaacu

SEQ ID NO: 293415 - RNA, 24 nt, Human
aaguggugggaucacaggcgugag

SEQ ID NO: 293416 - RNA, 24 nt, Human
aaguggugggauuacaagcaugag

SEQ ID NO: 293417 - RNA, 32 nt, Human
aaguggugggauuacagacgugagccacugca

SEQ ID NO: 293418 - RNA, 24 nt, Human
aaguggugggauuacaggugugag

SEQ ID NO: 293419 - RNA, 32 nt, Human
aaguggugggauuacaggugugagccaccgcg

SEQ ID NO: 293420 - RNA, 32 nt, Human
aaguggugggcgauccacugagcaaagccgaa

SEQ ID NO: 293421 - RNA, 32 nt, Human
aaguggugucugccagauuuccccgcuguaaa

SEQ ID NO: 293422 - RNA, 32 nt, Human
aaguggugugguggaggaggauaaaaagggcc

SEQ ID NO: 293423 - RNA, 32 nt, Human
aagugguuacuaggcagcuugcagugauuucu

SEQ ID NO: 293424 - RNA, 32 nt, Human
aagugguucuuagauggugaucugggauuagg

SEQ ID NO: 293425 - RNA, 31 nt, Human
aagugguucuuagcaaagguuggaggugucu

SEQ ID NO: 293426 - RNA, 32 nt, Human
aagugguugaaggaagcaaauaauggaauugu

SEQ ID NO: 293427 - RNA, 32 nt, Human
aagugguugccuggacaccccacgggaggagu

SEQ ID NO: 293428 - RNA, 32 nt, Human
aagugguuuggaggggauugggggauaguggg

SEQ ID NO: 293429 - RNA, 32 nt, Human
aagugguuuuuccaaaucgcacaauggcaaag

SEQ ID NO: 293430 - RNA, 32 nt, Human
aaguguaacuguccuuccucugugccaggaaa

SEQ ID NO: 293431 - RNA, 32 nt, Human
aaguguacacacacagagccacaccgucccuc

SEQ ID NO: 293432 - RNA, 32 nt, Human
aaguguaccuucaccugcuccagugaugagag

SEQ ID NO: 293433 - RNA, 32 nt, Human
aaguguagaagagggagagagaagcaggagag

SEQ ID NO: 293434 - RNA, 32 nt, Human
aaguguagccccggagagguaacugaggacau

SEQ ID NO: 293435 - RNA, 32 nt, Human
aaguguaggauagaauuguuuuuagcauucua

SEQ ID NO: 293436 - RNA, 32 nt, Human
aaguguagggauuacaggcgugagccacugug

SEQ ID NO: 293437 - RNA, 32 nt, Human
aaguguaguccccaaaaacagguggaagaggg

SEQ ID NO: 293438 - RNA, 32 nt, Human
aaguguagucuacaaaccuccuauaccagaau

SEQ ID NO: 293439 - RNA, 32 nt, Human
aaguguauguaacuugcuuuaaauccauuaug

SEQ ID NO: 293440 - RNA, 32 nt, Human
aaguguaugugaccaucauuucccaggccauu

SEQ ID NO: 293441 - RNA, 32 nt, Human
aagugucaacucccagugaaagaaugaugaac

SEQ ID NO: 293442 - RNA, 32 nt, Human
aagugucacucuuccuccuuuucuacuuucag

SEQ ID NO: 293443 - RNA, 32 nt, Human
aagugucagcucauuguuuucgucucccacuu

SEQ ID NO: 293444 - RNA, 32 nt, Human
aagugucaggagauguuccuccccuccacaau

SEQ ID NO: 293445 - RNA, 32 nt, Human
aagugucaucuaugacaaaaccacagccaaca

SEQ ID NO: 293446 - RNA, 32 nt, Human
aagugucaucuucugcccucccugucccaaua

SEQ ID NO: 293447 - RNA, 32 nt, Human
aaguguccaccaggggugguuugggggcgcuc

SEQ ID NO: 293448 - RNA, 32 nt, Human
aaguguccagaagaaggccauggacagaacgg

SEQ ID NO: 293449 - RNA, 32 nt, Human
aaguguccccaucucacugccaaaaaugaaag

SEQ ID NO: 293450 - RNA, 32 nt, Human
aagugucccuuucccuuuugccuggauuucca

SEQ ID NO: 293451 - RNA, 32 nt, Human
aagugucccuuuccuauguaugcauuuccuuu

SEQ ID NO: 293452 - RNA, 32 nt, Human
aaguguccugcaggcuguaaugcaguuuaauc

SEQ ID NO: 293453 - RNA, 32 nt, Human
aagugucggucaaacugugacacugccacacc

SEQ ID NO: 293454 - RNA, 32 nt, Human
aagugucuagcacauacuacaucuaagaggcu

SEQ ID NO: 293455 - RNA, 32 nt, Human
aagugucuauaagcucaucacagccuagaguu

SEQ ID NO: 293456 - RNA, 31 nt, Human
aagugucucaauaaaaucuuaaaugaauaaa

SEQ ID NO: 293457 - RNA, 32 nt, Human
aagugucugagagugugacccucuccuguaaa

SEQ ID NO: 293458 - RNA, 32 nt, Human
aagugucugagccugugaauccagagcucagu

SEQ ID NO: 293459 - RNA, 32 nt, Human
aagugucugcagauggcacugccugggcacca

SEQ ID NO: 293460 - RNA, 20 nt, Human
aagugucugggauuacaggc

SEQ ID NO: 293461 - RNA, 22 nt, Human
aagugucugggauuacaggcau

SEQ ID NO: 293462 - RNA, 32 nt, Human
aagugucuggugucuugucacugccuugcaua

SEQ ID NO: 293463 - RNA, 32 nt, Human
aagugucuuaguucauucaggcugccauaaca

SEQ ID NO: 293464 - RNA, 32 nt, Human
aagugugaacccaggaggcggagcuugcagug

SEQ ID NO: 293465 - RNA, 32 nt, Human
aagugugaaggugaaugagguaagggagauca

SEQ ID NO: 293466 - RNA, 32 nt, Human
aagugugacaguuccagcggaucagagggaga

SEQ ID NO: 293467 - RNA, 32 nt, Human
aagugugacugagcagugugcagagagugugg

SEQ ID NO: 293468 - RNA, 31 nt, Human
aagugugagaccagcccagccaacauggucc

SEQ ID NO: 293469 - RNA, 32 nt, Human
aagugugagaggacgagagggagguggcuccc

SEQ ID NO: 293470 - RNA, 32 nt, Human
aagugugauaaauaaacuuacagacacugaau

SEQ ID NO: 293471 - RNA, 32 nt, Human
aagugugauaaauauuuuuaaauaaaaacuua

SEQ ID NO: 293472 - RNA, 32 nt, Human
aagugugccagccucuuugcuggucucccugc

SEQ ID NO: 293473 - RNA, 32 nt, Human
aagugugccuggcuaauuuuuauguuuuuagu

SEQ ID NO: 293474 - RNA, 32 nt, Human
aagugugccuggcugguuugcagauauuuguu

SEQ ID NO: 293475 - RNA, 32 nt, Human
aaguguggaccauggcgggaccccaaggacac

SEQ ID NO: 293476 - RNA, 32 nt, Human
aaguguggauccuuuggguggcagucagggga

SEQ ID NO: 293477 - RNA, 32 nt, Human
aaguguggccacuuccucuugccuguccugac

SEQ ID NO: 293478 - RNA, 32 nt, Human
aaguguggcccacagaccaagagccucaacau

SEQ ID NO: 293479 - RNA, 32 nt, Human
aaguguggcuguaggccuuuguuuuccaaugg

SEQ ID NO: 293480 - RNA, 32 nt, Human
aagugugggaaaugcugcuuuucaucaagucc

SEQ ID NO: 293481 - RNA, 32 nt, Human
aagugugggauuauagugugagccaccgcguc

SEQ ID NO: 293482 - RNA, 32 nt, Human
aagugugggcagaagcagugaagguucuucuc

SEQ ID NO: 293483 - RNA, 32 nt, Human
aaguguggggauggagaggauggugcauuucc

SEQ ID NO: 293484 - RNA, 24 nt, Human
aaguguggggauuacaggugcgag

SEQ ID NO: 293485 - RNA, 32 nt, Human
aaguguggggauuacaggugcgagcuacugcu

SEQ ID NO: 293486 - RNA, 32 nt, Human
aagugugggggaaagggugguuucuugcugga

SEQ ID NO: 293487 - RNA, 32 nt, Human
aagugugguagagugugccugaagucccagau

SEQ ID NO: 293488 - RNA, 32 nt, Human
aagugugguagauacagugaaauucuguacag

SEQ ID NO: 293489 - RNA, 32 nt, Human
aaguguggugcaagccgggggucuccacaucu

SEQ ID NO: 293490 - RNA, 32 nt, Human
aagugugguguuugguuugccuggagaugcca

SEQ ID NO: 293491 - RNA, 32 nt, Human
aagugugguuuuccuaacugucugacuuauaa

SEQ ID NO: 293492 - RNA, 32 nt, Human
aagugugucaacuccauuguuguccucaaugg

SEQ ID NO: 293493 - RNA, 23 nt, Human
aaguguguggaucucaaagggug

SEQ ID NO: 293494 - RNA, 32 nt, Human
aaguguguggcagaagaauuagucaaagaaau

SEQ ID NO: 293495 - RNA, 25 nt, Human
aaguguguggcugggcggauucagc

SEQ ID NO: 293496 - RNA, 20 nt, Human
aaguguguggucccaaguug

SEQ ID NO: 293497 - RNA, 32 nt, Human
aaguguuaaacgacugaaauauacaaacaguc

SEQ ID NO: 293498 - RNA, 32 nt, Human
aaguguuaaggagaacaaaaauucaguauuau

SEQ ID NO: 293499 - RNA, 32 nt, Human
aaguguuacuggugccuggaacugaggggagu

SEQ ID NO: 293500 - RNA, 24 nt, Human
aaguguuaggauuacaggcaugag

SEQ ID NO: 293501 - RNA, 24 nt, Human
aaguguuaggauuacaggcgugag

SEQ ID NO: 293502 - RNA, 32 nt, Human
aaguguuaggauuacaggcgugagccaccgcg

SEQ ID NO: 293503 - RNA, 24 nt, Human
aaguguuaggauuauaggcgugag

SEQ ID NO: 293504 - RNA, 32 nt, Human
aaguguuaguagcugggauuacaaaagcaugu

SEQ ID NO: 293505 - RNA, 32 nt, Human
aaguguuaguccuuccugauuggaagccuucu

SEQ ID NO: 293506 - RNA, 32 nt, Human
aaguguuaugaacaucugauugguauuuguca

SEQ ID NO: 293507 - RNA, 32 nt, Human
aaguguuauuccauccuguaauccuagcacuu

SEQ ID NO: 293508 - RNA, 32 nt, Human
aaguguucaagccuguuguguucccaaaucug

SEQ ID NO: 293509 - RNA, 24 nt, Human
aaguguucagauuacaggugugag

SEQ ID NO: 293510 - RNA, 32 nt, Human
aaguguuccaacaaaaugagcgagugaaccaa

SEQ ID NO: 293511 - RNA, 32 nt, Human
aaguguucccacuagaacugaccuaagccacu

SEQ ID NO: 293512 - RNA, 32 nt, Human
aaguguuccuuaguucccgugugaaagcagag

SEQ ID NO: 293513 - RNA, 24 nt, Human
aaguguucggauuacaaacgugag

SEQ ID NO: 293514 - RNA, 32 nt, Human
aaguguucuagcucgaguggaagaacucauug

SEQ ID NO: 293515 - RNA, 32 nt, Human
aaguguucuauuuuguaaaucauuccauuuga

SEQ ID NO: 293516 - RNA, 32 nt, Human
aaguguucucagagugauguuuuaauccaguc

SEQ ID NO: 293517 - RNA, 32 nt, Human
aaguguucucggggaugcauagauucaucauu

SEQ ID NO: 293518 - RNA, 32 nt, Human
aaguguucucugcuggcucuuuccugccacug

SEQ ID NO: 293519 - RNA, 32 nt, Human
aaguguucugcuguguuucaggaucaggggga

SEQ ID NO: 293520 - RNA, 24 nt, Human
aaguguugagacuacaggcaugag

SEQ ID NO: 293521 - RNA, 24 nt, Human
aaguguugagaucacaggcgugag

SEQ ID NO: 293522 - RNA, 32 nt, Human
aaguguugagaucacaggcgugagccacugca

SEQ ID NO: 293523 - RNA, 24 nt, Human
aaguguugagauuacaggcaugag

SEQ ID NO: 293524 - RNA, 32 nt, Human
aaguguugagauuacaggcaugagccacugug

SEQ ID NO: 293525 - RNA, 24 nt, Human
aaguguugagauuacaggcgugag

SEQ ID NO: 293526 - RNA, 32 nt, Human
aaguguugcuggaucucugccugccagggaag

SEQ ID NO: 293527 - RNA, 32 nt, Human
aaguguuggaaaaucaaaagaggcucacucaa

SEQ ID NO: 293528 - RNA, 24 nt, Human
aaguguuggaauuacaggcgugag

SEQ ID NO: 293529 - RNA, 24 nt, Human
aaguguuggaguuacaggcaugag

SEQ ID NO: 293530 - RNA, 32 nt, Human
aaguguuggauuacaggugugagccaccacac

SEQ ID NO: 293531 - RNA, 24 nt, Human
aaguguugggauaacaggcaugag

SEQ ID NO: 293532 - RNA, 32 nt, Human
aaguguugggaucacaggcgugagccaccaca

SEQ ID NO: 293533 - RNA, 32 nt, Human
aaguguugggaucacaggcgugagccaccgca

SEQ ID NO: 293534 - RNA, 32 nt, Human
aaguguugggauuacagacauuagccaucacg

SEQ ID NO: 293535 - RNA, 32 nt, Human
aaguguugggauuacagccgugagccaccacg

SEQ ID NO: 293536 - RNA, 19 nt, Human
aaguguugggauuacaggc

SEQ ID NO: 293537 - RNA, 32 nt, Human
aaguguugggauuacaggcaagagccaacacg

SEQ ID NO: 293538 - RNA, 32 nt, Human
aaguguugggauuacaggcaaugagccaccac

SEQ ID NO: 293539 - RNA, 24 nt, Human
aaguguugggauuacaggcacgag

SEQ ID NO: 293540 - RNA, 32 nt, Human
aaguguugggauuacaggcacgagccacugug

SEQ ID NO: 293541 - RNA, 32 nt, Human
aaguguugggauuacaggcauaagccauugug

SEQ ID NO: 293542 - RNA, 23 nt, Human
aaguguugggauuacaggcauga

SEQ ID NO: 293543 - RNA, 32 nt, Human
aaguguugggauuacaggcaugaaucaccaug

SEQ ID NO: 293544 - RNA, 24 nt, Human
aaguguugggauuacaggcaugag

SEQ ID NO: 293545 - RNA, 32 nt, Human
aaguguugggauuacaggcaugagacacugcc

SEQ ID NO: 293546 - RNA, 32 nt, Human
aaguguugggauuacaggcaugagccaccacu

SEQ ID NO: 293547 - RNA, 32 nt, Human
aaguguugggauuacaggcaugagccaccaug

SEQ ID NO: 293548 - RNA, 32 nt, Human
aaguguugggauuacaggcaugagccaccgca

SEQ ID NO: 293549 - RNA, 32 nt, Human
aaguguugggauuacaggcaugagccaccuga

SEQ ID NO: 293550 - RNA, 32 nt, Human
aaguguugggauuacaggcaugagccacugcg

SEQ ID NO: 293551 - RNA, 32 nt, Human
aaguguugggauuacaggcaugagccacugug

SEQ ID NO: 293552 - RNA, 32 nt, Human
aaguguugggauuacaggcaugagcuacuaca

SEQ ID NO: 293553 - RNA, 21 nt, Human
aaguguugggauuacaggcgu

SEQ ID NO: 293554 - RNA, 24 nt, Human
aaguguugggauuacaggcgugag

SEQ ID NO: 293555 - RNA, 32 nt, Human
aaguguugggauuacaggcgugagccaccgca

SEQ ID NO: 293556 - RNA, 32 nt, Human
aaguguugggauuacaggcgugagccaccgcg

SEQ ID NO: 293557 - RNA, 32 nt, Human
aaguguugggauuacaggcgugagccaccuca

SEQ ID NO: 293558 - RNA, 32 nt, Human
aaguguugggauuacaggcgugagccacugca

SEQ ID NO: 293559 - RNA, 32 nt, Human
aaguguugggauuacaggcgugagccacugcc

SEQ ID NO: 293560 - RNA, 32 nt, Human
aaguguugggauuacaggcgugagccacugcg

SEQ ID NO: 293561 - RNA, 32 nt, Human
aaguguugggauuacaggcgugagccacugug

SEQ ID NO: 293562 - RNA, 32 nt, Human
aaguguugggauuacaggcgugagccauggug

SEQ ID NO: 293563 - RNA, 32 nt, Human
aaguguugggauuacaggcgugagccauugcg

SEQ ID NO: 293564 - RNA, 32 nt, Human
aaguguugggauuacaggcgugagucaccgcg

SEQ ID NO: 293565 - RNA, 32 nt, Human
aaguguugggauuacaggcgugagucacugug

SEQ ID NO: 293566 - RNA, 24 nt, Human
aaguguugggauuacaggcuugag

SEQ ID NO: 293567 - RNA, 32 nt, Human
aaguguugggauuacaggcuugagccaccgca

SEQ ID NO: 293568 - RNA, 32 nt, Human
aaguguugggauuacaggcuugagccaccgug

SEQ ID NO: 293569 - RNA, 23 nt, Human
aaguguugggauuacagguguga

SEQ ID NO: 293570 - RNA, 32 nt, Human
aaguguugggauuacaggugugaaccacugug

SEQ ID NO: 293571 - RNA, 24 nt, Human
aaguguugggauuacaggugugag

SEQ ID NO: 293572 - RNA, 32 nt, Human
aaguguugggauuacaggugugagccacagca

SEQ ID NO: 293573 - RNA, 32 nt, Human
aaguguugggauuacaggugugagccaccacg

SEQ ID NO: 293574 - RNA, 32 nt, Human
aaguguugggauuacaggugugagccaccgug

SEQ ID NO: 293575 - RNA, 32 nt, Human
aaguguugggauuacaggugugagccacugug

SEQ ID NO: 293576 - RNA, 32 nt, Human
aaguguugggauuacaggugugugucacugug

SEQ ID NO: 293577 - RNA, 24 nt, Human
aaguguugggauuauaagcgugag

SEQ ID NO: 293578 - RNA, 24 nt, Human
aaguguugggauuauaggcaugag

SEQ ID NO: 293579 - RNA, 24 nt, Human
aaguguugggauuauaggcgugag

SEQ ID NO: 293580 - RNA, 24 nt, Human
aaguguugggauugcaggcaugag

SEQ ID NO: 293581 - RNA, 24 nt, Human
aaguguugggauugcaggcgugag

SEQ ID NO: 293582 - RNA, 32 nt, Human
aaguguugugauuacaggcgugagccaccaca

SEQ ID NO: 293583 - RNA, 32 nt, Human
aaguguuucauuuuguggccuacugcucgggg

SEQ ID NO: 293584 - RNA, 32 nt, Human
aaguguuuccggcuaauuuuuguauuuuuagu

SEQ ID NO: 293585 - RNA, 32 nt, Human
aaguguuugagaccagccugagcaacauauca

SEQ ID NO: 293586 - RNA, 32 nt, Human
aaguguuuguaaucccagcacuuugggaggcc

SEQ ID NO: 293587 - RNA, 32 nt, Human
aaguguuuucuuuccauuuccuguuggacagg

SEQ ID NO: 293588 - RNA, 32 nt, Human
aaguguuuugacuaacagagcuggaggucaag

SEQ ID NO: 293589 - RNA, 21 nt, Human
aaguguuuuuguuuuguuuug

SEQ ID NO: 293590 - RNA, 32 nt, Human
aaguuaaaagagagugggucucugugccucuc

SEQ ID NO: 293591 - RNA, 32 nt, Human
aaguuaaaagagagugggucucuguggcucuc

SEQ ID NO: 293592 - RNA, 32 nt, Human
aaguuaaacaccuuguagaaagccuacuuuca

SEQ ID NO: 293593 - RNA, 32 nt, Human
aaguuaaacuuuacugaauuucaguacauuag

SEQ ID NO: 293594 - RNA, 32 nt, Human
aaguuaaagagguuuugcuggccagguauggu

SEQ ID NO: 293595 - RNA, 32 nt, Human
aaguuaacaguggauaaaagacuuuucuguaa

SEQ ID NO: 293596 - RNA, 32 nt, Human
aaguuaaccaagucuguaucugcuccccacau

SEQ ID NO: 293597 - RNA, 32 nt, Human
aaguuaacucuagcccagcccagaucaacucc

SEQ ID NO: 293598 - RNA, 32 nt, Human
aaguuaacucuagcccugaccucuauugaucu

SEQ ID NO: 293599 - RNA, 32 nt, Human
aaguuaagacuugcuugucaguggucauggcu

SEQ ID NO: 293600 - RNA, 32 nt, Human
aaguuaaggaacuagggaaaagagauggaaau

SEQ ID NO: 293601 - RNA, 24 nt, Human
aaguuaaguaaugacacucagaga

SEQ ID NO: 293602 - RNA, 32 nt, Human
aaguuaaguaucucaauuuuucauauugagua

SEQ ID NO: 293603 - RNA, 32 nt, Human
aaguuaauccaucaauccuuaguagaauccag

SEQ ID NO: 293604 - RNA, 32 nt, Human
aaguuaauuaauucaguccaaaaugaaauuau

SEQ ID NO: 293605 - RNA, 32 nt, Human
aaguuaauucaggccuuccuuuugaccacugc

SEQ ID NO: 293606 - RNA, 32 nt, Human
aaguuaauugcuauguggaaagaaggucaaag

SEQ ID NO: 293607 - RNA, 22 nt, Human
aaguuaauuuuaaucucacagu

SEQ ID NO: 293608 - RNA, 31 nt, Human
aaguuacaaguguccaagccagaaccugaug

SEQ ID NO: 293609 - RNA, 31 nt, Human
aaguuacaccaacagaauaccaagcagaaug

SEQ ID NO: 293610 - RNA, 32 nt, Human
aaguuacaggcagagugggacugagaugguac

SEQ ID NO: 293611 - RNA, 32 nt, Human
aaguuacaguaccuuuguggcuucauuggaua

SEQ ID NO: 293612 - RNA, 32 nt, Human
aaguuaccucaccuaauuuuugcuucucagga

SEQ ID NO: 293613 - RNA, 32 nt, Human
aaguuaccucuaaacccuccagcauggccauc

SEQ ID NO: 293614 - RNA, 32 nt, Human
aaguuacgaggaaaauaaaaagacugauguca

SEQ ID NO: 293615 - RNA, 32 nt, Human
aaguuacuaucaaaugccagugagaaucuucu

SEQ ID NO: 293616 - RNA, 32 nt, Human
aaguuacuucaccucugagccuaaguuuccac

SEQ ID NO: 293617 - RNA, 32 nt, Human
aaguuacuuccuguucaauaaauuuaacuuuu

SEQ ID NO: 293618 - RNA, 32 nt, Human
aaguuagaaaacugaauagcaacacugaauac

SEQ ID NO: 293619 - RNA, 32 nt, Human
aaguuagaauccaagucauuguuuccaagaaa

SEQ ID NO: 293620 - RNA, 32 nt, Human
aaguuagagcacgucgccacagagcuugacau

SEQ ID NO: 293621 - RNA, 32 nt, Human
aaguuagagugagggaaaugagcuuggcuucu

SEQ ID NO: 293622 - RNA, 32 nt, Human
aaguuagaucccacagucaucaaguuucagau

SEQ ID NO: 293623 - RNA, 32 nt, Human
aaguuagcauccuuuucccuuucuuacaaguu

SEQ ID NO: 293624 - RNA, 32 nt, Human
aaguuagccucaucauuuugugcugcuccaac

SEQ ID NO: 293625 - RNA, 32 nt, Human
aaguuaggaccagccaauggagagacacauaa

SEQ ID NO: 293626 - RNA, 32 nt, Human
aaguuaggcaucaccaguguuugccucugugc

SEQ ID NO: 293627 - RNA, 32 nt, Human
aaguuaggcuaugccuacaaaggucuuaaaaa

SEQ ID NO: 293628 - RNA, 32 nt, Human
aaguuagggaaccauauuugagacuuucaaaa

SEQ ID NO: 293629 - RNA, 32 nt, Human
aaguuagggagagaucagaggucauacuguga

SEQ ID NO: 293630 - RNA, 32 nt, Human
aaguuaggggugaaaauguuccaucaucacac

SEQ ID NO: 293631 - RNA, 32 nt, Human
aaguuaggguagaaaacaaaaagggaguggau

SEQ ID NO: 293632 - RNA, 32 nt, Human
aaguuaguuagaucacucccagaagagaccag

SEQ ID NO: 293633 - RNA, 32 nt, Human
aaguuauaacauggcugaaaagaaagauuaaa

SEQ ID NO: 293634 - RNA, 32 nt, Human
aaguuauaacucaggaucugaggucucaagcu

SEQ ID NO: 293635 - RNA, 32 nt, Human
aaguuauauaaagagaaaauugaauuuaacaa

SEQ ID NO: 293636 - RNA, 32 nt, Human
aaguuauauuuggcucuuaucaccgcaaaagg

SEQ ID NO: 293637 - RNA, 32 nt, Human
aaguuaucauuuccucagucuuuucuuuugua

SEQ ID NO: 293638 - RNA, 32 nt, Human
aaguuauccaagucacugaaagccugagacuc

SEQ ID NO: 293639 - RNA, 32 nt, Human
aaguuauccuuacuccaucugugaaagaaguu

SEQ ID NO: 293640 - RNA, 32 nt, Human
aaguuaucuuuauaaucacuguaguuagaugu

SEQ ID NO: 293641 - RNA, 32 nt, Human
aaguuaugcagcuguucugguuccuccuggua

SEQ ID NO: 293642 - RNA, 32 nt, Human
aaguuauuaaaccaaacuccuguccaauuuga

SEQ ID NO: 293643 - RNA, 32 nt, Human
aaguuauugauuccaaagaacuccaccaggaa

SEQ ID NO: 293644 - RNA, 32 nt, Human
aaguuauuugagacagagucucgcucugucac

SEQ ID NO: 293645 - RNA, 32 nt, Human
aaguucaaauauacuuguuaauaaaaggauua

SEQ ID NO: 293646 - RNA, 32 nt, Human
aaguucaaccacugcacuccacuaagcaacug

SEQ ID NO: 293647 - RNA, 32 nt, Human
aaguucaaccccuaacaggucuucuaugccuu

SEQ ID NO: 293648 - RNA, 21 nt, Human
aaguucaaguucaaagcuguu

SEQ ID NO: 293649 - RNA, 32 nt, Human
aaguucaauaaaccagcuuagccacaaagaaa

SEQ ID NO: 293650 - RNA, 32 nt, Human
aaguucacaccacugccauuuccuccugggca

SEQ ID NO: 293651 - RNA, 32 nt, Human
aaguucacacugcaggcaggcuuuagagugcu

SEQ ID NO: 293652 - RNA, 32 nt, Human
aaguucacagggugccugggcugcauuugaau

SEQ ID NO: 293653 - RNA, 32 nt, Human
aaguucagaagagagcgcagcgacuacgaccg

SEQ ID NO: 293654 - RNA, 32 nt, Human
aaguucagauuuuucccuccaguugguuuaau

SEQ ID NO: 293655 - RNA, 32 nt, Human
aaguucagcccagcuauggcccaggagaagac

SEQ ID NO: 293656 - RNA, 32 nt, Human
aaguucagccucccggguggcugggauuguag

SEQ ID NO: 293657 - RNA, 24 nt, Human
aaguucagggauuacaggcaugag

SEQ ID NO: 293658 - RNA, 32 nt, Human
aaguucagggauuacaggcaugagccaccaug

SEQ ID NO: 293659 - RNA, 32 nt, Human
aaguucagggguauguaugcagguuuguuaua

SEQ ID NO: 293660 - RNA, 32 nt, Human
aaguucagguccaggaaauggaaacauugcuu

SEQ ID NO: 293661 - RNA, 32 nt, Human
aaguucauaaaaucaaauuuugcuuaagaaua

SEQ ID NO: 293662 - RNA, 32 nt, Human
aaguucauaaauucugggcacugcucagcuug

SEQ ID NO: 293663 - RNA, 32 nt, Human
aaguucauccuacucugaauguaagcacacgg

SEQ ID NO: 293664 - RNA, 32 nt, Human
aaguucaucuugcucugaauguaagcacacag

SEQ ID NO: 293665 - RNA, 31 nt, Human
aaguucaugucucauguuaucuggaccuuga

SEQ ID NO: 293666 - RNA, 32 nt, Human
aaguucauucuuguaccaacuaauccagugcu

SEQ ID NO: 293667 - RNA, 32 nt, Human
aaguuccaaaagcagaggcggccuuggcguca

SEQ ID NO: 293668 - RNA, 32 nt, Human
aaguuccacagcuguguccuaaaccagguuuc

SEQ ID NO: 293669 - RNA, 32 nt, Human
aaguuccacugcacuccagccuggguuacaga

SEQ ID NO: 293670 - RNA, 24 nt, Human
aaguuccaugauacuauaacugga

SEQ ID NO: 293671 - RNA, 28 nt, Human
aaguucccaagugauugcugguccaggg

SEQ ID NO: 293672 - RNA, 32 nt, Human
aaguuccccaccccagaggagcucuuaccugg

SEQ ID NO: 293673 - RNA, 32 nt, Human
aaguucccuaaccucucccaacacagccucca

SEQ ID NO: 293674 - RNA, 32 nt, Human
aaguucccuaaggcccucucccucucaaauaa

SEQ ID NO: 293675 - RNA, 32 nt, Human
aaguucccuccaacaggaacucucugaccugu

SEQ ID NO: 293676 - RNA, 32 nt, Human
aaguucccucccuccagccagaaguuaaacau

SEQ ID NO: 293677 - RNA, 32 nt, Human
aaguucccugcucugcagcucuggcccaggag

SEQ ID NO: 293678 - RNA, 32 nt, Human
aaguucccuuaagucuugcccuagcugugcuc

SEQ ID NO: 293679 - RNA, 32 nt, Human
aaguucccuucccuuuucauccuaucccagcc

SEQ ID NO: 293680 - RNA, 32 nt, Human
aaguuccucacacccuaucucuaugacuucuu

SEQ ID NO: 293681 - RNA, 32 nt, Human
aaguuccucacacccugcuaccacccuaacgu

SEQ ID NO: 293682 - RNA, 32 nt, Human
aaguuccuggagucccaucaggccagugggua

SEQ ID NO: 293683 - RNA, 32 nt, Human
aaguuccuggauucaauguucuugccuuggcu

SEQ ID NO: 293684 - RNA, 32 nt, Human
aaguuccuuaaaaugcucugcaaagaaauugg

SEQ ID NO: 293685 - RNA, 32 nt, Human
aaguuccuuuuuacuuaggugugaaagauggu

SEQ ID NO: 293686 - RNA, 32 nt, Human
aaguucgaaagagugaauauuuugccauguuc

SEQ ID NO: 293687 - RNA, 32 nt, Human
aaguucgaagaguaacauggaggcagaguggc

SEQ ID NO: 293688 - RNA, 32 nt, Human
aaguucgcuuuguagcggccccggcuagagag

SEQ ID NO: 293689 - RNA, 32 nt, Human
aaguucgugccaucggacuccagccuggguga

SEQ ID NO: 293690 - RNA, 32 nt, Human
aaguucuaaaaauugaaugcaaugagagauug

SEQ ID NO: 293691 - RNA, 24 nt, Human
aaguucuaggauuacaggugugag

SEQ ID NO: 293692 - RNA, 32 nt, Human
aaguucuaggauuacaggugugagccaccacg

SEQ ID NO: 293693 - RNA, 31 nt, Human
aaguucucaauaaaaauuguuaagaaaugcc

SEQ ID NO: 293694 - RNA, 32 nt, Human
aaguucucaauguucuuuuccaacacaucuau

SEQ ID NO: 293695 - RNA, 32 nt, Human
aaguucucacacaagcuuauucucaggaucuu

SEQ ID NO: 293696 - RNA, 32 nt, Human
aaguucuccaccaaggauguuccccaggcacu

SEQ ID NO: 293697 - RNA, 32 nt, Human
aaguucuccagggaauugcagcuuugauggca

SEQ ID NO: 293698 - RNA, 32 nt, Human
aaguucuccuuccgucuuuucucccauuuuac

SEQ ID NO: 293699 - RNA, 32 nt, Human
aaguucucggauuacaggcgugagccacugcg

SEQ ID NO: 293700 - RNA, 32 nt, Human
aaguucucucucuuugccuucugccauccaua

SEQ ID NO: 293701 - RNA, 32 nt, Human
aaguucucuuggugaagaccgcacuucaaugg

SEQ ID NO: 293702 - RNA, 32 nt, Human
aaguucugaaggccaugacaccugccuugccu

SEQ ID NO: 293703 - RNA, 32 nt, Human
aaguucugcagaccacacaggaacuugcuuca

SEQ ID NO: 293704 - RNA, 31 nt, Human
aaguucugccucucugugcccagcucaaguc

SEQ ID NO: 293705 - RNA, 31 nt, Human
aaguucugccucugccuggggucuuggccac

SEQ ID NO: 293706 - RNA, 32 nt, Human
aaguucugcuaaaucacaucugccucauagag

SEQ ID NO: 293707 - RNA, 32 nt, Human
aaguucugcuaugaggaugcagcuggccccag

SEQ ID NO: 293708 - RNA, 32 nt, Human
aaguucugcuuugacaaacugacaaagucuaa

SEQ ID NO: 293709 - RNA, 32 nt, Human
aaguucuggacgccaggccugaggcaguuccg

SEQ ID NO: 293710 - RNA, 32 nt, Human
aaguucuggcuguuacuugagcagaggccuuu

SEQ ID NO: 293711 - RNA, 22 nt, Human
aaguucugggaggagacauugu

SEQ ID NO: 293712 - RNA, 23 nt, Human
aaguucugggauuacaaguguga

SEQ ID NO: 293713 - RNA, 24 nt, Human
aaguucugggauuacaggagugag

SEQ ID NO: 293714 - RNA, 32 nt, Human
aaguucugggauuacaggagugagccaccgcg

SEQ ID NO: 293715 - RNA, 24 nt, Human
aaguucugggauuacaggcaugag

SEQ ID NO: 293716 - RNA, 32 nt, Human
aaguucugggauuacaggcaugagccaccaug

SEQ ID NO: 293717 - RNA, 32 nt, Human
aaguucugggauuacaggcaugagccaccgug

SEQ ID NO: 293718 - RNA, 32 nt, Human
aaguucugggauuacaggcaugagccacugug

SEQ ID NO: 293719 - RNA, 24 nt, Human
aaguucugggauuacaggcgugag

SEQ ID NO: 293720 - RNA, 32 nt, Human
aaguucugggauuacaggcgugagccacacac

SEQ ID NO: 293721 - RNA, 32 nt, Human
aaguucugggauuacaggcgugagccaccgcg

SEQ ID NO: 293722 - RNA, 32 nt, Human
aaguucugggauuacaggcgugagccauggug

SEQ ID NO: 293723 - RNA, 24 nt, Human
aaguucugggauuacaggcuugag

SEQ ID NO: 293724 - RNA, 32 nt, Human
aaguucugggauuacaggcuugagccacugcg

SEQ ID NO: 293725 - RNA, 24 nt, Human
aaguucugggauuacaggggugag

SEQ ID NO: 293726 - RNA, 32 nt, Human
aaguucugggauuacaggggugagccacugug

SEQ ID NO: 293727 - RNA, 32 nt, Human
aaguucugggauuacaggguguugagccacuc

SEQ ID NO: 293728 - RNA, 32 nt, Human
aaguucugggauuacagguaugagccacaaca

SEQ ID NO: 293729 - RNA, 24 nt, Human
aaguucugggauuacaggugugag

SEQ ID NO: 293730 - RNA, 32 nt, Human
aaguucugggauuacaggugugagccaccgcg

SEQ ID NO: 293731 - RNA, 32 nt, Human
aaguucugggauuacaggugugagccaccgug

SEQ ID NO: 293732 - RNA, 32 nt, Human
aaguucugggauuauaggugcgagccacugug

SEQ ID NO: 293733 - RNA, 32 nt, Human
aaguucugggccagcccauugcucugggcugu

SEQ ID NO: 293734 - RNA, 32 nt, Human
aaguucugggccugacagguagauuccagcug

SEQ ID NO: 293735 - RNA, 32 nt, Human
aaguucuggggucuccagcugcaguggguggc

SEQ ID NO: 293736 - RNA, 32 nt, Human
aaguucuggucaaagaugaauggcaguaagac

SEQ ID NO: 293737 - RNA, 32 nt, Human
aaguucugugaugugugaacugugaguuuacu

SEQ ID NO: 293738 - RNA, 32 nt, Human
aaguucuguguuagucaugcacacacauaccu

SEQ ID NO: 293739 - RNA, 32 nt, Human
aaguucuguuucuucaccugggugguaguuag

SEQ ID NO: 293740 - RNA, 32 nt, Human
aaguucuguuucuucuuugauaccuuuguucu

SEQ ID NO: 293741 - RNA, 32 nt, Human
aaguucuuaguaaacugcagccagggagacuc

SEQ ID NO: 293742 - RNA, 32 nt, Human
aaguucuucaucucugugugcaugcagcuuag

SEQ ID NO: 293743 - RNA, 32 nt, Human
aaguucuuccaaaggcuggagaagugaacaag

SEQ ID NO: 293744 - RNA, 32 nt, Human
aaguucuuccaagagacuuccauguccugguu

SEQ ID NO: 293745 - RNA, 31 nt, Human
aaguucuuccucucugaggcuuuccuggguc

SEQ ID NO: 293746 - RNA, 32 nt, Human
aaguucuuggagaagggaguccaacucuucaa

SEQ ID NO: 293747 - RNA, 32 nt, Human
aaguucuuuauuaaagauuuuugaggccgggc

SEQ ID NO: 293748 - RNA, 32 nt, Human
aaguucuuucugugcugaagggagaggaguaa

SEQ ID NO: 293749 - RNA, 32 nt, Human
aaguucuuuucuuccucacuuuguugacaguc

SEQ ID NO: 293750 - RNA, 32 nt, Human
aaguugaaggaggcagaagggagagugaugca

SEQ ID NO: 293751 - RNA, 19 nt, Human
aaguugaagggacagggca

SEQ ID NO: 293752 - RNA, 32 nt, Human
aaguugaaucaggaaugaagauaaaaguacac

SEQ ID NO: 293753 - RNA, 32 nt, Human
aaguugaaugauuuauuguuacuuauauuaau

SEQ ID NO: 293754 - RNA, 32 nt, Human
aaguugaauuuagugucaaucauccagaaaau

SEQ ID NO: 293755 - RNA, 32 nt, Human
aaguugaauuucugcagguguugcaaguaugu

SEQ ID NO: 293756 - RNA, 32 nt, Human
aaguugagaaauguaccggcuuccauccuguc

SEQ ID NO: 293757 - RNA, 32 nt, Human
aaguugagaacugcuuucucuaccuuuugcaa

SEQ ID NO: 293758 - RNA, 32 nt, Human
aaguugagaucagcuagaccugcuuucuuuuc

SEQ ID NO: 293759 - RNA, 32 nt, Human
aaguugaggagaauaguuucauaaaagagaaa

SEQ ID NO: 293760 - RNA, 32 nt, Human
aaguugaggcccagagagaggaaggggcuggu

SEQ ID NO: 293761 - RNA, 32 nt, Human
aaguugaggcccuaauaaaaggcuccaaggca

SEQ ID NO: 293762 - RNA, 32 nt, Human
aaguugaggggcuggagcaaaaucuugggaga

SEQ ID NO: 293763 - RNA, 32 nt, Human
aaguugaguuugagaggcgacacggcggcggc

SEQ ID NO: 293764 - RNA, 32 nt, Human
aaguugauauagaacagugcuugccacagagc

SEQ ID NO: 293765 - RNA, 32 nt, Human
aaguugaugaccagaaaucagugcaaacacau

SEQ ID NO: 293766 - RNA, 32 nt, Human
aaguugcaacugaccuugaacugaaucacucu

SEQ ID NO: 293767 - RNA, 32 nt, Human
aaguugcacagguucuugcagcuucuggaauc

SEQ ID NO: 293768 - RNA, 32 nt, Human
aaguugcaccauugcacuccacccugggcgac

SEQ ID NO: 293769 - RNA, 32 nt, Human
aaguugcacuuuucaagaugugagaagguacu

SEQ ID NO: 293770 - RNA, 32 nt, Human
aaguugcagugagccgagacagugccaccgua

SEQ ID NO: 293771 - RNA, 32 nt, Human
aaguugcagugagccgagaccaugccauugca

SEQ ID NO: 293772 - RNA, 32 nt, Human
aaguugcagugagccgagaucacaccacugca

SEQ ID NO: 293773 - RNA, 32 nt, Human
aaguugcagugagccgagaucacgccacugca

SEQ ID NO: 293774 - RNA, 32 nt, Human
aaguugcagugagccgagaucaugccacugca

SEQ ID NO: 293775 - RNA, 32 nt, Human
aaguugcagugagccgagaucgcaccacugca

SEQ ID NO: 293776 - RNA, 32 nt, Human
aaguugcagugagccgagaucgcgccacugca

SEQ ID NO: 293777 - RNA, 32 nt, Human
aaguugcagugagccgagaucgcgccauugua

SEQ ID NO: 293778 - RNA, 32 nt, Human
aaguugcagugagccgagaucgugccauugca

SEQ ID NO: 293779 - RNA, 32 nt, Human
aaguugcagugagccgagauugcaccacagca

SEQ ID NO: 293780 - RNA, 32 nt, Human
aaguugcagugagccgagauugcaccacugca

SEQ ID NO: 293781 - RNA, 32 nt, Human
aaguugcagugagccgagauugugccacugaa

SEQ ID NO: 293782 - RNA, 32 nt, Human
aaguugcagugagccgagauugugccacugca

SEQ ID NO: 293783 - RNA, 32 nt, Human
aaguugcagugagcugauaucaugccccugua

SEQ ID NO: 293784 - RNA, 32 nt, Human
aaguugccaagaugcuccuuguugacuuccag

SEQ ID NO: 293785 - RNA, 32 nt, Human
aaguugccauuuuaauuagaggggagguccac

SEQ ID NO: 293786 - RNA, 32 nt, Human
aaguugcccgucucccccuucuucccuccucc

SEQ ID NO: 293787 - RNA, 22 nt, Human
aaguugccuuacagagccagga

SEQ ID NO: 293788 - RNA, 32 nt, Human
aaguugcgcugagaguugagggcugccaguug

SEQ ID NO: 293789 - RNA, 32 nt, Human
aaguugcgguuagccgagaucacgccacugcc

SEQ ID NO: 293790 - RNA, 32 nt, Human
aaguugcuaagugcccgagcgcagcgcguuaa

SEQ ID NO: 293791 - RNA, 32 nt, Human
aaguugcugcugcuuccaccgccccuuaaagu

SEQ ID NO: 293792 - RNA, 32 nt, Human
aaguugcugcuuggcauaaugagccucagcuu

SEQ ID NO: 293793 - RNA, 32 nt, Human
aaguugcugcuugugaucucacacacagauuu

SEQ ID NO: 293794 - RNA, 25 nt, Human
aaguugcugggauuacaggugugag

SEQ ID NO: 293795 - RNA, 32 nt, Human
aaguugcuguaagcaccugggcugaggaggca

SEQ ID NO: 293796 - RNA, 32 nt, Human
aaguugcuguauauuucagucugguuauaccu

SEQ ID NO: 293797 - RNA, 32 nt, Human
aaguugcuuucugcuuucucuuguuugugcuu

SEQ ID NO: 293798 - RNA, 30 nt, Human
aaguugcuuugcauaucagaaaaacuccau

SEQ ID NO: 293799 - RNA, 32 nt, Human
aaguuggaaagaacaaaagaagaacaaaaacc

SEQ ID NO: 293800 - RNA, 32 nt, Human
aaguuggaacgggacaagcagagaaggcuaaa

SEQ ID NO: 293801 - RNA, 32 nt, Human
aaguuggaaguuaagggagacaaaguugaaaa

SEQ ID NO: 293802 - RNA, 32 nt, Human
aaguuggacagaaggagguguuggggugaggu

SEQ ID NO: 293803 - RNA, 32 nt, Human
aaguuggaccugcgugcuuccucugccucuga

SEQ ID NO: 293804 - RNA, 32 nt, Human
aaguuggagggaggggcagggccuugcagggg

SEQ ID NO: 293805 - RNA, 32 nt, Human
aaguuggaggggcaaggggcugccguguccug

SEQ ID NO: 293806 - RNA, 32 nt, Human
aaguuggagguaggggccuguggaaacaugaa

SEQ ID NO: 293807 - RNA, 32 nt, Human
aaguuggauugagcauauucacugugaaauua

SEQ ID NO: 293808 - RNA, 32 nt, Human
aaguuggcaaagcuggucuguccaccaaggcc

SEQ ID NO: 293809 - RNA, 32 nt, Human
aaguuggcuagaagaaaguaaaaagaacaaca

SEQ ID NO: 293810 - RNA, 32 nt, Human
aaguugggaagacgacuugucuuucauucaaa

SEQ ID NO: 293811 - RNA, 32 nt, Human
aaguugggaaggauuuuccuggcaacuguacc

SEQ ID NO: 293812 - RNA, 32 nt, Human
aaguugggaggagcgagcuggagccagagcgc

SEQ ID NO: 293813 - RNA, 25 nt, Human
aaguugggaggcccuccucucaccu

SEQ ID NO: 293814 - RNA, 32 nt, Human
aaguugggaggcccuccucucaccuugcucaa

SEQ ID NO: 293815 - RNA, 32 nt, Human
aaguugggcccugaccuuucuguugcugucuc

SEQ ID NO: 293816 - RNA, 32 nt, Human
aaguuggggagguggagaaccaaugacccagg

SEQ ID NO: 293817 - RNA, 32 nt, Human
aaguuggguagaaaugacauuuuccagagcug

SEQ ID NO: 293818 - RNA, 32 nt, Human
aaguugggugagaccaggcuggucugauccuc

SEQ ID NO: 293819 - RNA, 32 nt, Human
aaguugguaggaacagguaagaauaggggguu

SEQ ID NO: 293820 - RNA, 32 nt, Human
aaguuggucucaaacuccugaccucaagugau

SEQ ID NO: 293821 - RNA, 32 nt, Human
aaguuggucuggaacuccugaccucgugaucc

SEQ ID NO: 293822 - RNA, 32 nt, Human
aaguuggugccaaugcauuccagccuggauga

SEQ ID NO: 293823 - RNA, 32 nt, Human
aaguugguggcugauuuaaaguugugcaggaa

SEQ ID NO: 293824 - RNA, 32 nt, Human
aaguuggugggugagagaaugggacuuccucu

SEQ ID NO: 293825 - RNA, 32 nt, Human
aaguugguguagcagcaguugaucagacugaa

SEQ ID NO: 293826 - RNA, 32 nt, Human
aaguuggugugcuggagcuaccucaccucagc

SEQ ID NO: 293827 - RNA, 32 nt, Human
aaguugguguugcccaaaucgcaguuugacau

SEQ ID NO: 293828 - RNA, 32 nt, Human
aaguugguuucaaacuccuggccucaagcagu

SEQ ID NO: 293829 - RNA, 32 nt, Human
aaguuguaccuugcccucucuccagcucugcu

SEQ ID NO: 293830 - RNA, 32 nt, Human
aaguuguacugugaacuggaagaugguggaau

SEQ ID NO: 293831 - RNA, 32 nt, Human
aaguuguagugagccgagaucaugccacugca

SEQ ID NO: 293832 - RNA, 22 nt, Human
aaguuguaucuagacaacugua

SEQ ID NO: 293833 - RNA, 32 nt, Human
aaguuguauugaggcaguuauggagugcagag

SEQ ID NO: 293834 - RNA, 23 nt, Human
aaguuguauuuaaugguucugua

SEQ ID NO: 293835 - RNA, 20 nt, Human
aaguugucacugaacuuggc

SEQ ID NO: 293836 - RNA, 32 nt, Human
aaguugucaguuaucacuguagaugagcaacu

SEQ ID NO: 293837 - RNA, 21 nt, Human
aaguuguccaaaagccuucag

SEQ ID NO: 293838 - RNA, 32 nt, Human
aaguugucgauugcuguguaacaaauugcccg

SEQ ID NO: 293839 - RNA, 32 nt, Human
aaguugugaauguuugcaacgaauccagcuca

SEQ ID NO: 293840 - RNA, 32 nt, Human
aaguugugagccauaagaacagagccuggaac

SEQ ID NO: 293841 - RNA, 32 nt, Human
aaguugugcuuugggguauauuugaauccuag

SEQ ID NO: 293842 - RNA, 32 nt, Human
aaguuguggaaccaaagagaacugucucaaga

SEQ ID NO: 293843 - RNA, 32 nt, Human
aaguugugggggcuuuucaagaggggccaggc

SEQ ID NO: 293844 - RNA, 32 nt, Human
aaguuguggugagccgagaucgcgccacugca

SEQ ID NO: 293845 - RNA, 32 nt, Human
aaguuguguacaugaacauacacccacaucca

SEQ ID NO: 293846 - RNA, 32 nt, Human
aaguugugucccaggguggacuagugggguuu

SEQ ID NO: 293847 - RNA, 32 nt, Human
aaguuguucccuuuacauuuucuucuugauuu

SEQ ID NO: 293848 - RNA, 32 nt, Human
aaguuguucucccacuacuuuccuuucccucu

SEQ ID NO: 293849 - RNA, 32 nt, Human
aaguuguuucucucccugggccucaguuuccc

SEQ ID NO: 293850 - RNA, 32 nt, Human
aaguuguuuuacuauuucuggagagagccgug

SEQ ID NO: 293851 - RNA, 32 nt, Human
aaguuguuuuagucuccaggaggcugccagcc

SEQ ID NO: 293852 - RNA, 32 nt, Human
aaguuguuuuugaauuuuauuguuuuguuauu

SEQ ID NO: 293853 - RNA, 32 nt, Human
aaguuuaacagaguucugagaauaccaugaaa

SEQ ID NO: 293854 - RNA, 32 nt, Human
aaguuuaagaugacuugaccccaaaccuuugu

SEQ ID NO: 293855 - RNA, 32 nt, Human
aaguuuaaggagaugagaggauucaaggagcc

SEQ ID NO: 293856 - RNA, 32 nt, Human
aaguuuacacagaaaugcugcuggccaaauag

SEQ ID NO: 293857 - RNA, 32 nt, Human
aaguuuacacucccaccaacaguguacaagac

SEQ ID NO: 293858 - RNA, 32 nt, Human
aaguuuacagaaaaggaagugcaggaacauuu

SEQ ID NO: 293859 - RNA, 32 nt, Human
aaguuuacaguaugauaaggacaccaaaccaa

SEQ ID NO: 293860 - RNA, 32 nt, Human
aaguuuaccaugucuguaauguguacaugaag

SEQ ID NO: 293861 - RNA, 22 nt, Human
aaguuuagaaaaaacaaagcaa

SEQ ID NO: 293862 - RNA, 32 nt, Human
aaguuuagaaagagguuuuugaaaugccuaug

SEQ ID NO: 293863 - RNA, 32 nt, Human
aaguuuagagaaaaggaauggaaaguacccag

SEQ ID NO: 293864 - RNA, 32 nt, Human
aaguuuagaguguuggcuggcucacaggcugc

SEQ ID NO: 293865 - RNA, 21 nt, Human
aaguuuaggaucccaaagagg

SEQ ID NO: 293866 - RNA, 32 nt, Human
aaguuuagggaaagaagguugcuguggugagg

SEQ ID NO: 293867 - RNA, 32 nt, Human
aaguuuagggccuggacaguggccccgagucc

SEQ ID NO: 293868 - RNA, 32 nt, Human
aaguuuaguauagucugauuacauuccauuca

SEQ ID NO: 293869 - RNA, 32 nt, Human
aaguuuauauaauguuuucacccuucauaaca

SEQ ID NO: 293870 - RNA, 32 nt, Human
aaguuuaugagacucaugggaguggccauugc

SEQ ID NO: 293871 - RNA, 32 nt, Human
aaguuuaugccugcugcuucucugccucuuug

SEQ ID NO: 293872 - RNA, 32 nt, Human
aaguuuauguuugagcaacuuuuucauuuaau

SEQ ID NO: 293873 - RNA, 32 nt, Human
aaguuuauuucagguuccuucuugccugcucu

SEQ ID NO: 293874 - RNA, 32 nt, Human
aaguuucaagaagcauguagaggaauaaaugc

SEQ ID NO: 293875 - RNA, 32 nt, Human
aaguuucaauccagaguuggguuccagcuuuc

SEQ ID NO: 293876 - RNA, 32 nt, Human
aaguuucacugacuuagaaccaggcgagagac

SEQ ID NO: 293877 - RNA, 32 nt, Human
aaguuucacuggcugguggcugucccuucucc

SEQ ID NO: 293878 - RNA, 32 nt, Human
aaguuucagacaagcagagagcucuauuuuua

SEQ ID NO: 293879 - RNA, 24 nt, Human
aaguuucauaugaauguaacuuga

SEQ ID NO: 293880 - RNA, 24 nt, Human
aaguuucaugaaucuguaacuaga

SEQ ID NO: 293881 - RNA, 32 nt, Human
aaguuucaugaauugcugcaguaaacauugau

SEQ ID NO: 293882 - RNA, 32 nt, Human
aaguuucauggauuagagugacugaaaaacau

SEQ ID NO: 293883 - RNA, 23 nt, Human
aaguuucauuauuggcaacuaga

SEQ ID NO: 293884 - RNA, 32 nt, Human
aaguuuccacuuggcccugcggcugcggucuu

SEQ ID NO: 293885 - RNA, 32 nt, Human
aaguuucccagaagugccugguucuguguacu

SEQ ID NO: 293886 - RNA, 32 nt, Human
aaguuucccagagaaaaugagaugcugauguu

SEQ ID NO: 293887 - RNA, 32 nt, Human
aaguuuccccaugcaggcagcuucucuggauu

SEQ ID NO: 293888 - RNA, 32 nt, Human
aaguuucccuaaaauauuucagacauuuagga

SEQ ID NO: 293889 - RNA, 32 nt, Human
aaguuuccuaguuuuaaguguuucaccagcaa

SEQ ID NO: 293890 - RNA, 32 nt, Human
aaguuuccuauuagcggggaagguguggggcu

SEQ ID NO: 293891 - RNA, 32 nt, Human
aaguuuccugguuuuaaaauguuagcaacaaa

SEQ ID NO: 293892 - RNA, 32 nt, Human
aaguuuccuuuuccuuugguucuuuccugaug

SEQ ID NO: 293893 - RNA, 32 nt, Human
aaguuucgguucagaagacaguuuggaauucc

SEQ ID NO: 293894 - RNA, 32 nt, Human
aaguuucuauuucuucuuucucugguucuucu

SEQ ID NO: 293895 - RNA, 31 nt, Human
aaguuucucaauaaaguuguuuggaaaauau

SEQ ID NO: 293896 - RNA, 32 nt, Human
aaguuucuccaggacaagagaaaaagagaauc

SEQ ID NO: 293897 - RNA, 32 nt, Human
aaguuucucccugccucacagcauccuccgaa

SEQ ID NO: 293898 - RNA, 32 nt, Human
aaguuucuccuuuucacaccuuauuucauuga

SEQ ID NO: 293899 - RNA, 32 nt, Human
aaguuucucuuucaaauagauuucaggccucu

SEQ ID NO: 293900 - RNA, 32 nt, Human
aaguuucugcacucagccaggcggcaucaaug

SEQ ID NO: 293901 - RNA, 32 nt, Human
aaguuucugccuggcccugcaucugguuccag

SEQ ID NO: 293902 - RNA, 32 nt, Human
aaguuucuggauccuaggcucagcuccacaga

SEQ ID NO: 293903 - RNA, 32 nt, Human
aaguuucuucugucuguuuuguuuuucaauug

SEQ ID NO: 293904 - RNA, 32 nt, Human
aaguuucuuucugucucuuaagugauguguga

SEQ ID NO: 293905 - RNA, 32 nt, Human
aaguuugauuucagauguuggaaaugugugcu

SEQ ID NO: 293906 - RNA, 19 nt, Human
aaguuugcaaauacugggg

SEQ ID NO: 293907 - RNA, 32 nt, Human
aaguuugcaauacucucuaccucuucgcaucc

SEQ ID NO: 293908 - RNA, 32 nt, Human
aaguuugcacaaaaucgcacaacgaugacgca

SEQ ID NO: 293909 - RNA, 32 nt, Human
aaguuugccuucugaccucauuuccuucuuga

SEQ ID NO: 293910 - RNA, 32 nt, Human
aaguuuggagugcaguggcaugaucaucagug

SEQ ID NO: 293911 - RNA, 32 nt, Human
aaguuuggauaaccuuccuucuaaacauuugg

SEQ ID NO: 293912 - RNA, 32 nt, Human
aaguuuggccacuucccucucaaagacuaacc

SEQ ID NO: 293913 - RNA, 32 nt, Human
aaguuugggcuguccugaaagucuggacuuug

SEQ ID NO: 293914 - RNA, 32 nt, Human
aaguuuggggaaaggugccaucuugaaaauuc

SEQ ID NO: 293915 - RNA, 32 nt, Human
aaguuuggggacaggcuucacccaacacccag

SEQ ID NO: 293916 - RNA, 32 nt, Human
aaguuuguaggaaugagugcagaugcaacccc

SEQ ID NO: 293917 - RNA, 32 nt, Human
aaguuugucucugaagaagcacaaaagaaaau

SEQ ID NO: 293918 - RNA, 32 nt, Human
aaguuugugccucacacuccagccuggguaac

SEQ ID NO: 293919 - RNA, 32 nt, Human
aaguuuguggaggaggcagggaaggaaaaaua

SEQ ID NO: 293920 - RNA, 32 nt, Human
aaguuugugucaccaucacaggggucguaucu

SEQ ID NO: 293921 - RNA, 32 nt, Human
aaguuuguucugacagggcgcgguggcucacg

SEQ ID NO: 293922 - RNA, 32 nt, Human
aaguuuguuuuaugauggcuugagugcgcgag

SEQ ID NO: 293923 - RNA, 32 nt, Human
aaguuuguuuucucccacugccuccaggcccc

SEQ ID NO: 293924 - RNA, 32 nt, Human
aaguuuguuuuuaaaaguuuucuauuaauuau

SEQ ID NO: 293925 - RNA, 32 nt, Human
aaguuuuauucugccuuugaaaaugcuuccaa

SEQ ID NO: 293926 - RNA, 32 nt, Human
aaguuuuauuugugaugucauaacuccacaga

SEQ ID NO: 293927 - RNA, 32 nt, Human
aaguuuucacccaacuggaauuugauggaaag

SEQ ID NO: 293928 - RNA, 32 nt, Human
aaguuuucacugaaugagcauggcagugccac

SEQ ID NO: 293929 - RNA, 32 nt, Human
aaguuuucauccccaucugccuguuaaugucu

SEQ ID NO: 293930 - RNA, 32 nt, Human
aaguuuuccaaaccuccuuccccacccuaucu

SEQ ID NO: 293931 - RNA, 32 nt, Human
aaguuuucccaaggucacacagcagagcugga

SEQ ID NO: 293932 - RNA, 32 nt, Human
aaguuuucccugcuucugguuugcugaagauu

SEQ ID NO: 293933 - RNA, 32 nt, Human
aaguuuucgcugagguuaaugugaacacugcu

SEQ ID NO: 293934 - RNA, 32 nt, Human
aaguuuucuccuccuugcacuuugccagaaaa

SEQ ID NO: 293935 - RNA, 32 nt, Human
aaguuuucugaccucaauucuaaaguaauugu

SEQ ID NO: 293936 - RNA, 32 nt, Human
aaguuuucugauggaaucuucaucucacccca

SEQ ID NO: 293937 - RNA, 32 nt, Human
aaguuuugagcuucaagucagugaggaguaaa

SEQ ID NO: 293938 - RNA, 32 nt, Human
aaguuuugaguagaggugagacccccucccca

SEQ ID NO: 293939 - RNA, 32 nt, Human
aaguuuugcauuguagaauuguauuuagcuuu

SEQ ID NO: 293940 - RNA, 32 nt, Human
aaguuuugcuuugggucaauuugaauuaaaaa

SEQ ID NO: 293941 - RNA, 32 nt, Human
aaguuuuggagaagagagagggagauaaaagg

SEQ ID NO: 293942 - RNA, 32 nt, Human
aaguuuuggagagggaaguggagcagccagca

SEQ ID NO: 293943 - RNA, 29 nt, Human
aaguuuuggcugcugcaccaucccucugg

SEQ ID NO: 293944 - RNA, 24 nt, Human
aaguuuuggggaguaaaaacuguu

SEQ ID NO: 293945 - RNA, 31 nt, Human
aaguuuuggguggaaguguugagaaguauga

SEQ ID NO: 293946 - RNA, 31 nt, Human
aaguuuuguacuucuuuuguuaaauauguuc

SEQ ID NO: 293947 - RNA, 32 nt, Human
aaguuuugugcaaauuaacauagucucuuauu

SEQ ID NO: 293948 - RNA, 32 nt, Human
aaguuuuuaaaggaagaguggaaaguacugca

SEQ ID NO: 293949 - RNA, 32 nt, Human
aaguuuuuaaagucuucagacaauuccaaaug

SEQ ID NO: 293950 - RNA, 32 nt, Human
aaguuuuuagucaacuuuugggacuuggggug

SEQ ID NO: 293951 - RNA, 32 nt, Human
aaguuuuuauuaugaauuacuaauccaguauu

SEQ ID NO: 293952 - RNA, 32 nt, Human
aaguuuuuccucauggcuucaucucuaucuuu

SEQ ID NO: 293953 - RNA, 32 nt, Human
aaguuuuucuucuccucgggucuccaguguca

SEQ ID NO: 293954 - RNA, 32 nt, Human
aaguuuuugcagccuauaugacuugagauugg

SEQ ID NO: 293955 - RNA, 32 nt, Human
aauaaaaacaaacuguucggcuacuggacagg

SEQ ID NO: 293956 - RNA, 32 nt, Human
aauaaaaaggauuuuuaaaaaguaauuccuua

SEQ ID NO: 293957 - RNA, 22 nt, Human
aauaaaaaggcaugauuccuga

SEQ ID NO: 293958 - RNA, 27 nt, Human
aauaaaaauaugaccaauugguaucag

SEQ ID NO: 293959 - RNA, 32 nt, Human
aauaaaaaugcacguagcugaggccggaugcg

SEQ ID NO: 293960 - RNA, 32 nt, Human
aauaaaacaaaucauaccaaaaagccacauug

SEQ ID NO: 293961 - RNA, 24 nt, Human
aauaaaacauaugugucuaugguu

SEQ ID NO: 293962 - RNA, 23 nt, Human
aauaaaacaugugcaugcuugaa

SEQ ID NO: 293963 - RNA, 22 nt, Human
aauaaaacauuuucugaaauca

SEQ ID NO: 293964 - RNA, 24 nt, Human
aauaaaaccaacucuaaaaucaca

SEQ ID NO: 293965 - RNA, 22 nt, Human
aauaaaaccuuuauguuagcuc

SEQ ID NO: 293966 - RNA, 32 nt, Human
aauaaaacucacaauuugugcucacaagcuua

SEQ ID NO: 293967 - RNA, 32 nt, Human
aauaaaacuuaucugagucacuugaaacuugg

SEQ ID NO: 293968 - RNA, 32 nt, Human
aauaaaagauggggaaccaccaugcucgagau

SEQ ID NO: 293969 - RNA, 32 nt, Human
aauaaaagcuuaggauuaauuagaagaagcaa

SEQ ID NO: 293970 - RNA, 32 nt, Human
aauaaaagcuucccccugauauccaucccuuu

SEQ ID NO: 293971 - RNA, 32 nt, Human
aauaaaagguccaauuugcaaauaggcaaaag

SEQ ID NO: 293972 - RNA, 32 nt, Human
aauaaaaggugucuugguuugaugucauagaa

SEQ ID NO: 293973 - RNA, 24 nt, Human
aauaaaauaaauguuauucucuga

SEQ ID NO: 293974 - RNA, 32 nt, Human
aauaaaauacaaaaaguguguugauuuauagc

SEQ ID NO: 293975 - RNA, 32 nt, Human
aauaaaauaguauacuggacugugcaucaaag

SEQ ID NO: 293976 - RNA, 23 nt, Human
aauaaaauaguugcuaauccuga

SEQ ID NO: 293977 - RNA, 32 nt, Human
aauaaaaucaauuaaaugaaauauucuauaga

SEQ ID NO: 293978 - RNA, 32 nt, Human
aauaaaauccaagugaacagauaauuagaaga

SEQ ID NO: 293979 - RNA, 18 nt, Human
aauaaaaugacaauuccu

SEQ ID NO: 293980 - RNA, 24 nt, Human
aauaaaaugaccgcauauuccuga

SEQ ID NO: 293981 - RNA, 32 nt, Human
aauaaaaugagggcccguaacagaaccagugu

SEQ ID NO: 293982 - RNA, 32 nt, Human
aauaaaaugcagaugauugcgcggcuuugaaa

SEQ ID NO: 293983 - RNA, 32 nt, Human
aauaaaauggaauguuuucgucucuacauuca

SEQ ID NO: 293984 - RNA, 31 nt, Human
aauaaaauggaccucuauacacacaccuguc

SEQ ID NO: 293985 - RNA, 32 nt, Human
aauaaaauggaucugccagcaaagggauggaa

SEQ ID NO: 293986 - RNA, 32 nt, Human
aauaaaauguucuccaagagccuggcuuuuua

SEQ ID NO: 293987 - RNA, 32 nt, Human
aauaaaauucaaggccucuccauauuaaaaac

SEQ ID NO: 293988 - RNA, 32 nt, Human
aauaaaauucuuuagcaauagacuccugcaaa

SEQ ID NO: 293989 - RNA, 32 nt, Human
aauaaacaaacaaaaagaaacaacccuuaaga

SEQ ID NO: 293990 - RNA, 32 nt, Human
aauaaacaacccaacaugaaaaggugacaagc

SEQ ID NO: 293991 - RNA, 32 nt, Human
aauaaacacaacaaugaguuaggucuuuauca

SEQ ID NO: 293992 - RNA, 32 nt, Human
aauaaacacacaaauuuccuacagccuuaaaa

SEQ ID NO: 293993 - RNA, 19 nt, Human
aauaaacacagccuuuaua

SEQ ID NO: 293994 - RNA, 31 nt, Human
aauaaacacauacccgagacuggguaauuua

SEQ ID NO: 293995 - RNA, 32 nt, Human
aauaaacacauacuugagacuggguaauuuau

SEQ ID NO: 293996 - RNA, 32 nt, Human
aauaaacacauacuuuuaagguauuaucucag

SEQ ID NO: 293997 - RNA, 32 nt, Human
aauaaacacauuaaaggcugggcgcgguggcu

SEQ ID NO: 293998 - RNA, 20 nt, Human
aauaaacacauuguuuuaua

SEQ ID NO: 293999 - RNA, 32 nt, Human
aauaaacaggcaggagcuagucaggugcaugu

SEQ ID NO: 294000 - RNA, 32 nt, Human
aauaaacagguuacagaauuucggcuagcacu

SEQ ID NO: 294001 - RNA, 32 nt, Human
aauaaacaguauauucuuugguugugaauccu

SEQ ID NO: 294002 - RNA, 32 nt, Human
aauaaacaugaccacgaagaaugcuguucuga

SEQ ID NO: 294003 - RNA, 32 nt, Human
aauaaacauuucucaguaacuuugccuuuaug

SEQ ID NO: 294004 - RNA, 24 nt, Human
aauaaaccauuuuguauguuugga

SEQ ID NO: 294005 - RNA, 32 nt, Human
aauaaacccagcaaagaacuagcagagcuggu

SEQ ID NO: 294006 - RNA, 32 nt, Human
aauaaaccuaaccuuuuaacagggucuaacau

SEQ ID NO: 294007 - RNA, 21 nt, Human
aauaaaccuguccacaaugaa

SEQ ID NO: 294008 - RNA, 32 nt, Human
aauaaacggacguuugagcucacguggcggcc

SEQ ID NO: 294009 - RNA, 32 nt, Human
aauaaacuaaagauuagagcauguuccaguua

SEQ ID NO: 294010 - RNA, 32 nt, Human
aauaaacuagaaaaucuagaagaaauggauaa

SEQ ID NO: 294011 - RNA, 32 nt, Human
aauaaacucagcugcuagagugccgaugucag

SEQ ID NO: 294012 - RNA, 32 nt, Human
aauaaacucccaggccccgcccacgccccgcc

SEQ ID NO: 294013 - RNA, 32 nt, Human
aauaaacucuggacaaugaccagcacagagcc

SEQ ID NO: 294014 - RNA, 21 nt, Human
aauaaacugacaugcaugcuu

SEQ ID NO: 294015 - RNA, 32 nt, Human
aauaaacugcccucaguaaauccaugguuaau

SEQ ID NO: 294016 - RNA, 32 nt, Human
aauaaacuggccaaagaugaggcuaauuguaa

SEQ ID NO: 294017 - RNA, 32 nt, Human
aauaaacuguaacacuguaccuacuagguucc

SEQ ID NO: 294018 - RNA, 22 nt, Human
aauaaacuguccuugcuuugga

SEQ ID NO: 294019 - RNA, 20 nt, Human
aauaaacugugguauuucuu

SEQ ID NO: 294020 - RNA, 24 nt, Human
aauaaacuguuaggugcucuugaa

SEQ ID NO: 294021 - RNA, 20 nt, Human
aauaaacuguuugacuugaa

SEQ ID NO: 294022 - RNA, 22 nt, Human
aauaaacuguuuguaccuggaa

SEQ ID NO: 294023 - RNA, 21 nt, Human
aauaaacuguuuucuuuugga

SEQ ID NO: 294024 - RNA, 32 nt, Human
aauaaacuuaggacacagcagacggcccaucc

SEQ ID NO: 294025 - RNA, 32 nt, Human
aauaaacuuggcuucuuuauacaucuguaaaa

SEQ ID NO: 294026 - RNA, 32 nt, Human
aauaaagaagaaaaacaggaaagaagagggaa

SEQ ID NO: 294027 - RNA, 32 nt, Human
aauaaagaaugagaaaaagaagaaauuauaag

SEQ ID NO: 294028 - RNA, 32 nt, Human
aauaaagacaaaugcaacauuuuaaggcaaug

SEQ ID NO: 294029 - RNA, 32 nt, Human
aauaaagacaauucaaccagcucccaccaaaa

SEQ ID NO: 294030 - RNA, 32 nt, Human
aauaaagacauaucauuaugcauuguaaacug

SEQ ID NO: 294031 - RNA, 32 nt, Human
aauaaagagaaaagggaaccuuggagcuggga

SEQ ID NO: 294032 - RNA, 32 nt, Human
aauaaagagccagcccccuuccauuuagucuc

SEQ ID NO: 294033 - RNA, 24 nt, Human
aauaaagagcucacuuccccccag

SEQ ID NO: 294034 - RNA, 20 nt, Human
aauaaagaggguaaagggaa

SEQ ID NO: 294035 - RNA, 21 nt, Human
aauaaagaguaggcuauaagg

SEQ ID NO: 294036 - RNA, 29 nt, Human
aauaaagaguaugauugugguucaaggau

SEQ ID NO: 294037 - RNA, 32 nt, Human
aauaaagagugauaugcuuagagauagauaau

SEQ ID NO: 294038 - RNA, 32 nt, Human
aauaaagaguggguggccugcccagcccagca

SEQ ID NO: 294039 - RNA, 32 nt, Human
aauaaagaguguuccagguaugacagcuaccu

SEQ ID NO: 294040 - RNA, 20 nt, Human
aauaaagaugauugaaucca

SEQ ID NO: 294041 - RNA, 32 nt, Human
aauaaagauuccauggguugaacaagccacgu

SEQ ID NO: 294042 - RNA, 32 nt, Human
aauaaagcaaaucugcauaaaugguaaccagu

SEQ ID NO: 294043 - RNA, 32 nt, Human
aauaaagcauccaggauucagugaagaacuga

SEQ ID NO: 294044 - RNA, 32 nt, Human
aauaaagccacugggccaggaacucaccuuuc

SEQ ID NO: 294045 - RNA, 32 nt, Human
aauaaagcuguccauucaauuccaaauacugg

SEQ ID NO: 294046 - RNA, 21 nt, Human
aauaaagcuguucuucaucua

SEQ ID NO: 294047 - RNA, 32 nt, Human
aauaaaggagaaaaugcaggagagaguaggga

SEQ ID NO: 294048 - RNA, 32 nt, Human
aauaaaggagaaagaggaagauggaauccugg

SEQ ID NO: 294049 - RNA, 32 nt, Human
aauaaagggaaagggaagucguggagaggcag

SEQ ID NO: 294050 - RNA, 32 nt, Human
aauaaagggagaagagggaaaacagaaaaccu

SEQ ID NO: 294051 - RNA, 32 nt, Human
aauaaagggccuuuugcugguggagggcacuc

SEQ ID NO: 294052 - RNA, 32 nt, Human
aauaaaggggaaaugguccuagccuggccccu

SEQ ID NO: 294053 - RNA, 32 nt, Human
aauaaaggugugaggaggcuggggccaguuga

SEQ ID NO: 294054 - RNA, 32 nt, Human
aauaaagguguuucucuuccuccuucuccucc

SEQ ID NO: 294055 - RNA, 32 nt, Human
aauaaaguaagccauggacagaauguggucug

SEQ ID NO: 294056 - RNA, 32 nt, Human
aauaaaguaauuauggaaaauauuuuaaacuc

SEQ ID NO: 294057 - RNA, 31 nt, Human
aauaaaguacuuuucucaugccgggaccaaa

SEQ ID NO: 294058 - RNA, 32 nt, Human
aauaaaguauuuuugugaugaggaaaucccua

SEQ ID NO: 294059 - RNA, 23 nt, Human
aauaaaguccaaagucugaucug

SEQ ID NO: 294060 - RNA, 32 nt, Human
aauaaagugcaagcucucucccuaccugaaac

SEQ ID NO: 294061 - RNA, 22 nt, Human
aauaaagugggggcaaccccug

SEQ ID NO: 294062 - RNA, 32 nt, Human
aauaaaguguucuauuaaccugaucucuuugc

SEQ ID NO: 294063 - RNA, 24 nt, Human
aauaaaguucaaagcaaccaccug

SEQ ID NO: 294064 - RNA, 32 nt, Human
aauaaaguucuguuauauuuccuugcucgagu

SEQ ID NO: 294065 - RNA, 32 nt, Human
aauaaaguugaaguucaggucuugccauugcc

SEQ ID NO: 294066 - RNA, 32 nt, Human
aauaaaguuuaacuggaacacagcgguucaug

SEQ ID NO: 294067 - RNA, 32 nt, Human
aauaaaguuuauaggcugggcgagguggcuca

SEQ ID NO: 294068 - RNA, 32 nt, Human
aauaaauaaaauaaaauaaagcaccauuuugu

SEQ ID NO: 294069 - RNA, 32 nt, Human
aauaaauaaauaaaaugcgggccaggcacagu

SEQ ID NO: 294070 - RNA, 32 nt, Human
aauaaauacaaggauucguuuagcuaauucaa

SEQ ID NO: 294071 - RNA, 23 nt, Human
aauaaauacaauauugcauuccc

SEQ ID NO: 294072 - RNA, 25 nt, Human
aauaaauacaauauugcauucccau

SEQ ID NO: 294073 - RNA, 32 nt, Human
aauaaauacagaaugccauguucuccacuucu

SEQ ID NO: 294074 - RNA, 24 nt, Human
aauaaauacauuuuggugugacua

SEQ ID NO: 294075 - RNA, 32 nt, Human
aauaaauacuucuggucugauaccuaaggagc

SEQ ID NO: 294076 - RNA, 32 nt, Human
aauaaauaguacacuggcuguuuucugccagc

SEQ ID NO: 294077 - RNA, 32 nt, Human
aauaaauauugugguuuuaucuacguuauugg

SEQ ID NO: 294078 - RNA, 32 nt, Human
aauaaaucacuuaucaaaaugugaacuguuuu

SEQ ID NO: 294079 - RNA, 32 nt, Human
aauaaaucagaagaacucugauugccagaggc

SEQ ID NO: 294080 - RNA, 32 nt, Human
aauaaaucaguuauuugaaacauaaaaaugaa

SEQ ID NO: 294081 - RNA, 32 nt, Human
aauaaaucuauccugaaagcuauauaauauau

SEQ ID NO: 294082 - RNA, 32 nt, Human
aauaaaucucugcuuuuguugcuucauucuuu

SEQ ID NO: 294083 - RNA, 32 nt, Human
aauaaaucugggcuuagggaaggagagaccuu

SEQ ID NO: 294084 - RNA, 32 nt, Human
aauaaaugaugcaaguugucaauggaugagug

SEQ ID NO: 294085 - RNA, 32 nt, Human
aauaaaugcaacuuauguuuucuuguugguuc

SEQ ID NO: 294086 - RNA, 32 nt, Human
aauaaaugcccaauaaauauuuguugaccaua

SEQ ID NO: 294087 - RNA, 32 nt, Human
aauaaauggaaagacacuccauguucauggau

SEQ ID NO: 294088 - RNA, 32 nt, Human
aauaaauggaaagggaacauagaaauaacacu

SEQ ID NO: 294089 - RNA, 32 nt, Human
aauaaauggcucgugggcucuggcucccuggg

SEQ ID NO: 294090 - RNA, 32 nt, Human
aauaaaugggauuugcaugaacuccacucuga

SEQ ID NO: 294091 - RNA, 32 nt, Human
aauaaaugguauagcaaauguuuugacaugaa

SEQ ID NO: 294092 - RNA, 32 nt, Human
aauaaauggugugauggauggaacuaacugga

SEQ ID NO: 294093 - RNA, 32 nt, Human
aauaaaugguuuucuuggcuuccuccuuacuc

SEQ ID NO: 294094 - RNA, 32 nt, Human
aauaaauguaaugugcuuaaaucuuuuggccc

SEQ ID NO: 294095 - RNA, 32 nt, Human
aauaaaugucauccucuucuccaucuucauuu

SEQ ID NO: 294096 - RNA, 32 nt, Human
aauaaaugucucugauuacuuugcuaccuuua

SEQ ID NO: 294097 - RNA, 32 nt, Human
aauaaaugucugcagugaaaagcuggagcccu

SEQ ID NO: 294098 - RNA, 32 nt, Human
aauaaauguuauauaaggaaacucaccuauuu

SEQ ID NO: 294099 - RNA, 32 nt, Human
aauaaauuaaugauguuuauuggguuuaaaaa

SEQ ID NO: 294100 - RNA, 22 nt, Human
aauaaauuccuucuaaaccaca

SEQ ID NO: 294101 - RNA, 32 nt, Human
aauaaauucuuuccuuuucuuuauucuugcuc

SEQ ID NO: 294102 - RNA, 32 nt, Human
aauaaauugccucccuuccuccgcuccccuuu

SEQ ID NO: 294103 - RNA, 32 nt, Human
aauaaauugugcucuuugucauggcaaccagc

SEQ ID NO: 294104 - RNA, 32 nt, Human
aauaaauuguugucgaugauagucaccuuuag

SEQ ID NO: 294105 - RNA, 24 nt, Human
aauaaauuuucuuccaugcuugaa

SEQ ID NO: 294106 - RNA, 32 nt, Human
aauaacaaaaucagaccuuggucugguccacu

SEQ ID NO: 294107 - RNA, 32 nt, Human
aauaacaaaauguacagcaagccuauguaguu

SEQ ID NO: 294108 - RNA, 32 nt, Human
aauaacaaaggcaguccgcauucuucccuuuc

SEQ ID NO: 294109 - RNA, 31 nt, Human
aauaacaacaacaacaaaacagcagaggaau

SEQ ID NO: 294110 - RNA, 32 nt, Human
aauaacaacuugacacagcuuagagacuaaaa

SEQ ID NO: 294111 - RNA, 32 nt, Human
aauaacaagcugaccuuggcaccccgcuuccu

SEQ ID NO: 294112 - RNA, 32 nt, Human
aauaacaagcuuuucugaagugagaagcuguu

SEQ ID NO: 294113 - RNA, 32 nt, Human
aauaacaaugguccuuacacuaccacaacauu

SEQ ID NO: 294114 - RNA, 32 nt, Human
aauaacacucaaauugcagcagccugggguca

SEQ ID NO: 294115 - RNA, 32 nt, Human
aauaacagauacaaagauaacaaaagcuuuac

SEQ ID NO: 294116 - RNA, 32 nt, Human
aauaacagccugagguuccaauucuuuaucau

SEQ ID NO: 294117 - RNA, 21 nt, Human
aauaacagcuauaccugaggu

SEQ ID NO: 294118 - RNA, 24 nt, Human
aauaacaggcccaagccuguggua

SEQ ID NO: 294119 - RNA, 32 nt, Human
aauaacaggcugggugcaauggcucacaccug

SEQ ID NO: 294120 - RNA, 22 nt, Human
aauaacaguaauuaauugugua

SEQ ID NO: 294121 - RNA, 32 nt, Human
aauaacaucacacugagggagcuuguacagaa

SEQ ID NO: 294122 - RNA, 32 nt, Human
aauaacaucucuacuugucacuuugccagugg

SEQ ID NO: 294123 - RNA, 32 nt, Human
aauaacaugccggcaagguugcagagaaaagg

SEQ ID NO: 294124 - RNA, 32 nt, Human
aauaacauggcacuucagcagagauucauaga

SEQ ID NO: 294125 - RNA, 32 nt, Human
aauaacauguaacccagauuaagugucauucc

SEQ ID NO: 294126 - RNA, 32 nt, Human
aauaacauugaauauuauaaugaagauguuug

SEQ ID NO: 294127 - RNA, 32 nt, Human
aauaacauuuaccuucagccuccaucagaaug

SEQ ID NO: 294128 - RNA, 32 nt, Human
aauaaccaauccagaugccagcagccugucaa

SEQ ID NO: 294129 - RNA, 32 nt, Human
aauaaccaauuuggauaccaucaagacaccug

SEQ ID NO: 294130 - RNA, 32 nt, Human
aauaaccacugcacuccaaccugggcaacaug

SEQ ID NO: 294131 - RNA, 32 nt, Human
aauaaccaucuucucaacaugaccugcuuaac

SEQ ID NO: 294132 - RNA, 28 nt, Human
aauaacccaagugacuccuuucuaguga

SEQ ID NO: 294133 - RNA, 32 nt, Human
aauaacccaguucugcaccacugguuuuugua

SEQ ID NO: 294134 - RNA, 32 nt, Human
aauaacccaucauaauccaaacaaaugaugcc

SEQ ID NO: 294135 - RNA, 32 nt, Human
aauaaccccauucauuucgacagggaaacgcu

SEQ ID NO: 294136 - RNA, 32 nt, Human
aauaaccccuuucugcuguucucccaugaucc

SEQ ID NO: 294137 - RNA, 32 nt, Human
aauaacccuagaagaugcaugccuucgacacu

SEQ ID NO: 294138 - RNA, 32 nt, Human
aauaaccgacuugcccagcugcccgguggugc

SEQ ID NO: 294139 - RNA, 32 nt, Human
aauaaccggaggcaggcugggugcaguggcuc

SEQ ID NO: 294140 - RNA, 32 nt, Human
aauaaccuacugggaaagauggaggucuaaau

SEQ ID NO: 294141 - RNA, 32 nt, Human
aauaaccucugccucccccaccccuuaacuuu

SEQ ID NO: 294142 - RNA, 32 nt, Human
aauaaccugcaauaacuugaaaugcauacccu

SEQ ID NO: 294143 - RNA, 32 nt, Human
aauaaccugcgauggccaaggcuguuuaagcg

SEQ ID NO: 294144 - RNA, 32 nt, Human
aauaaccuuaggcauagccauaggugaggacu

SEQ ID NO: 294145 - RNA, 32 nt, Human
aauaacguuccccagcaccccaaauggauuuc

SEQ ID NO: 294146 - RNA, 32 nt, Human
aauaacuaccauauauaacguguuauugccau

SEQ ID NO: 294147 - RNA, 32 nt, Human
aauaacuacuucugaacuccugagaucuagug

SEQ ID NO: 294148 - RNA, 32 nt, Human
aauaacuauccagcacucaccaugaaaguuaa

SEQ ID NO: 294149 - RNA, 32 nt, Human
aauaacucacaaucuuccugugcccggcuauu

SEQ ID NO: 294150 - RNA, 32 nt, Human
aauaacucagaguucugcccuuccucacauuc

SEQ ID NO: 294151 - RNA, 32 nt, Human
aauaacucauuuuucuuagagaacuaaaguag

SEQ ID NO: 294152 - RNA, 32 nt, Human
aauaacuccauucaaauuuuacauuauaaagc

SEQ ID NO: 294153 - RNA, 32 nt, Human
aauaacuccuccaguaauagagcuaggccuga

SEQ ID NO: 294154 - RNA, 32 nt, Human
aauaacucuucaggcugccucuccucgaaaag

SEQ ID NO: 294155 - RNA, 32 nt, Human
aauaacugaaacccagggggacagcagagcuu

SEQ ID NO: 294156 - RNA, 32 nt, Human
aauaacugacccucccuuccuguccgcccucu

SEQ ID NO: 294157 - RNA, 32 nt, Human
aauaacugaguuauauucacuguggcucaaac

SEQ ID NO: 294158 - RNA, 32 nt, Human
aauaacugcaccugaauuuguuuaugugccuu

SEQ ID NO: 294159 - RNA, 32 nt, Human
aauaacugccuauccagauaugccacacuucu

SEQ ID NO: 294160 - RNA, 32 nt, Human
aauaacugccugcugcucagagaugaucuuua

SEQ ID NO: 294161 - RNA, 32 nt, Human
aauaacugggagaugaaacaggaagcucuaug

SEQ ID NO: 294162 - RNA, 32 nt, Human
aauaacugggcuguugaugcaggucaggugga

SEQ ID NO: 294163 - RNA, 32 nt, Human
aauaacuggugugguuucucucuccugacuca

SEQ ID NO: 294164 - RNA, 32 nt, Human
aauaacuguucugcucauggaagucuuaaaca

SEQ ID NO: 294165 - RNA, 32 nt, Human
aauaacuugucuaacaacucucuaauagggac

SEQ ID NO: 294166 - RNA, 32 nt, Human
aauaacuuuguugccauagaagaagaaccgca

SEQ ID NO: 294167 - RNA, 32 nt, Human
aauaagaaaagcuuucagaaccaggaaggacg

SEQ ID NO: 294168 - RNA, 32 nt, Human
aauaagaacccagcagcauggaacuucccacu

SEQ ID NO: 294169 - RNA, 32 nt, Human
aauaagaacguggccaccugcccagcuucaca

SEQ ID NO: 294170 - RNA, 32 nt, Human
aauaagaagguugaggcugaagagugaggacu

SEQ ID NO: 294171 - RNA, 32 nt, Human
aauaagaaucaucagagagcuguauccauguc

SEQ ID NO: 294172 - RNA, 32 nt, Human
aauaagacacagauugcugggcucauggucag

SEQ ID NO: 294173 - RNA, 32 nt, Human
aauaagacauugaaggaccaauuuagacuuag

SEQ ID NO: 294174 - RNA, 32 nt, Human
aauaagacccaauucuuaacagucuuuucuac

SEQ ID NO: 294175 - RNA, 32 nt, Human
aauaagagagaaaguggaggagagggacaaaa

SEQ ID NO: 294176 - RNA, 32 nt, Human
aauaagagcucaggaugagggaaaagaaaaag

SEQ ID NO: 294177 - RNA, 32 nt, Human
aauaagagggagagaauuaagagaggaagcaa

SEQ ID NO: 294178 - RNA, 31 nt, Human
aauaagaucaauaaauacuuguggaaugcaa

SEQ ID NO: 294179 - RNA, 32 nt, Human
aauaagaucagguacugugucagcauugauuu

SEQ ID NO: 294180 - RNA, 32 nt, Human
aauaagauggaaccaggaaaccuagcaauagu

SEQ ID NO: 294181 - RNA, 31 nt, Human
aauaagaugugcaaagggcuugcaggucugc

SEQ ID NO: 294182 - RNA, 32 nt, Human
aauaagauuuucugauuguccagaagacauuu

SEQ ID NO: 294183 - RNA, 32 nt, Human
aauaagcaaaacugauccaugguguuagaagc

SEQ ID NO: 294184 - RNA, 18 nt, Human
aauaagcaaaggauuuca

SEQ ID NO: 294185 - RNA, 32 nt, Human
aauaagcaacagacccguuuccgggugcaucu

SEQ ID NO: 294186 - RNA, 32 nt, Human
aauaagcaaccaggaguaaucugacucuaaaa

SEQ ID NO: 294187 - RNA, 31 nt, Human
aauaagcacaauaaauaucuuuuuggauaca

SEQ ID NO: 294188 - RNA, 32 nt, Human
aauaagcacugggagauuggaagcacugcuaa

SEQ ID NO: 294189 - RNA, 32 nt, Human
aauaagcagacagaaucaaccacuaaagguag

SEQ ID NO: 294190 - RNA, 32 nt, Human
aauaagcagcaccccgcaugcacuacccccau

SEQ ID NO: 294191 - RNA, 32 nt, Human
aauaagcauggacugcaaccaccuacaugaau

SEQ ID NO: 294192 - RNA, 32 nt, Human
aauaagcauuuaaagugcugaagaggauuuau

SEQ ID NO: 294193 - RNA, 32 nt, Human
aauaagccaaagaauaccaggccaagguguga

SEQ ID NO: 294194 - RNA, 32 nt, Human
aauaagccagugaccagauuucccccagaugu

SEQ ID NO: 294195 - RNA, 32 nt, Human
aauaagccuaucuuuuugugcuuacauacuua

SEQ ID NO: 294196 - RNA, 32 nt, Human
aauaagcuacuauccugaggcugaggguuuug

SEQ ID NO: 294197 - RNA, 32 nt, Human
aauaagcucagcuaauucaagacacuguaguc

SEQ ID NO: 294198 - RNA, 32 nt, Human
aauaagcucuucuucuuugugcuccacuucag

SEQ ID NO: 294199 - RNA, 32 nt, Human
aauaagcuugccaacauaauggacuugaacaa

SEQ ID NO: 294200 - RNA, 32 nt, Human
aauaaggagacaaggacacagacauguacaga

SEQ ID NO: 294201 - RNA, 32 nt, Human
aauaaggaugaaauaaucacucauucuaugaa

SEQ ID NO: 294202 - RNA, 32 nt, Human
aauaaggauucccauuccccgaguauucuggu

SEQ ID NO: 294203 - RNA, 32 nt, Human
aauaaggcauacaggaccugguaugccaaacu

SEQ ID NO: 294204 - RNA, 32 nt, Human
aauaagggaaaaaugggaacuggagagugugg

SEQ ID NO: 294205 - RNA, 32 nt, Human
aauaagggacuugcagcucaaguauaucugug

SEQ ID NO: 294206 - RNA, 32 nt, Human
aauaagggaggagagaggacuggagagugugg

SEQ ID NO: 294207 - RNA, 32 nt, Human
aauaagggaggagaggggacuggagagugugg

SEQ ID NO: 294208 - RNA, 32 nt, Human
aauaaggucauuuuucuccaucaggggcaaau

SEQ ID NO: 294209 - RNA, 32 nt, Human
aauaaguaaaacacuuggccucgaggccuuuu

SEQ ID NO: 294210 - RNA, 32 nt, Human
aauaaguagacuguuuuuaugugugaauuaua

SEQ ID NO: 294211 - RNA, 32 nt, Human
aauaaguauacaagaucacagaccuaaauuga

SEQ ID NO: 294212 - RNA, 32 nt, Human
aauaaguauucuugcaucuggccuuagaaaug

SEQ ID NO: 294213 - RNA, 32 nt, Human
aauaagucauaccuucuuaaaacagaaaauuu

SEQ ID NO: 294214 - RNA, 32 nt, Human
aauaagucuaaaggcagagccccagccucaga

SEQ ID NO: 294215 - RNA, 32 nt, Human
aauaagucucucauaaugagugcagugucaga

SEQ ID NO: 294216 - RNA, 32 nt, Human
aauaagucugccucugccucugccucacccug

SEQ ID NO: 294217 - RNA, 32 nt, Human
aauaagugaacaaguaaugaagauuucaccug

SEQ ID NO: 294218 - RNA, 32 nt, Human
aauaagugaaguugccagaaauggucaacuga

SEQ ID NO: 294219 - RNA, 32 nt, Human
aauaagugauacuuuggaaagaugcaugccag

SEQ ID NO: 294220 - RNA, 32 nt, Human
aauaagugcaguuugcugucucuugcauccag

SEQ ID NO: 294221 - RNA, 32 nt, Human
aauaagugcucaauaaauacugagugaaaucc

SEQ ID NO: 294222 - RNA, 32 nt, Human
aauaaguggacuuucugucugccuuguacuuc

SEQ ID NO: 294223 - RNA, 32 nt, Human
aauaaguguacauauguaaaauauuguuacua

SEQ ID NO: 294224 - RNA, 32 nt, Human
aauaaguguuggggucugucccuucccaagca

SEQ ID NO: 294225 - RNA, 32 nt, Human
aauaaguugauguuuucuaaggcccuuuuucc

SEQ ID NO: 294226 - RNA, 32 nt, Human
aauaaguuucaaggagacuaucaggauuauua

SEQ ID NO: 294227 - RNA, 32 nt, Human
aauaauaaagaauagcuuuaaugauaugcuug

SEQ ID NO: 294228 - RNA, 28 nt, Human
aauaauaaagugaaaauauuaacauuug

SEQ ID NO: 294229 - RNA, 32 nt, Human
aauaauaacaggcugggugcaauggcucacac

SEQ ID NO: 294230 - RNA, 32 nt, Human
aauaauaacauacccacacaauuaauauaagg

SEQ ID NO: 294231 - RNA, 32 nt, Human
aauaauaacuuccaugcugccugcuguguucc

SEQ ID NO: 294232 - RNA, 32 nt, Human
aauaauaagauagggcugggcgcgguggcuca

SEQ ID NO: 294233 - RNA, 32 nt, Human
aauaauaaugcugcugcuacuccaaggcacac

SEQ ID NO: 294234 - RNA, 32 nt, Human
aauaauaauggugugugccugcaguccuagcu

SEQ ID NO: 294235 - RNA, 32 nt, Human
aauaauacgaugaaaacuaacauccuuauuuu

SEQ ID NO: 294236 - RNA, 32 nt, Human
aauaauacgggugccacacacagugaucaccu

SEQ ID NO: 294237 - RNA, 32 nt, Human
aauaauacugcaagaaaacuauggcugaacuu

SEQ ID NO: 294238 - RNA, 32 nt, Human
aauaauacugcuauauguguagaaggaaaauu

SEQ ID NO: 294239 - RNA, 32 nt, Human
aauaauacuuccuucucagaaggaggcucccg

SEQ ID NO: 294240 - RNA, 32 nt, Human
aauaauaggacaggacacagagcuggaauauu

SEQ ID NO: 294241 - RNA, 32 nt, Human
aauaauaggagagaaagagagaaacuucagaa

SEQ ID NO: 294242 - RNA, 32 nt, Human
aauaauaggagcaaccugcucucgagagucca

SEQ ID NO: 294243 - RNA, 32 nt, Human
aauaauaggcuacucgggaggcugaggcugga

SEQ ID NO: 294244 - RNA, 32 nt, Human
aauaauagguaaaugcaacagaaacagaagga

SEQ ID NO: 294245 - RNA, 31 nt, Human
aauaauauaauaaaagccuguugaggguccu

SEQ ID NO: 294246 - RNA, 32 nt, Human
aauaauaucccccaguauuuuccauauuaaau

SEQ ID NO: 294247 - RNA, 32 nt, Human
aauaauauuaauguagcuuuuucccaaaugaa

SEQ ID NO: 294248 - RNA, 32 nt, Human
aauaauauucuuacuguccaaggcuuaagugg

SEQ ID NO: 294249 - RNA, 32 nt, Human
aauaauauuugcuuuuguugaaugacuacuaa

SEQ ID NO: 294250 - RNA, 32 nt, Human
aauaaucaaaacugauaacaaugaaacugcgg

SEQ ID NO: 294251 - RNA, 32 nt, Human
aauaaucaagagccuuaaaacaucauuccuuu

SEQ ID NO: 294252 - RNA, 32 nt, Human
aauaaucacaauauauucaucccuucaguucu

SEQ ID NO: 294253 - RNA, 32 nt, Human
aauaaucacuaaaggccaggugcaguggccca

SEQ ID NO: 294254 - RNA, 32 nt, Human
aauaaucaggaggcuggguuugugcuuggcuc

SEQ ID NO: 294255 - RNA, 32 nt, Human
aauaaucauaucucuuuugacauuuuggaaau

SEQ ID NO: 294256 - RNA, 32 nt, Human
aauaaucaucacaaugaucaaaucacugaacc

SEQ ID NO: 294257 - RNA, 32 nt, Human
aauaauccaagcuugcaccacauucagcauua

SEQ ID NO: 294258 - RNA, 32 nt, Human
aauaaucccagugccauuugucugugcaaaga

SEQ ID NO: 294259 - RNA, 32 nt, Human
aauaauccucaggauuuuacaggcuggguaua

SEQ ID NO: 294260 - RNA, 32 nt, Human
aauaauccugcagguuuuauuguuaugaauaa

SEQ ID NO: 294261 - RNA, 32 nt, Human
aauaaucgcuugaacccaggaggcagagguug

SEQ ID NO: 294262 - RNA, 32 nt, Human
aauaaucgucauaggaaagacgugccaguugu

SEQ ID NO: 294263 - RNA, 32 nt, Human
aauaaucgucuccuuugacauuuccuucuuug

SEQ ID NO: 294264 - RNA, 32 nt, Human
aauaaucuaaaucauuagggcagcaguuucuc

SEQ ID NO: 294265 - RNA, 32 nt, Human
aauaaucuacagccuuccuuccccggaugccu

SEQ ID NO: 294266 - RNA, 32 nt, Human
aauaaucuccaaaagugacuuuuuggcuguuc

SEQ ID NO: 294267 - RNA, 32 nt, Human
aauaaucucuccccaaauuuuccaauaauaau

SEQ ID NO: 294268 - RNA, 32 nt, Human
aauaaucugggacccaggcuugugcccuuuca

SEQ ID NO: 294269 - RNA, 32 nt, Human
aauaaucuguaguuuccaggacaguggcagag

SEQ ID NO: 294270 - RNA, 32 nt, Human
aauaaucuuacucuagauaccuaaaacauaag

SEQ ID NO: 294271 - RNA, 32 nt, Human
aauaaucuugcuguuuuuccucuuuaugacaa

SEQ ID NO: 294272 - RNA, 32 nt, Human
aauaaucuuuuguaacacuuauacacugcugg

SEQ ID NO: 294273 - RNA, 32 nt, Human
aauaaugaaugagauuaauuaagaaaugaaug

SEQ ID NO: 294274 - RNA, 32 nt, Human
aauaaugacaccccacugucuccuugcccuca

SEQ ID NO: 294275 - RNA, 32 nt, Human
aauaaugacuauuucaaaauugcuaaaagaug

SEQ ID NO: 294276 - RNA, 32 nt, Human
aauaaugaggccaguagcaccugcuggacagg

SEQ ID NO: 294277 - RNA, 32 nt, Human
aauaaugauuggccuucuguuuggaagaucag

SEQ ID NO: 294278 - RNA, 32 nt, Human
aauaaugcacagaaaaaugcagccuauaauuu

SEQ ID NO: 294279 - RNA, 32 nt, Human
aauaaugcagugguuucuaucaugcuaauuua

SEQ ID NO: 294280 - RNA, 32 nt, Human
aauaaugcauaucagaaucuuuauauggaaga

SEQ ID NO: 294281 - RNA, 32 nt, Human
aauaaugcuaucuuauccuuuuuagugcuauu

SEQ ID NO: 294282 - RNA, 32 nt, Human
aauaaugcuguuguguuagcucugaguagaaa

SEQ ID NO: 294283 - RNA, 32 nt, Human
aauaauggcaaaaacuggcugggcacaguggc

SEQ ID NO: 294284 - RNA, 32 nt, Human
aauaauggccaucaugacuauagaaugcaagg

SEQ ID NO: 294285 - RNA, 32 nt, Human
aauaaugggaugucaucaccauugcuagaaua

SEQ ID NO: 294286 - RNA, 32 nt, Human
aauaauggggucuuuuauaaauccaaaguacu

SEQ ID NO: 294287 - RNA, 32 nt, Human
aauaaugguagaaaaugucccagcuuugauga

SEQ ID NO: 294288 - RNA, 32 nt, Human
aauaauggucccauccaggcagucgggggcug

SEQ ID NO: 294289 - RNA, 32 nt, Human
aauaaugguggcaguggugggauaaacggaga

SEQ ID NO: 294290 - RNA, 32 nt, Human
aauaauguaauacuguagaaauauugcucuaa

SEQ ID NO: 294291 - RNA, 32 nt, Human
aauaauguaccuauuccuucagaaagaugaua

SEQ ID NO: 294292 - RNA, 32 nt, Human
aauaaugucacugaauuauacacuuuaaagug

SEQ ID NO: 294293 - RNA, 32 nt, Human
aauaaugucaucccagugcuucuggagaauag

SEQ ID NO: 294294 - RNA, 32 nt, Human
aauaaugucuccugccaguacuaaggcauggc

SEQ ID NO: 294295 - RNA, 32 nt, Human
aauaaugugagugccacgcucuuucugaagcu

SEQ ID NO: 294296 - RNA, 32 nt, Human
aauaaugugcacugaauaaauuguacagccgg

SEQ ID NO: 294297 - RNA, 32 nt, Human
aauaaugugggauccuuaucagcaugcccaca

SEQ ID NO: 294298 - RNA, 32 nt, Human
aauaaugugggcugccagccucucacaucuug

SEQ ID NO: 294299 - RNA, 32 nt, Human
aauaaugugugugaccuugcaguucuuccaca

SEQ ID NO: 294300 - RNA, 32 nt, Human
aauaauguuaaagaaaaguuaucagagaagca

SEQ ID NO: 294301 - RNA, 32 nt, Human
aauaauguucaugaccacaggcugccauagca

SEQ ID NO: 294302 - RNA, 32 nt, Human
aauaauguucucugcuacuuuuaaccugauuu

SEQ ID NO: 294303 - RNA, 32 nt, Human
aauaauuaaucaccggaauuagccagguagaa

SEQ ID NO: 294304 - RNA, 32 nt, Human
aauaauuaccauugaaaaagaaguuccuuuga

SEQ ID NO: 294305 - RNA, 32 nt, Human
aauaauucaaagccuuaaugcagaugcacuaa

SEQ ID NO: 294306 - RNA, 32 nt, Human
aauaauucaguuaaacacugcugcaauauuuc

SEQ ID NO: 294307 - RNA, 32 nt, Human
aauaauucaugcacugaauuucccuucccggc

SEQ ID NO: 294308 - RNA, 32 nt, Human
aauaauucaugccaaaaauaaaauuagcguaa

SEQ ID NO: 294309 - RNA, 32 nt, Human
aauaauucauucuugcuaagcuucauguugac

SEQ ID NO: 294310 - RNA, 32 nt, Human
aauaauuccucuuuauucuuuucauuucaacc

SEQ ID NO: 294311 - RNA, 32 nt, Human
aauaauugaaaacaccagaagguugagguuua

SEQ ID NO: 294312 - RNA, 32 nt, Human
aauaauuggaagcacaaugcauggcacugacu

SEQ ID NO: 294313 - RNA, 32 nt, Human
aauaauuguuagaaauucagaaugacaaguuu

SEQ ID NO: 294314 - RNA, 32 nt, Human
aauaauuguucuaugcuuuaauaaucuauugu

SEQ ID NO: 294315 - RNA, 32 nt, Human
aauaauuuaguggauggaauaucagaaguaua

SEQ ID NO: 294316 - RNA, 32 nt, Human
aauaauuuaucaggaaauacugccuguagagu

SEQ ID NO: 294317 - RNA, 32 nt, Human
aauaauuuaugccaggaaaccaggaagucauu

SEQ ID NO: 294318 - RNA, 32 nt, Human
aauaauuucacucaccccuccccugguuucug

SEQ ID NO: 294319 - RNA, 32 nt, Human
aauaauuuguccuauuuuucucugucacuucc

SEQ ID NO: 294320 - RNA, 32 nt, Human
aauaauuuuaugcuggacucuggaccauauac

SEQ ID NO: 294321 - RNA, 32 nt, Human
aauaauuuuaugucagcacuaaccucacuuua

SEQ ID NO: 294322 - RNA, 32 nt, Human
aauaauuuuccugcauuuucugcuuuauuuac

SEQ ID NO: 294323 - RNA, 32 nt, Human
aauaauuuucuacaaaaauuagccaggcaugg

SEQ ID NO: 294324 - RNA, 32 nt, Human
aauaauuuuuaagagauuaaagugccagaugg

SEQ ID NO: 294325 - RNA, 32 nt, Human
aauaauuuuucuuggauuuggggugaaauuuu

SEQ ID NO: 294326 - RNA, 32 nt, Human
aauacaaaaauuagcuggcaugguggugugca

SEQ ID NO: 294327 - RNA, 32 nt, Human
aauacaaaauuagcagggcaugguggcgcaug

SEQ ID NO: 294328 - RNA, 32 nt, Human
aauacaaaauuagccaggcauggugacgcaug

SEQ ID NO: 294329 - RNA, 32 nt, Human
aauacaaaauuagccaggcaugguggcacaug

SEQ ID NO: 294330 - RNA, 32 nt, Human
aauacaaaauuagccaggcaugguggcgcaug

SEQ ID NO: 294331 - RNA, 32 nt, Human
aauacaaaauuagccaggcaugguggugcaug

SEQ ID NO: 294332 - RNA, 32 nt, Human
aauacaaaauuagccgagcaugguggcucacg

SEQ ID NO: 294333 - RNA, 32 nt, Human
aauacaaaauuagccgggcaugggggcgcgca

SEQ ID NO: 294334 - RNA, 32 nt, Human
aauacaaaauuagccgggcaugguggcacaua

SEQ ID NO: 294335 - RNA, 32 nt, Human
aauacaaaauuagccgggcaugguggcacaug

SEQ ID NO: 294336 - RNA, 32 nt, Human
aauacaaaauuagccgggcaugguggugcaug

SEQ ID NO: 294337 - RNA, 32 nt, Human
aauacaaaauuagccggucaugguggugcaug

SEQ ID NO: 294338 - RNA, 32 nt, Human
aauacaaaauuagcugggcaugguggcacaug

SEQ ID NO: 294339 - RNA, 32 nt, Human
aauacaaaauuagcugggcaugguggcaugug

SEQ ID NO: 294340 - RNA, 32 nt, Human
aauacaaaauuagcugggcaugguggcgcaug

SEQ ID NO: 294341 - RNA, 32 nt, Human
aauacaaaauuagcugggcaugguggugcaug

SEQ ID NO: 294342 - RNA, 32 nt, Human
aauacaaaauuagcugggcgugguggcacaug

SEQ ID NO: 294343 - RNA, 32 nt, Human
aauacaaaauuagcugggcgugguggcacgug

SEQ ID NO: 294344 - RNA, 32 nt, Human
aauacaaaauuagcugggcgugguggcgcaug

SEQ ID NO: 294345 - RNA, 32 nt, Human
aauacaaaauuagcugggcgugguggcgcauu

SEQ ID NO: 294346 - RNA, 32 nt, Human
aauacaaaauuagcugggcgugguggcgggcg

SEQ ID NO: 294347 - RNA, 32 nt, Human
aauacaaaauuagcugggcgugguggugcgca

SEQ ID NO: 294348 - RNA, 32 nt, Human
aauacaaaauuagcugggcgugguggugugca

SEQ ID NO: 294349 - RNA, 32 nt, Human
aauacaaaauuagcugggcguggugguuugcg

SEQ ID NO: 294350 - RNA, 32 nt, Human
aauacaaaauuagcugggugggguggugcaug

SEQ ID NO: 294351 - RNA, 32 nt, Human
aauacaaaauuagcugggugugcuggugcaug

SEQ ID NO: 294352 - RNA, 32 nt, Human
aauacaaaauuagcugggugugguggcacaug

SEQ ID NO: 294353 - RNA, 32 nt, Human
aauacaaaauuagcugggugugguggcgcaug

SEQ ID NO: 294354 - RNA, 32 nt, Human
aauacaaaauuagcugggugugguggcgggug

SEQ ID NO: 294355 - RNA, 32 nt, Human
aauacaaaauuagcuggguuugguggcgcaug

SEQ ID NO: 294356 - RNA, 32 nt, Human
aauacaaaauuagucggguaugguggcacaug

SEQ ID NO: 294357 - RNA, 32 nt, Human
aauacaaacugcacuaugauuugcuuuaacua

SEQ ID NO: 294358 - RNA, 32 nt, Human
aauacaaagauaaggauggucacagugauuuc

SEQ ID NO: 294359 - RNA, 32 nt, Human
aauacaaagauggaaagccaguaaagaaguca

SEQ ID NO: 294360 - RNA, 32 nt, Human
aauacaaagcccauucuuccagagucuugugc

SEQ ID NO: 294361 - RNA, 32 nt, Human
aauacaaaguuagccaggcaugguggugcaug

SEQ ID NO: 294362 - RNA, 32 nt, Human
aauacaaaguugagccacgguccuuacuuaaa

SEQ ID NO: 294363 - RNA, 32 nt, Human
aauacaaauauuaucacauagcgucaacuuau

SEQ ID NO: 294364 - RNA, 32 nt, Human
aauacaaauauuaucacauagcgucaauuuau

SEQ ID NO: 294365 - RNA, 32 nt, Human
aauacaaaugcugggcugggcacaguggcuca

SEQ ID NO: 294366 - RNA, 32 nt, Human
aauacaacaaauuuuggacaagguuacuucau

SEQ ID NO: 294367 - RNA, 32 nt, Human
aauacaacaacaacaaaauuagcugggcauga

SEQ ID NO: 294368 - RNA, 32 nt, Human
aauacaacacaaagcaauuauucuuccuaucu

SEQ ID NO: 294369 - RNA, 32 nt, Human
aauacaacaccuugugcugaaaacuucagguu

SEQ ID NO: 294370 - RNA, 32 nt, Human
aauacaaccagcuccugcucagaacucucuuc

SEQ ID NO: 294371 - RNA, 32 nt, Human
aauacaacugcaguggggcugcuugugguuuc

SEQ ID NO: 294372 - RNA, 32 nt, Human
aauacaagauuaccugggcaugguggugcaug

SEQ ID NO: 294373 - RNA, 32 nt, Human
aauacaagccaaaacaggaauauuucuccaca

SEQ ID NO: 294374 - RNA, 32 nt, Human
aauacaagcucuccacacagguaugcuccucu

SEQ ID NO: 294375 - RNA, 32 nt, Human
aauacaaggaggaggaggguuagcaggcguuc

SEQ ID NO: 294376 - RNA, 32 nt, Human
aauacaagucauggguugccauggugauuauu

SEQ ID NO: 294377 - RNA, 32 nt, Human
aauacaaucugcuacuuuacuaauucauaaau

SEQ ID NO: 294378 - RNA, 32 nt, Human
aauacaaugcauagaguaaacaugcaacagau

SEQ ID NO: 294379 - RNA, 23 nt, Human
aauacaaugcccaugccuucugg

SEQ ID NO: 294380 - RNA, 32 nt, Human
aauacaauugcaaguauuaacagcagaguaga

SEQ ID NO: 294381 - RNA, 32 nt, Human
aauacacaaaacacacuaggggccgggcacag

SEQ ID NO: 294382 - RNA, 32 nt, Human
aauacacaaaacugggagugagagggguauuu

SEQ ID NO: 294383 - RNA, 32 nt, Human
aauacacaaaggccagggagccuuuggcuugg

SEQ ID NO: 294384 - RNA, 32 nt, Human
aauacacaauuaauuuacacacacauuuuacu

SEQ ID NO: 294385 - RNA, 32 nt, Human
aauacacacaauaucugagacacuuacacuuu

SEQ ID NO: 294386 - RNA, 24 nt, Human
aauacacacacauacguauacaca

SEQ ID NO: 294387 - RNA, 32 nt, Human
aauacacacaugcacacacauauacacacaug

SEQ ID NO: 294388 - RNA, 32 nt, Human
aauacacacccacucgcacaagcuuccaucca

SEQ ID NO: 294389 - RNA, 32 nt, Human
aauacacagaagagguuucuguuuuucugugg

SEQ ID NO: 294390 - RNA, 32 nt, Human
aauacacagaugcacacacacaagcacacaug

SEQ ID NO: 294391 - RNA, 32 nt, Human
aauacacaugaaagccagccucggcgggcaga

SEQ ID NO: 294392 - RNA, 32 nt, Human
aauacacaugcuauaaguucgccuuaagauuu

SEQ ID NO: 294393 - RNA, 32 nt, Human
aauacaccuugauuuuguaauuuagaagcaac

SEQ ID NO: 294394 - RNA, 32 nt, Human
aauacacggcugcgggaugacagggacgccug

SEQ ID NO: 294395 - RNA, 32 nt, Human
aauacacguguauaugaggauguauguguaua

SEQ ID NO: 294396 - RNA, 32 nt, Human
aauacacuaugaguuacuaaaauaucauggau

SEQ ID NO: 294397 - RNA, 32 nt, Human
aauacacucuucucucagugcaguguacauuu

SEQ ID NO: 294398 - RNA, 32 nt, Human
aauacacugaagauggagaauuuggagccugg

SEQ ID NO: 294399 - RNA, 32 nt, Human
aauacacugacacgcuacuguugguuaaauuu

SEQ ID NO: 294400 - RNA, 32 nt, Human
aauacacuguaccucuuccuugcugucucugg

SEQ ID NO: 294401 - RNA, 32 nt, Human
aauacacuucuucuuuaggcauugaagacugu

SEQ ID NO: 294402 - RNA, 32 nt, Human
aauacagaaacaacuggcaaaaaugaacuaag

SEQ ID NO: 294403 - RNA, 32 nt, Human
aauacagaauuagccaggcaugguggcacaug

SEQ ID NO: 294404 - RNA, 32 nt, Human
aauacagaauuagccaggcaugguggcguaug

SEQ ID NO: 294405 - RNA, 32 nt, Human
aauacagaauuagccgggcauggugcaugccu

SEQ ID NO: 294406 - RNA, 32 nt, Human
aauacagaauuagcugagugugguggcgcaug

SEQ ID NO: 294407 - RNA, 32 nt, Human
aauacagacaugcacauuccuguaugugcauu

SEQ ID NO: 294408 - RNA, 32 nt, Human
aauacagagauaaaagaggaguagaagguaaa

SEQ ID NO: 294409 - RNA, 32 nt, Human
aauacagagcuggacaaccucugccucggccc

SEQ ID NO: 294410 - RNA, 24 nt, Human
aauacagaguaggaaagguuugca

SEQ ID NO: 294411 - RNA, 32 nt, Human
aauacagagucuuccaggugggcauuucaacc

SEQ ID NO: 294412 - RNA, 32 nt, Human
aauacagauagaaacauagauaaauauaacua

SEQ ID NO: 294413 - RNA, 32 nt, Human
aauacagauguuuucccuuguggcagucuuca

SEQ ID NO: 294414 - RNA, 32 nt, Human
aauacagcccugaggagcaggcagcaggcuua

SEQ ID NO: 294415 - RNA, 32 nt, Human
aauacagcgacagaccuaucugaaaagucugu

SEQ ID NO: 294416 - RNA, 32 nt, Human
aauacagcucagagaauggcucuugguguggc

SEQ ID NO: 294417 - RNA, 32 nt, Human
aauacagcuucagucuggcucucuaauaggac

SEQ ID NO: 294418 - RNA, 32 nt, Human
aauacagcuuccuacauggucucccuccuucg

SEQ ID NO: 294419 - RNA, 32 nt, Human
aauacagcuucuucaucucccuaucucaugac

SEQ ID NO: 294420 - RNA, 32 nt, Human
aauacaggaacacacagggcuguguagcauga

SEQ ID NO: 294421 - RNA, 32 nt, Human
aauacagggaagcaccaacagaccauaucagu

SEQ ID NO: 294422 - RNA, 32 nt, Human
aauacagggauuacuggugugagccacugugu

SEQ ID NO: 294423 - RNA, 32 nt, Human
aauacaguauccaaacauuggagauuagugac

SEQ ID NO: 294424 - RNA, 32 nt, Human
aauacagucuacacaucuuucuuccaaagcau

SEQ ID NO: 294425 - RNA, 32 nt, Human
aauacagugccacccagauagccucacaaaac

SEQ ID NO: 294426 - RNA, 32 nt, Human
aauacagugccuggaacaauagaaagaccacc

SEQ ID NO: 294427 - RNA, 23 nt, Human
aauacaguuccuguucauccugu

SEQ ID NO: 294428 - RNA, 32 nt, Human
aauacaguugggaagggugagggugggguucu

SEQ ID NO: 294429 - RNA, 32 nt, Human
aauacaguuucuagcauuaaacaaauaaacaa

SEQ ID NO: 294430 - RNA, 32 nt, Human
aauacauaauucucuucaaagacuucagcagc

SEQ ID NO: 294431 - RNA, 32 nt, Human
aauacauauauacaaaaauuagcugggcauca

SEQ ID NO: 294432 - RNA, 32 nt, Human
aauacauauauagacacacauguacaguccgu

SEQ ID NO: 294433 - RNA, 32 nt, Human
aauacaucacgaggccagcugugugauuucug

SEQ ID NO: 294434 - RNA, 32 nt, Human
aauacaucagcaggacuggacagguuuuauau

SEQ ID NO: 294435 - RNA, 21 nt, Human
aauacaugaaacaaccaguga

SEQ ID NO: 294436 - RNA, 32 nt, Human
aauacaugaaguagugucugccauacauguua

SEQ ID NO: 294437 - RNA, 32 nt, Human
aauacaugagggaaccagaguucaaaguccua

SEQ ID NO: 294438 - RNA, 32 nt, Human
aauacaugcaugcacaugaaaacaugcacaac

SEQ ID NO: 294439 - RNA, 32 nt, Human
aauacaugccuguggucucagcuacucgggag

SEQ ID NO: 294440 - RNA, 32 nt, Human
aauacaugcucacaucuuacucaacaucagag

SEQ ID NO: 294441 - RNA, 32 nt, Human
aauacauggucugcugacuccuccucagcccc

SEQ ID NO: 294442 - RNA, 32 nt, Human
aauacauguucaugucuacaccacgcuggaac

SEQ ID NO: 294443 - RNA, 32 nt, Human
aauacauucugaaccacuuuuuccaccagcuu

SEQ ID NO: 294444 - RNA, 32 nt, Human
aauacauugaaggaguguaggggguggggguu

SEQ ID NO: 294445 - RNA, 32 nt, Human
aauacauugucacccuuccugcuuuagagagg

SEQ ID NO: 294446 - RNA, 32 nt, Human
aauacauugugccuuucucuagaugugauacg

SEQ ID NO: 294447 - RNA, 32 nt, Human
aauacauuuaaugccagccauuggaaacuagu

SEQ ID NO: 294448 - RNA, 32 nt, Human
aauacauuucauuuccuguuacccagauuguu

SEQ ID NO: 294449 - RNA, 32 nt, Human
aauacauuugauucagcuaguauuccauguca

SEQ ID NO: 294450 - RNA, 19 nt, Human
aauacauuuuugcuuacua

SEQ ID NO: 294451 - RNA, 32 nt, Human
aauaccaaagcccagauuaugagguuuuggag

SEQ ID NO: 294452 - RNA, 32 nt, Human
aauaccaauuucucugaguuucuugaaauguc

SEQ ID NO: 294453 - RNA, 32 nt, Human
aauaccagaguuagcuggguauagagguggcu

SEQ ID NO: 294454 - RNA, 32 nt, Human
aauaccagccugggcaacauagggagaccccc

SEQ ID NO: 294455 - RNA, 32 nt, Human
aauaccagccugggcaacauaguaagacccug

SEQ ID NO: 294456 - RNA, 32 nt, Human
aauaccagcuacucaggagcugaggcaggaga

SEQ ID NO: 294457 - RNA, 32 nt, Human
aauaccagcuacucaggaggcugaggcaggag

SEQ ID NO: 294458 - RNA, 32 nt, Human
aauaccagcuacucagguggcugaggcauaag

SEQ ID NO: 294459 - RNA, 32 nt, Human
aauaccagcuacuccggaggcugaggcaggag

SEQ ID NO: 294460 - RNA, 30 nt, Human
aauaccagcuugcaaugggucagcacuuua

SEQ ID NO: 294461 - RNA, 32 nt, Human
aauaccaggcaaagauuuucuucaacuauagu

SEQ ID NO: 294462 - RNA, 32 nt, Human
aauaccauacuaacugcuaaagcccuccaaga

SEQ ID NO: 294463 - RNA, 22 nt, Human
aauaccauagcugaggccacug

SEQ ID NO: 294464 - RNA, 23 nt, Human
aauaccauauuaccuugcuguug

SEQ ID NO: 294465 - RNA, 32 nt, Human
aauaccaucccauuggggguuggggcuucaac

SEQ ID NO: 294466 - RNA, 32 nt, Human
aauaccaucccccagacccgauccauucaguc

SEQ ID NO: 294467 - RNA, 24 nt, Human
aauaccaugcaaaacaggcagcug

SEQ ID NO: 294468 - RNA, 32 nt, Human
aauaccauuuuucauagaguugugccugguuu

SEQ ID NO: 294469 - RNA, 32 nt, Human
aauacccaacccaguggcaucagcagucacag

SEQ ID NO: 294470 - RNA, 32 nt, Human
aauacccaagcccucugguacccagggagcug

SEQ ID NO: 294471 - RNA, 32 nt, Human
aauacccacagcuaggacauucucucuguaau

SEQ ID NO: 294472 - RNA, 32 nt, Human
aauacccacccugccagcagcccuaggucuuc

SEQ ID NO: 294473 - RNA, 32 nt, Human
aauacccaccucagggcugauagucuuugaug

SEQ ID NO: 294474 - RNA, 32 nt, Human
aauacccacuugguugcagaggccaacuuuca

SEQ ID NO: 294475 - RNA, 32 nt, Human
aauacccagggccucaaacuugaagucacucc

SEQ ID NO: 294476 - RNA, 32 nt, Human
aauacccagucccuagaaaugugucaauaugu

SEQ ID NO: 294477 - RNA, 32 nt, Human
aauacccauccauuucuuuucagccaggggag

SEQ ID NO: 294478 - RNA, 32 nt, Human
aauacccaucucggaagaacaggugugaaugc

SEQ ID NO: 294479 - RNA, 32 nt, Human
aauaccccaaaauauggugcauggacaugcug

SEQ ID NO: 294480 - RNA, 32 nt, Human
aauaccccaaucacucagacuuacggcaacaa

SEQ ID NO: 294481 - RNA, 32 nt, Human
aauaccccacucacccagaccccacaucucca

SEQ ID NO: 294482 - RNA, 32 nt, Human
aauaccccgaagcacaggcaaccaaagcaaaa

SEQ ID NO: 294483 - RNA, 32 nt, Human
aauacccgccugaugucgugggccacaccucc

SEQ ID NO: 294484 - RNA, 32 nt, Human
aauacccuccuuggaguugcaaguauucuuuc

SEQ ID NO: 294485 - RNA, 32 nt, Human
aauacccucugccugaccaacauggugaaacc

SEQ ID NO: 294486 - RNA, 32 nt, Human
aauacccugcagcaaaaguguucacauuacug

SEQ ID NO: 294487 - RNA, 32 nt, Human
aauacccugcagccuugaccucaugggcucaa

SEQ ID NO: 294488 - RNA, 32 nt, Human
aauacccugggaacuggugaggucccaggcug

SEQ ID NO: 294489 - RNA, 32 nt, Human
aauacccuggguaugcaggacccacuauaccu

SEQ ID NO: 294490 - RNA, 32 nt, Human
aauacccugucugaccugggcucuucccgccu

SEQ ID NO: 294491 - RNA, 32 nt, Human
aauacccuguguuguggacucuuuaaaaucug

SEQ ID NO: 294492 - RNA, 32 nt, Human
aauacccuucaucccuuccuguggucccucuu

SEQ ID NO: 294493 - RNA, 32 nt, Human
aauaccggacaacgugggagauuggcuucggg

SEQ ID NO: 294494 - RNA, 32 nt, Human
aauaccgggccguguccuccccugauaggauu

SEQ ID NO: 294495 - RNA, 32 nt, Human
aauaccuacuucuuuuauuccuccuuuuggua

SEQ ID NO: 294496 - RNA, 32 nt, Human
aauaccuaggaauucauccaaccaaggggguc

SEQ ID NO: 294497 - RNA, 32 nt, Human
aauaccucauauuccccaucuuccucagccca

SEQ ID NO: 294498 - RNA, 32 nt, Human
aauaccucaucgccaugaggugaggcuaagau

SEQ ID NO: 294499 - RNA, 20 nt, Human
aauaccuccuaagaaggaca

SEQ ID NO: 294500 - RNA, 32 nt, Human
aauaccugaaaauuaagauguucaugcaagau

SEQ ID NO: 294501 - RNA, 32 nt, Human
aauaccugagcagccacaucaaaggaacuuug

SEQ ID NO: 294502 - RNA, 26 nt, Human
aauaccuggauaccaaacauacccca

SEQ ID NO: 294503 - RNA, 29 nt, Human
aauaccuggcugcugucuuaacucguagu

SEQ ID NO: 294504 - RNA, 32 nt, Human
aauaccugggaggcggagauugcagugagccg

SEQ ID NO: 294505 - RNA, 32 nt, Human
aauaccuucuauguauuagugucaacuuuuaa

SEQ ID NO: 294506 - RNA, 32 nt, Human
aauaccuugagaacugaauuuuuccaagguug

SEQ ID NO: 294507 - RNA, 32 nt, Human
aauaccuuguucucuagguccugggcuuucua

SEQ ID NO: 294508 - RNA, 32 nt, Human
aauaccuuucucaacauaaaaggacccacaca

SEQ ID NO: 294509 - RNA, 32 nt, Human
aauacgcacaauaucuuaacucuucauauuug

SEQ ID NO: 294510 - RNA, 32 nt, Human
aauacgcacuccagaugccuggaacaccauug

SEQ ID NO: 294511 - RNA, 32 nt, Human
aauacggccaagcagaaaauguuuuauauuuu

SEQ ID NO: 294512 - RNA, 25 nt, Human
aauacggucccucuucaccuucuga

SEQ ID NO: 294513 - RNA, 32 nt, Human
aauacggugagaaauuccaggagcacagaagu

SEQ ID NO: 294514 - RNA, 32 nt, Human
aauacgucgcaccagaggccacugugaugcca

SEQ ID NO: 294515 - RNA, 32 nt, Human
aauacguucuccucugaccugccuguaccacg

SEQ ID NO: 294516 - RNA, 32 nt, Human
aauacguuguuguuaacuauagucaccaugcu

SEQ ID NO: 294517 - RNA, 32 nt, Human
aauacuaaaauguaacuuuuuaaucaucuggu

SEQ ID NO: 294518 - RNA, 32 nt, Human
aauacuaaagaauucauggugagaagucuaca

SEQ ID NO: 294519 - RNA, 32 nt, Human
aauacuaagaacucacuucuguccucauccca

SEQ ID NO: 294520 - RNA, 32 nt, Human
aauacuacucaaauacuacuuuuuaaaagaga

SEQ ID NO: 294521 - RNA, 32 nt, Human
aauacuacugcugagcauuuuugaagacucuu

SEQ ID NO: 294522 - RNA, 32 nt, Human
aauacuacugucacguagcuguguacaaagag

SEQ ID NO: 294523 - RNA, 32 nt, Human
aauacuagauuugggagaagggcagaguuacu

SEQ ID NO: 294524 - RNA, 32 nt, Human
aauacuaggccucuugccuuccuuccagugag

SEQ ID NO: 294525 - RNA, 32 nt, Human
aauacuaucggggaaacggaaguggccgucgg

SEQ ID NO: 294526 - RNA, 32 nt, Human
aauacuaucuuagccaaacuugccuuugcuuc

SEQ ID NO: 294527 - RNA, 32 nt, Human
aauacuaucuuucucucuggccucuccauccu

SEQ ID NO: 294528 - RNA, 32 nt, Human
aauacuaugaaaugaaagaacuuguucacagg

SEQ ID NO: 294529 - RNA, 32 nt, Human
aauacuauguccacacagcugcagccuccuca

SEQ ID NO: 294530 - RNA, 32 nt, Human
aauacucacaaauuauuuaguauaccugaauc

SEQ ID NO: 294531 - RNA, 32 nt, Human
aauacucacagagacagaaacacugagauuuu

SEQ ID NO: 294532 - RNA, 32 nt, Human
aauacucacauucccacauacauucacuauuu

SEQ ID NO: 294533 - RNA, 32 nt, Human
aauacucaucuuacaggggaauuugugaccag

SEQ ID NO: 294534 - RNA, 32 nt, Human
aauacucauuucuacuuucugcccucaaauuu

SEQ ID NO: 294535 - RNA, 32 nt, Human
aauacucauuucuccuugucagucuccuuguc

SEQ ID NO: 294536 - RNA, 32 nt, Human
aauacuccagccuggugacagagugagacucu

SEQ ID NO: 294537 - RNA, 32 nt, Human
aauacuccagguggguguuagcacuguggugg

SEQ ID NO: 294538 - RNA, 32 nt, Human
aauacuccauuugggaacucacugccuuauaa

SEQ ID NO: 294539 - RNA, 32 nt, Human
aauacucccacagauaaaagacugcaggaucu

SEQ ID NO: 294540 - RNA, 32 nt, Human
aauacucccaccaugguugauuucaagccacc

SEQ ID NO: 294541 - RNA, 32 nt, Human
aauacucccauauaaucucugucuucauaaau

SEQ ID NO: 294542 - RNA, 32 nt, Human
aauacucccugagauguacucucaugucucau

SEQ ID NO: 294543 - RNA, 32 nt, Human
aauacucccuucuuccugcccccacaccccau

SEQ ID NO: 294544 - RNA, 32 nt, Human
aauacuccuccccucuucucuuuugcccccuc

SEQ ID NO: 294545 - RNA, 32 nt, Human
aauacucggcaggccaccugugggugggcuaa

SEQ ID NO: 294546 - RNA, 21 nt, Human
aauacucuacaccuuugggau

SEQ ID NO: 294547 - RNA, 32 nt, Human
aauacucucuccuccugaccuccugggacuuu

SEQ ID NO: 294548 - RNA, 32 nt, Human
aauacucugaaaugcacuagaccauauaacug

SEQ ID NO: 294549 - RNA, 32 nt, Human
aauacucugccucugcuucauguagcaaauga

SEQ ID NO: 294550 - RNA, 32 nt, Human
aauacucugugcaagugguuuugcagggcaua

SEQ ID NO: 294551 - RNA, 32 nt, Human
aauacucuucuccaaggacugacaaaaacaac

SEQ ID NO: 294552 - RNA, 32 nt, Human
aauacucuuuccaaaacccccuccuggguuuu

SEQ ID NO: 294553 - RNA, 32 nt, Human
aauacucuuuggcuuaaaauguucagcagaau

SEQ ID NO: 294554 - RNA, 22 nt, Human
aauacucuuuuugugcuucuga

SEQ ID NO: 294555 - RNA, 32 nt, Human
aauacugaaauuagcugggugcagugaugcgc

SEQ ID NO: 294556 - RNA, 32 nt, Human
aauacugacaauuccucgggaaccuggccucu

SEQ ID NO: 294557 - RNA, 32 nt, Human
aauacugacccuccuccucgaugccuucggag

SEQ ID NO: 294558 - RNA, 32 nt, Human
aauacugacugcucacccacagacacaaucuu

SEQ ID NO: 294559 - RNA, 32 nt, Human
aauacugagauuacaggugugagccaccacac

SEQ ID NO: 294560 - RNA, 32 nt, Human
aauacugaggggucuccaggaggagacuagau

SEQ ID NO: 294561 - RNA, 32 nt, Human
aauacugaguccuacuuccugauaauguguca

SEQ ID NO: 294562 - RNA, 32 nt, Human
aauacugauccagcagcugcuccaggagaggc

SEQ ID NO: 294563 - RNA, 32 nt, Human
aauacugcacacugcacauuugcucagaauug

SEQ ID NO: 294564 - RNA, 32 nt, Human
aauacugcauaaaaagugccuguagaugacau

SEQ ID NO: 294565 - RNA, 32 nt, Human
aauacugccauggguggaggccagcagggcag

SEQ ID NO: 294566 - RNA, 32 nt, Human
aauacuggaacaaccucuucuccaagauucuc

SEQ ID NO: 294567 - RNA, 32 nt, Human
aauacuggaagagaaacaauaaauagagacuu

SEQ ID NO: 294568 - RNA, 32 nt, Human
aauacuggaaucaccagcucaauaauaagagg

SEQ ID NO: 294569 - RNA, 32 nt, Human
aauacuggagaagagagagggugggcagagca

SEQ ID NO: 294570 - RNA, 32 nt, Human
aauacugggauuacaggggugagucaccacac

SEQ ID NO: 294571 - RNA, 32 nt, Human
aauacuggucucaggccaagcccaauacagcc

SEQ ID NO: 294572 - RNA, 32 nt, Human
aauacugguguuagcugagaacucuguaaguc

SEQ ID NO: 294573 - RNA, 32 nt, Human
aauacugucauacuugcuauuuccugguacag

SEQ ID NO: 294574 - RNA, 32 nt, Human
aauacugucauuguccuuggggcggggugguu

SEQ ID NO: 294575 - RNA, 32 nt, Human
aauacugucgucauggcuaagagaacaaaucu

SEQ ID NO: 294576 - RNA, 32 nt, Human
aauacugugaugggaaaaaggaagagugucca

SEQ ID NO: 294577 - RNA, 32 nt, Human
aauacuguggugcuugggccacugccugagag

SEQ ID NO: 294578 - RNA, 32 nt, Human
aauacuguguaccucauggaugcuuuggcaau

SEQ ID NO: 294579 - RNA, 22 nt, Human
aauacuguuuucaugccugcua

SEQ ID NO: 294580 - RNA, 32 nt, Human
aauacuguuuucuuucauucuucaccaaagaa

SEQ ID NO: 294581 - RNA, 32 nt, Human
aauacuuacaccauuacuacuguuuuaaaauu

SEQ ID NO: 294582 - RNA, 32 nt, Human
aauacuuacucauaacuucucuuccaaaaugu

SEQ ID NO: 294583 - RNA, 32 nt, Human
aauacuuagauauuuauuagauagcccugaau

SEQ ID NO: 294584 - RNA, 32 nt, Human
aauacuuagccaugcagaauaugugaccagac

SEQ ID NO: 294585 - RNA, 32 nt, Human
aauacuuauggucggaagucauuggggcaaga

SEQ ID NO: 294586 - RNA, 32 nt, Human
aauacuuauggucggaagucguuggggcaaga

SEQ ID NO: 294587 - RNA, 32 nt, Human
aauacuucagccaccagguuuuucugucucac

SEQ ID NO: 294588 - RNA, 32 nt, Human
aauacuucaugccaggacaguugcuauuagca

SEQ ID NO: 294589 - RNA, 32 nt, Human
aauacuucucugaccuccuuucuaccacuucc

SEQ ID NO: 294590 - RNA, 32 nt, Human
aauacuucuggaaaaggguuuucuugaggacu

SEQ ID NO: 294591 - RNA, 32 nt, Human
aauacuucuuucuccuugcuugccuccaccau

SEQ ID NO: 294592 - RNA, 32 nt, Human
aauacuugaacucuguucccccacccuccaug

SEQ ID NO: 294593 - RNA, 32 nt, Human
aauacuugccugaaagcugugaagaagaaaaa

SEQ ID NO: 294594 - RNA, 32 nt, Human
aauacuugcugcagcauuuaauauguuuaauu

SEQ ID NO: 294595 - RNA, 32 nt, Human
aauacuuggaguuuaacugccuucccuuugaa

SEQ ID NO: 294596 - RNA, 32 nt, Human
aauacuuggggugggaggggagaaagggaacc

SEQ ID NO: 294597 - RNA, 32 nt, Human
aauacuugguauccaccggguaagagugguua

SEQ ID NO: 294598 - RNA, 32 nt, Human
aauacuugguuuauuucuacuguacauuguuu

SEQ ID NO: 294599 - RNA, 32 nt, Human
aauacuuuaagaggaguggaaggaacacaaac

SEQ ID NO: 294600 - RNA, 32 nt, Human
aauacuuuaagaggggugaggggagagagaaa

SEQ ID NO: 294601 - RNA, 32 nt, Human
aauacuuuaauguuguuuauagccuaacaguu

SEQ ID NO: 294602 - RNA, 32 nt, Human
aauacuuucccaacaggaagucugaucuguug

SEQ ID NO: 294603 - RNA, 32 nt, Human
aauacuuucuaccuucuucacagagcagccuu

SEQ ID NO: 294604 - RNA, 32 nt, Human
aauacuuugcauccuucaauccagucaagcug

SEQ ID NO: 294605 - RNA, 32 nt, Human
aauacuuuggacugcaggacaggacaguauug

SEQ ID NO: 294606 - RNA, 32 nt, Human
aauacuuuguuuccagcccccuucccacacuc

SEQ ID NO: 294607 - RNA, 32 nt, Human
aauacuuuucuucuucuuacuaauucuuuuag

SEQ ID NO: 294608 - RNA, 22 nt, Human
aauacuuuucuuuguaugaaaa

SEQ ID NO: 294609 - RNA, 32 nt, Human
aauagaaaaaguaggcugggcgcgguggcuca

SEQ ID NO: 294610 - RNA, 32 nt, Human
aauagaaaaggagagaagaugucaguauguuu

SEQ ID NO: 294611 - RNA, 32 nt, Human
aauagaaaagggagaggaaaaagggaaggauu

SEQ ID NO: 294612 - RNA, 32 nt, Human
aauagaaaaguggggagccgcuggggagccac

SEQ ID NO: 294613 - RNA, 32 nt, Human
aauagaaacaugcacauggaaacccaugagcu

SEQ ID NO: 294614 - RNA, 32 nt, Human
aauagaaacuuccaaauguaaccauggaagcu

SEQ ID NO: 294615 - RNA, 32 nt, Human
aauagaaagagucaguuaaaauucagcauuca

SEQ ID NO: 294616 - RNA, 32 nt, Human
aauagaaagaguucuauggagacuuugcuguu

SEQ ID NO: 294617 - RNA, 32 nt, Human
aauagaaagauaaugcaagccacauauguaaa

SEQ ID NO: 294618 - RNA, 32 nt, Human
aauagaaaggagagagaauaugaaagagcaaa

SEQ ID NO: 294619 - RNA, 32 nt, Human
aauagaaauacuggugccugcagagcagcacu

SEQ ID NO: 294620 - RNA, 32 nt, Human
aauagaaauauguauuuuaagcacucacgcaa

SEQ ID NO: 294621 - RNA, 32 nt, Human
aauagaaauauguauuuuaagcacucaugcaa

SEQ ID NO: 294622 - RNA, 32 nt, Human
aauagaacauugauugcuguguccaacuccag

SEQ ID NO: 294623 - RNA, 32 nt, Human
aauagaacccaggagguggagacugcagugag

SEQ ID NO: 294624 - RNA, 32 nt, Human
aauagaaccccugguuuuagcugggcacauga

SEQ ID NO: 294625 - RNA, 32 nt, Human
aauagaaccucaccugcucaugaccagagagc

SEQ ID NO: 294626 - RNA, 32 nt, Human
aauagaacuaucuucaccacacucacuauuuc

SEQ ID NO: 294627 - RNA, 32 nt, Human
aauagaacuccaagccuuuucuccacuacuau

SEQ ID NO: 294628 - RNA, 32 nt, Human
aauagaagcgucgaaggagaucaagugaaccu

SEQ ID NO: 294629 - RNA, 32 nt, Human
aauagaagcucacaugucuccugcucuuacaa

SEQ ID NO: 294630 - RNA, 32 nt, Human
aauagaagcuggauuccaucagauuucaaaug

SEQ ID NO: 294631 - RNA, 32 nt, Human
aauagaaggguuguuucuguauuuuaacauuu

SEQ ID NO: 294632 - RNA, 32 nt, Human
aauagaagugagaugucuuccucuucacuugc

SEQ ID NO: 294633 - RNA, 32 nt, Human
aauagaaugugaucaagagggccaggcgagau

SEQ ID NO: 294634 - RNA, 32 nt, Human
aauagaauucaaaaaucucugcauccugaggu

SEQ ID NO: 294635 - RNA, 32 nt, Human
aauagaauucagcucaagcaguuguuuucagu

SEQ ID NO: 294636 - RNA, 32 nt, Human
aauagaauuguauagauuauuuuugcacaguu

SEQ ID NO: 294637 - RNA, 32 nt, Human
aauagaauuguuucuucugaauaaucuaacaa

SEQ ID NO: 294638 - RNA, 32 nt, Human
aauagacacggccuuuccucucugccucuggc

SEQ ID NO: 294639 - RNA, 32 nt, Human
aauagacacucaauaaauaauuguugaauuca

SEQ ID NO: 294640 - RNA, 32 nt, Human
aauagacacucaauaaauacuuguugaauuca

SEQ ID NO: 294641 - RNA, 32 nt, Human
aauagacagcacaacacaaacucucucaauac

SEQ ID NO: 294642 - RNA, 32 nt, Human
aauagacagcuagaacugggguucaccuaagc

SEQ ID NO: 294643 - RNA, 32 nt, Human
aauagacagugauauaaagaauaaaaaguaaa

SEQ ID NO: 294644 - RNA, 32 nt, Human
aauagacaucuaaaauuccacuccucauagag

SEQ ID NO: 294645 - RNA, 32 nt, Human
aauagaccugguacaugguacacacaccccca

SEQ ID NO: 294646 - RNA, 32 nt, Human
aauagacuaucuagaacuugagaagauuuuau

SEQ ID NO: 294647 - RNA, 32 nt, Human
aauagacuauuuggaucacauuucucauuccu

SEQ ID NO: 294648 - RNA, 32 nt, Human
aauagacugagucagaugggucugauauuaau

SEQ ID NO: 294649 - RNA, 32 nt, Human
aauagacuugcaguuauuacuaagcuccucuu

SEQ ID NO: 294650 - RNA, 32 nt, Human
aauagagaaagauuagauaaagagaaaauaag

SEQ ID NO: 294651 - RNA, 31 nt, Human
aauagagaacaauuuccuuucuccuuacaag

SEQ ID NO: 294652 - RNA, 32 nt, Human
aauagagaaugagacuaagaagggaacauuuc

SEQ ID NO: 294653 - RNA, 32 nt, Human
aauagagacagaaaguuacaacacaguuugua

SEQ ID NO: 294654 - RNA, 32 nt, Human
aauagagacuggguuucaccauguugaccggg

SEQ ID NO: 294655 - RNA, 32 nt, Human
aauagagagaaagguuuuccugccucagagug

SEQ ID NO: 294656 - RNA, 32 nt, Human
aauagagaggcaguaaaaagaucagcaaagag

SEQ ID NO: 294657 - RNA, 32 nt, Human
aauagagauguuggaguccagaacaaaguuag

SEQ ID NO: 294658 - RNA, 32 nt, Human
aauagagauuaaaaacaacaaauuggccucuu

SEQ ID NO: 294659 - RNA, 32 nt, Human
aauagagcaaacaccuuuaguuucaucagauc

SEQ ID NO: 294660 - RNA, 32 nt, Human
aauagagcaagaaaacaguauucugcaucugu

SEQ ID NO: 294661 - RNA, 32 nt, Human
aauagagcacagcagggagacuggggccugga

SEQ ID NO: 294662 - RNA, 32 nt, Human
aauagagccauguucauuuucuuuccaguuag

SEQ ID NO: 294663 - RNA, 32 nt, Human
aauagagcuguccugugggggagcugcucacu

SEQ ID NO: 294664 - RNA, 32 nt, Human
aauagaggaagaaacauuuauucaccaguuuc

SEQ ID NO: 294665 - RNA, 32 nt, Human
aauagaggagaguguaagggaguagggggugc

SEQ ID NO: 294666 - RNA, 32 nt, Human
aauagaggcccuguuggcaagaugaguuuugc

SEQ ID NO: 294667 - RNA, 32 nt, Human
aauagaggcucaauuaguauuuguugaauaaa

SEQ ID NO: 294668 - RNA, 32 nt, Human
aauagagggggugcuggagcgcgagaggcugg

SEQ ID NO: 294669 - RNA, 32 nt, Human
aauagagggucugagaacugucagccuuuugc

SEQ ID NO: 294670 - RNA, 32 nt, Human
aauagagguagaaaauggaaauuuucccagua

SEQ ID NO: 294671 - RNA, 32 nt, Human
aauagauagauacuccagccugggugacagag

SEQ ID NO: 294672 - RNA, 32 nt, Human
aauagaucaguccaccucuccugggucccguc

SEQ ID NO: 294673 - RNA, 32 nt, Human
aauagaucgaccaaagagaugcagguuguacu

SEQ ID NO: 294674 - RNA, 32 nt, Human
aauagaugauuuauuaagagccaucugugauu

SEQ ID NO: 294675 - RNA, 32 nt, Human
aauagaugccucucccccuccagcccuagccg

SEQ ID NO: 294676 - RNA, 32 nt, Human
aauagaugccucucccccuccaguccuagccc

SEQ ID NO: 294677 - RNA, 32 nt, Human
aauagaugguuagugggguaauucugcuucua

SEQ ID NO: 294678 - RNA, 32 nt, Human
aauagauuuaaaacaugagauugcccucuaca

SEQ ID NO: 294679 - RNA, 32 nt, Human
aauagcaaaguggcugggcaugguggcucaug

SEQ ID NO: 294680 - RNA, 32 nt, Human
aauagcaacaggaaaagaacugagggacgugc

SEQ ID NO: 294681 - RNA, 32 nt, Human
aauagcaauaucuaggaaauuugcauugagac

SEQ ID NO: 294682 - RNA, 32 nt, Human
aauagcacaggguguacauacaugacguacac

SEQ ID NO: 294683 - RNA, 23 nt, Human
aauagcacauauggaauuuugca

SEQ ID NO: 294684 - RNA, 32 nt, Human
aauagcacauccaccaaacuccugccugagaa

SEQ ID NO: 294685 - RNA, 32 nt, Human
aauagcacggauuuccuggaugagcuaccacg

SEQ ID NO: 294686 - RNA, 32 nt, Human
aauagcagaaugucacagaugaagaauauuaa

SEQ ID NO: 294687 - RNA, 32 nt, Human
aauagcagcuacucgggaggcugaggcaggag

SEQ ID NO: 294688 - RNA, 32 nt, Human
aauagcagcuacugagguggcugaggcacaag

SEQ ID NO: 294689 - RNA, 32 nt, Human
aauagcaggaguggccugugccucaacaacau

SEQ ID NO: 294690 - RNA, 32 nt, Human
aauagcaguaguuuuggaaauauugccccaag

SEQ ID NO: 294691 - RNA, 32 nt, Human
aauagcauaaggcuuccauuaugaaagaaaac

SEQ ID NO: 294692 - RNA, 32 nt, Human
aauagcauaaugacagugggagggguacaagg

SEQ ID NO: 294693 - RNA, 32 nt, Human
aauagcaugggcuuacagcacaagcacguguu

SEQ ID NO: 294694 - RNA, 32 nt, Human
aauagcauuauucaagacacagaaagaaagca

SEQ ID NO: 294695 - RNA, 32 nt, Human
aauagcauuugucuugagugaggaagugaagc

SEQ ID NO: 294696 - RNA, 32 nt, Human
aauagccacauucugcucuacucuccaacaua

SEQ ID NO: 294697 - RNA, 32 nt, Human
aauagccacauuuaacuccagccuuggguuug

SEQ ID NO: 294698 - RNA, 32 nt, Human
aauagccacugcacuccagccugggcaacaua

SEQ ID NO: 294699 - RNA, 32 nt, Human
aauagccacugcacuccagccugggcaauaua

SEQ ID NO: 294700 - RNA, 32 nt, Human
aauagccacugcacuccaucuugggcaacaca

SEQ ID NO: 294701 - RNA, 32 nt, Human
aauagccacugcacucuagucuggggaacaua

SEQ ID NO: 294702 - RNA, 32 nt, Human
aauagccacugcacuucagccugggcaacaua

SEQ ID NO: 294703 - RNA, 32 nt, Human
aauagccacugcacuugagccucuugggaaac

SEQ ID NO: 294704 - RNA, 32 nt, Human
aauagccacugcauaccaaccugggcaauaua

SEQ ID NO: 294705 - RNA, 32 nt, Human
aauagccacuuuccuuuuguugucauucuugu

SEQ ID NO: 294706 - RNA, 32 nt, Human
aauagccauccuggcagauguaaggugauauu

SEQ ID NO: 294707 - RNA, 32 nt, Human
aauagccccaggagugggcuuuagucuccaau

SEQ ID NO: 294708 - RNA, 32 nt, Human
aauagccccuccacuuggauuucaccaaaacg

SEQ ID NO: 294709 - RNA, 32 nt, Human
aauagccugcgcgcuccaggacugccuaccca

SEQ ID NO: 294710 - RNA, 32 nt, Human
aauagccuuauuuucaaaauauggaaagaaau

SEQ ID NO: 294711 - RNA, 32 nt, Human
aauagcgcccugcagggacggugcaggcuggu

SEQ ID NO: 294712 - RNA, 32 nt, Human
aauagcggaggcacacccagaguagaacagca

SEQ ID NO: 294713 - RNA, 32 nt, Human
aauagcuaaauggcaacaaacacauugugaau

SEQ ID NO: 294714 - RNA, 32 nt, Human
aauagcuacaaaccauacuaauuauuccauuu

SEQ ID NO: 294715 - RNA, 32 nt, Human
aauagcuacagagaacuugcaaaggaguagag

SEQ ID NO: 294716 - RNA, 32 nt, Human
aauagcuacagcugugucccuuccugcuuuuu

SEQ ID NO: 294717 - RNA, 32 nt, Human
aauagcuauugcacuccagccuuggcaacaua

SEQ ID NO: 294718 - RNA, 32 nt, Human
aauagcucaccccucauucuguccuccggacu

SEQ ID NO: 294719 - RNA, 32 nt, Human
aauagcucauacaauaauccauucaauagaau

SEQ ID NO: 294720 - RNA, 32 nt, Human
aauagcucccagugucauggguacccaguacg

SEQ ID NO: 294721 - RNA, 32 nt, Human
aauagcuccuuauuuugcaccuuauaaaaagu

SEQ ID NO: 294722 - RNA, 32 nt, Human
aauagcuccuuucugggauaucugauguguac

SEQ ID NO: 294723 - RNA, 32 nt, Human
aauagcucuaacuccaaaccucuguccacacc

SEQ ID NO: 294724 - RNA, 32 nt, Human
aauagcucuucuccuaagauggaaucuguggu

SEQ ID NO: 294725 - RNA, 32 nt, Human
aauagcugaagaaacauuuccucaaauguauu

SEQ ID NO: 294726 - RNA, 32 nt, Human
aauagcugagacuacaggcaccugccaccagg

SEQ ID NO: 294727 - RNA, 32 nt, Human
aauagcuggauuauuucauuugccaguuucua

SEQ ID NO: 294728 - RNA, 32 nt, Human
aauagcuggcuucuuuccacauagugguucug

SEQ ID NO: 294729 - RNA, 32 nt, Human
aauagcugggauuacagacaggcaccaccaca

SEQ ID NO: 294730 - RNA, 32 nt, Human
aauagcugggauuacaggcacccaccaccaua

SEQ ID NO: 294731 - RNA, 32 nt, Human
aauagcugggauuacaggcacccaccaucacg

SEQ ID NO: 294732 - RNA, 32 nt, Human
aauagcugggauuacaggcgcccaccaccacg

SEQ ID NO: 294733 - RNA, 32 nt, Human
aauagcugggauuacaggcgcccgccaccaca

SEQ ID NO: 294734 - RNA, 32 nt, Human
aauagcugggauuacaggcguacaccaccaug

SEQ ID NO: 294735 - RNA, 32 nt, Human
aauagcugggauuacaggugcacgccaccaug

SEQ ID NO: 294736 - RNA, 32 nt, Human
aauagcugggauuacaggugcaugccaccaca

SEQ ID NO: 294737 - RNA, 32 nt, Human
aauagcugggauuacaggugcccaccaccaug

SEQ ID NO: 294738 - RNA, 32 nt, Human
aauagcugggauuacaggugccugccagcaca

SEQ ID NO: 294739 - RNA, 32 nt, Human
aaugcuccugaaugaaagaaauuaucccuuug

SEQ ID NO: 294740 - RNA, 32 nt, Human
aaugcucucaucgguuggcuucauuuucaaga

SEQ ID NO: 294741 - RNA, 32 nt, Human
aaugcucucuguuggcucugcaguacaauaug

SEQ ID NO: 294742 - RNA, 32 nt, Human
aaugcugaaaaagcguuuguuuuugaaacaaa

SEQ ID NO: 294743 - RNA, 32 nt, Human
aaugcugaaagugccugucaguaaaccuuaug

SEQ ID NO: 294744 - RNA, 32 nt, Human
aaugcugaaaucuaggaaaugaaaguagcguc

SEQ ID NO: 294745 - RNA, 32 nt, Human
aaugcugacgaagaucuugagccacccuaccu

SEQ ID NO: 294746 - RNA, 32 nt, Human
aaugcugagauuacaggugugagccaccaugc

SEQ ID NO: 294747 - RNA, 32 nt, Human
aaugcugagauuacaggugugagccacugcac

SEQ ID NO: 294748 - RNA, 32 nt, Human
aaugcugaguccagauccaaagcugucuucug

SEQ ID NO: 294749 - RNA, 32 nt, Human
aaugcugaguccggucccagguauggagcaga

SEQ ID NO: 294750 - RNA, 32 nt, Human
aaugcugauuuaacuccuccaggguggggucu

SEQ ID NO: 294751 - RNA, 32 nt, Human
aaugcugauuuggugaccaacugucacucauu

SEQ ID NO: 294752 - RNA, 32 nt, Human
aaugcugcaaauaugcuuuccaagugcuuugc

SEQ ID NO: 294753 - RNA, 32 nt, Human
aaugcugcagaauguguuagcugcagauaggc

SEQ ID NO: 294754 - RNA, 32 nt, Human
aaugcugcagagcagucaggcuggacaccccu

SEQ ID NO: 294755 - RNA, 32 nt, Human
aaugcugcaguccugcagucaccuauacauua

SEQ ID NO: 294756 - RNA, 32 nt, Human
aaugcugcagugagcugugauuucacccuugc

SEQ ID NO: 294757 - RNA, 26 nt, Human
aaugcugccaggcacgucaacaggca

SEQ ID NO: 294758 - RNA, 32 nt, Human
aaugcugccaucccuucugcuaauccagcaaa

SEQ ID NO: 294759 - RNA, 32 nt, Human
aaugcugccugccugucugucucuccaucugu

SEQ ID NO: 294760 - RNA, 32 nt, Human
aaugcugcggggaggaaggcaagaggugccaa

SEQ ID NO: 294761 - RNA, 32 nt, Human
aaugcugcuacuugauuucuuucucaucccac

SEQ ID NO: 294762 - RNA, 32 nt, Human
aaugcugcucacccuucugucuugcagagugg

SEQ ID NO: 294763 - RNA, 20 nt, Human
aaugcugcugaagaggaggg

SEQ ID NO: 294764 - RNA, 32 nt, Human
aaugcugcugagagugaaagaaaggaggaaag

SEQ ID NO: 294765 - RNA, 32 nt, Human
aaugcugcugucacacagucucuucucugaaa

SEQ ID NO: 294766 - RNA, 32 nt, Human
aaugcuggaacacaccagacauagagggaggg

SEQ ID NO: 294767 - RNA, 32 nt, Human
aaugcuggaauuacaggcgugagccaccaugc

SEQ ID NO: 294768 - RNA, 32 nt, Human
aaugcuggagcaggcuguucagaccgacguug

SEQ ID NO: 294769 - RNA, 32 nt, Human
aaugcuggagccagauauucauucaaauccug

SEQ ID NO: 294770 - RNA, 32 nt, Human
aaugcuggcacuaagcaaaaguucgagccuca

SEQ ID NO: 294771 - RNA, 32 nt, Human
aaugcuggcauuacaggugugagccacggugc

SEQ ID NO: 294772 - RNA, 32 nt, Human
aaugcugggacuauaggugugagccacugcac

SEQ ID NO: 294773 - RNA, 32 nt, Human
aaugcugggauuacaagcaugcgucaccacag

SEQ ID NO: 294774 - RNA, 32 nt, Human
aaugcugggauuacaagcgugagccaccgccc

SEQ ID NO: 294775 - RNA, 32 nt, Human
aaugcugggauuacagaugugagccaccacac

SEQ ID NO: 294776 - RNA, 32 nt, Human
aaugcugggauuacaggagugagccaccaugc

SEQ ID NO: 294777 - RNA, 32 nt, Human
aaugcugggauuacaggcauaagccaccgugc

SEQ ID NO: 294778 - RNA, 32 nt, Human
aaugcugggauuacaggcaugagccaccacac

SEQ ID NO: 294779 - RNA, 32 nt, Human
aaugcugggauuacaggcaugagccaccgcgc

SEQ ID NO: 294780 - RNA, 32 nt, Human
aaugcugggauuacaggcaugagccaccgugc

SEQ ID NO: 294781 - RNA, 32 nt, Human
aaugcugggauuacaggcaugagccaccugcc

SEQ ID NO: 294782 - RNA, 32 nt, Human
aaugcugggauuacaggcaugagccacugcgc

SEQ ID NO: 294783 - RNA, 32 nt, Human
aaugcugggauuacaggcaugagccacuguac

SEQ ID NO: 294784 - RNA, 32 nt, Human
aaugcugggauuacaggccugagccacugcgc

SEQ ID NO: 294785 - RNA, 32 nt, Human
aaugcugggauuacaggcguaagccacuaucc

SEQ ID NO: 294786 - RNA, 32 nt, Human
aaugcugggauuacaggcguaagccacugcac

SEQ ID NO: 294787 - RNA, 32 nt, Human
aaugcugggauuacaggcgugagcaaccgcac

SEQ ID NO: 294788 - RNA, 32 nt, Human
aaugcugggauuacaggcgugagcaaccgcgc

SEQ ID NO: 294789 - RNA, 32 nt, Human
aaugcugggauuacaggcgugagccaccacgc

SEQ ID NO: 294790 - RNA, 32 nt, Human
aaugcugggauuacaggcgugagccaccaugu

SEQ ID NO: 294791 - RNA, 32 nt, Human
aaugcugggauuacaggcgugagccaccgagc

SEQ ID NO: 294792 - RNA, 32 nt, Human
aaugcugggauuacaggcgugagccaccgcgc

SEQ ID NO: 294793 - RNA, 32 nt, Human
aaugcugggauuacaggcgugagccacggcac

SEQ ID NO: 294794 - RNA, 32 nt, Human
aaugcugggauuacaggcgugagccacugcac

SEQ ID NO: 294795 - RNA, 32 nt, Human
aaugcugggauuacaggcgugagccacuggcg

SEQ ID NO: 294796 - RNA, 32 nt, Human
aaugcugggauuacaggcuugagccacugcuc

SEQ ID NO: 294797 - RNA, 32 nt, Human
aaugcugggauuacagggguaagccacugugc

SEQ ID NO: 294798 - RNA, 32 nt, Human
aaugcugggauuacaggggugagccaccgugc

SEQ ID NO: 294799 - RNA, 32 nt, Human
aaugcugggauuacagguaugagcacugcacc

SEQ ID NO: 294800 - RNA, 32 nt, Human
aaugcugggauuacaggugugagccacaguuu

SEQ ID NO: 294801 - RNA, 32 nt, Human
aaugcugggauuacaggugugagccaccgcgc

SEQ ID NO: 294802 - RNA, 32 nt, Human
aaugcugggauuacaggugugagccaccgugc

SEQ ID NO: 294803 - RNA, 32 nt, Human
aaugcugggauuacaggugugagccacugcgc

SEQ ID NO: 294804 - RNA, 32 nt, Human
aaugcugggauuacaggugugagccacugugc

SEQ ID NO: 294805 - RNA, 32 nt, Human
aaugcugggauuacaugcaugagccacgcgcc

SEQ ID NO: 294806 - RNA, 32 nt, Human
aaugcugggauuaccggugugagccaccgcgc

SEQ ID NO: 294807 - RNA, 32 nt, Human
aaugcugggauuagaggugugagccacugugc

SEQ ID NO: 294808 - RNA, 32 nt, Human
aaugcugggauuauaggcaugagccgcugcac

SEQ ID NO: 294809 - RNA, 32 nt, Human
aaugcugggauugcaggcgugagccacugcau

SEQ ID NO: 294810 - RNA, 32 nt, Human
aaugcugggcacaagagcuacagggaauuaug

SEQ ID NO: 294811 - RNA, 32 nt, Human
aaugcugggcagugccucggacugccucggac

SEQ ID NO: 294812 - RNA, 32 nt, Human
aaugcuggggaacggaaaaugagggaguucaa

SEQ ID NO: 294813 - RNA, 32 nt, Human
aaugcuggggacaggcaugcugccgccaguag

SEQ ID NO: 294814 - RNA, 32 nt, Human
aaugcuggggcagugauuggaaaaggaggcaa

SEQ ID NO: 294815 - RNA, 32 nt, Human
aaugcuggugcugcuuuuguacauacauauuu

SEQ ID NO: 294816 - RNA, 32 nt, Human
aaugcuggugggucuccguguuuaugagucac

SEQ ID NO: 294817 - RNA, 32 nt, Human
aaugcugucagcucuuucccuaccuucaaguc

SEQ ID NO: 294818 - RNA, 32 nt, Human
aaugcugucaucuggagauaccuaacuaacua

SEQ ID NO: 294819 - RNA, 32 nt, Human
aaugcugucuucaucagaaaacaguuggcaua

SEQ ID NO: 294820 - RNA, 32 nt, Human
aaugcugucuuucccaguagcuacucaccugc

SEQ ID NO: 294821 - RNA, 32 nt, Human
aaugcugugaugaccaauuuugugaauaaaau

SEQ ID NO: 294822 - RNA, 32 nt, Human
aaugcuguuuuuacugcuuccuaaggauagau

SEQ ID NO: 294823 - RNA, 32 nt, Human
aaugcuuaaaggccacagauaaugaaaguuua

SEQ ID NO: 294824 - RNA, 32 nt, Human
aaugcuuacucugagcuacacacugaguagua

SEQ ID NO: 294825 - RNA, 32 nt, Human
aaugcuuauugcugcaugauguaagcaaaagu

SEQ ID NO: 294826 - RNA, 32 nt, Human
aaugcuucagaaacaccucaauaaaagagaaa

SEQ ID NO: 294827 - RNA, 32 nt, Human
aaugcuucauucacaaccuccauuuucagcaa

SEQ ID NO: 294828 - RNA, 27 nt, Human
aaugcuucgaggcugaugaggcugcug

SEQ ID NO: 294829 - RNA, 32 nt, Human
aaugcuucuagaugccuucucucuccaucuac

SEQ ID NO: 294830 - RNA, 32 nt, Human
aaugcuucucuagcccaaacagcgacaugcua

SEQ ID NO: 294831 - RNA, 32 nt, Human
aaugcuucugacuucauagauuuccuucccau

SEQ ID NO: 294832 - RNA, 32 nt, Human
aaugcuugaccuacauuucuaaaauaaaaaua

SEQ ID NO: 294833 - RNA, 32 nt, Human
aaugcuugcuaccugaaugaaugaucagaagc

SEQ ID NO: 294834 - RNA, 32 nt, Human
aaugcuugcucaggcucagagggaccucaccc

SEQ ID NO: 294835 - RNA, 32 nt, Human
aaugcuugcuuuuucucuaccuuucuuccuug

SEQ ID NO: 294836 - RNA, 32 nt, Human
aaugcuuguccuggcccgaugcaguggcucau

SEQ ID NO: 294837 - RNA, 32 nt, Human
aaugcuuugagggggucugugccugaagcuca

SEQ ID NO: 294838 - RNA, 21 nt, Human
aaugcuuuuccaguucuuaga

SEQ ID NO: 294839 - RNA, 21 nt, Human
aaugcuuuugaauguucuuag

SEQ ID NO: 294840 - RNA, 32 nt, Human
aaugcuuuugacuuaacuaggagaaaaagaca

SEQ ID NO: 294841 - RNA, 32 nt, Human
aaugcuuuuggcuguuauuuugcaguuaauac

SEQ ID NO: 294842 - RNA, 32 nt, Human
aauggaaaaagcuuucuucugacugugacccu

SEQ ID NO: 294843 - RNA, 32 nt, Human
aauggaaaacaaagugcuucugccuggcuggc

SEQ ID NO: 294844 - RNA, 32 nt, Human
aauggaaacuaguucagccacuguggagagaa

SEQ ID NO: 294845 - RNA, 26 nt, Human
aauggaaagaggaaagaagaaaagaa

SEQ ID NO: 294846 - RNA, 32 nt, Human
aauggaaagcacugugcucugaaguggaucag

SEQ ID NO: 294847 - RNA, 32 nt, Human
aauggaaagggaacccagauaggaagcuacug

SEQ ID NO: 294848 - RNA, 32 nt, Human
aauggaaagguucucauuuuccuccuccaaug

SEQ ID NO: 294849 - RNA, 32 nt, Human
aauggaaauguagucuuaggccagucuuaggu

SEQ ID NO: 294850 - RNA, 32 nt, Human
aauggaaauguucuuggagcuacuuccucaaa

SEQ ID NO: 294851 - RNA, 32 nt, Human
aauggaacauuuaagacaagucuggaaaguca

SEQ ID NO: 294852 - RNA, 32 nt, Human
aauggaaccucuccauguguauauaguauuuc

SEQ ID NO: 294853 - RNA, 32 nt, Human
aauggaacggucaccuuccagccaguaaaggc

SEQ ID NO: 294854 - RNA, 32 nt, Human
aauggaagaaccacuggaauaaugcuccugcc

SEQ ID NO: 294855 - RNA, 32 nt, Human
aauggaagaagacggaaggaagaaagagaaag

SEQ ID NO: 294856 - RNA, 32 nt, Human
aauggaagaaggaggaagagcaugaaggaucu

SEQ ID NO: 294857 - RNA, 32 nt, Human
aauggaagacggugguuuuuccccuacagcuc

SEQ ID NO: 294858 - RNA, 32 nt, Human
aauggaagccuggguuggagauccugaggcag

SEQ ID NO: 294859 - RNA, 32 nt, Human
aauggaaggagaagacugggcuagggagaaug

SEQ ID NO: 294860 - RNA, 32 nt, Human
aauggaaguauaaugggaauauauuuuugagg

SEQ ID NO: 294861 - RNA, 32 nt, Human
aauggaagugaggauguaacucuacugaauaa

SEQ ID NO: 294862 - RNA, 32 nt, Human
aauggaaguuacagcauucuacucugauggug

SEQ ID NO: 294863 - RNA, 32 nt, Human
aauggaaguuuuaaauguguaaaguucagaag

SEQ ID NO: 294864 - RNA, 32 nt, Human
aauggaauccugcugggggcucaggaggccug

SEQ ID NO: 294865 - RNA, 32 nt, Human
aauggaaugaguuggacacaagauccaagcgc

SEQ ID NO: 294866 - RNA, 32 nt, Human
aauggaauggaggcugugagcaaugugaggau

SEQ ID NO: 294867 - RNA, 32 nt, Human
aauggaauguccuggcuccacccuccagcaug

SEQ ID NO: 294868 - RNA, 23 nt, Human
aauggaauuaacuucaaguuuac

SEQ ID NO: 294869 - RNA, 32 nt, Human
aauggaauugauuuucaguaacugaauuugug

SEQ ID NO: 294870 - RNA, 22 nt, Human
aauggacacuggagagaaaacu

SEQ ID NO: 294871 - RNA, 32 nt, Human
aauggacagacaccuucccccacccauacccc

SEQ ID NO: 294872 - RNA, 32 nt, Human
aauggacagcacaggacaaccagacauuugag

SEQ ID NO: 294873 - RNA, 32 nt, Human
aauggacaggccuggcauguacccacagagac

SEQ ID NO: 294874 - RNA, 32 nt, Human
aauggacagguaggaaggaaggaaaggaggaa

SEQ ID NO: 294875 - RNA, 32 nt, Human
aauggacauauguuucauauccaaggguauuc

SEQ ID NO: 294876 - RNA, 32 nt, Human
aauggaccaagaaaaacugcuuuaccauagga

SEQ ID NO: 294877 - RNA, 32 nt, Human
aauggaccaguucuguucuccaaagacugcag

SEQ ID NO: 294878 - RNA, 32 nt, Human
aauggacccuccugucacucugcugaacagaa

SEQ ID NO: 294879 - RNA, 32 nt, Human
aauggacccuggggcuuugcaaaugacuuagu

SEQ ID NO: 294880 - RNA, 32 nt, Human
aauggaccuccucuguggacugugccuuccca

SEQ ID NO: 294881 - RNA, 32 nt, Human
aauggaccugugagaggaagggaagguggcag

SEQ ID NO: 294882 - RNA, 32 nt, Human
aauggaccuuuuccuuucuuagcuugcuguag

SEQ ID NO: 294883 - RNA, 32 nt, Human
aauggacuaaagguccuguucuugccuuuucu

SEQ ID NO: 294884 - RNA, 22 nt, Human
aauggacucaucuuaauuucuu

SEQ ID NO: 294885 - RNA, 20 nt, Human
aauggacucaucuuaguucu

SEQ ID NO: 294886 - RNA, 32 nt, Human
aauggacucaugcacagaacacuaugcauuuu

SEQ ID NO: 294887 - RNA, 24 nt, Human
aauggacuuuacauucaguuucuu

SEQ ID NO: 294888 - RNA, 32 nt, Human
aauggacuuuuuaaaagacacaggacccuuaa

SEQ ID NO: 294889 - RNA, 32 nt, Human
aauggagaaauggcuuaccaugcauguccuuc

SEQ ID NO: 294890 - RNA, 32 nt, Human
aauggagaaggugaaaagaggagggaaaggcc

SEQ ID NO: 294891 - RNA, 32 nt, Human
aauggagacagagucccuggcuccucuacugu

SEQ ID NO: 294892 - RNA, 32 nt, Human
aauggagacuguaccuuccacauagauucaca

SEQ ID NO: 294893 - RNA, 32 nt, Human
aauggagagcaccacuuuccugcagcugauca

SEQ ID NO: 294894 - RNA, 32 nt, Human
aauggagagcucagaaucuggccccagagaag

SEQ ID NO: 294895 - RNA, 32 nt, Human
aauggagaggccaagacacauaaugaagacua

SEQ ID NO: 294896 - RNA, 32 nt, Human
aauggagagggcggcgaagaggacccgcaggc

SEQ ID NO: 294897 - RNA, 32 nt, Human
aauggagaggggcaagcagugaggcugccuug

SEQ ID NO: 294898 - RNA, 32 nt, Human
aauggagagguagggagccaggugcagcagga

SEQ ID NO: 294899 - RNA, 32 nt, Human
aauggagauagaucauuguucucuccaucucc

SEQ ID NO: 294900 - RNA, 32 nt, Human
aauggagauggaaaccaccacaccugcuuccc

SEQ ID NO: 294901 - RNA, 32 nt, Human
aauggagcaguuuaauacuagaucucagaagu

SEQ ID NO: 294902 - RNA, 32 nt, Human
aauggagcaugucucagggugaugugaacucu

SEQ ID NO: 294903 - RNA, 32 nt, Human
aauggagccgagaguaagcaagccuuuccaca

SEQ ID NO: 294904 - RNA, 32 nt, Human
aauggagccuuucaucuuccaagaccaaagaa

SEQ ID NO: 294905 - RNA, 32 nt, Human
aauggagcuacagagcauuaacaaauacucau

SEQ ID NO: 294906 - RNA, 32 nt, Human
aauggagcucaucuucuaucucuagggucugu

SEQ ID NO: 294907 - RNA, 32 nt, Human
aauggagcucuaauauaucuggcagcagacuu

SEQ ID NO: 294908 - RNA, 32 nt, Human
aauggagcucuuugucauuccaccuccucugg

SEQ ID NO: 294909 - RNA, 32 nt, Human
aauggaggaagaggaaguaggaagaaugcagg

SEQ ID NO: 294910 - RNA, 32 nt, Human
aauggaggacucaggcauggcuugaggacuca

SEQ ID NO: 294911 - RNA, 32 nt, Human
aauggaggagcugaggaugcuggaagaagaga

SEQ ID NO: 294912 - RNA, 32 nt, Human
aauggaggaugagagaccacguggaggagagc

SEQ ID NO: 294913 - RNA, 32 nt, Human
aauggaggauggggcagccaggagccagacuu

SEQ ID NO: 294914 - RNA, 32 nt, Human
aauggaggcagaggugugggaggcagaaggcu

SEQ ID NO: 294915 - RNA, 32 nt, Human
aauggaggcagcguuccuacuugucaucacac

SEQ ID NO: 294916 - RNA, 32 nt, Human
aauggaggccucucuucugucgugcccaaguc

SEQ ID NO: 294917 - RNA, 32 nt, Human
aauggaggccuucagagauuacaggaccagau

SEQ ID NO: 294918 - RNA, 32 nt, Human
aauggaggcugcaggacuggcuagaccagguc

SEQ ID NO: 294919 - RNA, 32 nt, Human
aauggagggaaaaaggagagaucuaccuuucc

SEQ ID NO: 294920 - RNA, 32 nt, Human
aauggaggggaaauguuuguugccuuaaauca

SEQ ID NO: 294921 - RNA, 32 nt, Human
aauggaggggaaucacuagagcacacaagguu

SEQ ID NO: 294922 - RNA, 32 nt, Human
aauggagggucuggguccaguuagggacaugg

SEQ ID NO: 294923 - RNA, 31 nt, Human
aauggaggguggaaggugugaucugugggac

SEQ ID NO: 294924 - RNA, 32 nt, Human
aauggagguccuggagguuacaugacuagccc

SEQ ID NO: 294925 - RNA, 32 nt, Human
aauggagguggggccaggcaugguggcucaca

SEQ ID NO: 294926 - RNA, 32 nt, Human
aauggagugauggagggagcacuggacugcga

SEQ ID NO: 294927 - RNA, 32 nt, Human
aauggagugcugggacuggcagaggaaauuaa

SEQ ID NO: 294928 - RNA, 32 nt, Human
aauggaguggggcugaggagauguuggaagcc

SEQ ID NO: 294929 - RNA, 32 nt, Human
aauggauaauuuaaaagcuugauagcugggac

SEQ ID NO: 294930 - RNA, 32 nt, Human
aauggauacaaagauaaagaaaauguugccuu

SEQ ID NO: 294931 - RNA, 32 nt, Human
aauggauacacaugaaauacuuaaacaauaua

SEQ ID NO: 294932 - RNA, 32 nt, Human
aauggauagcugggguuggcagauggcuagag

SEQ ID NO: 294933 - RNA, 32 nt, Human
aauggauaggaaaugccuuucucagguugaau

SEQ ID NO: 294934 - RNA, 32 nt, Human
aauggauagucagagagcagcggcugggcagu

SEQ ID NO: 294935 - RNA, 32 nt, Human
aauggauauugccaagggaacaaucagaacuc

SEQ ID NO: 294936 - RNA, 32 nt, Human
aauggauauuuggaaacuuacuccuaagcugu

SEQ ID NO: 294937 - RNA, 31 nt, Human
aauggaucaaugucuucccuguauccaagac

SEQ ID NO: 294938 - RNA, 32 nt, Human
aauggaucacuaaugaacuacagugcugguga

SEQ ID NO: 294939 - RNA, 32 nt, Human
aauggaugagaggcggggaccgugcagcuguc

SEQ ID NO: 294940 - RNA, 32 nt, Human
aauggaugauccagugcugcagagccagaagg

SEQ ID NO: 294941 - RNA, 32 nt, Human
aauggauggauggauggauggauguuggugaa

SEQ ID NO: 294942 - RNA, 32 nt, Human
aauggauguggggacucuuccuggguucuggc

SEQ ID NO: 294943 - RNA, 30 nt, Human
aauggauguucccaggagcugccuauggga

SEQ ID NO: 294944 - RNA, 32 nt, Human
aauggauucucccaggagccuccagaaggaac

SEQ ID NO: 294945 - RNA, 32 nt, Human
aauggauucugcgaugcugucuggacuuugcu

SEQ ID NO: 294946 - RNA, 32 nt, Human
aauggauugugguggucaucuccggcuaccga

SEQ ID NO: 294947 - RNA, 32 nt, Human
aauggauuuagggcugugcaggaugugccuug

SEQ ID NO: 294948 - RNA, 32 nt, Human
aauggauuuagggcugugcaggaugugcuuug

SEQ ID NO: 294949 - RNA, 32 nt, Human
aauggauuucaucagaaauguguauaauggau

SEQ ID NO: 294950 - RNA, 22 nt, Human
aauggauuucuuuggaugcuga

SEQ ID NO: 294951 - RNA, 32 nt, Human
aauggcaaaaacuggcugggcacaguggcuca

SEQ ID NO: 294952 - RNA, 32 nt, Human
aauggcaaaaggccaggcgagcacagagucuu

SEQ ID NO: 294953 - RNA, 32 nt, Human
aauggcaaacauagugggggcugcaguagcac

SEQ ID NO: 294954 - RNA, 32 nt, Human
aauggcaacacuuuggaauaagugacuguaau

SEQ ID NO: 294955 - RNA, 32 nt, Human
aauggcaacagcuuugccacuugacuuuccaa

SEQ ID NO: 294956 - RNA, 20 nt, Human
aauggcaaucgcccagauua

SEQ ID NO: 294957 - RNA, 32 nt, Human
aauggcacaaccuccaccuccuggguucaagc

SEQ ID NO: 294958 - RNA, 32 nt, Human
aauggcacacugggcaggcuugcccauuccug

SEQ ID NO: 294959 - RNA, 32 nt, Human
aauggcacagaacuuagcaacagcaugugaau

SEQ ID NO: 294960 - RNA, 32 nt, Human
aauggcacagcccaaagaaggaaaaggcaggg

SEQ ID NO: 294961 - RNA, 32 nt, Human
aauggcaccacuguacuccacuugggcgacac

SEQ ID NO: 294962 - RNA, 32 nt, Human
aauggcagaaaugucauucucuuccauauaug

SEQ ID NO: 294963 - RNA, 32 nt, Human
aauggcagagggaguuccuacacacacuuuuu

SEQ ID NO: 294964 - RNA, 26 nt, Human
aauggcagagguggaggagacacuga

SEQ ID NO: 294965 - RNA, 32 nt, Human
aauggcagcaggaggcagacagguuucugggc

SEQ ID NO: 294966 - RNA, 32 nt, Human
aauggcagcugcugugugaggaccagugucuu

SEQ ID NO: 294967 - RNA, 32 nt, Human
aauggcaggaauagcagaauaauuggugcuug

SEQ ID NO: 294968 - RNA, 32 nt, Human
aauggcaggcaaaaaccagucauuucauuuuu

SEQ ID NO: 294969 - RNA, 23 nt, Human
aauggcaggugucauaugacuga

SEQ ID NO: 294970 - RNA, 26 nt, Human
aauggcagugggugagccccuggugc

SEQ ID NO: 294971 - RNA, 32 nt, Human
aauggcaguuacuggcugggcgcaguggcuca

SEQ ID NO: 294972 - RNA, 32 nt, Human
aauggcaguucugagaagucacuggucuagau

SEQ ID NO: 294973 - RNA, 32 nt, Human
aauggcauccuggaacaccucuaccccaccau

SEQ ID NO: 294974 - RNA, 32 nt, Human
aauggcaucugucaucuuuagcgccaccuuau

SEQ ID NO: 294975 - RNA, 32 nt, Human
aauggcauggaaucacugccuccugugauuug

SEQ ID NO: 294976 - RNA, 32 nt, Human
aauggccaauggacaggaagggaacccguaug

SEQ ID NO: 294977 - RNA, 26 nt, Human
aauggccacugcucagcuuucucacu

SEQ ID NO: 294978 - RNA, 32 nt, Human
aauggccaggaucagauugugcccggccugua

SEQ ID NO: 294979 - RNA, 32 nt, Human
aauggccaguacugggugugaggccuggccug

SEQ ID NO: 294980 - RNA, 32 nt, Human
aauggccaguggcugcuacaccccauguaaaa

SEQ ID NO: 294981 - RNA, 24 nt, Human
aauggccaugcuaucacaacccca

SEQ ID NO: 294982 - RNA, 32 nt, Human
aauggcccugcuccuuccuccucuaggcccag

SEQ ID NO: 294983 - RNA, 32 nt, Human
aauggccguuuguugauuucuuccugcagguu

SEQ ID NO: 294984 - RNA, 32 nt, Human
aauggccuaaugcacccccaaacauggaaaua

SEQ ID NO: 294985 - RNA, 32 nt, Human
aauggccucauuuuucucuuuuuaauuucuuu

SEQ ID NO: 294986 - RNA, 26 nt, Human
aauggccucccacgaaguugauaaug

SEQ ID NO: 294987 - RNA, 32 nt, Human
aauggccugagaaauauuuuggaaaaguuaaa

SEQ ID NO: 294988 - RNA, 32 nt, Human
aauggccugggagccuguucugucuugcaucu

SEQ ID NO: 294989 - RNA, 32 nt, Human
aauggccugggcagaacaaauagggagcauuu

SEQ ID NO: 294990 - RNA, 32 nt, Human
aauggccuuccuguucagcuguuagagacuga

SEQ ID NO: 294991 - RNA, 32 nt, Human
aauggcgacacugcacugcaggcugggcuaca

SEQ ID NO: 294992 - RNA, 32 nt, Human
aauggcgagaucuccuggagugggggauauuc

SEQ ID NO: 294993 - RNA, 32 nt, Human
aauggcgaugguggaggugauagggacuucaa

SEQ ID NO: 294994 - RNA, 32 nt, Human
aauggcgccacugcacuccagccuggguaaca

SEQ ID NO: 294995 - RNA, 32 nt, Human
aauggcgcucucucaguacacuuauggcuaug

SEQ ID NO: 294996 - RNA, 32 nt, Human
aauggcggaaacagcagccaaucggcgaucag

SEQ ID NO: 294997 - RNA, 32 nt, Human
aauggcggcggggagagccacagaggagcagg

SEQ ID NO: 294998 - RNA, 32 nt, Human
aauggcgugccaccccauccuucuccaccaaa

SEQ ID NO: 294999 - RNA, 32 nt, Human
aauggcuaaaaauuaaauguaaagggcaagag

SEQ ID NO: 295000 - RNA, 32 nt, Human
aauggcuaaacaguaucaaguacugcagaauu

SEQ ID NO: 295001 - RNA, 32 nt, Human
aauggcuaagcucugggggugcuuuugaugug

SEQ ID NO: 295002 - RNA, 32 nt, Human
aauggcuaaugcacuguucccuccagcccgaa

SEQ ID NO: 295003 - RNA, 32 nt, Human
aauggcuaggaauauuggaagcagcauagugu

SEQ ID NO: 295004 - RNA, 32 nt, Human
aauggcucaaauaccauuaccucuauucauuu

SEQ ID NO: 295005 - RNA, 32 nt, Human
aauggcucacugcagccucaaccuccugagcu

SEQ ID NO: 295006 - RNA, 32 nt, Human
aauggcucacuggcaugucuuuuauguguuca

SEQ ID NO: 295007 - RNA, 32 nt, Human
aauggcugaacuagaagcuguguuagaacagc

SEQ ID NO: 295008 - RNA, 32 nt, Human
aauggcugacacccccauucccucucuucuuc

SEQ ID NO: 295009 - RNA, 32 nt, Human
aauggcugacuucugguucucccucaaguguu

SEQ ID NO: 295010 - RNA, 32 nt, Human
aauggcugcaccuuuuugcaugauaucuucaa

SEQ ID NO: 295011 - RNA, 32 nt, Human
aauggcugcuuagagucagccuggguggcacc

SEQ ID NO: 295012 - RNA, 32 nt, Human
aauggcugcuucagggcagcugucuuuuaugg

SEQ ID NO: 295013 - RNA, 32 nt, Human
aauggcuggacccugcaugcagggcugggggu

SEQ ID NO: 295014 - RNA, 32 nt, Human
aauggcugggcugccaggccagacacgcuagg

SEQ ID NO: 295015 - RNA, 32 nt, Human
aauggcuggguuugggcaguggagaggggacu

SEQ ID NO: 295016 - RNA, 32 nt, Human
aauggcugguauaguggcuacugcugagaagu

SEQ ID NO: 295017 - RNA, 32 nt, Human
aauggcugugugacacacguaaggaaaggaaa

SEQ ID NO: 295018 - RNA, 32 nt, Human
aauggcuuacaguuucugucuggucaucugga

SEQ ID NO: 295019 - RNA, 26 nt, Human
aauggcuuccaaacuccugcgcgcgg

SEQ ID NO: 295020 - RNA, 32 nt, Human
aauggcuucuuccguuuugcagucuccuaugg

SEQ ID NO: 295021 - RNA, 32 nt, Human
aauggcuugcaguuguuccuccacucuaaaug

SEQ ID NO: 295022 - RNA, 32 nt, Human
aauggcuugccaucuuuuaauuuucuauuuag

SEQ ID NO: 295023 - RNA, 32 nt, Human
aauggcuuggaccaggccagagcuguucuccc

SEQ ID NO: 295024 - RNA, 32 nt, Human
aauggcuugggauuuggugcaaacaaacauga

SEQ ID NO: 295025 - RNA, 32 nt, Human
aauggcuuggguucagucagcccaggggccag

SEQ ID NO: 295026 - RNA, 32 nt, Human
aauggcuugugcuccugcuccuguggguauag

SEQ ID NO: 295027 - RNA, 32 nt, Human
aauggcuuguugaaucucagcaguuccgccau

SEQ ID NO: 295028 - RNA, 32 nt, Human
aaugggaaaaggaucccugauuaagcugauga

SEQ ID NO: 295029 - RNA, 32 nt, Human
aaugggaaaaucuauuccaaagagacacacua

SEQ ID NO: 295030 - RNA, 32 nt, Human
aaugggaaagacagagguuacagaggagccgg

SEQ ID NO: 295031 - RNA, 32 nt, Human
aaugggaacagcuucuggcugaaugaagaccu

SEQ ID NO: 295032 - RNA, 32 nt, Human
aaugggaaccugguuugcccauuuugaaaacc

SEQ ID NO: 295033 - RNA, 32 nt, Human
aaugggaacuggagaggacccugagaggagac

SEQ ID NO: 295034 - RNA, 32 nt, Human
aaugggaacuggagaguguggggaaugggaag

SEQ ID NO: 295035 - RNA, 20 nt, Human
aaugggaagcaacagaucac

SEQ ID NO: 295036 - RNA, 32 nt, Human
aaugggaagccauuuugauuucuugaguaauc

SEQ ID NO: 295037 - RNA, 32 nt, Human
aaugggaaggaaccugagcugcuggaaccucu

SEQ ID NO: 295038 - RNA, 32 nt, Human
aaugggaagguucuguuuucugcuccaagacu

SEQ ID NO: 295039 - RNA, 21 nt, Human
aaugggacaaguguaaagcau

SEQ ID NO: 295040 - RNA, 32 nt, Human
aaugggacagccgccacugagccucauuacuu

SEQ ID NO: 295041 - RNA, 32 nt, Human
aaugggacauucguagagugggauagaggugg

SEQ ID NO: 295042 - RNA, 32 nt, Human
aaugggaccacaucuaccaggaggagaugcug

SEQ ID NO: 295043 - RNA, 32 nt, Human
aaugggacucaaggacuugaccuccaggagua

SEQ ID NO: 295044 - RNA, 32 nt, Human
aaugggacuccaacuaagggaaccugaaauca

SEQ ID NO: 295045 - RNA, 26 nt, Human
aaugggacuccaagccugccuccuag

SEQ ID NO: 295046 - RNA, 32 nt, Human
aaugggagagagaaggggagaaccaaucucaa

SEQ ID NO: 295047 - RNA, 32 nt, Human
aaugggagaggaggagaaucaaugggaugugg

SEQ ID NO: 295048 - RNA, 32 nt, Human
aaugggagcacucugucuucuuugcuagagaa

SEQ ID NO: 295049 - RNA, 32 nt, Human
aaugggagcauauuguaaaauaguucccaaau

SEQ ID NO: 295050 - RNA, 32 nt, Human
aaugggaggacucaggaaggaggaucgucuuu

SEQ ID NO: 295051 - RNA, 32 nt, Human
aaugggaggagacaaggagcugaaggaguagu

SEQ ID NO: 295052 - RNA, 32 nt, Human
aaugggaggagggaggaggagacagagaaggc

SEQ ID NO: 295053 - RNA, 32 nt, Human
aaugggagguggaggaggguugcagcucccac

SEQ ID NO: 295054 - RNA, 32 nt, Human
aaugggaguaaguguucuuaucuggaaaaaua

SEQ ID NO: 295055 - RNA, 32 nt, Human
aaugggagucccaggcuguacaguggugagug

SEQ ID NO: 295056 - RNA, 32 nt, Human
aaugggaugauauggagguucaaugagauggu

SEQ ID NO: 295057 - RNA, 32 nt, Human
aaugggcaauaaggaaggaggaguuuggagaa

SEQ ID NO: 295058 - RNA, 32 nt, Human
aaugggcagguucuugcucucccaggcuggag

SEQ ID NO: 295059 - RNA, 32 nt, Human
aaugggcaguagaagcaaaugcuguuguuaca

SEQ ID NO: 295060 - RNA, 32 nt, Human
aaugggcaguaggggaaauggaguugcuucaa

SEQ ID NO: 295061 - RNA, 32 nt, Human
aaugggcagugacccaggcuuagugcucccaa

SEQ ID NO: 295062 - RNA, 32 nt, Human
aaugggccagagaagcaggcucuuuccucauc

SEQ ID NO: 295063 - RNA, 32 nt, Human
aaugggcccagaggaggguaagacucugcugu

SEQ ID NO: 295064 - RNA, 32 nt, Human
aaugggcccgcacuugcccagaggcagagcuc

SEQ ID NO: 295065 - RNA, 32 nt, Human
aaugggcccucaagccacccaggcucccacca

SEQ ID NO: 295066 - RNA, 32 nt, Human
aaugggcccucagaggacagugcuuccaagua

SEQ ID NO: 295067 - RNA, 32 nt, Human
aaugggccuuucucugccugcccugcccuugg

SEQ ID NO: 295068 - RNA, 32 nt, Human
aaugggcgugaggugcugauguccuugccuug

SEQ ID NO: 295069 - RNA, 32 nt, Human
aaugggcuccagaagguggagauggagaacca

SEQ ID NO: 295070 - RNA, 32 nt, Human
aaugggcugacuacucaacaaaggacaagaua

SEQ ID NO: 295071 - RNA, 32 nt, Human
aaugggcugcuggcuccugcccugcuuccugu

SEQ ID NO: 295072 - RNA, 32 nt, Human
aauggggaaaaguuaaggagcaaaaugggggu

SEQ ID NO: 295073 - RNA, 32 nt, Human
aauggggaaagaaaucugcagcaaaggggucu

SEQ ID NO: 295074 - RNA, 32 nt, Human
aauggggacaucaccguccgccugggcuacag

SEQ ID NO: 295075 - RNA, 32 nt, Human
aauggggacuuugccaccggcuugccuggugg

SEQ ID NO: 295076 - RNA, 32 nt, Human
aauggggagaaaagcucagagagaugcauuuu

SEQ ID NO: 295077 - RNA, 32 nt, Human
aauggggagagaaaaugccugcuuucuuuccc

SEQ ID NO: 295078 - RNA, 32 nt, Human
aauggggagagggagggccgggaagccaggaa

SEQ ID NO: 295079 - RNA, 32 nt, Human
aauggggagaggguggggcagaugaguagaga

SEQ ID NO: 295080 - RNA, 20 nt, Human
aauggggagccucagcucac

SEQ ID NO: 295081 - RNA, 32 nt, Human
aauggggagcugaggaaggagcaaacggguuu

SEQ ID NO: 295082 - RNA, 32 nt, Human
aauggggagggagggagggaccaaagccguga

SEQ ID NO: 295083 - RNA, 32 nt, Human
aauggggaguagagagaaaacaggcgagaaca

SEQ ID NO: 295084 - RNA, 32 nt, Human
aauggggaucuagugacaaaauaaucugcccu

SEQ ID NO: 295085 - RNA, 27 nt, Human
aauggggaugcaaauaaaguuuguggg

SEQ ID NO: 295086 - RNA, 32 nt, Human
aauggggcaaggaaaaagaaagccuaugggaa

SEQ ID NO: 295087 - RNA, 32 nt, Human
aauggggcagacugaggcuugugaggaagauc

SEQ ID NO: 295088 - RNA, 32 nt, Human
aauggggcagaggccgggagggguggggguuc

SEQ ID NO: 295089 - RNA, 32 nt, Human
aauggggcagaggcuagugcugaccuacgggc

SEQ ID NO: 295090 - RNA, 32 nt, Human
aauggggccaucugucuucucuccuuggagag

SEQ ID NO: 295091 - RNA, 31 nt, Human
aauggggcccuucucuugacauuccuuuugu

SEQ ID NO: 295092 - RNA, 32 nt, Human
aaugggggaggaacuugcacucuccugcggga

SEQ ID NO: 295093 - RNA, 32 nt, Human
aaugggggcccagggggugucagcucggggcc

SEQ ID NO: 295094 - RNA, 32 nt, Human
aaugggggccgauccggggcccucucugcacc

SEQ ID NO: 295095 - RNA, 32 nt, Human
aaugggguaggaacuccauccucgcugccgcg

SEQ ID NO: 295096 - RNA, 32 nt, Human
aaugggguauggaaguuuuccuacacuugaga

SEQ ID NO: 295097 - RNA, 32 nt, Human
aaugggguauucagugacuaaggucugcuauu

SEQ ID NO: 295098 - RNA, 32 nt, Human
aauggggucaagaggacacagaagaguuguau

SEQ ID NO: 295099 - RNA, 32 nt, Human
aauggggugccugcuugggcugggucgaaggc

SEQ ID NO: 295100 - RNA, 32 nt, Human
aauggggugggcuucucauccauguugcuucu

SEQ ID NO: 295101 - RNA, 32 nt, Human
aauggguaaggaacaaucaaauucaauucggg

SEQ ID NO: 295102 - RNA, 32 nt, Human
aauggguacaaaccacacaaugcaggugacca

SEQ ID NO: 295103 - RNA, 32 nt, Human
aauggguacagggggagucaggcucaccgugg

SEQ ID NO: 295104 - RNA, 32 nt, Human
aaugggucucuagccucagucuugucaucugu

SEQ ID NO: 295105 - RNA, 32 nt, Human
aaugggugcaauggguagaaugggagguggua

SEQ ID NO: 295106 - RNA, 32 nt, Human
aauggguuuuucuuuucuacugcaucaucagg

SEQ ID NO: 295107 - RNA, 32 nt, Human
aaugguaaacuugagcaucuuuucacuuucca

SEQ ID NO: 295108 - RNA, 32 nt, Human
aaugguaaauacucauuaccucucucagccca

SEQ ID NO: 295109 - RNA, 32 nt, Human
aaugguaaucaagaacuggaacuucacagaca

SEQ ID NO: 295110 - RNA, 32 nt, Human
aaugguacauugaguaguguggggaagacacc

SEQ ID NO: 295111 - RNA, 32 nt, Human
aaugguagcagaaaauccuauugauuucaucu

SEQ ID NO: 295112 - RNA, 32 nt, Human
aauggucaaguuggauuuagaugauguucccu

SEQ ID NO: 295113 - RNA, 32 nt, Human
aauggucaaguuggauuuagaugauguucucu

SEQ ID NO: 295114 - RNA, 32 nt, Human
aauggucagaauuucgagaacugugugcugaa

SEQ ID NO: 295115 - RNA, 32 nt, Human
aauggucauaacagugccuguuucugcgaacu

SEQ ID NO: 295116 - RNA, 32 nt, Human
aauggucauuagcuccuuuuaagcuagaaacg

SEQ ID NO: 295117 - RNA, 32 nt, Human
aauggucccaagaauuacucuaauauaguugu

SEQ ID NO: 295118 - RNA, 32 nt, Human
aauggucccccuaaccaugcagagagagauuc

SEQ ID NO: 295119 - RNA, 32 nt, Human
aaugguccucucacugcagccucccaacaggc

SEQ ID NO: 295120 - RNA, 32 nt, Human
aauggucuccugucuccagccugcuugaucuu

SEQ ID NO: 295121 - RNA, 32 nt, Human
aauggugaaagcuuccuucuaaacugccccaa

SEQ ID NO: 295122 - RNA, 32 nt, Human
aauggugacuccuguuauguuuuagcaaagag

SEQ ID NO: 295123 - RNA, 20 nt, Human
aauggugagaggccaggaga

SEQ ID NO: 295124 - RNA, 32 nt, Human
aauggugccacugcacuccagucugggcaaca

SEQ ID NO: 295125 - RNA, 32 nt, Human
aauggugccacuggacuccagccugggagaca

SEQ ID NO: 295126 - RNA, 32 nt, Human
aauggugcccaggcuggagugcaguggcguga

SEQ ID NO: 295127 - RNA, 32 nt, Human
aauggugccuguaaagcucucagcauuggcuu

SEQ ID NO: 295128 - RNA, 32 nt, Human
aauggugcuauuuccccucucuccuccucaac

SEQ ID NO: 295129 - RNA, 32 nt, Human
aauggugcucuccuggcccugcucuggcccuu

SEQ ID NO: 295130 - RNA, 32 nt, Human
aauggugcucuggggcuggaggcuaguaagga

SEQ ID NO: 295131 - RNA, 32 nt, Human
aauggugcugagguugagaaaaccugacuuaa

SEQ ID NO: 295132 - RNA, 32 nt, Human
aauggugcuggguggagaauggagagagcaug

SEQ ID NO: 295133 - RNA, 32 nt, Human
aauggugcuuaucuugauugaacauucagaac

SEQ ID NO: 295134 - RNA, 32 nt, Human
aaugguggacaaguuagcugugguugauuccu

SEQ ID NO: 295135 - RNA, 32 nt, Human
aaugguggcuaaagaaaauagggacucugaag

SEQ ID NO: 295136 - RNA, 32 nt, Human
aaugguggcuagauuagugggagcaguucacc

SEQ ID NO: 295137 - RNA, 32 nt, Human
aaugguggcucacgccuguaaucucagcauuu

SEQ ID NO: 295138 - RNA, 32 nt, Human
aaugguggcucaugccuguaaucccagcaccu

SEQ ID NO: 295139 - RNA, 32 nt, Human
aaugguggcuucagcuccagccccuuuccaaa

SEQ ID NO: 295140 - RNA, 32 nt, Human
aauggugggagcugggggagaaugaagacugu

SEQ ID NO: 295141 - RNA, 32 nt, Human
aauggugggauuacaggugugugggccaccgu

SEQ ID NO: 295142 - RNA, 32 nt, Human
aauggugguaacuuccaagccgcugggugguu

SEQ ID NO: 295143 - RNA, 32 nt, Human
aauggugguggaaggguagagaggcgcggagu

SEQ ID NO: 295144 - RNA, 32 nt, Human
aaugguggugggaaguccugggaacacacaca

SEQ ID NO: 295145 - RNA, 32 nt, Human
aauggugguucacgccuguaaucccagcacuu

SEQ ID NO: 295146 - RNA, 32 nt, Human
aauggugucauccugaaaaacaaaacccagug

SEQ ID NO: 295147 - RNA, 32 nt, Human
aaugguguccaggcuggagugcaguggcguga

SEQ ID NO: 295148 - RNA, 32 nt, Human
aaugguguccccaauuucagggaauccaugga

SEQ ID NO: 295149 - RNA, 32 nt, Human
aauggugucugaccacuggcuccuggaaggga

SEQ ID NO: 295150 - RNA, 17 nt, Human
aauggugucugcagaug

SEQ ID NO: 295151 - RNA, 32 nt, Human
aauggugucugcugugcauggcauuuuauaug

SEQ ID NO: 295152 - RNA, 32 nt, Human
aauggugucuguccagccccucccucuguccc

SEQ ID NO: 295153 - RNA, 32 nt, Human
aauggugugaugcuccuuguagcaggauacca

SEQ ID NO: 295154 - RNA, 32 nt, Human
aauggugugcuccccucugugucuccauggcc

SEQ ID NO: 295155 - RNA, 32 nt, Human
aaugguguguacuuaacaagcaucuagguaaa

SEQ ID NO: 295156 - RNA, 32 nt, Human
aauggugugugcucccucucccucucuucccu

SEQ ID NO: 295157 - RNA, 32 nt, Human
aaugguguuucagaagcugaacuucugaccaa

SEQ ID NO: 295158 - RNA, 32 nt, Human
aaugguguuucauguaaggaucuuuaaaggga

SEQ ID NO: 295159 - RNA, 32 nt, Human
aaugguuaaggcagaauaaugacuaaaauaug

SEQ ID NO: 295160 - RNA, 32 nt, Human
aaugguuacuaggcuuaauaccugggugauua

SEQ ID NO: 295161 - RNA, 32 nt, Human
aaugguuaucacaagaaggcugugcugucccc

SEQ ID NO: 295162 - RNA, 32 nt, Human
aaugguuaugaacgcuuuugugcugcugauuu

SEQ ID NO: 295163 - RNA, 32 nt, Human
aaugguuauuuugccaguuacauuugauuucu

SEQ ID NO: 295164 - RNA, 32 nt, Human
aaugguucacaaggaaacuucugccucaggug

SEQ ID NO: 295165 - RNA, 32 nt, Human
aaugguucagcccucuacugcaggaccagucc

SEQ ID NO: 295166 - RNA, 32 nt, Human
aaugguucaguugggcaaaaggcuccagugaa

SEQ ID NO: 295167 - RNA, 32 nt, Human
aaugguucauguuacucuuucucucuccauca

SEQ ID NO: 295168 - RNA, 32 nt, Human
aaugguuccauggugaaacacaucccugaccc

SEQ ID NO: 295169 - RNA, 19 nt, Human
aaugguucgcugccuccug

SEQ ID NO: 295170 - RNA, 32 nt, Human
aaugguugaagggagagagaauucuuuaaaau

SEQ ID NO: 295171 - RNA, 32 nt, Human
aaugguugguguauuuugucaguaauuguaca

SEQ ID NO: 295172 - RNA, 32 nt, Human
aaugguugucuuaacuucuuaaccucauauug

SEQ ID NO: 295173 - RNA, 32 nt, Human
aaugguuuacaaaucugaagcugaaguucaau

SEQ ID NO: 295174 - RNA, 32 nt, Human
aaugguuuagauaucuuucuuccuucauaauu

SEQ ID NO: 295175 - RNA, 32 nt, Human
aaugguuucacguggcuuucaaagggaaggaa

SEQ ID NO: 295176 - RNA, 32 nt, Human
aaugguuuccccuaugcuguucuugugauagu

SEQ ID NO: 295177 - RNA, 32 nt, Human
aaugguuucccuugaaugcacagccauuuccg

SEQ ID NO: 295178 - RNA, 32 nt, Human
aaugguuugcaaggaagccacagcugguggua

SEQ ID NO: 295179 - RNA, 32 nt, Human
aaugguuugguuugcagagaacacagccugau

SEQ ID NO: 295180 - RNA, 32 nt, Human
aaugguuugucagcugucacuguuguuuucuu

SEQ ID NO: 295181 - RNA, 32 nt, Human
aaugguuuucuuagcauauccuccuggggccg

SEQ ID NO: 295182 - RNA, 32 nt, Human
aauguaaaaccagccaagcaaggccauaaagg

SEQ ID NO: 295183 - RNA, 32 nt, Human
aauguaaaagaccucaggcaccaccuucgcau

SEQ ID NO: 295184 - RNA, 32 nt, Human
aauguaaaauggggcagccacuuuggaaaaag

SEQ ID NO: 295185 - RNA, 32 nt, Human
aauguaaacagaacuggcacacacacauuaag

SEQ ID NO: 295186 - RNA, 32 nt, Human
aauguaaacagaguuacaaaaaccacuccaaa

SEQ ID NO: 295187 - RNA, 32 nt, Human
aauguaaacagaguuauaaaaaccacuucaaa

SEQ ID NO: 295188 - RNA, 32 nt, Human
aauguaaacuaaauccgcgucugugaauacgu

SEQ ID NO: 295189 - RNA, 32 nt, Human
aauguaaagucucaucacaguacauuugguaa

SEQ ID NO: 295190 - RNA, 32 nt, Human
aauguaaauuaauucagccauuguggaaagca

SEQ ID NO: 295191 - RNA, 32 nt, Human
aauguaaauuaguucagccauugugaaaagua

SEQ ID NO: 295192 - RNA, 32 nt, Human
aauguaacaccauuagacacucaccagauguu

SEQ ID NO: 295193 - RNA, 32 nt, Human
aauguaagagauaggaagaggccagguguagu

SEQ ID NO: 295194 - RNA, 32 nt, Human
aauguaagaucagcuggagaaagcccagugug

SEQ ID NO: 295195 - RNA, 32 nt, Human
aauguaaguuuugucuugcccugguuauuagc

SEQ ID NO: 295196 - RNA, 32 nt, Human
aauguaauccaagccaaaaguuaacaagaaua

SEQ ID NO: 295197 - RNA, 32 nt, Human
aauguaaugcaaccaaguuccucccagauuaa

SEQ ID NO: 295198 - RNA, 32 nt, Human
aauguaauguagcuuuuuccacaagccacuuc

SEQ ID NO: 295199 - RNA, 32 nt, Human
aauguaauuaaccuuucuuuacauuucuuaug

SEQ ID NO: 295200 - RNA, 32 nt, Human
aauguaauugaaaagucagcuuccauauuuug

SEQ ID NO: 295201 - RNA, 32 nt, Human
aauguaauuuucucagaauuuacacucacucg

SEQ ID NO: 295202 - RNA, 32 nt, Human
aauguacaaacuguugguggccugaauccauc

SEQ ID NO: 295203 - RNA, 32 nt, Human
aauguacaacugacacugccauuuuuccuuuu

SEQ ID NO: 295204 - RNA, 32 nt, Human
aauguacaagagcacuacugaagaaguccagc

SEQ ID NO: 295205 - RNA, 32 nt, Human
aauguacaagaugagacucacucuaguggaug

SEQ ID NO: 295206 - RNA, 32 nt, Human
aauguacaauguucugauaaauuugacuguua

SEQ ID NO: 295207 - RNA, 32 nt, Human
aauguacacacacccugaaagacagcgaggcc

SEQ ID NO: 295208 - RNA, 32 nt, Human
aauguacaccaaaauaaaacaugugaagcagu

SEQ ID NO: 295209 - RNA, 27 nt, Human
aauguacaguacugacaccaccacaaa

SEQ ID NO: 295210 - RNA, 32 nt, Human
aauguacaugacucucagugucuguggaaaca

SEQ ID NO: 295211 - RNA, 32 nt, Human
aauguaccaacuucucuuucucuggucagguu

SEQ ID NO: 295212 - RNA, 22 nt, Human
aauguaccccuuuaagguucag

SEQ ID NO: 295213 - RNA, 32 nt, Human
aauguacccugccucugcuuucuccugcaucc

SEQ ID NO: 295214 - RNA, 32 nt, Human
aauguaccuccaggcccugcaugccgucagua

SEQ ID NO: 295215 - RNA, 32 nt, Human
aauguacuccagccuaggugacagagugagac

SEQ ID NO: 295216 - RNA, 32 nt, Human
aauguacucuagaccacaggacuaauguaaau

SEQ ID NO: 295217 - RNA, 32 nt, Human
aauguacuggaaaauugcuuaauggauuuuua

SEQ ID NO: 295218 - RNA, 32 nt, Human
aauguacugguuaggucagugguacaacuguu

SEQ ID NO: 295219 - RNA, 32 nt, Human
aauguagaccaggaaagggggcugcaaaaaug

SEQ ID NO: 295220 - RNA, 32 nt, Human
aauguagagaaaaggugacaguuuaaggaaaa

SEQ ID NO: 295221 - RNA, 32 nt, Human
aauguagagaaguugggauuaaaagcagucuc

SEQ ID NO: 295222 - RNA, 32 nt, Human
aauguagagagacugauggggaaaguaugaug

SEQ ID NO: 295223 - RNA, 32 nt, Human
aauguagagaugccaccucccucucucugagg

SEQ ID NO: 295224 - RNA, 32 nt, Human
aauguagagucgucagacugaaaggccagguu

SEQ ID NO: 295225 - RNA, 32 nt, Human
aauguagauacugauucuuucuccauaaaugu

SEQ ID NO: 295226 - RNA, 32 nt, Human
aauguagaucaaggcgagcugccuacaaauua

SEQ ID NO: 295227 - RNA, 32 nt, Human
aauguagaucaguuaauaaacaugaguagcuu

SEQ ID NO: 295228 - RNA, 32 nt, Human
aauguagcaaagcauuccuaguuaaccagagc

SEQ ID NO: 295229 - RNA, 32 nt, Human
aauguagccagcccacauccauuccagagcug

SEQ ID NO: 295230 - RNA, 32 nt, Human
aauguagccaugggaccaaaccuagccccuua

SEQ ID NO: 295231 - RNA, 32 nt, Human
aauguagcccugcauccuccaguguuaccugg

SEQ ID NO: 295232 - RNA, 32 nt, Human
aauguagccucuguccuuguaagucaguugac

SEQ ID NO: 295233 - RNA, 32 nt, Human
aauguagcugacuccuuucuucucccacuugc

SEQ ID NO: 295234 - RNA, 32 nt, Human
aauguagcuucucaggggaggcaggaagaaag

SEQ ID NO: 295235 - RNA, 31 nt, Human
aauguagggaagccaugucagaugcagauac

SEQ ID NO: 295236 - RNA, 32 nt, Human
aauguaggggcagaagcuugacuccagacccu

SEQ ID NO: 295237 - RNA, 32 nt, Human
aauguaggggcagaggaagauggcaucaggac

SEQ ID NO: 295238 - RNA, 32 nt, Human
aauguagguggaggcaacacagccacuucuga

SEQ ID NO: 295239 - RNA, 32 nt, Human
aauguagucugccuugaaaagucuuucagcug

SEQ ID NO: 295240 - RNA, 32 nt, Human
aauguagugaccaaauuguggaagagauuucu

SEQ ID NO: 295241 - RNA, 32 nt, Human
aauguaguuagaauuagccacaggagaaugua

SEQ ID NO: 295242 - RNA, 21 nt, Human
aauguauacuggagagaaacc

SEQ ID NO: 295243 - RNA, 32 nt, Human
aauguauauacccacacacauacacacauaug

SEQ ID NO: 295244 - RNA, 32 nt, Human
aauguauaugguacagauguaaaguuuucuau

SEQ ID NO: 295245 - RNA, 32 nt, Human
aauguaucacagacugucacuuuguauuccuc

SEQ ID NO: 295246 - RNA, 32 nt, Human
aauguaucacuauugaauuucucuccacaagu

SEQ ID NO: 295247 - RNA, 32 nt, Human
aauguaucauucuuuauaaaaaucuacugaaa

SEQ ID NO: 295248 - RNA, 32 nt, Human
aauguauccauguggcuacuucuccagccccc

SEQ ID NO: 295249 - RNA, 32 nt, Human
aauguaucccuccccucaguuuuaaccugagc

SEQ ID NO: 295250 - RNA, 32 nt, Human
aauguaucugaagaagaggcucagggaguaaa

SEQ ID NO: 295251 - RNA, 32 nt, Human
aauguaucuuaaaaugguucuaaaaauugcau

SEQ ID NO: 295252 - RNA, 32 nt, Human
aauguaugagcagcuuaacugaaguagaacua

SEQ ID NO: 295253 - RNA, 21 nt, Human
aauguaugcaagagaccaaaa

SEQ ID NO: 295254 - RNA, 32 nt, Human
aauguaugcuuuguacaugacacuucaauaaa

SEQ ID NO: 295255 - RNA, 32 nt, Human
aauguauggcaggcugggcagaauguauacug

SEQ ID NO: 295256 - RNA, 32 nt, Human
aauguauguauguauaauggcuguacagguag

SEQ ID NO: 295257 - RNA, 32 nt, Human
aauguauguggggcuuaaaaccuagaugauga

SEQ ID NO: 295258 - RNA, 32 nt, Human
aauguauucacauuauucuuuaauaaucuguu

SEQ ID NO: 295259 - RNA, 32 nt, Human
aauguauucccaagguuugcugggcucuggga

SEQ ID NO: 295260 - RNA, 32 nt, Human
aauguauugaggaucugugaaaugcuaagugc

SEQ ID NO: 295261 - RNA, 32 nt, Human
aauguauuggcuuagccaaaucacuacagaag

SEQ ID NO: 295262 - RNA, 32 nt, Human
aauguauuuauuucucagacuuggggcgagug

SEQ ID NO: 295263 - RNA, 32 nt, Human
aauguauuuuucucaucuaccaaaggaugaaa

SEQ ID NO: 295264 - RNA, 22 nt, Human
aauguauuuuugugguguuacg

SEQ ID NO: 295265 - RNA, 32 nt, Human
aaugucaaaccagcuucccgacucccaggagc

SEQ ID NO: 295266 - RNA, 32 nt, Human
aaugucaaauugaugugcccuagaucaacaga

SEQ ID NO: 295267 - RNA, 32 nt, Human
aaugucaacaagggacaagacagggcaccuuc

SEQ ID NO: 295268 - RNA, 32 nt, Human
aaugucaagcucagaagaaagacuggaaguuu

SEQ ID NO: 295269 - RNA, 32 nt, Human
aaugucacaagaaaaauucaaaaccuuuagcu

SEQ ID NO: 295270 - RNA, 31 nt, Human
aaugucacaagcuagaaucaucagcaugguu

SEQ ID NO: 295271 - RNA, 32 nt, Human
aaugucacaaucccuucuauagcccccuacag

SEQ ID NO: 295272 - RNA, 32 nt, Human
aaugucacaggcaggucccaggguuugaguuc

SEQ ID NO: 295273 - RNA, 32 nt, Human
aaugucacaguaggaagugcacuggacuaggg

SEQ ID NO: 295274 - RNA, 32 nt, Human
aaugucacaguugccucaaaugagcaccauuu

SEQ ID NO: 295275 - RNA, 32 nt, Human
aaugucacccgagacugucacaggcuugccau

SEQ ID NO: 295276 - RNA, 32 nt, Human
aaugucaccucacauccucuuggccacauuuu

SEQ ID NO: 295277 - RNA, 32 nt, Human
aaugucacucgcccagucuucagucuccugac

SEQ ID NO: 295278 - RNA, 23 nt, Human
aaugucacugccgaagaccaaaa

SEQ ID NO: 295279 - RNA, 32 nt, Human
aaugucagaaguugauagguuguuaaauacau

SEQ ID NO: 295280 - RNA, 32 nt, Human
aaugucagaggauuuaauugugucuaauugcg

SEQ ID NO: 295281 - RNA, 32 nt, Human
aaugucagcuacuugggaggcugaggcaggag

SEQ ID NO: 295282 - RNA, 26 nt, Human
aaugucaggaauggaagccacuguga

SEQ ID NO: 295283 - RNA, 32 nt, Human
aaugucaggguauugcucuguugcccaggcua

SEQ ID NO: 295284 - RNA, 32 nt, Human
aaugucaucacauccuccguguccucaucugu

SEQ ID NO: 295285 - RNA, 32 nt, Human
aaugucauccgcgugagggaaggagggacggc

SEQ ID NO: 295286 - RNA, 32 nt, Human
aaugucaucuucucuggaagccgucccugacc

SEQ ID NO: 295287 - RNA, 32 nt, Human
aaugucauucacaacagaaaacccaaaauauu

SEQ ID NO: 295288 - RNA, 32 nt, Human
aaugucauugucuacuccuagaagaaccaaau

SEQ ID NO: 295289 - RNA, 32 nt, Human
aauguccaagcagaggaaucuaaguggcagac

SEQ ID NO: 295290 - RNA, 32 nt, Human
aauguccacaccucugcaucccugcaccagga

SEQ ID NO: 295291 - RNA, 32 nt, Human
aauguccagcuacagacccagaggauaagcca

SEQ ID NO: 295292 - RNA, 32 nt, Human
aauguccauaaauaaaauguuauuggaacaca

SEQ ID NO: 295293 - RNA, 32 nt, Human
aaugucccacagccacauuggaaauacagguu

SEQ ID NO: 295294 - RNA, 32 nt, Human
aaugucccagcccagugcugggacagggaagg

SEQ ID NO: 295295 - RNA, 32 nt, Human
aaugucccaggccauggcagagcucguuccau

SEQ ID NO: 295296 - RNA, 32 nt, Human
aauguccccaggagcagcaacccugagucaau

SEQ ID NO: 295297 - RNA, 32 nt, Human
aauguccccauggaucuggauccuggagaacu

SEQ ID NO: 295298 - RNA, 32 nt, Human
aaugucccccuucuugcuucucucuccuucuu

SEQ ID NO: 295299 - RNA, 32 nt, Human
aauguccccuucuucagugucagaccucaguc

SEQ ID NO: 295300 - RNA, 32 nt, Human
aaugucccucuugcauuccuggccccuaucuc

SEQ ID NO: 295301 - RNA, 32 nt, Human
aaugucccugccucuagguucauaaugaauua

SEQ ID NO: 295302 - RNA, 32 nt, Human
aauguccgccaucuacccuccgcuccugggcg

SEQ ID NO: 295303 - RNA, 32 nt, Human
aauguccggcugucauuucuccaccuaagagc

SEQ ID NO: 295304 - RNA, 32 nt, Human
aauguccuccauuucagagucagcuuaaaacc

SEQ ID NO: 295305 - RNA, 32 nt, Human
aauguccucuccaucauccucagugugagucc

SEQ ID NO: 295306 - RNA, 32 nt, Human
aauguccugaguaaaguagaaaagcaaccuuu

SEQ ID NO: 295307 - RNA, 32 nt, Human
aauguccugcuuccuuggggagcugcagccau

SEQ ID NO: 295308 - RNA, 32 nt, Human
aauguccuuauaaaagggacccccaggaccug

SEQ ID NO: 295309 - RNA, 32 nt, Human
aauguccuucauuuuacuaaaaggacaaccau

SEQ ID NO: 295310 - RNA, 32 nt, Human
aauguccuucuaguauucucuggacucaaguc

SEQ ID NO: 295311 - RNA, 32 nt, Human
aauguccuugaugcuccugaacugggugcuua

SEQ ID NO: 295312 - RNA, 32 nt, Human
aauguccuuucccacaagcauuuauauuuuaa

SEQ ID NO: 295313 - RNA, 32 nt, Human
aaugucgacuguagcacugagaacaagugcuc

SEQ ID NO: 295314 - RNA, 28 nt, Human
aaugucgugcuugcugguggccacguug

SEQ ID NO: 295315 - RNA, 32 nt, Human
aaugucguuggguggggaagcaaaauguagag

SEQ ID NO: 295316 - RNA, 32 nt, Human
aaugucguuguuguuguuuuucuggaaacugc

SEQ ID NO: 295317 - RNA, 32 nt, Human
aaugucuccauuguuaaauguccccuuaggag

SEQ ID NO: 295318 - RNA, 32 nt, Human
aaugucucccccagcugccacacacacauuuu

SEQ ID NO: 295319 - RNA, 32 nt, Human
aaugucucgugaaucuuggguuuccauucacc

SEQ ID NO: 295320 - RNA, 32 nt, Human
aaugucucuggcccagaaagccucucucuccc

SEQ ID NO: 295321 - RNA, 32 nt, Human
aaugucugaggaaauuucaacugugaaaacua

SEQ ID NO: 295322 - RNA, 32 nt, Human
aaugucugaucgaucaugcagauacaauguug

SEQ ID NO: 295323 - RNA, 22 nt, Human
aaugucugccaugcacuugcua

SEQ ID NO: 295324 - RNA, 32 nt, Human
aaugucugcccuuuuguuuacuucuugguccu

SEQ ID NO: 295325 - RNA, 32 nt, Human
aaugucuggagugguaacagcucucuucuuac

SEQ ID NO: 295326 - RNA, 32 nt, Human
aaugucuggccugcggagcugcaggggcaggc

SEQ ID NO: 295327 - RNA, 32 nt, Human
aaugucuggcugaguugcuggaagcaaagggg

SEQ ID NO: 295328 - RNA, 32 nt, Human
aaugucugggaaauugugcugagagauauuau

SEQ ID NO: 295329 - RNA, 32 nt, Human
aaugucugggaagcuggggacauugcuaugca

SEQ ID NO: 295330 - RNA, 32 nt, Human
aaugucugguagcucaccacacuucuggcuuc

SEQ ID NO: 295331 - RNA, 32 nt, Human
aaugucuguacugcaagagggcccugggccuc

SEQ ID NO: 295332 - RNA, 26 nt, Human
aaugucugugaggagagagcaaggca

SEQ ID NO: 295333 - RNA, 32 nt, Human
aaugucuucauguguaaaauggagauuaaaug

SEQ ID NO: 295334 - RNA, 32 nt, Human
aaugucuuccagguccaaacccuucaacuccu

SEQ ID NO: 295335 - RNA, 32 nt, Human
aaugucuucuaaggauggucuuccaggcuuuu

SEQ ID NO: 295336 - RNA, 32 nt, Human
aaugucuuucccucuugcuucuuuggcaaaug

SEQ ID NO: 295337 - RNA, 32 nt, Human
aaugucuuuccuuucacuugcuucugggguuu

SEQ ID NO: 295338 - RNA, 32 nt, Human
aaugugaaaagaagaaagcggcugguggaggc

SEQ ID NO: 295339 - RNA, 32 nt, Human
aaugugaaaagccugcacucuuccugugggcu

SEQ ID NO: 295340 - RNA, 32 nt, Human
aaugugaaaugagaaguauuuacauuggaggg

SEQ ID NO: 295341 - RNA, 32 nt, Human
aaugugaaauggggucuugaggugagagaacu

SEQ ID NO: 295342 - RNA, 32 nt, Human
aaugugaaauggugcagccacuguggaaaaca

SEQ ID NO: 295343 - RNA, 32 nt, Human
aaugugaacacaugagugaagcauacauccau

SEQ ID NO: 295344 - RNA, 32 nt, Human
aaugugaacuugccuaguaagcacuuugucuc

SEQ ID NO: 295345 - RNA, 32 nt, Human
aaugugaagcagaucaaggaaacuucuguuga

SEQ ID NO: 295346 - RNA, 32 nt, Human
aaugugaagcagcagcuccagccccgggauaa

SEQ ID NO: 295347 - RNA, 32 nt, Human
aaugugaagccccagccccacccucugcccuu

SEQ ID NO: 295348 - RNA, 32 nt, Human
aaugugaaggaaauggugucuggaagaaaguu

SEQ ID NO: 295349 - RNA, 31 nt, Human
aaugugaauaugcuuuuacauuugggcuuau

SEQ ID NO: 295350 - RNA, 32 nt, Human
aaugugaaugugcccaaugcuacugaaaaacg

SEQ ID NO: 295351 - RNA, 32 nt, Human
aaugugacaagcucuuuguuucaguuggagug

SEQ ID NO: 295352 - RNA, 32 nt, Human
aaugugacaagcuuugcuuuguuaucauuggu

SEQ ID NO: 295353 - RNA, 32 nt, Human
aaugugacagcuuucuguauucugagcucuua

SEQ ID NO: 295354 - RNA, 32 nt, Human
aaugugacaugaaauaauugugcugcuacauu

SEQ ID NO: 295355 - RNA, 32 nt, Human
aaugugaccacuguuuuguguugacaauauug

SEQ ID NO: 295356 - RNA, 32 nt, Human
aaugugacugagaccacuacaauggccaugcc

SEQ ID NO: 295357 - RNA, 32 nt, Human
aaugugacuuuggucuauguguguucuccccc

SEQ ID NO: 295358 - RNA, 32 nt, Human
aaugugagaacagcucauugugccccagugau

SEQ ID NO: 295359 - RNA, 32 nt, Human
aaugugagagucugcagacaauguggguucuc

SEQ ID NO: 295360 - RNA, 21 nt, Human
aaugugagcacuguuagcaga

SEQ ID NO: 295361 - RNA, 22 nt, Human
aaugugagccccaggcugcaga

SEQ ID NO: 295362 - RNA, 32 nt, Human
aaugugaggaagaaagaaaggcagggcauuca

SEQ ID NO: 295363 - RNA, 32 nt, Human
aaugugagucaugucacaaagccuuuaaaugg

SEQ ID NO: 295364 - RNA, 32 nt, Human
aaugugaguccugucuuuugucucaaaaacuu

SEQ ID NO: 295365 - RNA, 32 nt, Human
aaugugaugagugugguaaagacuucagucag

SEQ ID NO: 295366 - RNA, 32 nt, Human
aaugugauugcagcuuuuugccuucagccuuu

SEQ ID NO: 295367 - RNA, 32 nt, Human
aaugugcaauaugcuauucaucaccacgacaa

SEQ ID NO: 295368 - RNA, 32 nt, Human
aaugugcaccacugugguggcguggaaagaug

SEQ ID NO: 295369 - RNA, 32 nt, Human
aaugugcagagcuuacuguggggaccuaaggg

SEQ ID NO: 295370 - RNA, 32 nt, Human
aaugugcagguuuguuacauagguauacaugu

SEQ ID NO: 295371 - RNA, 32 nt, Human
aaugugcaugaugcauuuacuacagcauagaa

SEQ ID NO: 295372 - RNA, 32 nt, Human
aaugugcauggcccaugagaaaggcuuauaag

SEQ ID NO: 295373 - RNA, 32 nt, Human
aaugugcauggugcacagucugugcaugccca

SEQ ID NO: 295374 - RNA, 32 nt, Human
aaugugccacuggacucccagccugggugaca

SEQ ID NO: 295375 - RNA, 32 nt, Human
aaugugccaucagcuaaugccaggcuuacgua

SEQ ID NO: 295376 - RNA, 32 nt, Human
aaugugcgaguccauagcugaagaggagcgcc

SEQ ID NO: 295377 - RNA, 32 nt, Human
aaugugcggcccuccuggaggcagggggcccc

SEQ ID NO: 295378 - RNA, 32 nt, Human
aaugugcuaguagcaucuugcccagccauaaa

SEQ ID NO: 295379 - RNA, 32 nt, Human
aaugugcucaaauuacuaaugauuuaguguug

SEQ ID NO: 295380 - RNA, 32 nt, Human
aaugugcucuuuuggaaaauaguugguuagca

SEQ ID NO: 295381 - RNA, 32 nt, Human
aaugugcugaagacagagcuauucuggaugga

SEQ ID NO: 295382 - RNA, 32 nt, Human
aaugugcugggaaaggcaggacugggagccgg

SEQ ID NO: 295383 - RNA, 32 nt, Human
aaugugcugggaaccucuuggagccugucagg

SEQ ID NO: 295384 - RNA, 32 nt, Human
aaugugcuguuaaacacuugaaugaagagaau

SEQ ID NO: 295385 - RNA, 32 nt, Human
aaugugcuguuugguuucuucauugccauaaa

SEQ ID NO: 295386 - RNA, 20 nt, Human
aauguggaaaucaaauuuaa

SEQ ID NO: 295387 - RNA, 32 nt, Human
aauguggaaauggaggcaucaggcacauuacu

SEQ ID NO: 295388 - RNA, 31 nt, Human
aauguggaacaaauggagugaucuguuaucc

SEQ ID NO: 295389 - RNA, 32 nt, Human
aauguggaagcccaugagguugcccagggaag

SEQ ID NO: 295390 - RNA, 32 nt, Human
aauguggacucaggagccagacugccuggcug

SEQ ID NO: 295391 - RNA, 32 nt, Human
aauguggagaaaggaauucuguugauuccguu

SEQ ID NO: 295392 - RNA, 32 nt, Human
aauguggaggcaggugcaaucagccaaacucu

SEQ ID NO: 295393 - RNA, 32 nt, Human
aauguggcaaagccuuuauccaguccucaacu

SEQ ID NO: 295394 - RNA, 32 nt, Human
aauguggcaaagccuuuuaccaguccucaacu

SEQ ID NO: 295395 - RNA, 32 nt, Human
aauguggcaaagcuuuuaaacgaucuucaacc

SEQ ID NO: 295396 - RNA, 32 nt, Human
aauguggcaaagcuuuuaaccaaucuucaaca

SEQ ID NO: 295397 - RNA, 32 nt, Human
aauguggcaaagcuuuuaaccaaucuucaacc

SEQ ID NO: 295398 - RNA, 32 nt, Human
aauguggcaaagcuuuuaaccaauucucaaac

SEQ ID NO: 295399 - RNA, 32 nt, Human
aauguggcaaagcuuuuaaccaauuuucaaac

SEQ ID NO: 295400 - RNA, 32 nt, Human
aauguggcaaagcuuuuuaccgauucucauac

SEQ ID NO: 295401 - RNA, 32 nt, Human
aauguggcacuucacauuuuaaacuacagaug

SEQ ID NO: 295402 - RNA, 32 nt, Human
aauguggcaguuaacuguaguacugaauggaa

SEQ ID NO: 295403 - RNA, 32 nt, Human
aauguggccaaagagaugugaggguaagggga

SEQ ID NO: 295404 - RNA, 32 nt, Human
aauguggccaucgggcaucaagcacaaggcca

SEQ ID NO: 295405 - RNA, 32 nt, Human
aauguggccgggaagcagaguucaugugaggg

SEQ ID NO: 295406 - RNA, 32 nt, Human
aauguggccuuauuuggagacagggucuucac

SEQ ID NO: 295407 - RNA, 32 nt, Human
aauguggccuucugggugagauauggcuauua

SEQ ID NO: 295408 - RNA, 32 nt, Human
aauguggcguggagaaguggugcuccaagggu

SEQ ID NO: 295409 - RNA, 32 nt, Human
aauguggcucaauuaucggguucuagucauua

SEQ ID NO: 295410 - RNA, 32 nt, Human
aauguggcugaccugggcugcugguuccguug

SEQ ID NO: 295411 - RNA, 32 nt, Human
aauguggcugugccggccaccuccaggcuggc

SEQ ID NO: 295412 - RNA, 32 nt, Human
aaugugggaaagcccuuguuuccuucacuucc

SEQ ID NO: 295413 - RNA, 32 nt, Human
aaugugggaagcucuggguuucucccacuacu

SEQ ID NO: 295414 - RNA, 32 nt, Human
aaugugggaauuaagcaaaaucaagcaagccu

SEQ ID NO: 295415 - RNA, 32 nt, Human
aaugugggagagaaaaggguucuuggccaggc

SEQ ID NO: 295416 - RNA, 32 nt, Human
aaugugggaggcaggaugcagggaugggcucu

SEQ ID NO: 295417 - RNA, 32 nt, Human
aaugugggaggcggagguugcagugagucaga

SEQ ID NO: 295418 - RNA, 32 nt, Human
aaugugggcaguuugacuucagcacugaaaac

SEQ ID NO: 295419 - RNA, 32 nt, Human
aauguggggagaaaggaagcuuuccgaggccu

SEQ ID NO: 295420 - RNA, 32 nt, Human
aauguggggauucugaaacagaaaugaaacug

SEQ ID NO: 295421 - RNA, 32 nt, Human
aauguggggcuuuggauuuccacaccauccca

SEQ ID NO: 295422 - RNA, 32 nt, Human
aaugugggguggggaaaguaaaugcuaagacu

SEQ ID NO: 295423 - RNA, 32 nt, Human
aaugugggucuugccuccuuccagaaauaugu

SEQ ID NO: 295424 - RNA, 32 nt, Human
aauguggguuuggcagggaucaagcaggucag

SEQ ID NO: 295425 - RNA, 32 nt, Human
aauguggucugcuuuauaagauggccagaucu

SEQ ID NO: 295426 - RNA, 32 nt, Human
aauguggugagaugcacucuuuuguuguacca

SEQ ID NO: 295427 - RNA, 32 nt, Human
aaugugguuucacaccugacccagcaauuccu

SEQ ID NO: 295428 - RNA, 32 nt, Human
aaugugguuucuguuucucaggauaaauuggu

SEQ ID NO: 295429 - RNA, 32 nt, Human
aauguguaauaugccauuuucuuuggccaaau

SEQ ID NO: 295430 - RNA, 32 nt, Human
aauguguacacuccaguagaugagcacgucua

SEQ ID NO: 295431 - RNA, 32 nt, Human
aauguguacggugcacacacacagugcaucau

SEQ ID NO: 295432 - RNA, 32 nt, Human
aauguguacuggcucccaggccuccucagacu

SEQ ID NO: 295433 - RNA, 32 nt, Human
aauguguagggcagugcuuccuuggcacuggg

SEQ ID NO: 295434 - RNA, 32 nt, Human
aauguguaguacugcccaugugaacagucucu

SEQ ID NO: 295435 - RNA, 21 nt, Human
aauguguaguggagagaaccu

SEQ ID NO: 295436 - RNA, 32 nt, Human
aauguguaugaugcaacagagcugaagaaugg

SEQ ID NO: 295437 - RNA, 32 nt, Human
aauguguauugaaguaccuagauuuguuugau

SEQ ID NO: 295438 - RNA, 32 nt, Human
aauguguauuuuaauuauguguauuuaacucu

SEQ ID NO: 295439 - RNA, 32 nt, Human
aauguguauuuuuaguagagaaaggguuucac

SEQ ID NO: 295440 - RNA, 32 nt, Human
aaugugucaagaccauccagaaaugauaugag

SEQ ID NO: 295441 - RNA, 32 nt, Human
aaugugucagaauauccuuccuuuuuagguga

SEQ ID NO: 295442 - RNA, 32 nt, Human
aaugugucccccaacuucaucuggaaguuaaa

SEQ ID NO: 295443 - RNA, 32 nt, Human
aaugugucgugugguuugugaugcuaucuuuc

SEQ ID NO: 295444 - RNA, 32 nt, Human
aaugugucuaaggugcggcaucuugcuguugu

SEQ ID NO: 295445 - RNA, 32 nt, Human
aaugugucucugguacagaauaguugauauua

SEQ ID NO: 295446 - RNA, 32 nt, Human
aaugugucuuaugaaaauugccaaacaacugu

SEQ ID NO: 295447 - RNA, 19 nt, Human
aaugugugaaacccagggg

SEQ ID NO: 295448 - RNA, 32 nt, Human
aaugugugagagaagcggcugcgcagcccgga

SEQ ID NO: 295449 - RNA, 32 nt, Human
aaugugugcauaacaguaaugagaucuggaaa

SEQ ID NO: 295450 - RNA, 32 nt, Human
aaugugugcccauggcugggcgcaguggcuca

SEQ ID NO: 295451 - RNA, 32 nt, Human
aauguguggagauucuucuuuguuuuuagcuu

SEQ ID NO: 295452 - RNA, 32 nt, Human
aauguguggcaccuccaucaguuauacuuaga

SEQ ID NO: 295453 - RNA, 26 nt, Human
aauguguggcaucauuucacuucagc

SEQ ID NO: 295454 - RNA, 32 nt, Human
aaugugugggccggagccagauuuccucuguu

SEQ ID NO: 295455 - RNA, 32 nt, Human
aaugugugggucucauuuccaugcuagccaug

SEQ ID NO: 295456 - RNA, 29 nt, Human
aaugugugggugugugugaguggguauga

SEQ ID NO: 295457 - RNA, 32 nt, Human
aauguguggugcaaaguggggccagggcccag

SEQ ID NO: 295458 - RNA, 32 nt, Human
aauguguguuaagaaaaggugucgaggggagg

SEQ ID NO: 295459 - RNA, 28 nt, Human
aauguguuaagugcuguucauuuaaguu

SEQ ID NO: 295460 - RNA, 32 nt, Human
aauguguuauuaauuaaugauaaaauuggcgc

SEQ ID NO: 295461 - RNA, 32 nt, Human
aauguguugcugcugccaccccugccccaaag

SEQ ID NO: 295462 - RNA, 32 nt, Human
aauguguuguaaacaagauucuaaauuuaaaa

SEQ ID NO: 295463 - RNA, 32 nt, Human
aauguguuucuccccaugguccuauuucucuc

SEQ ID NO: 295464 - RNA, 32 nt, Human
aauguguuugaugccacugaccuguacaguua

SEQ ID NO: 295465 - RNA, 32 nt, Human
aauguguuuggcuucugucucuugaguagccc

SEQ ID NO: 295466 - RNA, 32 nt, Human
aauguuaacagaccuaaauaacugggaagaua

SEQ ID NO: 295467 - RNA, 32 nt, Human
aauguuaacagcuggagguccauacuaucucc

SEQ ID NO: 295468 - RNA, 32 nt, Human
aauguuaaccacccaccacagaugacuaaugc

SEQ ID NO: 295469 - RNA, 32 nt, Human
aauguuaacuaucaucauauggacucuaugua

SEQ ID NO: 295470 - RNA, 21 nt, Human
aauguuaagauuuuuucuucu

SEQ ID NO: 295471 - RNA, 31 nt, Human
aauguuaaggauggggaaaaagaaugccuuu

SEQ ID NO: 295472 - RNA, 32 nt, Human
aauguuaaguaaucauuucucauuccaaagac

SEQ ID NO: 295473 - RNA, 32 nt, Human
aauguuaauuaugcaguguuucccucuguguu

SEQ ID NO: 295474 - RNA, 32 nt, Human
aauguuacauuuguuugugggauuauuuaagg

SEQ ID NO: 295475 - RNA, 22 nt, Human
aauguuaccuuuucugauuuac

SEQ ID NO: 295476 - RNA, 22 nt, Human
aauguuacuagagaagaagccu

SEQ ID NO: 295477 - RNA, 32 nt, Human
aauguuacugguuucugcuuucuuuugacuac

SEQ ID NO: 295478 - RNA, 32 nt, Human
aauguuagagaaggaggaggaagcccauagac

SEQ ID NO: 295479 - RNA, 32 nt, Human
aauguuagcauguaugacaagacaaugagagu

SEQ ID NO: 295480 - RNA, 32 nt, Human
aauguuagcccaaacugcacuauuuugcagac

SEQ ID NO: 295481 - RNA, 32 nt, Human
aauguuagguuuccuaaaggguacagugccgu

SEQ ID NO: 295482 - RNA, 32 nt, Human
aauguuaugacuauguaaacuacuucucuugu

SEQ ID NO: 295483 - RNA, 23 nt, Human
aauguuaugcuuuggggcuccug

SEQ ID NO: 295484 - RNA, 32 nt, Human
aauguuauguagacauuauacaugguugguug

SEQ ID NO: 295485 - RNA, 24 nt, Human
aauguuauuaaguucaaugacuga

SEQ ID NO: 295486 - RNA, 32 nt, Human
aauguuauuaccuauaauccucauguuguaca

SEQ ID NO: 295487 - RNA, 32 nt, Human
aauguuauuucaccacacagugugguagggag

SEQ ID NO: 295488 - RNA, 32 nt, Human
aauguuauuucuguaaacuuugagcuuuguua

SEQ ID NO: 295489 - RNA, 32 nt, Human
aauguuauuugaagaaugccugugaagccagg

SEQ ID NO: 295490 - RNA, 32 nt, Human
aauguuauuugcucuguguguuuuuguguguu

SEQ ID NO: 295491 - RNA, 32 nt, Human
aauguuauuuggugguguauaauucuacuuuu

SEQ ID NO: 295492 - RNA, 32 nt, Human
aauguuauuuucucccauccuuggcccaagga

SEQ ID NO: 295493 - RNA, 32 nt, Human
aauguucaaagauucagacacaccuggguuug

SEQ ID NO: 295494 - RNA, 32 nt, Human
aauguucaaugccacgugcugcugacaccgac

SEQ ID NO: 295495 - RNA, 32 nt, Human
aauguucagacuccugaccuuugccaagugag

SEQ ID NO: 295496 - RNA, 32 nt, Human
aauguucagcaugccauuucugacuggcacau

SEQ ID NO: 295497 - RNA, 32 nt, Human
aauguucagcuugcacuuucuggcuuauguaa

SEQ ID NO: 295498 - RNA, 32 nt, Human
aauguucagugagaaguaaacagagcagaagu

SEQ ID NO: 295499 - RNA, 32 nt, Human
aauguucauaacuguuuuuauauucuugucug

SEQ ID NO: 295500 - RNA, 21 nt, Human
aauguucauagagaaggaggg

SEQ ID NO: 295501 - RNA, 32 nt, Human
aauguucauuccaaucagaugcagcuuucucc

SEQ ID NO: 295502 - RNA, 32 nt, Human
aauguucccugagcccacacuguggccagugg

SEQ ID NO: 295503 - RNA, 32 nt, Human
aauguuccuaaaccaggaagcugcguuagccg

SEQ ID NO: 295504 - RNA, 32 nt, Human
aauguuccuacucacacuucagcugggucaca

SEQ ID NO: 295505 - RNA, 32 nt, Human
aauguuccugcagccugagauuucagguagag

SEQ ID NO: 295506 - RNA, 32 nt, Human
aauguucuaaaaugucaaggcaguugcuugug

SEQ ID NO: 295507 - RNA, 32 nt, Human
aauguucuaccugccuuaauucuaucagccag

SEQ ID NO: 295508 - RNA, 32 nt, Human
aauguucuauguucaccugccccagccccacc

SEQ ID NO: 295509 - RNA, 32 nt, Human
aauguucucaaaggaaacagacuugaguuguu

SEQ ID NO: 295510 - RNA, 32 nt, Human
aauguucuccacccaccugugccuggcggacc

SEQ ID NO: 295511 - RNA, 23 nt, Human
aauguucucuaugagaaggaggg

SEQ ID NO: 295512 - RNA, 32 nt, Human
aauguucugcuaugauguuugaucucaucuua

SEQ ID NO: 295513 - RNA, 32 nt, Human
aauguucugggcaaguucuguguguggugggu

SEQ ID NO: 295514 - RNA, 21 nt, Human
aauguucuuuuuaaaguuauu

SEQ ID NO: 295515 - RNA, 19 nt, Human
aauguucuuuuuaugcaaa

SEQ ID NO: 295516 - RNA, 32 nt, Human
aauguugaaauccugacauccaaauucugggg

SEQ ID NO: 295517 - RNA, 32 nt, Human
aauguugaacaaaauaaauuggaguuggagua

SEQ ID NO: 295518 - RNA, 24 nt, Human
aauguugacaauuagauucuugga

SEQ ID NO: 295519 - RNA, 32 nt, Human
aauguugagaccaaaguaguauagaaguaugg

SEQ ID NO: 295520 - RNA, 32 nt, Human
aauguugagauugcaggcaugagccacugcgc

SEQ ID NO: 295521 - RNA, 32 nt, Human
aauguugauggcuauuuuguggugcuaacaug

SEQ ID NO: 295522 - RNA, 32 nt, Human
aauguugcagaaugguaucuauuggauaaaau

SEQ ID NO: 295523 - RNA, 28 nt, Human
aauguugcaggugcugccuccgagucug

SEQ ID NO: 295524 - RNA, 32 nt, Human
aauguugcaguuccuaaaagcauguuccaguu

SEQ ID NO: 295525 - RNA, 32 nt, Human
aauguugccagaaaaaguaucuccuccaacca

SEQ ID NO: 295526 - RNA, 32 nt, Human
aauguugcccaggcuggagugcaguggcguga

SEQ ID NO: 295527 - RNA, 32 nt, Human
aauguugcuucuuugaaggcaaugucuuuucu

SEQ ID NO: 295528 - RNA, 32 nt, Human
aauguuggaaacugccuauccuggugacucuu

SEQ ID NO: 295529 - RNA, 32 nt, Human
aauguugggaaaauagagaagagcaagagcaa

SEQ ID NO: 295530 - RNA, 32 nt, Human
aauguugggaccacgggugugagccaccgcgc

SEQ ID NO: 295531 - RNA, 32 nt, Human
aauguugggauauggaaugaagacuuaagagc

SEQ ID NO: 295532 - RNA, 32 nt, Human
aauguugggauuacaggcaugagccacugcac

SEQ ID NO: 295533 - RNA, 32 nt, Human
aauguugggauuacaggcgugagccaccgugc

SEQ ID NO: 295534 - RNA, 32 nt, Human
aauguugggcuucacauuuguuccuuguaaau

SEQ ID NO: 295535 - RNA, 32 nt, Human
aauguuggucauuccuuuaaggcaguuaagga

SEQ ID NO: 295536 - RNA, 19 nt, Human
aauguugucaagaccaaaa

SEQ ID NO: 295537 - RNA, 32 nt, Human
aauguuguggcuucugagcuuucuucagccca

SEQ ID NO: 295538 - RNA, 32 nt, Human
aauguuguguguguucugaccgcuccacccac

SEQ ID NO: 295539 - RNA, 32 nt, Human
aauguuguuuuuaaaggaauugacuuaccuga

SEQ ID NO: 295540 - RNA, 32 nt, Human
aauguuuaaagaagaaugauggguacaguuag

SEQ ID NO: 295541 - RNA, 32 nt, Human
aauguuuaaagcuuccucuagauucuuauucc

SEQ ID NO: 295542 - RNA, 32 nt, Human
aauguuuacagcccugucuuagggccgcggcu

SEQ ID NO: 295543 - RNA, 32 nt, Human
aauguuuagcacaagacacagcggagcucggg

SEQ ID NO: 295544 - RNA, 32 nt, Human
aauguuuagcagcaaccgaauauaccaggcaa

SEQ ID NO: 295545 - RNA, 32 nt, Human
aauguuuagcucccacuuguaagucagaacac

SEQ ID NO: 295546 - RNA, 32 nt, Human
aauguuuauacaaauacauacauguacaccau

SEQ ID NO: 295547 - RNA, 32 nt, Human
aauguuuauuagacacaucuccugggacauac

SEQ ID NO: 295548 - RNA, 32 nt, Human
aauguuuauuucugugcuuaaaaguuagacug

SEQ ID NO: 295549 - RNA, 23 nt, Human
aauguuucaaaaacauguccuua

SEQ ID NO: 295550 - RNA, 32 nt, Human
aauguuucaaagcugcucaaucaaaagaaacg

SEQ ID NO: 295551 - RNA, 32 nt, Human
aauguuucaaguugagaucaugcuugggaaaa

SEQ ID NO: 295552 - RNA, 25 nt, Human
aauguuucaccuuugugcauuugug

SEQ ID NO: 295553 - RNA, 32 nt, Human
aauguuucagcccccuagaguugucccuguga

SEQ ID NO: 295554 - RNA, 32 nt, Human
aauguuucaguaggaaucaugauaucuaaaaa

SEQ ID NO: 295555 - RNA, 32 nt, Human
aauguuucaguuauagagguaaaauuugcaca

SEQ ID NO: 295556 - RNA, 32 nt, Human
aauguuuccaacuguuggaccugcacugccuu

SEQ ID NO: 295557 - RNA, 32 nt, Human
aauguuuccaggguguugggaaggccugcguc

SEQ ID NO: 295558 - RNA, 32 nt, Human
aauguuucggacccaaaagaggugcugucagu

SEQ ID NO: 295559 - RNA, 23 nt, Human
aauguuucuagaauaagcccuua

SEQ ID NO: 295560 - RNA, 32 nt, Human
aauguuucuccucuccuucccauggccccugu

SEQ ID NO: 295561 - RNA, 21 nt, Human
aauguuucucuaacccuuuca

SEQ ID NO: 295562 - RNA, 32 nt, Human
aauguuucucucuacacauaaacugggcuguu

SEQ ID NO: 295563 - RNA, 32 nt, Human
aauguuugcaaucuacccaucugacaaauguc

SEQ ID NO: 295564 - RNA, 32 nt, Human
aauguuugcacaaauuuccuuaaaaaucaacu

SEQ ID NO: 295565 - RNA, 32 nt, Human
aauguuugcugagugagugaugaaucagcaau

SEQ ID NO: 295566 - RNA, 32 nt, Human
aauguuuggcuugaagaaggagcucaguaaac

SEQ ID NO: 295567 - RNA, 32 nt, Human
aauguuuguaaaucuuaaccuccugccuagga

SEQ ID NO: 295568 - RNA, 32 nt, Human
aauguuuguaaucucauaagcacuuuauaaac

SEQ ID NO: 295569 - RNA, 32 nt, Human
aauguuuguugaggaaaggagugaagaguugg

SEQ ID NO: 295570 - RNA, 32 nt, Human
aauguuuuacaugcaucagcucuuucaacauu

SEQ ID NO: 295571 - RNA, 32 nt, Human
aauguuuuagagaauucuuuggcaugaucuga

SEQ ID NO: 295572 - RNA, 32 nt, Human
aauguuuucaaaggaagguaucagcugugggc

SEQ ID NO: 295573 - RNA, 32 nt, Human
aauguuuucaagaaauguacacugugguaaau

SEQ ID NO: 295574 - RNA, 26 nt, Human
aauguuuuccaaacuagcacauuugc

SEQ ID NO: 295575 - RNA, 32 nt, Human
aauguuuuccugcuuugguuaccuuuccuuuc

SEQ ID NO: 295576 - RNA, 32 nt, Human
aauguuuugagacagggucucauucugaugcc

SEQ ID NO: 295577 - RNA, 26 nt, Human
aauguuuugccaccugagaccuauga

SEQ ID NO: 295578 - RNA, 32 nt, Human
aauuaaaaacaacaaggaaauauuuagaauuu

SEQ ID NO: 295579 - RNA, 32 nt, Human
aauuaaaaacaggacaggaagaaggucuaaaa

SEQ ID NO: 295580 - RNA, 32 nt, Human
aauuaaaaaggaaaaguagaaauaaguaaaac

SEQ ID NO: 295581 - RNA, 32 nt, Human
aauuaaaaauuagcuggacauggugucacaug

SEQ ID NO: 295582 - RNA, 32 nt, Human
aauuaaaaauuagcugggcaugguggcacaca

SEQ ID NO: 295583 - RNA, 32 nt, Human
aauuaaaacacuggcauggccuaggaagggcg

SEQ ID NO: 295584 - RNA, 32 nt, Human
aauuaaaagcaacacuggcucuugccucacuc

SEQ ID NO: 295585 - RNA, 32 nt, Human
aauuaaaaggauuuuuaaaaaguaauuacugc

SEQ ID NO: 295586 - RNA, 32 nt, Human
aauuaaaauuggccuggaagacaucuguacuu

SEQ ID NO: 295587 - RNA, 32 nt, Human
aauuaaaauuuucacaccaccugcuuuucuau

SEQ ID NO: 295588 - RNA, 32 nt, Human
aauuaaacagcaugcauugaacugaagauaac

SEQ ID NO: 295589 - RNA, 32 nt, Human
aauuaaacauggaggaugaauuaccuuccuau

SEQ ID NO: 295590 - RNA, 32 nt, Human
aauuaaaccaacaauauuauugauuauugcaa

SEQ ID NO: 295591 - RNA, 32 nt, Human
aauuaaaccauccuugucagcagaagccaaga

SEQ ID NO: 295592 - RNA, 32 nt, Human
aauuaaaccggaccaucucuccaacucaacuc

SEQ ID NO: 295593 - RNA, 32 nt, Human
aauuaaacugcacuuuuugcuguuuuugccua

SEQ ID NO: 295594 - RNA, 32 nt, Human
aauuaaacuguacauacugugcauauaaugaa

SEQ ID NO: 295595 - RNA, 32 nt, Human
aauuaaagaaaauguuuuucucaauuuaaaau

SEQ ID NO: 295596 - RNA, 32 nt, Human
aauuaaagaaggaggugggaaaagaggacuua

SEQ ID NO: 295597 - RNA, 32 nt, Human
aauuaaagagaaacugcuuagacagaaaccug

SEQ ID NO: 295598 - RNA, 32 nt, Human
aauuaaagauuagcugggcgugguugcacaug

SEQ ID NO: 295599 - RNA, 32 nt, Human
aauuaaagccauaaugguaaaagauggcauac

SEQ ID NO: 295600 - RNA, 32 nt, Human
aauuaaauacagauuccuagagacguuaugau

SEQ ID NO: 295601 - RNA, 17 nt, Human
aauuaaaugcaagcaca

SEQ ID NO: 295602 - RNA, 32 nt, Human
aauuaaaugcuuauuguauugagaaccaagau

SEQ ID NO: 295603 - RNA, 31 nt, Human
aauuaaauggcagcagcagaggaagggauag

SEQ ID NO: 295604 - RNA, 32 nt, Human
aauuaaaugugggugaggaagaauguguggag

SEQ ID NO: 295605 - RNA, 32 nt, Human
aauuaaauuuaggggauccugaugccacuuag

SEQ ID NO: 295606 - RNA, 32 nt, Human
aauuaacaaccuggauuucuguuuccagaccu

SEQ ID NO: 295607 - RNA, 32 nt, Human
aauuaacaagggacaaaccaaaucccaauugc

SEQ ID NO: 295608 - RNA, 32 nt, Human
aauuaacacaugcauggucaugacacccagaa

SEQ ID NO: 295609 - RNA, 32 nt, Human
aauuaacaugguaagccuuagcagcaaacauu

SEQ ID NO: 295610 - RNA, 32 nt, Human
aauuaacccaauucaacaaagacaaagaaaaa

SEQ ID NO: 295611 - RNA, 32 nt, Human
aauuaaccuccugccaugacucuggcucaucu

SEQ ID NO: 295612 - RNA, 32 nt, Human
aauuaacgggcuuucuauuuuuguauguuacu

SEQ ID NO: 295613 - RNA, 32 nt, Human
aauuaacguguugcuucugccccacgggcaaa

SEQ ID NO: 295614 - RNA, 32 nt, Human
aauuaacuauuuuaaagugagaaguucagugc

SEQ ID NO: 295615 - RNA, 32 nt, Human
aauuaacucaaccuauaucucccuugaaaaua

SEQ ID NO: 295616 - RNA, 32 nt, Human
aauuaacuccucucaacaaagcuaagaggugc

SEQ ID NO: 295617 - RNA, 32 nt, Human
aauuaacugacauuccuccuguauuuccuccc

SEQ ID NO: 295618 - RNA, 32 nt, Human
aauuaacugccucagcuucccuaguaauggau

SEQ ID NO: 295619 - RNA, 32 nt, Human
aauuaacuuucccaucuggccuuuaucuccaa

SEQ ID NO: 295620 - RNA, 32 nt, Human
aauuaagaauaaccuuagaagcacucagaaaa

SEQ ID NO: 295621 - RNA, 32 nt, Human
aauuaagaauuucuagaggucacugcagcaug

SEQ ID NO: 295622 - RNA, 32 nt, Human
aauuaagacaggggcucagggaaucucggaaa

SEQ ID NO: 295623 - RNA, 32 nt, Human
aauuaagagacagggucugucuuuguuaccca

SEQ ID NO: 295624 - RNA, 32 nt, Human
aauuaagaguucacccuucaucucaccaaauu

SEQ ID NO: 295625 - RNA, 32 nt, Human
aauuaagaucggguuccuuuucugccagcuug

SEQ ID NO: 295626 - RNA, 32 nt, Human
aauuaagaugugaaaauaaugcauaaagacag

SEQ ID NO: 295627 - RNA, 32 nt, Human
aauuaagcccaguaggugaccugcacaagacg

SEQ ID NO: 295628 - RNA, 32 nt, Human
aauuaagccuuaccuccauguaaagaacagca

SEQ ID NO: 295629 - RNA, 32 nt, Human
aauuaagcuaguuucaaaucucaaaggaauuc

SEQ ID NO: 295630 - RNA, 32 nt, Human
aauuaagcugagugcaagaugagggagggaag

SEQ ID NO: 295631 - RNA, 32 nt, Human
aauuaagcuguaauucugucucuuucauauuu

SEQ ID NO: 295632 - RNA, 32 nt, Human
aauuaagcuuguauucacaagacuucaugcca

SEQ ID NO: 295633 - RNA, 32 nt, Human
aauuaagcuuuaguaaaacaaagugaugaggu

SEQ ID NO: 295634 - RNA, 32 nt, Human
aauuaaggccaggaguucaaccagccuggaca

SEQ ID NO: 295635 - RNA, 32 nt, Human
aauuaaggugugagccacugugcccagccuau

SEQ ID NO: 295636 - RNA, 32 nt, Human
aauuaagguuugcccugccugcagccuccccc

SEQ ID NO: 295637 - RNA, 32 nt, Human
aauuaaguauuagaccagucuguagauauaau

SEQ ID NO: 295638 - RNA, 32 nt, Human
aauuaagugccaggcugggcacaauggcucgu

SEQ ID NO: 295639 - RNA, 32 nt, Human
aauuaaguuguuccuuuccccauccuuccuuc

SEQ ID NO: 295640 - RNA, 32 nt, Human
aauuaauagcacagcagaugugugcugcccau

SEQ ID NO: 295641 - RNA, 32 nt, Human
aauuaauaucugucuccgugggagaaaauagu

SEQ ID NO: 295642 - RNA, 32 nt, Human
aauuaauauuuuggcagaugauaggggaacuc

SEQ ID NO: 295643 - RNA, 31 nt, Human
aauuaaucaguaaauaccuugaaaugcuuag

SEQ ID NO: 295644 - RNA, 32 nt, Human
aauuaauggccaacauaaugggcuuuuagcug

SEQ ID NO: 295645 - RNA, 32 nt, Human
aauuaaugggauuguuaaaaauggcugaaaac

SEQ ID NO: 295646 - RNA, 32 nt, Human
aauuaauuaguuuuggaaauucuuuuaccauu

SEQ ID NO: 295647 - RNA, 32 nt, Human
aauuaauuauuucucaucacucccucaaucca

SEQ ID NO: 295648 - RNA, 32 nt, Human
aauuaauucaugaauaaaugcaccuuauaugu

SEQ ID NO: 295649 - RNA, 32 nt, Human
aauuaauucuuaaucauuaagagaccauaaua

SEQ ID NO: 295650 - RNA, 32 nt, Human
aauuaauugcuuguaaccucacuuuacuaaua

SEQ ID NO: 295651 - RNA, 32 nt, Human
aauuaauuggaguagggugaggagagagccac

SEQ ID NO: 295652 - RNA, 32 nt, Human
aauuaauuuacacacacauuuuacuuaguucu

SEQ ID NO: 295653 - RNA, 32 nt, Human
aauuaauuuugaaucacuaauauuuucacagu

SEQ ID NO: 295654 - RNA, 32 nt, Human
aauuaauuuuuauuccuuaagcauuuuaaaaa

SEQ ID NO: 295655 - RNA, 32 nt, Human
aauuacaaaaggaauuugaaacugcaggacuu

SEQ ID NO: 295656 - RNA, 32 nt, Human
aauuacaaagaaugcuuccuggguggaguguu

SEQ ID NO: 295657 - RNA, 32 nt, Human
aauuacaaccaccaaaauagcuacagucaaaa

SEQ ID NO: 295658 - RNA, 32 nt, Human
aauuacaaccaccaggaaauugacugcuuuuu

SEQ ID NO: 295659 - RNA, 32 nt, Human
aauuacacagggaugcaucuugugcacuacaa

SEQ ID NO: 295660 - RNA, 32 nt, Human
aauuacaccauggcuugaccucucucagcuua

SEQ ID NO: 295661 - RNA, 32 nt, Human
aauuacacccugccagaaaacuuucuuuccua

SEQ ID NO: 295662 - RNA, 32 nt, Human
aauuacacgugggagcuuuccaaagaaaugga

SEQ ID NO: 295663 - RNA, 32 nt, Human
aauuacacugaaucuaggaggggaguuggcag

SEQ ID NO: 295664 - RNA, 32 nt, Human
aauuacacuguacuuuccucuaggugaucugu

SEQ ID NO: 295665 - RNA, 32 nt, Human
aauuacauggugcugaccacaaaguuucugga

SEQ ID NO: 295666 - RNA, 32 nt, Human
aauuacaugugcccucuaaccugggcccgaag

SEQ ID NO: 295667 - RNA, 32 nt, Human
aauuacauuacaggcuggaauguaauuguggu

SEQ ID NO: 295668 - RNA, 32 nt, Human
aauuacauuuguugcagaaccuccacaaggcu

SEQ ID NO: 295669 - RNA, 32 nt, Human
aauuaccacaaacuggguggcuuuaaacaaca

SEQ ID NO: 295670 - RNA, 32 nt, Human
aauuaccacagcuucuuggcccaguucugccc

SEQ ID NO: 295671 - RNA, 32 nt, Human
aauuaccaccagcaggauuuccgacgaauguc

SEQ ID NO: 295672 - RNA, 32 nt, Human
aauuaccauuuucuucuuucucaggauuuggu

SEQ ID NO: 295673 - RNA, 32 nt, Human
aauuacccucauugucccucacucaggccaug

SEQ ID NO: 295674 - RNA, 32 nt, Human
aauuaccggccuuccaacuuuugucugccuca

SEQ ID NO: 295675 - RNA, 32 nt, Human
aauuaccucaaaccacaggguagucugcuaaa

SEQ ID NO: 295676 - RNA, 32 nt, Human
aauuaccugcagguggaauauuucauggacaa

SEQ ID NO: 295677 - RNA, 32 nt, Human
aauuaccugggcauagugguguaugccuguag

SEQ ID NO: 295678 - RNA, 32 nt, Human
aauuaccuucaaaaggaggcucgugcaggugc

SEQ ID NO: 295679 - RNA, 32 nt, Human
aauuacgccacugcacuccagccugggcaaca

SEQ ID NO: 295680 - RNA, 32 nt, Human
aauuacggcccgacuccugggcucaagcgauc

SEQ ID NO: 295681 - RNA, 32 nt, Human
aauuacggugauuggccaggugcaguggcuca

SEQ ID NO: 295682 - RNA, 32 nt, Human
aauuacuaaaauaggcugggcgcgguggcuca

SEQ ID NO: 295683 - RNA, 32 nt, Human
aauuacuagggaggagagaaagggacaaaagc

SEQ ID NO: 295684 - RNA, 32 nt, Human
aauuacuaucauuuuacagucaucucaacaau

SEQ ID NO: 295685 - RNA, 32 nt, Human
aauuacucaagaaacccaacacagucuuugga

SEQ ID NO: 295686 - RNA, 32 nt, Human
aauuacucaguuucucuuucucuaaagcuugu

SEQ ID NO: 295687 - RNA, 32 nt, Human
aauuacucuccaaguugagagaugucuuuggg

SEQ ID NO: 295688 - RNA, 32 nt, Human
aauuacugacaaacacgugauauggguugggg

SEQ ID NO: 295689 - RNA, 32 nt, Human
aauuacugcuauuuuaaaauuucuugaucauu

SEQ ID NO: 295690 - RNA, 32 nt, Human
aauuacugcuugacauguuggcauucauauua

SEQ ID NO: 295691 - RNA, 32 nt, Human
aauuacugcuuuccaucuacuggguaaaauga

SEQ ID NO: 295692 - RNA, 32 nt, Human
aauuacugcuuuguugauauucaaagugugaa

SEQ ID NO: 295693 - RNA, 32 nt, Human
aauuacugggauuacaggcaugaggcaucaca

SEQ ID NO: 295694 - RNA, 32 nt, Human
aauuacuguccuccuuucacugagcuuuauuc

SEQ ID NO: 295695 - RNA, 32 nt, Human
aauuacuuacuggggacauccuuuguaaugcu

SEQ ID NO: 295696 - RNA, 32 nt, Human
aauuacuugcuuaugacuauugccuguucuuu

SEQ ID NO: 295697 - RNA, 32 nt, Human
aauuacuuuaacugcuaaucacugugguugcc

SEQ ID NO: 295698 - RNA, 32 nt, Human
aauuacuuuugaagacaaucagaaggauuuua

SEQ ID NO: 295699 - RNA, 32 nt, Human
aauuagaacaaugcacaucugucuuccaagau

SEQ ID NO: 295700 - RNA, 32 nt, Human
aauuagaacagcucccuagaauugugaacuuu

SEQ ID NO: 295701 - RNA, 25 nt, Human
aauuagaauaaagucauuuucuucc

SEQ ID NO: 295702 - RNA, 32 nt, Human
aauuagaccagaagauccccgcuccugucucu

SEQ ID NO: 295703 - RNA, 32 nt, Human
aauuagagaaagguugggacagaaaguacuuu

SEQ ID NO: 295704 - RNA, 32 nt, Human
aauuagagagcaucugcaacaaaaagucauuu

SEQ ID NO: 295705 - RNA, 32 nt, Human
aauuagaggagcugggucagggagacaaaagu

SEQ ID NO: 295706 - RNA, 32 nt, Human
aauuagaguaauuaugagauggugggaaccag

SEQ ID NO: 295707 - RNA, 32 nt, Human
aauuagaucagcacaaagacuugauauugugg

SEQ ID NO: 295708 - RNA, 32 nt, Human
aauuagaugaggaaauuuuuaaaaaggaucaa

SEQ ID NO: 295709 - RNA, 32 nt, Human
aauuagauuucagaucuagcucugucagacug

SEQ ID NO: 295710 - RNA, 32 nt, Human
aauuagauuuugagugcaugaaucugugauaa

SEQ ID NO: 295711 - RNA, 32 nt, Human
aauuagcaaaacugaacuggguugaacugaac

SEQ ID NO: 295712 - RNA, 32 nt, Human
aauuagcacaaaccgacagagaucaucaaaca

SEQ ID NO: 295713 - RNA, 32 nt, Human
aauuagcagaauagccuacauuuguauuuauu

SEQ ID NO: 295714 - RNA, 32 nt, Human
aauuagcauagcaaucaucgaacuuggauuuc

SEQ ID NO: 295715 - RNA, 32 nt, Human
aauuagcaucaggaaagccugaaaugccuuaa

SEQ ID NO: 295716 - RNA, 32 nt, Human
aauuagccaggugcgguggaagugccuguagu

SEQ ID NO: 295717 - RNA, 32 nt, Human
aauuagccauuuuaaaggagggauguaccugu

SEQ ID NO: 295718 - RNA, 32 nt, Human
aauuagcccaaaacaguugccaaacuuugcca

SEQ ID NO: 295719 - RNA, 32 nt, Human
aauuagccugaccacagguggucacuguaggc

SEQ ID NO: 295720 - RNA, 32 nt, Human
aauuagccuuagugauucugugguugaguaau

SEQ ID NO: 295721 - RNA, 32 nt, Human
aauuagcuaacuuggauuuguggaagcuuuug

SEQ ID NO: 295722 - RNA, 32 nt, Human
aauuagcugcacaugguugcacaugccuauag

SEQ ID NO: 295723 - RNA, 32 nt, Human
aauuagcuggcgugcaccaccgcgcccagcua

SEQ ID NO: 295724 - RNA, 32 nt, Human
aauuagcugggcaugguagcacaugccugugg

SEQ ID NO: 295725 - RNA, 32 nt, Human
aauuagcugggguugguggcacaugccuguaa

SEQ ID NO: 295726 - RNA, 32 nt, Human
aauuagcuggguguguuggcacaugccuguag

SEQ ID NO: 295727 - RNA, 32 nt, Human
aauuagcuuuccacagggauuucuugaaaugc

SEQ ID NO: 295728 - RNA, 32 nt, Human
aauuaggaacugcuuccucauuuaacaaggua

SEQ ID NO: 295729 - RNA, 32 nt, Human
aauuaggaagugcagaagcacaugauggugaa

SEQ ID NO: 295730 - RNA, 32 nt, Human
aauuaggacuccaguaccacugccuucacccu

SEQ ID NO: 295731 - RNA, 24 nt, Human
aauuaggcagugguuucuuagaua

SEQ ID NO: 295732 - RNA, 32 nt, Human
aauuaggguuuuucaggcugggcacagugacu

SEQ ID NO: 295733 - RNA, 32 nt, Human
aauuagguaaacuugaauauucccaguaaaug

SEQ ID NO: 295734 - RNA, 32 nt, Human
aauuagguuuaaauucaguaggaugugauuuu

SEQ ID NO: 295735 - RNA, 32 nt, Human
aauuaguaguaaguggggucuuuguggguugg

SEQ ID NO: 295736 - RNA, 32 nt, Human
aauuaguauuguuagcaucuauuuggcuuauu

SEQ ID NO: 295737 - RNA, 31 nt, Human
aauuaguauuuucucugacaucucaugacau

SEQ ID NO: 295738 - RNA, 32 nt, Human
aauuagucauuugaucugacaacuaaagccag

SEQ ID NO: 295739 - RNA, 21 nt, Human
aauuaguccuugccucagaug

SEQ ID NO: 295740 - RNA, 32 nt, Human
aauuagugacaguguguguagagcaugugcca

SEQ ID NO: 295741 - RNA, 32 nt, Human
aauuaguggaaagaaaguuugauggagcuuuc

SEQ ID NO: 295742 - RNA, 32 nt, Human
aauuaguggacagacucccuggaacauguuug

SEQ ID NO: 295743 - RNA, 32 nt, Human
aauuaguggggagggggcagaccugggggccc

SEQ ID NO: 295744 - RNA, 32 nt, Human
aauuaguguuccccucauuuagcaaccuccau

SEQ ID NO: 295745 - RNA, 32 nt, Human
aauuaguuaacuggaagagauuaccaagagaa

SEQ ID NO: 295746 - RNA, 32 nt, Human
aauuaguucagccucagaccauggcacuuuga

SEQ ID NO: 295747 - RNA, 32 nt, Human
aauuaguucucaucucccugucgucgucauug

SEQ ID NO: 295748 - RNA, 32 nt, Human
aauuaguucuuccuccucaacucauaggagua

SEQ ID NO: 295749 - RNA, 32 nt, Human
aauuaguuggaaacucauauaaaaugagcuuu

SEQ ID NO: 295750 - RNA, 32 nt, Human
aauuaguuggugagccagaggcuugacagagc

SEQ ID NO: 295751 - RNA, 32 nt, Human
aauuaguuuucuuuucuugcuugcaauagaaa

SEQ ID NO: 295752 - RNA, 32 nt, Human
aauuaguuuuucuuccuuugauuuuauuggcc

SEQ ID NO: 295753 - RNA, 32 nt, Human
aauuauaaaauguuaaccggcagaaguauuuu

SEQ ID NO: 295754 - RNA, 32 nt, Human
aauuauaauguaucuguacagcacuuuuuaca

SEQ ID NO: 295755 - RNA, 32 nt, Human
aauuauacuacaaauggaaugagggcugagaa

SEQ ID NO: 295756 - RNA, 32 nt, Human
aauuauagaaaaucauguuguccguuuucaaa

SEQ ID NO: 295757 - RNA, 32 nt, Human
aauuauagcauaacauacagacuuuugcacau

SEQ ID NO: 295758 - RNA, 32 nt, Human
aauuauaggauagaauugucauuuuaugcagg

SEQ ID NO: 295759 - RNA, 32 nt, Human
aauuauauaguaguuuguuuauaagccgguac

SEQ ID NO: 295760 - RNA, 23 nt, Human
aauuauauaucacagaacccuga

SEQ ID NO: 295761 - RNA, 32 nt, Human
aauuauauggguggguuuuccuauguucuugu

SEQ ID NO: 295762 - RNA, 32 nt, Human
aauuauauuuucagaaguaaagcaaagaagcu

SEQ ID NO: 295763 - RNA, 31 nt, Human
aauuaucacaucaaggagucaggggaaagug

SEQ ID NO: 295764 - RNA, 32 nt, Human
aauuaucauauguacucccaaaauaugcacau

SEQ ID NO: 295765 - RNA, 32 nt, Human
aauuauccaacagauaaaugugcaagugcaaa

SEQ ID NO: 295766 - RNA, 32 nt, Human
aauuauccagccccaaaugccaauagggcuca

SEQ ID NO: 295767 - RNA, 32 nt, Human
aauuauccauuuuccauucaugcauucacuaa

SEQ ID NO: 295768 - RNA, 32 nt, Human
aauuaucccagcuggaagcauggagaugcagg

SEQ ID NO: 295769 - RNA, 32 nt, Human
aauuaucccugccuguguccaugucagacuuu

SEQ ID NO: 295770 - RNA, 32 nt, Human
aauuauccuagagugaggacuucugcagcuua

SEQ ID NO: 295771 - RNA, 32 nt, Human
aauuauccucuuaaccuucucuucccagugaa

SEQ ID NO: 295772 - RNA, 32 nt, Human
aauuaucggcacacccugcccacugccagggg

SEQ ID NO: 295773 - RNA, 32 nt, Human
aauuaucuacaauggaaucuucccucuguucu

SEQ ID NO: 295774 - RNA, 32 nt, Human
aauuaucucacuuguuuuguguucugucaucc

SEQ ID NO: 295775 - RNA, 32 nt, Human
aauuaucuccuccaaaggacuuuuuauuuaca

SEQ ID NO: 295776 - RNA, 32 nt, Human
aauuaucucucaucuuuugacuauuucaaguc

SEQ ID NO: 295777 - RNA, 32 nt, Human
aauuaucuggagagagaggaaaagucagcaga

SEQ ID NO: 295778 - RNA, 32 nt, Human
aauuaucugggcauggugaugugugccuguaa

SEQ ID NO: 295779 - RNA, 32 nt, Human
aauuaucuucagauuucucuguauuuauuaug

SEQ ID NO: 295780 - RNA, 32 nt, Human
aauuaucuucagcccaggcuuuugcuagaugg

SEQ ID NO: 295781 - RNA, 32 nt, Human
aauuaugaaagugaaaugcaaaugucuguuau

SEQ ID NO: 295782 - RNA, 32 nt, Human
aauuaugaacaucucugaguuucggucuccug

SEQ ID NO: 295783 - RNA, 32 nt, Human
aauuaugaacuaauguucuacagcagaaaauu

SEQ ID NO: 295784 - RNA, 32 nt, Human
aauuaugaccaagaaaggauacacuggccccu

SEQ ID NO: 295785 - RNA, 32 nt, Human
aauuaugauucugcuggagaacuuuucagcug

SEQ ID NO: 295786 - RNA, 32 nt, Human
aauuaugcacugacaugacccugggugacagg

SEQ ID NO: 295787 - RNA, 32 nt, Human
aauuaugcagucaagcaucagugacuuucuau

SEQ ID NO: 295788 - RNA, 32 nt, Human
aauuaugccacugcacuccagccugggcaaca

SEQ ID NO: 295789 - RNA, 32 nt, Human
aauuaugccaggaaggugggaccggguuaugg

SEQ ID NO: 295790 - RNA, 32 nt, Human
aauuauggacacacaaaaacacaugcacccaa

SEQ ID NO: 295791 - RNA, 32 nt, Human
aauuauggauggaggaagagggagaggaaaaa

SEQ ID NO: 295792 - RNA, 32 nt, Human
aauuauggcuuauuugaaaaguaaauaaugau

SEQ ID NO: 295793 - RNA, 32 nt, Human
aauuaugggaaaauaguguagccagcugccac

SEQ ID NO: 295794 - RNA, 32 nt, Human
aauuauguucagaaaguggucagaacuuaagc

SEQ ID NO: 295795 - RNA, 32 nt, Human
aauuauguucuuuagacacugcuaccugaaaa

SEQ ID NO: 295796 - RNA, 32 nt, Human
aauuauuaagcuguuagaaaugcauucaaauu

SEQ ID NO: 295797 - RNA, 32 nt, Human
aauuauuacaaaguuaugaaauaaaagaggau

SEQ ID NO: 295798 - RNA, 32 nt, Human
aauuauuagaagcagggaaguauuguuagucu

SEQ ID NO: 295799 - RNA, 32 nt, Human
aauuauuauauacuuccuuguaacaaagauug

SEQ ID NO: 295800 - RNA, 32 nt, Human
aauuauuauccagcagguaacagugauuacuc

SEQ ID NO: 295801 - RNA, 32 nt, Human
aauuauucauucucccuuuauugauucaucga

SEQ ID NO: 295802 - RNA, 32 nt, Human
aauuauuccuucaaguuuccuagcucugugcu

SEQ ID NO: 295803 - RNA, 32 nt, Human
aauuauucuccaaguugagagauguccuuggg

SEQ ID NO: 295804 - RNA, 32 nt, Human
aauuauucuggccuccgcugcauacaaaucag

SEQ ID NO: 295805 - RNA, 32 nt, Human
aauuauugcaccacugaacuccagccugggcc

SEQ ID NO: 295806 - RNA, 32 nt, Human
aauuauugccacuuaaaaacacaaagugauau

SEQ ID NO: 295807 - RNA, 32 nt, Human
aauuauuggaaagaggagacagaaugacaaga

SEQ ID NO: 295808 - RNA, 32 nt, Human
aauuauuggucuucuggguuuuugcuuuuuaa

SEQ ID NO: 295809 - RNA, 32 nt, Human
aauuauuguccaggaggggcagcacugggccu

SEQ ID NO: 295810 - RNA, 32 nt, Human
aauuauuuagcacauguuaaaauagcuuuauu

SEQ ID NO: 295811 - RNA, 32 nt, Human
aauuauuucccaaaaaguuuaguugauuuguu

SEQ ID NO: 295812 - RNA, 32 nt, Human
aauuauuucucagucuuucaaggcuugagacu

SEQ ID NO: 295813 - RNA, 32 nt, Human
aauuauuucuggguugauucaaagggaggacu

SEQ ID NO: 295814 - RNA, 32 nt, Human
aauuauuucuuuuggagggaaguggcuugccc

SEQ ID NO: 295815 - RNA, 23 nt, Human
aauuauuugaguuguuucucaga

SEQ ID NO: 295816 - RNA, 32 nt, Human
aauuauuugcuuaagaagaauggucuuaacca

SEQ ID NO: 295817 - RNA, 32 nt, Human
aauuauuuguguugacgcucucugcucucucc

SEQ ID NO: 295818 - RNA, 32 nt, Human
aauuauuuuauuaagagacacaaaaaguauuu

SEQ ID NO: 295819 - RNA, 32 nt, Human
aauuauuuucauucuuuauccaugagcaccag

SEQ ID NO: 295820 - RNA, 32 nt, Human
aauuauuuuuaaaaggaggaggggacauagaa

SEQ ID NO: 295821 - RNA, 32 nt, Human
aauucaaagauaaggcaacaaaaugguuuacu

SEQ ID NO: 295822 - RNA, 32 nt, Human
aauucaaagcaggguucugaggcaaauggcac

SEQ ID NO: 295823 - RNA, 32 nt, Human
aauucaacccuuguaagucacaaagccauuca

SEQ ID NO: 295824 - RNA, 32 nt, Human
aauucaagaacagcuuaucucuguaguuacac

SEQ ID NO: 295825 - RNA, 32 nt, Human
aauucaagaacuccagaaaucaggagacggag

SEQ ID NO: 295826 - RNA, 32 nt, Human
aauucaagaaguaggcugggcccgguggcuca

SEQ ID NO: 295827 - RNA, 32 nt, Human
aauucaagacugccuuuccuacuucuucagug

SEQ ID NO: 295828 - RNA, 32 nt, Human
aauucaagacuggucaguccaagagcagacaa

SEQ ID NO: 295829 - RNA, 32 nt, Human
aauucaaggagaaggaaugaggaguuagggaa

SEQ ID NO: 295830 - RNA, 32 nt, Human
aauucaaggggcccugaggacuggacugcuag

SEQ ID NO: 295831 - RNA, 24 nt, Human
aauucaagugauucuccugccuca

SEQ ID NO: 295832 - RNA, 25 nt, Human
aauucaagugcuuaaaaauacuucu

SEQ ID NO: 295833 - RNA, 32 nt, Human
aauucaaguucaacagacuucacuuuggucau

SEQ ID NO: 295834 - RNA, 32 nt, Human
aauucaaucagagcuccaguuugcauuuggau

SEQ ID NO: 295835 - RNA, 32 nt, Human
aauucaaucuuucauucugugugacagaagua

SEQ ID NO: 295836 - RNA, 32 nt, Human
aauucacaagcagggugcauuuuccucucauu

SEQ ID NO: 295837 - RNA, 32 nt, Human
aauucacacaugcucacuggugaacagugucu

SEQ ID NO: 295838 - RNA, 21 nt, Human
aauucacacuggagaaaagcc

SEQ ID NO: 295839 - RNA, 22 nt, Human
aauucacacuggagaaaagccu

SEQ ID NO: 295840 - RNA, 21 nt, Human
aauucacacuggagagaaacc

SEQ ID NO: 295841 - RNA, 22 nt, Human
aauucacacuggagagaaaccu

SEQ ID NO: 295842 - RNA, 22 nt, Human
aauucacacuggggagaaaccu

SEQ ID NO: 295843 - RNA, 32 nt, Human
aauucacacuuguucucuugacugccucucuc

SEQ ID NO: 295844 - RNA, 32 nt, Human
aauucacagaugguaaaugcgggguauuuuau

SEQ ID NO: 295845 - RNA, 32 nt, Human
aauucacaggaaagaauacaaagacagcacaa

SEQ ID NO: 295846 - RNA, 32 nt, Human
aauucacagguaaaucaucaucauaggagugu

SEQ ID NO: 295847 - RNA, 32 nt, Human
aauucacauaugaacuauuucuaggcuuugac

SEQ ID NO: 295848 - RNA, 32 nt, Human
aauucacauccugggugggacagagcaggaca

SEQ ID NO: 295849 - RNA, 32 nt, Human
aauucacauggaaauggggaagauggucuguu

SEQ ID NO: 295850 - RNA, 32 nt, Human
aauucaccggagacauccgggccccgcuucga

SEQ ID NO: 295851 - RNA, 32 nt, Human
aauucaccuagagugaguacuuuccuugugca

SEQ ID NO: 295852 - RNA, 32 nt, Human
aauucaccucaguuugcugugguugcuauugg

SEQ ID NO: 295853 - RNA, 22 nt, Human
aauucacguugaagcccuaauc

SEQ ID NO: 295854 - RNA, 21 nt, Human
aauucacuaacagacagacca

SEQ ID NO: 295855 - RNA, 32 nt, Human
aauucacuaagcugccuagccacacucuuuag

SEQ ID NO: 295856 - RNA, 32 nt, Human
aauucacuacagccuaaagccuugccuuugua

SEQ ID NO: 295857 - RNA, 32 nt, Human
aauucacucauugauucauuuguucacacaac

SEQ ID NO: 295858 - RNA, 32 nt, Human
aauucacucccacugccugggauugcacugga

SEQ ID NO: 295859 - RNA, 32 nt, Human
aauucacugcaaggagaccucuacugucaccg

SEQ ID NO: 295860 - RNA, 32 nt, Human
aauucacuguacuaucagguucacaaacuuca

SEQ ID NO: 295861 - RNA, 32 nt, Human
aauucacuuguucugucaguaauccauaagac

SEQ ID NO: 295862 - RNA, 32 nt, Human
aauucagaaacugagccagccucggcgggacc

SEQ ID NO: 295863 - RNA, 32 nt, Human
aauucagaaaguugguccagauauaugucaca

SEQ ID NO: 295864 - RNA, 23 nt, Human
aauucagaaauaguuaccaaugg

SEQ ID NO: 295865 - RNA, 24 nt, Human
aauucagaagcauuuuaccaguga

SEQ ID NO: 295866 - RNA, 32 nt, Human
aauucagaaucuauucucuucucuccaguccc

SEQ ID NO: 295867 - RNA, 32 nt, Human
aauucagaccucauuagaaaucaaagaauuca

SEQ ID NO: 295868 - RNA, 32 nt, Human
aauucagacuaugagcucaccuacaaccuaga

SEQ ID NO: 295869 - RNA, 32 nt, Human
aauucagaggucccuauuuccuuuguacauac

SEQ ID NO: 295870 - RNA, 22 nt, Human
aauucagagugauuaacaguga

SEQ ID NO: 295871 - RNA, 32 nt, Human
aauucagaugccacucgaugcacccuucuugg

SEQ ID NO: 295872 - RNA, 32 nt, Human
aauucagcagcccagacugagggucugggaug

SEQ ID NO: 295873 - RNA, 32 nt, Human
aauucagcaggaagcaguuaagcggucgucgg

SEQ ID NO: 295874 - RNA, 32 nt, Human
aauucagcaucuccccuuccacccucaccccc

SEQ ID NO: 295875 - RNA, 32 nt, Human
aauucagcccuuguaauucauaaggcaauuca

SEQ ID NO: 295876 - RNA, 32 nt, Human
aauucagcccuuguaauucauaaggcuauuca

SEQ ID NO: 295877 - RNA, 32 nt, Human
aauucagcuuugugaagucccugcucucugug

SEQ ID NO: 295878 - RNA, 26 nt, Human
aauucaggaggcggagguugcagcga

SEQ ID NO: 295879 - RNA, 32 nt, Human
aauucaggaggcggagguugcagugagccaag

SEQ ID NO: 295880 - RNA, 26 nt, Human
aauucaggagguggagguugcaguga

SEQ ID NO: 295881 - RNA, 32 nt, Human
aauucaggagguggagguugcagugagccgac

SEQ ID NO: 295882 - RNA, 31 nt, Human
aauucaggcaguguuaauaugccaagguagg

SEQ ID NO: 295883 - RNA, 32 nt, Human
aauucaggcuugcccaacucacauucuaugac

SEQ ID NO: 295884 - RNA, 32 nt, Human
aauucaggggguacaagugcagguuuguuaca

SEQ ID NO: 295885 - RNA, 24 nt, Human
aauucaggguccccuaccagauga

SEQ ID NO: 295886 - RNA, 32 nt, Human
aauucaggucuguuucagacugugucucuggu

SEQ ID NO: 295887 - RNA, 32 nt, Human
aauucaguaaguuuccucugaagcacccugaa

SEQ ID NO: 295888 - RNA, 32 nt, Human
aauucaguauuuuaugauaaucacuucguuuu

SEQ ID NO: 295889 - RNA, 32 nt, Human
aauucagucuuuucaaaacaaaucacaaaagc

SEQ ID NO: 295890 - RNA, 32 nt, Human
aauucaguggcagaaaauaaauaagaagauaa

SEQ ID NO: 295891 - RNA, 32 nt, Human
aauucaguguuggaagcuuuuucccaagguuu

SEQ ID NO: 295892 - RNA, 32 nt, Human
aauucaguucaugugugaaguucuugauauuc

SEQ ID NO: 295893 - RNA, 32 nt, Human
aauucaguucuuugcuggcucucagcuggagg

SEQ ID NO: 295894 - RNA, 22 nt, Human
aauucauacaggagagaaaccu

SEQ ID NO: 295895 - RNA, 22 nt, Human
aauucauaccggagagaaaccu

SEQ ID NO: 295896 - RNA, 32 nt, Human
aauucauacucuguugccuccucucucccugc

SEQ ID NO: 295897 - RNA, 21 nt, Human
aauucauacuggaaagaaacc

SEQ ID NO: 295898 - RNA, 22 nt, Human
aauucauacuggaaagaaaccu

SEQ ID NO: 295899 - RNA, 21 nt, Human
aauucauacuggagaaaaacc

SEQ ID NO: 295900 - RNA, 21 nt, Human
aauucauacuggagaaaagcc

SEQ ID NO: 295901 - RNA, 21 nt, Human
aauucauacuggagagaaacc

SEQ ID NO: 295902 - RNA, 22 nt, Human
aauucauacuggagagaaaccu

SEQ ID NO: 295903 - RNA, 21 nt, Human
aauucauacuggagagaaacu

SEQ ID NO: 295904 - RNA, 22 nt, Human
aauucauacuggagagaaagcc

SEQ ID NO: 295905 - RNA, 22 nt, Human
aauucauacuggagagaaagcu

SEQ ID NO: 295906 - RNA, 21 nt, Human
aauucauacuggagagaagcc

SEQ ID NO: 295907 - RNA, 22 nt, Human
aauucauacuggagcaaaaccu

SEQ ID NO: 295908 - RNA, 21 nt, Human
aauucauacuggcgagaaacc

SEQ ID NO: 295909 - RNA, 21 nt, Human
aauucauacuggggagaaacc

SEQ ID NO: 295910 - RNA, 21 nt, Human
aauucauacuggugagaaacc

SEQ ID NO: 295911 - RNA, 22 nt, Human
aauucauacuggugagaaaccu

SEQ ID NO: 295912 - RNA, 22 nt, Human
aauucauaguggagagaaaccu

SEQ ID NO: 295913 - RNA, 32 nt, Human
aauucauauguugaaacccuaaucuacuaugu

SEQ ID NO: 295914 - RNA, 32 nt, Human
aauucaucaaauaugagaucuccuucaaugua

SEQ ID NO: 295915 - RNA, 31 nt, Human
aauucaucacuuuucuggcuacagcaggaca

SEQ ID NO: 295916 - RNA, 32 nt, Human
aauucauccuccacggacccauucauacuaaa

SEQ ID NO: 295917 - RNA, 32 nt, Human
aauucaucuggaaccacaaaagagcuugaaua

SEQ ID NO: 295918 - RNA, 32 nt, Human
aauucaucuuuagauagcagauuaucccuuaa

SEQ ID NO: 295919 - RNA, 32 nt, Human
aauucaugaacugcuuuguggaaaaauuuaaa

SEQ ID NO: 295920 - RNA, 32 nt, Human
aauucaugccaaaaauaaaauuagcguaauau

SEQ ID NO: 295921 - RNA, 32 nt, Human
aauucaugccaacuugaaaacucuccaguuug

SEQ ID NO: 295922 - RNA, 21 nt, Human
aauucaugcuggagagaaacc

SEQ ID NO: 295923 - RNA, 21 nt, Human
aauucaugcuggagagaaacu

SEQ ID NO: 295924 - RNA, 22 nt, Human
aauucaugcuggagagaaacuu

SEQ ID NO: 295925 - RNA, 32 nt, Human
aauucauggaaacagagccacugucaagaagg

SEQ ID NO: 295926 - RNA, 25 nt, Human
aauucauggagccuuuacagaagca

SEQ ID NO: 295927 - RNA, 32 nt, Human
aauucauggcagggagguggggaccaaggccc

SEQ ID NO: 295928 - RNA, 32 nt, Human
aauucauuaacuuauucuguauaaaacugucu

SEQ ID NO: 295929 - RNA, 32 nt, Human
aauucauuaagccaagggaguaagaauggcca

SEQ ID NO: 295930 - RNA, 32 nt, Human
aauucauuacauggaggcucaaucuugaguuu

SEQ ID NO: 295931 - RNA, 21 nt, Human
aauucauucuggagagaaacc

SEQ ID NO: 295932 - RNA, 32 nt, Human
aauucauugggcauuuguuagcuuugaugaau

SEQ ID NO: 295933 - RNA, 32 nt, Human
aauucauuguuacuguucuguuuuucuauuaa

SEQ ID NO: 295934 - RNA, 32 nt, Human
aauucauuuucaccaccucugguguucagagg

SEQ ID NO: 295935 - RNA, 32 nt, Human
aauuccaaaggugagaguuggagugagauguc

SEQ ID NO: 295936 - RNA, 32 nt, Human
aauuccaaauggugugaacccagggggccuuu

SEQ ID NO: 295937 - RNA, 31 nt, Human
aauuccaacaacacaaccagcagagugacac

SEQ ID NO: 295938 - RNA, 32 nt, Human
aauuccaagguuuuugcuacaguuaguuucuc

SEQ ID NO: 295939 - RNA, 18 nt, Human
aauuccaaguaaucucug

SEQ ID NO: 295940 - RNA, 32 nt, Human
aauuccacacuugcuucaaugugcacaaacuu

SEQ ID NO: 295941 - RNA, 32 nt, Human
aauuccacagaagaggaaagcaguuaucuggc

SEQ ID NO: 295942 - RNA, 32 nt, Human
aauuccacagaguccugcccauucauaaaacu

SEQ ID NO: 295943 - RNA, 32 nt, Human
aauuccacagcuccuaccaagaccaugaggau

SEQ ID NO: 295944 - RNA, 32 nt, Human
aauuccaccaacauccagaccaaaaagaaaaa

SEQ ID NO: 295945 - RNA, 32 nt, Human
aauuccacuacauuucuuuuggcuccaacauu

SEQ ID NO: 295946 - RNA, 32 nt, Human
aauuccacugccugccaagcaacugaaagugc

SEQ ID NO: 295947 - RNA, 32 nt, Human
aauuccacuguacauguuauucaguguuuggu

SEQ ID NO: 295948 - RNA, 32 nt, Human
aauuccacuuggcugggguuucagaggugagc

SEQ ID NO: 295949 - RNA, 23 nt, Human
aauuccagaaguggaggcuccag

SEQ ID NO: 295950 - RNA, 32 nt, Human
aauuccagcacuuugggagacugaggcgagug

SEQ ID NO: 295951 - RNA, 32 nt, Human
aauuccagccuucuguggucgcugcggccugu

SEQ ID NO: 295952 - RNA, 32 nt, Human
aauuccagcuacucaggaggcugagacagggg

SEQ ID NO: 295953 - RNA, 32 nt, Human
aauuccagcuacucaggaggcugaggcaggag

SEQ ID NO: 295954 - RNA, 32 nt, Human
aauuccagcuacucaggaggcugaggcaggug

SEQ ID NO: 295955 - RNA, 32 nt, Human
aauuccagcuacucaggagucugaggcaggag

SEQ ID NO: 295956 - RNA, 32 nt, Human
aauuccagcuacucaggggguugaggcaggag

SEQ ID NO: 295957 - RNA, 32 nt, Human
aauuccagcuacucauaggauauugaggcagg

SEQ ID NO: 295958 - RNA, 32 nt, Human
aauuccagcuacucgggaggccgaggcaggag

SEQ ID NO: 295959 - RNA, 32 nt, Human
aauuccagcuacucgggaggcuaaggcagggg

SEQ ID NO: 295960 - RNA, 32 nt, Human
aauuccagcuacucgggaggcugaggcaggag

SEQ ID NO: 295961 - RNA, 32 nt, Human
aauuccagcuacucuggaagcugaggcaggag

SEQ ID NO: 295962 - RNA, 32 nt, Human
aauuccagcuacucuggcugcugaggcacaag

SEQ ID NO: 295963 - RNA, 32 nt, Human
aauuccagcuacuugagaggcugagauaggag

SEQ ID NO: 295964 - RNA, 32 nt, Human
aauuccagcuacuuggaggcugaggcgggaga

SEQ ID NO: 295965 - RNA, 32 nt, Human
aauuccagcuacuugggaggcugaggcaggag

SEQ ID NO: 295966 - RNA, 32 nt, Human
aauuccagcuacuugggaggcugaggcaugga

SEQ ID NO: 295967 - RNA, 32 nt, Human
aauuccagcuacuugggagguugaggcaggag

SEQ ID NO: 295968 - RNA, 32 nt, Human
aauuccagcugguuucuuugcugauucuaaaa

SEQ ID NO: 295969 - RNA, 32 nt, Human
aauuccagggcugccuugacuucuucccugca

SEQ ID NO: 295970 - RNA, 23 nt, Human
aauuccaguagcugcaaaaugag

SEQ ID NO: 295971 - RNA, 32 nt, Human
aauuccagucugaggugaauucuuagagagug

SEQ ID NO: 295972 - RNA, 32 nt, Human
aauuccaguguuuugggagacuaaggcaagaa

SEQ ID NO: 295973 - RNA, 32 nt, Human
aauuccauccacugcugagaaaucuccucaaa

SEQ ID NO: 295974 - RNA, 32 nt, Human
aauuccauccccagccgagcaggugcuuaaag

SEQ ID NO: 295975 - RNA, 32 nt, Human
aauuccaucuacucgggaggcugaggcaggag

SEQ ID NO: 295976 - RNA, 32 nt, Human
aauuccaugaaucagaaaauguuuccauagcc

SEQ ID NO: 295977 - RNA, 32 nt, Human
aauuccaugcuagaucacagacugcaugccua

SEQ ID NO: 295978 - RNA, 32 nt, Human
aauucccacagcaaauagaaauaauuuaucau

SEQ ID NO: 295979 - RNA, 32 nt, Human
aauucccaccacagacuggcuuguacguccuc

SEQ ID NO: 295980 - RNA, 24 nt, Human
aauucccacuuuggcauuuuccua

SEQ ID NO: 295981 - RNA, 32 nt, Human
aauucccagcugucugugucagccuguccccc

SEQ ID NO: 295982 - RNA, 32 nt, Human
aauucccaggcagggggagaguggcaugggga

SEQ ID NO: 295983 - RNA, 32 nt, Human
aauucccagggaggacugggaaccuuaucucu

SEQ ID NO: 295984 - RNA, 32 nt, Human
aauucccaguaggguggcugggcagaggcgcc

SEQ ID NO: 295985 - RNA, 32 nt, Human
aauucccaugccaaaggacaaacaggugugac

SEQ ID NO: 295986 - RNA, 28 nt, Human
aauuccccaagugugaagccucauucau

SEQ ID NO: 295987 - RNA, 32 nt, Human
aauucccccaagagccgcauaugaaucugccc

SEQ ID NO: 295988 - RNA, 32 nt, Human
aauucccccuucccccuccaacacauacaccg

SEQ ID NO: 295989 - RNA, 32 nt, Human
aauucccccuugcccaggcccuugggggaggg

SEQ ID NO: 295990 - RNA, 32 nt, Human
aauucccccuugugguaguuaccacaacacau

SEQ ID NO: 295991 - RNA, 32 nt, Human
aauuccccucccccucgucuuucucuuaccuc

SEQ ID NO: 295992 - RNA, 32 nt, Human
aauuccccugccucagcuuccugaguagcugg

SEQ ID NO: 295993 - RNA, 32 nt, Human
aauuccccuuccacuccagauccgcaccucag

SEQ ID NO: 295994 - RNA, 32 nt, Human
aauucccucaaaccacccaacuucauccagga

SEQ ID NO: 295995 - RNA, 32 nt, Human
aauucccucuccccagucuucuccaggugucc

SEQ ID NO: 295996 - RNA, 32 nt, Human
aauucccugcccacuuucuguuccuccaugcc

SEQ ID NO: 295997 - RNA, 32 nt, Human
aauucccugccugugccugcugggaccagacu

SEQ ID NO: 295998 - RNA, 32 nt, Human
aauucccugucuccccuuaaccagcacuggaa

SEQ ID NO: 295999 - RNA, 32 nt, Human
aauucccuguuuccuuguccagggccugagga

SEQ ID NO: 296000 - RNA, 32 nt, Human
aauuccgaaaugaccacccugcccccacugcc

SEQ ID NO: 296001 - RNA, 32 nt, Human
aauuccggacacaguuggaaaugcagaagggc

SEQ ID NO: 296002 - RNA, 32 nt, Human
aauuccggcauuaagaggcauuccgucuucau

SEQ ID NO: 296003 - RNA, 32 nt, Human
aauuccggugcaacgguucagaacagcaacca

SEQ ID NO: 296004 - RNA, 32 nt, Human
aauuccgguuauucucuuuuucaucuggggau

SEQ ID NO: 296005 - RNA, 32 nt, Human
aauuccgugggcggaggucugggaucuccugg

SEQ ID NO: 296006 - RNA, 32 nt, Human
aauuccuaaagaagagaaggacccuggaaugg

SEQ ID NO: 296007 - RNA, 32 nt, Human
aauuccuaggauagcagagagauggacaacag

SEQ ID NO: 296008 - RNA, 32 nt, Human
aauuccuauugcaaccucgugcacugcucgag

SEQ ID NO: 296009 - RNA, 32 nt, Human
aauuccucaguuacuccaaagauggaauaggg

SEQ ID NO: 296010 - RNA, 32 nt, Human
aauuccucauuucaucauuggucuuuauaugu

SEQ ID NO: 296011 - RNA, 32 nt, Human
aauuccucccagaggcacucuauaucugcuau

SEQ ID NO: 296012 - RNA, 32 nt, Human
aauuccucccuccugguaauccugcccgugug

SEQ ID NO: 296013 - RNA, 32 nt, Human
aauuccucuaagaacagagaauggucuuuccc

SEQ ID NO: 296014 - RNA, 32 nt, Human
aauuccucuaccagaacuaagcacuuuguuaa

SEQ ID NO: 296015 - RNA, 23 nt, Human
aauuccugaccucaggugaucca

SEQ ID NO: 296016 - RNA, 23 nt, Human
aauuccugaccuuaagugaucca

SEQ ID NO: 296017 - RNA, 31 nt, Human
aauuccugacuucucuauacagagucuucac

SEQ ID NO: 296018 - RNA, 32 nt, Human
aauuccugagggcagccagagcuccuuggucc

SEQ ID NO: 296019 - RNA, 32 nt, Human
aauuccugagugugcucugccauguuacacgg

SEQ ID NO: 296020 - RNA, 32 nt, Human
aauuccugaugcacagugguuauggguugaau

SEQ ID NO: 296021 - RNA, 32 nt, Human
aauuccugauuccaagaaugccaucugauaaa

SEQ ID NO: 296022 - RNA, 32 nt, Human
aauuccugcauccuuuucaaaacaucuuucca

SEQ ID NO: 296023 - RNA, 32 nt, Human
aauuccugccaucuugguucaugagaugagau

SEQ ID NO: 296024 - RNA, 32 nt, Human
aauuccugccuuccucccuuuucccaguccac

SEQ ID NO: 296025 - RNA, 32 nt, Human
aauuccuggaaagauuaaauagaucagaauga

SEQ ID NO: 296026 - RNA, 32 nt, Human
aauuccuggaugguaaaauacauauuagaucu

SEQ ID NO: 296027 - RNA, 33 nt, Human
aauuccuggccugucuagucuuuguagcuguga

SEQ ID NO: 296028 - RNA, 32 nt, Human
aauuccugggagggggauuauuuagugaaaua

SEQ ID NO: 296029 - RNA, 32 nt, Human
aauuccuggggucuucaucugaguuaaauucu

SEQ ID NO: 296030 - RNA, 32 nt, Human
aauuccugucauucaggacaacauggauggaa

SEQ ID NO: 296031 - RNA, 32 nt, Human
aauuccugucuccuggacucuccugggaaguu

SEQ ID NO: 296032 - RNA, 32 nt, Human
aauuccugugagaggauggggaagggauucgc

SEQ ID NO: 296033 - RNA, 19 nt, Human
aauuccuguuagccaggug

SEQ ID NO: 296034 - RNA, 32 nt, Human
aauuccuuccucucccuuguucccaaguaggu

SEQ ID NO: 296035 - RNA, 32 nt, Human
aauuccuuccuucucuucuguacagcagaagu

SEQ ID NO: 296036 - RNA, 32 nt, Human
aauuccuuuccaguucuuccccuggcugccuu

SEQ ID NO: 296037 - RNA, 32 nt, Human
aauucgaagcucacugugccucuuguuuccga

SEQ ID NO: 296038 - RNA, 32 nt, Human
aauucgaccaaaggauuuggaagaguuuuucu

SEQ ID NO: 296039 - RNA, 32 nt, Human
aauucgaccuuuccuuauuggguggguaccau

SEQ ID NO: 296040 - RNA, 32 nt, Human
aauucgagacaggcagaaucaguagcuggaga

SEQ ID NO: 296041 - RNA, 32 nt, Human
aauucgagaccagccuaggugacauagugaga

SEQ ID NO: 296042 - RNA, 32 nt, Human
aauucgaggaaaggaggcauggcagagggcua

SEQ ID NO: 296043 - RNA, 32 nt, Human
aauucgagguugcugagcuucucuccaaaguc

SEQ ID NO: 296044 - RNA, 32 nt, Human
aauucgcaucuucucuauccacaucaugacca

SEQ ID NO: 296045 - RNA, 32 nt, Human
aauucgcgaggcagagguugcagcgaacccag

SEQ ID NO: 296046 - RNA, 32 nt, Human
aauucggauguuuugcuggagucgcuagggag

SEQ ID NO: 296047 - RNA, 32 nt, Human
aauucgggagguggagguugcagugagccgaa

SEQ ID NO: 296048 - RNA, 32 nt, Human
aauucguacuggagagaaacccugugaguuug

SEQ ID NO: 296049 - RNA, 22 nt, Human
aauucguacuggagagaauccu

SEQ ID NO: 296050 - RNA, 32 nt, Human
aauucguggaaauguaauaauuauaggaacgu

SEQ ID NO: 296051 - RNA, 32 nt, Human
aauucguucucugccacagggacuugccucac

SEQ ID NO: 296052 - RNA, 32 nt, Human
aauucuaaaggaagcaaggaacccccuuuuca

SEQ ID NO: 296053 - RNA, 32 nt, Human
aauucuaacugaucuccugaaaauguugaucu

SEQ ID NO: 296054 - RNA, 32 nt, Human
aauucuaagccuuuuuguggcuaaguuuuguu

SEQ ID NO: 296055 - RNA, 32 nt, Human
aauucuaauguucaaaucacugcgugcuguau

SEQ ID NO: 296056 - RNA, 32 nt, Human
aauucuacagaagaaucugauggcuaaauggc

SEQ ID NO: 296057 - RNA, 32 nt, Human
aauucuacccucaggggccuguagauguugcu

SEQ ID NO: 296058 - RNA, 32 nt, Human
aauucuacugcacugccuggcucagcugcacg

SEQ ID NO: 296059 - RNA, 32 nt, Human
aauucuagaaguccaaaucacucauuguuugu

SEQ ID NO: 296060 - RNA, 32 nt, Human
aauucuagagacaaaagccaauuaaaguccau

SEQ ID NO: 296061 - RNA, 32 nt, Human
aauucuagauuguucucucagaauuccaaauu

SEQ ID NO: 296062 - RNA, 32 nt, Human
aauucuagcacuuugggagacugaagcgggug

SEQ ID NO: 296063 - RNA, 32 nt, Human
aauucuagccugggcaacagagcgagacccug

SEQ ID NO: 296064 - RNA, 32 nt, Human
aauucuauaaauucucuuucucccucucuucu

SEQ ID NO: 296065 - RNA, 32 nt, Human
aauucuaugcacccuacacugacagacucccu

SEQ ID NO: 296066 - RNA, 32 nt, Human
aauucuauggguuugcugcagcauaauccuug

SEQ ID NO: 296067 - RNA, 32 nt, Human
aauucuauguuaauuacaacugcuauauagac

SEQ ID NO: 296068 - RNA, 32 nt, Human
aauucucaaacaguuauggacucucaggagca

SEQ ID NO: 296069 - RNA, 32 nt, Human
aauucucaaaucacugccaggaguucuugcuc

SEQ ID NO: 296070 - RNA, 32 nt, Human
aauucucagucuggacagugagaccaccccgc

SEQ ID NO: 296071 - RNA, 32 nt, Human
aauucucaucuucucuccucuucucccuuuua

SEQ ID NO: 296072 - RNA, 32 nt, Human
aauucuccaacucucuggucaggaggaggagc

SEQ ID NO: 296073 - RNA, 32 nt, Human
aauucuccagccucagccuccccaguagcugg

SEQ ID NO: 296074 - RNA, 32 nt, Human
aauucucccaggaguccuggccacuuugaaug

SEQ ID NO: 296075 - RNA, 32 nt, Human
aauucuccccuagaccuuucagaaggagcgug

SEQ ID NO: 296076 - RNA, 32 nt, Human
aauucucccugccucagccuccugaguagcua

SEQ ID NO: 296077 - RNA, 32 nt, Human
aauucucccuuuguaaccucagugcuggggac

SEQ ID NO: 296078 - RNA, 32 nt, Human
aauucuccuaccucagcuucccgaguagcugg

SEQ ID NO: 296079 - RNA, 32 nt, Human
aauucuccugccucagccuccugguagcuggg

SEQ ID NO: 296080 - RNA, 32 nt, Human
aauucuccugccucagcuacucaagaggcuga

SEQ ID NO: 296081 - RNA, 32 nt, Human
aauucuccugccucagcuccucgaguagcugg

SEQ ID NO: 296082 - RNA, 32 nt, Human
aauucuccugccucagcuccugaguagcuggg

SEQ ID NO: 296083 - RNA, 32 nt, Human
aauucuccugccucagcucugaguagcuggga

SEQ ID NO: 296084 - RNA, 32 nt, Human
aauucuccugccucagcuucccgaguagcgug

SEQ ID NO: 296085 - RNA, 32 nt, Human
aauucuccugccucagcuucccgaguagcugg

SEQ ID NO: 296086 - RNA, 32 nt, Human
aauucuccugccucagcuuccugaguagcuag

SEQ ID NO: 296087 - RNA, 32 nt, Human
aauucuccugccucagcuuccugaguagcugg

SEQ ID NO: 296088 - RNA, 32 nt, Human
aauucucucaacaagauguaaacaggaaagaa

SEQ ID NO: 296089 - RNA, 32 nt, Human
aauucucugaucauuuaguucuaucuauuuag

SEQ ID NO: 296090 - RNA, 32 nt, Human
aauucucuucuaggauuuuugugaaagcuuaa

SEQ ID NO: 296091 - RNA, 32 nt, Human
aauucucuuuagcauaaagcugugcauuggaa

SEQ ID NO: 296092 - RNA, 32 nt, Human
aauucugaaagcuuccuccuuguaagaaaccc

SEQ ID NO: 296093 - RNA, 32 nt, Human
aauucugaaaugaagauggaggaggcaguggg

SEQ ID NO: 296094 - RNA, 32 nt, Human
aauucugaaccaggaauugucuccaacuccag

SEQ ID NO: 296095 - RNA, 32 nt, Human
aauucugaagaaaucuuggggagggaagggga

SEQ ID NO: 296096 - RNA, 32 nt, Human
aauucugaggaaccuuguguccaguuguuaca

SEQ ID NO: 296097 - RNA, 32 nt, Human
aauucugcacacacccaggaaguucugccuuu

SEQ ID NO: 296098 - RNA, 32 nt, Human
aauucugcacauucauggagugcaauaauacu

SEQ ID NO: 296099 - RNA, 32 nt, Human
aauucugcagguggagguugcuagucuaguuu

SEQ ID NO: 296100 - RNA, 32 nt, Human
aauucugcagucgggccagcugucgcaccuca

SEQ ID NO: 296101 - RNA, 32 nt, Human
aauucugcauggugacagucucccccaaacau

SEQ ID NO: 296102 - RNA, 32 nt, Human
aauucugccuuccucuaggggaagcuuuuaga

SEQ ID NO: 296103 - RNA, 32 nt, Human
aauucugcuugguguucuugcauugcauuuaa

SEQ ID NO: 296104 - RNA, 32 nt, Human
aauucugggagcgcaggcaaugcggaagcacg

SEQ ID NO: 296105 - RNA, 32 nt, Human
aauucugggagguuugggccuggcggcucucc

SEQ ID NO: 296106 - RNA, 32 nt, Human
aauucugggauuacaggcaugagccaccaugc

SEQ ID NO: 296107 - RNA, 32 nt, Human
aauucugggcuggcggccugguggcagugcug

SEQ ID NO: 296108 - RNA, 32 nt, Human
aauucuguccccaucaaggggucagcuggaga

SEQ ID NO: 296109 - RNA, 32 nt, Human
aauucugugagugcuggggccaguggggcugg

SEQ ID NO: 296110 - RNA, 32 nt, Human
aauucugugcugcuuugcaaauuguugaaacu

SEQ ID NO: 296111 - RNA, 32 nt, Human
aauucuguggguuacuccacagcuucagcuuu

SEQ ID NO: 296112 - RNA, 32 nt, Human
aauucuguggugcuugagaaacagacaguacu

SEQ ID NO: 296113 - RNA, 32 nt, Human
aauucuguguaugacagugcuauugaaaucac

SEQ ID NO: 296114 - RNA, 32 nt, Human
aauucugugugaaugugaacuugccuaguaag

SEQ ID NO: 296115 - RNA, 32 nt, Human
aauucuguugaaaucagugaaguggugauaag

SEQ ID NO: 296116 - RNA, 32 nt, Human
aauucuguuuuuaaaaauuagccuaagauaua

SEQ ID NO: 296117 - RNA, 32 nt, Human
aauucuuaaauauugaggccccauugugagua

SEQ ID NO: 296118 - RNA, 32 nt, Human
aauucuuacccuguucaaaugauaugauucua

SEQ ID NO: 296119 - RNA, 32 nt, Human
aauucuuagcuuauuuuauauuuccuugucuu

SEQ ID NO: 296120 - RNA, 32 nt, Human
aauucuuaggaauucuuuuaagcaaugcaggu

SEQ ID NO: 296121 - RNA, 32 nt, Human
aauucuuauucuuucauuuucuugcccgcacg

SEQ ID NO: 296122 - RNA, 32 nt, Human
aauucuuauuuaaccuuccucccuucaucuuc

SEQ ID NO: 296123 - RNA, 18 nt, Human
aauucuucaaucccuuca

SEQ ID NO: 296124 - RNA, 32 nt, Human
aauucuucccugggggucccaggauccccugc

SEQ ID NO: 296125 - RNA, 32 nt, Human
aauucuuccucccauuccccucuacuugcgag

SEQ ID NO: 296126 - RNA, 32 nt, Human
aauucuuccucuucguucuucaccuggguuuc

SEQ ID NO: 296127 - RNA, 19 nt, Human
aauucuucuaauuccuuca

SEQ ID NO: 296128 - RNA, 32 nt, Human
aauucuucuccuccuccuugcguagaaguuga

SEQ ID NO: 296129 - RNA, 32 nt, Human
aauucuugaacccaggagacggaaguugcagu

SEQ ID NO: 296130 - RNA, 32 nt, Human
aauucuugacuguaaaacauuuugaccagugu

SEQ ID NO: 296131 - RNA, 32 nt, Human
aauucuugcuuuuaauaacaaagguacaauau

SEQ ID NO: 296132 - RNA, 32 nt, Human
aauucuugucuuccaaucaucucccauauauu

SEQ ID NO: 296133 - RNA, 32 nt, Human
aauucuuuacagucuuuccuuuauauccagaa

SEQ ID NO: 296134 - RNA, 32 nt, Human
aauucuuuagggacugggauuggguuugacug

SEQ ID NO: 296135 - RNA, 32 nt, Human
aauucuuuugagaaaguaugaaguuuugcaga

SEQ ID NO: 296136 - RNA, 32 nt, Human
aauucuuuuuaaaucaccuuuuacuuuauuga

SEQ ID NO: 296137 - RNA, 32 nt, Human
aauugaaaaauggaccuuugaaaaugcuagau

SEQ ID NO: 296138 - RNA, 32 nt, Human
aauugaaaacaaccuggaaguccagugauggg

SEQ ID NO: 296139 - RNA, 32 nt, Human
aauugaaaaguauucugagacugcaaaauggg

SEQ ID NO: 296140 - RNA, 32 nt, Human
aauugaaaauaaauaauuaaaauaucagacau

SEQ ID NO: 296141 - RNA, 32 nt, Human
aauugaaagaagcaaggacaucagcugagaag

SEQ ID NO: 296142 - RNA, 32 nt, Human
aauugaaagagggagaggggagacuguagccu

SEQ ID NO: 296143 - RNA, 32 nt, Human
aauugaaagauggagucuaaaaauuauuagcu

SEQ ID NO: 296144 - RNA, 32 nt, Human
aauugaaagcaaguggauuacacaggagaacc

SEQ ID NO: 296145 - RNA, 32 nt, Human
aauugaaagcaggauaucgaagagauauuugc

SEQ ID NO: 296146 - RNA, 32 nt, Human
aauugaaagcagggacuugaacagauauuugu

SEQ ID NO: 296147 - RNA, 32 nt, Human
aauugaaagcagggucucaaagagauaucugu

SEQ ID NO: 296148 - RNA, 31 nt, Human
aauugaaagugugaaagaaaagacugauaaa

SEQ ID NO: 296149 - RNA, 32 nt, Human
aauugaaauaaauaugaaaauaucaaguucaa

SEQ ID NO: 296150 - RNA, 32 nt, Human
aauugaaauggaauuggcaaugugggaaauaa

SEQ ID NO: 296151 - RNA, 32 nt, Human
aauugaaauguucuuaauagcuaaguuuuaaa

SEQ ID NO: 296152 - RNA, 32 nt, Human
aauugaacaaacccucacugagcaccucugau

SEQ ID NO: 296153 - RNA, 32 nt, Human
aauugaacaggcugcuugcagagagauaagag

SEQ ID NO: 296154 - RNA, 32 nt, Human
aauugaacaucagaggaugggaagagggcucu

SEQ ID NO: 296155 - RNA, 32 nt, Human
aauugaacccaggagguggagguugcagugag

SEQ ID NO: 296156 - RNA, 32 nt, Human
aauugaaccuaggagguugaggcuauagugag

SEQ ID NO: 296157 - RNA, 32 nt, Human
aauugaaccuuagaacacagacugcaaauaau

SEQ ID NO: 296158 - RNA, 32 nt, Human
aauugaacgugagauuccgagaccggcuaccc

SEQ ID NO: 296159 - RNA, 32 nt, Human
aauugaacucacaaacugauguuauauacuca

SEQ ID NO: 296160 - RNA, 32 nt, Human
aauugaacuccaucaggcaaaauuuaaaauca

SEQ ID NO: 296161 - RNA, 32 nt, Human
aauugaagacuugauggaaauggugcaaaagc

SEQ ID NO: 296162 - RNA, 32 nt, Human
aauugaagagccaagaaaaagggagauucuua

SEQ ID NO: 296163 - RNA, 32 nt, Human
aauugaagaggaagucuaccugggcuucuggg

SEQ ID NO: 296164 - RNA, 32 nt, Human
aauugaagauauagcaccaauaguuuauuuau

SEQ ID NO: 296165 - RNA, 32 nt, Human
aauugaaggcacugugcacaccauuggacugc

SEQ ID NO: 296166 - RNA, 32 nt, Human
aauugaaguucugcagcaugucaggccaggau

SEQ ID NO: 296167 - RNA, 32 nt, Human
aauugaauaagcugcaugugugcauacuugcu

SEQ ID NO: 296168 - RNA, 32 nt, Human
aauugaauauuaauacaaagcauauuaaaaac

SEQ ID NO: 296169 - RNA, 32 nt, Human
aauugaaucugaauuuuggggauguuguauag

SEQ ID NO: 296170 - RNA, 32 nt, Human
aauugaauucauuaguaaaaugaguuaccaag

SEQ ID NO: 296171 - RNA, 32 nt, Human
aauugaauugaaagggaggagugaugguggaa

SEQ ID NO: 296172 - RNA, 32 nt, Human
aauugaauuuucugaauuuggguggagcagag

SEQ ID NO: 296173 - RNA, 32 nt, Human
aauugacacaauauagaccaacaguuucaucc

SEQ ID NO: 296174 - RNA, 32 nt, Human
aauugacagcuuucuaacucacaggcauagag

SEQ ID NO: 296175 - RNA, 32 nt, Human
aauugacauaagugcuuuuacaagcaccaaag

SEQ ID NO: 296176 - RNA, 32 nt, Human
aauugacauacucaggauaacagagaauggug

SEQ ID NO: 296177 - RNA, 32 nt, Human
aauugacauuagggucaauucagcauugacuu

SEQ ID NO: 296178 - RNA, 32 nt, Human
aauugaccagaacacaguugugggaauuuggu

SEQ ID NO: 296179 - RNA, 19 nt, Human
aauugaccauccaggcaca

SEQ ID NO: 296180 - RNA, 32 nt, Human
aauugacccauguaacaaaccugcacaugugg

SEQ ID NO: 296181 - RNA, 32 nt, Human
aauugacccugacgaagaagaaagugccaaga

SEQ ID NO: 296182 - RNA, 32 nt, Human
aauugaccuagaaaaugucucuuuuaaauuua

SEQ ID NO: 296183 - RNA, 32 nt, Human
aauugaccucuucugggaacuuccucagaugg

SEQ ID NO: 296184 - RNA, 32 nt, Human
aauugacuagagugcuguaaacuugcuguaac

SEQ ID NO: 296185 - RNA, 32 nt, Human
aauugacugacuggauuucuccauuucucaca

SEQ ID NO: 296186 - RNA, 32 nt, Human
aauugacugcaaccucugcuucccaggcucaa

SEQ ID NO: 296187 - RNA, 32 nt, Human
aauugacugccaggcugggugcaguggcucac

SEQ ID NO: 296188 - RNA, 32 nt, Human
aauugacuuacauaaacuacugccaauguuua

SEQ ID NO: 296189 - RNA, 32 nt, Human
aauugagaaaauaaagcugucuucuuauuaac

SEQ ID NO: 296190 - RNA, 32 nt, Human
aauugagagagaagaagggggagaggaacagc

SEQ ID NO: 296191 - RNA, 32 nt, Human
aauugagauuccaucagccaggaagaaggggu

SEQ ID NO: 296192 - RNA, 32 nt, Human
aauugagauugauguguuuucacuggauuuuu

SEQ ID NO: 296193 - RNA, 32 nt, Human
aauugagcagacaaguuuguuuuauuuuggag

SEQ ID NO: 296194 - RNA, 32 nt, Human
aauugagcaguuguaucuucugaccaccaaca

SEQ ID NO: 296195 - RNA, 32 nt, Human
aauugagcccacgaguucaaggcugcagugag

SEQ ID NO: 296196 - RNA, 32 nt, Human
aauugagcccaggaguucaaagcuguagugag

SEQ ID NO: 296197 - RNA, 32 nt, Human
aauugagcccaugaguucaaggcugcagugag

SEQ ID NO: 296198 - RNA, 32 nt, Human
aauugagcuccuggcccuucugaugcuuugaa

SEQ ID NO: 296199 - RNA, 32 nt, Human
aauugagcuucuaaugagaugcaccccuuuac

SEQ ID NO: 296200 - RNA, 32 nt, Human
aauugaggacuuuucugcuucauccagacagc

SEQ ID NO: 296201 - RNA, 32 nt, Human
aauugaggagaaagugagcuaaguuggggugg

SEQ ID NO: 296202 - RNA, 32 nt, Human
aauugaggagucuggaguuuuguauuuggacc

SEQ ID NO: 296203 - RNA, 32 nt, Human
aauugaggaucccggacacagagugcagagac

SEQ ID NO: 296204 - RNA, 32 nt, Human
aauugaggccuugaggaaugaagcuuugaagg

SEQ ID NO: 296205 - RNA, 32 nt, Human
aauugagggaagagaugggagccagggcacga

SEQ ID NO: 296206 - RNA, 32 nt, Human
aauugagggaagcggaagggaagaauaaggga

SEQ ID NO: 296207 - RNA, 32 nt, Human
aauugaggguaguggaaagcaggugugggaca

SEQ ID NO: 296208 - RNA, 32 nt, Human
aauugaggugugcagagcacuguacagacccc

SEQ ID NO: 296209 - RNA, 32 nt, Human
aauugaguaguacaguggaaacuguuaaaugc

SEQ ID NO: 296210 - RNA, 32 nt, Human
aauugagucugaccucaggaguguaguuaaac

SEQ ID NO: 296211 - RNA, 32 nt, Human
aauugaguuucuggcuccccuccugggguugu

SEQ ID NO: 296212 - RNA, 32 nt, Human
aauugaguuugagacuagccugggcaacaugg

SEQ ID NO: 296213 - RNA, 32 nt, Human
aauugauaaccaggacaaccagguagucaccc

SEQ ID NO: 296214 - RNA, 32 nt, Human
aauugauauacuuuaaaugucuccaguguggc

SEQ ID NO: 296215 - RNA, 32 nt, Human
aauugaugagugccaucagaaagcuguaucau

SEQ ID NO: 296216 - RNA, 32 nt, Human
aauugauguugcuggacugucauagaaauuac

SEQ ID NO: 296217 - RNA, 32 nt, Human
aauugauuacuuuugcacauugcacagaaccc

SEQ ID NO: 296218 - RNA, 32 nt, Human
aauugauucuggagccacacagcuccccaccc

SEQ ID NO: 296219 - RNA, 32 nt, Human
aauugauuggcuuaucacaaaaaucauuucau

SEQ ID NO: 296220 - RNA, 32 nt, Human
aauugauuuccagcugcaauaagccgugccuc

SEQ ID NO: 296221 - RNA, 32 nt, Human
aauugcacagaauucuagagacagcguuguuc

SEQ ID NO: 296222 - RNA, 32 nt, Human
aauugcaccacugcacuccagccugggaaaca

SEQ ID NO: 296223 - RNA, 32 nt, Human
aauugcaccacugcacuccagccugggagaca

SEQ ID NO: 296224 - RNA, 32 nt, Human
aauugcaccacugcacuccagccugggugaca

SEQ ID NO: 296225 - RNA, 32 nt, Human
aauugcaccacugcacuccauccugggcaaca

SEQ ID NO: 296226 - RNA, 32 nt, Human
aauugcaccacugcacugcagccugggaaaca

SEQ ID NO: 296227 - RNA, 32 nt, Human
aauugcaccauugcacuccagccugggcaaua

SEQ ID NO: 296228 - RNA, 32 nt, Human
aauugcacccuccagacacucagguugaaaau

SEQ ID NO: 296229 - RNA, 32 nt, Human
aauugcacuggugacagauaagguuuaacaga

SEQ ID NO: 296230 - RNA, 32 nt, Human
aauugcagaagcaggaaggugacucugaccuu

SEQ ID NO: 296231 - RNA, 32 nt, Human
aauugcagacuucaggucguggcagagaaaac

SEQ ID NO: 296232 - RNA, 32 nt, Human
aauugcagaggaaggcugaggcgggaggauug

SEQ ID NO: 296233 - RNA, 32 nt, Human
aauugcagaggggagggggaaaagagagagag

SEQ ID NO: 296234 - RNA, 32 nt, Human
aauugcagagucuguagguggagagguggaaa

SEQ ID NO: 296235 - RNA, 32 nt, Human
aauugcagaucuucccuuguaaaugugacugu

SEQ ID NO: 296236 - RNA, 32 nt, Human
aauugcagcauuuccccagcugggcuguccca

SEQ ID NO: 296237 - RNA, 32 nt, Human
aauugcauauugaagggagauauugccacacu

SEQ ID NO: 296238 - RNA, 32 nt, Human
aauugcaucacugcacuccaaccugggcaaca

SEQ ID NO: 296239 - RNA, 32 nt, Human
aauugcaucauugcacuccagccugggcaaca

SEQ ID NO: 296240 - RNA, 32 nt, Human
aauugcaugaagcagaggcuaagaugguuuuc

SEQ ID NO: 296241 - RNA, 32 nt, Human
aauugcauucgucugcaguagacacgaguucc

SEQ ID NO: 296242 - RNA, 32 nt, Human
aauugcauuucuggcagggaaggagaggaggg

SEQ ID NO: 296243 - RNA, 32 nt, Human
aauugccaaaaaccaccaggagcuggagaggc

SEQ ID NO: 296244 - RNA, 32 nt, Human
aauugccacagcuguauuuuggcuuucucccu

SEQ ID NO: 296245 - RNA, 32 nt, Human
aauugccacugcaccugagauaagggggaucc

SEQ ID NO: 296246 - RNA, 32 nt, Human
aauugccacugcacuccagccuaagcaaauag

SEQ ID NO: 296247 - RNA, 32 nt, Human
aauugccagcaaccucugcuuguccggaaaac

SEQ ID NO: 296248 - RNA, 32 nt, Human
aauugccaguacagaaugcagagagauaaaga

SEQ ID NO: 296249 - RNA, 32 nt, Human
aauugccauugcacagaugaggaaauugaaag

SEQ ID NO: 296250 - RNA, 32 nt, Human
aauugccccugccauuuccacccuccagucau

SEQ ID NO: 296251 - RNA, 32 nt, Human
aauugcccgauugcccgugcugggcagggucc

SEQ ID NO: 296252 - RNA, 32 nt, Human
aauugcccuccagguauccucagucuuucugc

SEQ ID NO: 296253 - RNA, 32 nt, Human
aauugcccugcaggcuggagugcagcggcaug

SEQ ID NO: 296254 - RNA, 28 nt, Human
aauugcccuuuccagggucccaacaagg

SEQ ID NO: 296255 - RNA, 32 nt, Human
aauugccgggauuacaggcaugagccacugug

SEQ ID NO: 296256 - RNA, 32 nt, Human
aauugccuccuccaucucucaccuuuuccugu

SEQ ID NO: 296257 - RNA, 32 nt, Human
aauugccucuacucugagucacuaucuucccu

SEQ ID NO: 296258 - RNA, 32 nt, Human
aauugccugcucccucugcaugcucuuucuug

SEQ ID NO: 296259 - RNA, 23 nt, Human
aauugccuggucaaaucugugag

SEQ ID NO: 296260 - RNA, 32 nt, Human
aauugccuugaaggagagggagagggauccug

SEQ ID NO: 296261 - RNA, 32 nt, Human
aauugccuuugucucauauaaugcuuuucaua

SEQ ID NO: 296262 - RNA, 32 nt, Human
aauugcgcauaacuuccaucucccuuacuggc

SEQ ID NO: 296263 - RNA, 32 nt, Human
aauugcgccacugcacuccagccugagcgaca

SEQ ID NO: 296264 - RNA, 32 nt, Human
aauugcgccgcuccuggagaccugauaacuua

SEQ ID NO: 296265 - RNA, 32 nt, Human
aauugcguaucaacaguggauuugcugguugu

SEQ ID NO: 296266 - RNA, 32 nt, Human
aauugcuaaaggauuucaugacuuaguuugaa

SEQ ID NO: 296267 - RNA, 32 nt, Human
aauugcuacagagagaauaaaauaccuaggaa

SEQ ID NO: 296268 - RNA, 32 nt, Human
aauugcucaaagcugucgccgcuagucuuaug

SEQ ID NO: 296269 - RNA, 32 nt, Human
aauugcucagagaagguaaaagacugaaucua

SEQ ID NO: 296270 - RNA, 32 nt, Human
aauugcucagcccaaagggcaucugacuucac

SEQ ID NO: 296271 - RNA, 32 nt, Human
aauugcucauguuggccaaacauggugcaccg

SEQ ID NO: 296272 - RNA, 32 nt, Human
aauugcuccagccacaggcgaggccuggccaa

SEQ ID NO: 296273 - RNA, 32 nt, Human
aauugcuccuuugauggagguuagggacuguc

SEQ ID NO: 296274 - RNA, 32 nt, Human
aauugcugaagcaaguguggacaacuucagca

SEQ ID NO: 296275 - RNA, 32 nt, Human
aauugcugacaaauuuuucuguguacauguag

SEQ ID NO: 296276 - RNA, 32 nt, Human
aauugcugacuugcagaaucaugagaaaaacg

SEQ ID NO: 296277 - RNA, 32 nt, Human
aauugcugcagcucuguggcccagcccacugc

SEQ ID NO: 296278 - RNA, 24 nt, Human
aauugcugcgucuuuccacuugcu

SEQ ID NO: 296279 - RNA, 32 nt, Human
aauugcugcuaccucaccauguugcugugccc

SEQ ID NO: 296280 - RNA, 32 nt, Human
aauugcugcuacucaacagguuuucugcagaa

SEQ ID NO: 296281 - RNA, 29 nt, Human
aauugcuggcugcuuuuacuuccugacca

SEQ ID NO: 296282 - RNA, 32 nt, Human
aauugcugggauuacaggcaugagccaccaca

SEQ ID NO: 296283 - RNA, 32 nt, Human
aauugcugggauuacaggcaugagccacugca

SEQ ID NO: 296284 - RNA, 32 nt, Human
aauugcugggauuacaggcgugagccaccaca

SEQ ID NO: 296285 - RNA, 32 nt, Human
aauugcugggauuacaggcgugagccauggcg

SEQ ID NO: 296286 - RNA, 32 nt, Human
aauugcugggauuacaggcgugagucaccgug

SEQ ID NO: 296287 - RNA, 32 nt, Human
aauugcugggauuacaggugugagccaccgca

SEQ ID NO: 296288 - RNA, 32 nt, Human
aauugcugggauuacaggugugagccaccgcg

SEQ ID NO: 296289 - RNA, 32 nt, Human
aauugcugggcaaacuuugaagaccucaacuu

SEQ ID NO: 296290 - RNA, 32 nt, Human
aauugcuguccugugguacagacauuaaagug

SEQ ID NO: 296291 - RNA, 32 nt, Human
aauugcugugccaggggucucuggaucacagc

SEQ ID NO: 296292 - RNA, 32 nt, Human
aauugcuuacccacugccugcccagacuuucu

SEQ ID NO: 296293 - RNA, 32 nt, Human
aauugcuuaggaggaggaaggggaaaguauac

SEQ ID NO: 296294 - RNA, 23 nt, Human
aauugcuuccggggaguugcgag

SEQ ID NO: 296295 - RNA, 32 nt, Human
aauugcuuccugcuccuuccucuggaagcuuc

SEQ ID NO: 296296 - RNA, 32 nt, Human
aauugcuucuaagaaaaguuucauaguggacu

SEQ ID NO: 296297 - RNA, 32 nt, Human
aauugcuugaacccgggagacggagguugcag

SEQ ID NO: 296298 - RNA, 32 nt, Human
aauugcuugaacccgggaggcagcaguugcag

SEQ ID NO: 296299 - RNA, 31 nt, Human
aauugcuugaacucaggaguuggagaccagc

SEQ ID NO: 296300 - RNA, 32 nt, Human
aauugcuugaacucgggaggcagagccaagau

SEQ ID NO: 296301 - RNA, 32 nt, Human
aauugcuugaacucgggaggcggagguugcag

SEQ ID NO: 296302 - RNA, 32 nt, Human
aauugcuugaacucgggagguggagguugcag

SEQ ID NO: 296303 - RNA, 32 nt, Human
aauugcuugagccaggaagguugagguugcag

SEQ ID NO: 296304 - RNA, 21 nt, Human
aauugcuugauaaacuacgag

SEQ ID NO: 296305 - RNA, 32 nt, Human
aauugcuugucugucuacuucagcuuuguuuu

SEQ ID NO: 296306 - RNA, 32 nt, Human
aauugcuuuaaccuuggaggcggagguugcau

SEQ ID NO: 296307 - RNA, 32 nt, Human
aauugcuuucccugggagugugcaguaucuca

SEQ ID NO: 296308 - RNA, 32 nt, Human
aauugcuuuguggcugggugcagugguucaca

SEQ ID NO: 296309 - RNA, 32 nt, Human
aauuggaaagcagagguugcagugagcugaga

SEQ ID NO: 296310 - RNA, 32 nt, Human
aauuggaacucauauacugcuaguuagaaugu

SEQ ID NO: 296311 - RNA, 32 nt, Human
aauuggaagaggaggcagaagaggagcagcgc

SEQ ID NO: 296312 - RNA, 32 nt, Human
aauuggaauagaauugguaaguugcaaagacu

SEQ ID NO: 296313 - RNA, 32 nt, Human
aauuggacaauuauuuuugcucugcucuguuu

SEQ ID NO: 296314 - RNA, 32 nt, Human
aauuggacagcauaugaagauuggacaucaca

SEQ ID NO: 296315 - RNA, 32 nt, Human
aauuggaccuggaagucauagugaauuugcag

SEQ ID NO: 296316 - RNA, 32 nt, Human
aauuggacuggcaggggaaagaaugguagaga

SEQ ID NO: 296317 - RNA, 32 nt, Human
aauuggacuguaaucauaucgcuacuggcauc

SEQ ID NO: 296318 - RNA, 32 nt, Human
aauuggagacaggcaaggagccauggauauua

SEQ ID NO: 296319 - RNA, 26 nt, Human
aauuggagacuagccugggcaacaua

SEQ ID NO: 296320 - RNA, 32 nt, Human
aauuggaggugaggcgcuccugccauuuucuc

SEQ ID NO: 296321 - RNA, 32 nt, Human
aauuggagucauacuguaaacaguuuuauaag

SEQ ID NO: 296322 - RNA, 32 nt, Human
aauuggaguuggaagguugcauaggguuuccu

SEQ ID NO: 296323 - RNA, 32 nt, Human
aauuggauagcacuauaaggugccucacggug

SEQ ID NO: 296324 - RNA, 32 nt, Human
aauuggaucgaguuuuucuucugcagaaauug

SEQ ID NO: 296325 - RNA, 32 nt, Human
aauuggauuuucuuucuuuugucauugggcac

SEQ ID NO: 296326 - RNA, 32 nt, Human
aauuggcagcagaaauccaaauuuguauggua

SEQ ID NO: 296327 - RNA, 32 nt, Human
aauuggcaggauaagaaaaauaggucagauaa

SEQ ID NO: 296328 - RNA, 32 nt, Human
aauuggccagaacaaagggacuacaggggcgg

SEQ ID NO: 296329 - RNA, 32 nt, Human
aauuggccaggcaauuccuuccuucagacaug

SEQ ID NO: 296330 - RNA, 32 nt, Human
aauuggccauauugaggaucacucugaauacu

SEQ ID NO: 296331 - RNA, 32 nt, Human
aauuggccaugcaugguggcacaugccuguaa

SEQ ID NO: 296332 - RNA, 32 nt, Human
aauuggccucuucuuucccagcuccugccucc

SEQ ID NO: 296333 - RNA, 32 nt, Human
aauuggcggggugggaagucccugagugcucc

SEQ ID NO: 296334 - RNA, 32 nt, Human
aauuggcggggugggaaguccugagugcuccg

SEQ ID NO: 296335 - RNA, 32 nt, Human
aauuggcuacagaacauaauaagauccuugcc

SEQ ID NO: 296336 - RNA, 32 nt, Human
aauuggcucccaagcuucccccaccucauaug

SEQ ID NO: 296337 - RNA, 32 nt, Human
aauuggcucuuccuggccucaggcuuugggac

SEQ ID NO: 296338 - RNA, 32 nt, Human
aauuggcugggaaaacaugggaacaagagaag

SEQ ID NO: 296339 - RNA, 32 nt, Human
aauuggcuuagagugugcaguccaacccuauc

SEQ ID NO: 296340 - RNA, 32 nt, Human
aauuggcuuaugcccaggucuaggcugagaag

SEQ ID NO: 296341 - RNA, 31 nt, Human
aauuggcuuauuucuguaugccaaagugauc

SEQ ID NO: 296342 - RNA, 32 nt, Human
aauuggcuucucaguccugaaggacuauuuga

SEQ ID NO: 296343 - RNA, 32 nt, Human
aauuggcuuggagcagggucucuccuccccgg

SEQ ID NO: 296344 - RNA, 32 nt, Human
aauugggaacagugucacugggaagugaaggc

SEQ ID NO: 296345 - RNA, 32 nt, Human
aauugggaggcugaagcaggagaauugcucaa

SEQ ID NO: 296346 - RNA, 32 nt, Human
aauugggagggcggagggaggcaguguccuuc

SEQ ID NO: 296347 - RNA, 32 nt, Human
aauugggcagggccgacccagggugaagaaac

SEQ ID NO: 296348 - RNA, 32 nt, Human
aauugggcaguagguaacuggcauuccucucu

SEQ ID NO: 296349 - RNA, 32 nt, Human
aauugggcccugcugguuuguugaugaauuga

SEQ ID NO: 296350 - RNA, 32 nt, Human
aauugggcucaagugauccuccugcuucagcc

SEQ ID NO: 296351 - RNA, 32 nt, Human
aauugggcugggaccucucuccccaacugccc

SEQ ID NO: 296352 - RNA, 32 nt, Human
aauuggggaggcggagguugcagugagcugag

SEQ ID NO: 296353 - RNA, 32 nt, Human
aauuggggccacccuuaagauaccaagaaaag

SEQ ID NO: 296354 - RNA, 32 nt, Human
aauugggggaugucagugcccgggaggacaga

SEQ ID NO: 296355 - RNA, 32 nt, Human
aauugggggugaggaagaugugcgggccaggg

SEQ ID NO: 296356 - RNA, 32 nt, Human
aauuggggugaugaccccauagaccuaacugu

SEQ ID NO: 296357 - RNA, 32 nt, Human
aauugggguuaccuauaauaguacaauuugua

SEQ ID NO: 296358 - RNA, 32 nt, Human
aauugggguuaccuauaucaguacaauuugua

SEQ ID NO: 296359 - RNA, 32 nt, Human
aauuggguggugggcaugcugggcaggcuugg

SEQ ID NO: 296360 - RNA, 32 nt, Human
aauuggguuauaucuggcuucucuccagaccu

SEQ ID NO: 296361 - RNA, 32 nt, Human
aauuggguuauauuugaaauugcugauacuga

SEQ ID NO: 296362 - RNA, 32 nt, Human
aauuggguucucaacaaguggugacucagaac

SEQ ID NO: 296363 - RNA, 32 nt, Human
aauuggguuucugaaugucugugaauuucaga

SEQ ID NO: 296364 - RNA, 32 nt, Human
aauugguaaacccuuaggaagaaauuagaaaa

SEQ ID NO: 296365 - RNA, 32 nt, Human
aauugguaauugcugaagcugugugauggaug

SEQ ID NO: 296366 - RNA, 32 nt, Human
aauugguaguaaaauauagucuucaaguauac

SEQ ID NO: 296367 - RNA, 32 nt, Human
aauugguauaaauucauaauuucuaaaccaug

SEQ ID NO: 296368 - RNA, 32 nt, Human
aauuggucaugugaugcaagccagcuuacuag

SEQ ID NO: 296369 - RNA, 32 nt, Human
aauugguccauggcuacacugcaacuuccguc

SEQ ID NO: 296370 - RNA, 32 nt, Human
aauugguccuccaaggagguugucucuuccuc

SEQ ID NO: 296371 - RNA, 32 nt, Human
aauugguccuggaagggaaagaaaccacagau

SEQ ID NO: 296372 - RNA, 32 nt, Human
aauuggugggugacagagauggguggaggggc

SEQ ID NO: 296373 - RNA, 24 nt, Human
aauugguugguuuugacuucagau

SEQ ID NO: 296374 - RNA, 32 nt, Human
aauuguaaacaguuauuagcuuuuccagaagc

SEQ ID NO: 296375 - RNA, 24 nt, Human
aauuguaagaaaauaaacuucugu

SEQ ID NO: 296376 - RNA, 32 nt, Human
aauuguaagcuccucacugguauacuaucauc

SEQ ID NO: 296377 - RNA, 32 nt, Human
aauuguaaguauauuuugugaagccuguauuc

SEQ ID NO: 296378 - RNA, 32 nt, Human
aauuguaaguggauuugcaggccagggagaaa

SEQ ID NO: 296379 - RNA, 32 nt, Human
aauuguaaucccaguaauccccauauguugag

SEQ ID NO: 296380 - RNA, 32 nt, Human
aauuguaauguucauauucaauaucuuacagu

SEQ ID NO: 296381 - RNA, 32 nt, Human
aauuguacacauauggagaaaauuagcaaugc

SEQ ID NO: 296382 - RNA, 32 nt, Human
aauuguacccaugccacacaauugacucacaa

SEQ ID NO: 296383 - RNA, 32 nt, Human
aauuguacuaacuguaccuaaauagcaaagcc

SEQ ID NO: 296384 - RNA, 32 nt, Human
aauuguagaacuaggcucaucagaaucgugac

SEQ ID NO: 296385 - RNA, 32 nt, Human
aauuguagaguucauaguaaauaaaagcauua

SEQ ID NO: 296386 - RNA, 32 nt, Human
aauuguaguagggaggcuggaggacuuucuuu

SEQ ID NO: 296387 - RNA, 25 nt, Human
aauuguagucaccuuugcacuugcu

SEQ ID NO: 296388 - RNA, 32 nt, Human
aauuguauuauaugugauuuacauuucacuuu

SEQ ID NO: 296389 - RNA, 32 nt, Human
aauuguauucauccuuucaugacuguggccug

SEQ ID NO: 296390 - RNA, 32 nt, Human
aauuguauugaauucuuuuuagaucaaaguaa

SEQ ID NO: 296391 - RNA, 32 nt, Human
aauugucaugagauucugaacacuaguauuga

SEQ ID NO: 296392 - RNA, 32 nt, Human
aauugucaugauguuuacacugucugaguuaa

SEQ ID NO: 296393 - RNA, 32 nt, Human
aauugucauuuuagauuuuugacauuuguauc

SEQ ID NO: 296394 - RNA, 32 nt, Human
aauuguccaugccaccaauuccacugcuacuu

SEQ ID NO: 296395 - RNA, 32 nt, Human
aauugucccuugccguccuccugaggguaucu

SEQ ID NO: 296396 - RNA, 32 nt, Human
aauuguccucaagggguguggacugcagaugg

SEQ ID NO: 296397 - RNA, 32 nt, Human
aauuguccucaagucagccucuccagggccaa

SEQ ID NO: 296398 - RNA, 32 nt, Human
aauuguccugaguucuacaguaugugaacaau

SEQ ID NO: 296399 - RNA, 32 nt, Human
aauugucuaguuagggggcagcuggagaaaau

SEQ ID NO: 296400 - RNA, 32 nt, Human
aauugucucaggcaggaagucagucuauaucu

SEQ ID NO: 296401 - RNA, 32 nt, Human
aauugugaacauauuuccuuuauaggggcagg

SEQ ID NO: 296402 - RNA, 32 nt, Human
aauugugaacuuuccaucagacugccucccug

SEQ ID NO: 296403 - RNA, 32 nt, Human
aauugugacuuguucuccccggcuggcagcgu

SEQ ID NO: 296404 - RNA, 23 nt, Human
aauugugagaaauaaauuucugu

SEQ ID NO: 296405 - RNA, 32 nt, Human
aauugugagccaagcuucucccagggucagag

SEQ ID NO: 296406 - RNA, 32 nt, Human
aauugugccacuaguacuccagccugggugac

SEQ ID NO: 296407 - RNA, 32 nt, Human
aauugugccacugcacuccagacugggugaca

SEQ ID NO: 296408 - RNA, 32 nt, Human
aauugugccacugcacugcagccugggcgaca

SEQ ID NO: 296409 - RNA, 32 nt, Human
aauugugccacugcacuuuucagccugggugc

SEQ ID NO: 296410 - RNA, 32 nt, Human
aauugugcccaugagaugcugcaugggcaugg

SEQ ID NO: 296411 - RNA, 32 nt, Human
aauugugcuacucuccccugggugguuugcag

SEQ ID NO: 296412 - RNA, 32 nt, Human
aauugugcuauugcacuccagccugggugaca

SEQ ID NO: 296413 - RNA, 32 nt, Human
aauuguggcaagucuuaacacacagauuccuc

SEQ ID NO: 296414 - RNA, 32 nt, Human
aauuguggcugcagguguuagguguuaguugg

SEQ ID NO: 296415 - RNA, 32 nt, Human
aauugugggaagacaaaaauaugccugugaaa

SEQ ID NO: 296416 - RNA, 32 nt, Human
aauugugggagaagagaggagaggagggcuca

SEQ ID NO: 296417 - RNA, 32 nt, Human
aauugugggugaggcugucuggcauaggguga

SEQ ID NO: 296418 - RNA, 32 nt, Human
aauuguguggagaacucagugccacaccucga

SEQ ID NO: 296419 - RNA, 32 nt, Human
aauuguguuagaaauuaugacuguaaagaaau

SEQ ID NO: 296420 - RNA, 32 nt, Human
aauuguguuuugcauaaaauugccaaaacaca

SEQ ID NO: 296421 - RNA, 32 nt, Human
aauuguuaagaguuaacagguaguuggauuug

SEQ ID NO: 296422 - RNA, 32 nt, Human
aauuguuaagaucccccaccuggcagaggacc

SEQ ID NO: 296423 - RNA, 31 nt, Human
aauuguuacaaaaauaccugucagaaacccu

SEQ ID NO: 296424 - RNA, 32 nt, Human
aauuguuacauauccuauuucaugccauucuu

SEQ ID NO: 296425 - RNA, 32 nt, Human
aauuguuacccccuuuacucagagauaacaua

SEQ ID NO: 296426 - RNA, 32 nt, Human
aauuguuccugccuccuccgccaccuccgccc

SEQ ID NO: 296427 - RNA, 32 nt, Human
aauuguuccugccuuuagcuuuucagaacuug

SEQ ID NO: 296428 - RNA, 32 nt, Human
aauuguugaacccgggaggcggagguugcagu

SEQ ID NO: 296429 - RNA, 32 nt, Human
aauuguugccuuucuugaaguguucucugccu

SEQ ID NO: 296430 - RNA, 32 nt, Human
aauuguugggauuacaggugugagacagugca

SEQ ID NO: 296431 - RNA, 32 nt, Human
aauuguuggggccccucuaccucucucagggc

SEQ ID NO: 296432 - RNA, 32 nt, Human
aauuguugugugugcacauaugcauauauuuu

SEQ ID NO: 296433 - RNA, 32 nt, Human
aauuguuuaagcugcaucaauggagcacauac

SEQ ID NO: 296434 - RNA, 32 nt, Human
aauuguuuauucaaccaucagguuccaggaaa

SEQ ID NO: 296435 - RNA, 32 nt, Human
aauuguuucuauaauggauuuucacauggaac

SEQ ID NO: 296436 - RNA, 32 nt, Human
aauuguuucugaguuauggguugaauuuauuu

SEQ ID NO: 296437 - RNA, 32 nt, Human
aauuguuuggucucugguuuucauccuuagag

SEQ ID NO: 296438 - RNA, 32 nt, Human
aauuguuuuccagacuuguguuagaguuauug

SEQ ID NO: 296439 - RNA, 32 nt, Human
aauuguuuuucuggacuuccaaaucucaagug

SEQ ID NO: 296440 - RNA, 32 nt, Human
aauuuaaaaagcuuucucuuuaaguugcuaca

SEQ ID NO: 296441 - RNA, 32 nt, Human
aauuuaaaaguacacuucacuucaacuugaau

SEQ ID NO: 296442 - RNA, 32 nt, Human
aauuuaaaaugcuagggaacaggcuuacaaca

SEQ ID NO: 296443 - RNA, 32 nt, Human
aauuuaaaauggcacagccacucuggaaagca

SEQ ID NO: 296444 - RNA, 32 nt, Human
aauuuaaaauuagcugggcaugguggugcaaa

SEQ ID NO: 296445 - RNA, 32 nt, Human
aauuuaaagauguggaccaaggccugugggua

SEQ ID NO: 296446 - RNA, 32 nt, Human
aauuuaaagcagacuucuaagacagaggaaau

SEQ ID NO: 296447 - RNA, 32 nt, Human
aauuuaaaggcuguguggacuuggggauggaa

SEQ ID NO: 296448 - RNA, 32 nt, Human
aauuuaaaguuuucagagauuguuaaaacugg

SEQ ID NO: 296449 - RNA, 32 nt, Human
aauuuaaauacugugcuuacugugaaauauau

SEQ ID NO: 296450 - RNA, 32 nt, Human
aauuuaacaaaccugcacaugugcucuugaau

SEQ ID NO: 296451 - RNA, 32 nt, Human
aauuuaacaccacuugauccuggguaguagcu

SEQ ID NO: 296452 - RNA, 32 nt, Human
aauuuaacacccuuuagaaccuuaaagaacca

SEQ ID NO: 296453 - RNA, 32 nt, Human
aauuuaacauacaaaugagggaccaggaguag

SEQ ID NO: 296454 - RNA, 32 nt, Human
aauuuaacauuagccuccaccaaaaagccguc

SEQ ID NO: 296455 - RNA, 32 nt, Human
aauuuaacccagcuaugggaugccagauaaca

SEQ ID NO: 296456 - RNA, 32 nt, Human
aauuuaagaaaaucuucaucuauuucauaucu

SEQ ID NO: 296457 - RNA, 32 nt, Human
aauuuaagaagauuccucugaaccaggaagaa

SEQ ID NO: 296458 - RNA, 32 nt, Human
aauuuaagccaagaacaggacaggcaauguga

SEQ ID NO: 296459 - RNA, 32 nt, Human
aauuuaagcugcaauauuugugacugaauagg

SEQ ID NO: 296460 - RNA, 32 nt, Human
aauuuaaguucagggccuaggaaggggagcau

SEQ ID NO: 296461 - RNA, 32 nt, Human
aauuuaauaaaugauccauauaaaaauagaga

SEQ ID NO: 296462 - RNA, 32 nt, Human
aauuuaauccguaagcccauggauccauaaug

SEQ ID NO: 296463 - RNA, 32 nt, Human
aauuuaaugaaggauguaaaauaggauucauu

SEQ ID NO: 296464 - RNA, 32 nt, Human
aauuuaaugauguguucaacuccaccagaaau

SEQ ID NO: 296465 - RNA, 32 nt, Human
aauuuaaugauuauuccuauucuuuauaauuu

SEQ ID NO: 296466 - RNA, 32 nt, Human
aauuuaauggagcauguacuuauuugcauuug

SEQ ID NO: 296467 - RNA, 32 nt, Human
aauuuaauguggauuuccuccuuccuuccaag

SEQ ID NO: 296468 - RNA, 32 nt, Human
aauuuaauugaauucaucuaaagaugucucug

SEQ ID NO: 296469 - RNA, 32 nt, Human
aauuuaauuguagaagucacugccuucugagu

SEQ ID NO: 296470 - RNA, 32 nt, Human
aauuuacaaauacagauugaauaggaccuacu

SEQ ID NO: 296471 - RNA, 32 nt, Human
aauuuacaacagcaaccacacugccugucauu

SEQ ID NO: 296472 - RNA, 32 nt, Human
aauuuacaagauaccaggaaacccaucuguug

SEQ ID NO: 296473 - RNA, 32 nt, Human
aauuuacaauagccacaaagaaaaugaaauac

SEQ ID NO: 296474 - RNA, 32 nt, Human
aauuuacagagaaaucacagacuuuugcuaca

SEQ ID NO: 296475 - RNA, 32 nt, Human
aauuuacagugauagaacaaaagaggauuagu

SEQ ID NO: 296476 - RNA, 32 nt, Human
aauuuacauauguucacgcaaaauaugcuuag

SEQ ID NO: 296477 - RNA, 32 nt, Human
aauuuaccagaacaguuuagccuggggguuaa

SEQ ID NO: 296478 - RNA, 32 nt, Human
aauuuaccuuacugcugacagcaaccauguuc

SEQ ID NO: 296479 - RNA, 32 nt, Human
aauuuacuaagcuuaacuacaugucacacauu

SEQ ID NO: 296480 - RNA, 32 nt, Human
aauuuacucccaggaauguugggauugagagu

SEQ ID NO: 296481 - RNA, 32 nt, Human
aauuuacugaguagcugcaacaugccagccuc

SEQ ID NO: 296482 - RNA, 32 nt, Human
aauuuacuguaacuucuuaaucuaagaaaauu

SEQ ID NO: 296483 - RNA, 32 nt, Human
aauuuacugugccaggaaaucuuccugaacuc

SEQ ID NO: 296484 - RNA, 32 nt, Human
aauuuacuuugcugcugacagccaccaugcuc

SEQ ID NO: 296485 - RNA, 32 nt, Human
aauuuagaaauggcaugcaucacacauuuauu

SEQ ID NO: 296486 - RNA, 32 nt, Human
aauuuagaacagcauuguccucugaguugguu

SEQ ID NO: 296487 - RNA, 32 nt, Human
aauuuagaagaccaaguagauaauggaaccaa

SEQ ID NO: 296488 - RNA, 32 nt, Human
aauuuagacaauacaucaccuguaguucaaau

SEQ ID NO: 296489 - RNA, 32 nt, Human
aauuuagagagcagaaacugaagaacuguaug

SEQ ID NO: 296490 - RNA, 32 nt, Human
aauuuagaguccauuuuguggcugacuauucu

SEQ ID NO: 296491 - RNA, 32 nt, Human
aauuuagcaaaauuauguaaacuugauccuga

SEQ ID NO: 296492 - RNA, 32 nt, Human
aauuuagcaaagaaauauguagaugaauauuu

SEQ ID NO: 296493 - RNA, 32 nt, Human
aauuuagcacagaacuagaugaguugcacuuu

SEQ ID NO: 296494 - RNA, 32 nt, Human
aauuuagccagcagugcccugcccugcccugc

SEQ ID NO: 296495 - RNA, 32 nt, Human
aauuuaggguagagauuccugccccucuuuug

SEQ ID NO: 296496 - RNA, 32 nt, Human
aauuuagguauucuauaguugcuuagaauuuu

SEQ ID NO: 296497 - RNA, 32 nt, Human
aauuuaggugagugaauauaugaaacacuuca

SEQ ID NO: 296498 - RNA, 32 nt, Human
aauuuaggugagugcuuugaggacaugaagcu

SEQ ID NO: 296499 - RNA, 32 nt, Human
aauuuaguaagcugcauucuauaagccaucag

SEQ ID NO: 296500 - RNA, 32 nt, Human
aauuuaguagagacaggagagaggaugaaacu

SEQ ID NO: 296501 - RNA, 32 nt, Human
aauuuagugaaacagcucuuuccauucuuaac

SEQ ID NO: 296502 - RNA, 32 nt, Human
aauuuaguuucucuacaugucauuucggucuc

SEQ ID NO: 296503 - RNA, 32 nt, Human
aauuuauaaagaaccugccuuccuuccuucau

SEQ ID NO: 296504 - RNA, 32 nt, Human
aauuuauaaauacuuuaucauccauuugcuuu

SEQ ID NO: 296505 - RNA, 31 nt, Human
aauuuauaagugucccauggggcagacacuc

SEQ ID NO: 296506 - RNA, 32 nt, Human
aauuuauaggaaccuuguccucugguauagua

SEQ ID NO: 296507 - RNA, 32 nt, Human
aauuuauagugaagcaaaucaucuuuaauaau

SEQ ID NO: 296508 - RNA, 32 nt, Human
aauuuauagugcuauuugguuucuccaugauu

SEQ ID NO: 296509 - RNA, 32 nt, Human
aauuuauauuggagaaaagcacuguaaaugua

SEQ ID NO: 296510 - RNA, 32 nt, Human
aauuuauauuggaugagaguggucaagaaaua

SEQ ID NO: 296511 - RNA, 32 nt, Human
aauuuaucaauacuuaugaaauuaggcugggc

SEQ ID NO: 296512 - RNA, 32 nt, Human
aauuuaucacauagauugggaaggcaagcuaa

SEQ ID NO: 296513 - RNA, 32 nt, Human
aauuuaucauacaacagaaaauggccaauuaa

SEQ ID NO: 296514 - RNA, 32 nt, Human
aauuuaucggcucacuucauucguacaguuuc

SEQ ID NO: 296515 - RNA, 32 nt, Human
aauuuaucuuucauuuuaaacuccugaaauuc

SEQ ID NO: 296516 - RNA, 32 nt, Human
aauuuaugaggcucuucacugcagagaacggc

SEQ ID NO: 296517 - RNA, 32 nt, Human
aauuuaugcucacaccuuacugcacagaaaag

SEQ ID NO: 296518 - RNA, 32 nt, Human
aauuuauggccguaucaaaugguagcugaaaa

SEQ ID NO: 296519 - RNA, 32 nt, Human
aauuuaugggcagaccgagaaaaugcugcugu

SEQ ID NO: 296520 - RNA, 32 nt, Human
aauuuauggucuucuguuuugaagcucauggg

SEQ ID NO: 296521 - RNA, 32 nt, Human
aauuuauguaguucuauguuuauagauguguu

SEQ ID NO: 296522 - RNA, 32 nt, Human
aauuuauguauuaguuuuugcauauguaguac

SEQ ID NO: 296523 - RNA, 32 nt, Human
aauuuauguccaucaaaaguggagauugcuuu

SEQ ID NO: 296524 - RNA, 32 nt, Human
aauuuaugugcacacucacacaugcacacaca

SEQ ID NO: 296525 - RNA, 32 nt, Human
aauuuaugugguuccugcuugaaaaccuuccc

SEQ ID NO: 296526 - RNA, 32 nt, Human
aauuuauguucugcaauauccugcagcucauc

SEQ ID NO: 296527 - RNA, 32 nt, Human
aauuuauguucuucugccuuggcuccagcugg

SEQ ID NO: 296528 - RNA, 32 nt, Human
aauuuauucagagcuaggaaugugguuuauaa

SEQ ID NO: 296529 - RNA, 32 nt, Human
aauuuauucaguuucauuaggacuauuuuuau

SEQ ID NO: 296530 - RNA, 32 nt, Human
aauuuauucucaauaauaaagacuucaugaug

SEQ ID NO: 296531 - RNA, 32 nt, Human
aauuuauucucucacaccauggaggcccaaag

SEQ ID NO: 296532 - RNA, 32 nt, Human
aauuuauugaggaaaaauaugugaaggaccuu

SEQ ID NO: 296533 - RNA, 32 nt, Human
aauuuauugcuauauugugauacgugaggggu

SEQ ID NO: 296534 - RNA, 32 nt, Human
aauuuauuuaaugaaaugucauggcucuguuc

SEQ ID NO: 296535 - RNA, 32 nt, Human
aauuuauuuguuguuuucuguggguugcgacc

SEQ ID NO: 296536 - RNA, 32 nt, Human
aauuuauuuucacugucacacgcauagaucca

SEQ ID NO: 296537 - RNA, 32 nt, Human
aauuuauuuuuagcagagaugggguuucacug

SEQ ID NO: 296538 - RNA, 32 nt, Human
aauuucaaacucaacaagauuucagaaaggua

SEQ ID NO: 296539 - RNA, 32 nt, Human
aauuucaaagagaacuuauacagaaugguuuu

SEQ ID NO: 296540 - RNA, 32 nt, Human
aauuucaaaucuaggcagccaccaccacaaau

SEQ ID NO: 296541 - RNA, 32 nt, Human
aauuucaaguaaaaugaauuuccuuccaagua

SEQ ID NO: 296542 - RNA, 32 nt, Human
aauuucaauagggcugagauguuuuggagcau

SEQ ID NO: 296543 - RNA, 32 nt, Human
aauuucaauuagcuucugcuucccuuuucuaa

SEQ ID NO: 296544 - RNA, 32 nt, Human
aauuucacacuggcauuaacaggucuagcaua

SEQ ID NO: 296545 - RNA, 24 nt, Human
aauuucacauguaguagcuucuga

SEQ ID NO: 296546 - RNA, 32 nt, Human
aauuucaccagaaacaacuugcuuccaauaua

SEQ ID NO: 296547 - RNA, 32 nt, Human
aauuucacccccaccccacccuccaggguuag

SEQ ID NO: 296548 - RNA, 21 nt, Human
aauuucaccuugaaaaagcac

SEQ ID NO: 296549 - RNA, 32 nt, Human
aauuucaccuuguaaggaggaagugaaugaaa

SEQ ID NO: 296550 - RNA, 32 nt, Human
aauuucacuacugaaguggauuucucugucca

SEQ ID NO: 296551 - RNA, 32 nt, Human
aauuucagaaauucauuauuuucucucacucu

SEQ ID NO: 296552 - RNA, 32 nt, Human
aauuucagacaggcaauaguggggaggucauu

SEQ ID NO: 296553 - RNA, 32 nt, Human
aauuucagacuguacaacacagaaccaaauga

SEQ ID NO: 296554 - RNA, 32 nt, Human
aauuucagagcacuuuuccuugcaugaguaau

SEQ ID NO: 296555 - RNA, 32 nt, Human
aauuucagaguuucuccagaccuccaaucugg

SEQ ID NO: 296556 - RNA, 32 nt, Human
aauuucagcauaucucuggcucagggagagug

SEQ ID NO: 296557 - RNA, 32 nt, Human
aauuucagccaagaaguuagaagagauguuua

SEQ ID NO: 296558 - RNA, 32 nt, Human
aauuucagcucacugaaccucugccucccagg

SEQ ID NO: 296559 - RNA, 32 nt, Human
aauuucagcucacugcaaucucugccacccag

SEQ ID NO: 296560 - RNA, 32 nt, Human
aauuucaggauuaacuaaagaagaggagaaaa

SEQ ID NO: 296561 - RNA, 32 nt, Human
aauuucaggcccuuccuuaggccagguacuuc

SEQ ID NO: 296562 - RNA, 32 nt, Human
aauuucagggagcauagcaucgggaggaugcu

SEQ ID NO: 296563 - RNA, 32 nt, Human
aauuucagggcucuuggcuguuggacacagaa

SEQ ID NO: 296564 - RNA, 32 nt, Human
aauuucaggggagucaaaaaccuugcaacuuc

SEQ ID NO: 296565 - RNA, 32 nt, Human
aauuucagggugcagcccaaucugccagacuu

SEQ ID NO: 296566 - RNA, 32 nt, Human
aauuucaggguuaggguuuaaagaaaggagaa

SEQ ID NO: 296567 - RNA, 32 nt, Human
aauuucagguggacacccaccaugcuaaauag

SEQ ID NO: 296568 - RNA, 32 nt, Human
aauuucaguacuaagguggugaugccauuuug

SEQ ID NO: 296569 - RNA, 32 nt, Human
aauuucagucggggagaugagaggaggcauga

SEQ ID NO: 296570 - RNA, 32 nt, Human
aauuucauacagaauuuguuacauuccaauua

SEQ ID NO: 296571 - RNA, 32 nt, Human
aauuucaucaaauucauucagugauuuuuauu

SEQ ID NO: 296572 - RNA, 21 nt, Human
aauuucauccuggcucacaga

SEQ ID NO: 296573 - RNA, 32 nt, Human
aauuucaucuuaaaauguugcugauuauauua

SEQ ID NO: 296574 - RNA, 32 nt, Human
aauuucaugcaaacacauuuagggugaauuca

SEQ ID NO: 296575 - RNA, 32 nt, Human
aauuucaugcuggcaugagaagauauccuuug

SEQ ID NO: 296576 - RNA, 32 nt, Human
aauuucauuggugaggauuuccuuugaauauu

SEQ ID NO: 296577 - RNA, 32 nt, Human
aauuucauuuguuuacaaaguagauuaugccu

SEQ ID NO: 296578 - RNA, 32 nt, Human
aauuuccaacuucucccuaucuucaacucugc

SEQ ID NO: 296579 - RNA, 32 nt, Human
aauuuccaccuacuuuccaaucuauguuccaa

SEQ ID NO: 296580 - RNA, 32 nt, Human
aauuuccagacagagaccagaaggaagguuua

SEQ ID NO: 296581 - RNA, 32 nt, Human
aauuuccaggagaccauggaagcaaugcacau

SEQ ID NO: 296582 - RNA, 32 nt, Human
aauuuccaguggagggcauccacaccuccauu

SEQ ID NO: 296583 - RNA, 32 nt, Human
aauuuccaguguccuaagagccucucaugaag

SEQ ID NO: 296584 - RNA, 32 nt, Human
aauuuccauagaucugcaguccugccucugcc

SEQ ID NO: 296585 - RNA, 32 nt, Human
aauuuccauauggugaaccauccuuacauucc

SEQ ID NO: 296586 - RNA, 32 nt, Human
aauuuccaugaagaaccaagucagggcagcau

SEQ ID NO: 296587 - RNA, 26 nt, Human
aauuuccauuuuguaaaagcuucuga

SEQ ID NO: 296588 - RNA, 32 nt, Human
aauuucccagcuauagaaaucucucuauuuuu

SEQ ID NO: 296589 - RNA, 32 nt, Human
aauuuccccugccaugugugcugauccugcug

SEQ ID NO: 296590 - RNA, 32 nt, Human
aauuucccggcaccuggaggccgcgcuuagaa

SEQ ID NO: 296591 - RNA, 32 nt, Human
aauuucccuccaccacccccucaaauccaguc

SEQ ID NO: 296592 - RNA, 32 nt, Human
aauuucccugcuccuuccuuuaagaccaucug

SEQ ID NO: 296593 - RNA, 32 nt, Human
aauuuccucaagccagaaggcuuuaucauuca

SEQ ID NO: 296594 - RNA, 32 nt, Human
aauuuccugacaacgaaagugaagaguaucac

SEQ ID NO: 296595 - RNA, 32 nt, Human
aauuuccugccaccccaacaguauuuuugugu

SEQ ID NO: 296596 - RNA, 32 nt, Human
aauuuccugggcaagaguguaugcauacaaag

SEQ ID NO: 296597 - RNA, 32 nt, Human
aauuuccugggugauggcagcagauucuucca

SEQ ID NO: 296598 - RNA, 32 nt, Human
aauuuccugguucugcucacguaucauguuug

SEQ ID NO: 296599 - RNA, 32 nt, Human
aauuuccuguacacuugcuaugugcuggggac

SEQ ID NO: 296600 - RNA, 32 nt, Human
aauuuccuuccauagacagcugccucaaaggg

SEQ ID NO: 296601 - RNA, 32 nt, Human
aauuuccuugggauagagguuguguuggggaa

SEQ ID NO: 296602 - RNA, 32 nt, Human
aauuuccuuucauucaauuccaccuccuuccu

SEQ ID NO: 296603 - RNA, 32 nt, Human
aauuucgauuuucaaacgcaacuccuacagga

SEQ ID NO: 296604 - RNA, 32 nt, Human
aauuucgcugaaggcugaggcaggaguggaga

SEQ ID NO: 296605 - RNA, 32 nt, Human
aauuucgggaggcugaggcaggagaacggcgu

SEQ ID NO: 296606 - RNA, 32 nt, Human
aauuucgguuuccucugagguugaaggaccca

SEQ ID NO: 296607 - RNA, 32 nt, Human
aauuucgguuuguaucuuccauauaauaacca

SEQ ID NO: 296608 - RNA, 32 nt, Human
aauuucuaccuuccuguuucucugaaucagcc

SEQ ID NO: 296609 - RNA, 32 nt, Human
aauuucuacuaaaauguccaaguagaauguuu

SEQ ID NO: 296610 - RNA, 24 nt, Human
aauuucuacugcacuuacauucaa

SEQ ID NO: 296611 - RNA, 32 nt, Human
aauuucuacuuucauagagucauagaauuuua

SEQ ID NO: 296612 - RNA, 32 nt, Human
aauuucuaguuuucacucaugguuaacacgca

SEQ ID NO: 296613 - RNA, 32 nt, Human
aauuucucaagguuauagguugggguucuuag

SEQ ID NO: 296614 - RNA, 32 nt, Human
aauuucucacacaccaguuuaucuuccagcuu

SEQ ID NO: 296615 - RNA, 32 nt, Human
aauuucucaccuauuuugugugugugacuuga

SEQ ID NO: 296616 - RNA, 32 nt, Human
aauuucucaggcauaaauaccuaauggccuug

SEQ ID NO: 296617 - RNA, 32 nt, Human
aauuucucauacuuagaaacaaaaagagcuuu

SEQ ID NO: 296618 - RNA, 32 nt, Human
aauuucucaucacagggauuuagacuuacuau

SEQ ID NO: 296619 - RNA, 32 nt, Human
aauuucucaucuucugccucccuuccuacucc

SEQ ID NO: 296620 - RNA, 32 nt, Human
aauuucuccccagaaaauggguuuuucuuuuc

SEQ ID NO: 296621 - RNA, 32 nt, Human
aauuucucccugcaagcgcucagucucauccc

SEQ ID NO: 296622 - RNA, 32 nt, Human
aauuucuccguaauuuccacugcuugaaggcu

SEQ ID NO: 296623 - RNA, 32 nt, Human
aauuucucucuagcccauuauaaccugcuauc

SEQ ID NO: 296624 - RNA, 32 nt, Human
aauuucucuuuacuucucuccaccuucuccau

SEQ ID NO: 296625 - RNA, 32 nt, Human
aauuucugaagugaaucauuuagauaaugaca

SEQ ID NO: 296626 - RNA, 32 nt, Human
aauuucugaggacgagcucacaucuggaagaa

SEQ ID NO: 296627 - RNA, 32 nt, Human
aauuucugagucuuucuuugcucugcuggaaa

SEQ ID NO: 296628 - RNA, 32 nt, Human
aauuucugaugcacagacacugugggagauaa

SEQ ID NO: 296629 - RNA, 32 nt, Human
aauuucugaugcuccagccacgaaaucuaugg

SEQ ID NO: 296630 - RNA, 32 nt, Human
aauuucugcacuuugggagacugaggugggug

SEQ ID NO: 296631 - RNA, 32 nt, Human
aauuucuggauugggaaauggaggcaaauucu

SEQ ID NO: 296632 - RNA, 32 nt, Human
aauuucugguccugucuguucuuauugauguc

SEQ ID NO: 296633 - RNA, 32 nt, Human
aauuucuguacaaauaucuaaauaagagaugu

SEQ ID NO: 296634 - RNA, 32 nt, Human
aauuucuguaucugcugaauuauuaaugccac

SEQ ID NO: 296635 - RNA, 32 nt, Human
aauuucugugauggcagagaaaaugcucaucu

SEQ ID NO: 296636 - RNA, 32 nt, Human
aauuucuguucuguuccuguagaacgcucucu

SEQ ID NO: 296637 - RNA, 32 nt, Human
aauuucuguuuacauguccuugcuacuuuuaa

SEQ ID NO: 296638 - RNA, 32 nt, Human
aauuucuuaaggcugaaggaaugaagagagug

SEQ ID NO: 296639 - RNA, 32 nt, Human
aauuucuuaaggcugaaggaauggagagagug

SEQ ID NO: 296640 - RNA, 32 nt, Human
aauuucuuauacugcugcccaccaaagcagcu

SEQ ID NO: 296641 - RNA, 32 nt, Human
aauuucuucacucaaucucugauucugucaau

SEQ ID NO: 296642 - RNA, 32 nt, Human
aauuucuuccuccaaauauccuaaaucaccuc

SEQ ID NO: 296643 - RNA, 32 nt, Human
aauuucuuccugauuggugccauugcauacuu

SEQ ID NO: 296644 - RNA, 32 nt, Human
aauuucuucuucuuuuccuuuuggcaaagcag

SEQ ID NO: 296645 - RNA, 32 nt, Human
aauuucuugcagaaucagcuacacuuaauuau

SEQ ID NO: 296646 - RNA, 32 nt, Human
aauuucuugccuguaacccuagcacuuuggga

SEQ ID NO: 296647 - RNA, 32 nt, Human
aauuucuuuuacuccacgaggcugcuuggaga

SEQ ID NO: 296648 - RNA, 32 nt, Human
aauuucuuuuagcuccccaucuggcugugaaa

SEQ ID NO: 296649 - RNA, 32 nt, Human
aauuugaaaauguaaguaauuauacuaagacc

SEQ ID NO: 296650 - RNA, 32 nt, Human
aauuugaaacauccuaugaauuugaaaguuuc

SEQ ID NO: 296651 - RNA, 32 nt, Human
aauuugaaaccugaaaugccucuuuagcaaag

SEQ ID NO: 296652 - RNA, 32 nt, Human
aauuugaaagaaaaaugcauccuaaccauucc

SEQ ID NO: 296653 - RNA, 32 nt, Human
aauuugaaagaagaaaaccagauggaacaacg

SEQ ID NO: 296654 - RNA, 32 nt, Human
aauuugaaagaagaaaaccagauggaacaaga

SEQ ID NO: 296655 - RNA, 32 nt, Human
aauuugaaagaauguuuucugcaggaaaacca

SEQ ID NO: 296656 - RNA, 32 nt, Human
aauuugaaagaugcuuguaaugugaguuuugg

SEQ ID NO: 296657 - RNA, 32 nt, Human
aauuugaaaggaugugaaucauggauggaagg

SEQ ID NO: 296658 - RNA, 32 nt, Human
aauuugaaauuagccaggcaugguggugcgag

SEQ ID NO: 296659 - RNA, 32 nt, Human
aauuugaacagcucaccacugugccuacauuu

SEQ ID NO: 296660 - RNA, 32 nt, Human
aauuugaauuggcagcuuucuuugcuaaaucu

SEQ ID NO: 296661 - RNA, 32 nt, Human
aauuugacccuuguaaaugacuuagucauuua

SEQ ID NO: 296662 - RNA, 32 nt, Human
aauuugagaccagcaugggaaacagagcaaga

SEQ ID NO: 296663 - RNA, 32 nt, Human
aauuugagaccagccuggccaacagacgggag

SEQ ID NO: 296664 - RNA, 32 nt, Human
aauuugagacuaccuuuauauucuccaacaca

SEQ ID NO: 296665 - RNA, 32 nt, Human
aauuugagccugcugauuuugaugacaacuca

SEQ ID NO: 296666 - RNA, 32 nt, Human
aauuugauaaacauuccuguugaugggaaaag

SEQ ID NO: 296667 - RNA, 32 nt, Human
aauuugaugggaaaauaguacacacauauaua

SEQ ID NO: 296668 - RNA, 32 nt, Human
aauuugauguaacugucugauuguacuagaga

SEQ ID NO: 296669 - RNA, 32 nt, Human
aauuugcacaucccaaguugcuaugugaauag

SEQ ID NO: 296670 - RNA, 32 nt, Human
aauuugcacaugcucaaugcuuacauugugcg

SEQ ID NO: 296671 - RNA, 32 nt, Human
aauuugcaggagaagccaggagucaucuguga

SEQ ID NO: 296672 - RNA, 32 nt, Human
aauuugcauccagcagcagcacuuagaccugc

SEQ ID NO: 296673 - RNA, 32 nt, Human
aauuugccauuuggacaguuaacauccaggug

SEQ ID NO: 296674 - RNA, 32 nt, Human
aauuugccauuuucaaaccuaugucucauacc

SEQ ID NO: 296675 - RNA, 32 nt, Human
aauuugcccugggaaaccccuucucugugacc

SEQ ID NO: 296676 - RNA, 32 nt, Human
aauuugcgccacugcauucuagccugagugac

SEQ ID NO: 296677 - RNA, 32 nt, Human
aauuugcuagaguucccugaccugcaaucccu

SEQ ID NO: 296678 - RNA, 32 nt, Human
aauuugcucaugugaaacuucugcuaacguug

SEQ ID NO: 296679 - RNA, 32 nt, Human
aauuugcuguucucaaccauucuuucaaggcu

SEQ ID NO: 296680 - RNA, 32 nt, Human
aauuugcuugaaugggaaaacucucucauuug

SEQ ID NO: 296681 - RNA, 32 nt, Human
aauuuggaagcaccccuggagcaaagaggcua

SEQ ID NO: 296682 - RNA, 32 nt, Human
aauuuggaagccucuuucugaaaucauuagcu

SEQ ID NO: 296683 - RNA, 32 nt, Human
aauuuggaauuugaagaagaagaagagggugg

SEQ ID NO: 296684 - RNA, 32 nt, Human
aauuuggacaaggcuuaauuuaggcauuuccc

SEQ ID NO: 296685 - RNA, 32 nt, Human
aauuuggacccagguugccugcucuuguugug

SEQ ID NO: 296686 - RNA, 32 nt, Human
aauuuggagaagugauugaacuuuucaagaca

SEQ ID NO: 296687 - RNA, 32 nt, Human
aauuuggagagggaaugcugagcagauagccc

SEQ ID NO: 296688 - RNA, 32 nt, Human
aauuuggaggcgagcggggagguggaggaagc

SEQ ID NO: 296689 - RNA, 32 nt, Human
aauuuggaggcugaggugggaggaucauuuga

SEQ ID NO: 296690 - RNA, 32 nt, Human
aauuuggaggcuggaguaaucagauuacugcu

SEQ ID NO: 296691 - RNA, 32 nt, Human
aauuuggaggcugggugcuguggcucacgccu

SEQ ID NO: 296692 - RNA, 32 nt, Human
aauuuggauacagacauagacacacacugagg

SEQ ID NO: 296693 - RNA, 32 nt, Human
aauuuggauuuggaaggcuuacauugugguug

SEQ ID NO: 296694 - RNA, 31 nt, Human
aauuuggcaauguuaaugcuuuuaagauuug

SEQ ID NO: 296695 - RNA, 32 nt, Human
aauuuggcacaaaaucaacuguauuaguccau

SEQ ID NO: 296696 - RNA, 32 nt, Human
aauuuggcacgaggcuuugcaguggaugcccu

SEQ ID NO: 296697 - RNA, 32 nt, Human
aauuuggccacuaacaucucccauggaauugu

SEQ ID NO: 296698 - RNA, 31 nt, Human
aauuuggcuacagccgcuaggaggggaucgg

SEQ ID NO: 296699 - RNA, 32 nt, Human
aauuuggcucacaucccucucauuccaucccu

SEQ ID NO: 296700 - RNA, 32 nt, Human
aauuuggcuucagaaugggaagagauagucaa

SEQ ID NO: 296701 - RNA, 32 nt, Human
aauuugggagaaaccugguugucugcaggaga

SEQ ID NO: 296702 - RNA, 32 nt, Human
aauuugggagccagcaagaguccugacagcag

SEQ ID NO: 296703 - RNA, 32 nt, Human
aauuugggaggcaaaggugggagaaucgcgug

SEQ ID NO: 296704 - RNA, 32 nt, Human
aauuugggaggcagaggugagagaaucgcuug

SEQ ID NO: 296705 - RNA, 32 nt, Human
aauuugggaggcugagacaggaggauugccug

SEQ ID NO: 296706 - RNA, 32 nt, Human
aauuugggauuggacuuugaagacggauuacu

SEQ ID NO: 296707 - RNA, 32 nt, Human
aauuuggggaacagaccuccacugugauucca

SEQ ID NO: 296708 - RNA, 32 nt, Human
aauuuggggguguacuguccugccugugcauc

SEQ ID NO: 296709 - RNA, 32 nt, Human
aauuugggguucuaaauauacaacuuguaaga

SEQ ID NO: 296710 - RNA, 32 nt, Human
aauuuggguaccauuuuaucacuguucaaagc

SEQ ID NO: 296711 - RNA, 32 nt, Human
aauuuggguuuuuaacuuuacagggucaguuc

SEQ ID NO: 296712 - RNA, 32 nt, Human
aauuuggucuaaggaauaaauagcuuuuacac

SEQ ID NO: 296713 - RNA, 32 nt, Human
aauuuggucucgggguagggggagacggggug

SEQ ID NO: 296714 - RNA, 32 nt, Human
aauuugguggguaggggaccagugaguuggga

SEQ ID NO: 296715 - RNA, 32 nt, Human
aauuugguucauguguggcaaaguucuuagcu

SEQ ID NO: 296716 - RNA, 32 nt, Human
aauuugguugugacaguggcguggggagaggg

SEQ ID NO: 296717 - RNA, 32 nt, Human
aauuuguaaacccauucagauaaauggcagua

SEQ ID NO: 296718 - RNA, 32 nt, Human
aauuuguacuacuucagccaaucugugaaugu

SEQ ID NO: 296719 - RNA, 32 nt, Human
aauuuguagagauugacuuccuaagcuacuua

SEQ ID NO: 296720 - RNA, 32 nt, Human
aauuuguaguaaaccaggccucccaggauggc

SEQ ID NO: 296721 - RNA, 32 nt, Human
aauuuguagugacugauaacagcaggaauugg

SEQ ID NO: 296722 - RNA, 32 nt, Human
aauuuguaucagaaaaacauuacaaauuuacu

SEQ ID NO: 296723 - RNA, 32 nt, Human
aauuuguauuccugaaaaugucauauauuuuc

SEQ ID NO: 296724 - RNA, 32 nt, Human
aauuuguauuucccugguuuccagucauauug

SEQ ID NO: 296725 - RNA, 32 nt, Human
aauuuguauuuuuaguagagacaggguuucac

SEQ ID NO: 296726 - RNA, 32 nt, Human
aauuuguccaauaacaggucaacuucagagac

SEQ ID NO: 296727 - RNA, 32 nt, Human
aauuugucuccauuuucaccaucaagcacaaa

SEQ ID NO: 296728 - RNA, 32 nt, Human
aauuugugaacagcagaauugaccgacagcuu

SEQ ID NO: 296729 - RNA, 32 nt, Human
aauuugugacaucuggcaagauuucccuuuau

SEQ ID NO: 296730 - RNA, 32 nt, Human
aauuugugaucugauccacauacaagcacagu

SEQ ID NO: 296731 - RNA, 32 nt, Human
aauuuguggcacuaugacagcuauuuuuauga

SEQ ID NO: 296732 - RNA, 32 nt, Human
aauuuguggcugcuccagcuacugggcauuuu

SEQ ID NO: 296733 - RNA, 32 nt, Human
aauuuguggcuggucugaagguagugaguuag

SEQ ID NO: 296734 - RNA, 32 nt, Human
aauuuguguaacuguugaaucuggaaauugau

SEQ ID NO: 296735 - RNA, 32 nt, Human
aauuuguguuugagaugggguggaaauuggaa

SEQ ID NO: 296736 - RNA, 32 nt, Human
aauuuguucucaggcugugcugugagggccgc

SEQ ID NO: 296737 - RNA, 32 nt, Human
aauuuguucugcacaggugacccggccuguac

SEQ ID NO: 296738 - RNA, 32 nt, Human
aauuuguucuuacacacaucucucugguucau

SEQ ID NO: 296739 - RNA, 32 nt, Human
aauuuguuuauccagaaggagugcuguuuccu

SEQ ID NO: 296740 - RNA, 32 nt, Human
aauuuguuugcuggaacagaagccgucuuuga

SEQ ID NO: 296741 - RNA, 32 nt, Human
aauuuguuuguguucaauaucagcuuugauaa

SEQ ID NO: 296742 - RNA, 32 nt, Human
aauuuguuuucucauaguuuaauuccaacaac

SEQ ID NO: 296743 - RNA, 32 nt, Human
aauuuuaaacucaaccaagcugugauaagugg

SEQ ID NO: 296744 - RNA, 31 nt, Human
aauuuuaaagugucagaaaaaggugacggca

SEQ ID NO: 296745 - RNA, 32 nt, Human
aauuuuaacauugcagaaaccugcucugggug

SEQ ID NO: 296746 - RNA, 32 nt, Human
aauuuuaaccaccaccuacuucccuuaaacac

SEQ ID NO: 296747 - RNA, 32 nt, Human
aauuuuaaggggaauggcuggcucacagaagc

SEQ ID NO: 296748 - RNA, 32 nt, Human
aauuuuaauguucuuaccgcaacgaaauaauu

SEQ ID NO: 296749 - RNA, 32 nt, Human
aauuuuaauuuucuucuuucucagaccucagu

SEQ ID NO: 296750 - RNA, 32 nt, Human
aauuuuacauuucaacccaucuggcuaaaguu

SEQ ID NO: 296751 - RNA, 32 nt, Human
aauuuuacccuuuagacuguagccuggauauu

SEQ ID NO: 296752 - RNA, 32 nt, Human
aauuuuaccuacugaggcucaagccuucacag

SEQ ID NO: 296753 - RNA, 32 nt, Human
aauuuuacuacaagacucuuguccucauuguu

SEQ ID NO: 296754 - RNA, 32 nt, Human
aauuuuacuaccauauguuauguaauaaaugu

SEQ ID NO: 296755 - RNA, 32 nt, Human
aauuuuacuugcugggagcgaggagaguaauc

SEQ ID NO: 296756 - RNA, 32 nt, Human
aauuuuagaagaggaaguacagaauucaguuu

SEQ ID NO: 296757 - RNA, 32 nt, Human
aauuuuagaagagguagagaaaauggaacauu

SEQ ID NO: 296758 - RNA, 32 nt, Human
aauuuuagccccacccugcucccaucugcccc

SEQ ID NO: 296759 - RNA, 32 nt, Human
aauuuuagcuccagcucaguugcccagacugg

SEQ ID NO: 296760 - RNA, 32 nt, Human
aauuuuaggaacugugagagggggacaaggug

SEQ ID NO: 296761 - RNA, 32 nt, Human
aauuuuaguagagaugggguuucuccauguug

SEQ ID NO: 296762 - RNA, 32 nt, Human
aauuuuagugaaaaccuaggaggcaagaaaua

SEQ ID NO: 296763 - RNA, 32 nt, Human
aauuuuaguugagugcagagggcuuuuauaac

SEQ ID NO: 296764 - RNA, 32 nt, Human
aauuuuauauguauauagauauauuuggcuua

SEQ ID NO: 296765 - RNA, 32 nt, Human
aauuuuauuaugcaaccaguuuauccaccaag

SEQ ID NO: 296766 - RNA, 32 nt, Human
aauuuuauucaggaccuaguaucugcagucca

SEQ ID NO: 296767 - RNA, 32 nt, Human
aauuuucaaaagaaagcuaaaugcugauugug

SEQ ID NO: 296768 - RNA, 32 nt, Human
aauuuucaagagccuaauucugcuaaucauaa

SEQ ID NO: 296769 - RNA, 32 nt, Human
aauuuucacaggcucaucugggagaaggauca

SEQ ID NO: 296770 - RNA, 32 nt, Human
aauuuucacauauugggcuuacccagagugga

SEQ ID NO: 296771 - RNA, 32 nt, Human
aauuuucaccugccagcccugccuccuccuuu

SEQ ID NO: 296772 - RNA, 32 nt, Human
aauuuucacucccccagcagugugugugaguu

SEQ ID NO: 296773 - RNA, 32 nt, Human
aauuuucagaucuuuucaggaguguaaggaaa

SEQ ID NO: 296774 - RNA, 32 nt, Human
aauuuucagcaccugcuuuucucagcuuggcc

SEQ ID NO: 296775 - RNA, 32 nt, Human
aauuuucauggccaugggacaaagaaccccgu

SEQ ID NO: 296776 - RNA, 32 nt, Human
aauuuuccaguuucaaguaccuauucaaaauu

SEQ ID NO: 296777 - RNA, 32 nt, Human
aauuuucccaaaacugauacccuuugaaaaag

SEQ ID NO: 296778 - RNA, 32 nt, Human
aauuuucccagaggaaugccuggaauggccgg

SEQ ID NO: 296779 - RNA, 32 nt, Human
aauuuuccccaagaggagggcucagugauucu

SEQ ID NO: 296780 - RNA, 32 nt, Human
aauuuucccucuaucuucuguguggguguuuc

SEQ ID NO: 296781 - RNA, 32 nt, Human
aauuuucccuggcuauuuucuacccacagcug

SEQ ID NO: 296782 - RNA, 32 nt, Human
aauuuucccuucgccugccaugggcuucaccc

SEQ ID NO: 296783 - RNA, 32 nt, Human
aauuuuccuagucuuuaguaacuguuaguguu

SEQ ID NO: 296784 - RNA, 32 nt, Human
aauuuuccucauuucaaaauaauuuaugacuc

SEQ ID NO: 296785 - RNA, 32 nt, Human
aauuuuccuccacuaccuccgcccccgccccc

SEQ ID NO: 296786 - RNA, 32 nt, Human
aauuuuccugcagcaaaagucugaggcuguug

SEQ ID NO: 296787 - RNA, 32 nt, Human
aauuuuccuguggccuuccuggccucuacuuc

SEQ ID NO: 296788 - RNA, 32 nt, Human
aauuuucgcaaccuacucaucugacaaagggc

SEQ ID NO: 296789 - RNA, 32 nt, Human
aauuuucuagcucuggaaaggccuuccugggu

SEQ ID NO: 296790 - RNA, 32 nt, Human
aauuuucuagucuuccucugcuuuucuccaau

SEQ ID NO: 296791 - RNA, 32 nt, Human
aauuuucuccacccagaccccaaaaauaaaug

SEQ ID NO: 296792 - RNA, 32 nt, Human
aauuuucucuccaugggccacaggggacaggg

SEQ ID NO: 296793 - RNA, 32 nt, Human
aauuuucugcagcauuaagcuggcgcuuaaua

SEQ ID NO: 296794 - RNA, 32 nt, Human
aauuuucuggaaaauauccaugugguaauggu

SEQ ID NO: 296795 - RNA, 32 nt, Human
aauuuucuggaaaaugcuucuuggcuggggcc

SEQ ID NO: 296796 - RNA, 32 nt, Human
aauuuucuguacaguuugugaggaccuuugca

SEQ ID NO: 296797 - RNA, 32 nt, Human
aauuuucugucuuguugaucugucuaauauug

SEQ ID NO: 296798 - RNA, 32 nt, Human
aauuuucuuacagaugucaaaagcagucuagu

SEQ ID NO: 296799 - RNA, 32 nt, Human
aauuuucuuagcauucuggaauucucaucuaa

SEQ ID NO: 296800 - RNA, 32 nt, Human
aauuuucuucacacuaucaacacugcagcauu

SEQ ID NO: 296801 - RNA, 32 nt, Human
aauuuucuuccagauacagggggauaccugcc

SEQ ID NO: 296802 - RNA, 32 nt, Human
aauuuucuucuagcaugugauaaugaguaaac

SEQ ID NO: 296803 - RNA, 32 nt, Human
aauuuucuugcagaaaaguuaagucuaauugc

SEQ ID NO: 296804 - RNA, 32 nt, Human
aauuuucuuucgauggcauuaccagaguauag

SEQ ID NO: 296805 - RNA, 24 nt, Human
aauuuucuuuuuaaaaauacuucu

SEQ ID NO: 296806 - RNA, 32 nt, Human
aauuuugagaacuugggaucacagacucuaau

SEQ ID NO: 296807 - RNA, 32 nt, Human
aauuuugagaagguaaaaguuucuuaauuaaa

SEQ ID NO: 296808 - RNA, 32 nt, Human
aauuuugagacaggcucucacucuguugccca

SEQ ID NO: 296809 - RNA, 32 nt, Human
aauuuugaggccucccuagccauggggacugu

SEQ ID NO: 296810 - RNA, 32 nt, Human
aauuuugaggggagggaaagaaacaauaccuu

SEQ ID NO: 296811 - RNA, 32 nt, Human
aauuuugagggugggagagaagaaaagggaaa

SEQ ID NO: 296812 - RNA, 32 nt, Human
aauuuugaucauauuaacuguacuucaguuuu

SEQ ID NO: 296813 - RNA, 32 nt, Human
aauuuugauuuauuuuuccucucccaaccaua

SEQ ID NO: 296814 - RNA, 32 nt, Human
aauuuugcaauguuaaagaugcacagaauaug

SEQ ID NO: 296815 - RNA, 32 nt, Human
aauuuugcccccuuuuaggccauguuccauua

SEQ ID NO: 296816 - RNA, 32 nt, Human
aauuuugccuauaauaaugagacaucuugggg

SEQ ID NO: 296817 - RNA, 32 nt, Human
aauuuugcuacuuggaauuuggagauagcauc

SEQ ID NO: 296818 - RNA, 32 nt, Human
aauuuugcugauaacuuuauaaaacucacuau

SEQ ID NO: 296819 - RNA, 32 nt, Human
aauuuugcuggacuucaaccuggguagaagac

SEQ ID NO: 296820 - RNA, 32 nt, Human
aauuuuggacaagguuacuucaucuucauuca

SEQ ID NO: 296821 - RNA, 32 nt, Human
aauuuuggagaguuugggagcauuugggggca

SEQ ID NO: 296822 - RNA, 32 nt, Human
aauuuuggaguaacguuuuccuugugacuaag

SEQ ID NO: 296823 - RNA, 32 nt, Human
aauuuuggagugaagggcccugaggucagcuc

SEQ ID NO: 296824 - RNA, 32 nt, Human
aauuuuggauggguauuuauuuggauaaaggu

SEQ ID NO: 296825 - RNA, 32 nt, Human
aauuuuggccaaaucuucucucccucuccuac

SEQ ID NO: 296826 - RNA, 32 nt, Human
aauuuuggccuucugcacuacucuuuugcucu

SEQ ID NO: 296827 - RNA, 32 nt, Human
aauuuugggaggccgaggcggguggaucgcuu

SEQ ID NO: 296828 - RNA, 32 nt, Human
aauuuugggaggccgaggugggcugaucaauu

SEQ ID NO: 296829 - RNA, 32 nt, Human
aauuuuggguuccuuccuuggagccauaguua

SEQ ID NO: 296830 - RNA, 32 nt, Human
aauuuuguaaauaaaugauuauacaaaacagu

SEQ ID NO: 296831 - RNA, 32 nt, Human
aauuuuguacuacauuuauuuuguuucauuug

SEQ ID NO: 296832 - RNA, 32 nt, Human
aauuuuguauauuuaagugucauagaaaauau

SEQ ID NO: 296833 - RNA, 32 nt, Human
aauuuuguauuuucacugucuucaaaauauuu

SEQ ID NO: 296834 - RNA, 32 nt, Human
aauuuugucagccaggcguggugacucaugcc

SEQ ID NO: 296835 - RNA, 32 nt, Human
aauuuuguccccacuguuuaaaaauguuaccu

SEQ ID NO: 296836 - RNA, 32 nt, Human
aauuuugucuaucaauggauguaauuaauccu

SEQ ID NO: 296837 - RNA, 32 nt, Human
aauuuugucuuccucacuuuucaccuuaguuu

SEQ ID NO: 296838 - RNA, 32 nt, Human
aauuuugugaaagaaggagcaagagaacauuc

SEQ ID NO: 296839 - RNA, 32 nt, Human
aauuuugugagcuccacacgggcaggguugca

SEQ ID NO: 296840 - RNA, 32 nt, Human
aauuuuguuccuuauuagcuuuauuuuacuuu

SEQ ID NO: 296841 - RNA, 32 nt, Human
aauuuuguuuuuaaaauauuguuuaucuuuau

SEQ ID NO: 296842 - RNA, 32 nt, Human
aauuuuguuuuuccuguuuucugagaauaaag

SEQ ID NO: 296843 - RNA, 32 nt, Human
aauuuuuaaaaauacaguuagguguuuauauu

SEQ ID NO: 296844 - RNA, 32 nt, Human
aauuuuuaaaaauuauuaucaggggagaaaaa

SEQ ID NO: 296845 - RNA, 32 nt, Human
aauuuuuaaaacaaaacaccuuaaaacuuucu

SEQ ID NO: 296846 - RNA, 32 nt, Human
aauuuuuaaagaaaugaacauacacauaguua

SEQ ID NO: 296847 - RNA, 32 nt, Human
aauuuuuaaagauaccagugggacagauuugg

SEQ ID NO: 296848 - RNA, 32 nt, Human
aauuuuuaaagauaccagugggacagguuugg

SEQ ID NO: 296849 - RNA, 32 nt, Human
aauuuuuaacuaaugucaaaacuacaguguca

SEQ ID NO: 296850 - RNA, 32 nt, Human
aauuuuuaacugccuuuuugucgagucaaacu

SEQ ID NO: 296851 - RNA, 32 nt, Human
aauuuuuaauccagcacauacuauugcaagcg

SEQ ID NO: 296852 - RNA, 32 nt, Human
aauuuuuaauucaguugagugcagcaucuuuc

SEQ ID NO: 296853 - RNA, 32 nt, Human
aauuuuuacaguaucucaaagacuucacuuga

SEQ ID NO: 296854 - RNA, 32 nt, Human
aauuuuuagaagccuucagaagaggcuaaaau

SEQ ID NO: 296855 - RNA, 32 nt, Human
aauuuuuaugcuucauacauugugcuagacuc

SEQ ID NO: 296856 - RNA, 32 nt, Human
aauuuuuauuuuuaguagagaugggguuucac

SEQ ID NO: 296857 - RNA, 32 nt, Human
aauuuuucaaaugauaaaacuguauaaauaca

SEQ ID NO: 296858 - RNA, 32 nt, Human
aauuuuucaaugccgucauuuucaguuagaug

SEQ ID NO: 296859 - RNA, 32 nt, Human
aauuuuucaccaugcaucggaaaaagguggau

SEQ ID NO: 296860 - RNA, 32 nt, Human
aauuuuucauuuccugugucaccccucccaca

SEQ ID NO: 296861 - RNA, 32 nt, Human
aauuuuuccagccucauccuggccugcccucu

SEQ ID NO: 296862 - RNA, 32 nt, Human
aauuuuucuaacucugucucuucucucuuucc

SEQ ID NO: 296863 - RNA, 32 nt, Human
aauuuuucuagcagaaauguugaaccucucag

SEQ ID NO: 296864 - RNA, 32 nt, Human
aauuuuucucagacuuauuuuaucugccucug

SEQ ID NO: 296865 - RNA, 32 nt, Human
aauuuuucucauuuuuaguagaaacgggguuu

SEQ ID NO: 296866 - RNA, 32 nt, Human
aauuuuucuccucccuccuccuacaagguuuu

SEQ ID NO: 296867 - RNA, 32 nt, Human
aauuuuucugauuguuuccuuuauagaguguc

SEQ ID NO: 296868 - RNA, 32 nt, Human
aauuuuucugcaggagcuccucaaagucucug

SEQ ID NO: 296869 - RNA, 32 nt, Human
aauuuuucugcugcuacuacaguuucacagaa

SEQ ID NO: 296870 - RNA, 32 nt, Human
aauuuuucuuaggugaggaggauuauuaacug

SEQ ID NO: 296871 - RNA, 32 nt, Human
aauuuuucuuucuccaccccaaaccugugcua

SEQ ID NO: 296872 - RNA, 32 nt, Human
aauuuuugcaaccuacucaucugacaaagggc

SEQ ID NO: 296873 - RNA, 32 nt, Human
aauuuuugcagccuacucaucugacaaagagc

SEQ ID NO: 296874 - RNA, 32 nt, Human
aauuuuugcccagucugccuguuguggggcuc

SEQ ID NO: 296875 - RNA, 32 nt, Human
aauuuuugcucaaaaccagaaaaagaauugua

SEQ ID NO: 296876 - RNA, 32 nt, Human
aauuuuuggauugacaguaacuugguuauaca

SEQ ID NO: 296877 - RNA, 32 nt, Human
aauuuuugguauagggucaucucuccaccuug

SEQ ID NO: 296878 - RNA, 32 nt, Human
aauuuuuguaaauuaucugaauaaaaguuaua

SEQ ID NO: 296879 - RNA, 32 nt, Human
aauuuuuguucaagggacuaaauugcuuaugu

SEQ ID NO: 296880 - RNA, 32 nt, Human
acaaaaacaaaccuguguuguuuuuguauaga

SEQ ID NO: 296881 - RNA, 32 nt, Human
acaaaaacaaaccuuuugguaaugugcacugu

SEQ ID NO: 296882 - RNA, 32 nt, Human
acaaaaacaaaugaaaacaaaaacaaaccauu

SEQ ID NO: 296883 - RNA, 32 nt, Human
acaaaaacaaauucuuuuaauucaacgggugc

SEQ ID NO: 296884 - RNA, 32 nt, Human
acaaaaacaacaaaagaagaacauucucucac

SEQ ID NO: 296885 - RNA, 32 nt, Human
acaaaaacaacugccauuuuuguauauaauag

SEQ ID NO: 296886 - RNA, 32 nt, Human
acaaaaacacaaaaacucugaggggaucuggu

SEQ ID NO: 296887 - RNA, 32 nt, Human
acaaaaacacaaauuagucgggugugguggca

SEQ ID NO: 296888 - RNA, 19 nt, Human
acaaaaacacacugcuuca

SEQ ID NO: 296889 - RNA, 32 nt, Human
acaaaaacaccuuccagcagugccugcuucug

SEQ ID NO: 296890 - RNA, 32 nt, Human
acaaaaacagcaguugcauugauuuugaaaac

SEQ ID NO: 296891 - RNA, 32 nt, Human
acaaaaaccaaccaaccaaccaaccaaccaac

SEQ ID NO: 296892 - RNA, 21 nt, Human
acaaaaaccagcagccaaaua

SEQ ID NO: 296893 - RNA, 32 nt, Human
acaaaaaccagcugcaaccacagagcucaguc

SEQ ID NO: 296894 - RNA, 32 nt, Human
acaaaaaccggccuugcccugcagggaugggg

SEQ ID NO: 296895 - RNA, 32 nt, Human
acaaaaaccuggugagggucaucaggagaugg

SEQ ID NO: 296896 - RNA, 32 nt, Human
acaaaaacuagccuggcaagguggugcacccc

SEQ ID NO: 296897 - RNA, 32 nt, Human
acaaaaacuaugaaacagaugcauauuuccuc

SEQ ID NO: 296898 - RNA, 32 nt, Human
acaaaaacucaaugaacuagacauaugagaaa

SEQ ID NO: 296899 - RNA, 32 nt, Human
acaaaaacuugaaaugagagacuuuaagaacc

SEQ ID NO: 296900 - RNA, 32 nt, Human
acaaaaagaaaauuagugcucuuaagaaaagc

SEQ ID NO: 296901 - RNA, 18 nt, Human
acaaaaagaaauuucuca

SEQ ID NO: 296902 - RNA, 32 nt, Human
acaaaaagaaucaggacuuguacugggaaaaa

SEQ ID NO: 296903 - RNA, 32 nt, Human
acaaaaagauuagccaggcaugguggcauaca

SEQ ID NO: 296904 - RNA, 32 nt, Human
acaaaaagauuagcugggcaugguggcgcaug

SEQ ID NO: 296905 - RNA, 32 nt, Human
acaaaaagauuagcugggugugguggugugug

SEQ ID NO: 296906 - RNA, 32 nt, Human
acaaaaagccauagaacuuggucauguuuucc

SEQ ID NO: 296907 - RNA, 32 nt, Human
acaaaaagcuaggcacauguugacaggugaau

SEQ ID NO: 296908 - RNA, 32 nt, Human
acaaaaagcugcaaccccagcccaucagaagg

SEQ ID NO: 296909 - RNA, 32 nt, Human
acaaaaagcugcuuucccaucccaggccgagc

SEQ ID NO: 296910 - RNA, 32 nt, Human
acaaaaagcuggaggaaggagcacaugaggua

SEQ ID NO: 296911 - RNA, 32 nt, Human
acaaaaaggaagaccagggaggcccuuaagaa

SEQ ID NO: 296912 - RNA, 32 nt, Human
acaaaaaguacaacaguguacacuaaaggaac

SEQ ID NO: 296913 - RNA, 32 nt, Human
acaaaaaguauucauauuuaauuucucuuaca

SEQ ID NO: 296914 - RNA, 32 nt, Human
acaaaaaguucugcaauugccugugccaaacu

SEQ ID NO: 296915 - RNA, 32 nt, Human
acaaaaauacaaaaauuagccagguuugguga

SEQ ID NO: 296916 - RNA, 32 nt, Human
acaaaaauacaaaaauuagcuggacguguagu

SEQ ID NO: 296917 - RNA, 32 nt, Human
acaaaaauacaaaaauuagcugggcguggagg

SEQ ID NO: 296918 - RNA, 32 nt, Human
acaaaaauacccacucagucuguguuagauug

SEQ ID NO: 296919 - RNA, 22 nt, Human
acaaaaauagccccuccugaag

SEQ ID NO: 296920 - RNA, 21 nt, Human
acaaaaaucaaaugccuauaa

SEQ ID NO: 296921 - RNA, 24 nt, Human
acaaaaaucaagcuuagugcuuua

SEQ ID NO: 296922 - RNA, 32 nt, Human
acaaaaaucagccaggcaugguggugagugcc

SEQ ID NO: 296923 - RNA, 32 nt, Human
acaaaaaucuagaaauggagagggaacuguuu

SEQ ID NO: 296924 - RNA, 32 nt, Human
acaaaaaugaggaaaacuaggggaccccacac

SEQ ID NO: 296925 - RNA, 32 nt, Human
acaaaaauggaggccucacuccacuacuccau

SEQ ID NO: 296926 - RNA, 32 nt, Human
acaaaaauguaaaauaaaauuagccagguaug

SEQ ID NO: 296927 - RNA, 32 nt, Human
acaaaaauguaaaucccaccauucauauaaag

SEQ ID NO: 296928 - RNA, 32 nt, Human
acaaaaauuagccaggugugguggcgcaagcc

SEQ ID NO: 296929 - RNA, 32 nt, Human
acaaaaauuagccaggugugguggcgcauacc

SEQ ID NO: 296930 - RNA, 32 nt, Human
acaaaaauuagccaggugugguggcgccuggu

SEQ ID NO: 296931 - RNA, 32 nt, Human
acaaaaauuagccaggugugguggcucacgcu

SEQ ID NO: 296932 - RNA, 32 nt, Human
acaaaaauuagccaggugugguggcucaugcc

SEQ ID NO: 296933 - RNA, 32 nt, Human
acaaaaauuagccgagugugguggcucaugcc

SEQ ID NO: 296934 - RNA, 32 nt, Human
acaaaaauuagccggguguggugacucacagc

SEQ ID NO: 296935 - RNA, 32 nt, Human
acaaaaauuagccgggugugguggcgcacgcc

SEQ ID NO: 296936 - RNA, 32 nt, Human
acaaaaauuagccgggugugguggcgcaugcc

SEQ ID NO: 296937 - RNA, 32 nt, Human
acaaaaauuagccuggcauauggcggguaccg

SEQ ID NO: 296938 - RNA, 32 nt, Human
acaaaaauuagccuggcgugguggugcacacc

SEQ ID NO: 296939 - RNA, 32 nt, Human
acaaaaauuagccuggcgugguggugcaugcc

SEQ ID NO: 296940 - RNA, 32 nt, Human
acaaaaauuagcuaggugugguggcgcacacc

SEQ ID NO: 296941 - RNA, 32 nt, Human
acaaaaauuagcuggguguggugggcaccugu

SEQ ID NO: 296942 - RNA, 32 nt, Human
acaaaaauuagucaggugugguggacgccugu

SEQ ID NO: 296943 - RNA, 32 nt, Human
acaaaaauuaguugcauuucuauacaccagua

SEQ ID NO: 296944 - RNA, 32 nt, Human
acaaaaauugacuccccauugcagugaacuuc

SEQ ID NO: 296945 - RNA, 27 nt, Human
acaaaaauugauauaauacauucauca

SEQ ID NO: 296946 - RNA, 32 nt, Human
acaaaaauugcgaagacucaucuuucccuaga

SEQ ID NO: 296947 - RNA, 32 nt, Human
acaaaacaaaaacccaccccuuuaaggaguug

SEQ ID NO: 296948 - RNA, 32 nt, Human
acaaaacaaacacacggaccaauaaacaaaga

SEQ ID NO: 296949 - RNA, 32 nt, Human
acaaaacaacagacacaguuguaaugacauua

SEQ ID NO: 296950 - RNA, 32 nt, Human
acaaaacaaucaaaaccuaccaaaaagggacu

SEQ ID NO: 296951 - RNA, 32 nt, Human
acaaaacaauuagcugggugugguggcacaca

SEQ ID NO: 296952 - RNA, 32 nt, Human
acaaaacacacuaggggccgggcacagugcuc

SEQ ID NO: 296953 - RNA, 32 nt, Human
acaaaacacagaaccauucagaugacuccauu

SEQ ID NO: 296954 - RNA, 32 nt, Human
acaaaacacagccaaggggauauuuacugcuc

SEQ ID NO: 296955 - RNA, 32 nt, Human
acaaaacacaggcaacccagacuaccuuguuu

SEQ ID NO: 296956 - RNA, 32 nt, Human
acaaaacaccauggcacacauauaccuaugua

SEQ ID NO: 296957 - RNA, 32 nt, Human
acaaaacacucuugggucucugaccccaggga

SEQ ID NO: 296958 - RNA, 32 nt, Human
acaaaacacuuagcugggcaugguggcgggug

SEQ ID NO: 296959 - RNA, 21 nt, Human
acaaaacaguucuuggucuug

SEQ ID NO: 296960 - RNA, 32 nt, Human
acaaaaccaagcucccuucccuuccucccccu

SEQ ID NO: 296961 - RNA, 32 nt, Human
acaaaaccacacaaaccaaaccgucaacagca

SEQ ID NO: 296962 - RNA, 32 nt, Human
acaaaaccacagugagauagcaccucaccccc

SEQ ID NO: 296963 - RNA, 32 nt, Human
acaaaaccacggucaguuuacucaacauacuu

SEQ ID NO: 296964 - RNA, 32 nt, Human
acaaaaccacuguccaacacugguaucugugu

SEQ ID NO: 296965 - RNA, 32 nt, Human
acaaaaccagcaucuguuacuggaacagagac

SEQ ID NO: 296966 - RNA, 32 nt, Human
acaaaaccagucccuggugccaaaaaggcugg

SEQ ID NO: 296967 - RNA, 32 nt, Human
acaaaacccacacuccaaaaacuaacaaagaa

SEQ ID NO: 296968 - RNA, 32 nt, Human
acaaaacccaggagguagcuggcagaguagcu

SEQ ID NO: 296969 - RNA, 32 nt, Human
acaaaacccaguguuugcacacacacaaaauc

SEQ ID NO: 296970 - RNA, 32 nt, Human
acaaaaccuccaccaucugacgggacccacag

SEQ ID NO: 296971 - RNA, 32 nt, Human
acaaaacuagcugggggugguggugcaugccu

SEQ ID NO: 296972 - RNA, 32 nt, Human
acaaaacucacucaaaaccagcagugcugcua

SEQ ID NO: 296973 - RNA, 32 nt, Human
acaaaacucauuuuuccuucuucauuuuguau

SEQ ID NO: 296974 - RNA, 32 nt, Human
acaaaacuccgcccccagccuaugagcauccu

SEQ ID NO: 296975 - RNA, 32 nt, Human
acaaaacucucaaaaauguauuucaagucagu

SEQ ID NO: 296976 - RNA, 32 nt, Human
acaaaacuggacucagcacacuccugggaauc

SEQ ID NO: 296977 - RNA, 32 nt, Human
acaaaacuguacuugugccugcuaaaucugug

SEQ ID NO: 296978 - RNA, 32 nt, Human
acaaaacuucuuuccauuguccugcccguuuc

SEQ ID NO: 296979 - RNA, 25 nt, Human
acaaaacuuuuaaacuuccuauagg

SEQ ID NO: 296980 - RNA, 19 nt, Human
acaaaagaaaaagccaaca

SEQ ID NO: 296981 - RNA, 32 nt, Human
acaaaagaaagcacauguaacuaccuucuuug

SEQ ID NO: 296982 - RNA, 32 nt, Human
acaaaagaccauuuaaauagugaauuauuaaa

SEQ ID NO: 296983 - RNA, 25 nt, Human
acaaaagacuguaggagagccaaac

SEQ ID NO: 296984 - RNA, 32 nt, Human
acaaaagagaauacacaaacuggacuucauca

SEQ ID NO: 296985 - RNA, 32 nt, Human
acaaaagaggacagcugugcugagggggcagg

SEQ ID NO: 296986 - RNA, 32 nt, Human
acaaaagaggccagccacccaccuccaacacc

SEQ ID NO: 296987 - RNA, 32 nt, Human
acaaaagagggcagccacccaccuccaacacc

SEQ ID NO: 296988 - RNA, 32 nt, Human
acaaaagcaauuucaguaucucugugcaaggc

SEQ ID NO: 296989 - RNA, 32 nt, Human
acaaaagcacaggcaugcacacacacagaacc

SEQ ID NO: 296990 - RNA, 22 nt, Human
acaaaagcaggaaugacuaaca

SEQ ID NO: 296991 - RNA, 22 nt, Human
acaaaagcaguucuuccuaagg

SEQ ID NO: 296992 - RNA, 20 nt, Human
acaaaagcauaagccaaaca

SEQ ID NO: 296993 - RNA, 32 nt, Human
acaaaagcaucuucccuagaaauuuuugugaa

SEQ ID NO: 296994 - RNA, 32 nt, Human
acaaaagcauuuccuaugcuagucucccagua

SEQ ID NO: 296995 - RNA, 22 nt, Human
acaaaagcauuuuccugagagg

SEQ ID NO: 296996 - RNA, 32 nt, Human
acaaaagccacuguuugcacguguuaaacuuc

SEQ ID NO: 296997 - RNA, 32 nt, Human
acaaaagccagaccugucacugaacauugaac

SEQ ID NO: 296998 - RNA, 32 nt, Human
acaaaagccagcauacuuucccugcacccauc

SEQ ID NO: 296999 - RNA, 32 nt, Human
acaaaagccaugagcugcuuuuaugcugaaaa

SEQ ID NO: 297000 - RNA, 32 nt, Human
acaaaagcccugcuugcuuuugcagcugggag

SEQ ID NO: 297001 - RNA, 24 nt, Human
acaaaagccugaacuuccugaagg

SEQ ID NO: 297002 - RNA, 32 nt, Human
acaaaagccuggcugaguugauguuuuacauu

SEQ ID NO: 297003 - RNA, 32 nt, Human
acaaaagcuacagcuccaggagcccagcgccg

SEQ ID NO: 297004 - RNA, 32 nt, Human
acaaaaggaaaauguuguugauucuugguuuu

SEQ ID NO: 297005 - RNA, 22 nt, Human
acaaaaggacaguucuguguug

SEQ ID NO: 297006 - RNA, 32 nt, Human
acaaaaggagugaaaagccaagaggacgaagu

SEQ ID NO: 297007 - RNA, 32 nt, Human
acaaaaggcacgccgugugcucugccugcuuc

SEQ ID NO: 297008 - RNA, 32 nt, Human
acaaaaggcuagaggcaugggccagguaaaaa

SEQ ID NO: 297009 - RNA, 32 nt, Human
acaaaagggaaacugugaucucaucugguugg

SEQ ID NO: 297010 - RNA, 32 nt, Human
acaaaaguaucagaacuuggaauggauggaug

SEQ ID NO: 297011 - RNA, 32 nt, Human
acaaaagucaucuggcaaaacauuuaccugua

SEQ ID NO: 297012 - RNA, 32 nt, Human
acaaaagugaaaguaguuguucacaaaagaau

SEQ ID NO: 297013 - RNA, 30 nt, Human
acaaaagugccagaagauguccagccaccg

SEQ ID NO: 297014 - RNA, 32 nt, Human
acaaaagugccuggcauccacuacugcugccu

SEQ ID NO: 297015 - RNA, 20 nt, Human
acaaaagugcuaauucacua

SEQ ID NO: 297016 - RNA, 32 nt, Human
acaaaaguuagccgggugugguggugcaugcc

SEQ ID NO: 297017 - RNA, 32 nt, Human
acaaaaguucugaagaugaugcggccucagag

SEQ ID NO: 297018 - RNA, 32 nt, Human
acaaaauaaaaugcaggaucuuuguaaagccu

SEQ ID NO: 297019 - RNA, 32 nt, Human
acaaaauaacuagcaaccaugaagugggugga

SEQ ID NO: 297020 - RNA, 32 nt, Human
acaaaauacacagaguguggaggcagggaggu

SEQ ID NO: 297021 - RNA, 19 nt, Human
acaaaauacagauaugcaa

SEQ ID NO: 297022 - RNA, 18 nt, Human
acaaaauacggcaagcag

SEQ ID NO: 297023 - RNA, 32 nt, Human
acaaaauacuaguuguuuuacacucucuuuuc

SEQ ID NO: 297024 - RNA, 32 nt, Human
acaaaauagaggagagaaagagagcaugagag

SEQ ID NO: 297025 - RNA, 32 nt, Human
acaaaauaggugaggggauagcgaaugcacuc

SEQ ID NO: 297026 - RNA, 20 nt, Human
acaaaauaguuuuucaggca

SEQ ID NO: 297027 - RNA, 21 nt, Human
acaaaauauccaagcccagcc

SEQ ID NO: 297028 - RNA, 32 nt, Human
acaaaauaugccaggaccucacagacaaagcc

SEQ ID NO: 297029 - RNA, 32 nt, Human
acaaaaucacagcacccacuaccauacagaca

SEQ ID NO: 297030 - RNA, 32 nt, Human
acaaaaucacucuuuccucucucccucuccuu

SEQ ID NO: 297031 - RNA, 26 nt, Human
acaaaaucagagcuaaggcuaccaaa

SEQ ID NO: 297032 - RNA, 32 nt, Human
acaaaaucaguggcucuuagaguuuagaaaac

SEQ ID NO: 297033 - RNA, 32 nt, Human
acaaaaucauauccaccucugccuggcagaag

SEQ ID NO: 297034 - RNA, 32 nt, Human
acaaaaucaucauuccuuguauuuauauuugu

SEQ ID NO: 297035 - RNA, 32 nt, Human
acaaaauccaacaacaauacugagaugaucua

SEQ ID NO: 297036 - RNA, 32 nt, Human
acaaaaucugacauauacauacauacagugga

SEQ ID NO: 297037 - RNA, 32 nt, Human
acaaaaucugucacauggcugcauaaucucag

SEQ ID NO: 297038 - RNA, 32 nt, Human
acaaaaucuguguacaaaaauuaguugcauuu

SEQ ID NO: 297039 - RNA, 22 nt, Human
acaaaaugaaaggaaaaagccu

SEQ ID NO: 297040 - RNA, 32 nt, Human
acaaaaugaaagugacuuucaagaaagaucag

SEQ ID NO: 297041 - RNA, 24 nt, Human
acaaaaugagggccucugcucuug

SEQ ID NO: 297042 - RNA, 32 nt, Human
acaaaaugccaaggguggacaggcgcuguggc

SEQ ID NO: 297043 - RNA, 32 nt, Human
acaaaaugcuuguccaggacucagccaugcac

SEQ ID NO: 297044 - RNA, 30 nt, Human
acaaaauggaaauuauuucaucaaaacuau

SEQ ID NO: 297045 - RNA, 32 nt, Human
acaaaauguacccaguauucuagguagugccc

SEQ ID NO: 297046 - RNA, 32 nt, Human
acaaaauguaguucccaugugccaaacaaaau

SEQ ID NO: 297047 - RNA, 32 nt, Human
acaaaaugugagccaggaaacccaguuuuuaa

SEQ ID NO: 297048 - RNA, 32 nt, Human
acaaaaugugcuguuuugguggggugggcaau

SEQ ID NO: 297049 - RNA, 32 nt, Human
acaaaaugugcuuuggggucagguguggagau

SEQ ID NO: 297050 - RNA, 32 nt, Human
acaaaauguucugcuagcuuguuuucuucaca

SEQ ID NO: 297051 - RNA, 32 nt, Human
acaaaauuagccaggcguaguggugcaugccu

SEQ ID NO: 297052 - RNA, 32 nt, Human
acaaaauuagccaggcgugguggugcaugccu

SEQ ID NO: 297053 - RNA, 32 nt, Human
acaaaauuagcugggugggguggugcaugccu

SEQ ID NO: 297054 - RNA, 32 nt, Human
acaaaauuagucgggcguaguggugcaugccu

SEQ ID NO: 297055 - RNA, 32 nt, Human
acaaaauuauuuuuauggucccuuuaacgagg

SEQ ID NO: 297056 - RNA, 32 nt, Human
acaaaauucccaucgauguugccaucagucau

SEQ ID NO: 297057 - RNA, 32 nt, Human
acaaaauucccuuuaugaacuuucgcuuuuua

SEQ ID NO: 297058 - RNA, 32 nt, Human
acaaaauugaacacaggacucuucugcucagc

SEQ ID NO: 297059 - RNA, 32 nt, Human
acaaaauugggaccuguucacauggcuaaacu

SEQ ID NO: 297060 - RNA, 32 nt, Human
acaaacaaaaaccaaccaaccaaccaaccaac

SEQ ID NO: 297061 - RNA, 32 nt, Human
acaaacaacauacaaaaguucucaucaugaua

SEQ ID NO: 297062 - RNA, 32 nt, Human
acaaacaacccccaaaucucagugacuuuaca

SEQ ID NO: 297063 - RNA, 32 nt, Human
acaaacaacugcuucaaacugugaauucugua

SEQ ID NO: 297064 - RNA, 32 nt, Human
acaaacaagaacaggccaugguuaaccaaagc

SEQ ID NO: 297065 - RNA, 22 nt, Human
acaaacaagagauggcaaagca

SEQ ID NO: 297066 - RNA, 32 nt, Human
acaaacaaggauagucuuggugaccuuuuaua

SEQ ID NO: 297067 - RNA, 32 nt, Human
acaaacaaggggauugagauuuacagagagag

SEQ ID NO: 297068 - RNA, 32 nt, Human
acaaacaauaugagugugcagaauguggagag

SEQ ID NO: 297069 - RNA, 32 nt, Human
acaaacaaugaccaaguauugcuuggcuuaac

SEQ ID NO: 297070 - RNA, 32 nt, Human
acaaacacagaaccacacagccagucccagga

SEQ ID NO: 297071 - RNA, 32 nt, Human
acaaacacaugcgcaggcuccugcaggcguga

SEQ ID NO: 297072 - RNA, 32 nt, Human
acaaacaccaaggaguggaggucagaguguca

SEQ ID NO: 297073 - RNA, 32 nt, Human
acaaacacucacugcaucgggacuuuuuaauu

SEQ ID NO: 297074 - RNA, 32 nt, Human
acaaacacugccuucugucaggcccugugcug

SEQ ID NO: 297075 - RNA, 24 nt, Human
acaaacacuguggggcacuugaua

SEQ ID NO: 297076 - RNA, 32 nt, Human
acaaacacugugguuguuugguuccauuauag

SEQ ID NO: 297077 - RNA, 32 nt, Human
acaaacacuuagccaccucugugcuccagggu

SEQ ID NO: 297078 - RNA, 32 nt, Human
acaaacagaaggacaggaagcgggagaaggca

SEQ ID NO: 297079 - RNA, 32 nt, Human
acaaacagcaauaacaaaaccaaaaagaugcc

SEQ ID NO: 297080 - RNA, 32 nt, Human
acaaacagccuucccuacucccugccagagca

SEQ ID NO: 297081 - RNA, 32 nt, Human
acaaacagcgacugagccccugguguauacug

SEQ ID NO: 297082 - RNA, 32 nt, Human
acaaacagcugcuuauaguggcaaaugcccac

SEQ ID NO: 297083 - RNA, 19 nt, Human
acaaacaggccugcugcua

SEQ ID NO: 297084 - RNA, 32 nt, Human
acaaacagguacaaaccagcugcguuacaggu

SEQ ID NO: 297085 - RNA, 32 nt, Human
acaaacagucucuuaguuacucauuuccaucu

SEQ ID NO: 297086 - RNA, 32 nt, Human
acaaacaguuuguuuuuaccucugccuccugg

SEQ ID NO: 297087 - RNA, 32 nt, Human
acaaacauaagggaacaaacagcaaccauaac

SEQ ID NO: 297088 - RNA, 32 nt, Human
acaaacauacacaccccuugacacccccuuac

SEQ ID NO: 297089 - RNA, 32 nt, Human
acaaacauagaucucaguuuuggaagggccuu

SEQ ID NO: 297090 - RNA, 21 nt, Human
acaaacauccaugagccccca

SEQ ID NO: 297091 - RNA, 32 nt, Human
acaaacauuucuucuaaucccugcuuucaguu

SEQ ID NO: 297092 - RNA, 32 nt, Human
acaaaccaaaaauacaccaaauguucugaaaa

SEQ ID NO: 297093 - RNA, 32 nt, Human
acaaaccaacacagcaucaucuaaaccaccaa

SEQ ID NO: 297094 - RNA, 32 nt, Human
acaaaccaacuccaccaaccucuggcucuuaa

SEQ ID NO: 297095 - RNA, 32 nt, Human
acaaaccaacuccaccaaccucuggcucuuac

SEQ ID NO: 297096 - RNA, 32 nt, Human
acaaaccacccaggcagugugauggaggcuau

SEQ ID NO: 297097 - RNA, 32 nt, Human
acaaaccaccccuccaccucuggaggucccac

SEQ ID NO: 297098 - RNA, 32 nt, Human
acaaaccagagccucugcgccuccacagggaa

SEQ ID NO: 297099 - RNA, 32 nt, Human
acaaaccaggaaugauuucauuucuccugaga

SEQ ID NO: 297100 - RNA, 32 nt, Human
acaaaccaggcaggugguguguguggacucac

SEQ ID NO: 297101 - RNA, 32 nt, Human
acaaaccaguguacucacuggucuccaucuuu

SEQ ID NO: 297102 - RNA, 32 nt, Human
acaaaccaucacacuaugauuuuauggagaug

SEQ ID NO: 297103 - RNA, 32 nt, Human
acaaaccaucucuccauuggaaaaggagcugu

SEQ ID NO: 297104 - RNA, 32 nt, Human
acaaaccaugcucuacuccacccccaaaguac

SEQ ID NO: 297105 - RNA, 32 nt, Human
acaaacccaggccugaugggaaaaaugauucc

SEQ ID NO: 297106 - RNA, 32 nt, Human
acaaacccgaggcagcauggagaggggccgug

SEQ ID NO: 297107 - RNA, 32 nt, Human
acaaacccuggcauguccuuccagaaaaacca

SEQ ID NO: 297108 - RNA, 32 nt, Human
acaaacccugggcugcucaggaugggcccaag

SEQ ID NO: 297109 - RNA, 32 nt, Human
acaaacccuggucucuccuuuuacagaugagg

SEQ ID NO: 297110 - RNA, 32 nt, Human
acaaaccucuaacccaggucuugacaccagcu

SEQ ID NO: 297111 - RNA, 24 nt, Human
acaaaccuggccaacauggugaaa

SEQ ID NO: 297112 - RNA, 32 nt, Human
acaaaccuguauggcauauuacuguacugauu

SEQ ID NO: 297113 - RNA, 32 nt, Human
acaaaccuuaauguguguaugugaacucacau

SEQ ID NO: 297114 - RNA, 32 nt, Human
acaaacgcauggaaccagaggaagaaaauggc

SEQ ID NO: 297115 - RNA, 32 nt, Human
acaaacgcugccacccuccacuucccaaccca

SEQ ID NO: 297116 - RNA, 20 nt, Human
acaaacgcuggagcagccca

SEQ ID NO: 297117 - RNA, 32 nt, Human
acaaacgugagccaucgcaccuagccucuuug

SEQ ID NO: 297118 - RNA, 32 nt, Human
acaaacguggcagagggcaagacgggcacuca

SEQ ID NO: 297119 - RNA, 32 nt, Human
acaaacuaaacccagaagagaggggugggcug

SEQ ID NO: 297120 - RNA, 32 nt, Human
acaaacucccaggugacauagauggcaucaau

SEQ ID NO: 297121 - RNA, 32 nt, Human
acaaacuccucaugauaacugcacacaaucug

SEQ ID NO: 297122 - RNA, 32 nt, Human
acaaacucucauguucccucuggacuucuguu

SEQ ID NO: 297123 - RNA, 32 nt, Human
acaaacugaaaauacaguagauaagcugucga

SEQ ID NO: 297124 - RNA, 32 nt, Human
acaaacugaaguaucugucucauccaaaaagu

SEQ ID NO: 297125 - RNA, 32 nt, Human
acaaacugacccauccugggccuuguucucca

SEQ ID NO: 297126 - RNA, 32 nt, Human
acaaacugcccuuaagagucauuuccuuguua

SEQ ID NO: 297127 - RNA, 32 nt, Human
acaaacugccuccuggagguuuuuagaaaugu

SEQ ID NO: 297128 - RNA, 32 nt, Human
acaaacuguccugguugcuggucagagggagg

SEQ ID NO: 297129 - RNA, 32 nt, Human
acaaacuguucccagcccuaggcugacaugag

SEQ ID NO: 297130 - RNA, 32 nt, Human
acaaacuguuuguuuuucuacuugcuccaucu

SEQ ID NO: 297131 - RNA, 32 nt, Human
acaaacuuaaugauuaaaagugauugagucuc

SEQ ID NO: 297132 - RNA, 31 nt, Human
acaaacuuccucucuggccucucaggaauca

SEQ ID NO: 297133 - RNA, 32 nt, Human
acaaacuucucaucuuuuugcuuuuauuccua

SEQ ID NO: 297134 - RNA, 32 nt, Human
acaaacuuggcugggcuuaguggugcaugccu

SEQ ID NO: 297135 - RNA, 32 nt, Human
acaaacuugugagcuuacugcagucagucaca

SEQ ID NO: 297136 - RNA, 32 nt, Human
acaaacuuuaccucauagccugugaagcaggu

SEQ ID NO: 297137 - RNA, 32 nt, Human
acaaacuuuaggguaaaaauugcgauuggaca

SEQ ID NO: 297138 - RNA, 21 nt, Human
acaaagaaaaagacuucugca

SEQ ID NO: 297139 - RNA, 23 nt, Human
acaaagaaaaaguuacccauagc

SEQ ID NO: 297140 - RNA, 32 nt, Human
acaaagaaagagaaaggggccgggcgcggugg

SEQ ID NO: 297141 - RNA, 32 nt, Human
acaaagaaauuagcugggcaugguggcaugca

SEQ ID NO: 297142 - RNA, 32 nt, Human
acaaagaaauuucccucccugccugcacaaua

SEQ ID NO: 297143 - RNA, 32 nt, Human
acaaagaacaugaacaaaaagcauuaaacugg

SEQ ID NO: 297144 - RNA, 25 nt, Human
acaaagaacuauuguuuugaccuug

SEQ ID NO: 297145 - RNA, 19 nt, Human
acaaagaacugaagcucuu

SEQ ID NO: 297146 - RNA, 24 nt, Human
acaaagaacugcuucuugcucuug

SEQ ID NO: 297147 - RNA, 32 nt, Human
acaaagaagggacuuggcaguuuaaaagccac

SEQ ID NO: 297148 - RNA, 32 nt, Human
acaaagacaacauuguuccuggaacgcccucu

SEQ ID NO: 297149 - RNA, 32 nt, Human
acaaagacaagcuucuguuauuaucauccugu

SEQ ID NO: 297150 - RNA, 32 nt, Human
acaaagacagugugacaaguucugagccccac

SEQ ID NO: 297151 - RNA, 32 nt, Human
acaaagacauugauucagccuguuuggcguuu

SEQ ID NO: 297152 - RNA, 32 nt, Human
acaaagaccgagcaaaagacgagugugccauu

SEQ ID NO: 297153 - RNA, 32 nt, Human
acaaagaccuguuuuugugacugccuugaguu

SEQ ID NO: 297154 - RNA, 32 nt, Human
acaaagacggcuucagcaccauccugcaccug

SEQ ID NO: 297155 - RNA, 32 nt, Human
acaaagacuaucuucccucccuucccugaauu

SEQ ID NO: 297156 - RNA, 32 nt, Human
acaaagacucccauaaggagguggugagagcg

SEQ ID NO: 297157 - RNA, 23 nt, Human
acaaagagacgaugaccacagca

SEQ ID NO: 297158 - RNA, 32 nt, Human
acaaagagaggaaggagaagugaggaagccag

SEQ ID NO: 297159 - RNA, 32 nt, Human
acaaagagauagagaaucucuuuuacuugaaa

SEQ ID NO: 297160 - RNA, 32 nt, Human
acaaagagccuccccgcgcucccgcucuccgc

SEQ ID NO: 297161 - RNA, 32 nt, Human
acaaagagcugcaaaccaggucuuuguuuugc

SEQ ID NO: 297162 - RNA, 32 nt, Human
acaaagaggaaauauuccaaagguacucagga

SEQ ID NO: 297163 - RNA, 32 nt, Human
acaaagaggagaagcacagaaagugggcucuc

SEQ ID NO: 297164 - RNA, 32 nt, Human
acaaagaggagguggcaaugguagauccaccc

SEQ ID NO: 297165 - RNA, 32 nt, Human
acaaagaggccugggauauuaggacuuugggg

SEQ ID NO: 297166 - RNA, 32 nt, Human
acaaagagugaaauauuguaaaugcuauuaua

SEQ ID NO: 297167 - RNA, 32 nt, Human
acaaagauaggaacccaggagcagcaguguuu

SEQ ID NO: 297168 - RNA, 31 nt, Human
acaaagaugauucucccuucuuauagacagg

SEQ ID NO: 297169 - RNA, 32 nt, Human
acaaagauggggagaaaccagagcagaaaagc

SEQ ID NO: 297170 - RNA, 32 nt, Human
acaaagauggugcuuauggggcagguucccua

SEQ ID NO: 297171 - RNA, 32 nt, Human
acaaagauuucuggaaguauuuugccaaccuu

SEQ ID NO: 297172 - RNA, 32 nt, Human
acaaagcaauugucugccucucccucugccuc

SEQ ID NO: 297173 - RNA, 32 nt, Human
acaaagcacacgauugcugggcacuguggcuc

SEQ ID NO: 297174 - RNA, 32 nt, Human
acaaagcacagaaacaguacauacacagcgua

SEQ ID NO: 297175 - RNA, 32 nt, Human
acaaagcagaguaauacuggaggcagaguagg

SEQ ID NO: 297176 - RNA, 32 nt, Human
acaaagcagcacuuaaggguggugcucuaaua

SEQ ID NO: 297177 - RNA, 32 nt, Human
acaaagcagggugggguaggugacauuugugu

SEQ ID NO: 297178 - RNA, 32 nt, Human
acaaagcagugcaguuggauuguaaggaaaaa

SEQ ID NO: 297179 - RNA, 32 nt, Human
acaaagcaguguaacugaaaauguuucuuuua

SEQ ID NO: 297180 - RNA, 32 nt, Human
acaaagcauaccagaucucaccagagaguccu

SEQ ID NO: 297181 - RNA, 32 nt, Human
acaaagcaugaagaugugaaaauaucaucuua

SEQ ID NO: 297182 - RNA, 32 nt, Human
acaaagcccccagagcugaauucauugaguau

SEQ ID NO: 297183 - RNA, 32 nt, Human
acaaagcccuggaggcucggccuugcuucucu

SEQ ID NO: 297184 - RNA, 32 nt, Human
acaaagcccuucaggcuggaguauaguggcau

SEQ ID NO: 297185 - RNA, 32 nt, Human
acaaagccucaagcaugcauaucuggucccuc

SEQ ID NO: 297186 - RNA, 32 nt, Human
acaaagccuuuaaccaacccucaaaccuuaau

SEQ ID NO: 297187 - RNA, 32 nt, Human
acaaagcggugacuggcuuugccuggcucugg

SEQ ID NO: 297188 - RNA, 22 nt, Human
acaaagcuaccacauguggaaa

SEQ ID NO: 297189 - RNA, 32 nt, Human
acaaagcuaguucugucuuuucagaaguccua

SEQ ID NO: 297190 - RNA, 32 nt, Human
acaaagcuaugcaugagcgaaauaucaaacuu

SEQ ID NO: 297191 - RNA, 32 nt, Human
acaaagcucccggcaacuuucucccucgcagc

SEQ ID NO: 297192 - RNA, 32 nt, Human
acaaagcugagcucaaaugucauucauauuca

SEQ ID NO: 297193 - RNA, 32 nt, Human
acaaagcugcuguggaucugucuuucaaacaa

SEQ ID NO: 297194 - RNA, 32 nt, Human
acacucgcuguguccccucuccuccccugugc

SEQ ID NO: 297195 - RNA, 32 nt, Human
acacucggagccuggcgauggcuuccagaaac

SEQ ID NO: 297196 - RNA, 32 nt, Human
acacucguuuccgaacugccucuccccaaaga

SEQ ID NO: 297197 - RNA, 32 nt, Human
acacucuacucuggcaaaggaaugaaguuauu

SEQ ID NO: 297198 - RNA, 32 nt, Human
acacucuagacccaaaggugugcuaaucacuu

SEQ ID NO: 297199 - RNA, 32 nt, Human
acacucuaguugcccaugucugauugggggcu

SEQ ID NO: 297200 - RNA, 32 nt, Human
acacucuauauacuaauuuucugcaagggaaa

SEQ ID NO: 297201 - RNA, 32 nt, Human
acacucuauauguaacuauaacuuucuagaua

SEQ ID NO: 297202 - RNA, 32 nt, Human
acacucuccaggcuggagugcaguggcacaau

SEQ ID NO: 297203 - RNA, 32 nt, Human
acacucucccggcuugcgcaggaggggccagc

SEQ ID NO: 297204 - RNA, 32 nt, Human
acacucucuucucugcugaguuugccuuguua

SEQ ID NO: 297205 - RNA, 32 nt, Human
acacucugagcaccuuguuuuagcgaacucua

SEQ ID NO: 297206 - RNA, 32 nt, Human
acacucugaggagcugguugugguguuuucca

SEQ ID NO: 297207 - RNA, 32 nt, Human
acacucugccaacauccucugauucuaggugu

SEQ ID NO: 297208 - RNA, 32 nt, Human
acacucuggagccccauugucagccccaggcc

SEQ ID NO: 297209 - RNA, 32 nt, Human
acacucugggaaugaggaacaagacuuuuucu

SEQ ID NO: 297210 - RNA, 32 nt, Human
acacucugggccggccuucugccugcauggac

SEQ ID NO: 297211 - RNA, 23 nt, Human
acacucuguccccaaguuggaca

SEQ ID NO: 297212 - RNA, 32 nt, Human
acacucugucugucuccccaagcugggcagcc

SEQ ID NO: 297213 - RNA, 32 nt, Human
acacucuuaaagugccuggguuuggaugauaa

SEQ ID NO: 297214 - RNA, 32 nt, Human
acacucuuacacucuucuguccuguuuaaugu

SEQ ID NO: 297215 - RNA, 32 nt, Human
acacucuucucacuugacauuuuagcuauaua

SEQ ID NO: 297216 - RNA, 32 nt, Human
acacucuuuccuccucuucacuuaaugcuggg

SEQ ID NO: 297217 - RNA, 32 nt, Human
acacugaaaccagugugauaaaaaccugccaa

SEQ ID NO: 297218 - RNA, 32 nt, Human
acacugaaagggcagagcaggccuaaggcucc

SEQ ID NO: 297219 - RNA, 32 nt, Human
acacugaaauauacacacagcaguagcaguag

SEQ ID NO: 297220 - RNA, 31 nt, Human
acacugaaccucucugagccucaguuccuua

SEQ ID NO: 297221 - RNA, 32 nt, Human
acacugaacgacugauuggugaugccacaaag

SEQ ID NO: 297222 - RNA, 32 nt, Human
acacugaacgccuuccuguaccgcacgggcca

SEQ ID NO: 297223 - RNA, 21 nt, Human
acacugaagaaaggcagaaug

SEQ ID NO: 297224 - RNA, 22 nt, Human
acacugaagacccucagcuguu

SEQ ID NO: 297225 - RNA, 32 nt, Human
acacugaaggaacaguuacccugcuuugccuc

SEQ ID NO: 297226 - RNA, 32 nt, Human
acacugaaggcugcaaagaacuucaccuuucc

SEQ ID NO: 297227 - RNA, 32 nt, Human
acacugacagcugugccuagccccggaugcca

SEQ ID NO: 297228 - RNA, 32 nt, Human
acacugacauaccccauguacacacacagauc

SEQ ID NO: 297229 - RNA, 32 nt, Human
acacugaccccuggccucucuggacaggagcu

SEQ ID NO: 297230 - RNA, 32 nt, Human
acacugacccucccccagggaggagagaggag

SEQ ID NO: 297231 - RNA, 32 nt, Human
acacugacccugacccacagcuugccuggcau

SEQ ID NO: 297232 - RNA, 32 nt, Human
acacugacuguugcuguaaaagugaauuugga

SEQ ID NO: 297233 - RNA, 32 nt, Human
acacugacuuuccuuaugauaauucuacagau

SEQ ID NO: 297234 - RNA, 32 nt, Human
acacugacuuucuccucccuccccugccaccu

SEQ ID NO: 297235 - RNA, 32 nt, Human
acacugagaauguaagaacuacaaacaaaauu

SEQ ID NO: 297236 - RNA, 32 nt, Human
acacugagaccagaaaagauggugcuaugcuu

SEQ ID NO: 297237 - RNA, 32 nt, Human
acacugagacuaagaauugaagcaaugcaguu

SEQ ID NO: 297238 - RNA, 32 nt, Human
acacugagagcugguggugccugcugucccag

SEQ ID NO: 297239 - RNA, 32 nt, Human
acacugagauggaaagcagagaugcauccauc

SEQ ID NO: 297240 - RNA, 32 nt, Human
acacugagauugccccagagcugcagugggca

SEQ ID NO: 297241 - RNA, 32 nt, Human
acacugagcaaguuuucaccuaucuggaaaaa

SEQ ID NO: 297242 - RNA, 19 nt, Human
acacugagccauacacccu

SEQ ID NO: 297243 - RNA, 32 nt, Human
acacugagccgggccagagggagaggagccga

SEQ ID NO: 297244 - RNA, 32 nt, Human
acacugagccuuucgcccuggaaguucuuggc

SEQ ID NO: 297245 - RNA, 32 nt, Human
acacugagcuuucuucuagggguggguaugaa

SEQ ID NO: 297246 - RNA, 32 nt, Human
acacugaggaaaaaugaagaagacugacaagc

SEQ ID NO: 297247 - RNA, 32 nt, Human
acacugaggcucagagagguuaagugacucag

SEQ ID NO: 297248 - RNA, 32 nt, Human
acacugaggguaggggacagggaggcucagga

SEQ ID NO: 297249 - RNA, 21 nt, Human
acacugagucggaggcgaagg

SEQ ID NO: 297250 - RNA, 32 nt, Human
acacugaucaaccacugaacugccuucuucca

SEQ ID NO: 297251 - RNA, 32 nt, Human
acacugaucugcuagugcuguaauauuguaaa

SEQ ID NO: 297252 - RNA, 32 nt, Human
acacugauuaaauaagaacuggagcaaguacu

SEQ ID NO: 297253 - RNA, 32 nt, Human
acacugauucuuucuucuucuuggcugaguca

SEQ ID NO: 297254 - RNA, 32 nt, Human
acacugcaacaacaggagugcaaacuucucua

SEQ ID NO: 297255 - RNA, 32 nt, Human
acacugcacuaggggagccccaggaaggcagc

SEQ ID NO: 297256 - RNA, 32 nt, Human
acacugcagccaaggacacagaggcucagaga

SEQ ID NO: 297257 - RNA, 32 nt, Human
acacugcaggcaggcuuuagagugcuuugaau

SEQ ID NO: 297258 - RNA, 32 nt, Human
acacugcagggcccaggagugggagcccaggc

SEQ ID NO: 297259 - RNA, 32 nt, Human
acacugcaguccagucuggaccacagagugag

SEQ ID NO: 297260 - RNA, 32 nt, Human
acacugcauaugguccccaucuggccucagag

SEQ ID NO: 297261 - RNA, 32 nt, Human
acacugcauaugguccccaucuggccugagag

SEQ ID NO: 297262 - RNA, 32 nt, Human
acacugcaugcacacacauacaccacagccac

SEQ ID NO: 297263 - RNA, 32 nt, Human
acacugcaugggaaaggcugagugucaugacu

SEQ ID NO: 297264 - RNA, 32 nt, Human
acacugccacuccagccugggugacagagcaa

SEQ ID NO: 297265 - RNA, 32 nt, Human
acacugccagcaaccucugcucucuggagagg

SEQ ID NO: 297266 - RNA, 32 nt, Human
acacugccagccccagggcuccagcccagccc

SEQ ID NO: 297267 - RNA, 32 nt, Human
acacugccagccccguguuagcaccugggccu

SEQ ID NO: 297268 - RNA, 32 nt, Human
acacugccaggggagccucacugugaagucua

SEQ ID NO: 297269 - RNA, 31 nt, Human
acacugcccaaggccaucacaggaggaauau

SEQ ID NO: 297270 - RNA, 22 nt, Human
acacugcccacucagcgaggaa

SEQ ID NO: 297271 - RNA, 20 nt, Human
acacugcccagcacaggggc

SEQ ID NO: 297272 - RNA, 32 nt, Human
acacugcccaggcuggagcauaguggcaagau

SEQ ID NO: 297273 - RNA, 19 nt, Human
acacugccccaccccagcc

SEQ ID NO: 297274 - RNA, 25 nt, Human
acacugcccccaacccucugccguu

SEQ ID NO: 297275 - RNA, 24 nt, Human
acacugcccccacccucagccguu

SEQ ID NO: 297276 - RNA, 23 nt, Human
acacugccccccaugccucagcc

SEQ ID NO: 297277 - RNA, 19 nt, Human
acacugccccccucccagc

SEQ ID NO: 297278 - RNA, 32 nt, Human
acacugccccugugguggagggcgggcugccu

SEQ ID NO: 297279 - RNA, 32 nt, Human
acacugcccugggguuuaccagcuggauuggc

SEQ ID NO: 297280 - RNA, 32 nt, Human
acacugccgccugcagaagguggagaguuaag

SEQ ID NO: 297281 - RNA, 32 nt, Human
acacugccuccacgagucuggagggcagcugg

SEQ ID NO: 297282 - RNA, 32 nt, Human
acacugccuccuuuuuauacagacacaaauau

SEQ ID NO: 297283 - RNA, 32 nt, Human
acacugccucuggagccagccugacaccaagg

SEQ ID NO: 297284 - RNA, 32 nt, Human
acacugccugauaugugagcaagagcaugaaa

SEQ ID NO: 297285 - RNA, 32 nt, Human
acacugccugcagcagucucuggguguguugu

SEQ ID NO: 297286 - RNA, 24 nt, Human
acacugccugccuuaagugaggaa

SEQ ID NO: 297287 - RNA, 32 nt, Human
acacugccugcucuuccauaucauggcccucc

SEQ ID NO: 297288 - RNA, 32 nt, Human
acacugccugggacaguguccugcauccacac

SEQ ID NO: 297289 - RNA, 32 nt, Human
acacugccuucaccaucuacaccagugacgcc

SEQ ID NO: 297290 - RNA, 32 nt, Human
acacugcgaacucucaggacuaccguuaccaa

SEQ ID NO: 297291 - RNA, 32 nt, Human
acacugcgaggacugccuugccacaggcccac

SEQ ID NO: 297292 - RNA, 32 nt, Human
acacugcucacugcagccucgaccucccaagg

SEQ ID NO: 297293 - RNA, 32 nt, Human
acacugcucauuuauccuauucucaugugcuu

SEQ ID NO: 297294 - RNA, 32 nt, Human
acacugcucugccucucugaaccucgguuucu

SEQ ID NO: 297295 - RNA, 21 nt, Human
acacugcugaaaucacacuac

SEQ ID NO: 297296 - RNA, 32 nt, Human
acacugcugaguguucagcuguguucagauaa

SEQ ID NO: 297297 - RNA, 32 nt, Human
acacugcugcacguagugccucaccagagcca

SEQ ID NO: 297298 - RNA, 32 nt, Human
acacugcugcacuccagccugugcaacagagc

SEQ ID NO: 297299 - RNA, 32 nt, Human
acacugcugcaucuugggucucagggacccag

SEQ ID NO: 297300 - RNA, 32 nt, Human
acacugcugccuggugcucccgccggcccaca

SEQ ID NO: 297301 - RNA, 32 nt, Human
acacugcuggacugcuccuggcucugucagca

SEQ ID NO: 297302 - RNA, 32 nt, Human
acacugcugggcaggcgggcaggcaggccugg

SEQ ID NO: 297303 - RNA, 32 nt, Human
acacugcugggcugggugaauggccuggucuc

SEQ ID NO: 297304 - RNA, 32 nt, Human
acacugcuguucuuuaaaugcguuccucaucc

SEQ ID NO: 297305 - RNA, 32 nt, Human
acacugcuuacacugcacucugacccuguagu

SEQ ID NO: 297306 - RNA, 24 nt, Human
acacugcuucccuuaugugaagaa

SEQ ID NO: 297307 - RNA, 32 nt, Human
acacuggaaaacaaauucccccaaaacacaug

SEQ ID NO: 297308 - RNA, 32 nt, Human
acacuggaaaauucacauuggagagaaacuuu

SEQ ID NO: 297309 - RNA, 32 nt, Human
acacuggaaggagcgcucucacuguggaagag

SEQ ID NO: 297310 - RNA, 32 nt, Human
acacuggaagugaaauuuuaaucaaacauaaa

SEQ ID NO: 297311 - RNA, 22 nt, Human
acacuggaaucccagugaggaa

SEQ ID NO: 297312 - RNA, 32 nt, Human
acacuggacagugcagguguagacggaguuca

SEQ ID NO: 297313 - RNA, 19 nt, Human
acacuggagaaaagccaua

SEQ ID NO: 297314 - RNA, 32 nt, Human
acacuggagagaaaccuaugaauguaaggaau

SEQ ID NO: 297315 - RNA, 24 nt, Human
acacuggagaggugauggggcagg

SEQ ID NO: 297316 - RNA, 32 nt, Human
acacuggagaucaugaugaacuuuuggcugaa

SEQ ID NO: 297317 - RNA, 23 nt, Human
acacuggagcccaggaguuugag

SEQ ID NO: 297318 - RNA, 21 nt, Human
acacuggagcccgcugcaggc

SEQ ID NO: 297319 - RNA, 32 nt, Human
acacuggaggcugagucaggagaaucacuuga

SEQ ID NO: 297320 - RNA, 20 nt, Human
acacuggagggcccccgagg

SEQ ID NO: 297321 - RNA, 32 nt, Human
acacuggaggugggggacgggaagggacuggg

SEQ ID NO: 297322 - RNA, 32 nt, Human
acacuggauccagaagcuauggaaccagcagu

SEQ ID NO: 297323 - RNA, 32 nt, Human
acacuggcacacacacauacacacauaugcac

SEQ ID NO: 297324 - RNA, 32 nt, Human
acacuggcaggugcuccucuccuuggcaauuc

SEQ ID NO: 297325 - RNA, 32 nt, Human
acacuggcccauuacauugaugacauuaugcu

SEQ ID NO: 297326 - RNA, 32 nt, Human
acacuggccccagggcccugcugccugggccu

SEQ ID NO: 297327 - RNA, 32 nt, Human
acacuggccgagucucugggucugucuacacu

SEQ ID NO: 297328 - RNA, 32 nt, Human
acacuggccuccagaagggcagcuccacaggg

SEQ ID NO: 297329 - RNA, 32 nt, Human
acacuggccuccauucugacaucugggcuggg

SEQ ID NO: 297330 - RNA, 32 nt, Human
acacuggcucauauuccugcagccuggaggcc

SEQ ID NO: 297331 - RNA, 32 nt, Human
acacuggcucgcagccucccccggcugcuggu

SEQ ID NO: 297332 - RNA, 20 nt, Human
acacuggcugcaagugguua

SEQ ID NO: 297333 - RNA, 32 nt, Human
acacugggaacuccagaaguuguggggagagu

SEQ ID NO: 297334 - RNA, 32 nt, Human
acacugggagcacuauuuccaugggcagcagg

SEQ ID NO: 297335 - RNA, 21 nt, Human
acacugggaggccgaggcagg

SEQ ID NO: 297336 - RNA, 32 nt, Human
acacugggaggcggggcaggacugggucugga

SEQ ID NO: 297337 - RNA, 32 nt, Human
acacugggaguuguucucccuacucuagaagu

SEQ ID NO: 297338 - RNA, 32 nt, Human
acacugggccugggccagggccccagagcucc

SEQ ID NO: 297339 - RNA, 32 nt, Human
acacuggggcugccuuucucugacucugucuu

SEQ ID NO: 297340 - RNA, 32 nt, Human
acacuggggcugggcauggugguucacaccug

SEQ ID NO: 297341 - RNA, 32 nt, Human
acacuggggguuuccuuggcagcuggggucau

SEQ ID NO: 297342 - RNA, 32 nt, Human
acacuggggugaagugggcaggagaauagaua

SEQ ID NO: 297343 - RNA, 20 nt, Human
acacuggucaaguaucugcu

SEQ ID NO: 297344 - RNA, 16 nt, Human
acacuggucacaggca

SEQ ID NO: 297345 - RNA, 32 nt, Human
acacuggucacuggcccugcacacugggcuau

SEQ ID NO: 297346 - RNA, 32 nt, Human
acacuggucucaaacuccugaccucaggcgau

SEQ ID NO: 297347 - RNA, 32 nt, Human
acacuggucucaaacuccugaccucaggugau

SEQ ID NO: 297348 - RNA, 32 nt, Human
acacuggugcgaucauagcucacugcagccuc

SEQ ID NO: 297349 - RNA, 32 nt, Human
acacugguuucuugcuuuguuuucccuggcua

SEQ ID NO: 297350 - RNA, 32 nt, Human
acacugguuuuccccaaagcuggcaguuuugu

SEQ ID NO: 297351 - RNA, 32 nt, Human
acacuguaaauccuggccuuaagcaaguuaua

SEQ ID NO: 297352 - RNA, 32 nt, Human
acacuguaaucaggauaacacaagcuuagugu

SEQ ID NO: 297353 - RNA, 32 nt, Human
acacuguacccugcucccagcaucacaaggca

SEQ ID NO: 297354 - RNA, 32 nt, Human
acacuguaccuggcuucucuucuuccuuuccu

SEQ ID NO: 297355 - RNA, 32 nt, Human
acacuguacuguacuaucuugcucugaguagu

SEQ ID NO: 297356 - RNA, 32 nt, Human
acacuguagccagaauggaauggucuuucugu

SEQ ID NO: 297357 - RNA, 32 nt, Human
acacuguaguuacugccuagccagcagcaguc

SEQ ID NO: 297358 - RNA, 32 nt, Human
acacuguauacauaugccaaaauaucauuuug

SEQ ID NO: 297359 - RNA, 32 nt, Human
acacugucacccaggcuggagugcaguguugc

SEQ ID NO: 297360 - RNA, 32 nt, Human
acacugucaggccaaccaugcacuccacaaag

SEQ ID NO: 297361 - RNA, 22 nt, Human
acacugucauugaagugaggaa

SEQ ID NO: 297362 - RNA, 32 nt, Human
acacuguccagggaaagagccaggaauggcag

SEQ ID NO: 297363 - RNA, 32 nt, Human
acacugucccauagccucauugggcucccaga

SEQ ID NO: 297364 - RNA, 32 nt, Human
acacuguccugccuuuuccucuagaauuuuau

SEQ ID NO: 297365 - RNA, 32 nt, Human
acacugucgccaggcuggagugcaguggugcg

SEQ ID NO: 297366 - RNA, 32 nt, Human
acacugucgcccaaucuggagugcacuggcgc

SEQ ID NO: 297367 - RNA, 32 nt, Human
acacugucggacuugcuuucugcuuuaugaug

SEQ ID NO: 297368 - RNA, 32 nt, Human
acacugucuuuuaguggugccuaaaauaaugg

SEQ ID NO: 297369 - RNA, 17 nt, Human
acacugugaaccacuua

SEQ ID NO: 297370 - RNA, 32 nt, Human
acacugugcagcccauccccucccagaaauag

SEQ ID NO: 297371 - RNA, 32 nt, Human
acacugugcagggccacacaaggggcugcacu

SEQ ID NO: 297372 - RNA, 18 nt, Human
acacugugcauaccuuga

SEQ ID NO: 297373 - RNA, 21 nt, Human
acacuguggcccaggcuggac

SEQ ID NO: 297374 - RNA, 32 nt, Human
acacuguggcccaggcuggacuccagcacagu

SEQ ID NO: 297375 - RNA, 32 nt, Human
acacuguggggaggaggaggaagaagaggagg

SEQ ID NO: 297376 - RNA, 32 nt, Human
acacugugguagggguuacaaauguuuauggg

SEQ ID NO: 297377 - RNA, 32 nt, Human
acacugugugaggcugugucucugccauccaa

SEQ ID NO: 297378 - RNA, 32 nt, Human
acacuguguuaucaaccauuaagaagaaagaa

SEQ ID NO: 297379 - RNA, 32 nt, Human
acacuguucacaaagguuuugucuccuuucca

SEQ ID NO: 297380 - RNA, 32 nt, Human
acacuguucagaagaugaacuaaacucagcag

SEQ ID NO: 297381 - RNA, 32 nt, Human
acacuguucaggcugaggcaggagaauugcuu

SEQ ID NO: 297382 - RNA, 32 nt, Human
acacuguugcccaggcuggagugcagugacgc

SEQ ID NO: 297383 - RNA, 32 nt, Human
acacuguugcccaggcuggagugcaguggcgu

SEQ ID NO: 297384 - RNA, 32 nt, Human
acacuguugguuggaauguaaagugguauaac

SEQ ID NO: 297385 - RNA, 32 nt, Human
acacuguugucuuuuaaaaugcuuccaaccca

SEQ ID NO: 297386 - RNA, 32 nt, Human
acacuguuugggaaaguguuccagcauagucc

SEQ ID NO: 297387 - RNA, 24 nt, Human
acacuguuuggucaaguuaaggaa

SEQ ID NO: 297388 - RNA, 32 nt, Human
acacuguuuguguagccaagaggacagaauua

SEQ ID NO: 297389 - RNA, 32 nt, Human
acacuuaaaccagcuuugcggggcugucgggg

SEQ ID NO: 297390 - RNA, 32 nt, Human
acacuuaaggaccaggacugggcacagccagc

SEQ ID NO: 297391 - RNA, 32 nt, Human
acacuuaauaacacgugaaacuauuuauguga

SEQ ID NO: 297392 - RNA, 21 nt, Human
acacuuaauuauauuuauggg

SEQ ID NO: 297393 - RNA, 32 nt, Human
acacuuacacauacuugaaacuuggaauaaaa

SEQ ID NO: 297394 - RNA, 22 nt, Human
acacuuaccccauggcugcaca

SEQ ID NO: 297395 - RNA, 32 nt, Human
acacuuaccugacagcggauccacaauauucu

SEQ ID NO: 297396 - RNA, 32 nt, Human
acacuuagaagagggaaaaugacaaguucagg

SEQ ID NO: 297397 - RNA, 32 nt, Human
acacuuagccuucugaagugcucaucucuugc

SEQ ID NO: 297398 - RNA, 32 nt, Human
acacuuagggacaggucacuaagcagaauagg

SEQ ID NO: 297399 - RNA, 32 nt, Human
acacuuagggguauggguugugcuccacuucc

SEQ ID NO: 297400 - RNA, 32 nt, Human
acacuuaguucagaaaccuuaaaggauuugaa

SEQ ID NO: 297401 - RNA, 18 nt, Human
acacuucaacuaaaaaua

SEQ ID NO: 297402 - RNA, 32 nt, Human
acacuucagaagcaaugggggcagagacaugu

SEQ ID NO: 297403 - RNA, 32 nt, Human
acacuucagauacgaccaucacggccacaugg

SEQ ID NO: 297404 - RNA, 32 nt, Human
acacuucaggaguccucagcuagugacauggu

SEQ ID NO: 297405 - RNA, 32 nt, Human
acacuucauacauacagagaacuuaucauuaa

SEQ ID NO: 297406 - RNA, 32 nt, Human
acacuuccaucuuucuuuugucuucauuucac

SEQ ID NO: 297407 - RNA, 32 nt, Human
acacuucccacacaugauccuucuucccuuca

SEQ ID NO: 297408 - RNA, 32 nt, Human
acacuucccacacgagcugcggcugccagccu

SEQ ID NO: 297409 - RNA, 32 nt, Human
acacuucccagagaggauucuagucugguaaa

SEQ ID NO: 297410 - RNA, 32 nt, Human
acacuuccccucccccaggagcccucaucugc

SEQ ID NO: 297411 - RNA, 32 nt, Human
acacuucccugccuugugucuuuugcuaaaua

SEQ ID NO: 297412 - RNA, 32 nt, Human
acacuucccuuucgcgacucaggcucuggugc

SEQ ID NO: 297413 - RNA, 32 nt, Human
acacuucguaucucuucucucuccucuguccu

SEQ ID NO: 297414 - RNA, 32 nt, Human
acacuucgugagccucccuguagccguggacc

SEQ ID NO: 297415 - RNA, 32 nt, Human
acacuucuacaaauaucaauuugcccaagacc

SEQ ID NO: 297416 - RNA, 32 nt, Human
acacuucucaacaguuuccuuuuuguuuuccu

SEQ ID NO: 297417 - RNA, 32 nt, Human
acacuucucacccccucacacaggcccagggg

SEQ ID NO: 297418 - RNA, 32 nt, Human
acacuucuccugccucagccucccagguagcc

SEQ ID NO: 297419 - RNA, 32 nt, Human
acacuucucugggcugcacagcagaaacguug

SEQ ID NO: 297420 - RNA, 32 nt, Human
acacuucucuuccucuugcccucccugccucu

SEQ ID NO: 297421 - RNA, 32 nt, Human
acacuucugagguacgguaucucucuccagcc

SEQ ID NO: 297422 - RNA, 32 nt, Human
acacuucugcagagacaaagcauuucacugca

SEQ ID NO: 297423 - RNA, 32 nt, Human
acacuucuguuucaugguuaagacagaaucag

SEQ ID NO: 297424 - RNA, 32 nt, Human
acacuucuucucuugacugccucucucuuacc

SEQ ID NO: 297425 - RNA, 32 nt, Human
acacuucuugaaacagccugggugacgguccu

SEQ ID NO: 297426 - RNA, 32 nt, Human
acacuugaaaauucuaugcaagagcaccaggc

SEQ ID NO: 297427 - RNA, 32 nt, Human
acacuugaaaucaucggucucaucucaaguca

SEQ ID NO: 297428 - RNA, 32 nt, Human
acacuugagaaagaauccucuaaaaaucccgg

SEQ ID NO: 297429 - RNA, 32 nt, Human
acacuugagccuggaaaagguugcagugagcu

SEQ ID NO: 297430 - RNA, 32 nt, Human
acacuugaggcuucugcuguguguucuuuugu

SEQ ID NO: 297431 - RNA, 32 nt, Human
acacuugcagagcugcuggaggugaggucagg

SEQ ID NO: 297432 - RNA, 32 nt, Human
acacuugcaugccaacuccuuccaaauucauu

SEQ ID NO: 297433 - RNA, 32 nt, Human
acacuugcccucaugugacacugggugacagu

SEQ ID NO: 297434 - RNA, 32 nt, Human
acacuugccucccauccugccugcagaaaacc

SEQ ID NO: 297435 - RNA, 32 nt, Human
acacuugcuaucucuugcugcugcuguuucau

SEQ ID NO: 297436 - RNA, 18 nt, Human
acacuugcuccagaaaua

SEQ ID NO: 297437 - RNA, 32 nt, Human
acacuugcuuaggggcucuccugggccccaca

SEQ ID NO: 297438 - RNA, 32 nt, Human
acacuugcuucaaugugcacaaacuuuguuuc

SEQ ID NO: 297439 - RNA, 32 nt, Human
acacuuggaugcauucuugcucucacagaauu

SEQ ID NO: 297440 - RNA, 32 nt, Human
acacuuggccguggcugaggggagagggcagc

SEQ ID NO: 297441 - RNA, 19 nt, Human
acacuuggcuggguuucua

SEQ ID NO: 297442 - RNA, 32 nt, Human
acacuuggcuguguguggaggcauuuugguug

SEQ ID NO: 297443 - RNA, 32 nt, Human
acacuuggggaaaagugaggccagucugcccg

SEQ ID NO: 297444 - RNA, 19 nt, Human
acacuuggggccaagaaua

SEQ ID NO: 297445 - RNA, 32 nt, Human
acacuugggguaaacacuauccaugcauuacu

SEQ ID NO: 297446 - RNA, 32 nt, Human
acacuugggguggccuaauaccuaggaagaug

SEQ ID NO: 297447 - RNA, 32 nt, Human
acacuugguagaagaaauugaaggguuacuca

SEQ ID NO: 297448 - RNA, 16 nt, Human
acacuugguccacuua

SEQ ID NO: 297449 - RNA, 32 nt, Human
acacuugguccauccauuuccaaaccuccacu

SEQ ID NO: 297450 - RNA, 32 nt, Human
acacuugguuccucagaaagccaagcccacug

SEQ ID NO: 297451 - RNA, 32 nt, Human
acacuugguuccucagaaagccaagcccgcug

SEQ ID NO: 297452 - RNA, 32 nt, Human
acacuuguaauuacauugcagcaaggaauggg

SEQ ID NO: 297453 - RNA, 32 nt, Human
acacuugucaggcagaaaagguagugaccggc

SEQ ID NO: 297454 - RNA, 32 nt, Human
acacuugugacugaaccaugcccaguuuaugc

SEQ ID NO: 297455 - RNA, 32 nt, Human
acacuugugcagcugcaaccaccauauccagg

SEQ ID NO: 297456 - RNA, 32 nt, Human
acacuuguguggaaugaaaacuugccaguuua

SEQ ID NO: 297457 - RNA, 32 nt, Human
acacuuguuacgaauccucccugcacugcauu

SEQ ID NO: 297458 - RNA, 32 nt, Human
acacuuguuccugcuugcuccuuuccccucuc

SEQ ID NO: 297459 - RNA, 32 nt, Human
acacuuguucucuugacugccucucucuuacc

SEQ ID NO: 297460 - RNA, 32 nt, Human
acacuuuacauacauuaucucauuuaauuccc

SEQ ID NO: 297461 - RNA, 32 nt, Human
acacuuuauauguguucacacauguaaguaca

SEQ ID NO: 297462 - RNA, 32 nt, Human
acacuuuauucugauuacagugcauugaauuu

SEQ ID NO: 297463 - RNA, 32 nt, Human
acacuuucaauggggaggcccacccaguggcc

SEQ ID NO: 297464 - RNA, 32 nt, Human
acacuuucacacuuaaacucuguggauaaauu

SEQ ID NO: 297465 - RNA, 32 nt, Human
acacuuucauaaggaucacagguuacguguuc

SEQ ID NO: 297466 - RNA, 32 nt, Human
acacuuuccaagcagagagcugaagugaaggc

SEQ ID NO: 297467 - RNA, 32 nt, Human
acacuuucccucccaccugccugcuccuggcg

SEQ ID NO: 297468 - RNA, 32 nt, Human
acacuuucccucucuggaccucaguuucccuc

SEQ ID NO: 297469 - RNA, 32 nt, Human
acacuuuccguuuucaugcagaauaaaucuaa

SEQ ID NO: 297470 - RNA, 20 nt, Human
acacuuuccugagaugcacu

SEQ ID NO: 297471 - RNA, 32 nt, Human
acacuuuccuuaaaauguugucaacagacaca

SEQ ID NO: 297472 - RNA, 32 nt, Human
acacuuucuaauucuacacuuccagguugaca

SEQ ID NO: 297473 - RNA, 32 nt, Human
acacuuucugacugcaacuucugucccuuguu

SEQ ID NO: 297474 - RNA, 32 nt, Human
acacuuugagacacaggaagcagcugaaggag

SEQ ID NO: 297475 - RNA, 32 nt, Human
acacuuugcccaagccuagucccguuucauca

SEQ ID NO: 297476 - RNA, 32 nt, Human
acacuuugcuuguauuuuaaaaggaggauaua

SEQ ID NO: 297477 - RNA, 32 nt, Human
acacuuugcuuugcacgauaacuuguaugcga

SEQ ID NO: 297478 - RNA, 32 nt, Human
acacuuugggagacugaagugggcagaucauu

SEQ ID NO: 297479 - RNA, 32 nt, Human
acacuuugggaggcugagauggguggauugcu

SEQ ID NO: 297480 - RNA, 32 nt, Human
acacuuugggagguggaggcagguggaucacg

SEQ ID NO: 297481 - RNA, 32 nt, Human
acacuuugggggauccaaaaagagcugcaauu

SEQ ID NO: 297482 - RNA, 32 nt, Human
acacuuugguagaccgaagugggcagaucacc

SEQ ID NO: 297483 - RNA, 32 nt, Human
acacuuuggucacaucugucucuagaugguca

SEQ ID NO: 297484 - RNA, 32 nt, Human
acacuuuuaugaccaccucuuucccagauuau

SEQ ID NO: 297485 - RNA, 32 nt, Human
acacuuuucaaaagaagacaucuguggccaac

SEQ ID NO: 297486 - RNA, 18 nt, Human
acacuuuucacaaaaaua

SEQ ID NO: 297487 - RNA, 32 nt, Human
acacuuuuccacccuccaccaccccaaccuca

SEQ ID NO: 297488 - RNA, 32 nt, Human
acacuuuugcccugcagccucaguuuugaauu

SEQ ID NO: 297489 - RNA, 32 nt, Human
acacuuuugccucucaaguugagacugccucu

SEQ ID NO: 297490 - RNA, 32 nt, Human
acacuuuugucaucccaagagcuguguuacac

SEQ ID NO: 297491 - RNA, 32 nt, Human
acacuuuuucaucaucuaaacugauucgcaua

SEQ ID NO: 297492 - RNA, 32 nt, Human
acacuuuuuccauguugaacaaaugccaacuu

SEQ ID NO: 297493 - RNA, 32 nt, Human
acacuuuuucccacccuuuuaaagcuacaagu

SEQ ID NO: 297494 - RNA, 32 nt, Human
acacuuuuucugcuuuucuuaauccuuuucca

SEQ ID NO: 297495 - RNA, 32 nt, Human
acacuuuuucuuuccgguuugccggaauaaac

SEQ ID NO: 297496 - RNA, 32 nt, Human
acacuuuuuguagacauggguaccaaaaauac

SEQ ID NO: 297497 - RNA, 20 nt, Human
acagaaaaaaugggagcaag

SEQ ID NO: 297498 - RNA, 32 nt, Human
acagaaaaaguaaacugucaaggaauucagag

SEQ ID NO: 297499 - RNA, 23 nt, Human
acagaaaaaugccuugagggcaa

SEQ ID NO: 297500 - RNA, 32 nt, Human
acagaaaaauuagccaggcauggugguagaug

SEQ ID NO: 297501 - RNA, 32 nt, Human
acagaaaaauuagcugggugugguggugggca

SEQ ID NO: 297502 - RNA, 20 nt, Human
acagaaaaauugagaggaag

SEQ ID NO: 297503 - RNA, 32 nt, Human
acagaaaacaucagggucuuggaacaccagag

SEQ ID NO: 297504 - RNA, 32 nt, Human
acagaaaaccaccagacucacacagcuuguau

SEQ ID NO: 297505 - RNA, 32 nt, Human
acagaaaacccgcaaucgagcaucaucgacuc

SEQ ID NO: 297506 - RNA, 32 nt, Human
acagaaaacugaucuguagauaacgagggaga

SEQ ID NO: 297507 - RNA, 19 nt, Human
acagaaaagaaaagaaaag

SEQ ID NO: 297508 - RNA, 17 nt, Human
acagaaaagaaaagcag

SEQ ID NO: 297509 - RNA, 19 nt, Human
acagaaaagaaagcaguaa

SEQ ID NO: 297510 - RNA, 32 nt, Human
acagaaaagaagauggagagaccaccuucacu

SEQ ID NO: 297511 - RNA, 22 nt, Human
acagaaaagacagaagaugcaa

SEQ ID NO: 297512 - RNA, 31 nt, Human
acagaaaagagacauuucagcugugauuaug

SEQ ID NO: 297513 - RNA, 32 nt, Human
acagaaaagaggaagaggagaauggauguugg

SEQ ID NO: 297514 - RNA, 16 nt, Human
acagaaaagagguaag

SEQ ID NO: 297515 - RNA, 18 nt, Human
acagaaaagauauagcaa

SEQ ID NO: 297516 - RNA, 32 nt, Human
acagaaaagaugaccccagcuccugacacaca

SEQ ID NO: 297517 - RNA, 19 nt, Human
acagaaaagcaaauagcaa

SEQ ID NO: 297518 - RNA, 18 nt, Human
acagaaaagcaagagcaa

SEQ ID NO: 297519 - RNA, 19 nt, Human
acagaaaagccugagauaa

SEQ ID NO: 297520 - RNA, 32 nt, Human
acagaaaagccugcuuguugguuuaguuggau

SEQ ID NO: 297521 - RNA, 19 nt, Human
acagaaaaggaaagaagca

SEQ ID NO: 297522 - RNA, 19 nt, Human
acagaaaaggaagaggaag

SEQ ID NO: 297523 - RNA, 19 nt, Human
acagaaaaguacuugcagg

SEQ ID NO: 297524 - RNA, 18 nt, Human
acagaaaaguagcgcagg

SEQ ID NO: 297525 - RNA, 20 nt, Human
acagaaaaguggaggccaag

SEQ ID NO: 297526 - RNA, 18 nt, Human
acagaaaaguuccccaag

SEQ ID NO: 297527 - RNA, 18 nt, Human
acagaaaaguucuccaag

SEQ ID NO: 297528 - RNA, 19 nt, Human
acagaaaaguugggaaaag

SEQ ID NO: 297529 - RNA, 19 nt, Human
acagaaaauaaaaaagcaa

SEQ ID NO: 297530 - RNA, 17 nt, Human
acagaaaauaaaaagca

SEQ ID NO: 297531 - RNA, 32 nt, Human
acagaaaaucauuguaagacaauuuauuaauu

SEQ ID NO: 297532 - RNA, 32 nt, Human
acagaaaaugaugcucucuccugccaaguccc

SEQ ID NO: 297533 - RNA, 19 nt, Human
acagaaaauguacagcaag

SEQ ID NO: 297534 - RNA, 19 nt, Human
acagaaaauuaaaaggcaa

SEQ ID NO: 297535 - RNA, 32 nt, Human
acagaaacaacuggcaaaaaugaacuaagauu

SEQ ID NO: 297536 - RNA, 32 nt, Human
acagaaacacaaaacuuugacuugacuugcga

SEQ ID NO: 297537 - RNA, 32 nt, Human
acagaaacacagagaaggcuagguaugagagg

SEQ ID NO: 297538 - RNA, 28 nt, Human
acagaaacacucccagggacucugggga

SEQ ID NO: 297539 - RNA, 32 nt, Human
acagaaacacuucagaagcaaugggggcagag

SEQ ID NO: 297540 - RNA, 18 nt, Human
acagaaacagagaguaag

SEQ ID NO: 297541 - RNA, 32 nt, Human
acagaaacagcaucuucgcuacaaccacugac

SEQ ID NO: 297542 - RNA, 32 nt, Human
acagaaacaguuuccccacugaugggaccaga

SEQ ID NO: 297543 - RNA, 32 nt, Human
acagaaacauagcugaggaacaaauagaccau

SEQ ID NO: 297544 - RNA, 32 nt, Human
acagaaaccaccugcguccacacccucacugc

SEQ ID NO: 297545 - RNA, 19 nt, Human
acagaaaccagaaaagcaa

SEQ ID NO: 297546 - RNA, 32 nt, Human
acagaaaccagccucagaguccggggcaggag

SEQ ID NO: 297547 - RNA, 32 nt, Human
acagaaaccagucauggcccugccuuugcccc

SEQ ID NO: 297548 - RNA, 22 nt, Human
acagaaaccaguccugcucucc

SEQ ID NO: 297549 - RNA, 28 nt, Human
acagaaaccccucuucuccccgcccucc

SEQ ID NO: 297550 - RNA, 20 nt, Human
acagaaacguguagagcaag

SEQ ID NO: 297551 - RNA, 32 nt, Human
acagaaacuggagugcuugaaggagcugcaga

SEQ ID NO: 297552 - RNA, 18 nt, Human
acagaaacuugagagaag

SEQ ID NO: 297553 - RNA, 31 nt, Human
acagaaacuugcccugugccuguguccccca

SEQ ID NO: 297554 - RNA, 32 nt, Human
acagaaagaagaaaggaaagaaaggaaccaga

SEQ ID NO: 297555 - RNA, 32 nt, Human
acagaaagacagggagaaagagaaacagaaaa

SEQ ID NO: 297556 - RNA, 32 nt, Human
acagaaagagacauuguucuuuuccugagucu

SEQ ID NO: 297557 - RNA, 18 nt, Human
acagaaagagcgagcgag

SEQ ID NO: 297558 - RNA, 20 nt, Human
acagaaagaggaggagcaag

SEQ ID NO: 297559 - RNA, 22 nt, Human
acagaaagaggaguggucuuug

SEQ ID NO: 297560 - RNA, 17 nt, Human
acagaaagagggacaag

SEQ ID NO: 297561 - RNA, 32 nt, Human
acagaaagagguggggguaaacaaugagcuca

SEQ ID NO: 297562 - RNA, 24 nt, Human
acagaaagauugguaagagccaag

SEQ ID NO: 297563 - RNA, 32 nt, Human
acagaaagauugguggacaggagcagcggccg

SEQ ID NO: 297564 - RNA, 32 nt, Human
acagaaagccugggugacauuugggagacaug

SEQ ID NO: 297565 - RNA, 32 nt, Human
acagaaagcgaagauggugagagccagcccgg

SEQ ID NO: 297566 - RNA, 32 nt, Human
acagaaaggaagcaggacagcagggccccucu

SEQ ID NO: 297567 - RNA, 22 nt, Human
acagaaaggagcagagagcaag

SEQ ID NO: 297568 - RNA, 18 nt, Human
acagaaaggaugagacaa

SEQ ID NO: 297569 - RNA, 32 nt, Human
acagaaagguucuguuggauucugagcggaac

SEQ ID NO: 297570 - RNA, 19 nt, Human
acagaaaguagggaggaag

SEQ ID NO: 297571 - RNA, 32 nt, Human
acagaaaguagggaggaaggggaccaagccag

SEQ ID NO: 297572 - RNA, 20 nt, Human
acagaaagugcugagccaag

SEQ ID NO: 297573 - RNA, 32 nt, Human
acagaaaguucaggagcccuggaaaggagaag

SEQ ID NO: 297574 - RNA, 32 nt, Human
acagaaaguuggauucagagucuggaaagaug

SEQ ID NO: 297575 - RNA, 17 nt, Human
acagaaauaaagagcaa

SEQ ID NO: 297576 - RNA, 32 nt, Human
acagaaauaccugaaauucaguaguacuucau

SEQ ID NO: 297577 - RNA, 20 nt, Human
acagaaauacgcagagcaag

SEQ ID NO: 297578 - RNA, 20 nt, Human
acagaaauagaagaaagcaa

SEQ ID NO: 297579 - RNA, 21 nt, Human
acagaaauagaagaaagcaag

SEQ ID NO: 297580 - RNA, 32 nt, Human
acagaaauaggagcagagaaaagggaaugaga

SEQ ID NO: 297581 - RNA, 32 nt, Human
acagaaauauuccuacugucuuuggaaacccu

SEQ ID NO: 297582 - RNA, 18 nt, Human
acagaaaucaagaguaag

SEQ ID NO: 297583 - RNA, 25 nt, Human
acagaaaucugaagaaaggcugaaa

SEQ ID NO: 297584 - RNA, 24 nt, Human
acagaaaugcugucugagagcaag

SEQ ID NO: 297585 - RNA, 32 nt, Human
acagaaauucauuaugcugcuaauuuaacgug

SEQ ID NO: 297586 - RNA, 32 nt, Human
acagaaauugaaaaugaccaaaaucaggaacc

SEQ ID NO: 297587 - RNA, 32 nt, Human
acagaaauuuagucucucgugguucuggaggg

SEQ ID NO: 297588 - RNA, 32 nt, Human
acagaaauuuguuuuaaaaucuuucaggagcu

SEQ ID NO: 297589 - RNA, 32 nt, Human
acagaacaaaggcaaauuaaaagcagcuuugu

SEQ ID NO: 297590 - RNA, 19 nt, Human
acagaacacaaaagagcag

SEQ ID NO: 297591 - RNA, 32 nt, Human
acagaacacagcugguuuccuggguaugccug

SEQ ID NO: 297592 - RNA, 32 nt, Human
acagaacacccacugccuagaggccaucuuaa

SEQ ID NO: 297593 - RNA, 32 nt, Human
acagaacacuccuauuuguaccucaacaaaug

SEQ ID NO: 297594 - RNA, 19 nt, Human
acagaacagcaagagcagg

SEQ ID NO: 297595 - RNA, 18 nt, Human
acagaacagcgagagcaa

SEQ ID NO: 297596 - RNA, 32 nt, Human
acagaacagcuuucugcucauugaacccagag

SEQ ID NO: 297597 - RNA, 17 nt, Human
acagaacagggaagcag

SEQ ID NO: 297598 - RNA, 32 nt, Human
acagaacagguucaaauaacuuuuccacugca

SEQ ID NO: 297599 - RNA, 24 nt, Human
acagaacauagacagaagaaacaa

SEQ ID NO: 297600 - RNA, 24 nt, Human
acagaacauagccacccuguuuca

SEQ ID NO: 297601 - RNA, 18 nt, Human
acagaacauaucuucaca

SEQ ID NO: 297602 - RNA, 24 nt, Human
acagaacauugguagguaacaaga

SEQ ID NO: 297603 - RNA, 20 nt, Human
acagaaccaaaauuggaagc

SEQ ID NO: 297604 - RNA, 18 nt, Human
acagaaccaaagaagcaa

SEQ ID NO: 297605 - RNA, 22 nt, Human
acagaaccagaacuagagccug

SEQ ID NO: 297606 - RNA, 32 nt, Human
acagaaccauguccaggacuucauccguggga

SEQ ID NO: 297607 - RNA, 20 nt, Human
acagaacccagagaaaacaa

SEQ ID NO: 297608 - RNA, 32 nt, Human
acagaaccccaagaacagcccaggaagucgcc

SEQ ID NO: 297609 - RNA, 32 nt, Human
acagaaccccuggaagucuggacaugagccug

SEQ ID NO: 297610 - RNA, 24 nt, Human
acagaaccugcuaaggccaucaaa

SEQ ID NO: 297611 - RNA, 32 nt, Human
acagaacgaggcaccaacagcaaggggcaagc

SEQ ID NO: 297612 - RNA, 32 nt, Human
acagaacuaagaugaucaucuccaguuuauag

SEQ ID NO: 297613 - RNA, 32 nt, Human
acagaacuagagcaaggaggugaugaaauacu

SEQ ID NO: 297614 - RNA, 32 nt, Human
acagaacuauauacacacauuguaccaauuuc

SEQ ID NO: 297615 - RNA, 19 nt, Human
acagaacucagagaaacaa

SEQ ID NO: 297616 - RNA, 18 nt, Human
acagaacucuagccaaag

SEQ ID NO: 297617 - RNA, 21 nt, Human
acagaacugaugcucaggcca

SEQ ID NO: 297618 - RNA, 32 nt, Human
acagaacugcuguuuacacaguucucaggagg

SEQ ID NO: 297619 - RNA, 32 nt, Human
acagaacuggaagagaaagaaggaaaagauga

SEQ ID NO: 297620 - RNA, 32 nt, Human
acagaacuuagagugugcugguuagucacaua

SEQ ID NO: 297621 - RNA, 32 nt, Human
acagaacuuccugagccuagagcugcuguguu

SEQ ID NO: 297622 - RNA, 32 nt, Human
acagaacuuggccuuuuguugugaauuaggua

SEQ ID NO: 297623 - RNA, 32 nt, Human
acagaacuuggcuaauggaauucacagaggug

SEQ ID NO: 297624 - RNA, 31 nt, Human
acagaagaaagaccuguguccuagagaguag

SEQ ID NO: 297625 - RNA, 32 nt, Human
acagaagaaauuauuucucugaucauuuaguu

SEQ ID NO: 297626 - RNA, 18 nt, Human
acagaagaacaagagcaa

SEQ ID NO: 297627 - RNA, 32 nt, Human
acagaagaagaaaaagaacuggggugcagaug

SEQ ID NO: 297628 - RNA, 18 nt, Human
acagaagaagagaggaag

SEQ ID NO: 297629 - RNA, 32 nt, Human
acagaagaauuugaaaaacacagcugcugaag

SEQ ID NO: 297630 - RNA, 32 nt, Human
acagaagacacaccuugggcauauccuacaga

SEQ ID NO: 297631 - RNA, 32 nt, Human
acagaagacagagcaugcucuuuuagucugau

SEQ ID NO: 297632 - RNA, 32 nt, Human
acagaagacagaggcagaagcagcuuuauuga

SEQ ID NO: 297633 - RNA, 18 nt, Human
acagaagacagcagcaag

SEQ ID NO: 297634 - RNA, 32 nt, Human
acagaagacagugucuuggacgcccagcggaa

SEQ ID NO: 297635 - RNA, 18 nt, Human
acagaagagagaagagca

SEQ ID NO: 297636 - RNA, 32 nt, Human
acagaagaggcugcugggccucuugucuucac

SEQ ID NO: 297637 - RNA, 32 nt, Human
acagaagauguagcaguuccugaacagggaaa

SEQ ID NO: 297638 - RNA, 32 nt, Human
acagaagcaauaugauuuccauacauccaacc

SEQ ID NO: 297639 - RNA, 32 nt, Human
acagaagcacaauggcccuucgcucuccccca

SEQ ID NO: 297640 - RNA, 32 nt, Human
acagaagcacacuguuuuugaacuugacaaca

SEQ ID NO: 297641 - RNA, 32 nt, Human
acagaagcagagcccauggagccagaccccac

SEQ ID NO: 297642 - RNA, 32 nt, Human
acagaagcagaggcaguucugaggcagcaggc

SEQ ID NO: 297643 - RNA, 32 nt, Human
acagaagcagcuggaagagaacucgaggggcu

SEQ ID NO: 297644 - RNA, 19 nt, Human
acagaagcaggaaaaccaa

SEQ ID NO: 297645 - RNA, 32 nt, Human
acagaagcauccaggcugcaggaguacagguc

SEQ ID NO: 297646 - RNA, 32 nt, Human
acagaagcaugaucacuugcuaucaacagugu

SEQ ID NO: 297647 - RNA, 32 nt, Human
acagaagcauggcaaggauguuucuggcagca

SEQ ID NO: 297648 - RNA, 20 nt, Human
acagaagccaacaaaagcaa

SEQ ID NO: 297649 - RNA, 32 nt, Human
acagaagccagccagccuagcagcccuaugcg

SEQ ID NO: 297650 - RNA, 21 nt, Human
acagaagcccaggacgucucc

SEQ ID NO: 297651 - RNA, 32 nt, Human
acagaagcuggggaggugagagugcagaaagg

SEQ ID NO: 297652 - RNA, 30 nt, Human
acagaaggaagccaagggagcagugcaaug

SEQ ID NO: 297653 - RNA, 32 nt, Human
acagaaggacugccugccucccucccugucug

SEQ ID NO: 297654 - RNA, 19 nt, Human
acagaaggagaagaggaag

SEQ ID NO: 297655 - RNA, 32 nt, Human
acagaaggaggauugaauuaaagggaaagugu

SEQ ID NO: 297656 - RNA, 32 nt, Human
acagaaggaggguggaggaagugaucagaggg

SEQ ID NO: 297657 - RNA, 18 nt, Human
acagaaggaguagaguaa

SEQ ID NO: 297658 - RNA, 32 nt, Human
acagaaggauucacaauuagaagaaaaguuga

SEQ ID NO: 297659 - RNA, 20 nt, Human
acagaaggcagaacugaagc

SEQ ID NO: 297660 - RNA, 32 nt, Human
acagaaggccuccagcuccuccgcucugcccu

SEQ ID NO: 297661 - RNA, 32 nt, Human
acagaagggacuggaaaguuauguucaaaggc

SEQ ID NO: 297662 - RNA, 21 nt, Human
acagaaggggagcgaggcaag

SEQ ID NO: 297663 - RNA, 19 nt, Human
acagaagggggaacgcaag

SEQ ID NO: 297664 - RNA, 32 nt, Human
acagaagggucuccuuggucauguggcauuuu

SEQ ID NO: 297665 - RNA, 32 nt, Human
acagaagggugcagaggcgcccaggggaguac

SEQ ID NO: 297666 - RNA, 18 nt, Human
acagaaggguuaaggcaa

SEQ ID NO: 297667 - RNA, 32 nt, Human
acagaaggugaguuuggggccugcagagccuc

SEQ ID NO: 297668 - RNA, 18 nt, Human
acagaaguacaaaagcaa

SEQ ID NO: 297669 - RNA, 32 nt, Human
acagaaguauugagagaaacaccaagacucua

SEQ ID NO: 297670 - RNA, 32 nt, Human
acagaaguauugauggugauuuggagggcuga

SEQ ID NO: 297671 - RNA, 32 nt, Human
acagaagucacgugauggagagaggauucaaa

SEQ ID NO: 297672 - RNA, 32 nt, Human
acagaagucauguuccagcuuagacugaugaa

SEQ ID NO: 297673 - RNA, 32 nt, Human
acagaagucccugaggcccccagaccuggcuc

SEQ ID NO: 297674 - RNA, 23 nt, Human
acagaagucuuaagucuguggca

SEQ ID NO: 297675 - RNA, 32 nt, Human
acagaagugacuucuggagaaagcucauggcu

SEQ ID NO: 297676 - RNA, 32 nt, Human
acagaagugcuagaagccagugcucgugaacu

SEQ ID NO: 297677 - RNA, 20 nt, Human
acagaagugggugagagcaa

SEQ ID NO: 297678 - RNA, 22 nt, Human
acagaaguuuaauacuuucuua

SEQ ID NO: 297679 - RNA, 19 nt, Human
acagaauaauggagaacaa

SEQ ID NO: 297680 - RNA, 17 nt, Human
acagaauacaguugcag

SEQ ID NO: 297681 - RNA, 32 nt, Human
acagaauacauacuuauucccauuuuuaagca

SEQ ID NO: 297682 - RNA, 16 nt, Human
acagaauaccaagcag

SEQ ID NO: 297683 - RNA, 20 nt, Human
acagaauacggaagagcagg

SEQ ID NO: 297684 - RNA, 16 nt, Human
acagaauacuaaagca

SEQ ID NO: 297685 - RNA, 20 nt, Human
acagaauacuguuaaaggaa

SEQ ID NO: 297686 - RNA, 32 nt, Human
acagaauagcuccacaccacagcuugagauuu

SEQ ID NO: 297687 - RNA, 32 nt, Human
acagaauaggagaggacacagagacacagaga

SEQ ID NO: 297688 - RNA, 20 nt, Human
acagaauaggaggaaaacaa

SEQ ID NO: 297689 - RNA, 24 nt, Human
acagaauaggauaaaauauuugua

SEQ ID NO: 297690 - RNA, 32 nt, Human
acagaauagggagaaggaggagaggggaggcu

SEQ ID NO: 297691 - RNA, 20 nt, Human
acagaauauacagaaagcaa

SEQ ID NO: 297692 - RNA, 22 nt, Human
acagaauauucuuugcguugua

SEQ ID NO: 297693 - RNA, 23 nt, Human
acagaauauuucaucugacagua

SEQ ID NO: 297694 - RNA, 32 nt, Human
acagaaucaccaggaugggacacaggucuugc

SEQ ID NO: 297695 - RNA, 32 nt, Human
acagaaucagaccaugacuaccuucaccugga

SEQ ID NO: 297696 - RNA, 32 nt, Human
acagaaucccaucuuuuccuucggcagauugc

SEQ ID NO: 297697 - RNA, 32 nt, Human
acagaaucgguccaggagggugcggcugugga

SEQ ID NO: 297698 - RNA, 32 nt, Human
acagaaucuaacuggugagcuucagaaccaau

SEQ ID NO: 297699 - RNA, 32 nt, Human
acagaaucucacuccagccugggcaacagaau

SEQ ID NO: 297700 - RNA, 32 nt, Human
acagaaucucucucauggcuuccuaagggaug

SEQ ID NO: 297701 - RNA, 32 nt, Human
acagaaucuucucugcugguucccaggcugcu

SEQ ID NO: 297702 - RNA, 32 nt, Human
acagaaugaaucgugaacauuaucucaauauu

SEQ ID NO: 297703 - RNA, 32 nt, Human
acagaaugcagcuuucaagguucguuucaagc

SEQ ID NO: 297704 - RNA, 20 nt, Human
acagaaugcaguaaaagcag

SEQ ID NO: 297705 - RNA, 20 nt, Human
acagaauggaaugaagcaac

SEQ ID NO: 297706 - RNA, 24 nt, Human
acagaaugggagaaaauuuuugca

SEQ ID NO: 297707 - RNA, 31 nt, Human
acagaaugguggagagaaaagagaaugcuga

SEQ ID NO: 297708 - RNA, 32 nt, Human
acagaaugucaacaucacacugugcauccucu

SEQ ID NO: 297709 - RNA, 17 nt, Human
acagaaugugaaaaagc

SEQ ID NO: 297710 - RNA, 32 nt, Human
acagaauguucugccuucccuuccaucucuuc

SEQ ID NO: 297711 - RNA, 17 nt, Human
acagaauuaaaaagcag

SEQ ID NO: 297712 - RNA, 32 nt, Human
acagaauuaucauuuucccuggcucccauuac

SEQ ID NO: 297713 - RNA, 32 nt, Human
acagaauuauuuuucucuguagaaacacagau

SEQ ID NO: 297714 - RNA, 32 nt, Human
acagaauucccaagcuuuuuccaguucuagau

SEQ ID NO: 297715 - RNA, 24 nt, Human
acagaauucucauccuuccacuga

SEQ ID NO: 297716 - RNA, 32 nt, Human
acagaauugcuuagaaaggagcagagaaggac

SEQ ID NO: 297717 - RNA, 32 nt, Human
acagaauuucaucacccaaugcagggggagcu

SEQ ID NO: 297718 - RNA, 32 nt, Human
acagaauuucccacagucuuugcccucaagga

SEQ ID NO: 297719 - RNA, 32 nt, Human
acagaauuuccuaaaaucagaagaauuggaag

SEQ ID NO: 297720 - RNA, 32 nt, Human
acagaauuuuaaggcguguguaugacacagua

SEQ ID NO: 297721 - RNA, 19 nt, Human
acagaauuuuuaaaagcaa

SEQ ID NO: 297722 - RNA, 32 nt, Human
acagacaaccuucugugccuucaucaagcugg

SEQ ID NO: 297723 - RNA, 32 nt, Human
acagacaagcagcuccacaggaggagugcaca

SEQ ID NO: 297724 - RNA, 32 nt, Human
acagacaaggaaaucaagacccagcuuggggg

SEQ ID NO: 297725 - RNA, 32 nt, Human
acagacaaggucuugcuauguugcccaggcug

SEQ ID NO: 297726 - RNA, 32 nt, Human
acagacaaguuacagacaggaggggaaagagg

SEQ ID NO: 297727 - RNA, 32 nt, Human
acagacacacaagcagacacacacauauauac

SEQ ID NO: 297728 - RNA, 32 nt, Human
acagacacagagauggagaagcagggacaugc

SEQ ID NO: 297729 - RNA, 32 nt, Human
acagacacaggaaaauccauuuuccccacucu

SEQ ID NO: 297730 - RNA, 32 nt, Human
acagacacaggguggggguggggaggggcggu

SEQ ID NO: 297731 - RNA, 32 nt, Human
acagacaccacuucuaguaaaucucuguaaau

SEQ ID NO: 297732 - RNA, 32 nt, Human
acagacaccaugucccaggacaguguuacuuc

SEQ ID NO: 297733 - RNA, 32 nt, Human
acagacacccgccaccacgcccggcuaauuuu

SEQ ID NO: 297734 - RNA, 32 nt, Human
acagacaccuucccauccccagcguuuguuca

SEQ ID NO: 297735 - RNA, 32 nt, Human
acagacacucagcccuccccacccuggcucuc

SEQ ID NO: 297736 - RNA, 32 nt, Human
acagacacugagccacgcagccccgccucugg

SEQ ID NO: 297737 - RNA, 32 nt, Human
acagacacugcacagaccuuagggaauggcag

SEQ ID NO: 297738 - RNA, 32 nt, Human
acagacacuguugcaaagguagggacuggagg

SEQ ID NO: 297739 - RNA, 32 nt, Human
acagacacuucacuuagccuagggggccuucc

SEQ ID NO: 297740 - RNA, 32 nt, Human
acagacacuuuucaaaagaagacaucuguggc

SEQ ID NO: 297741 - RNA, 32 nt, Human
acagacagaaaauccagaaucuuuucaaagcc

SEQ ID NO: 297742 - RNA, 32 nt, Human
acagacagaauuuccagccauuguucuuuucu

SEQ ID NO: 297743 - RNA, 32 nt, Human
acagacagacagacacgcacacacacccaucu

SEQ ID NO: 297744 - RNA, 32 nt, Human
acagacagacagacgcacacacacaacagaug

SEQ ID NO: 297745 - RNA, 32 nt, Human
acagacagacaggcagacagacgcacggacaa

SEQ ID NO: 297746 - RNA, 32 nt, Human
acagacagacucaccccauuguguacagacaa

SEQ ID NO: 297747 - RNA, 32 nt, Human
acagacagaggaugagcucuacccagggccug

SEQ ID NO: 297748 - RNA, 32 nt, Human
acagacagagucucacucugucacccaggcug

SEQ ID NO: 297749 - RNA, 32 nt, Human
acagacagagucuugcucugucacccaggcug

SEQ ID NO: 297750 - RNA, 32 nt, Human
acagacagcagucuagaagcagcagcugggcc

SEQ ID NO: 297751 - RNA, 32 nt, Human
acagacagccacugaggcccauggacaaucuc

SEQ ID NO: 297752 - RNA, 32 nt, Human
acagacaggagaaaagagauggugcccugggc

SEQ ID NO: 297753 - RNA, 32 nt, Human
acagacaggauggacuuccuccggcuauaccu

SEQ ID NO: 297754 - RNA, 32 nt, Human
acagacagggaggcgguggcagaggacacuug

SEQ ID NO: 297755 - RNA, 32 nt, Human
acagacaggggcgcugcugcagaugcuccagg

SEQ ID NO: 297756 - RNA, 18 nt, Human
acagacagggugaacaag

SEQ ID NO: 297757 - RNA, 32 nt, Human
acagacaggguuucaccauguuggccaggcug

SEQ ID NO: 297758 - RNA, 32 nt, Human
acagacagucaggcugaaaaggacaguucuuu

SEQ ID NO: 297759 - RNA, 32 nt, Human
acagacagucaggcugaaauggacaguucuuu

SEQ ID NO: 297760 - RNA, 32 nt, Human
acagacauaagguauuucaaaauaaaucucag

SEQ ID NO: 297761 - RNA, 32 nt, Human
acagacauauagacaaauagauacuugcauag

SEQ ID NO: 297762 - RNA, 32 nt, Human
acagacaucuuccuccucccucaucccuucca

SEQ ID NO: 297763 - RNA, 17 nt, Human
acagacaugaaaagcaa

SEQ ID NO: 297764 - RNA, 32 nt, Human
acagacaugagaccauaggggaccugucuggg

SEQ ID NO: 297765 - RNA, 18 nt, Human
acagacaugcaccaccac

SEQ ID NO: 297766 - RNA, 32 nt, Human
acagacaugccuuccguuuggagggccgcggc

SEQ ID NO: 297767 - RNA, 32 nt, Human
acagacauggcgcuucagcugucuucagaaua

SEQ ID NO: 297768 - RNA, 23 nt, Human
acagacauuagccaucacgccug

SEQ ID NO: 297769 - RNA, 32 nt, Human
acagacauugcccggaaacucagucuauuuau

SEQ ID NO: 297770 - RNA, 32 nt, Human
acagacauuugcuuccugguggcaaguaacug

SEQ ID NO: 297771 - RNA, 32 nt, Human
acagaccaagggagacagaggguggagggcca

SEQ ID NO: 297772 - RNA, 32 nt, Human
acagaccacaauauuaucauaccacucuucaa

SEQ ID NO: 297773 - RNA, 32 nt, Human
acagaccacugcauggugcuucgucaccaccg

SEQ ID NO: 297774 - RNA, 32 nt, Human
acagaccagcaaaauuuuuggcaauucuuuca

SEQ ID NO: 297775 - RNA, 32 nt, Human
acagaccagcaauacuucagagcccaguuucu

SEQ ID NO: 297776 - RNA, 32 nt, Human
acagaccagcuuuuaggggagccaaguuggga

SEQ ID NO: 297777 - RNA, 32 nt, Human
acagaccaggacauuccaugugccucauggca

SEQ ID NO: 297778 - RNA, 32 nt, Human
acagaccaugaccacagccaaggagccaagcg

SEQ ID NO: 297779 - RNA, 23 nt, Human
acagaccaugaggagacgcuggg

SEQ ID NO: 297780 - RNA, 32 nt, Human
acagaccauggacagaggcaggaaguaaggaa

SEQ ID NO: 297781 - RNA, 32 nt, Human
acagacccaagauggacuugcugugauggugc

SEQ ID NO: 297782 - RNA, 32 nt, Human
acagacccaccauaaaguuucugugaugcauu

SEQ ID NO: 297783 - RNA, 32 nt, Human
acagacccaggggcgggcagagagggaaggag

SEQ ID NO: 297784 - RNA, 32 nt, Human
acagacccaucuuuggaucuucauucauuaag

SEQ ID NO: 297785 - RNA, 32 nt, Human
acagaccccaaagccaggaaccucucagccga

SEQ ID NO: 297786 - RNA, 32 nt, Human
acagaccccaacagggaaaucaguaucugucu

SEQ ID NO: 297787 - RNA, 32 nt, Human
acagaccccacaccaggcucugacgccaagug

SEQ ID NO: 297788 - RNA, 21 nt, Human
acagaccccccacccaccucc

SEQ ID NO: 297789 - RNA, 25 nt, Human
acagaccccuagggauuuaaaggga

SEQ ID NO: 297790 - RNA, 32 nt, Human
acagaccccucugcccugacccucugcauugg

SEQ ID NO: 297791 - RNA, 32 nt, Human
acagacccggacucccuuucugccaccccagg

SEQ ID NO: 297792 - RNA, 26 nt, Human
acagacccucacccccacccuggggg

SEQ ID NO: 297793 - RNA, 19 nt, Human
acagacccucuggcugggg

SEQ ID NO: 297794 - RNA, 32 nt, Human
acagacccugcaguccgcucagggugggaugg

SEQ ID NO: 297795 - RNA, 32 nt, Human
acagacccugcaguccuacuacagucuggagu

SEQ ID NO: 297796 - RNA, 21 nt, Human
acagacccuguucacuggaga

SEQ ID NO: 297797 - RNA, 27 nt, Human
acagacccuucccaccacaugugggga

SEQ ID NO: 297798 - RNA, 21 nt, Human
acagacccuuggaggcagggg

SEQ ID NO: 297799 - RNA, 32 nt, Human
acagacccuuggaggcaggggcuguggaaaua

SEQ ID NO: 297800 - RNA, 32 nt, Human
acagaccgcuuuaaccucuuuauuucuguccc

SEQ ID NO: 297801 - RNA, 32 nt, Human
acagaccgggcuggagggugaccuuggcugug

SEQ ID NO: 297802 - RNA, 32 nt, Human
acagaccgugggccccucccagcccucagacc

SEQ ID NO: 297803 - RNA, 32 nt, Human
acagaccguuccccaucucucucccucuucuu

SEQ ID NO: 297804 - RNA, 32 nt, Human
acagaccuauggggccuggaagugcccgcuga

SEQ ID NO: 297805 - RNA, 32 nt, Human
acagaccucagugaugucagcacuguugcuca

SEQ ID NO: 297806 - RNA, 32 nt, Human
acagaccuccacugugauuccauacucucucu

SEQ ID NO: 297807 - RNA, 32 nt, Human
acagaccucccuggcccaccuagaggcuuucu

SEQ ID NO: 297808 - RNA, 32 nt, Human
acagaccucugaguuucugacuuaaccuugaa

SEQ ID NO: 297809 - RNA, 31 nt, Human
acagaccugauuucugggccuggauccaggg

SEQ ID NO: 297810 - RNA, 32 nt, Human
acagaccuggacacuagugggacccagcaaag

SEQ ID NO: 297811 - RNA, 32 nt, Human
acagaccuguguauaaacaacuuuuguauaua

SEQ ID NO: 297812 - RNA, 31 nt, Human
acagaccuguuucagcugcuacuucagccaa

SEQ ID NO: 297813 - RNA, 32 nt, Human
acagaccuuuaagaguaugcuuuauugaguaa

SEQ ID NO: 297814 - RNA, 32 nt, Human
acagacgaacacagcuaaggccucgcugccag

SEQ ID NO: 297815 - RNA, 32 nt, Human
acagacgcacacacacaacagaugcgcagcaa

SEQ ID NO: 297816 - RNA, 32 nt, Human
acagacgcauggcucuuccucccagagcagcc

SEQ ID NO: 297817 - RNA, 20 nt, Human
acagacgcccaccugcuccc

SEQ ID NO: 297818 - RNA, 32 nt, Human
acagacgccgaucuucaaucccuucuccccag

SEQ ID NO: 297819 - RNA, 32 nt, Human
acagacgccuguaaucccagcuacuugggagg

SEQ ID NO: 297820 - RNA, 32 nt, Human
acagacgcuggagcuccagccuccuggcggcc

SEQ ID NO: 297821 - RNA, 32 nt, Human
acagacggaguuuccccauguuggccgggcua

SEQ ID NO: 297822 - RNA, 32 nt, Human
acagacgggguuucaccauguuggccaggaug

SEQ ID NO: 297823 - RNA, 32 nt, Human
acagacgggguuucaccauguuggcugggcug

SEQ ID NO: 297824 - RNA, 32 nt, Human
acagacgggguuucaccauguuggucaggcug

SEQ ID NO: 297825 - RNA, 32 nt, Human
acagacgggguuucacuguguugcccaggcug

SEQ ID NO: 297826 - RNA, 32 nt, Human
acagacgggguuucuccguguuggucaggcug

SEQ ID NO: 297827 - RNA, 32 nt, Human
acagacggucagcacugugccuuuguaucagg

SEQ ID NO: 297828 - RNA, 32 nt, Human
acagacgguugcagagcuaggaagaaaaccca

SEQ ID NO: 297829 - RNA, 32 nt, Human
acagacgucaccuguucccucgccucugucuc

SEQ ID NO: 297830 - RNA, 19 nt, Human
acagacgugagccaccgcg

SEQ ID NO: 297831 - RNA, 32 nt, Human
acagacguucuuucuccuccaugcaguuacac

SEQ ID NO: 297832 - RNA, 32 nt, Human
acagacuagcacuccuggggccgccguguuau

SEQ ID NO: 297833 - RNA, 22 nt, Human
acagacuaucucuuuucuccua

SEQ ID NO: 297834 - RNA, 32 nt, Human
acagacucagagcgugaaaaugaauggaagug

SEQ ID NO: 297835 - RNA, 32 nt, Human
acagacucagccccaggacucgggccagccuc

SEQ ID NO: 297836 - RNA, 21 nt, Human
acagacucaggaagcuggggg

SEQ ID NO: 297837 - RNA, 32 nt, Human
acagacucaggccacuuuaggaaaacgaaauc

SEQ ID NO: 297838 - RNA, 32 nt, Human
acagacucagucuuauuacagcuuugaccaau

SEQ ID NO: 297839 - RNA, 32 nt, Human
acagacuccauucagacaucuuuauacuucca

SEQ ID NO: 297840 - RNA, 21 nt, Human
acagacucccgaguagcuggg

SEQ ID NO: 297841 - RNA, 32 nt, Human
acagacucccuccugugaaccaacacagacac

SEQ ID NO: 297842 - RNA, 32 nt, Human
acagacucccugcuucucaucuccuuaauaaa

SEQ ID NO: 297843 - RNA, 32 nt, Human
acagacuccugucuucacuccuaaaugcaguu

SEQ ID NO: 297844 - RNA, 32 nt, Human
acagacucucaccucuucuccugaggucugcu

SEQ ID NO: 297845 - RNA, 18 nt, Human
acagacucugcagaggcu

SEQ ID NO: 297846 - RNA, 32 nt, Human
acagacucugcaggaaguggcugacuugaugc

SEQ ID NO: 297847 - RNA, 32 nt, Human
acagacucugcuggcccuccuucccugccccu

SEQ ID NO: 297848 - RNA, 32 nt, Human
acagacucugcuuucuaaggucucacaaaguu

SEQ ID NO: 297849 - RNA, 32 nt, Human
acagacucugggaggcucggcggcuggagcag

SEQ ID NO: 297850 - RNA, 32 nt, Human
acagacugaagccacugaacucugccaggagu

SEQ ID NO: 297851 - RNA, 32 nt, Human
acagacugaccucacagcuggaggcuuuccag

SEQ ID NO: 297852 - RNA, 32 nt, Human
acagacugcccucugugaaggugacagugaug

SEQ ID NO: 297853 - RNA, 32 nt, Human
acagacugcuccugacagaaggaugucccagc

SEQ ID NO: 297854 - RNA, 32 nt, Human
acagacugcuuugcaugagucgaaccaugagu

SEQ ID NO: 297855 - RNA, 32 nt, Human
acagacugcuuuucgaagcuguguacccucau

SEQ ID NO: 297856 - RNA, 32 nt, Human
acagacugggaaugaauaaagcacuuacagaa

SEQ ID NO: 297857 - RNA, 32 nt, Human
acagacugggaauuuuuaaugugaacuggaua

SEQ ID NO: 297858 - RNA, 32 nt, Human
acagacugggagaaagaauuggaagccuucca

SEQ ID NO: 297859 - RNA, 32 nt, Human
acagacugggagcugggagccugggguggaca

SEQ ID NO: 297860 - RNA, 32 nt, Human
acagacuguagggggagccagagggcagcagg

SEQ ID NO: 297861 - RNA, 32 nt, Human
acagacugugaacaaaucauucacaaacagaa

SEQ ID NO: 297862 - RNA, 32 nt, Human
acagacugugagccuagcagggcagaucuugu

SEQ ID NO: 297863 - RNA, 32 nt, Human
acagacuguuggcuuuguguuuggaggauagg

SEQ ID NO: 297864 - RNA, 20 nt, Human
acagacuuagcgggaguaga

SEQ ID NO: 297865 - RNA, 32 nt, Human
acagacuuagggagccuuuaccagagacgccu

SEQ ID NO: 297866 - RNA, 32 nt, Human
acagacuuauuucucacugcggcccaguaaca

SEQ ID NO: 297867 - RNA, 32 nt, Human
acagacuucacugucugagauuucccacauuu

SEQ ID NO: 297868 - RNA, 21 nt, Human
acagacuucuaggccacuggg

SEQ ID NO: 297869 - RNA, 32 nt, Human
acagacuucuaggucuguaagcucuuuagggg

SEQ ID NO: 297870 - RNA, 32 nt, Human
acagacuuggccccuagcagugcagaacuaca

SEQ ID NO: 297871 - RNA, 32 nt, Human
acagacuugggaaacaacuucuccccaggggc

SEQ ID NO: 297872 - RNA, 32 nt, Human
acagacuuuacagccccgggggcacagucgua

SEQ ID NO: 297873 - RNA, 32 nt, Human
acagagaaaacacauacauuuaugcauuuuaa

SEQ ID NO: 297874 - RNA, 17 nt, Human
acagagaaaaggagcaa

SEQ ID NO: 297875 - RNA, 32 nt, Human
acagagaaaccagcuagagacagagggaggua

SEQ ID NO: 297876 - RNA, 32 nt, Human
acagagaaaccagcuagaggcagagggaggua

SEQ ID NO: 297877 - RNA, 32 nt, Human
acagagaaaccagcuuccuucagagagcagug

SEQ ID NO: 297878 - RNA, 19 nt, Human
acagagaaagaaaaggcaa

SEQ ID NO: 297879 - RNA, 32 nt, Human
acagagaaagaacagcgggcccaggagaccgg

SEQ ID NO: 297880 - RNA, 32 nt, Human
acagagaaagagagacagagaggcagagagag

SEQ ID NO: 297881 - RNA, 32 nt, Human
acagagaaagaguaucuuuggagccaggugcg

SEQ ID NO: 297882 - RNA, 32 nt, Human
acagagaaaggugagaggaggagaguggcauu

SEQ ID NO: 297883 - RNA, 32 nt, Human
acagagaaaugagaaagagucugugggugggc

SEQ ID NO: 297884 - RNA, 19 nt, Human
acagagaacaagaaagcaa

SEQ ID NO: 297885 - RNA, 32 nt, Human
acagagaacccugcuucaaagcagaaguagca

SEQ ID NO: 297886 - RNA, 32 nt, Human
acagagaacucauguguucagcucaagacucc

SEQ ID NO: 297887 - RNA, 32 nt, Human
acagagaagacugugauucuagcauauuauca

SEQ ID NO: 297888 - RNA, 32 nt, Human
acagagaagagaaaaaugcaggacacuggcuc

SEQ ID NO: 297889 - RNA, 32 nt, Human
acagagaagcgaagacagagacguggaaagac

SEQ ID NO: 297890 - RNA, 32 nt, Human
acagagaaggaagcagagacuggagggaugcc

SEQ ID NO: 297891 - RNA, 32 nt, Human
acagagaaggcagaggggaguguggaguggga

SEQ ID NO: 297892 - RNA, 32 nt, Human
acagagaaggcugcaggaguccuuuguugcuc

SEQ ID NO: 297893 - RNA, 19 nt, Human
acagagaagucacagggca

SEQ ID NO: 297894 - RNA, 32 nt, Human
acagagaaguugcugcuugugaucucacacac

SEQ ID NO: 297895 - RNA, 32 nt, Human
acagagaaucagcuggagcccagauuucaagu

SEQ ID NO: 297896 - RNA, 32 nt, Human
acagagaaucagcuggaucauuucagcugucc

SEQ ID NO: 297897 - RNA, 32 nt, Human
acagagaaugauuuuaagacuucacugaagua

SEQ ID NO: 297898 - RNA, 32 nt, Human
acagagacaaggcccgugaguccuggcccagc

SEQ ID NO: 297899 - RNA, 32 nt, Human
acagagacaauaagcaacaguucaaugaauca

SEQ ID NO: 297900 - RNA, 32 nt, Human
acagagacacagagaaggaagcagagacugga

SEQ ID NO: 297901 - RNA, 32 nt, Human
acagagacacauauaaguagugcucauccaug

SEQ ID NO: 297902 - RNA, 32 nt, Human
acagagacagaaagacagggagaaagagaaac

SEQ ID NO: 297903 - RNA, 32 nt, Human
acagagacagaagaaagagaucaagggcagau

SEQ ID NO: 297904 - RNA, 32 nt, Human
acagagacagagagacagggacacagagaggc

SEQ ID NO: 297905 - RNA, 18 nt, Human
acagagacagagagcaag

SEQ ID NO: 297906 - RNA, 32 nt, Human
acagagacaugagcaccagcaaguuugagguu

SEQ ID NO: 297907 - RNA, 18 nt, Human
acagagaccaagagcagg

SEQ ID NO: 297908 - RNA, 32 nt, Human
acagagaccauccuggccaacacggugaaacc

SEQ ID NO: 297909 - RNA, 32 nt, Human
acagagacccccagggcaguggguggguggcg

SEQ ID NO: 297910 - RNA, 32 nt, Human
acagagaccuccugccuccgccucaguaagac

SEQ ID NO: 297911 - RNA, 32 nt, Human
acagagacgcagacaugugcacuugaagaugc

SEQ ID NO: 297912 - RNA, 18 nt, Human
acagagacgcagagcaag

SEQ ID NO: 297913 - RNA, 32 nt, Human
acagagacgugggguucaucccagacuccucc

SEQ ID NO: 297914 - RNA, 32 nt, Human
acagagacugcagggguccacugugagaggug

SEQ ID NO: 297915 - RNA, 32 nt, Human
acagagacuguuguggaggugaguucggcugu

SEQ ID NO: 297916 - RNA, 32 nt, Human
acagagagaaaagaauugagacucaggaggcu

SEQ ID NO: 297917 - RNA, 32 nt, Human
acagagagaaagggaucugaugaccaaagcag

SEQ ID NO: 297918 - RNA, 32 nt, Human
acagagagaauggauuaccauuucagaaauuc

SEQ ID NO: 297919 - RNA, 32 nt, Human
acagagagacuggccaggccuccccgguggcc

SEQ ID NO: 297920 - RNA, 32 nt, Human
acagagagaggagagguaaggggugaggaugu

SEQ ID NO: 297921 - RNA, 32 nt, Human
acagagagaggcagauuucagggaagcccuga

SEQ ID NO: 297922 - RNA, 32 nt, Human
acagagagaggcugguaacaagcccaaaguca

SEQ ID NO: 297923 - RNA, 32 nt, Human
acagagagagguccuacagcugucauaaauua

SEQ ID NO: 297924 - RNA, 32 nt, Human
acagagagaguguuacgcaggagcaagccuuu

SEQ ID NO: 297925 - RNA, 32 nt, Human
acagagagcagccuggcccucaccagugcgca

SEQ ID NO: 297926 - RNA, 32 nt, Human
acagagaggaggaggagggagaaauggccacc

SEQ ID NO: 297927 - RNA, 32 nt, Human
acagagaggcagagagaaacagagacagagag

SEQ ID NO: 297928 - RNA, 32 nt, Human
acagagaggcccagagaggggaagagauucau

SEQ ID NO: 297929 - RNA, 32 nt, Human
acagagagggugagggguugagcccagaucua

SEQ ID NO: 297930 - RNA, 32 nt, Human
acagagagugugugugcccacugcugcccaac

SEQ ID NO: 297931 - RNA, 32 nt, Human
acagagaucccagaccaccacccaugauccca

SEQ ID NO: 297932 - RNA, 32 nt, Human
acagagaucccauccugaccuuggaggcuugg

SEQ ID NO: 297933 - RNA, 32 nt, Human
acagagaucuucauuaacaagaucuggacagu

SEQ ID NO: 297934 - RNA, 17 nt, Human
acagagaugaaaacaac

SEQ ID NO: 297935 - RNA, 32 nt, Human
acagagauggggucuugcuuuguugcccaggc

SEQ ID NO: 297936 - RNA, 32 nt, Human
acagagaugggguugaggaaggaggguuggcg

SEQ ID NO: 297937 - RNA, 31 nt, Human
acagagauggguggaggggcuggggaaaggc

SEQ ID NO: 297938 - RNA, 32 nt, Human
acagagaugugaugcaggaaaccaucagaaac

SEQ ID NO: 297939 - RNA, 32 nt, Human
acagagaugugugcucucacagcuuugcaggc

SEQ ID NO: 297940 - RNA, 17 nt, Human
acagagcaagagauaag

SEQ ID NO: 297941 - RNA, 23 nt, Human
acagagcaaggcauccccacugg

SEQ ID NO: 297942 - RNA, 32 nt, Human
acagagcaaguccucacucuucaaggaggccc

SEQ ID NO: 297943 - RNA, 32 nt, Human
acagagcaaucacugcacccagccaccucuau

SEQ ID NO: 297944 - RNA, 20 nt, Human
acagagcaaucugagacagg

SEQ ID NO: 297945 - RNA, 32 nt, Human
acagagcacuucagagagaauuuuaaagcggu

SEQ ID NO: 297946 - RNA, 32 nt, Human
acagagcagagccauggagaauaagcauugac

SEQ ID NO: 297947 - RNA, 32 nt, Human
acagagcagcagagaaaagcugaugggaguga

SEQ ID NO: 297948 - RNA, 32 nt, Human
acagagcagcuagaggcuccuccucugcuggc

SEQ ID NO: 297949 - RNA, 32 nt, Human
acagagcagcuagguuaaaaagauuuauccau

SEQ ID NO: 297950 - RNA, 32 nt, Human
acagagcagcuuuacaaguugucacauuucuu

SEQ ID NO: 297951 - RNA, 32 nt, Human
acagagcaggaggcugaggcuggugugaggga

SEQ ID NO: 297952 - RNA, 32 nt, Human
acagagcaggccacauguggccaucugcuccc

SEQ ID NO: 297953 - RNA, 32 nt, Human
acagagcagggccgaagggaggggacagaggg

SEQ ID NO: 297954 - RNA, 32 nt, Human
acagagcaggucugcaggccaccagcugcugg

SEQ ID NO: 297955 - RNA, 32 nt, Human
acagagcagugcagugggaggagacgccauga

SEQ ID NO: 297956 - RNA, 32 nt, Human
acagagcagugcccuggcuguguccuggacgg

SEQ ID NO: 297957 - RNA, 32 nt, Human
acagagcauccacugaacaacauacauuauuc

SEQ ID NO: 297958 - RNA, 32 nt, Human
acagagcaucugugcugaccaggccugggccc

SEQ ID NO: 297959 - RNA, 18 nt, Human
acagagcaugagagcaag

SEQ ID NO: 297960 - RNA, 32 nt, Human
acagagccaaacaugaaagggaaggugacggc

SEQ ID NO: 297961 - RNA, 32 nt, Human
acagagccacagagggcugugagcuugcccag

SEQ ID NO: 297962 - RNA, 32 nt, Human
acagagccacaucuugaaugugagauaguagg

SEQ ID NO: 297963 - RNA, 32 nt, Human
acagagccaccagcagcaaaacaaauauuccc

SEQ ID NO: 297964 - RNA, 32 nt, Human
acagagccacguuugaacccagaagaacacca

SEQ ID NO: 297965 - RNA, 32 nt, Human
acagagccagggcagaggccaugccacuuuau

SEQ ID NO: 297966 - RNA, 32 nt, Human
acagagccaugcugggaagacgccugagcuca

SEQ ID NO: 297967 - RNA, 32 nt, Human
acagagcccagugccacccacuuugaugugcg

SEQ ID NO: 297968 - RNA, 32 nt, Human
acagagcccccacccucucucccucaccccuc

SEQ ID NO: 297969 - RNA, 23 nt, Human
acagagcccccacccuucacuga

SEQ ID NO: 297970 - RNA, 32 nt, Human
acagagcccuacuuucgggaccagccugaggu

SEQ ID NO: 297971 - RNA, 32 nt, Human
acagagcccucagaaauaaugccacuugucua

SEQ ID NO: 297972 - RNA, 32 nt, Human
acagagccuccuuucaucucugcagcaggcug

SEQ ID NO: 297973 - RNA, 32 nt, Human
acagagccugcaggaaguggggcuaaaguggc

SEQ ID NO: 297974 - RNA, 32 nt, Human
acagagccuggcugagcacuaugacauccugu

SEQ ID NO: 297975 - RNA, 32 nt, Human
acagagcgagaaggugucaggagcagcccagu

SEQ ID NO: 297976 - RNA, 20 nt, Human
acagagcggacccaggcccu

SEQ ID NO: 297977 - RNA, 32 nt, Human
acagagcuaaacaccagugcacugccuguaac

SEQ ID NO: 297978 - RNA, 32 nt, Human
acagagcucaggacagcccacagggagguggu

SEQ ID NO: 297979 - RNA, 32 nt, Human
acagagcuccacagcaaguugugccaaagggc

SEQ ID NO: 297980 - RNA, 32 nt, Human
acagagcugcccccgaggguccuggcugaggg

SEQ ID NO: 297981 - RNA, 32 nt, Human
acagagcugcugacccugcugaagaugccuag

SEQ ID NO: 297982 - RNA, 32 nt, Human
acagagcugcuugaagauauaugaggcuaauu

SEQ ID NO: 297983 - RNA, 32 nt, Human
acagagcuguccaggauugcaguggauaggaa

SEQ ID NO: 297984 - RNA, 32 nt, Human
acagagcugucuuccuucugcaugucagcaca

SEQ ID NO: 297985 - RNA, 32 nt, Human
acagagcuuggaacugcugauagcccuuacug

SEQ ID NO: 297986 - RNA, 32 nt, Human
acagagcuuguuccuguucagugacugacccu

SEQ ID NO: 297987 - RNA, 32 nt, Human
acagagcuuuuauguuuaaagacuucaaugga

SEQ ID NO: 297988 - RNA, 32 nt, Human
acagaggaaagcccgugugagcacacagugca

SEQ ID NO: 297989 - RNA, 32 nt, Human
acagaggaagaaaaggggucacaggagaaaca

SEQ ID NO: 297990 - RNA, 32 nt, Human
acagaggaagccaaggccuggagcugcagguc

SEQ ID NO: 297991 - RNA, 32 nt, Human
acagaggaaggaugaggugggauguggagguc

SEQ ID NO: 297992 - RNA, 32 nt, Human
acagaggacaagggcguggaucugggccagaa

SEQ ID NO: 297993 - RNA, 32 nt, Human
acagaggacagcccgggcuguguccccacagu

SEQ ID NO: 297994 - RNA, 32 nt, Human
acagaggacaggaggaaagugaggacaggugg

SEQ ID NO: 297995 - RNA, 32 nt, Human
acagaggacccucagccagagcagaaagcucc

SEQ ID NO: 297996 - RNA, 32 nt, Human
acagaggacgaugucauagaacaagaacucug

SEQ ID NO: 297997 - RNA, 18 nt, Human
acagaggagagaagcaag

SEQ ID NO: 297998 - RNA, 32 nt, Human
acagaggagaggagggaggaagagcugggcga

SEQ ID NO: 297999 - RNA, 32 nt, Human
acagaggagauggagagaggccagucaacgcg

SEQ ID NO: 298000 - RNA, 32 nt, Human
acagaggaggcugaggcucagagaggcacagu

SEQ ID NO: 298001 - RNA, 32 nt, Human
acagaggagucucuucccaagagacugcuggc

SEQ ID NO: 298002 - RNA, 32 nt, Human
acagaggagugggagaggggacacaggcaugg

SEQ ID NO: 298003 - RNA, 17 nt, Human
acagaggaugaggcaag

SEQ ID NO: 298004 - RNA, 32 nt, Human
acagaggauguggccugguucaaaguaaagca

SEQ ID NO: 298005 - RNA, 32 nt, Human
acagaggauuugcucuggacagagauggaaga

SEQ ID NO: 298006 - RNA, 32 nt, Human
acagaggcaaaaaucugcuaacucagggggca

SEQ ID NO: 298007 - RNA, 31 nt, Human
acagaggcaaugugaccagucacagggacag

SEQ ID NO: 298008 - RNA, 32 nt, Human
acagaggcagagagacagggagacagacagag

SEQ ID NO: 298009 - RNA, 32 nt, Human
acagaggcagauggguuagaucacacauaaca

SEQ ID NO: 298010 - RNA, 32 nt, Human
acagaggcagcagcaguccuucggcuucaucu

SEQ ID NO: 298011 - RNA, 32 nt, Human
acagaggcagccaaggcucaggaaaaacuggg

SEQ ID NO: 298012 - RNA, 32 nt, Human
acagaggcaggcaauuccuggagcuucuugau

SEQ ID NO: 298013 - RNA, 32 nt, Human
acagaggcagguugcuaauuugcacauagacc

SEQ ID NO: 298014 - RNA, 19 nt, Human
acagaggcccagcucacgg

SEQ ID NO: 298015 - RNA, 18 nt, Human
acagaggcuaacuacgga

SEQ ID NO: 298016 - RNA, 32 nt, Human
acagaggcuacaucugcccuagggagguccuu

SEQ ID NO: 298017 - RNA, 32 nt, Human
acagaggcuagaaagcauccauuaauuaauga

SEQ ID NO: 298018 - RNA, 32 nt, Human
acagaggcugcugagggcagaggaugcaacac

SEQ ID NO: 298019 - RNA, 32 nt, Human
acagaggcugguggggcccccuccucaucaga

SEQ ID NO: 298020 - RNA, 32 nt, Human
acagagggaagaggaggguggggcccuggaug

SEQ ID NO: 298021 - RNA, 18 nt, Human
acagagggagacuaugga

SEQ ID NO: 298022 - RNA, 32 nt, Human
acagagggagagaacaaaggggaagaagagag

SEQ ID NO: 298023 - RNA, 32 nt, Human
acagagggagagaacaaggccucccagcacuc

SEQ ID NO: 298024 - RNA, 32 nt, Human
acagagggaggcaggugggaauugagggugag

SEQ ID NO: 298025 - RNA, 32 nt, Human
acagagggaggucauuguuacacacacauccc

SEQ ID NO: 298026 - RNA, 32 nt, Human
acagagggagguggacggcagggaucagggag

SEQ ID NO: 298027 - RNA, 32 nt, Human
acagagggagugagaauacaggaaaagaguug

SEQ ID NO: 298028 - RNA, 32 nt, Human
acagagggcaguguauggaggaauggucuucu

SEQ ID NO: 298029 - RNA, 32 nt, Human
acagaggggaaagaagugaugaaggaggaacc

SEQ ID NO: 298030 - RNA, 32 nt, Human
acagaggggaagagaggcagagagggaaagag

SEQ ID NO: 298031 - RNA, 32 nt, Human
acagaggggauuaaagaggggaggagagagug

SEQ ID NO: 298032 - RNA, 18 nt, Human
acagaggggcagagcaag

SEQ ID NO: 298033 - RNA, 32 nt, Human
acagaggggcugggguguuuaccuggagccug

SEQ ID NO: 298034 - RNA, 32 nt, Human
acagaggggguuucaccauguuugucaggcug

SEQ ID NO: 298035 - RNA, 32 nt, Human
acagagggguccacucuccugccugcugggac

SEQ ID NO: 298036 - RNA, 32 nt, Human
acagaggguacaacaguggcaucacagugaca

SEQ ID NO: 298037 - RNA, 19 nt, Human
acagagguaaagugucuuu

SEQ ID NO: 298038 - RNA, 32 nt, Human
acagagguagugagccaguguccugggccucu

SEQ ID NO: 298039 - RNA, 25 nt, Human
acagaggucugccccacccacuucc

SEQ ID NO: 298040 - RNA, 32 nt, Human
acagaggucuuugaguuggaugguugcaaaua

SEQ ID NO: 298041 - RNA, 32 nt, Human
acagagguggcacaugcuuggccacacaucua

SEQ ID NO: 298042 - RNA, 32 nt, Human
acagagguggcucugccugcagcugggccucu

SEQ ID NO: 298043 - RNA, 21 nt, Human
acagagguggcugcugugcug

SEQ ID NO: 298044 - RNA, 32 nt, Human
acagagguggggaaguuguccugaggaagcag

SEQ ID NO: 298045 - RNA, 32 nt, Human
acagagguggugccagaaugccuggacugcag

SEQ ID NO: 298046 - RNA, 32 nt, Human
acagaggugugagacagcacuuuccauuugcc

SEQ ID NO: 298047 - RNA, 32 nt, Human
acagagguuaucugucccagguuaucugggca

SEQ ID NO: 298048 - RNA, 32 nt, Human
acagagguucagcagacgucucaggaucuguc

SEQ ID NO: 298049 - RNA, 32 nt, Human
acagagguuguuggcuuccaucaggggugguc

SEQ ID NO: 298050 - RNA, 19 nt, Human
acagaguaaaauggacaag

SEQ ID NO: 298051 - RNA, 32 nt, Human
acagaguaaauacuucaucugauuguucauuu

SEQ ID NO: 298052 - RNA, 20 nt, Human
acagaguaaauguuguguug

SEQ ID NO: 298053 - RNA, 17 nt, Human
acagaguaagaaacaag

SEQ ID NO: 298054 - RNA, 19 nt, Human
acagaguaauuggggcaag

SEQ ID NO: 298055 - RNA, 32 nt, Human
acagaguagagcagacguauaagaacuggaaa

SEQ ID NO: 298056 - RNA, 17 nt, Human
acagaguaggagagaag

SEQ ID NO: 298057 - RNA, 32 nt, Human
acagaguaggagagaaguuagggcuggcacac

SEQ ID NO: 298058 - RNA, 32 nt, Human
acagaguagggaaucauggcuggagaauugga

SEQ ID NO: 298059 - RNA, 32 nt, Human
acagaguauccugucuaaaaggucccaaagau

SEQ ID NO: 298060 - RNA, 21 nt, Human
acagagucaacuucugcagca

SEQ ID NO: 298061 - RNA, 28 nt, Human
acagagucaauaaaugugcacuguaugg

SEQ ID NO: 298062 - RNA, 32 nt, Human
acagagucacaguccccagucaauucccagac

SEQ ID NO: 298063 - RNA, 32 nt, Human
acagagucacccaggcuggagugcagugguga

SEQ ID NO: 298064 - RNA, 32 nt, Human
acagagucagggacagaagggaagggacccac

SEQ ID NO: 298065 - RNA, 32 nt, Human
acagagucagggggugacaaagccagacuggg

SEQ ID NO: 298066 - RNA, 32 nt, Human
acagagucauuuccugcccuaaaacccccugu

SEQ ID NO: 298067 - RNA, 32 nt, Human
acagaguccccaagguuccuguuguugccucc

SEQ ID NO: 298068 - RNA, 32 nt, Human
acagagucccgucucaccauccugggcuucca

SEQ ID NO: 298069 - RNA, 32 nt, Human
acagagucgcacucugucauccaggcuggagu

SEQ ID NO: 298070 - RNA, 32 nt, Human
acagagucucacuauuauccagugcaguggug

SEQ ID NO: 298071 - RNA, 19 nt, Human
acagagucucacucuguca

SEQ ID NO: 298072 - RNA, 19 nt, Human
acagagucucacucuguug

SEQ ID NO: 298073 - RNA, 32 nt, Human
acagagucucagggcccagcaaggucagguua

SEQ ID NO: 298074 - RNA, 19 nt, Human
acagagucucauucuguca

SEQ ID NO: 298075 - RNA, 32 nt, Human
acagagucucgcuauguugcccaggcuggucu

SEQ ID NO: 298076 - RNA, 32 nt, Human
acagagucucgcuccauugcccaggcuggacu

SEQ ID NO: 298077 - RNA, 25 nt, Human
acagagucuggggugcgcuguguug

SEQ ID NO: 298078 - RNA, 32 nt, Human
acagagucuggguuuucaugucccuguuugcu

SEQ ID NO: 298079 - RNA, 32 nt, Human
acagagucuugcuccauugcccaggcuggauu

SEQ ID NO: 298080 - RNA, 18 nt, Human
acagagugaaagagcagg

SEQ ID NO: 298081 - RNA, 20 nt, Human
acagagugaccugagaccag

SEQ ID NO: 298082 - RNA, 32 nt, Human
acagagugagauccugucucuaaaaauaaaau

SEQ ID NO: 298083 - RNA, 32 nt, Human
acagagugcaggcaggcagccaaaugaguggg

SEQ ID NO: 298084 - RNA, 32 nt, Human
acagagugccuuaggaauucucugauuuugau

SEQ ID NO: 298085 - RNA, 32 nt, Human
acagagugcuggagcugggaauacugacccag

SEQ ID NO: 298086 - RNA, 15 nt, Human
acagaguggaagaca

SEQ ID NO: 298087 - RNA, 18 nt, Human
acagaguggaggacacaa

SEQ ID NO: 298088 - RNA, 32 nt, Human
acagagugucgucgcccaccucccuggguccu

SEQ ID NO: 298089 - RNA, 32 nt, Human
acagagugugagccaccacacccagccagcaa

SEQ ID NO: 298090 - RNA, 32 nt, Human
acagaguguggacaucagcccagggccgcgug

SEQ ID NO: 298091 - RNA, 32 nt, Human
acagaguucagcccuggccuggccgccagccg

SEQ ID NO: 298092 - RNA, 18 nt, Human
acagaguugcagagcaag

SEQ ID NO: 298093 - RNA, 32 nt, Human
acagaguuggcaguauauuauagugauaauuu

SEQ ID NO: 298094 - RNA, 19 nt, Human
acagaguugggaaaaacaa

SEQ ID NO: 298095 - RNA, 32 nt, Human
acagaguuguccauuaccaaagccuggaaguu

SEQ ID NO: 298096 - RNA, 19 nt, Human
acagaguuucaccauguug

SEQ ID NO: 298097 - RNA, 32 nt, Human
acagaguuuggauaguaaagaaaacaacaaua

SEQ ID NO: 298098 - RNA, 32 nt, Human
acagauaaaacaacugaggcucagggagauuc

SEQ ID NO: 298099 - RNA, 32 nt, Human
acagauaaccccuucgcuuccagcucuuaaaa

SEQ ID NO: 298100 - RNA, 32 nt, Human
acagauaagaaggcacuggggccaggcucaca

SEQ ID NO: 298101 - RNA, 32 nt, Human
acagauaaucccuggugugggaagaggagucc

SEQ ID NO: 298102 - RNA, 32 nt, Human
acagauaauguucucacuacccauaauaugua

SEQ ID NO: 298103 - RNA, 32 nt, Human
acagauacaagugguugaagcagaauguucag

SEQ ID NO: 298104 - RNA, 32 nt, Human
acagauacacauccaagcucacaaauaggagu

SEQ ID NO: 298105 - RNA, 32 nt, Human
acagauacugugagcuuacauugaaaacagau

SEQ ID NO: 298106 - RNA, 32 nt, Human
acagauacuuguucucauuccguauaugagca

SEQ ID NO: 298107 - RNA, 32 nt, Human
acagauagcaggaaggcagaaagaaaacauaa

SEQ ID NO: 298108 - RNA, 32 nt, Human
acagauaggaagggauuggcaucggcuggccu

SEQ ID NO: 298109 - RNA, 32 nt, Human
acagauaggagguggcccauaggagcaguccc

SEQ ID NO: 298110 - RNA, 32 nt, Human
acagauaggccugccacuggucauggguagcu

SEQ ID NO: 298111 - RNA, 32 nt, Human
acagauagggucuugcuauguugcccaggcug

SEQ ID NO: 298112 - RNA, 32 nt, Human
acagauaguccccauggaguagauuguccaaa

SEQ ID NO: 298113 - RNA, 24 nt, Human
acagauauuggaaaaaagacaaca

SEQ ID NO: 298114 - RNA, 32 nt, Human
acagauauuuacuugguaaagugcagugggga

SEQ ID NO: 298115 - RNA, 32 nt, Human
acagaucaagaaacugaagaccagagaagaga

SEQ ID NO: 298116 - RNA, 32 nt, Human
acagaucaaucucugcagaugacagggaggug

SEQ ID NO: 298117 - RNA, 32 nt, Human
acagaucaauguacacuuaccucuccagaagg

SEQ ID NO: 298118 - RNA, 32 nt, Human
acagaucacagcaacgacaaacgcucauggcg

SEQ ID NO: 298119 - RNA, 32 nt, Human
acagaucacugcagccuccaacuccugggcuc

SEQ ID NO: 298120 - RNA, 32 nt, Human
acagaucaggagaaccucagucugacgacauu

SEQ ID NO: 298121 - RNA, 32 nt, Human
acagaucaugccacugcacuccagccugggca

SEQ ID NO: 298122 - RNA, 32 nt, Human
acagauccagaagaugaaagaaggaagugagc

SEQ ID NO: 298123 - RNA, 32 nt, Human
acagaucccagaaugacaaggaagggaccuua

SEQ ID NO: 298124 - RNA, 32 nt, Human
acagauccuacaggacugucugucuccugccc

SEQ ID NO: 298125 - RNA, 32 nt, Human
acagaucuaaauauacuaucuugguucaauaa

SEQ ID NO: 298126 - RNA, 32 nt, Human
acagaucucucucaaugcauuagcaaaaauca

SEQ ID NO: 298127 - RNA, 32 nt, Human
acagaucugagaucacugacucccagagacac

SEQ ID NO: 298128 - RNA, 32 nt, Human
acagaucuugacaccaauacaggggcuggaua

SEQ ID NO: 298129 - RNA, 24 nt, Human
acagaucuugggggacauugggga

SEQ ID NO: 298130 - RNA, 32 nt, Human
acagaucuuuguccuaaccacaagguuccccu

SEQ ID NO: 298131 - RNA, 32 nt, Human
acagaugaagugccagagcaucagagauaggu

SEQ ID NO: 298132 - RNA, 32 nt, Human
acagaugacaggcccagaggcacacccagggc

SEQ ID NO: 298133 - RNA, 32 nt, Human
acagaugaccaaagccaccacauuuagaacuu

SEQ ID NO: 298134 - RNA, 32 nt, Human
acagaugacuccacagcccagaucccauucuu

SEQ ID NO: 298135 - RNA, 32 nt, Human
acagaugacugucaagugaaugagcuguugau

SEQ ID NO: 298136 - RNA, 32 nt, Human
acagaugagaagcagagugaccaugugacaua

SEQ ID NO: 298137 - RNA, 32 nt, Human
acagaugaggcaaacguggcacggagagcucc

SEQ ID NO: 298138 - RNA, 32 nt, Human
acagaugaggucuugcuguguugcccaggcug

SEQ ID NO: 298139 - RNA, 32 nt, Human
acagaugagucacaccuuugagcuuaaucuug

SEQ ID NO: 298140 - RNA, 32 nt, Human
acagaugaguccauuugaagccguccaagaac

SEQ ID NO: 298141 - RNA, 32 nt, Human
acagaugauaccuuaauauuaacuuacuuaca

SEQ ID NO: 298142 - RNA, 29 nt, Human
acagaugaugagacagaguuuagggugca

SEQ ID NO: 298143 - RNA, 32 nt, Human
acagaugauguggaaggagcucaaacagacga

SEQ ID NO: 298144 - RNA, 32 nt, Human
acagaugauucucaccuuuacuucucuccaga

SEQ ID NO: 298145 - RNA, 32 nt, Human
acagaugcaaauucuggcagcuggcuucuuug

SEQ ID NO: 298146 - RNA, 32 nt, Human
acagaugcacacacacaagcacacaugcacag

SEQ ID NO: 298147 - RNA, 22 nt, Human
acagaugcacugcugugcugcu

SEQ ID NO: 298148 - RNA, 32 nt, Human
acagaugcagaaauccucaaaauauuagcaaa

SEQ ID NO: 298149 - RNA, 32 nt, Human
acagaugcagaacaagucauauuugaagaaug

SEQ ID NO: 298150 - RNA, 32 nt, Human
acagaugccaaaagcuguacuuuccaucaggc

SEQ ID NO: 298151 - RNA, 32 nt, Human
acagaugccaggagagcugggcccaagacucc

SEQ ID NO: 298152 - RNA, 32 nt, Human
acagaugccaucauuucccuuuccccucugaa

SEQ ID NO: 298153 - RNA, 22 nt, Human
acagaugccuguggcauugcaa

SEQ ID NO: 298154 - RNA, 32 nt, Human
acagaugcuccagggaugauucaagccauucc

SEQ ID NO: 298155 - RNA, 32 nt, Human
acagaugcuggagcagguguaggaggaagcgc

SEQ ID NO: 298156 - RNA, 32 nt, Human
acagaugcugggacccagucucugcccagguc

SEQ ID NO: 298157 - RNA, 32 nt, Human
acagauggacacuuuggauacugugaaaagca

SEQ ID NO: 298158 - RNA, 17 nt, Human
acagauggagagacaag

SEQ ID NO: 298159 - RNA, 32 nt, Human
acagauggagcuuugggaacgcggagaacagu

SEQ ID NO: 298160 - RNA, 32 nt, Human
acagauggaggcaguggcuggugggccacucu

SEQ ID NO: 298161 - RNA, 32 nt, Human
acagauggagucuugcucugucacccaggcug

SEQ ID NO: 298162 - RNA, 32 nt, Human
acagauggauaaacugccucgucugaucuugu

SEQ ID NO: 298163 - RNA, 32 nt, Human
acagauggauaacugccaagaaccagauuuuu

SEQ ID NO: 298164 - RNA, 32 nt, Human
acagauggcaugaaugaaaaugugcucuguca

SEQ ID NO: 298165 - RNA, 29 nt, Human
acagauggcauugucccagucuguucccu

SEQ ID NO: 298166 - RNA, 24 nt, Human
acagauggccacuuccagagcuug

SEQ ID NO: 298167 - RNA, 32 nt, Human
acagauggccacuuugaccuggggcuggacgu

SEQ ID NO: 298168 - RNA, 19 nt, Human
acagauggccagccccuua

SEQ ID NO: 298169 - RNA, 19 nt, Human
acagauggccugagauaag

SEQ ID NO: 298170 - RNA, 32 nt, Human
acagauggccuggaucagugcaaugugcaaca

SEQ ID NO: 298171 - RNA, 29 nt, Human
acagaugggcauaggugcagugagugcag

SEQ ID NO: 298172 - RNA, 32 nt, Human
acagaugggccaccaggcaggagcugcugcug

SEQ ID NO: 298173 - RNA, 32 nt, Human
acagauggggaaacugaagcccagggagguac

SEQ ID NO: 298174 - RNA, 32 nt, Human
acagauggggucuugcuauguugcccaagcug

SEQ ID NO: 298175 - RNA, 32 nt, Human
acagaugggguuucaccauauugggcaggcug

SEQ ID NO: 298176 - RNA, 32 nt, Human
acagaugggguuucaccauguuggccaggcug

SEQ ID NO: 298177 - RNA, 32 nt, Human
acagaugggguuucaccauguuggucaggcua

SEQ ID NO: 298178 - RNA, 32 nt, Human
acagaugguauucugguuucuugcaggagguu

SEQ ID NO: 298179 - RNA, 32 nt, Human
acagauggucuagacagcccucugucacccug

SEQ ID NO: 298180 - RNA, 32 nt, Human
acagauguagaacuuuaauaauccagaugcaa

SEQ ID NO: 298181 - RNA, 32 nt, Human
acagauguccuggaugaugguccauaagaaua

SEQ ID NO: 298182 - RNA, 32 nt, Human
acagaugucuggcagugaggguggagggagac

SEQ ID NO: 298183 - RNA, 32 nt, Human
acagaugugagccaccgugccuagccaaggau

SEQ ID NO: 298184 - RNA, 32 nt, Human
acagaugugagccugugccuggcuggucuuuc

SEQ ID NO: 298185 - RNA, 24 nt, Human
acagaugugcaccaccacacuggc

SEQ ID NO: 298186 - RNA, 32 nt, Human
acagaugugcagugugcacggaucacagggaa

SEQ ID NO: 298187 - RNA, 32 nt, Human
acagaugugcugcuguucccaggccaccugca

SEQ ID NO: 298188 - RNA, 20 nt, Human
acagauguggcugagacagg

SEQ ID NO: 298189 - RNA, 32 nt, Human
acagaugugugggagugcagggcugcagaggg

SEQ ID NO: 298190 - RNA, 32 nt, Human
acagauguuccucuggccuucuugccuggggc

SEQ ID NO: 298191 - RNA, 22 nt, Human
acagauuaagggcuaagggcaa

SEQ ID NO: 298192 - RNA, 32 nt, Human
acagauuaaguuuccagaagcaguggauggga

SEQ ID NO: 298193 - RNA, 32 nt, Human
acagauuaauaucaucauaaaauaucauuuac

SEQ ID NO: 298194 - RNA, 32 nt, Human
acagauuauauggugaaccuacuuuuagagug

SEQ ID NO: 298195 - RNA, 17 nt, Human
acagauuauugguuaca

SEQ ID NO: 298196 - RNA, 32 nt, Human
acagauuauuuuuaucagagcuguaaagaaaa

SEQ ID NO: 298197 - RNA, 32 nt, Human
acagauucauggucugcugcagcuggggaugg

SEQ ID NO: 298198 - RNA, 32 nt, Human
acagauuccaggaccacugaaaccagcugagg

SEQ ID NO: 298199 - RNA, 21 nt, Human
acagauuccucacacugggga

SEQ ID NO: 298200 - RNA, 32 nt, Human
acagauucugaccuuagauucugugacaaacu

SEQ ID NO: 298201 - RNA, 32 nt, Human
acagauucugguggcucccugcuggcccucuu

SEQ ID NO: 298202 - RNA, 32 nt, Human
acagauugaagugagcuuuagugagcaaaagg

SEQ ID NO: 298203 - RNA, 32 nt, Human
acagauugaggucucuguggcuuuggugaccc

SEQ ID NO: 298204 - RNA, 30 nt, Human
acagauugcugcuccaugcauucuguccag

SEQ ID NO: 298205 - RNA, 32 nt, Human
acagauuggcagccacugcagagaugcagaau

SEQ ID NO: 298206 - RNA, 32 nt, Human
acagauuuccaucagcaggaugugggggcuca

SEQ ID NO: 298207 - RNA, 32 nt, Human
acagauuugagguuucuucucaucucauuuag

SEQ ID NO: 298208 - RNA, 32 nt, Human
acagauuugcuacacaucuuaggauaaauaug

SEQ ID NO: 298209 - RNA, 32 nt, Human
acagauuuugcaaagcggaggcugcgacgggu

SEQ ID NO: 298210 - RNA, 32 nt, Human
acagcaaaaagcuugcugagaaggcugugcug

SEQ ID NO: 298211 - RNA, 32 nt, Human
acagcaaaagaggcccuucuuccucacccaag

SEQ ID NO: 298212 - RNA, 32 nt, Human
acagcaaacugcagaggucacuccaggcugug

SEQ ID NO: 298213 - RNA, 32 nt, Human
acagcaaagccagaaaugcucucuccagggag

SEQ ID NO: 298214 - RNA, 32 nt, Human
acagcaaaugagaaaaguggacuggggaaugc

SEQ ID NO: 298215 - RNA, 32 nt, Human
acagcaaaugagauguaugcccaaagcgguag

SEQ ID NO: 298216 - RNA, 32 nt, Human
acagcaacaacaaaagcccagccgcugucuga

SEQ ID NO: 298217 - RNA, 32 nt, Human
acagcaacaacaaaaguauacucuaccauuaa

SEQ ID NO: 298218 - RNA, 32 nt, Human
acagcaacaacaaagacagacuuuccguagca

SEQ ID NO: 298219 - RNA, 32 nt, Human
acagcaacaaccgaggggccacugccugauga

SEQ ID NO: 298220 - RNA, 32 nt, Human
acagcaacagaaguaaauugaagauacuggcu

SEQ ID NO: 298221 - RNA, 32 nt, Human
acagcaacagaaguccaggacccacuagguug

SEQ ID NO: 298222 - RNA, 19 nt, Human
acagcaacagagagcagga

SEQ ID NO: 298223 - RNA, 32 nt, Human
acagcaaccagaaaacaucugcucacuuccuu

SEQ ID NO: 298224 - RNA, 32 nt, Human
acagcaaccccagguguccagagcacugcccc

SEQ ID NO: 298225 - RNA, 32 nt, Human
acagcaacuuccuguagugagcacuuuguaug

SEQ ID NO: 298226 - RNA, 32 nt, Human
acagcaagaacaguccauguuguauauaauac

SEQ ID NO: 298227 - RNA, 32 nt, Human
acagcaagaacgggacccugguguggcgcuug

SEQ ID NO: 298228 - RNA, 19 nt, Human
acagcaagagagagacaag

SEQ ID NO: 298229 - RNA, 32 nt, Human
acagcaagauggcaaaagcuugcugaguggua

SEQ ID NO: 298230 - RNA, 32 nt, Human
acagcaagcgaguuaucgucuucuguauuuug

SEQ ID NO: 298231 - RNA, 21 nt, Human
acagcaagcuuuugggaucgg

SEQ ID NO: 298232 - RNA, 32 nt, Human
acagcaaggaagaaccauggcccaggggucac

SEQ ID NO: 298233 - RNA, 32 nt, Human
acagcaaggcagcaaggagacggggaagagca

SEQ ID NO: 298234 - RNA, 32 nt, Human
acagcaaggcccugccacccaccuucaggcca

SEQ ID NO: 298235 - RNA, 32 nt, Human
acagcaaguccacccuaacuuguuacacagca

SEQ ID NO: 298236 - RNA, 32 nt, Human
acagcaagugaagaaagaggcgcagagcccug

SEQ ID NO: 298237 - RNA, 32 nt, Human
acagcaaucaaauuaaggacucaugaaggggg

SEQ ID NO: 298238 - RNA, 32 nt, Human
acagcaaucaaauuauggacacaugaaagggg

SEQ ID NO: 298239 - RNA, 32 nt, Human
acagcaaucaaauuauggacccaugaaagggg

SEQ ID NO: 298240 - RNA, 32 nt, Human
acagcaaucaaauuauggacccaugaaggggg

SEQ ID NO: 298241 - RNA, 32 nt, Human
acagcaaucuagucacucccuggucaucccuc

SEQ ID NO: 298242 - RNA, 32 nt, Human
acagcaaucuucacuccagucucugccucugu

SEQ ID NO: 298243 - RNA, 32 nt, Human
acagcacaaaggaaagcgagggcgggggagga

SEQ ID NO: 298244 - RNA, 32 nt, Human
acagcacacagcaagcaaccacaaaaccagag

SEQ ID NO: 298245 - RNA, 32 nt, Human
acagcacagagcgcugaacacacaccccacag

SEQ ID NO: 298246 - RNA, 32 nt, Human
acagcacagaugagguugagaccaugcaguca

SEQ ID NO: 298247 - RNA, 32 nt, Human
acagcacagcacagcagugcugacagcaucga

SEQ ID NO: 298248 - RNA, 32 nt, Human
acagcacaggccaucucagcuugguugccaac

SEQ ID NO: 298249 - RNA, 32 nt, Human
acagcacauacgugugcacacgcaugcacaca

SEQ ID NO: 298250 - RNA, 31 nt, Human
acagcacauacuucuuuucuuucauuuaaua

SEQ ID NO: 298251 - RNA, 32 nt, Human
acagcacaucacagacacaguuucuggaauac

SEQ ID NO: 298252 - RNA, 32 nt, Human
acagcacaugcacacaggugcacagaccacac

SEQ ID NO: 298253 - RNA, 32 nt, Human
acagcaccaagcucagccuuuccuccgaggcu

SEQ ID NO: 298254 - RNA, 32 nt, Human
acagcaccaaggcccuccuggagcucacugag

SEQ ID NO: 298255 - RNA, 21 nt, Human
acagcaccaccagcagcagca

SEQ ID NO: 298256 - RNA, 32 nt, Human
acagcaccacccccgcaccugcccucggccuu

SEQ ID NO: 298257 - RNA, 32 nt, Human
acagcaccacugcacagagcuuugggaggcug

SEQ ID NO: 298258 - RNA, 32 nt, Human
acagcaccacugcacuccagccaggaaugagg

SEQ ID NO: 298259 - RNA, 32 nt, Human
acagcaccacugcacuccagccugggugacag

SEQ ID NO: 298260 - RNA, 32 nt, Human
acagcacccacacacggcugcugguagagggu

SEQ ID NO: 298261 - RNA, 32 nt, Human
acagcaccucccaccaaccagccacucccggu

SEQ ID NO: 298262 - RNA, 32 nt, Human
acagcaccugaaguggcaaagauccauggucu

SEQ ID NO: 298263 - RNA, 32 nt, Human
acagcaccuggguccucgccacccuaagcccc

SEQ ID NO: 298264 - RNA, 32 nt, Human
acagcaccuugccugaacaugacuuuaaagaa

SEQ ID NO: 298265 - RNA, 32 nt, Human
acagcacggccuuggucuccaggcuggccccc

SEQ ID NO: 298266 - RNA, 29 nt, Human
acagcacgucuguguugaccuggacccac

SEQ ID NO: 298267 - RNA, 32 nt, Human
acagcacgugccauccuaagccugugugugug

SEQ ID NO: 298268 - RNA, 32 nt, Human
acagcacuauccucaucucuccccagauguga

SEQ ID NO: 298269 - RNA, 32 nt, Human
acagcacuccacugcuggugaaucccaucuaa

SEQ ID NO: 298270 - RNA, 32 nt, Human
acagcacuccagccugggcgacagagugagac

SEQ ID NO: 298271 - RNA, 32 nt, Human
acagcacuccccaccuuucuuucguucaucuc

SEQ ID NO: 298272 - RNA, 32 nt, Human
acagcacugcacugcagccugggugacaaagc

SEQ ID NO: 298273 - RNA, 32 nt, Human
acagcacugcacugcugccugggcgacagcga

SEQ ID NO: 298274 - RNA, 32 nt, Human
acagcacugccuggauggccgcuguccggcag

SEQ ID NO: 298275 - RNA, 32 nt, Human
acagcacuggcccaccucccacucacagcccc

SEQ ID NO: 298276 - RNA, 32 nt, Human
acagcacugggcugccaggauuccccuggccc

SEQ ID NO: 298277 - RNA, 32 nt, Human
acagcacuguccuaugaaccuuccugcacgcc

SEQ ID NO: 298278 - RNA, 32 nt, Human
acagcacuucaggcugggaaaggagccaggcu

SEQ ID NO: 298279 - RNA, 32 nt, Human
acagcacuugacuucaccaggugacccuuugg

SEQ ID NO: 298280 - RNA, 32 nt, Human
acagcagaaaacugcauucuuacuauuuaccc

SEQ ID NO: 298281 - RNA, 32 nt, Human
acagcagaaagucccugaagccugccaaguac

SEQ ID NO: 298282 - RNA, 32 nt, Human
acagcagaaauguuccugcacuagacaauuaa

SEQ ID NO: 298283 - RNA, 21 nt, Human
acagcagaaccuaccugcagc

SEQ ID NO: 298284 - RNA, 32 nt, Human
acagcagaauuggccucagugaagagcuuaaa

SEQ ID NO: 298285 - RNA, 32 nt, Human
acagcagacugaggcccccacccugaaaaagc

SEQ ID NO: 298286 - RNA, 32 nt, Human
acagcagagaacuggcuggaugaccugugacu

SEQ ID NO: 298287 - RNA, 31 nt, Human
acagcagagacacucaguuguguggggugcu

SEQ ID NO: 298288 - RNA, 32 nt, Human
acagcagagcagagaggcccagggaggggcca

SEQ ID NO: 298289 - RNA, 32 nt, Human
acagcagagcccacagguggcagaaucccacc

SEQ ID NO: 298290 - RNA, 22 nt, Human
acagcagagcccgcggugcagc

SEQ ID NO: 298291 - RNA, 32 nt, Human
acagcagagguggaggcaagcagugacuccug

SEQ ID NO: 298292 - RNA, 21 nt, Human
acagcagaguccagcugcagc

SEQ ID NO: 298293 - RNA, 17 nt, Human
acagcagauaagaucaa

SEQ ID NO: 298294 - RNA, 32 nt, Human
acagcagaugacagggugauugauggcaggca

SEQ ID NO: 298295 - RNA, 32 nt, Human
acagcagaugaguugaguggggcagagggaca

SEQ ID NO: 298296 - RNA, 32 nt, Human
acagcagauguaagcacagaaauaguuccagu

SEQ ID NO: 298297 - RNA, 32 nt, Human
acagcagauucuucacgcccagccucugccuc

SEQ ID NO: 298298 - RNA, 32 nt, Human
acagcagauugcuucccuguuggugauugcaa

SEQ ID NO: 298299 - RNA, 32 nt, Human
acagcagcaagaaaaucagcuugguaccacca

SEQ ID NO: 298300 - RNA, 32 nt, Human
acagcagcaagaaaauuuuccucgacaagaac

SEQ ID NO: 298301 - RNA, 32 nt, Human
acagcagcacauauuaucauacagacagaaaa

SEQ ID NO: 298302 - RNA, 32 nt, Human
acagcagcacauuggccaccagaagacaccca

SEQ ID NO: 298303 - RNA, 32 nt, Human
acagcagcagaagaauuauggcagcucuucac

SEQ ID NO: 298304 - RNA, 32 nt, Human
acagcagcagaggggcccuagagcccccacag

SEQ ID NO: 298305 - RNA, 32 nt, Human
acagcagcagaugucccucacacacaugcccu

SEQ ID NO: 298306 - RNA, 24 nt, Human
acagcagcagcagcagccacagca

SEQ ID NO: 298307 - RNA, 32 nt, Human
acagcagcagcagcugcugccuccacagugug

SEQ ID NO: 298308 - RNA, 32 nt, Human
acagcagcagggaagccauucucacugcaucc

SEQ ID NO: 298309 - RNA, 32 nt, Human
acagcagcaugagccucaggugcuuuggggau

SEQ ID NO: 298310 - RNA, 32 nt, Human
acagcagcaugcccuucucaccccuugcagug

SEQ ID NO: 298311 - RNA, 32 nt, Human
acagcagccccacggccccaugggaggcggcg

SEQ ID NO: 298312 - RNA, 32 nt, Human
acagcagcccugggggugggugcaaugaggau

SEQ ID NO: 298313 - RNA, 32 nt, Human
acagcagccgccgggcacgguuaugggggcgg

SEQ ID NO: 298314 - RNA, 32 nt, Human
acagcagccuucugagucugggucaggaagau

SEQ ID NO: 298315 - RNA, 32 nt, Human
acagcagcucuauugaauaacaugcaucugaa

SEQ ID NO: 298316 - RNA, 32 nt, Human
acagcagcugaggagguacuagcugguagaga

SEQ ID NO: 298317 - RNA, 32 nt, Human
acagcagcugcacacaaccucuugcugaaaua

SEQ ID NO: 298318 - RNA, 32 nt, Human
acagcagcugccugcccugcccuggcucaacg

SEQ ID NO: 298319 - RNA, 32 nt, Human
acagcagcugcuacuccaccugcagcugggcu

SEQ ID NO: 298320 - RNA, 32 nt, Human
acagcaggaaaagauucugcgcuuucagggag

SEQ ID NO: 298321 - RNA, 32 nt, Human
acagcaggaacuugagggaaagaugaauaaag

SEQ ID NO: 298322 - RNA, 32 nt, Human
acagcaggaagcaaagcagagguggagaagau

SEQ ID NO: 298323 - RNA, 32 nt, Human
acagcaggaagugccucugacagauuccaaga

SEQ ID NO: 298324 - RNA, 32 nt, Human
acagcaggacaggccaggggagggcaucugga

SEQ ID NO: 298325 - RNA, 21 nt, Human
acagcaggacccaaaugcagc

SEQ ID NO: 298326 - RNA, 32 nt, Human
acagcaggacuggccacacccacgccgcaccu

SEQ ID NO: 298327 - RNA, 32 nt, Human
acagcaggagcacgggcugcccgcgcggugcg

SEQ ID NO: 298328 - RNA, 32 nt, Human
acagcaggagcagggcgagagccagacggagu

SEQ ID NO: 298329 - RNA, 32 nt, Human
acagcaggaggucagcccagggccaggagaca

SEQ ID NO: 298330 - RNA, 32 nt, Human
acagcaggaguacuaaacuuguucuuucuugc

SEQ ID NO: 298331 - RNA, 32 nt, Human
acagcaggauuagcuucagcuugggcuggagc

SEQ ID NO: 298332 - RNA, 32 nt, Human
acagcaggccccuguccuucugucgggcgccg

SEQ ID NO: 298333 - RNA, 32 nt, Human
acagcaggccucugggguccagccugggagcc

SEQ ID NO: 298334 - RNA, 17 nt, Human
acagcaggcuccugguc

SEQ ID NO: 298335 - RNA, 32 nt, Human
acagcaggcuuagguucuaguuccgugucugc

SEQ ID NO: 298336 - RNA, 32 nt, Human
acagcagggaaacugagaccuggaaagggagg

SEQ ID NO: 298337 - RNA, 32 nt, Human
acagcagggaaagggaggagaaaucugauguc

SEQ ID NO: 298338 - RNA, 32 nt, Human
acagcagggaagggaaguuccaccugagcaaa

SEQ ID NO: 298339 - RNA, 32 nt, Human
acagcagggaggacagcagggcgggcaggggg

SEQ ID NO: 298340 - RNA, 32 nt, Human
acagcagggaggcugaggcugaaggaauacuu

SEQ ID NO: 298341 - RNA, 32 nt, Human
acagcagggccugagggcaggaacagaggacg

SEQ ID NO: 298342 - RNA, 32 nt, Human
acagcagguaacacccacccccaggcagcccc

SEQ ID NO: 298343 - RNA, 32 nt, Human
acagcagguccuuaacuucucuccaguggacu

SEQ ID NO: 298344 - RNA, 32 nt, Human
acagcaggugccagugacuacuucucccuggu

SEQ ID NO: 298345 - RNA, 22 nt, Human
acagcaggugcugccauacucu

SEQ ID NO: 298346 - RNA, 32 nt, Human
acagcagguucugcagcauccugccuugcugc

SEQ ID NO: 298347 - RNA, 32 nt, Human
acagcagguuuauccagaugaacugagaaggu

SEQ ID NO: 298348 - RNA, 32 nt, Human
acagcagucaugguuaggaaggcagugcccuu

SEQ ID NO: 298349 - RNA, 32 nt, Human
acagcaguccccaagcauguggacagaugcau

SEQ ID NO: 298350 - RNA, 32 nt, Human
acagcagucggagacaucuggcagagacaaau

SEQ ID NO: 298351 - RNA, 32 nt, Human
acagcagucuccccgggccuccuggccucucc

SEQ ID NO: 298352 - RNA, 32 nt, Human
acagcagucugauguccaccuggaaugcuuga

SEQ ID NO: 298353 - RNA, 32 nt, Human
acagcagucuucauauguaucaauagcaagca

SEQ ID NO: 298354 - RNA, 32 nt, Human
acagcagucuugcugaugcuccuggccgaaua

SEQ ID NO: 298355 - RNA, 32 nt, Human
acagcagugauaccccacucucuccauuauug

SEQ ID NO: 298356 - RNA, 32 nt, Human
acagcagugaugacacugucugucuguggcuc

SEQ ID NO: 298357 - RNA, 32 nt, Human
acagcagugcaccucagagucacauucaugaa

SEQ ID NO: 298358 - RNA, 32 nt, Human
acagcagugccaaggcugagaccugucccugg

SEQ ID NO: 298359 - RNA, 16 nt, Human
acagcagugcugguuu

SEQ ID NO: 298360 - RNA, 31 nt, Human
acagcagugcuucucccugugcugagguaca

SEQ ID NO: 298361 - RNA, 32 nt, Human
acagcaguggauucuuucucucagaaggucau

SEQ ID NO: 298362 - RNA, 32 nt, Human
acagcaguggugaggccaguuucaugucuugu

SEQ ID NO: 298363 - RNA, 32 nt, Human
acagcagugguguccaugggcucuggagacca

SEQ ID NO: 298364 - RNA, 32 nt, Human
acagcagugugaauagccuggccaccagccau

SEQ ID NO: 298365 - RNA, 32 nt, Human
acagcaguuacacugcggcgggcgucuguucu

SEQ ID NO: 298366 - RNA, 32 nt, Human
acagcauaagagacugcccugcuugguguuuu

SEQ ID NO: 298367 - RNA, 32 nt, Human
acagcauaagaugaugaguaagaaaagaaugc

SEQ ID NO: 298368 - RNA, 32 nt, Human
acagcauaaucaggaucagcaguccugaagcu

SEQ ID NO: 298369 - RNA, 20 nt, Human
acagcauaaugcgagacaag

SEQ ID NO: 298370 - RNA, 32 nt, Human
acagcauaauuaagagagauagccuucgaaaa

SEQ ID NO: 298371 - RNA, 32 nt, Human
acagcauacucccaucuauacggcuggcucuu

SEQ ID NO: 298372 - RNA, 21 nt, Human
acagcauagaagaaagagcaa

SEQ ID NO: 298373 - RNA, 20 nt, Human
acagcauagaauaaaagcaa

SEQ ID NO: 298374 - RNA, 32 nt, Human
acagcauauuuagagaaaagacuuggagcuua

SEQ ID NO: 298375 - RNA, 32 nt, Human
acagcaucagcaugggcuuagagcuggcauga

SEQ ID NO: 298376 - RNA, 32 nt, Human
acagcaucauaacucagcaggcuggauuuaau

SEQ ID NO: 298377 - RNA, 19 nt, Human
acagcauccagaaagaguc

SEQ ID NO: 298378 - RNA, 32 nt, Human
acagcauccuccucucaccugugggucagagc

SEQ ID NO: 298379 - RNA, 32 nt, Human
acagcaucucaccauccuccuguuaucccacc

SEQ ID NO: 298380 - RNA, 32 nt, Human
acagcaucucacuauguugccaaggcucaucu

SEQ ID NO: 298381 - RNA, 32 nt, Human
acagcaucugugccaugcaauggggcuuuggu

SEQ ID NO: 298382 - RNA, 32 nt, Human
acagcaucuuccugguuguauguggccuguuu

SEQ ID NO: 298383 - RNA, 32 nt, Human
acagcaugaaugugguucuguacagugaugua

SEQ ID NO: 298384 - RNA, 32 nt, Human
acagcaugagaugcucagucggcuuggggaag

SEQ ID NO: 298385 - RNA, 32 nt, Human
acagcaugaggcaaaaauguccagccaccccu

SEQ ID NO: 298386 - RNA, 32 nt, Human
acagcaugcagucuuccaucugcuuucucuuc

SEQ ID NO: 298387 - RNA, 32 nt, Human
acagcaugccaccacaguaacacacauuagag

SEQ ID NO: 298388 - RNA, 32 nt, Human
acagcaugccagcuccucaguguuacauuccu

SEQ ID NO: 298389 - RNA, 32 nt, Human
acagcaugcugccugaggguuuucagaauagg

SEQ ID NO: 298390 - RNA, 32 nt, Human
acagcauggaaagaaggaggcagaaguggaac

SEQ ID NO: 298391 - RNA, 32 nt, Human
acagcauggaagaugugugcucuggcucggau

SEQ ID NO: 298392 - RNA, 32 nt, Human
acagcauggcugugguuccacacuccucuguc

SEQ ID NO: 298393 - RNA, 18 nt, Human
acagcauggggcuguucu

SEQ ID NO: 298394 - RNA, 32 nt, Human
acagcaugggggaaacccauccauccaauuac

SEQ ID NO: 298395 - RNA, 32 nt, Human
acagcaugguggucacuguugcugcugguaga

SEQ ID NO: 298396 - RNA, 32 nt, Human
acagcaugucucgacuuccugaggaauaucug

SEQ ID NO: 298397 - RNA, 32 nt, Human
acagcauguggugaaaccaaaaucacugauuu

SEQ ID NO: 298398 - RNA, 32 nt, Human
acagcauuaucagaaacacacucugaaaacau

SEQ ID NO: 298399 - RNA, 32 nt, Human
acagcauucagcccugcagccugggaccuugc

SEQ ID NO: 298400 - RNA, 32 nt, Human
acagcauuccagccugggcgauggagugagac

SEQ ID NO: 298401 - RNA, 32 nt, Human
acagcauucccaggaacaaaggcugggggugg

SEQ ID NO: 298402 - RNA, 19 nt, Human
acagcauucugggcuuaaa

SEQ ID NO: 298403 - RNA, 32 nt, Human
acagcauugaucuccuggaggcugguucugcu

SEQ ID NO: 298404 - RNA, 32 nt, Human
acagcauuuugucaucuaaaguccagugacau

SEQ ID NO: 298405 - RNA, 32 nt, Human
acagccaaauugcagaagaaacuccuggaucc

SEQ ID NO: 298406 - RNA, 20 nt, Human
acagccaacagaaaaaucaa

SEQ ID NO: 298407 - RNA, 32 nt, Human
acagccaaccucaggcuuagaucaauguauag

SEQ ID NO: 298408 - RNA, 32 nt, Human
acagccaacuccugacacuuucacacucacag

SEQ ID NO: 298409 - RNA, 32 nt, Human
acagccaagaggagucagagaugaggugggaa

SEQ ID NO: 298410 - RNA, 32 nt, Human
acagccaagauaagauccacacacacauuauu

SEQ ID NO: 298411 - RNA, 32 nt, Human
acagccaagcaggugugggaggcugcccgcug

SEQ ID NO: 298412 - RNA, 32 nt, Human
acagccaagccgcugcggccggguccggcgcg

SEQ ID NO: 298413 - RNA, 32 nt, Human
acagccaagccuuuugaagacuaauuagaaaa

SEQ ID NO: 298414 - RNA, 32 nt, Human
acagccaaggaacuuugagaccugccauuaca

SEQ ID NO: 298415 - RNA, 32 nt, Human
acagccaaggauccagaaggccaaggucuugu

SEQ ID NO: 298416 - RNA, 32 nt, Human
acagccaaguacucguuuccacaccaagacuc

SEQ ID NO: 298417 - RNA, 32 nt, Human
acagccaaguucaaggaagcagccuggcuaaa

SEQ ID NO: 298418 - RNA, 32 nt, Human
acagccacaaagcaaaccacagggccagugac

SEQ ID NO: 298419 - RNA, 32 nt, Human
acagccacacacacagucacacagacgcguuc

SEQ ID NO: 298420 - RNA, 32 nt, Human
acagccacacacaucaauuuguuuuugguuaa

SEQ ID NO: 298421 - RNA, 21 nt, Human
acagccacagccccaggcaua

SEQ ID NO: 298422 - RNA, 32 nt, Human
acagccacagccgccgccaucacucgcucgcc

SEQ ID NO: 298423 - RNA, 32 nt, Human
acagccacaucucuuccauugccuggugcccu

SEQ ID NO: 298424 - RNA, 21 nt, Human
acagccaccaagccugacaga

SEQ ID NO: 298425 - RNA, 32 nt, Human
acagccaccaauaagaacaaaggcaucauuug

SEQ ID NO: 298426 - RNA, 18 nt, Human
acagccaccauucauuau

SEQ ID NO: 298427 - RNA, 32 nt, Human
acagccacccacccucucccaccucaugcucc

SEQ ID NO: 298428 - RNA, 17 nt, Human
acagccacccccaccac

SEQ ID NO: 298429 - RNA, 19 nt, Human
acagccacccuggaacgga

SEQ ID NO: 298430 - RNA, 17 nt, Human
acagccaccugccacca

SEQ ID NO: 298431 - RNA, 32 nt, Human
acagccacuccaacucuccaccuccagcuucu

SEQ ID NO: 298432 - RNA, 32 nt, Human
acagccacugagauccuccagccuggacaugc

SEQ ID NO: 298433 - RNA, 32 nt, Human
acagccacugggccugggcacacacauugaag

SEQ ID NO: 298434 - RNA, 19 nt, Human
acagccacuugcccacaga

SEQ ID NO: 298435 - RNA, 32 nt, Human
acagccagaacugccuuuggcccuacggaugg

SEQ ID NO: 298436 - RNA, 32 nt, Human
acagccagagaaacuccagacaaacaauguag

SEQ ID NO: 298437 - RNA, 32 nt, Human
acagccagagaggcagaggcaagagcagagcc

SEQ ID NO: 298438 - RNA, 32 nt, Human
acagccagaguugccucuccuccuccucuucc

SEQ ID NO: 298439 - RNA, 32 nt, Human
acagccagcaccagggcaggcagaugggggcg

SEQ ID NO: 298440 - RNA, 32 nt, Human
acagccaggaagcaucauccacgaaccagaaa

SEQ ID NO: 298441 - RNA, 32 nt, Human
acagccaggagcuuccugucaguaaccauguu

SEQ ID NO: 298442 - RNA, 32 nt, Human
acagccaggccccucuggaauuguccuuauua

SEQ ID NO: 298443 - RNA, 28 nt, Human
acagccaggccggcugccucaucucagc

SEQ ID NO: 298444 - RNA, 32 nt, Human
acagccaggcucuuacuccagccggggcugcc

SEQ ID NO: 298445 - RNA, 32 nt, Human
acagccaggcuggagucagugucugccccuga

SEQ ID NO: 298446 - RNA, 32 nt, Human
acagccaggcuucugucauacagguagauccc

SEQ ID NO: 298447 - RNA, 32 nt, Human
acagccagggugugucaccugacaggcucacc

SEQ ID NO: 298448 - RNA, 32 nt, Human
acagccaggugaggugggagguuggagagcca

SEQ ID NO: 298449 - RNA, 32 nt, Human
acagccaguaaccucuccugugccucuaccua

SEQ ID NO: 298450 - RNA, 32 nt, Human
acagccagucaccacccuccuggaccauacuc

SEQ ID NO: 298451 - RNA, 32 nt, Human
acagccagugaggccagaaauuggucuugugg

SEQ ID NO: 298452 - RNA, 17 nt, Human
acagccagugggacaag

SEQ ID NO: 298453 - RNA, 32 nt, Human
acagccauaugcaggacggcaguacucagcau

SEQ ID NO: 298454 - RNA, 20 nt, Human
acagccaucaacuucccuuc

SEQ ID NO: 298455 - RNA, 32 nt, Human
acagccaucacauucaccucuaccuccaccau

SEQ ID NO: 298456 - RNA, 32 nt, Human
acagccaucacugaggccugggcccgccucaa

SEQ ID NO: 298457 - RNA, 32 nt, Human
acagccaucaucucucacgguaccacaggccu

SEQ ID NO: 298458 - RNA, 32 nt, Human
acagccauccccuauagaaaggcacagcuuuu

SEQ ID NO: 298459 - RNA, 32 nt, Human
acagccauccgccaccaccgcugccgcagccu

SEQ ID NO: 298460 - RNA, 32 nt, Human
acagccauccuaggaagcagguaacagcccua

SEQ ID NO: 298461 - RNA, 31 nt, Human
acagccaugggcugggaccugacggugaaga

SEQ ID NO: 298462 - RNA, 31 nt, Human
acagccauguccucgucagccggcagcggcc

SEQ ID NO: 298463 - RNA, 22 nt, Human
acagccauucuguucugcccuc

SEQ ID NO: 298464 - RNA, 32 nt, Human
acagccauugcacuccagccugggcaacagag

SEQ ID NO: 298465 - RNA, 32 nt, Human
acagccauugcugaggccugggcucgccugga

SEQ ID NO: 298466 - RNA, 32 nt, Human
acagccauuugugauuugcuguucuguaggcg

SEQ ID NO: 298467 - RNA, 32 nt, Human
acagcccacaccugaagagcacgcccaagcug

SEQ ID NO: 298468 - RNA, 32 nt, Human
acagcccacaugcugcauaagaugggccuuau

SEQ ID NO: 298469 - RNA, 32 nt, Human
acagcccacccaggcggcggggucuugguggg

SEQ ID NO: 298470 - RNA, 32 nt, Human
acagcccacugaggcccuguccccagaagaug

SEQ ID NO: 298471 - RNA, 32 nt, Human
acagcccagaaagagaaagacggagaggcaga

SEQ ID NO: 298472 - RNA, 32 nt, Human
acagcccagagcagccugagugcagucaugug

SEQ ID NO: 298473 - RNA, 32 nt, Human
acagcccagagguggcuucuuccuucaggaac

SEQ ID NO: 298474 - RNA, 32 nt, Human
acagcccagcacagguauuucaggugugaaag

SEQ ID NO: 298475 - RNA, 32 nt, Human
acagcccagcacuccucugggcugcucucaaa

SEQ ID NO: 298476 - RNA, 32 nt, Human
acagcccagccuucccuuccucugagcagagc

SEQ ID NO: 298477 - RNA, 32 nt, Human
acagcccagcgccacaccaugggccugguagu

SEQ ID NO: 298478 - RNA, 32 nt, Human
acagcccagcucugagucucagucgcugauca

SEQ ID NO: 298479 - RNA, 32 nt, Human
acagcccagcuggguugcaauuccagaaugcu

SEQ ID NO: 298480 - RNA, 32 nt, Human
acagcccaggcaggacagagcagaucacacaa

SEQ ID NO: 298481 - RNA, 32 nt, Human
acagcccagggaaaccuccucacaguuuucau

SEQ ID NO: 298482 - RNA, 32 nt, Human
acagcccagggacuuaauguggccaucgggca

SEQ ID NO: 298483 - RNA, 32 nt, Human
acagcccagguucuucugcccaacacaaaagg

SEQ ID NO: 298484 - RNA, 32 nt, Human
acagcccaugccaaccccuccuggagccagcc

SEQ ID NO: 298485 - RNA, 32 nt, Human
acagcccauuucccaguagucugccuugcccu

SEQ ID NO: 298486 - RNA, 32 nt, Human
acagcccauuuugccaagaugucuagaguagc

SEQ ID NO: 298487 - RNA, 32 nt, Human
acagccccacucuccagccauuuggaaacaaa

SEQ ID NO: 298488 - RNA, 32 nt, Human
acagcccccaucccacugaggguggggcagcu

SEQ ID NO: 298489 - RNA, 32 nt, Human
acagcccccgugggcauggaccaccuuuauuu

SEQ ID NO: 298490 - RNA, 32 nt, Human
acagcccccucaggcagccaggucaucugagu

SEQ ID NO: 298491 - RNA, 32 nt, Human
acagcccccugccccaucuucuggcacaggcc

SEQ ID NO: 298492 - RNA, 32 nt, Human
acagcccccugccugauccccugcuggcuggg

SEQ ID NO: 298493 - RNA, 32 nt, Human
acagccccgaggauggucuugcucugggaauu

SEQ ID NO: 298494 - RNA, 16 nt, Human
acagccccgcagguca

SEQ ID NO: 298495 - RNA, 19 nt, Human
acagccccggacuguguug

SEQ ID NO: 298496 - RNA, 32 nt, Human
acagccccuccuggugcgcggcuggaggcugc

SEQ ID NO: 298497 - RNA, 32 nt, Human
acagccccugcaccuggcagccagcgagcuac

SEQ ID NO: 298498 - RNA, 32 nt, Human
acagccccugcucacuuucuguuggccacaac

SEQ ID NO: 298499 - RNA, 22 nt, Human
acagccccugcuucccugcacc

SEQ ID NO: 298500 - RNA, 32 nt, Human
acagccccugugucucugucucuuggggaccu

SEQ ID NO: 298501 - RNA, 32 nt, Human
acagcccgagacaggcagcccaggccggcugu

SEQ ID NO: 298502 - RNA, 32 nt, Human
acagcccgcacagcugcccagccugcggagac

SEQ ID NO: 298503 - RNA, 32 nt, Human
acagcccgccuucugccaaaagaagugauggc

SEQ ID NO: 298504 - RNA, 32 nt, Human
acagcccggagccugcagcccagccccaccca

SEQ ID NO: 298505 - RNA, 32 nt, Human
acagcccggcagagugguuccaccuccccaug

SEQ ID NO: 298506 - RNA, 32 nt, Human
acagcccggguguggagaggcggccauccuug

SEQ ID NO: 298507 - RNA, 32 nt, Human
acagcccguuguucgcagccucccucugaccc

SEQ ID NO: 298508 - RNA, 32 nt, Human
acagcccucacagcucuucagagcaagcacug

SEQ ID NO: 298509 - RNA, 32 nt, Human
acagcccucacugcucucuaucuccagguggc

SEQ ID NO: 298510 - RNA, 32 nt, Human
acagcccuccaggagauaucaaaggaggucag

SEQ ID NO: 298511 - RNA, 32 nt, Human
acagcccuccagguccuccagcucugucagau

SEQ ID NO: 298512 - RNA, 32 nt, Human
acagcccucucaucuccuggaaccauggccag

SEQ ID NO: 298513 - RNA, 32 nt, Human
acagcccucuucuggaacagucaccuuguuaa

SEQ ID NO: 298514 - RNA, 32 nt, Human
acagcccugccugcucugagggccacagccug

SEQ ID NO: 298515 - RNA, 32 nt, Human
acagcccugccuggccuccccucucauggccc

SEQ ID NO: 298516 - RNA, 32 nt, Human
acagcccugccugggccugucucucaagggca

SEQ ID NO: 298517 - RNA, 32 nt, Human
acagcccugcuccccaaggccugguggcuuug

SEQ ID NO: 298518 - RNA, 32 nt, Human
acagcccuggggagccagacaggcuuugguau

SEQ ID NO: 298519 - RNA, 32 nt, Human
acagcccugucccucccugccuccgccuugcc

SEQ ID NO: 298520 - RNA, 32 nt, Human
acagcccugugggagcagcuuggcugugagca

SEQ ID NO: 298521 - RNA, 32 nt, Human
acagcccuuucaucuaccuuguggggaaccug

SEQ ID NO: 298522 - RNA, 32 nt, Human
acagccgaagcacccggcaucuuggugggggc

SEQ ID NO: 298523 - RNA, 32 nt, Human
acagccgagacucauuuccaaggcacagcagc

SEQ ID NO: 298524 - RNA, 31 nt, Human
acagccgagagaccugaucucuggauucagu

SEQ ID NO: 298525 - RNA, 32 nt, Human
acagccgcaccgccuauuccagccuuuggaga

SEQ ID NO: 298526 - RNA, 21 nt, Human
acagccgcagcgugucacagg

SEQ ID NO: 298527 - RNA, 32 nt, Human
acagccgccacuggugcugagcugcuaggaag

SEQ ID NO: 298528 - RNA, 21 nt, Human
acagccgccgccgccgccgcc

SEQ ID NO: 298529 - RNA, 25 nt, Human
acagccgccgccuccaccaccacca

SEQ ID NO: 298530 - RNA, 22 nt, Human
acagccgccgcugccgccgccg

SEQ ID NO: 298531 - RNA, 32 nt, Human
acagccgccuuuggguuccaucuugcuaauaa

SEQ ID NO: 298532 - RNA, 32 nt, Human
acagccgcgcagugcccauggaggcgcugcug

SEQ ID NO: 298533 - RNA, 32 nt, Human
acagccgcgccgcggaucgucaacaucucggu

SEQ ID NO: 298534 - RNA, 32 nt, Human
acagccgcucccucgcucugcuggggccuccg

SEQ ID NO: 298535 - RNA, 32 nt, Human
acagccgcuccugguaucagagcugcuuucca

SEQ ID NO: 298536 - RNA, 32 nt, Human
acagccggagcaguuggccugugcuuggaggc

SEQ ID NO: 298537 - RNA, 32 nt, Human
acagccgggaaagacuggucaccugagaggag

SEQ ID NO: 298538 - RNA, 32 nt, Human
acagccgggaccccgguucacacugacucugg

SEQ ID NO: 298539 - RNA, 32 nt, Human
acagccggguaugggcuuccacacagcauggg

SEQ ID NO: 298540 - RNA, 32 nt, Human
acagccgguagagccucugcccucccgaaacu

SEQ ID NO: 298541 - RNA, 32 nt, Human
acagccgguagauggaagucauuuuuccaggg

SEQ ID NO: 298542 - RNA, 32 nt, Human
acagccggucaggcugcagggugcccaggggc

SEQ ID NO: 298543 - RNA, 32 nt, Human
acagccgugaugaugaaagagugaagaaccgc

SEQ ID NO: 298544 - RNA, 32 nt, Human
acagccgugggugucaaagguggcauuugagg

SEQ ID NO: 298545 - RNA, 21 nt, Human
acagccuaaacgccaccacca

SEQ ID NO: 298546 - RNA, 32 nt, Human
acagccuacugccggaacucucuggauggcca

SEQ ID NO: 298547 - RNA, 32 nt, Human
acagccuacuguuugucuccaguuuuuaaacu

SEQ ID NO: 298548 - RNA, 32 nt, Human
acagccuacuucauaaaaaccccacagugaca

SEQ ID NO: 298549 - RNA, 32 nt, Human
acagccuacuucggcagaugugggagaggaug

SEQ ID NO: 298550 - RNA, 23 nt, Human
acagccuagccaacauggugaaa

SEQ ID NO: 298551 - RNA, 23 nt, Human
acagccuagccaagauggugaaa

SEQ ID NO: 298552 - RNA, 23 nt, Human
acagccuaggcaacauggugaaa

SEQ ID NO: 298553 - RNA, 32 nt, Human
acagccuagggcugagcuggggaccugguacc

SEQ ID NO: 298554 - RNA, 32 nt, Human
acagccucacacacagcaggggccugagaagu

SEQ ID NO: 298555 - RNA, 22 nt, Human
acagccucaccuccuacagccu

SEQ ID NO: 298556 - RNA, 32 nt, Human
acagccucaccuucaccucuuggguauuucag

SEQ ID NO: 298557 - RNA, 28 nt, Human
acagccucagcuccguccccugccccac

SEQ ID NO: 298558 - RNA, 32 nt, Human
acagccucaggagaauaaaugacuugcuuuuc

SEQ ID NO: 298559 - RNA, 21 nt, Human
acagccucaggccuauaccac

SEQ ID NO: 298560 - RNA, 32 nt, Human
acagccucauuccuaacacagaaaguuauuua

SEQ ID NO: 298561 - RNA, 32 nt, Human
acagccucauuuccccagcuucccugauuucu

SEQ ID NO: 298562 - RNA, 32 nt, Human
acagccuccagccucucccuccagcacaaccu

SEQ ID NO: 298563 - RNA, 32 nt, Human
acagccuccagcggcugccacugugggcucug

SEQ ID NO: 298564 - RNA, 32 nt, Human
acagccucccaaacugcugggauuacaggcgu

SEQ ID NO: 298565 - RNA, 32 nt, Human
acagccucccaaaguucugggauuacaagugu

SEQ ID NO: 298566 - RNA, 32 nt, Human
acagccucccacccccaucucucccuccccug

SEQ ID NO: 298567 - RNA, 32 nt, Human
acagccucccggagucccagcagcaagacggc

SEQ ID NO: 298568 - RNA, 32 nt, Human
acagccucccuuccuucuuucucccuccgccu

SEQ ID NO: 298569 - RNA, 32 nt, Human
acagccuccuggcaacacuagaggccucaaga

SEQ ID NO: 298570 - RNA, 32 nt, Human
acagccuccuugccuuuggucuccuuaccagu

SEQ ID NO: 298571 - RNA, 32 nt, Human
acagccucgcucugucacccaggcuggaguac

SEQ ID NO: 298572 - RNA, 32 nt, Human
acagccucuaggccccagccccggaggugaau

SEQ ID NO: 298573 - RNA, 32 nt, Human
acagccucucaaagugcugggauuacagucuc

SEQ ID NO: 298574 - RNA, 32 nt, Human
acagccucucccacagguaccaugaaggucuc

SEQ ID NO: 298575 - RNA, 32 nt, Human
acagccucuccucuuuaccugaucaauguuaa

SEQ ID NO: 298576 - RNA, 32 nt, Human
acagccucucuuucuccuccacauacugcagc

SEQ ID NO: 298577 - RNA, 32 nt, Human
acagccucugcaggcccugcucuugccuccca

SEQ ID NO: 298578 - RNA, 32 nt, Human
acagccucugcaggcccugcucuugccucuua

SEQ ID NO: 298579 - RNA, 32 nt, Human
acagccucugcagggccugcucuugccuccca

SEQ ID NO: 298580 - RNA, 25 nt, Human
acagccucugccgagccugcaucac

SEQ ID NO: 298581 - RNA, 32 nt, Human
acagccucuguaucucugcaggccauacuggu

SEQ ID NO: 298582 - RNA, 32 nt, Human
acagccucugugagagaugccccacaccaaac

SEQ ID NO: 298583 - RNA, 32 nt, Human
acagccugacaguccccacaucagcccggacc

SEQ ID NO: 298584 - RNA, 32 nt, Human
acagccugacauacacauaucaucucaugaaa

SEQ ID NO: 298585 - RNA, 23 nt, Human
acagccugaccaacauggugaaa

SEQ ID NO: 298586 - RNA, 32 nt, Human
acagccugacuucccuuccccaggccaggguu

SEQ ID NO: 298587 - RNA, 32 nt, Human
acagccugagaucugucccuucaacgggcugg

SEQ ID NO: 298588 - RNA, 22 nt, Human
acagccugaggcagggcucugu

SEQ ID NO: 298589 - RNA, 32 nt, Human
acagccugcugaagcagggcgagggcuucucu

SEQ ID NO: 298590 - RNA, 16 nt, Human
acagccugcugggccc

SEQ ID NO: 298591 - RNA, 32 nt, Human
acagccugcuucuccccugggcugcugugggc

SEQ ID NO: 298592 - RNA, 23 nt, Human
acagccuggcaaagucccacuca

SEQ ID NO: 298593 - RNA, 23 nt, Human
acagccuggccaacaaggugaaa

SEQ ID NO: 298594 - RNA, 23 nt, Human
acagccuggccaacacagugaaa

SEQ ID NO: 298595 - RNA, 23 nt, Human
acagccuggccaacagggugaaa

SEQ ID NO: 298596 - RNA, 23 nt, Human
acagccuggccaacauaaugaaa

SEQ ID NO: 298597 - RNA, 23 nt, Human
acagccuggccaacauagugaaa

SEQ ID NO: 298598 - RNA, 23 nt, Human
acagccuggccaacaugaugaaa

SEQ ID NO: 298599 - RNA, 23 nt, Human
acagccuggccaacauggcgaaa

SEQ ID NO: 298600 - RNA, 23 nt, Human
acagccuggccaacauggugaaa

SEQ ID NO: 298601 - RNA, 32 nt, Human
acagccuggccaacauggugaaaccucaucuc

SEQ ID NO: 298602 - RNA, 32 nt, Human
acagccuggccaacgugaugaaaccccaucug

SEQ ID NO: 298603 - RNA, 23 nt, Human
acagccuggccaauauggugaaa

SEQ ID NO: 298604 - RNA, 23 nt, Human
acagccuggcccacauggugaaa

SEQ ID NO: 298605 - RNA, 23 nt, Human
acagccuggccgacauggugaaa

SEQ ID NO: 298606 - RNA, 32 nt, Human
acagccuggcugggaaaggggguguggaaaga

SEQ ID NO: 298607 - RNA, 32 nt, Human
acagccugggaaccugccuuaagcugggugau

SEQ ID NO: 298608 - RNA, 32 nt, Human
acagccugggaggcgcaggggcugggcagcug

SEQ ID NO: 298609 - RNA, 32 nt, Human
acagccugggcaacaagagcgaaacuccgucu

SEQ ID NO: 298610 - RNA, 23 nt, Human
acagccugggcaacauggcgaaa

SEQ ID NO: 298611 - RNA, 23 nt, Human
acagccugggcaacauggugaaa

SEQ ID NO: 298612 - RNA, 32 nt, Human
acagccugggcaacauggugaaaccugucucu

SEQ ID NO: 298613 - RNA, 32 nt, Human
acagccugggcaacgcaggaauggaauuuuaa

SEQ ID NO: 298614 - RNA, 32 nt, Human
acagccugggcuggggguggggugggagaggu

SEQ ID NO: 298615 - RNA, 32 nt, Human
acagccuggggaugcagagcacaugccggccc

SEQ ID NO: 298616 - RNA, 31 nt, Human
acagccuggguggaaggcagaccugaaucac

SEQ ID NO: 298617 - RNA, 23 nt, Human
acagccuggucaacauggcgaaa

SEQ ID NO: 298618 - RNA, 32 nt, Human
acagccugugaggaagugagccagcaguggcc

SEQ ID NO: 298619 - RNA, 32 nt, Human
acagccuguggcugggaagggagacagaggcg

SEQ ID NO: 298620 - RNA, 32 nt, Human
acagccuguuucugcugaguuucuuaucagcc

SEQ ID NO: 298621 - RNA, 32 nt, Human
acagccuucagccuugaacugcagcgucaccu

SEQ ID NO: 298622 - RNA, 32 nt, Human
acagccuucugccuccucgccucuccuggacu

SEQ ID NO: 298623 - RNA, 32 nt, Human
acagccuucuggcugggacugacuuggccaug

SEQ ID NO: 298624 - RNA, 32 nt, Human
acagccuucuucccaacccuucuugaacuguc

SEQ ID NO: 298625 - RNA, 20 nt, Human
acagccuugacccccgacag

SEQ ID NO: 298626 - RNA, 32 nt, Human
acagccuugauuuccucccaaaguaggugagc

SEQ ID NO: 298627 - RNA, 20 nt, Human
acagccuugcagaaaagcaa

SEQ ID NO: 298628 - RNA, 32 nt, Human
acagccuugcccacaaacccugccucugaggg

SEQ ID NO: 298629 - RNA, 32 nt, Human
acagccuugcccucagccucugagcuccaggg

SEQ ID NO: 298630 - RNA, 32 nt, Human
acagccuugcuacagcggaggcagcugggauu

SEQ ID NO: 298631 - RNA, 32 nt, Human
acagccuuguuucuccccuuugaaucagcaga

SEQ ID NO: 298632 - RNA, 32 nt, Human
acagcgaaugcaaagguccugaggcaggagcg

SEQ ID NO: 298633 - RNA, 32 nt, Human
acagcgagaggcagagaaagaagagacaggag

SEQ ID NO: 298634 - RNA, 26 nt, Human
acagcgagaugccccaccaccuccug

SEQ ID NO: 298635 - RNA, 22 nt, Human
acagcgagccagagucugggug

SEQ ID NO: 298636 - RNA, 32 nt, Human
acagcgagccuccagcuccuacccucugccug

SEQ ID NO: 298637 - RNA, 18 nt, Human
acagcgaggcaccacccg

SEQ ID NO: 298638 - RNA, 32 nt, Human
acagcgauaaauaccagcauucaaaccacagu

SEQ ID NO: 298639 - RNA, 32 nt, Human
acagcgaugaacguucuuuucccuccuggguu

SEQ ID NO: 298640 - RNA, 32 nt, Human
acagcgcagccucaucaaaaugcagcuggcaa

SEQ ID NO: 298641 - RNA, 32 nt, Human
acagcgcagcgcgggcggcagcgcggccccaa

SEQ ID NO: 298642 - RNA, 32 nt, Human
acagcgcaguugcauucuggccacuuugaccu

SEQ ID NO: 298643 - RNA, 32 nt, Human
acagcgccucugcugccccagccuucuacagc

SEQ ID NO: 298644 - RNA, 32 nt, Human
acagcgccugggaaucagcccuucucccuacu

SEQ ID NO: 298645 - RNA, 32 nt, Human
acagcgcgcagagacugcagccucccaaucgu

SEQ ID NO: 298646 - RNA, 32 nt, Human
acagcgcugauuuggaaaaaugacuagaaagc

SEQ ID NO: 298647 - RNA, 32 nt, Human
acagcgcugccugggcauuguuggugcucagg

SEQ ID NO: 298648 - RNA, 32 nt, Human
acagcggacucuccacgcccagcuacucucgc

SEQ ID NO: 298649 - RNA, 32 nt, Human
acagcggagagggggugauagcagcugaggug

SEQ ID NO: 298650 - RNA, 32 nt, Human
acagcggaggggccagucuccuggcgaagggg

SEQ ID NO: 298651 - RNA, 32 nt, Human
acagcggagguggcggcgcgggcaggucggag

SEQ ID NO: 298652 - RNA, 32 nt, Human
acagcggcagcuccagcccggcccggcagcga

SEQ ID NO: 298653 - RNA, 20 nt, Human
acagcggcgccgcugugcuc

SEQ ID NO: 298654 - RNA, 32 nt, Human
acagcggcuccccgcuaccaccacucuccugc

SEQ ID NO: 298655 - RNA, 32 nt, Human
acagcgggaggcucaaaccugcccucggacgc

SEQ ID NO: 298656 - RNA, 32 nt, Human
acagcgggaggggacgccagcgccugcagagg

SEQ ID NO: 298657 - RNA, 32 nt, Human
acagcggucagugggauucagccugagaaccu

SEQ ID NO: 298658 - RNA, 32 nt, Human
acagcguauguggggagguggaggggguccau

SEQ ID NO: 298659 - RNA, 32 nt, Human
acagcgugaaacacuggaauccuucauggacg

SEQ ID NO: 298660 - RNA, 32 nt, Human
acagcgugagccaccacaccuggccaagaaug

SEQ ID NO: 298661 - RNA, 32 nt, Human
acagcgugagccaccgcacccagccgcuugcu

SEQ ID NO: 298662 - RNA, 32 nt, Human
acagcuaaaaaugaguuaugauagcagcuuga

SEQ ID NO: 298663 - RNA, 32 nt, Human
acagcuaaaauugcagcauuuccccagcuggg

SEQ ID NO: 298664 - RNA, 18 nt, Human
acagcuaaagcagacaag

SEQ ID NO: 298665 - RNA, 32 nt, Human
acagcuaauucuuuugcuuucuguaaaugucu

SEQ ID NO: 298666 - RNA, 32 nt, Human
acagcuacagcuuucuugcucccuucagcccc

SEQ ID NO: 298667 - RNA, 32 nt, Human
acagcuagaaggcacugucagagaagagaaac

SEQ ID NO: 298668 - RNA, 32 nt, Human
acagcuaggaucugcauuuucagguuccgagc

SEQ ID NO: 298669 - RNA, 32 nt, Human
acagcuaggaugugcauucuccagccaucaag

SEQ ID NO: 298670 - RNA, 32 nt, Human
acagcuaggcucccccuccccucuuuaaacca

SEQ ID NO: 298671 - RNA, 32 nt, Human
acagcuagggcugaggaugggaacagggacag

SEQ ID NO: 298672 - RNA, 32 nt, Human
acagcuagggcugcucaguaacugccccaacc

SEQ ID NO: 298673 - RNA, 32 nt, Human
acagcuaggugguggaaucggugaggaggggg

SEQ ID NO: 298674 - RNA, 32 nt, Human
acagcuauccuagaauaaugacauauaugcua

SEQ ID NO: 298675 - RNA, 22 nt, Human
acagcuaugccaccacccuagc

SEQ ID NO: 298676 - RNA, 32 nt, Human
acagcuauguguaugaaauaggucacaacaga

SEQ ID NO: 298677 - RNA, 32 nt, Human
acagcuauugguauggugguagaaagagauga

SEQ ID NO: 298678 - RNA, 32 nt, Human
acagcucaaaacuuuuguuucauuucaugccu

SEQ ID NO: 298679 - RNA, 31 nt, Human
acagcucaaauguccaucaauagcagaaaga

SEQ ID NO: 298680 - RNA, 31 nt, Human
acagcucaagugucuaucaugaauggauaaa

SEQ ID NO: 298681 - RNA, 32 nt, Human
acagcucaaucuuugaacaagauuccaagcga

SEQ ID NO: 298682 - RNA, 32 nt, Human
acagcucacagcaggcuccaccucucaggcuc

SEQ ID NO: 298683 - RNA, 32 nt, Human
acagcucacugcaaccucaauccugggcucaa

SEQ ID NO: 298684 - RNA, 32 nt, Human
acagcucacugcaaccucuacucccaggcuca

SEQ ID NO: 298685 - RNA, 32 nt, Human
acagcucacugcaaccuuacuccuaggcucaa

SEQ ID NO: 298686 - RNA, 32 nt, Human
acagcucacugcagccucaaccucugaaggcc

SEQ ID NO: 298687 - RNA, 32 nt, Human
acagcucacugcagccucaaccuggguucaag

SEQ ID NO: 298688 - RNA, 32 nt, Human
acagcucacugcagccuccaccuccugggcuc

SEQ ID NO: 298689 - RNA, 32 nt, Human
acagcucacugcagccuccaucuccuaggcuc

SEQ ID NO: 298690 - RNA, 32 nt, Human
acagcucacugcagccucgaccucccgggcuc

SEQ ID NO: 298691 - RNA, 32 nt, Human
acagcucacugcagccucgacuucccaggcuc

SEQ ID NO: 298692 - RNA, 32 nt, Human
acagcucacugcagccuugaccucccgggcuc

SEQ ID NO: 298693 - RNA, 32 nt, Human
acagcucacugcagccuugauuucccgggcuc

SEQ ID NO: 298694 - RNA, 32 nt, Human
acagcucacugcagccuuguccucccaggcuc

SEQ ID NO: 298695 - RNA, 32 nt, Human
acagcucacugcagcuuugaucugaccgcuca

SEQ ID NO: 298696 - RNA, 32 nt, Human
acagcucacugcagguucagccuucugaguuc

SEQ ID NO: 298697 - RNA, 32 nt, Human
acagcucagaaggaauccaaaaagcagaaguc

SEQ ID NO: 298698 - RNA, 32 nt, Human
acagcucagagagagaaagaucugagggaaga

SEQ ID NO: 298699 - RNA, 32 nt, Human
acagcucagagcagggcagaacuggggacacu

SEQ ID NO: 298700 - RNA, 32 nt, Human
acagcucagagggaggagccagaccagcagug

SEQ ID NO: 298701 - RNA, 32 nt, Human
acagcucagcacagcuauugauauguuagagg

SEQ ID NO: 298702 - RNA, 32 nt, Human
acagcucagcagacauccacacacaguaaugg

SEQ ID NO: 298703 - RNA, 32 nt, Human
acagcucaggcagcgcaggugugaugggcaca

SEQ ID NO: 298704 - RNA, 32 nt, Human
acagcucauacuguucucaccugggaaacuug

SEQ ID NO: 298705 - RNA, 32 nt, Human
acagcucaugcccucggucucuugccucggca

SEQ ID NO: 298706 - RNA, 32 nt, Human
acagcuccagacauguccaacaacagccccga

SEQ ID NO: 298707 - RNA, 32 nt, Human
acagcuccagauggauccccaguacccccuuc

SEQ ID NO: 298708 - RNA, 32 nt, Human
acagcuccagcucgugccaucuucccaaugua

SEQ ID NO: 298709 - RNA, 32 nt, Human
acagcuccaggcucuugggcccuucccgaggg

SEQ ID NO: 298710 - RNA, 32 nt, Human
acagcuccaguaaacaaaaaggucagggcaga

SEQ ID NO: 298711 - RNA, 32 nt, Human
acagcucccuccacuccucucuuaucacuggg

SEQ ID NO: 298712 - RNA, 32 nt, Human
acagcucccuuccauccauuuuuaacucuuuc

SEQ ID NO: 298713 - RNA, 32 nt, Human
acagcuccucaugccauuuccuguccagauug

SEQ ID NO: 298714 - RNA, 32 nt, Human
acagcuccuggaccaggcccauacuagaguuc

SEQ ID NO: 298715 - RNA, 32 nt, Human
acagcuccuggggccuuccuggcucuggccca

SEQ ID NO: 298716 - RNA, 32 nt, Human
acagcuccugguguguagaauucccggagcgu

SEQ ID NO: 298717 - RNA, 32 nt, Human
acagcuccugucacccugucaggcagcccuuu

SEQ ID NO: 298718 - RNA, 32 nt, Human
acagcuccuuccucacguucucaggccuccac

SEQ ID NO: 298719 - RNA, 32 nt, Human
acagcucgauaagccuuuuugacuguguacau

SEQ ID NO: 298720 - RNA, 32 nt, Human
acagcucgcagucccugagccucugcaggcag

SEQ ID NO: 298721 - RNA, 32 nt, Human
acagcucggagcuuaaauuugccuuccugggu

SEQ ID NO: 298722 - RNA, 32 nt, Human
acagcucgugcccucggucucuugccucggca

SEQ ID NO: 298723 - RNA, 32 nt, Human
acagcucguguccuccgucucuugccucggcg

SEQ ID NO: 298724 - RNA, 32 nt, Human
acagcucuccagccugggcgacagagugagac

SEQ ID NO: 298725 - RNA, 32 nt, Human
acagcucuccaucacccagugaacaucucacc

SEQ ID NO: 298726 - RNA, 32 nt, Human
acagcucuccccucggguacgagggccagugu

SEQ ID NO: 298727 - RNA, 32 nt, Human
acagcucucccugguccugucauugcauggcu

SEQ ID NO: 298728 - RNA, 32 nt, Human
acagcucucccuuggauggcuuugcugguucc

SEQ ID NO: 298729 - RNA, 32 nt, Human
acagcucucgccuaaucugucauuuuaaugcc

SEQ ID NO: 298730 - RNA, 32 nt, Human
acagcucucuccacucccuugugauuucugag

SEQ ID NO: 298731 - RNA, 32 nt, Human
acagcucugagaggauaauccuggaggucaaa

SEQ ID NO: 298732 - RNA, 32 nt, Human
acagcucugccuggacuuggagagaugggagg

SEQ ID NO: 298733 - RNA, 32 nt, Human
acagcucuggaaggugcucacaggugcacugc

SEQ ID NO: 298734 - RNA, 32 nt, Human
acagcucuggaggcugcugcugccugggccau

SEQ ID NO: 298735 - RNA, 32 nt, Human
acagcucugggaacagaggacacugaggacua

SEQ ID NO: 298736 - RNA, 32 nt, Human
acagcucugggaacugggaaaagugcuucgga

SEQ ID NO: 298737 - RNA, 32 nt, Human
acagcucuucucccagauguaaauagaacaac

SEQ ID NO: 298738 - RNA, 32 nt, Human
acagcucuucucccagauguuaauagaacaac

SEQ ID NO: 298739 - RNA, 32 nt, Human
acagcucuucucccagauguuaauagaacaag

SEQ ID NO: 298740 - RNA, 32 nt, Human
acagcucuuuccccucagcucuucuccuggaa

SEQ ID NO: 298741 - RNA, 32 nt, Human
acagcucuuuccuuccccuccucucuccaggg

SEQ ID NO: 298742 - RNA, 32 nt, Human
acagcugaaaagagagggucagggggaggcug

SEQ ID NO: 298743 - RNA, 32 nt, Human
acagcugaaauaggcucugccuaccagcugac

SEQ ID NO: 298744 - RNA, 32 nt, Human
acagcugaacacucagcagugugugaguggca

SEQ ID NO: 298745 - RNA, 32 nt, Human
acagcugaacgucccacugaaaaccagcuaag

SEQ ID NO: 298746 - RNA, 32 nt, Human
acagcugaagaaaagcagcgauuggaagagcu

SEQ ID NO: 298747 - RNA, 32 nt, Human
acagcugaagaaauggaauaguguugaugucu

SEQ ID NO: 298748 - RNA, 32 nt, Human
acagcugacaaaucaucuccucuaucggagcc

SEQ ID NO: 298749 - RNA, 32 nt, Human
acagcugaccugccaacagcauuacagggaga

SEQ ID NO: 298750 - RNA, 32 nt, Human
acagcugagaugggguucaaccucagcuguau

SEQ ID NO: 298751 - RNA, 32 nt, Human
acagcugagcacauucuggcucagggagguua

SEQ ID NO: 298752 - RNA, 32 nt, Human
acagcugaggaaacgucucucccacuguuugu

SEQ ID NO: 298753 - RNA, 19 nt, Human
acagcugaggaacuggcaa

SEQ ID NO: 298754 - RNA, 32 nt, Human
acagcugagggagaggaagugagcgccacugc

SEQ ID NO: 298755 - RNA, 23 nt, Human
acagcugauuaaaggcagagaca

SEQ ID NO: 298756 - RNA, 32 nt, Human
acagcugcaaaagagaacaccaaucccaucca

SEQ ID NO: 298757 - RNA, 32 nt, Human
acagcugcaagccagggaugaagaaagacucu

SEQ ID NO: 298758 - RNA, 32 nt, Human
acagcugcagaguaggcagcugccuccaggau

SEQ ID NO: 298759 - RNA, 32 nt, Human
acagcugcaggaagaagucaggguggaaucca

SEQ ID NO: 298760 - RNA, 32 nt, Human
acagcugcagugagcugcggucaugccacugc

SEQ ID NO: 298761 - RNA, 23 nt, Human
acagcugcauuagaaaaagaggc

SEQ ID NO: 298762 - RNA, 32 nt, Human
acagcugccaggggagugccaccccacccgug

SEQ ID NO: 298763 - RNA, 32 nt, Human
acagcugccaguagcuggaaccacgggggugu

SEQ ID NO: 298764 - RNA, 32 nt, Human
acagcugccauccacuucucagucccagggcc

SEQ ID NO: 298765 - RNA, 32 nt, Human
acagcugcccacuccuccuggggaggcugccg

SEQ ID NO: 298766 - RNA, 32 nt, Human
acagcugccguuucuucugccugcuuauggga

SEQ ID NO: 298767 - RNA, 32 nt, Human
acagcugccugccaaauuuuuguauuuuuagu

SEQ ID NO: 298768 - RNA, 32 nt, Human
acagcugccugggaagucuucacucacuuccu

SEQ ID NO: 298769 - RNA, 32 nt, Human
acagcugccugggaucccucauccucauaccc

SEQ ID NO: 298770 - RNA, 32 nt, Human
acagcugcggagcaagcagggaguaauggaga

SEQ ID NO: 298771 - RNA, 23 nt, Human
acagcugcggauugcccaugcca

SEQ ID NO: 298772 - RNA, 32 nt, Human
acagcugcucuagccuuaguugccacuaggaa

SEQ ID NO: 298773 - RNA, 32 nt, Human
acagcugcucuuuugucccagcauagccccug

SEQ ID NO: 298774 - RNA, 32 nt, Human
acagcugcugucccugcccuguccuguccuug

SEQ ID NO: 298775 - RNA, 32 nt, Human
acagcuggaaaccaccagaagcuaagaaggag

SEQ ID NO: 298776 - RNA, 32 nt, Human
acagcuggaacccuggugucuccuccagcgug

SEQ ID NO: 298777 - RNA, 32 nt, Human
acagcuggaaccuggaguuccacacgccuguc

SEQ ID NO: 298778 - RNA, 32 nt, Human
acagcuggaagagaggccuggcccaugcuccu

SEQ ID NO: 298779 - RNA, 32 nt, Human
acagcuggaagagucugggccacacgauuuga

SEQ ID NO: 298780 - RNA, 32 nt, Human
acagcuggaaggcaagguucagcugggacugu

SEQ ID NO: 298781 - RNA, 32 nt, Human
acagcuggacagaaaaggggcagacacaccga

SEQ ID NO: 298782 - RNA, 32 nt, Human
acagcuggacggugucuaucaaaagugcaaau

SEQ ID NO: 298783 - RNA, 20 nt, Human
acagcuggagucaaacaacu

SEQ ID NO: 298784 - RNA, 32 nt, Human
acagcuggagugaccgcaguguacagagaugg

SEQ ID NO: 298785 - RNA, 32 nt, Human
acagcuggauccucuauguggcagccgcccuu

SEQ ID NO: 298786 - RNA, 32 nt, Human
acagcuggauccucuguguggcagccgcccuu

SEQ ID NO: 298787 - RNA, 32 nt, Human
acagcuggauccucuguguggcagcugcccuu

SEQ ID NO: 298788 - RNA, 32 nt, Human
acagcuggccaagauggugaaaccccgucucu

SEQ ID NO: 298789 - RNA, 32 nt, Human
acagcuggcuacacugcucaggcuucaggccc

SEQ ID NO: 298790 - RNA, 32 nt, Human
acagcuggcucuacuuccccauggcccugagc

SEQ ID NO: 298791 - RNA, 32 nt, Human
acagcuggcugaggccguccagccucaggaca

SEQ ID NO: 298792 - RNA, 32 nt, Human
acagcuggcugcagaugugcagugccaggacu

SEQ ID NO: 298793 - RNA, 32 nt, Human
acagcuggcuguuaccaggaugugacaucugu

SEQ ID NO: 298794 - RNA, 22 nt, Human
acagcugggaaucccugcugca

SEQ ID NO: 298795 - RNA, 22 nt, Human
acagcugggagggggccguguu

SEQ ID NO: 298796 - RNA, 32 nt, Human
acagcugggauuacaggcgugagccaccgcgc

SEQ ID NO: 298797 - RNA, 32 nt, Human
acagcugggcaaagccacaaggcuggccagca

SEQ ID NO: 298798 - RNA, 32 nt, Human
acagcugggcccagccagcuugagucacucuu

SEQ ID NO: 298799 - RNA, 32 nt, Human
acagcugggcccaggguauuugcucaguaaau

SEQ ID NO: 298800 - RNA, 32 nt, Human
acagcugggccugcugugaccacugggaggga

SEQ ID NO: 298801 - RNA, 32 nt, Human
acagcuggugcagccucacagcccaugugcuc

SEQ ID NO: 298802 - RNA, 32 nt, Human
acagcuguacuuuugauagcugugccaggaag

SEQ ID NO: 298803 - RNA, 32 nt, Human
acagcugucaaccucagaguaacuauuucuaa

SEQ ID NO: 298804 - RNA, 32 nt, Human
acagcugucacuuccaaauguuccuguagcau

SEQ ID NO: 298805 - RNA, 21 nt, Human
acagcugucaugaagaggaug

SEQ ID NO: 298806 - RNA, 32 nt, Human
acagcugugccucuggagucugcuuuuaauug

SEQ ID NO: 298807 - RNA, 32 nt, Human
acagcugugcuuaaaacccucauuucauauaa

SEQ ID NO: 298808 - RNA, 32 nt, Human
acagcugugggaagaaaacuugcuguuuuuag

SEQ ID NO: 298809 - RNA, 17 nt, Human
acagcuguugcauuaca

SEQ ID NO: 298810 - RNA, 32 nt, Human
acagcuguuggugguugcuggauccacuggag

SEQ ID NO: 298811 - RNA, 20 nt, Human
acagcuguugucaucacuga

SEQ ID NO: 298812 - RNA, 32 nt, Human
acagcuuauggggcccagaaaggcacugggcu

SEQ ID NO: 298813 - RNA, 32 nt, Human
acagcuucaaaugcagacaggucuucauguaa

SEQ ID NO: 298814 - RNA, 32 nt, Human
acagcuucagagccaugaaggugaaaggcagu

SEQ ID NO: 298815 - RNA, 32 nt, Human
acagcuucaugaaacuguccaccaagaucaag

SEQ ID NO: 298816 - RNA, 32 nt, Human
acagcuuccacuuaccuccaucagcuaacucu

SEQ ID NO: 298817 - RNA, 32 nt, Human
acagcuuccagcuucgcagcccuucccggagc

SEQ ID NO: 298818 - RNA, 32 nt, Human
acagcuucccaaguagcugggauuuacaggug

SEQ ID NO: 298819 - RNA, 32 nt, Human
acagcuucccaggagucuggggcucaaccucu

SEQ ID NO: 298820 - RNA, 32 nt, Human
acagcuucuaagguguccagugcauugggaug

SEQ ID NO: 298821 - RNA, 32 nt, Human
acagcuucuccaagugccuagugaaacgggga

SEQ ID NO: 298822 - RNA, 32 nt, Human
acagcuucucccuuucccaaccaauaaaguaa

SEQ ID NO: 298823 - RNA, 32 nt, Human
acagcuucuccucugccccgauggaugcuuua

SEQ ID NO: 298824 - RNA, 32 nt, Human
acagcuucuggggauuaggacauggacaucuu

SEQ ID NO: 298825 - RNA, 32 nt, Human
acagcuucuuccuccuccuuggagcugcucug

SEQ ID NO: 298826 - RNA, 32 nt, Human
acagcuugaaguauugauaccaggccacagcc

SEQ ID NO: 298827 - RNA, 32 nt, Human
acagcuuucaguguaucccugcaguccuucca

SEQ ID NO: 298828 - RNA, 32 nt, Human
acagcuuucugguuugugagcccauaaaugac

SEQ ID NO: 298829 - RNA, 32 nt, Human
acagcuuugaacuagagagguagauguauuaa

SEQ ID NO: 298830 - RNA, 32 nt, Human
acagcuuugcucuuugguccucaggccaccag

SEQ ID NO: 298831 - RNA, 32 nt, Human
acagcuuuucugagagaaagaaacaucugcaa

SEQ ID NO: 298832 - RNA, 32 nt, Human
acagcuuuuggaccagcugauccagauuuuuc

SEQ ID NO: 298833 - RNA, 32 nt, Human
acaggaaaagaauggcauugaagcagauuucc

SEQ ID NO: 298834 - RNA, 32 nt, Human
acaggaaacacaugaaaaaugccacgauugua

SEQ ID NO: 298835 - RNA, 32 nt, Human
acaggaaacauacaauuagcucauaaucaaau

SEQ ID NO: 298836 - RNA, 32 nt, Human
acaggaaacaugacuugcccgggaggggcauc

SEQ ID NO: 298837 - RNA, 32 nt, Human
acaggaaacgucacuuucacacacacagaugg

SEQ ID NO: 298838 - RNA, 32 nt, Human
acaggaaagaggagagaaagaaagaaagggca

SEQ ID NO: 298839 - RNA, 32 nt, Human
acaggaaagcuagaagagguugcugugucaac

SEQ ID NO: 298840 - RNA, 32 nt, Human
acaggaaagcugucugucuguacccugcucug

SEQ ID NO: 298841 - RNA, 32 nt, Human
acaggaaaggaaggagagaaagaaaagcugga

SEQ ID NO: 298842 - RNA, 32 nt, Human
acaggaaagggagccagaagauggguucaagu

SEQ ID NO: 298843 - RNA, 32 nt, Human
acaggaaagguagaggaugaggagguuggacg

SEQ ID NO: 298844 - RNA, 32 nt, Human
acaggaaaguggcaccugucugcuccagcucu

SEQ ID NO: 298845 - RNA, 24 nt, Human
acaggaacaauagaacacucugcc

SEQ ID NO: 298846 - RNA, 32 nt, Human
acaggaacaauagaacacucugccuguuauuu

SEQ ID NO: 298847 - RNA, 20 nt, Human
acaggaacagaaaaaggcaa

SEQ ID NO: 298848 - RNA, 32 nt, Human
acaggaacagcaggugacaggccuagcuauag

SEQ ID NO: 298849 - RNA, 32 nt, Human
acaggaacagcccaggaacccagggacuucag

SEQ ID NO: 298850 - RNA, 32 nt, Human
acaggaaccagagguaggaugggagggggaac

SEQ ID NO: 298851 - RNA, 32 nt, Human
acaggaacccagccagaguuugccucccugca

SEQ ID NO: 298852 - RNA, 32 nt, Human
acaggaacuggcagagcugagacugggacgca

SEQ ID NO: 298853 - RNA, 32 nt, Human
acaggaacuuccgcaccuccugaggcccugga

SEQ ID NO: 298854 - RNA, 28 nt, Human
acaggaagaaaacauguccaggccccug

SEQ ID NO: 298855 - RNA, 31 nt, Human
acaggaagaacaccucugaggagggauuccc

SEQ ID NO: 298856 - RNA, 32 nt, Human
acaggaagaaugcagaagccucaggagccgau

SEQ ID NO: 298857 - RNA, 32 nt, Human
acaggaagagagaagcugggagaaucgggaac

SEQ ID NO: 298858 - RNA, 23 nt, Human
acaggaagagauggggggccuca

SEQ ID NO: 298859 - RNA, 22 nt, Human
acaggaagaggacuggacgccc

SEQ ID NO: 298860 - RNA, 24 nt, Human
acaggaagaggagccaggcccuug

SEQ ID NO: 298861 - RNA, 19 nt, Human
acaggaagaggggcggccc

SEQ ID NO: 298862 - RNA, 21 nt, Human
acaggaagaugcaggccuuca

SEQ ID NO: 298863 - RNA, 32 nt, Human
acaggaagcacagcagguuuauccagaugaac

SEQ ID NO: 298864 - RNA, 32 nt, Human
acaggaagcagacaaagcaaauauggcaacuu

SEQ ID NO: 298865 - RNA, 32 nt, Human
acaggaagcagcucagcccagccugggagagg

SEQ ID NO: 298866 - RNA, 32 nt, Human
acaggaagccagguaaagaggggccagggaag

SEQ ID NO: 298867 - RNA, 32 nt, Human
acaggaagccuccuaggguucugagcagaaga

SEQ ID NO: 298868 - RNA, 19 nt, Human
acaggaaggagccaggccc

SEQ ID NO: 298869 - RNA, 18 nt, Human
acaggaagggaaaagcaa

SEQ ID NO: 298870 - RNA, 30 nt, Human
acaggaaggggccacagggcugagugcagg

SEQ ID NO: 298871 - RNA, 20 nt, Human
acaggaaguaggaacaugca

SEQ ID NO: 298872 - RNA, 32 nt, Human
acaggaagucacaguggugcccagggaugugu

SEQ ID NO: 298873 - RNA, 31 nt, Human
acaggaagugagacggauccagaucugugug

SEQ ID NO: 298874 - RNA, 32 nt, Human
acaggaaguguccagacaggagaggaagagau

SEQ ID NO: 298875 - RNA, 32 nt, Human
acaggaauaauaaaggcaucacugaccaggaa

SEQ ID NO: 298876 - RNA, 18 nt, Human
acaggaauccucugcaaa

SEQ ID NO: 298877 - RNA, 32 nt, Human
acaggaaugaagccuuagccaggaggccaggc

SEQ ID NO: 298878 - RNA, 32 nt, Human
acaggaauggagcucuuugucauuccaccucc

SEQ ID NO: 298879 - RNA, 32 nt, Human
acaggaauggaugauuuaaagcaucaauaaua

SEQ ID NO: 298880 - RNA, 32 nt, Human
acaggaauggggcgaggaaggagccaggcccg

SEQ ID NO: 298881 - RNA, 19 nt, Human
acaggaauuaaaaacaacu

SEQ ID NO: 298882 - RNA, 22 nt, Human
acaggaauuauuccuucuuguu

SEQ ID NO: 298883 - RNA, 32 nt, Human
acaggaauucaaccccagaaagacauaaacuu

SEQ ID NO: 298884 - RNA, 32 nt, Human
acaggacacacuguucccagggcacagacacc

SEQ ID NO: 298885 - RNA, 32 nt, Human
acaggacacagagcagcaggccccagaggcuu

SEQ ID NO: 298886 - RNA, 32 nt, Human
acaggacacagccuuggaucaggacagagacu

SEQ ID NO: 298887 - RNA, 32 nt, Human
acaggacacagcuggguucugaagcuucugag

SEQ ID NO: 298888 - RNA, 23 nt, Human
acaggacacaugggguacaaaga

SEQ ID NO: 298889 - RNA, 19 nt, Human
acaggacaccggccccuag

SEQ ID NO: 298890 - RNA, 32 nt, Human
acaggacacuucacaggacacuugagcacagu

SEQ ID NO: 298891 - RNA, 32 nt, Human
acaggacagaagcagacagcagguggaugaga

SEQ ID NO: 298892 - RNA, 32 nt, Human
acaggacagaagcagaguggguggugguuaug

SEQ ID NO: 298893 - RNA, 23 nt, Human
acaggacagaagcugggccaaga

SEQ ID NO: 298894 - RNA, 32 nt, Human
acaggacagaaggaauuggaagggggcggggc

SEQ ID NO: 298895 - RNA, 32 nt, Human
acaggacagccugucucuuguagcuuccuggg

SEQ ID NO: 298896 - RNA, 32 nt, Human
acaggacaggaugaugcuguccgagcaagccc

SEQ ID NO: 298897 - RNA, 17 nt, Human
acaggacaguaggcaga

SEQ ID NO: 298898 - RNA, 23 nt, Human
acaggacaugcccaaggcaaaga

SEQ ID NO: 298899 - RNA, 32 nt, Human
acaggacauggcacuggauggcuggcagagag

SEQ ID NO: 298900 - RNA, 21 nt, Human
acaggaccaccuccucugcca

SEQ ID NO: 298901 - RNA, 32 nt, Human
acaggaccagccacccucccacggccugggag

SEQ ID NO: 298902 - RNA, 32 nt, Human
acaggaccaggcgcuuggcaagacaucagaca

SEQ ID NO: 298903 - RNA, 32 nt, Human
acaggaccagggcagagccccgguacaaacag

SEQ ID NO: 298904 - RNA, 32 nt, Human
acaggacccaaaucaccucuuacugcaggaaa

SEQ ID NO: 298905 - RNA, 32 nt, Human
acaggacccacugcugaugauggcuccaccug

SEQ ID NO: 298906 - RNA, 32 nt, Human
acaggacccaggaagaccaggcuuguccugug

SEQ ID NO: 298907 - RNA, 32 nt, Human
acaggacccugccugcuggccacguaccuaga

SEQ ID NO: 298908 - RNA, 32 nt, Human
acaggaccucguacacgaucuccaacaauuuu

SEQ ID NO: 298909 - RNA, 22 nt, Human
acaggaccuggcugucaaccuc

SEQ ID NO: 298910 - RNA, 22 nt, Human
acaggacgcacagcccaggcca

SEQ ID NO: 298911 - RNA, 18 nt, Human
acaggacuaaaagagcaa

SEQ ID NO: 298912 - RNA, 32 nt, Human
acaggacucauucaacccaguaccauguggcu

SEQ ID NO: 298913 - RNA, 32 nt, Human
acaggacucgcugccuuucuuucccgucagaa

SEQ ID NO: 298914 - RNA, 32 nt, Human
acaggacugacccuucuucagagauaaugaca

SEQ ID NO: 298915 - RNA, 32 nt, Human
acaggacugcaaaaauccuucuccaccgcaca

SEQ ID NO: 298916 - RNA, 19 nt, Human
acaggacugggaggucuug

SEQ ID NO: 298917 - RNA, 32 nt, Human
acaggacuuggaccgcuucagccugggcuggg

SEQ ID NO: 298918 - RNA, 21 nt, Human
acaggagaaaaagaaaagcaa

SEQ ID NO: 298919 - RNA, 32 nt, Human
acaggagaaaagggagaaagcaaaaaguugaa

SEQ ID NO: 298920 - RNA, 32 nt, Human
acaggagaaagccaugugaugaagcaggcagg

SEQ ID NO: 298921 - RNA, 32 nt, Human
acaggagaaaggccuuauggugcagugaauau

SEQ ID NO: 298922 - RNA, 32 nt, Human
acaggagaaaguguauguaaacuaccugaaag

SEQ ID NO: 298923 - RNA, 32 nt, Human
acaggagaacccaucuagaccaaccuguuuug

SEQ ID NO: 298924 - RNA, 32 nt, Human
acaggagaaggugagauggagagaaagcaacc

SEQ ID NO: 298925 - RNA, 32 nt, Human
acaggagaaucacuugaacccaggagguggag

SEQ ID NO: 298926 - RNA, 32 nt, Human
acaggagaaucgcuugaacccaggaaguggag

SEQ ID NO: 298927 - RNA, 32 nt, Human
acaggagaaucgcuugagcuggagugcagugg

SEQ ID NO: 298928 - RNA, 32 nt, Human
acaggagaaugauggaaggaagggaggaagga

SEQ ID NO: 298929 - RNA, 32 nt, Human
acaggagacagcaguggcccagaggaagccca

SEQ ID NO: 298930 - RNA, 32 nt, Human
acaggagacaggucaguagucacaaacugauc

SEQ ID NO: 298931 - RNA, 32 nt, Human
acaggagaccugcucccuaucugcgcacccgg

SEQ ID NO: 298932 - RNA, 32 nt, Human
acaggagaccugcucccuaugugcacacccgg

SEQ ID NO: 298933 - RNA, 32 nt, Human
acaggagagaggcucagagagcugggaagcag

SEQ ID NO: 298934 - RNA, 32 nt, Human
acaggagagaucuaguuuucucaaggucaaag

SEQ ID NO: 298935 - RNA, 32 nt, Human
acaggagagcagugcagugacacagaugagaa

SEQ ID NO: 298936 - RNA, 32 nt, Human
acaggagagccagcaggguggaugcaaggggc

SEQ ID NO: 298937 - RNA, 32 nt, Human
acaggagaggcuucaggagcaggaugagaggc

SEQ ID NO: 298938 - RNA, 32 nt, Human
acaggagagggaggggugggggacagugggug

SEQ ID NO: 298939 - RNA, 32 nt, Human
acaggagauggggcaguuaaugcugaauggua

SEQ ID NO: 298940 - RNA, 19 nt, Human
acaggagauguaaacaacu

SEQ ID NO: 298941 - RNA, 18 nt, Human
acaggagauuuagagcaa

SEQ ID NO: 298942 - RNA, 32 nt, Human
acaggagcacagaccucugcuguagcuuuaau

SEQ ID NO: 298943 - RNA, 32 nt, Human
acaggagcacugaaccugcccucccaggugca

SEQ ID NO: 298944 - RNA, 32 nt, Human
acaggagcagcggcgaaacccaggucugucgg

SEQ ID NO: 298945 - RNA, 32 nt, Human
acaggagcagggccccugucccucucuucugg

SEQ ID NO: 298946 - RNA, 32 nt, Human
acaggagcaugccacaagacccagcuaauuuu

SEQ ID NO: 298947 - RNA, 32 nt, Human
acaggagccacugcacuccagccugggugaca

SEQ ID NO: 298948 - RNA, 32 nt, Human
acaggagccagccugcuucccacaacuacuag

SEQ ID NO: 298949 - RNA, 32 nt, Human
acaggagccgcagugaguccugccuggcucua

SEQ ID NO: 298950 - RNA, 32 nt, Human
acaggagccggugugugcacucugccuccuaa

SEQ ID NO: 298951 - RNA, 32 nt, Human
acaggagccucaccagcuuagauuuacaggag

SEQ ID NO: 298952 - RNA, 32 nt, Human
acaggagccucugcuucuaugaaaauugggaa

SEQ ID NO: 298953 - RNA, 32 nt, Human
acaggagccugagugaaggacaaggacagauc

SEQ ID NO: 298954 - RNA, 32 nt, Human
acaggagccuguaugcagcccagugcagccuu

SEQ ID NO: 298955 - RNA, 32 nt, Human
acaggagcgaggagacccgagagcagacgcgc

SEQ ID NO: 298956 - RNA, 32 nt, Human
acaggagcuacaccuugauccucuccuggcau

SEQ ID NO: 298957 - RNA, 32 nt, Human
acaggagcucacucucaccccuucugccugcc

SEQ ID NO: 298958 - RNA, 32 nt, Human
acaggagcuccagcaaaagcgcaggaagagag

SEQ ID NO: 298959 - RNA, 32 nt, Human
acaggagcuccuccaggagcaggcugggaucc

SEQ ID NO: 298960 - RNA, 32 nt, Human
acaggagcuccuggucaucauggugggcaagc

SEQ ID NO: 298961 - RNA, 24 nt, Human
acaggagcugcagugcuguacucu

SEQ ID NO: 298962 - RNA, 32 nt, Human
acaggagcuggagucaaagcuggugagcaauc

SEQ ID NO: 298963 - RNA, 32 nt, Human
acaggagcugucuggagcuccaccuuugcaaa

SEQ ID NO: 298964 - RNA, 32 nt, Human
acaggagcuguugcuuaagcuuuugccugaug

SEQ ID NO: 298965 - RNA, 32 nt, Human
acaggaggaaagagagaaagcaaaaaguuaga

SEQ ID NO: 298966 - RNA, 20 nt, Human
acaggaggaauguuugguug

SEQ ID NO: 298967 - RNA, 19 nt, Human
acaggaggagaggcugugu

SEQ ID NO: 298968 - RNA, 32 nt, Human
acaggaggagcacgggcagcugcuugcgcuac

SEQ ID NO: 298969 - RNA, 21 nt, Human
acaggaggagcagcugcuuug

SEQ ID NO: 298970 - RNA, 19 nt, Human
acaggaggagcaggugcug

SEQ ID NO: 298971 - RNA, 32 nt, Human
acaggaggaggaagagggucaggguggagagg

SEQ ID NO: 298972 - RNA, 19 nt, Human
acaggaggaggggagguug

SEQ ID NO: 298973 - RNA, 22 nt, Human
acaggaggagguagcuagcgug

SEQ ID NO: 298974 - RNA, 20 nt, Human
acaggaggauuccuuguguu

SEQ ID NO: 298975 - RNA, 32 nt, Human
acaggaggcaggaggggagcaagaauaagaaa

SEQ ID NO: 298976 - RNA, 32 nt, Human
acaggaggcccaggugggaagaucacuugagg

SEQ ID NO: 298977 - RNA, 32 nt, Human
acaggaggcgacugcaugagaccauggcugag

SEQ ID NO: 298978 - RNA, 32 nt, Human
acaggaggcugaggcacgagaaucacuugaac

SEQ ID NO: 298979 - RNA, 32 nt, Human
acaggaggcugaggcaggagaaucacuugaac

SEQ ID NO: 298980 - RNA, 32 nt, Human
acaggaggcugaggcaggagaauugcuugaac

SEQ ID NO: 298981 - RNA, 32 nt, Human
acaggagggaaaggcagaaugauaucacagca

SEQ ID NO: 298982 - RNA, 32 nt, Human
acaggagggacaucuucccaugccuucccuag

SEQ ID NO: 298983 - RNA, 32 nt, Human
acaggagggaggaggagaugaaagaggaggga

SEQ ID NO: 298984 - RNA, 32 nt, Human
acaggagggcaggaggaaaaucaagccuaaau

SEQ ID NO: 298985 - RNA, 32 nt, Human
acaggagggcugggcuccacuucauccagaug

SEQ ID NO: 298986 - RNA, 32 nt, Human
acaggaggggacggagaggagcugcaggaggg

SEQ ID NO: 298987 - RNA, 24 nt, Human
acaggaggggaggucaccggcaga

SEQ ID NO: 298988 - RNA, 32 nt, Human
acaggagggggcaccuucuccagaugaugucc

SEQ ID NO: 298989 - RNA, 32 nt, Human
acaggagguagaauaucagaguggggcuggau

SEQ ID NO: 298990 - RNA, 32 nt, Human
acaggagguccagauucaccacccucaaccuu

SEQ ID NO: 298991 - RNA, 32 nt, Human
acaggaggugugagccagcaaucagauggaga

SEQ ID NO: 298992 - RNA, 19 nt, Human
acaggagguucagcugugu

SEQ ID NO: 298993 - RNA, 32 nt, Human
acaggagucagaggcuggagugcaauggcgug

SEQ ID NO: 298994 - RNA, 32 nt, Human
acaggagucccuaacugugccacccuuggaau

SEQ ID NO: 298995 - RNA, 32 nt, Human
acaggagugaccgaaauguccaucuuaaggag

SEQ ID NO: 298996 - RNA, 25 nt, Human
acaggagugagccaccacaccuggc

SEQ ID NO: 298997 - RNA, 32 nt, Human
acaggagugccuccccuccagggccuggcaag

SEQ ID NO: 298998 - RNA, 32 nt, Human
acaggagugggagcagggagauaggagacaau

SEQ ID NO: 298999 - RNA, 32 nt, Human
acaggagugggugacagaggagacugcagagg

SEQ ID NO: 299000 - RNA, 32 nt, Human
acaggagugggugaggauggcagagggacaca

SEQ ID NO: 299001 - RNA, 18 nt, Human
acaggaguuaaaauaacu

SEQ ID NO: 299002 - RNA, 32 nt, Human
acaggaguuauaucagcacccucaguccuauc

SEQ ID NO: 299003 - RNA, 32 nt, Human
acaggauaaucgugguguaaaugaguguuucc

SEQ ID NO: 299004 - RNA, 32 nt, Human
acaggauacagugggaaucuugagacucuuug

SEQ ID NO: 299005 - RNA, 19 nt, Human
acaggauaccucccuucca

SEQ ID NO: 299006 - RNA, 32 nt, Human
acaggauagggguaggaggagaggaggcaggc

SEQ ID NO: 299007 - RNA, 32 nt, Human
acaggaucaguaagcucagacucuccaucucc

SEQ ID NO: 299008 - RNA, 32 nt, Human
acaggaucauuugagcccaggaauuugaggcu

SEQ ID NO: 299009 - RNA, 32 nt, Human
acaggauccuccggcucccugcauugccuggu

SEQ ID NO: 299010 - RNA, 32 nt, Human
acaggaucucacuauguugcccaggcuggucu

SEQ ID NO: 299011 - RNA, 32 nt, Human
acaggaucucaggcuggagugcaguggcacaa

SEQ ID NO: 299012 - RNA, 21 nt, Human
acaggaucuccuuugggcucu

SEQ ID NO: 299013 - RNA, 32 nt, Human
acaggaucugaacuuuguuuccagaaauucuu

SEQ ID NO: 299014 - RNA, 32 nt, Human
acaggaugacacccucccauaccccauagcug

SEQ ID NO: 299015 - RNA, 30 nt, Human
acaggaugagagugucaggugugcuucgcc

SEQ ID NO: 299016 - RNA, 32 nt, Human
acaggaugaggguggagggagagcuauuuaac

SEQ ID NO: 299017 - RNA, 32 nt, Human
acaggaugauggggucaggagggaccuggcuc

SEQ ID NO: 299018 - RNA, 32 nt, Human
acaggaugcaaccacaacacacggcuaugauc

SEQ ID NO: 299019 - RNA, 32 nt, Human
acaggaugccaggggccugaccagccucccca

SEQ ID NO: 299020 - RNA, 32 nt, Human
acaggaugccuaggggacggcgaugggccuca

SEQ ID NO: 299021 - RNA, 32 nt, Human
acaggaugccucucucacacuuguauucucga

SEQ ID NO: 299022 - RNA, 32 nt, Human
acaggaugcgggggccaagaugaugcugaggc

SEQ ID NO: 299023 - RNA, 20 nt, Human
acaggaugcuggaaaacagc

SEQ ID NO: 299024 - RNA, 32 nt, Human
acaggaugcuucuguuccuggaaacaugaaug

SEQ ID NO: 299025 - RNA, 32 nt, Human
acaggauggaggaggccagggaacaggcaggg

SEQ ID NO: 299026 - RNA, 21 nt, Human
acaggauggaguaaaacaacu

SEQ ID NO: 299027 - RNA, 20 nt, Human
acaggauggaguaagagaau

SEQ ID NO: 299028 - RNA, 32 nt, Human
acaggauggaguuucgcucugucgccaggcug

SEQ ID NO: 299029 - RNA, 20 nt, Human
acaggauggcugucaacaac

SEQ ID NO: 299030 - RNA, 32 nt, Human
acaggaugggaaauuaccaaagagagacauca

SEQ ID NO: 299031 - RNA, 32 nt, Human
acaggaugggccaccagccaccuccuccaacu

SEQ ID NO: 299032 - RNA, 32 nt, Human
acaggauggugaggcugggaggaggaagacug

SEQ ID NO: 299033 - RNA, 32 nt, Human
acaggauguaaagaaaagucacaguaggcacu

SEQ ID NO: 299034 - RNA, 32 nt, Human
acaggaugucccaagaguaacaaaagauggga

SEQ ID NO: 299035 - RNA, 21 nt, Human
acaggaugucuuaggauuguu

SEQ ID NO: 299036 - RNA, 32 nt, Human
acaggauucagacgcaaaagacuugcauaaga

SEQ ID NO: 299037 - RNA, 32 nt, Human
acaggauuccugcuccgccucuaccccacccu

SEQ ID NO: 299038 - RNA, 32 nt, Human
acaggauuggcaaacuccgcccuccacuuacu

SEQ ID NO: 299039 - RNA, 32 nt, Human
acaggauugugugaggauugagacugacacag

SEQ ID NO: 299040 - RNA, 19 nt, Human
acaggauuucgccauguug

SEQ ID NO: 299041 - RNA, 32 nt, Human
acaggauuugagaauaguuucaucucagcccc

SEQ ID NO: 299042 - RNA, 19 nt, Human
acaggauuugcuuguguug

SEQ ID NO: 299043 - RNA, 32 nt, Human
acaggauuuggucacugguucuucaucuuuug

SEQ ID NO: 299044 - RNA, 19 nt, Human
acaggauuuugcuguguug

SEQ ID NO: 299045 - RNA, 32 nt, Human
acaggauuuuugcugaaaaggcaggcagugug

SEQ ID NO: 299046 - RNA, 18 nt, Human
acaggcaaagaaacagca

SEQ ID NO: 299047 - RNA, 21 nt, Human
acaggcaaagcugggaucguu

SEQ ID NO: 299048 - RNA, 32 nt, Human
acaggcaacucaggaacagcucuccagcccca

SEQ ID NO: 299049 - RNA, 32 nt, Human
acaggcaagaaccugggcuguaacugccaccu

SEQ ID NO: 299050 - RNA, 32 nt, Human
acaggcaagaagaaagcuguggucaugauaug

SEQ ID NO: 299051 - RNA, 21 nt, Human
acaggcaagugcaccaccaug

SEQ ID NO: 299052 - RNA, 32 nt, Human
acaggcaaucaaggccugagcaaccaaaagga

SEQ ID NO: 299053 - RNA, 32 nt, Human
acaggcaaugccccugcccugugggccuuaua

SEQ ID NO: 299054 - RNA, 18 nt, Human
acaggcacaaaaaagcaa

SEQ ID NO: 299055 - RNA, 21 nt, Human
acaggcacacgcaccugcucu

SEQ ID NO: 299056 - RNA, 32 nt, Human
acaggcacagcagagcccccacccucgaggca

SEQ ID NO: 299057 - RNA, 32 nt, Human
acaggcacagcccgacugcagggagggaugca

SEQ ID NO: 299058 - RNA, 32 nt, Human
acaggcacagcucucacaaagcucuucaagca

SEQ ID NO: 299059 - RNA, 24 nt, Human
acaggcacagugcugcugugcucu

SEQ ID NO: 299060 - RNA, 32 nt, Human
acaggcacaugccaccaccaagcccagcuauu

SEQ ID NO: 299061 - RNA, 22 nt, Human
acaggcacaugccaccaugcuc

SEQ ID NO: 299062 - RNA, 32 nt, Human
acaggcacauguacaugcacaggugugcuaca

SEQ ID NO: 299063 - RNA, 32 nt, Human
acaggcaccacacucaaaugcucacaggagcu

SEQ ID NO: 299064 - RNA, 24 nt, Human
acaggcaccagccaccaugccugg

SEQ ID NO: 299065 - RNA, 32 nt, Human
acaggcacccaccaccuccauugucuuuuuac

SEQ ID NO: 299066 - RNA, 32 nt, Human
acaggcacccaccacuaugcccggcuaauuuu

SEQ ID NO: 299067 - RNA, 32 nt, Human
acaggcacccacugacuccagccucauggaac

SEQ ID NO: 299068 - RNA, 18 nt, Human
acaggcacccgccaccac

SEQ ID NO: 299069 - RNA, 25 nt, Human
acaggcacccgccaccacacccagc

SEQ ID NO: 299070 - RNA, 32 nt, Human
acaggcacccgccaccacacccggcuaauuuu

SEQ ID NO: 299071 - RNA, 32 nt, Human
acaggcacccgccaccaugcccggcuaauuuu

SEQ ID NO: 299072 - RNA, 32 nt, Human
acaggcacccgccaccaugcccggcuauuuuu

SEQ ID NO: 299073 - RNA, 32 nt, Human
acaggcacccgccaccgugcccggcuaguuuu

SEQ ID NO: 299074 - RNA, 32 nt, Human
acaggcacccuccacuaggcccggcuaauuuu

SEQ ID NO: 299075 - RNA, 32 nt, Human
acaggcaccuaugguuccagcuacucaggagg

SEQ ID NO: 299076 - RNA, 32 nt, Human
acaggcaccugccaacacgcccggcuaauuuu

SEQ ID NO: 299077 - RNA, 25 nt, Human
acaggcaccugccaccacacccggc

SEQ ID NO: 299078 - RNA, 32 nt, Human
acaggcaccugccaccacacccggcuacuuuu

SEQ ID NO: 299079 - RNA, 20 nt, Human
acaggcaccugccaccacca

SEQ ID NO: 299080 - RNA, 32 nt, Human
acaggcaccugccaccacgcccggcuaauuuu

SEQ ID NO: 299081 - RNA, 25 nt, Human
acaggcaccugccaccacgccuggc

SEQ ID NO: 299082 - RNA, 32 nt, Human
acaggcaccugccaccaugcccggcuaauuuu

SEQ ID NO: 299083 - RNA, 32 nt, Human
acaggcaccugccacuaugcccggcuaacuuu

SEQ ID NO: 299084 - RNA, 32 nt, Human
acaggcaccugccauuaugcccggcuaaguuu

SEQ ID NO: 299085 - RNA, 22 nt, Human
acaggcacgagccacugugccu

SEQ ID NO: 299086 - RNA, 32 nt, Human
acaggcacgcucuaccacaccuggcuaauuuu

SEQ ID NO: 299087 - RNA, 32 nt, Human
acaggcacggcugguggugugcagugaacagc

SEQ ID NO: 299088 - RNA, 23 nt, Human
acaggcacgugccaccacgcccu

SEQ ID NO: 299089 - RNA, 19 nt, Human
acaggcacgugccaccaug

SEQ ID NO: 299090 - RNA, 22 nt, Human
acaggcacgugccaccaugccu

SEQ ID NO: 299091 - RNA, 20 nt, Human
acaggcacgugccauugcuc

SEQ ID NO: 299092 - RNA, 21 nt, Human
acaggcacuaugcuauucucu

SEQ ID NO: 299093 - RNA, 23 nt, Human
acaggcacuauuuuggugugcuc

SEQ ID NO: 299094 - RNA, 32 nt, Human
acaggcacucgccaccaugcccggcugauuuu

SEQ ID NO: 299095 - RNA, 32 nt, Human
acaggcacucuacgaaguuucuaaugggcaga

SEQ ID NO: 299096 - RNA, 20 nt, Human
acaggcacugcugccaugcu

SEQ ID NO: 299097 - RNA, 32 nt, Human
acaggcagacacaugcuguuggccucaagcaa

SEQ ID NO: 299098 - RNA, 32 nt, Human
acaggcagagacagggcacagucucuaggucu

SEQ ID NO: 299099 - RNA, 32 nt, Human
acaggcagagcccagacccuggaggaaauccu

SEQ ID NO: 299100 - RNA, 32 nt, Human
acaggcagcacaggcgccccaccaccacccag

SEQ ID NO: 299101 - RNA, 32 nt, Human
acaggcagcaccagggcuccugacugaaaggg

SEQ ID NO: 299102 - RNA, 32 nt, Human
acaggcagcacugaggccgggacccugcuggc

SEQ ID NO: 299103 - RNA, 32 nt, Human
acaggcagcccccauucccaaguucucucuuu

SEQ ID NO: 299104 - RNA, 32 nt, Human
acaggcagccuggacauagagagggagaagaa

SEQ ID NO: 299105 - RNA, 32 nt, Human
acaggcaggaagcacagccuaccauggccucc

SEQ ID NO: 299106 - RNA, 32 nt, Human
acaggcaggaugccccucccaaccccucaguc

SEQ ID NO: 299107 - RNA, 17 nt, Human
acaggcaggcaccccac

SEQ ID NO: 299108 - RNA, 32 nt, Human
acaggcaggcagcaggaggggcgagcugggag

SEQ ID NO: 299109 - RNA, 32 nt, Human
acaggcagggagggcuaggcugugcaucccuc

SEQ ID NO: 299110 - RNA, 32 nt, Human
acaggcagggcccuggagagacgcucccugcu

SEQ ID NO: 299111 - RNA, 32 nt, Human
acaggcaguagaggaggaaugaggauggguug

SEQ ID NO: 299112 - RNA, 32 nt, Human
acaggcaguucugcgacaagcuuggcuugaaa

SEQ ID NO: 299113 - RNA, 32 nt, Human
acaggcaguucugugcaagcuuggcuugaaag

SEQ ID NO: 299114 - RNA, 32 nt, Human
acaggcauaaagcacuccccauuuuuccuacu

SEQ ID NO: 299115 - RNA, 22 nt, Human
acaggcauaagccacugugccu

SEQ ID NO: 299116 - RNA, 20 nt, Human
acaggcauaggccacugugc

SEQ ID NO: 299117 - RNA, 32 nt, Human
acaggcaucaagcucauucggcaaaauccagu

SEQ ID NO: 299118 - RNA, 24 nt, Human
acaggcaucagccaccacaccugg

SEQ ID NO: 299119 - RNA, 32 nt, Human
acaggcaucagccaccaugcccggaugaaaag

SEQ ID NO: 299120 - RNA, 32 nt, Human
acaggcauccgccaccaugcccggcuaguuuu

SEQ ID NO: 299121 - RNA, 19 nt, Human
acaggcauccgcugcgcuc

SEQ ID NO: 299122 - RNA, 32 nt, Human
acaggcauccuugccaagccuccaccacuagg

SEQ ID NO: 299123 - RNA, 32 nt, Human
acaggcaucgggaagcagaccgccuuggaacu

SEQ ID NO: 299124 - RNA, 32 nt, Human
acaggcaucucuucaggcuugcuugguacuug

SEQ ID NO: 299125 - RNA, 18 nt, Human
acaggcaugaaccaccac

SEQ ID NO: 299126 - RNA, 25 nt, Human
acaggcaugaaccaccacaccuggc

SEQ ID NO: 299127 - RNA, 22 nt, Human
acaggcaugaaccacugugccu

SEQ ID NO: 299128 - RNA, 32 nt, Human
acaggcaugaaucaccaugccuagccacuuag

SEQ ID NO: 299129 - RNA, 21 nt, Human
acaggcaugagcacugugcuu

SEQ ID NO: 299130 - RNA, 25 nt, Human
acaggcaugagccaccacgcccagc

SEQ ID NO: 299131 - RNA, 25 nt, Human
acaggcaugagccaccacgcccggc

SEQ ID NO: 299132 - RNA, 21 nt, Human
acaggcaugagccaccacggc

SEQ ID NO: 299133 - RNA, 32 nt, Human
acaggcaugagccaccaugccuagccagcaag

SEQ ID NO: 299134 - RNA, 21 nt, Human
acaggcaugagccaccguggc

SEQ ID NO: 299135 - RNA, 32 nt, Human
acaggcaugagccacugcacccaacuccucuu

SEQ ID NO: 299136 - RNA, 22 nt, Human
acaggcaugagccacugugccu

SEQ ID NO: 299137 - RNA, 32 nt, Human
acaggcaugagccacugugcucagccuucaug

SEQ ID NO: 299138 - RNA, 22 nt, Human
acaggcaugagccacugugcuu

SEQ ID NO: 299139 - RNA, 22 nt, Human
acaggcaugagccacugugucu

SEQ ID NO: 299140 - RNA, 32 nt, Human
acaggcaugagccgcuacacccggcucugucu

SEQ ID NO: 299141 - RNA, 22 nt, Human
acaggcaugagccgcuaugccu

SEQ ID NO: 299142 - RNA, 32 nt, Human
acaggcaugagucauugcucccagccauuaga

SEQ ID NO: 299143 - RNA, 32 nt, Human
acaggcaugcaagugagagcuuccugagcuuu

SEQ ID NO: 299144 - RNA, 25 nt, Human
acaggcaugcaccaccacgcccagc

SEQ ID NO: 299145 - RNA, 25 nt, Human
acaggcaugcaccaccacgccuggc

SEQ ID NO: 299146 - RNA, 19 nt, Human
acaggcaugcaccacuacg

SEQ ID NO: 299147 - RNA, 23 nt, Human
acaggcaugcaucacuaugcucu

SEQ ID NO: 299148 - RNA, 18 nt, Human
acaggcaugcgccaccac

SEQ ID NO: 299149 - RNA, 19 nt, Human
acaggcaugcgccaccaug

SEQ ID NO: 299150 - RNA, 22 nt, Human
acaggcaugcgccaccaugccc

SEQ ID NO: 299151 - RNA, 24 nt, Human
acaggcaugcgucaccacgccggc

SEQ ID NO: 299152 - RNA, 32 nt, Human
acaggcaugcuggcucaugccuguaaucccag

SEQ ID NO: 299153 - RNA, 22 nt, Human
acaggcauggccugcgugcccu

SEQ ID NO: 299154 - RNA, 22 nt, Human
acaggcaugugccgccaugccu

SEQ ID NO: 299155 - RNA, 32 nt, Human
acaggcauuggcguguaccugacuucagcugu

SEQ ID NO: 299156 - RNA, 32 nt, Human
acaggcauuggcguguaccugacuuccgcugu

SEQ ID NO: 299157 - RNA, 32 nt, Human
acaggcauuuccucuuugcuaauugcaccaau

SEQ ID NO: 299158 - RNA, 23 nt, Human
acaggccaacccagaggacagga

SEQ ID NO: 299159 - RNA, 22 nt, Human
acaggccaaccggaggacagga

SEQ ID NO: 299160 - RNA, 32 nt, Human
acaggccaaggcaggggaauugcuugaguuca

SEQ ID NO: 299161 - RNA, 24 nt, Human
acaggccaaugagucggccaguga

SEQ ID NO: 299162 - RNA, 24 nt, Human
acaggccacagaccccagagcuug

SEQ ID NO: 299163 - RNA, 32 nt, Human
acaggccacagaccccagagcuuggcuuuuga

SEQ ID NO: 299164 - RNA, 32 nt, Human
acaggccacugcaucucagauucaggggagaa

SEQ ID NO: 299165 - RNA, 32 nt, Human
acaggccagccugcuugggcgcucggucucca

SEQ ID NO: 299166 - RNA, 32 nt, Human
acaggccaggacgccauggcaggauggagagg

SEQ ID NO: 299167 - RNA, 31 nt, Human
acaggccaggcuucggugcuaccucagaggg

SEQ ID NO: 299168 - RNA, 21 nt, Human
acaggccagggaaagcaggga

SEQ ID NO: 299169 - RNA, 32 nt, Human
acaggccagggaggguacaggguagucccccu

SEQ ID NO: 299170 - RNA, 32 nt, Human
acaggccaggggagggcaucuggaccagggca

SEQ ID NO: 299171 - RNA, 32 nt, Human
acaggccaugaggagaacuaggagcaagugcu

SEQ ID NO: 299172 - RNA, 32 nt, Human
acaggccaugcucagauggagugcugucugga

SEQ ID NO: 299173 - RNA, 18 nt, Human
acaggcccacugcugugc

SEQ ID NO: 299174 - RNA, 32 nt, Human
acaggcccaggcccgaccucaggucauccgcc

SEQ ID NO: 299175 - RNA, 32 nt, Human
acaggcccaucccggcggggcaccggggacuc

SEQ ID NO: 299176 - RNA, 32 nt, Human
acaggcccaugggaagaaggggguuuuaaaaa

SEQ ID NO: 299177 - RNA, 32 nt, Human
acaggcccauggugaugcucaggccucugcuu

SEQ ID NO: 299178 - RNA, 22 nt, Human
acaggcccauucagggcugccu

SEQ ID NO: 299179 - RNA, 32 nt, Human
acaggccccaugcauccucccugccucacucc

SEQ ID NO: 299180 - RNA, 24 nt, Human
acaggcccccaggaccccugggga

SEQ ID NO: 299181 - RNA, 32 nt, Human
acaggccccuaguugggaagacuggaugagag

SEQ ID NO: 299182 - RNA, 32 nt, Human
acaggcccuagcagggcaggcgggaggugagc

SEQ ID NO: 299183 - RNA, 28 nt, Human
acaggcccucaguuagggacgcucgggg

SEQ ID NO: 299184 - RNA, 24 nt, Human
acaggcccucauggcaggcuuguu

SEQ ID NO: 299185 - RNA, 32 nt, Human
acaggcccuccaccucaccuccagcucagggg

SEQ ID NO: 299186 - RNA, 32 nt, Human
acaggcccugccugccacccuaggcagggaaa

SEQ ID NO: 299187 - RNA, 32 nt, Human
acaggcccuuagcugcuccaugcaugcucagc

SEQ ID NO: 299188 - RNA, 21 nt, Human
acaggcccuugggugugggga

SEQ ID NO: 299189 - RNA, 32 nt, Human
acaggccgcggaggaggaggagguggaguugc

SEQ ID NO: 299190 - RNA, 32 nt, Human
acaggccggagagagccguaggcaggaccccg

SEQ ID NO: 299191 - RNA, 23 nt, Human
acaggccggcccggggcgcuggg

SEQ ID NO: 299192 - RNA, 21 nt, Human
acaggccgggaagacaguuga

SEQ ID NO: 299193 - RNA, 28 nt, Human
acaggccggguccuggagagacuggggg

SEQ ID NO: 299194 - RNA, 32 nt, Human
acaggccuaggagacuaggagggaaucuggag

SEQ ID NO: 299195 - RNA, 32 nt, Human
acaggccuccacccaaccaccauccccuuggc

SEQ ID NO: 299196 - RNA, 32 nt, Human
acaggccuccaccccugcaccagagccugcuc

SEQ ID NO: 299197 - RNA, 22 nt, Human
acaggccucugccugcugggga

SEQ ID NO: 299198 - RNA, 32 nt, Human
acaggccugcgggagccagggugggcagccac

SEQ ID NO: 299199 - RNA, 32 nt, Human
acaggccugcucucuuuuucuccagggucaga

SEQ ID NO: 299200 - RNA, 32 nt, Human
acaggccuggaauucuaccacagggaauuugg

SEQ ID NO: 299201 - RNA, 32 nt, Human
acaggccuggagcacggaugaauaagagggaa

SEQ ID NO: 299202 - RNA, 32 nt, Human
acaggccuggggacagggagggaugggagucc

SEQ ID NO: 299203 - RNA, 32 nt, Human
acaggccuggguaguauauacacacauacgca

SEQ ID NO: 299204 - RNA, 32 nt, Human
acaggccuguagucccagcuacuugggaggcu

SEQ ID NO: 299205 - RNA, 32 nt, Human
acaggccugugaacaagccaggccagucuugg

SEQ ID NO: 299206 - RNA, 22 nt, Human
acaggccuuaggacaauggggg

SEQ ID NO: 299207 - RNA, 32 nt, Human
acaggccuuccuccucucaaaccuggcagaug

SEQ ID NO: 299208 - RNA, 19 nt, Human
acaggccuucgcugaggug

SEQ ID NO: 299209 - RNA, 18 nt, Human
acaggcgacugccaccac

SEQ ID NO: 299210 - RNA, 32 nt, Human
acaggcgcaccacgcccgucugacugaccucu

SEQ ID NO: 299211 - RNA, 24 nt, Human
acaggcgccagccaccaugccugg

SEQ ID NO: 299212 - RNA, 21 nt, Human
acaggcgcccaccaccacagc

SEQ ID NO: 299213 - RNA, 19 nt, Human
acaggcgcccaccaccaug

SEQ ID NO: 299214 - RNA, 22 nt, Human
acaggcgcccaccaccaugccc

SEQ ID NO: 299215 - RNA, 32 nt, Human
acaggcgcccaccaccaugcccagaugagagg

SEQ ID NO: 299216 - RNA, 17 nt, Human
acaggcgcccaccaccc

SEQ ID NO: 299217 - RNA, 19 nt, Human
acaggcgccccaccaccac

SEQ ID NO: 299218 - RNA, 20 nt, Human
acaggcgccccaccaccacc

SEQ ID NO: 299219 - RNA, 32 nt, Human
acaggcgcccgccaccacacccggcuaacuuu

SEQ ID NO: 299220 - RNA, 32 nt, Human
acaggcgcccgccaccacacccggcuaauuuu

SEQ ID NO: 299221 - RNA, 32 nt, Human
acaggcgcccgccaccacgcccggcuaauuuu

SEQ ID NO: 299222 - RNA, 32 nt, Human
acaggcgcccgccaccacgcccggcuauuuuu

SEQ ID NO: 299223 - RNA, 21 nt, Human
acaggcgcccgccaccacggc

SEQ ID NO: 299224 - RNA, 32 nt, Human
acaggcgcccgccaccaugcccggcuaauuuu

SEQ ID NO: 299225 - RNA, 32 nt, Human
acaggcgcccgccaccgcucccggcuaauuuu

SEQ ID NO: 299226 - RNA, 32 nt, Human
acaggcgcccgccaccucgcccggcuaauauu

SEQ ID NO: 299227 - RNA, 32 nt, Human
acaggcgcccgccacugcgcccggcuaauuuu

SEQ ID NO: 299228 - RNA, 32 nt, Human
acaggcgcccgccaucacacccggcuaauuuu

SEQ ID NO: 299229 - RNA, 32 nt, Human
acaggcgcccgccaucacgcccggcuaauguu

SEQ ID NO: 299230 - RNA, 32 nt, Human
acaggcgcccgccaucacgcccggcuaauuuu

SEQ ID NO: 299231 - RNA, 32 nt, Human
acaggcgcccgcuaccguacccggcuaauuuu

SEQ ID NO: 299232 - RNA, 23 nt, Human
acaggcgccgucugccacccucu

SEQ ID NO: 299233 - RNA, 32 nt, Human
acaggcgccugccacaacgcccggcuaauuuu

SEQ ID NO: 299234 - RNA, 32 nt, Human
acaggcgccugccaccacacccggcuaauuuu

SEQ ID NO: 299235 - RNA, 32 nt, Human
acaggcgccugccaccacgcccggcuaauuuu

SEQ ID NO: 299236 - RNA, 32 nt, Human
acaggcgccugccaccagccuggcuaauuuuu

SEQ ID NO: 299237 - RNA, 32 nt, Human
acaggcgccugccaccaugccuggcugauauu

SEQ ID NO: 299238 - RNA, 32 nt, Human
acaggcgccugccuccaugccuggcuaauuuu

SEQ ID NO: 299239 - RNA, 32 nt, Human
acaggcgccuuccucuguccuuccugcucuuu

SEQ ID NO: 299240 - RNA, 19 nt, Human
acaggcgcgcacacaccgc

SEQ ID NO: 299241 - RNA, 32 nt, Human
acaggcgcuggcugugagugguuuguacaugc

SEQ ID NO: 299242 - RNA, 32 nt, Human
acaggcgcuguggcucacgccuguaaucccag

SEQ ID NO: 299243 - RNA, 32 nt, Human
acaggcgcuguggcucacgccuguaauuccag

SEQ ID NO: 299244 - RNA, 17 nt, Human
acaggcgcuucaccgcg

SEQ ID NO: 299245 - RNA, 32 nt, Human
acaggcggaaaucugaaaaaugaagacguucc

SEQ ID NO: 299246 - RNA, 32 nt, Human
acaggcggcaggcugggguugguggggcuugu

SEQ ID NO: 299247 - RNA, 32 nt, Human
acaggcggcgcugaagugaaggaugcuggcgg

SEQ ID NO: 299248 - RNA, 32 nt, Human
acaggcgggaggaucacuugagccugggaggu

SEQ ID NO: 299249 - RNA, 32 nt, Human
acaggcggggucucacuauauuguccaggcua

SEQ ID NO: 299250 - RNA, 22 nt, Human
acaggcgucagccaccaugccc

SEQ ID NO: 299251 - RNA, 24 nt, Human
acaggcgucagccaccgcgccugg

SEQ ID NO: 299252 - RNA, 19 nt, Human
acaggcgucccccaccacg

SEQ ID NO: 299253 - RNA, 18 nt, Human
acaggcguccgcccccac

SEQ ID NO: 299254 - RNA, 32 nt, Human
acaggcgucuuccccgaacccuucccaaaccu

SEQ ID NO: 299255 - RNA, 32 nt, Human
acaggcgugaaccugcucugcuguguaucuuu

SEQ ID NO: 299256 - RNA, 18 nt, Human
acaggcgugaagagcaag

SEQ ID NO: 299257 - RNA, 18 nt, Human
acaggcgugagccaccac

SEQ ID NO: 299258 - RNA, 32 nt, Human
acaggcgugagccaccacacccggccguggaa

SEQ ID NO: 299259 - RNA, 25 nt, Human
acaggcgugagccaccacaccuggc

SEQ ID NO: 299260 - RNA, 25 nt, Human
acaggcgugagccaccacgcccggc

SEQ ID NO: 299261 - RNA, 19 nt, Human
acaggcgugagccacccug

SEQ ID NO: 299262 - RNA, 18 nt, Human
acaggcgugagccaccgc

SEQ ID NO: 299263 - RNA, 21 nt, Human
acaggcgugagccaccgcggc

SEQ ID NO: 299264 - RNA, 22 nt, Human
acaggcgugagccacugugccu

SEQ ID NO: 299265 - RNA, 32 nt, Human
acaggcgugagccacugugccuagccauuccc

SEQ ID NO: 299266 - RNA, 18 nt, Human
acaggcgugagcuaucac

SEQ ID NO: 299267 - RNA, 25 nt, Human
acaggcgugcaccaccacgcccggc

SEQ ID NO: 299268 - RNA, 19 nt, Human
acaggcgugcaccaccaug

SEQ ID NO: 299269 - RNA, 22 nt, Human
acaggcgugcaccaccaugccc

SEQ ID NO: 299270 - RNA, 19 nt, Human
acaggcgugcaccaucacg

SEQ ID NO: 299271 - RNA, 19 nt, Human
acaggcguggcuguacacg

SEQ ID NO: 299272 - RNA, 32 nt, Human
acaggcguggugguggguaccuguaaucccag

SEQ ID NO: 299273 - RNA, 18 nt, Human
acaggcgugugccaccac

SEQ ID NO: 299274 - RNA, 19 nt, Human
acaggcgugugccaccacg

SEQ ID NO: 299275 - RNA, 22 nt, Human
acaggcgugugccacugugccu

SEQ ID NO: 299276 - RNA, 17 nt, Human
acaggcgugugcccaug

SEQ ID NO: 299277 - RNA, 32 nt, Human
acaggcguguuagcaugugccuguaaucccag

SEQ ID NO: 299278 - RNA, 24 nt, Human
acaggcguuagccacugcgcccgg

SEQ ID NO: 299279 - RNA, 32 nt, Human
acaggcguucgagaccagccugggcaacauag

SEQ ID NO: 299280 - RNA, 32 nt, Human
acaggcguugcugaccagaaggugaguaaccc

SEQ ID NO: 299281 - RNA, 32 nt, Human
acaggcuaagaccacagacagagcagggcuuc

SEQ ID NO: 299282 - RNA, 32 nt, Human
acaggcuacaucuuugcuuuguuggcaguuuu

SEQ ID NO: 299283 - RNA, 32 nt, Human
acaggcuacguuuaaagagcauagagacaaug

SEQ ID NO: 299284 - RNA, 19 nt, Human
acaggcuagucacaaugca

SEQ ID NO: 299285 - RNA, 32 nt, Human
acaggcuaucaucagugcccacaaacacugcc

SEQ ID NO: 299286 - RNA, 32 nt, Human
acaggcucaagcaauucuccugccucagccuc

SEQ ID NO: 299287 - RNA, 32 nt, Human
acaggcucaccuuuguguuuccagcugcagag

SEQ ID NO: 299288 - RNA, 32 nt, Human
acaggcucagccauacucuuacuaucaugcag

SEQ ID NO: 299289 - RNA, 32 nt, Human
acaggcucaugccaccaugcccagcuaauuuu

SEQ ID NO: 299290 - RNA, 32 nt, Human
acaggcuccaugcccaagguggcagaugugga

SEQ ID NO: 299291 - RNA, 32 nt, Human
acaggcuccaugcccaaguuggcagauguggg

SEQ ID NO: 299292 - RNA, 28 nt, Human
acaggcuccccucauuagggcuugggga

SEQ ID NO: 299293 - RNA, 32 nt, Human
acaggcuccugaggaggauugagggugaaagu

SEQ ID NO: 299294 - RNA, 17 nt, Human
acaggcuccuggaaugu

SEQ ID NO: 299295 - RNA, 27 nt, Human
acaggcuccuggagggcugccuggggg

SEQ ID NO: 299296 - RNA, 32 nt, Human
acaggcucgguucugguccccugcuuuuugag

SEQ ID NO: 299297 - RNA, 32 nt, Human
acaggcucugcagauucuaggcugcccuagga

SEQ ID NO: 299298 - RNA, 32 nt, Human
acaggcucugcaggcuaucucccccucuggcu

SEQ ID NO: 299299 - RNA, 32 nt, Human
acaggcucuggcccauggcuuccuacuggcag

SEQ ID NO: 299300 - RNA, 23 nt, Human
acaggcucuucagauaauggggg

SEQ ID NO: 299301 - RNA, 32 nt, Human
acaggcucuuccuaugguauuauuuaaaauua

SEQ ID NO: 299302 - RNA, 32 nt, Human
acaggcucuugcuauguugcccaggcuggucu

SEQ ID NO: 299303 - RNA, 32 nt, Human
acaggcucuuggguggaagggagcagguuucc

SEQ ID NO: 299304 - RNA, 32 nt, Human
acaggcugaaaagcaugacguaccaaacaggc

SEQ ID NO: 299305 - RNA, 32 nt, Human
acaggcugagccuccugaaaacccaugaacgc

SEQ ID NO: 299306 - RNA, 32 nt, Human
acaggcugcacugaaauaaccugguaaacaac

SEQ ID NO: 299307 - RNA, 32 nt, Human
acaggcugcaggcuagagggggcaguuaugac

SEQ ID NO: 299308 - RNA, 32 nt, Human
acaggcugcucuggccaggagagaaacagcuc

SEQ ID NO: 299309 - RNA, 32 nt, Human
acaggcuggagcagcccaggagaugggccuaa

SEQ ID NO: 299310 - RNA, 32 nt, Human
acaggcuggagugcaguacaauuacggcucag

SEQ ID NO: 299311 - RNA, 32 nt, Human
acaggcuggagugcaguggcaaagucucgacu

SEQ ID NO: 299312 - RNA, 32 nt, Human
acaggcuggagugcaguggcacgaucuuggcu

SEQ ID NO: 299313 - RNA, 32 nt, Human
acaggcuggagugcaguggcuccgaucucugc

SEQ ID NO: 299314 - RNA, 32 nt, Human
acaggcuggagugcaguggugugaucuuggcu

SEQ ID NO: 299315 - RNA, 32 nt, Human
acaggcuggcgugcaguagugggaucuuggug

SEQ ID NO: 299316 - RNA, 29 nt, Human
acaggcuggcugcucagucauucugcagg

SEQ ID NO: 299317 - RNA, 32 nt, Human
acaggcuggcugcucagucauucugcagggcc

SEQ ID NO: 299318 - RNA, 32 nt, Human
acaggcugggaaauauuguguuggaagcacug

SEQ ID NO: 299319 - RNA, 32 nt, Human
acaggcugggauuacaggcgugagccacugca

SEQ ID NO: 299320 - RNA, 32 nt, Human
acaggcugggcagaggggagagagggcaggac

SEQ ID NO: 299321 - RNA, 32 nt, Human
acaggcugggccuggcagacagcacuggcagu

SEQ ID NO: 299322 - RNA, 32 nt, Human
acaggcugggcugcuggagguggggcgaggca

SEQ ID NO: 299323 - RNA, 32 nt, Human
acaggcuggggaggagaaaacaaacacaucaa

SEQ ID NO: 299324 - RNA, 32 nt, Human
acaggcuggguguucccagcagcccuggcuug

SEQ ID NO: 299325 - RNA, 32 nt, Human
acaggcuggucucgaacucccaccucagccuc

SEQ ID NO: 299326 - RNA, 32 nt, Human
acaggcugguggaggggcagacccccuacaag

SEQ ID NO: 299327 - RNA, 17 nt, Human
acaggcugugccacccg

SEQ ID NO: 299328 - RNA, 32 nt, Human
acaggcuguuggacgcagccuggguggcagag

SEQ ID NO: 299329 - RNA, 18 nt, Human
acaggcuucacagugauu

SEQ ID NO: 299330 - RNA, 22 nt, Human
acaggcuucaccuguucuuguu

SEQ ID NO: 299331 - RNA, 19 nt, Human
acaggcuucacuggagcug

SEQ ID NO: 299332 - RNA, 18 nt, Human
acaggcuucaugggcugu

SEQ ID NO: 299333 - RNA, 32 nt, Human
acaggcuuccuaccugcagcuucacuuugcuc

SEQ ID NO: 299334 - RNA, 20 nt, Human
acaggcuucucccagauugu

SEQ ID NO: 299335 - RNA, 22 nt, Human
acaggcuucucuaggcuggggg

SEQ ID NO: 299336 - RNA, 32 nt, Human
acaggcuucucuaggcugggggcagguguggg

SEQ ID NO: 299337 - RNA, 24 nt, Human
acaggcuucuugucacacuggggg

SEQ ID NO: 299338 - RNA, 32 nt, Human
acaggcuugagccacugcaccuagccucuauu

SEQ ID NO: 299339 - RNA, 32 nt, Human
acaggcuuggugguuucaaggaagcacaagaa

SEQ ID NO: 299340 - RNA, 21 nt, Human
acaggcuuguaaaugaggcaa

SEQ ID NO: 299341 - RNA, 21 nt, Human
acaggcuuguacacagauguu

SEQ ID NO: 299342 - RNA, 32 nt, Human
acaggcuuguaggagcacaggcuuccaguggc

SEQ ID NO: 299343 - RNA, 32 nt, Human
acaggcuugucugccugguuuuccuccuacac

SEQ ID NO: 299344 - RNA, 20 nt, Human
acaggcuuguuaccaccaug

SEQ ID NO: 299345 - RNA, 32 nt, Human
acaggcuuguuaccaccaugcucggcuuuugc

SEQ ID NO: 299346 - RNA, 32 nt, Human
acaggcuuuauuuucaccuuguguacaacaug

SEQ ID NO: 299347 - RNA, 32 nt, Human
acaggcuuucaauucucuaaucucacagaagu

SEQ ID NO: 299348 - RNA, 32 nt, Human
acaggcuuucccaggcagcuggcuaguucauu

SEQ ID NO: 299349 - RNA, 32 nt, Human
acagggaaagagagagaaagaacaagcuuucu

SEQ ID NO: 299350 - RNA, 32 nt, Human
acagggaaagcuaugacugcaggaucagucua

SEQ ID NO: 299351 - RNA, 32 nt, Human
acagggaacacugucagggcugaggagaacag

SEQ ID NO: 299352 - RNA, 32 nt, Human
acagggaacagcuucaggauacuuccaggaga

SEQ ID NO: 299353 - RNA, 32 nt, Human
acagggaacuugacuggggcagagggacaggg

SEQ ID NO: 299354 - RNA, 19 nt, Human
acagggaagacggccaugg

SEQ ID NO: 299355 - RNA, 32 nt, Human
acagggaagauggaucccauccuaauuuuuau

SEQ ID NO: 299356 - RNA, 32 nt, Human
acagggaagcagcugggagcuuggaaaccugg

SEQ ID NO: 299357 - RNA, 32 nt, Human
acagggaagcaggggaggcggaaaaauagagu

SEQ ID NO: 299358 - RNA, 32 nt, Human
acagggaagccaggucgagaucaagcccccuu

SEQ ID NO: 299359 - RNA, 31 nt, Human
acagggaaguccguccuaaugccaaguuucu

SEQ ID NO: 299360 - RNA, 32 nt, Human
acagggaaugaacaugaguuuuuguaacguga

SEQ ID NO: 299361 - RNA, 32 nt, Human
acagggacacugcucugccugccuggcccuca

SEQ ID NO: 299362 - RNA, 32 nt, Human
acagggacacugucugggggugcagugcaagc

SEQ ID NO: 299363 - RNA, 32 nt, Human
acagggaccaggaguuugagacuagcuuggcc

SEQ ID NO: 299364 - RNA, 32 nt, Human
acagggacccaggcaggguuggguguugugac

SEQ ID NO: 299365 - RNA, 32 nt, Human
acagggacccgccaccacgcccggcuaauuuu

SEQ ID NO: 299366 - RNA, 32 nt, Human
acagggacccuuguaaauugucauacgccaau

SEQ ID NO: 299367 - RNA, 32 nt, Human
acagggacgggcuuucuuuggaagaugaugaa

SEQ ID NO: 299368 - RNA, 32 nt, Human
acagggacuacaccaucucucaagccauagua

SEQ ID NO: 299369 - RNA, 32 nt, Human
acagggacucagaaauguggugggagggccuc

SEQ ID NO: 299370 - RNA, 32 nt, Human
acagggagacagacagagguugcagugagccg

SEQ ID NO: 299371 - RNA, 32 nt, Human
acagggagacagcaaccaucgccugccacgcc

SEQ ID NO: 299372 - RNA, 32 nt, Human
acagggagacccagugaggauaagcacagauu

SEQ ID NO: 299373 - RNA, 19 nt, Human
acagggagagaaaaagcaa

SEQ ID NO: 299374 - RNA, 32 nt, Human
acagggagaggggcaacaggaggcugggaaau

SEQ ID NO: 299375 - RNA, 32 nt, Human
acagggagcuauggugcacucuaguuuauacu

SEQ ID NO: 299376 - RNA, 32 nt, Human
acagggagcucagaccccaacccuggauccca

SEQ ID NO: 299377 - RNA, 32 nt, Human
acagggaggaaggacccagugcccucaggcgu

SEQ ID NO: 299378 - RNA, 32 nt, Human
acagggaggcagagguugcagugagccgagac

SEQ ID NO: 299379 - RNA, 32 nt, Human
acagggagggaagcccuuauccccagcagcca

SEQ ID NO: 299380 - RNA, 32 nt, Human
acagggagggagcaucccccuggcagagccgc

SEQ ID NO: 299381 - RNA, 32 nt, Human
acagggagggccugagaaaagaaugggagggg

SEQ ID NO: 299382 - RNA, 32 nt, Human
acagggagggucagagggaggccggcugcuuc

SEQ ID NO: 299383 - RNA, 32 nt, Human
acagggaguaagacauccauggaugucagcaa

SEQ ID NO: 299384 - RNA, 32 nt, Human
acagggagucccaggacccagggagagugugg

SEQ ID NO: 299385 - RNA, 32 nt, Human
acagggagugaguguuucauggggacagaguu

SEQ ID NO: 299386 - RNA, 25 nt, Human
acagggaguggguucuaggcaaaga

SEQ ID NO: 299387 - RNA, 31 nt, Human
acagggauaaauaaagacaaagacugaagac

SEQ ID NO: 299388 - RNA, 32 nt, Human
acagggauaaauaaaggcaaagacugaagaca

SEQ ID NO: 299389 - RNA, 32 nt, Human
acagggaugcaaucuuggcucacuacaaccuc

SEQ ID NO: 299390 - RNA, 32 nt, Human
acagggauggccugagggaaagggcccuggca

SEQ ID NO: 299391 - RNA, 32 nt, Human
acagggauucuccuccuucauccuguaaaggu

SEQ ID NO: 299392 - RNA, 32 nt, Human
acagggcacacagccggcugagccaggaccca

SEQ ID NO: 299393 - RNA, 32 nt, Human
acagggcacagaaacaugcaggaauacauuag

SEQ ID NO: 299394 - RNA, 32 nt, Human
acagggcacuguucacagacugccuuugcucc

SEQ ID NO: 299395 - RNA, 32 nt, Human
acagggcagagcagugccucuacgugucugcg

SEQ ID NO: 299396 - RNA, 32 nt, Human
acagggcagagggaccagggaggggaacagga

SEQ ID NO: 299397 - RNA, 32 nt, Human
acagggcagauuucuggucccacccaccucug

SEQ ID NO: 299398 - RNA, 32 nt, Human
acagggcagcaacccagagcccaugggcccuc

SEQ ID NO: 299399 - RNA, 32 nt, Human
acagggcagcccccacagagcacagcgucauc

SEQ ID NO: 299400 - RNA, 32 nt, Human
acagggcagcugggcgaggaagagauaccagu

SEQ ID NO: 299401 - RNA, 32 nt, Human
acagggcaggcagaggaggcaccuguaggggg

SEQ ID NO: 299402 - RNA, 32 nt, Human
acagggcagggugcagaggaaaacaugccgca

SEQ ID NO: 299403 - RNA, 32 nt, Human
acagggcaguguuguggggacugcaaaagaga

SEQ ID NO: 299404 - RNA, 32 nt, Human
acagggcauauaggauguggcuuuuguccagc

SEQ ID NO: 299405 - RNA, 32 nt, Human
acagggcaucuucuccagggccucauucaguc

SEQ ID NO: 299406 - RNA, 32 nt, Human
acagggcauggccagguggccacuccagaccc

SEQ ID NO: 299407 - RNA, 32 nt, Human
acagggcauugagcugaaaaugguggcuggaa

SEQ ID NO: 299408 - RNA, 20 nt, Human
acagggccaacuuccaggcc

SEQ ID NO: 299409 - RNA, 32 nt, Human
acagggccaagaagguugaugggccaucuuga

SEQ ID NO: 299410 - RNA, 32 nt, Human
acagggccacauuugcaugagacauggcuguc

SEQ ID NO: 299411 - RNA, 32 nt, Human
acagggccaccaggagugcguggaucucaguc

SEQ ID NO: 299412 - RNA, 32 nt, Human
acagggccagcaacguggagguuuaggggcuc

SEQ ID NO: 299413 - RNA, 32 nt, Human
acagggccaucuguucaucacacacacccccu

SEQ ID NO: 299414 - RNA, 28 nt, Human
acagggccaugugcugcccuguugccga

SEQ ID NO: 299415 - RNA, 21 nt, Human
acagggcccagcccacagcca

SEQ ID NO: 299416 - RNA, 32 nt, Human
acagggcccucugaggcucagcccugagcugg

SEQ ID NO: 299417 - RNA, 32 nt, Human
acagggcccugccaccaagcccagcuaauugu

SEQ ID NO: 299418 - RNA, 32 nt, Human
acagggccgacccuucccuugugggcuggcuu

SEQ ID NO: 299419 - RNA, 26 nt, Human
acagggccggccugcugcugugcccu

SEQ ID NO: 299420 - RNA, 32 nt, Human
acagggccuggcccauggcaggagcucaggaa

SEQ ID NO: 299421 - RNA, 32 nt, Human
acagggccuuaaaauuacuuggcuuuuuccaa

SEQ ID NO: 299422 - RNA, 32 nt, Human
acagggccuuucucuucauuacuucuugggua

SEQ ID NO: 299423 - RNA, 32 nt, Human
acagggcgagugagacagagggaaggcgggga

SEQ ID NO: 299424 - RNA, 32 nt, Human
acagggcucauuuuugcacuuaucucgaauuu

SEQ ID NO: 299425 - RNA, 32 nt, Human
acagggcuccaggacacccuccuucuggagcc

SEQ ID NO: 299426 - RNA, 24 nt, Human
acagggcugcacuggcccaagcca

SEQ ID NO: 299427 - RNA, 32 nt, Human
acagggcugccuggccucucccucgugcuccu

SEQ ID NO: 299428 - RNA, 32 nt, Human
acagggcugcggccccucugcccacacucagu

SEQ ID NO: 299429 - RNA, 32 nt, Human
acagggcuggagaagaggagugaggagccucc

SEQ ID NO: 299430 - RNA, 32 nt, Human
acagggcuggcacucccagaggggacacggca

SEQ ID NO: 299431 - RNA, 32 nt, Human
acagggcuuggacacuucacagcugcugggag

SEQ ID NO: 299432 - RNA, 32 nt, Human
acaggggaaaucucagagcacaauucagcagg

SEQ ID NO: 299433 - RNA, 32 nt, Human
acaggggaaaugagaggguccugcaggcagag

SEQ ID NO: 299434 - RNA, 32 nt, Human
acaggggaaugagcaaaucucaaagagcuggc

SEQ ID NO: 299435 - RNA, 21 nt, Human
acaggggacacucccaggcca

SEQ ID NO: 299436 - RNA, 32 nt, Human
acaggggaccaguggggaacacuacuguaguu

SEQ ID NO: 299437 - RNA, 32 nt, Human
acaggggagaagaaaauucagauggagcguuc

SEQ ID NO: 299438 - RNA, 32 nt, Human
acaggggagagcagcuuccagccugggucaga

SEQ ID NO: 299439 - RNA, 32 nt, Human
acaggggagauggagguugcagugagcugaga

SEQ ID NO: 299440 - RNA, 32 nt, Human
acaggggagauggaguaauuuugcuguggaaa

SEQ ID NO: 299441 - RNA, 32 nt, Human
acaggggagaugguggaaucuucccuguuuuu

SEQ ID NO: 299442 - RNA, 32 nt, Human
acaggggaggcugagacgcaaggaucacuuga

SEQ ID NO: 299443 - RNA, 32 nt, Human
acaggggaggcugaggcaggagaaucgcuuga

SEQ ID NO: 299444 - RNA, 32 nt, Human
acaggggaggguguucaaggaagaguggcucu

SEQ ID NO: 299445 - RNA, 32 nt, Human
acaggggauauuagcuguaguuuaauggauaa

SEQ ID NO: 299446 - RNA, 32 nt, Human
acaggggcacagcagagguuugggaagcgguc

SEQ ID NO: 299447 - RNA, 32 nt, Human
acaggggcagaggcuucuccggcaggcugauu

SEQ ID NO: 299448 - RNA, 32 nt, Human
acaggggccaacuagggccagguggaagggga

SEQ ID NO: 299449 - RNA, 32 nt, Human
acaggggccacuuuucgagaccgaguagagac

SEQ ID NO: 299450 - RNA, 19 nt, Human
acaggggcccaccaccgcg

SEQ ID NO: 299451 - RNA, 32 nt, Human
acaggggcccauggacucuucagucuggaggg

SEQ ID NO: 299452 - RNA, 32 nt, Human
acaggggcccgccaccacgcccggcuaacuuu

SEQ ID NO: 299453 - RNA, 32 nt, Human
acaggggcccugggcauuucugcugagaacca

SEQ ID NO: 299454 - RNA, 19 nt, Human
acaggggcuacagagccca

SEQ ID NO: 299455 - RNA, 32 nt, Human
acaggggcucugagcuccugaccugagucaug

SEQ ID NO: 299456 - RNA, 32 nt, Human
acaggggcugaguugcuggagcugggcugggg

SEQ ID NO: 299457 - RNA, 32 nt, Human
acagggggaaauggguaugagagacugaggcu

SEQ ID NO: 299458 - RNA, 32 nt, Human
acagggggaaguuauuaaagaggcugcaaagu

SEQ ID NO: 299459 - RNA, 32 nt, Human
acagggggagaaacagaagcccagagagggaa

SEQ ID NO: 299460 - RNA, 32 nt, Human
acaggggucaccaagcgcacucacaggguccc

SEQ ID NO: 299461 - RNA, 32 nt, Human
acaggggugaagcucagggacaagucugggcu

SEQ ID NO: 299462 - RNA, 32 nt, Human
acaggggugcugcagguggcagagugaauguc

SEQ ID NO: 299463 - RNA, 32 nt, Human
acagggguggggacccagaguuagcagugggg

SEQ ID NO: 299464 - RNA, 32 nt, Human
acaggggugggguuugggggaagcgagagagg

SEQ ID NO: 299465 - RNA, 32 nt, Human
acagggguuacaucaaccuccgauucugaaga

SEQ ID NO: 299466 - RNA, 32 nt, Human
acagggguucuuagucucagcacuaugacauu

SEQ ID NO: 299467 - RNA, 32 nt, Human
acagggguuggguggggguugcaggacuccac

SEQ ID NO: 299468 - RNA, 32 nt, Human
acaggguaaggaagagagagugggaggcagag

SEQ ID NO: 299469 - RNA, 20 nt, Human
acaggguacucuggggucga

SEQ ID NO: 299470 - RNA, 22 nt, Human
acaggguagcugcuguugcucu

SEQ ID NO: 299471 - RNA, 32 nt, Human
acaggguagggagaggaggggcagaggcugug

SEQ ID NO: 299472 - RNA, 32 nt, Human
acaggguagggagaggguauaacaggaagagc

SEQ ID NO: 299473 - RNA, 32 nt, Human
acaggguagggagaugacaguggugcaugaug

SEQ ID NO: 299474 - RNA, 32 nt, Human
acagggucaccaccuuucucucccuucuucuc

SEQ ID NO: 299475 - RNA, 32 nt, Human
acagggucacccaggaggguggaugccagguc

SEQ ID NO: 299476 - RNA, 32 nt, Human
acagggucaccuugggaaggcuugggagccag

SEQ ID NO: 299477 - RNA, 32 nt, Human
acagggucagcaguucaagaccagccuggcca

SEQ ID NO: 299478 - RNA, 27 nt, Human
acaggguccaccuggagacacuggggg

SEQ ID NO: 299479 - RNA, 32 nt, Human
acaggguccccugagcauugugcagaugcugc

SEQ ID NO: 299480 - RNA, 32 nt, Human
acagggucccuuuguugcccaggcuggucucc

SEQ ID NO: 299481 - RNA, 32 nt, Human
acaggguccuuugagaaacauggcccuugauc

SEQ ID NO: 299482 - RNA, 32 nt, Human
acagggucgggaguucgagaccagccuggcca

SEQ ID NO: 299483 - RNA, 32 nt, Human
acagggucuaauucucucacccaggugcaaau

SEQ ID NO: 299484 - RNA, 32 nt, Human
acagggucuacaacacgaugccauggcugacg

SEQ ID NO: 299485 - RNA, 32 nt, Human
acagggucucacuacauuacccagcuggucuc

SEQ ID NO: 299486 - RNA, 32 nt, Human
acagggucucacuauguugcccaggccggucu

SEQ ID NO: 299487 - RNA, 32 nt, Human
acagggucucacuauguugcccaggcugcucu

SEQ ID NO: 299488 - RNA, 32 nt, Human
acagggucucacuauguugcccaggcuggagu

SEQ ID NO: 299489 - RNA, 32 nt, Human
acagggucucacuauguugcccaggcuggucu

SEQ ID NO: 299490 - RNA, 19 nt, Human
acagggucucacucuguug

SEQ ID NO: 299491 - RNA, 32 nt, Human
acagggucucacugcauugcccuugcugaccu

SEQ ID NO: 299492 - RNA, 32 nt, Human
acagggucucacuguguugccuaggccggucu

SEQ ID NO: 299493 - RNA, 32 nt, Human
acagggucuccauauguugcccaggcuggucu

SEQ ID NO: 299494 - RNA, 32 nt, Human
acagggucucccuauguugcccaggcuggucu

SEQ ID NO: 299495 - RNA, 32 nt, Human
acagggucucgcuauguugcccaggcugggac

SEQ ID NO: 299496 - RNA, 32 nt, Human
acagggucucuacccuccucacaacacccucu

SEQ ID NO: 299497 - RNA, 32 nt, Human
acagggucugcacucuaacccuaggcaucaca

SEQ ID NO: 299498 - RNA, 32 nt, Human
acagggucuucccauguugcccaggcuggucu

SEQ ID NO: 299499 - RNA, 32 nt, Human
acagggucuugacuggagugcaguggugcgau

SEQ ID NO: 299500 - RNA, 32 nt, Human
acagggucuugcaagcagccuccugggcaguc

SEQ ID NO: 299501 - RNA, 32 nt, Human
acagggucuugccauguugcccugacuagucu

SEQ ID NO: 299502 - RNA, 32 nt, Human
acagggucuugcuauguugcccaggcuggucu

SEQ ID NO: 299503 - RNA, 32 nt, Human
acagggucuugguauguugcccagacuguucg

SEQ ID NO: 299504 - RNA, 32 nt, Human
acagggugagacagcagggcccaggggagugg

SEQ ID NO: 299505 - RNA, 32 nt, Human
acagggugcaggacuccacugaugagagaucc

SEQ ID NO: 299506 - RNA, 32 nt, Human
acagggugcccgccccacagugcuuuccccag

SEQ ID NO: 299507 - RNA, 32 nt, Human
acaggguggaacccggcagaggacaaugggag

SEQ ID NO: 299508 - RNA, 32 nt, Human
acaggguggccaacaguggcaucgggaccaaa

SEQ ID NO: 299509 - RNA, 32 nt, Human
acagggugggggcaaggaaauuagcugagauu

SEQ ID NO: 299510 - RNA, 32 nt, Human
acaggguguacaaucucugccuuccagguucu

SEQ ID NO: 299511 - RNA, 32 nt, Human
acagggugucauccuucuuuccuucaagaaac

SEQ ID NO: 299512 - RNA, 32 nt, Human
acagggugugagccacugcaccuggccgauaa

SEQ ID NO: 299513 - RNA, 19 nt, Human
acagggugugagugagaca

SEQ ID NO: 299514 - RNA, 31 nt, Human
acaggguguguggaaagcgcugugggggaag

SEQ ID NO: 299515 - RNA, 19 nt, Human
acaggguguuaccauguug

SEQ ID NO: 299516 - RNA, 32 nt, Human
acaggguucacaggguuucacagucugaugag

SEQ ID NO: 299517 - RNA, 32 nt, Human
acaggguucaggugccccaggugacccugucu

SEQ ID NO: 299518 - RNA, 32 nt, Human
acaggguucgccccaguccuccugccuggaga

SEQ ID NO: 299519 - RNA, 32 nt, Human
acaggguucugcaucuuagccugcugcuaccc

SEQ ID NO: 299520 - RNA, 32 nt, Human
acaggguugcccaggguggagugcaguggcag

SEQ ID NO: 299521 - RNA, 21 nt, Human
acaggguugggugcugugcug

SEQ ID NO: 299522 - RNA, 21 nt, Human
acaggguuguugcugcccagg

SEQ ID NO: 299523 - RNA, 19 nt, Human
acaggguuucaccauguua

SEQ ID NO: 299524 - RNA, 32 nt, Human
acaggguuuggacuagguguucccugguauuc

SEQ ID NO: 299525 - RNA, 32 nt, Human
acaggguuuucuucccugucuguguauuuuga

SEQ ID NO: 299526 - RNA, 32 nt, Human
acaggguuuugccauguugcccaggcuggucu

SEQ ID NO: 299527 - RNA, 32 nt, Human
acaggguuuuuccauguugcccaggcugguuu

SEQ ID NO: 299528 - RNA, 32 nt, Human
acagguaagugagacucagccucuacccucag

SEQ ID NO: 299529 - RNA, 32 nt, Human
acagguaauguugaugaacaagcgaggcuccc

SEQ ID NO: 299530 - RNA, 22 nt, Human
acagguacaugccacugugccu

SEQ ID NO: 299531 - RNA, 32 nt, Human
acagguaccacuucugaucacccuguacauac

SEQ ID NO: 299532 - RNA, 32 nt, Human
acagguaccuacugcuggccucuucaguggcc

SEQ ID NO: 299533 - RNA, 32 nt, Human
acagguaccugccaccaugcccggcuaauuuu

SEQ ID NO: 299534 - RNA, 19 nt, Human
acagguacuaaggauuguu

SEQ ID NO: 299535 - RNA, 32 nt, Human
acagguacuaaggauuguuuacuuccgaacuu

SEQ ID NO: 299536 - RNA, 32 nt, Human
acagguagagagaagggggcccaauggccagg

SEQ ID NO: 299537 - RNA, 23 nt, Human
acagguaugaagaagacuguucu

SEQ ID NO: 299538 - RNA, 18 nt, Human
acagguaugcaccaccau

SEQ ID NO: 299539 - RNA, 31 nt, Human
acagguaugcacugguaacaugcagaugauu

SEQ ID NO: 299540 - RNA, 32 nt, Human
acaggucaaaaugguccccaucagccuggagc

SEQ ID NO: 299541 - RNA, 32 nt, Human
acaggucacaucugaucccuuuggggugcggg

SEQ ID NO: 299542 - RNA, 32 nt, Human
acaggucaccucugcuuuccauagaagaaucu

SEQ ID NO: 299543 - RNA, 32 nt, Human
acaggucagcauggagggacccgacucugucu

SEQ ID NO: 299544 - RNA, 32 nt, Human
acaggucagggauggcaugcaagaccaccgcc

SEQ ID NO: 299545 - RNA, 32 nt, Human
acaggucauaagagcaccuaaggccagcauau

SEQ ID NO: 299546 - RNA, 32 nt, Human
acaggucauugcacucaagccugggcaauaag

SEQ ID NO: 299547 - RNA, 32 nt, Human
acagguccacacuguguaaacaugcaucugau

SEQ ID NO: 299548 - RNA, 32 nt, Human
acagguccagccugugguguccacaaugcccc

SEQ ID NO: 299549 - RNA, 32 nt, Human
acagguccagcuccucccucacggugaccucu

SEQ ID NO: 299550 - RNA, 32 nt, Human
acaggucccagagcaguggauaugucuggucc

SEQ ID NO: 299551 - RNA, 32 nt, Human
acaggucccagccuguagacaucuuuuacucc

SEQ ID NO: 299552 - RNA, 32 nt, Human
acaggucccuccccuucucugugcaguagcau

SEQ ID NO: 299553 - RNA, 32 nt, Human
acagguccgagaucggggguuggagugcgggu

SEQ ID NO: 299554 - RNA, 32 nt, Human
acagguccuagugcccaucagauacccgcggc

SEQ ID NO: 299555 - RNA, 32 nt, Human
acagguccucugucuguaugaucuugccaagg

SEQ ID NO: 299556 - RNA, 32 nt, Human
acagguccugggaaagaagugggaucuagggc

SEQ ID NO: 299557 - RNA, 32 nt, Human
acagguccugguuagaaacagagcaggugaaa

SEQ ID NO: 299558 - RNA, 32 nt, Human
acagguccugucauuucauucaucucaaauua

SEQ ID NO: 299559 - RNA, 32 nt, Human
acagguccuucuggugggaagggaggcgggag

SEQ ID NO: 299560 - RNA, 32 nt, Human
acaggucuauagaucuccaguuggaguacaga

SEQ ID NO: 299561 - RNA, 32 nt, Human
acaggucugauuguagccugcuacagccuuga

SEQ ID NO: 299562 - RNA, 32 nt, Human
acaggucuggaucuaauccaaggucuggacuc

SEQ ID NO: 299563 - RNA, 32 nt, Human
acaggucuggugacccugcaagggaggagcca

SEQ ID NO: 299564 - RNA, 32 nt, Human
acaggucuguggggcaagaggcugcaauauuc

SEQ ID NO: 299565 - RNA, 32 nt, Human
acaggugaacaggugaacacaaacaugaggga

SEQ ID NO: 299566 - RNA, 32 nt, Human
acaggugacacagagcaggggcuucagccaca

SEQ ID NO: 299567 - RNA, 32 nt, Human
acaggugagaagcaaacucccgcuggaagccu

SEQ ID NO: 299568 - RNA, 32 nt, Human
acaggugagagacagauugaaagacaacacac

SEQ ID NO: 299569 - RNA, 32 nt, Human
acaggugaggaaauggaggcucagagagguua

SEQ ID NO: 299570 - RNA, 32 nt, Human
acaggugaggucagaggagugaagugacuugc

SEQ ID NO: 299571 - RNA, 32 nt, Human
acaggugagguggcucaccccuguaaucccag

SEQ ID NO: 299572 - RNA, 32 nt, Human
acaggugauuucugcauuuccaucugaggcau

SEQ ID NO: 299573 - RNA, 32 nt, Human
acaggugcacacacacgaugccgaacaaggca

SEQ ID NO: 299574 - RNA, 25 nt, Human
acaggugcacaccaccacaccuggc

SEQ ID NO: 299575 - RNA, 18 nt, Human
acaggugcacgccaccac

SEQ ID NO: 299576 - RNA, 32 nt, Human
acaggugcagaaggugcaggugcaguggguac

SEQ ID NO: 299577 - RNA, 31 nt, Human
acaggugcagagagagaauaaacugugucua

SEQ ID NO: 299578 - RNA, 32 nt, Human
acaggugcagcaaaccaccauggcacauguuu

SEQ ID NO: 299579 - RNA, 32 nt, Human
acaggugcagccuugccuccugaaugaaaauu

SEQ ID NO: 299580 - RNA, 32 nt, Human
acaggugcaggacugccagggaucggagugcg

SEQ ID NO: 299581 - RNA, 32 nt, Human
acaggugcagguagacaacgcccauaaacaga

SEQ ID NO: 299582 - RNA, 23 nt, Human
acaggugccacaggcacugggga

SEQ ID NO: 299583 - RNA, 32 nt, Human
acaggugccagggcuccugccugcuccuccug

SEQ ID NO: 299584 - RNA, 32 nt, Human
acaggugccagugccuccagaauguggcagcu

SEQ ID NO: 299585 - RNA, 32 nt, Human
acaggugcccaccaccaugccuggcugguuuu

SEQ ID NO: 299586 - RNA, 18 nt, Human
acaggugcccgccaccac

SEQ ID NO: 299587 - RNA, 32 nt, Human
acaggugcccgccaccacacccggcuaauuuu

SEQ ID NO: 299588 - RNA, 20 nt, Human
acaggugcccgccaccacca

SEQ ID NO: 299589 - RNA, 32 nt, Human
acaggugcccgccaccacgcccggcuaauuuu

SEQ ID NO: 299590 - RNA, 32 nt, Human
acaggugcccgccaccaugcccggcuaauuuu

SEQ ID NO: 299591 - RNA, 32 nt, Human
acaggugcccgccaccaugcccggcugauuuc

SEQ ID NO: 299592 - RNA, 32 nt, Human
acaggugcccgccaccgugcccggcuaauuuu

SEQ ID NO: 299593 - RNA, 32 nt, Human
acaggugcccgcuacuaugcccggcuaauuuu

SEQ ID NO: 299594 - RNA, 19 nt, Human
acaggugccuaccaccaug

SEQ ID NO: 299595 - RNA, 32 nt, Human
acaggugccucacgccuguaaucccagcacuu

SEQ ID NO: 299596 - RNA, 32 nt, Human
acaggugccugccaccacacccggcuaauuuu

SEQ ID NO: 299597 - RNA, 32 nt, Human
acaggugccugccaccaugcccagcuaauuuu

SEQ ID NO: 299598 - RNA, 32 nt, Human
acaggugccugccaccaugcccggcuaauacu

SEQ ID NO: 299599 - RNA, 32 nt, Human
acaggugccuguaaucccagcuacucgguagg

SEQ ID NO: 299600 - RNA, 32 nt, Human
acaggugccuguaaucccagcuacuugggagg

SEQ ID NO: 299601 - RNA, 32 nt, Human
acaggugccuguagucccagcuacucgggagg

SEQ ID NO: 299602 - RNA, 32 nt, Human
acaggugcugucagcccagggugggagcagga

SEQ ID NO: 299603 - RNA, 32 nt, Human
acaggugcuguucagugccgaccugcgccaau

SEQ ID NO: 299604 - RNA, 32 nt, Human
acagguggagagaagaagcccuggcuggggga

SEQ ID NO: 299605 - RNA, 32 nt, Human
acagguggagggcugcuuccaccccaggugcu

SEQ ID NO: 299606 - RNA, 32 nt, Human
acagguggauaaccuagugcccaaggcagggc

SEQ ID NO: 299607 - RNA, 32 nt, Human
acagguggaucucuugagcccaggaguuugag

SEQ ID NO: 299608 - RNA, 32 nt, Human
acagguggaugggugaaagauccagagagugg

SEQ ID NO: 299609 - RNA, 32 nt, Human
acagguggcuccugggcuugggcugcagguuu

SEQ ID NO: 299610 - RNA, 32 nt, Human
acaggugggagccacaacacccggccaugaau

SEQ ID NO: 299611 - RNA, 32 nt, Human
acaggugggauuauaggcacaguggcccacug

SEQ ID NO: 299612 - RNA, 32 nt, Human
acaggugggcagcagcgagcuggcaggugaag

SEQ ID NO: 299613 - RNA, 32 nt, Human
acaggugggcauaggugcagugagugcaggug

SEQ ID NO: 299614 - RNA, 32 nt, Human
acagguggggugaccaggaugggaggaaaaua

SEQ ID NO: 299615 - RNA, 32 nt, Human
acagguggguccagcugcccaggucauggccu

SEQ ID NO: 299616 - RNA, 32 nt, Human
acaggugggugaggaucugagaaaugcuaaag

SEQ ID NO: 299617 - RNA, 32 nt, Human
acaggugggugugaggcccccucuggaguuuc

SEQ ID NO: 299618 - RNA, 18 nt, Human
acaggugugagccaccac

SEQ ID NO: 299619 - RNA, 25 nt, Human
acaggugugagccaccacacccggc

SEQ ID NO: 299620 - RNA, 32 nt, Human
acaggugugagccaccacgccagccugacgau

SEQ ID NO: 299621 - RNA, 24 nt, Human
acaggugugagccaccacgcuggc

SEQ ID NO: 299622 - RNA, 32 nt, Human
acaggugugagccacugugcucggccuaccuu

SEQ ID NO: 299623 - RNA, 19 nt, Human
acaggugugcaccaccacg

SEQ ID NO: 299624 - RNA, 19 nt, Human
acaggugugcaccaccaug

SEQ ID NO: 299625 - RNA, 22 nt, Human
acaggugugcaccaccaugccc

SEQ ID NO: 299626 - RNA, 23 nt, Human
acaggugugccaccacgccuggc

SEQ ID NO: 299627 - RNA, 32 nt, Human
acaggugugcugcgcgggaagccccaugcucc

SEQ ID NO: 299628 - RNA, 32 nt, Human
acagguguggagaacccagggguagaggccac

SEQ ID NO: 299629 - RNA, 32 nt, Human
acaggugugguuucaccauauugcccaggcug

SEQ ID NO: 299630 - RNA, 19 nt, Human
acagguguguaccaccacg

SEQ ID NO: 299631 - RNA, 18 nt, Human
acagguuaaaagcauuca

SEQ ID NO: 299632 - RNA, 32 nt, Human
acagguuaacaugcagcagcucugugaccuug

SEQ ID NO: 299633 - RNA, 18 nt, Human
acagguuacaucauugca

SEQ ID NO: 299634 - RNA, 18 nt, Human
acagguuacuggcaaugc

SEQ ID NO: 299635 - RNA, 19 nt, Human
acagguuacuugguuuaca

SEQ ID NO: 299636 - RNA, 17 nt, Human
acagguuagcuguuaca

SEQ ID NO: 299637 - RNA, 17 nt, Human
acagguuagggaucaca

SEQ ID NO: 299638 - RNA, 18 nt, Human
acagguuauggacauuca

SEQ ID NO: 299639 - RNA, 18 nt, Human
acagguuauggggucuca

SEQ ID NO: 299640 - RNA, 16 nt, Human
acagguuauucauaac

SEQ ID NO: 299641 - RNA, 19 nt, Human
acagguuauugacauuaca

SEQ ID NO: 299642 - RNA, 16 nt, Human
acagguuauuuuuacg

SEQ ID NO: 299643 - RNA, 32 nt, Human
acagguucacccagcgcccucuaccuccuagc

SEQ ID NO: 299644 - RNA, 32 nt, Human
acagguucaggcgauucccgugccucagccuc

SEQ ID NO: 299645 - RNA, 32 nt, Human
acagguucagggucuaggaaggggagacauuu

SEQ ID NO: 299646 - RNA, 32 nt, Human
acagguucauucugaccguggaaggugaacac

SEQ ID NO: 299647 - RNA, 32 nt, Human
acagguuccaucccaacacuccugucuguggg

SEQ ID NO: 299648 - RNA, 20 nt, Human
acagguucccaggccugggg

SEQ ID NO: 299649 - RNA, 32 nt, Human
acagguuccccauguacauacaugcacauacu

SEQ ID NO: 299650 - RNA, 32 nt, Human
acagguucucauuccuuuucccauuauacuuc

SEQ ID NO: 299651 - RNA, 32 nt, Human
acagguucucuuccuggcaucauaaggaguug

SEQ ID NO: 299652 - RNA, 17 nt, Human
acagguucugcguuaca

SEQ ID NO: 299653 - RNA, 21 nt, Human
acagguucugugcaucaccac

SEQ ID NO: 299654 - RNA, 32 nt, Human
acagguucuucuugaggaaacugaggcaaaga

SEQ ID NO: 299655 - RNA, 32 nt, Human
acagguugcauagcacuggaacuuuccuagag

SEQ ID NO: 299656 - RNA, 32 nt, Human
acagguuggggagagacagagaagugggcagg

SEQ ID NO: 299657 - RNA, 32 nt, Human
acagguuggggcucugcaggaugaggaagaca

SEQ ID NO: 299658 - RNA, 18 nt, Human
acagguuggguuauuaua

SEQ ID NO: 299659 - RNA, 17 nt, Human
acagguuggucauuuca

SEQ ID NO: 299660 - RNA, 17 nt, Human
acagguuguacacugca

SEQ ID NO: 299661 - RNA, 32 nt, Human
acagguugugcaagagguggaaauguucucca

SEQ ID NO: 299662 - RNA, 18 nt, Human
acagguuguuccauccca

SEQ ID NO: 299663 - RNA, 32 nt, Human
acagguuucccaagcuaacauuucaagguaaa

SEQ ID NO: 299664 - RNA, 32 nt, Human
acagguuuccucaagccccauuugucaacuaa

SEQ ID NO: 299665 - RNA, 19 nt, Human
acagguuucuagaguuguu

SEQ ID NO: 299666 - RNA, 32 nt, Human
acagguuucugggcagaagggggugagucccu

SEQ ID NO: 299667 - RNA, 22 nt, Human
acagguuugaggaugcugggga

SEQ ID NO: 299668 - RNA, 32 nt, Human
acagguuugcagcuacccucucugaccuuuuc

SEQ ID NO: 299669 - RNA, 32 nt, Human
acagguuugggcaguggugggggagggggcca

SEQ ID NO: 299670 - RNA, 17 nt, Human
acagguuuuagcauugu

SEQ ID NO: 299671 - RNA, 32 nt, Human
acaguaaaaauacuaauagauuagcugggugg

SEQ ID NO: 299672 - RNA, 32 nt, Human
acaguaaaacuuccuguccuuguugaaccaaa

SEQ ID NO: 299673 - RNA, 32 nt, Human
acaguaaacuggcauaugaauagugauuucua

SEQ ID NO: 299674 - RNA, 32 nt, Human
acaguaaacuugcaggggcgagagggagggac

SEQ ID NO: 299675 - RNA, 32 nt, Human
acaguaaagagaaaggaagacaaccuccagag

SEQ ID NO: 299676 - RNA, 32 nt, Human
acaguaaaucacacaacagguuucuacucucu

SEQ ID NO: 299677 - RNA, 21 nt, Human
acaguaaaucucuggguuucu

SEQ ID NO: 299678 - RNA, 32 nt, Human
acaguaacaaguguucacaaggauauggagaa

SEQ ID NO: 299679 - RNA, 32 nt, Human
acaguaacaaguguuggcauuaucaguugaac

SEQ ID NO: 299680 - RNA, 32 nt, Human
acaguaacaaugcucaucacucuuuuccaaca

SEQ ID NO: 299681 - RNA, 32 nt, Human
acaguaacagcagcagcaaacuuuuccucuca

SEQ ID NO: 299682 - RNA, 32 nt, Human
acaguaaccaagguaauguucaguuucagcau

SEQ ID NO: 299683 - RNA, 32 nt, Human
acaguaagagaaagccaaaaagcaaugcagag

SEQ ID NO: 299684 - RNA, 32 nt, Human
acaguaagcuuccccagcccugccugagcagc

SEQ ID NO: 299685 - RNA, 32 nt, Human
acaguaagggagcagagugguuaaggacuuuc

SEQ ID NO: 299686 - RNA, 32 nt, Human
acaguaaggggaggggagcggaggcggaggcg

SEQ ID NO: 299687 - RNA, 32 nt, Human
acaguaaucauggucuacuccucuuuccgugg

SEQ ID NO: 299688 - RNA, 32 nt, Human
acaguaauccucagaguggcccagguggguag

SEQ ID NO: 299689 - RNA, 32 nt, Human
acaguaauuccagccacaaucuuuagaucacc

SEQ ID NO: 299690 - RNA, 32 nt, Human
acaguacacaugcaccacaacaaaggcucauc

SEQ ID NO: 299691 - RNA, 32 nt, Human
acaguacagauagucguacugaucaugagaga

SEQ ID NO: 299692 - RNA, 32 nt, Human
acaguacagugggggaaauagaaaacauguga

SEQ ID NO: 299693 - RNA, 32 nt, Human
acaguacauuccauucaugcaguagauaugaa

SEQ ID NO: 299694 - RNA, 32 nt, Human
acaguacuaggaaaugggagcucacagcacug

SEQ ID NO: 299695 - RNA, 32 nt, Human
acaguacuccauuuugggguccaaacuguaau

SEQ ID NO: 299696 - RNA, 23 nt, Human
acaguacugaagacucugcagcc

SEQ ID NO: 299697 - RNA, 22 nt, Human
acaguagacaaaagcaguggca

SEQ ID NO: 299698 - RNA, 32 nt, Human
acaguagauaaaggaggauguccuggaagaag

SEQ ID NO: 299699 - RNA, 32 nt, Human
acaguagcagggaauugauccacuucuuaaug

SEQ ID NO: 299700 - RNA, 32 nt, Human
acaguagcaguggauucgggacccaccuguac

SEQ ID NO: 299701 - RNA, 32 nt, Human
acaguagcaguuuccugguccuguuccucauc

SEQ ID NO: 299702 - RNA, 32 nt, Human
acaguagccaaguucuggagcaaauaaaaggc

SEQ ID NO: 299703 - RNA, 32 nt, Human
acaguagccagagcuccucuuccuuuaccagg

SEQ ID NO: 299704 - RNA, 32 nt, Human
acaguagccauccuguuccuacucagaguccu

SEQ ID NO: 299705 - RNA, 31 nt, Human
acaguagccaugucuccuuucaaggucuucu

SEQ ID NO: 299706 - RNA, 32 nt, Human
acaguagcuggcacagaggggcuacuaaacaa

SEQ ID NO: 299707 - RNA, 32 nt, Human
acaguaggacgagguuucacccuguuggccag

SEQ ID NO: 299708 - RNA, 32 nt, Human
acaguaggagagaagaugccaaguuagaagug

SEQ ID NO: 299709 - RNA, 32 nt, Human
acaguaggauucagcagagaaugagucccaca

SEQ ID NO: 299710 - RNA, 32 nt, Human
acaguagggcugggcaguguuuaauccuucca

SEQ ID NO: 299711 - RNA, 32 nt, Human
acaguagguccaggcuggaugcugguaugaug

SEQ ID NO: 299712 - RNA, 32 nt, Human
acaguaguuccaucaaaauauguaauaauuca

SEQ ID NO: 299713 - RNA, 32 nt, Human
acaguauaaugccaaaugcagcaaaaucuucc

SEQ ID NO: 299714 - RNA, 32 nt, Human
acaguauagagucucauaaaagcugccuuuaa

SEQ ID NO: 299715 - RNA, 32 nt, Human
acaguaucagacacagccccagaagggggcau

SEQ ID NO: 299716 - RNA, 32 nt, Human
acaguaucccuucaaaacaaauaggaguucag

SEQ ID NO: 299717 - RNA, 32 nt, Human
acaguaucuuugucucugccagguggcucuuc

SEQ ID NO: 299718 - RNA, 32 nt, Human
acaguaugcaaaagcagcauucaggagccgaa

SEQ ID NO: 299719 - RNA, 31 nt, Human
acaguauggacaauuucaaaaaccaaaaccc

SEQ ID NO: 299720 - RNA, 32 nt, Human
acaguauuaguggaaaaguaccaugugauuua

SEQ ID NO: 299721 - RNA, 32 nt, Human
acaguauuccaaagguugaaguucugcuguuu

SEQ ID NO: 299722 - RNA, 32 nt, Human
acaguauuggaaaauuacuugaagcuggauuu

SEQ ID NO: 299723 - RNA, 32 nt, Human
acaguauuguaucuggcaaccucccggggcgc

SEQ ID NO: 299724 - RNA, 32 nt, Human
acaguauuuguacaaauacugccuaguguauu

SEQ ID NO: 299725 - RNA, 32 nt, Human
acaguauuuuccaugguucugccugcacuuac

SEQ ID NO: 299726 - RNA, 32 nt, Human
acaguauuuuuguguguuaauuaauuuugcaa

SEQ ID NO: 299727 - RNA, 32 nt, Human
acagucaaaggauggaucaaguacugguuuug

SEQ ID NO: 299728 - RNA, 32 nt, Human
acagucaaauguucauugauuucauguuauuu

SEQ ID NO: 299729 - RNA, 32 nt, Human
acagucaagucaacguucccaccccacuggcu

SEQ ID NO: 299730 - RNA, 23 nt, Human
acagucaauccugcucuguuugc

SEQ ID NO: 299731 - RNA, 32 nt, Human
acagucacagaagguuccugcagcagaugccu

SEQ ID NO: 299732 - RNA, 32 nt, Human
acagucaccacugggacaggccugggccccac

SEQ ID NO: 299733 - RNA, 32 nt, Human
accaccgagcaucucuucaccucuccuccucu

SEQ ID NO: 299734 - RNA, 32 nt, Human
accaccgaggcgggagacagagcgcggcgaag

SEQ ID NO: 299735 - RNA, 32 nt, Human
accaccgcacuccagccugggugacagagcga

SEQ ID NO: 299736 - RNA, 32 nt, Human
accaccgcagcagccccugaggccaggaggca

SEQ ID NO: 299737 - RNA, 25 nt, Human
accaccgcccccgccaccuccgccg

SEQ ID NO: 299738 - RNA, 23 nt, Human
accaccgccgccgccaccaccgu

SEQ ID NO: 299739 - RNA, 20 nt, Human
accaccgccgccgccgccgc

SEQ ID NO: 299740 - RNA, 32 nt, Human
accaccgcgugugcuccggcuccugggacagc

SEQ ID NO: 299741 - RNA, 24 nt, Human
accaccgcugccgucgccgccgcc

SEQ ID NO: 299742 - RNA, 32 nt, Human
accaccggcaccgccucccaaacagggcugcu

SEQ ID NO: 299743 - RNA, 22 nt, Human
accaccggcaugaccggcgcca

SEQ ID NO: 299744 - RNA, 32 nt, Human
accaccggcccgggccagucccugccaguccg

SEQ ID NO: 299745 - RNA, 32 nt, Human
accaccggggacaggcuugcggacgccggcug

SEQ ID NO: 299746 - RNA, 32 nt, Human
accaccgugggugagcuguaugaacucgaggu

SEQ ID NO: 299747 - RNA, 32 nt, Human
accaccguguggggacgcccccaggccggaac

SEQ ID NO: 299748 - RNA, 32 nt, Human
accaccuaagccccaggaggucgaggcugcag

SEQ ID NO: 299749 - RNA, 32 nt, Human
accaccuacgugcacacagcauccuuccacac

SEQ ID NO: 299750 - RNA, 32 nt, Human
accaccuagaaccugaaaggcuuggaacuugc

SEQ ID NO: 299751 - RNA, 32 nt, Human
accaccuagcacuuaaccugcuguuggccuuu

SEQ ID NO: 299752 - RNA, 32 nt, Human
accaccucacaaccacacacugcaugcacaca

SEQ ID NO: 299753 - RNA, 32 nt, Human
accaccucauuucccuccauuaucucccuaaa

SEQ ID NO: 299754 - RNA, 25 nt, Human
accaccuccaccgccgccgccgccg

SEQ ID NO: 299755 - RNA, 32 nt, Human
accaccuccaccugccuguccugggccaggac

SEQ ID NO: 299756 - RNA, 32 nt, Human
accaccuccaggaaaagugucuucucagaaac

SEQ ID NO: 299757 - RNA, 20 nt, Human
accaccuccuccagcugcaa

SEQ ID NO: 299758 - RNA, 22 nt, Human
accaccuccugcuucccaagga

SEQ ID NO: 299759 - RNA, 32 nt, Human
accaccucucaggugaagaaccgucaggaauu

SEQ ID NO: 299760 - RNA, 32 nt, Human
accaccucugguguucagagggggcuuuuaaa

SEQ ID NO: 299761 - RNA, 32 nt, Human
accaccucugugggacuguccacccaccucug

SEQ ID NO: 299762 - RNA, 21 nt, Human
accaccugccuuccagccccu

SEQ ID NO: 299763 - RNA, 32 nt, Human
accaccugcuucccagagugccaagccacaag

SEQ ID NO: 299764 - RNA, 29 nt, Human
accaccugcuugcauucauccccuccucc

SEQ ID NO: 299765 - RNA, 32 nt, Human
accaccugcuuuucugacacugucccuggaau

SEQ ID NO: 299766 - RNA, 32 nt, Human
accaccuggaaacccuccccaugucuuuucag

SEQ ID NO: 299767 - RNA, 32 nt, Human
accaccuggacgaagagcaggccagcccggac

SEQ ID NO: 299768 - RNA, 23 nt, Human
accaccuggccaacauggugaaa

SEQ ID NO: 299769 - RNA, 20 nt, Human
accaccugggccccugaggg

SEQ ID NO: 299770 - RNA, 32 nt, Human
accaccuggucuuugaaguuucuguccuacca

SEQ ID NO: 299771 - RNA, 32 nt, Human
accaccuguaaccccuuccuggcauuggccac

SEQ ID NO: 299772 - RNA, 32 nt, Human
accaccuguaguucagccaaguccaaggguuc

SEQ ID NO: 299773 - RNA, 18 nt, Human
accaccugucgcucccaa

SEQ ID NO: 299774 - RNA, 21 nt, Human
accaccuuaagagcuguaaca

SEQ ID NO: 299775 - RNA, 19 nt, Human
accaccuuagcauguauca

SEQ ID NO: 299776 - RNA, 32 nt, Human
accaccuucccuccucuccagcccucccagcc

SEQ ID NO: 299777 - RNA, 32 nt, Human
accaccuuccugugcaggccagccuggaccuc

SEQ ID NO: 299778 - RNA, 32 nt, Human
accaccuucucccuccccacccccuccaggcc

SEQ ID NO: 299779 - RNA, 15 nt, Human
accaccuugccacca

SEQ ID NO: 299780 - RNA, 32 nt, Human
accaccuugggcaacauaacgagaccccgucu

SEQ ID NO: 299781 - RNA, 32 nt, Human
accaccuugguugagcggcuucauggcagaca

SEQ ID NO: 299782 - RNA, 32 nt, Human
accaccuugguuucuaggcacugugguucuug

SEQ ID NO: 299783 - RNA, 20 nt, Human
accaccuuuggagugacucc

SEQ ID NO: 299784 - RNA, 32 nt, Human
accaccuuugugcugcucuaaccuucagaguu

SEQ ID NO: 299785 - RNA, 32 nt, Human
accacgaaaaacaaagcuuuuuaaacuuaugc

SEQ ID NO: 299786 - RNA, 21 nt, Human
accacgaacgccgccgccgcc

SEQ ID NO: 299787 - RNA, 32 nt, Human
accacgaagggagggaagggaagucagcucug

SEQ ID NO: 299788 - RNA, 32 nt, Human
accacgaauaagaauggaaaugacaauggcug

SEQ ID NO: 299789 - RNA, 32 nt, Human
accacgaggccccguccgguggaacacgccau

SEQ ID NO: 299790 - RNA, 32 nt, Human
accacgauacagucagcaagaggaagccagga

SEQ ID NO: 299791 - RNA, 32 nt, Human
accacgauacagucagcaagaggaagccggga

SEQ ID NO: 299792 - RNA, 32 nt, Human
accacgauggaggcaggagcugcuccuggcug

SEQ ID NO: 299793 - RNA, 32 nt, Human
accacgauugcgcgaccucccuuucccugggg

SEQ ID NO: 299794 - RNA, 32 nt, Human
accacgauuugugcccuugaaaaugcuguuug

SEQ ID NO: 299795 - RNA, 32 nt, Human
accacgccacugcacuccagcccgggugacag

SEQ ID NO: 299796 - RNA, 32 nt, Human
accacgccacugcacuccagccugggugacag

SEQ ID NO: 299797 - RNA, 32 nt, Human
accacgccacugcacuccagcgugggcaacag

SEQ ID NO: 299798 - RNA, 32 nt, Human
accacgccauugcacuccagccugggugacaa

SEQ ID NO: 299799 - RNA, 32 nt, Human
accacgccauugcacuccagcuugggcaauaa

SEQ ID NO: 299800 - RNA, 32 nt, Human
accacgcccaacuaauauuuuguauuuuuagu

SEQ ID NO: 299801 - RNA, 32 nt, Human
accacgcccagacuaauuuuuguauuuuuagu

SEQ ID NO: 299802 - RNA, 32 nt, Human
accacgcccagccuguggccagcacuuuagau

SEQ ID NO: 299803 - RNA, 32 nt, Human
accacgcccagccuucccuugcacuuuuaaug

SEQ ID NO: 299804 - RNA, 32 nt, Human
accacgcccagcuaauauuuuguauuuucagu

SEQ ID NO: 299805 - RNA, 32 nt, Human
accacgccuggcuaauucuuuguauuuuuagu

SEQ ID NO: 299806 - RNA, 20 nt, Human
accacgcgcccgccgccgcc

SEQ ID NO: 299807 - RNA, 32 nt, Human
accacgcucucauccugcaagucggcgcacac

SEQ ID NO: 299808 - RNA, 32 nt, Human
accacgcugggaaggaagaggacagcaagaca

SEQ ID NO: 299809 - RNA, 32 nt, Human
accacgcugggagcuggccugucguacaggcg

SEQ ID NO: 299810 - RNA, 32 nt, Human
accacggacauuggacucacuguggcuggacg

SEQ ID NO: 299811 - RNA, 32 nt, Human
accacggagccccagggccccugggcuugucg

SEQ ID NO: 299812 - RNA, 32 nt, Human
accacggaggccccaaacgaggagcgggacca

SEQ ID NO: 299813 - RNA, 32 nt, Human
accacggaggcuguguguauacguaugugaac

SEQ ID NO: 299814 - RNA, 32 nt, Human
accacggcacuccagccugggugacagaguga

SEQ ID NO: 299815 - RNA, 32 nt, Human
accacggcacuccagccugggugacagugaga

SEQ ID NO: 299816 - RNA, 32 nt, Human
accacggcacuucagccugggugacagaauga

SEQ ID NO: 299817 - RNA, 21 nt, Human
accacggcaggaaguccacca

SEQ ID NO: 299818 - RNA, 32 nt, Human
accacggcaggauccaaucacagccgaggggc

SEQ ID NO: 299819 - RNA, 32 nt, Human
accacggcucacugcagccucagcguccuggg

SEQ ID NO: 299820 - RNA, 32 nt, Human
accacgggccgcagaaucaccaugcccaccuu

SEQ ID NO: 299821 - RNA, 32 nt, Human
accacggggagcaaaccagcuuguucugggcu

SEQ ID NO: 299822 - RNA, 32 nt, Human
accacgggggcaggaccccucucugagucaca

SEQ ID NO: 299823 - RNA, 32 nt, Human
accacgggugcuuuguucuuccuucugcaccu

SEQ ID NO: 299824 - RNA, 32 nt, Human
accacgggugugagccaccgcgcccagcuagc

SEQ ID NO: 299825 - RNA, 32 nt, Human
accacgguguuuccccuuaucucuaccauggc

SEQ ID NO: 299826 - RNA, 32 nt, Human
accacguaacacagcugcaucuugagcaguga

SEQ ID NO: 299827 - RNA, 32 nt, Human
accacguccccacgaaugggaaagcacguuag

SEQ ID NO: 299828 - RNA, 32 nt, Human
accacgucugagcuugcuuuucccucuggaca

SEQ ID NO: 299829 - RNA, 32 nt, Human
accacgucugcuggucuccagccuuguaugga

SEQ ID NO: 299830 - RNA, 32 nt, Human
accacgugaacugucaucaccuggcaacccca

SEQ ID NO: 299831 - RNA, 19 nt, Human
accacgugaggggcacuug

SEQ ID NO: 299832 - RNA, 32 nt, Human
accacgugcacugugcugcugcuggcagagag

SEQ ID NO: 299833 - RNA, 32 nt, Human
accacgugcuccacuccagcucccugccagug

SEQ ID NO: 299834 - RNA, 32 nt, Human
accacguguuauauccuguugcuagucugagu

SEQ ID NO: 299835 - RNA, 32 nt, Human
accacguucuucuugcuuugcuuuuuccuaag

SEQ ID NO: 299836 - RNA, 32 nt, Human
accacguugcccaggcuggucuccagcuccug

SEQ ID NO: 299837 - RNA, 32 nt, Human
accacguuggccaggcuggucuuguacuccug

SEQ ID NO: 299838 - RNA, 32 nt, Human
accacuaacugacauuucuuccagaaacguuc

SEQ ID NO: 299839 - RNA, 32 nt, Human
accacuaaggcggguggaucaccugaggccag

SEQ ID NO: 299840 - RNA, 32 nt, Human
accacuacacuccagccugggugacagcaaga

SEQ ID NO: 299841 - RNA, 32 nt, Human
accacuaccauagggcaaagccagcaggugug

SEQ ID NO: 299842 - RNA, 23 nt, Human
accacuacugaugagggacaguu

SEQ ID NO: 299843 - RNA, 32 nt, Human
accacuagccucucgggagcauggcgucggcc

SEQ ID NO: 299844 - RNA, 32 nt, Human
accacuaggcaggcacugcucucugcagaggg

SEQ ID NO: 299845 - RNA, 32 nt, Human
accacuagggccugggcugacccugacucaga

SEQ ID NO: 299846 - RNA, 32 nt, Human
accacuagguggcgacagagugcagcugcauu

SEQ ID NO: 299847 - RNA, 32 nt, Human
accacuaucuccguuccaucugggcuuauaug

SEQ ID NO: 299848 - RNA, 32 nt, Human
accacuaugaauguaaugaauguggagaaagu

SEQ ID NO: 299849 - RNA, 32 nt, Human
accacuaugauuauaauguaacagacuggagu

SEQ ID NO: 299850 - RNA, 32 nt, Human
accacuauuccaugcuuuuaaguaguuuucuc

SEQ ID NO: 299851 - RNA, 25 nt, Human
accacuauugauacauuauuauaaa

SEQ ID NO: 299852 - RNA, 32 nt, Human
accacucaaccaguggcuguuucacaaggauu

SEQ ID NO: 299853 - RNA, 32 nt, Human
accacucaagcucuucgauaccaaaaucagga

SEQ ID NO: 299854 - RNA, 22 nt, Human
accacucaguggggccugugug

SEQ ID NO: 299855 - RNA, 32 nt, Human
accacuccagccugggcgagagcgagacuccu

SEQ ID NO: 299856 - RNA, 32 nt, Human
accacuccaugugcgucccuccagaagcugug

SEQ ID NO: 299857 - RNA, 32 nt, Human
accacucccacauaaaaugcucauaguuuggg

SEQ ID NO: 299858 - RNA, 32 nt, Human
accacuccccucccaagacccagccgccgccg

SEQ ID NO: 299859 - RNA, 32 nt, Human
accacuccccucccuauauacccccaccccac

SEQ ID NO: 299860 - RNA, 32 nt, Human
accacuccugacaauuccagcacucuacgacu

SEQ ID NO: 299861 - RNA, 32 nt, Human
accacuccugccugcccccacacccacuccac

SEQ ID NO: 299862 - RNA, 32 nt, Human
accacuccugggcuaaggaguaaccucccuca

SEQ ID NO: 299863 - RNA, 21 nt, Human
accacuccuuaugauccagug

SEQ ID NO: 299864 - RNA, 32 nt, Human
accacuccuugauccuucccuucuuaguggcu

SEQ ID NO: 299865 - RNA, 32 nt, Human
accacuccuuuuccaucucccagaagccugcu

SEQ ID NO: 299866 - RNA, 22 nt, Human
accacucgugccgccgccggcg

SEQ ID NO: 299867 - RNA, 22 nt, Human
accacucuaccaaauaauuuca

SEQ ID NO: 299868 - RNA, 32 nt, Human
accacucucauaccugcgugcccacguucaca

SEQ ID NO: 299869 - RNA, 32 nt, Human
accacucuccacccuuucugucugugugacuu

SEQ ID NO: 299870 - RNA, 32 nt, Human
accacucucuccuggguucaagugauucuccu

SEQ ID NO: 299871 - RNA, 32 nt, Human
accacucugaaccaaaacuucuuucuugguuc

SEQ ID NO: 299872 - RNA, 32 nt, Human
accacucugccuggccuccugcugaugaggac

SEQ ID NO: 299873 - RNA, 32 nt, Human
accacucugcucccugcuugccuccacucccu

SEQ ID NO: 299874 - RNA, 21 nt, Human
accacucuuggugacugucau

SEQ ID NO: 299875 - RNA, 32 nt, Human
accacucuuuuucuucuaagccuguguguuau

SEQ ID NO: 299876 - RNA, 32 nt, Human
accacugaacugccuucuuccauuguccugca

SEQ ID NO: 299877 - RNA, 32 nt, Human
accacugaagaaaaucuguggugaagggaaca

SEQ ID NO: 299878 - RNA, 32 nt, Human
accacugaaggaguuccuggaagcccugcggu

SEQ ID NO: 299879 - RNA, 32 nt, Human
accacugacuccuacucuccuacuucuccaga

SEQ ID NO: 299880 - RNA, 32 nt, Human
accacugagaaaccaugaaggccaugcagcga

SEQ ID NO: 299881 - RNA, 24 nt, Human
accacugagaagaccgcuccggca

SEQ ID NO: 299882 - RNA, 32 nt, Human
accacugagacaggggucucacuauguugccc

SEQ ID NO: 299883 - RNA, 19 nt, Human
accacugagaugcuggggg

SEQ ID NO: 299884 - RNA, 22 nt, Human
accacugcaacacccaccagca

SEQ ID NO: 299885 - RNA, 32 nt, Human
accacugcacacugcacuccauccugggcgac

SEQ ID NO: 299886 - RNA, 32 nt, Human
accacugcaccccagccugggugacagcgaga

SEQ ID NO: 299887 - RNA, 32 nt, Human
accacugcacgcacuccagccugggugacaga

SEQ ID NO: 299888 - RNA, 32 nt, Human
accacugcacuacagcuugggugacagcgcga

SEQ ID NO: 299889 - RNA, 32 nt, Human
accacugcacuccaaccugggugacagaguga

SEQ ID NO: 299890 - RNA, 32 nt, Human
accacugcacuccagcccaggugacagagcaa

SEQ ID NO: 299891 - RNA, 32 nt, Human
accacugcacuccagccggggugacagaguga

SEQ ID NO: 299892 - RNA, 32 nt, Human
accacugcacuccagccuaggugacagaguga

SEQ ID NO: 299893 - RNA, 32 nt, Human
accacugcacuccagccuaggugacagggcaa

SEQ ID NO: 299894 - RNA, 32 nt, Human
accacugcacuccagccuggggugauagaaca

SEQ ID NO: 299895 - RNA, 32 nt, Human
accacugcacuccagccugggugacagagacc

SEQ ID NO: 299896 - RNA, 32 nt, Human
accacugcacuccagccugggugacagagaga

SEQ ID NO: 299897 - RNA, 32 nt, Human
accacugcacuccagccugggugacagagcaa

SEQ ID NO: 299898 - RNA, 32 nt, Human
accacugcacuccagccugggugacagagcag

SEQ ID NO: 299899 - RNA, 32 nt, Human
accacugcacuccagccugggugacagagcca

SEQ ID NO: 299900 - RNA, 32 nt, Human
accacugcacuccagccugggugacagagcga

SEQ ID NO: 299901 - RNA, 32 nt, Human
accacugcacuccagccugggugacagaggga

SEQ ID NO: 299902 - RNA, 32 nt, Human
accacugcacuccagccugggugacagaguaa

SEQ ID NO: 299903 - RNA, 32 nt, Human
accacugcacuccagccugggugacagaguag

SEQ ID NO: 299904 - RNA, 32 nt, Human
accacugcacuccagccugggugacagaguga

SEQ ID NO: 299905 - RNA, 32 nt, Human
accacugcacuccagccugggugacagauuga

SEQ ID NO: 299906 - RNA, 32 nt, Human
accacugcacuccagccugggugacagcaaga

SEQ ID NO: 299907 - RNA, 32 nt, Human
accacugcacuccagccuuggugacagaguga

SEQ ID NO: 299908 - RNA, 32 nt, Human
accacugcacuccagcuugggugacagaguga

SEQ ID NO: 299909 - RNA, 32 nt, Human
accacugcacuccaggcugggugacagagcga

SEQ ID NO: 299910 - RNA, 32 nt, Human
accacugcacuccauccagccugggugacagg

SEQ ID NO: 299911 - RNA, 32 nt, Human
accacugcacuccauccugggugacagagcaa

SEQ ID NO: 299912 - RNA, 32 nt, Human
accacugcacucuacucugggugacagaauga

SEQ ID NO: 299913 - RNA, 32 nt, Human
accacugcacucuagccugggugacagagcaa

SEQ ID NO: 299914 - RNA, 32 nt, Human
accacugcacugcagccugggugacagaguga

SEQ ID NO: 299915 - RNA, 32 nt, Human
accacugcacuucagccugggugacagaggga

SEQ ID NO: 299916 - RNA, 32 nt, Human
accacugcacuucagccugggugacagaguga

SEQ ID NO: 299917 - RNA, 32 nt, Human
accacugcacuuuagucugggugacagagcaa

SEQ ID NO: 299918 - RNA, 32 nt, Human
accacugcagaacugaaccacuucggccguga

SEQ ID NO: 299919 - RNA, 32 nt, Human
accacugcagggugguuacuugcagcugugac

SEQ ID NO: 299920 - RNA, 32 nt, Human
accacugcauuccagccugggcaacagagcga

SEQ ID NO: 299921 - RNA, 32 nt, Human
accacugcauuccagccugggcacuagaguga

SEQ ID NO: 299922 - RNA, 32 nt, Human
accacugcauuccagccugggugacagagcaa

SEQ ID NO: 299923 - RNA, 32 nt, Human
accacugcauuccagccugggugacagagcca

SEQ ID NO: 299924 - RNA, 32 nt, Human
accacugcauuccagccugggugacagagcga

SEQ ID NO: 299925 - RNA, 32 nt, Human
accacugcauuccagccugggugacagaguga

SEQ ID NO: 299926 - RNA, 32 nt, Human
accacugcauucccgccugggcagcagagcga

SEQ ID NO: 299927 - RNA, 32 nt, Human
accacugcauucuggccugggugacagaguua

SEQ ID NO: 299928 - RNA, 32 nt, Human
accacugcauuuucacauguaccuucaggggg

SEQ ID NO: 299929 - RNA, 32 nt, Human
accacugccccuucauugauuuccugugucaa

SEQ ID NO: 299930 - RNA, 32 nt, Human
accacugcccuccagccuaggugacagaauga

SEQ ID NO: 299931 - RNA, 32 nt, Human
accacugcccuccagccugggugacagagcga

SEQ ID NO: 299932 - RNA, 32 nt, Human
accacugcccuccugguaccagcccucagugu

SEQ ID NO: 299933 - RNA, 32 nt, Human
accacugcccugagguuacugcacugaggcca

SEQ ID NO: 299934 - RNA, 32 nt, Human
accacugccuccaggguucaagcgauucucuu

SEQ ID NO: 299935 - RNA, 32 nt, Human
accacugccucccagguucaagagauucuccu

SEQ ID NO: 299936 - RNA, 32 nt, Human
accacugccucccagguucaagcgauucuccu

SEQ ID NO: 299937 - RNA, 32 nt, Human
accacugccucccucccucccccuggcaccgg

SEQ ID NO: 299938 - RNA, 32 nt, Human
accacugccuguuggaagaauaguugauucca

SEQ ID NO: 299939 - RNA, 32 nt, Human
accacugcucacugcuuuccacuugcuaggau

SEQ ID NO: 299940 - RNA, 32 nt, Human
accacugcuuccuggguucaagugauucucau

SEQ ID NO: 299941 - RNA, 20 nt, Human
accacugcuuguuccgagcu

SEQ ID NO: 299942 - RNA, 32 nt, Human
accacugcuuuagaccaaacaccaaaggaaga

SEQ ID NO: 299943 - RNA, 32 nt, Human
accacuggaaccuugaacccaccagcuggcug

SEQ ID NO: 299944 - RNA, 32 nt, Human
accacuggcacuccagccugggcaacagagug

SEQ ID NO: 299945 - RNA, 32 nt, Human
accacuggcccuaaaccuuuucccucuguggc

SEQ ID NO: 299946 - RNA, 32 nt, Human
accacuggccgcugcuggucuuccugcugccc

SEQ ID NO: 299947 - RNA, 32 nt, Human
accacuggcggccugggaccagcuggguguca

SEQ ID NO: 299948 - RNA, 32 nt, Human
accacuggcugcagcuucgggaugucccucuc

SEQ ID NO: 299949 - RNA, 32 nt, Human
accacuggcugccucaccuacuccccacacca

SEQ ID NO: 299950 - RNA, 32 nt, Human
accacugggaacucuggacuugaguguguuug

SEQ ID NO: 299951 - RNA, 18 nt, Human
accacugggagcuaccau

SEQ ID NO: 299952 - RNA, 32 nt, Human
accacugggcagccaccuccuuugcccuagac

SEQ ID NO: 299953 - RNA, 32 nt, Human
accacugggccuuccaacuuugcuggcaagcu

SEQ ID NO: 299954 - RNA, 32 nt, Human
accacuggguagugccauuuuggccggacaug

SEQ ID NO: 299955 - RNA, 32 nt, Human
accacugguauuccugagccucucccagcucc

SEQ ID NO: 299956 - RNA, 18 nt, Human
accacugguccccaggaa

SEQ ID NO: 299957 - RNA, 32 nt, Human
accacuguacuccagccugggugacagagcaa

SEQ ID NO: 299958 - RNA, 32 nt, Human
accacuguacuccagccugggugacagagcga

SEQ ID NO: 299959 - RNA, 32 nt, Human
accacuguacuccagccugggugacagggcaa

SEQ ID NO: 299960 - RNA, 32 nt, Human
accacuguaggcaaugggggagaguuaugcau

SEQ ID NO: 299961 - RNA, 32 nt, Human
accacuguauccuccagcuccuuccuuccuuc

SEQ ID NO: 299962 - RNA, 32 nt, Human
accacuguauuccagcccgggugacagagcaa

SEQ ID NO: 299963 - RNA, 32 nt, Human
accacuguauuccagccugggugacagaguga

SEQ ID NO: 299964 - RNA, 23 nt, Human
accacugucagcacucuccagca

SEQ ID NO: 299965 - RNA, 32 nt, Human
accacuguccauccugugaggcucccgucugg

SEQ ID NO: 299966 - RNA, 32 nt, Human
accacugucucaauaaggucucagugcugugu

SEQ ID NO: 299967 - RNA, 32 nt, Human
accacugucucccggguucaagcgauucuccc

SEQ ID NO: 299968 - RNA, 32 nt, Human
accacugugcaggagaacagacagaggaaaug

SEQ ID NO: 299969 - RNA, 32 nt, Human
accacugugccuggccuguuuguuuguuuguu

SEQ ID NO: 299970 - RNA, 32 nt, Human
accacuguggauuuugggguuaagucucauuu

SEQ ID NO: 299971 - RNA, 32 nt, Human
accacugugggaugacagccagaggaauaaga

SEQ ID NO: 299972 - RNA, 20 nt, Human
accacuguggucuguuguac

SEQ ID NO: 299973 - RNA, 32 nt, Human
accacugugugaggaagccaucagaucugugc

SEQ ID NO: 299974 - RNA, 16 nt, Human
accacuguucuguuca

SEQ ID NO: 299975 - RNA, 32 nt, Human
accacuuaaaggcauucuuaaaccacaaacaa

SEQ ID NO: 299976 - RNA, 32 nt, Human
accacuuaaaggcauucuuaagccacaaacaa

SEQ ID NO: 299977 - RNA, 32 nt, Human
accacuuaaugaagaagaaugaucagaaguuc

SEQ ID NO: 299978 - RNA, 32 nt, Human
accacuuaccucaaauuaagcauauguguuac

SEQ ID NO: 299979 - RNA, 32 nt, Human
accacuuauugcacuccagcccgggcgacaga

SEQ ID NO: 299980 - RNA, 32 nt, Human
accacuucaaagauuuuguugaaaguuuuagu

SEQ ID NO: 299981 - RNA, 32 nt, Human
accacuucauuccagccugggugacagagcaa

SEQ ID NO: 299982 - RNA, 32 nt, Human
accacuuccauucugagugcacuuuuauaggu

SEQ ID NO: 299983 - RNA, 32 nt, Human
accacuucccccgugugggguccagaguggug

SEQ ID NO: 299984 - RNA, 18 nt, Human
accacuugcccuaaggaa

SEQ ID NO: 299985 - RNA, 32 nt, Human
accacuugcucagugugccucucaccugccuc

SEQ ID NO: 299986 - RNA, 21 nt, Human
accacuuggagagacacagga

SEQ ID NO: 299987 - RNA, 32 nt, Human
accacuuggcuagacggaccagcuggaaagau

SEQ ID NO: 299988 - RNA, 32 nt, Human
accacuuggcuagaguucagagacaggaagug

SEQ ID NO: 299989 - RNA, 29 nt, Human
accacuuggcugcucauuccuucuggagg

SEQ ID NO: 299990 - RNA, 32 nt, Human
accacuuggcugucuggccucucaggugucag

SEQ ID NO: 299991 - RNA, 32 nt, Human
accacuuguaacuccagccugggcaacagagu

SEQ ID NO: 299992 - RNA, 32 nt, Human
accacuuucacaaucugcuagcaaagguuaug

SEQ ID NO: 299993 - RNA, 32 nt, Human
accacuuucauaccugccuacugaugcauaga

SEQ ID NO: 299994 - RNA, 32 nt, Human
accacuuucuucuucuuuuucuucucugggau

SEQ ID NO: 299995 - RNA, 32 nt, Human
accacuuucuuuccuucuuuugccuaauacag

SEQ ID NO: 299996 - RNA, 20 nt, Human
accacuuuugcaugcuguac

SEQ ID NO: 299997 - RNA, 32 nt, Human
accagaaaagaauucacuccagauagagcccc

SEQ ID NO: 299998 - RNA, 32 nt, Human
accagaaaccugccaagcccaggcuggggcca

SEQ ID NO: 299999 - RNA, 32 nt, Human
accagaaagaccaaaauuaaacuccuggaucu

SEQ ID NO: 300000 - RNA, 32 nt, Human
accagaaaggcuacuuccugcaccacaucauc

SEQ ID NO: 300001 - RNA, 17 nt, Human
accagaaauccaggugc

SEQ ID NO: 300002 - RNA, 32 nt, Human
accagaacaaacccagcuuuuguccacaaggu

SEQ ID NO: 300003 - RNA, 32 nt, Human
accagaaccagcagucuccugccuuguucccu

SEQ ID NO: 300004 - RNA, 21 nt, Human
accagaaccauuuggccuuaa

SEQ ID NO: 300005 - RNA, 32 nt, Human
accagaacccaucucaccacacugcuuuacag

SEQ ID NO: 300006 - RNA, 32 nt, Human
accagaaccucacaccucuccugggacuggaa

SEQ ID NO: 300007 - RNA, 32 nt, Human
accagaacuuguggcuugcugaagaugguaug

SEQ ID NO: 300008 - RNA, 32 nt, Human
accagaagaaaagacaacauuuuccggaaauc

SEQ ID NO: 300009 - RNA, 32 nt, Human
accagaagacacagcuagucugccauguaaaa

SEQ ID NO: 300010 - RNA, 32 nt, Human
accagaagagcaucacaucucacuuuguucgg

SEQ ID NO: 300011 - RNA, 32 nt, Human
accagaagccugacauguuuggaaguccuuuu

SEQ ID NO: 300012 - RNA, 32 nt, Human
accagaaggaugaucugcuccuuuguaacguu

SEQ ID NO: 300013 - RNA, 32 nt, Human
accagaagguggagguggcagugagccgagau

SEQ ID NO: 300014 - RNA, 32 nt, Human
accagaaguagugagagaaggaaggggauagg

SEQ ID NO: 300015 - RNA, 32 nt, Human
accagaaucugccauggcaacaggcuuuaaaa

SEQ ID NO: 300016 - RNA, 32 nt, Human
accagaaugaagaguauucgugcugcuuuuca

SEQ ID NO: 300017 - RNA, 32 nt, Human
accagaaugaucaacagagugagaccccuguc

SEQ ID NO: 300018 - RNA, 18 nt, Human
accagaauucacacggua

SEQ ID NO: 300019 - RNA, 32 nt, Human
accagaauugccuuagaagauaccagaaggug

SEQ ID NO: 300020 - RNA, 31 nt, Human
accagacaaguguccuaggagagugaacagg

SEQ ID NO: 300021 - RNA, 32 nt, Human
accagacacagcaacccaagggagcugcgcca

SEQ ID NO: 300022 - RNA, 32 nt, Human
accagacacagcuguuguucggggcuguggaa

SEQ ID NO: 300023 - RNA, 32 nt, Human
accagacacucuucuucucccaccucacucuc

SEQ ID NO: 300024 - RNA, 32 nt, Human
accagacagaugggggcugggcccacacaggc

SEQ ID NO: 300025 - RNA, 21 nt, Human
accagacaguaagguguuacu

SEQ ID NO: 300026 - RNA, 18 nt, Human
accagacaguuggccacu

SEQ ID NO: 300027 - RNA, 32 nt, Human
accagacaugaacaaaaguugaccucaugagc

SEQ ID NO: 300028 - RNA, 32 nt, Human
accagaccaagaaguauggaggccacagaggg

SEQ ID NO: 300029 - RNA, 32 nt, Human
accagaccaaggagaugaccuggagaacugca

SEQ ID NO: 300030 - RNA, 26 nt, Human
accagacccccugccagaagagccca

SEQ ID NO: 300031 - RNA, 32 nt, Human
accagacccucacggcccauauccaauucgaa

SEQ ID NO: 300032 - RNA, 32 nt, Human
accagacccugacccagauguuagggagacag

SEQ ID NO: 300033 - RNA, 32 nt, Human
accagaccuuguucauaacccugggccucuua

SEQ ID NO: 300034 - RNA, 32 nt, Human
accagacgcagcuggggaugagcccaaguucc

SEQ ID NO: 300035 - RNA, 32 nt, Human
accagacucaaaggaugucagccguagcccug

SEQ ID NO: 300036 - RNA, 32 nt, Human
accagacucagcccugagcagggaacagggcc

SEQ ID NO: 300037 - RNA, 32 nt, Human
accagacucuugcuuugagucuccgggaggau

SEQ ID NO: 300038 - RNA, 19 nt, Human
accagacugaccaacaugg

SEQ ID NO: 300039 - RNA, 24 nt, Human
accagacugaccaacauggagaaa

SEQ ID NO: 300040 - RNA, 32 nt, Human
accagacugagaugguaaguuaacugauaaaa

SEQ ID NO: 300041 - RNA, 32 nt, Human
accagacuggcaacauagugagacccugucuc

SEQ ID NO: 300042 - RNA, 24 nt, Human
accagacuggccaacacagcgaga

SEQ ID NO: 300043 - RNA, 24 nt, Human
accagacuggccaacauggagaaa

SEQ ID NO: 300044 - RNA, 32 nt, Human
accagacuggcgugggugagcuccacacccug

SEQ ID NO: 300045 - RNA, 32 nt, Human
accagacugggcaaauuauguguccaaaacuu

SEQ ID NO: 300046 - RNA, 32 nt, Human
accagacuugcuaauaaauaaccagagagaug

SEQ ID NO: 300047 - RNA, 32 nt, Human
accagacuugcugccaagggcuucugcaucca

SEQ ID NO: 300048 - RNA, 32 nt, Human
accagagaaagaugaagaggaggaguuagguc

SEQ ID NO: 300049 - RNA, 32 nt, Human
accagagaacccagccagagggguugugagua

SEQ ID NO: 300050 - RNA, 32 nt, Human
accagagaaguggaaggaagcaaaauggaggu

SEQ ID NO: 300051 - RNA, 23 nt, Human
accagagacagaacugguccauc

SEQ ID NO: 300052 - RNA, 32 nt, Human
accagagacgucuucugcagccaccugcuuuc

SEQ ID NO: 300053 - RNA, 32 nt, Human
accagagacucauguuuccaggggucagucug

SEQ ID NO: 300054 - RNA, 32 nt, Human
accagagagcccaaaggccugaagacaaaucu

SEQ ID NO: 300055 - RNA, 32 nt, Human
accagagagguggagguugcagugaaccgaga

SEQ ID NO: 300056 - RNA, 32 nt, Human
accagagaguggccugucuuuccuucaagcag

SEQ ID NO: 300057 - RNA, 32 nt, Human
accagagaugaaacuucgacuccaguucuggc

SEQ ID NO: 300058 - RNA, 32 nt, Human
accagagaugacugaaaccacucugaaauaau

SEQ ID NO: 300059 - RNA, 32 nt, Human
accagagauggcaucuguggauuucaagaccu

SEQ ID NO: 300060 - RNA, 32 nt, Human
accagagcacguuccuggcugcagaggccaca

SEQ ID NO: 300061 - RNA, 32 nt, Human
accagagcagaggcccagccagcccucugcag

SEQ ID NO: 300062 - RNA, 32 nt, Human
accagagccagauuaucuggucuuccaagacu

SEQ ID NO: 300063 - RNA, 32 nt, Human
accagagccuggagagagcucgguggggccaa

SEQ ID NO: 300064 - RNA, 32 nt, Human
accagagcgagaacccucaacugacaugaaau

SEQ ID NO: 300065 - RNA, 31 nt, Human
accagagcgguuuugccucagcugcucucaa

SEQ ID NO: 300066 - RNA, 32 nt, Human
accagagcucacugagccuccaccuggggucu

SEQ ID NO: 300067 - RNA, 32 nt, Human
accagagcugacuccauuucucaaucugccuu

SEQ ID NO: 300068 - RNA, 32 nt, Human
accagagcuguggagaggggacccuaagacuc

SEQ ID NO: 300069 - RNA, 32 nt, Human
accagagcuuugacaaaccuccugcuccuugg

SEQ ID NO: 300070 - RNA, 32 nt, Human
accagaggacuccugcccugccacacccugga

SEQ ID NO: 300071 - RNA, 32 nt, Human
accagaggagcgagacgagcaagaaccacacc

SEQ ID NO: 300072 - RNA, 32 nt, Human
accagaggaggaggaggacagagggagagaau

SEQ ID NO: 300073 - RNA, 32 nt, Human
accagaggaucagaguagcccacuccagacga

SEQ ID NO: 300074 - RNA, 32 nt, Human
accagaggccacuccagggugucaggacuaag

SEQ ID NO: 300075 - RNA, 32 nt, Human
accagaggcccaggcugcacacccauuucagc

SEQ ID NO: 300076 - RNA, 32 nt, Human
accagaggcccuccacugucacccuaaauaga

SEQ ID NO: 300077 - RNA, 32 nt, Human
accagaggccucuuuuccugaagaaauccaau

SEQ ID NO: 300078 - RNA, 32 nt, Human
accagaggcuucacacaagugaaaagcccuau

SEQ ID NO: 300079 - RNA, 32 nt, Human
accagagggaagcccaucucuccagcagaacu

SEQ ID NO: 300080 - RNA, 32 nt, Human
accagagggaggauuauccuugaccuuugaag

SEQ ID NO: 300081 - RNA, 25 nt, Human
accagagggcagcaagcuccuuuca

SEQ ID NO: 300082 - RNA, 32 nt, Human
accagaggggagcuuguucuucugcuguagug

SEQ ID NO: 300083 - RNA, 32 nt, Human
accagagguaggagaccuggauucaagugcca

SEQ ID NO: 300084 - RNA, 32 nt, Human
accagaggucaggaguuggagaccagccugcc

SEQ ID NO: 300085 - RNA, 32 nt, Human
accagagguggaggaagaacgguaggaaggcu

SEQ ID NO: 300086 - RNA, 32 nt, Human
accagaguacagaugagaacagcuuacaugaa

SEQ ID NO: 300087 - RNA, 32 nt, Human
accagaguaucuggauuacccaggaagguuga

SEQ ID NO: 300088 - RNA, 32 nt, Human
accagagucucagaacucauuaagaaacaguu

SEQ ID NO: 300089 - RNA, 32 nt, Human
accagagucucugaggaugaaguuuccuaccc

SEQ ID NO: 300090 - RNA, 32 nt, Human
accagagucugcaccucagacuuuaguaggaa

SEQ ID NO: 300091 - RNA, 32 nt, Human
accagagucuuggacacagacuucugaggugg

SEQ ID NO: 300092 - RNA, 32 nt, Human
accagagugaacagggcaggcagguaguaggc

SEQ ID NO: 300093 - RNA, 22 nt, Human
accagagugauguccucucuca

SEQ ID NO: 300094 - RNA, 32 nt, Human
accagagugcuagaagggaaugaaagggagag

SEQ ID NO: 300095 - RNA, 32 nt, Human
accagauaacauaccuuuccugcucuggugcu

SEQ ID NO: 300096 - RNA, 32 nt, Human
accagauacaguugucuuggaagccuguuauu

SEQ ID NO: 300097 - RNA, 32 nt, Human
accagauacaucugcuggagagcccagguggg

SEQ ID NO: 300098 - RNA, 32 nt, Human
accagaucaagcaauucuaucuauuuacacua

SEQ ID NO: 300099 - RNA, 32 nt, Human
accagaucaguuacauguauaucuugccucuc

SEQ ID NO: 300100 - RNA, 32 nt, Human
accagaucauuuccuaaaaucuccagucccaa

SEQ ID NO: 300101 - RNA, 32 nt, Human
accagaucccagaggcugaacaccucgaccuu

SEQ ID NO: 300102 - RNA, 23 nt, Human
accagauccucucagggaggaag

SEQ ID NO: 300103 - RNA, 32 nt, Human
accagauccuuaaauccugggcucugagcuag

SEQ ID NO: 300104 - RNA, 32 nt, Human
accagaucuccaagaacucacuaacacagaau

SEQ ID NO: 300105 - RNA, 22 nt, Human
accagaucucucuccaggaaag

SEQ ID NO: 300106 - RNA, 32 nt, Human
accagaucugggguaaagucaauguacacuuc

SEQ ID NO: 300107 - RNA, 32 nt, Human
accagaugaaaccucuccaggcaaguggcccc

SEQ ID NO: 300108 - RNA, 32 nt, Human
accagaugagcaggaagagauuccaaagagga

SEQ ID NO: 300109 - RNA, 32 nt, Human
accagaugcauccucagaggacgagucuacua

SEQ ID NO: 300110 - RNA, 32 nt, Human
accagauggaggcuuugauuugcucaaccuaa

SEQ ID NO: 300111 - RNA, 32 nt, Human
accagauggccagaagcugcccaucagcccug

SEQ ID NO: 300112 - RNA, 32 nt, Human
accagauggggaggggauguccaggcaggugc

SEQ ID NO: 300113 - RNA, 32 nt, Human
accagauggucugggaaaguucugugccucug

SEQ ID NO: 300114 - RNA, 25 nt, Human
accagaugucgcccuacucaccuga

SEQ ID NO: 300115 - RNA, 32 nt, Human
accagauguuggcugcuguacuuacucccuga

SEQ ID NO: 300116 - RNA, 32 nt, Human
accagauucagucuguggagguuugcauucac

SEQ ID NO: 300117 - RNA, 32 nt, Human
accagauucccaacucuucuggcuccugguua

SEQ ID NO: 300118 - RNA, 23 nt, Human
accagauugaaauccuagaaaua

SEQ ID NO: 300119 - RNA, 32 nt, Human
accagauugcucugccccaccuugccagggca

SEQ ID NO: 300120 - RNA, 23 nt, Human
accagauuguacccagauagcug

SEQ ID NO: 300121 - RNA, 32 nt, Human
accagauuuacuuguuucuguaauacaucacc

SEQ ID NO: 300122 - RNA, 32 nt, Human
accagcaagcaacccccagggcacgagaagag

SEQ ID NO: 300123 - RNA, 32 nt, Human
accagcaagucuugaagucucuucccaagcaa

SEQ ID NO: 300124 - RNA, 22 nt, Human
accagcaagugcuccagaguga

SEQ ID NO: 300125 - RNA, 24 nt, Human
accagcaaugucaucugugaggaa

SEQ ID NO: 300126 - RNA, 32 nt, Human
accagcacaauccugccucacuggccuuaccc

SEQ ID NO: 300127 - RNA, 32 nt, Human
accagcacaggaggggacggagaggagcugca

SEQ ID NO: 300128 - RNA, 32 nt, Human
accagcacaugggccgagacucuccccacggg

SEQ ID NO: 300129 - RNA, 32 nt, Human
accagcaccagccuggccaacacggugaaacc

SEQ ID NO: 300130 - RNA, 21 nt, Human
accagcacccagaccgaaccc

SEQ ID NO: 300131 - RNA, 32 nt, Human
accagcaccccacuccagccucgaggaagcuu

SEQ ID NO: 300132 - RNA, 21 nt, Human
accagcaccucccugacaccu

SEQ ID NO: 300133 - RNA, 32 nt, Human
accagcaccugaggccgggccgcaggccgacu

SEQ ID NO: 300134 - RNA, 32 nt, Human
accagcaccuggggcccugccagccugucgcc

SEQ ID NO: 300135 - RNA, 23 nt, Human
accagcacuccaucacugagagc

SEQ ID NO: 300136 - RNA, 19 nt, Human
accagcacugcucacugcg

SEQ ID NO: 300137 - RNA, 32 nt, Human
accagcagaaacauccucccacucucccaacc

SEQ ID NO: 300138 - RNA, 32 nt, Human
accagcagaacagcagcgcugaccaguaccug

SEQ ID NO: 300139 - RNA, 32 nt, Human
accagcagaaucagugccuagccugugcccag

SEQ ID NO: 300140 - RNA, 32 nt, Human
accagcagacccagaaguggugggugaaacac

SEQ ID NO: 300141 - RNA, 32 nt, Human
accagcagaggcagauccuggacuuggaccug

SEQ ID NO: 300142 - RNA, 32 nt, Human
accagcagcacaauucugucccugucccugcc

SEQ ID NO: 300143 - RNA, 32 nt, Human
accagcagcagaccagucacaaaaagagauga

SEQ ID NO: 300144 - RNA, 32 nt, Human
accagcagccaagaaggaaccacugugguauc

SEQ ID NO: 300145 - RNA, 32 nt, Human
accagcagcccauccaccccaguggcucacuu

SEQ ID NO: 300146 - RNA, 32 nt, Human
accagcagcccauggggccugaagggaaauga

SEQ ID NO: 300147 - RNA, 32 nt, Human
accagcagccucccccguugccccucuggauc

SEQ ID NO: 300148 - RNA, 20 nt, Human
accagcagcgcaucccggcg

SEQ ID NO: 300149 - RNA, 32 nt, Human
accagcagcuacuagggagaagucugcaagau

SEQ ID NO: 300150 - RNA, 32 nt, Human
accagcagcucggaauaguugcacugaaucua

SEQ ID NO: 300151 - RNA, 32 nt, Human
accagcaggaggaggaggagaagaaacuauuu

SEQ ID NO: 300152 - RNA, 32 nt, Human
accagcaggaugaaugcaagacugacagugau

SEQ ID NO: 300153 - RNA, 32 nt, Human
accagcaggcagaugaccagagagccugagcc

SEQ ID NO: 300154 - RNA, 32 nt, Human
accagcagggguugccgccagaccagagccag

SEQ ID NO: 300155 - RNA, 31 nt, Human
accagcaguggaagagaaaauacuguaagcu

SEQ ID NO: 300156 - RNA, 32 nt, Human
accagcaucccuccucuccccaaggugaagug

SEQ ID NO: 300157 - RNA, 32 nt, Human
accagcaucggccuggcccucacgguguccgc

SEQ ID NO: 300158 - RNA, 32 nt, Human
accagcaucuccacccuccgccccacuccagc

SEQ ID NO: 300159 - RNA, 32 nt, Human
accagcaucucccuccugagaugccggccucu

SEQ ID NO: 300160 - RNA, 32 nt, Human
accagcaucuguuugggaagauaaaagaaaaa

SEQ ID NO: 300161 - RNA, 32 nt, Human
accagcaugaacaccaagcuggggguggacag

SEQ ID NO: 300162 - RNA, 24 nt, Human
accagcaugaccaacauggagaaa

SEQ ID NO: 300163 - RNA, 24 nt, Human
accagcaugaccaacauggcgaaa

SEQ ID NO: 300164 - RNA, 24 nt, Human
accagcaugaccaacauggugaaa

SEQ ID NO: 300165 - RNA, 24 nt, Human
accagcauggccaacauagugaga

SEQ ID NO: 300166 - RNA, 24 nt, Human
accagcauggccaaccuggugaaa

SEQ ID NO: 300167 - RNA, 32 nt, Human
accagcaugguggaacccccaucucuacuaaa

SEQ ID NO: 300168 - RNA, 32 nt, Human
accagcauuaaaggguaauuacccacacggcu

SEQ ID NO: 300169 - RNA, 18 nt, Human
accagcauuaacauggua

SEQ ID NO: 300170 - RNA, 32 nt, Human
accagcauuacugcaccucuuguuagacucug

SEQ ID NO: 300171 - RNA, 19 nt, Human
accagcauucuugcugcug

SEQ ID NO: 300172 - RNA, 32 nt, Human
accagcauuugcaaauguccauagggagcagg

SEQ ID NO: 300173 - RNA, 32 nt, Human
accagccaagagccuucccuugaaguccccaa

SEQ ID NO: 300174 - RNA, 24 nt, Human
accagccaaggcaacauggugaaa

SEQ ID NO: 300175 - RNA, 32 nt, Human
accagccaauggcaaccaagaccaaagccagc

SEQ ID NO: 300176 - RNA, 32 nt, Human
accagccaccacaucaucccagagcugagcuc

SEQ ID NO: 300177 - RNA, 32 nt, Human
accagccaccccaucccuccccuacccaucug

SEQ ID NO: 300178 - RNA, 32 nt, Human
accagccacccgcaccuugccugcugccacua

SEQ ID NO: 300179 - RNA, 32 nt, Human
accagccaccucugcaaccugccaccuccugc

SEQ ID NO: 300180 - RNA, 32 nt, Human
accagccacuccugaugggguugcucacacug

SEQ ID NO: 300181 - RNA, 32 nt, Human
accagccacugcagcccuccagcucuggcccu

SEQ ID NO: 300182 - RNA, 21 nt, Human
accagccacugcaggcagcau

SEQ ID NO: 300183 - RNA, 32 nt, Human
accagccagaagcacggagcgcagggcaggac

SEQ ID NO: 300184 - RNA, 32 nt, Human
accagccagaagcaugcagugacauugcacaa

SEQ ID NO: 300185 - RNA, 24 nt, Human
accagccagaccaacaugaugaaa

SEQ ID NO: 300186 - RNA, 32 nt, Human
accagccagagcaacacagugagacccccauc

SEQ ID NO: 300187 - RNA, 32 nt, Human
accagccagccaugagcgccuuccugcagaac

SEQ ID NO: 300188 - RNA, 32 nt, Human
accagccagcugggugauugcucagcgugaag

SEQ ID NO: 300189 - RNA, 19 nt, Human
accagccaggacagggccu

SEQ ID NO: 300190 - RNA, 24 nt, Human
accagccaggccaacauggugaaa

SEQ ID NO: 300191 - RNA, 32 nt, Human
accagccagggaugugagcaugaguuuaggaa

SEQ ID NO: 300192 - RNA, 32 nt, Human
accagccagggcaacacagugagaccccuucu

SEQ ID NO: 300193 - RNA, 32 nt, Human
accagccagggcaacauaauaagacuuuucuc

SEQ ID NO: 300194 - RNA, 32 nt, Human
accagccagggcaacaugaugagacccugucu

SEQ ID NO: 300195 - RNA, 24 nt, Human
accagccagggcaacauggugaaa

SEQ ID NO: 300196 - RNA, 24 nt, Human
accagccagggcaacauggugaga

SEQ ID NO: 300197 - RNA, 32 nt, Human
accagccagggugccauccugcaggcccugag

SEQ ID NO: 300198 - RNA, 32 nt, Human
accagcccaagugccgucuuagccauucagug

SEQ ID NO: 300199 - RNA, 32 nt, Human
accagcccaccuuggcccuccggcaagcuaga

SEQ ID NO: 300200 - RNA, 19 nt, Human
accagcccagccaacaugg

SEQ ID NO: 300201 - RNA, 21 nt, Human
accagcccagccaacauggca

SEQ ID NO: 300202 - RNA, 24 nt, Human
accagcccagccaacauggcgaaa

SEQ ID NO: 300203 - RNA, 20 nt, Human
accagcccagccaacauggu

SEQ ID NO: 300204 - RNA, 21 nt, Human
accagcccagccaacauggug

SEQ ID NO: 300205 - RNA, 24 nt, Human
accagcccagccaacauggugaaa

SEQ ID NO: 300206 - RNA, 32 nt, Human
accagcccagccuggucaacauggcaaaaccc

SEQ ID NO: 300207 - RNA, 24 nt, Human
accagcccaggcaacauggugaaa

SEQ ID NO: 300208 - RNA, 32 nt, Human
accagcccaggcaauaguguugaggaggggag

SEQ ID NO: 300209 - RNA, 32 nt, Human
accagcccaggcccucaggaggaggagauacc

SEQ ID NO: 300210 - RNA, 32 nt, Human
accagcccagugcgcccugccgccgcgcuugg

SEQ ID NO: 300211 - RNA, 32 nt, Human
accagcccaguuucaaacuccugaccucaggu

SEQ ID NO: 300212 - RNA, 32 nt, Human
accagcccauaggugggaugucaagacccauc

SEQ ID NO: 300213 - RNA, 22 nt, Human
accagccccaauccaaaacugg

SEQ ID NO: 300214 - RNA, 32 nt, Human
accagccccacugucagcagcaccgagccggg

SEQ ID NO: 300215 - RNA, 32 nt, Human
accagccccacugucucuaaccacuccugggc

SEQ ID NO: 300216 - RNA, 32 nt, Human
accagccccaggcuccugugcugguugcacgc

SEQ ID NO: 300217 - RNA, 16 nt, Human
accagccccaguauca

SEQ ID NO: 300218 - RNA, 32 nt, Human
accagcccccggcagaggcugagguggcagug

SEQ ID NO: 300219 - RNA, 32 nt, Human
accagcccccuuucaccuccagugccacaaua

SEQ ID NO: 300220 - RNA, 32 nt, Human
accagccccucagauaccacuuggccacuccc

SEQ ID NO: 300221 - RNA, 32 nt, Human
accagccccuccacucuuuggccucuucgaca

SEQ ID NO: 300222 - RNA, 32 nt, Human
accagccccucuucugugccuugucugagguc

SEQ ID NO: 300223 - RNA, 32 nt, Human
accagccccugccaugcucucacccugcauau

SEQ ID NO: 300224 - RNA, 24 nt, Human
accagcccgcccaauauggugaaa

SEQ ID NO: 300225 - RNA, 32 nt, Human
accagcccgcgggccagcaccauggaggacgu

SEQ ID NO: 300226 - RNA, 32 nt, Human
accagcccggacaacauggcgaaaccucaucu

SEQ ID NO: 300227 - RNA, 21 nt, Human
accagcccggccaacauggug

SEQ ID NO: 300228 - RNA, 24 nt, Human
accagcccggccaacauggugaaa

SEQ ID NO: 300229 - RNA, 18 nt, Human
accagcccggcccauggu

SEQ ID NO: 300230 - RNA, 19 nt, Human
accagcccgggcaacaugg

SEQ ID NO: 300231 - RNA, 32 nt, Human
accagcccucagagaccugagcucuucuggcc

SEQ ID NO: 300232 - RNA, 22 nt, Human
accagcccucagcaugaggaaa

SEQ ID NO: 300233 - RNA, 32 nt, Human
accagcccuccagagcaggagacuggcaagag

SEQ ID NO: 300234 - RNA, 32 nt, Human
accagcccucccccaucuucuucuuccuccuc

SEQ ID NO: 300235 - RNA, 32 nt, Human
accagcccucgaucccagcccccggagaggac

SEQ ID NO: 300236 - RNA, 32 nt, Human
accagcccuggcaacauugugagacccaucuc

SEQ ID NO: 300237 - RNA, 32 nt, Human
accagcccuggugggcaugggguggggagcag

SEQ ID NO: 300238 - RNA, 32 nt, Human
accagcccuucuguggccucacucucugaaaa

SEQ ID NO: 300239 - RNA, 32 nt, Human
accagcccuugcccaugguggggaggacaucu

SEQ ID NO: 300240 - RNA, 32 nt, Human
accagcccuuguucuguucccuaccgguacca

SEQ ID NO: 300241 - RNA, 32 nt, Human
accagccggaaguuuucugucacuggacgcca

SEQ ID NO: 300242 - RNA, 21 nt, Human
accagccgggccaacauggug

SEQ ID NO: 300243 - RNA, 24 nt, Human
accagccgggccaacauggugaaa

SEQ ID NO: 300244 - RNA, 24 nt, Human
accagccgggccagcauggugaaa

SEQ ID NO: 300245 - RNA, 32 nt, Human
accagccguuuccugcgugcucugccguuggu

SEQ ID NO: 300246 - RNA, 24 nt, Human
accagccuaaacaacauagugaaa

SEQ ID NO: 300247 - RNA, 32 nt, Human
accagccuaaacaacauagugaaacccugucu

SEQ ID NO: 300248 - RNA, 19 nt, Human
accagccuaaccaacaugg

SEQ ID NO: 300249 - RNA, 24 nt, Human
accagccuaaccaacauggagaaa

SEQ ID NO: 300250 - RNA, 24 nt, Human
accagccuaaccaacauggcgaaa

SEQ ID NO: 300251 - RNA, 20 nt, Human
accagccuaaccaacguggu

SEQ ID NO: 300252 - RNA, 21 nt, Human
accagccuaaccaacguggua

SEQ ID NO: 300253 - RNA, 32 nt, Human
accagccuaagagaagcuaaagaagucuugaa

SEQ ID NO: 300254 - RNA, 24 nt, Human
accagccuacccaacauggugaaa

SEQ ID NO: 300255 - RNA, 32 nt, Human
accagccuagacaacauggugaaaccuugucu

SEQ ID NO: 300256 - RNA, 18 nt, Human
accagccuagccaacaug

SEQ ID NO: 300257 - RNA, 24 nt, Human
accagccuagccaacaugcugaaa

SEQ ID NO: 300258 - RNA, 19 nt, Human
accagccuagccaacaugg

SEQ ID NO: 300259 - RNA, 21 nt, Human
accagccuagccaacauggca

SEQ ID NO: 300260 - RNA, 21 nt, Human
accagccuagccaacauggug

SEQ ID NO: 300261 - RNA, 24 nt, Human
accagccuagccaacauggugaaa

SEQ ID NO: 300262 - RNA, 21 nt, Human
accagccuagccaacguggug

SEQ ID NO: 300263 - RNA, 24 nt, Human
accagccuagccaacguggugaaa

SEQ ID NO: 300264 - RNA, 21 nt, Human
accagccuagccaagauggug

SEQ ID NO: 300265 - RNA, 24 nt, Human
accagccuagccaagauggugaaa

SEQ ID NO: 300266 - RNA, 21 nt, Human
accagccuagccuacauggug

SEQ ID NO: 300267 - RNA, 24 nt, Human
accagccuagccuacauggugaaa

SEQ ID NO: 300268 - RNA, 20 nt, Human
accagccuagcuaacauggu

SEQ ID NO: 300269 - RNA, 21 nt, Human
accagccuagcuaacauggua

SEQ ID NO: 300270 - RNA, 32 nt, Human
accagccuagcuaacaugguaaaacucugucu

SEQ ID NO: 300271 - RNA, 21 nt, Human
accagccuaggcaacacagug

SEQ ID NO: 300272 - RNA, 24 nt, Human
accagccuaggcaacacagugaaa

SEQ ID NO: 300273 - RNA, 21 nt, Human
accagccuaggcaacauagca

SEQ ID NO: 300274 - RNA, 24 nt, Human
accagccuaggcaacauagugaga

SEQ ID NO: 300275 - RNA, 24 nt, Human
accagccuaggcaacauggagaaa

SEQ ID NO: 300276 - RNA, 24 nt, Human
accagccuaggcaacauggcgaaa

SEQ ID NO: 300277 - RNA, 24 nt, Human
accagccuaggcaacauggugaaa

SEQ ID NO: 300278 - RNA, 24 nt, Human
accagccuaggcagcauagugaga

SEQ ID NO: 300279 - RNA, 24 nt, Human
accagccuagguaacauagugaga

SEQ ID NO: 300280 - RNA, 32 nt, Human
accagccuagguaacauagugagacccccuau

SEQ ID NO: 300281 - RNA, 32 nt, Human
accagccuaggugacaaagugagaccccaucu

SEQ ID NO: 300282 - RNA, 32 nt, Human
accagccuaggugacagaaugagacccugucu

SEQ ID NO: 300283 - RNA, 24 nt, Human
accagccuaggugacauagugaga

SEQ ID NO: 300284 - RNA, 32 nt, Human
accagccuaggugacauagugagaccccaucu

SEQ ID NO: 300285 - RNA, 19 nt, Human
accagccuauccccaggua

SEQ ID NO: 300286 - RNA, 32 nt, Human
accagccucaaaccacaacgggggccagcugc

SEQ ID NO: 300287 - RNA, 32 nt, Human
accagccucaaauugugcaaccaugauguaua

SEQ ID NO: 300288 - RNA, 32 nt, Human
accagccucacagccacacgggggaagcagag

SEQ ID NO: 300289 - RNA, 32 nt, Human
accagccucacggagaaggcgcagucccuguc

SEQ ID NO: 300290 - RNA, 32 nt, Human
accagccucacuccccaucccaaccagagaug

SEQ ID NO: 300291 - RNA, 21 nt, Human
accagccucaucaacacagug

SEQ ID NO: 300292 - RNA, 24 nt, Human
accagccucaucaacacagugaaa

SEQ ID NO: 300293 - RNA, 24 nt, Human
accagccucaucaacauagugaga

SEQ ID NO: 300294 - RNA, 32 nt, Human
accagccucaucaacauagugagaccccaucu

SEQ ID NO: 300295 - RNA, 32 nt, Human
accagccuccagccuuuggcaggauggagcuu

SEQ ID NO: 300296 - RNA, 32 nt, Human
accagccucccugccaggugggccacagugac

SEQ ID NO: 300297 - RNA, 19 nt, Human
accagccuccggaacaggg

SEQ ID NO: 300298 - RNA, 32 nt, Human
accagccuccugaaagaaacaggugugucuuu

SEQ ID NO: 300299 - RNA, 24 nt, Human
accagccucgccaacauggcgaaa

SEQ ID NO: 300300 - RNA, 24 nt, Human
accagccucgccaacauggugaga

SEQ ID NO: 300301 - RNA, 32 nt, Human
accagccucgccaacauggugagacccugucu

SEQ ID NO: 300302 - RNA, 32 nt, Human
accagccucuugguuaggcagcugaggccuca

SEQ ID NO: 300303 - RNA, 24 nt, Human
accagccugaacaacauggugaaa

SEQ ID NO: 300304 - RNA, 24 nt, Human
accagccugacaaacauggagaaa

SEQ ID NO: 300305 - RNA, 19 nt, Human
accagccugaccaaaaugg

SEQ ID NO: 300306 - RNA, 24 nt, Human
accagccugaccaaaauggagaaa

SEQ ID NO: 300307 - RNA, 21 nt, Human
accagccugaccaaaauggug

SEQ ID NO: 300308 - RNA, 24 nt, Human
accagccugaccaaaauggugaaa

SEQ ID NO: 300309 - RNA, 20 nt, Human
accagccugaccaaacaugg

SEQ ID NO: 300310 - RNA, 24 nt, Human
accagccugaccaaacauggcgaa

SEQ ID NO: 300311 - RNA, 22 nt, Human
accagccugaccaacaacaugg

SEQ ID NO: 300312 - RNA, 27 nt, Human
accagccugaccaacaacauggagaaa

SEQ ID NO: 300313 - RNA, 18 nt, Human
accagccugaccaacacg

SEQ ID NO: 300314 - RNA, 24 nt, Human
accagccugaccaacacgaugaaa

SEQ ID NO: 300315 - RNA, 19 nt, Human
accagccugaccaacacgg

SEQ ID NO: 300316 - RNA, 24 nt, Human
accagccugaccaacacggagaaa

SEQ ID NO: 300317 - RNA, 21 nt, Human
accagccugaccaacacggug

SEQ ID NO: 300318 - RNA, 24 nt, Human
accagccugaccaacacggugaaa

SEQ ID NO: 300319 - RNA, 22 nt, Human
accagccugaccaacacugaga

SEQ ID NO: 300320 - RNA, 21 nt, Human
accagccugaccaacauagug

SEQ ID NO: 300321 - RNA, 24 nt, Human
accagccugaccaacauagugaaa

SEQ ID NO: 300322 - RNA, 21 nt, Human
accagccugaccaacaucgug

SEQ ID NO: 300323 - RNA, 24 nt, Human
accagccugaccaacaucgugaaa

SEQ ID NO: 300324 - RNA, 18 nt, Human
accagccugaccaacaug

SEQ ID NO: 300325 - RNA, 19 nt, Human
accagccugaccaacaugg

SEQ ID NO: 300326 - RNA, 24 nt, Human
accagccugaccaacauggagaaa

SEQ ID NO: 300327 - RNA, 24 nt, Human
accagccugaccaacauggagaag

SEQ ID NO: 300328 - RNA, 24 nt, Human
accagccugaccaacauggcgaaa

SEQ ID NO: 300329 - RNA, 22 nt, Human
accagccugaccaacaugggga

SEQ ID NO: 300330 - RNA, 21 nt, Human
accagccugaccaacauggua

SEQ ID NO: 300331 - RNA, 24 nt, Human
accagccugaccaacaugguagaa

SEQ ID NO: 300332 - RNA, 21 nt, Human
accagccugaccaacauggug

SEQ ID NO: 300333 - RNA, 24 nt, Human
accagccugaccaacauggugaaa

SEQ ID NO: 300334 - RNA, 23 nt, Human
accagccugaccaacauggugag

SEQ ID NO: 300335 - RNA, 24 nt, Human
accagccugaccaacauggugaga

SEQ ID NO: 300336 - RNA, 32 nt, Human
accagccugaccaacauggugagacccugucu

SEQ ID NO: 300337 - RNA, 19 nt, Human
accagccugaccaacgugg

SEQ ID NO: 300338 - RNA, 24 nt, Human
accagccugaccaacguggagaaa

SEQ ID NO: 300339 - RNA, 24 nt, Human
accagccugaccaacguggcgaaa

SEQ ID NO: 300340 - RNA, 21 nt, Human
accagccugaccaacguggug

SEQ ID NO: 300341 - RNA, 24 nt, Human
accagccugaccaacguggugaaa

SEQ ID NO: 300342 - RNA, 21 nt, Human
accagccugaccaagguggug

SEQ ID NO: 300343 - RNA, 24 nt, Human
accagccugaccaagguggugaaa

SEQ ID NO: 300344 - RNA, 21 nt, Human
accagccugaccaauauagug

SEQ ID NO: 300345 - RNA, 24 nt, Human
accagccugaccaauauagugaaa

SEQ ID NO: 300346 - RNA, 18 nt, Human
accagccugaccaauaug

SEQ ID NO: 300347 - RNA, 24 nt, Human
accagccugaccaauaugaugaaa

SEQ ID NO: 300348 - RNA, 19 nt, Human
accagccugaccaauaugg

SEQ ID NO: 300349 - RNA, 24 nt, Human
accagccugaccaauauggagaaa

SEQ ID NO: 300350 - RNA, 21 nt, Human
accagccugaccaauauggug

SEQ ID NO: 300351 - RNA, 24 nt, Human
accagccugaccaauauggugaaa

SEQ ID NO: 300352 - RNA, 19 nt, Human
accagccugaccaccaugg

SEQ ID NO: 300353 - RNA, 24 nt, Human
accagccugaccaccauggagaaa

SEQ ID NO: 300354 - RNA, 21 nt, Human
accagccugaccagcauggug

SEQ ID NO: 300355 - RNA, 24 nt, Human
accagccugaccagcaugguggaa

SEQ ID NO: 300356 - RNA, 19 nt, Human
accagccugaccagcgugg

SEQ ID NO: 300357 - RNA, 24 nt, Human
accagccugaccagcguggagaaa

SEQ ID NO: 300358 - RNA, 21 nt, Human
accagccugaccaucauggug

SEQ ID NO: 300359 - RNA, 24 nt, Human
accagccugaccaucauggugaaa

SEQ ID NO: 300360 - RNA, 19 nt, Human
accagccugacccacaugg

SEQ ID NO: 300361 - RNA, 24 nt, Human
accagccugacccacauggagaaa

SEQ ID NO: 300362 - RNA, 19 nt, Human
accagccugaccgacaugg

SEQ ID NO: 300363 - RNA, 24 nt, Human
accagccugaccgacauggagaaa

SEQ ID NO: 300364 - RNA, 24 nt, Human
accagccugacuaacaugcugaaa

SEQ ID NO: 300365 - RNA, 22 nt, Human
accagccugacugacauugaga

SEQ ID NO: 300366 - RNA, 24 nt, Human
accagccugagcaacauagcgaga

SEQ ID NO: 300367 - RNA, 24 nt, Human
accagccugagcaacauagugaga

SEQ ID NO: 300368 - RNA, 32 nt, Human
accagccugagcaacauagugagacccugucu

SEQ ID NO: 300369 - RNA, 24 nt, Human
accagccugagcaacaugaugaaa

SEQ ID NO: 300370 - RNA, 24 nt, Human
accagccugagcaacaugaugaga

SEQ ID NO: 300371 - RNA, 32 nt, Human
accagccugagcaacaugaugagaccccaucu

SEQ ID NO: 300372 - RNA, 24 nt, Human
accagccugagcaacauggcgaaa

SEQ ID NO: 300373 - RNA, 20 nt, Human
accagccugagcaacauggu

SEQ ID NO: 300374 - RNA, 21 nt, Human
accagccugagcaacauggua

SEQ ID NO: 300375 - RNA, 32 nt, Human
accagccugagcaaccuaaugagacccucccu

SEQ ID NO: 300376 - RNA, 32 nt, Human
accagccugaguaacaugaugagacccccauc

SEQ ID NO: 300377 - RNA, 19 nt, Human
accagccugagucgcggug

SEQ ID NO: 300378 - RNA, 24 nt, Human
accagccugaucaacauggugaaa

SEQ ID NO: 300379 - RNA, 24 nt, Human
accagccugaucaacguggugaaa

SEQ ID NO: 300380 - RNA, 32 nt, Human
accagccugcagcacaccccacagccaaguag

SEQ ID NO: 300381 - RNA, 23 nt, Human
accagccugccaacauggugaaa

SEQ ID NO: 300382 - RNA, 24 nt, Human
accagccugcccaacauagugaaa

SEQ ID NO: 300383 - RNA, 19 nt, Human
accagccugcccaacaugg

SEQ ID NO: 300384 - RNA, 24 nt, Human
accagccugcccaacauggugaaa

SEQ ID NO: 300385 - RNA, 32 nt, Human
accagccugccugacuucugcaaaccuacccu

SEQ ID NO: 300386 - RNA, 32 nt, Human
accagccugccuggucacugacugcuuacucu

SEQ ID NO: 300387 - RNA, 32 nt, Human
accagccugccuggucacugcugcuuacucua

SEQ ID NO: 300388 - RNA, 32 nt, Human
accagccuggacaacaaagcaagaccccaucu

SEQ ID NO: 300389 - RNA, 32 nt, Human
accagccuggacaacacagcagaccccgucuu

SEQ ID NO: 300390 - RNA, 21 nt, Human
accagccuggacaacacagug

SEQ ID NO: 300391 - RNA, 24 nt, Human
accagccuggacaacacagugaga

SEQ ID NO: 300392 - RNA, 32 nt, Human
accagccuggacaacacagugagaccucaucu

SEQ ID NO: 300393 - RNA, 32 nt, Human
accagccuggacaacagagcgagacucugugu

SEQ ID NO: 300394 - RNA, 24 nt, Human
accagccuggacaacauaaugaga

SEQ ID NO: 300395 - RNA, 32 nt, Human
accagccuggacaacauaaugagacccucguc

SEQ ID NO: 300396 - RNA, 32 nt, Human
accagccuggacaacauagcaagaccucaucu

SEQ ID NO: 300397 - RNA, 32 nt, Human
accagccuggacaacauaggaagauccaucuc

SEQ ID NO: 300398 - RNA, 32 nt, Human
accagccuggacaacauaggaagaucccaucu

SEQ ID NO: 300399 - RNA, 24 nt, Human
accagccuggacaacauagugaga

SEQ ID NO: 300400 - RNA, 32 nt, Human
accagccuggacaacauagugagacccccauc

SEQ ID NO: 300401 - RNA, 32 nt, Human
accagccuggacaacauagugagaccccgucu

SEQ ID NO: 300402 - RNA, 32 nt, Human
accagccuggacaacauagugagaccucgucu

SEQ ID NO: 300403 - RNA, 32 nt, Human
accagccuggacaacauagugagaccuugucu

SEQ ID NO: 300404 - RNA, 32 nt, Human
accagccuggacaacaucgugaaaccuugucu

SEQ ID NO: 300405 - RNA, 19 nt, Human
accagccuggacaacaugg

SEQ ID NO: 300406 - RNA, 32 nt, Human
accagccuggacaacauggcaaaacccugucu

SEQ ID NO: 300407 - RNA, 24 nt, Human
accagccuggacaacauggcaaga

SEQ ID NO: 300408 - RNA, 32 nt, Human
accagccuggacaacauggcaagacccauuuc

SEQ ID NO: 300409 - RNA, 23 nt, Human
accagccuggacaacaugggaaa

SEQ ID NO: 300410 - RNA, 32 nt, Human
accagccuggacaacaugggaaaacccugucu

SEQ ID NO: 300411 - RNA, 22 nt, Human
accagccuggacaacaugguga

SEQ ID NO: 300412 - RNA, 24 nt, Human
accagccuggacaacauggugaaa

SEQ ID NO: 300413 - RNA, 32 nt, Human
accagccuggacaacauggugaaaccccaucu

SEQ ID NO: 300414 - RNA, 32 nt, Human
accagccuggacaacauggugaaaccccgucu

SEQ ID NO: 300415 - RNA, 32 nt, Human
accagccuggacaacauggugaaaccccuucu

SEQ ID NO: 300416 - RNA, 32 nt, Human
accagccuggacaacauggugaaacccuaucu

SEQ ID NO: 300417 - RNA, 32 nt, Human
accagccuggacaacauggugaaacccuucuc

SEQ ID NO: 300418 - RNA, 32 nt, Human
accagccuggacaacauggugaacccgucucu

SEQ ID NO: 300419 - RNA, 24 nt, Human
accagccuggacaacauggugaga

SEQ ID NO: 300420 - RNA, 32 nt, Human
accagccuggacaacauggugagaccucgucu

SEQ ID NO: 300421 - RNA, 32 nt, Human
accagccuggacaacauugugaaaccuugucu

SEQ ID NO: 300422 - RNA, 24 nt, Human
accagccuggacaauauagugaaa

SEQ ID NO: 300423 - RNA, 32 nt, Human
accagccuggacaauauagugaaaccccgucu

SEQ ID NO: 300424 - RNA, 32 nt, Human
accagccuggacaaucuggcgaaaccccauuu

SEQ ID NO: 300425 - RNA, 32 nt, Human
accagccuggacagcuuagugagaucccgucu

SEQ ID NO: 300426 - RNA, 24 nt, Human
accagccuggacuacauggugaaa

SEQ ID NO: 300427 - RNA, 24 nt, Human
accagccuggaugacagagcgaaa

SEQ ID NO: 300428 - RNA, 24 nt, Human
accagccuggaugacauaaugaga

SEQ ID NO: 300429 - RNA, 32 nt, Human
accagccuggaugacauaaugagauucugucu

SEQ ID NO: 300430 - RNA, 19 nt, Human
accagccuggcaaacaugg

SEQ ID NO: 300431 - RNA, 24 nt, Human
accagccuggcaaacauggcgaaa

SEQ ID NO: 300432 - RNA, 23 nt, Human
accagccuggcaacauagugaga

SEQ ID NO: 300433 - RNA, 18 nt, Human
accagccuggcaacaugg

SEQ ID NO: 300434 - RNA, 23 nt, Human
accagccuggcaacauggcaaga

SEQ ID NO: 300435 - RNA, 21 nt, Human
accagccuggccaaaacagug

SEQ ID NO: 300436 - RNA, 24 nt, Human
accagccuggccaaaacagugaaa

SEQ ID NO: 300437 - RNA, 18 nt, Human
accagccuggccaaaaug

SEQ ID NO: 300438 - RNA, 24 nt, Human
accagccuggccaaaaugaugaaa

SEQ ID NO: 300439 - RNA, 21 nt, Human
accagccuggccaaaauggug

SEQ ID NO: 300440 - RNA, 24 nt, Human
accagccuggccaaaauggugaaa

SEQ ID NO: 300441 - RNA, 22 nt, Human
accagccuggccaaacauggug

SEQ ID NO: 300442 - RNA, 25 nt, Human
accagccuggccaaacauggugaaa

SEQ ID NO: 300443 - RNA, 20 nt, Human
accagccuggccaaauggug

SEQ ID NO: 300444 - RNA, 23 nt, Human
accagccuggccaaauggugaaa

SEQ ID NO: 300445 - RNA, 19 nt, Human
accagccuggccaacaagg

SEQ ID NO: 300446 - RNA, 24 nt, Human
accagccuggccaacaaggcgaaa

SEQ ID NO: 300447 - RNA, 21 nt, Human
accagccuggccaacaaggug

SEQ ID NO: 300448 - RNA, 24 nt, Human
accagccuggccaacaaggugaaa

SEQ ID NO: 300449 - RNA, 24 nt, Human
accagccuggccaacacaaugaaa

SEQ ID NO: 300450 - RNA, 20 nt, Human
accagccuggccaacacagu

SEQ ID NO: 300451 - RNA, 21 nt, Human
accagccuggccaacacagua

SEQ ID NO: 300452 - RNA, 21 nt, Human
accagccuggccaacacagug

SEQ ID NO: 300453 - RNA, 24 nt, Human
accagccuggccaacacagugaaa

SEQ ID NO: 300454 - RNA, 18 nt, Human
accagccuggccaacacg

SEQ ID NO: 300455 - RNA, 24 nt, Human
accagccuggccaacacgaugaaa

SEQ ID NO: 300456 - RNA, 19 nt, Human
accagccuggccaacacgg

SEQ ID NO: 300457 - RNA, 21 nt, Human
accagccuggccaacacggug

SEQ ID NO: 300458 - RNA, 24 nt, Human
accagccuggccaacacggugaaa

SEQ ID NO: 300459 - RNA, 24 nt, Human
accagccuggccaacacggugaga

SEQ ID NO: 300460 - RNA, 32 nt, Human
accagccuggccaacacggugagacccugucu

SEQ ID NO: 300461 - RNA, 21 nt, Human
accagccuggccaacacuggu

SEQ ID NO: 300462 - RNA, 21 nt, Human
accagccuggccaacagggug

SEQ ID NO: 300463 - RNA, 24 nt, Human
accagccuggccaacagggugaaa

SEQ ID NO: 300464 - RNA, 20 nt, Human
accagccuggccaacaggug

SEQ ID NO: 300465 - RNA, 23 nt, Human
accagccuggccaacaggugaaa

SEQ ID NO: 300466 - RNA, 24 nt, Human
accagccuggccaacauaaugaaa

SEQ ID NO: 300467 - RNA, 32 nt, Human
accagccuggccaacauaaugaaaccccaucu

SEQ ID NO: 300468 - RNA, 21 nt, Human
accagccuggccaacauagca

SEQ ID NO: 300469 - RNA, 24 nt, Human
accagccuggccaacauagcgaaa

SEQ ID NO: 300470 - RNA, 24 nt, Human
accagccuggccaacauagcgaga

SEQ ID NO: 300471 - RNA, 20 nt, Human
accagccuggccaacauagg

SEQ ID NO: 300472 - RNA, 24 nt, Human
accagccuggccaacauagggaaa

SEQ ID NO: 300473 - RNA, 21 nt, Human
accagccuggccaacauagug

SEQ ID NO: 300474 - RNA, 24 nt, Human
accagccuggccaacauagugaaa

SEQ ID NO: 300475 - RNA, 24 nt, Human
accagccuggccaacauauaguga

SEQ ID NO: 300476 - RNA, 18 nt, Human
accagccuggccaacaug

SEQ ID NO: 300477 - RNA, 24 nt, Human
accagccuggccaacaugacgaaa

SEQ ID NO: 300478 - RNA, 24 nt, Human
accagccuggccaacaugaugaaa

SEQ ID NO: 300479 - RNA, 24 nt, Human
accagccuggccaacaugaugaga

SEQ ID NO: 300480 - RNA, 32 nt, Human
accagccuggccaacaugaugagaccuccguc

SEQ ID NO: 300481 - RNA, 19 nt, Human
accagccuggccaacaugg

SEQ ID NO: 300482 - RNA, 24 nt, Human
accagccuggccaacauggagaaa

SEQ ID NO: 300483 - RNA, 24 nt, Human
accagccuggccaacauggcaaga

SEQ ID NO: 300484 - RNA, 23 nt, Human
accagccuggccaacauggcgaa

SEQ ID NO: 300485 - RNA, 24 nt, Human
accagccuggccaacauggcgaaa

SEQ ID NO: 300486 - RNA, 24 nt, Human
accagccuggccaacauggcgaga

SEQ ID NO: 300487 - RNA, 24 nt, Human
accagccuggccaacauggcggaa

SEQ ID NO: 300488 - RNA, 24 nt, Human
accagccuggccaacauggggaaa

SEQ ID NO: 300489 - RNA, 20 nt, Human
accagccuggccaacauggu

SEQ ID NO: 300490 - RNA, 21 nt, Human
accagccuggccaacauggua

SEQ ID NO: 300491 - RNA, 24 nt, Human
accagccuggccaacauggucaaa

SEQ ID NO: 300492 - RNA, 21 nt, Human
accagccuggccaacauggug

SEQ ID NO: 300493 - RNA, 22 nt, Human
accagccuggccaacaugguga

SEQ ID NO: 300494 - RNA, 23 nt, Human
accagccuggccaacauggugaa

SEQ ID NO: 300495 - RNA, 24 nt, Human
accagccuggccaacauggugaaa

SEQ ID NO: 300496 - RNA, 24 nt, Human
accagccuggccaacauggugaag

SEQ ID NO: 300497 - RNA, 23 nt, Human
accagccuggccaacauggugag

SEQ ID NO: 300498 - RNA, 24 nt, Human
accagccuggccaacauggugaga

SEQ ID NO: 300499 - RNA, 32 nt, Human
accagccuggccaacauggugagaccccaucu

SEQ ID NO: 300500 - RNA, 32 nt, Human
accagccuggccaacauggugagacccugucu

SEQ ID NO: 300501 - RNA, 24 nt, Human
accagccuggccaacaugguggaa

SEQ ID NO: 300502 - RNA, 24 nt, Human
accagccuggccaacaugguuaaa

SEQ ID NO: 300503 - RNA, 23 nt, Human
accagccuggccaacaugugaaa

SEQ ID NO: 300504 - RNA, 21 nt, Human
accagccuggccaacauugug

SEQ ID NO: 300505 - RNA, 24 nt, Human
accagccuggccaacauugugaaa

SEQ ID NO: 300506 - RNA, 25 nt, Human
accagccuggccaaccaacauggug

SEQ ID NO: 300507 - RNA, 28 nt, Human
accagccuggccaaccaacauggugaaa

SEQ ID NO: 300508 - RNA, 21 nt, Human
accagccuggccaaccuggug

SEQ ID NO: 300509 - RNA, 24 nt, Human
accagccuggccaaccuggugaaa

SEQ ID NO: 300510 - RNA, 19 nt, Human
accagccuggccaacgugg

SEQ ID NO: 300511 - RNA, 24 nt, Human
accagccuggccaacguggggaaa

SEQ ID NO: 300512 - RNA, 21 nt, Human
accagccuggccaacguggug

SEQ ID NO: 300513 - RNA, 24 nt, Human
accagccuggccaacguggugaaa

SEQ ID NO: 300514 - RNA, 32 nt, Human
accagccuggccaacguggugagacccugucu

SEQ ID NO: 300515 - RNA, 24 nt, Human
accagccuggccaacugccugaaa

SEQ ID NO: 300516 - RNA, 24 nt, Human
accagccuggccaacuugaugaaa

SEQ ID NO: 300517 - RNA, 19 nt, Human
accagccuggccaacuugg

SEQ ID NO: 300518 - RNA, 24 nt, Human
accagccuggccaacuuggagaaa

SEQ ID NO: 300519 - RNA, 21 nt, Human
accagccuggccaacuuggug

SEQ ID NO: 300520 - RNA, 24 nt, Human
accagccuggccaacuuggugaaa

SEQ ID NO: 300521 - RNA, 19 nt, Human
accagccuggccaagaugg

SEQ ID NO: 300522 - RNA, 24 nt, Human
accagccuggccaagauggcgaaa

SEQ ID NO: 300523 - RNA, 21 nt, Human
accagccuggccaagauggug

SEQ ID NO: 300524 - RNA, 24 nt, Human
accagccuggccaagauggugaaa

SEQ ID NO: 300525 - RNA, 24 nt, Human
accagccuggccaagaugguggaa

SEQ ID NO: 300526 - RNA, 19 nt, Human
accagccuggccaaggcgg

SEQ ID NO: 300527 - RNA, 21 nt, Human
accagccuggccaauaaggug

SEQ ID NO: 300528 - RNA, 24 nt, Human
accagccuggccaauaaggugaaa

SEQ ID NO: 300529 - RNA, 18 nt, Human
accagccuggccaauacg

SEQ ID NO: 300530 - RNA, 24 nt, Human
accagccuggccaauacgaugaaa

SEQ ID NO: 300531 - RNA, 19 nt, Human
accagccuggccaauacgg

SEQ ID NO: 300532 - RNA, 19 nt, Human
accagccuggccaauaugg

SEQ ID NO: 300533 - RNA, 20 nt, Human
accagccuggccaauauggu

SEQ ID NO: 300534 - RNA, 21 nt, Human
accagccuggccaauauggua

SEQ ID NO: 300535 - RNA, 21 nt, Human
accagccuggccaauauggug

SEQ ID NO: 300536 - RNA, 24 nt, Human
accagccuggccaauauggugaaa

SEQ ID NO: 300537 - RNA, 24 nt, Human
accagccuggccaauauggugaga

SEQ ID NO: 300538 - RNA, 32 nt, Human
accagccuggccaauauggugagaccccaucu

SEQ ID NO: 300539 - RNA, 21 nt, Human
accagccuggccaauguagug

SEQ ID NO: 300540 - RNA, 24 nt, Human
accagccuggccaauguagugaaa

SEQ ID NO: 300541 - RNA, 18 nt, Human
accagccuggccaaugug

SEQ ID NO: 300542 - RNA, 24 nt, Human
accagccuggccaaugugaugaaa

SEQ ID NO: 300543 - RNA, 21 nt, Human
accagccuggccaauguggug

SEQ ID NO: 300544 - RNA, 24 nt, Human
accagccuggccaauguggugaaa

SEQ ID NO: 300545 - RNA, 18 nt, Human
accagccuggccacaugg

SEQ ID NO: 300546 - RNA, 20 nt, Human
accagccuggccacauggug

SEQ ID NO: 300547 - RNA, 23 nt, Human
accagccuggccacauggugaaa

SEQ ID NO: 300548 - RNA, 21 nt, Human
accagccuggccaccauggug

SEQ ID NO: 300549 - RNA, 24 nt, Human
accagccuggccaccauggugaaa

SEQ ID NO: 300550 - RNA, 24 nt, Human
accagccuggccaccauggugaga

SEQ ID NO: 300551 - RNA, 32 nt, Human
accagccuggccaccauggugagaccccgucu

SEQ ID NO: 300552 - RNA, 24 nt, Human
accagccuggccaccuuagugaga

SEQ ID NO: 300553 - RNA, 18 nt, Human
accagccuggccagacgc

SEQ ID NO: 300554 - RNA, 21 nt, Human
accagccuggccagcauagug

SEQ ID NO: 300555 - RNA, 24 nt, Human
accagccuggccagcauagugaaa

SEQ ID NO: 300556 - RNA, 19 nt, Human
accagccuggccagcaugg

SEQ ID NO: 300557 - RNA, 24 nt, Human
accagccuggccagcauggcgaaa

SEQ ID NO: 300558 - RNA, 21 nt, Human
accagccuggccagcauggug

SEQ ID NO: 300559 - RNA, 24 nt, Human
accagccuggccagcauggugaaa

SEQ ID NO: 300560 - RNA, 32 nt, Human
accagccuggccagcauggugagaccccgucu

SEQ ID NO: 300561 - RNA, 21 nt, Human
accagccuggccaguauggug

SEQ ID NO: 300562 - RNA, 24 nt, Human
accagccuggccaguauggugaaa

SEQ ID NO: 300563 - RNA, 21 nt, Human
accagccuggccaucauggug

SEQ ID NO: 300564 - RNA, 24 nt, Human
accagccuggccaucauggugaaa

SEQ ID NO: 300565 - RNA, 24 nt, Human
accagccuggcccaaauggugaaa

SEQ ID NO: 300566 - RNA, 21 nt, Human
accagccuggcccacauggug

SEQ ID NO: 300567 - RNA, 24 nt, Human
accagccuggcccacauggugaaa

SEQ ID NO: 300568 - RNA, 20 nt, Human
accagccuggcccguauggu

SEQ ID NO: 300569 - RNA, 21 nt, Human
accagccuggcccguauggua

SEQ ID NO: 300570 - RNA, 19 nt, Human
accagccuggccgacaugg

SEQ ID NO: 300571 - RNA, 24 nt, Human
accagccuggccgacauggcgaaa

SEQ ID NO: 300572 - RNA, 21 nt, Human
accagccuggccgacauggug

SEQ ID NO: 300573 - RNA, 24 nt, Human
accagccuggccgacauggugaaa

SEQ ID NO: 300574 - RNA, 21 nt, Human
accagccuggccgggguggug

SEQ ID NO: 300575 - RNA, 24 nt, Human
accagccuggccgggguggugaaa

SEQ ID NO: 300576 - RNA, 24 nt, Human
accagccuggcgaacauagugaga

SEQ ID NO: 300577 - RNA, 21 nt, Human
accagccuggcuaacacagug

SEQ ID NO: 300578 - RNA, 24 nt, Human
accagccuggcuaacacagugaaa

SEQ ID NO: 300579 - RNA, 19 nt, Human
accagccuggcuaacaugg

SEQ ID NO: 300580 - RNA, 24 nt, Human
accagccuggcuaacauggugaaa

SEQ ID NO: 300581 - RNA, 24 nt, Human
accagccuggcuaauauggugaaa

SEQ ID NO: 300582 - RNA, 24 nt, Human
accagccuggcuagcauggcgaaa

SEQ ID NO: 300583 - RNA, 24 nt, Human
accagccuggcuuacauggugaaa

SEQ ID NO: 300584 - RNA, 24 nt, Human
accagccugggaaacauagcgaaa

SEQ ID NO: 300585 - RNA, 24 nt, Human
accagccugggaaacauagugaga

SEQ ID NO: 300586 - RNA, 19 nt, Human
accagccugggaaacaugg

SEQ ID NO: 300587 - RNA, 20 nt, Human
accagccugggaaacauggu

SEQ ID NO: 300588 - RNA, 21 nt, Human
accagccugggaaacauggua

SEQ ID NO: 300589 - RNA, 24 nt, Human
accagccugggaaauauagugaaa

SEQ ID NO: 300590 - RNA, 19 nt, Human
accagccugggaagcaugg

SEQ ID NO: 300591 - RNA, 21 nt, Human
accagccugggcaacaaagua

SEQ ID NO: 300592 - RNA, 32 nt, Human
accagccugggcaacaaagugagacccccauc

SEQ ID NO: 300593 - RNA, 22 nt, Human
accagccugggcaacaaugaga

SEQ ID NO: 300594 - RNA, 20 nt, Human
accagccugggcaacacagc

SEQ ID NO: 300595 - RNA, 32 nt, Human
accagccugggcaacacagcaagacucugucu

SEQ ID NO: 300596 - RNA, 24 nt, Human
accagccugggcaacacagcgaga

SEQ ID NO: 300597 - RNA, 20 nt, Human
accagccugggcaacacagg

SEQ ID NO: 300598 - RNA, 21 nt, Human
accagccugggcaacacagua

SEQ ID NO: 300599 - RNA, 21 nt, Human
accagccugggcaacacagug

SEQ ID NO: 300600 - RNA, 22 nt, Human
accagccugggcaacacaguga

SEQ ID NO: 300601 - RNA, 24 nt, Human
accagccugggcaacacagugaga

SEQ ID NO: 300602 - RNA, 21 nt, Human
accagccugggcaacacggug

SEQ ID NO: 300603 - RNA, 24 nt, Human
accagccugggcaacacggugaaa

SEQ ID NO: 300604 - RNA, 21 nt, Human
accagccugggcaacagggua

SEQ ID NO: 300605 - RNA, 18 nt, Human
accagccugggcaacaua

SEQ ID NO: 300606 - RNA, 32 nt, Human
accagccugggcaacauaagaaggcccccgga

SEQ ID NO: 300607 - RNA, 32 nt, Human
accagccugggcaacauaauaagaccucaugu

SEQ ID NO: 300608 - RNA, 24 nt, Human
accagccugggcaacauaaugaga

SEQ ID NO: 300609 - RNA, 32 nt, Human
accagccugggcaacauaaugagacccuguuu

SEQ ID NO: 300610 - RNA, 32 nt, Human
accagccugggcaacauaaugagaccucaugu

SEQ ID NO: 300611 - RNA, 20 nt, Human
accagccugggcaacauagc

SEQ ID NO: 300612 - RNA, 32 nt, Human
accagccugggcaacauagcaagacucugucu

SEQ ID NO: 300613 - RNA, 22 nt, Human
accagccugggcaacauagcga

SEQ ID NO: 300614 - RNA, 24 nt, Human
accagccugggcaacauagcgaga

SEQ ID NO: 300615 - RNA, 20 nt, Human
accagccugggcaacauagu

SEQ ID NO: 300616 - RNA, 21 nt, Human
accagccugggcaacauagua

SEQ ID NO: 300617 - RNA, 22 nt, Human
accagccugggcaacauaguga

SEQ ID NO: 300618 - RNA, 24 nt, Human
accagccugggcaacauagugaaa

SEQ ID NO: 300619 - RNA, 24 nt, Human
accagccugggcaacauagugaga

SEQ ID NO: 300620 - RNA, 32 nt, Human
accagccugggcaacauagugagacccaaucu

SEQ ID NO: 300621 - RNA, 32 nt, Human
accagccugggcaacauagugagaccccaucu

SEQ ID NO: 300622 - RNA, 32 nt, Human
accagccugggcaacauagugagacccccauc

SEQ ID NO: 300623 - RNA, 32 nt, Human
accagccugggcaacauagugagacccugccu

SEQ ID NO: 300624 - RNA, 32 nt, Human
accagccugggcaacauagugagacccuguau

SEQ ID NO: 300625 - RNA, 32 nt, Human
accagccugggcaacaugacaaaacugcaacu

SEQ ID NO: 300626 - RNA, 19 nt, Human
accagccugggcaacaugg

SEQ ID NO: 300627 - RNA, 24 nt, Human
accagccugggcaacauggagaaa

SEQ ID NO: 300628 - RNA, 24 nt, Human
accagccugggcaacauggcaaga

SEQ ID NO: 300629 - RNA, 24 nt, Human
accagccugggcaacauggcgaaa

SEQ ID NO: 300630 - RNA, 24 nt, Human
accagccugggcaacauggcgaga

SEQ ID NO: 300631 - RNA, 24 nt, Human
accagccugggcaacauggggaaa

SEQ ID NO: 300632 - RNA, 20 nt, Human
accagccugggcaacauggu

SEQ ID NO: 300633 - RNA, 21 nt, Human
accagccugggcaacauggua

SEQ ID NO: 300634 - RNA, 22 nt, Human
accagccugggcaacaugguga

SEQ ID NO: 300635 - RNA, 24 nt, Human
accagccugggcaacauggugaaa

SEQ ID NO: 300636 - RNA, 24 nt, Human
accagccugggcaacauggugaag

SEQ ID NO: 300637 - RNA, 24 nt, Human
accagccugggcaacauggugaga

SEQ ID NO: 300638 - RNA, 32 nt, Human
accagccugggcaacauggugagaccccaucu

SEQ ID NO: 300639 - RNA, 32 nt, Human
accagccugggcaacauggugagaccccgucu

SEQ ID NO: 300640 - RNA, 32 nt, Human
accagccugggcaaccuaaugagaguuccucc

SEQ ID NO: 300641 - RNA, 22 nt, Human
accagccugggcaacguggcga

SEQ ID NO: 300642 - RNA, 24 nt, Human
accagccugggcaacguggcgaaa

SEQ ID NO: 300643 - RNA, 24 nt, Human
accagccugggcaacguggugaaa

SEQ ID NO: 300644 - RNA, 32 nt, Human
accagccugggcaacgugguggugugcaccug

SEQ ID NO: 300645 - RNA, 24 nt, Human
accagccugggcaagauggugaaa

SEQ ID NO: 300646 - RNA, 32 nt, Human
accagccugggcaauagagugagacccugucu

SEQ ID NO: 300647 - RNA, 32 nt, Human
accagccugggcaauauagugagaccccaucu

SEQ ID NO: 300648 - RNA, 32 nt, Human
accagccugggcaauaucgugagaccccaucu

SEQ ID NO: 300649 - RNA, 22 nt, Human
accagccugggcaccaugguga

SEQ ID NO: 300650 - RNA, 24 nt, Human
accagccugggcaccauggugaaa

SEQ ID NO: 300651 - RNA, 24 nt, Human
accagccugggcaccauggugaga

SEQ ID NO: 300652 - RNA, 32 nt, Human
accagccugggcaccauggugagaccccaucu

SEQ ID NO: 300653 - RNA, 23 nt, Human
accagccugggcagcagcaagaa

SEQ ID NO: 300654 - RNA, 32 nt, Human
accagccugggcagcaucgugagacccccguu

SEQ ID NO: 300655 - RNA, 18 nt, Human
accagccugggcagcaug

SEQ ID NO: 300656 - RNA, 24 nt, Human
accagccugggcagcauggugaaa

SEQ ID NO: 300657 - RNA, 18 nt, Human
accagccugggccacacg

SEQ ID NO: 300658 - RNA, 21 nt, Human
accagccugggcgacacggug

SEQ ID NO: 300659 - RNA, 24 nt, Human
accagccugggcgacacggugaaa

SEQ ID NO: 300660 - RNA, 32 nt, Human
accagccugggcuacagagcaagaccucaucu

SEQ ID NO: 300661 - RNA, 24 nt, Human
accagccugggcuacauagugaga

SEQ ID NO: 300662 - RNA, 24 nt, Human
accagccuggggaacauaaugaga

SEQ ID NO: 300663 - RNA, 24 nt, Human
accagccuggggaacauagugaga

SEQ ID NO: 300664 - RNA, 32 nt, Human
accagccuggggaacauagugagacccuuucu

SEQ ID NO: 300665 - RNA, 32 nt, Human
accagccuggguaacaaagugagacccccauc

SEQ ID NO: 300666 - RNA, 18 nt, Human
accagccuggguaacacg

SEQ ID NO: 300667 - RNA, 32 nt, Human
accagccuggguaacauagcaagacucugucg

SEQ ID NO: 300668 - RNA, 24 nt, Human
accagccuggguaacauagugaga

SEQ ID NO: 300669 - RNA, 32 nt, Human
accagccuggguaacauagugagacccuaucu

SEQ ID NO: 300670 - RNA, 19 nt, Human
accagccuggguaacaugg

SEQ ID NO: 300671 - RNA, 24 nt, Human
accagccuggguaacauggugaaa

SEQ ID NO: 300672 - RNA, 32 nt, Human
accagccugggugacacagcaagaccccaucu

SEQ ID NO: 300673 - RNA, 32 nt, Human
accagccugggugacagagcaagacucuuauc

SEQ ID NO: 300674 - RNA, 28 nt, Human
accagccugggugacagagcgagacucc

SEQ ID NO: 300675 - RNA, 32 nt, Human
accagccugggugacagagggagacccugucu

SEQ ID NO: 300676 - RNA, 32 nt, Human
accagccugggugacagugugagacccagccu

SEQ ID NO: 300677 - RNA, 20 nt, Human
accagccugggugcccggug

SEQ ID NO: 300678 - RNA, 23 nt, Human
accagccugguaaaauagugaga

SEQ ID NO: 300679 - RNA, 23 nt, Human
accagccugguaacauggugaaa

SEQ ID NO: 300680 - RNA, 19 nt, Human
accagccuggucaacaugg

SEQ ID NO: 300681 - RNA, 24 nt, Human
accagccuggucaacauggcgaaa

SEQ ID NO: 300682 - RNA, 20 nt, Human
accagccuggucaacauggu

SEQ ID NO: 300683 - RNA, 21 nt, Human
accagccuggucaacauggua

SEQ ID NO: 300684 - RNA, 24 nt, Human
accagccuggucaacauggugaaa

SEQ ID NO: 300685 - RNA, 20 nt, Human
accagccuggucaacuuggu

SEQ ID NO: 300686 - RNA, 24 nt, Human
accagccuggucaagauggugaaa

SEQ ID NO: 300687 - RNA, 24 nt, Human
accagccuggucaauauggugaaa

SEQ ID NO: 300688 - RNA, 24 nt, Human
accagccuggugaacauggcgaaa

SEQ ID NO: 300689 - RNA, 24 nt, Human
accagccugguuaacauggugaaa

SEQ ID NO: 300690 - RNA, 23 nt, Human
accagccugguuucauaccgaaa

SEQ ID NO: 300691 - RNA, 24 nt, Human
accagccuguccaacauggugaaa

SEQ ID NO: 300692 - RNA, 32 nt, Human
accagccuguggaguucaggaggcgagacauc

SEQ ID NO: 300693 - RNA, 24 nt, Human
accagccuguucaacauggcgaaa

SEQ ID NO: 300694 - RNA, 32 nt, Human
accagccuguucugcuacuggugaauggcaag

SEQ ID NO: 300695 - RNA, 24 nt, Human
accagccuuaccaacauggagaaa

SEQ ID NO: 300696 - RNA, 24 nt, Human
accagccuucccaacauggugaaa

SEQ ID NO: 300697 - RNA, 24 nt, Human
accagccuugacaacauggugaaa

SEQ ID NO: 300698 - RNA, 32 nt, Human
accagccuugacaacauggugaaaccccaucu

SEQ ID NO: 300699 - RNA, 32 nt, Human
accagccuugcagccaggugcaguggcucaca

SEQ ID NO: 300700 - RNA, 21 nt, Human
accagccuugccaacacagug

SEQ ID NO: 300701 - RNA, 24 nt, Human
accagccuugccaacacagugaaa

SEQ ID NO: 300702 - RNA, 24 nt, Human
accagccuugccaacauagugaaa

SEQ ID NO: 300703 - RNA, 24 nt, Human
accagccuugccaacauggugaaa

SEQ ID NO: 300704 - RNA, 24 nt, Human
accagccuuggcaacauggugaaa

SEQ ID NO: 300705 - RNA, 25 nt, Human
accagccuuggccaacauggcgaaa

SEQ ID NO: 300706 - RNA, 32 nt, Human
accagccuugggcacagcuccacccaucaccc

SEQ ID NO: 300707 - RNA, 24 nt, Human
accagccuugggcuacuaccgagg

SEQ ID NO: 300708 - RNA, 32 nt, Human
accagcgacucugcccuguggcugcuuugcac

SEQ ID NO: 300709 - RNA, 32 nt, Human
accagcgccccagccccgaggcucagaagcgg

SEQ ID NO: 300710 - RNA, 32 nt, Human
accagcggccagagccucagugacugccaccc

SEQ ID NO: 300711 - RNA, 32 nt, Human
accagcggccccgccugugcccucucugcccg

SEQ ID NO: 300712 - RNA, 32 nt, Human
accagcggcccugcuugcuccguagcugggaa

SEQ ID NO: 300713 - RNA, 32 nt, Human
accagcggcuaugcagguggucugagcucggc

SEQ ID NO: 300714 - RNA, 32 nt, Human
accagcgggccucauccuacacccucaccacc

SEQ ID NO: 300715 - RNA, 32 nt, Human
accagcggggugcuugccauucugugauaaua

SEQ ID NO: 300716 - RNA, 32 nt, Human
accagcggucagaaucagucagccucugucau

SEQ ID NO: 300717 - RNA, 32 nt, Human
accagcguaccugagcagauguguagucucuc

SEQ ID NO: 300718 - RNA, 32 nt, Human
accagcgucgcagcagcaaggaggcuuguguc

SEQ ID NO: 300719 - RNA, 32 nt, Human
accagcgucgguggaggaagggguauaagcua

SEQ ID NO: 300720 - RNA, 24 nt, Human
accagcgugagggcauccccugga

SEQ ID NO: 300721 - RNA, 32 nt, Human
accagcgugagugagcugggccagcagcaggg

SEQ ID NO: 300722 - RNA, 32 nt, Human
accagcgugcaggaggacaagacgggcggcaa

SEQ ID NO: 300723 - RNA, 24 nt, Human
accagcguggccaacaugaugaaa

SEQ ID NO: 300724 - RNA, 24 nt, Human
accagcguggcuaacacggugaaa

SEQ ID NO: 300725 - RNA, 32 nt, Human
accagcguuacugcaccaugccaugccugagg

SEQ ID NO: 300726 - RNA, 32 nt, Human
accagcuacaaugaguaaucuaaugucugcag

SEQ ID NO: 300727 - RNA, 32 nt, Human
accagcuaccuaccaccucccaccuccacccc

SEQ ID NO: 300728 - RNA, 18 nt, Human
accagcuagccccuucca

SEQ ID NO: 300729 - RNA, 32 nt, Human
accagcucaaagauuccaugaguuucaucgag

SEQ ID NO: 300730 - RNA, 32 nt, Human
accagcucaaaugccaccuccaguaccagcuu

SEQ ID NO: 300731 - RNA, 32 nt, Human
accagcucacugcagccuugaccuccugggcu

SEQ ID NO: 300732 - RNA, 32 nt, Human
accagcucagccacagcagagccaaucacaga

SEQ ID NO: 300733 - RNA, 20 nt, Human
accagcucaggcuacugcca

SEQ ID NO: 300734 - RNA, 32 nt, Human
accagcucauguuuggaaaaggaaucuuccac

SEQ ID NO: 300735 - RNA, 16 nt, Human
accagcuccaggugcu

SEQ ID NO: 300736 - RNA, 23 nt, Human
accagcuccccagaggccugcca

SEQ ID NO: 300737 - RNA, 32 nt, Human
accagcuccggcuccauuguucccgcccgggc

SEQ ID NO: 300738 - RNA, 32 nt, Human
accagcuccuccagucaugcucuugucccuca

SEQ ID NO: 300739 - RNA, 32 nt, Human
accagcuccugccucacaauggccucgucugg

SEQ ID NO: 300740 - RNA, 32 nt, Human
accagcuccugcucagaacucucuucaggcag

SEQ ID NO: 300741 - RNA, 32 nt, Human
accagcuccuggucaggagacugagcugucau

SEQ ID NO: 300742 - RNA, 32 nt, Human
accagcucgaucucuaaucugcuucaguucau

SEQ ID NO: 300743 - RNA, 32 nt, Human
accagcucgcauggcugcugggcauggccauu

SEQ ID NO: 300744 - RNA, 32 nt, Human
accagcucgcccucccccuacccggggccgca

SEQ ID NO: 300745 - RNA, 32 nt, Human
accagcucggucaggggcugcuuggcgcggca

SEQ ID NO: 300746 - RNA, 32 nt, Human
accagcucucagagaaaugcuggguaucccug

SEQ ID NO: 300747 - RNA, 32 nt, Human
accagcucucuguucugcucugugcccaacug

SEQ ID NO: 300748 - RNA, 32 nt, Human
accagcucugcagccagccuauggcaauuaua

SEQ ID NO: 300749 - RNA, 32 nt, Human
accagcucugcuaagaugcuccuggccccucc

SEQ ID NO: 300750 - RNA, 32 nt, Human
accagcucugcugacacuuugaucucaagcuc

SEQ ID NO: 300751 - RNA, 20 nt, Human
accagcucuggcuucugcuc

SEQ ID NO: 300752 - RNA, 32 nt, Human
accagcucuggggaaagcuacugugaacuagg

SEQ ID NO: 300753 - RNA, 32 nt, Human
accagcucuuucucucaccccaccagcuacag

SEQ ID NO: 300754 - RNA, 20 nt, Human
accagcugaaaacagcagca

SEQ ID NO: 300755 - RNA, 32 nt, Human
accagcugaaggccugguggggccaagggagg

SEQ ID NO: 300756 - RNA, 23 nt, Human
accagcugaccuagaagcagcau

SEQ ID NO: 300757 - RNA, 32 nt, Human
accagcugaggcagaggcugcaagggguggag

SEQ ID NO: 300758 - RNA, 32 nt, Human
accagcugagggagcuuguacaacaccuuaug

SEQ ID NO: 300759 - RNA, 32 nt, Human
accagcugcacugguuucguggaaggaagcuc

SEQ ID NO: 300760 - RNA, 31 nt, Human
accagcugccucuuugcugcuuuguuuuccu

SEQ ID NO: 300761 - RNA, 32 nt, Human
accagcugccuguccaguuggccuauggaagg

SEQ ID NO: 300762 - RNA, 32 nt, Human
accagcugcgcgcggagcggugcaaugcagca

SEQ ID NO: 300763 - RNA, 32 nt, Human
accagcuggacgccaugcuggacuggcccucc

SEQ ID NO: 300764 - RNA, 23 nt, Human
accagcuggccaacaugguggaa

SEQ ID NO: 300765 - RNA, 32 nt, Human
accagcugggagaggugugggucagucauggg

SEQ ID NO: 300766 - RNA, 32 nt, Human
accagcugggaggacugguugugcugcuggag

SEQ ID NO: 300767 - RNA, 32 nt, Human
accagcugggauuacagguaugagccaccgca

SEQ ID NO: 300768 - RNA, 23 nt, Human
accagcugggcaacauggugaaa

SEQ ID NO: 300769 - RNA, 32 nt, Human
accagcugggcaacauggugaaaccccaucuc

SEQ ID NO: 300770 - RNA, 32 nt, Human
accagcugggcaacauggugaaacccugucuc

SEQ ID NO: 300771 - RNA, 22 nt, Human
accagcugggccccaccacggc

SEQ ID NO: 300772 - RNA, 19 nt, Human
accagcugggccccugcgc

SEQ ID NO: 300773 - RNA, 19 nt, Human
accagcugggcgcgcagca

SEQ ID NO: 300774 - RNA, 32 nt, Human
accagcuggggagcuagagggagcaggcccaa

SEQ ID NO: 300775 - RNA, 23 nt, Human
accagcuggguccagcuagcagc

SEQ ID NO: 300776 - RNA, 19 nt, Human
accagcugggucggucuca

SEQ ID NO: 300777 - RNA, 32 nt, Human
accagcuguaaucccagcuacuugggaggcug

SEQ ID NO: 300778 - RNA, 32 nt, Human
accagcugucucaguggaggaguguuugccua

SEQ ID NO: 300779 - RNA, 32 nt, Human
accagcugugcuucaguuucucucacuuugcc

SEQ ID NO: 300780 - RNA, 32 nt, Human
accagcuguguaguacagacagggcucaccga

SEQ ID NO: 300781 - RNA, 32 nt, Human
accagcugugugaccuugggcaagacauuucc

SEQ ID NO: 300782 - RNA, 32 nt, Human
accagcuuacugggugcccaugcugaugucua

SEQ ID NO: 300783 - RNA, 21 nt, Human
accagcuuagccaacauagua

SEQ ID NO: 300784 - RNA, 24 nt, Human
accagcuuaggcaacacggugaaa

SEQ ID NO: 300785 - RNA, 21 nt, Human
accagcuuaggcaacauagca

SEQ ID NO: 300786 - RNA, 32 nt, Human
accagcuucaaggagcggaaggcuggcuugag

SEQ ID NO: 300787 - RNA, 32 nt, Human
accagcuuccagggcggcuuggaguccggggg

SEQ ID NO: 300788 - RNA, 32 nt, Human
accagcuucccaaagggaucuacucaccauug

SEQ ID NO: 300789 - RNA, 32 nt, Human
accagcuucccugaugucugcagccauggcuu

SEQ ID NO: 300790 - RNA, 32 nt, Human
accagcuucucacuccaguuucaaguggcuau

SEQ ID NO: 300791 - RNA, 32 nt, Human
accagcuucuggaccuggagagaggaugaaag

SEQ ID NO: 300792 - RNA, 24 nt, Human
accagcuugaccaacauggagaaa

SEQ ID NO: 300793 - RNA, 24 nt, Human
accagcuugaccaacauggugaaa

SEQ ID NO: 300794 - RNA, 24 nt, Human
accagcuuggccaacauagugaaa

SEQ ID NO: 300795 - RNA, 24 nt, Human
accagcuuggccaacauggagaaa

SEQ ID NO: 300796 - RNA, 24 nt, Human
accagcuuggccaacauggcgaaa

SEQ ID NO: 300797 - RNA, 23 nt, Human
accagcuuggccaacaugggaaa

SEQ ID NO: 300798 - RNA, 24 nt, Human
accagcuuggccaacauggugaaa

SEQ ID NO: 300799 - RNA, 24 nt, Human
accagcuuggccaacauggugaag

SEQ ID NO: 300800 - RNA, 24 nt, Human
accagcuuggccaagauggugaaa

SEQ ID NO: 300801 - RNA, 32 nt, Human
accagcuuggccaaggugauaaaacccgucuc

SEQ ID NO: 300802 - RNA, 24 nt, Human
accagcuuggccaauauagugaaa

SEQ ID NO: 300803 - RNA, 32 nt, Human
accagcuugggcaacauaagaagaccgugucu

SEQ ID NO: 300804 - RNA, 32 nt, Human
accagcuugggcaacauagugagacccugucu

SEQ ID NO: 300805 - RNA, 32 nt, Human
accagcuugguggggaaaggguuugaugaaua

SEQ ID NO: 300806 - RNA, 24 nt, Human
accagcuugugcaacauggugaaa

SEQ ID NO: 300807 - RNA, 32 nt, Human
accagcuugugucucugggagggcgcugcuuu

SEQ ID NO: 300808 - RNA, 32 nt, Human
accagcuuugcagugacagcuugaguggguuc

SEQ ID NO: 300809 - RNA, 32 nt, Human
accagcuuuucaaugaaaaaugagcuauccug

SEQ ID NO: 300810 - RNA, 32 nt, Human
accagcuuuuggcugugaagaccugagcaggg

SEQ ID NO: 300811 - RNA, 32 nt, Human
accaggaaaauguugguuuucaauccauguua

SEQ ID NO: 300812 - RNA, 32 nt, Human
accaggaaacaggcacacggggacagaggcgc

SEQ ID NO: 300813 - RNA, 32 nt, Human
accaggaaacuacagauugagauuagggggug

SEQ ID NO: 300814 - RNA, 32 nt, Human
accaggaaagaggaccccugcauuuuaucuuc

SEQ ID NO: 300815 - RNA, 32 nt, Human
accaggaaaggaagaaaggcagcuucacuucc

SEQ ID NO: 300816 - RNA, 32 nt, Human
accaggaaaugagauaggaggacuggaugagg

SEQ ID NO: 300817 - RNA, 31 nt, Human
accaggaacaacacacaucugggacaggagg

SEQ ID NO: 300818 - RNA, 32 nt, Human
accaggaacauguaacuuggagagggacgaag

SEQ ID NO: 300819 - RNA, 32 nt, Human
accaggaaccaauuucagguucuauaaauuuc

SEQ ID NO: 300820 - RNA, 32 nt, Human
accaggaacccggcgacugaggugcuuccagg

SEQ ID NO: 300821 - RNA, 19 nt, Human
accaggaacgcaggugcug

SEQ ID NO: 300822 - RNA, 32 nt, Human
accaggaagcaacccagcagugucagagagga

SEQ ID NO: 300823 - RNA, 32 nt, Human
accaggaagcaauucaucaccauccaaggccu

SEQ ID NO: 300824 - RNA, 32 nt, Human
accaggaagcagcuugaacuggauggagacuu

SEQ ID NO: 300825 - RNA, 32 nt, Human
accaggaagcagggccucaccggaugccaaac

SEQ ID NO: 300826 - RNA, 19 nt, Human
accaggaaggaauggaaaa

SEQ ID NO: 300827 - RNA, 32 nt, Human
accaggaaggcagagauugcagugagcugaga

SEQ ID NO: 300828 - RNA, 32 nt, Human
accaggaaggcagagguugcacugagcugaga

SEQ ID NO: 300829 - RNA, 32 nt, Human
accaggaaucuuuccuuccagcaucccuuuac

SEQ ID NO: 300830 - RNA, 32 nt, Human
accaggaaugagaccugcuccuucacuugggc

SEQ ID NO: 300831 - RNA, 32 nt, Human
accaggaauucaagaccagccugggcaacaca

SEQ ID NO: 300832 - RNA, 32 nt, Human
accaggacaaauccguugagaaagcacugugu

SEQ ID NO: 300833 - RNA, 32 nt, Human
accaggacaagcugcccuuccugucuccaccu

SEQ ID NO: 300834 - RNA, 32 nt, Human
accaggacaauauacaaguaaugcuggacaca

SEQ ID NO: 300835 - RNA, 32 nt, Human
accaggacacaaaaauccucuucaaaacuacu

SEQ ID NO: 300836 - RNA, 21 nt, Human
accaggacacccacgccucac

SEQ ID NO: 300837 - RNA, 32 nt, Human
accaggacacuacccugagaucugcacaguca

SEQ ID NO: 300838 - RNA, 32 nt, Human
accaggacaguuggaggggguaggccgagguu

SEQ ID NO: 300839 - RNA, 21 nt, Human
accaggaccaaagagccuuaa

SEQ ID NO: 300840 - RNA, 32 nt, Human
accaggaccacugcauuuaccagccugauacu

SEQ ID NO: 300841 - RNA, 32 nt, Human
accaggacccagaggguggagcucuucuuacc

SEQ ID NO: 300842 - RNA, 32 nt, Human
accaggacccagggagaggcugugucccugcu

SEQ ID NO: 300843 - RNA, 32 nt, Human
accaggaccuguggugagaagguuggggaaag

SEQ ID NO: 300844 - RNA, 32 nt, Human
accaggacucaucucccuuccuucucaggggg

SEQ ID NO: 300845 - RNA, 32 nt, Human
accaggacuccugcuuggagcuggccuuagaa

SEQ ID NO: 300846 - RNA, 32 nt, Human
accaggacugcugcugggcacugagcugccgc

SEQ ID NO: 300847 - RNA, 19 nt, Human
accaggacugugccugaac

SEQ ID NO: 300848 - RNA, 32 nt, Human
accaggagacggagguugcagugagcugaaau

SEQ ID NO: 300849 - RNA, 20 nt, Human
accaggagagguccaggugc

SEQ ID NO: 300850 - RNA, 32 nt, Human
accaggagaggugggggagggaaagugggcca

SEQ ID NO: 300851 - RNA, 32 nt, Human
accaggagcagggagaggccuggaacgguucu

SEQ ID NO: 300852 - RNA, 32 nt, Human
accaggagcaggggcauggagcacagugaggg

SEQ ID NO: 300853 - RNA, 19 nt, Human
accaggagcccccaaggag

SEQ ID NO: 300854 - RNA, 21 nt, Human
accaggagcccccaaggaguu

SEQ ID NO: 300855 - RNA, 18 nt, Human
accaggagcccggugcua

SEQ ID NO: 300856 - RNA, 32 nt, Human
accaggagcccuuggggcuccucugccuaugg

SEQ ID NO: 300857 - RNA, 32 nt, Human
accaggagcucagcugcaggaggcaggauggu

SEQ ID NO: 300858 - RNA, 32 nt, Human
accaggagcugauggcagcuggggcuagggga

SEQ ID NO: 300859 - RNA, 32 nt, Human
accaggaggaacagccugcagcucacuccaug

SEQ ID NO: 300860 - RNA, 31 nt, Human
accaggaggaaccugacucagaugcugaggu

SEQ ID NO: 300861 - RNA, 20 nt, Human
accaggaggacuggaugcug

SEQ ID NO: 300862 - RNA, 32 nt, Human
accaggaggaggaggaggaggaggaggagagc

SEQ ID NO: 300863 - RNA, 32 nt, Human
accaggaggaggcgugcucaaguaucgguacg

SEQ ID NO: 300864 - RNA, 32 nt, Human
accaggaggccccuggagcccagaucugucau

SEQ ID NO: 300865 - RNA, 32 nt, Human
accaggagggacugcugugcucucccuucucg

SEQ ID NO: 300866 - RNA, 32 nt, Human
accaggaggggcccaggagcugggugacgagg

SEQ ID NO: 300867 - RNA, 22 nt, Human
accaggaggggcccccaccuga

SEQ ID NO: 300868 - RNA, 32 nt, Human
accaggagggggcaaugggcccagccuuucug

SEQ ID NO: 300869 - RNA, 32 nt, Human
accaggaggguuugguuagcucacaggacuuc

SEQ ID NO: 300870 - RNA, 32 nt, Human
accaggagguugaggcugcagugagccgugau

SEQ ID NO: 300871 - RNA, 32 nt, Human
accaggaguaccuggaccuguccaugccccug

SEQ ID NO: 300872 - RNA, 32 nt, Human
accaggagucuggagugcaauggcacgaucuc

SEQ ID NO: 300873 - RNA, 32 nt, Human
accaggaguguggcaagccucccuggaagcag

SEQ ID NO: 300874 - RNA, 32 nt, Human
accaggaguuugagaccagccuaggcaacaua

SEQ ID NO: 300875 - RNA, 32 nt, Human
accaggaguuugaggcuucagugagcucuaau

SEQ ID NO: 300876 - RNA, 32 nt, Human
accaggaucccaagccuccugcugccacaaug

SEQ ID NO: 300877 - RNA, 32 nt, Human
accaggaucuaguuucuuucucucuacucugg

SEQ ID NO: 300878 - RNA, 32 nt, Human
accaggaugacaccuccauuucucuccaggaa

SEQ ID NO: 300879 - RNA, 32 nt, Human
accaggaugagagaggagagaggaauccacag

SEQ ID NO: 300880 - RNA, 32 nt, Human
accaggaugaggaagagaagaaaugaggagcc

SEQ ID NO: 300881 - RNA, 31 nt, Human
accaggaugaggucagagagugcacuggggu

SEQ ID NO: 300882 - RNA, 32 nt, Human
accaggaugcucugggacaccuuguccacguc

SEQ ID NO: 300883 - RNA, 32 nt, Human
accaggauggcagagagccagggcagagagag

SEQ ID NO: 300884 - RNA, 32 nt, Human
accaggauuuuucaaagaauucuugcugguga

SEQ ID NO: 300885 - RNA, 32 nt, Human
accaggcaacacagcaggaggugagcagccag

SEQ ID NO: 300886 - RNA, 32 nt, Human
accaggcaacauaacaagacccccaucucuac

SEQ ID NO: 300887 - RNA, 32 nt, Human
accaggcaaccucccaucccacccccgacccu

SEQ ID NO: 300888 - RNA, 32 nt, Human
accaggcaauagacaggagagaggugagaacu

SEQ ID NO: 300889 - RNA, 32 nt, Human
accaggcaccaggcuccugggcucuggggguu

SEQ ID NO: 300890 - RNA, 32 nt, Human
accaggcaccgcuguugagcagccugguggua

SEQ ID NO: 300891 - RNA, 32 nt, Human
accaggcacuauauuucaucuuugaggcuuuu

SEQ ID NO: 300892 - RNA, 32 nt, Human
accaggcacuguccuaagccauuuacaagcuu

SEQ ID NO: 300893 - RNA, 22 nt, Human
accaggcagagcugggccuuaa

SEQ ID NO: 300894 - RNA, 32 nt, Human
accaggcagaggaaucuggagcugucauuuua

SEQ ID NO: 300895 - RNA, 32 nt, Human
accaggcagagugggagccuaggucaggcccc

SEQ ID NO: 300896 - RNA, 32 nt, Human
accaggcagccauggccacugccuuccucucu

SEQ ID NO: 300897 - RNA, 22 nt, Human
accaggcagguuccuuccccca

SEQ ID NO: 300898 - RNA, 32 nt, Human
accaggcaugggggagcuggaggcagggacua

SEQ ID NO: 300899 - RNA, 32 nt, Human
accaggccaaagauuccacugugguccugaga

SEQ ID NO: 300900 - RNA, 32 nt, Human
accaggccaaagcggagcggagcgggggugag

SEQ ID NO: 300901 - RNA, 32 nt, Human
accaggccaacuagaacacccaacaccaaacu

SEQ ID NO: 300902 - RNA, 21 nt, Human
accaggccaccacccaccuga

SEQ ID NO: 300903 - RNA, 32 nt, Human
accaggccaccuggccaggccuucuaccuggg

SEQ ID NO: 300904 - RNA, 17 nt, Human
accaggccagaagaggu

SEQ ID NO: 300905 - RNA, 32 nt, Human
accaggccagagcaaacagaaaaagaagguug

SEQ ID NO: 300906 - RNA, 32 nt, Human
accaggccaggcuuccccuccuaccuggacuc

SEQ ID NO: 300907 - RNA, 32 nt, Human
accaggccaucagaggagaacccggccguuaa

SEQ ID NO: 300908 - RNA, 32 nt, Human
accaggcccacccucgucucugccugggugag

SEQ ID NO: 300909 - RNA, 25 nt, Human
accaggcccagagccaggggacagg

SEQ ID NO: 300910 - RNA, 32 nt, Human
accaggcccagccaaccagcauuucuuaaggu

SEQ ID NO: 300911 - RNA, 32 nt, Human
accaggcccagcugcagccacccggccucagg

SEQ ID NO: 300912 - RNA, 32 nt, Human
accaggcccagugcccucaaaugccucccuca

SEQ ID NO: 300913 - RNA, 22 nt, Human
accaggccccacccacaaggua

SEQ ID NO: 300914 - RNA, 22 nt, Human
accaggccccauacucccucca

SEQ ID NO: 300915 - RNA, 32 nt, Human
accaggcccuagucucggucagggagucugcu

SEQ ID NO: 300916 - RNA, 32 nt, Human
accaggcccugccauuggccucuugucccuug

SEQ ID NO: 300917 - RNA, 32 nt, Human
accaggcccugccccaucuccucugccaucuu

SEQ ID NO: 300918 - RNA, 32 nt, Human
accaggcccugccuaggcccugccgcagaacc

SEQ ID NO: 300919 - RNA, 32 nt, Human
accaggcccuugucugugcccuguccacaccc

SEQ ID NO: 300920 - RNA, 21 nt, Human
accaggccucauuucaccuga

SEQ ID NO: 300921 - RNA, 32 nt, Human
accaggccucuuuguuggcuuccuuuccuccu

SEQ ID NO: 300922 - RNA, 32 nt, Human
accaggccugcagggacccuccgaggauguag

SEQ ID NO: 300923 - RNA, 32 nt, Human
accaggccuggaaaagaaccagaaggaggcug

SEQ ID NO: 300924 - RNA, 32 nt, Human
accaggccuucauccuccuccccagcucuucu

SEQ ID NO: 300925 - RNA, 23 nt, Human
accaggccuuccugcucgacuga

SEQ ID NO: 300926 - RNA, 21 nt, Human
accaggccuuuccuggaggaa

SEQ ID NO: 300927 - RNA, 32 nt, Human
accaggcgaagagagaaauuaaagauuugagg

SEQ ID NO: 300928 - RNA, 32 nt, Human
accaggcgagcuccucuuucucucagagcugc

SEQ ID NO: 300929 - RNA, 31 nt, Human
accaggcgugguggcgggcacuuguaauccc

SEQ ID NO: 300930 - RNA, 32 nt, Human
accaggcuacuucuccccuccucuugccuccc

SEQ ID NO: 300931 - RNA, 26 nt, Human
accaggcucagagcucuccucuauca

SEQ ID NO: 300932 - RNA, 32 nt, Human
accaggcucccaggggauggggcagguggcug

SEQ ID NO: 300933 - RNA, 23 nt, Human
accaggcuccccugcaucccugg

SEQ ID NO: 300934 - RNA, 23 nt, Human
accaggcucccugcuccuccuga

SEQ ID NO: 300935 - RNA, 32 nt, Human
accaggcucucccggcugggcacugcguggcc

SEQ ID NO: 300936 - RNA, 32 nt, Human
accaggcugcagagcuaugaugcuucgggagc

SEQ ID NO: 300937 - RNA, 32 nt, Human
accaggcugcagccuccacuucccucguaguu

SEQ ID NO: 300938 - RNA, 32 nt, Human
accaggcugccaucagcacccacucaccaccc

SEQ ID NO: 300939 - RNA, 32 nt, Human
accaggcugccuggcaguuacugagugcuuau

SEQ ID NO: 300940 - RNA, 32 nt, Human
accaggcuggaaagggaccaggaaguuugaaa

SEQ ID NO: 300941 - RNA, 24 nt, Human
accaggcuggacaacauggugaaa

SEQ ID NO: 300942 - RNA, 32 nt, Human
accaggcuggagugcacuggcgcaaucucggc

SEQ ID NO: 300943 - RNA, 19 nt, Human
accaggcuggagugcagug

SEQ ID NO: 300944 - RNA, 21 nt, Human
accaggcuggccaacacggug

SEQ ID NO: 300945 - RNA, 24 nt, Human
accaggcuggccaacacggugaaa

SEQ ID NO: 300946 - RNA, 20 nt, Human
accaggcuggccaacauggu

SEQ ID NO: 300947 - RNA, 21 nt, Human
accaggcuggccaacauggua

SEQ ID NO: 300948 - RNA, 24 nt, Human
accaggcuggccaacauggugaaa

SEQ ID NO: 300949 - RNA, 24 nt, Human
accaggcuggccagcauggugaaa

SEQ ID NO: 300950 - RNA, 32 nt, Human
accaggcuggccuagacccagggaugagaaug

SEQ ID NO: 300951 - RNA, 20 nt, Human
accaggcugggcaacauagc

SEQ ID NO: 300952 - RNA, 18 nt, Human
accaggcugggugcaaug

SEQ ID NO: 300953 - RNA, 24 nt, Human
accaggcuggucaacauggcgaaa

SEQ ID NO: 300954 - RNA, 32 nt, Human
accaggcuggucuugaacugaccucaggugau

SEQ ID NO: 300955 - RNA, 32 nt, Human
accaggcugguuucgaacuccugggcuuaagu

SEQ ID NO: 300956 - RNA, 32 nt, Human
accaggcuguggaguguggccccuccugcggg

SEQ ID NO: 300957 - RNA, 32 nt, Human
accaggcuugcaaaugaacuucagacggaccu

SEQ ID NO: 300958 - RNA, 24 nt, Human
accaggcuuuccugcuccaccuga

SEQ ID NO: 300959 - RNA, 20 nt, Human
accaggcuuuccuugacccc

SEQ ID NO: 300960 - RNA, 15 nt, Human
accagggaaaggugu

SEQ ID NO: 300961 - RNA, 32 nt, Human
accagggaaccagccaaauacugugcagccgc

SEQ ID NO: 300962 - RNA, 32 nt, Human
accagggaagcggagguugcagugagccgagu

SEQ ID NO: 300963 - RNA, 20 nt, Human
accagggaaggaggcagcua

SEQ ID NO: 300964 - RNA, 18 nt, Human
accagggaagucuggugc

SEQ ID NO: 300965 - RNA, 32 nt, Human
accagggacauccugaguuugguggcuacuuc

SEQ ID NO: 300966 - RNA, 32 nt, Human
accagggaccuuuagaucuucagucuaacgcu

SEQ ID NO: 300967 - RNA, 24 nt, Human
accagggacuugccccagggcagc

SEQ ID NO: 300968 - RNA, 32 nt, Human
accagggagaaagugauccuugcucccugcag

SEQ ID NO: 300969 - RNA, 32 nt, Human
accagggagaaugaccauagggcacuaaguaa

SEQ ID NO: 300970 - RNA, 19 nt, Human
accagggagagagugacua

SEQ ID NO: 300971 - RNA, 20 nt, Human
accagggagaggagguacug

SEQ ID NO: 300972 - RNA, 32 nt, Human
accagggagcaguugcccucaggccugugccc

SEQ ID NO: 300973 - RNA, 32 nt, Human
accagggagcuuggaaaacaauaaacaucugu

SEQ ID NO: 300974 - RNA, 32 nt, Human
accagggaggaggagcuugcagugagccgaga

SEQ ID NO: 300975 - RNA, 32 nt, Human
accagggaggcagagauugcagugagccgaga

SEQ ID NO: 300976 - RNA, 32 nt, Human
accagggaggcagaggcugcggugagccgaga

SEQ ID NO: 300977 - RNA, 32 nt, Human
accagggaggcagagguugcagugagcccaga

SEQ ID NO: 300978 - RNA, 32 nt, Human
accagggaggcagagguugcagugagccgaga

SEQ ID NO: 300979 - RNA, 32 nt, Human
accagggaggcagagguuguggugagccgaga

SEQ ID NO: 300980 - RNA, 32 nt, Human
accagggaggcagaguuugcagugaauggaga

SEQ ID NO: 300981 - RNA, 32 nt, Human
accagggaggcggagguugcagcaagccaaga

SEQ ID NO: 300982 - RNA, 32 nt, Human
accagggaggcggagguugcagugagccgagg

SEQ ID NO: 300983 - RNA, 32 nt, Human
accagggaggcggagguugcugcaaagcaugg

SEQ ID NO: 300984 - RNA, 32 nt, Human
accagggagggagcuuguggggcaggucugga

SEQ ID NO: 300985 - RNA, 32 nt, Human
accagggaggggagggaggacugcaugacgcg

SEQ ID NO: 300986 - RNA, 32 nt, Human
accagggagguagagguugcagugagcugaga

SEQ ID NO: 300987 - RNA, 32 nt, Human
accagggagguggagguugcagugagccaaga

SEQ ID NO: 300988 - RNA, 32 nt, Human
accagggagguggagguugcagugagccgaga

SEQ ID NO: 300989 - RNA, 32 nt, Human
accagggagguggagguugcagugagcugaga

SEQ ID NO: 300990 - RNA, 32 nt, Human
accagggagucagagguuucagugagccaaga

SEQ ID NO: 300991 - RNA, 32 nt, Human
accagggagucggagauugcagugagcugaga

SEQ ID NO: 300992 - RNA, 22 nt, Human
accagggagugccuccucuuca

SEQ ID NO: 300993 - RNA, 32 nt, Human
accagggauccagagacauagaggaaguaggg

SEQ ID NO: 300994 - RNA, 32 nt, Human
accagggaugcugagguugcacgagcugagau

SEQ ID NO: 300995 - RNA, 19 nt, Human
accagggauguagaagcua

SEQ ID NO: 300996 - RNA, 18 nt, Human
accagggauugagugcug

SEQ ID NO: 300997 - RNA, 32 nt, Human
accagggcaggcagaggucuuccugccuuuac

SEQ ID NO: 300998 - RNA, 32 nt, Human
accagggcaugcaacagggcugggacaggaag

SEQ ID NO: 300999 - RNA, 32 nt, Human
accagggccaaagugcugguguggagcagaug

SEQ ID NO: 301000 - RNA, 32 nt, Human
accagggccagagacgggaccaggaaggaacu

SEQ ID NO: 301001 - RNA, 32 nt, Human
accagggccugggaagagggucgcucuccggc

SEQ ID NO: 301002 - RNA, 32 nt, Human
accagggcucacugcagccuugaccucccagg

SEQ ID NO: 301003 - RNA, 32 nt, Human
accagggcugucuucagaugucagggucccug

SEQ ID NO: 301004 - RNA, 32 nt, Human
accaggggaaguugacaacuuguugguaguua

SEQ ID NO: 301005 - RNA, 18 nt, Human
accaggggacaaaugcug

SEQ ID NO: 301006 - RNA, 32 nt, Human
accagggggagcaaacccugccccugcccgcc

SEQ ID NO: 301007 - RNA, 32 nt, Human
accagggggagcugucugcggagccagcgccu

SEQ ID NO: 301008 - RNA, 32 nt, Human
accagggggcagaguugcacuuuuccaggcuu

SEQ ID NO: 301009 - RNA, 32 nt, Human
accaggggugacuaaggacagagcaggugaua

SEQ ID NO: 301010 - RNA, 22 nt, Human
accaggguaggacagggugcua

SEQ ID NO: 301011 - RNA, 32 nt, Human
accaggguaguccuggccagcauggugaaacc

SEQ ID NO: 301012 - RNA, 32 nt, Human
accaggguagugauaugugcagccggguaauu

SEQ ID NO: 301013 - RNA, 22 nt, Human
accagggucaucugcacuugau

SEQ ID NO: 301014 - RNA, 17 nt, Human
accagggucccaggugu

SEQ ID NO: 301015 - RNA, 32 nt, Human
accagggucuguccuucgugucccaagugugu

SEQ ID NO: 301016 - RNA, 24 nt, Human
accaggguugccgcugcccagagc

SEQ ID NO: 301017 - RNA, 19 nt, Human
accagguaaccaaucgcca

SEQ ID NO: 301018 - RNA, 32 nt, Human
accagguaaggauucaagacucaauguggaaa

SEQ ID NO: 301019 - RNA, 32 nt, Human
accagguaccgccuagccacacugcacugugg

SEQ ID NO: 301020 - RNA, 32 nt, Human
accagguaccucuguuggaaaugcagaaauca

SEQ ID NO: 301021 - RNA, 32 nt, Human
accagguagagccugugcagccugggcugcug

SEQ ID NO: 301022 - RNA, 32 nt, Human
accagguagccgccugccugcccugcucugcg

SEQ ID NO: 301023 - RNA, 32 nt, Human
accagguagggaggcuguugaagaaagccaag

SEQ ID NO: 301024 - RNA, 32 nt, Human
accaggucaagcaagaugccaugucaccccug

SEQ ID NO: 301025 - RNA, 32 nt, Human
accaggucacccagcuaugcugcaaagugggu

SEQ ID NO: 301026 - RNA, 32 nt, Human
accaggucacuggggagucugcuucauuuccu

SEQ ID NO: 301027 - RNA, 32 nt, Human
accaggucaggagaucaagaccauccuggcua

SEQ ID NO: 301028 - RNA, 32 nt, Human
accaggucaggagaucaagaccauccuugauc

SEQ ID NO: 301029 - RNA, 32 nt, Human
accaggucagggccuacagcuguguuguccag

SEQ ID NO: 301030 - RNA, 21 nt, Human
accaggucccaagggagcaag

SEQ ID NO: 301031 - RNA, 26 nt, Human
accagguccccacuggcaccucucuc

SEQ ID NO: 301032 - RNA, 32 nt, Human
accaggucccccuccugaccucugccccacuc

SEQ ID NO: 301033 - RNA, 32 nt, Human
accaggucccugcugcucacaccugggccucu

SEQ ID NO: 301034 - RNA, 32 nt, Human
accaggucguccaagcaaaaacaaaugggaaa

SEQ ID NO: 301035 - RNA, 32 nt, Human
accaggucucacuauguugcccaggccggucu

SEQ ID NO: 301036 - RNA, 32 nt, Human
accaggucucacuauguugcccaggcuagucu

SEQ ID NO: 301037 - RNA, 32 nt, Human
accaggucugccaguuucugugccugcagaga

SEQ ID NO: 301038 - RNA, 26 nt, Human
accaggucugugccaccuccucucuc

SEQ ID NO: 301039 - RNA, 32 nt, Human
accaggucuuagucacauguauuuucauaccc

SEQ ID NO: 301040 - RNA, 32 nt, Human
accaggucuuccggaaccaccugggccgcuac

SEQ ID NO: 301041 - RNA, 32 nt, Human
accaggucuucuugcugaccucgucuacaaag

SEQ ID NO: 301042 - RNA, 32 nt, Human
accaggucuuuccuggccugagaaauauucuc

SEQ ID NO: 301043 - RNA, 32 nt, Human
accaggugacuccgugcgugggccaagccugg

SEQ ID NO: 301044 - RNA, 32 nt, Human
accaggugagaaugaauaagcuaugcaaggua

SEQ ID NO: 301045 - RNA, 32 nt, Human
accaggugcaccacugccgucauuucagcuuc

SEQ ID NO: 301046 - RNA, 32 nt, Human
accaggugcugcugcuggaggagaggcuaggu

SEQ ID NO: 301047 - RNA, 20 nt, Human
accagguggagcaggugcug

SEQ ID NO: 301048 - RNA, 32 nt, Human
accagguggaggcggcggcggcagaggagugg

SEQ ID NO: 301049 - RNA, 32 nt, Human
accagguggauguggagcaggagagcuggauc

SEQ ID NO: 301050 - RNA, 32 nt, Human
accaggugggaaggaagacauacugggcuugg

SEQ ID NO: 301051 - RNA, 32 nt, Human
accaggugguucccucccuuugccggaggaac

SEQ ID NO: 301052 - RNA, 32 nt, Human
accaggugucccaguagagcacugacaugugu

SEQ ID NO: 301053 - RNA, 22 nt, Human
accagguuccauuagcucucca

SEQ ID NO: 301054 - RNA, 32 nt, Human
accagguuccuuuccaggaagggaggcaggag

SEQ ID NO: 301055 - RNA, 32 nt, Human
accagguucucuuuucacugggaccuugcaag

SEQ ID NO: 301056 - RNA, 24 nt, Human
accagguuggccaacauggugaga

SEQ ID NO: 301057 - RNA, 32 nt, Human
accagguuggccaacauggugagaccccaucu

SEQ ID NO: 301058 - RNA, 32 nt, Human
accagguuggucucgaacuccugggcucaagc

SEQ ID NO: 301059 - RNA, 32 nt, Human
accagguuuacaccacugcacuccagucugga

SEQ ID NO: 301060 - RNA, 32 nt, Human
accagguuucuucuccccauaccacguugugc

SEQ ID NO: 301061 - RNA, 32 nt, Human
accaguaacacuuguucuuuacacccuuucuc

SEQ ID NO: 301062 - RNA, 32 nt, Human
accaguaaccaccuuccuucaagccuucagcc

SEQ ID NO: 301063 - RNA, 32 nt, Human
accaguaagagagguuuuaucaauccccaccg

SEQ ID NO: 301064 - RNA, 32 nt, Human
accaguaauagaauugaaaagggagagugucu

SEQ ID NO: 301065 - RNA, 32 nt, Human
accaguacacuuuuagauuagacaguaucuuc

SEQ ID NO: 301066 - RNA, 19 nt, Human
accaguacaucuggcauac

SEQ ID NO: 301067 - RNA, 32 nt, Human
accaguacucugucaucgaagagaccagcucu

SEQ ID NO: 301068 - RNA, 32 nt, Human
accaguaggaacugucacagaauggccugcug

SEQ ID NO: 301069 - RNA, 32 nt, Human
accaguagguugaggacaggagagggaagggu

SEQ ID NO: 301070 - RNA, 32 nt, Human
accaguaguacgaugagccaaagcuuuacauu

SEQ ID NO: 301071 - RNA, 32 nt, Human
accaguaucaguuccuuccucccuucaagagu

SEQ ID NO: 301072 - RNA, 32 nt, Human
accaguauccuucaacuacuucaucaauguuu

SEQ ID NO: 301073 - RNA, 32 nt, Human
accagucagagggagcaguccggagaggcaag

SEQ ID NO: 301074 - RNA, 32 nt, Human
accagucauguggagcacuucagccuccagag

SEQ ID NO: 301075 - RNA, 32 nt, Human
accaguccaacacugaauguaucugcacugug

SEQ ID NO: 301076 - RNA, 23 nt, Human
accaguccagaacuugcaguggg

SEQ ID NO: 301077 - RNA, 19 nt, Human
accaguccagccaacacgg

SEQ ID NO: 301078 - RNA, 19 nt, Human
accagucccggcagagcca

SEQ ID NO: 301079 - RNA, 32 nt, Human
accagucccggcaguggccacaacagcacauc

SEQ ID NO: 301080 - RNA, 32 nt, Human
accagucccuguuaccagcuguguggccuugg

SEQ ID NO: 301081 - RNA, 32 nt, Human
accaguccucugcaguuacauggccacaucuu

SEQ ID NO: 301082 - RNA, 32 nt, Human
accaguccugcucuccuccguggacauuucau

SEQ ID NO: 301083 - RNA, 32 nt, Human
accaguccuggaccuaugaccacccagcuggg

SEQ ID NO: 301084 - RNA, 32 nt, Human
accagucgcuccccgccugggagcucagcuuu

SEQ ID NO: 301085 - RNA, 32 nt, Human
accagucgucuuuacugugcugcccagggacu

SEQ ID NO: 301086 - RNA, 32 nt, Human
accagucuaagcaacauaaugagacucagucu

SEQ ID NO: 301087 - RNA, 32 nt, Human
accagucuagggacaaaggagacugaacaucu

SEQ ID NO: 301088 - RNA, 32 nt, Human
accagucucccaggaggcugaggcugcuguau

SEQ ID NO: 301089 - RNA, 19 nt, Human
accagucugaccaacacgg

SEQ ID NO: 301090 - RNA, 21 nt, Human
accagucugaccaacacggag

SEQ ID NO: 301091 - RNA, 24 nt, Human
accagucugaccaacacggagaaa

SEQ ID NO: 301092 - RNA, 32 nt, Human
accagucugaguguggaagagacggcgcugga

SEQ ID NO: 301093 - RNA, 32 nt, Human
accagucugcaacccugcucuaugcugacccu

SEQ ID NO: 301094 - RNA, 32 nt, Human
accagucugcagaugcccuagcaugaaucuuc

SEQ ID NO: 301095 - RNA, 32 nt, Human
accagucugccucuugggucuuccucccaggc

SEQ ID NO: 301096 - RNA, 19 nt, Human
accagucugccugccacca

SEQ ID NO: 301097 - RNA, 32 nt, Human
accagucuggacaacauggggagaccccaucu

SEQ ID NO: 301098 - RNA, 21 nt, Human
accagucuggccaacauagca

SEQ ID NO: 301099 - RNA, 24 nt, Human
accagucuggccaacaucgugaaa

SEQ ID NO: 301100 - RNA, 24 nt, Human
accagucuggccaacauggcgaaa

SEQ ID NO: 301101 - RNA, 24 nt, Human
accagucuggccaacauggggaaa

SEQ ID NO: 301102 - RNA, 24 nt, Human
accagucuggccaacauggugaaa

SEQ ID NO: 301103 - RNA, 24 nt, Human
accagucuggccaaccuggugaaa

SEQ ID NO: 301104 - RNA, 24 nt, Human
accagucuggccaauauggugaaa

SEQ ID NO: 301105 - RNA, 24 nt, Human
accagucuggcccacauggugaaa

SEQ ID NO: 301106 - RNA, 32 nt, Human
accagucugggcaacauagcgagacuccaucu

SEQ ID NO: 301107 - RNA, 32 nt, Human
accagucugggcaacauagugagacccuuucc

SEQ ID NO: 301108 - RNA, 32 nt, Human
accagucugggcaacauggugagacccucguc

SEQ ID NO: 301109 - RNA, 32 nt, Human
accagucugggugacagagaaagacccugucu

SEQ ID NO: 301110 - RNA, 24 nt, Human
accagucuggucaacauggugaaa

SEQ ID NO: 301111 - RNA, 32 nt, Human
accagucuguccccaucucugaaauccuuccu

SEQ ID NO: 301112 - RNA, 32 nt, Human
accagucugucuguguuaggggagaggggagu

SEQ ID NO: 301113 - RNA, 32 nt, Human
accagucuuguccugagaaauguuucucuuag

SEQ ID NO: 301114 - RNA, 20 nt, Human
accagucuuucaguucucca

SEQ ID NO: 301115 - RNA, 32 nt, Human
accagugaaagagaagcacacaggcuccauga

SEQ ID NO: 301116 - RNA, 32 nt, Human
accagugaaggugagggaggugugacaguaga

SEQ ID NO: 301117 - RNA, 32 nt, Human
accagugaauuucucaaucuugccucacagug

SEQ ID NO: 301118 - RNA, 32 nt, Human
accagugacaggcuggucagagggcggggcug

SEQ ID NO: 301119 - RNA, 32 nt, Human
accagugaccuucaaucaacuccaucacuucu

SEQ ID NO: 301120 - RNA, 32 nt, Human
accagugacugaggccuggacccagaggugga

SEQ ID NO: 301121 - RNA, 31 nt, Human
accagugacuucucugggccugggucugggg

SEQ ID NO: 301122 - RNA, 32 nt, Human
accagugcacuccagccugggugacagagcaa

SEQ ID NO: 301123 - RNA, 32 nt, Human
accagugcacuccagccuuggugacaauggga

SEQ ID NO: 301124 - RNA, 32 nt, Human
accagugcagggcuguuaacaggguugcaggc

SEQ ID NO: 301125 - RNA, 32 nt, Human
accagugcauaccaccaugccugggugauuuu

SEQ ID NO: 301126 - RNA, 32 nt, Human
accagugcaugcucaggagaacaaaugagcaa

SEQ ID NO: 301127 - RNA, 32 nt, Human
accagugcauuccagccuggguacacagcgag

SEQ ID NO: 301128 - RNA, 32 nt, Human
accagugccaccuuauggcaaagagcucccgc

SEQ ID NO: 301129 - RNA, 32 nt, Human
accagugccagccuuggaguugccagucagug

SEQ ID NO: 301130 - RNA, 22 nt, Human
accagugccaggccagggagcc

SEQ ID NO: 301131 - RNA, 32 nt, Human
accagugccucgcuccauuggcaccaacgccc

SEQ ID NO: 301132 - RNA, 32 nt, Human
accagugcgugagccuuggaucccucaacgua

SEQ ID NO: 301133 - RNA, 32 nt, Human
accagugcuccugccaccucucuggcugcccc

SEQ ID NO: 301134 - RNA, 32 nt, Human
accagugcugggacaaagauggggaaggugug

SEQ ID NO: 301135 - RNA, 32 nt, Human
accagugcugugccagacacugaggcauucua

SEQ ID NO: 301136 - RNA, 32 nt, Human
accagugcugugggaaaaaugguaacauuuca

SEQ ID NO: 301137 - RNA, 32 nt, Human
accaguggaagaccccagcccccagggagagg

SEQ ID NO: 301138 - RNA, 32 nt, Human
accaguggaugcaggcuucagugaccaagacc

SEQ ID NO: 301139 - RNA, 31 nt, Human
accaguggcaaagaaacuccuuucauuuugu

SEQ ID NO: 301140 - RNA, 32 nt, Human
accaguggcaacugccugcacagcagagauaa

SEQ ID NO: 301141 - RNA, 23 nt, Human
accaguggcaggcacagguccag

SEQ ID NO: 301142 - RNA, 32 nt, Human
accaguggcaggcacagguccagggagacaga

SEQ ID NO: 301143 - RNA, 32 nt, Human
accaguggccuggccgaccugcucuggcccug

SEQ ID NO: 301144 - RNA, 32 nt, Human
accaguggcugcagaagggccacccuagccuu

SEQ ID NO: 301145 - RNA, 32 nt, Human
accaguggcugccacaccagucacaugaccug

SEQ ID NO: 301146 - RNA, 32 nt, Human
accaguggcuucaaacuuccugguuucaugau

SEQ ID NO: 301147 - RNA, 32 nt, Human
accagugggggaaagauggaucuugaagcuaa

SEQ ID NO: 301148 - RNA, 32 nt, Human
accagugggugagaaagacaccuggucaggaa

SEQ ID NO: 301149 - RNA, 32 nt, Human
accagugggugagaaggacaccuggucaagaa

SEQ ID NO: 301150 - RNA, 32 nt, Human
accaguggucucacauggugcuacgccugcau

SEQ ID NO: 301151 - RNA, 32 nt, Human
accaguggucuuucaggccccuucccugcucu

SEQ ID NO: 301152 - RNA, 32 nt, Human
accaguguccaugcccagagguucuggguucu

SEQ ID NO: 301153 - RNA, 32 nt, Human
accaguguccccaccaucagccaccacacacc

SEQ ID NO: 301154 - RNA, 32 nt, Human
accagugugcagggcgggccugggacaauggg

SEQ ID NO: 301155 - RNA, 32 nt, Human
accaguguggccgagguugcagugaguguaga

SEQ ID NO: 301156 - RNA, 24 nt, Human
accagugugggcaacauggugaaa

SEQ ID NO: 301157 - RNA, 32 nt, Human
accagugugguggcucacaccuguaaucccag

SEQ ID NO: 301158 - RNA, 21 nt, Human
accaguguguggagccugcca

SEQ ID NO: 301159 - RNA, 32 nt, Human
accagugugugggcagcacccaggcauuaaac

SEQ ID NO: 301160 - RNA, 32 nt, Human
accaguguucaaguugguuuggucuuuauuaa

SEQ ID NO: 301161 - RNA, 32 nt, Human
accaguguucauggugacagggcgacgggagg

SEQ ID NO: 301162 - RNA, 32 nt, Human
accaguguuggauauucugugauugauuuugg

SEQ ID NO: 301163 - RNA, 32 nt, Human
accaguguuggccaggcuggucucgaacuccu

SEQ ID NO: 301164 - RNA, 32 nt, Human
accaguucacuggguuauucuaugauuccaua

SEQ ID NO: 301165 - RNA, 32 nt, Human
accaguuccucugcaacccacucuggccucuc

SEQ ID NO: 301166 - RNA, 32 nt, Human
accaguucucucucacucuccguacagcugaa

SEQ ID NO: 301167 - RNA, 32 nt, Human
accaguugaacugcaggaagagaggacccauc

SEQ ID NO: 301168 - RNA, 31 nt, Human
accaguugaaucaucuguugaaauaaaugac

SEQ ID NO: 301169 - RNA, 32 nt, Human
accaguugugcuucagccuccuuucccuugca

SEQ ID NO: 301170 - RNA, 32 nt, Human
accaguuguuagaucuguagggacuuguacaa

SEQ ID NO: 301171 - RNA, 32 nt, Human
accaguuuaggggaguuaaggaauuauuuuuc

SEQ ID NO: 301172 - RNA, 32 nt, Human
accaguuucauuuuggccauuucuuuuucaaa

SEQ ID NO: 301173 - RNA, 18 nt, Human
accaguuuccagguggua

SEQ ID NO: 301174 - RNA, 32 nt, Human
accaguuuccucucacacuuauuuaccugcua

SEQ ID NO: 301175 - RNA, 32 nt, Human
accaguuucucaggcuggggagcacagagggg

SEQ ID NO: 301176 - RNA, 32 nt, Human
accaguuucugaauccaaccucccagacuuca

SEQ ID NO: 301177 - RNA, 32 nt, Human
accaguuugcaggaagaaaggaagagaaugga

SEQ ID NO: 301178 - RNA, 32 nt, Human
accaguuugccuccuucccugccuuaaaagca

SEQ ID NO: 301179 - RNA, 24 nt, Human
accaguuugggcaacauggcgaaa

SEQ ID NO: 301180 - RNA, 18 nt, Human
accaguuuugugguccua

SEQ ID NO: 301181 - RNA, 32 nt, Human
accauaaagauaaggagagcaauuaaugagcu

SEQ ID NO: 301182 - RNA, 32 nt, Human
accauaaauuuccaggaucagacuaacggcua

SEQ ID NO: 301183 - RNA, 32 nt, Human
accauaacacaaaaagcaugaacuuguauuaa

SEQ ID NO: 301184 - RNA, 32 nt, Human
accauaagcccagggaugugacagcugcagcg

SEQ ID NO: 301185 - RNA, 32 nt, Human
accauaauaaauacuccuuuucaagagaaaag

SEQ ID NO: 301186 - RNA, 32 nt, Human
accauaauaaaucugcuccuauaauugaggca

SEQ ID NO: 301187 - RNA, 32 nt, Human
accauaauccugcaagaaaauucuucagaauu

SEQ ID NO: 301188 - RNA, 32 nt, Human
accauaauccugucuuaauacugcaaacaaau

SEQ ID NO: 301189 - RNA, 32 nt, Human
accauaaugaugggcucugaaauuguccaagg

SEQ ID NO: 301190 - RNA, 32 nt, Human
accauaauggccaggcuggucuugaaccucaa

SEQ ID NO: 301191 - RNA, 32 nt, Human
accauaauguguuuguugcaagauccacaaga

SEQ ID NO: 301192 - RNA, 32 nt, Human
accauaauuuuuauaauuuucauuccaguccu

SEQ ID NO: 301193 - RNA, 32 nt, Human
accauacaaagccacaggaguggagcuguggc

SEQ ID NO: 301194 - RNA, 32 nt, Human
accauacacauaagggaagagaggaggaugug

SEQ ID NO: 301195 - RNA, 32 nt, Human
accauacaucacaacgucaguuuuccuaucug

SEQ ID NO: 301196 - RNA, 32 nt, Human
accauaccacugcauuccagccugggugacag

SEQ ID NO: 301197 - RNA, 32 nt, Human
accauaccagugcauuccagccuggguacaca

SEQ ID NO: 301198 - RNA, 32 nt, Human
accauaccccuacuccagcccaccccagacag

SEQ ID NO: 301199 - RNA, 32 nt, Human
accauaccuucaggauggagacaggaaagugu

SEQ ID NO: 301200 - RNA, 32 nt, Human
accauacgucagaccauugccucccaguuacc

SEQ ID NO: 301201 - RNA, 32 nt, Human
accauacucccuuucagggccagggcuccagc

SEQ ID NO: 301202 - RNA, 32 nt, Human
accauacuuacuggccuuggcuggcucuucag

SEQ ID NO: 301203 - RNA, 32 nt, Human
accauagaacccaucuuguugaauacaaguaa

SEQ ID NO: 301204 - RNA, 32 nt, Human
accauagaauacugauuggauagccauccuag

SEQ ID NO: 301205 - RNA, 20 nt, Human
accauagacccagccaggua

SEQ ID NO: 301206 - RNA, 32 nt, Human
accauagaggcagagauuggagugaaguggcu

SEQ ID NO: 301207 - RNA, 32 nt, Human
accauagcauaagugaucugugccuuaacgac

SEQ ID NO: 301208 - RNA, 32 nt, Human
accauagcucacugcagcaucaaauuccuagg

SEQ ID NO: 301209 - RNA, 32 nt, Human
accauagcucugauucccaccccacauaggaa

SEQ ID NO: 301210 - RNA, 32 nt, Human
accauaggcagcacaggcaucaagauguccaa

SEQ ID NO: 301211 - RNA, 32 nt, Human
accauaggcuguaaagcguuccaaauauccac

SEQ ID NO: 301212 - RNA, 32 nt, Human
accauagguauuuauugauuggaggaagggag

SEQ ID NO: 301213 - RNA, 32 nt, Human
accauaggugugagccagcacgucugguuaau

SEQ ID NO: 301214 - RNA, 32 nt, Human
accauaguuguacugcugcugcuucauugcca

SEQ ID NO: 301215 - RNA, 32 nt, Human
accauauaauccagcaauuucacuucuaggua

SEQ ID NO: 301216 - RNA, 32 nt, Human
accauauacauaagggaagagaggaggaugug

SEQ ID NO: 301217 - RNA, 25 nt, Human
accauaucagcugcugcucuuuaug

SEQ ID NO: 301218 - RNA, 32 nt, Human
accauaucuccaagcuuccuggcaaccagugg

SEQ ID NO: 301219 - RNA, 32 nt, Human
accauaugauccagcaaucccacugcuaggua

SEQ ID NO: 301220 - RNA, 32 nt, Human
accauauggccacuggggugguggcccaucuc

SEQ ID NO: 301221 - RNA, 19 nt, Human
accauauggccccagggaa

SEQ ID NO: 301222 - RNA, 32 nt, Human
accauauguggauccuuucauuucucagcucc

SEQ ID NO: 301223 - RNA, 32 nt, Human
accauauugggaaaguccugggggacgugugu

SEQ ID NO: 301224 - RNA, 32 nt, Human
accauauuuuuguccccaccacaagcuggguu

SEQ ID NO: 301225 - RNA, 32 nt, Human
accaucaaaaccaggaacccacacugaugccc

SEQ ID NO: 301226 - RNA, 32 nt, Human
accaucaaacucacaaauagguugaaauccuu

SEQ ID NO: 301227 - RNA, 32 nt, Human
accaucacacgugaagcaccaggcugggagau

SEQ ID NO: 301228 - RNA, 32 nt, Human
accaucacacucagcugaccuaagagccuaac

SEQ ID NO: 301229 - RNA, 32 nt, Human
accaucaccaacaacauuggcucaauagcaag

SEQ ID NO: 301230 - RNA, 16 nt, Human
accaucaccaccacca

SEQ ID NO: 301231 - RNA, 32 nt, Human
accaucacccaaucuguugauucuccauuggg

SEQ ID NO: 301232 - RNA, 32 nt, Human
accaucacugaacucaaggacuugugcugaag

SEQ ID NO: 301233 - RNA, 32 nt, Human
accaucacuguggugcccacugugccucaagu

SEQ ID NO: 301234 - RNA, 32 nt, Human
accaucagagcagaggaggaaagacucacuac

SEQ ID NO: 301235 - RNA, 32 nt, Human
accaucagcagacauuggcaucuucaaaauua

SEQ ID NO: 301236 - RNA, 32 nt, Human
accaucagccaccacacaccucugcugcccug

SEQ ID NO: 301237 - RNA, 32 nt, Human
accaucagcuucagaggaugucagccuuugau

SEQ ID NO: 301238 - RNA, 19 nt, Human
accaucaucacugccacca

SEQ ID NO: 301239 - RNA, 20 nt, Human
accaucaucuaaacuacuau

SEQ ID NO: 301240 - RNA, 32 nt, Human
accaucaucucaggaugucucuuucuggccgc

SEQ ID NO: 301241 - RNA, 32 nt, Human
accaucauggggaccaggauagaaggcuucuu

SEQ ID NO: 301242 - RNA, 32 nt, Human
accaucauuauauuccaaucuuccucaucucc

SEQ ID NO: 301243 - RNA, 32 nt, Human
accauccaaaaauguugagggcaugcuuugcu

SEQ ID NO: 301244 - RNA, 32 nt, Human
accauccaagaauguuguuagcuuuucaguuc

SEQ ID NO: 301245 - RNA, 32 nt, Human
accauccaagaggugguagguuggaguaagau

SEQ ID NO: 301246 - RNA, 32 nt, Human
accauccacuguccauauucagucccagcccc

SEQ ID NO: 301247 - RNA, 32 nt, Human
accauccagaaucaaagcagcaaccacauagu

SEQ ID NO: 301248 - RNA, 18 nt, Human
accauccagcccaaggag

SEQ ID NO: 301249 - RNA, 32 nt, Human
accauccagggcaacauaacaagacucugucu

SEQ ID NO: 301250 - RNA, 32 nt, Human
accauccagggguggagggggaaaaccaggca

SEQ ID NO: 301251 - RNA, 24 nt, Human
accauccaguucuuccuccaggcc

SEQ ID NO: 301252 - RNA, 32 nt, Human
accauccaugucuuccaggugacuccugaagg

SEQ ID NO: 301253 - RNA, 32 nt, Human
accaucccaaacuccucccaggcacagucugg

SEQ ID NO: 301254 - RNA, 32 nt, Human
accaucccacacaauuuugaggucuggacggc

SEQ ID NO: 301255 - RNA, 22 nt, Human
accaucccagacggcaucagcu

SEQ ID NO: 301256 - RNA, 32 nt, Human
accaucccagagaaaauaagggacuuuugcaa

SEQ ID NO: 301257 - RNA, 32 nt, Human
accaucccaguccuucugucagucuccgaugc

SEQ ID NO: 301258 - RNA, 32 nt, Human
accauccccagcugccugcuccugguaccucc

SEQ ID NO: 301259 - RNA, 32 nt, Human
accaucccccucacugucucugaggcaccugc

SEQ ID NO: 301260 - RNA, 24 nt, Human
accaucccggcuaacacggugaaa

SEQ ID NO: 301261 - RNA, 32 nt, Human
accaucccgugaggcccugccugagcagccag

SEQ ID NO: 301262 - RNA, 32 nt, Human
accaucccucauuucugcgggguccagcugga

SEQ ID NO: 301263 - RNA, 32 nt, Human
accaucccugcucaccuugcuaggccuggggc

SEQ ID NO: 301264 - RNA, 32 nt, Human
accauccuaaaggguuuuuaagcccuaacacu

SEQ ID NO: 301265 - RNA, 24 nt, Human
accauccuagccaacaucgugaaa

SEQ ID NO: 301266 - RNA, 32 nt, Human
accauccucauauagaauaaaauaucaaccua

SEQ ID NO: 301267 - RNA, 32 nt, Human
accauccucugacuuccugggccccuagaauu

SEQ ID NO: 301268 - RNA, 32 nt, Human
accauccucuugaaaaacccagacacagaguu

SEQ ID NO: 301269 - RNA, 32 nt, Human
accauccugaagaaguucaauggggaggacau

SEQ ID NO: 301270 - RNA, 24 nt, Human
accauccugaccaacauggugaaa

SEQ ID NO: 301271 - RNA, 19 nt, Human
accauccugagccagggaa

SEQ ID NO: 301272 - RNA, 15 nt, Human
accauccugccacca

SEQ ID NO: 301273 - RNA, 24 nt, Human
accauccugcccaacauggugaaa

SEQ ID NO: 301274 - RNA, 32 nt, Human
accauccugcgcuucuauccugugggccaggg

SEQ ID NO: 301275 - RNA, 32 nt, Human
accauccuggaugacagagcaagacuccauca

SEQ ID NO: 301276 - RNA, 24 nt, Human
accauccuggcaaacauggugaaa

SEQ ID NO: 301277 - RNA, 21 nt, Human
accauccuggccaacacagug

SEQ ID NO: 301278 - RNA, 24 nt, Human
accauccuggccaacacagugaaa

SEQ ID NO: 301279 - RNA, 21 nt, Human
accauccuggccaacacggug

SEQ ID NO: 301280 - RNA, 24 nt, Human
accauccuggccaacacggugaaa

SEQ ID NO: 301281 - RNA, 24 nt, Human
accauccuggccaacauagugaaa

SEQ ID NO: 301282 - RNA, 24 nt, Human
accauccuggccaacaugaugaaa

SEQ ID NO: 301283 - RNA, 19 nt, Human
accauccuggccaacaugg

SEQ ID NO: 301284 - RNA, 24 nt, Human
accauccuggccaacauggcgaaa

SEQ ID NO: 301285 - RNA, 24 nt, Human
accauccuggccaacauggggaaa

SEQ ID NO: 301286 - RNA, 24 nt, Human
accauccuggccaacauggugaaa

SEQ ID NO: 301287 - RNA, 24 nt, Human
accauccuggccaacguagugaaa

SEQ ID NO: 301288 - RNA, 24 nt, Human
accauccuggccaacguggugaaa

SEQ ID NO: 301289 - RNA, 24 nt, Human
accauccuggccaauauggugaaa

SEQ ID NO: 301290 - RNA, 24 nt, Human
accauccuggccagcauggugaaa

SEQ ID NO: 301291 - RNA, 32 nt, Human
accauccuggccucaccuccacccaacacugg

SEQ ID NO: 301292 - RNA, 24 nt, Human
accauccuggcgaacauggugaaa

SEQ ID NO: 301293 - RNA, 32 nt, Human
accauccuggcgaacauggugagacccaucuc

SEQ ID NO: 301294 - RNA, 24 nt, Human
accauccuggcuaacacagugaaa

SEQ ID NO: 301295 - RNA, 24 nt, Human
accauccuggcuaacacgaugaaa

SEQ ID NO: 301296 - RNA, 24 nt, Human
accauccuggcuaacacggcgaaa

SEQ ID NO: 301297 - RNA, 24 nt, Human
accauccuggcuaacacggugaaa

SEQ ID NO: 301298 - RNA, 32 nt, Human
accauccuggcuaacacggugagaccccaucu

SEQ ID NO: 301299 - RNA, 32 nt, Human
accauccuggcuaacacggugagaccccgucu

SEQ ID NO: 301300 - RNA, 24 nt, Human
accauccuggcuaacauagugaaa

SEQ ID NO: 301301 - RNA, 20 nt, Human
accauccuggcuaacauggu

SEQ ID NO: 301302 - RNA, 24 nt, Human
accauccuggcuaacauggugaaa

SEQ ID NO: 301303 - RNA, 32 nt, Human
accauccugggcaacauaaugaaacaccaucu

SEQ ID NO: 301304 - RNA, 32 nt, Human
accauccugggcaacauagugagacccugucu

SEQ ID NO: 301305 - RNA, 24 nt, Human
accauccugggcaacauggcgaaa

SEQ ID NO: 301306 - RNA, 24 nt, Human
accauccuggucaacauggugaaa

SEQ ID NO: 301307 - RNA, 32 nt, Human
accauccuuaauugcuccuucucaccuccucu

SEQ ID NO: 301308 - RNA, 32 nt, Human
accaucggaacagcagcgcccgcagcacccac

SEQ ID NO: 301309 - RNA, 32 nt, Human
accaucgggcuuaaccagcccagcacaccaac

SEQ ID NO: 301310 - RNA, 32 nt, Human
accaucggucccggagucccagugaugcucug

SEQ ID NO: 301311 - RNA, 32 nt, Human
accaucguaccacugcacuccagccuggauga

SEQ ID NO: 301312 - RNA, 32 nt, Human
accaucguagacugauguugcucuacaugauc

SEQ ID NO: 301313 - RNA, 24 nt, Human
accaucguggcuaacacggugaaa

SEQ ID NO: 301314 - RNA, 24 nt, Human
accaucguggcuaacauggugaaa

SEQ ID NO: 301315 - RNA, 32 nt, Human
accaucuaccuacagaagaugaccccagacag

SEQ ID NO: 301316 - RNA, 32 nt, Human
accaucuacuauugauuuuacagugcacugac

SEQ ID NO: 301317 - RNA, 32 nt, Human
accaucuacuccuggaaccaggaccugccacc

SEQ ID NO: 301318 - RNA, 23 nt, Human
accaucuaggaacaggggccagg

SEQ ID NO: 301319 - RNA, 32 nt, Human
accaucuaggaacaggggccaggcagagggcg

SEQ ID NO: 301320 - RNA, 32 nt, Human
accaucuauguaaugaauggggauuauacauu

SEQ ID NO: 301321 - RNA, 32 nt, Human
accaucucacugcaguagcacgcccuccuggg

SEQ ID NO: 301322 - RNA, 32 nt, Human
accaucucagugaggggcaggagcuggggcuc

SEQ ID NO: 301323 - RNA, 21 nt, Human
accaucucagugucaagagaa

SEQ ID NO: 301324 - RNA, 19 nt, Human
accaucuccaccugcccca

SEQ ID NO: 301325 - RNA, 32 nt, Human
accaucuccaggaguccaugagaggcuuucuu

SEQ ID NO: 301326 - RNA, 32 nt, Human
accaucucccacuguggcuaccaccuucccuu

SEQ ID NO: 301327 - RNA, 20 nt, Human
accaucuccucccuaaugag

SEQ ID NO: 301328 - RNA, 32 nt, Human
accaucuccugguuuccugaaggaggugggug

SEQ ID NO: 301329 - RNA, 32 nt, Human
accaucucgggauaugaggccucggaggcugg

SEQ ID NO: 301330 - RNA, 32 nt, Human
accaucucuccucugcuaaauuugcaugacug

SEQ ID NO: 301331 - RNA, 32 nt, Human
accaucucucuacucuuuaucuugcccucaca

SEQ ID NO: 301332 - RNA, 32 nt, Human
accaucucugcagaccccucuccuccuccuuc

SEQ ID NO: 301333 - RNA, 32 nt, Human
accaucucuuggacuccagccuguaugcacag

SEQ ID NO: 301334 - RNA, 32 nt, Human
accaucugcaguauuauaaaagucauuuagaa

SEQ ID NO: 301335 - RNA, 21 nt, Human
accaucugccugggaguccuc

SEQ ID NO: 301336 - RNA, 32 nt, Human
accaucugcugacuguucuuguggaucuugug

SEQ ID NO: 301337 - RNA, 32 nt, Human
accaucugcugccccucuuuccaucuuuccau

SEQ ID NO: 301338 - RNA, 21 nt, Human
accaucugcuucucccuuggc

SEQ ID NO: 301339 - RNA, 29 nt, Human
accaucuggcugcuuguccccuggagaaa

SEQ ID NO: 301340 - RNA, 28 nt, Human
accaucuuaagagaugccucauuuuaga

SEQ ID NO: 301341 - RNA, 22 nt, Human
accaucuuccacucuccuauua

SEQ ID NO: 301342 - RNA, 32 nt, Human
accaucuuggcaaucucugccucugcaacagg

SEQ ID NO: 301343 - RNA, 24 nt, Human
accaucuuggccaacauggugaaa

SEQ ID NO: 301344 - RNA, 24 nt, Human
accaucuuggcuaacacagugaaa

SEQ ID NO: 301345 - RNA, 24 nt, Human
accaucuuggcuaacacggugaaa

SEQ ID NO: 301346 - RNA, 24 nt, Human
accaucuuggcuaacauggugaaa

SEQ ID NO: 301347 - RNA, 24 nt, Human
accaucuugggcaacauggugaaa

SEQ ID NO: 301348 - RNA, 32 nt, Human
accaucuuggggaccuacaagggccuggacuc

SEQ ID NO: 301349 - RNA, 32 nt, Human
accaucuugugcaaaugguguggcccagggcc

SEQ ID NO: 301350 - RNA, 32 nt, Human
accaucuugugucuuuggaggugcugcuuaau

SEQ ID NO: 301351 - RNA, 32 nt, Human
accaucuuuccucuuuguuuauucaagacuau

SEQ ID NO: 301352 - RNA, 24 nt, Human
accaucuuugccaacauggugaaa

SEQ ID NO: 301353 - RNA, 32 nt, Human
accaugaaaccagccaacccucugcaugccag

SEQ ID NO: 301354 - RNA, 32 nt, Human
accaugaaauauccagaacauacuuauaugua

SEQ ID NO: 301355 - RNA, 32 nt, Human
accaugaacagaggaugaacaagugaaguugc

SEQ ID NO: 301356 - RNA, 32 nt, Human
accaugaagacugggcgccucagucccagccc

SEQ ID NO: 301357 - RNA, 32 nt, Human
accaugaagagaccuaguuaccugccaaggga

SEQ ID NO: 301358 - RNA, 32 nt, Human
accaugaagugacagaugcuggcagauguuag

SEQ ID NO: 301359 - RNA, 28 nt, Human
accaugaaguucuuagcaguccugguac

SEQ ID NO: 301360 - RNA, 32 nt, Human
accaugacaugaaggaggccaccgugugagca

SEQ ID NO: 301361 - RNA, 32 nt, Human
accaugaccucaccccuccuugguuucucccu

SEQ ID NO: 301362 - RNA, 32 nt, Human
accaugacugcagcacaaaauuaucgacucug

SEQ ID NO: 301363 - RNA, 28 nt, Human
accaugagagagaccuuggaggcccuca

SEQ ID NO: 301364 - RNA, 32 nt, Human
accaugagagcucccuugccuuaccuggagga

SEQ ID NO: 301365 - RNA, 32 nt, Human
accaugagcgcuccagugaacagaacaggaau

SEQ ID NO: 301366 - RNA, 32 nt, Human
accaugaggaggaggaggggaaagcgccagug

SEQ ID NO: 301367 - RNA, 28 nt, Human
accaugaggcucauccugccuguggguu

SEQ ID NO: 301368 - RNA, 28 nt, Human
accaugaggcuucucauucucaccuguc

SEQ ID NO: 301369 - RNA, 32 nt, Human
accaugaggcuucugcguguagucccugcccc

SEQ ID NO: 301370 - RNA, 28 nt, Human
accaugagggcccuggugcuucugcugu

SEQ ID NO: 301371 - RNA, 32 nt, Human
accaugagugagccaccagcucuccacguucc

SEQ ID NO: 301372 - RNA, 32 nt, Human
accaugaguggggcuggcaucuugccagccug

SEQ ID NO: 301373 - RNA, 32 nt, Human
accaugagugugccacuuucauuggacccuga

SEQ ID NO: 301374 - RNA, 28 nt, Human
accaugauccccugggugcuccuggccu

SEQ ID NO: 301375 - RNA, 32 nt, Human
accaugaucugcagcaagaaacgugccuucca

SEQ ID NO: 301376 - RNA, 32 nt, Human
accaugauggccagguugguuuugaacuccug

SEQ ID NO: 301377 - RNA, 32 nt, Human
accaugaugggcuaacacccaucucuacuaaa

SEQ ID NO: 301378 - RNA, 32 nt, Human
accaugauuccaaacaaaacuaacuuguuuaa

SEQ ID NO: 301379 - RNA, 32 nt, Human
accaugauugcacuccaaccugggcgacagag

SEQ ID NO: 301380 - RNA, 32 nt, Human
accaugauugugccacugcacuccagucugga

SEQ ID NO: 301381 - RNA, 21 nt, Human
accaugcaaaacccugaaaca

SEQ ID NO: 301382 - RNA, 32 nt, Human
accaugcaagcccucccaccucccagggcucc

SEQ ID NO: 301383 - RNA, 18 nt, Human
accaugcaagcuggcaac

SEQ ID NO: 301384 - RNA, 18 nt, Human
accaugcaauaauacaac

SEQ ID NO: 301385 - RNA, 20 nt, Human
accaugcaauauucugaaca

SEQ ID NO: 301386 - RNA, 32 nt, Human
accaugcagagcugugaucuagaggcucugag

SEQ ID NO: 301387 - RNA, 32 nt, Human
accaugcagccugaccugugaacucuccagua

SEQ ID NO: 301388 - RNA, 32 nt, Human
accaugcaggccccaggccccaugcucuuugu

SEQ ID NO: 301389 - RNA, 32 nt, Human
accaugcaguucugccuggguuggaguuggaa

SEQ ID NO: 301390 - RNA, 32 nt, Human
accaugccacacacuugcuguaaggcuagaag

SEQ ID NO: 301391 - RNA, 32 nt, Human
accaugccacugcacuccagccugggcaacaa

SEQ ID NO: 301392 - RNA, 32 nt, Human
accaugccacugcacuccagccugggcaacag

SEQ ID NO: 301393 - RNA, 28 nt, Human
accaugccacugcacuccagccugggug

SEQ ID NO: 301394 - RNA, 32 nt, Human
accaugccacugcacuccggccugggugacaa

SEQ ID NO: 301395 - RNA, 32 nt, Human
accaugccagauucugccucucuggaaagagg

SEQ ID NO: 301396 - RNA, 32 nt, Human
accaugccauugcacuccagccugggcgacag

SEQ ID NO: 301397 - RNA, 32 nt, Human
accaugccauuggacuccagccugggcaaaaa

SEQ ID NO: 301398 - RNA, 32 nt, Human
accaugcccagcccugcgucuacauuucuaaa

SEQ ID NO: 301399 - RNA, 32 nt, Human
accaugcccagcccuggagccaucacuacuca

SEQ ID NO: 301400 - RNA, 32 nt, Human
accaugcccagccuaauuuuuguauuuuuagu

SEQ ID NO: 301401 - RNA, 32 nt, Human
accaugcccagcuaauucuuuguauuuuuagu

SEQ ID NO: 301402 - RNA, 32 nt, Human
accaugcccagcuaauuuguuguauuuuuagu

SEQ ID NO: 301403 - RNA, 32 nt, Human
accaugcccaggagggaagaagccauccacag

SEQ ID NO: 301404 - RNA, 32 nt, Human
accaugccccggcuauuuuuguauuuuuagua

SEQ ID NO: 301405 - RNA, 22 nt, Human
accaugcccggcucucacuuca

SEQ ID NO: 301406 - RNA, 32 nt, Human
accaugccuagcuauucuuuuguauuuuuggu

SEQ ID NO: 301407 - RNA, 32 nt, Human
accaugccugggaauggagccaccacauccag

SEQ ID NO: 301408 - RNA, 22 nt, Human
accaugcgauugcccugcaaca

SEQ ID NO: 301409 - RNA, 32 nt, Human
accaugcuaauauguaaaguucaugccaucca

SEQ ID NO: 301410 - RNA, 32 nt, Human
accaugcuccauccucccucucuuccaccucc

SEQ ID NO: 301411 - RNA, 32 nt, Human
accaugcuccccucugcugcccagagccccag

SEQ ID NO: 301412 - RNA, 32 nt, Human
accaugcucuccugggacugugaggcuccuuu

SEQ ID NO: 301413 - RNA, 32 nt, Human
accaugcugagagugagcccugugcaugcaca

SEQ ID NO: 301414 - RNA, 32 nt, Human
accaugcugccuucucugggcucacgacuguu

SEQ ID NO: 301415 - RNA, 32 nt, Human
accaugcuggacugcuauaggcccagcuuccc

SEQ ID NO: 301416 - RNA, 24 nt, Human
accaugcuggcuaacauggugaaa

SEQ ID NO: 301417 - RNA, 32 nt, Human
accaugcuucucauucccuugacucaugucuu

SEQ ID NO: 301418 - RNA, 28 nt, Human
accaugcuucuccuggugacaagccuuc

SEQ ID NO: 301419 - RNA, 32 nt, Human
accauggaacuacccaaaggucuucaaggagu

SEQ ID NO: 301420 - RNA, 32 nt, Human
accauggacuccagagagagcagcuuauagua

SEQ ID NO: 301421 - RNA, 32 nt, Human
accauggagcggaaagaaagaaaacagcauuc

SEQ ID NO: 301422 - RNA, 32 nt, Human
accauggaggcugaagauaaauagaugauccc

SEQ ID NO: 301423 - RNA, 28 nt, Human
accauggaugacgcugcuguccucaagc

SEQ ID NO: 301424 - RNA, 32 nt, Human
accauggauucugccuuuggaccccucucuau

SEQ ID NO: 301425 - RNA, 32 nt, Human
accauggcaagagagaaagaaagagaaaguac

SEQ ID NO: 301426 - RNA, 19 nt, Human
accauggcacccugcacca

SEQ ID NO: 301427 - RNA, 32 nt, Human
accauggcagagaaaagcaggagaggagcaaa

SEQ ID NO: 301428 - RNA, 28 nt, Human
accauggccacccuuaacucagccucua

SEQ ID NO: 301429 - RNA, 32 nt, Human
accauggccaggacaugugcaaugccagcccc

SEQ ID NO: 301430 - RNA, 28 nt, Human
accauggcccaagcccugcccuggcucc

SEQ ID NO: 301431 - RNA, 32 nt, Human
accauggcccaggauggaggcagcacuggcgc

SEQ ID NO: 301432 - RNA, 28 nt, Human
accauggccugagggcccugcucgucuc

SEQ ID NO: 301433 - RNA, 28 nt, Human
accauggcggagaaguuugacugccacu

SEQ ID NO: 301434 - RNA, 32 nt, Human
accauggcuaggcuggucucaaacucuugacc

SEQ ID NO: 301435 - RNA, 32 nt, Human
accauggcuuuuccuuuccuuucuucuccauu

SEQ ID NO: 301436 - RNA, 32 nt, Human
accaugggaccagcucuggccagagggaacua

SEQ ID NO: 301437 - RNA, 32 nt, Human
accaugggaggaaaacuucuuccuggccuggg

SEQ ID NO: 301438 - RNA, 32 nt, Human
accaugggaggaccagcugcuguaagugaagg

SEQ ID NO: 301439 - RNA, 32 nt, Human
accauggggauacuguggcuucugcuguccua

SEQ ID NO: 301440 - RNA, 32 nt, Human
accaugggugcugugacacuaacagucauuga

SEQ ID NO: 301441 - RNA, 22 nt, Human
accaugguagaaaaugcaccaa

SEQ ID NO: 301442 - RNA, 32 nt, Human
accaugguaggcaaggaaucucagggcgaaau

SEQ ID NO: 301443 - RNA, 32 nt, Human
accaugguauacaacaaaaauacauuucuuug

SEQ ID NO: 301444 - RNA, 32 nt, Human
accaugguccacugaccaggccccagagcaac

SEQ ID NO: 301445 - RNA, 32 nt, Human
accauggucugagcucccugcccugagagguc

SEQ ID NO: 301446 - RNA, 28 nt, Human
accauggugaagaucgugacaguuaaga

SEQ ID NO: 301447 - RNA, 32 nt, Human
accauggugaaggcuucuuuccccacugcagg

SEQ ID NO: 301448 - RNA, 32 nt, Human
accauggugcucugcagccaccucucacuuca

SEQ ID NO: 301449 - RNA, 28 nt, Human
accauggugugcgugaacguccuggccg

SEQ ID NO: 301450 - RNA, 32 nt, Human
accaugguugacuuacaagugucacuacagcu

SEQ ID NO: 301451 - RNA, 32 nt, Human
accauguaaaaauuggcaguucagagguugca

SEQ ID NO: 301452 - RNA, 31 nt, Human
accauguaauaaaacccaaaggaacagccca

SEQ ID NO: 301453 - RNA, 32 nt, Human
accauguacauacauguucugaaacuuucuca

SEQ ID NO: 301454 - RNA, 32 nt, Human
accauguacaucugcauuguuccuauagauaa

SEQ ID NO: 301455 - RNA, 22 nt, Human
accaugucaaggcugcagugag

SEQ ID NO: 301456 - RNA, 32 nt, Human
accaugucaucuuuacaauguugucuuccaau

SEQ ID NO: 301457 - RNA, 32 nt, Human
accauguccaaucauuggcuggaagcagccca

SEQ ID NO: 301458 - RNA, 32 nt, Human
accaugucccuagcccggccuggguggcgggg

SEQ ID NO: 301459 - RNA, 32 nt, Human
accaugucucaaacuccugaccucaggcgauc

SEQ ID NO: 301460 - RNA, 32 nt, Human
accaugugaacccagcaauccagugagguuga

SEQ ID NO: 301461 - RNA, 19 nt, Human
accaugugaccccgcacca

SEQ ID NO: 301462 - RNA, 32 nt, Human
accaugugaggacacagugagaagacagccgu

SEQ ID NO: 301463 - RNA, 18 nt, Human
accaugugauccucaaca

SEQ ID NO: 301464 - RNA, 32 nt, Human
accaugugccuccuuguuucucaggccuucca

SEQ ID NO: 301465 - RNA, 28 nt, Human
accaugugccugaaggagagccugcggc

SEQ ID NO: 301466 - RNA, 32 nt, Human
accaugugccugauccagccucuccccugauu

SEQ ID NO: 301467 - RNA, 28 nt, Human
accaugugcugcacccuggccuggggac

SEQ ID NO: 301468 - RNA, 32 nt, Human
accauguggccaggcuggucuagaacucaacc

SEQ ID NO: 301469 - RNA, 28 nt, Human
accauguggcugccuugggcucuguugc

SEQ ID NO: 301470 - RNA, 28 nt, Human
accaugugggugaacccggaggaggugu

SEQ ID NO: 301471 - RNA, 32 nt, Human
accaugugugggcucagggacccccaggacca

SEQ ID NO: 301472 - RNA, 28 nt, Human
accauguuaaggaggauuuuacagagga

SEQ ID NO: 301473 - RNA, 32 nt, Human
accauguuccuaagcuuccaagaagguuuugg

SEQ ID NO: 301474 - RNA, 32 nt, Human
accauguuccuugccaggccuccccaaccccu

SEQ ID NO: 301475 - RNA, 32 nt, Human
accauguucuugcaggcugggggcaagggauu

SEQ ID NO: 301476 - RNA, 32 nt, Human
accauguugcccaggcuggugucaaacuccug

SEQ ID NO: 301477 - RNA, 32 nt, Human
accauguugcccagguuggucuugagauccug

SEQ ID NO: 301478 - RNA, 32 nt, Human
accauguuggccaggauggucuugaaccccug

SEQ ID NO: 301479 - RNA, 32 nt, Human
accauguuggucaggcugcucucgaacuccag

SEQ ID NO: 301480 - RNA, 28 nt, Human
accauguuugccaaaggcaaaggcuccu

SEQ ID NO: 301481 - RNA, 28 nt, Human
accauguuugccaaaggcaaaggcucgg

SEQ ID NO: 301482 - RNA, 28 nt, Human
accauguuuuccucaaccuccacacccu

SEQ ID NO: 301483 - RNA, 20 nt, Human
accauuaaaagaacucaggg

SEQ ID NO: 301484 - RNA, 32 nt, Human
accauuaaggcuuuaagaacauguggaauaag

SEQ ID NO: 301485 - RNA, 32 nt, Human
accauuaauguguagagggcaaacaaagcaua

SEQ ID NO: 301486 - RNA, 32 nt, Human
accauuagcagccugaggagcuggcuggcugg

SEQ ID NO: 301487 - RNA, 32 nt, Human
accauuaguaccuaggaggcagggaucagagg

SEQ ID NO: 301488 - RNA, 32 nt, Human
accauuauaacccuacagagguggugagcaug

SEQ ID NO: 301489 - RNA, 32 nt, Human
accauuauauucuaaguuuucuaggcucauuc

SEQ ID NO: 301490 - RNA, 23 nt, Human
accauuaucacaauaaucagacu

SEQ ID NO: 301491 - RNA, 32 nt, Human
accauuaucugcauauuauaaaagccaauuuc

SEQ ID NO: 301492 - RNA, 32 nt, Human
accauucaacaugcuggggcaggauggacaug

SEQ ID NO: 301493 - RNA, 32 nt, Human
accauucaaccugccggggcaggauggacaug

SEQ ID NO: 301494 - RNA, 32 nt, Human
accauucacagaaggcucuauuucaauggauu

SEQ ID NO: 301495 - RNA, 32 nt, Human
accauucacucauguaauccucauauuaaugc

SEQ ID NO: 301496 - RNA, 32 nt, Human
accauucagcucaccugccuaggccgcagcag

SEQ ID NO: 301497 - RNA, 32 nt, Human
accauucaggaaucugcccugcacuuugcaua

SEQ ID NO: 301498 - RNA, 32 nt, Human
accauucauuacuccuccuccagauaccaacu

SEQ ID NO: 301499 - RNA, 32 nt, Human
accauucccaggcugcagaugcagaaacugug

SEQ ID NO: 301500 - RNA, 32 nt, Human
accauuccuagcucccugucacaguuuaagau

SEQ ID NO: 301501 - RNA, 32 nt, Human
accauuccuauauaauuccuggacuggugaga

SEQ ID NO: 301502 - RNA, 32 nt, Human
accauucgugaggggagaguugcaguccucuu

SEQ ID NO: 301503 - RNA, 32 nt, Human
accauucuccugccucagccucccagguagcu

SEQ ID NO: 301504 - RNA, 22 nt, Human
accauucucugcaauaaacuca

SEQ ID NO: 301505 - RNA, 32 nt, Human
accauucugaucuagagacaaaggauacucaa

SEQ ID NO: 301506 - RNA, 32 nt, Human
accauucugcucccccuaaaccuuuuguuuga

SEQ ID NO: 301507 - RNA, 24 nt, Human
accauucuggccaacauagugaaa

SEQ ID NO: 301508 - RNA, 24 nt, Human
accauucuggccaacauggugaaa

SEQ ID NO: 301509 - RNA, 32 nt, Human
accauucugugacauucuuuacaccaucccac

SEQ ID NO: 301510 - RNA, 32 nt, Human
accauucuugggaggacacuuuugccaaugaa

SEQ ID NO: 301511 - RNA, 32 nt, Human
accauugcaacaaaauacauucuuuuugcucu

SEQ ID NO: 301512 - RNA, 32 nt, Human
accauugcaacaaccucucaccaucugaagag

SEQ ID NO: 301513 - RNA, 32 nt, Human
accauugcacaccaaccugggugacagagcaa

SEQ ID NO: 301514 - RNA, 32 nt, Human
accauugcacacuaaccugggugacagaauga

SEQ ID NO: 301515 - RNA, 32 nt, Human
accauugcaccuccagccugggcaacagagug

SEQ ID NO: 301516 - RNA, 32 nt, Human
accauugcacuccagccugggugacagagcga

SEQ ID NO: 301517 - RNA, 32 nt, Human
accauugcacuccagcuugggugacagagcga

SEQ ID NO: 301518 - RNA, 32 nt, Human
accauugcacucuugucugggugacagaguga

SEQ ID NO: 301519 - RNA, 32 nt, Human
accauugcaggauaaucucacugacauuugga

SEQ ID NO: 301520 - RNA, 32 nt, Human
accauugcauuccagccuaggcaacagaguga

SEQ ID NO: 301521 - RNA, 32 nt, Human
accauugcauuccagccugggcaacaagagcg

SEQ ID NO: 301522 - RNA, 32 nt, Human
accauugcauuccagccugggcaacaagaggg

SEQ ID NO: 301523 - RNA, 32 nt, Human
accauugcauuccagccugggcaacaagagug

SEQ ID NO: 301524 - RNA, 32 nt, Human
accauugcauuccagccugggcaacagagcaa

SEQ ID NO: 301525 - RNA, 32 nt, Human
accauugcauuccagccugggugacagagcga

SEQ ID NO: 301526 - RNA, 32 nt, Human
accauugcccuccagccugggugacagaguga

SEQ ID NO: 301527 - RNA, 32 nt, Human
accauugcccucucccccgccucuucugagcu

SEQ ID NO: 301528 - RNA, 32 nt, Human
accauugcucuuuuaacauacagugcuugaau

SEQ ID NO: 301529 - RNA, 32 nt, Human
accauugcugauauugaaacuauucuaagagu

SEQ ID NO: 301530 - RNA, 32 nt, Human
accauugcuguccagccugggugacagagcaa

SEQ ID NO: 301531 - RNA, 32 nt, Human
accauuggauuggccuuagaagagaaucaucc

SEQ ID NO: 301532 - RNA, 32 nt, Human
accauuggccugguugagggcgugaccaccaa

SEQ ID NO: 301533 - RNA, 32 nt, Human
accauugguggggcuggcacgaauccagaucu

SEQ ID NO: 301534 - RNA, 32 nt, Human
accauuguacuccagccugggugacagagcaa

SEQ ID NO: 301535 - RNA, 32 nt, Human
accauuguaggcaauggaggagaguuaugcau

SEQ ID NO: 301536 - RNA, 32 nt, Human
accauugucucuguucagccaagugugcaagu

SEQ ID NO: 301537 - RNA, 23 nt, Human
accauugugcuucugagacccua

SEQ ID NO: 301538 - RNA, 32 nt, Human
accauuguguagcugggacuacaggcguccac

SEQ ID NO: 301539 - RNA, 32 nt, Human
accauuuacaaccugcauaauguggacucuug

SEQ ID NO: 301540 - RNA, 32 nt, Human
accauuuauauuuggcuuaugacauuuaaccc

SEQ ID NO: 301541 - RNA, 32 nt, Human
accauuucaguuagcaugugccucacuuuaag

SEQ ID NO: 301542 - RNA, 32 nt, Human
accauuucauucuguuucuacuaaccuauacc

SEQ ID NO: 301543 - RNA, 32 nt, Human
accauuuccaaaaagggcuuugugcuuuucac

SEQ ID NO: 301544 - RNA, 32 nt, Human
accauuuccagccucagcggggcagucuccuu

SEQ ID NO: 301545 - RNA, 32 nt, Human
accauuucccauccccauuccccaccacauua

SEQ ID NO: 301546 - RNA, 32 nt, Human
accauuucccccagauccugauucucuggggg

SEQ ID NO: 301547 - RNA, 32 nt, Human
accauuuccuccacucuuuauggcccaucacu

SEQ ID NO: 301548 - RNA, 32 nt, Human
accauuuccuggguguccuggguguuugcagc

SEQ ID NO: 301549 - RNA, 32 nt, Human
accauuucuacuucauuuggaaaaagauucag

SEQ ID NO: 301550 - RNA, 32 nt, Human
accauuucucucuuacuaacaguuucaucugu

SEQ ID NO: 301551 - RNA, 32 nt, Human
accauuucuggcuuccuuucuuugguuuugga

SEQ ID NO: 301552 - RNA, 25 nt, Human
accauuucuuccaauguaggauuca

SEQ ID NO: 301553 - RNA, 32 nt, Human
accauuugaaguugauuucucaaugcuaacua

SEQ ID NO: 301554 - RNA, 32 nt, Human
accauuugcauucagaaagcagcauuugaagc

SEQ ID NO: 301555 - RNA, 19 nt, Human
accauuugccuaaggaggu

SEQ ID NO: 301556 - RNA, 32 nt, Human
accauuuggccaaacaaccggcuacaaugcuc

SEQ ID NO: 301557 - RNA, 32 nt, Human
accauuugggcuaguuucuguguaaguguaaa

SEQ ID NO: 301558 - RNA, 32 nt, Human
accauuuguguaacagccaucugugaccugga

SEQ ID NO: 301559 - RNA, 32 nt, Human
accauuuuacuccuaugaauuuaauacuaaag

SEQ ID NO: 301560 - RNA, 32 nt, Human
accauuuuccuuguacucuucucuccacccuu

SEQ ID NO: 301561 - RNA, 32 nt, Human
accauuuucucagcaccauuguggggaguccu

SEQ ID NO: 301562 - RNA, 32 nt, Human
accauuuucugguucuuguguuggcuguggca

SEQ ID NO: 301563 - RNA, 32 nt, Human
accauuuucuucuuucucaggauuuggugcau

SEQ ID NO: 301564 - RNA, 32 nt, Human
accauuuucuugcucucccuccuuccuugggc

SEQ ID NO: 301565 - RNA, 32 nt, Human
accauuuugcuagggugugcaaugcccacaca

SEQ ID NO: 301566 - RNA, 32 nt, Human
accauuuuuaacuguuagauuugagaugaaca

SEQ ID NO: 301567 - RNA, 32 nt, Human
accauuuuugcagcuuuaauccuuagccucuu

SEQ ID NO: 301568 - RNA, 32 nt, Human
acccaaaaaucucaucuuggguguuuucaggg

SEQ ID NO: 301569 - RNA, 32 nt, Human
acccaaaaccuacauggaauguaugucuggag

SEQ ID NO: 301570 - RNA, 32 nt, Human
acccaaaacugagucccuuugggcucagaaau

SEQ ID NO: 301571 - RNA, 32 nt, Human
acccaaaagcccaucaaugauacacuggauaa

SEQ ID NO: 301572 - RNA, 32 nt, Human
acccaaaaggcagacauugcagugagccaaga

SEQ ID NO: 301573 - RNA, 32 nt, Human
acccaaaaggcggagguugcagugagccaaga

SEQ ID NO: 301574 - RNA, 32 nt, Human
acccaaaccaauaaauggugaguuuugaacaa

SEQ ID NO: 301575 - RNA, 32 nt, Human
acccaaaccaugggacccagcgccaggaauaa

SEQ ID NO: 301576 - RNA, 32 nt, Human
acccaaacuucuaaaaauugcuugcagaugag

SEQ ID NO: 301577 - RNA, 32 nt, Human
acccaaagcucucuccccacccuaccugccca

SEQ ID NO: 301578 - RNA, 32 nt, Human
acccaaaggaagcuaaacaccaccucacacuu

SEQ ID NO: 301579 - RNA, 32 nt, Human
acccaaaggcuuuauguucucauuccaaaaug

SEQ ID NO: 301580 - RNA, 32 nt, Human
acccaaagggaacacagcagaagaggaggugg

SEQ ID NO: 301581 - RNA, 32 nt, Human
acccaaaguuuucccaaaugaagagaacucac

SEQ ID NO: 301582 - RNA, 32 nt, Human
acccaaauauuaugccuuucaggaugauggua

SEQ ID NO: 301583 - RNA, 32 nt, Human
acccaaauauuugaccuaagggauccuuuauu

SEQ ID NO: 301584 - RNA, 32 nt, Human
acccaaaugaaagaaacugggggccaggcacg

SEQ ID NO: 301585 - RNA, 23 nt, Human
acccaaauggucucacacaccag

SEQ ID NO: 301586 - RNA, 18 nt, Human
acccaaauuaccccuucc

SEQ ID NO: 301587 - RNA, 32 nt, Human
acccaaauucuaggcaccugagguguuucccu

SEQ ID NO: 301588 - RNA, 32 nt, Human
acccaaauugccgcccuggcugugcugcaaac

SEQ ID NO: 301589 - RNA, 32 nt, Human
acccaaauuuuaauauuccagaagaacaacuu

SEQ ID NO: 301590 - RNA, 17 nt, Human
acccaacacccccucaa

SEQ ID NO: 301591 - RNA, 32 nt, Human
acccaacaccuuccaugacacuuccuugcuuu

SEQ ID NO: 301592 - RNA, 20 nt, Human
acccaacagugccaauggcc

SEQ ID NO: 301593 - RNA, 32 nt, Human
acccaacauaauagcagauacagacuuuuaag

SEQ ID NO: 301594 - RNA, 32 nt, Human
acccaacauggugaaaccccaucucuucuaaa

SEQ ID NO: 301595 - RNA, 32 nt, Human
acccaaccacgguccucuccggcgcaggccga

SEQ ID NO: 301596 - RNA, 32 nt, Human
acccaaccagggcuccgaaagccagccggccg

SEQ ID NO: 301597 - RNA, 32 nt, Human
acccaacccaaaccaccacaggugcuccuccu

SEQ ID NO: 301598 - RNA, 32 nt, Human
acccaacccccaggaccucaggcugcugucau

SEQ ID NO: 301599 - RNA, 32 nt, Human
acccaacccugccucccugggcuaggcucugg

SEQ ID NO: 301600 - RNA, 32 nt, Human
acccaaccuccaggagcacucgcucaucuccc

SEQ ID NO: 301601 - RNA, 32 nt, Human
acccaacuauaccaucucucuacucuuuaucu

SEQ ID NO: 301602 - RNA, 32 nt, Human
acccaacuccaccccaccugucuucaucguga

SEQ ID NO: 301603 - RNA, 32 nt, Human
acccaacuccgagggcccacgcuggggaaagc

SEQ ID NO: 301604 - RNA, 32 nt, Human
acccaacuccucccucuccgccccauagucca

SEQ ID NO: 301605 - RNA, 32 nt, Human
acccaacuccugcucucaaauggaugcagugg

SEQ ID NO: 301606 - RNA, 32 nt, Human
acccaacuggaauuugauggaaagaagguuug

SEQ ID NO: 301607 - RNA, 32 nt, Human
acccaacugucaccaucuuugcaccaaacugu

SEQ ID NO: 301608 - RNA, 32 nt, Human
acccaacuuaaccaaugcucugccucagggug

SEQ ID NO: 301609 - RNA, 32 nt, Human
acccaagaaaggaggcaacauggcugccauaa

SEQ ID NO: 301610 - RNA, 32 nt, Human
acccaagaagcugaggcaagaggaucacuuga

SEQ ID NO: 301611 - RNA, 32 nt, Human
acccaagaaguggagguugcagugagccaaga

SEQ ID NO: 301612 - RNA, 32 nt, Human
acccaagaaugagcuuacaaaguggccuuucc

SEQ ID NO: 301613 - RNA, 24 nt, Human
acccaagacugugccuucuccaga

SEQ ID NO: 301614 - RNA, 32 nt, Human
acccaagaggcagaggaugcaaugagccaaga

SEQ ID NO: 301615 - RNA, 32 nt, Human
acccaagaggcagagguugaguaagcugagaa

SEQ ID NO: 301616 - RNA, 32 nt, Human
acccaagaggcagagguugcagugaacugaga

SEQ ID NO: 301617 - RNA, 32 nt, Human
acccaagaggcagaguuugcagugagcugaga

SEQ ID NO: 301618 - RNA, 32 nt, Human
acccaagaggcggagguugaguaagcugagaa

SEQ ID NO: 301619 - RNA, 32 nt, Human
acccaagaggcggagguugcagugagccaaga

SEQ ID NO: 301620 - RNA, 32 nt, Human
acccaagaggcggagguuguggugagccgaga

SEQ ID NO: 301621 - RNA, 32 nt, Human
acccaagagguccaaggcugcagugagccaug

SEQ ID NO: 301622 - RNA, 32 nt, Human
acccaagaggucgaggcugcagugagccaaga

SEQ ID NO: 301623 - RNA, 32 nt, Human
acccaagagguggaggcugaagugagccaaga

SEQ ID NO: 301624 - RNA, 32 nt, Human
acccaagagguggagguugcggugagccaaga

SEQ ID NO: 301625 - RNA, 32 nt, Human
acccaagaucagaacuccaaaaccacucccac

SEQ ID NO: 301626 - RNA, 32 nt, Human
acccaagauccagcaggggacaggacagagua

SEQ ID NO: 301627 - RNA, 32 nt, Human
acccaagauggaagagccagagggcucuggag

SEQ ID NO: 301628 - RNA, 32 nt, Human
acccaagccacuagcaagacuccacaauguca

SEQ ID NO: 301629 - RNA, 32 nt, Human
acccaagcccaggaagucaagaaugcacugag

SEQ ID NO: 301630 - RNA, 18 nt, Human
acccaagcccccaacgcc

SEQ ID NO: 301631 - RNA, 32 nt, Human
acccaagccugcugggucucccuucccaguau

SEQ ID NO: 301632 - RNA, 32 nt, Human
acccaagccuucuucucccagauacaacggug

SEQ ID NO: 301633 - RNA, 20 nt, Human
acccaagcgccccagcgccu

SEQ ID NO: 301634 - RNA, 32 nt, Human
acccaagcugccuccccucuccuuccugugug

SEQ ID NO: 301635 - RNA, 22 nt, Human
acccaagcuggagugcaguggc

SEQ ID NO: 301636 - RNA, 32 nt, Human
acccaaggauggcugcuaucaauucuuccuuu

SEQ ID NO: 301637 - RNA, 32 nt, Human
acccaaggcauaagguugggaaaacaccucau

SEQ ID NO: 301638 - RNA, 32 nt, Human
acccaaggcugccuccagccccagcaacccgg

SEQ ID NO: 301639 - RNA, 32 nt, Human
acccaagggaccccuccccagaccagaaccaa

SEQ ID NO: 301640 - RNA, 32 nt, Human
acccaagggcagagcauuuaagagugaaguca

SEQ ID NO: 301641 - RNA, 32 nt, Human
acccaagggccugucugccagccugccugacc

SEQ ID NO: 301642 - RNA, 32 nt, Human
acccaagggucaacaggagacucucugcugag

SEQ ID NO: 301643 - RNA, 32 nt, Human
acccaaggugcugagagaucuccagcugcaca

SEQ ID NO: 301644 - RNA, 32 nt, Human
acccaaguauuuaaaaaugacucucuuaagcc

SEQ ID NO: 301645 - RNA, 32 nt, Human
acccaagucaccgaccacagagacugacgaga

SEQ ID NO: 301646 - RNA, 32 nt, Human
acccaaguccaggaguugcuaacugcacucuu

SEQ ID NO: 301647 - RNA, 32 nt, Human
acccaagucggugccacuagcccaggcagagc

SEQ ID NO: 301648 - RNA, 23 nt, Human
acccaagugauccucccaccuca

SEQ ID NO: 301649 - RNA, 20 nt, Human
acccaaguggcagggaucca

SEQ ID NO: 301650 - RNA, 32 nt, Human
acccaauacuggccuguguuguuaacagcagg

SEQ ID NO: 301651 - RNA, 32 nt, Human
acccaauagcaauggcgagaucaaggggucca

SEQ ID NO: 301652 - RNA, 32 nt, Human
acccaaucagcaguuagagagcaaggaaacuc

SEQ ID NO: 301653 - RNA, 32 nt, Human
acccaaucucucuugguagcaaauugucaaau

SEQ ID NO: 301654 - RNA, 32 nt, Human
acccaaugcagcauuuuccuuacugacaaaga

SEQ ID NO: 301655 - RNA, 32 nt, Human
acccaaugcaggucugcagggucucugcugug

SEQ ID NO: 301656 - RNA, 32 nt, Human
acccaaugccuguaccccuauuuuaucuagga

SEQ ID NO: 301657 - RNA, 30 nt, Human
acccaaugcucugcucccagccuggacuag

SEQ ID NO: 301658 - RNA, 32 nt, Human
acccaaugugcaaagugaaaacacugggcucc

SEQ ID NO: 301659 - RNA, 32 nt, Human
acccaauuucugucugaaaucuaaauuggaug

SEQ ID NO: 301660 - RNA, 32 nt, Human
acccacaacaugaaagaaauggugcuacccag

SEQ ID NO: 301661 - RNA, 32 nt, Human
acccacaaccagccccaugcaugcugcugccu

SEQ ID NO: 301662 - RNA, 32 nt, Human
acccacaacuuaggcccuagcggcagaaagga

SEQ ID NO: 301663 - RNA, 32 nt, Human
acccacaagcuuuuguucucucaguacuuguu

SEQ ID NO: 301664 - RNA, 20 nt, Human
acccacacacacaggacccg

SEQ ID NO: 301665 - RNA, 20 nt, Human
acccacacagaucaggacac

SEQ ID NO: 301666 - RNA, 32 nt, Human
acccacacagucacagucacacacacauaugu

SEQ ID NO: 301667 - RNA, 21 nt, Human
acccacacauucccauucacc

SEQ ID NO: 301668 - RNA, 32 nt, Human
acccacaccagguuccugugcuguacaguggc

SEQ ID NO: 301669 - RNA, 32 nt, Human
acccacaccccaaagcuggaaggaucugguuc

SEQ ID NO: 301670 - RNA, 32 nt, Human
acccacaccuguaaucccagcacuuugggagg

SEQ ID NO: 301671 - RNA, 32 nt, Human
acccacaccuuguguuccucauggccuacccc

SEQ ID NO: 301672 - RNA, 32 nt, Human
acccacacuuccaugagaagaagcagaucccc

SEQ ID NO: 301673 - RNA, 32 nt, Human
acccacagaaggaggaaguggaagggacagga

SEQ ID NO: 301674 - RNA, 32 nt, Human
acccacagagagagagcugcaagagcauggaa

SEQ ID NO: 301675 - RNA, 32 nt, Human
acccacagagugugcaucagucaccaccccaa

SEQ ID NO: 301676 - RNA, 32 nt, Human
acccacagaguuuaggcuggugcugccaaaaa

SEQ ID NO: 301677 - RNA, 32 nt, Human
acccacagccaagaggagucagagaugaggug

SEQ ID NO: 301678 - RNA, 32 nt, Human
acccacagcccaggcagcggguguguggagau

SEQ ID NO: 301679 - RNA, 32 nt, Human
acccacaggcggagguugcggugggcuggggu

SEQ ID NO: 301680 - RNA, 32 nt, Human
acccacagggacaauuccaaaugaaggccuua

SEQ ID NO: 301681 - RNA, 32 nt, Human
acccacagggacaauuccaaaugagggccuua

SEQ ID NO: 301682 - RNA, 32 nt, Human
acccacagggcagaggucacagugagccaaga

SEQ ID NO: 301683 - RNA, 32 nt, Human
acccacagucaguuccugccuccugcagaugu

SEQ ID NO: 301684 - RNA, 32 nt, Human
acccacagugcugcacuccuccugccccugcc

SEQ ID NO: 301685 - RNA, 32 nt, Human
acccacagugguggucaucucuucugaucuuc

SEQ ID NO: 301686 - RNA, 32 nt, Human
acccacaguuccucuuacagagcacuucagag

SEQ ID NO: 301687 - RNA, 32 nt, Human
acccacaucaccuugggaaggagaccucuacu

SEQ ID NO: 301688 - RNA, 32 nt, Human
acccacaucuggagcaggguggggagucagag

SEQ ID NO: 301689 - RNA, 23 nt, Human
acccacaugaaccaauacagccc

SEQ ID NO: 301690 - RNA, 32 nt, Human
acccacaugggguuccugguuguuccugcauc

SEQ ID NO: 301691 - RNA, 32 nt, Human
acccacauuacagcggagaagacugaggucca

SEQ ID NO: 301692 - RNA, 32 nt, Human
acccaccaaggaagacaaagaaaaacaaugaa

SEQ ID NO: 301693 - RNA, 28 nt, Human
acccaccacagcgcagccucaucaaaau

SEQ ID NO: 301694 - RNA, 32 nt, Human
acccaccaccucagugcugaggucaaggcagc

SEQ ID NO: 301695 - RNA, 32 nt, Human
acccaccaccucuugcacucucgcuuuuggag

SEQ ID NO: 301696 - RNA, 32 nt, Human
acccaccacgcccugacugcaggugugauucg

SEQ ID NO: 301697 - RNA, 32 nt, Human
acccaccagaagagcacaaagcaaggccauug

SEQ ID NO: 301698 - RNA, 24 nt, Human
acccaccagacaccacacagcaga

SEQ ID NO: 301699 - RNA, 21 nt, Human
acccaccagcucagaaccugu

SEQ ID NO: 301700 - RNA, 32 nt, Human
acccaccagcuggcuguacccggagccguggc

SEQ ID NO: 301701 - RNA, 22 nt, Human
acccaccaggacagcagucuca

SEQ ID NO: 301702 - RNA, 32 nt, Human
acccaccaugacacccacagacuucacaagcc

SEQ ID NO: 301703 - RNA, 32 nt, Human
acccaccauggcgagccccacucugagccccg

SEQ ID NO: 301704 - RNA, 32 nt, Human
acccaccaugucugccccaucacgcggccgag

SEQ ID NO: 301705 - RNA, 32 nt, Human
acccacccaaguacugaggugugacgcggcac

SEQ ID NO: 301706 - RNA, 22 nt, Human
acccacccacacgcucgucuca

SEQ ID NO: 301707 - RNA, 32 nt, Human
acccacccacaucacaggauggagucugcaag

SEQ ID NO: 301708 - RNA, 32 nt, Human
acccacccaccacacuggacuuuucuagagau

SEQ ID NO: 301709 - RNA, 32 nt, Human
acccacccagaaccuccacccucugacaccau

SEQ ID NO: 301710 - RNA, 32 nt, Human
acccacccagcuagggcagaggggucaggaug

SEQ ID NO: 301711 - RNA, 32 nt, Human
acccacccaucuuugucccuggggccugcucc

SEQ ID NO: 301712 - RNA, 32 nt, Human
acccaccccaaaaugaccuuggccaccugucu

SEQ ID NO: 301713 - RNA, 21 nt, Human
acccaccccaccccccaaaau

SEQ ID NO: 301714 - RNA, 32 nt, Human
acccaccccacccuuugcuuucauuucaggug

SEQ ID NO: 301715 - RNA, 32 nt, Human
acccaccccaguuuagaacugcaggagcuccc

SEQ ID NO: 301716 - RNA, 32 nt, Human
acccaccccuuccagcugucucagccucaggg

SEQ ID NO: 301717 - RNA, 32 nt, Human
acccaccccuuggaggagagagaccccgcacc

SEQ ID NO: 301718 - RNA, 21 nt, Human
acccacccgcccgcccagggc

SEQ ID NO: 301719 - RNA, 22 nt, Human
acccacccgccucggccucuca

SEQ ID NO: 301720 - RNA, 32 nt, Human
acccacccgcugugcugaccaugggcccugag

SEQ ID NO: 301721 - RNA, 32 nt, Human
acccacccuccaggaccccagcaaguggauuc

SEQ ID NO: 301722 - RNA, 32 nt, Human
acccacccuccccuuaaacccucugccuuuga

SEQ ID NO: 301723 - RNA, 32 nt, Human
acccacccugcagcgcuccagcucuguugugu

SEQ ID NO: 301724 - RNA, 32 nt, Human
acccacccugcucaccccugaagcuucucugg

SEQ ID NO: 301725 - RNA, 32 nt, Human
acccacccugcuccuccccaauugcucccagc

SEQ ID NO: 301726 - RNA, 32 nt, Human
acccaccgcuaccaccaccaccaccgccacca

SEQ ID NO: 301727 - RNA, 32 nt, Human
acccaccggaagcagaagccugguggaugccu

SEQ ID NO: 301728 - RNA, 32 nt, Human
acccaccggcacacagaccccaaccacgacac

SEQ ID NO: 301729 - RNA, 32 nt, Human
acccaccggcacacagaccccaaccacgguac

SEQ ID NO: 301730 - RNA, 32 nt, Human
acccaccggccacugcagcccuggugagggcg

SEQ ID NO: 301731 - RNA, 25 nt, Human
acccaccggccccaccaggcuccgc

SEQ ID NO: 301732 - RNA, 32 nt, Human
acccaccguggaggaggaaggcaagagggggu

SEQ ID NO: 301733 - RNA, 20 nt, Human
acccaccuacaccccuggca

SEQ ID NO: 301734 - RNA, 19 nt, Human
acccaccuaccccccaaaa

SEQ ID NO: 301735 - RNA, 32 nt, Human
acccaccucaacaucaagccuggggcaggugg

SEQ ID NO: 301736 - RNA, 32 nt, Human
acccaccucaggaagugcugggauuacaggcg

SEQ ID NO: 301737 - RNA, 19 nt, Human
acccaccuccaagucucca

SEQ ID NO: 301738 - RNA, 32 nt, Human
acccaccuccacccccgccacggccacccucc

SEQ ID NO: 301739 - RNA, 32 nt, Human
acccaccuccacccccuucuuccagaaucugc

SEQ ID NO: 301740 - RNA, 18 nt, Human
acccaccuccagcuucca

SEQ ID NO: 301741 - RNA, 32 nt, Human
acccaccucccaggcugaugccuggaggcagc

SEQ ID NO: 301742 - RNA, 32 nt, Human
acccaccucccauccaugcacacaccaggaug

SEQ ID NO: 301743 - RNA, 32 nt, Human
acccaccucgaaccaacaacagaagcugacaa

SEQ ID NO: 301744 - RNA, 32 nt, Human
acccaccucuuucauaagcgugaccuggaugu

SEQ ID NO: 301745 - RNA, 20 nt, Human
acccaccugauggcuucuca

SEQ ID NO: 301746 - RNA, 19 nt, Human
acccaccugcaagguccca

SEQ ID NO: 301747 - RNA, 32 nt, Human
acccaccugcagcucaggaacauacacagcuc

SEQ ID NO: 301748 - RNA, 23 nt, Human
acccaccugccaucaggcuccca

SEQ ID NO: 301749 - RNA, 22 nt, Human
acccaccugccccuuucuuuca

SEQ ID NO: 301750 - RNA, 22 nt, Human
acccaccugccucggccuccca

SEQ ID NO: 301751 - RNA, 22 nt, Human
acccaccugcgucucauacuca

SEQ ID NO: 301752 - RNA, 23 nt, Human
acccaccugcuagucgccccuca

SEQ ID NO: 301753 - RNA, 32 nt, Human
acccaccugcugcaucuuaguucagucggcuc

SEQ ID NO: 301754 - RNA, 20 nt, Human
acccaccugcugcucaccuc

SEQ ID NO: 301755 - RNA, 32 nt, Human
acccaccugcugcuguaugaauagcuguguau

SEQ ID NO: 301756 - RNA, 32 nt, Human
acccaccuggacaacauagugaaacccugucu

SEQ ID NO: 301757 - RNA, 18 nt, Human
acccaccuggcuugcauc

SEQ ID NO: 301758 - RNA, 32 nt, Human
acccaccuggugcucccccaaccagagaucca

SEQ ID NO: 301759 - RNA, 18 nt, Human
acccaccuuccccuguga

SEQ ID NO: 301760 - RNA, 32 nt, Human
acccacgaaggccacagagauggccggggcuu

SEQ ID NO: 301761 - RNA, 32 nt, Human
acccacgauucugagcccugaguaugccugga

SEQ ID NO: 301762 - RNA, 32 nt, Human
acccacgccacagcgggcucucagcacccuuc

SEQ ID NO: 301763 - RNA, 25 nt, Human
acccacgccacggccaggagcccag

SEQ ID NO: 301764 - RNA, 32 nt, Human
acccacgccuccugaggacacagccaucagca

SEQ ID NO: 301765 - RNA, 32 nt, Human
acccacgccuggcugauguuuuuauuuuacuc

SEQ ID NO: 301766 - RNA, 32 nt, Human
acccacgccuguuuucagcuguggguggccau

SEQ ID NO: 301767 - RNA, 32 nt, Human
acccacggcuggagagaaauagggagaugcag

SEQ ID NO: 301768 - RNA, 32 nt, Human
acccacgggaagauguccguggagaggcagag

SEQ ID NO: 301769 - RNA, 32 nt, Human
acccacgucuucucgggagggguggguggcac

SEQ ID NO: 301770 - RNA, 18 nt, Human
acccacgugauuugcaua

SEQ ID NO: 301771 - RNA, 32 nt, Human
acccacuaaacaguaacuccccacucccccug

SEQ ID NO: 301772 - RNA, 32 nt, Human
acccacuaauuugcacaaaacuauucuggcug

SEQ ID NO: 301773 - RNA, 32 nt, Human
acccacuacauggcagaggcugaggcggugug

SEQ ID NO: 301774 - RNA, 31 nt, Human
acccacucaauaaaucuugaaacaugaaaaa

SEQ ID NO: 301775 - RNA, 32 nt, Human
acccacucacacccacccucaguggcuucuug

SEQ ID NO: 301776 - RNA, 32 nt, Human
acccacucauauaacauaccucaggucuauuu

SEQ ID NO: 301777 - RNA, 32 nt, Human
acccacucaucugucccugaccucuaaccuuu

SEQ ID NO: 301778 - RNA, 32 nt, Human
acccacuccaggaacccagagccacauuagaa

SEQ ID NO: 301779 - RNA, 32 nt, Human
acccacuccauguuacuucugcuucgcuuucc

SEQ ID NO: 301780 - RNA, 32 nt, Human
acccacuccauucaauguuacauauaaaauag

SEQ ID NO: 301781 - RNA, 32 nt, Human
acccacucccagcucccagccuggcaugagcu

SEQ ID NO: 301782 - RNA, 32 nt, Human
acccacucccucuuagccaauauugugccuau

SEQ ID NO: 301783 - RNA, 32 nt, Human
acccacuccugccucccacccgggugccgugu

SEQ ID NO: 301784 - RNA, 32 nt, Human
acccacucucuucucccccugacccccgcucc

SEQ ID NO: 301785 - RNA, 21 nt, Human
acccacugacucagggcucag

SEQ ID NO: 301786 - RNA, 32 nt, Human
acccacugagagaagaggagcaucagcuacag

SEQ ID NO: 301787 - RNA, 32 nt, Human
acccacuggaagcugcucagcccugcucacca

SEQ ID NO: 301788 - RNA, 22 nt, Human
acccacuggaaggagaggccag

SEQ ID NO: 301789 - RNA, 28 nt, Human
acccacuggcaguccccaaggggcgcag

SEQ ID NO: 301790 - RNA, 32 nt, Human
acccacuggccagccaggccauggcuucuccc

SEQ ID NO: 301791 - RNA, 20 nt, Human
acccacuggccauagguaca

SEQ ID NO: 301792 - RNA, 24 nt, Human
acccacuggcggccaggggcacag

SEQ ID NO: 301793 - RNA, 32 nt, Human
acccacugggagaagaugccuggggguccagg

SEQ ID NO: 301794 - RNA, 32 nt, Human
acccacuggucugcuuaaagcuucccucucag

SEQ ID NO: 301795 - RNA, 32 nt, Human
acccacuguaugcacacaacuguucuugcugg

SEQ ID NO: 301796 - RNA, 32 nt, Human
acccacuuagccaagauaucacucuuggacac

SEQ ID NO: 301797 - RNA, 32 nt, Human
acccacuucuggguucucaggcuggcugacag

SEQ ID NO: 301798 - RNA, 32 nt, Human
acccacuuggacucacccccucuuggggaggg

SEQ ID NO: 301799 - RNA, 32 nt, Human
acccacuuucagcuggacacaggcgcggccuc

SEQ ID NO: 301800 - RNA, 32 nt, Human
acccacuuucucucucaaacugucuuuucuca

SEQ ID NO: 301801 - RNA, 32 nt, Human
acccacuuuguggagcuuaucauuucauuucc

SEQ ID NO: 301802 - RNA, 22 nt, Human
acccacuuuucuaccucuccca

SEQ ID NO: 301803 - RNA, 32 nt, Human
acccacuuuucugccagcuccacaaccuuggg

SEQ ID NO: 301804 - RNA, 24 nt, Human
acccagaaaaucaguacuaacaaa

SEQ ID NO: 301805 - RNA, 32 nt, Human
acccagaaaggcaagggcauggggaagaauau

SEQ ID NO: 301806 - RNA, 32 nt, Human
acccagaaauuuagacagggaucucuuaccuu

SEQ ID NO: 301807 - RNA, 32 nt, Human
acccagaacacagggcuucuacuccaggguuu

SEQ ID NO: 301808 - RNA, 21 nt, Human
acccagaacccugacucuuga

SEQ ID NO: 301809 - RNA, 32 nt, Human
acccagaacugaacuagacuccccuaccuuag

SEQ ID NO: 301810 - RNA, 32 nt, Human
acccagaagcagcucugggcugccaggauggu

SEQ ID NO: 301811 - RNA, 32 nt, Human
acccagaagccaggacugacugugcaccagag

SEQ ID NO: 301812 - RNA, 32 nt, Human
acccagaagcggagguugcagugagcugagau

SEQ ID NO: 301813 - RNA, 32 nt, Human
acccagaaggcagacgccaguaguacuguccu

SEQ ID NO: 301814 - RNA, 32 nt, Human
acccagaaggcagagguugcagugagcugaga

SEQ ID NO: 301815 - RNA, 32 nt, Human
acccagaaggcagagguugcaugaugcaauca

SEQ ID NO: 301816 - RNA, 32 nt, Human
acccagaaggcagggguugcagugagccaaga

SEQ ID NO: 301817 - RNA, 32 nt, Human
acccagaaggcggaaguugcagugagccgaga

SEQ ID NO: 301818 - RNA, 32 nt, Human
acccagaaggcggaaguugcagugagcugaga

SEQ ID NO: 301819 - RNA, 32 nt, Human
acccagaaggugcagguugcagugagcugaga

SEQ ID NO: 301820 - RNA, 32 nt, Human
acccagaagguggagguagcagugagccgaga

SEQ ID NO: 301821 - RNA, 32 nt, Human
acccagaagguggagguugcagugagccgaga

SEQ ID NO: 301822 - RNA, 32 nt, Human
acccagaaugccacaaccacaggccgaaccac

SEQ ID NO: 301823 - RNA, 18 nt, Human
acccagacaauggcgaga

SEQ ID NO: 301824 - RNA, 32 nt, Human
acccagacacacaccccagcaccuggcacuua

SEQ ID NO: 301825 - RNA, 32 nt, Human
acccagacacaccagucuuguaucucuuaaaa

SEQ ID NO: 301826 - RNA, 32 nt, Human
acccagacagagagacaggcagacacagccua

SEQ ID NO: 301827 - RNA, 19 nt, Human
acccagacagaugguccca

SEQ ID NO: 301828 - RNA, 21 nt, Human
acccagaccagucccaacgcc

SEQ ID NO: 301829 - RNA, 32 nt, Human
acccagaccccacuccagagggagccuggcag

SEQ ID NO: 301830 - RNA, 22 nt, Human
acccagacgcaggacagagugg

SEQ ID NO: 301831 - RNA, 32 nt, Human
acccagacucacuggccacaccucagcagggg

SEQ ID NO: 301832 - RNA, 22 nt, Human
acccagacuggagugcaguggc

SEQ ID NO: 301833 - RNA, 23 nt, Human
acccagacuggagugcaguggcg

SEQ ID NO: 301834 - RNA, 24 nt, Human
acccagacuggagugcaguggugu

SEQ ID NO: 301835 - RNA, 22 nt, Human
acccagacuggagugcgauggc

SEQ ID NO: 301836 - RNA, 18 nt, Human
acccagagaaccugggca

SEQ ID NO: 301837 - RNA, 32 nt, Human
acccagagaaggagaagccagcaaaggagacg

SEQ ID NO: 301838 - RNA, 32 nt, Human
acccagagacagacagacuauggccauggcuc

SEQ ID NO: 301839 - RNA, 32 nt, Human
acccagagacuuguaucagcaggaagccauug

SEQ ID NO: 301840 - RNA, 32 nt, Human
acccagagaggcggcagcaggagagccacaga

SEQ ID NO: 301841 - RNA, 32 nt, Human
acccagagagugagcagcagcaagauuuauug

SEQ ID NO: 301842 - RNA, 32 nt, Human
acccagagccaagaaagcugagauauccugug

SEQ ID NO: 301843 - RNA, 32 nt, Human
acccagagcccaugggcccucccgggacaucu

SEQ ID NO: 301844 - RNA, 32 nt, Human
acccagagccuccaccaaacccucuccauguc

SEQ ID NO: 301845 - RNA, 32 nt, Human
acccagagcucucacccucucuucuagggcac

SEQ ID NO: 301846 - RNA, 32 nt, Human
acccagaggaaagcuguugaugcugaaauguu

SEQ ID NO: 301847 - RNA, 21 nt, Human
acccagaggaaguucuccaga

SEQ ID NO: 301848 - RNA, 19 nt, Human
acccagaggaugcagggaa

SEQ ID NO: 301849 - RNA, 32 nt, Human
acccagaggcggagguuguagugagccgaaau

SEQ ID NO: 301850 - RNA, 32 nt, Human
acccagagggagcagugaggcaggacagaugg

SEQ ID NO: 301851 - RNA, 32 nt, Human
acccagaggggaaggugguggaaaaugugcac

SEQ ID NO: 301852 - RNA, 32 nt, Human
acccagaggggccccuggcacacuccagucca

SEQ ID NO: 301853 - RNA, 32 nt, Human
acccagagggugcugcccaccaugcuccugag

SEQ ID NO: 301854 - RNA, 32 nt, Human
acccagaguagaacagcagccagcaagcugcc

SEQ ID NO: 301855 - RNA, 32 nt, Human
acccagagucccaggccccuggaguuguuuuc

SEQ ID NO: 301856 - RNA, 32 nt, Human
acccagagugucccugugggaggcaggcagaa

SEQ ID NO: 301857 - RNA, 32 nt, Human
acccagagugugguccuuggccgccuccugcu

SEQ ID NO: 301858 - RNA, 32 nt, Human
acccagaguuuauguagaaagcauugaauguu

SEQ ID NO: 301859 - RNA, 32 nt, Human
acccagauagcagagguugcagugagcugaga

SEQ ID NO: 301860 - RNA, 32 nt, Human
acccagauaugcuuuuggaaugugguccucac

SEQ ID NO: 301861 - RNA, 20 nt, Human
acccagaucccgagguccga

SEQ ID NO: 301862 - RNA, 32 nt, Human
acccagauccuggggucccucacuacagcucc

SEQ ID NO: 301863 - RNA, 32 nt, Human
acccagaucguccacaccacacccucuuucag

SEQ ID NO: 301864 - RNA, 32 nt, Human
acccagaugccccuuucuggauuauucugggg

SEQ ID NO: 301865 - RNA, 21 nt, Human
acccagauggcuccucugggc

SEQ ID NO: 301866 - RNA, 32 nt, Human
acccagaugguuuaaggacaccccagaguccc

SEQ ID NO: 301867 - RNA, 32 nt, Human
acccagauuagugcagcccggaggcuuagggu

SEQ ID NO: 301868 - RNA, 32 nt, Human
acccagcaaaaaugaagaggaaaacaaacagg

SEQ ID NO: 301869 - RNA, 32 nt, Human
acccagcaacaacaaaagaacuaguccucuua

SEQ ID NO: 301870 - RNA, 32 nt, Human
acccagcaagaguuucaggaaguggguugcua

SEQ ID NO: 301871 - RNA, 32 nt, Human
acccagcaagggacagaggccacaggccugga

SEQ ID NO: 301872 - RNA, 20 nt, Human
acccagcacacccacuucca

SEQ ID NO: 301873 - RNA, 32 nt, Human
acccagcacagcccgcuggccccucuccugca

SEQ ID NO: 301874 - RNA, 32 nt, Human
acccagcacccaagguucagugacacagggug

SEQ ID NO: 301875 - RNA, 32 nt, Human
acccagcaccccuccgguagguggguggccac

SEQ ID NO: 301876 - RNA, 32 nt, Human
acccagcaccucagugaagggggccugcuugc

SEQ ID NO: 301877 - RNA, 32 nt, Human
acccagcaccuugcagauuuucuuaaggaauu

SEQ ID NO: 301878 - RNA, 20 nt, Human
acccagcacuaccccaaacc

SEQ ID NO: 301879 - RNA, 32 nt, Human
acccagcacuuccucuugcccuccuggcuuua

SEQ ID NO: 301880 - RNA, 21 nt, Human
acccagcagacacugcccagg

SEQ ID NO: 301881 - RNA, 32 nt, Human
acccagcagagggaggcagaagggccuuccca

SEQ ID NO: 301882 - RNA, 32 nt, Human
acccagcagauggagguugcagugagccaaga

SEQ ID NO: 301883 - RNA, 18 nt, Human
acccagcagcaucaagcc

SEQ ID NO: 301884 - RNA, 19 nt, Human
acccagcagccaaacgccu

SEQ ID NO: 301885 - RNA, 22 nt, Human
acccagcagcgcccacagcgcc

SEQ ID NO: 301886 - RNA, 20 nt, Human
acccagcagcgcccgaggcc

SEQ ID NO: 301887 - RNA, 18 nt, Human
acccagcagcgcggcgcc

SEQ ID NO: 301888 - RNA, 19 nt, Human
acccagcagcgcuccaccu

SEQ ID NO: 301889 - RNA, 19 nt, Human
acccagcagcgcuccgccu

SEQ ID NO: 301890 - RNA, 23 nt, Human
acccagcaggaggacccaacgcu

SEQ ID NO: 301891 - RNA, 32 nt, Human
acccagcaggcagagguugcagugagccaaga

SEQ ID NO: 301892 - RNA, 21 nt, Human
acccagcaggcagaguggcgu

SEQ ID NO: 301893 - RNA, 32 nt, Human
acccagcaggcagaguggcguggccuccccau

SEQ ID NO: 301894 - RNA, 32 nt, Human
acccagcaggcggagguugcggugagucgaga

SEQ ID NO: 301895 - RNA, 32 nt, Human
acccagcagggaacagggagcggugugcagag

SEQ ID NO: 301896 - RNA, 32 nt, Human
acccagcagguggcccagggaggcagauacag

SEQ ID NO: 301897 - RNA, 24 nt, Human
acccagcaguccagugcaacgucu

SEQ ID NO: 301898 - RNA, 18 nt, Human
acccagcagugcccugcc

SEQ ID NO: 301899 - RNA, 31 nt, Human
acccagcaguuuccucugcucacucuuuucc

SEQ ID NO: 301900 - RNA, 32 nt, Human
acccagcaucugcagugcccagccgcacaggg

SEQ ID NO: 301901 - RNA, 32 nt, Human
acccagcaucuugccagaaguuggcucagaau

SEQ ID NO: 301902 - RNA, 32 nt, Human
acccagcauguccuaggaaugcagccccagga

SEQ ID NO: 301903 - RNA, 32 nt, Human
acccagccaaaccagguaaggccuacgugggg

SEQ ID NO: 301904 - RNA, 32 nt, Human
acccagccaacucgcagagggaagggaggggc

SEQ ID NO: 301905 - RNA, 32 nt, Human
acccagccaagugccuuuuccucagcacugag

SEQ ID NO: 301906 - RNA, 23 nt, Human
acccagccagaggccuggcucaa

SEQ ID NO: 301907 - RNA, 32 nt, Human
acccagccagcaaguauauagcacagaacacu

SEQ ID NO: 301908 - RNA, 19 nt, Human
acccagccaucggcugcgg

SEQ ID NO: 301909 - RNA, 20 nt, Human
acccagccaucugcccaggg

SEQ ID NO: 301910 - RNA, 18 nt, Human
acccagcccaccccuucc

SEQ ID NO: 301911 - RNA, 19 nt, Human
acccagcccacuucugcca

SEQ ID NO: 301912 - RNA, 19 nt, Human
acccagccccaggcauggc

SEQ ID NO: 301913 - RNA, 22 nt, Human
acccagcccccacauccugugc

SEQ ID NO: 301914 - RNA, 32 nt, Human
acccagcccccacauccugugccuccaucagc

SEQ ID NO: 301915 - RNA, 21 nt, Human
acccagcccccuccccuucca

SEQ ID NO: 301916 - RNA, 20 nt, Human
acccagccccuggcucuggg

SEQ ID NO: 301917 - RNA, 32 nt, Human
acccagcccgggagguggaugaaugugggaga

SEQ ID NO: 301918 - RNA, 32 nt, Human
acccagcccucauccucccuugcucacaaagu

SEQ ID NO: 301919 - RNA, 32 nt, Human
acccagcccuccugaagauagccagagagccc

SEQ ID NO: 301920 - RNA, 32 nt, Human
acccagcccucugaaccagcagucuuugccug

SEQ ID NO: 301921 - RNA, 32 nt, Human
acccagcccugccuccucagccagugucuuca

SEQ ID NO: 301922 - RNA, 21 nt, Human
acccagcccugcugucccgcg

SEQ ID NO: 301923 - RNA, 32 nt, Human
acccagccgcaaggucuuccagcugcugccca

SEQ ID NO: 301924 - RNA, 19 nt, Human
acccagccgcugcccggcg

SEQ ID NO: 301925 - RNA, 32 nt, Human
acccagccggagcgagcaacagguuggugaaa

SEQ ID NO: 301926 - RNA, 32 nt, Human
acccagccucacagacccucucaggccucuga

SEQ ID NO: 301927 - RNA, 32 nt, Human
acccagccucaguccuaacuccuggggcuggg

SEQ ID NO: 301928 - RNA, 23 nt, Human
acccagccucuagaacuaugaga

SEQ ID NO: 301929 - RNA, 32 nt, Human
acccagccucuuccucuuccuuuuggauacgc

SEQ ID NO: 301930 - RNA, 19 nt, Human
acccagccugcugccucag

SEQ ID NO: 301931 - RNA, 32 nt, Human
acccagccuggaccccgugcagagcuucuccc

SEQ ID NO: 301932 - RNA, 32 nt, Human
acccagccuggccacacacuguggugccaucu

SEQ ID NO: 301933 - RNA, 32 nt, Human
acccagccuggccagcagacacacacagggau

SEQ ID NO: 301934 - RNA, 32 nt, Human
acccagccugggauaggggcagaggaggcgag

SEQ ID NO: 301935 - RNA, 25 nt, Human
acccagccugggugacagagcgaga

SEQ ID NO: 301936 - RNA, 32 nt, Human
acccagccuguuucucuuuuuccacucuucuu

SEQ ID NO: 301937 - RNA, 32 nt, Human
acccagccuugcacuccaaggcugcgcaccgc

SEQ ID NO: 301938 - RNA, 17 nt, Human
acccagcgcccccucaa

SEQ ID NO: 301939 - RNA, 32 nt, Human
acccagcgcgccuucuccaggaauaggcgaga

SEQ ID NO: 301940 - RNA, 32 nt, Human
acccagcggcgccggggcgucugugauuggga

SEQ ID NO: 301941 - RNA, 32 nt, Human
acccagcgggaagagguugcagugagccaaga

SEQ ID NO: 301942 - RNA, 32 nt, Human
acccagcuacucgggagguugaggcaggagaa

SEQ ID NO: 301943 - RNA, 32 nt, Human
acccagcuacuuugcauuccagaaguuuccau

SEQ ID NO: 301944 - RNA, 32 nt, Human
acccagcuagauguggccaggccacacuccag

SEQ ID NO: 301945 - RNA, 19 nt, Human
acccagcucaaggagcuua

SEQ ID NO: 301946 - RNA, 32 nt, Human
acccagcucaaggagcuuaugcaggagcaggu

SEQ ID NO: 301947 - RNA, 20 nt, Human
acccagcucacaggagcuua

SEQ ID NO: 301948 - RNA, 32 nt, Human
acccagcucacuggucagccuacacaugucuc

SEQ ID NO: 301949 - RNA, 22 nt, Human
acccagcucaggccugccccag

SEQ ID NO: 301950 - RNA, 32 nt, Human
acccagcuccacccucucgucaagcucauccu

SEQ ID NO: 301951 - RNA, 32 nt, Human
acccagcucccaucugcugcccauggaugcuc

SEQ ID NO: 301952 - RNA, 23 nt, Human
acccagcucccuaccuccugugc

SEQ ID NO: 301953 - RNA, 24 nt, Human
acccagcucccugcacacccaggc

SEQ ID NO: 301954 - RNA, 19 nt, Human
acccagcuccucacauugg

SEQ ID NO: 301955 - RNA, 19 nt, Human
acccagcuccucugagcca

SEQ ID NO: 301956 - RNA, 23 nt, Human
acccagcuccugaagcaccaggc

SEQ ID NO: 301957 - RNA, 24 nt, Human
acccagcuccugccacccaauggc

SEQ ID NO: 301958 - RNA, 24 nt, Human
acccagcuccugccacccaguggc

SEQ ID NO: 301959 - RNA, 21 nt, Human
acccagcuccuuuugcugggc

SEQ ID NO: 301960 - RNA, 24 nt, Human
acccagcucgaggaucccaggugc

SEQ ID NO: 301961 - RNA, 32 nt, Human
acccagcucucauucucuucuagguuguucca

SEQ ID NO: 301962 - RNA, 24 nt, Human
acccagcucuccugcucugaacca

SEQ ID NO: 301963 - RNA, 32 nt, Human
acccagcucugagugguuggugggaccucugc

SEQ ID NO: 301964 - RNA, 21 nt, Human
acccagcucugugcccaaggc

SEQ ID NO: 301965 - RNA, 32 nt, Human
acccagcucuuccucaccuuccugucuaguuu

SEQ ID NO: 301966 - RNA, 32 nt, Human
acccagcugcagcaaggagguggggaaggagg

SEQ ID NO: 301967 - RNA, 32 nt, Human
acccagcugccacccaccuccuccaucacugg

SEQ ID NO: 301968 - RNA, 32 nt, Human
acccagcugccaccucuccauccugcugcccu

SEQ ID NO: 301969 - RNA, 23 nt, Human
acccagcuggcaaugugcccagg

SEQ ID NO: 301970 - RNA, 32 nt, Human
acccagcugggagggggaggaggaggagcuca

SEQ ID NO: 301971 - RNA, 32 nt, Human
acccagcuggguagcagccagcaaaggccauc

SEQ ID NO: 301972 - RNA, 32 nt, Human
acccagcuguagugagguugcagugauugagu

SEQ ID NO: 301973 - RNA, 32 nt, Human
acccagcuguggucccagagaucagggggugu

SEQ ID NO: 301974 - RNA, 32 nt, Human
acccagcuucacuaacagugggcugaaaacau

SEQ ID NO: 301975 - RNA, 32 nt, Human
acccagcuucacuaacagugggcugaaaccaa

SEQ ID NO: 301976 - RNA, 19 nt, Human
acccagcuuccagcccagg

SEQ ID NO: 301977 - RNA, 20 nt, Human
acccagcuucccuucuaacc

SEQ ID NO: 301978 - RNA, 32 nt, Human
acccaggaaagguguggcuggaagcacugaac

SEQ ID NO: 301979 - RNA, 32 nt, Human
acccaggaacugagaaggagguuuccaguuca

SEQ ID NO: 301980 - RNA, 32 nt, Human
acccaggaagaggagguugcagugagccgaga

SEQ ID NO: 301981 - RNA, 32 nt, Human
acccaggaagcagagguugcaguaagcugaga

SEQ ID NO: 301982 - RNA, 32 nt, Human
acccaggaagcagagguugcagugagcagaga

SEQ ID NO: 301983 - RNA, 32 nt, Human
acccaggaagcagagguugcagugagcugaga

SEQ ID NO: 301984 - RNA, 32 nt, Human
acccaggaagcggagguugcaaucagcugaga

SEQ ID NO: 301985 - RNA, 32 nt, Human
acccaggaagcggagguugcagugagccaaga

SEQ ID NO: 301986 - RNA, 32 nt, Human
acccaggaagcggagguugcagugagccgaga

SEQ ID NO: 301987 - RNA, 32 nt, Human
acccaggaagcgggguugcagugagccaaagg

SEQ ID NO: 301988 - RNA, 32 nt, Human
acccaggaaguagagguugcagugagccgaga

SEQ ID NO: 301989 - RNA, 32 nt, Human
acccaggaaguggagacugcagugagccgaua

SEQ ID NO: 301990 - RNA, 25 nt, Human
acccaggaaguggagguugcaguga

SEQ ID NO: 301991 - RNA, 32 nt, Human
acccaggaaguggagguugcagugagccgaga

SEQ ID NO: 301992 - RNA, 32 nt, Human
acccaggaaguggagguugcagugagcuaaga

SEQ ID NO: 301993 - RNA, 32 nt, Human
acccaggaaguggagguugcagugagcugaga

SEQ ID NO: 301994 - RNA, 32 nt, Human
acccaggaaguggagguugcagugagcugagg

SEQ ID NO: 301995 - RNA, 32 nt, Human
acccaggaaguggcaguugcagugagccgaga

SEQ ID NO: 301996 - RNA, 20 nt, Human
acccaggacaagcccuccag

SEQ ID NO: 301997 - RNA, 32 nt, Human
acccaggacacggagauugcagugagccaaga

SEQ ID NO: 301998 - RNA, 32 nt, Human
acccaggacagcccccagcccaacuaggaaag

SEQ ID NO: 301999 - RNA, 32 nt, Human
acccaggaccgggagcggcagagcagagggcg

SEQ ID NO: 302000 - RNA, 32 nt, Human
acccaggaccucuggaccucagguucccaaga

SEQ ID NO: 302001 - RNA, 32 nt, Human
acccaggacgcagagguugcggugagccaaga

SEQ ID NO: 302002 - RNA, 32 nt, Human
acccaggacggaggcugcaugcccgaggacca

SEQ ID NO: 302003 - RNA, 32 nt, Human
acccaggacuccuuucuuccauuuuaacacuu

SEQ ID NO: 302004 - RNA, 22 nt, Human
acccaggacugaacucuccagg

SEQ ID NO: 302005 - RNA, 32 nt, Human
acccaggacugccccgcggagcuggcuuggac

SEQ ID NO: 302006 - RNA, 32 nt, Human
acccaggacugcgugggaguuugugccuugug

SEQ ID NO: 302007 - RNA, 32 nt, Human
acccaggacuucccaaacccagaggcugccau

SEQ ID NO: 302008 - RNA, 32 nt, Human
acccaggacuuccucacccucuucuauacucu

SEQ ID NO: 302009 - RNA, 32 nt, Human
acccaggagacagagguugcagugagccaaga

SEQ ID NO: 302010 - RNA, 32 nt, Human
acccaggagacagagguuguagugagcugaga

SEQ ID NO: 302011 - RNA, 32 nt, Human
acccaggagacagggguugcagugagccaaga

SEQ ID NO: 302012 - RNA, 32 nt, Human
acccaggagacauggguugcagugagccgaga

SEQ ID NO: 302013 - RNA, 32 nt, Human
acccaggagaccagaagagugcaucaggggac

SEQ ID NO: 302014 - RNA, 32 nt, Human
acccaggagacggaaguugcagugagcugaga

SEQ ID NO: 302015 - RNA, 32 nt, Human
acccaggagacggagcuugcagugagccgaga

SEQ ID NO: 302016 - RNA, 32 nt, Human
acccaggagacggagguugcagugagccgaga

SEQ ID NO: 302017 - RNA, 32 nt, Human
acccaggagacggagguugcggugaguugaga

SEQ ID NO: 302018 - RNA, 32 nt, Human
acccaggagacggugguugcagugagccaaga

SEQ ID NO: 302019 - RNA, 32 nt, Human
acccaggagacggugguugcagugagcgaaga

SEQ ID NO: 302020 - RNA, 32 nt, Human
acccaggagaggaagaaagaaaggagagaggg

SEQ ID NO: 302021 - RNA, 32 nt, Human
acccaggagaggaagguugcaguaagcugaga

SEQ ID NO: 302022 - RNA, 32 nt, Human
acccaggagagggaugggacacagcacugggc

SEQ ID NO: 302023 - RNA, 32 nt, Human
acccaggagauagagguugcaaugagccaaga

SEQ ID NO: 302024 - RNA, 32 nt, Human
acccaggagauggaaguugcagugagcugaua

SEQ ID NO: 302025 - RNA, 25 nt, Human
acccaggagauggagguugcaguga

SEQ ID NO: 302026 - RNA, 32 nt, Human
acccaggagauggagguugcagugagccaaga

SEQ ID NO: 302027 - RNA, 32 nt, Human
acccaggagauggagguugcagugagcugaga

SEQ ID NO: 302028 - RNA, 32 nt, Human
acccaggagauggagguugcggugagcugaga

SEQ ID NO: 302029 - RNA, 32 nt, Human
acccaggagcauccaccuccuucucugucuca

SEQ ID NO: 302030 - RNA, 32 nt, Human
acccaggagcuagggaagagacccuagccucc

SEQ ID NO: 302031 - RNA, 32 nt, Human
acccaggaggaagagguugcagugagccaaga

SEQ ID NO: 302032 - RNA, 32 nt, Human
acccaggaggaggagcuugcagugagccgaga

SEQ ID NO: 302033 - RNA, 32 nt, Human
acccaggaggagguggagaucgcagugagcug

SEQ ID NO: 302034 - RNA, 32 nt, Human
acccaggaggcaaaggcugcagugagccaaga

SEQ ID NO: 302035 - RNA, 32 nt, Human
acccaggaggcaaagguugcagugagccacga

SEQ ID NO: 302036 - RNA, 32 nt, Human
acccaggaggcacagauugcagugagccaaga

SEQ ID NO: 302037 - RNA, 32 nt, Human
acccaggaggcacagcuugcagugagcgaaga

SEQ ID NO: 302038 - RNA, 32 nt, Human
acccaggaggcacagguugcagugagccagga

SEQ ID NO: 302039 - RNA, 32 nt, Human
acccaggaggcagaaguugcaagguugagcca

SEQ ID NO: 302040 - RNA, 32 nt, Human
acccaggaggcagaaguugcagugagcagaga

SEQ ID NO: 302041 - RNA, 32 nt, Human
acccaggaggcagaaguugcagugagccgaau

SEQ ID NO: 302042 - RNA, 32 nt, Human
acccaggaggcagaaguugcagugagcugaga

SEQ ID NO: 302043 - RNA, 32 nt, Human
acccaggaggcagacguugcagcgagccaaau

SEQ ID NO: 302044 - RNA, 32 nt, Human
acccaggaggcagagaucgcagugaguugaga

SEQ ID NO: 302045 - RNA, 32 nt, Human
acccaggaggcagagauugcagugagccaaga

SEQ ID NO: 302046 - RNA, 32 nt, Human
acccaggaggcagagauugcagugagcugaga

SEQ ID NO: 302047 - RNA, 32 nt, Human
acccaggaggcagagauugcggugagccaaga

SEQ ID NO: 302048 - RNA, 32 nt, Human
acccaggaggcagagauugcggugagccggga

SEQ ID NO: 302049 - RNA, 32 nt, Human
acccaggaggcagagcuugcagugagccaaga

SEQ ID NO: 302050 - RNA, 32 nt, Human
acccaggaggcagagcuugcagugagccgaga

SEQ ID NO: 302051 - RNA, 32 nt, Human
acccaggaggcagagcuugcagugagccuaga

SEQ ID NO: 302052 - RNA, 32 nt, Human
acccaggaggcagagcuugcagugagcugaga

SEQ ID NO: 302053 - RNA, 32 nt, Human
acccaggaggcagagcuuguagugagccuaga

SEQ ID NO: 302054 - RNA, 32 nt, Human
acccaggaggcagaggcuacagugagcugaga

SEQ ID NO: 302055 - RNA, 32 nt, Human
acccaggaggcagaggguugcagugagccgag

SEQ ID NO: 302056 - RNA, 32 nt, Human
acccaggaggcagaggucgcagugagucgaga

SEQ ID NO: 302057 - RNA, 32 nt, Human
acccaggaggcagagguuacagugagcagaga

SEQ ID NO: 302058 - RNA, 32 nt, Human
acccaggaggcagagguugcaaugagccaaga

SEQ ID NO: 302059 - RNA, 32 nt, Human
acccaggaggcagagguugcagcgagcugaga

SEQ ID NO: 302060 - RNA, 32 nt, Human
acccaggaggcagagguugcaguaagccaaga

SEQ ID NO: 302061 - RNA, 32 nt, Human
acccaggaggcagagguugcaguaagccuagg

SEQ ID NO: 302062 - RNA, 32 nt, Human
acccaggaggcagagguugcagucagccaaga

SEQ ID NO: 302063 - RNA, 25 nt, Human
acccaggaggcagagguugcaguga

SEQ ID NO: 302064 - RNA, 32 nt, Human
acccaggaggcagagguugcagugagccaaga

SEQ ID NO: 302065 - RNA, 32 nt, Human
acccaggaggcagagguugcagugagccaagg

SEQ ID NO: 302066 - RNA, 32 nt, Human
acccaggaggcagagguugcagugagccgaga

SEQ ID NO: 302067 - RNA, 32 nt, Human
acccaggaggcagagguugcagugagcuaaga

SEQ ID NO: 302068 - RNA, 32 nt, Human
acccaggaggcagagguugcagugagcugaga

SEQ ID NO: 302069 - RNA, 32 nt, Human
acccaggaggcagagguugcagugagcuguga

SEQ ID NO: 302070 - RNA, 32 nt, Human
acccaggaggcagagguugcagugagucaaga

SEQ ID NO: 302071 - RNA, 32 nt, Human
acccaggaggcagagguugcagugagugaaga

SEQ ID NO: 302072 - RNA, 32 nt, Human
acccaggaggcagagguugcagugcaccaaga

SEQ ID NO: 302073 - RNA, 32 nt, Human
acccaggaggcagagguugcagugcgcugaga

SEQ ID NO: 302074 - RNA, 32 nt, Human
acccaggaggcagagguugcagugggccaaga

SEQ ID NO: 302075 - RNA, 32 nt, Human
acccaggaggcagagguugcggugagccgaga

SEQ ID NO: 302076 - RNA, 32 nt, Human
acccaggaggcagagguugcggugagucgaga

SEQ ID NO: 302077 - RNA, 32 nt, Human
acccaggaggcagagguugcguugagccaaga

SEQ ID NO: 302078 - RNA, 32 nt, Human
acccaggaggcagagguuggggugagcugaga

SEQ ID NO: 302079 - RNA, 32 nt, Human
acccaggaggcagagguugguccacagcacuc

SEQ ID NO: 302080 - RNA, 32 nt, Human
acccaggaggcagagguuguagugagccaaga

SEQ ID NO: 302081 - RNA, 32 nt, Human
acccaggaggcagaguuugcagucagccaaga

SEQ ID NO: 302082 - RNA, 32 nt, Human
acccaggaggcagaguuugcagugagccaaga

SEQ ID NO: 302083 - RNA, 32 nt, Human
acccaggaggcagaguuugcagugagcugaga

SEQ ID NO: 302084 - RNA, 32 nt, Human
acccaggaggcagcuguugcagugagccaaga

SEQ ID NO: 302085 - RNA, 32 nt, Human
acccaggaggcagugauugcagugagcugaga

SEQ ID NO: 302086 - RNA, 32 nt, Human
acccaggaggcagugguugcaaugagccgaga

SEQ ID NO: 302087 - RNA, 32 nt, Human
acccaggaggccgagguugcagugagccaaga

SEQ ID NO: 302088 - RNA, 32 nt, Human
acccaggaggcggaaguugcagugagcugaga

SEQ ID NO: 302089 - RNA, 25 nt, Human
acccaggaggcggacguugcaguga

SEQ ID NO: 302090 - RNA, 32 nt, Human
acccaggaggcggagauugcagugagccgaga

SEQ ID NO: 302091 - RNA, 32 nt, Human
acccaggaggcggagauugcagugagcugaga

SEQ ID NO: 302092 - RNA, 32 nt, Human
acccaggaggcggagcuggcagugagcugaga

SEQ ID NO: 302093 - RNA, 25 nt, Human
acccaggaggcggagcuugcaguga

SEQ ID NO: 302094 - RNA, 32 nt, Human
acccaggaggcggagcuugcagugagcagaga

SEQ ID NO: 302095 - RNA, 32 nt, Human
acccaggaggcggagcuugcagugagccaaga

SEQ ID NO: 302096 - RNA, 32 nt, Human
acccaggaggcggagcuugcagugagccauga

SEQ ID NO: 302097 - RNA, 32 nt, Human
acccaggaggcggagcuugcagugagccgaga

SEQ ID NO: 302098 - RNA, 32 nt, Human
acccaggaggcggagcuugcagugagcugaga

SEQ ID NO: 302099 - RNA, 32 nt, Human
acccaggaggcggaggcagaggcugcagugac

SEQ ID NO: 302100 - RNA, 32 nt, Human
acccaggaggcggaggcugcagugagcccaga

SEQ ID NO: 302101 - RNA, 32 nt, Human
acccaggaggcggaggcugcagugagcugaga

SEQ ID NO: 302102 - RNA, 32 nt, Human
acccaggaggcggagguagcagugagccaaga

SEQ ID NO: 302103 - RNA, 32 nt, Human
acccaggaggcggagguuacagugagccaaga

SEQ ID NO: 302104 - RNA, 32 nt, Human
acccaggaggcggagguugcacugagccgaga

SEQ ID NO: 302105 - RNA, 32 nt, Human
acccaggaggcggagguugcagggagggagac

SEQ ID NO: 302106 - RNA, 32 nt, Human
acccaggaggcggagguugcaguaagccaagg

SEQ ID NO: 302107 - RNA, 25 nt, Human
acccaggaggcggagguugcaguga

SEQ ID NO: 302108 - RNA, 32 nt, Human
acccaggaggcggagguugcagugaaccgaga

SEQ ID NO: 302109 - RNA, 32 nt, Human
acccaggaggcggagguugcagugacccgaga

SEQ ID NO: 302110 - RNA, 32 nt, Human
acccaggaggcggagguugcagugagacgaga

SEQ ID NO: 302111 - RNA, 32 nt, Human
acccaggaggcggagguugcagugagcagaga

SEQ ID NO: 302112 - RNA, 32 nt, Human
acccaggaggcggagguugcagugagccaaga

SEQ ID NO: 302113 - RNA, 32 nt, Human
acccaggaggcggagguugcagugagccagga

SEQ ID NO: 302114 - RNA, 32 nt, Human
acccaggaggcggagguugcagugagccgaga

SEQ ID NO: 302115 - RNA, 32 nt, Human
acccaggaggcggagguugcagugagcucaga

SEQ ID NO: 302116 - RNA, 32 nt, Human
acccaggaggcggagguugcagugagcugaga

SEQ ID NO: 302117 - RNA, 32 nt, Human
acccaggaggcggagguugcagugagcugagu

SEQ ID NO: 302118 - RNA, 32 nt, Human
acccaggaggcggagguugcagugaguugaga

SEQ ID NO: 302119 - RNA, 32 nt, Human
acccaggaggcggagguugcagugauccaaga

SEQ ID NO: 302120 - RNA, 32 nt, Human
acccaggaggcggagguugccgugagccaaga

SEQ ID NO: 302121 - RNA, 25 nt, Human
acccaggaggcggagguugcgguga

SEQ ID NO: 302122 - RNA, 32 nt, Human
acccaggaggcggagguugcggugacccucca

SEQ ID NO: 302123 - RNA, 32 nt, Human
acccaggaggcggagguugcggugagccaaga

SEQ ID NO: 302124 - RNA, 32 nt, Human
acccaggaggcggagguugcggugagccgaga

SEQ ID NO: 302125 - RNA, 32 nt, Human
acccaggaggcggagguugcggugagcugaga

SEQ ID NO: 302126 - RNA, 32 nt, Human
acccaggaggcggagguugcggugaguugaga

SEQ ID NO: 302127 - RNA, 32 nt, Human
acccaggaggcggagguuguagugagccaaga

SEQ ID NO: 302128 - RNA, 32 nt, Human
acccaggaggcggagguuguagugagcugaga

SEQ ID NO: 302129 - RNA, 32 nt, Human
acccaggaggcggagguuguauaggcugagau

SEQ ID NO: 302130 - RNA, 32 nt, Human
acccaggaggcggagguuguggugagccaaga

SEQ ID NO: 302131 - RNA, 32 nt, Human
acccaggaggcggaguuugcagugagcugaga

SEQ ID NO: 302132 - RNA, 32 nt, Human
acccaggaggcggcgguugcagugagccaaga

SEQ ID NO: 302133 - RNA, 32 nt, Human
acccaggaggcggggguugcagugagucgaga

SEQ ID NO: 302134 - RNA, 32 nt, Human
acccaggaggcguagcuagcagugagccaaga

SEQ ID NO: 302135 - RNA, 32 nt, Human
acccaggaggcugaggcaagagaaucacuuga

SEQ ID NO: 302136 - RNA, 32 nt, Human
acccaggaggcugaggcaggagaaucgcugga

SEQ ID NO: 302137 - RNA, 32 nt, Human
acccaggaggcugaggcaggagaaucgcuuga

SEQ ID NO: 302138 - RNA, 32 nt, Human
acccaggaggcugaggcaugagaaucgcuugg

SEQ ID NO: 302139 - RNA, 32 nt, Human
acccaggaggcugagguaggaggaucacuuaa

SEQ ID NO: 302140 - RNA, 32 nt, Human
acccaggaggcugaggugggaggaucacuuaa

SEQ ID NO: 302141 - RNA, 32 nt, Human
acccaggaggcugagguugcagugagccagga

SEQ ID NO: 302142 - RNA, 32 nt, Human
acccaggaggcugagguugcagugagcccaga

SEQ ID NO: 302143 - RNA, 32 nt, Human
acccaggagggagcuuguggggcaggucugga

SEQ ID NO: 302144 - RNA, 32 nt, Human
acccaggagguagaagcugcagugagcaggga

SEQ ID NO: 302145 - RNA, 32 nt, Human
acccaggagguagaaguugcagugagccgaga

SEQ ID NO: 302146 - RNA, 32 nt, Human
acccaggagguagaggcugcagugagcaggga

SEQ ID NO: 302147 - RNA, 32 nt, Human
acccaggagguagaggcugcagugagccggga

SEQ ID NO: 302148 - RNA, 32 nt, Human
acccaggagguagaggcugcagugagcuggga

SEQ ID NO: 302149 - RNA, 32 nt, Human
acccaggagguagagguugcagugagccaaga

SEQ ID NO: 302150 - RNA, 32 nt, Human
acccaggagguagagguugcagugagccgaga

SEQ ID NO: 302151 - RNA, 32 nt, Human
acccaggaggugaagguugcagugaccggaga

SEQ ID NO: 302152 - RNA, 32 nt, Human
acccaggaggugcagguugcagugagccgaga

SEQ ID NO: 302153 - RNA, 32 nt, Human
acccaggagguggaaguugcuuugagccgaga

SEQ ID NO: 302154 - RNA, 32 nt, Human
acccaggagguggacauuacagugagcccaga

SEQ ID NO: 302155 - RNA, 32 nt, Human
acccaggagguggagacugcagugagccaaga

SEQ ID NO: 302156 - RNA, 32 nt, Human
acccaggagguggagauugcagugagcugaga

SEQ ID NO: 302157 - RNA, 32 nt, Human
acccaggagguggagcuugcaaugagccgaga

SEQ ID NO: 302158 - RNA, 32 nt, Human
acccaggagguggagcuugcagugagccgaga

SEQ ID NO: 302159 - RNA, 32 nt, Human
acccaggagguggaggaugcagugaacugaga

SEQ ID NO: 302160 - RNA, 32 nt, Human
acccaggagguggaggcugcagugagcugaga

SEQ ID NO: 302161 - RNA, 32 nt, Human
acccaggagguggaggcugcggugagccgaga

SEQ ID NO: 302162 - RNA, 32 nt, Human
acccaggagguggagguagcagugagccgaga

SEQ ID NO: 302163 - RNA, 32 nt, Human
acccaggagguggaggucgcagugagccgaga

SEQ ID NO: 302164 - RNA, 32 nt, Human
acccaggagguggagguuacagugagccaaga

SEQ ID NO: 302165 - RNA, 32 nt, Human
acccaggagguggagguuacagugagcugaga

SEQ ID NO: 302166 - RNA, 25 nt, Human
acccaggagguggagguuccaguga

SEQ ID NO: 302167 - RNA, 32 nt, Human
acccaggagguggagguuccagugagccaaaa

SEQ ID NO: 302168 - RNA, 32 nt, Human
acccaggagguggagguugaaaugagcugaga

SEQ ID NO: 302169 - RNA, 32 nt, Human
acccaggagguggagguugcaagugagcugag

SEQ ID NO: 302170 - RNA, 32 nt, Human
acccaggagguggagguugcagcaagcagaga

SEQ ID NO: 302171 - RNA, 23 nt, Human
acccaggagguggagguugcagu

SEQ ID NO: 302172 - RNA, 32 nt, Human
acccaggagguggagguugcaguaagccaaga

SEQ ID NO: 302173 - RNA, 32 nt, Human
acccaggagguggagguugcaguaagcugaga

SEQ ID NO: 302174 - RNA, 25 nt, Human
acccaggagguggagguugcaguga

SEQ ID NO: 302175 - RNA, 32 nt, Human
acccaggagguggagguugcagugaacugaga

SEQ ID NO: 302176 - RNA, 32 nt, Human
acccaggagguggagguugcagugagcagaga

SEQ ID NO: 302177 - RNA, 32 nt, Human
acccaggagguggagguugcagugagccaaga

SEQ ID NO: 302178 - RNA, 32 nt, Human
acccaggagguggagguugcagugagccaagg

SEQ ID NO: 302179 - RNA, 32 nt, Human
acccaggagguggagguugcagugagccagag

SEQ ID NO: 302180 - RNA, 32 nt, Human
acccaggagguggagguugcagugagccgaag

SEQ ID NO: 302181 - RNA, 32 nt, Human
acccaggagguggagguugcagugagccgaga

SEQ ID NO: 302182 - RNA, 32 nt, Human
acccaggagguggagguugcagugagccgagu

SEQ ID NO: 302183 - RNA, 32 nt, Human
acccaggagguggagguugcagugagcugaga

SEQ ID NO: 302184 - RNA, 32 nt, Human
acccaggagguggagguugcagugagcuggga

SEQ ID NO: 302185 - RNA, 32 nt, Human
acccaggagguggagguugcagugaggcaaga

SEQ ID NO: 302186 - RNA, 32 nt, Human
acccaggagguggagguugcagugagucaaga

SEQ ID NO: 302187 - RNA, 32 nt, Human
acccaggagguggagguugcagugagucgaga

SEQ ID NO: 302188 - RNA, 25 nt, Human
acccaggagguggagguugcagugg

SEQ ID NO: 302189 - RNA, 32 nt, Human
acccaggagguggagguugcagugggccgaga

SEQ ID NO: 302190 - RNA, 32 nt, Human
acccaggagguggagguugcaguuagcugaga

SEQ ID NO: 302191 - RNA, 25 nt, Human
acccaggagguggagguugcgguga

SEQ ID NO: 302192 - RNA, 32 nt, Human
acccaggagguggagguugcggugaacugaga

SEQ ID NO: 302193 - RNA, 32 nt, Human
acccaggagguggagguugcggugagcugagg

SEQ ID NO: 302194 - RNA, 32 nt, Human
acccaggagguggagguugcugugagccaaga

SEQ ID NO: 302195 - RNA, 32 nt, Human
acccaggagguggagguuguagugagacaaga

SEQ ID NO: 302196 - RNA, 32 nt, Human
acccaggagguggagguuguggugagccaaga

SEQ ID NO: 302197 - RNA, 32 nt, Human
acccaggagguggagguuguggugagccgaga

SEQ ID NO: 302198 - RNA, 32 nt, Human
acccaggagguggagguuguggugagcugaga

SEQ ID NO: 302199 - RNA, 25 nt, Human
acccaggagguggaguuugcaguga

SEQ ID NO: 302200 - RNA, 32 nt, Human
acccaggagguggaguuugcagugagcugaga

SEQ ID NO: 302201 - RNA, 32 nt, Human
acccaggaggugggcauugcagugagccgaga

SEQ ID NO: 302202 - RNA, 32 nt, Human
acccaggagguggggguugcaccgagcagaga

SEQ ID NO: 302203 - RNA, 32 nt, Human
acccaggagguggugguugcagugagccuaga

SEQ ID NO: 302204 - RNA, 32 nt, Human
acccaggagguugaggcugcagugagucauga

SEQ ID NO: 302205 - RNA, 32 nt, Human
acccaggagucaaaagcugcagugagcuacug

SEQ ID NO: 302206 - RNA, 32 nt, Human
acccaggagucagagguuucagugagccgaga

SEQ ID NO: 302207 - RNA, 32 nt, Human
acccaggaguccaggcccccagccccuccucc

SEQ ID NO: 302208 - RNA, 32 nt, Human
acccaggagucggagguugcagugaguugaga

SEQ ID NO: 302209 - RNA, 32 nt, Human
acccaggagucugucucacuguuuauccaaac

SEQ ID NO: 302210 - RNA, 32 nt, Human
acccaggaguucaagaccagccuggacaacau

SEQ ID NO: 302211 - RNA, 32 nt, Human
acccaggaguucaagucugcagugagcuauga

SEQ ID NO: 302212 - RNA, 32 nt, Human
acccaggaguuggagcuugcagugagccgaga

SEQ ID NO: 302213 - RNA, 32 nt, Human
acccaggaugcggagguugcagugagccgaga

SEQ ID NO: 302214 - RNA, 32 nt, Human
acccaggcaagagagaagcaaccaccacaagc

SEQ ID NO: 302215 - RNA, 31 nt, Human
acccaggcaauguccucaaacaagccugugc

SEQ ID NO: 302216 - RNA, 22 nt, Human
acccaggcaccagacagccaga

SEQ ID NO: 302217 - RNA, 32 nt, Human
acccaggcaccuucgcuuccagaugcugccag

SEQ ID NO: 302218 - RNA, 32 nt, Human
acccaggcagagugagcucucuggccucuugg

SEQ ID NO: 302219 - RNA, 32 nt, Human
acccaggcaggaagcccaggaggagugcgggc

SEQ ID NO: 302220 - RNA, 32 nt, Human
acccaggcaguggagguugcagugagccaaga

SEQ ID NO: 302221 - RNA, 32 nt, Human
acccaggcaucugcuuuacucuggaccauagg

SEQ ID NO: 302222 - RNA, 23 nt, Human
acccaggccacaagaguggacgu

SEQ ID NO: 302223 - RNA, 22 nt, Human
acccaggccagaguguaguggc

SEQ ID NO: 302224 - RNA, 21 nt, Human
acccaggccagcagguggggu

SEQ ID NO: 302225 - RNA, 20 nt, Human
acccaggccaggcauguggc

SEQ ID NO: 302226 - RNA, 32 nt, Human
acccaggccauguucccaaaggccagcggggg

SEQ ID NO: 302227 - RNA, 32 nt, Human
acccaggcccaccccagagacccuccaugaac

SEQ ID NO: 302228 - RNA, 32 nt, Human
acccaggcccuauccugaacaggagacuaaac

SEQ ID NO: 302229 - RNA, 22 nt, Human
acccaggccgagcaggaugagc

SEQ ID NO: 302230 - RNA, 23 nt, Human
acccaggccggacugcagcggcg

SEQ ID NO: 302231 - RNA, 22 nt, Human
acccaggccggagugcaguggc

SEQ ID NO: 302232 - RNA, 23 nt, Human
acccaggccggagugcaguggcg

SEQ ID NO: 302233 - RNA, 21 nt, Human
acccaggccugcgaggagcgu

SEQ ID NO: 302234 - RNA, 32 nt, Human
acccaggccuggagcugggaugcaauguaggc

SEQ ID NO: 302235 - RNA, 32 nt, Human
acccaggccugggaagagcucggccccgauca

SEQ ID NO: 302236 - RNA, 32 nt, Human
acccaggccuuccuuccucagcuccugcagcc

SEQ ID NO: 302237 - RNA, 22 nt, Human
acccaggccuuuggagaauggc

SEQ ID NO: 302238 - RNA, 32 nt, Human
acccaggcggcagagguugcagugagccaaga

SEQ ID NO: 302239 - RNA, 32 nt, Human
acccaggcggcagagguugcagugagucgaga

SEQ ID NO: 302240 - RNA, 32 nt, Human
acccaggcggccaagcuccagaccgugccaga

SEQ ID NO: 302241 - RNA, 32 nt, Human
acccaggcgggugggagccucagucugucggg

SEQ ID NO: 302242 - RNA, 23 nt, Human
acccaggcuagaaugcaguggug

SEQ ID NO: 302243 - RNA, 20 nt, Human
acccaggcuagaggguggug

SEQ ID NO: 302244 - RNA, 21 nt, Human
acccaggcuagagugcagugg

SEQ ID NO: 302245 - RNA, 22 nt, Human
acccaggcuagagugcaguggc

SEQ ID NO: 302246 - RNA, 23 nt, Human
acccaggcuagagugcaguggcg

SEQ ID NO: 302247 - RNA, 22 nt, Human
acccaggcuagaguguaguggc

SEQ ID NO: 302248 - RNA, 32 nt, Human
acccaggcucaagugauccuccuaucucagcc

SEQ ID NO: 302249 - RNA, 32 nt, Human
acccaggcucucaugagcagauugucccuuau

SEQ ID NO: 302250 - RNA, 32 nt, Human
acccaggcucuuccucuggguaaaggucugua

SEQ ID NO: 302251 - RNA, 24 nt, Human
acccaggcugaacugcaguggugu

SEQ ID NO: 302252 - RNA, 32 nt, Human
acccaggcugaagugcaguagugcaaucucag

SEQ ID NO: 302253 - RNA, 21 nt, Human
acccaggcugaagugcagugg

SEQ ID NO: 302254 - RNA, 21 nt, Human
acccaggcugagaagggacgu

SEQ ID NO: 302255 - RNA, 21 nt, Human
acccaggcugagugcaguggc

SEQ ID NO: 302256 - RNA, 23 nt, Human
acccaggcugcagugcaauggcg

SEQ ID NO: 302257 - RNA, 32 nt, Human
acccaggcugccaggcuggaguggaguggcau

SEQ ID NO: 302258 - RNA, 22 nt, Human
acccaggcuggaauacaguggc

SEQ ID NO: 302259 - RNA, 22 nt, Human
acccaggcuggaauccaguggc

SEQ ID NO: 302260 - RNA, 22 nt, Human
acccaggcuggaaugcaauggc

SEQ ID NO: 302261 - RNA, 22 nt, Human
acccaggcuggaaugcaguggc

SEQ ID NO: 302262 - RNA, 23 nt, Human
acccaggcuggaaugcaguggcg

SEQ ID NO: 302263 - RNA, 24 nt, Human
acccaggcuggaaugcaguggugu

SEQ ID NO: 302264 - RNA, 23 nt, Human
acccaggcuggaccccagcacgu

SEQ ID NO: 302265 - RNA, 23 nt, Human
acccaggcuggacugcaaugacg

SEQ ID NO: 302266 - RNA, 22 nt, Human
acccaggcuggacugcaguggc

SEQ ID NO: 302267 - RNA, 23 nt, Human
acccaggcuggagagacacugcg

SEQ ID NO: 302268 - RNA, 22 nt, Human
acccaggcuggagagcaguggc

SEQ ID NO: 302269 - RNA, 23 nt, Human
acccaggcuggagcacacuggug

SEQ ID NO: 302270 - RNA, 22 nt, Human
acccaggcuggagcgcaguggc

SEQ ID NO: 302271 - RNA, 32 nt, Human
acccaggcuggaggacaggaccagccacccuc

SEQ ID NO: 302272 - RNA, 24 nt, Human
acccaggcuggaggacagugaugu

SEQ ID NO: 302273 - RNA, 24 nt, Human
acccaggcuggaguacaauagcgu

SEQ ID NO: 302274 - RNA, 22 nt, Human
acccaggcuggaguacacuggc

SEQ ID NO: 302275 - RNA, 20 nt, Human
acccaggcuggaguacagug

SEQ ID NO: 302276 - RNA, 22 nt, Human
acccaggcuggaguacaguggc

SEQ ID NO: 302277 - RNA, 24 nt, Human
acccaggcuggaguacaguggcgu

SEQ ID NO: 302278 - RNA, 23 nt, Human
acccaggcuggaguacagugggu

SEQ ID NO: 302279 - RNA, 24 nt, Human
acccaggcuggaguacaguggugu

SEQ ID NO: 302280 - RNA, 20 nt, Human
acccaggcuggaguagagug

SEQ ID NO: 302281 - RNA, 20 nt, Human
acccaggcuggaguauagug

SEQ ID NO: 302282 - RNA, 24 nt, Human
acccaggcuggaguauaguggugu

SEQ ID NO: 302283 - RNA, 22 nt, Human
acccaggcuggaguccaguggc

SEQ ID NO: 302284 - RNA, 24 nt, Human
acccaggcuggaguccaguggcgu

SEQ ID NO: 302285 - RNA, 23 nt, Human
acccaggcuggaguccaguggug

SEQ ID NO: 302286 - RNA, 24 nt, Human
acccaggcuggaguccaguggugu

SEQ ID NO: 302287 - RNA, 24 nt, Human
acccaggcuggagucuagugucgu

SEQ ID NO: 302288 - RNA, 22 nt, Human
acccaggcuggagugagguggu

SEQ ID NO: 302289 - RNA, 21 nt, Human
acccaggcuggagugcaaggc

SEQ ID NO: 302290 - RNA, 23 nt, Human
acccaggcuggagugcaaugacg

SEQ ID NO: 302291 - RNA, 24 nt, Human
acccaggcuggagugcaauggagu

SEQ ID NO: 302292 - RNA, 22 nt, Human
acccaggcuggagugcaauggc

SEQ ID NO: 302293 - RNA, 23 nt, Human
acccaggcuggagugcaauggcg

SEQ ID NO: 302294 - RNA, 24 nt, Human
acccaggcuggagugcaauggcgu

SEQ ID NO: 302295 - RNA, 22 nt, Human
acccaggcuggagugcaauggu

SEQ ID NO: 302296 - RNA, 23 nt, Human
acccaggcuggagugcaauggug

SEQ ID NO: 302297 - RNA, 22 nt, Human
acccaggcuggagugcacuggc

SEQ ID NO: 302298 - RNA, 22 nt, Human
acccaggcuggagugcagcagu

SEQ ID NO: 302299 - RNA, 22 nt, Human
acccaggcuggagugcaguagc

SEQ ID NO: 302300 - RNA, 23 nt, Human
acccaggcuggagugcaguagcg

SEQ ID NO: 302301 - RNA, 23 nt, Human
acccaggcuggagugcaguagug

SEQ ID NO: 302302 - RNA, 32 nt, Human
acccaggcuggagugcaguagugcaaucaggg

SEQ ID NO: 302303 - RNA, 20 nt, Human
acccaggcuggagugcagug

SEQ ID NO: 302304 - RNA, 21 nt, Human
acccaggcuggagugcagugg

SEQ ID NO: 302305 - RNA, 22 nt, Human
acccaggcuggagugcaguggc

SEQ ID NO: 302306 - RNA, 23 nt, Human
acccaggcuggagugcaguggcg

SEQ ID NO: 302307 - RNA, 24 nt, Human
acccaggcuggagugcaguggcgu

SEQ ID NO: 302308 - RNA, 23 nt, Human
acccaggcuggagugcagugggu

SEQ ID NO: 302309 - RNA, 22 nt, Human
acccaggcuggagugcaguggu

SEQ ID NO: 302310 - RNA, 23 nt, Human
acccaggcuggagugcaguggug

SEQ ID NO: 302311 - RNA, 24 nt, Human
acccaggcuggagugcaguggugu

SEQ ID NO: 302312 - RNA, 24 nt, Human
acccaggcuggagugcagugucgu

SEQ ID NO: 302313 - RNA, 24 nt, Human
acccaggcuggagugccauagugu

SEQ ID NO: 302314 - RNA, 22 nt, Human
acccaggcuggagugccauggc

SEQ ID NO: 302315 - RNA, 22 nt, Human
acccaggcuggagugccguggc

SEQ ID NO: 302316 - RNA, 23 nt, Human
acccaggcuggagugcgauggcg

SEQ ID NO: 302317 - RNA, 22 nt, Human
acccaggcuggagugcgguggc

SEQ ID NO: 302318 - RNA, 23 nt, Human
acccaggcuggagugcgguggcg

SEQ ID NO: 302319 - RNA, 23 nt, Human
acccaggcuggagugcgguggug

SEQ ID NO: 302320 - RNA, 22 nt, Human
acccaggcuggagugcuauggc

SEQ ID NO: 302321 - RNA, 22 nt, Human
acccaggcuggagugcuguggc

SEQ ID NO: 302322 - RNA, 23 nt, Human
acccaggcuggagugcuguggug

SEQ ID NO: 302323 - RNA, 32 nt, Human
accuacuguaugacaccacauucuuccuaaca

SEQ ID NO: 302324 - RNA, 32 nt, Human
accuacugugugcuugcucuguuaguucuuug

SEQ ID NO: 302325 - RNA, 32 nt, Human
accuacuuaaagucuucauuuauauucuuuca

SEQ ID NO: 302326 - RNA, 32 nt, Human
accuacuucuuuucaugggaaggugagguguc

SEQ ID NO: 302327 - RNA, 32 nt, Human
accuacuugaaagccugugggcaacguucuuu

SEQ ID NO: 302328 - RNA, 32 nt, Human
accuacuuguucccaccuugggagaggacgau

SEQ ID NO: 302329 - RNA, 31 nt, Human
accuacuuugacuuuuugcauuuaaaacaga

SEQ ID NO: 302330 - RNA, 32 nt, Human
accuacuuugggaccuuugggggugaguuccc

SEQ ID NO: 302331 - RNA, 32 nt, Human
accuagaaagcgagcggcgccgcccgugggga

SEQ ID NO: 302332 - RNA, 32 nt, Human
accuagaacagguccugaagcauaugcgagag

SEQ ID NO: 302333 - RNA, 22 nt, Human
accuagaaccuccacccucuga

SEQ ID NO: 302334 - RNA, 32 nt, Human
accuagaagacgcuauccgauccaucaggccc

SEQ ID NO: 302335 - RNA, 32 nt, Human
accuagaagguggagguugcagugagcggaga

SEQ ID NO: 302336 - RNA, 32 nt, Human
accuagaaguaagaagaggagccucagaagaa

SEQ ID NO: 302337 - RNA, 22 nt, Human
accuagaauuuucaaucuggca

SEQ ID NO: 302338 - RNA, 32 nt, Human
accuagacacugggagugcugccaccacgugg

SEQ ID NO: 302339 - RNA, 32 nt, Human
accuagaccacccuccaugucagguacugagc

SEQ ID NO: 302340 - RNA, 32 nt, Human
accuagacuagacuggagugcaauggccugau

SEQ ID NO: 302341 - RNA, 32 nt, Human
accuagacuuagaacaaauccugcuuuugaaa

SEQ ID NO: 302342 - RNA, 32 nt, Human
accuagagacuucacccgggggugaaggggua

SEQ ID NO: 302343 - RNA, 32 nt, Human
accuagagaggaagugagggaggccacggaau

SEQ ID NO: 302344 - RNA, 22 nt, Human
accuagagccgggcacagcccu

SEQ ID NO: 302345 - RNA, 32 nt, Human
accuagagcucuacagcugcugccucgguacu

SEQ ID NO: 302346 - RNA, 32 nt, Human
accuagagcuguccuguccacuccaggccgga

SEQ ID NO: 302347 - RNA, 32 nt, Human
accuagaggaugagccacaaaauaccucuaug

SEQ ID NO: 302348 - RNA, 32 nt, Human
accuagagucauggccauggcaaccaaaggag

SEQ ID NO: 302349 - RNA, 32 nt, Human
accuagaguuccagcaggagugaacaggaaca

SEQ ID NO: 302350 - RNA, 32 nt, Human
accuagaucuggagcgggaguaggaacgggag

SEQ ID NO: 302351 - RNA, 20 nt, Human
accuagauguccccagcacc

SEQ ID NO: 302352 - RNA, 32 nt, Human
accuagcaaugaagguugggaagguuguuccc

SEQ ID NO: 302353 - RNA, 32 nt, Human
accuagcaccgccaaucccgccuggauggagu

SEQ ID NO: 302354 - RNA, 32 nt, Human
accuagccagcuguugcauuagcuaaagcagc

SEQ ID NO: 302355 - RNA, 32 nt, Human
accuagccccuucuuugggguggagagaauuu

SEQ ID NO: 302356 - RNA, 32 nt, Human
accuagccucagagacagagaaggagaggggg

SEQ ID NO: 302357 - RNA, 32 nt, Human
accuagccugugcagccuccugggaauccagu

SEQ ID NO: 302358 - RNA, 24 nt, Human
accuagccuugcagcugcagcaga

SEQ ID NO: 302359 - RNA, 20 nt, Human
accuagcgccgccgccgccg

SEQ ID NO: 302360 - RNA, 32 nt, Human
accuagcguucugugccaugcuagagcuugag

SEQ ID NO: 302361 - RNA, 32 nt, Human
accuagcucacugcucucucuccugcaaaguc

SEQ ID NO: 302362 - RNA, 19 nt, Human
accuagcucagcugaauca

SEQ ID NO: 302363 - RNA, 32 nt, Human
accuagcugcaccccagcgccugggcccgccc

SEQ ID NO: 302364 - RNA, 18 nt, Human
accuagcuucccucuacc

SEQ ID NO: 302365 - RNA, 32 nt, Human
accuaggagaaacaagacagaaaacaaaucuu

SEQ ID NO: 302366 - RNA, 32 nt, Human
accuaggaggcagaagcuaagugauuugcuca

SEQ ID NO: 302367 - RNA, 32 nt, Human
accuaggaggcagaaguugcagugagcagaga

SEQ ID NO: 302368 - RNA, 32 nt, Human
accuaggaggcagagguugcagugaaccgagg

SEQ ID NO: 302369 - RNA, 32 nt, Human
accuaggaggcagagguugcagugagccaagu

SEQ ID NO: 302370 - RNA, 32 nt, Human
accuaggaggcagaguuugcagugagcugaga

SEQ ID NO: 302371 - RNA, 25 nt, Human
accuaggaggcggagguugcaguga

SEQ ID NO: 302372 - RNA, 32 nt, Human
accuaggaggcggagguugcagugagccaaga

SEQ ID NO: 302373 - RNA, 32 nt, Human
accuaggaggcggagguugcagugagucaaga

SEQ ID NO: 302374 - RNA, 32 nt, Human
accuaggaggcugagauugcagugagccgaaa

SEQ ID NO: 302375 - RNA, 32 nt, Human
accuaggaggggaagguugcagugagccgaga

SEQ ID NO: 302376 - RNA, 21 nt, Human
accuaggagguccaccuggca

SEQ ID NO: 302377 - RNA, 32 nt, Human
accuaggaggucgaggcugcagugagccaaga

SEQ ID NO: 302378 - RNA, 32 nt, Human
accuaggagguggaggcugcagcgagcugaga

SEQ ID NO: 302379 - RNA, 32 nt, Human
accuaggagguggagguugcagugagccgaga

SEQ ID NO: 302380 - RNA, 32 nt, Human
accuaggagguggagguugcagugagcugaga

SEQ ID NO: 302381 - RNA, 32 nt, Human
accuaggagguggagguugcauucaacugaga

SEQ ID NO: 302382 - RNA, 32 nt, Human
accuaggagguggcgguugcugugagccaaga

SEQ ID NO: 302383 - RNA, 32 nt, Human
accuaggagguggucuuguggugguacauuug

SEQ ID NO: 302384 - RNA, 31 nt, Human
accuaggcaaagaguauauguaggagguggg

SEQ ID NO: 302385 - RNA, 32 nt, Human
accuaggcaaccugggcggggcucauagagcu

SEQ ID NO: 302386 - RNA, 32 nt, Human
accuaggcacgaucucagcucacugcaaccuc

SEQ ID NO: 302387 - RNA, 32 nt, Human
accuaggcaggccugucuccaguuguuucaga

SEQ ID NO: 302388 - RNA, 32 nt, Human
accuaggcuagccccaaacuccugggcucaag

SEQ ID NO: 302389 - RNA, 32 nt, Human
accuaggcucacugcaaccucagccuccuggg

SEQ ID NO: 302390 - RNA, 32 nt, Human
accuaggcuccgaacacugagauaaagcagca

SEQ ID NO: 302391 - RNA, 32 nt, Human
accuagggaagcaugaaccacagggucccuga

SEQ ID NO: 302392 - RNA, 32 nt, Human
accuagggagcugaggccuaggcgaggcgaga

SEQ ID NO: 302393 - RNA, 32 nt, Human
accuagggaggcagagguuguagugagccaag

SEQ ID NO: 302394 - RNA, 32 nt, Human
accuagggauucagcaacagguuuccacaggg

SEQ ID NO: 302395 - RNA, 32 nt, Human
accuaggggaaaugcaaaaaccugcaaaagau

SEQ ID NO: 302396 - RNA, 32 nt, Human
accuaggggugggagagcuggauaguccuggg

SEQ ID NO: 302397 - RNA, 32 nt, Human
accuagggugccucccagccugguggacccaa

SEQ ID NO: 302398 - RNA, 32 nt, Human
accuaggucaggacgaggcauggagaugcuac

SEQ ID NO: 302399 - RNA, 32 nt, Human
accuagguucaagugauucucaugccucagcc

SEQ ID NO: 302400 - RNA, 32 nt, Human
accuaguaaauacuuucccaucucucacccca

SEQ ID NO: 302401 - RNA, 32 nt, Human
accuaguacgugugaggugcugugaggauaga

SEQ ID NO: 302402 - RNA, 32 nt, Human
accuagucuuucuaugcuccaaaugaaugucu

SEQ ID NO: 302403 - RNA, 32 nt, Human
accuagugccccagccgaaccugcccuggcuc

SEQ ID NO: 302404 - RNA, 24 nt, Human
accuagugcggaacaagucuccca

SEQ ID NO: 302405 - RNA, 32 nt, Human
accuaguggagcugugagaagagguccuccag

SEQ ID NO: 302406 - RNA, 32 nt, Human
accuauaaaggcagguauuucgggcccuccuc

SEQ ID NO: 302407 - RNA, 32 nt, Human
accuauaagaaaaaggagagaagaguauauaa

SEQ ID NO: 302408 - RNA, 32 nt, Human
accuauaagaagccuuaauuugcacagugugu

SEQ ID NO: 302409 - RNA, 32 nt, Human
accuauacaccaacuacuguuaccaugacgac

SEQ ID NO: 302410 - RNA, 32 nt, Human
accuauacauacgugcacacacacauacauau

SEQ ID NO: 302411 - RNA, 32 nt, Human
accuauaccuucucaaaagaggacacugagcc

SEQ ID NO: 302412 - RNA, 32 nt, Human
accuauagccuuugugcuguucugccuugccu

SEQ ID NO: 302413 - RNA, 32 nt, Human
accuauaucucccuugaaaauacuuucaggcu

SEQ ID NO: 302414 - RNA, 32 nt, Human
accuauaugcgacacaaaaugagaccuuuccc

SEQ ID NO: 302415 - RNA, 32 nt, Human
accuauauuuccacauugugcauugugacaca

SEQ ID NO: 302416 - RNA, 19 nt, Human
accuaucaaaucaugguga

SEQ ID NO: 302417 - RNA, 22 nt, Human
accuaucaagaccucugggaua

SEQ ID NO: 302418 - RNA, 32 nt, Human
accuaucacccaggcuggaguggaguggcacg

SEQ ID NO: 302419 - RNA, 32 nt, Human
accuaucagaaccugcacugaccaacaaauaa

SEQ ID NO: 302420 - RNA, 32 nt, Human
accuaucaguuagcacaggauccuucccugga

SEQ ID NO: 302421 - RNA, 32 nt, Human
accuaucccuuucgauuuggcuuuaccuucau

SEQ ID NO: 302422 - RNA, 32 nt, Human
accuauccuaagcuuaugaugaugaguuaugu

SEQ ID NO: 302423 - RNA, 32 nt, Human
accuauccuguguccccacccccuuggcagcc

SEQ ID NO: 302424 - RNA, 22 nt, Human
accuaucguggugacugggaua

SEQ ID NO: 302425 - RNA, 32 nt, Human
accuaucucugccuucccaccugugcccacag

SEQ ID NO: 302426 - RNA, 32 nt, Human
accuaucugcagucccccagcacacaaggaag

SEQ ID NO: 302427 - RNA, 32 nt, Human
accuaucugcauggaccucuguggaccacagc

SEQ ID NO: 302428 - RNA, 32 nt, Human
accuaucuucugcagggcccugagaugggguc

SEQ ID NO: 302429 - RNA, 32 nt, Human
accuaucuuuaagaucucuaauuggaauuaua

SEQ ID NO: 302430 - RNA, 32 nt, Human
accuaugaaaagaagcggggaaaacaacaaca

SEQ ID NO: 302431 - RNA, 32 nt, Human
accuaugaauguaaagaguguggggaagcuuu

SEQ ID NO: 302432 - RNA, 32 nt, Human
accuaugacucggcucugccucccaguccgca

SEQ ID NO: 302433 - RNA, 32 nt, Human
accuaugagugagaacaggcgguguuugguuu

SEQ ID NO: 302434 - RNA, 24 nt, Human
accuaugcaauaacauuuaggaua

SEQ ID NO: 302435 - RNA, 32 nt, Human
accuaugccugcaauccagcacuuugggaagc

SEQ ID NO: 302436 - RNA, 32 nt, Human
accuaugcuucaccuucagcuccugggaguuc

SEQ ID NO: 302437 - RNA, 32 nt, Human
accuauggcuuucugcaacuugcuacucucuc

SEQ ID NO: 302438 - RNA, 32 nt, Human
accuauguaaccugcacguucugcacauguau

SEQ ID NO: 302439 - RNA, 32 nt, Human
accuauuaaaacaugaacaggccaggcauggu

SEQ ID NO: 302440 - RNA, 32 nt, Human
accuauuacacacccauuagaaugacuguaaa

SEQ ID NO: 302441 - RNA, 32 nt, Human
accuauuaccaaaaacugacugagcccucccu

SEQ ID NO: 302442 - RNA, 32 nt, Human
accuauuaugggaggcuggagugcaauggugc

SEQ ID NO: 302443 - RNA, 32 nt, Human
accuauuauugaugccuuaaauguauugauaa

SEQ ID NO: 302444 - RNA, 32 nt, Human
accuauucaugaguuauuauugaaaccucaaa

SEQ ID NO: 302445 - RNA, 32 nt, Human
accuauucucucucacaugaugacaaacucgu

SEQ ID NO: 302446 - RNA, 32 nt, Human
accuauucuuauuuaguuaacacaagugugau

SEQ ID NO: 302447 - RNA, 32 nt, Human
accuauucuucaaccaccucgguuacucugac

SEQ ID NO: 302448 - RNA, 32 nt, Human
accuauugccaucauucccuugucccugcucu

SEQ ID NO: 302449 - RNA, 32 nt, Human
accuauuggcuauugugaauggugcugcuaug

SEQ ID NO: 302450 - RNA, 32 nt, Human
accuauuuccucagauccccagcuuucuccuc

SEQ ID NO: 302451 - RNA, 32 nt, Human
accuauuugacuguucagaaaaguggggacca

SEQ ID NO: 302452 - RNA, 32 nt, Human
accuauuugcccaccagcuucuccucuggagc

SEQ ID NO: 302453 - RNA, 32 nt, Human
accucaaaaagcuuggcugcagaauuguuggu

SEQ ID NO: 302454 - RNA, 32 nt, Human
accucaaaacaguuaaucucccugguuuaaaa

SEQ ID NO: 302455 - RNA, 24 nt, Human
accucaaaacuuuaugaacuucac

SEQ ID NO: 302456 - RNA, 32 nt, Human
accucaaaccauuguuuuuauucuuacacgac

SEQ ID NO: 302457 - RNA, 24 nt, Human
accucaaacgaucugcccacccca

SEQ ID NO: 302458 - RNA, 32 nt, Human
accucaaagacgcuauccgauccaucaggccc

SEQ ID NO: 302459 - RNA, 32 nt, Human
accucaaaguugagaaggcuuuucuuugcaug

SEQ ID NO: 302460 - RNA, 32 nt, Human
accucaaaucuaaauccuccaaucccaacucc

SEQ ID NO: 302461 - RNA, 24 nt, Human
accucaaaugauccacccaccuca

SEQ ID NO: 302462 - RNA, 23 nt, Human
accucaaaugauccacccaccuu

SEQ ID NO: 302463 - RNA, 23 nt, Human
accucaaaugauccaccugccuc

SEQ ID NO: 302464 - RNA, 23 nt, Human
accucaaaugauccgcccaccuc

SEQ ID NO: 302465 - RNA, 32 nt, Human
accucaacagggguccagggugcagugaacuc

SEQ ID NO: 302466 - RNA, 32 nt, Human
accucaaccagucccugcugggcacaacuggg

SEQ ID NO: 302467 - RNA, 23 nt, Human
accucaaccaucagggugaaauc

SEQ ID NO: 302468 - RNA, 32 nt, Human
accucaacugccagugcccugcagccucgggc

SEQ ID NO: 302469 - RNA, 32 nt, Human
accucaacugggggagugaggggcuggccagg

SEQ ID NO: 302470 - RNA, 32 nt, Human
accucaagacugcucccuuccuccgcagcuag

SEQ ID NO: 302471 - RNA, 32 nt, Human
accucaagccccggagaacucagcggcgcuuu

SEQ ID NO: 302472 - RNA, 31 nt, Human
accucaagccuaaauaccuguuaggauugga

SEQ ID NO: 302473 - RNA, 26 nt, Human
accucaagccuggaccagccaccuca

SEQ ID NO: 302474 - RNA, 22 nt, Human
accucaagcgauccacccaccu

SEQ ID NO: 302475 - RNA, 23 nt, Human
accucaagcgauccacccaccuc

SEQ ID NO: 302476 - RNA, 32 nt, Human
accucaaggaacaguauucugugaaccaucug

SEQ ID NO: 302477 - RNA, 32 nt, Human
accucaaggaguacaaccuggucuggcgcccc

SEQ ID NO: 302478 - RNA, 23 nt, Human
accucaaguaauccaccugccuc

SEQ ID NO: 302479 - RNA, 24 nt, Human
accucaaguaauccaccugccuca

SEQ ID NO: 302480 - RNA, 23 nt, Human
accucaaguaauccaccuggccu

SEQ ID NO: 302481 - RNA, 32 nt, Human
accucaagugagccacaucugccucagccucc

SEQ ID NO: 302482 - RNA, 23 nt, Human
accucaagugauccacacauguc

SEQ ID NO: 302483 - RNA, 22 nt, Human
accucaagugauccaccacuuc

SEQ ID NO: 302484 - RNA, 23 nt, Human
accucaagugauccacccaccuc

SEQ ID NO: 302485 - RNA, 24 nt, Human
accucaagugauccacccaccuca

SEQ ID NO: 302486 - RNA, 23 nt, Human
accucaagugauccacccaccuu

SEQ ID NO: 302487 - RNA, 24 nt, Human
accucaagugauccacccacuuca

SEQ ID NO: 302488 - RNA, 22 nt, Human
accucaagugauccacccgccu

SEQ ID NO: 302489 - RNA, 23 nt, Human
accucaagugauccacccgccuc

SEQ ID NO: 302490 - RNA, 24 nt, Human
accucaagugauccacccgccuca

SEQ ID NO: 302491 - RNA, 21 nt, Human
accucaagugauccacccguc

SEQ ID NO: 302492 - RNA, 23 nt, Human
accucaagugauccaccuaccuc

SEQ ID NO: 302493 - RNA, 22 nt, Human
accucaagugauccaccugccu

SEQ ID NO: 302494 - RNA, 23 nt, Human
accucaagugauccaccugccuc

SEQ ID NO: 302495 - RNA, 23 nt, Human
accucaagugauccaccugcuuc

SEQ ID NO: 302496 - RNA, 22 nt, Human
accucaagugauccaccuuccu

SEQ ID NO: 302497 - RNA, 23 nt, Human
accucaagugauccacugccuca

SEQ ID NO: 302498 - RNA, 22 nt, Human
accucaagugauccacuggccu

SEQ ID NO: 302499 - RNA, 22 nt, Human
accucaagugaucccccaccuc

SEQ ID NO: 302500 - RNA, 24 nt, Human
accucaagugauccucccaccuca

SEQ ID NO: 302501 - RNA, 24 nt, Human
accucaagugaucggcccaccuca

SEQ ID NO: 302502 - RNA, 23 nt, Human
accucaagugaucuacccaccuc

SEQ ID NO: 302503 - RNA, 32 nt, Human
accucaagugaucuacccgccuuggccuccca

SEQ ID NO: 302504 - RNA, 24 nt, Human
accucaagugaucugcccaccuca

SEQ ID NO: 302505 - RNA, 24 nt, Human
accucaagugaucugcccaucuca

SEQ ID NO: 302506 - RNA, 24 nt, Human
accucaagugaucugcccgccuca

SEQ ID NO: 302507 - RNA, 24 nt, Human
accucaagugaucugcccuccuca

SEQ ID NO: 302508 - RNA, 23 nt, Human
accucaagugaucugucuaccuc

SEQ ID NO: 302509 - RNA, 21 nt, Human
accucaagugaucuuccggcc

SEQ ID NO: 302510 - RNA, 32 nt, Human
accucaaucuacaccagagcccagggaguccc

SEQ ID NO: 302511 - RNA, 15 nt, Human
accucacaacacaaa

SEQ ID NO: 302512 - RNA, 32 nt, Human
accucacaagcuuguaauaaaaauccaaagag

SEQ ID NO: 302513 - RNA, 22 nt, Human
accucacacaaucuguaugggc

SEQ ID NO: 302514 - RNA, 32 nt, Human
accucacacagcaaguuagagacccagcucca

SEQ ID NO: 302515 - RNA, 32 nt, Human
accucacacccaggaccucugaggugcaucua

SEQ ID NO: 302516 - RNA, 32 nt, Human
accucacaccuguaaucccagcacuuagguag

SEQ ID NO: 302517 - RNA, 32 nt, Human
accucacacuccuucaaggcacaauuuuaaug

SEQ ID NO: 302518 - RNA, 32 nt, Human
accucacagauggggaaacugaagcccaggga

SEQ ID NO: 302519 - RNA, 32 nt, Human
accucacagccagagucaaugccuucauggga

SEQ ID NO: 302520 - RNA, 32 nt, Human
accucaccagcagcugcugucucuccaaugca

SEQ ID NO: 302521 - RNA, 32 nt, Human
accucacccaggagucacuuccucucuacacc

SEQ ID NO: 302522 - RNA, 31 nt, Human
accucaccccuccuugguuucucccuccccg

SEQ ID NO: 302523 - RNA, 32 nt, Human
accucaccccuguaaucccagcacuuugggug

SEQ ID NO: 302524 - RNA, 18 nt, Human
accucacccgaggcugcc

SEQ ID NO: 302525 - RNA, 32 nt, Human
accucacccugcccugccgugcgcucaacagc

SEQ ID NO: 302526 - RNA, 32 nt, Human
accucaccgcccaguccagcugugcuccagaa

SEQ ID NO: 302527 - RNA, 32 nt, Human
accucaccggacugagcucacaggaggagccu

SEQ ID NO: 302528 - RNA, 32 nt, Human
accucaccgggccugugauauuugcucuccug

SEQ ID NO: 302529 - RNA, 32 nt, Human
accucaccuagcucacugcucucucuccugca

SEQ ID NO: 302530 - RNA, 30 nt, Human
accucaccugaucugucaccaguccuguca

SEQ ID NO: 302531 - RNA, 32 nt, Human
accucaccuguaucaaaagacuguucuuucau

SEQ ID NO: 302532 - RNA, 32 nt, Human
accucaccuuccagcccugccgccccugcugc

SEQ ID NO: 302533 - RNA, 32 nt, Human
accucaccuugcacagcucacagggagcaaga

SEQ ID NO: 302534 - RNA, 32 nt, Human
accucaccuuuucauauuugguaaacuguaug

SEQ ID NO: 302535 - RNA, 32 nt, Human
accucacgcaggcugaguccagagcuugugcu

SEQ ID NO: 302536 - RNA, 32 nt, Human
accucacguccucccgugcgucgggagcgucu

SEQ ID NO: 302537 - RNA, 32 nt, Human
accucacuccagccugggugacagcguaagac

SEQ ID NO: 302538 - RNA, 32 nt, Human
accucacucuagaucugagccuucauauccca

SEQ ID NO: 302539 - RNA, 32 nt, Human
accucacugaacacuacugaguucacaguuga

SEQ ID NO: 302540 - RNA, 32 nt, Human
accucacugcaaccuccaccuccuagguucaa

SEQ ID NO: 302541 - RNA, 32 nt, Human
accucacugcaaccuccgccuccuggguucaa

SEQ ID NO: 302542 - RNA, 32 nt, Human
accucacugcaaccucugccucccggguccaa

SEQ ID NO: 302543 - RNA, 32 nt, Human
accucacugcaagcucugccucccgggcucac

SEQ ID NO: 302544 - RNA, 32 nt, Human
accucacugcagcuggcaugcuuggcugugug

SEQ ID NO: 302545 - RNA, 32 nt, Human
accucacugcauuccagccugggcaacagaga

SEQ ID NO: 302546 - RNA, 32 nt, Human
accucacugcauugcacuggaccugggaugcc

SEQ ID NO: 302547 - RNA, 32 nt, Human
accucacugcggccucaaacuccugggcucaa

SEQ ID NO: 302548 - RNA, 32 nt, Human
accucacuggcaugcuagccuguggcaggccu

SEQ ID NO: 302549 - RNA, 32 nt, Human
accucacugucuccauccuccaccucugagau

SEQ ID NO: 302550 - RNA, 32 nt, Human
accucacuguuggacauacauuccaagcuuuu

SEQ ID NO: 302551 - RNA, 32 nt, Human
accucacuuaauucugguguaggguguaugug

SEQ ID NO: 302552 - RNA, 32 nt, Human
accucagaaugugaccuuguuuggaaacacag

SEQ ID NO: 302553 - RNA, 21 nt, Human
accucagaauuaaaacuuuaa

SEQ ID NO: 302554 - RNA, 21 nt, Human
accucagacacucucuggcua

SEQ ID NO: 302555 - RNA, 32 nt, Human
accucagaccccagagggaaugaacaggugcc

SEQ ID NO: 302556 - RNA, 32 nt, Human
accucagaccuccccagcccuggguuucuccg

SEQ ID NO: 302557 - RNA, 32 nt, Human
accucagacucugggucccuuugggccgaagc

SEQ ID NO: 302558 - RNA, 32 nt, Human
accucagagcacaggggcccagagccaggcca

SEQ ID NO: 302559 - RNA, 32 nt, Human
accucagagcaccccacugcucaggggcuccu

SEQ ID NO: 302560 - RNA, 23 nt, Human
accucagagccaggagccugggg

SEQ ID NO: 302561 - RNA, 32 nt, Human
accucagagccuucucuuuacucuccaaagug

SEQ ID NO: 302562 - RNA, 32 nt, Human
accucagaggcagagguugcaaugaagcggag

SEQ ID NO: 302563 - RNA, 32 nt, Human
accucagagggcccuugaaaacccaccgaggg

SEQ ID NO: 302564 - RNA, 19 nt, Human
accucagauaaaaugcaga

SEQ ID NO: 302565 - RNA, 23 nt, Human
accucagauaauccaccugcuuc

SEQ ID NO: 302566 - RNA, 32 nt, Human
accucagaugacaggugcgugccaccacaccc

SEQ ID NO: 302567 - RNA, 23 nt, Human
accucagaugacccaccugccuc

SEQ ID NO: 302568 - RNA, 23 nt, Human
accucagaugauccacccaccuu

SEQ ID NO: 302569 - RNA, 22 nt, Human
accucagaugauccaccugccu

SEQ ID NO: 302570 - RNA, 24 nt, Human
accucagaugaucugcccgccuca

SEQ ID NO: 302571 - RNA, 24 nt, Human
accucagaugauucacccgccuca

SEQ ID NO: 302572 - RNA, 23 nt, Human
accucagaugguccacccaccuc

SEQ ID NO: 302573 - RNA, 32 nt, Human
accucagauugcuuacucagcaaccaucaugg

SEQ ID NO: 302574 - RNA, 32 nt, Human
accucagcaagguuguuuccugaaaugaaagc

SEQ ID NO: 302575 - RNA, 32 nt, Human
accucagcaaguucuaggccccuucccagccu

SEQ ID NO: 302576 - RNA, 32 nt, Human
accucagcagcaguuggaucuuuugaagggag

SEQ ID NO: 302577 - RNA, 18 nt, Human
accucagccaacuguggc

SEQ ID NO: 302578 - RNA, 18 nt, Human
accucagccaggguccuc

SEQ ID NO: 302579 - RNA, 32 nt, Human
accucagcccccacccacaucucccagaguau

SEQ ID NO: 302580 - RNA, 32 nt, Human
accucagccucccaagggugugugugacuaca

SEQ ID NO: 302581 - RNA, 32 nt, Human
accucagccuccugggcucaagcaauucucau

SEQ ID NO: 302582 - RNA, 24 nt, Human
accucagccuggccagacacaggc

SEQ ID NO: 302583 - RNA, 32 nt, Human
accucagcgaugcuuccuagccccaggcuugc

SEQ ID NO: 302584 - RNA, 32 nt, Human
accucagcggcggagguugcagugagucgaga

SEQ ID NO: 302585 - RNA, 32 nt, Human
accucagcucacugaaaccucugccucccggg

SEQ ID NO: 302586 - RNA, 32 nt, Human
accucagcucacugcaaccucugccucccggg

SEQ ID NO: 302587 - RNA, 32 nt, Human
accucagcucacugcacccucugugucccgga

SEQ ID NO: 302588 - RNA, 32 nt, Human
accucagcucacugcagccuccaccuccuggg

SEQ ID NO: 302589 - RNA, 32 nt, Human
accucagcucacugcgaccuccaccuccuggg

SEQ ID NO: 302590 - RNA, 32 nt, Human
accucagcugacuucccugugaaugucuaaug

SEQ ID NO: 302591 - RNA, 32 nt, Human
accucaggaaaggagggugaccagguugucuu

SEQ ID NO: 302592 - RNA, 23 nt, Human
accucaggaagccucccacggcc

SEQ ID NO: 302593 - RNA, 32 nt, Human
accucaggacaggcauggaggccacaggggcc

SEQ ID NO: 302594 - RNA, 24 nt, Human
accucaggacugggcucucuggcc

SEQ ID NO: 302595 - RNA, 32 nt, Human
accucaggagaguuccagggaagaaccccacc

SEQ ID NO: 302596 - RNA, 32 nt, Human
accucaggaggcggagguugcagugagccgag

SEQ ID NO: 302597 - RNA, 32 nt, Human
accucaggagggcaggcugagguggggaagga

SEQ ID NO: 302598 - RNA, 21 nt, Human
accucaggauaaaccuugaaa

SEQ ID NO: 302599 - RNA, 32 nt, Human
accucaggaucuuguuaaaaugcagauucugg

SEQ ID NO: 302600 - RNA, 32 nt, Human
accucaggaugggagaugaggagaagcggaac

SEQ ID NO: 302601 - RNA, 24 nt, Human
accucaggcaaucugcccaccuca

SEQ ID NO: 302602 - RNA, 22 nt, Human
accucaggcagagcccuacuca

SEQ ID NO: 302603 - RNA, 32 nt, Human
accucaggcaggaagggcaggaaggagagccu

SEQ ID NO: 302604 - RNA, 25 nt, Human
accucaggcgauccacccccaccuc

SEQ ID NO: 302605 - RNA, 22 nt, Human
accucaggcgauccaccugucu

SEQ ID NO: 302606 - RNA, 24 nt, Human
accucaggcgauccgcccgccuca

SEQ ID NO: 302607 - RNA, 24 nt, Human
accucaggcgaucugcccaccuca

SEQ ID NO: 302608 - RNA, 32 nt, Human
accucaggcuacagcuggcuccgagacagggc

SEQ ID NO: 302609 - RNA, 32 nt, Human
accucaggcugggccuuugugcuggccuugca

SEQ ID NO: 302610 - RNA, 21 nt, Human
accucagggaaucuuccagcc

SEQ ID NO: 302611 - RNA, 23 nt, Human
accucagggacagcguccaggcu

SEQ ID NO: 302612 - RNA, 23 nt, Human
accucagggaccagagggcuagg

SEQ ID NO: 302613 - RNA, 32 nt, Human
accucaggggccagggcacugacaggacagga

SEQ ID NO: 302614 - RNA, 32 nt, Human
accucagggggcgggugcuggggucuucucca

SEQ ID NO: 302615 - RNA, 20 nt, Human
accucagggguccccacgcc

SEQ ID NO: 302616 - RNA, 32 nt, Human
accucaggguggagagacugaaugcuugugag

SEQ ID NO: 302617 - RNA, 32 nt, Human
accucagggugucgguuaagagacaggccucc

SEQ ID NO: 302618 - RNA, 22 nt, Human
accucagguaauccaccugccu

SEQ ID NO: 302619 - RNA, 24 nt, Human
accucagguaauccaccugcuuca

SEQ ID NO: 302620 - RNA, 24 nt, Human
accucagguaauccucccaccuca

SEQ ID NO: 302621 - RNA, 24 nt, Human
accucagguaauuuuucacucuca

SEQ ID NO: 302622 - RNA, 24 nt, Human
accucagguacugaugaaccccac

SEQ ID NO: 302623 - RNA, 32 nt, Human
accucaggugagccacccgccucggccuccca

SEQ ID NO: 302624 - RNA, 23 nt, Human
accucaggugauccaacugccuc

SEQ ID NO: 302625 - RNA, 23 nt, Human
accucaggugauccacaugacuc

SEQ ID NO: 302626 - RNA, 22 nt, Human
accucaggugauccaccaccuc

SEQ ID NO: 302627 - RNA, 23 nt, Human
accucaggugauccaccagccuc

SEQ ID NO: 302628 - RNA, 23 nt, Human
accucaggugauccacccaccuc

SEQ ID NO: 302629 - RNA, 24 nt, Human
accucaggugauccacccaccuca

SEQ ID NO: 302630 - RNA, 32 nt, Human
accucaggugauccacccaccugggccuccca

SEQ ID NO: 302631 - RNA, 23 nt, Human
accucaggugauccacccaccuu

SEQ ID NO: 302632 - RNA, 24 nt, Human
accucaggugauccacccacguca

SEQ ID NO: 302633 - RNA, 23 nt, Human
accucaggugauccacccacuuu

SEQ ID NO: 302634 - RNA, 20 nt, Human
accucaggugauccaccccc

SEQ ID NO: 302635 - RNA, 26 nt, Human
accucaggugauccaccccccgccuc

SEQ ID NO: 302636 - RNA, 22 nt, Human
accucaggugauccacccgccc

SEQ ID NO: 302637 - RNA, 22 nt, Human
accucaggugauccacccgccu

SEQ ID NO: 302638 - RNA, 23 nt, Human
accucaggugauccacccgccuc

SEQ ID NO: 302639 - RNA, 24 nt, Human
accucaggugauccacccgccuca

SEQ ID NO: 302640 - RNA, 24 nt, Human
accucaggugauccacccgccuua

SEQ ID NO: 302641 - RNA, 24 nt, Human
accucaggugauccacccgcuuca

SEQ ID NO: 302642 - RNA, 22 nt, Human
accucaggugauccacccuccu

SEQ ID NO: 302643 - RNA, 23 nt, Human
accucaggugauccacccuccuc

SEQ ID NO: 302644 - RNA, 24 nt, Human
accucaggugauccacccuccuca

SEQ ID NO: 302645 - RNA, 21 nt, Human
accucaggugauccaccgccu

SEQ ID NO: 302646 - RNA, 23 nt, Human
accucaggugauccaccuaccuc

SEQ ID NO: 302647 - RNA, 21 nt, Human
accucaggugauccaccugcc

SEQ ID NO: 302648 - RNA, 22 nt, Human
accucaggugauccaccugccu

SEQ ID NO: 302649 - RNA, 23 nt, Human
accucaggugauccaccugccuc

SEQ ID NO: 302650 - RNA, 24 nt, Human
accucaggugauccaccugccuca

SEQ ID NO: 302651 - RNA, 22 nt, Human
accucaggugauccaccugucu

SEQ ID NO: 302652 - RNA, 24 nt, Human
accucaggugauccaccuuggccu

SEQ ID NO: 302653 - RNA, 23 nt, Human
accucaggugauccacucgccuc

SEQ ID NO: 302654 - RNA, 22 nt, Human
accucaggugauccaucagccu

SEQ ID NO: 302655 - RNA, 23 nt, Human
accucaggugauccauccaccuc

SEQ ID NO: 302656 - RNA, 23 nt, Human
accucaggugauccaucugccuc

SEQ ID NO: 302657 - RNA, 24 nt, Human
accucaggugauccgcaugccuca

SEQ ID NO: 302658 - RNA, 22 nt, Human
accucaggugauccgcccaccu

SEQ ID NO: 302659 - RNA, 23 nt, Human
accucaggugauccgcccaccuc

SEQ ID NO: 302660 - RNA, 24 nt, Human
accucaggugauccgcccaccuca

SEQ ID NO: 302661 - RNA, 24 nt, Human
accucaggugauccgcccgccuca

SEQ ID NO: 302662 - RNA, 32 nt, Human
accucaggugauccgcccgccugggccuccca

SEQ ID NO: 302663 - RNA, 24 nt, Human
accucaggugauccgccuaccuca

SEQ ID NO: 302664 - RNA, 24 nt, Human
accucaggugauccguccaccuca

SEQ ID NO: 302665 - RNA, 23 nt, Human
accucaggugauccucccaccuc

SEQ ID NO: 302666 - RNA, 23 nt, Human
accucaggugaucuacccaccuc

SEQ ID NO: 302667 - RNA, 24 nt, Human
accucaggugaucuacccaccuca

SEQ ID NO: 302668 - RNA, 24 nt, Human
accucaggugaucuacccgccuca

SEQ ID NO: 302669 - RNA, 23 nt, Human
accucaggugaucugcccaccuc

SEQ ID NO: 302670 - RNA, 24 nt, Human
accucaggugaucugcccaccuca

SEQ ID NO: 302671 - RNA, 24 nt, Human
accucaggugaucugcccgccuca

SEQ ID NO: 302672 - RNA, 21 nt, Human
accucaggugaucugcccucc

SEQ ID NO: 302673 - RNA, 24 nt, Human
accucaggugaucugugugcccca

SEQ ID NO: 302674 - RNA, 24 nt, Human
accucaggugaugcacccaccuca

SEQ ID NO: 302675 - RNA, 24 nt, Human
accucaggugauucaccagccuca

SEQ ID NO: 302676 - RNA, 32 nt, Human
accucaguaaaccagaugaaacuccaaaugcu

SEQ ID NO: 302677 - RNA, 31 nt, Human
accucaguauuucagcaccuuaagcacugau

SEQ ID NO: 302678 - RNA, 32 nt, Human
accucagucuaugugagaggaagagaaugugu

SEQ ID NO: 302679 - RNA, 32 nt, Human
accucagugcugcuggacucaguuccaagauc

SEQ ID NO: 302680 - RNA, 31 nt, Human
accucaguggagaaauguaaagacugaauug

SEQ ID NO: 302681 - RNA, 32 nt, Human
accucaguguggcccuccuuccugauuuaguu

SEQ ID NO: 302682 - RNA, 32 nt, Human
accucaguugacugucaaagauaucagcugua

SEQ ID NO: 302683 - RNA, 24 nt, Human
accucaguugauccacccgccuca

SEQ ID NO: 302684 - RNA, 32 nt, Human
accucaguuguccccaucaucauggagaccca

SEQ ID NO: 302685 - RNA, 32 nt, Human
accucaguuucaagucaucuaaaccuguguca

SEQ ID NO: 302686 - RNA, 32 nt, Human
accucauacucuucuguuuuccauuccacaug

SEQ ID NO: 302687 - RNA, 32 nt, Human
accucauacugagguuuuugcacugaaauauc

SEQ ID NO: 302688 - RNA, 32 nt, Human
accucauagcaguaaaugacuugcuguuguuu

SEQ ID NO: 302689 - RNA, 23 nt, Human
accucauaggacuaugaauucac

SEQ ID NO: 302690 - RNA, 32 nt, Human
accucaucaagccagcacauccugccugcugu

SEQ ID NO: 302691 - RNA, 32 nt, Human
accucaucacagucuuccuuccucuucaagcg

SEQ ID NO: 302692 - RNA, 32 nt, Human
accucaucaccuuuugugcagacaggcagguu

SEQ ID NO: 302693 - RNA, 32 nt, Human
accucaucacuggagguaaaagcacaagcaau

SEQ ID NO: 302694 - RNA, 18 nt, Human
accucauccgaccaugua

SEQ ID NO: 302695 - RNA, 32 nt, Human
accucauccucccaggaucuaccaguugaugg

SEQ ID NO: 302696 - RNA, 32 nt, Human
accucauccuccuggaggguguggcuacccuc

SEQ ID NO: 302697 - RNA, 32 nt, Human
accucaucuagcaccuucucuaccucccaggg

SEQ ID NO: 302698 - RNA, 32 nt, Human
accucaucucauuccucuucuuacagagaccu

SEQ ID NO: 302699 - RNA, 32 nt, Human
accucaucuccucccucuucucuugcuuuccc

SEQ ID NO: 302700 - RNA, 32 nt, Human
accucaugaacaaaaguacuuuggcauccaga

SEQ ID NO: 302701 - RNA, 32 nt, Human
accucaugagccucuaagggaaaggaggaaca

SEQ ID NO: 302702 - RNA, 32 nt, Human
accucaugagugggauuaguguccuuauaaaa

SEQ ID NO: 302703 - RNA, 32 nt, Human
accucaugcaggugaagccacuguggaaacag

SEQ ID NO: 302704 - RNA, 32 nt, Human
accucaugccugaagacagcuugggcagguga

SEQ ID NO: 302705 - RNA, 32 nt, Human
accucaugcucuguucaaggccaucacaaagg

SEQ ID NO: 302706 - RNA, 32 nt, Human
accucaugcuucuuauuuggggagagggcugu

SEQ ID NO: 302707 - RNA, 32 nt, Human
accucauggaaagaaugaagagccagaaauag

SEQ ID NO: 302708 - RNA, 24 nt, Human
accucauguaauccacccaccuca

SEQ ID NO: 302709 - RNA, 32 nt, Human
accucaugucagugaagaugggauuaaaaaca

SEQ ID NO: 302710 - RNA, 22 nt, Human
accucauuccuccacccaccuc

SEQ ID NO: 302711 - RNA, 32 nt, Human
accucauucucuguccagaauguggacucccu

SEQ ID NO: 302712 - RNA, 32 nt, Human
accucauugcaaccuccgccucccggguucgc

SEQ ID NO: 302713 - RNA, 32 nt, Human
accucauugcagccucagacuccuggguucaa

SEQ ID NO: 302714 - RNA, 32 nt, Human
accucauuggaaacccagaggcugcagagagc

SEQ ID NO: 302715 - RNA, 32 nt, Human
accucauuucccuccauuaucucccuaaaggc

SEQ ID NO: 302716 - RNA, 32 nt, Human
accucauuugaaucgcccucccaugggaaucc

SEQ ID NO: 302717 - RNA, 32 nt, Human
accucauuuuucucccaggccuaggagcucaa

SEQ ID NO: 302718 - RNA, 32 nt, Human
accuccaaaguguugggauuacaggcaaugag

SEQ ID NO: 302719 - RNA, 32 nt, Human
accuccaacagcuuucccugccacugugggug

SEQ ID NO: 302720 - RNA, 32 nt, Human
accuccaacauggugaaaccccgucccuaaua

SEQ ID NO: 302721 - RNA, 32 nt, Human
accuccaacucccugguucaagcgauucuccu

SEQ ID NO: 302722 - RNA, 32 nt, Human
accuccaaugacucaggaauugccuguaaauu

SEQ ID NO: 302723 - RNA, 32 nt, Human
accuccacaucccagguucaagugauucuccu

SEQ ID NO: 302724 - RNA, 32 nt, Human
accuccacauccuggguucaagugauucuccu

SEQ ID NO: 302725 - RNA, 32 nt, Human
accuccaccaggaccaggauccugggccacag

SEQ ID NO: 302726 - RNA, 32 nt, Human
accuccacccagccccucccacauuucacuca

SEQ ID NO: 302727 - RNA, 32 nt, Human
accuccaccccccagguucaagcaguucuucc

SEQ ID NO: 302728 - RNA, 32 nt, Human
accuccacccgccggguucaagcgauucuccu

SEQ ID NO: 302729 - RNA, 32 nt, Human
accuccacccugcauuuuccucuuguccuggc

SEQ ID NO: 302730 - RNA, 32 nt, Human
accuccaccgccaccuccaccuccggcaccca

SEQ ID NO: 302731 - RNA, 32 nt, Human
accuccaccgguccaggucuuugcugcugucc

SEQ ID NO: 302732 - RNA, 32 nt, Human
accuccaccuacuaggcucaagcaauucucgu

SEQ ID NO: 302733 - RNA, 32 nt, Human
accuccaccucacagguucaagcgauucucgu

SEQ ID NO: 302734 - RNA, 32 nt, Human
accuccaccuccaccgccaccuccaccuccgg

SEQ ID NO: 302735 - RNA, 32 nt, Human
accuccaccuccaggguucagaguagcuggga

SEQ ID NO: 302736 - RNA, 32 nt, Human
accuccaccucccagguucaagcaauuauccu

SEQ ID NO: 302737 - RNA, 32 nt, Human
accuccaccucccagguucaagcaauucuccu

SEQ ID NO: 302738 - RNA, 32 nt, Human
accuccaccucccagguucaagcaauucucug

SEQ ID NO: 302739 - RNA, 32 nt, Human
accuccaccucccagguucaagcaauucucuu

SEQ ID NO: 302740 - RNA, 32 nt, Human
accuccaccucccagguucaagcaauucuucu

SEQ ID NO: 302741 - RNA, 32 nt, Human
accuccaccucccagguucaagcaguucuccu

SEQ ID NO: 302742 - RNA, 32 nt, Human
accuccaccucccagguucaagcaguucucug

SEQ ID NO: 302743 - RNA, 32 nt, Human
accuccaccucccagguucaagcgauuccccu

SEQ ID NO: 302744 - RNA, 32 nt, Human
accuccaccucccagguucaagcgauucuccu

SEQ ID NO: 302745 - RNA, 32 nt, Human
accuccaccucccagguucaagcgauucucgu

SEQ ID NO: 302746 - RNA, 32 nt, Human
accuccaccucccagguucaagggauucgucu

SEQ ID NO: 302747 - RNA, 32 nt, Human
accuccaccucccagguucaagggauucuccc

SEQ ID NO: 302748 - RNA, 32 nt, Human
accuccaccucccagguucaagugauucucau

SEQ ID NO: 302749 - RNA, 32 nt, Human
accuccaccucccagguucaagugauucuccu

SEQ ID NO: 302750 - RNA, 32 nt, Human
accuccaccucccagguucaagugauucuucu

SEQ ID NO: 302751 - RNA, 32 nt, Human
accuccaccucccagguucacaccauucuccu

SEQ ID NO: 302752 - RNA, 32 nt, Human
accuccaccucccggauucaagcaauucuucu

SEQ ID NO: 302753 - RNA, 32 nt, Human
accuccaccucccggguucaagcaauucuccu

SEQ ID NO: 302754 - RNA, 32 nt, Human
accuccaccucccggguucaagcaguucuccu

SEQ ID NO: 302755 - RNA, 32 nt, Human
accuccaccucccggguucaagcgauucuccu

SEQ ID NO: 302756 - RNA, 32 nt, Human
accuccaccucccggguucaagggauucugcc

SEQ ID NO: 302757 - RNA, 32 nt, Human
accuccaccucccggguucaagugauucaugu

SEQ ID NO: 302758 - RNA, 32 nt, Human
accuccaccucccggguucaagugauucucau

SEQ ID NO: 302759 - RNA, 32 nt, Human
accuccaccucccggguucaagugauucuccu

SEQ ID NO: 302760 - RNA, 32 nt, Human
accuccaccucccggguucaagugauucucug

SEQ ID NO: 302761 - RNA, 32 nt, Human
accuccaccucccugguucaagcgauucuccu

SEQ ID NO: 302762 - RNA, 32 nt, Human
accuccaccuccuagguucaagcaauucuccu

SEQ ID NO: 302763 - RNA, 32 nt, Human
accuccaccuccuagguucaagugauucuacu

SEQ ID NO: 302764 - RNA, 32 nt, Human
accuccaccuccuggguucaaacaauucuccu

SEQ ID NO: 302765 - RNA, 32 nt, Human
accuccaccuccuggguucaagacaauccucc

SEQ ID NO: 302766 - RNA, 32 nt, Human
accuccaccuccuggguucaagcaauucucca

SEQ ID NO: 302767 - RNA, 32 nt, Human
accuccaccuccuggguucaagcaauucuccu

SEQ ID NO: 302768 - RNA, 32 nt, Human
accuccaccuccuggguucaagcaauucuugu

SEQ ID NO: 302769 - RNA, 32 nt, Human
accuccaccuccuggguucaagcaguucuccc

SEQ ID NO: 302770 - RNA, 32 nt, Human
accuccaccuccuggguucaagcaguucucgu

SEQ ID NO: 302771 - RNA, 32 nt, Human
accuccaccuccuggguucaagcgauucuccu

SEQ ID NO: 302772 - RNA, 32 nt, Human
accuccaccuccuggguucaagcgauucucuu

SEQ ID NO: 302773 - RNA, 32 nt, Human
accuccaccuccuggguucaagcgauucugcu

SEQ ID NO: 302774 - RNA, 32 nt, Human
accuccaccuccuggguucaagcgauucuuau

SEQ ID NO: 302775 - RNA, 32 nt, Human
accuccaccuccuggguucaagcgauuuucuu

SEQ ID NO: 302776 - RNA, 32 nt, Human
accuccaccuccuggguucaagugauucuccu

SEQ ID NO: 302777 - RNA, 32 nt, Human
accuccaccuccuggguucaagugauucuugu

SEQ ID NO: 302778 - RNA, 32 nt, Human
accuccaccuccuggguucaagugauuuuccu

SEQ ID NO: 302779 - RNA, 32 nt, Human
accuccaccuccuggguucacgcaauucuccu

SEQ ID NO: 302780 - RNA, 32 nt, Human
accuccaccuccuggguucaggcgauucuccu

SEQ ID NO: 302781 - RNA, 32 nt, Human
accuccaccuccuggguuccagcgauucuccu

SEQ ID NO: 302782 - RNA, 32 nt, Human
accuccaccuccuggguugaagugauucucgu

SEQ ID NO: 302783 - RNA, 32 nt, Human
accuccaccuccuggguuuaagcaaugcuucu

SEQ ID NO: 302784 - RNA, 32 nt, Human
accuccaccuccuggguuuaagcgauucuccu

SEQ ID NO: 302785 - RNA, 32 nt, Human
accuccaccuccuggguuugaggaauuguccu

SEQ ID NO: 302786 - RNA, 32 nt, Human
accuccaccuccuuccccuucucccucaggca

SEQ ID NO: 302787 - RNA, 32 nt, Human
accuccaccucucagauucaagcaauucuccu

SEQ ID NO: 302788 - RNA, 32 nt, Human
accuccaccucucagguucaagcaauucucau

SEQ ID NO: 302789 - RNA, 32 nt, Human
accuccaccucucagguucaagcaauucuccu

SEQ ID NO: 302790 - RNA, 32 nt, Human
accuccaccucucggcuucaagcaauucuccu

SEQ ID NO: 302791 - RNA, 32 nt, Human
accuccaccucugggauucaagcaauucuccc

SEQ ID NO: 302792 - RNA, 32 nt, Human
accuccaccucuuauguucaagcaauucuccu

SEQ ID NO: 302793 - RNA, 32 nt, Human
accuccaccucuuggguucaagcgauucuccu

SEQ ID NO: 302794 - RNA, 16 nt, Human
accuccaccugcccca

SEQ ID NO: 302795 - RNA, 32 nt, Human
accuccaccuuccggguucaagugauucuccu

SEQ ID NO: 302796 - RNA, 32 nt, Human
accuccaccuuccugguucaagcgauucugcc

SEQ ID NO: 302797 - RNA, 32 nt, Human
accuccaccuuccugguucaagggauucuccu

SEQ ID NO: 302798 - RNA, 21 nt, Human
accuccacggaccucggaccu

SEQ ID NO: 302799 - RNA, 20 nt, Human
accuccacggccaccacgug

SEQ ID NO: 302800 - RNA, 32 nt, Human
accuccacuacugcuugacccugccgggauuc

SEQ ID NO: 302801 - RNA, 20 nt, Human
accuccacuccacuccccac

SEQ ID NO: 302802 - RNA, 32 nt, Human
accuccacucccuccgcugccaugaagcucau

SEQ ID NO: 302803 - RNA, 32 nt, Human
accuccacugcacaacucgggcggggguguga

SEQ ID NO: 302804 - RNA, 32 nt, Human
accuccacuucccagguucaagcgauccuccu

SEQ ID NO: 302805 - RNA, 32 nt, Human
accuccacuucccagguucaagcgauucucau

SEQ ID NO: 302806 - RNA, 32 nt, Human
accuccacuucccggguucaagcgauucuccu

SEQ ID NO: 302807 - RNA, 32 nt, Human
accuccacuucccggguucaagcgauucuucu

SEQ ID NO: 302808 - RNA, 32 nt, Human
accuccacuucccugguucaagcaauuccccu

SEQ ID NO: 302809 - RNA, 32 nt, Human
accuccacuuccuagguucaagcaauucuccu

SEQ ID NO: 302810 - RNA, 32 nt, Human
accuccacuuccuggguucaagcgauucuccu

SEQ ID NO: 302811 - RNA, 32 nt, Human
accuccacuucucagguucaagcaauucuccu

SEQ ID NO: 302812 - RNA, 32 nt, Human
accuccacuucuuggguucaagugauucuccu

SEQ ID NO: 302813 - RNA, 32 nt, Human
accuccacuuuccagguucaagcaauucuccu

SEQ ID NO: 302814 - RNA, 32 nt, Human
accuccagaagauucaaggagcuguagaggug

SEQ ID NO: 302815 - RNA, 32 nt, Human
accuccagagccuccaggggaccacacaguag

SEQ ID NO: 302816 - RNA, 32 nt, Human
accuccagcauuggcccagcaggcccagcacg

SEQ ID NO: 302817 - RNA, 32 nt, Human
accuccagccaccccaggucucagccucccug

SEQ ID NO: 302818 - RNA, 32 nt, Human
accuccagcccaucagaaacaugagugugagc

SEQ ID NO: 302819 - RNA, 32 nt, Human
accuccagcccugcaaaagcccuaccacaggu

SEQ ID NO: 302820 - RNA, 32 nt, Human
accuccagccggucacucacccucucuggacc

SEQ ID NO: 302821 - RNA, 32 nt, Human
accuccagccucccgggccuugagggaguaaa

SEQ ID NO: 302822 - RNA, 32 nt, Human
accuccagccuggaggagacagccacggggug

SEQ ID NO: 302823 - RNA, 32 nt, Human
accuccagccugggcaacagagugagacucug

SEQ ID NO: 302824 - RNA, 32 nt, Human
accuccagccugggggacagagcaagaccgug

SEQ ID NO: 302825 - RNA, 32 nt, Human
accuccagcuacagggcucucauccaagucaa

SEQ ID NO: 302826 - RNA, 32 nt, Human
accuccagcucccagguugaagcaauucuccu

SEQ ID NO: 302827 - RNA, 32 nt, Human
accuccagcuccuggguucaagcaauucucau

SEQ ID NO: 302828 - RNA, 32 nt, Human
accuccagcuccuggguucaggugauucuccu

SEQ ID NO: 302829 - RNA, 30 nt, Human
accuccagcuucuccaugaccuccugcaug

SEQ ID NO: 302830 - RNA, 32 nt, Human
accuccaggagcuguguaacagcaaccggaaa

SEQ ID NO: 302831 - RNA, 21 nt, Human
accuccaggaugagcacugca

SEQ ID NO: 302832 - RNA, 32 nt, Human
accuccaggguggagggcaccucugggcucca

SEQ ID NO: 302833 - RNA, 32 nt, Human
accuccaguggggccaacacagccaccaacuc

SEQ ID NO: 302834 - RNA, 22 nt, Human
accuccagugucaggguccagg

SEQ ID NO: 302835 - RNA, 32 nt, Human
accuccagugucaggguccaggagagccuggg

SEQ ID NO: 302836 - RNA, 32 nt, Human
accuccaucucccggguucaagcaauucuccu

SEQ ID NO: 302837 - RNA, 32 nt, Human
accuccaucucccuggcucaagcaauucuccu

SEQ ID NO: 302838 - RNA, 32 nt, Human
accuccaucuccugggucccagcgauucuccu

SEQ ID NO: 302839 - RNA, 32 nt, Human
accuccaucuucuuugcagccuggguggcuau

SEQ ID NO: 302840 - RNA, 20 nt, Human
accuccauggagccacuagg

SEQ ID NO: 302841 - RNA, 32 nt, Human
accuccauggugggagaucaggaguuaaggac

SEQ ID NO: 302842 - RNA, 24 nt, Human
accuccauguggccagggguuggg

SEQ ID NO: 302843 - RNA, 32 nt, Human
accucccaaauuugaguugcacccuucccugu

SEQ ID NO: 302844 - RNA, 32 nt, Human
accucccacagcuccaccccagacugggcgcc

SEQ ID NO: 302845 - RNA, 32 nt, Human
accucccacauauacuacguucaagaguucac

SEQ ID NO: 302846 - RNA, 20 nt, Human
accucccacccaccacagaa

SEQ ID NO: 302847 - RNA, 32 nt, Human
accucccacugaggcggcuccagccccagaca

SEQ ID NO: 302848 - RNA, 32 nt, Human
accucccacugcacugccgguuucccuggguu

SEQ ID NO: 302849 - RNA, 32 nt, Human
accucccacugcucccugucaggggcccaggc

SEQ ID NO: 302850 - RNA, 22 nt, Human
accucccacuggguuccuccca

SEQ ID NO: 302851 - RNA, 32 nt, Human
accucccagaggccccucccacccuucccuuc

SEQ ID NO: 302852 - RNA, 32 nt, Human
accucccagcucccagcccuuccuagugccca

SEQ ID NO: 302853 - RNA, 32 nt, Human
accucccaggaaaaggaugagaggagaaagcc

SEQ ID NO: 302854 - RNA, 32 nt, Human
accucccaggaaugcugccuuccuucagccca

SEQ ID NO: 302855 - RNA, 32 nt, Human
accucccagggcauuggugaauucauacagga

SEQ ID NO: 302856 - RNA, 32 nt, Human
accucccagggugggagcugggccgggcuggg

SEQ ID NO: 302857 - RNA, 26 nt, Human
accucccaggugauccucccaccuca

SEQ ID NO: 302858 - RNA, 32 nt, Human
accucccaggugauccucccaccucagcuucc

SEQ ID NO: 302859 - RNA, 32 nt, Human
accucccagguucaagggauucucccaccuca

SEQ ID NO: 302860 - RNA, 32 nt, Human
accucccaguuuggugggcaaguggggcugau

SEQ ID NO: 302861 - RNA, 24 nt, Human
accucccaucucuccuuccaggcc

SEQ ID NO: 302862 - RNA, 32 nt, Human
accucccauuucuuggacauauaccauuggac

SEQ ID NO: 302863 - RNA, 32 nt, Human
accuccccagccugcgccugcugcaugcccuc

SEQ ID NO: 302864 - RNA, 32 nt, Human
accuccccauuaacaaacacugccccuuaagu

SEQ ID NO: 302865 - RNA, 19 nt, Human
accucccccaacccugccc

SEQ ID NO: 302866 - RNA, 21 nt, Human
accucccccagggcuccuccc

SEQ ID NO: 302867 - RNA, 20 nt, Human
accuccccccgccuccuucc

SEQ ID NO: 302868 - RNA, 32 nt, Human
accucccccgacugccacucuggaccuaauag

SEQ ID NO: 302869 - RNA, 21 nt, Human
accucccccguggcuccuucc

SEQ ID NO: 302870 - RNA, 32 nt, Human
accucccccuccuggguucaagcgauucuccu

SEQ ID NO: 302871 - RNA, 18 nt, Human
accucccccucugugagg

SEQ ID NO: 302872 - RNA, 32 nt, Human
accucccccugcagggggccucaggccaagag

SEQ ID NO: 302873 - RNA, 32 nt, Human
accucccccugccucccagccuccgcagauga

SEQ ID NO: 302874 - RNA, 32 nt, Human
accuccccgagucuugggagccuggaccccga

SEQ ID NO: 302875 - RNA, 22 nt, Human
accuccccgcgccgccgccgcc

SEQ ID NO: 302876 - RNA, 32 nt, Human
accuccccgcucucccugucacgcucaugucc

SEQ ID NO: 302877 - RNA, 32 nt, Human
accuccccggaaggaauuuuguuucucucuag

SEQ ID NO: 302878 - RNA, 32 nt, Human
accuccccggggacccagcgaaggaggagccg

SEQ ID NO: 302879 - RNA, 32 nt, Human
accuccccuaaccccaaacauagaucacaccu

SEQ ID NO: 302880 - RNA, 23 nt, Human
accuccccuauccacccagccca

SEQ ID NO: 302881 - RNA, 32 nt, Human
accuccccuccccacagccuuccucacccuug

SEQ ID NO: 302882 - RNA, 32 nt, Human
accuccccucuugcacuuucucuccagucacc

SEQ ID NO: 302883 - RNA, 32 nt, Human
accuccccugccacagacucucccucuucugc

SEQ ID NO: 302884 - RNA, 32 nt, Human
accuccccugcucuccuucccagcauugagcc

SEQ ID NO: 302885 - RNA, 32 nt, Human
accuccccuggaggcacagagggcgggggccu

SEQ ID NO: 302886 - RNA, 32 nt, Human
accuccccuucccacuucacugccaucccaga

SEQ ID NO: 302887 - RNA, 32 nt, Human
accuccccuuucaagcccuccugccgccuugg

SEQ ID NO: 302888 - RNA, 32 nt, Human
accucccgcucccuucccccagcccuggagcc

SEQ ID NO: 302889 - RNA, 32 nt, Human
accucccggcagcagcggcagcugagacucac

SEQ ID NO: 302890 - RNA, 32 nt, Human
accucccggggcugcugacccucagcccgcac

SEQ ID NO: 302891 - RNA, 21 nt, Human
accucccguccgccgccgccg

SEQ ID NO: 302892 - RNA, 32 nt, Human
accucccuacucucccugccgaggcguccaua

SEQ ID NO: 302893 - RNA, 32 nt, Human
accucccuaggguuuugugugugugcacacua

SEQ ID NO: 302894 - RNA, 32 nt, Human
accucccuaugugaacuguagacucagauccc

SEQ ID NO: 302895 - RNA, 32 nt, Human
accucccucacagaacagggaagcagugacag

SEQ ID NO: 302896 - RNA, 32 nt, Human
accucccuccaggagaucccagggugcaaagu

SEQ ID NO: 302897 - RNA, 32 nt, Human
accucccucccucccuacuuuccuugcuuccu

SEQ ID NO: 302898 - RNA, 32 nt, Human
accucccucccucccucgcuucuucucucuuu

SEQ ID NO: 302899 - RNA, 32 nt, Human
accucccuccuggggccuuuuguuuuggaucc

SEQ ID NO: 302900 - RNA, 32 nt, Human
accucccuccuuggcacgaugagcaccugcag

SEQ ID NO: 302901 - RNA, 32 nt, Human
accucccuccuuggggcuguuugcaucccugc

SEQ ID NO: 302902 - RNA, 32 nt, Human
accucccucggccgugcggcacuggaccucgc

SEQ ID NO: 302903 - RNA, 32 nt, Human
accucccucucauccaugcauucuauucccag

SEQ ID NO: 302904 - RNA, 32 nt, Human
accucccugaaccaucccugaugucugucugg

SEQ ID NO: 302905 - RNA, 32 nt, Human
accucccugaaccuuaauuuaauccuagguag

SEQ ID NO: 302906 - RNA, 32 nt, Human
accucccugccaaauaacucagaagaggagug

SEQ ID NO: 302907 - RNA, 24 nt, Human
accucccugccaggccaagccagg

SEQ ID NO: 302908 - RNA, 32 nt, Human
accucccugcccuccuccucccugggccuuca

SEQ ID NO: 302909 - RNA, 32 nt, Human
accucccugcccuguccuccagcuuccccucg

SEQ ID NO: 302910 - RNA, 32 nt, Human
accucccugccucucacacucuguguauuuug

SEQ ID NO: 302911 - RNA, 32 nt, Human
accucccugccugaaccuccaggcccugcaga

SEQ ID NO: 302912 - RNA, 32 nt, Human
accucccugccugauucuccugccucagccug

SEQ ID NO: 302913 - RNA, 32 nt, Human
accucccugccugauucucuugccucagccug

SEQ ID NO: 302914 - RNA, 32 nt, Human
accucccugcucucuuuccuuuucaguuuuuc

SEQ ID NO: 302915 - RNA, 32 nt, Human
accucccugcucuucugcacuccuggacacaa

SEQ ID NO: 302916 - RNA, 32 nt, Human
accucccuggcccucuggcuggccccaggagc

SEQ ID NO: 302917 - RNA, 32 nt, Human
accucccuggggagucgggggauuggguugug

SEQ ID NO: 302918 - RNA, 32 nt, Human
accucccuuguuagcaucucccagagaaccug

SEQ ID NO: 302919 - RNA, 32 nt, Human
accucccuuuaucuccuccuuccccucuggca

SEQ ID NO: 302920 - RNA, 32 nt, Human
accucccuuuccaagccugccugggugggugu

SEQ ID NO: 302921 - RNA, 32 nt, Human
accuccgacucccagguucaagcaauucuccu

SEQ ID NO: 302922 - RNA, 32 nt, Human
accuccgacucccugguucaagcgauucuccu

SEQ ID NO: 302923 - RNA, 32 nt, Human
accuccgacuccuggguucaagcaauucuucu

SEQ ID NO: 302924 - RNA, 32 nt, Human
accuccgcaacgauuccucggacuaugugguu

SEQ ID NO: 302925 - RNA, 32 nt, Human
accuccgcauccacccccguccgccauccugc

SEQ ID NO: 302926 - RNA, 32 nt, Human
accuccgcaucccggguucaagagauucugcc

SEQ ID NO: 302927 - RNA, 32 nt, Human
accuccgcaucccggguucaagcgauucuccu

SEQ ID NO: 302928 - RNA, 32 nt, Human
accuccgccccccagguucaagcgauucugcc

SEQ ID NO: 302929 - RNA, 32 nt, Human
accuccgcccccuggguucaagcaauucuccu

SEQ ID NO: 302930 - RNA, 32 nt, Human
accuccgcccccuggguucaagcgauucuccu

SEQ ID NO: 302931 - RNA, 32 nt, Human
accuccgcccccuggguuuaagcgauucuccu

SEQ ID NO: 302932 - RNA, 32 nt, Human
accuccgccguccuccccaacccucguccucu

SEQ ID NO: 302933 - RNA, 32 nt, Human
accuccgccuacuggguucaagugauucucuu

SEQ ID NO: 302934 - RNA, 32 nt, Human
accuccgccucccaaguucaagcgauucuccu

SEQ ID NO: 302935 - RNA, 32 nt, Human
accuccgccucccaaguucaagcgauuguccu

SEQ ID NO: 302936 - RNA, 32 nt, Human
accuccgccucccagguucaagcaauucuccc

SEQ ID NO: 302937 - RNA, 32 nt, Human
accuccgccucccagguucaagcaauucuccu

SEQ ID NO: 302938 - RNA, 32 nt, Human
accuccgccucccagguucaagcaauucugcu

SEQ ID NO: 302939 - RNA, 32 nt, Human
accuccgccucccagguucaagcaguucuccu

SEQ ID NO: 302940 - RNA, 32 nt, Human
accuccgccucccagguucaagcgauucuccu

SEQ ID NO: 302941 - RNA, 32 nt, Human
accuccgccucccagguucaagcgauuuuccu

SEQ ID NO: 302942 - RNA, 32 nt, Human
accuccgccucccagguucaagcgguucuccu

SEQ ID NO: 302943 - RNA, 32 nt, Human
accuccgccucccagguucaaguaauuccucu

SEQ ID NO: 302944 - RNA, 32 nt, Human
accuccgccucccagguucaaguaauucuccu

SEQ ID NO: 302945 - RNA, 32 nt, Human
accuccgccucccagguucaaguaauucugcc

SEQ ID NO: 302946 - RNA, 32 nt, Human
accuccgccucccagguucacgccauucuccu

SEQ ID NO: 302947 - RNA, 32 nt, Human
accuccgccucccagguuccagcuauucuccu

SEQ ID NO: 302948 - RNA, 32 nt, Human
accuccgccucccauguucaagcgauucuccu

SEQ ID NO: 302949 - RNA, 32 nt, Human
accuccgccucccgaguucaagcgauucuccu

SEQ ID NO: 302950 - RNA, 32 nt, Human
accuccgccucccggauucaagcaauucuccc

SEQ ID NO: 302951 - RNA, 32 nt, Human
accuccgccucccggguucaagaaguuucccu

SEQ ID NO: 302952 - RNA, 32 nt, Human
accuccgccucccggguucaagagauucuccu

SEQ ID NO: 302953 - RNA, 32 nt, Human
accuccgccucccggguucaagcaauccuccc

SEQ ID NO: 302954 - RNA, 32 nt, Human
accuccgccucccggguucaagcaauucuccu

SEQ ID NO: 302955 - RNA, 32 nt, Human
accuccgccucccggguucaagcaguucuccu

SEQ ID NO: 302956 - RNA, 32 nt, Human
accuccgccucccggguucaagcgauucaucu

SEQ ID NO: 302957 - RNA, 32 nt, Human
accuccgccucccggguucaagcgauucucca

SEQ ID NO: 302958 - RNA, 32 nt, Human
accuccgccucccggguucaagcgauucuccu

SEQ ID NO: 302959 - RNA, 32 nt, Human
accuccgccucccggguucaaguaauucugcu

SEQ ID NO: 302960 - RNA, 32 nt, Human
accuccgccucccggguucaagugauuccccu

SEQ ID NO: 302961 - RNA, 32 nt, Human
accuccgccucccggguucaagugauucucca

SEQ ID NO: 302962 - RNA, 32 nt, Human
accuccgccucccggguucaagugauucuccu

SEQ ID NO: 302963 - RNA, 32 nt, Human
accuccgccucccggguucaagugauucucgu

SEQ ID NO: 302964 - RNA, 32 nt, Human
accuccgccucccggguucaagugauucucuu

SEQ ID NO: 302965 - RNA, 32 nt, Human
accuccgccucccggguucaagugauucuucu

SEQ ID NO: 302966 - RNA, 32 nt, Human
accuccgccucccugguucaagcaauucuccu

SEQ ID NO: 302967 - RNA, 32 nt, Human
accuccgccucccugguucaagcgauucuccu

SEQ ID NO: 302968 - RNA, 32 nt, Human
accuccgccuccgggguucaagcgauucuccu

SEQ ID NO: 302969 - RNA, 32 nt, Human
accuccgccuccuggguccaagugauucuccu

SEQ ID NO: 302970 - RNA, 32 nt, Human
accuccgccuccuggguuaaagugauucucuc

SEQ ID NO: 302971 - RNA, 32 nt, Human
accuccgccuccuggguucaaacaauucuccu

SEQ ID NO: 302972 - RNA, 32 nt, Human
accuccgccuccuggguucaaacaauucuguc

SEQ ID NO: 302973 - RNA, 32 nt, Human
accuccgccuccuggguucaaacgauucuccu

SEQ ID NO: 302974 - RNA, 32 nt, Human
accuccgccuccuggguucaagagauucuccu

SEQ ID NO: 302975 - RNA, 32 nt, Human
accuccgccuccuggguucaagcaagucuccu

SEQ ID NO: 302976 - RNA, 32 nt, Human
accuccgccuccuggguucaagcaauucucca

SEQ ID NO: 302977 - RNA, 32 nt, Human
accuccgccuccuggguucaagcaauucuccu

SEQ ID NO: 302978 - RNA, 32 nt, Human
accuccgccuccuggguucaagcaauucucug

SEQ ID NO: 302979 - RNA, 32 nt, Human
accuccgccuccuggguucaagcaauucugug

SEQ ID NO: 302980 - RNA, 32 nt, Human
accuccgccuccuggguucaagcaauucuucu

SEQ ID NO: 302981 - RNA, 32 nt, Human
accuccgccuccuggguucaagcaguucucuu

SEQ ID NO: 302982 - RNA, 32 nt, Human
accuccgccuccuggguucaagcgauccuccu

SEQ ID NO: 302983 - RNA, 32 nt, Human
accuccgccuccuggguucaagcgauucaccc

SEQ ID NO: 302984 - RNA, 32 nt, Human
accuccgccuccuggguucaagcgauucaccu

SEQ ID NO: 302985 - RNA, 32 nt, Human
accuccgccuccuggguucaagcgauuccucu

SEQ ID NO: 302986 - RNA, 32 nt, Human
accuccgccuccuggguucaagcgauuccugu

SEQ ID NO: 302987 - RNA, 32 nt, Human
accuccgccuccuggguucaagcgauucucca

SEQ ID NO: 302988 - RNA, 32 nt, Human
accuccgccuccuggguucaagcgauucuccu

SEQ ID NO: 302989 - RNA, 32 nt, Human
accuccgccuccuggguucaagcgauucucgu

SEQ ID NO: 302990 - RNA, 32 nt, Human
accuccgccuccuggguucaagcgauucucuu

SEQ ID NO: 302991 - RNA, 32 nt, Human
accuccgccuccuggguucaagcgauuguccu

SEQ ID NO: 302992 - RNA, 32 nt, Human
accuccgccuccuggguucaagggauucuccu

SEQ ID NO: 302993 - RNA, 32 nt, Human
accuccgccuccuggguucaaguaauucuccu

SEQ ID NO: 302994 - RNA, 32 nt, Human
accuccgccuccuggguucaagugauucuccu

SEQ ID NO: 302995 - RNA, 32 nt, Human
accuccgccuccuggguucaagugauucucgu

SEQ ID NO: 302996 - RNA, 32 nt, Human
accuccgccuccuggguucacaugauucuccu

SEQ ID NO: 302997 - RNA, 32 nt, Human
accuccgccuccuggguucaggagauucuccu

SEQ ID NO: 302998 - RNA, 32 nt, Human
accuccgccuccuggguucaggcaauuuuccu

SEQ ID NO: 302999 - RNA, 32 nt, Human
accuccgccuccuggguucaggcgauucuccu

SEQ ID NO: 303000 - RNA, 32 nt, Human
accuccgccuccuggguuccaacgauucuccu

SEQ ID NO: 303001 - RNA, 32 nt, Human
accuccgccuccuggguucgggcgauucuccu

SEQ ID NO: 303002 - RNA, 32 nt, Human
accuccgccuccuggguucgggugauucuccu

SEQ ID NO: 303003 - RNA, 32 nt, Human
accuccgccuccuggguugaagcgauucuugu

SEQ ID NO: 303004 - RNA, 32 nt, Human
accuccgccucucagguucaagcaauucuccu

SEQ ID NO: 303005 - RNA, 32 nt, Human
accuccgccucucggguucaagcgauucuccu

SEQ ID NO: 303006 - RNA, 32 nt, Human
accuccgccucugcacuccagccugggugaca

SEQ ID NO: 303007 - RNA, 32 nt, Human
accuccgccucuuggguucaaccgauucuccu

SEQ ID NO: 303008 - RNA, 32 nt, Human
accuccgccucuuggguucaagcaauucugcu

SEQ ID NO: 303009 - RNA, 32 nt, Human
accuccgccucuuggguucaagcgauucuucu

SEQ ID NO: 303010 - RNA, 32 nt, Human
accuccgccugcuggguucaagcgauucuccu

SEQ ID NO: 303011 - RNA, 32 nt, Human
accuccgccuuccagguucaagcgauucuccu

SEQ ID NO: 303012 - RNA, 32 nt, Human
accuccgccuuccugguucaagugauucuccu

SEQ ID NO: 303013 - RNA, 32 nt, Human
accuccgccuucuggguucaagcaauucuccu

SEQ ID NO: 303014 - RNA, 32 nt, Human
accuccgccuucuggguucaagcaguucucgu

SEQ ID NO: 303015 - RNA, 32 nt, Human
accuccgccuugcugguugagauggauucucg

SEQ ID NO: 303016 - RNA, 32 nt, Human
accuccgcucccuggguucaagcgauucuccu

SEQ ID NO: 303017 - RNA, 32 nt, Human
accuccgcugagggucauuaugugccaggcau

SEQ ID NO: 303018 - RNA, 32 nt, Human
accuccgcuuccuggguucaaacaauucuccu

SEQ ID NO: 303019 - RNA, 32 nt, Human
accuccggcgaauaaaggucggccugcgggua

SEQ ID NO: 303020 - RNA, 32 nt, Human
accuccggcucuugucaggcucuugucuggua

SEQ ID NO: 303021 - RNA, 32 nt, Human
accuccgucucccagguucaagcgauucuccc

SEQ ID NO: 303022 - RNA, 32 nt, Human
accuccgucucccagguucaagcgauucucuu

SEQ ID NO: 303023 - RNA, 32 nt, Human
accuccgucucccagguucaagcgauucuucu

SEQ ID NO: 303024 - RNA, 32 nt, Human
accuccgucuccuggguucaagcgauucuccu

SEQ ID NO: 303025 - RNA, 32 nt, Human
accuccgucuccuggguucaagugauucucca

SEQ ID NO: 303026 - RNA, 32 nt, Human
accuccgucuccuggguucaagugauucuucu

SEQ ID NO: 303027 - RNA, 32 nt, Human
accuccguguuuacuccagccuauggauccgu

SEQ ID NO: 303028 - RNA, 32 nt, Human
accuccguuuccuggguucgagugauucuccu

SEQ ID NO: 303029 - RNA, 32 nt, Human
accuccuaugccucauguccagccagguugag

SEQ ID NO: 303030 - RNA, 32 nt, Human
accuccuauugccaccaccgcugccaccacca

SEQ ID NO: 303031 - RNA, 18 nt, Human
accuccucaccccagccc

SEQ ID NO: 303032 - RNA, 32 nt, Human
accuccucaccccagcccuccaccucucgggg

SEQ ID NO: 303033 - RNA, 32 nt, Human
accuccucaccucugcuccuugcccucucacc

SEQ ID NO: 303034 - RNA, 32 nt, Human
accuccucacugacaccccugccugccuuugu

SEQ ID NO: 303035 - RNA, 32 nt, Human
accuccucauggcauccucccuguacccaggu

SEQ ID NO: 303036 - RNA, 32 nt, Human
accuccucauuuuagugaugaggaaucugaga

SEQ ID NO: 303037 - RNA, 20 nt, Human
accuccuccaauccuugaga

SEQ ID NO: 303038 - RNA, 32 nt, Human
accuccuccacucccccugccugcccccagca

SEQ ID NO: 303039 - RNA, 32 nt, Human
accuccuccaucuccggcuccugggcuuggga

SEQ ID NO: 303040 - RNA, 32 nt, Human
accuccuccaugaagcuuucucucauucuccc

SEQ ID NO: 303041 - RNA, 32 nt, Human
accuccucccacccucccccugcuccccacca

SEQ ID NO: 303042 - RNA, 32 nt, Human
accuccuccccaugggcaccaucucugccauu

SEQ ID NO: 303043 - RNA, 32 nt, Human
accuccucccucuucuccucuguggccuggga

SEQ ID NO: 303044 - RNA, 32 nt, Human
accuccuccguaucccccucuccugaagcccu

SEQ ID NO: 303045 - RNA, 32 nt, Human
accuccuccucccagagguacuucucagcccu

SEQ ID NO: 303046 - RNA, 32 nt, Human
accuccuccucccggguucaagcaauucuccc

SEQ ID NO: 303047 - RNA, 32 nt, Human
accuccuccuccuccuggcccugcugcugccc

SEQ ID NO: 303048 - RNA, 32 nt, Human
accuccuccuccuggauucaagcaauucucuu

SEQ ID NO: 303049 - RNA, 32 nt, Human
accuccuccuccuggguucaagcgauucuccu

SEQ ID NO: 303050 - RNA, 32 nt, Human
accuccuccucuuccucuccuuuaccccacuu

SEQ ID NO: 303051 - RNA, 32 nt, Human
accuccuccucuuggguucaagcgauucuccu

SEQ ID NO: 303052 - RNA, 32 nt, Human
accuccuccugcuccccauccccagcccacca

SEQ ID NO: 303053 - RNA, 32 nt, Human
accuccuccuguggagggugugcccugucugc

SEQ ID NO: 303054 - RNA, 32 nt, Human
accuccucgagugcccugggaccacugggcca

SEQ ID NO: 303055 - RNA, 18 nt, Human
accuccucgcccugggcu

SEQ ID NO: 303056 - RNA, 32 nt, Human
accuccucucaaguagaggggucuccagaucg

SEQ ID NO: 303057 - RNA, 32 nt, Human
accuccucucacuccccagccugggcccaucu

SEQ ID NO: 303058 - RNA, 32 nt, Human
accuccucucacugcuagaauauucaccaagg

SEQ ID NO: 303059 - RNA, 32 nt, Human
accuccucuccaagacaaaacaaacaaaacua

SEQ ID NO: 303060 - RNA, 32 nt, Human
accuccucuccccaaaauuuguagaaauaguu

SEQ ID NO: 303061 - RNA, 32 nt, Human
accuccucugcaggcccuucccucuccgccug

SEQ ID NO: 303062 - RNA, 32 nt, Human
accuccucugccagggccuacuucuccccagc

SEQ ID NO: 303063 - RNA, 32 nt, Human
accuccucugcccucuggaucuagugaagccu

SEQ ID NO: 303064 - RNA, 32 nt, Human
accuccucuguggacugugccuucccauccag

SEQ ID NO: 303065 - RNA, 32 nt, Human
accuccucuuccccacugccaucuucuaagag

SEQ ID NO: 303066 - RNA, 32 nt, Human
accuccucuuugccucccuccugccccuuucc

SEQ ID NO: 303067 - RNA, 32 nt, Human
accuccugacaccuccauauaccccagcuaua

SEQ ID NO: 303068 - RNA, 32 nt, Human
accuccugacccuucccucuuucaaggagaag

SEQ ID NO: 303069 - RNA, 32 nt, Human
accuccugagaggugugaggugcagggauacc

SEQ ID NO: 303070 - RNA, 21 nt, Human
accuccugauccacccaccuc

SEQ ID NO: 303071 - RNA, 22 nt, Human
accuccugauccacccaccuca

SEQ ID NO: 303072 - RNA, 32 nt, Human
accuccugauccacccuccucugccucccaaa

SEQ ID NO: 303073 - RNA, 22 nt, Human
accuccugauccgcccaccuca

SEQ ID NO: 303074 - RNA, 32 nt, Human
accuccugccaggccccaccuccaacacuggg

SEQ ID NO: 303075 - RNA, 19 nt, Human
accuccugccccgcgcggg

SEQ ID NO: 303076 - RNA, 20 nt, Human
accuccugcccuaggccugg

SEQ ID NO: 303077 - RNA, 22 nt, Human
accuccugcccucugggaagug

SEQ ID NO: 303078 - RNA, 20 nt, Human
accuccugcccugcuggggu

SEQ ID NO: 303079 - RNA, 32 nt, Human
accuccugcuccuggguucgagcgauucuccu

SEQ ID NO: 303080 - RNA, 32 nt, Human
accuccuggaacacuggcaucucugagccucc

SEQ ID NO: 303081 - RNA, 21 nt, Human
accuccuggaaggcagccagg

SEQ ID NO: 303082 - RNA, 32 nt, Human
accuccugggcaacauagugagaucccaucuc

SEQ ID NO: 303083 - RNA, 32 nt, Human
accuccugggcugggcagagugacagugcuag

SEQ ID NO: 303084 - RNA, 32 nt, Human
accuccuggggaauucugugggagacacuugg

SEQ ID NO: 303085 - RNA, 32 nt, Human
accuccuguaucaucagcuucacuuucuugca

SEQ ID NO: 303086 - RNA, 32 nt, Human
accuccugugacgcccucccagagccaaccuc

SEQ ID NO: 303087 - RNA, 22 nt, Human
accuccuucaccagggguuggg

SEQ ID NO: 303088 - RNA, 24 nt, Human
accuccuucagcagggcagcuccu

SEQ ID NO: 303089 - RNA, 21 nt, Human
accuccuucaucuucuccuuc

SEQ ID NO: 303090 - RNA, 32 nt, Human
accuccuuccacagccgcaucuucucaugaca

SEQ ID NO: 303091 - RNA, 32 nt, Human
accuccuuccacccucuuugguuuuguaaagg

SEQ ID NO: 303092 - RNA, 28 nt, Human
accuccuuccagguucuggcuccuucca

SEQ ID NO: 303093 - RNA, 32 nt, Human
accuccuucccaaacaccuccuucccaaacac

SEQ ID NO: 303094 - RNA, 32 nt, Human
accuccuucccaaacaccuccuucccaacacc

SEQ ID NO: 303095 - RNA, 32 nt, Human
accuccuucccaaacauccccuucccaaacac

SEQ ID NO: 303096 - RNA, 32 nt, Human
accuccuucccaaaccccucuuucccaaacac

SEQ ID NO: 303097 - RNA, 32 nt, Human
accuccuucccaaaccccuuucccaaacaucu

SEQ ID NO: 303098 - RNA, 32 nt, Human
accuccuucccaacaccuccuucccaaacccc

SEQ ID NO: 303099 - RNA, 32 nt, Human
accuccuucccaacaccuccuuccccaacacc

SEQ ID NO: 303100 - RNA, 32 nt, Human
accuccuucccaacaccuccuucccccuuccc

SEQ ID NO: 303101 - RNA, 32 nt, Human
accuccuucccagacaccuccuucccaacacc

SEQ ID NO: 303102 - RNA, 32 nt, Human
accuccuuccccaacaccuccuucccaaacac

SEQ ID NO: 303103 - RNA, 32 nt, Human
accuccuuccccaacaccuccuucccaacacc

SEQ ID NO: 303104 - RNA, 22 nt, Human
accuccuuccccagcuccccca

SEQ ID NO: 303105 - RNA, 32 nt, Human
accuccuucccucccuucuagaguucuuugga

SEQ ID NO: 303106 - RNA, 21 nt, Human
accuccuuccugggccugcgg

SEQ ID NO: 303107 - RNA, 32 nt, Human
accuccuucgccacuccaccagccuggaccuc

SEQ ID NO: 303108 - RNA, 32 nt, Human
accuccuucuccucccccucccccuccuccaa

SEQ ID NO: 303109 - RNA, 32 nt, Human
accuccuugaaaaaccucuuuauuaaucucac

SEQ ID NO: 303110 - RNA, 22 nt, Human
accuccuugguacuacccuucc

SEQ ID NO: 303111 - RNA, 32 nt, Human
accuccuuguuuacaucuucaggccaagauga

SEQ ID NO: 303112 - RNA, 32 nt, Human
accuccuuguuucagcugggccugcuguccag

SEQ ID NO: 303113 - RNA, 32 nt, Human
accuccuuucccuccaugcuuccgcggaggag

SEQ ID NO: 303114 - RNA, 32 nt, Human
accuccuuucccucucuccaucuuccaauccc

SEQ ID NO: 303115 - RNA, 32 nt, Human
accuccuuucuucucugcucccaaaccauguc

SEQ ID NO: 303116 - RNA, 32 nt, Human
accuccuuugaaucccagcccuacucgaaaua

SEQ ID NO: 303117 - RNA, 32 nt, Human
accuccuuugcccuagaccagcuccucuccaa

SEQ ID NO: 303118 - RNA, 32 nt, Human
accuccuuuggcccaacuccugcugagcagcu

SEQ ID NO: 303119 - RNA, 32 nt, Human
accuccuuuggcccaacuccugcugagcugcu

SEQ ID NO: 303120 - RNA, 32 nt, Human
accucgaagacgcuauccgauccaucagaccc

SEQ ID NO: 303121 - RNA, 32 nt, Human
accucgaccuccuggguucaagcgauucuccc

SEQ ID NO: 303122 - RNA, 32 nt, Human
accucgaccucuuggguucaagugauucuccu

SEQ ID NO: 303123 - RNA, 32 nt, Human
accucgacgcuacccaaaugcuuuccucauca

SEQ ID NO: 303124 - RNA, 32 nt, Human
accucgagagcaccccuugccggugaaggaug

SEQ ID NO: 303125 - RNA, 32 nt, Human
accucgagaugggugcugguccuguugauccc

SEQ ID NO: 303126 - RNA, 26 nt, Human
accucgagcagccgccgccgccgccg

SEQ ID NO: 303127 - RNA, 32 nt, Human
accucgagcuucucaaccacugcggccuaauc

SEQ ID NO: 303128 - RNA, 19 nt, Human
accucgaggcuccgccccc

SEQ ID NO: 303129 - RNA, 32 nt, Human
accucgaguccuuaugcacagaaaggcccuga

SEQ ID NO: 303130 - RNA, 32 nt, Human
accucgaguguggccuucuaagggucuuugcu

SEQ ID NO: 303131 - RNA, 32 nt, Human
accucgccagcggggcccucuguggcacuggg

SEQ ID NO: 303132 - RNA, 32 nt, Human
accucgccccuggacagagcaguccuuccaga

SEQ ID NO: 303133 - RNA, 32 nt, Human
accucgcccggcuaauauuuuguauuuuuagu

SEQ ID NO: 303134 - RNA, 32 nt, Human
accucgccgcaaagcgaaagaaacuggagcag

SEQ ID NO: 303135 - RNA, 32 nt, Human
accucgccgcucuucuugaaucaugcugggcu

SEQ ID NO: 303136 - RNA, 32 nt, Human
accucgcgcuaggccagcuccaggagggcaac

SEQ ID NO: 303137 - RNA, 32 nt, Human
accucgcugcagcccccaucgccucggggagu

SEQ ID NO: 303138 - RNA, 32 nt, Human
accucggaccacccagaguuuccucuuggucc

SEQ ID NO: 303139 - RNA, 32 nt, Human
accucggagacgggacccugcccagagcugag

SEQ ID NO: 303140 - RNA, 32 nt, Human
accucggaggcagggcgcgcaggcgggcggcg

SEQ ID NO: 303141 - RNA, 25 nt, Human
accucggaggcggagguugcaguga

SEQ ID NO: 303142 - RNA, 32 nt, Human
accucggaggcggagguugcagugagccaaga

SEQ ID NO: 303143 - RNA, 32 nt, Human
accucggaggcugaaguugcagugagccaaga

SEQ ID NO: 303144 - RNA, 32 nt, Human
accucggcauccacccaguccaucccaccauc

SEQ ID NO: 303145 - RNA, 32 nt, Human
accucggcccacgccgccugaguuagaaacgc

SEQ ID NO: 303146 - RNA, 32 nt, Human
accucggccccagugauggcugaucucacucc

SEQ ID NO: 303147 - RNA, 32 nt, Human
accucggcccccucagcuucccgggcuggcag

SEQ ID NO: 303148 - RNA, 32 nt, Human
accucggccucagagauggcucugaguaaauc

SEQ ID NO: 303149 - RNA, 32 nt, Human
accucggcucacugcaaccuccgccucccagg

SEQ ID NO: 303150 - RNA, 32 nt, Human
accucggcucacugcaaccucugucuccuggg

SEQ ID NO: 303151 - RNA, 32 nt, Human
accucggcucacugcaaccuuugccuccuagg

SEQ ID NO: 303152 - RNA, 32 nt, Human
accucggcucacugcagccuccuucuccuggg

SEQ ID NO: 303153 - RNA, 32 nt, Human
accucggcucacugcauccucugccuccuggg

SEQ ID NO: 303154 - RNA, 32 nt, Human
accucggcucacuguaaccuucaccuuccgug

SEQ ID NO: 303155 - RNA, 32 nt, Human
accucggcugcaguaaaguuacgugaggccug

SEQ ID NO: 303156 - RNA, 32 nt, Human
accucggcuguggucucucugcuuuaaauccu

SEQ ID NO: 303157 - RNA, 32 nt, Human
accucggcuuacugcaaccuccaccucccggg

SEQ ID NO: 303158 - RNA, 32 nt, Human
accucggcuuacugcaaccuccgccuucccag

SEQ ID NO: 303159 - RNA, 32 nt, Human
accucggcuuccacucucucuuccucacccua

SEQ ID NO: 303160 - RNA, 32 nt, Human
accucgggauguggcguuguuuggagaaaggg

SEQ ID NO: 303161 - RNA, 32 nt, Human
accucgggccacucgcugccccucucugggcc

SEQ ID NO: 303162 - RNA, 32 nt, Human
accucggggcugccugggccucuggcuuccag

SEQ ID NO: 303163 - RNA, 32 nt, Human
accucggggcugggacaccuccuggcccucac

SEQ ID NO: 303164 - RNA, 32 nt, Human
accucggggugggggugggcagugagugcagg

SEQ ID NO: 303165 - RNA, 24 nt, Human
accucgggugauccacccaccuca

SEQ ID NO: 303166 - RNA, 32 nt, Human
accucgguaaagggguggaguggcgcgcuggu

SEQ ID NO: 303167 - RNA, 32 nt, Human
accucggugcucaagagagaggccccagcugg

SEQ ID NO: 303168 - RNA, 32 nt, Human
accucguaggaacgcugagcugccucaacagg

SEQ ID NO: 303169 - RNA, 32 nt, Human
accucgucugaaauggcugccucccagugucu

SEQ ID NO: 303170 - RNA, 32 nt, Human
accucgucuucuguggagaaccaccugccauc

SEQ ID NO: 303171 - RNA, 32 nt, Human
accucgucuuucuccauauuguccugcucccc

SEQ ID NO: 303172 - RNA, 32 nt, Human
accucgucuuugcuuguccugcucagaugcug

SEQ ID NO: 303173 - RNA, 32 nt, Human
accucgugagccaccacgcccagccucuuuug

SEQ ID NO: 303174 - RNA, 22 nt, Human
accucgugauccacccaccuca

SEQ ID NO: 303175 - RNA, 21 nt, Human
accucgugauccgcccgccuc

SEQ ID NO: 303176 - RNA, 32 nt, Human
accucgugauccgcccgccucugccucccaaa

SEQ ID NO: 303177 - RNA, 32 nt, Human
accucgugauccgccugccucugccucccaaa

SEQ ID NO: 303178 - RNA, 32 nt, Human
accucgugauuugcccgccucugccuccccaa

SEQ ID NO: 303179 - RNA, 31 nt, Human
accucgugccucucugcgugccggguugguc

SEQ ID NO: 303180 - RNA, 32 nt, Human
accucguggcugcugcugcuccugcucucccu

SEQ ID NO: 303181 - RNA, 32 nt, Human
accucgugggcuguaggaaagcaaauguaggu

SEQ ID NO: 303182 - RNA, 32 nt, Human
accucguugccucucuucguccuuccuuacag

SEQ ID NO: 303183 - RNA, 22 nt, Human
accucguugugagccucugaac

SEQ ID NO: 303184 - RNA, 32 nt, Human
accucuaaaggcaugcuuagaggucaaggacc

SEQ ID NO: 303185 - RNA, 32 nt, Human
accucuaacagaaccgugguguccaugguugc

SEQ ID NO: 303186 - RNA, 32 nt, Human
accucuaacagaagcuuauacacauaugcaug

SEQ ID NO: 303187 - RNA, 32 nt, Human
accucuaagcucuggcaccugugaagcccuuu

SEQ ID NO: 303188 - RNA, 32 nt, Human
accucuaagcuguuccugcuucugcucuccuc

SEQ ID NO: 303189 - RNA, 32 nt, Human
accucuaccaacccucucucuccagcuagacu

SEQ ID NO: 303190 - RNA, 32 nt, Human
accucuaccccagcucuccaggacacagcgcu

SEQ ID NO: 303191 - RNA, 32 nt, Human
accucuaccgcgugggacagagcaagaucuuc

SEQ ID NO: 303192 - RNA, 32 nt, Human
accucuaccuccaggguucaagcaauucuccu

SEQ ID NO: 303193 - RNA, 32 nt, Human
accucuaccuccuggguucaagcaaaucuccu

SEQ ID NO: 303194 - RNA, 32 nt, Human
accucuaccuccuggguucaagcaauccuccu

SEQ ID NO: 303195 - RNA, 32 nt, Human
accucuaccuccuggguucaagcgauucuccu

SEQ ID NO: 303196 - RNA, 32 nt, Human
accucuaccuccuggguucaagggauucuccu

SEQ ID NO: 303197 - RNA, 32 nt, Human
accucuaccuccuggguucaagugauucucgu

SEQ ID NO: 303198 - RNA, 32 nt, Human
accucuaccuccuggguucaagugauucucuu

SEQ ID NO: 303199 - RNA, 17 nt, Human
accucuaccugccccca

SEQ ID NO: 303200 - RNA, 32 nt, Human
accucuagaucaaccugggaacagucacaagg

SEQ ID NO: 303201 - RNA, 32 nt, Human
accucuagccccagcuacucaggcuggggugg

SEQ ID NO: 303202 - RNA, 32 nt, Human
accucuagcugcaugaccuugggcaagcuaug

SEQ ID NO: 303203 - RNA, 32 nt, Human
accucuagucugggugacagagcaagacccug

SEQ ID NO: 303204 - RNA, 32 nt, Human
accucuagugcaagccgguacagcauuauacu

SEQ ID NO: 303205 - RNA, 32 nt, Human
accucuaucuggagaggugaaaacacaaaggc

SEQ ID NO: 303206 - RNA, 32 nt, Human
accucucaagccucaggagacaggaggauggc

SEQ ID NO: 303207 - RNA, 32 nt, Human
accucucaagccucuucagccuuucucagcag

SEQ ID NO: 303208 - RNA, 32 nt, Human
accucucaaggcccagcuucagccucaccuuc

SEQ ID NO: 303209 - RNA, 32 nt, Human
accucucacaauauuaaaugcacuucaauaau

SEQ ID NO: 303210 - RNA, 32 nt, Human
accucucacagcuacccagcacaugccacaau

SEQ ID NO: 303211 - RNA, 26 nt, Human
accucucacgcagccagugaguuagg

SEQ ID NO: 303212 - RNA, 32 nt, Human
accucucagagcaaugucaugcugggggucca

SEQ ID NO: 303213 - RNA, 32 nt, Human
accucucagagcaguccuugcaccagcucagg

SEQ ID NO: 303214 - RNA, 32 nt, Human
accucucaggcucaagcgauucucccaccuca

SEQ ID NO: 303215 - RNA, 32 nt, Human
accucucauacacuggccaggaggcugcagaa

SEQ ID NO: 303216 - RNA, 32 nt, Human
accucuccacccccaaaccuaaaacaggccag

SEQ ID NO: 303217 - RNA, 32 nt, Human
accucuccacugccuccuccaccccuguauuu

SEQ ID NO: 303218 - RNA, 32 nt, Human
accucuccagcaggugccugaccauggguuca

SEQ ID NO: 303219 - RNA, 32 nt, Human
accucucccagccagggcugagaggauucgag

SEQ ID NO: 303220 - RNA, 32 nt, Human
accucucccaggaagugguggggcaccggucu

SEQ ID NO: 303221 - RNA, 32 nt, Human
accucucccuccccucuccucuccuccccuug

SEQ ID NO: 303222 - RNA, 32 nt, Human
accucucccugcaaacaccacacacacauggc

SEQ ID NO: 303223 - RNA, 32 nt, Human
accucuccuaaagcacagggccccggcuaaga

SEQ ID NO: 303224 - RNA, 32 nt, Human
accucuccucaaggacugcuaagucaggaaau

SEQ ID NO: 303225 - RNA, 32 nt, Human
accucuccuccaggcccugccuugucccugcu

SEQ ID NO: 303226 - RNA, 32 nt, Human
accucuccuccccucuccucaguuuugccgac

SEQ ID NO: 303227 - RNA, 16 nt, Human
accucuccugcugcug

SEQ ID NO: 303228 - RNA, 32 nt, Human
accucuccugggacuggaacccuucagugggu

SEQ ID NO: 303229 - RNA, 32 nt, Human
accucuccuuuggagccaccuugucccuggcu

SEQ ID NO: 303230 - RNA, 32 nt, Human
accucucgaugguucucuccugggcucaggcg

SEQ ID NO: 303231 - RNA, 32 nt, Human
accucucgguuugccagccuuugcagccacuu

SEQ ID NO: 303232 - RNA, 32 nt, Human
accucucgugcucugucaccugcagcagaggu

SEQ ID NO: 303233 - RNA, 32 nt, Human
accucucuccuccccuccuuccucucuccucc

SEQ ID NO: 303234 - RNA, 32 nt, Human
accucucucucacagguacacacacaaccauc

SEQ ID NO: 303235 - RNA, 32 nt, Human
accucucucuucaacugccucucuccagagcu

SEQ ID NO: 303236 - RNA, 32 nt, Human
accucucugacugggacauccaucucugccua

SEQ ID NO: 303237 - RNA, 32 nt, Human
accucucugccuuugugccauagggaaaugga

SEQ ID NO: 303238 - RNA, 32 nt, Human
accucucugcuuuucaagcauuuccuugaguc

SEQ ID NO: 303239 - RNA, 32 nt, Human
accucucuggcucucccccagagacuaucaga

SEQ ID NO: 303240 - RNA, 32 nt, Human
accucucuguaucuuucccuugucacuuuauc

SEQ ID NO: 303241 - RNA, 32 nt, Human
accucucugucugacuucugcaucuccuucca

SEQ ID NO: 303242 - RNA, 32 nt, Human
accucucuucaguuggccacccugcacguugu

SEQ ID NO: 303243 - RNA, 20 nt, Human
accucucuucccugcugcug

SEQ ID NO: 303244 - RNA, 32 nt, Human
accucucuuccucugggacuuuugcaccggga

SEQ ID NO: 303245 - RNA, 23 nt, Human
accucucuuuguccccuuccaga

SEQ ID NO: 303246 - RNA, 32 nt, Human
accucugaaaaaugagaauggugagcgcacgg

SEQ ID NO: 303247 - RNA, 32 nt, Human
accucugaaagcagaacacuugcucaacaacc

SEQ ID NO: 303248 - RNA, 32 nt, Human
accucugaaauguucccugcucugaaaucugg

SEQ ID NO: 303249 - RNA, 32 nt, Human
accucugaacucugaccucaggaggcucuggg

SEQ ID NO: 303250 - RNA, 32 nt, Human
accucugaccacaccuuggcaagucuuuccca

SEQ ID NO: 303251 - RNA, 26 nt, Human
accucugaccucaggugauccaucca

SEQ ID NO: 303252 - RNA, 32 nt, Human
accucugacuccacacccuucagggcuccagc

SEQ ID NO: 303253 - RNA, 32 nt, Human
accucugagagacucagggugggcuuucucac

SEQ ID NO: 303254 - RNA, 19 nt, Human
accucugagccacccauca

SEQ ID NO: 303255 - RNA, 32 nt, Human
accucugaggggcaggagugcuuccuggugug

SEQ ID NO: 303256 - RNA, 32 nt, Human
accucugauguuuuccagcaccugcaaagucu

SEQ ID NO: 303257 - RNA, 32 nt, Human
accucugcaaccugccaccuccugcuggcagg

SEQ ID NO: 303258 - RNA, 32 nt, Human
accucugcagaggcugggggccuccacccagc

SEQ ID NO: 303259 - RNA, 32 nt, Human
accucugcagugaacugagauugcgccacugc

SEQ ID NO: 303260 - RNA, 32 nt, Human
accucugcauucuaguuacccuuugcuucccu

SEQ ID NO: 303261 - RNA, 32 nt, Human
accucugcauuugugaguguucccucuggcuu

SEQ ID NO: 303262 - RNA, 32 nt, Human
accucugccacccauguucaagcgauucuccu

SEQ ID NO: 303263 - RNA, 32 nt, Human
accucugccaccuggguucaagcgauucuccu

SEQ ID NO: 303264 - RNA, 32 nt, Human
accucugccacuacccagagcuuguccugccc

SEQ ID NO: 303265 - RNA, 22 nt, Human
accucugccagcaaccuugaga

SEQ ID NO: 303266 - RNA, 32 nt, Human
accucugccaucaggauuaaagugauucucgg

SEQ ID NO: 303267 - RNA, 32 nt, Human
accucugccauccuggagggcuagagauauag

SEQ ID NO: 303268 - RNA, 32 nt, Human
accucugcccccuggguucaagcgauucuccu

SEQ ID NO: 303269 - RNA, 32 nt, Human
accucugcccuccucaccuuccagucagggca

SEQ ID NO: 303270 - RNA, 32 nt, Human
accucugcccugcccuccagccugggacaaua

SEQ ID NO: 303271 - RNA, 32 nt, Human
accucugccucacggguucaagcaauucuccu

SEQ ID NO: 303272 - RNA, 32 nt, Human
accucugccuccagcaggcuugagcuugcccc

SEQ ID NO: 303273 - RNA, 32 nt, Human
accucugccucccagguucacgccauucuccu

SEQ ID NO: 303274 - RNA, 32 nt, Human
accucugccucccagguucaugccauucuccu

SEQ ID NO: 303275 - RNA, 32 nt, Human
accucugccucccggguucaagcaauuaacug

SEQ ID NO: 303276 - RNA, 32 nt, Human
accucugccucccggguucaagcaauucccug

SEQ ID NO: 303277 - RNA, 32 nt, Human
accucugccucccggguucaagcaauucuccu

SEQ ID NO: 303278 - RNA, 32 nt, Human
accucugccucccggguucaagcaauuuccug

SEQ ID NO: 303279 - RNA, 32 nt, Human
accucugccucccugguucaagcaauucucau

SEQ ID NO: 303280 - RNA, 32 nt, Human
accucugccucccugguucaagcgauucuucu

SEQ ID NO: 303281 - RNA, 32 nt, Human
accucugccuccugggcucaagcaauucuccc

SEQ ID NO: 303282 - RNA, 32 nt, Human
accucugccuccugggugcaagcaauuauccu

SEQ ID NO: 303283 - RNA, 32 nt, Human
accucugccuccuggguucaagaaauucuccu

SEQ ID NO: 303284 - RNA, 32 nt, Human
accucugccuccuggguucaagcaauucucau

SEQ ID NO: 303285 - RNA, 32 nt, Human
accucugccuccuggguucaagcaauucuccu

SEQ ID NO: 303286 - RNA, 32 nt, Human
accucugccuccuggguucaagcaauucucgu

SEQ ID NO: 303287 - RNA, 32 nt, Human
accucugccuccuggguucaagcaauuuuccu

SEQ ID NO: 303288 - RNA, 32 nt, Human
accucugccuccuggguucaagcaguucuccu

SEQ ID NO: 303289 - RNA, 32 nt, Human
accucugccuccuggguucaagcaguucucuu

SEQ ID NO: 303290 - RNA, 32 nt, Human
accucugccuccuggguucaagcgauuauccu

SEQ ID NO: 303291 - RNA, 32 nt, Human
accucugccuccuggguucaagcgauucucag

SEQ ID NO: 303292 - RNA, 32 nt, Human
accucugccuccuggguucaagcgauucuccu

SEQ ID NO: 303293 - RNA, 32 nt, Human
accucugccuccuggguucaagcgauucuugu

SEQ ID NO: 303294 - RNA, 32 nt, Human
accucugccuccuggguucaagcgauuuuccu

SEQ ID NO: 303295 - RNA, 32 nt, Human
accucugccuccuggguucaggcaauucuccc

SEQ ID NO: 303296 - RNA, 32 nt, Human
accucugccuccuggguuuaagcaauucuccu

SEQ ID NO: 303297 - RNA, 32 nt, Human
accucugccuccuggguuuaagcgauucuccu

SEQ ID NO: 303298 - RNA, 32 nt, Human
accucugccuccuugguucaagcaauucuccu

SEQ ID NO: 303299 - RNA, 32 nt, Human
accucugccucuuggguucaagcaauucucau

SEQ ID NO: 303300 - RNA, 32 nt, Human
accucugccucuuggguucaagcaauucuucu

SEQ ID NO: 303301 - RNA, 32 nt, Human
accucugccugccggguucaagcaguucuccu

SEQ ID NO: 303302 - RNA, 32 nt, Human
accucugccugggaaucuucuuuccuccccuc

SEQ ID NO: 303303 - RNA, 32 nt, Human
accucugccuuccagguucaagcaauuauccu

SEQ ID NO: 303304 - RNA, 32 nt, Human
accucugccuucuggguucaagcaauucucug

SEQ ID NO: 303305 - RNA, 32 nt, Human
accucugccuucuggguucaagcaauuguccu

SEQ ID NO: 303306 - RNA, 32 nt, Human
accucugccuucuggguucgagcaauucuccu

SEQ ID NO: 303307 - RNA, 18 nt, Human
accucugcuccagaaaua

SEQ ID NO: 303308 - RNA, 32 nt, Human
accucugcugcaaaggaaucucuugcugaguc

SEQ ID NO: 303309 - RNA, 32 nt, Human
accucugcuucccagguucaagcgauucuccu

SEQ ID NO: 303310 - RNA, 32 nt, Human
accucugcuucccgaguucaagcaauucuccu

SEQ ID NO: 303311 - RNA, 32 nt, Human
accucugcuucccggguucaagcaguuuccug

SEQ ID NO: 303312 - RNA, 32 nt, Human
accucugcuucccggguucaagugauucuccu

SEQ ID NO: 303313 - RNA, 32 nt, Human
accucugcuuccuagguucaagugauucuccu

SEQ ID NO: 303314 - RNA, 32 nt, Human
accucugcuuccuggguucaaacaauucucau

SEQ ID NO: 303315 - RNA, 32 nt, Human
accucugcuuccuggguucaagcgauucuccu

SEQ ID NO: 303316 - RNA, 32 nt, Human
accucugcuuccuggguucaggugauugucag

SEQ ID NO: 303317 - RNA, 32 nt, Human
accucuggagcaguugagguccaagcugggga

SEQ ID NO: 303318 - RNA, 32 nt, Human
accucuggcuaggugauccugauguuuccuac

SEQ ID NO: 303319 - RNA, 32 nt, Human
accucuggcuccuguccucuggcuccaccugc

SEQ ID NO: 303320 - RNA, 32 nt, Human
accucuggcugcagaucuuagaaggcugaaau

SEQ ID NO: 303321 - RNA, 32 nt, Human
accucuggcugcaggcauccagggauuauucc

SEQ ID NO: 303322 - RNA, 32 nt, Human
accucugggagggcaggagugggagcagauga

SEQ ID NO: 303323 - RNA, 32 nt, Human
accucugggagguagggaguucccuggcacug

SEQ ID NO: 303324 - RNA, 32 nt, Human
accucugggagugggaggggaacuggcuugaa

SEQ ID NO: 303325 - RNA, 32 nt, Human
accucugggcagagaaacaaagcucuauaugc

SEQ ID NO: 303326 - RNA, 32 nt, Human
accucugggcuugccauuccagccugguauaa

SEQ ID NO: 303327 - RNA, 32 nt, Human
accucuggggccacagcccugccccuccaguu

SEQ ID NO: 303328 - RNA, 32 nt, Human
accucuggggcccaaagcugucccuucucagu

SEQ ID NO: 303329 - RNA, 32 nt, Human
accucuggggucagaauaugcccagccugcgg

SEQ ID NO: 303330 - RNA, 32 nt, Human
accucugggucaacacagauuuacuggauucc

SEQ ID NO: 303331 - RNA, 18 nt, Human
accucugguauacuguua

SEQ ID NO: 303332 - RNA, 32 nt, Human
accucuguagccuaaaugaaauucuuaaaauc

SEQ ID NO: 303333 - RNA, 32 nt, Human
accucuguagcuccaaugagugacacauagua

SEQ ID NO: 303334 - RNA, 32 nt, Human
accucugucacccgagcuggagugcaguggug

SEQ ID NO: 303335 - RNA, 32 nt, Human
accucuguccugcagcagaaccccuccuuguc

SEQ ID NO: 303336 - RNA, 32 nt, Human
accucugucucccggguucaagcaauucuccc

SEQ ID NO: 303337 - RNA, 32 nt, Human
accucugucucccggguucaagcaauucuccu

SEQ ID NO: 303338 - RNA, 32 nt, Human
accucugucuccugggcucaagcaauucuucu

SEQ ID NO: 303339 - RNA, 32 nt, Human
accucugucuccuggguucaagcgauucuccu

SEQ ID NO: 303340 - RNA, 32 nt, Human
accucugucugcccgcugccucuugucuagcu

SEQ ID NO: 303341 - RNA, 32 nt, Human
accucugucuuccagguucaagcaauucugcc

SEQ ID NO: 303342 - RNA, 32 nt, Human
accucugugcagggcacagaaggcuggggugg

SEQ ID NO: 303343 - RNA, 32 nt, Human
accucugugcucccuccugccugcaugcaacc

SEQ ID NO: 303344 - RNA, 32 nt, Human
accucuguggcuaguuguccuaccucccuggc

SEQ ID NO: 303345 - RNA, 32 nt, Human
accucugugguauaggugaggggugugaggcc

SEQ ID NO: 303346 - RNA, 32 nt, Human
accucuguuaauacuuuuguacacucucacua

SEQ ID NO: 303347 - RNA, 32 nt, Human
accucuguuaucuuagcagcaagcaccugccu

SEQ ID NO: 303348 - RNA, 32 nt, Human
accucuguucucagacucuggaaaaggcuucu

SEQ ID NO: 303349 - RNA, 32 nt, Human
accucuguugccucguccaucccuggguugug

SEQ ID NO: 303350 - RNA, 32 nt, Human
accucuguuguccuccccuugggcggcugaga

SEQ ID NO: 303351 - RNA, 23 nt, Human
accucuuaagacauuagaaagua

SEQ ID NO: 303352 - RNA, 32 nt, Human
accucuuaggguguguuucuuugucuuuccug

SEQ ID NO: 303353 - RNA, 31 nt, Human
accucuuauuguggaaaccuguugagaucac

SEQ ID NO: 303354 - RNA, 32 nt, Human
accucuucaagaaaaauugaagcaguguugcc

SEQ ID NO: 303355 - RNA, 32 nt, Human
accucuucagcccguccgguggccuggaggcc

SEQ ID NO: 303356 - RNA, 32 nt, Human
accucuucauuacuggagaaaaaugaauuuug

SEQ ID NO: 303357 - RNA, 26 nt, Human
accucuuccaggagaacugauucugu

SEQ ID NO: 303358 - RNA, 32 nt, Human
accucuucccgagcgccauccccaccuucgcc

SEQ ID NO: 303359 - RNA, 32 nt, Human
accucuucccuaaugccaccucaguuuguuuc

SEQ ID NO: 303360 - RNA, 32 nt, Human
accucuuccucaccacuaggcuucuggggcug

SEQ ID NO: 303361 - RNA, 32 nt, Human
accucuuccucagagcccccacugaggggccg

SEQ ID NO: 303362 - RNA, 32 nt, Human
accucuuccuccaggguucaagugauucuccc

SEQ ID NO: 303363 - RNA, 32 nt, Human
accucuuccugaaaguccucccccacugacuc

SEQ ID NO: 303364 - RNA, 32 nt, Human
accucuucguccuccucuccugccucaccauc

SEQ ID NO: 303365 - RNA, 32 nt, Human
accucuucuccccacaaccccaaccccagagg

SEQ ID NO: 303366 - RNA, 32 nt, Human
accucuucugccgucucagccugggcgucgcu

SEQ ID NO: 303367 - RNA, 32 nt, Human
accucuugaauccauuuccaucccaucauccu

SEQ ID NO: 303368 - RNA, 32 nt, Human
accucuugacuuccuguuccccuaaaccugag

SEQ ID NO: 303369 - RNA, 32 nt, Human
accucuugagagaagagacuggcuccaggucu

SEQ ID NO: 303370 - RNA, 28 nt, Human
accucuugcccagcugccucuucugaaa

SEQ ID NO: 303371 - RNA, 32 nt, Human
accucuuggauuggcccuggcugcugccacac

SEQ ID NO: 303372 - RNA, 32 nt, Human
accucuuggucuuggucucuucagacacuuuc

SEQ ID NO: 303373 - RNA, 32 nt, Human
accucuuguacagaaguugcccccagguggug

SEQ ID NO: 303374 - RNA, 32 nt, Human
accucuuguauguaccuccaugauauuccucu

SEQ ID NO: 303375 - RNA, 32 nt, Human
accucuuguuacucccuguuauuuuucugccc

SEQ ID NO: 303376 - RNA, 32 nt, Human
accucuuuagaauaugcuuacacgagccacuc

SEQ ID NO: 303377 - RNA, 32 nt, Human
accucuuucuaaagccgcagacccuggugcaa

SEQ ID NO: 303378 - RNA, 19 nt, Human
accucuuugccuccugcug

SEQ ID NO: 303379 - RNA, 32 nt, Human
accucuuuucaucuuguuuucuuccaauaaug

SEQ ID NO: 303380 - RNA, 22 nt, Human
accucuuuuccacacgugggaa

SEQ ID NO: 303381 - RNA, 32 nt, Human
accucuuuucuuccccgcccccugcacauucg

SEQ ID NO: 303382 - RNA, 32 nt, Human
accugaaaaccugaaaaugccacuuucaugca

SEQ ID NO: 303383 - RNA, 32 nt, Human
accugaaaauucaacuuguucaagagaagguc

SEQ ID NO: 303384 - RNA, 32 nt, Human
accugaaacuguuuguucucucccacuagaau

SEQ ID NO: 303385 - RNA, 32 nt, Human
accugaaagagguaugcucucuuaggaauaca

SEQ ID NO: 303386 - RNA, 22 nt, Human
accugaacccaggaggcagagg

SEQ ID NO: 303387 - RNA, 32 nt, Human
accugaacccaggaggcagagguugcagugag

SEQ ID NO: 303388 - RNA, 32 nt, Human
accugaacccccaggcuggaguacaguggcag

SEQ ID NO: 303389 - RNA, 32 nt, Human
accugaaccgagacaaggagguaccacacuau

SEQ ID NO: 303390 - RNA, 32 nt, Human
accugaaccugaccaaugaaaugugacccgug

SEQ ID NO: 303391 - RNA, 32 nt, Human
accugaaccuggugcuguaugugugugaaacu

SEQ ID NO: 303392 - RNA, 32 nt, Human
accugaaccugugggggccuugcccauuugac

SEQ ID NO: 303393 - RNA, 32 nt, Human
accugaacgccgcuccagccuccacggggacc

SEQ ID NO: 303394 - RNA, 32 nt, Human
accugaacucucuggaccucagguuuccaucu

SEQ ID NO: 303395 - RNA, 18 nt, Human
accugaacugaacaccau

SEQ ID NO: 303396 - RNA, 32 nt, Human
accugaacuugcuauuuuaaacaaauaguucu

SEQ ID NO: 303397 - RNA, 32 nt, Human
accugaagaaggaggucgaccuucuucagcac

SEQ ID NO: 303398 - RNA, 32 nt, Human
accugaagacaugcucucacauauagagguac

SEQ ID NO: 303399 - RNA, 32 nt, Human
accugaagagggaggaaguggauuugggguuc

SEQ ID NO: 303400 - RNA, 32 nt, Human
accugaagcacaaguucccauggcugucggag

SEQ ID NO: 303401 - RNA, 32 nt, Human
accugaagccugggcugcgcagugugggaggg

SEQ ID NO: 303402 - RNA, 32 nt, Human
accugaagcugaccaacacuacagagauccca

SEQ ID NO: 303403 - RNA, 32 nt, Human
accugaagcugguuucauggcagccucaaaaa

SEQ ID NO: 303404 - RNA, 32 nt, Human
accugaagcugguuucauggcagccucaaaga

SEQ ID NO: 303405 - RNA, 32 nt, Human
accugaaggaugacauggcccugccugagccc

SEQ ID NO: 303406 - RNA, 32 nt, Human
accugaaggccauccucuuucugcuguguguc

SEQ ID NO: 303407 - RNA, 32 nt, Human
accugaaggcuucaaucauuuggaucaacaac

SEQ ID NO: 303408 - RNA, 32 nt, Human
accugaaggcuugcugggggugcaaugucacc

SEQ ID NO: 303409 - RNA, 32 nt, Human
accugaagucugcagucugccacacagaagac

SEQ ID NO: 303410 - RNA, 32 nt, Human
accugaagugagucuuuggguaggggaagggu

SEQ ID NO: 303411 - RNA, 32 nt, Human
accugaaguugcacagucucaggcugggggcc

SEQ ID NO: 303412 - RNA, 32 nt, Human
accugaauaguuuuaagaguccaguggagccu

SEQ ID NO: 303413 - RNA, 32 nt, Human
accugaaucccaccccucgaccaauccuccac

SEQ ID NO: 303414 - RNA, 32 nt, Human
accugaaucuacacuaguaaucucaagaaaga

SEQ ID NO: 303415 - RNA, 32 nt, Human
accugaaugccaggaaaaauuccugggccaag

SEQ ID NO: 303416 - RNA, 32 nt, Human
accugacaaagaggaggagcuggaggaagcau

SEQ ID NO: 303417 - RNA, 32 nt, Human
accugacacaagaggaauaagaauggagcagu

SEQ ID NO: 303418 - RNA, 32 nt, Human
accugacacccacuccuggggacacaaacacc

SEQ ID NO: 303419 - RNA, 21 nt, Human
accugacaccugcucucccca

SEQ ID NO: 303420 - RNA, 32 nt, Human
accugacaccugcucuccccagccuguuuucu

SEQ ID NO: 303421 - RNA, 32 nt, Human
accugacagagcccuggcuuugaccugcucag

SEQ ID NO: 303422 - RNA, 32 nt, Human
accugacagcaaacacagucacuguugguucc

SEQ ID NO: 303423 - RNA, 32 nt, Human
accugacaggcagcagaggguguggagaccuc

SEQ ID NO: 303424 - RNA, 22 nt, Human
accugacauggcagccucgagg

SEQ ID NO: 303425 - RNA, 32 nt, Human
accugaccaguaaacuguggacuaguagaaag

SEQ ID NO: 303426 - RNA, 32 nt, Human
accugacccaggugcaagagacaggggaagag

SEQ ID NO: 303427 - RNA, 32 nt, Human
accugacccagugcccugcgacacgcccacag

SEQ ID NO: 303428 - RNA, 32 nt, Human
accugacccccaucugccacagggcaggggug

SEQ ID NO: 303429 - RNA, 32 nt, Human
accugaccccuccacucugaaggaggaacagg

SEQ ID NO: 303430 - RNA, 32 nt, Human
accugacccuccugcccgcauacacaacccau

SEQ ID NO: 303431 - RNA, 32 nt, Human
accugacccuugugccucccucccucugccca

SEQ ID NO: 303432 - RNA, 32 nt, Human
accugacgagccuucagaaucuccagaaucuc

SEQ ID NO: 303433 - RNA, 32 nt, Human
accugacuaugcuuucucuccuaggagcuguc

SEQ ID NO: 303434 - RNA, 32 nt, Human
accugacuccccucaaaaccaagcacaucgcu

SEQ ID NO: 303435 - RNA, 32 nt, Human
accugacucccuguaaaggagugcugucuuaa

SEQ ID NO: 303436 - RNA, 32 nt, Human
accugacucugcuucucucauuugucuuccua

SEQ ID NO: 303437 - RNA, 32 nt, Human
accugacucuguccgcucacacagccucaccu

SEQ ID NO: 303438 - RNA, 32 nt, Human
accugacugcacuccagccuggguggcaaagc

SEQ ID NO: 303439 - RNA, 32 nt, Human
accugacugccucuguuaaauuugcacuguua

SEQ ID NO: 303440 - RNA, 32 nt, Human
accugacugccugguucagccucuucgcugac

SEQ ID NO: 303441 - RNA, 32 nt, Human
accugacuggggcagugaaggaagggauggca

SEQ ID NO: 303442 - RNA, 32 nt, Human
accugacugguuuuggagguucuguccacugc

SEQ ID NO: 303443 - RNA, 32 nt, Human
accugacuuggugggagcuccaggcagucacu

SEQ ID NO: 303444 - RNA, 32 nt, Human
accugagaacaguaucauucacuugaggauau

SEQ ID NO: 303445 - RNA, 32 nt, Human
accugagaacauccuguuugugaauucugagu

SEQ ID NO: 303446 - RNA, 32 nt, Human
accugagaaggaagguuucuuuaguacugcca

SEQ ID NO: 303447 - RNA, 32 nt, Human
accugagaaguggagguuguggugagcugaga

SEQ ID NO: 303448 - RNA, 32 nt, Human
accugagacagagagcaaguaagcugucccuu

SEQ ID NO: 303449 - RNA, 32 nt, Human
accugagacuacagaugugcaccaccacacug

SEQ ID NO: 303450 - RNA, 32 nt, Human
accugagagaaaacucaccagggcagaaaaga

SEQ ID NO: 303451 - RNA, 32 nt, Human
accugagagacggagguugcagggagccgaga

SEQ ID NO: 303452 - RNA, 32 nt, Human
accugagagagauguucuagcugagagggccu

SEQ ID NO: 303453 - RNA, 32 nt, Human
accugagaggcagagguuacagugagccaaga

SEQ ID NO: 303454 - RNA, 32 nt, Human
accugagaggcagagguuacagugagcugaga

SEQ ID NO: 303455 - RNA, 32 nt, Human
accugagaggcagagguugcagugagccaaga

SEQ ID NO: 303456 - RNA, 32 nt, Human
accugagaggcagagguugcagugagccgaga

SEQ ID NO: 303457 - RNA, 32 nt, Human
accugagaggcagagguugcagugagccgagg

SEQ ID NO: 303458 - RNA, 32 nt, Human
accugagaggcggagguugcagugagccaaaa

SEQ ID NO: 303459 - RNA, 32 nt, Human
accugagaggcggagguugcagugagccaaga

SEQ ID NO: 303460 - RNA, 32 nt, Human
accugagaggcggagguugcagugagccgaga

SEQ ID NO: 303461 - RNA, 32 nt, Human
accugagaggugagguugcagugagccgagau

SEQ ID NO: 303462 - RNA, 32 nt, Human
accugagagguggagguuacagugaguugaga

SEQ ID NO: 303463 - RNA, 32 nt, Human
accugagagguggagguugcagugagccgaga

SEQ ID NO: 303464 - RNA, 32 nt, Human
accugagagguggagguugcaguugagccaag

SEQ ID NO: 303465 - RNA, 32 nt, Human
accugagagguggagguuucagugagccgaga

SEQ ID NO: 303466 - RNA, 32 nt, Human
accugagauuacaggcacccaccaccaugccc

SEQ ID NO: 303467 - RNA, 32 nt, Human
accugagcaguucuacccucccaaggcaccag

SEQ ID NO: 303468 - RNA, 32 nt, Human
accugagccagugcuuucuggagcucacaccu

SEQ ID NO: 303469 - RNA, 32 nt, Human
accugagcccaagaggucaaggcuucagugag

SEQ ID NO: 303470 - RNA, 23 nt, Human
accugagcccaaggaggucaagg

SEQ ID NO: 303471 - RNA, 32 nt, Human
accugagcccaggaauagggaggcucaacgga

SEQ ID NO: 303472 - RNA, 32 nt, Human
accugagcccaggagcucaagauugcagugag

SEQ ID NO: 303473 - RNA, 32 nt, Human
accugagcccaggaggucaagacugcagugag

SEQ ID NO: 303474 - RNA, 22 nt, Human
accugagcccaggagguggagg

SEQ ID NO: 303475 - RNA, 32 nt, Human
accugagcccaggagguggaggcugcagugag

SEQ ID NO: 303476 - RNA, 32 nt, Human
accugagcccaggagguggagguugcacugag

SEQ ID NO: 303477 - RNA, 32 nt, Human
accugagcccaggaguuugagacuacaguagc

SEQ ID NO: 303478 - RNA, 32 nt, Human
accugagcccaggaguuuggaccagccugggc

SEQ ID NO: 303479 - RNA, 32 nt, Human
accugagcccagggaaguugaggcugcuguga

SEQ ID NO: 303480 - RNA, 32 nt, Human
accugagccccuaaggcagugucuccucagcu

SEQ ID NO: 303481 - RNA, 21 nt, Human
accugagccuaggccaaagcu

SEQ ID NO: 303482 - RNA, 32 nt, Human
accugagccucacugccaccuaggcaggguga

SEQ ID NO: 303483 - RNA, 32 nt, Human
accugagccugggaggucgaggcugcagcgag

SEQ ID NO: 303484 - RNA, 32 nt, Human
accugagccugguaggcugaggcugcagugag

SEQ ID NO: 303485 - RNA, 32 nt, Human
accugagcgagugggugugugugcaaagaugg

SEQ ID NO: 303486 - RNA, 32 nt, Human
accugagcuagaagcuggaggacuagaaccug

SEQ ID NO: 303487 - RNA, 32 nt, Human
accugagcucuggagguggaggcugccaugag

SEQ ID NO: 303488 - RNA, 32 nt, Human
accugagcugacuuuguucuuccuucacaacc

SEQ ID NO: 303489 - RNA, 32 nt, Human
accugagcugggggacacuggcuccugccauc

SEQ ID NO: 303490 - RNA, 32 nt, Human
accugagcuuuucugguucugcugacccucag

SEQ ID NO: 303491 - RNA, 30 nt, Human
accugaggaagccacaguccauggcacucc

SEQ ID NO: 303492 - RNA, 32 nt, Human
accugaggaaggcagaagugaauuuggagaac

SEQ ID NO: 303493 - RNA, 32 nt, Human
accugaggauuucuagccagaggucccagaug

SEQ ID NO: 303494 - RNA, 32 nt, Human
accugaggccaggaguucgagaccagccugcc

SEQ ID NO: 303495 - RNA, 32 nt, Human
accugaggcggagucugcguggagaggggcgg

SEQ ID NO: 303496 - RNA, 31 nt, Human
accugaggcggaucucccauccgggccgcgc

SEQ ID NO: 303497 - RNA, 32 nt, Human
accugaggcugaggcaggagaauugcuugaac

SEQ ID NO: 303498 - RNA, 32 nt, Human
accugaggcugcacaggccagggcucgggcau

SEQ ID NO: 303499 - RNA, 32 nt, Human
accugaggcuguacggcuacagccugggcaac

SEQ ID NO: 303500 - RNA, 32 nt, Human
accugaggcuucuccccucucaacuugcuguu

SEQ ID NO: 303501 - RNA, 32 nt, Human
accugagggacuggacaucccauguucagcaa

SEQ ID NO: 303502 - RNA, 32 nt, Human
accugagggcaagaagaaggggaaguucaaga

SEQ ID NO: 303503 - RNA, 32 nt, Human
accugaggucaggaguucgugacaagaacccu

SEQ ID NO: 303504 - RNA, 32 nt, Human
accugaggucaguucaagaccagccuggccaa

SEQ ID NO: 303505 - RNA, 32 nt, Human
accugaggucccugcuuugaaccagcuuguug

SEQ ID NO: 303506 - RNA, 32 nt, Human
accugagguggcccugaagaugccccgccuua

SEQ ID NO: 303507 - RNA, 32 nt, Human
accugaguagggaagaaaaaccuuguaaaggc

SEQ ID NO: 303508 - RNA, 32 nt, Human
accugagucacuuuauuggguucagucaacac

SEQ ID NO: 303509 - RNA, 32 nt, Human
accugaguccaggaggucgaggcugcagugag

SEQ ID NO: 303510 - RNA, 32 nt, Human
accugagucucagagcaggggaguggcuuccc

SEQ ID NO: 303511 - RNA, 32 nt, Human
accugagugaagacugucauugguaggucaug

SEQ ID NO: 303512 - RNA, 32 nt, Human
accugagugucaucugaggauugccaauuggc

SEQ ID NO: 303513 - RNA, 32 nt, Human
accugaguucagugagagagaaaaugauuuag

SEQ ID NO: 303514 - RNA, 32 nt, Human
accugaguucugcuuccuuggaugucauugcu

SEQ ID NO: 303515 - RNA, 32 nt, Human
accugauacuuuucucuugagaagcaaaccag

SEQ ID NO: 303516 - RNA, 32 nt, Human
accugauagacacauuccucucugccaccuuc

SEQ ID NO: 303517 - RNA, 32 nt, Human
accugauaggauugccugcuuagaugauaaaa

SEQ ID NO: 303518 - RNA, 32 nt, Human
accugaucacccugaagcaacacccacaagca

SEQ ID NO: 303519 - RNA, 32 nt, Human
accugaucugggucuugcacccugggugcagc

SEQ ID NO: 303520 - RNA, 32 nt, Human
accugaugaaagauacaccacagggugagagc

SEQ ID NO: 303521 - RNA, 32 nt, Human
accugaugacccuuucccuuuuuauuaaaccg

SEQ ID NO: 303522 - RNA, 30 nt, Human
accugaugauccagcacaacugcucccgcc

SEQ ID NO: 303523 - RNA, 32 nt, Human
accugaugcgcccuaaacacuccugggccaug

SEQ ID NO: 303524 - RNA, 22 nt, Human
accugaugcgguuccucuccac

SEQ ID NO: 303525 - RNA, 30 nt, Human
accugaugcuggagggcggcagccugagcu

SEQ ID NO: 303526 - RNA, 32 nt, Human
accugaugcuguuugcccaucuguguccuugu

SEQ ID NO: 303527 - RNA, 32 nt, Human
accugaugggguagcuggggugugggguuggg

SEQ ID NO: 303528 - RNA, 32 nt, Human
accugauguaccugaagcagauccuguauuug

SEQ ID NO: 303529 - RNA, 32 nt, Human
accugauguuauuuuccuucuuuuggagggca

SEQ ID NO: 303530 - RNA, 32 nt, Human
accugauucaccuccagcccagggaauggaau

SEQ ID NO: 303531 - RNA, 32 nt, Human
accugauucugaggugaugaaagcagagggau

SEQ ID NO: 303532 - RNA, 32 nt, Human
accugauuggccacuggauccugcugcuuugg

SEQ ID NO: 303533 - RNA, 32 nt, Human
accugauuucagaagagacugauccaaaaauu

SEQ ID NO: 303534 - RNA, 32 nt, Human
accugcaaaauuguaaugcaagcccugacugg

SEQ ID NO: 303535 - RNA, 32 nt, Human
accugcaaacgugaccuuauuuggaaauaggg

SEQ ID NO: 303536 - RNA, 32 nt, Human
accugcaacccagccaagacccagugccuugg

SEQ ID NO: 303537 - RNA, 32 nt, Human
accugcaacucagccaagacccagugccuugg

SEQ ID NO: 303538 - RNA, 32 nt, Human
accugcaacugcuggggagaaccacaagcaca

SEQ ID NO: 303539 - RNA, 32 nt, Human
accugcaaggacugcaggacugcucugugaug

SEQ ID NO: 303540 - RNA, 32 nt, Human
accugcaaguuuugaagucaacaguuugcaga

SEQ ID NO: 303541 - RNA, 32 nt, Human
accugcaaugaguaggccuggcuggucacuuu

SEQ ID NO: 303542 - RNA, 22 nt, Human
accugcacaaggugcuugggaa

SEQ ID NO: 303543 - RNA, 32 nt, Human
accugcacacaagacccccacccaaggaaugu

SEQ ID NO: 303544 - RNA, 32 nt, Human
accugcacacauagcccugccugggguuccug

SEQ ID NO: 303545 - RNA, 32 nt, Human
accugcacaugugggcugggcgcgguggcuca

SEQ ID NO: 303546 - RNA, 32 nt, Human
accugcacccagucacagcagcacagaugugc

SEQ ID NO: 303547 - RNA, 32 nt, Human
accugcaccccucccuucuccaucucgcuugc

SEQ ID NO: 303548 - RNA, 32 nt, Human
accugcacccgagcccuggggcucagccccac

SEQ ID NO: 303549 - RNA, 32 nt, Human
accugcaccggcugcgaggagcagggagcucc

SEQ ID NO: 303550 - RNA, 32 nt, Human
accugcaccucccggguucaagugauucucau

SEQ ID NO: 303551 - RNA, 32 nt, Human
accugcaccuccuggguucaagcaauucucca

SEQ ID NO: 303552 - RNA, 32 nt, Human
accugcacgguuuggagacaggcuucuuuguc

SEQ ID NO: 303553 - RNA, 32 nt, Human
accugcacgucucuucugucauguguucuauu

SEQ ID NO: 303554 - RNA, 32 nt, Human
accugcacuuccugcuggacucaggccuccag

SEQ ID NO: 303555 - RNA, 32 nt, Human
accugcacuucugccucacuuucuugcuggcu

SEQ ID NO: 303556 - RNA, 32 nt, Human
accugcagaacugcacuauaagaaaaguuaag

SEQ ID NO: 303557 - RNA, 32 nt, Human
accugcagaccacccucgcuucugugaagaga

SEQ ID NO: 303558 - RNA, 32 nt, Human
accugcagaccugcacuauaagaaaaguuaag

SEQ ID NO: 303559 - RNA, 32 nt, Human
accugcagagccuuugcccuaggcaacugcag

SEQ ID NO: 303560 - RNA, 18 nt, Human
accugcagaugcccccca

SEQ ID NO: 303561 - RNA, 24 nt, Human
accugcagccaccaugaacagcaa

SEQ ID NO: 303562 - RNA, 32 nt, Human
accugcagccccaacauccauucuuucagcuc

SEQ ID NO: 303563 - RNA, 32 nt, Human
accugcagcuuccgcaccuccugguccgcguu

SEQ ID NO: 303564 - RNA, 32 nt, Human
accugcaggaaggcaucauuguauacuguggu

SEQ ID NO: 303565 - RNA, 32 nt, Human
accugcaggaauaccagagcaagaaacugaug

SEQ ID NO: 303566 - RNA, 32 nt, Human
accugcaggacaguuuuccuggagccauuugg

SEQ ID NO: 303567 - RNA, 20 nt, Human
accugcaggacccucaccca

SEQ ID NO: 303568 - RNA, 32 nt, Human
accugcaggagucgcagcagcucugugggaug

SEQ ID NO: 303569 - RNA, 25 nt, Human
accugcaggaugugcagggcugccu

SEQ ID NO: 303570 - RNA, 32 nt, Human
accugcaggcagcugcuaagccaagagugggu

SEQ ID NO: 303571 - RNA, 32 nt, Human
accugcagggccucuuuagugcagagaaaaac

SEQ ID NO: 303572 - RNA, 32 nt, Human
accugcaguacagcuauccagagagacugggc

SEQ ID NO: 303573 - RNA, 32 nt, Human
accugcagucgccagggauucccuccagguga

SEQ ID NO: 303574 - RNA, 32 nt, Human
accugcagugcuccuucuucacaugccagucu

SEQ ID NO: 303575 - RNA, 32 nt, Human
accugcagugucucugagcuucuggcaaguau

SEQ ID NO: 303576 - RNA, 32 nt, Human
accugcauaagucccuucccuuccuuacuccu

SEQ ID NO: 303577 - RNA, 32 nt, Human
accugcauaggcagugcuuuggccaggaggau

SEQ ID NO: 303578 - RNA, 22 nt, Human
accugcaucauugucaccuuca

SEQ ID NO: 303579 - RNA, 32 nt, Human
accugcaucugcaggcgauggggcaggggcca

SEQ ID NO: 303580 - RNA, 32 nt, Human
accugcaucuuccuccugccacagauggaggc

SEQ ID NO: 303581 - RNA, 32 nt, Human
accugcaucuucucaucaaagccauccaggga

SEQ ID NO: 303582 - RNA, 19 nt, Human
accugcaugauguguuuug

SEQ ID NO: 303583 - RNA, 32 nt, Human
accugcaugcaggcaccagagcagggacugag

SEQ ID NO: 303584 - RNA, 32 nt, Human
accugcauggccaggcagagucagcagcugca

SEQ ID NO: 303585 - RNA, 32 nt, Human
accugcauugcucucccucgugcuccccaaau

SEQ ID NO: 303586 - RNA, 32 nt, Human
accugcauuuuauuugaauuacccgaauagca

SEQ ID NO: 303587 - RNA, 32 nt, Human
accugccaaaugcuauacugugucauggugau

SEQ ID NO: 303588 - RNA, 32 nt, Human
accugccaaucgcggagagaucaaagggucug

SEQ ID NO: 303589 - RNA, 32 nt, Human
accugccacaguugauggugagaagcuccuuu

SEQ ID NO: 303590 - RNA, 32 nt, Human
accugccacccacucugcgagccaaucucagu

SEQ ID NO: 303591 - RNA, 32 nt, Human
accugccacccagggucggggccccgcaccau

SEQ ID NO: 303592 - RNA, 32 nt, Human
accugccaccugcuucccuucucagccaccca

SEQ ID NO: 303593 - RNA, 32 nt, Human
accugccacucaaccaaagaguccucgagccg

SEQ ID NO: 303594 - RNA, 32 nt, Human
accugccacugccgucaccucucccuccucag

SEQ ID NO: 303595 - RNA, 32 nt, Human
accugccagagcaacagagugagaccccuguc

SEQ ID NO: 303596 - RNA, 32 nt, Human
accugccagauggcuuuuacugugucugaauu

SEQ ID NO: 303597 - RNA, 32 nt, Human
accugccagcacuucugcaagcugaaauuuac

SEQ ID NO: 303598 - RNA, 22 nt, Human
accugccaggccaagggucagg

SEQ ID NO: 303599 - RNA, 32 nt, Human
accugccaguggagcugagcacugccuagccu

SEQ ID NO: 303600 - RNA, 32 nt, Human
accugccagugucuugggcauuuccuuggcaa

SEQ ID NO: 303601 - RNA, 32 nt, Human
accugccaucgaggguuccuccccgcacccuc

SEQ ID NO: 303602 - RNA, 32 nt, Human
accugccaugaccaccacccauaccgcccgug

SEQ ID NO: 303603 - RNA, 32 nt, Human
accugccaugcugcucuuccuccucucugcac

SEQ ID NO: 303604 - RNA, 32 nt, Human
accugccaugugugcccugccuuccuggccag

SEQ ID NO: 303605 - RNA, 25 nt, Human
accugccauuucuccacucccuaca

SEQ ID NO: 303606 - RNA, 32 nt, Human
accugccauuuugccuugcaucguuucccucg

SEQ ID NO: 303607 - RNA, 32 nt, Human
accugcccaaagaaagaaaagacugaagggau

SEQ ID NO: 303608 - RNA, 32 nt, Human
accugcccaaccauauaucacccccuaccccu

SEQ ID NO: 303609 - RNA, 32 nt, Human
accugcccaccgucccuguccaugccccgccc

SEQ ID NO: 303610 - RNA, 32 nt, Human
accugcccaccuggcccagugcugccacugcc

SEQ ID NO: 303611 - RNA, 32 nt, Human
accugcccagaggagaggggcaguguucccac

SEQ ID NO: 303612 - RNA, 20 nt, Human
accugcccagccccaccuca

SEQ ID NO: 303613 - RNA, 32 nt, Human
accugcccagcuucacaccucccccgacuuca

SEQ ID NO: 303614 - RNA, 32 nt, Human
accugcccaggcccauucuccaaagaagcugu

SEQ ID NO: 303615 - RNA, 32 nt, Human
accugcccagugagccuccuugacaugcuuau

SEQ ID NO: 303616 - RNA, 32 nt, Human
accugccccagccuggcucuaccugcugugcu

SEQ ID NO: 303617 - RNA, 32 nt, Human
accugccccaggagcuggagacaagaccuugu

SEQ ID NO: 303618 - RNA, 32 nt, Human
accugccccagugcccagaccaaccaaggccc

SEQ ID NO: 303619 - RNA, 20 nt, Human
accugcccccagcccugccc

SEQ ID NO: 303620 - RNA, 32 nt, Human
accugcccccaucucucacucacugcaauugc

SEQ ID NO: 303621 - RNA, 21 nt, Human
accugccccccacucugcaca

SEQ ID NO: 303622 - RNA, 32 nt, Human
accugccccgcccagcugcaccugccagccug

SEQ ID NO: 303623 - RNA, 32 nt, Human
accugccccucaacucuccuccagagucagaa

SEQ ID NO: 303624 - RNA, 27 nt, Human
accugccccucccucuagaggcugccu

SEQ ID NO: 303625 - RNA, 32 nt, Human
accugccccucggcugcaugcccacagccgua

SEQ ID NO: 303626 - RNA, 32 nt, Human
accugccccugccucucagccuccccgggugc

SEQ ID NO: 303627 - RNA, 32 nt, Human
accugccccuuucugcccuccugcuccagccc

SEQ ID NO: 303628 - RNA, 32 nt, Human
accugcccgccacauccucugccugcuguccc

SEQ ID NO: 303629 - RNA, 32 nt, Human
accugcccgcuggucugaguggccuggcccau

SEQ ID NO: 303630 - RNA, 32 nt, Human
accugcccggagacagagggagcagcugaggc

SEQ ID NO: 303631 - RNA, 32 nt, Human
accugcccuccaccaccacccaaaguguggga

SEQ ID NO: 303632 - RNA, 32 nt, Human
accugcccuccagguguacuuuaggccugugg

SEQ ID NO: 303633 - RNA, 21 nt, Human
accugcccucccacucuucca

SEQ ID NO: 303634 - RNA, 32 nt, Human
accugcccuccccuuacucuuguuucuccucc

SEQ ID NO: 303635 - RNA, 32 nt, Human
accugcccugcacccuggggagaggaccaggg

SEQ ID NO: 303636 - RNA, 32 nt, Human
accugcccuuccccagcgcccccaccaccccg

SEQ ID NO: 303637 - RNA, 18 nt, Human
accugccgccgccucauu

SEQ ID NO: 303638 - RNA, 32 nt, Human
accugccgccugcuggggaagucuggagcccc

SEQ ID NO: 303639 - RNA, 32 nt, Human
accugccggcagaguuccccagccuggaggcu

SEQ ID NO: 303640 - RNA, 32 nt, Human
accugccggcuccucuucccacggccacccuc

SEQ ID NO: 303641 - RNA, 19 nt, Human
accugccguggacuugggg

SEQ ID NO: 303642 - RNA, 32 nt, Human
accugccuauaaucccagcuauuugggaggcu

SEQ ID NO: 303643 - RNA, 32 nt, Human
accugccucaccuaauccucacccuugcugcu

SEQ ID NO: 303644 - RNA, 32 nt, Human
accugccuccaccccgucugucauccucaucc

SEQ ID NO: 303645 - RNA, 32 nt, Human
accugccuccacccuuccaggugccacgggag

SEQ ID NO: 303646 - RNA, 32 nt, Human
accugccuccgccucuuccuccagcggcucca

SEQ ID NO: 303647 - RNA, 32 nt, Human
accugccuccgggcgccugggcuucaggauga

SEQ ID NO: 303648 - RNA, 32 nt, Human
accugccucgucucccuggggaggugguccca

SEQ ID NO: 303649 - RNA, 32 nt, Human
accugccucucccaccuccagucuuuccccug

SEQ ID NO: 303650 - RNA, 32 nt, Human
accugccucuggcuucucaggccucugcucuc

SEQ ID NO: 303651 - RNA, 20 nt, Human
accugccucuucccccucca

SEQ ID NO: 303652 - RNA, 32 nt, Human
accugccugcaaaggccauugugucgggcagu

SEQ ID NO: 303653 - RNA, 32 nt, Human
accugccugcauugcugaccacaggccuggcc

SEQ ID NO: 303654 - RNA, 32 nt, Human
accugccugccacccuccucucccacucaggc

SEQ ID NO: 303655 - RNA, 32 nt, Human
accugccugccugcaucacugcacugaauggc

SEQ ID NO: 303656 - RNA, 32 nt, Human
accugccugccuggauugcaccuuucugcccu

SEQ ID NO: 303657 - RNA, 32 nt, Human
accugccugccugguugggccuucagcugucu

SEQ ID NO: 303658 - RNA, 32 nt, Human
accugccugccugucucccuccucugucacca

SEQ ID NO: 303659 - RNA, 32 nt, Human
accugccugcggggagaauggagccaggggag

SEQ ID NO: 303660 - RNA, 32 nt, Human
accugccugcuugcuucucuggcugccugguc

SEQ ID NO: 303661 - RNA, 19 nt, Human
accugccuggccaacaugg

SEQ ID NO: 303662 - RNA, 24 nt, Human
accugccuggccaacauggugaaa

SEQ ID NO: 303663 - RNA, 32 nt, Human
accugccugggcaacauaaugaaacuuccuuu

SEQ ID NO: 303664 - RNA, 32 nt, Human
accugccugggcaacauagugagaccccaucu

SEQ ID NO: 303665 - RNA, 32 nt, Human
accugccugggcagcccucacacccaugcucc

SEQ ID NO: 303666 - RNA, 32 nt, Human
accugccugggucucccugucucuccagccag

SEQ ID NO: 303667 - RNA, 32 nt, Human
accugccugguacauagcuggcauucagaaaa

SEQ ID NO: 303668 - RNA, 32 nt, Human
accugccuguaaucccagcuacuugggaggcu

SEQ ID NO: 303669 - RNA, 32 nt, Human
accugccuguaaucucagcuacucaggaggcu

SEQ ID NO: 303670 - RNA, 32 nt, Human
accugccuguaugacagagugagacccugucu

SEQ ID NO: 303671 - RNA, 32 nt, Human
accugccugugaccuuugcccuguccuggagg

SEQ ID NO: 303672 - RNA, 32 nt, Human
accugccuuacagagcagcccagguacccagg

SEQ ID NO: 303673 - RNA, 32 nt, Human
accugccuuaugcaccuuacugccuagauuuu

SEQ ID NO: 303674 - RNA, 32 nt, Human
accugccuucauuucaaccaccugucuucaua

SEQ ID NO: 303675 - RNA, 19 nt, Human
accugccuuucugccagga

SEQ ID NO: 303676 - RNA, 32 nt, Human
accugccuuuucccaucuccccagcauaaccu

SEQ ID NO: 303677 - RNA, 32 nt, Human
accugcgaggcagagauugcagugagccaaga

SEQ ID NO: 303678 - RNA, 32 nt, Human
accugcgaugacgacgaggaggaacaaguggg

SEQ ID NO: 303679 - RNA, 32 nt, Human
accugcgaugcugaggggaggaagcugcggaa

SEQ ID NO: 303680 - RNA, 32 nt, Human
accugcgaugugagccucaccugagccagagc

SEQ ID NO: 303681 - RNA, 32 nt, Human
accugcgcagcaaggcuggcugugcuggaguc

SEQ ID NO: 303682 - RNA, 32 nt, Human
accugcgccgggccaucaugccgugccggacu

SEQ ID NO: 303683 - RNA, 32 nt, Human
accugcgccuccuggguucaagugauucuucu

SEQ ID NO: 303684 - RNA, 32 nt, Human
accugcggccccggagaaggcagcgagcgcag

SEQ ID NO: 303685 - RNA, 32 nt, Human
accugcggccuccccugccuuuucuccggugg

SEQ ID NO: 303686 - RNA, 32 nt, Human
accugcgggcaggcgccgggaggccgagccag

SEQ ID NO: 303687 - RNA, 32 nt, Human
accugcgggccugggaagcauugcucagggug

SEQ ID NO: 303688 - RNA, 32 nt, Human
accugcggucggagugggagggccagucugca

SEQ ID NO: 303689 - RNA, 32 nt, Human
accugcguccucugaccugagagcgaagggga

SEQ ID NO: 303690 - RNA, 32 nt, Human
accugcgucuaccuuccaucuguguccagcgg

SEQ ID NO: 303691 - RNA, 32 nt, Human
accugcguuuucauuuguuugacauuugucua

SEQ ID NO: 303692 - RNA, 32 nt, Human
accugcguuuuucugccacagcauccaaucgu

SEQ ID NO: 303693 - RNA, 32 nt, Human
accugcuaacuuggagcuucagagccauggca

SEQ ID NO: 303694 - RNA, 32 nt, Human
accugcuacuuaccaggcccaggcuggggugg

SEQ ID NO: 303695 - RNA, 32 nt, Human
accugcuaggggcugggcaaggccccggcucu

SEQ ID NO: 303696 - RNA, 32 nt, Human
accugcuaguggggaggccacacccacaagcg

SEQ ID NO: 303697 - RNA, 32 nt, Human
accugcucacacaccuuguucaacuuuucagc

SEQ ID NO: 303698 - RNA, 32 nt, Human
accugcucacccagcccugauguaauuaaaaa

SEQ ID NO: 303699 - RNA, 32 nt, Human
accugcucacuggcuggguauucuucguaaaa

SEQ ID NO: 303700 - RNA, 32 nt, Human
accugcucagaaucaugcaggucuccacugcu

SEQ ID NO: 303701 - RNA, 32 nt, Human
accugcucagagcagagccucuaccuccccug

SEQ ID NO: 303702 - RNA, 32 nt, Human
accugcucaucucugcccugaggucaccccgu

SEQ ID NO: 303703 - RNA, 32 nt, Human
accugcucauggccagucuggacugggaaagc

SEQ ID NO: 303704 - RNA, 32 nt, Human
accugcucauuuccauuagaaccuucaagcag

SEQ ID NO: 303705 - RNA, 17 nt, Human
accugcuccaccccuuc

SEQ ID NO: 303706 - RNA, 32 nt, Human
accugcuccaggggucaaggacuugccuugcc

SEQ ID NO: 303707 - RNA, 32 nt, Human
accugcucccaaauggcaaggauuuuugcuac

SEQ ID NO: 303708 - RNA, 32 nt, Human
accugcucccaaucaugcaggucuccacugcu

SEQ ID NO: 303709 - RNA, 32 nt, Human
accugcucccuagugggcucuccuccccagga

SEQ ID NO: 303710 - RNA, 18 nt, Human
accugcucccugcugcug

SEQ ID NO: 303711 - RNA, 32 nt, Human
accugcuccuccauuuccauuuauucucaaca

SEQ ID NO: 303712 - RNA, 32 nt, Human
accugcuccugacuucucagggcuggcaguca

SEQ ID NO: 303713 - RNA, 23 nt, Human
accugcucggaauuaaaggcuuc

SEQ ID NO: 303714 - RNA, 32 nt, Human
accugcucucaaggacucugccuuggaggggg

SEQ ID NO: 303715 - RNA, 32 nt, Human
accugcucucauaaccgugccugcuccuccug

SEQ ID NO: 303716 - RNA, 32 nt, Human
accugcucugcagcugcuauaaauagccuccc

SEQ ID NO: 303717 - RNA, 32 nt, Human
accugcucugugcugggaaccugcucugugcc

SEQ ID NO: 303718 - RNA, 32 nt, Human
accugcugaaccuugguguccauguccuggag

SEQ ID NO: 303719 - RNA, 22 nt, Human
accugcugacccuggccuuggc

SEQ ID NO: 303720 - RNA, 32 nt, Human
accugcugagagucccucccacucccacucac

SEQ ID NO: 303721 - RNA, 32 nt, Human
accugcugaguccucagguuguuuggccucuc

SEQ ID NO: 303722 - RNA, 32 nt, Human
accugcugaugguggagaaugagcgacugagg

SEQ ID NO: 303723 - RNA, 32 nt, Human
accugcugcacuguaagcccagggauguggca

SEQ ID NO: 303724 - RNA, 32 nt, Human
accugcugcauccugugcuccgcaggcugggc

SEQ ID NO: 303725 - RNA, 32 nt, Human
accugcugcucaccuucauccucuuuuucugg

SEQ ID NO: 303726 - RNA, 32 nt, Human
accugcugcuccagacaagcacaaagcaaucu

SEQ ID NO: 303727 - RNA, 32 nt, Human
accugcugcuccugaacaacaggccucaugcc

SEQ ID NO: 303728 - RNA, 32 nt, Human
accugcugcucugagccugugcaccuggggug

SEQ ID NO: 303729 - RNA, 32 nt, Human
accugcugcugcacucccugcagcuggucagc

SEQ ID NO: 303730 - RNA, 32 nt, Human
accugcugcuuccacgugagucagggaugguc

SEQ ID NO: 303731 - RNA, 32 nt, Human
accugcugcuucugugacccccacagcccaga

SEQ ID NO: 303732 - RNA, 32 nt, Human
accugcuggaaagaccugggcagaaauggaga

SEQ ID NO: 303733 - RNA, 32 nt, Human
accugcuggaagcugccagcugcccggcuggc

SEQ ID NO: 303734 - RNA, 23 nt, Human
accugcuggccaugcaagcugac

SEQ ID NO: 303735 - RNA, 32 nt, Human
accugcuggcgccccagcacagccuggccaag

SEQ ID NO: 303736 - RNA, 32 nt, Human
accugcugggaaaauuuaggguagagcacucu

SEQ ID NO: 303737 - RNA, 32 nt, Human
accugcugggcccugagcuggcauugccccug

SEQ ID NO: 303738 - RNA, 32 nt, Human
accugcugggcggacgugggccuagguggucc

SEQ ID NO: 303739 - RNA, 25 nt, Human
accugcuguaguuagauaugggcuu

SEQ ID NO: 303740 - RNA, 32 nt, Human
accugcuguauggaaacuacuuucacuuaugg

SEQ ID NO: 303741 - RNA, 32 nt, Human
accugcugucuuagggaagaaaugguucaaau

SEQ ID NO: 303742 - RNA, 32 nt, Human
accugcugugaccugggagcagcuuccccugg

SEQ ID NO: 303743 - RNA, 32 nt, Human
accugcuguggacuguuuucuuugccuaguga

SEQ ID NO: 303744 - RNA, 32 nt, Human
accugcuguggagccuuaagaggagaauaaau

SEQ ID NO: 303745 - RNA, 32 nt, Human
accugcuguggagggugcccagcagacguggu

SEQ ID NO: 303746 - RNA, 32 nt, Human
accugcuguuguugccaaccagucucccaaag

SEQ ID NO: 303747 - RNA, 32 nt, Human
accugcuucaaaagccugaauaaugggaaaau

SEQ ID NO: 303748 - RNA, 32 nt, Human
accugcuucagaagauagacauggacagcaag

SEQ ID NO: 303749 - RNA, 23 nt, Human
accugcuuccagcggagccgccu

SEQ ID NO: 303750 - RNA, 32 nt, Human
accugcuucuagcuucacuuuugggccagauu

SEQ ID NO: 303751 - RNA, 32 nt, Human
accugcuucuccuucuccuuuuucucugauuu

SEQ ID NO: 303752 - RNA, 22 nt, Human
accugcuucugagagggcugcc

SEQ ID NO: 303753 - RNA, 23 nt, Human
accugcuucugucacagcacuga

SEQ ID NO: 303754 - RNA, 32 nt, Human
accugcuugagcuuucugugcaugugcagguc

SEQ ID NO: 303755 - RNA, 32 nt, Human
accugcuuggcccuggcccagcucccugcccu

SEQ ID NO: 303756 - RNA, 32 nt, Human
accugcuuggugguuagaaggaggcuagaaga

SEQ ID NO: 303757 - RNA, 19 nt, Human
accugcuugugaggccgcc

SEQ ID NO: 303758 - RNA, 19 nt, Human
accugcuuucaccagacug

SEQ ID NO: 303759 - RNA, 21 nt, Human
accugcuuucauuuuagacug

SEQ ID NO: 303760 - RNA, 21 nt, Human
accugcuuucugaggcuucug

SEQ ID NO: 303761 - RNA, 23 nt, Human
accugcuuucugcaaacaacuga

SEQ ID NO: 303762 - RNA, 32 nt, Human
accuggaaacaucuggaacauccugggauaua

SEQ ID NO: 303763 - RNA, 32 nt, Human
accuggaaacuaagcucagaggcaagguaaua

SEQ ID NO: 303764 - RNA, 16 nt, Human
accuggaaacuaccau

SEQ ID NO: 303765 - RNA, 32 nt, Human
accuggaacgcggagguugcaaugagccgaga

SEQ ID NO: 303766 - RNA, 32 nt, Human
accuggaacugauucguguacagugacagaga

SEQ ID NO: 303767 - RNA, 22 nt, Human
accuggaacugugcaccuggca

SEQ ID NO: 303768 - RNA, 21 nt, Human
accuggaagacuacugaauca

SEQ ID NO: 303769 - RNA, 32 nt, Human
accuggaagacuuggcuuuacguacucccaau

SEQ ID NO: 303770 - RNA, 32 nt, Human
accuggaagcagcagcaggugccugaacucgu

SEQ ID NO: 303771 - RNA, 32 nt, Human
accuggaagcucuuucuauuacacucaggcug

SEQ ID NO: 303772 - RNA, 32 nt, Human
accuggaaggaagagguugcagugagccaaga

SEQ ID NO: 303773 - RNA, 32 nt, Human
accuggaaggaucggguaaagauacagagaag

SEQ ID NO: 303774 - RNA, 32 nt, Human
accuggaaggcagaaguugcagugagcugaga

SEQ ID NO: 303775 - RNA, 32 nt, Human
accuggaaggcagagauugcagugagcugaga

SEQ ID NO: 303776 - RNA, 32 nt, Human
accuggaaggcagggguugcagugaccugaga

SEQ ID NO: 303777 - RNA, 32 nt, Human
accuggaaggcggagcuugcagugagcugaga

SEQ ID NO: 303778 - RNA, 32 nt, Human
accuggaaggcggagguugcagugagcagaga

SEQ ID NO: 303779 - RNA, 32 nt, Human
accuggaaggcggagguugcagugagccaaga

SEQ ID NO: 303780 - RNA, 32 nt, Human
accuggaaggcggagguugcagugagccgaga

SEQ ID NO: 303781 - RNA, 32 nt, Human
accuggaaggucggacagggacagcagagaag

SEQ ID NO: 303782 - RNA, 32 nt, Human
accuggaaggugaaggugaaggugagacccug

SEQ ID NO: 303783 - RNA, 32 nt, Human
accuggaagguggagcuugcagugagcugaga

SEQ ID NO: 303784 - RNA, 32 nt, Human
accuggaauacagagguuucagugagcugaga

SEQ ID NO: 303785 - RNA, 32 nt, Human
accuggaccagcugcucagcugucugaagacc

SEQ ID NO: 303786 - RNA, 32 nt, Human
accuggaccaggaaccgagccugcucuaugcg

SEQ ID NO: 303787 - RNA, 32 nt, Human
accuggacccacauuugcuccaauccacauuc

SEQ ID NO: 303788 - RNA, 32 nt, Human
accuggaccuccugggcucaagcaauccucuc

SEQ ID NO: 303789 - RNA, 32 nt, Human
accuggacggggacggaacccaggugggggca

SEQ ID NO: 303790 - RNA, 32 nt, Human
accuggacucaagugauucuccugccucagcc

SEQ ID NO: 303791 - RNA, 32 nt, Human
accuggacuguggugggcuccgacugagccgc

SEQ ID NO: 303792 - RNA, 32 nt, Human
accuggagaacagcaagaucuaggcaccagcc

SEQ ID NO: 303793 - RNA, 32 nt, Human
accuggagaagaaaccaccagaccaugaggcc

SEQ ID NO: 303794 - RNA, 32 nt, Human
accuggagacagucccuccacugugaacaagc

SEQ ID NO: 303795 - RNA, 32 nt, Human
accuggagaggguuagaaagaaccaacagcug

SEQ ID NO: 303796 - RNA, 32 nt, Human
accuggagaugggggccagguugugcagacuu

SEQ ID NO: 303797 - RNA, 32 nt, Human
accuggagcaaugcacuguaccugccucacuc

SEQ ID NO: 303798 - RNA, 24 nt, Human
accuggagcccaucggggcugccu

SEQ ID NO: 303799 - RNA, 32 nt, Human
accuggagcccccgcagucucuccucaggggu

SEQ ID NO: 303800 - RNA, 32 nt, Human
accuggagcccgaggaggugcucaaguacagc

SEQ ID NO: 303801 - RNA, 32 nt, Human
accuggagcggucagagcaggauggccagaga

SEQ ID NO: 303802 - RNA, 23 nt, Human
accuggaggacacgcugcugcag

SEQ ID NO: 303803 - RNA, 32 nt, Human
accuggaggagagugcuggugaauggcaggug

SEQ ID NO: 303804 - RNA, 32 nt, Human
accuggaggagguggugcaggaggcugccggc

SEQ ID NO: 303805 - RNA, 32 nt, Human
accuggaggcagagauugcagugagccgagau

SEQ ID NO: 303806 - RNA, 32 nt, Human
accuggaggcagagguugcagugagucgaggu

SEQ ID NO: 303807 - RNA, 32 nt, Human
accuggagggucagguaacuugccaaacuaaa

SEQ ID NO: 303808 - RNA, 32 nt, Human
accuggaggucugaaaagaggagccagagaag

SEQ ID NO: 303809 - RNA, 32 nt, Human
accuggagguggagguugcagugagccgaggu

SEQ ID NO: 303810 - RNA, 32 nt, Human
accuggaggugggagggcaggagcgucgucuu

SEQ ID NO: 303811 - RNA, 32 nt, Human
accuggaguauuuccccuucugccuuuacagc

SEQ ID NO: 303812 - RNA, 32 nt, Human
accuggaguggggagagcagccuccacggcca

SEQ ID NO: 303813 - RNA, 24 nt, Human
accuggaguuucaaaacaugugaa

SEQ ID NO: 303814 - RNA, 32 nt, Human
accuggaugagaagaauaaaugacacggauac

SEQ ID NO: 303815 - RNA, 32 nt, Human
accuggaugaggaagaugaagaggugcuggaa

SEQ ID NO: 303816 - RNA, 32 nt, Human
accuggaugaucacuaauacuaauucauuuau

SEQ ID NO: 303817 - RNA, 32 nt, Human
accuggaugauucaggagaguguauaugaaug

SEQ ID NO: 303818 - RNA, 22 nt, Human
accuggaugcgcugggcacagg

SEQ ID NO: 303819 - RNA, 32 nt, Human
accuggauggcauggcgccugccaccaaacau

SEQ ID NO: 303820 - RNA, 32 nt, Human
accuggauucugaguuuuucagucuagcccag

SEQ ID NO: 303821 - RNA, 32 nt, Human
accuggauucugugccuaccugcuccaucuaa

SEQ ID NO: 303822 - RNA, 32 nt, Human
accuggcaaaccugccgcaugcugcacacauc

SEQ ID NO: 303823 - RNA, 32 nt, Human
accuggcaacaucacgauuuaagcuaagguug

SEQ ID NO: 303824 - RNA, 32 nt, Human
accuggcaagugguuaucaggauucagugacg

SEQ ID NO: 303825 - RNA, 32 nt, Human
accuggcaaguguagguugcagugagcugaga

SEQ ID NO: 303826 - RNA, 32 nt, Human
accuggcacauucauuuucucaguugaagaag

SEQ ID NO: 303827 - RNA, 32 nt, Human
accuggcacuccuccaagcuuggcacagugag

SEQ ID NO: 303828 - RNA, 32 nt, Human
accuggcagagacaaucgccacccuagaauuc

SEQ ID NO: 303829 - RNA, 32 nt, Human
accuggcagcuauagaauacacuaugugcauu

SEQ ID NO: 303830 - RNA, 32 nt, Human
accuggcaggaggcgggugugugaauagcaua

SEQ ID NO: 303831 - RNA, 32 nt, Human
accuggcaggcagagguugcagugagccaaga

SEQ ID NO: 303832 - RNA, 32 nt, Human
accuggcaggcagaguuugcagugaaccaaga

SEQ ID NO: 303833 - RNA, 32 nt, Human
accuggcaggcggagguugcagugagccgaga

SEQ ID NO: 303834 - RNA, 32 nt, Human
accuggcaggguggccagagaggcuuggacaa

SEQ ID NO: 303835 - RNA, 32 nt, Human
accuggcagguggagguuacagugagccaaga

SEQ ID NO: 303836 - RNA, 32 nt, Human
accuggcagguggagguugcagugaguggaga

SEQ ID NO: 303837 - RNA, 32 nt, Human
accuggcaguggagggaggcugugcugugugu

SEQ ID NO: 303838 - RNA, 32 nt, Human
accuggcaguuggcugcagggccaggucuagg

SEQ ID NO: 303839 - RNA, 32 nt, Human
accuggcaucuucugcccuguucaucuacgga

SEQ ID NO: 303840 - RNA, 19 nt, Human
accuggccaaccugagcca

SEQ ID NO: 303841 - RNA, 32 nt, Human
accuggccaaccugagccaccucuuccuccac

SEQ ID NO: 303842 - RNA, 19 nt, Human
accuggccacccugcagca

SEQ ID NO: 303843 - RNA, 32 nt, Human
accuggccagacucucccuccuguccuguaca

SEQ ID NO: 303844 - RNA, 32 nt, Human
accuggccagcuuccccaagaugugcuccagc

SEQ ID NO: 303845 - RNA, 32 nt, Human
accuggccaugaggacagagcugguaguagag

SEQ ID NO: 303846 - RNA, 19 nt, Human
accuggccaugcuguacca

SEQ ID NO: 303847 - RNA, 32 nt, Human
accuggccccagguggggguuguagugagagc

SEQ ID NO: 303848 - RNA, 32 nt, Human
accuggcccuuccagccccagccuuuggagcg

SEQ ID NO: 303849 - RNA, 32 nt, Human
accuggccgagcuugaggccacaugugaaggg

SEQ ID NO: 303850 - RNA, 21 nt, Human
accuggccgccagccccuuca

SEQ ID NO: 303851 - RNA, 32 nt, Human
accuggccuagugacagagccaggauucaaag

SEQ ID NO: 303852 - RNA, 32 nt, Human
accuggccucacugccagcccaccuccccuac

SEQ ID NO: 303853 - RNA, 32 nt, Human
accuggccuccaggagucgcuguguugggaga

SEQ ID NO: 303854 - RNA, 32 nt, Human
accuggccuccucucgccuggccgccagcccc

SEQ ID NO: 303855 - RNA, 32 nt, Human
accuggccucugcaccugaggguagaaaguca

SEQ ID NO: 303856 - RNA, 32 nt, Human
accuggccugagccuccugaaguugcugcugu

SEQ ID NO: 303857 - RNA, 32 nt, Human
accuggccugcucuucccauguuggccucugc

SEQ ID NO: 303858 - RNA, 32 nt, Human
accuggccugggaaaguacuugccucauguug

SEQ ID NO: 303859 - RNA, 32 nt, Human
accuggccugggaagcaccgucugcccgggcc

SEQ ID NO: 303860 - RNA, 32 nt, Human
accuggccugggagacccaucuggucccugcg

SEQ ID NO: 303861 - RNA, 32 nt, Human
accuggccugggauccuuuccccaaacgcacc

SEQ ID NO: 303862 - RNA, 32 nt, Human
accuggcgaccacccgcccugccuggugcauu

SEQ ID NO: 303863 - RNA, 20 nt, Human
accuggcgcccacuggacca

SEQ ID NO: 303864 - RNA, 32 nt, Human
accuggcuaaggauuuuucuagaaacuguccu

SEQ ID NO: 303865 - RNA, 32 nt, Human
accuggcuacagaccaggacguggcuuguguu

SEQ ID NO: 303866 - RNA, 19 nt, Human
accuggcuacccccuucca

SEQ ID NO: 303867 - RNA, 32 nt, Human
accuggcuacccuuucaguuuuaagccauaau

SEQ ID NO: 303868 - RNA, 32 nt, Human
accuggcuacuguucagcaaguuuacaaagug

SEQ ID NO: 303869 - RNA, 32 nt, Human
accuggcucaauccuccuccaccaccaggggc

SEQ ID NO: 303870 - RNA, 18 nt, Human
accuggcucccggcaacc

SEQ ID NO: 303871 - RNA, 32 nt, Human
accuggcucccggcaaccucaggugccuuccu

SEQ ID NO: 303872 - RNA, 32 nt, Human
accuggcuccgugcucaacccccagcccaccc

SEQ ID NO: 303873 - RNA, 20 nt, Human
accuggcuccugugaaacca

SEQ ID NO: 303874 - RNA, 32 nt, Human
accuggcucgggggauccagguugcagaugaa

SEQ ID NO: 303875 - RNA, 32 nt, Human
accuggcucggggugggagugcagaggcaacc

SEQ ID NO: 303876 - RNA, 32 nt, Human
accuggcucuggcccaggcuagagugcagugg

SEQ ID NO: 303877 - RNA, 21 nt, Human
accuggcucugggccaagcca

SEQ ID NO: 303878 - RNA, 21 nt, Human
accuggcucuguggcgagcca

SEQ ID NO: 303879 - RNA, 32 nt, Human
accuggcugagcugcccaggauucuggcugac

SEQ ID NO: 303880 - RNA, 32 nt, Human
accuggcugccuggagaugguugcugccauug

SEQ ID NO: 303881 - RNA, 32 nt, Human
accuggcugcugucuuaacucguagucugggc

SEQ ID NO: 303882 - RNA, 32 nt, Human
accuggcugggagcugggccaucgcgaugucg

SEQ ID NO: 303883 - RNA, 21 nt, Human
accuggcuguccccagcaccu

SEQ ID NO: 303884 - RNA, 29 nt, Human
accuggcugucuuuaucauccccacaaac

SEQ ID NO: 303885 - RNA, 32 nt, Human
accuggcuguguucccagcugagggagggcug

SEQ ID NO: 303886 - RNA, 18 nt, Human
accuggcuucccaggacc

SEQ ID NO: 303887 - RNA, 21 nt, Human
accuggcuucccugaauccca

SEQ ID NO: 303888 - RNA, 32 nt, Human
accuggcuuccgggagcuucauagaccgauug

SEQ ID NO: 303889 - RNA, 19 nt, Human
accuggcuuccguggacca

SEQ ID NO: 303890 - RNA, 32 nt, Human
accuggcuugccacccacagugcaccacaggc

SEQ ID NO: 303891 - RNA, 32 nt, Human
accuggcuuucaccuccacaguccuuaagagc

SEQ ID NO: 303892 - RNA, 32 nt, Human
accuggcuuugcuuagcuuguugaagaaagua

SEQ ID NO: 303893 - RNA, 32 nt, Human
accuggcuuuucccaucuccccagcauaacca

SEQ ID NO: 303894 - RNA, 32 nt, Human
accugggaacccggggaggggccuggaggaga

SEQ ID NO: 303895 - RNA, 32 nt, Human
accugggaaccuaauuccccagaagcuaaaaa

SEQ ID NO: 303896 - RNA, 32 nt, Human
accugggaagcagaggcuacagugagccaaga

SEQ ID NO: 303897 - RNA, 32 nt, Human
accugggaagcagagguugcagugagccgaga

SEQ ID NO: 303898 - RNA, 32 nt, Human
accugggaagcagaguuugcagugagccaaga

SEQ ID NO: 303899 - RNA, 32 nt, Human
accugggaagccgaaguagcagugagccgaga

SEQ ID NO: 303900 - RNA, 32 nt, Human
accugggaagcgcagguugcagugagcugaga

SEQ ID NO: 303901 - RNA, 32 nt, Human
accugggaagcggagcucgcagugagccgaga

SEQ ID NO: 303902 - RNA, 32 nt, Human
accugggaagucgaggcugcaagugagcugag

SEQ ID NO: 303903 - RNA, 32 nt, Human
accugggaagugcagguugcagugagccaaga

SEQ ID NO: 303904 - RNA, 32 nt, Human
accugggaaguggaagcugcagugagccgaga

SEQ ID NO: 303905 - RNA, 32 nt, Human
accugggaaguggaggcugcagugagcccaga

SEQ ID NO: 303906 - RNA, 32 nt, Human
accugggaaguggaggcugcagugagccgaga

SEQ ID NO: 303907 - RNA, 32 nt, Human
accugggaaucggagguugcagggccaagauc

SEQ ID NO: 303908 - RNA, 32 nt, Human
accugggacaagguguuagaugaauuugaaca

SEQ ID NO: 303909 - RNA, 32 nt, Human
accugggacggcagugaggaugagcaccucua

SEQ ID NO: 303910 - RNA, 32 nt, Human
accugggacuacaggcacgcaccaccaugccu

SEQ ID NO: 303911 - RNA, 32 nt, Human
accugggacuacaggcacucgccaccaugccc

SEQ ID NO: 303912 - RNA, 32 nt, Human
accugggacuacaggugcaugccauuaugcca

SEQ ID NO: 303913 - RNA, 32 nt, Human
accugggacuacaggugcgugccaccacaccc

SEQ ID NO: 303914 - RNA, 32 nt, Human
accugggacuacaggugugcaccaccacacca

SEQ ID NO: 303915 - RNA, 32 nt, Human
accugggacuauaugugcgcaccaccacgccu

SEQ ID NO: 303916 - RNA, 32 nt, Human
accugggacucaauaauacacuugggaauauu

SEQ ID NO: 303917 - RNA, 32 nt, Human
accugggacucugcccaugugcuuuugccugu

SEQ ID NO: 303918 - RNA, 32 nt, Human
accugggagacagaaguuugcagugauccgag

SEQ ID NO: 303919 - RNA, 32 nt, Human
accugggagacagagguugcaaugaaccgaga

SEQ ID NO: 303920 - RNA, 32 nt, Human
accugggagacagagguugcagugagccaaga

SEQ ID NO: 303921 - RNA, 32 nt, Human
accugggagacggagcuugcagugagcugaga

SEQ ID NO: 303922 - RNA, 32 nt, Human
accugggagacggagguugcagugagccaaga

SEQ ID NO: 303923 - RNA, 32 nt, Human
accugggagacggagguugcagugagccauga

SEQ ID NO: 303924 - RNA, 32 nt, Human
accugggagagggauagaggagggagagccag

SEQ ID NO: 303925 - RNA, 32 nt, Human
accugggagagggugagguucagcacaucaca

SEQ ID NO: 303926 - RNA, 32 nt, Human
accugggagauggagauugcagugagcagaga

SEQ ID NO: 303927 - RNA, 32 nt, Human
accugggagauggagguugcagagagccaaga

SEQ ID NO: 303928 - RNA, 32 nt, Human
accugggagauggagguugcagugagccgaga

SEQ ID NO: 303929 - RNA, 32 nt, Human
accugggagcaggagguugcagugagccgagg

SEQ ID NO: 303930 - RNA, 32 nt, Human
accugggagcccccuggcuugcacugaacccu

SEQ ID NO: 303931 - RNA, 32 nt, Human
accugggagccggaggcugcagugagccaaga

SEQ ID NO: 303932 - RNA, 32 nt, Human
accugggagccugagguugcagugagccaaga

SEQ ID NO: 303933 - RNA, 32 nt, Human
accugggaggagaagguugcagugagcugaga

SEQ ID NO: 303934 - RNA, 32 nt, Human
accugggaggaggagguugcagugagcugaga

SEQ ID NO: 303935 - RNA, 32 nt, Human
accugggaggcaaagguugcagugagcugaga

SEQ ID NO: 303936 - RNA, 32 nt, Human
accugggaggcagaaguugcagugaaacaagu

SEQ ID NO: 303937 - RNA, 32 nt, Human
accugggaggcagaaguugcagugagccgaga

SEQ ID NO: 303938 - RNA, 32 nt, Human
accugggaggcagaaguugcagugagcugaga

SEQ ID NO: 303939 - RNA, 32 nt, Human
accugggaggcagaaguuguggugagccgaga

SEQ ID NO: 303940 - RNA, 32 nt, Human
accugggaggcagagauugcagugagccaaga

SEQ ID NO: 303941 - RNA, 32 nt, Human
accugggaggcagagauugcagugagccgaga

SEQ ID NO: 303942 - RNA, 32 nt, Human
accugggaggcagagauugcagugagcugaga

SEQ ID NO: 303943 - RNA, 32 nt, Human
accugggaggcagagcuugcaguaagccgaga

SEQ ID NO: 303944 - RNA, 32 nt, Human
accugggaggcagagcuugcagugagccaaga

SEQ ID NO: 303945 - RNA, 32 nt, Human
accugggaggcagagcuugcagugagccgaga

SEQ ID NO: 303946 - RNA, 32 nt, Human
accugggaggcagagcuugcagugagccuaga

SEQ ID NO: 303947 - RNA, 32 nt, Human
accugggaggcagagcuugcagugagcugaga

SEQ ID NO: 303948 - RNA, 32 nt, Human
accugggaggcagagcuugcagugaguggaga

SEQ ID NO: 303949 - RNA, 32 nt, Human
accugggaggcagagcuugcagugauuggaga

SEQ ID NO: 303950 - RNA, 32 nt, Human
accugggaggcagagggugcaguaagcugaga

SEQ ID NO: 303951 - RNA, 32 nt, Human
accugggaggcagaggugagcugagaucgcgu

SEQ ID NO: 303952 - RNA, 32 nt, Human
accugggaggcagagguuacaaugagccgaga

SEQ ID NO: 303953 - RNA, 32 nt, Human
accugggaggcagagguuacagugagccgaga

SEQ ID NO: 303954 - RNA, 32 nt, Human
accugggaggcagagguugcaaugagccaaga

SEQ ID NO: 303955 - RNA, 32 nt, Human
accugggaggcagagguugcaaugagcugaga

SEQ ID NO: 303956 - RNA, 32 nt, Human
accugggaggcagagguugcagggaaccuaga

SEQ ID NO: 303957 - RNA, 32 nt, Human
accugggaggcagagguugcaguaagccaaga

SEQ ID NO: 303958 - RNA, 32 nt, Human
accugggaggcagagguugcaguaagcuaaga

SEQ ID NO: 303959 - RNA, 32 nt, Human
accugggaggcagagguugcaguaagcugaga

SEQ ID NO: 303960 - RNA, 32 nt, Human
accugggaggcagagguugcagugaacagaga

SEQ ID NO: 303961 - RNA, 32 nt, Human
accugggaggcagagguugcagugaaccaaga

SEQ ID NO: 303962 - RNA, 32 nt, Human
accugggaggcagagguugcagugaaccuaga

SEQ ID NO: 303963 - RNA, 32 nt, Human
accugggaggcagagguugcagugaacugaua

SEQ ID NO: 303964 - RNA, 32 nt, Human
accugggaggcagagguugcagugagccaaga

SEQ ID NO: 303965 - RNA, 32 nt, Human
accugggaggcagagguugcagugagccaaua

SEQ ID NO: 303966 - RNA, 32 nt, Human
accugggaggcagagguugcagugagccgaga

SEQ ID NO: 303967 - RNA, 32 nt, Human
accugggaggcagagguugcagugagccgaua

SEQ ID NO: 303968 - RNA, 32 nt, Human
accugggaggcagagguugcagugagcuaaga

SEQ ID NO: 303969 - RNA, 32 nt, Human
accugggaggcagagguugcagugagcucaga

SEQ ID NO: 303970 - RNA, 32 nt, Human
accugggaggcagagguugcagugagcugaga

SEQ ID NO: 303971 - RNA, 32 nt, Human
accugggaggcagagguugcagugaggugaca

SEQ ID NO: 303972 - RNA, 32 nt, Human
accugggaggcagagguugcagugauccaaga

SEQ ID NO: 303973 - RNA, 32 nt, Human
accugggaggcagagguugcagugauccgaga

SEQ ID NO: 303974 - RNA, 32 nt, Human
accugggaggcagagguugccgugagcugaga

SEQ ID NO: 303975 - RNA, 32 nt, Human
accugggaggcagagguugcgguaagccgaga

SEQ ID NO: 303976 - RNA, 32 nt, Human
accugggaggcagagguuguagcgagccaaga

SEQ ID NO: 303977 - RNA, 32 nt, Human
accugggaggcagagguuguagugagcugaga

SEQ ID NO: 303978 - RNA, 32 nt, Human
accugggaggcagagguuguggugagccaaca

SEQ ID NO: 303979 - RNA, 32 nt, Human
accugggaggcagagguuguggugagcuaaga

SEQ ID NO: 303980 - RNA, 32 nt, Human
accugggaggcagagguuguggugagcugaga

SEQ ID NO: 303981 - RNA, 32 nt, Human
accugggaggcagagguuucagugagccaaga

SEQ ID NO: 303982 - RNA, 32 nt, Human
accugggaggcagagguuucagugagcccaga

SEQ ID NO: 303983 - RNA, 32 nt, Human
accugggaggcagagucugcagugagccgaga

SEQ ID NO: 303984 - RNA, 32 nt, Human
accugggaggcagaguuuacagugagccgaga

SEQ ID NO: 303985 - RNA, 32 nt, Human
accugggaggcagaguuugcagugagccgaga

SEQ ID NO: 303986 - RNA, 32 nt, Human
accugggaggcagaguuugcagugagcggaga

SEQ ID NO: 303987 - RNA, 32 nt, Human
accugggaggcagauguugcagugagccgaga

SEQ ID NO: 303988 - RNA, 32 nt, Human
accugggaggcagauguuguggugagccgaga

SEQ ID NO: 303989 - RNA, 32 nt, Human
accugggaggcagcgguugcaguaagccaaga

SEQ ID NO: 303990 - RNA, 32 nt, Human
accugggaggcaggcaggcaugcaugugggcc

SEQ ID NO: 303991 - RNA, 32 nt, Human
accugggaggcagggguugcagugagcugaga

SEQ ID NO: 303992 - RNA, 32 nt, Human
accugggaggcaguuugcagugagcugagauc

SEQ ID NO: 303993 - RNA, 32 nt, Human
accugggaggccaagguugcagugagccgaga

SEQ ID NO: 303994 - RNA, 32 nt, Human
accugggaggcgaagauugcagugagcugaaa

SEQ ID NO: 303995 - RNA, 32 nt, Human
accugggaggcgaagguugcagugagccaaga

SEQ ID NO: 303996 - RNA, 32 nt, Human
accugggaggcgaagguugcagugagcugaga

SEQ ID NO: 303997 - RNA, 32 nt, Human
accugggaggcgcagguugcagggaggcggag

SEQ ID NO: 303998 - RNA, 32 nt, Human
accugggaggcggaaguugcagugagccaaga

SEQ ID NO: 303999 - RNA, 32 nt, Human
accugggaggcggaaguugcagugagccgaga

SEQ ID NO: 304000 - RNA, 32 nt, Human
accugggaggcggaaguugcagugagcugaga

SEQ ID NO: 304001 - RNA, 32 nt, Human
accugggaggcggagaguacagugagccaaga

SEQ ID NO: 304002 - RNA, 32 nt, Human
accugggaggcggagauugcagugaaccaaga

SEQ ID NO: 304003 - RNA, 32 nt, Human
accugggaggcggagauugcagugagccgaga

SEQ ID NO: 304004 - RNA, 32 nt, Human
accugggaggcggagcuugcagugagccaagg

SEQ ID NO: 304005 - RNA, 32 nt, Human
accugggaggcggagcuugcagugagcccaga

SEQ ID NO: 304006 - RNA, 32 nt, Human
accugggaggcggagcuugcagugagccgaga

SEQ ID NO: 304007 - RNA, 32 nt, Human
accugggaggcggagcuugcagugagcugaaa

SEQ ID NO: 304008 - RNA, 32 nt, Human
accugggaggcggagcuugcagugagcugaga

SEQ ID NO: 304009 - RNA, 32 nt, Human
accugggaggcggaggagguugcagugaacug

SEQ ID NO: 304010 - RNA, 32 nt, Human
accugggaggcggaggcugcagugagccgaga

SEQ ID NO: 304011 - RNA, 32 nt, Human
accugggaggcggaggcugcagugagcuggga

SEQ ID NO: 304012 - RNA, 32 nt, Human
accugggaggcggagguugcaaugagccgaga

SEQ ID NO: 304013 - RNA, 32 nt, Human
accugggaggcggagguugcagggagcugaga

SEQ ID NO: 304014 - RNA, 32 nt, Human
accugggaggcggagguugcaguaagcccaga

SEQ ID NO: 304015 - RNA, 32 nt, Human
accugggaggcggagguugcagucagccaaga

SEQ ID NO: 304016 - RNA, 25 nt, Human
accugggaggcggagguugcaguga

SEQ ID NO: 304017 - RNA, 32 nt, Human
accugggaggcggagguugcagugaaccaaga

SEQ ID NO: 304018 - RNA, 32 nt, Human
accugggaggcggagguugcagugagccaaaa

SEQ ID NO: 304019 - RNA, 32 nt, Human
accugggaggcggagguugcagugagccaaga

SEQ ID NO: 304020 - RNA, 32 nt, Human
accugggaggcggagguugcagugagccacug

SEQ ID NO: 304021 - RNA, 32 nt, Human
accugggaggcggagguugcagugagccgaga

SEQ ID NO: 304022 - RNA, 32 nt, Human
accugggaggcggagguugcagugagccgcga

SEQ ID NO: 304023 - RNA, 32 nt, Human
accugggaggcggagguugcagugagcgagau

SEQ ID NO: 304024 - RNA, 32 nt, Human
accugggaggcggagguugcagugagcggaga

SEQ ID NO: 304025 - RNA, 32 nt, Human
accugggaggcggagguugcagugagcuaaga

SEQ ID NO: 304026 - RNA, 32 nt, Human
accugggaggcggagguugcagugagcugaaa

SEQ ID NO: 304027 - RNA, 32 nt, Human
accugggaggcggagguugcagugagcugaga

SEQ ID NO: 304028 - RNA, 32 nt, Human
accugggaggcggagguugcagugagcuuaga

SEQ ID NO: 304029 - RNA, 32 nt, Human
accugggaggcggagguugcagugagucgaga

SEQ ID NO: 304030 - RNA, 32 nt, Human
accugggaggcggagguugcagugaguugaga

SEQ ID NO: 304031 - RNA, 32 nt, Human
accugggaggcggagguugcaguggccgagau

SEQ ID NO: 304032 - RNA, 32 nt, Human
accugggaggcggagguugccgugagccgaga

SEQ ID NO: 304033 - RNA, 32 nt, Human
accugggaggcggagguugcggucagcugaga

SEQ ID NO: 304034 - RNA, 32 nt, Human
accugggaggcggagguugcggugagcugaga

SEQ ID NO: 304035 - RNA, 32 nt, Human
accugggaggcggagguugcugugagcugaga

SEQ ID NO: 304036 - RNA, 32 nt, Human
accugggaggcggagguuguagugagccaaga

SEQ ID NO: 304037 - RNA, 32 nt, Human
accugggaggcggagguuguagugagccaagg

SEQ ID NO: 304038 - RNA, 32 nt, Human
accugggaggcggagguuguagugagccgaga

SEQ ID NO: 304039 - RNA, 32 nt, Human
accugggaggcggagguuguggugagccaaga

SEQ ID NO: 304040 - RNA, 32 nt, Human
accugggaggcggagguuguggugagccgaga

SEQ ID NO: 304041 - RNA, 32 nt, Human
accugggaggcugaaguugcagugagccgaga

SEQ ID NO: 304042 - RNA, 32 nt, Human
accugggaggcugagcuugcagugagcugaga

SEQ ID NO: 304043 - RNA, 32 nt, Human
accugggaggcugaggcaggagaaucacuuga

SEQ ID NO: 304044 - RNA, 32 nt, Human
accugggaggcugaggcaggagaaucauuugc

SEQ ID NO: 304045 - RNA, 32 nt, Human
accugggaggcugaggcaggagaaucgcuuga

SEQ ID NO: 304046 - RNA, 32 nt, Human
accugggaggcugaggcaggagaaucucuuga

SEQ ID NO: 304047 - RNA, 32 nt, Human
accugggaggcugaggcgggagaaucaccuga

SEQ ID NO: 304048 - RNA, 32 nt, Human
accugggaggcugagguaugaggauugcuuga

SEQ ID NO: 304049 - RNA, 32 nt, Human
accugggaggcugaggugggaggaucgcuuga

SEQ ID NO: 304050 - RNA, 32 nt, Human
accugggagggcggagguugcagugagccagg

SEQ ID NO: 304051 - RNA, 32 nt, Human
accugggagggggagguugccgugagcugagc

SEQ ID NO: 304052 - RNA, 32 nt, Human
accugggagguacagguugcagugagcccaga

SEQ ID NO: 304053 - RNA, 32 nt, Human
accugggagguagaaguugcagugagccaaaa

SEQ ID NO: 304054 - RNA, 32 nt, Human
accugggagguagagguugcacugagccgaga

SEQ ID NO: 304055 - RNA, 32 nt, Human
accugggagguagagguugcagugagccaaua

SEQ ID NO: 304056 - RNA, 32 nt, Human
accugggagguagagguugcagugagccgaga

SEQ ID NO: 304057 - RNA, 32 nt, Human
accugggaggucaaagcggcagugagcuaaaa

SEQ ID NO: 304058 - RNA, 32 nt, Human
accugggaggucaagauugcagugagcuauga

SEQ ID NO: 304059 - RNA, 32 nt, Human
accugggagguggaagcugcagugagccaaga

SEQ ID NO: 304060 - RNA, 32 nt, Human
accugggagguggaaguugcagugagccaaga

SEQ ID NO: 304061 - RNA, 32 nt, Human
accugggagguggaaguugcagugagccgaga

SEQ ID NO: 304062 - RNA, 32 nt, Human
accugggagguggaaguugcagugagcugaga

SEQ ID NO: 304063 - RNA, 32 nt, Human
accugggagguggagacugcagugagccgaga

SEQ ID NO: 304064 - RNA, 32 nt, Human
accugggagguggagauugcagugagcccaga

SEQ ID NO: 304065 - RNA, 32 nt, Human
accugggagguggagauugcagugagucaaga

SEQ ID NO: 304066 - RNA, 32 nt, Human
accugggagguggagcuugcagugaaccgaga

SEQ ID NO: 304067 - RNA, 32 nt, Human
accugggagguggagcuugcagugagccgaga

SEQ ID NO: 304068 - RNA, 32 nt, Human
accugggagguggagcuugcagugagcggaca

SEQ ID NO: 304069 - RNA, 32 nt, Human
accugggagguggagcuugcagugagcugaga

SEQ ID NO: 304070 - RNA, 32 nt, Human
  misc_feature (22)..(22): n is a, c, g or u
accugggagguggagcuugcanugagccaagg

SEQ ID NO: 304071 - RNA, 32 nt, Human
accugggagguggaggcagugagcugagaucg

SEQ ID NO: 304072 - RNA, 32 nt, Human
accugggagguggaggcuacagugagcugaga

SEQ ID NO: 304073 - RNA, 32 nt, Human
accugggagguggaggcugcagugaaccgaga

SEQ ID NO: 304074 - RNA, 32 nt, Human
accugggagguggagggagacaggagagaaac

SEQ ID NO: 304075 - RNA, 32 nt, Human
accugggagguggaggggaggcugcagugagc

SEQ ID NO: 304076 - RNA, 32 nt, Human
accugggagguggagguuacagugagccgaga

SEQ ID NO: 304077 - RNA, 32 nt, Human
accugggagguggagguuauagugagccuaga

SEQ ID NO: 304078 - RNA, 32 nt, Human
accugggagguggagguugaggugagcucaga

SEQ ID NO: 304079 - RNA, 32 nt, Human
accugggagguggagguugcagcgagccaaga

SEQ ID NO: 304080 - RNA, 32 nt, Human
accugggagguggagguugcaguaagccaaga

SEQ ID NO: 304081 - RNA, 32 nt, Human
accugggagguggagguugcaguaagcugaga

SEQ ID NO: 304082 - RNA, 25 nt, Human
accugggagguggagguugcaguga

SEQ ID NO: 304083 - RNA, 32 nt, Human
accugggagguggagguugcagugacccgaga

SEQ ID NO: 304084 - RNA, 32 nt, Human
accugggagguggagguugcagugagcagaga

SEQ ID NO: 304085 - RNA, 32 nt, Human
accugggagguggagguugcagugagccaaga

SEQ ID NO: 304086 - RNA, 32 nt, Human
accugggagguggagguugcagugagccgaga

SEQ ID NO: 304087 - RNA, 32 nt, Human
accugggagguggagguugcagugagccgagc

SEQ ID NO: 304088 - RNA, 32 nt, Human
accugggagguggagguugcagugagcugaga

SEQ ID NO: 304089 - RNA, 32 nt, Human
accugggagguggagguugcagugagcugagc

SEQ ID NO: 304090 - RNA, 32 nt, Human
accugggagguggagguugcagugagcugagg

SEQ ID NO: 304091 - RNA, 32 nt, Human
accugggagguggagguugcagugagcuguga

SEQ ID NO: 304092 - RNA, 32 nt, Human
accugggagguggagguugcagugagucgaga

SEQ ID NO: 304093 - RNA, 32 nt, Human
accugggagguggagguugcagugaguugaga

SEQ ID NO: 304094 - RNA, 32 nt, Human
accugggagguggagguugcagugggccaaga

SEQ ID NO: 304095 - RNA, 32 nt, Human
accugggagguggagguugcagugggcuaaga

SEQ ID NO: 304096 - RNA, 32 nt, Human
accugggagguggagguugcagugggcugaga

SEQ ID NO: 304097 - RNA, 32 nt, Human
accugggagguggagguugcauugagccaaga

SEQ ID NO: 304098 - RNA, 32 nt, Human
accugggagguggagguugcauugagcugaga

SEQ ID NO: 304099 - RNA, 32 nt, Human
accugggagguggagguugcgagaucacacca

SEQ ID NO: 304100 - RNA, 25 nt, Human
accugggagguggagguugcgguga

SEQ ID NO: 304101 - RNA, 32 nt, Human
accugggagguggagguugcggugagccaaga

SEQ ID NO: 304102 - RNA, 32 nt, Human
accugggagguggagguugcggugagccgaga

SEQ ID NO: 304103 - RNA, 32 nt, Human
accugggagguggagguugcggugagcugaga

SEQ ID NO: 304104 - RNA, 32 nt, Human
accugggagguggagguugcugugagcugaca

SEQ ID NO: 304105 - RNA, 32 nt, Human
accugggagguggagguugcugugagcugaga

SEQ ID NO: 304106 - RNA, 32 nt, Human
accugggagguggagguuguggugagccaaua

SEQ ID NO: 304107 - RNA, 32 nt, Human
accugggagguggagguuguggugaggcgaga

SEQ ID NO: 304108 - RNA, 32 nt, Human
accugggagguggagguuucagugagccaaga

SEQ ID NO: 304109 - RNA, 32 nt, Human
accugggagguggaguugcagugagccgagau

SEQ ID NO: 304110 - RNA, 32 nt, Human
accugggagguggauguugcagugagcugaga

SEQ ID NO: 304111 - RNA, 32 nt, Human
accugggagguggggguuucagugagcugaga

SEQ ID NO: 304112 - RNA, 32 nt, Human
accugggagguggugguugcagugagcugaga

SEQ ID NO: 304113 - RNA, 32 nt, Human
accugggagguugaggcugcagugagcugugu

SEQ ID NO: 304114 - RNA, 32 nt, Human
accugggaguuagagguugcagugagcugaga

SEQ ID NO: 304115 - RNA, 32 nt, Human
accugggaguuggagguugcagugaaacgaga

SEQ ID NO: 304116 - RNA, 32 nt, Human
accugggaguuugaagcugcagugagccauga

SEQ ID NO: 304117 - RNA, 32 nt, Human
accugggaucuugagauacccaggaagggagg

SEQ ID NO: 304118 - RNA, 32 nt, Human
accugggaugacaggcgccugccaccacgccc

SEQ ID NO: 304119 - RNA, 32 nt, Human
accugggaugcugaggugggaggaucacucaa

SEQ ID NO: 304120 - RNA, 32 nt, Human
accugggaugguaggcacgcaccaccaugcca

SEQ ID NO: 304121 - RNA, 32 nt, Human
accugggauguggagguugcagugaacugagg

SEQ ID NO: 304122 - RNA, 32 nt, Human
accugggauguggagguugcagugagccaaga

SEQ ID NO: 304123 - RNA, 32 nt, Human
accugggauuacaggcaugcaccaccaugccc

SEQ ID NO: 304124 - RNA, 32 nt, Human
accugggauuacaggcaugugccaccacaccu

SEQ ID NO: 304125 - RNA, 32 nt, Human
accugggauuacaggcaugugccaccacgccc

SEQ ID NO: 304126 - RNA, 32 nt, Human
accugggauuacaggcauguuucaccauguug

SEQ ID NO: 304127 - RNA, 32 nt, Human
accugggauuacaggugcacaccaccacgcuu

SEQ ID NO: 304128 - RNA, 32 nt, Human
accugggcaaagacagagaagcucccagaagg

SEQ ID NO: 304129 - RNA, 32 nt, Human
accugggcaaaguggccagguggaugaaguua

SEQ ID NO: 304130 - RNA, 32 nt, Human
accugggcaaucugcaugugaugccaaccaag

SEQ ID NO: 304131 - RNA, 32 nt, Human
accugggcaauguggggagaccccaucucuac

SEQ ID NO: 304132 - RNA, 32 nt, Human
accugggcacacacguagacaagggcagcuau

SEQ ID NO: 304133 - RNA, 32 nt, Human
accugggcaccggccagcugcgagacgugacu

SEQ ID NO: 304134 - RNA, 32 nt, Human
accugggcagcuuggaccuggucauccucuac

SEQ ID NO: 304135 - RNA, 32 nt, Human
accugggcaggcgagaguaguacuggagggcc

SEQ ID NO: 304136 - RNA, 32 nt, Human
accugggccagccccuuguccucugccuucug

SEQ ID NO: 304137 - RNA, 32 nt, Human
accugggcccaagucucucaucagcccccaau

SEQ ID NO: 304138 - RNA, 32 nt, Human
accugggcccaggaguugcaagucucugcuuc

SEQ ID NO: 304139 - RNA, 32 nt, Human
accugggcccggagaagguggagggagacgag

SEQ ID NO: 304140 - RNA, 32 nt, Human
accugggcccuggccagggcucuaggggccgg

SEQ ID NO: 304141 - RNA, 32 nt, Human
accugggcccugucucccagccacuuucccuc

SEQ ID NO: 304142 - RNA, 18 nt, Human
accugggccgcccggcag

SEQ ID NO: 304143 - RNA, 32 nt, Human
accugggccucccagcccagcccagccugaga

SEQ ID NO: 304144 - RNA, 32 nt, Human
accugggccucccggguucaagcaauucuguc

SEQ ID NO: 304145 - RNA, 32 nt, Human
accugggccugcauuccauccgcucugcagcc

SEQ ID NO: 304146 - RNA, 32 nt, Human
accugggccuggcugcucagaugcugcuggaa

SEQ ID NO: 304147 - RNA, 32 nt, Human
accugggcggcagagguugcagugagucaaga

SEQ ID NO: 304148 - RNA, 32 nt, Human
accugggcuacauuccuaacucauauuaacag

SEQ ID NO: 304149 - RNA, 32 nt, Human
accugggcucaagcaauccucccgcuucagcc

SEQ ID NO: 304150 - RNA, 32 nt, Human
accugggcucaagugauccgccugccucuacc

SEQ ID NO: 304151 - RNA, 32 nt, Human
accugggcucaagugauccuucugccucagcc

SEQ ID NO: 304152 - RNA, 32 nt, Human
accugggcucaagugauucucccaccucagcc

SEQ ID NO: 304153 - RNA, 32 nt, Human
accugggcuccacguccagccugggaccuggc

SEQ ID NO: 304154 - RNA, 32 nt, Human
accugggcuccugccacacgugggaccaccag

SEQ ID NO: 304155 - RNA, 32 nt, Human
accugggcuggccucaguugaaggaucaugca

SEQ ID NO: 304156 - RNA, 32 nt, Human
accugggcuguggcugagacaauaaugaggcc

SEQ ID NO: 304157 - RNA, 32 nt, Human
accuggggaagagcagcagcagcagcggcggc

SEQ ID NO: 304158 - RNA, 32 nt, Human
accuggggaaguggggcuggaggcucugcccc

SEQ ID NO: 304159 - RNA, 32 nt, Human
accuggggagaaaguugagugucaggggacau

SEQ ID NO: 304160 - RNA, 32 nt, Human
accuggggaggcacagcagccaaguggggagg

SEQ ID NO: 304161 - RNA, 32 nt, Human
accuggggauucagcaacagguuuccacaggg

SEQ ID NO: 304162 - RNA, 32 nt, Human
accuggggauuuuaguaagugugucuuccuag

SEQ ID NO: 304163 - RNA, 32 nt, Human
accuggggauuuucacagugugcuccagaugg

SEQ ID NO: 304164 - RNA, 32 nt, Human
accuggggcaagccccuuccccucucugggcc

SEQ ID NO: 304165 - RNA, 32 nt, Human
accuggggccacucucccacccucucgaucug

SEQ ID NO: 304166 - RNA, 32 nt, Human
accuggggccugacgucagcaggauggggccg

SEQ ID NO: 304167 - RNA, 32 nt, Human
accuggggcgagaccgggugacuguggcagug

SEQ ID NO: 304168 - RNA, 32 nt, Human
accuggggcucaacaaagccugaaagaagaaa

SEQ ID NO: 304169 - RNA, 32 nt, Human
accuggggcucugaggccccuggggaggcugg

SEQ ID NO: 304170 - RNA, 32 nt, Human
accuggggcugccucacccucucuccagaccc

SEQ ID NO: 304171 - RNA, 32 nt, Human
accuggggcuugguuucccugcccugggcuca

SEQ ID NO: 304172 - RNA, 32 nt, Human
accugggguugggggacacagacgcgagagag

SEQ ID NO: 304173 - RNA, 32 nt, Human
accugggguuuccgacuugcagccaggaaaga

SEQ ID NO: 304174 - RNA, 18 nt, Human
accuggguccccacgcag

SEQ ID NO: 304175 - RNA, 32 nt, Human
accuggguccccugcaaccucccaucaaagga

SEQ ID NO: 304176 - RNA, 32 nt, Human
accuggguccgggaguuggggacagcagaacg

SEQ ID NO: 304177 - RNA, 32 nt, Human
accugggucuggggucucaggcgcaaacugga

SEQ ID NO: 304178 - RNA, 32 nt, Human
accugggugaaauauaccaaauucugcaucuc

SEQ ID NO: 304179 - RNA, 32 nt, Human
accugggugcagcuucauggggugguucuggc

SEQ ID NO: 304180 - RNA, 32 nt, Human
accugggugcucuggaaacacugcaaagacug

SEQ ID NO: 304181 - RNA, 32 nt, Human
accuggguggccagggccucccucucuguuac

SEQ ID NO: 304182 - RNA, 32 nt, Human
accuggguggucgaggcugcagugagccgaga

SEQ ID NO: 304183 - RNA, 32 nt, Human
accuggguucaagugauccucccaccucagcu

SEQ ID NO: 304184 - RNA, 32 nt, Human
accuggguucaagugauccucucaccucagcc

SEQ ID NO: 304185 - RNA, 32 nt, Human
accuggguucuggaccugaucugccacuucaa

SEQ ID NO: 304186 - RNA, 32 nt, Human
accugguaaggugcuucuuccucuuuuccagg

SEQ ID NO: 304187 - RNA, 32 nt, Human
accugguacccagugauccccaccccaggauc

SEQ ID NO: 304188 - RNA, 32 nt, Human
accugguacuacaggcgcgugccaccacaccu

SEQ ID NO: 304189 - RNA, 32 nt, Human
accugguagagaaagagaggucagaaauagca

SEQ ID NO: 304190 - RNA, 32 nt, Human
accugguaggcagagguugcagugagccgagu

SEQ ID NO: 304191 - RNA, 32 nt, Human
accugguaggcagagguuguagugagccgagg

SEQ ID NO: 304192 - RNA, 32 nt, Human
accugguagguggagguuucauugagccacga

SEQ ID NO: 304193 - RNA, 32 nt, Human
accugguauaugccaugcugggaggccacuga

SEQ ID NO: 304194 - RNA, 32 nt, Human
accugguauuaggagcucagaauggaaugcau

SEQ ID NO: 304195 - RNA, 22 nt, Human
accugguauuuccacucucaca

SEQ ID NO: 304196 - RNA, 32 nt, Human
accuggucacccaggcugcagaaacaaccgca

SEQ ID NO: 304197 - RNA, 32 nt, Human
accuggucagccagcguugcaaagagggauag

SEQ ID NO: 304198 - RNA, 19 nt, Human
accuggucaggugguccca

SEQ ID NO: 304199 - RNA, 32 nt, Human
accuggucccccgacucuccccaggcccccgg

SEQ ID NO: 304200 - RNA, 32 nt, Human
accuggucccucuggagguugcgguggcugaa

SEQ ID NO: 304201 - RNA, 32 nt, Human
accugguccucuugagguuauauuguggaugu

SEQ ID NO: 304202 - RNA, 32 nt, Human
accuggucucccagcccugcgggcagaauggg

SEQ ID NO: 304203 - RNA, 32 nt, Human
accuggucucucuagggccugcccugagcuca

SEQ ID NO: 304204 - RNA, 32 nt, Human
accuggucuggauccaguugagcagcacagca

SEQ ID NO: 304205 - RNA, 32 nt, Human
accuggucuugcggcuguggccaccgccggcc

SEQ ID NO: 304206 - RNA, 32 nt, Human
accuggugcccagguggaggugcagugggggu

SEQ ID NO: 304207 - RNA, 32 nt, Human
accuggugccuuuuuaaauaaauugcugaaau

SEQ ID NO: 304208 - RNA, 32 nt, Human
accugguggaggaugcugcggcaggugcuucg

SEQ ID NO: 304209 - RNA, 32 nt, Human
accuggugggcauagccagagcuguucgaacc

SEQ ID NO: 304210 - RNA, 32 nt, Human
accugguggggauguggagaaccuuugugucu

SEQ ID NO: 304211 - RNA, 23 nt, Human
accuggugggggaugcaugggaa

SEQ ID NO: 304212 - RNA, 32 nt, Human
accugguggugcuggccagggaggaugcugga

SEQ ID NO: 304213 - RNA, 32 nt, Human
accuggugucucccacugugagcccagcuguc

SEQ ID NO: 304214 - RNA, 29 nt, Human
accuggugucuguguauugccuguguuug

SEQ ID NO: 304215 - RNA, 32 nt, Human
accuggugugggaugggagaacuccgcugaga

SEQ ID NO: 304216 - RNA, 32 nt, Human
accuggugugugggacacccucuccuucaccg

SEQ ID NO: 304217 - RNA, 32 nt, Human
accugguuagggacugacucaaagacccugag

SEQ ID NO: 304218 - RNA, 32 nt, Human
accugguuaugaauucucaaaagagaaagcag

SEQ ID NO: 304219 - RNA, 32 nt, Human
accugguucaucccaacucucuuccagcccuu

SEQ ID NO: 304220 - RNA, 32 nt, Human
accugguuggccggggaagcuguaggggugga

SEQ ID NO: 304221 - RNA, 32 nt, Human
accugguuuagcacuggcauccugaacaguua

SEQ ID NO: 304222 - RNA, 32 nt, Human
accugguuuauacaacaucugccuucuccaaa

SEQ ID NO: 304223 - RNA, 32 nt, Human
accugguuuggucagugcaguugugcaaucug

SEQ ID NO: 304224 - RNA, 24 nt, Human
accugguuuucuccacuccacaca

SEQ ID NO: 304225 - RNA, 32 nt, Human
accuguaaaaggaaauaacaagagcacuuacu

SEQ ID NO: 304226 - RNA, 32 nt, Human
accuguaaacucuggccccuugcccaccugaa

SEQ ID NO: 304227 - RNA, 32 nt, Human
accuguaaggcggagguugcagugagccgagu

SEQ ID NO: 304228 - RNA, 22 nt, Human
accuguaagucccagcuacuca

SEQ ID NO: 304229 - RNA, 32 nt, Human
accuguaaucacugcacuccaaccuggcaaca

SEQ ID NO: 304230 - RNA, 21 nt, Human
accuguaaucccagcuaccca

SEQ ID NO: 304231 - RNA, 21 nt, Human
accuguaaucccagcuacuca

SEQ ID NO: 304232 - RNA, 32 nt, Human
accuguaauuccagcacuuugugaggcugagg

SEQ ID NO: 304233 - RNA, 32 nt, Human
accuguacaacgacucugccucuuagaugaua

SEQ ID NO: 304234 - RNA, 32 nt, Human
accuguacacacacagacacacaagcagacac

SEQ ID NO: 304235 - RNA, 32 nt, Human
accuguaccagcugcccagcugccucccuucu

SEQ ID NO: 304236 - RNA, 32 nt, Human
accuguaccccagcuguuccggaggcugaggc

SEQ ID NO: 304237 - RNA, 20 nt, Human
accuguacgccaacacggug

SEQ ID NO: 304238 - RNA, 32 nt, Human
accuguacucccagcacuucaggaagcugagg

SEQ ID NO: 304239 - RNA, 32 nt, Human
accuguacuguauucuuggucaucucaaaugg

SEQ ID NO: 304240 - RNA, 32 nt, Human
accuguacuuccccugccacccugcacaccuc

SEQ ID NO: 304241 - RNA, 32 nt, Human
accuguagggaaaugaguguucccuggaacaa

SEQ ID NO: 304242 - RNA, 32 nt, Human
accuguaguagucccagcuacaugggaagcug

SEQ ID NO: 304243 - RNA, 21 nt, Human
accuguaucuucuuccaagcc

SEQ ID NO: 304244 - RNA, 32 nt, Human
accuguauguaaucccaaauacucgggaggcu

SEQ ID NO: 304245 - RNA, 32 nt, Human
accuguauuuauuucaaagaugcuaauuugua

SEQ ID NO: 304246 - RNA, 32 nt, Human
accuguauuucaguaggaccuggguagggauu

SEQ ID NO: 304247 - RNA, 32 nt, Human
accugucaaacugugugaaaccugccaaucug

SEQ ID NO: 304248 - RNA, 32 nt, Human
accugucaacucugcgcgcucccagguucuug

SEQ ID NO: 304249 - RNA, 32 nt, Human
accugucaagaguucagaucaaaguugcgcug

SEQ ID NO: 304250 - RNA, 32 nt, Human
accugucacccuggcccuucucugcuuggaug

SEQ ID NO: 304251 - RNA, 32 nt, Human
accugucacugcaaaugcuuugucucugggca

SEQ ID NO: 304252 - RNA, 17 nt, Human
accugucaggguaugac

SEQ ID NO: 304253 - RNA, 32 nt, Human
accuguccaaggguaggcaaccaccuucaccu

SEQ ID NO: 304254 - RNA, 32 nt, Human
accuguccaggccaggaggcugguggaccuga

SEQ ID NO: 304255 - RNA, 32 nt, Human
accuguccccacccuccacucagcuguccugc

SEQ ID NO: 304256 - RNA, 32 nt, Human
accuguccccuccacugggcagugguggucag

SEQ ID NO: 304257 - RNA, 32 nt, Human
accuguccccucgaggcuucugaccuuugauc

SEQ ID NO: 304258 - RNA, 32 nt, Human
accugucccucuccuauguggcagcuggggag

SEQ ID NO: 304259 - RNA, 32 nt, Human
accugucccugagaaggacccugugccccaag

SEQ ID NO: 304260 - RNA, 32 nt, Human
accugucccugccugcucccagcccacucauc

SEQ ID NO: 304261 - RNA, 32 nt, Human
accuguccgagaagguugcaagaagaugccac

SEQ ID NO: 304262 - RNA, 32 nt, Human
accuguccuagcaggaucugcccacaccucgg

SEQ ID NO: 304263 - RNA, 32 nt, Human
accuguccugcuguuuauuaugugggguggcu

SEQ ID NO: 304264 - RNA, 32 nt, Human
accuguccugggaaaugcagacucucugucag

SEQ ID NO: 304265 - RNA, 32 nt, Human
accuguccuguuugagggaacagggucgaccc

SEQ ID NO: 304266 - RNA, 32 nt, Human
accuguccuucccucauggaagcuacugcuua

SEQ ID NO: 304267 - RNA, 32 nt, Human
accugucgcuaaggucuggaggcugcaggccu

SEQ ID NO: 304268 - RNA, 32 nt, Human
accugucggggagggggccaaggacacagcac

SEQ ID NO: 304269 - RNA, 19 nt, Human
accugucucacgacggucu

SEQ ID NO: 304270 - RNA, 32 nt, Human
accugucuccagaugguacagagucccuugau

SEQ ID NO: 304271 - RNA, 32 nt, Human
accugucucccuaguucucugccgccuuuucc

SEQ ID NO: 304272 - RNA, 32 nt, Human
accugucuccgaauccgucgugguguuucaag

SEQ ID NO: 304273 - RNA, 32 nt, Human
accugucuccuucuuccugccugcuugucugu

SEQ ID NO: 304274 - RNA, 32 nt, Human
accugucucugcacucuaguuucccugugugg

SEQ ID NO: 304275 - RNA, 32 nt, Human
accugucugccuggacuguccccuguccccgc

SEQ ID NO: 304276 - RNA, 19 nt, Human
accugucuggacaccacaa

SEQ ID NO: 304277 - RNA, 32 nt, Human
accugucugggaaacaccucaucucuacaaaa

SEQ ID NO: 304278 - RNA, 32 nt, Human
accugucuguaaccuguuuugugcucugaaag

SEQ ID NO: 304279 - RNA, 32 nt, Human
accugucuucaggcugccaggggaggaggaga

SEQ ID NO: 304280 - RNA, 32 nt, Human
accugucuuccccuccucccauccaggucucc

SEQ ID NO: 304281 - RNA, 20 nt, Human
accugucuuccucccuggca

SEQ ID NO: 304282 - RNA, 22 nt, Human
accugucuugauaagugcuuga

SEQ ID NO: 304283 - RNA, 32 nt, Human
accugugaccacagcaggcugacagauggaca

SEQ ID NO: 304284 - RNA, 32 nt, Human
accugugagcacuuugggaggcugaggugggc

SEQ ID NO: 304285 - RNA, 32 nt, Human
accugugagcagcugcuguuugucgugcuccc

SEQ ID NO: 304286 - RNA, 32 nt, Human
accugugagccccacucccggccccacucaca

SEQ ID NO: 304287 - RNA, 32 nt, Human
accugugagccccacucccggccccacucacu

SEQ ID NO: 304288 - RNA, 32 nt, Human
accugugagcugacaaaugcucuggcuccggu

SEQ ID NO: 304289 - RNA, 32 nt, Human
accugugaggaagagguugcagugagcugaga

SEQ ID NO: 304290 - RNA, 32 nt, Human
accugugaggcagagguugcagugagccaaga

SEQ ID NO: 304291 - RNA, 32 nt, Human
accugugaggcugcagugauugugauucucau

SEQ ID NO: 304292 - RNA, 32 nt, Human
accugugagguggagcuugcagugagccaaga

SEQ ID NO: 304293 - RNA, 32 nt, Human
accugugaucagcuccaccagacacagcaacc

SEQ ID NO: 304294 - RNA, 32 nt, Human
accugugcaaaugacccuggaguugguuucgc

SEQ ID NO: 304295 - RNA, 32 nt, Human
accugugcaacaacgccguccagaaguaccug

SEQ ID NO: 304296 - RNA, 24 nt, Human
accugugcaccccuggcccuccca

SEQ ID NO: 304297 - RNA, 32 nt, Human
accugugcaccugguugugagcauuuuaaagg

SEQ ID NO: 304298 - RNA, 32 nt, Human
accugugcauuuucuguuugcccccauucacu

SEQ ID NO: 304299 - RNA, 32 nt, Human
accugugccagagcugugguugaggaggagcc

SEQ ID NO: 304300 - RNA, 32 nt, Human
accugugcccaggccagcuucgagcuacaugc

SEQ ID NO: 304301 - RNA, 32 nt, Human
accugugccugcaggcagggaugcugcaggac

SEQ ID NO: 304302 - RNA, 32 nt, Human
accugugcugacuggggcuggggugagagagg

SEQ ID NO: 304303 - RNA, 32 nt, Human
accugugcugcacuccagcugacccaaguagg

SEQ ID NO: 304304 - RNA, 32 nt, Human
accugugcuuauuggauggagugagaaacuaa

SEQ ID NO: 304305 - RNA, 32 nt, Human
accugugcuugaggggccggaggcaggugcug

SEQ ID NO: 304306 - RNA, 17 nt, Human
accuguggaugguugac

SEQ ID NO: 304307 - RNA, 32 nt, Human
accuguggcccagggagcuacugucuuaaacg

SEQ ID NO: 304308 - RNA, 32 nt, Human
accuguggccgccgcccacagaccaugcuccu

SEQ ID NO: 304309 - RNA, 32 nt, Human
accuguggccugaucuguaaauaaaacuuaca

SEQ ID NO: 304310 - RNA, 32 nt, Human
accuguggcugcugcugacuagggcugcaugg

SEQ ID NO: 304311 - RNA, 32 nt, Human
accuguggcuuccucugugcucuaccuuuuua

SEQ ID NO: 304312 - RNA, 32 nt, Human
accuguggcuuccugcgaauggagggggagca

SEQ ID NO: 304313 - RNA, 32 nt, Human
accuguggggagacuuuuccagcugggccaag

SEQ ID NO: 304314 - RNA, 32 nt, Human
accuguggggugguauuuugcauugcaaggag

SEQ ID NO: 304315 - RNA, 32 nt, Human
accugugggugcggucuccccucuccaaaugc

SEQ ID NO: 304316 - RNA, 32 nt, Human
accuguggucccagcugccucagcuucccgag

SEQ ID NO: 304317 - RNA, 32 nt, Human
accuguggucggcauccccgcguugucacugc

SEQ ID NO: 304318 - RNA, 32 nt, Human
accuguguaaggagguaugugugggagaagau

SEQ ID NO: 304319 - RNA, 32 nt, Human
accuguguacgcacacacacauauacauacag

SEQ ID NO: 304320 - RNA, 32 nt, Human
accuguguauuuagaucagaccuguguaucac

SEQ ID NO: 304321 - RNA, 32 nt, Human
accuguguauuugccccugagcacuuuccuuu

SEQ ID NO: 304322 - RNA, 32 nt, Human
accugugucacuucugacaugagccuguaaac

SEQ ID NO: 304323 - RNA, 32 nt, Human
accuguguccaacauguugagaacucaaaaag

SEQ ID NO: 304324 - RNA, 32 nt, Human
accuguguccgggaguggcuccagugaaaccc

SEQ ID NO: 304325 - RNA, 32 nt, Human
accuguguccgugcuccagcagucuccucagc

SEQ ID NO: 304326 - RNA, 32 nt, Human
accuguguccucuacuuuucugaucucccaca

SEQ ID NO: 304327 - RNA, 32 nt, Human
accugugucucacaucagccuaggugaagccu

SEQ ID NO: 304328 - RNA, 32 nt, Human
accugugucuggacaagucugauguccugugu

SEQ ID NO: 304329 - RNA, 32 nt, Human
accugugugcaggauccgccuccauggagcua

SEQ ID NO: 304330 - RNA, 32 nt, Human
accugugugccagacauuugugcauuguugca

SEQ ID NO: 304331 - RNA, 32 nt, Human
accugugugccccagcaaucuagugcucaaga

SEQ ID NO: 304332 - RNA, 32 nt, Human
accuguguggggaggcccuccugcugccuugg

SEQ ID NO: 304333 - RNA, 32 nt, Human
accugugugugugcaaguuucuaucuuccaga

SEQ ID NO: 304334 - RNA, 32 nt, Human
accuguguguuuuccacagucccugcuucccg

SEQ ID NO: 304335 - RNA, 32 nt, Human
accuguguuaucuguaaaucccagacauugua

SEQ ID NO: 304336 - RNA, 32 nt, Human
accuguguuaucuguaaauuccagacacugua

SEQ ID NO: 304337 - RNA, 32 nt, Human
accuguguucugacucuucccaguguccugca

SEQ ID NO: 304338 - RNA, 32 nt, Human
accuguuaauggaaagcagucacagcuggagg

SEQ ID NO: 304339 - RNA, 32 nt, Human
accuguuacugaggcuggauggaggauggcau

SEQ ID NO: 304340 - RNA, 32 nt, Human
accuguuauggacccccaaauucugagaguuc

SEQ ID NO: 304341 - RNA, 32 nt, Human
accuguucagagccaggaaggagacugcacag

SEQ ID NO: 304342 - RNA, 32 nt, Human
accuguucccauuugagaagcuguggcugagc

SEQ ID NO: 304343 - RNA, 32 nt, Human
accuguuccuacaccuugcaucaugccagcuu

SEQ ID NO: 304344 - RNA, 32 nt, Human
accuguuccugcaagccagcugccuugucuga

SEQ ID NO: 304345 - RNA, 24 nt, Human
accuguucgcucuccgccccuccu

SEQ ID NO: 304346 - RNA, 32 nt, Human
accuguucucacugaaaagucuggcuaaugcu

SEQ ID NO: 304347 - RNA, 32 nt, Human
accuguucucagacugacccuuugcucaucac

SEQ ID NO: 304348 - RNA, 32 nt, Human
accuguucucccaaggaaugggguugaaauca

SEQ ID NO: 304349 - RNA, 32 nt, Human
accuguucucuagcugugaucuuaccacuuca

SEQ ID NO: 304350 - RNA, 32 nt, Human
accuguucucuuucccuucuugucuuuaaaaa

SEQ ID NO: 304351 - RNA, 32 nt, Human
accuguucuguaaaguccuuggcacugcugaa

SEQ ID NO: 304352 - RNA, 32 nt, Human
accuguucuugcaacagucuucuucccaggga

SEQ ID NO: 304353 - RNA, 32 nt, Human
accuguugagccaggagacagaagcugugagc

SEQ ID NO: 304354 - RNA, 22 nt, Human
accuguugagccagggaguagg

SEQ ID NO: 304355 - RNA, 18 nt, Human
accuguugcaugcuucaa

SEQ ID NO: 304356 - RNA, 19 nt, Human
accuguugcccacagggua

SEQ ID NO: 304357 - RNA, 19 nt, Human
accuguugcucugcaucaa

SEQ ID NO: 304358 - RNA, 32 nt, Human
accuguuggcuccacucuugucacucaugucc

SEQ ID NO: 304359 - RNA, 32 nt, Human
accuguugucugaaaauaaaguuaauuuguuu

SEQ ID NO: 304360 - RNA, 32 nt, Human
accuguuguucaaccucugucucuuuauguua

SEQ ID NO: 304361 - RNA, 32 nt, Human
accuguuuaccuggggaaagaugaggaugagg

SEQ ID NO: 304362 - RNA, 32 nt, Human
accuguuuacuuugugcuaacagugccggagc

SEQ ID NO: 304363 - RNA, 32 nt, Human
accuguuucacucaaugccaggcagugcagca

SEQ ID NO: 304364 - RNA, 32 nt, Human
accuguuuccagccuggccugagguggaaccc

SEQ ID NO: 304365 - RNA, 32 nt, Human
accuguuuccuugagacuuuccuagguggaaa

SEQ ID NO: 304366 - RNA, 32 nt, Human
accuguuucuaccuauaugcagucucuuuauu

SEQ ID NO: 304367 - RNA, 32 nt, Human
accuguuucugaagagacacagacacagaaua

SEQ ID NO: 304368 - RNA, 32 nt, Human
accuguuucuucuguuauuacagaacacagug

SEQ ID NO: 304369 - RNA, 32 nt, Human
accuguuugacuugaguagaugccauugcccu

SEQ ID NO: 304370 - RNA, 32 nt, Human
accuguuuguuucugagucugccugugugucc

SEQ ID NO: 304371 - RNA, 32 nt, Human
accuguuuuacugccuguacauuccacauuaa

SEQ ID NO: 304372 - RNA, 32 nt, Human
accuguuuucuucaagccugagguuuuauaua

SEQ ID NO: 304373 - RNA, 32 nt, Human
accuuaaaaacucccuggauuaggcaagagaa

SEQ ID NO: 304374 - RNA, 32 nt, Human
accuuaaaacuagcuuuauucacagagaaaga

SEQ ID NO: 304375 - RNA, 32 nt, Human
accuuaaacagccuggguugacuggccuggua

SEQ ID NO: 304376 - RNA, 32 nt, Human
accuuaaagcuuuugcucuauguucuuuacug

SEQ ID NO: 304377 - RNA, 32 nt, Human
accuuaaaugggagggaaguuggggugucugc

SEQ ID NO: 304378 - RNA, 32 nt, Human
accuuaaauugaaagccagugcugcuacuuuc

SEQ ID NO: 304379 - RNA, 32 nt, Human
accuuaacagcugaagcuaugccuuauuaugc

SEQ ID NO: 304380 - RNA, 32 nt, Human
accuuaaccucugaacucugaccucaggaggc

SEQ ID NO: 304381 - RNA, 32 nt, Human
accuuaacuucaaacauuucucuucagaaaag

SEQ ID NO: 304382 - RNA, 32 nt, Human
accuuaagagcuguaacacucaccgccagggu

SEQ ID NO: 304383 - RNA, 32 nt, Human
accuuaagccaucuugguggguucuggguggu

SEQ ID NO: 304384 - RNA, 32 nt, Human
accuuaagccugcuuagcuuggaauaagacuu

SEQ ID NO: 304385 - RNA, 32 nt, Human
accuuaauacgcucauaugguuggaguguuaa

SEQ ID NO: 304386 - RNA, 32 nt, Human
accuuaaucccagcuacuugggaggcagaggc

SEQ ID NO: 304387 - RNA, 32 nt, Human
accuuaauugagcaaguuugaaaccucgcuug

SEQ ID NO: 304388 - RNA, 31 nt, Human
accuuacaaguguaaugaaugcagcaggacc

SEQ ID NO: 304389 - RNA, 32 nt, Human
accuuacagaccauuauggcauuugcuagacu

SEQ ID NO: 304390 - RNA, 32 nt, Human
accuuacagccuuugggccccugggccccugc

SEQ ID NO: 304391 - RNA, 32 nt, Human
accuuacagcuugccucacacccacccacauc

SEQ ID NO: 304392 - RNA, 32 nt, Human
accuuacagggaauuuccuuuguacuuaauug

SEQ ID NO: 304393 - RNA, 32 nt, Human
accuuacaugcuacuugccucugacaacucuu

SEQ ID NO: 304394 - RNA, 32 nt, Human
accuuaccuuagaugcuaacagaaggguccug

SEQ ID NO: 304395 - RNA, 32 nt, Human
accuuacgagagagcuaugcuccuccucaaag

SEQ ID NO: 304396 - RNA, 32 nt, Human
accuuacuaccuccucccucguggcagggcuc

SEQ ID NO: 304397 - RNA, 32 nt, Human
accuuacuccagcagccuccaggugcuuucau

SEQ ID NO: 304398 - RNA, 32 nt, Human
accuuacugcaaccaccacuuccuggguucaa

SEQ ID NO: 304399 - RNA, 32 nt, Human
accuuacuucaccucuuagccuuguucuccuc

SEQ ID NO: 304400 - RNA, 32 nt, Human
accuuacuucauuucaaaugaaguuaauuaau

SEQ ID NO: 304401 - RNA, 32 nt, Human
accuuacuuccaccauuccucagcaaaucaag

SEQ ID NO: 304402 - RNA, 32 nt, Human
accuuagaauauuuggauaacaggcaugacug

SEQ ID NO: 304403 - RNA, 32 nt, Human
accuuagacagaauaauacaaagcuuuaacga

SEQ ID NO: 304404 - RNA, 32 nt, Human
accuuagaccaccagccccagcuguucucugu

SEQ ID NO: 304405 - RNA, 32 nt, Human
accuuagaguauguuucucagcccuaccuacc

SEQ ID NO: 304406 - RNA, 32 nt, Human
accuuagcaacuuggcccacauggacaucgac

SEQ ID NO: 304407 - RNA, 32 nt, Human
accuuagcacuaaggagauugaguaaggaccu

SEQ ID NO: 304408 - RNA, 32 nt, Human
accuuagcagagggcaaguucuuucaucgugg

SEQ ID NO: 304409 - RNA, 32 nt, Human
accuuagccacuuuggacacauguucucagga

SEQ ID NO: 304410 - RNA, 32 nt, Human
accuuagccucuccaguagcuggaacuacagg

SEQ ID NO: 304411 - RNA, 32 nt, Human
accuuagguaacauaccugcagcugcuuuucu

SEQ ID NO: 304412 - RNA, 32 nt, Human
accuuaggugaugcacugugcccagccauucc

SEQ ID NO: 304413 - RNA, 32 nt, Human
accuuagugaggccucuggccuagccagagag

SEQ ID NO: 304414 - RNA, 32 nt, Human
accuuaguuccagaagacccaaaggagaguac

SEQ ID NO: 304415 - RNA, 32 nt, Human
accuuauagguuaaugaaugucucuaagauau

SEQ ID NO: 304416 - RNA, 32 nt, Human
accuuauccugauccugaagacgagauuccag

SEQ ID NO: 304417 - RNA, 32 nt, Human
accuuaucuccuugugcucaggccagugucuu

SEQ ID NO: 304418 - RNA, 32 nt, Human
accuuaugaacaaauuaacaggcucuggaccu

SEQ ID NO: 304419 - RNA, 32 nt, Human
accuuaugcaugaacauuucccagacuuucau

SEQ ID NO: 304420 - RNA, 32 nt, Human
accuuauguagugaguucuuccaaaauauaau

SEQ ID NO: 304421 - RNA, 32 nt, Human
accuuaugugccagaggcuccugaccaccaua

SEQ ID NO: 304422 - RNA, 32 nt, Human
accuuauucccaggcuggagugcaaugucgug

SEQ ID NO: 304423 - RNA, 32 nt, Human
accuuauugcagucauggcuuucacaaauuac

SEQ ID NO: 304424 - RNA, 32 nt, Human
accuuauuuauucaaaaccuauaaggugguau

SEQ ID NO: 304425 - RNA, 32 nt, Human
accuucaaaccuugccuccgaggcugggccug

SEQ ID NO: 304426 - RNA, 32 nt, Human
accuucaacauccggcucaaugccuccaacgc

SEQ ID NO: 304427 - RNA, 32 nt, Human
accuucaacaucuggcucaaugccuccaacgc

SEQ ID NO: 304428 - RNA, 32 nt, Human
accuucaagggcaucaucagcgcacaaccagc

SEQ ID NO: 304429 - RNA, 32 nt, Human
accuucacagcccagaucugcuggguuuugag

SEQ ID NO: 304430 - RNA, 32 nt, Human
accuucaccauuaacuugcugugugaccuugg

SEQ ID NO: 304431 - RNA, 32 nt, Human
accuucaccccgagacagguccugacacaccc

SEQ ID NO: 304432 - RNA, 32 nt, Human
accuucacccgcuucagggggauuccagcuug

SEQ ID NO: 304433 - RNA, 32 nt, Human
accuucacccugucauggucucagggaacagc

SEQ ID NO: 304434 - RNA, 32 nt, Human
accuucaccgcccagguucaagcgauucucuu

SEQ ID NO: 304435 - RNA, 32 nt, Human
accuucaccucccagguucaagcgauucuccu

SEQ ID NO: 304436 - RNA, 32 nt, Human
accuucaccuccccgguucaagcaauucuccu

SEQ ID NO: 304437 - RNA, 32 nt, Human
accuucaccugugcugcacuccagcugaccca

SEQ ID NO: 304438 - RNA, 32 nt, Human
accuucacgucaugaagguucuggaagguuuu

SEQ ID NO: 304439 - RNA, 32 nt, Human
accuucacucugguauuccugcugucuguguu

SEQ ID NO: 304440 - RNA, 32 nt, Human
accuucacuggggaaaggcugggagccucugg

SEQ ID NO: 304441 - RNA, 32 nt, Human
accuucagaacagccaucugugcccagcucug

SEQ ID NO: 304442 - RNA, 32 nt, Human
accuucagaccaccaccgcauauucugagccu

SEQ ID NO: 304443 - RNA, 32 nt, Human
accuucagacucuauucuuuacccuuccauug

SEQ ID NO: 304444 - RNA, 32 nt, Human
accuucagcggcgcgagcccaagccuucucca

SEQ ID NO: 304445 - RNA, 32 nt, Human
accuucagcuacuuggagauucauggcgucgu

SEQ ID NO: 304446 - RNA, 21 nt, Human
accuucagcuuuggaagugac

SEQ ID NO: 304447 - RNA, 32 nt, Human
accuucaggagaacgagaaggcugccugauca

SEQ ID NO: 304448 - RNA, 32 nt, Human
accuucaggauggagacaggaaaguguggauc

SEQ ID NO: 304449 - RNA, 32 nt, Human
accuucagguucuagaagauugguugcacucc

SEQ ID NO: 304450 - RNA, 32 nt, Human
accuucagucuuggacauccuaccuccaacug

SEQ ID NO: 304451 - RNA, 32 nt, Human
accuucagugcugguggcccucaggcccacag

SEQ ID NO: 304452 - RNA, 32 nt, Human
accuucagugcuguguguuuccacagcgccaa

SEQ ID NO: 304453 - RNA, 32 nt, Human
accuucaguuagagaauacucuuaguagucau

SEQ ID NO: 304454 - RNA, 32 nt, Human
accuucauagcauacuccuucccccucaggug

SEQ ID NO: 304455 - RNA, 32 nt, Human
accuucauaugcacuuuguucuaucuguugcg

SEQ ID NO: 304456 - RNA, 32 nt, Human
accuucauccacccacucaccggcaaaccccu

SEQ ID NO: 304457 - RNA, 32 nt, Human
accuucaucccuggcccugcagaggccugcuu

SEQ ID NO: 304458 - RNA, 32 nt, Human
accuucauccugcugcucacgcuggccauccu

SEQ ID NO: 304459 - RNA, 32 nt, Human
accuucaucuccuccauguccugggccagccu

SEQ ID NO: 304460 - RNA, 32 nt, Human
accuucaucuuucugaccuccuccuauucugu

SEQ ID NO: 304461 - RNA, 32 nt, Human
accuucaugccugggguuucucucccaaaagc

SEQ ID NO: 304462 - RNA, 32 nt, Human
accuucauuccauagcccugaguuucugugug

SEQ ID NO: 304463 - RNA, 32 nt, Human
accuucauugauuccucccuacacuggacuaa

SEQ ID NO: 304464 - RNA, 32 nt, Human
accuuccaacuuccuguggccugaagaagcac

SEQ ID NO: 304465 - RNA, 19 nt, Human
accuuccacaccccugccc

SEQ ID NO: 304466 - RNA, 23 nt, Human
accuuccagagcccaaggucagg

SEQ ID NO: 304467 - RNA, 32 nt, Human
accuuccagcagugccugcuucuggaacagga

SEQ ID NO: 304468 - RNA, 32 nt, Human
accuuccagcccucaguccugcccucaagaga

SEQ ID NO: 304469 - RNA, 32 nt, Human
accuuccagcccugccgccccugcugcaucuu

SEQ ID NO: 304470 - RNA, 20 nt, Human
accuucccaacugcugcgug

SEQ ID NO: 304471 - RNA, 32 nt, Human
accuucccacuggccucaagugagccaagaaa

SEQ ID NO: 304472 - RNA, 32 nt, Human
accuucccagcucucccucuggcccugcuucu

SEQ ID NO: 304473 - RNA, 24 nt, Human
accuucccauccccugcugaacca

SEQ ID NO: 304474 - RNA, 32 nt, Human
accuuccccaaaguccugacgucgcuguuugc

SEQ ID NO: 304475 - RNA, 32 nt, Human
accuuccccacuggugaugaccuaggcaggaa

SEQ ID NO: 304476 - RNA, 32 nt, Human
accuuccccaggagagacucugccuuuagggu

SEQ ID NO: 304477 - RNA, 32 nt, Human
accuuccccaggcuggacgugguggcucacgc

SEQ ID NO: 304478 - RNA, 32 nt, Human
accuuccccaucucccugccagccccuaacua

SEQ ID NO: 304479 - RNA, 32 nt, Human
accuuccccuccauuccccacuucucucuccc

SEQ ID NO: 304480 - RNA, 32 nt, Human
accuucccuacuaaggcucugccacaagcgca

SEQ ID NO: 304481 - RNA, 32 nt, Human
accuucccuccccuauuguccugugacccugc

SEQ ID NO: 304482 - RNA, 32 nt, Human
accuucccuccccuucccacuccuuccggagu

SEQ ID NO: 304483 - RNA, 32 nt, Human
accuucccuccuggaaccacacuacuugaauc

SEQ ID NO: 304484 - RNA, 32 nt, Human
accuucccucucucuucuaccuccgucucgcu

SEQ ID NO: 304485 - RNA, 32 nt, Human
accuucccugaggacacucaauaaagguuccu

SEQ ID NO: 304486 - RNA, 32 nt, Human
accuucccugcaggccgcuguucaugucugga

SEQ ID NO: 304487 - RNA, 23 nt, Human
accuucccugccccucacagggg

SEQ ID NO: 304488 - RNA, 32 nt, Human
accuucccugcuggccugcacacagcugcuca

SEQ ID NO: 304489 - RNA, 32 nt, Human
accuucccuuccuugaucccuggaccagacuc

SEQ ID NO: 304490 - RNA, 21 nt, Human
accuuccggaaaagugcugga

SEQ ID NO: 304491 - RNA, 32 nt, Human
accuuccguaauuccaggcuuguggccccaaa

SEQ ID NO: 304492 - RNA, 32 nt, Human
accuuccuagugagcagcugcccagcuccugc

SEQ ID NO: 304493 - RNA, 32 nt, Human
accuuccucaagggacugugacccuuugggga

SEQ ID NO: 304494 - RNA, 32 nt, Human
accuuccucaggcucacuccaccuacaucccc

SEQ ID NO: 304495 - RNA, 32 nt, Human
accuuccucaugcaugugaugaucuuauugua

SEQ ID NO: 304496 - RNA, 32 nt, Human
accuuccuccacccuccacccugggcugcuac

SEQ ID NO: 304497 - RNA, 32 nt, Human
accuuccuccacuacgugcuaggcccuucgcu

SEQ ID NO: 304498 - RNA, 18 nt, Human
accuuccuccaucaugua

SEQ ID NO: 304499 - RNA, 32 nt, Human
accuuccucccacccaccccugccuugcuuuu

SEQ ID NO: 304500 - RNA, 32 nt, Human
accuuccucccacucuaaccaccgucacccug

SEQ ID NO: 304501 - RNA, 25 nt, Human
accuuccuccucccuuacugaacca

SEQ ID NO: 304502 - RNA, 23 nt, Human
accuuccucuagggacacugggg

SEQ ID NO: 304503 - RNA, 32 nt, Human
accuuccucucaguaacuacagagaggacguu

SEQ ID NO: 304504 - RNA, 32 nt, Human
accuuccucuggggcucuaggguugcuggagc

SEQ ID NO: 304505 - RNA, 32 nt, Human
accuuccucugguccagcaccaccuggauguu

SEQ ID NO: 304506 - RNA, 32 nt, Human
accuuccugaauagcugagacuacaggcgugu

SEQ ID NO: 304507 - RNA, 32 nt, Human
accuuccugaggcuucccuccugcugcuacca

SEQ ID NO: 304508 - RNA, 32 nt, Human
accuuccugcugggggcagggggugagggagg

SEQ ID NO: 304509 - RNA, 32 nt, Human
accuuccugcugucuuccccucccucaacccc

SEQ ID NO: 304510 - RNA, 32 nt, Human
accuuccuggaggagcugcuguuugagccagc

SEQ ID NO: 304511 - RNA, 32 nt, Human
accuuccuggcagggaaagugggugaacagag

SEQ ID NO: 304512 - RNA, 24 nt, Human
accuuccuggcuaacauggugaaa

SEQ ID NO: 304513 - RNA, 32 nt, Human
accuuccuggggaggccccaggagagugaauc

SEQ ID NO: 304514 - RNA, 32 nt, Human
accuuccuuaagaaaauacaaaauuaggaaca

SEQ ID NO: 304515 - RNA, 32 nt, Human
accuuccuucauguggagggacgcagccucau

SEQ ID NO: 304516 - RNA, 32 nt, Human
accuuccuuccaccauuuuauuccguccuguu

SEQ ID NO: 304517 - RNA, 32 nt, Human
accuuccuuccucuucccucuucuaggacaca

SEQ ID NO: 304518 - RNA, 32 nt, Human
accuuccuuccuucccccuccucccccuccuu

SEQ ID NO: 304519 - RNA, 32 nt, Human
accuuccuuuaaauuuguuauaacuccagcua

SEQ ID NO: 304520 - RNA, 32 nt, Human
accuuccuuugucuuacauuggcuuuuuaaau

SEQ ID NO: 304521 - RNA, 32 nt, Human
accuucgaagcaucaaugcacacaccugcugu

SEQ ID NO: 304522 - RNA, 32 nt, Human
accuucgaggcaggagcccucucauggugaac

SEQ ID NO: 304523 - RNA, 32 nt, Human
accuucgaguugcagcccaugaccucaccugg

SEQ ID NO: 304524 - RNA, 32 nt, Human
accuucgccaccuggguuccagcaauucuccu

SEQ ID NO: 304525 - RNA, 32 nt, Human
accuucgccucccagguucaagcaauucuccu

SEQ ID NO: 304526 - RNA, 32 nt, Human
accuucgcuagcagggagugggaggcuucuuu

SEQ ID NO: 304527 - RNA, 32 nt, Human
accuucgggcugugcccggggaaaggcaaggu

SEQ ID NO: 304528 - RNA, 32 nt, Human
accuucgucccuuugugcuuuguaaagcaaac

SEQ ID NO: 304529 - RNA, 32 nt, Human
accuucgugggaacaggaccguaagaugaugu

SEQ ID NO: 304530 - RNA, 32 nt, Human
accuucguugcaacuucucccauccgagucac

SEQ ID NO: 304531 - RNA, 32 nt, Human
accuucucaccagauuccccugaauccaaacu

SEQ ID NO: 304532 - RNA, 32 nt, Human
accuucucaccuuuugucaacggcaaaggcag

SEQ ID NO: 304533 - RNA, 32 nt, Human
accuucucagccagcagcuccagcucagagca

SEQ ID NO: 304534 - RNA, 32 nt, Human
accuucuccuaaggagcuugcccugcaguaag

SEQ ID NO: 304535 - RNA, 32 nt, Human
accuucucuagggaggagucaaauguagguca

SEQ ID NO: 304536 - RNA, 32 nt, Human
accuucucucacucauaauucuucaggccuuu

SEQ ID NO: 304537 - RNA, 32 nt, Human
accuucucucagggaugaccuaucaguuugag

SEQ ID NO: 304538 - RNA, 32 nt, Human
accuucucuccccuccucucugcuuuaauuuu

SEQ ID NO: 304539 - RNA, 32 nt, Human
accuucucuccuccugaaauagguccuuuaga

SEQ ID NO: 304540 - RNA, 32 nt, Human
accuucucuccucuugucauucagcucucucu

SEQ ID NO: 304541 - RNA, 32 nt, Human
accuucucucuccaccccuccuccauccaccc

SEQ ID NO: 304542 - RNA, 32 nt, Human
accuucucucugagagccgggcagaggcuccg

SEQ ID NO: 304543 - RNA, 32 nt, Human
accuucucugcugagagcugcagagaugaccu

SEQ ID NO: 304544 - RNA, 32 nt, Human
accuucucuucucuugucacuagggggacuag

SEQ ID NO: 304545 - RNA, 32 nt, Human
accuucugcaaaaguaaaaacucucuuaguaa

SEQ ID NO: 304546 - RNA, 32 nt, Human
accuucugcccuugcuucuggugacagcccag

SEQ ID NO: 304547 - RNA, 25 nt, Human
accuucugccgccgccaccacagcc

SEQ ID NO: 304548 - RNA, 32 nt, Human
accuucugccuggaauagcucaaguucuuaaa

SEQ ID NO: 304549 - RNA, 22 nt, Human
accuucugcucaauuuccuuuc

SEQ ID NO: 304550 - RNA, 18 nt, Human
accuucugcuucccugga

SEQ ID NO: 304551 - RNA, 32 nt, Human
accuucuggaagagaagacuggcagaauauuu

SEQ ID NO: 304552 - RNA, 32 nt, Human
accuucugguugcuucagaccugacaccgucc

SEQ ID NO: 304553 - RNA, 32 nt, Human
accuucuguaccaugccuucagaaaccuucuu

SEQ ID NO: 304554 - RNA, 32 nt, Human
accuucuguggacaagguauugugcuaccagc

SEQ ID NO: 304555 - RNA, 32 nt, Human
accuucugugguuccccuggguggagauuucc

SEQ ID NO: 304556 - RNA, 32 nt, Human
accuucuguuuccaugucacagcuccaccaua

SEQ ID NO: 304557 - RNA, 32 nt, Human
accuucuuaccucccagcuaccucucaugugg

SEQ ID NO: 304558 - RNA, 32 nt, Human
accuucuucaaguuccugacccucucugggcu

SEQ ID NO: 304559 - RNA, 32 nt, Human
accuucuuccuuucugcgccaggauuugggaa

SEQ ID NO: 304560 - RNA, 32 nt, Human
accuucuuggcucugugcauccuugaaaccag

SEQ ID NO: 304561 - RNA, 32 nt, Human
accuucuuggggacucgggggcuggucugaug

SEQ ID NO: 304562 - RNA, 32 nt, Human
accuucuugguugaaguuguguuaacaaugca

SEQ ID NO: 304563 - RNA, 32 nt, Human
accuucuuucccuccauugucugaguaugcuc

SEQ ID NO: 304564 - RNA, 32 nt, Human
accuugaaauaaaucacuucugaccuugaaau

SEQ ID NO: 304565 - RNA, 32 nt, Human
accuugaacaucucccgucacagcagguacug

SEQ ID NO: 304566 - RNA, 32 nt, Human
accuugaacugugcucaacagccuggcccuuu

SEQ ID NO: 304567 - RNA, 32 nt, Human
accuugaagcauggucagcagcagagagagca

SEQ ID NO: 304568 - RNA, 20 nt, Human
accuugaaggcaucgugugg

SEQ ID NO: 304569 - RNA, 32 nt, Human
accuugaagggccuugccccuggacacccugu

SEQ ID NO: 304570 - RNA, 32 nt, Human
accuugacaacaggcgcauccucccaggccac

SEQ ID NO: 304571 - RNA, 32 nt, Human
accuugacaguacguaguauacauugugguuu

SEQ ID NO: 304572 - RNA, 32 nt, Human
accuugacauugauuuugcuucccaucuuuga

SEQ ID NO: 304573 - RNA, 32 nt, Human
accuugaccaaaggggaagagagacacuuggg

SEQ ID NO: 304574 - RNA, 32 nt, Human
accuugaccaucguccuuccucucaagcuagc

SEQ ID NO: 304575 - RNA, 32 nt, Human
accuugacgcaaaaacucaaaccacaaauguu

SEQ ID NO: 304576 - RNA, 32 nt, Human
accuugacgucccagguucaagcgauucucuc

SEQ ID NO: 304577 - RNA, 32 nt, Human
accuugacgugagacuaaaacgugaccguagg

SEQ ID NO: 304578 - RNA, 32 nt, Human
accuugacuaguuucacaauuuugccucaagu

SEQ ID NO: 304579 - RNA, 32 nt, Human
accuugacuuauauuuuucaugacguuucaug

SEQ ID NO: 304580 - RNA, 32 nt, Human
accuugagagagaagcauugggggugcaagug

SEQ ID NO: 304581 - RNA, 32 nt, Human
accuugagauccacccuccacagccucccaaa

SEQ ID NO: 304582 - RNA, 32 nt, Human
accuugagaugauucugcuacuuuccagacuu

SEQ ID NO: 304583 - RNA, 23 nt, Human
accuugagcagacccucuggcua

SEQ ID NO: 304584 - RNA, 32 nt, Human
accuugagcccaagcagcacuuugggucaugg

SEQ ID NO: 304585 - RNA, 32 nt, Human
accuugagcccaaguccuuuuccguuggcuga

SEQ ID NO: 304586 - RNA, 32 nt, Human
accuugagccugcgacccccuaccucacaggg

SEQ ID NO: 304587 - RNA, 32 nt, Human
accuugagcugguuauuucuccucucugagcc

SEQ ID NO: 304588 - RNA, 32 nt, Human
accuugagcuugggaauugaacuggggucacc

SEQ ID NO: 304589 - RNA, 32 nt, Human
accuugaggcccaagacccaggacaaggaaca

SEQ ID NO: 304590 - RNA, 32 nt, Human
accuugaggggcugcgggucugagggaggaga

SEQ ID NO: 304591 - RNA, 32 nt, Human
accuugaguauuguuaaauggagagaaaggca

SEQ ID NO: 304592 - RNA, 19 nt, Human
accuugaucaacucacuuu

SEQ ID NO: 304593 - RNA, 32 nt, Human
accuugauucauucacccuugauucauuucuc

SEQ ID NO: 304594 - RNA, 18 nt, Human
accuugcacccugcacca

SEQ ID NO: 304595 - RNA, 32 nt, Human
accuugcagacacgagccacacgggccacacg

SEQ ID NO: 304596 - RNA, 32 nt, Human
accuugcagagcagcaagaggcucucuccaga

SEQ ID NO: 304597 - RNA, 32 nt, Human
accuugcagccugcucaggucuuugugcucug

SEQ ID NO: 304598 - RNA, 32 nt, Human
accuugcaggcacuaguccuuuacagaugaca

SEQ ID NO: 304599 - RNA, 32 nt, Human
accuugcaggugcaguuuccuuggggaccccu

SEQ ID NO: 304600 - RNA, 32 nt, Human
accuugcaguagcagaggcaaugacaugaguu

SEQ ID NO: 304601 - RNA, 32 nt, Human
accuugcauuucauuucaacacugcuucaagg

SEQ ID NO: 304602 - RNA, 32 nt, Human
accuugccagcaucuguuauuuauugacuuuc

SEQ ID NO: 304603 - RNA, 32 nt, Human
accuugccccucucugucauagcuaacaggaa

SEQ ID NO: 304604 - RNA, 32 nt, Human
accuugccgccacccccuacccuaccgagcgg

SEQ ID NO: 304605 - RNA, 32 nt, Human
accuugccggccacuccuccagcugccagggg

SEQ ID NO: 304606 - RNA, 32 nt, Human
accuugccucuuucuuccuuuuuaguauccuc

SEQ ID NO: 304607 - RNA, 32 nt, Human
accuugccuuuccuucuugugggcaucuggga

SEQ ID NO: 304608 - RNA, 24 nt, Human
accuugcuccccacugcccagggc

SEQ ID NO: 304609 - RNA, 32 nt, Human
accuugcucugccaucccuggcagcccccacc

SEQ ID NO: 304610 - RNA, 32 nt, Human
accuugcuguucgcugcugugucgucuucuaa

SEQ ID NO: 304611 - RNA, 32 nt, Human
accuugcuuuacacaaaacaccuguguauaaa

SEQ ID NO: 304612 - RNA, 32 nt, Human
accuuggaggaggagagguuggugacaugcau

SEQ ID NO: 304613 - RNA, 32 nt, Human
accuuggaggcagagguugcagugagcugaga

SEQ ID NO: 304614 - RNA, 32 nt, Human
accuuggaggcccugcacugccagcaucugga

SEQ ID NO: 304615 - RNA, 32 nt, Human
accuuggaggcggagguugcauugagcugaga

SEQ ID NO: 304616 - RNA, 32 nt, Human
accuuggaggugaacuucucaccugagggcug

SEQ ID NO: 304617 - RNA, 32 nt, Human
accuuggagguggagguuguggugagccauga

SEQ ID NO: 304618 - RNA, 32 nt, Human
accuuggauaccacucucucagccacagaaac

SEQ ID NO: 304619 - RNA, 32 nt, Human
accuuggauaucuauugaauguuaaacaucuc

SEQ ID NO: 304620 - RNA, 32 nt, Human
accuuggcagcccaggccgggguggagcaugg

SEQ ID NO: 304621 - RNA, 32 nt, Human
accuuggccacucuguuucuccaccccagcac

SEQ ID NO: 304622 - RNA, 32 nt, Human
accuuggccccaggaacccugggaguggccuu

SEQ ID NO: 304623 - RNA, 32 nt, Human
accuuggccccucccccgaccuugccaguguu

SEQ ID NO: 304624 - RNA, 32 nt, Human
accuuggccucccguguucaagcgauucuccu

SEQ ID NO: 304625 - RNA, 32 nt, Human
accuuggccuccuagguucaagcaauucuccu

SEQ ID NO: 304626 - RNA, 32 nt, Human
accuuggccuucuccccucuucugagcuaguu

SEQ ID NO: 304627 - RNA, 32 nt, Human
accuuggcucacugcaaccuccaccucccagg

SEQ ID NO: 304628 - RNA, 32 nt, Human
accuuggcucacugcaaccuccaggccagccu

SEQ ID NO: 304629 - RNA, 32 nt, Human
accuuggcucacugcaaccuccaucuccgggg

SEQ ID NO: 304630 - RNA, 32 nt, Human
accuuggcucacugcaaccuccgccucccggg

SEQ ID NO: 304631 - RNA, 32 nt, Human
accuuggcucacugcaaccucugccucccugg

SEQ ID NO: 304632 - RNA, 32 nt, Human
accuugggaacugcaggagcccguucugccuc

SEQ ID NO: 304633 - RNA, 32 nt, Human
accuugggaccagcaaacauuuugcccagcug

SEQ ID NO: 304634 - RNA, 32 nt, Human
accuugggaggaaggggcuacuccgcccacgu

SEQ ID NO: 304635 - RNA, 32 nt, Human
accuugggcaaguuccugucccucucugagcc

SEQ ID NO: 304636 - RNA, 32 nt, Human
accuugggcaggcagacugagaagggacugug

SEQ ID NO: 304637 - RNA, 32 nt, Human
accuugggcccucaggggcugcagaggaaccu

SEQ ID NO: 304638 - RNA, 32 nt, Human
accuugggcccuggaagaguccuccaccccau

SEQ ID NO: 304639 - RNA, 32 nt, Human
accuuggggaccuguugauuaauugguggccc

SEQ ID NO: 304640 - RNA, 32 nt, Human
accuugguaccaucaagcucagccuggaaguc

SEQ ID NO: 304641 - RNA, 32 nt, Human
accuugguagcuaugaugagagcuauuaucau

SEQ ID NO: 304642 - RNA, 32 nt, Human
accuuggugaugcggccaaggacgucugcucu

SEQ ID NO: 304643 - RNA, 32 nt, Human
accuuggugggacuucuaacagaucagccuga

SEQ ID NO: 304644 - RNA, 32 nt, Human
accuugguguggguuacugggugcaggaugaa

SEQ ID NO: 304645 - RNA, 32 nt, Human
accuugguuaccuguguugcugucuacugaca

SEQ ID NO: 304646 - RNA, 32 nt, Human
accuugguuucucaagguaucaucagggauug

SEQ ID NO: 304647 - RNA, 32 nt, Human
accuuguagacacuuagccaucaagaaucaag

SEQ ID NO: 304648 - RNA, 32 nt, Human
accuuguagccccucaccuucucuccccaaug

SEQ ID NO: 304649 - RNA, 32 nt, Human
accuuguagugagccgagaucgcgccacugug

SEQ ID NO: 304650 - RNA, 22 nt, Human
accuuguauauacccugcacca

SEQ ID NO: 304651 - RNA, 32 nt, Human
accuuguaucuucaucaucagcaacaacaaaa

SEQ ID NO: 304652 - RNA, 32 nt, Human
accuugucacccaggcuagagugcaguggcac

SEQ ID NO: 304653 - RNA, 32 nt, Human
accuugucacugccgucugugcacugauucac

SEQ ID NO: 304654 - RNA, 32 nt, Human
accuuguccaaccagcuacccaccucaacucc

SEQ ID NO: 304655 - RNA, 32 nt, Human
accuuguccuccauuuccuuuucucauccaaa

SEQ ID NO: 304656 - RNA, 32 nt, Human
accuuguccugccuuuuugcagauaggcuuuc

SEQ ID NO: 304657 - RNA, 18 nt, Human
accuugucucuaaaaaua

SEQ ID NO: 304658 - RNA, 32 nt, Human
accuugucugcucaucccuaacuccuguuccu

SEQ ID NO: 304659 - RNA, 32 nt, Human
accuugucuuuguccccacuggauagcuguua

SEQ ID NO: 304660 - RNA, 23 nt, Human
accuugugccgcagccugaccca

SEQ ID NO: 304661 - RNA, 32 nt, Human
accuugugccuucuguccuaccaguuuucuuu

SEQ ID NO: 304662 - RNA, 32 nt, Human
accuugugggaucaccuuuucccagcuggcua

SEQ ID NO: 304663 - RNA, 32 nt, Human
accuugugggcuggugcaggccccugagguuu

SEQ ID NO: 304664 - RNA, 32 nt, Human
accuuguggggaggggaaccuugaagggagcg

SEQ ID NO: 304665 - RNA, 32 nt, Human
accuuguuagccaccagugcaagcacaugggu

SEQ ID NO: 304666 - RNA, 32 nt, Human
accuuguucccaagaaguguuuggaaugugcu

SEQ ID NO: 304667 - RNA, 32 nt, Human
accuuguucccuuuuuaucuccuucacugcac

SEQ ID NO: 304668 - RNA, 32 nt, Human
accuuguucucuagguccugggcuuucuaaag

SEQ ID NO: 304669 - RNA, 17 nt, Human
accuuguuggagccugc

SEQ ID NO: 304670 - RNA, 32 nt, Human
accuuguuuggcuacauuaccucagugaacaa

SEQ ID NO: 304671 - RNA, 32 nt, Human
accuuuacauuuugcuuaauguaacaauauau

SEQ ID NO: 304672 - RNA, 32 nt, Human
accuuuacccuuuaaugguaagacuuguauuu

SEQ ID NO: 304673 - RNA, 32 nt, Human
accuuuaccuagaucagccaucagccugucaa

SEQ ID NO: 304674 - RNA, 32 nt, Human
accuuuacucuucgcccuuccuccuggcaugg

SEQ ID NO: 304675 - RNA, 32 nt, Human
accuuuacugauuuccagaggaaagcuagagg

SEQ ID NO: 304676 - RNA, 32 nt, Human
accuuuagaacaggagacuugagcuugaccua

SEQ ID NO: 304677 - RNA, 32 nt, Human
accuuuagcagcuuuuuauuguggacuaaugc

SEQ ID NO: 304678 - RNA, 32 nt, Human
accuuuagcugcagcggcuacgcugccacgug

SEQ ID NO: 304679 - RNA, 24 nt, Human
accuuuaucgccaaugcacagcuu

SEQ ID NO: 304680 - RNA, 32 nt, Human
accuuucaccagguuuuuggugccauuuaccc

SEQ ID NO: 304681 - RNA, 32 nt, Human
accuuucacucaugagcaaugugcccaagaac

SEQ ID NO: 304682 - RNA, 32 nt, Human
accuuucacugaggucaggagccccugagcag

SEQ ID NO: 304683 - RNA, 32 nt, Human
accuuucacugcaaugaccuuucaaugcaaua

SEQ ID NO: 304684 - RNA, 32 nt, Human
accuuucagacccucugugugggcugggcugg

SEQ ID NO: 304685 - RNA, 32 nt, Human
accuuucagccugugagccucugcacaaagca

SEQ ID NO: 304686 - RNA, 32 nt, Human
accuuucagcuggcagaguuagcauuggguag

SEQ ID NO: 304687 - RNA, 32 nt, Human
accuuucaugccacugcagccacuggaaauac

SEQ ID NO: 304688 - RNA, 32 nt, Human
accuuucauuuucaaguaauucacaguuacag

SEQ ID NO: 304689 - RNA, 32 nt, Human
accuuuccaagguggggauggaagcacagucg

SEQ ID NO: 304690 - RNA, 32 nt, Human
accuuuccagaagacuaaaggugauagcaaca

SEQ ID NO: 304691 - RNA, 21 nt, Human
accuuuccauuguugcaucuu

SEQ ID NO: 304692 - RNA, 32 nt, Human
accuuucccucgggguuaacaaacaucuucaa

SEQ ID NO: 304693 - RNA, 32 nt, Human
accuuucccuucugaaagucugguuccugccc

SEQ ID NO: 304694 - RNA, 32 nt, Human
accuuuccucaccucuaucucucucaaccaga

SEQ ID NO: 304695 - RNA, 32 nt, Human
accuuuccucuccuggcgggcccggcggcggg

SEQ ID NO: 304696 - RNA, 32 nt, Human
accuuuccugcacuccacggcggcagugacaa

SEQ ID NO: 304697 - RNA, 32 nt, Human
accuuucgcuccugcccucugcccggcccuac

SEQ ID NO: 304698 - RNA, 32 nt, Human
accuuucucaacauaaaaggacccacacagua

SEQ ID NO: 304699 - RNA, 32 nt, Human
accuuucucaguuaccagaaucuugcugcuaa

SEQ ID NO: 304700 - RNA, 32 nt, Human
accuuucucauggauuuuuguggugugggcca

SEQ ID NO: 304701 - RNA, 32 nt, Human
accuuucucaugggugcuguuagauuuuggca

SEQ ID NO: 304702 - RNA, 32 nt, Human
accuuucuccuagccgggugacccaggggauu

SEQ ID NO: 304703 - RNA, 32 nt, Human
accuuucucugccucucccacacucucccaga

SEQ ID NO: 304704 - RNA, 23 nt, Human
accuuucugaaucagacacaagc

SEQ ID NO: 304705 - RNA, 32 nt, Human
accuuucugagagaggcaccacugugaccuuc

SEQ ID NO: 304706 - RNA, 32 nt, Human
accuuucugccuggaagucuguuagccuuuca

SEQ ID NO: 304707 - RNA, 32 nt, Human
accuuucugucucucugggcuguggcugggca

SEQ ID NO: 304708 - RNA, 32 nt, Human
accuuucuucacugagauuccagugacaugag

SEQ ID NO: 304709 - RNA, 19 nt, Human
accuuucuuucaaccagua

SEQ ID NO: 304710 - RNA, 32 nt, Human
accuuugaaaacucuccugggguggaggagac

SEQ ID NO: 304711 - RNA, 32 nt, Human
accuuugaaguuaagggaaggacagguggaca

SEQ ID NO: 304712 - RNA, 24 nt, Human
accuuugagaagacaccauacuca

SEQ ID NO: 304713 - RNA, 32 nt, Human
accuuugagaguauccacaaagcaaugucuca

SEQ ID NO: 304714 - RNA, 32 nt, Human
accuuugaguucagucuacaccuaagcaggua

SEQ ID NO: 304715 - RNA, 32 nt, Human
accuuugauguuaaaggaauccuucauuuauu

SEQ ID NO: 304716 - RNA, 32 nt, Human
accuuugcacuugcugaaucugucuuuguuuc

SEQ ID NO: 304717 - RNA, 32 nt, Human
accuuugcccaaauccagcagaagagcaucuu

SEQ ID NO: 304718 - RNA, 32 nt, Human
accuuugccucccuaguucaagcgauuuuccu

SEQ ID NO: 304719 - RNA, 32 nt, Human
accuuugccuccuggguucaagcgauucuucu

SEQ ID NO: 304720 - RNA, 32 nt, Human
accuuugccugguacaguauggggguuguaaa

SEQ ID NO: 304721 - RNA, 32 nt, Human
accuuugcucacugccugagaccccuuccuua

SEQ ID NO: 304722 - RNA, 32 nt, Human
accuuugcugaguuccggggugcaauggggga

SEQ ID NO: 304723 - RNA, 32 nt, Human
accuuugcugucuccccuucagaaaaggcugg

SEQ ID NO: 304724 - RNA, 32 nt, Human
accuuuggaagacaugacaaagcugccuggac

SEQ ID NO: 304725 - RNA, 32 nt, Human
accuuuggacugccuuccuugggggucugaga

SEQ ID NO: 304726 - RNA, 32 nt, Human
accuuuggagaguuaauugucugugugaggug

SEQ ID NO: 304727 - RNA, 24 nt, Human
accuuuggauagaaaaguguuuga

SEQ ID NO: 304728 - RNA, 32 nt, Human
accuuuggcaaaauacucuugcccagauucug

SEQ ID NO: 304729 - RNA, 32 nt, Human
accuuuggccuuccucucuacauuuaagagua

SEQ ID NO: 304730 - RNA, 32 nt, Human
accuuugggcucuccagguccgagauccuagu

SEQ ID NO: 304731 - RNA, 32 nt, Human
accuuuggggcucguggugguggagagggcag

SEQ ID NO: 304732 - RNA, 32 nt, Human
accuuuguagcuccuccagccucugcagagac

SEQ ID NO: 304733 - RNA, 32 nt, Human
accuuugucaggcugggcgcgguggcucacuc

SEQ ID NO: 304734 - RNA, 32 nt, Human
accuuuguccccaccgcagacaggaccagggg

SEQ ID NO: 304735 - RNA, 32 nt, Human
accuuugucgcaccuuaaccagucaccacuug

SEQ ID NO: 304736 - RNA, 32 nt, Human
accuuugucucuuccucccuuugauuaauugc

SEQ ID NO: 304737 - RNA, 32 nt, Human
accuuugucuucuucaucuggcgccgguacug

SEQ ID NO: 304738 - RNA, 32 nt, Human
accuuugugagucagccaugcccgcaaagcgu

SEQ ID NO: 304739 - RNA, 32 nt, Human
accuuuguuggaugugggccuuagccuccagg

SEQ ID NO: 304740 - RNA, 32 nt, Human
accuuuguugggaggcgguuugggagaacaca

SEQ ID NO: 304741 - RNA, 32 nt, Human
accuuuguugucuuugaauucuuuaggcugca

SEQ ID NO: 304742 - RNA, 32 nt, Human
accuuuguuuguaucauagaucuuauuguaca

SEQ ID NO: 304743 - RNA, 32 nt, Human
accuuuuaaaggccacuggcaguaggauuuaa

SEQ ID NO: 304744 - RNA, 32 nt, Human
accuuuuaaguugacaacaugacucauauaua

SEQ ID NO: 304745 - RNA, 32 nt, Human
accuuuucauaccugguucaacaucagcgaau

SEQ ID NO: 304746 - RNA, 32 nt, Human
accuuuucauauuaaugacaaaauuagagucu

SEQ ID NO: 304747 - RNA, 32 nt, Human
accuuuucauucucucuuucuuuaucuuuguu

SEQ ID NO: 304748 - RNA, 32 nt, Human
accuuuucauucuuuucuuuauauucuagaca

SEQ ID NO: 304749 - RNA, 32 nt, Human
accuuuucauuuccugcucucuccccucuuuu

SEQ ID NO: 304750 - RNA, 21 nt, Human
accuuuuccaaagcuuccaga

SEQ ID NO: 304751 - RNA, 32 nt, Human
accuuuuccagaggaaccuguucuacggccag

SEQ ID NO: 304752 - RNA, 32 nt, Human
accuuuuccaguucuccaaagcgauguauuuu

SEQ ID NO: 304753 - RNA, 32 nt, Human
accuuuuccugucucugaccucaucugcuccc

SEQ ID NO: 304754 - RNA, 32 nt, Human
accuuuuccuuauuuuauugccaaucaggaca

SEQ ID NO: 304755 - RNA, 32 nt, Human
accuuuuccuucugguuuugagagacuuccuc

SEQ ID NO: 304756 - RNA, 32 nt, Human
accuuuucucacaaaaaggcaaauauugaagu

SEQ ID NO: 304757 - RNA, 32 nt, Human
accuuuucucccuggccuucugcuccaagcuc

SEQ ID NO: 304758 - RNA, 32 nt, Human
accuuuucuccgugaguuccucagccaggacu

SEQ ID NO: 304759 - RNA, 32 nt, Human
accuuuucuccuaaaacuucucuccuuucucu

SEQ ID NO: 304760 - RNA, 32 nt, Human
accuuuucuguggcuggcucuaccuuccuguc

SEQ ID NO: 304761 - RNA, 32 nt, Human
accuuuugaccauaacuguuuccccagagcag

SEQ ID NO: 304762 - RNA, 32 nt, Human
accuuuugaguggucuacuuguuuucucucuu

SEQ ID NO: 304763 - RNA, 32 nt, Human
accuuuugcaguccuugucaaacacacuccug

SEQ ID NO: 304764 - RNA, 32 nt, Human
accuuuugccuggguggcugccugagaaaggu

SEQ ID NO: 304765 - RNA, 32 nt, Human
accuuuugcuacugcuggaccaugauccgccu

SEQ ID NO: 304766 - RNA, 22 nt, Human
accuuuugcuguagauuuacca

SEQ ID NO: 304767 - RNA, 32 nt, Human
accuuuuggaaaugcccauugccgacuugaau

SEQ ID NO: 304768 - RNA, 32 nt, Human
accuuuuggucuucagccucccucagccccca

SEQ ID NO: 304769 - RNA, 32 nt, Human
accuuuuguucuagggacuagcacugcuauca

SEQ ID NO: 304770 - RNA, 32 nt, Human
accuuuuuaucuguucucuccaccuucaguuu

SEQ ID NO: 304771 - RNA, 32 nt, Human
accuuuuucuugcuauagccucccuccucugc

SEQ ID NO: 304772 - RNA, 32 nt, Human
accuuuuugguaucugugugacugcucugugc

SEQ ID NO: 304773 - RNA, 32 nt, Human
accuuuuuguuuuguagccugcuuuugcuuuc

SEQ ID NO: 304774 - RNA, 32 nt, Human
acgaaacugcaucaaaaugucaguuguaauuu

SEQ ID NO: 304775 - RNA, 32 nt, Human
acgaaacuuguggggcuacaggccaguggaac

SEQ ID NO: 304776 - RNA, 32 nt, Human
acgaaagaguucuguucagacuucugaagagc

SEQ ID NO: 304777 - RNA, 20 nt, Human
acgaaagauccaucccggaa

SEQ ID NO: 304778 - RNA, 32 nt, Human
acgaaagcaauguuggguuggggaagacagug

SEQ ID NO: 304779 - RNA, 32 nt, Human
acgaaaggcaggcgggcuguguacugggcccu

SEQ ID NO: 304780 - RNA, 32 nt, Human
acgaaaggcagggcugacugaauagccagggg

SEQ ID NO: 304781 - RNA, 32 nt, Human
acgaaaggcauagaaggagaagacaaaguguc

SEQ ID NO: 304782 - RNA, 32 nt, Human
acgaaagggagaccacaugugugcacagggaa

SEQ ID NO: 304783 - RNA, 32 nt, Human
acgaaauacuacagcccugcucccaggugugc

SEQ ID NO: 304784 - RNA, 32 nt, Human
acgaaaucaccuucaguuucugaggucacagc

SEQ ID NO: 304785 - RNA, 32 nt, Human
acgaaaucauuuuacucugacuccucaccguc

SEQ ID NO: 304786 - RNA, 32 nt, Human
acgaaaugcuagccagggugcaauggcucaug

SEQ ID NO: 304787 - RNA, 32 nt, Human
acgaacaaggacugggcuggguccagcuggug

SEQ ID NO: 304788 - RNA, 32 nt, Human
acgaacaauugggaaucuccugggacaacuug

SEQ ID NO: 304789 - RNA, 32 nt, Human
acgaacacacacccuucuccgcucccaggucu

SEQ ID NO: 304790 - RNA, 32 nt, Human
acgaacagccugacacauacgcacggggccgc

SEQ ID NO: 304791 - RNA, 31 nt, Human
acgaacaggccaauaaggagggagcagugcg

SEQ ID NO: 304792 - RNA, 32 nt, Human
acgaaccaggguggaagcgccaggagcagcug

SEQ ID NO: 304793 - RNA, 32 nt, Human
acgaacuuccugagcuuuucaggcucuaaugg

SEQ ID NO: 304794 - RNA, 32 nt, Human
acgaagacaccuggagcagggcaaacaccacu

SEQ ID NO: 304795 - RNA, 32 nt, Human
acgaagacagaagaaguaagaggcagggccgu

SEQ ID NO: 304796 - RNA, 32 nt, Human
acgaagacaugugaacuugguucaguccaaau

SEQ ID NO: 304797 - RNA, 32 nt, Human
acgaagaccagcuucugccacugccuuuccag

SEQ ID NO: 304798 - RNA, 32 nt, Human
acgaagacgagaugucacagagguccacucag

SEQ ID NO: 304799 - RNA, 21 nt, Human
acgaagagagccaucuuccag

SEQ ID NO: 304800 - RNA, 32 nt, Human
acgaagagcaggaagagguugcugagauuguu

SEQ ID NO: 304801 - RNA, 32 nt, Human
acgaagaggaggaggaugaggaggacacagaa

SEQ ID NO: 304802 - RNA, 21 nt, Human
acgaagaucaagccacggcug

SEQ ID NO: 304803 - RNA, 32 nt, Human
acgaagaugagguaggcauauaggggcuucug

SEQ ID NO: 304804 - RNA, 32 nt, Human
acgaagcaacagcagucagauccauuacaaag

SEQ ID NO: 304805 - RNA, 32 nt, Human
acgaagcaggacaggcagagcccaggguacug

SEQ ID NO: 304806 - RNA, 32 nt, Human
acgaagcccuccucagcuggccuguguuuggg

SEQ ID NO: 304807 - RNA, 32 nt, Human
acuagccugggcaacccagugagaccccguau

SEQ ID NO: 304808 - RNA, 32 nt, Human
acuagccugggcaauaugaugagacccugucu

SEQ ID NO: 304809 - RNA, 32 nt, Human
acuagccugggcgagacuucaucucuacaaaa

SEQ ID NO: 304810 - RNA, 24 nt, Human
acuagccuggucaacauggugaaa

SEQ ID NO: 304811 - RNA, 32 nt, Human
acuagccugugaucccagcacuuugggaggcc

SEQ ID NO: 304812 - RNA, 32 nt, Human
acuagccuucagauuacuuugcacuggaaccu

SEQ ID NO: 304813 - RNA, 32 nt, Human
acuagcgaggggcagagcacaccccagugcuu

SEQ ID NO: 304814 - RNA, 32 nt, Human
acuagcgucauccccagagggcuugguaaggg

SEQ ID NO: 304815 - RNA, 32 nt, Human
acuagcguguguuguccuucugccucagaucu

SEQ ID NO: 304816 - RNA, 32 nt, Human
acuagcuaaccaagaagagaggcagagaaggu

SEQ ID NO: 304817 - RNA, 32 nt, Human
acuagcuacauccucaggguaggaggaagaug

SEQ ID NO: 304818 - RNA, 32 nt, Human
acuagcuacugcacuccaaccugggcaacaua

SEQ ID NO: 304819 - RNA, 32 nt, Human
acuagcuaguuuaccuuaacugccuuuauuuu

SEQ ID NO: 304820 - RNA, 32 nt, Human
acuagcucgauggucugaaaacagagaugagc

SEQ ID NO: 304821 - RNA, 32 nt, Human
acuagcucuggcccugcaccuacucucacugg

SEQ ID NO: 304822 - RNA, 32 nt, Human
acuagcucuguugcuacuaagcagcuuuuacu

SEQ ID NO: 304823 - RNA, 32 nt, Human
acuagcugcucacaagccuguuccuucuucca

SEQ ID NO: 304824 - RNA, 32 nt, Human
acuagcuggaggacaccugaguacucuuaaag

SEQ ID NO: 304825 - RNA, 32 nt, Human
acuagcuggcacauuaucccuaccuuaguucu

SEQ ID NO: 304826 - RNA, 32 nt, Human
acuagcuggccuggcccuguugagucugcaca

SEQ ID NO: 304827 - RNA, 32 nt, Human
acuagcugggauuacagcugccugccaccgug

SEQ ID NO: 304828 - RNA, 32 nt, Human
acuagcugggauuacaggcacaagccaccaug

SEQ ID NO: 304829 - RNA, 32 nt, Human
acuagcugggauuacaggcgugcgccaccaug

SEQ ID NO: 304830 - RNA, 32 nt, Human
acuagcuggucaagggcaugacagugcuggag

SEQ ID NO: 304831 - RNA, 32 nt, Human
acuagcuguaagcggaacacccugccccaggg

SEQ ID NO: 304832 - RNA, 32 nt, Human
acuagcuguggucugaccuaguuaauuuacaa

SEQ ID NO: 304833 - RNA, 32 nt, Human
acuagcugugugaccuugggcaaguugcuuau

SEQ ID NO: 304834 - RNA, 32 nt, Human
acuagcugugugagcucuucugcccagguggg

SEQ ID NO: 304835 - RNA, 32 nt, Human
acuagcuucaaguugggauucccaccaccccu

SEQ ID NO: 304836 - RNA, 32 nt, Human
acuagcuuccaaaauguguucccuuuuugaau

SEQ ID NO: 304837 - RNA, 32 nt, Human
acuagcuugggugacagaggaagacugucuca

SEQ ID NO: 304838 - RNA, 32 nt, Human
acuagcuuugccugguuuugucuuuuaugcag

SEQ ID NO: 304839 - RNA, 32 nt, Human
acuagcuuuuuggccauuucaucuuccaguca

SEQ ID NO: 304840 - RNA, 32 nt, Human
acuaggaaaaauucacuuacguuauuuuaaaa

SEQ ID NO: 304841 - RNA, 32 nt, Human
acuaggaaacuugccauccucucagaauugcu

SEQ ID NO: 304842 - RNA, 32 nt, Human
acuaggaaaggaggaaagguaucagggauuuu

SEQ ID NO: 304843 - RNA, 32 nt, Human
acuaggacuagaggaauugucagcauuauugg

SEQ ID NO: 304844 - RNA, 32 nt, Human
acuaggacucagaaacgagaucgggaagacga

SEQ ID NO: 304845 - RNA, 28 nt, Human
acuaggagcagggcugccucuucucccu

SEQ ID NO: 304846 - RNA, 32 nt, Human
acuaggagccucagcaggauugcuaggaugug

SEQ ID NO: 304847 - RNA, 32 nt, Human
acuaggagcugucuuagaaaugacuucaaacu

SEQ ID NO: 304848 - RNA, 21 nt, Human
acuaggaggcagagguugcag

SEQ ID NO: 304849 - RNA, 32 nt, Human
acuaggaggcagagguugcagugagcaguuau

SEQ ID NO: 304850 - RNA, 32 nt, Human
acuaggaggcagagguugcagugagccgagau

SEQ ID NO: 304851 - RNA, 32 nt, Human
acuaggagggccuggcaaggaagugugcccuu

SEQ ID NO: 304852 - RNA, 32 nt, Human
acuaggaguaucucacuuuccacugagaaccc

SEQ ID NO: 304853 - RNA, 32 nt, Human
acuaggaguuuucucuggcuucaccuuuuuca

SEQ ID NO: 304854 - RNA, 32 nt, Human
acuaggauaauacaucuuccacacauuuggcc

SEQ ID NO: 304855 - RNA, 32 nt, Human
acuaggauauauaaaacagggacucuagcuag

SEQ ID NO: 304856 - RNA, 32 nt, Human
acuaggaugcagagaugaccucucgcugccuc

SEQ ID NO: 304857 - RNA, 32 nt, Human
acuaggaugcagauggaccacacuuugagaaa

SEQ ID NO: 304858 - RNA, 32 nt, Human
acuaggauuugaggaagucacagggaagcaga

SEQ ID NO: 304859 - RNA, 32 nt, Human
acuaggcaacagagccagacccugucucaaau

SEQ ID NO: 304860 - RNA, 32 nt, Human
acuaggcaagcagaagagugugagcucaucag

SEQ ID NO: 304861 - RNA, 32 nt, Human
acuaggcacuaacaucgcugacuugcaugauu

SEQ ID NO: 304862 - RNA, 32 nt, Human
acuaggcagccccagaucuggggaacagauga

SEQ ID NO: 304863 - RNA, 32 nt, Human
acuaggcauaggacaggaaguggggugguaag

SEQ ID NO: 304864 - RNA, 32 nt, Human
acuaggccagggauuagccacugugggagggu

SEQ ID NO: 304865 - RNA, 32 nt, Human
acuaggcccaggagucaagaaaagcuuuugug

SEQ ID NO: 304866 - RNA, 32 nt, Human
acuaggccccacucagccuggccuggacaccg

SEQ ID NO: 304867 - RNA, 32 nt, Human
acuaggccucuuuccagggccccacacucaca

SEQ ID NO: 304868 - RNA, 32 nt, Human
acuaggcucagagcaaccuccagccuucucca

SEQ ID NO: 304869 - RNA, 24 nt, Human
acuaggcugcauugcuuugaagag

SEQ ID NO: 304870 - RNA, 32 nt, Human
acuaggcuguaucccacacaaaacacgcacac

SEQ ID NO: 304871 - RNA, 32 nt, Human
acuaggcuuaauaccugggugaugacauaauc

SEQ ID NO: 304872 - RNA, 32 nt, Human
acuaggcuuaauaccugggugauuacauaauc

SEQ ID NO: 304873 - RNA, 32 nt, Human
acuaggcuucuccccucaggggcucuuucuga

SEQ ID NO: 304874 - RNA, 32 nt, Human
acuagggaccgccugggugaggugaggaccug

SEQ ID NO: 304875 - RNA, 32 nt, Human
acuagggaggagagaaagggacaaaagcaccc

SEQ ID NO: 304876 - RNA, 32 nt, Human
acuagggaggcugagccaggaggaucacuuga

SEQ ID NO: 304877 - RNA, 32 nt, Human
acuagggaggcugaggagggaggaucucuugu

SEQ ID NO: 304878 - RNA, 32 nt, Human
acuagggaggcugaggcaagaggcuugagacc

SEQ ID NO: 304879 - RNA, 32 nt, Human
acuagggaggcugaggcagaagaaucgcuuga

SEQ ID NO: 304880 - RNA, 32 nt, Human
acuagggaggcugaggcaggagaaucacuuga

SEQ ID NO: 304881 - RNA, 32 nt, Human
acuagggaggcugaggcaggagaaucgcuuga

SEQ ID NO: 304882 - RNA, 32 nt, Human
acuagggaggcugaggcaggagaaucucuuga

SEQ ID NO: 304883 - RNA, 32 nt, Human
acuagggaggcugaggugggaggaucacuuga

SEQ ID NO: 304884 - RNA, 32 nt, Human
acuagggaggcuuuugaacccaggaggcagag

SEQ ID NO: 304885 - RNA, 32 nt, Human
acuagggagggagggagagggagagagggaga

SEQ ID NO: 304886 - RNA, 32 nt, Human
acuagggagggagggagggaaggcagagaaaa

SEQ ID NO: 304887 - RNA, 32 nt, Human
acuagggcagggacaggauaagagggauuagg

SEQ ID NO: 304888 - RNA, 32 nt, Human
acuagggcaguaucuccucuagcuagugccca

SEQ ID NO: 304889 - RNA, 32 nt, Human
acuagggccauggcggagacagaccuggacac

SEQ ID NO: 304890 - RNA, 32 nt, Human
acuagggccugcaaauggagugggggaguccu

SEQ ID NO: 304891 - RNA, 32 nt, Human
acuaggggcauguagaguauaugaggaggcag

SEQ ID NO: 304892 - RNA, 32 nt, Human
acuagggguaccccaacucggagagaaggacc

SEQ ID NO: 304893 - RNA, 32 nt, Human
acuagggucgccggggaagcgguuugggagag

SEQ ID NO: 304894 - RNA, 32 nt, Human
acuagggucuggggacacagaaggagccggca

SEQ ID NO: 304895 - RNA, 32 nt, Human
acuaggguugacaugaaucccccugguucagg

SEQ ID NO: 304896 - RNA, 32 nt, Human
acuagguaagagaagcaccugauuggguagaa

SEQ ID NO: 304897 - RNA, 20 nt, Human
acuagguaagccaaggaguu

SEQ ID NO: 304898 - RNA, 32 nt, Human
acuagguacuuaauaaauauuugcuguugaug

SEQ ID NO: 304899 - RNA, 32 nt, Human
acuaggucaggaguucaagaccagccuggcca

SEQ ID NO: 304900 - RNA, 32 nt, Human
acuaggugccaggaaugcgccaccccauccuc

SEQ ID NO: 304901 - RNA, 32 nt, Human
acuaggugccgaccccucagaauauaacccuc

SEQ ID NO: 304902 - RNA, 32 nt, Human
acuaggugggcccuugaaggggagcccaacuc

SEQ ID NO: 304903 - RNA, 32 nt, Human
acuaggugugcaccacugcucuucuuauggag

SEQ ID NO: 304904 - RNA, 32 nt, Human
acuaggugugugugcacauguguagggugcag

SEQ ID NO: 304905 - RNA, 32 nt, Human
acuagguuuugagccacgggucagggugccac

SEQ ID NO: 304906 - RNA, 32 nt, Human
acuaguaacugagacuccuccagccuccuccc

SEQ ID NO: 304907 - RNA, 32 nt, Human
acuaguacauugaccagcgcugggugauacag

SEQ ID NO: 304908 - RNA, 32 nt, Human
acuaguagcucuggacugaggaauccucccug

SEQ ID NO: 304909 - RNA, 32 nt, Human
acuaguaggcagguuucucuuguugucuagac

SEQ ID NO: 304910 - RNA, 32 nt, Human
acuaguauuuugcuucaagccuucugaaaaua

SEQ ID NO: 304911 - RNA, 32 nt, Human
acuagucaaguaucuucuuuccuuuuccagua

SEQ ID NO: 304912 - RNA, 32 nt, Human
acuagucauaacuguuuauacaccacucucau

SEQ ID NO: 304913 - RNA, 32 nt, Human
acuaguccaggaaaggaacaugacagauuugu

SEQ ID NO: 304914 - RNA, 32 nt, Human
acuagucccucucuccccaaccucugccaggg

SEQ ID NO: 304915 - RNA, 32 nt, Human
acuagucuaccagugaccucagggcacuuugg

SEQ ID NO: 304916 - RNA, 32 nt, Human
acuagucuccccuuaucugugguuuugcuucc

SEQ ID NO: 304917 - RNA, 32 nt, Human
acuagucuuucaggagguuugcucuuagaacu

SEQ ID NO: 304918 - RNA, 32 nt, Human
acuagugaaagaugcaguguguagaccagaga

SEQ ID NO: 304919 - RNA, 32 nt, Human
acuagugacccagaaaggcaagggcaugggga

SEQ ID NO: 304920 - RNA, 32 nt, Human
acuagugagcaagguuggaaacagggccaggu

SEQ ID NO: 304921 - RNA, 32 nt, Human
acuagugccacugccguggcccagccgggcca

SEQ ID NO: 304922 - RNA, 32 nt, Human
acuagugggacccagcaaagacccacagcagc

SEQ ID NO: 304923 - RNA, 32 nt, Human
acuagugggcggggccugucagugagcggccc

SEQ ID NO: 304924 - RNA, 19 nt, Human
acuaguguauauucacuga

SEQ ID NO: 304925 - RNA, 32 nt, Human
acuagugugggaaggaaaauauugagcuaggc

SEQ ID NO: 304926 - RNA, 32 nt, Human
acuaguguuagcccaaggugggcagaaagccc

SEQ ID NO: 304927 - RNA, 32 nt, Human
acuaguguugggggcagagcggggcaggaaag

SEQ ID NO: 304928 - RNA, 18 nt, Human
acuaguguuuuuuagaua

SEQ ID NO: 304929 - RNA, 21 nt, Human
acuaguuauuccuugcuuuua

SEQ ID NO: 304930 - RNA, 32 nt, Human
acuaguucacacauaaaguccuuuuaaggaga

SEQ ID NO: 304931 - RNA, 32 nt, Human
acuaguugaagggaguucuggggccaggcuca

SEQ ID NO: 304932 - RNA, 31 nt, Human
acuauaaaacaaugcuacucuccuuaccaaa

SEQ ID NO: 304933 - RNA, 32 nt, Human
acuauaaaacauccuucucuuauucuccauac

SEQ ID NO: 304934 - RNA, 32 nt, Human
acuauaaaagacaagaggaagggcagguacua

SEQ ID NO: 304935 - RNA, 32 nt, Human
acuauaaacaugacaucuacaaaaagaggggu

SEQ ID NO: 304936 - RNA, 32 nt, Human
acuauaaaugugaaaacuacaaggaagguuuu

SEQ ID NO: 304937 - RNA, 19 nt, Human
acuauaacaccugccacca

SEQ ID NO: 304938 - RNA, 32 nt, Human
acuauaagaaggucugauaaacugaugaaaug

SEQ ID NO: 304939 - RNA, 31 nt, Human
acuauaagaugaguucgcucacuggauccuu

SEQ ID NO: 304940 - RNA, 32 nt, Human
acuauaagccagacugcucugauaggucugau

SEQ ID NO: 304941 - RNA, 32 nt, Human
acuauaagcccaaacuuuccucagcugcauaa

SEQ ID NO: 304942 - RNA, 24 nt, Human
acuauaagcuccaccucccagguu

SEQ ID NO: 304943 - RNA, 32 nt, Human
acuauaauaaccaccccauacacuuuacaguu

SEQ ID NO: 304944 - RNA, 32 nt, Human
acuauaaucccagcuacucgggaggcugagac

SEQ ID NO: 304945 - RNA, 32 nt, Human
acuauaaucccagcuacuugggaggcugaggc

SEQ ID NO: 304946 - RNA, 32 nt, Human
acuauaauuggaagugcugagcucuggggcag

SEQ ID NO: 304947 - RNA, 32 nt, Human
acuauacaguuacaucuuaauuccauccaaag

SEQ ID NO: 304948 - RNA, 32 nt, Human
acuauacauauguauguguauauguguauaca

SEQ ID NO: 304949 - RNA, 32 nt, Human
acuauaccagucccccuguuccuccuuccccu

SEQ ID NO: 304950 - RNA, 24 nt, Human
acuauaccuuggucagccaccuca

SEQ ID NO: 304951 - RNA, 26 nt, Human
acuauacgaauuuuaugguuuguaua

SEQ ID NO: 304952 - RNA, 32 nt, Human
acuauacuuuuuggaaauuaugaauuuguccu

SEQ ID NO: 304953 - RNA, 32 nt, Human
acuauagaguuuguggacagauuuauauuggg

SEQ ID NO: 304954 - RNA, 32 nt, Human
acuauagaugcgccaccauggccagcuaauuu

SEQ ID NO: 304955 - RNA, 32 nt, Human
acuauagcagggcugggcucugucuuccuggu

SEQ ID NO: 304956 - RNA, 32 nt, Human
acuauagcccacaacccaaagaagcaaaaauu

SEQ ID NO: 304957 - RNA, 32 nt, Human
acuauagccugaugucccacauugacccacug

SEQ ID NO: 304958 - RNA, 32 nt, Human
acuauagcgcugcagccgcccccagcccugug

SEQ ID NO: 304959 - RNA, 32 nt, Human
acuauagcuaaaauauguaaaccuuucuaggu

SEQ ID NO: 304960 - RNA, 32 nt, Human
acuauagcuucagggauaauauagcuuuaagg

SEQ ID NO: 304961 - RNA, 32 nt, Human
acuauagggggcagcccccugccuugugaccu

SEQ ID NO: 304962 - RNA, 32 nt, Human
acuauaggugugagccacugcaccuggccugg

SEQ ID NO: 304963 - RNA, 32 nt, Human
acuauaguucacaggacagagcagagccaugg

SEQ ID NO: 304964 - RNA, 32 nt, Human
acuauauacuauacacuguaucuccuguggcc

SEQ ID NO: 304965 - RNA, 32 nt, Human
acuauaucaugggcucugcagaacauaucaaa

SEQ ID NO: 304966 - RNA, 20 nt, Human
acuauaugcucuagagaccu

SEQ ID NO: 304967 - RNA, 32 nt, Human
acuauauguguccaaaauaucacugcauacaa

SEQ ID NO: 304968 - RNA, 32 nt, Human
acuauauguguguauauagugugugauguaua

SEQ ID NO: 304969 - RNA, 32 nt, Human
acuauauuagucaguuuucacacugcugauaa

SEQ ID NO: 304970 - RNA, 32 nt, Human
acuauauugcccaagcuacagugcaaugauua

SEQ ID NO: 304971 - RNA, 32 nt, Human
acuauauuguccaggcuagagugcaguggcua

SEQ ID NO: 304972 - RNA, 32 nt, Human
acuauauuuacagaagauguuugguugcuggg

SEQ ID NO: 304973 - RNA, 32 nt, Human
acuaucaaacaauaaaggaagaauggugcugu

SEQ ID NO: 304974 - RNA, 32 nt, Human
acuaucacccaggcuggagugcaguggcauaa

SEQ ID NO: 304975 - RNA, 32 nt, Human
acuaucaccugggcuggagugcgauggcauga

SEQ ID NO: 304976 - RNA, 32 nt, Human
acuaucacugcaaccuccgccuccuggguuca

SEQ ID NO: 304977 - RNA, 32 nt, Human
acuaucagauuugacuaaugaagaggaaaucu

SEQ ID NO: 304978 - RNA, 32 nt, Human
acuaucaucacaaggucccuggacuaaggcug

SEQ ID NO: 304979 - RNA, 32 nt, Human
acuauccacugcaguccucaguuguuggggua

SEQ ID NO: 304980 - RNA, 32 nt, Human
acuauccagguaaaacacuggcccaagauuug

SEQ ID NO: 304981 - RNA, 32 nt, Human
acuaucccaagagagcagaaaagggauguagu

SEQ ID NO: 304982 - RNA, 32 nt, Human
acuaucccauugcaaguuucucuccaaauaaa

SEQ ID NO: 304983 - RNA, 32 nt, Human
acuauccccaaagaaggagcuguuggggaccc

SEQ ID NO: 304984 - RNA, 32 nt, Human
acuauccugggcaaauguuuuacccuguccuc

SEQ ID NO: 304985 - RNA, 32 nt, Human
acuauccuguggcuguggcagauaugucaaua

SEQ ID NO: 304986 - RNA, 32 nt, Human
acuauccuugcagcccuuguggugagagcuuc

SEQ ID NO: 304987 - RNA, 32 nt, Human
acuaucguugcugguaagccugggcuugcugu

SEQ ID NO: 304988 - RNA, 32 nt, Human
acuaucuaucuaugcuuugcaaagacuaaggc

SEQ ID NO: 304989 - RNA, 32 nt, Human
acuaucucaaccuccauuguuacccacuaggu

SEQ ID NO: 304990 - RNA, 32 nt, Human
acuaucucagaaaaggagagcuuguugugaaa

SEQ ID NO: 304991 - RNA, 32 nt, Human
acuaucucagaaacaaaacaaaacaaaacaac

SEQ ID NO: 304992 - RNA, 32 nt, Human
acuaucuccaaagaaaaggcugacagauggua

SEQ ID NO: 304993 - RNA, 32 nt, Human
acuaucuccccuguuggaggugaguggccugu

SEQ ID NO: 304994 - RNA, 32 nt, Human
acuaucucugcacuccugggguuuuguuacau

SEQ ID NO: 304995 - RNA, 32 nt, Human
acuaucucuugggagcccccaaaagcugggaa

SEQ ID NO: 304996 - RNA, 32 nt, Human
acuaucugccuaaauaauuucuuucuaccucc

SEQ ID NO: 304997 - RNA, 32 nt, Human
acuaucugucaggggagguuguacaggugaau

SEQ ID NO: 304998 - RNA, 32 nt, Human
acuaucuuaaugauucuucaaaucuaaaacug

SEQ ID NO: 304999 - RNA, 20 nt, Human
acuaucuugauuuucacuga

SEQ ID NO: 305000 - RNA, 32 nt, Human
acuaucuuggaugauuucuuuuacagauuggu

SEQ ID NO: 305001 - RNA, 32 nt, Human
acuaucuugguuggcaucaucaggcccugagg

SEQ ID NO: 305002 - RNA, 32 nt, Human
acuaucuuuccaagccucacauuauacaucac

SEQ ID NO: 305003 - RNA, 32 nt, Human
acuaucuuucuccaagucaucaaaacaaagcu

SEQ ID NO: 305004 - RNA, 32 nt, Human
acuaugaagggcccuguuuucaaaaucuaaca

SEQ ID NO: 305005 - RNA, 32 nt, Human
acuaugaaucuacauaaaagccacuuguuuuu

SEQ ID NO: 305006 - RNA, 32 nt, Human
acuaugaaugcagugaccucagccagcaacag

SEQ ID NO: 305007 - RNA, 32 nt, Human
acuaugaugggcuucuguucucugcugagggc

SEQ ID NO: 305008 - RNA, 32 nt, Human
acuaugauugugccacugcacuccagccuggg

SEQ ID NO: 305009 - RNA, 32 nt, Human
acuaugauuuuagaaucauuuauuucucccuu

SEQ ID NO: 305010 - RNA, 32 nt, Human
acuaugcaagcuauaagacaauggaguauuau

SEQ ID NO: 305011 - RNA, 31 nt, Human
acuaugcaaggagguuagagaaauaaggaag

SEQ ID NO: 305012 - RNA, 32 nt, Human
acuaugcacacagcacucgcucuuaacuccuc

SEQ ID NO: 305013 - RNA, 32 nt, Human
acuaugcacacagcacucgcucuuagcuccuc

SEQ ID NO: 305014 - RNA, 32 nt, Human
acuaugcacaugcauuacacacaugcacacac

SEQ ID NO: 305015 - RNA, 32 nt, Human
acuaugcagaugggaacucugagccacacaga

SEQ ID NO: 305016 - RNA, 32 nt, Human
acuaugcauccuucacagccucagggaacuua

SEQ ID NO: 305017 - RNA, 32 nt, Human
acuaugccacugcacuccagccuaggugacaa

SEQ ID NO: 305018 - RNA, 32 nt, Human
acuaugccacugcacucccgccugggugacaa

SEQ ID NO: 305019 - RNA, 32 nt, Human
acuaugccacuguacuccagccuggguaacag

SEQ ID NO: 305020 - RNA, 32 nt, Human
acuaugccauaguguucuccaucucuagugaa

SEQ ID NO: 305021 - RNA, 32 nt, Human
acuaugcccggcuaacuuuuuguauuuuuagu

SEQ ID NO: 305022 - RNA, 32 nt, Human
acuaugccgcauucauuuaaagcuauuuuguu

SEQ ID NO: 305023 - RNA, 32 nt, Human
acuauggagaaacuuuguaugugcacacaaaa

SEQ ID NO: 305024 - RNA, 32 nt, Human
acuauggaggcugggcagugguucaugccuua

SEQ ID NO: 305025 - RNA, 32 nt, Human
acuauggaucagaauagccacauuuggaauac

SEQ ID NO: 305026 - RNA, 28 nt, Human
acuauggcagcagcacggcacagcacgc

SEQ ID NO: 305027 - RNA, 32 nt, Human
acuauggcaggaaaacagagaugguuuaguaa

SEQ ID NO: 305028 - RNA, 32 nt, Human
acuauggccugggagucccagguucuccugug

SEQ ID NO: 305029 - RNA, 32 nt, Human
acuauggcuauauacccugaccaauaaaugau

SEQ ID NO: 305030 - RNA, 32 nt, Human
acuauggcuccaugcugugugacagaucaacg

SEQ ID NO: 305031 - RNA, 32 nt, Human
acuauggcugcccucugggcucccagaaccca

SEQ ID NO: 305032 - RNA, 32 nt, Human
acuauggcuggaacauuggaaaaaggagagcc

SEQ ID NO: 305033 - RNA, 32 nt, Human
acuaugggacuggauacaaacacacacccggc

SEQ ID NO: 305034 - RNA, 32 nt, Human
acuaugggagugaaggaggaggagggaugcca

SEQ ID NO: 305035 - RNA, 22 nt, Human
acuaugggcaaagauacaugug

SEQ ID NO: 305036 - RNA, 32 nt, Human
acuauguaccagaaucaguuguuggagaaaaa

SEQ ID NO: 305037 - RNA, 32 nt, Human
acuauguaccugcagugggguugcagagaugg

SEQ ID NO: 305038 - RNA, 32 nt, Human
acuauguauauuaugcagaaacagucuguucc

SEQ ID NO: 305039 - RNA, 32 nt, Human
acuauguauuuuuaaagaguugguaaaucuua

SEQ ID NO: 305040 - RNA, 32 nt, Human
acuaugucacccuggcuggagugcaguagugc

SEQ ID NO: 305041 - RNA, 32 nt, Human
acuaugucaggaauggagguuugcuaacccag

SEQ ID NO: 305042 - RNA, 32 nt, Human
acuaugucauuuuucuuuaccuugaagaacau

SEQ ID NO: 305043 - RNA, 32 nt, Human
acuauguccccuccauugaauuuuuguaaaaa

SEQ ID NO: 305044 - RNA, 32 nt, Human
acuauguccuagugaagacaucaaccuccgcc

SEQ ID NO: 305045 - RNA, 28 nt, Human
acuaugucgcccaggguagucucaaacu

SEQ ID NO: 305046 - RNA, 32 nt, Human
acuaugucuaauucuuccuuacucccaaccca

SEQ ID NO: 305047 - RNA, 32 nt, Human
acuaugugaagggugauuggagaaggacaaga

SEQ ID NO: 305048 - RNA, 32 nt, Human
acuaugugaauggcacuuaccaccugcuggag

SEQ ID NO: 305049 - RNA, 32 nt, Human
acuaugugacgcaguccucucaggagucugag

SEQ ID NO: 305050 - RNA, 32 nt, Human
acuaugugagccacuccaguguucccagcccc

SEQ ID NO: 305051 - RNA, 32 nt, Human
acuauguggccuuccaaaauagguaguguuug

SEQ ID NO: 305052 - RNA, 32 nt, Human
acuauguguauguauauagaugugcauauaaa

SEQ ID NO: 305053 - RNA, 28 nt, Human
acuaugugucugcagacccagggaccac

SEQ ID NO: 305054 - RNA, 28 nt, Human
acuaugugugagaaggagcuggagcuug

SEQ ID NO: 305055 - RNA, 32 nt, Human
acuauguuacccaggcuggacuccaacuccug

SEQ ID NO: 305056 - RNA, 32 nt, Human
acuauguugccaaggcucaucuugagaagcag

SEQ ID NO: 305057 - RNA, 32 nt, Human
acuauguugcccaggcuggagugcaguggugc

SEQ ID NO: 305058 - RNA, 32 nt, Human
acuauguugcccaggcuggccucaagcaaucc

SEQ ID NO: 305059 - RNA, 32 nt, Human
acuauguugcccaggcuggucucaaguuccug

SEQ ID NO: 305060 - RNA, 32 nt, Human
acuauguuuuguaucauguuccuugaaacugu

SEQ ID NO: 305061 - RNA, 32 nt, Human
acuauuaacuaaaauaugaaacuuaaaaacaa

SEQ ID NO: 305062 - RNA, 32 nt, Human
acuauuacaaccuuccccuugaagaccuggaa

SEQ ID NO: 305063 - RNA, 32 nt, Human
acuauuacccuguguuguauuucccaaguguc

SEQ ID NO: 305064 - RNA, 32 nt, Human
acuauuacucacugcuacacacucgaccuaua

SEQ ID NO: 305065 - RNA, 30 nt, Human
acuauuagccucuccuuuugcuuuuuaagg

SEQ ID NO: 305066 - RNA, 32 nt, Human
acuauuaguggaaaauaccaaauggacaaaua

SEQ ID NO: 305067 - RNA, 32 nt, Human
acuauuaucaacacccuccaugugcagaaacc

SEQ ID NO: 305068 - RNA, 32 nt, Human
acuauuaucucagggcuuucugggcacugcac

SEQ ID NO: 305069 - RNA, 32 nt, Human
acuauuauuugcuuccuaauaggaccacauua

SEQ ID NO: 305070 - RNA, 32 nt, Human
acuauucacagcuucucauuuguguagcuuuc

SEQ ID NO: 305071 - RNA, 32 nt, Human
acuauucacggucacccacagcuuugaggaug

SEQ ID NO: 305072 - RNA, 32 nt, Human
acuauucagaggagccagaaguaaaguuuauu

SEQ ID NO: 305073 - RNA, 32 nt, Human
acuauuccaacaaagagauucuggaaguuuuu

SEQ ID NO: 305074 - RNA, 32 nt, Human
acuauucccagguuuauuucucucucauauga

SEQ ID NO: 305075 - RNA, 16 nt, Human
acuauuccugccacca

SEQ ID NO: 305076 - RNA, 32 nt, Human
acuauuccuucccuuccuaucuccuuucuagc

SEQ ID NO: 305077 - RNA, 32 nt, Human
acuauucucuggagaaaaauaaaauggaaauu

SEQ ID NO: 305078 - RNA, 32 nt, Human
acuauucugcccucccgucaccccuguuucug

SEQ ID NO: 305079 - RNA, 32 nt, Human
acuauucuuguuugccucuuuauuuuugccag

SEQ ID NO: 305080 - RNA, 32 nt, Human
acuauugaaggagggaaaauucucaagguucc

SEQ ID NO: 305081 - RNA, 32 nt, Human
acuauugagaaucuaaauggccauucggauuc

SEQ ID NO: 305082 - RNA, 32 nt, Human
acuauugauccuccugucuccaccucccgagu

SEQ ID NO: 305083 - RNA, 16 nt, Human
acuauugauucacugg

SEQ ID NO: 305084 - RNA, 22 nt, Human
acuauugcucuguuucauuuca

SEQ ID NO: 305085 - RNA, 32 nt, Human
acuauugcugcuuucucuucuacuucuugugc

SEQ ID NO: 305086 - RNA, 32 nt, Human
acuauuggaagugcuuucaacucagccacauc

SEQ ID NO: 305087 - RNA, 32 nt, Human
acuauuggugcgcuccagccgggcagguuuug

SEQ ID NO: 305088 - RNA, 32 nt, Human
acuauugucugcuauuguugccauuuuucaaa

SEQ ID NO: 305089 - RNA, 32 nt, Human
acuauuuauuuugccauguuuacauuuuguau

SEQ ID NO: 305090 - RNA, 32 nt, Human
acuauuucauucuauuucaaaugcuuauaaag

SEQ ID NO: 305091 - RNA, 32 nt, Human
acuauuucccauaaugcuucugagagccacua

SEQ ID NO: 305092 - RNA, 32 nt, Human
acuauuucugaacaaagagagcucaucaucag

SEQ ID NO: 305093 - RNA, 32 nt, Human
acuauuucugggguaaagauuuuacaauagca

SEQ ID NO: 305094 - RNA, 32 nt, Human
acuauuucugugcuguccacacucucuugccu

SEQ ID NO: 305095 - RNA, 32 nt, Human
acuauuugaaaauauugaggaggaggaacucc

SEQ ID NO: 305096 - RNA, 32 nt, Human
acuauuugccuuugcccacauuuuugcuccuu

SEQ ID NO: 305097 - RNA, 32 nt, Human
acuauuugcuuacagccacauaugcacccuuc

SEQ ID NO: 305098 - RNA, 32 nt, Human
acuauuuggcaaagauuuguuuuuaaaaaucu

SEQ ID NO: 305099 - RNA, 32 nt, Human
acuauuuguacacauacacacaugcacacccu

SEQ ID NO: 305100 - RNA, 32 nt, Human
acuauuuguacuugaagaaauaaauguuuuug

SEQ ID NO: 305101 - RNA, 32 nt, Human
acuauuuguuagaauaaaguaauuuugcgaaa

SEQ ID NO: 305102 - RNA, 32 nt, Human
acuauuuuccacugcaguguuuugacuucaca

SEQ ID NO: 305103 - RNA, 32 nt, Human
acuauuuuccuugagaaacauucucagcauca

SEQ ID NO: 305104 - RNA, 32 nt, Human
acuauuuucucccauuucugaguugucucuuc

SEQ ID NO: 305105 - RNA, 32 nt, Human
acuauuuucuucucucuuucucucuuuuuccu

SEQ ID NO: 305106 - RNA, 32 nt, Human
acuauuuugcccaggcuggagugcgauggugc

SEQ ID NO: 305107 - RNA, 32 nt, Human
acuauuuuugcaaauauaucauuuuuccuaau

SEQ ID NO: 305108 - RNA, 32 nt, Human
acucaaaaacacaugcauaaauugccaagugg

SEQ ID NO: 305109 - RNA, 32 nt, Human
acucaaaacauguaguuuggaaaugagaauuu

SEQ ID NO: 305110 - RNA, 32 nt, Human
acucaaaagugcugggauuacuggcgucagcc

SEQ ID NO: 305111 - RNA, 32 nt, Human
acucaaacauggcagcgccaccuucuccagga

SEQ ID NO: 305112 - RNA, 32 nt, Human
acucaaaccuagauggcacagacucaucgccu

SEQ ID NO: 305113 - RNA, 32 nt, Human
acucaaaccugucgagcaagggguuaagaguu

SEQ ID NO: 305114 - RNA, 32 nt, Human
acucaaacucugaucuaccaucauuguuuaau

SEQ ID NO: 305115 - RNA, 32 nt, Human
acucaaagaccaggaccucaugcgagccaaga

SEQ ID NO: 305116 - RNA, 32 nt, Human
acucaaaggcggagagcucagugggcaccacc

SEQ ID NO: 305117 - RNA, 32 nt, Human
acucaaaguaauguaaucucagcugggcgugg

SEQ ID NO: 305118 - RNA, 32 nt, Human
acucaaaugcuuucagcucaaaauauuuuuau

SEQ ID NO: 305119 - RNA, 32 nt, Human
acucaaauguguucguggggucuuccaaagcu

SEQ ID NO: 305120 - RNA, 16 nt, Human
acucaaauguguugaa

SEQ ID NO: 305121 - RNA, 32 nt, Human
acucaaauguucuuaaaaaugagaaccagugg

SEQ ID NO: 305122 - RNA, 21 nt, Human
acucaacaaagacaggacaca

SEQ ID NO: 305123 - RNA, 32 nt, Human
acucaacaacucagauuccuggaccugguguc

SEQ ID NO: 305124 - RNA, 32 nt, Human
acucaacaauauaaagaaaaauaaccaaauua

SEQ ID NO: 305125 - RNA, 32 nt, Human
acucaacacugagcagaucuguucuuugagcu

SEQ ID NO: 305126 - RNA, 32 nt, Human
acucaacagaaaauauauuccccaaacaccca

SEQ ID NO: 305127 - RNA, 32 nt, Human
acucaacagaaaauauauuccccaaagcugcu

SEQ ID NO: 305128 - RNA, 32 nt, Human
acucaacagaaaauauauuccccaaaugcccc

SEQ ID NO: 305129 - RNA, 32 nt, Human
acucaacagaaaauauauuccccaaaugcccg

SEQ ID NO: 305130 - RNA, 32 nt, Human
acucaacagguuugaggccccacagcaacaga

SEQ ID NO: 305131 - RNA, 32 nt, Human
acucaacauagaguagaguaacuaucuuuuua

SEQ ID NO: 305132 - RNA, 32 nt, Human
acucaaccacacacagcagcugccugcccugc

SEQ ID NO: 305133 - RNA, 32 nt, Human
acucaaccauaucccuucuggcaauuuccuuc

SEQ ID NO: 305134 - RNA, 32 nt, Human
acucaaccuacaccaugaauuugugucuaucu

SEQ ID NO: 305135 - RNA, 32 nt, Human
acucaacgccagggcgccgccuagagguuggu

SEQ ID NO: 305136 - RNA, 32 nt, Human
acucaacuacaaauaggcugggauucaaugug

SEQ ID NO: 305137 - RNA, 32 nt, Human
acucaacucacagaggagcagaaugggaagag

SEQ ID NO: 305138 - RNA, 32 nt, Human
acucaacuccaccccaucccaucccaccuuga

SEQ ID NO: 305139 - RNA, 32 nt, Human
acucaacugaguaagaaggggcuggugcccag

SEQ ID NO: 305140 - RNA, 32 nt, Human
acucaacugccaagggcaucacuggccaauuc

SEQ ID NO: 305141 - RNA, 32 nt, Human
acucaacuucuguucgacuuguggaucuucac

SEQ ID NO: 305142 - RNA, 32 nt, Human
acucaagacacaaaguccucagggggcgaggg

SEQ ID NO: 305143 - RNA, 32 nt, Human
acucaagacacugaagacuccaaaaaguagga

SEQ ID NO: 305144 - RNA, 18 nt, Human
acucaagagaacgggaug

SEQ ID NO: 305145 - RNA, 32 nt, Human
acucaagagacugaggcaggaggaucacguga

SEQ ID NO: 305146 - RNA, 32 nt, Human
acucaagaggcacaggcgggaggaucacuuga

SEQ ID NO: 305147 - RNA, 32 nt, Human
acucaagaggcugaggcaagagaaucacuuga

SEQ ID NO: 305148 - RNA, 32 nt, Human
acucaagaggcugaggcacgagaaucacuuga

SEQ ID NO: 305149 - RNA, 32 nt, Human
acucaagaggcugaggcagaaggaucccuuga

SEQ ID NO: 305150 - RNA, 32 nt, Human
acucaagaggcugaggcaggagaaucacuugc

SEQ ID NO: 305151 - RNA, 32 nt, Human
acucaagaggcugaggcaggagaaucacuugu

SEQ ID NO: 305152 - RNA, 32 nt, Human
acucaagaggcugagguaggagaaucacuuga

SEQ ID NO: 305153 - RNA, 32 nt, Human
acucaagaggcugaggugagaggagcaaguga

SEQ ID NO: 305154 - RNA, 32 nt, Human
acucaagauacuugccagucucuccagugugg

SEQ ID NO: 305155 - RNA, 32 nt, Human
acucaagaucugugcugccuccucaggagaga

SEQ ID NO: 305156 - RNA, 32 nt, Human
acucaagccagccuguaaacggugcuauuucu

SEQ ID NO: 305157 - RNA, 32 nt, Human
acucaagccucuggcuauuaacauacccuagu

SEQ ID NO: 305158 - RNA, 32 nt, Human
acucaagccugggcaacaccugggugacagag

SEQ ID NO: 305159 - RNA, 32 nt, Human
acucaagccuguaucccagcacuuugggaggc

SEQ ID NO: 305160 - RNA, 32 nt, Human
acucaagcgacugacccgucucagccucccaa

SEQ ID NO: 305161 - RNA, 32 nt, Human
acucaagcgauccaccugccucagcuucccaa

SEQ ID NO: 305162 - RNA, 23 nt, Human
acucaagcgauuuuccugccuca

SEQ ID NO: 305163 - RNA, 32 nt, Human
acucaagcuacagcagcagcacuucccaagcc

SEQ ID NO: 305164 - RNA, 32 nt, Human
acucaaggagggaaugcuuagauaggagcaug

SEQ ID NO: 305165 - RNA, 32 nt, Human
acucaaggcugaggcaggagaaucacuugaac

SEQ ID NO: 305166 - RNA, 32 nt, Human
acucaagggaaagauggaguagagggcaaaua

SEQ ID NO: 305167 - RNA, 32 nt, Human
acucaagggaagagcugcuggagccaggagaa

SEQ ID NO: 305168 - RNA, 32 nt, Human
acucaagguagaugacugacugggaaauuccg

SEQ ID NO: 305169 - RNA, 32 nt, Human
acucaaggucacgcagauagugaaugacagau

SEQ ID NO: 305170 - RNA, 32 nt, Human
acucaagguucauugggcucugcucuccuccc

SEQ ID NO: 305171 - RNA, 24 nt, Human
acucaaguaaaugcuucagucagg

SEQ ID NO: 305172 - RNA, 32 nt, Human
acucaagucaucaccaaugucugucaugcuga

SEQ ID NO: 305173 - RNA, 32 nt, Human
acucaagucuguauguacacuggggagaagca

SEQ ID NO: 305174 - RNA, 32 nt, Human
acucaagugauccuccugccucagcuucccaa

SEQ ID NO: 305175 - RNA, 32 nt, Human
acucaaguggggauugacagagccagauuggg

SEQ ID NO: 305176 - RNA, 32 nt, Human
acucaagugguagugacuccagcagacuuaau

SEQ ID NO: 305177 - RNA, 32 nt, Human
acucaaguuacugcugcugcuauugucuuucc

SEQ ID NO: 305178 - RNA, 32 nt, Human
acucaaguucccaagguauucuguccuccagg

SEQ ID NO: 305179 - RNA, 26 nt, Human
acucaauaaacaaugcauugaaugag

SEQ ID NO: 305180 - RNA, 32 nt, Human
acucaauaaaggaguguuuuuaaucaccucaa

SEQ ID NO: 305181 - RNA, 32 nt, Human
acucaauagagauucuucauuaucuucauggu

SEQ ID NO: 305182 - RNA, 32 nt, Human
acucaauagugagaauauagccucccacccca

SEQ ID NO: 305183 - RNA, 32 nt, Human
acucaauaugcagcuuccuguuucaguagggg

SEQ ID NO: 305184 - RNA, 32 nt, Human
acucaauccaaagugaaugaaaccaaguugga

SEQ ID NO: 305185 - RNA, 32 nt, Human
acucaaucucucccaccucauccucuggcaug

SEQ ID NO: 305186 - RNA, 32 nt, Human
acucaauggccuugggugaugaugcuguaccc

SEQ ID NO: 305187 - RNA, 32 nt, Human
acucaauguguaugacgccacucugaagagua

SEQ ID NO: 305188 - RNA, 32 nt, Human
acucaauucauuguuaacuuccuaaaacagaa

SEQ ID NO: 305189 - RNA, 32 nt, Human
acucaauugauccucccaucucagccucccaa

SEQ ID NO: 305190 - RNA, 20 nt, Human
acucacaaaggucuccuuca

SEQ ID NO: 305191 - RNA, 32 nt, Human
acucacaagacuguaucuccagcccaauggga

SEQ ID NO: 305192 - RNA, 32 nt, Human
acucacaaugacucuggcuggccccacgcagc

SEQ ID NO: 305193 - RNA, 31 nt, Human
acucacacaaguaacaccacagcagaccucg

SEQ ID NO: 305194 - RNA, 32 nt, Human
acucacacacaccacacagacacauacuguuu

SEQ ID NO: 305195 - RNA, 32 nt, Human
acucacacagagaccucucuggguuucuuugc

SEQ ID NO: 305196 - RNA, 32 nt, Human
acucacacagcagccuaggaaggaagggcaga

SEQ ID NO: 305197 - RNA, 21 nt, Human
acucacacaugccucagugcc

SEQ ID NO: 305198 - RNA, 32 nt, Human
acucacaccugcaaucccagcacuuugggagg

SEQ ID NO: 305199 - RNA, 19 nt, Human
acucacaccuguaauccca

SEQ ID NO: 305200 - RNA, 32 nt, Human
acucacaccuguaaucccagcacuuucggagg

SEQ ID NO: 305201 - RNA, 32 nt, Human
acucacaccuguaaucccagcacuuugggaac

SEQ ID NO: 305202 - RNA, 32 nt, Human
acucacaccuguaaucccagcacuuugggagg

SEQ ID NO: 305203 - RNA, 32 nt, Human
acucacaccuguaaucccagcacuuugggagu

SEQ ID NO: 305204 - RNA, 32 nt, Human
acucacaccuguaaucccagcacuuugggauu

SEQ ID NO: 305205 - RNA, 32 nt, Human
acucacaccuguaauccgaguacuuugcgggg

SEQ ID NO: 305206 - RNA, 32 nt, Human
acucacaccuguaaucucagcacguugggaag

SEQ ID NO: 305207 - RNA, 32 nt, Human
acucacaccuguaauuccagcacuucaggagg

SEQ ID NO: 305208 - RNA, 32 nt, Human
acucacaccuguaauuccagcacuuugggaga

SEQ ID NO: 305209 - RNA, 32 nt, Human
acucacaccuguacucccagcacuucaggaag

SEQ ID NO: 305210 - RNA, 32 nt, Human
acucacaccuguauccgaacacuuugggaggc

SEQ ID NO: 305211 - RNA, 32 nt, Human
acucacacugucugaaaggccacccaggaucc

SEQ ID NO: 305212 - RNA, 32 nt, Human
acucacacuuccagcgcccagguccaagucug

SEQ ID NO: 305213 - RNA, 32 nt, Human
acucacacuuguaaucccagcacuuugggagg

SEQ ID NO: 305214 - RNA, 32 nt, Human
acucacagaauauuugcccuccuucuacaaaa

SEQ ID NO: 305215 - RNA, 32 nt, Human
acucacagacuggccccuagucacuggggcug

SEQ ID NO: 305216 - RNA, 32 nt, Human
acucacagaggagcugcuuuagugcagcauug

SEQ ID NO: 305217 - RNA, 32 nt, Human
acucacagauacuagcuccuuagcagcucaca

SEQ ID NO: 305218 - RNA, 32 nt, Human
acucacagccaagagcaggugaccucagaggg

SEQ ID NO: 305219 - RNA, 21 nt, Human
acucacagcccgcugcuguac

SEQ ID NO: 305220 - RNA, 32 nt, Human
acucacagccucccuuccuucuuucucccucc

SEQ ID NO: 305221 - RNA, 32 nt, Human
acucacagcugcugcaccaccaccuuccgcag

SEQ ID NO: 305222 - RNA, 23 nt, Human
acucacagcuuaaagaauuucag

SEQ ID NO: 305223 - RNA, 24 nt, Human
acucacaggcaucggcucaggcca

SEQ ID NO: 305224 - RNA, 20 nt, Human
acucacaggcauuccuccca

SEQ ID NO: 305225 - RNA, 23 nt, Human
acucacagguacuuuuccagcca

SEQ ID NO: 305226 - RNA, 20 nt, Human
acucacaggugggcaaugcc

SEQ ID NO: 305227 - RNA, 23 nt, Human
acucacaggugguccccaggcca

SEQ ID NO: 305228 - RNA, 32 nt, Human
acucacagucuuguuuucccagccucuuuuac

SEQ ID NO: 305229 - RNA, 32 nt, Human
acucacaguggagaaagguaaugcaagauaug

SEQ ID NO: 305230 - RNA, 23 nt, Human
acucacaguuagccagcugacca

SEQ ID NO: 305231 - RNA, 32 nt, Human
acucacaguucaguuucuccuguucuugggga

SEQ ID NO: 305232 - RNA, 32 nt, Human
acucacaguucugcauggcuggggaggccuca

SEQ ID NO: 305233 - RNA, 32 nt, Human
acucacaucuguaauccaagcacuuugggagg

SEQ ID NO: 305234 - RNA, 32 nt, Human
acucacaucuguaaucccagcacuuugggaga

SEQ ID NO: 305235 - RNA, 32 nt, Human
acucacaucuuaagcauucuuccuggcaaaaa

SEQ ID NO: 305236 - RNA, 32 nt, Human
acucacaugugccugcaauaaaccuuuuggaa

SEQ ID NO: 305237 - RNA, 32 nt, Human
acucacauuuaugaugauguucagagauucau

SEQ ID NO: 305238 - RNA, 32 nt, Human
acucacauuuucucagugugcccuucucuuau

SEQ ID NO: 305239 - RNA, 32 nt, Human
acucacauuuuucacugcucugugccuguccg

SEQ ID NO: 305240 - RNA, 32 nt, Human
acucaccaaaucuuugcaccuaguagauauau

SEQ ID NO: 305241 - RNA, 32 nt, Human
acucaccaacaaauguacagcaauacaccauc

SEQ ID NO: 305242 - RNA, 32 nt, Human
acucaccaacuccaguagaaagaaggguguua

SEQ ID NO: 305243 - RNA, 32 nt, Human
acucaccacaaccuccgccuccuggguucaag

SEQ ID NO: 305244 - RNA, 32 nt, Human
acucaccacagcugccuccugagcugccugag

SEQ ID NO: 305245 - RNA, 32 nt, Human
acucaccagcaaaugcugaccugggaauuuga

SEQ ID NO: 305246 - RNA, 32 nt, Human
acucaccaggagguggcagcggugugggagga

SEQ ID NO: 305247 - RNA, 23 nt, Human
acucaccagggccacaggacaca

SEQ ID NO: 305248 - RNA, 20 nt, Human
acucaccaguguccccucca

SEQ ID NO: 305249 - RNA, 32 nt, Human
acucaccaguguccccuccacugucacauugu

SEQ ID NO: 305250 - RNA, 32 nt, Human
acucaccauucaaaccgucugccagcccgggg

SEQ ID NO: 305251 - RNA, 32 nt, Human
acucaccauugcacuccagccuggaugacaga

SEQ ID NO: 305252 - RNA, 32 nt, Human
acucacccauagucccagcuauucaggaggcu

SEQ ID NO: 305253 - RNA, 32 nt, Human
acucaccccugccccaccccgucugcaugcuc

SEQ ID NO: 305254 - RNA, 32 nt, Human
acucaccccuucuauaggcaggccaguucuaa

SEQ ID NO: 305255 - RNA, 32 nt, Human
acucacccgcuauuagaguauggaggaagggg

SEQ ID NO: 305256 - RNA, 32 nt, Human
acucacccuaugcccugguccgcauauggcac

SEQ ID NO: 305257 - RNA, 32 nt, Human
acucacccuuccaccauaugaggacguggcaa

SEQ ID NO: 305258 - RNA, 32 nt, Human
acucaccgugagccaucaaugugcucuggucu

SEQ ID NO: 305259 - RNA, 32 nt, Human
acucaccugaggaagggaaggaagggaauaau

SEQ ID NO: 305260 - RNA, 32 nt, Human
acucaccugccugggacggucaccuguugcag

SEQ ID NO: 305261 - RNA, 32 nt, Human
acucaccugggagcacggcgccuggcucuuac

SEQ ID NO: 305262 - RNA, 32 nt, Human
acucaccuggggccuccaucccagaagcgcag

SEQ ID NO: 305263 - RNA, 32 nt, Human
acucaccuucacuuuccaaaauagcugagggu

SEQ ID NO: 305264 - RNA, 32 nt, Human
acucacgcacacacaagcagagaaggcgcuga

SEQ ID NO: 305265 - RNA, 32 nt, Human
acucacgcagcuccagcccaucuugcugaccu

SEQ ID NO: 305266 - RNA, 32 nt, Human
acucacgccuauaaucccagcacuuugggagg

SEQ ID NO: 305267 - RNA, 32 nt, Human
acucacgccuguaaccccagcacuuugggagg

SEQ ID NO: 305268 - RNA, 19 nt, Human
acucacgccuguaauccca

SEQ ID NO: 305269 - RNA, 32 nt, Human
acucacgccuguaaucccaacauuuugggagg

SEQ ID NO: 305270 - RNA, 32 nt, Human
acucacgccuguaaucccagcacauugggagg

SEQ ID NO: 305271 - RNA, 32 nt, Human
acucacgccuguaaucccagcacuuaggaaga

SEQ ID NO: 305272 - RNA, 32 nt, Human
acucacgccuguaaucccagcacuuuaggagg

SEQ ID NO: 305273 - RNA, 32 nt, Human
acucacgccuguaaucccagcacuuugggagg

SEQ ID NO: 305274 - RNA, 32 nt, Human
acucacgccuguaaucccccagcaauuuggga

SEQ ID NO: 305275 - RNA, 32 nt, Human
acucacgccugucauccuagcacuuugggagg

SEQ ID NO: 305276 - RNA, 32 nt, Human
acucacgccuucacuccugggcccgggacggc

SEQ ID NO: 305277 - RNA, 32 nt, Human
acucacgcuggucaccccauuguuagaaagag

SEQ ID NO: 305278 - RNA, 32 nt, Human
acucacggaagggagguagcucagggaccucc

SEQ ID NO: 305279 - RNA, 32 nt, Human
acucacggcagcccuguggaguacgguguacu

SEQ ID NO: 305280 - RNA, 32 nt, Human
acucacgucugcuucgacagaacugccguaua

SEQ ID NO: 305281 - RNA, 32 nt, Human
acucacgucuguaaucccagcacuuugggagg

SEQ ID NO: 305282 - RNA, 32 nt, Human
acucacuaaagggcuucauuuuaguccagauu

SEQ ID NO: 305283 - RNA, 32 nt, Human
acucacuacuaaacucuaccaagaauggaaac

SEQ ID NO: 305284 - RNA, 32 nt, Human
acucacuaugcagccaaggcuggaagccacuc

SEQ ID NO: 305285 - RNA, 32 nt, Human
acucacuauugacagugcaccaccaccugcuu

SEQ ID NO: 305286 - RNA, 32 nt, Human
acucacucaaaaccagcagugcugcuaucaga

SEQ ID NO: 305287 - RNA, 32 nt, Human
acucacucaccuaauggcaagaaaguugcaug

SEQ ID NO: 305288 - RNA, 32 nt, Human
acucacucacucuccaccagccugggaaauga

SEQ ID NO: 305289 - RNA, 32 nt, Human
acucacucagccuggucagccugguggguacc

SEQ ID NO: 305290 - RNA, 19 nt, Human
acucacuccauggcugcag

SEQ ID NO: 305291 - RNA, 32 nt, Human
acucacuccauggcugcagcaaggagaggcgg

SEQ ID NO: 305292 - RNA, 32 nt, Human
acucacucccacacacacccccuggcucugcu

SEQ ID NO: 305293 - RNA, 32 nt, Human
acucacuccuuaagaaaauggaagagaaaaag

SEQ ID NO: 305294 - RNA, 17 nt, Human
acucacucgccaggguc

SEQ ID NO: 305295 - RNA, 32 nt, Human
acucacucggccucacuucauccuugcaaaga

SEQ ID NO: 305296 - RNA, 32 nt, Human
acucacucguacaugccuucuuccacaguggg

SEQ ID NO: 305297 - RNA, 32 nt, Human
acucacucucucucaccauuucccagcgcucc

SEQ ID NO: 305298 - RNA, 32 nt, Human
acucacucugauucuccugugccacaggaaaa

SEQ ID NO: 305299 - RNA, 32 nt, Human
acucacucuuucccucuuucuucaggaaugaa

SEQ ID NO: 305300 - RNA, 32 nt, Human
acucacugaagucccuucccucucccuucuag

SEQ ID NO: 305301 - RNA, 32 nt, Human
acucacugagccccaggcccaaggauaaugau

SEQ ID NO: 305302 - RNA, 32 nt, Human
acucacugagccugacaucugccuguaagcag

SEQ ID NO: 305303 - RNA, 32 nt, Human
acucacugauuccuacacauugccaagauuuc

SEQ ID NO: 305304 - RNA, 32 nt, Human
acucacugcaaccuccaccucccagguucaag

SEQ ID NO: 305305 - RNA, 32 nt, Human
acucacugcaaccuccaccucccagguucaga

SEQ ID NO: 305306 - RNA, 32 nt, Human
acucacugcaaccuccaccucccggguucaag

SEQ ID NO: 305307 - RNA, 32 nt, Human
acucacugcaaccuccaccuccuguguucaag

SEQ ID NO: 305308 - RNA, 32 nt, Human
acucacugcaaccuccgccuccuggguucaag

SEQ ID NO: 305309 - RNA, 32 nt, Human
acucacugcaacuuccaccuccuggagucaag

SEQ ID NO: 305310 - RNA, 32 nt, Human
acucacugcaacuuccgccuccuggggucaag

SEQ ID NO: 305311 - RNA, 32 nt, Human
acucacugcaacuucugccacccagguucaag

SEQ ID NO: 305312 - RNA, 32 nt, Human
acucacugcaagcuccgccuccuggguucaca

SEQ ID NO: 305313 - RNA, 32 nt, Human
acucacugcaaucuccaccucccacagguuca

SEQ ID NO: 305314 - RNA, 19 nt, Human
acucacugcagagcugcug

SEQ ID NO: 305315 - RNA, 32 nt, Human
acucacugcagccucaaacuccuggguucaag

SEQ ID NO: 305316 - RNA, 32 nt, Human
acucacugcagccucaaacuucuggccucaag

SEQ ID NO: 305317 - RNA, 32 nt, Human
acucacugcagccucaaccucccaggcucaug

SEQ ID NO: 305318 - RNA, 32 nt, Human
acucacugcagccucaaccuccuggggccaag

SEQ ID NO: 305319 - RNA, 32 nt, Human
acucacugcagccuccgccuccuggguucaag

SEQ ID NO: 305320 - RNA, 21 nt, Human
acucacugccagguacugugc

SEQ ID NO: 305321 - RNA, 32 nt, Human
acucacugcccugucugaaauguggcagccac

SEQ ID NO: 305322 - RNA, 32 nt, Human
acucacugccucccccaagggcccccucuaag

SEQ ID NO: 305323 - RNA, 32 nt, Human
acucacugcucuuugcuguugccugaggacca

SEQ ID NO: 305324 - RNA, 24 nt, Human
acucacuggcugcagcagaacaca

SEQ ID NO: 305325 - RNA, 32 nt, Human
acucacuggggaggaagcaaggaagcaaacag

SEQ ID NO: 305326 - RNA, 24 nt, Human
acucacugucauucacaaggcaca

SEQ ID NO: 305327 - RNA, 32 nt, Human
acucacuguggaggucauaaggaagcuacuuu

SEQ ID NO: 305328 - RNA, 32 nt, Human
acucacuucauccucagcagaacuccugccug

SEQ ID NO: 305329 - RNA, 32 nt, Human
acucacuugcaacuccaccucagcaguggucu

SEQ ID NO: 305330 - RNA, 32 nt, Human
acucacuuguuaguuugcagggaggguaaaac

SEQ ID NO: 305331 - RNA, 32 nt, Human
acucagaaaaggaggcggcuucgggcuuucgu

SEQ ID NO: 305332 - RNA, 22 nt, Human
acucagaaaaucaaagggcuag

SEQ ID NO: 305333 - RNA, 26 nt, Human
acucagaaaaugucuuuucuuuaaaa

SEQ ID NO: 305334 - RNA, 32 nt, Human
acucagaaacagacaguuucaagcuggccuau

SEQ ID NO: 305335 - RNA, 32 nt, Human
acucagaaaccaggcucgaggccuaucccagc

SEQ ID NO: 305336 - RNA, 32 nt, Human
acucagaaaccucaggguucaccagaaacauu

SEQ ID NO: 305337 - RNA, 32 nt, Human
acucagaaagccucaaugaaauggagcuggcu

SEQ ID NO: 305338 - RNA, 32 nt, Human
acucagaaaucaagauacacaagugggaauug

SEQ ID NO: 305339 - RNA, 32 nt, Human
acucagaacccccuccagucucucugucucuc

SEQ ID NO: 305340 - RNA, 32 nt, Human
acucagaacucuugugacauuagccagugggg

SEQ ID NO: 305341 - RNA, 32 nt, Human
acucagaagaaugggccuuucugccauaauuc

SEQ ID NO: 305342 - RNA, 32 nt, Human
acucagaagacugaggccggaggaucacuuga

SEQ ID NO: 305343 - RNA, 32 nt, Human
acucagaaggcggaggcugcagugagccgaga

SEQ ID NO: 305344 - RNA, 32 nt, Human
acucagaaggcggagguuccagugagccaucg

SEQ ID NO: 305345 - RNA, 32 nt, Human
acucagaagguggagguugcagugaggcgaga

SEQ ID NO: 305346 - RNA, 32 nt, Human
acucagaauuggaacuuuuuacauuugaguuu

SEQ ID NO: 305347 - RNA, 32 nt, Human
acucagacaccaccgaucacaggcuggcccag

SEQ ID NO: 305348 - RNA, 32 nt, Human
acucagacagggcugagugccuccacccugau

SEQ ID NO: 305349 - RNA, 32 nt, Human
acucagaccccagcccucagcuggcugcccau

SEQ ID NO: 305350 - RNA, 32 nt, Human
acucagacccuccuuaaagugaggagcgaggg

SEQ ID NO: 305351 - RNA, 32 nt, Human
acucagacuagaauggagguagaaagaacuga

SEQ ID NO: 305352 - RNA, 32 nt, Human
acucagacuauagccguuguuucccaaacuuc

SEQ ID NO: 305353 - RNA, 32 nt, Human
acucagacucacugcccugagccugcacagag

SEQ ID NO: 305354 - RNA, 32 nt, Human
acucagagaaaagagauugagauguaagucuc

SEQ ID NO: 305355 - RNA, 32 nt, Human
acucagagaagacauucuggaucauuucauau

SEQ ID NO: 305356 - RNA, 18 nt, Human
acucagagaagcuggccg

SEQ ID NO: 305357 - RNA, 20 nt, Human
acucagagaauaaccagaga

SEQ ID NO: 305358 - RNA, 31 nt, Human
acucagaggaaauuugcacagaugcugcuuu

SEQ ID NO: 305359 - RNA, 32 nt, Human
acucagaggaagaggcaggggcagcagccgac

SEQ ID NO: 305360 - RNA, 32 nt, Human
acucagaggagaaaacuaaauaguagagaaag

SEQ ID NO: 305361 - RNA, 32 nt, Human
acucagaggagaaggagggggaggagaagaga

SEQ ID NO: 305362 - RNA, 32 nt, Human
acucagaggagagagauaaggaaggaaaguag

SEQ ID NO: 305363 - RNA, 32 nt, Human
acucagaggcagacccagaaaggggcucagga

SEQ ID NO: 305364 - RNA, 32 nt, Human
acucagaggcggcccuuugccucugccugccg

SEQ ID NO: 305365 - RNA, 32 nt, Human
acucagagggaugacugcuggggguagacugg

SEQ ID NO: 305366 - RNA, 32 nt, Human
acucagagggcugaggugggaggaucacuuga

SEQ ID NO: 305367 - RNA, 32 nt, Human
acucagagugugcuuguccuucccuaaaaugu

SEQ ID NO: 305368 - RNA, 32 nt, Human
acucagaugaggacagagugguuuccaaugug

SEQ ID NO: 305369 - RNA, 32 nt, Human
acucagaugaucaagugagagccccagauucc

SEQ ID NO: 305370 - RNA, 32 nt, Human
acucagcaacgacccauaccucagacccgacg

SEQ ID NO: 305371 - RNA, 32 nt, Human
acucagcacagcccugggcacaucgcuucucu

SEQ ID NO: 305372 - RNA, 32 nt, Human
acucagcaccugugguucccauggcaguguca

SEQ ID NO: 305373 - RNA, 32 nt, Human
acucagcacucacucagggcucugggagccag

SEQ ID NO: 305374 - RNA, 32 nt, Human
acucagcagaaguaucagaaguagugguaugg

SEQ ID NO: 305375 - RNA, 32 nt, Human
acucagcagccagagccucagagccagcaggc

SEQ ID NO: 305376 - RNA, 32 nt, Human
acucagcagggcucugggaaugugccuuccuu

SEQ ID NO: 305377 - RNA, 32 nt, Human
acucagcagggugaggugagaggaucacuuga

SEQ ID NO: 305378 - RNA, 32 nt, Human
acucagcagucuuuacugcaggaaaagcugcg

SEQ ID NO: 305379 - RNA, 32 nt, Human
acucagcagugcaguuggcugagaagaggaaa

SEQ ID NO: 305380 - RNA, 32 nt, Human
acucagcaguuguugggcaaguuccuuugccc

SEQ ID NO: 305381 - RNA, 24 nt, Human
acucagcauagauuguauaaaaua

SEQ ID NO: 305382 - RNA, 32 nt, Human
acucagcaucggaagguggcggugaccgaggg

SEQ ID NO: 305383 - RNA, 32 nt, Human
acucagccaggaauucaagaccagccugggca

SEQ ID NO: 305384 - RNA, 32 nt, Human
acucagccaggcccuccuccuccugggcuugc

SEQ ID NO: 305385 - RNA, 32 nt, Human
acucagccaucccgguuaccgguggcaggaug

SEQ ID NO: 305386 - RNA, 32 nt, Human
acucagccauggaacugucauagaagaaaccu

SEQ ID NO: 305387 - RNA, 32 nt, Human
acucagcccauuucccccucuggugcugagaa

SEQ ID NO: 305388 - RNA, 17 nt, Human
acucagccccgcuccca

SEQ ID NO: 305389 - RNA, 32 nt, Human
acucagccccuaggaguauauuuccgcacuuc

SEQ ID NO: 305390 - RNA, 32 nt, Human
acucagcccgggaggcaggcuccaggccucag

SEQ ID NO: 305391 - RNA, 32 nt, Human
acucagcccuucccagcacuuguccagagccu

SEQ ID NO: 305392 - RNA, 32 nt, Human
acucagcccuuccccaugucagggagcuacuc

SEQ ID NO: 305393 - RNA, 32 nt, Human
acucagcccuucuccagcaccacugaagagac

SEQ ID NO: 305394 - RNA, 32 nt, Human
acucagccucccaggcugccagcaauucacuu

SEQ ID NO: 305395 - RNA, 32 nt, Human
acucagccuggcagaggaagaaggaaggcaga

SEQ ID NO: 305396 - RNA, 32 nt, Human
acucagccugggacuggcugggcgagacucuc

SEQ ID NO: 305397 - RNA, 32 nt, Human
acucagccuuuaaucuuacacacacgucucuu

SEQ ID NO: 305398 - RNA, 32 nt, Human
acucagccuuucuguucuaccuaggucucuaa

SEQ ID NO: 305399 - RNA, 32 nt, Human
acucagcgggcguggaggucgcggcggacgga

SEQ ID NO: 305400 - RNA, 32 nt, Human
acucagcgucucugaaccucaugcuccucccc

SEQ ID NO: 305401 - RNA, 21 nt, Human
acucagcuacaugugaccucc

SEQ ID NO: 305402 - RNA, 32 nt, Human
acucagcucaccucucccuccaccuccucucc

SEQ ID NO: 305403 - RNA, 32 nt, Human
acucagcucacugcaaccucugccuccuggau

SEQ ID NO: 305404 - RNA, 32 nt, Human
acucagcucugucugcucaaugccauugugca

SEQ ID NO: 305405 - RNA, 32 nt, Human
acucagcugcagaggccgcacagccaggagcu

SEQ ID NO: 305406 - RNA, 32 nt, Human
acucagcugccuacugggaggcuggggagaau

SEQ ID NO: 305407 - RNA, 32 nt, Human
acucagcuggacugcauugaaggcgaggcugc

SEQ ID NO: 305408 - RNA, 32 nt, Human
acucagcugggguggcagagggcgagaggcuc

SEQ ID NO: 305409 - RNA, 23 nt, Human
acucagcugugacccugcuccaa

SEQ ID NO: 305410 - RNA, 32 nt, Human
acucagcugugacccugcuccaacaccagccc

SEQ ID NO: 305411 - RNA, 32 nt, Human
acucagcuuaauucuccuucccagauaaggca

SEQ ID NO: 305412 - RNA, 32 nt, Human
acucagcuuccuacccacaccucugccagaag

SEQ ID NO: 305413 - RNA, 32 nt, Human
acucagcuugacuucugucaugaaucagugcu

SEQ ID NO: 305414 - RNA, 32 nt, Human
acucagcuuggguucugugcuccuccucucuu

SEQ ID NO: 305415 - RNA, 31 nt, Human
acucagcuuucccagcaccuacccaggcaga

SEQ ID NO: 305416 - RNA, 21 nt, Human
acucaggaaagccagccccca

SEQ ID NO: 305417 - RNA, 32 nt, Human
acucaggaagcugagacaagaggaucaauuga

SEQ ID NO: 305418 - RNA, 32 nt, Human
acucaggaagcugaggugagaggaucucuaga

SEQ ID NO: 305419 - RNA, 32 nt, Human
acucaggaaggugggagagagccaagcccugu

SEQ ID NO: 305420 - RNA, 32 nt, Human
acucaggaauagcuucccucuggacuguagag

SEQ ID NO: 305421 - RNA, 32 nt, Human
acucaggacagagagucugagaaucuucaaaa

SEQ ID NO: 305422 - RNA, 32 nt, Human
acucaggaccccgggcaccacacccaggcggu

SEQ ID NO: 305423 - RNA, 32 nt, Human
acucaggagacggagguuacagugagucgaga

SEQ ID NO: 305424 - RNA, 32 nt, Human
acucaggagaggggagaaaggaggugcaccug

SEQ ID NO: 305425 - RNA, 32 nt, Human
acucaggagauggagguuucagugagccaaga

SEQ ID NO: 305426 - RNA, 15 nt, Human
acucaggagcaaggu

SEQ ID NO: 305427 - RNA, 32 nt, Human
acucaggagcucugucacaaagcuguucaugg

SEQ ID NO: 305428 - RNA, 32 nt, Human
acucaggaggcagaaguugcgguuagccgaga

SEQ ID NO: 305429 - RNA, 32 nt, Human
acucaggaggcagaauucaguguguuaucauu

SEQ ID NO: 305430 - RNA, 32 nt, Human
acucaggaggcagaggcacaagaauggcuuga

SEQ ID NO: 305431 - RNA, 32 nt, Human
acucaggaggcagagguugcaaugagccaaga

SEQ ID NO: 305432 - RNA, 32 nt, Human
acucaggaggcagagguugcagugagccaaga

SEQ ID NO: 305433 - RNA, 32 nt, Human
acucaggaggccaaggugggaggaucacuuga

SEQ ID NO: 305434 - RNA, 32 nt, Human
acucaggaggcggagcuugcagugagccgaga

SEQ ID NO: 305435 - RNA, 32 nt, Human
acucaggaggcggagguugcggugagccgaga

SEQ ID NO: 305436 - RNA, 32 nt, Human
acucaggaggcggagguugcggugagcugaga

SEQ ID NO: 305437 - RNA, 32 nt, Human
acucaggaggcggaguuugcagugagcugagg

SEQ ID NO: 305438 - RNA, 32 nt, Human
acucaggaggcugaaacaggagaaucacuuga

SEQ ID NO: 305439 - RNA, 32 nt, Human
acucaggaggcugaagcaagagaaucacuuga

SEQ ID NO: 305440 - RNA, 32 nt, Human
acucaggaggcugaagcaagagaaucgcuuga

SEQ ID NO: 305441 - RNA, 32 nt, Human
acucaggaggcugaagcaccagaaucucuuga

SEQ ID NO: 305442 - RNA, 32 nt, Human
acucaggaggcugaagcagaagaaucacuuga

SEQ ID NO: 305443 - RNA, 32 nt, Human
acucaggaggcugaagcaggagaaucacuuga

SEQ ID NO: 305444 - RNA, 32 nt, Human
acucaggaggcugaagcaggagaaucgcugga

SEQ ID NO: 305445 - RNA, 32 nt, Human
acucaggaggcugaagcaggagaaucgcuuga

SEQ ID NO: 305446 - RNA, 32 nt, Human
acucaggaggcugaagcaggaggauagcuuga

SEQ ID NO: 305447 - RNA, 32 nt, Human
acucaggaggcugaagugggaggaucccuuga

SEQ ID NO: 305448 - RNA, 32 nt, Human
acucaggaggcugagacaagaaucacuugaac

SEQ ID NO: 305449 - RNA, 32 nt, Human
acucaggaggcugagacaggagaaucaccuga

SEQ ID NO: 305450 - RNA, 32 nt, Human
acucaggaggcugagacaggagaaucacuuga

SEQ ID NO: 305451 - RNA, 32 nt, Human
acucaggaggcugagaugagaggaucacuuga

SEQ ID NO: 305452 - RNA, 32 nt, Human
acucaggaggcugagaugggaguaucagaauc

SEQ ID NO: 305453 - RNA, 32 nt, Human
acucaggaggcugaggaagaucacuugaaccc

SEQ ID NO: 305454 - RNA, 32 nt, Human
acucaggaggcugaggaaggagaaucacuuga

SEQ ID NO: 305455 - RNA, 32 nt, Human
acucaggaggcugaggagggaggauuaucuga

SEQ ID NO: 305456 - RNA, 32 nt, Human
acucaggaggcugaggcaagagaaucacugga

SEQ ID NO: 305457 - RNA, 32 nt, Human
acucaggaggcugaggcaagagaaucacuuga

SEQ ID NO: 305458 - RNA, 32 nt, Human
acucaggaggcugaggcaagagaaucgcuuga

SEQ ID NO: 305459 - RNA, 32 nt, Human
acucaggaggcugaggcaagagaaucguuuga

SEQ ID NO: 305460 - RNA, 32 nt, Human
acucaggaggcugaggcaagagaauugcuuga

SEQ ID NO: 305461 - RNA, 32 nt, Human
acucaggaggcugaggcaagagaauugcuugg

SEQ ID NO: 305462 - RNA, 32 nt, Human
acucaggaggcugaggcacaagaaucacuuga

SEQ ID NO: 305463 - RNA, 32 nt, Human
acucaggaggcugaggcacaagaaucgcuuga

SEQ ID NO: 305464 - RNA, 32 nt, Human
acucaggaggcugaggcacgagaaucgcuuga

SEQ ID NO: 305465 - RNA, 32 nt, Human
acucaggaggcugaggcagaagaaucacuuga

SEQ ID NO: 305466 - RNA, 32 nt, Human
acucaggaggcugaggcagaagaaucgcuuga

SEQ ID NO: 305467 - RNA, 32 nt, Human
acucaggaggcugaggcagaaggaucucugga

SEQ ID NO: 305468 - RNA, 32 nt, Human
acucaggaggcugaggcaggaaaaucacuuga

SEQ ID NO: 305469 - RNA, 32 nt, Human
acucaggaggcugaggcaggaagaucgcuuaa

SEQ ID NO: 305470 - RNA, 32 nt, Human
acucaggaggcugaggcaggagaaaaguguga

SEQ ID NO: 305471 - RNA, 32 nt, Human
acucaggaggcugaggcaggagaagggcguga

SEQ ID NO: 305472 - RNA, 32 nt, Human
acucaggaggcugaggcaggagaaggguggga

SEQ ID NO: 305473 - RNA, 32 nt, Human
acucaggaggcugaggcaggagaaucaauuga

SEQ ID NO: 305474 - RNA, 32 nt, Human
acucaggaggcugaggcaggagaaucacucgg

SEQ ID NO: 305475 - RNA, 32 nt, Human
acucaggaggcugaggcaggagaaucacuuga

SEQ ID NO: 305476 - RNA, 32 nt, Human
acucaggaggcugaggcaggagaaucacuugu

SEQ ID NO: 305477 - RNA, 32 nt, Human
acucaggaggcugaggcaggagaaucacuuuc

SEQ ID NO: 305478 - RNA, 32 nt, Human
acucaggaggcugaggcaggagaaucagaggu

SEQ ID NO: 305479 - RNA, 32 nt, Human
acucaggaggcugaggcaggagaaucauuuca

SEQ ID NO: 305480 - RNA, 32 nt, Human
acucaggaggcugaggcaggagaaucccuuga

SEQ ID NO: 305481 - RNA, 32 nt, Human
acucaggaggcugaggcaggagaaucgccuga

SEQ ID NO: 305482 - RNA, 32 nt, Human
acucaggaggcugaggcaggagaaucgcguga

SEQ ID NO: 305483 - RNA, 32 nt, Human
acucaggaggcugaggcaggagaaucgcuaga

SEQ ID NO: 305484 - RNA, 32 nt, Human
acucaggaggcugaggcaggagaaucgcugga

SEQ ID NO: 305485 - RNA, 32 nt, Human
acucaggaggcugaggcaggagaaucgcuuaa

SEQ ID NO: 305486 - RNA, 32 nt, Human
acucaggaggcugaggcaggagaaucgcuuga

SEQ ID NO: 305487 - RNA, 32 nt, Human
acucaggaggcugaggcaggagaaucgcuugu

SEQ ID NO: 305488 - RNA, 32 nt, Human
acucaggaggcugaggcaggagaaucguuuga

SEQ ID NO: 305489 - RNA, 32 nt, Human
acucaggaggcugaggcaggagaaucucggga

SEQ ID NO: 305490 - RNA, 32 nt, Human
acucaggaggcugaggcaggagaaucucuuga

SEQ ID NO: 305491 - RNA, 32 nt, Human
acucaggaggcugaggcaggagaauuacuuga

SEQ ID NO: 305492 - RNA, 32 nt, Human
acucaggaggcugaggcaggagaauuacuuua

SEQ ID NO: 305493 - RNA, 32 nt, Human
acucaggaggcugaggcaggagagucacuuga

SEQ ID NO: 305494 - RNA, 32 nt, Human
acucaggaggcugaggcaggagagugguguga

SEQ ID NO: 305495 - RNA, 32 nt, Human
acucaggaggcugaggcaggagcauugcuuga

SEQ ID NO: 305496 - RNA, 32 nt, Human
acucaggaggcugaggcaggaggaccgcuuga

SEQ ID NO: 305497 - RNA, 32 nt, Human
acucaggaggcugaggcaggaggaucacagug

SEQ ID NO: 305498 - RNA, 32 nt, Human
acucaggaggcugaggcaggaggaucacuuga

SEQ ID NO: 305499 - RNA, 32 nt, Human
acucaggaggcugaggcaggaggaucccuuga

SEQ ID NO: 305500 - RNA, 32 nt, Human
acucaggaggcugaggcaggaggaucccuugg

SEQ ID NO: 305501 - RNA, 32 nt, Human
acucaggaggcugaggcaggaggaucgcuuga

SEQ ID NO: 305502 - RNA, 32 nt, Human
acucaggaggcugaggcaggaggauugccuga

SEQ ID NO: 305503 - RNA, 32 nt, Human
acucaggaggcugaggcaggaggauugcuuga

SEQ ID NO: 305504 - RNA, 32 nt, Human
acucaggaggcugaggcaggagggucucuuga

SEQ ID NO: 305505 - RNA, 32 nt, Human
acucaggaggcugaggcaggauaaucacuuga

SEQ ID NO: 305506 - RNA, 32 nt, Human
acucaggaggcugaggcagggaggauccauug

SEQ ID NO: 305507 - RNA, 32 nt, Human
acucaggaggcugaggcaggggaaucgcuuga

SEQ ID NO: 305508 - RNA, 32 nt, Human
acucaggaggcugaggcaggggaaucucuuga

SEQ ID NO: 305509 - RNA, 32 nt, Human
acucaggaggcugaggcaggugaaucacuuga

SEQ ID NO: 305510 - RNA, 32 nt, Human
acucaggaggcugaggcaguagaaucauuuga

SEQ ID NO: 305511 - RNA, 32 nt, Human
acucaggaggcugaggcaugagaaucacuuga

SEQ ID NO: 305512 - RNA, 32 nt, Human
acucaggaggcugaggcaugagaaucgcuuga

SEQ ID NO: 305513 - RNA, 32 nt, Human
acucaggaggcugaggcaugagaaucgcuugg

SEQ ID NO: 305514 - RNA, 32 nt, Human
acucaggaggcugaggccggagaaucgcuuga

SEQ ID NO: 305515 - RNA, 32 nt, Human
acucaggaggcugaggcgagagaaucgcuuga

SEQ ID NO: 305516 - RNA, 32 nt, Human
acucaggaggcugaggcgggagaaucacuuga

SEQ ID NO: 305517 - RNA, 32 nt, Human
acucaggaggcugaggcgggagaaucccuuga

SEQ ID NO: 305518 - RNA, 32 nt, Human
acucaggaggcugaggcgggaggaucgcuuga

SEQ ID NO: 305519 - RNA, 32 nt, Human
acucaggaggcugaggcggggaggauccauug

SEQ ID NO: 305520 - RNA, 32 nt, Human
acucaggaggcugaggcuagagaaucacuuga

SEQ ID NO: 305521 - RNA, 32 nt, Human
acucaggaggcugaggcuagaggauccuugag

SEQ ID NO: 305522 - RNA, 32 nt, Human
acucaggaggcugaggcuggagaaucauuuga

SEQ ID NO: 305523 - RNA, 32 nt, Human
acucaggaggcugaggcuggaggaucgcuuga

SEQ ID NO: 305524 - RNA, 32 nt, Human
acucaggaggcugaggcuggaggauugguuga

SEQ ID NO: 305525 - RNA, 32 nt, Human
acucaggaggcugaggcuugagcccaggaggu

SEQ ID NO: 305526 - RNA, 32 nt, Human
acucaggaggcugaggggaggaucacuggagc

SEQ ID NO: 305527 - RNA, 32 nt, Human
acucaggaggcugagguaggagaaucaccuga

SEQ ID NO: 305528 - RNA, 32 nt, Human
acucaggaggcugagguaggagaaucacuuga

SEQ ID NO: 305529 - RNA, 32 nt, Human
acucaggaggcugagguaggagaaucauugaa

SEQ ID NO: 305530 - RNA, 32 nt, Human
acucaggaggcugagguaggaggaucgcuuga

SEQ ID NO: 305531 - RNA, 32 nt, Human
acucaggaggcugagguaguaggauuguuuga

SEQ ID NO: 305532 - RNA, 32 nt, Human
acucaggaggcugaggugagagaucuuuugag

SEQ ID NO: 305533 - RNA, 32 nt, Human
acucaggaggcugaggugagaggauuccuuga

SEQ ID NO: 305534 - RNA, 32 nt, Human
acucaggaggcugagguggaaggaucacuuga

SEQ ID NO: 305535 - RNA, 32 nt, Human
acucaggaggcugagguggaaggauugcuuga

SEQ ID NO: 305536 - RNA, 32 nt, Human
acucaggaggcugaggugggaaaaucacuuga

SEQ ID NO: 305537 - RNA, 32 nt, Human
acucaggaggcugaggugggaagaucaucuaa

SEQ ID NO: 305538 - RNA, 32 nt, Human
acucaggaggcugaggugggaggaucaccuaa

SEQ ID NO: 305539 - RNA, 32 nt, Human
acucaggaggcugaggugggaggaucacugga

SEQ ID NO: 305540 - RNA, 32 nt, Human
acucaggaggcugaggugggaggaucacuugg

SEQ ID NO: 305541 - RNA, 32 nt, Human
acucaggaggcugaggugggaggaucauuuga

SEQ ID NO: 305542 - RNA, 32 nt, Human
acucaggaggcugaggugggaggaucccuuga

SEQ ID NO: 305543 - RNA, 32 nt, Human
acucaggaggcugaggugggaggaucgcuugu

SEQ ID NO: 305544 - RNA, 32 nt, Human
acucaggaggcugaggugggaggauugcuuga

SEQ ID NO: 305545 - RNA, 32 nt, Human
acucaggaggcugagucaggagaaucacuuga

SEQ ID NO: 305546 - RNA, 32 nt, Human
acucaggaggcugaugcaagaggaucgcuuga

SEQ ID NO: 305547 - RNA, 32 nt, Human
acucaggaggcugauguaugaggaucaccuga

SEQ ID NO: 305548 - RNA, 32 nt, Human
acucaggaggcuggggaaggaagaucacuuaa

SEQ ID NO: 305549 - RNA, 32 nt, Human
acucaggaggcuguggcgagaggaacacuuga

SEQ ID NO: 305550 - RNA, 32 nt, Human
acucaggaggucagaggacuggcuccugugac

SEQ ID NO: 305551 - RNA, 32 nt, Human
acucaggagguggagguugcagugagcugaga

SEQ ID NO: 305552 - RNA, 32 nt, Human
acucaggagguggagguugcggugagccaaga

SEQ ID NO: 305553 - RNA, 32 nt, Human
acucaggagguugaggugggaggaucacuuga

SEQ ID NO: 305554 - RNA, 32 nt, Human
acucaggagucugagcugggaggaucacucaa

SEQ ID NO: 305555 - RNA, 32 nt, Human
acucaggaguuugagagcagccagggcaacac

SEQ ID NO: 305556 - RNA, 32 nt, Human
acucaggaugacuaagaacagagcaggugaca

SEQ ID NO: 305557 - RNA, 32 nt, Human
acucaggaugcugaagcagaagaauggccuga

SEQ ID NO: 305558 - RNA, 32 nt, Human
acucaggaugcugaaguaggaggaucgcuuga

SEQ ID NO: 305559 - RNA, 32 nt, Human
acucaggaugcugaggugggagaaucaccuga

SEQ ID NO: 305560 - RNA, 20 nt, Human
acucaggauguguauaagau

SEQ ID NO: 305561 - RNA, 22 nt, Human
acucaggcacccgaggcugcug

SEQ ID NO: 305562 - RNA, 32 nt, Human
acucaggccacuggcacguugggccaggcaga

SEQ ID NO: 305563 - RNA, 32 nt, Human
acucaggccaguuucaugcaggagggaacuuu

SEQ ID NO: 305564 - RNA, 32 nt, Human
acucaggccuccagggauccaugggggaguga

SEQ ID NO: 305565 - RNA, 32 nt, Human
acucaggccuguaaucccagcacuuugggagg

SEQ ID NO: 305566 - RNA, 32 nt, Human
acucaggcuacugagguauuuuagagcaacaa

SEQ ID NO: 305567 - RNA, 32 nt, Human
acucaggcuagcccaucugagaagacuuuccu

SEQ ID NO: 305568 - RNA, 32 nt, Human
acucaggcucaagcaauccucccgccucagcc

SEQ ID NO: 305569 - RNA, 32 nt, Human
acucaggcucccagaacugaagaugguggcug

SEQ ID NO: 305570 - RNA, 32 nt, Human
acucaggcugaagaggcccccuugucuuaucu

SEQ ID NO: 305571 - RNA, 20 nt, Human
acucaggcuggagugcagug

SEQ ID NO: 305572 - RNA, 32 nt, Human
acucaggcuugugaaggccccgaguuuugggg

SEQ ID NO: 305573 - RNA, 31 nt, Human
acucagggacuucucuugccuggagggugca

SEQ ID NO: 305574 - RNA, 32 nt, Human
acucagggagagcacguggcauuggagaaggu

SEQ ID NO: 305575 - RNA, 32 nt, Human
acucagggagcagcagcaccuccagacuggaa

SEQ ID NO: 305576 - RNA, 32 nt, Human
acucagggccuggaggcuugcuugggacugga

SEQ ID NO: 305577 - RNA, 32 nt, Human
acucagggcucugggagccaggccuagcucuc

SEQ ID NO: 305578 - RNA, 32 nt, Human
acucagggcugaggcaggagaauugcuugaac

SEQ ID NO: 305579 - RNA, 32 nt, Human
acucagggcugcagccacagacagagaccgug

SEQ ID NO: 305580 - RNA, 32 nt, Human
acucagggcuggccccacaaagggucucgugg

SEQ ID NO: 305581 - RNA, 32 nt, Human
acucaggggaccccacuccccucacacacacc

SEQ ID NO: 305582 - RNA, 32 nt, Human
acucaggggguggagguugcagugaguugaga

SEQ ID NO: 305583 - RNA, 32 nt, Human
acucagggugauggcaggagagcuggcugaca

SEQ ID NO: 305584 - RNA, 32 nt, Human
acucaggguguucgggauaaagaagacucagg

SEQ ID NO: 305585 - RNA, 32 nt, Human
acucagguccccagacugcagugagcugaccu

SEQ ID NO: 305586 - RNA, 22 nt, Human
acucaggugcugaaggguaaua

SEQ ID NO: 305587 - RNA, 32 nt, Human
acucagguggcagagguugcagugagccgaga

SEQ ID NO: 305588 - RNA, 32 nt, Human
acucaggugugaggacaagaaugcaaauggcu

SEQ ID NO: 305589 - RNA, 32 nt, Human
acucagguuccauuccagaccugcugaauugg

SEQ ID NO: 305590 - RNA, 32 nt, Human
acucagguuuucuggaguuggagagaaagggu

SEQ ID NO: 305591 - RNA, 32 nt, Human
acucaguaccuccagcacacccuucucaugga

SEQ ID NO: 305592 - RNA, 32 nt, Human
acucaguaggugagaauaauuaguagguucag

SEQ ID NO: 305593 - RNA, 22 nt, Human
acucaguauagguagggagaua

SEQ ID NO: 305594 - RNA, 32 nt, Human
acucaguaucugguggguaaugguggcuaccc

SEQ ID NO: 305595 - RNA, 32 nt, Human
acucagucacacacaagacaaaagcaugcaau

SEQ ID NO: 305596 - RNA, 32 nt, Human
acucagucaccugguuucccaucucuaagccc

SEQ ID NO: 305597 - RNA, 32 nt, Human
acucagucacugacacugagccugaggacgag

SEQ ID NO: 305598 - RNA, 32 nt, Human
acucaguccacaccccauuggaaaugugggcc

SEQ ID NO: 305599 - RNA, 32 nt, Human
acucaguccccugaccaccacacagcagcugc

SEQ ID NO: 305600 - RNA, 32 nt, Human
acucagucgcccaggcuggagugcaguggcau

SEQ ID NO: 305601 - RNA, 32 nt, Human
acucagucucaggacuucuaagaaaggccugg

SEQ ID NO: 305602 - RNA, 32 nt, Human
acucagugagccagacuguacuguggagaaag

SEQ ID NO: 305603 - RNA, 20 nt, Human
acucagugagugagcaggug

SEQ ID NO: 305604 - RNA, 32 nt, Human
acucagugcauaugugaaagagaaugaugcau

SEQ ID NO: 305605 - RNA, 21 nt, Human
acucagugccccagaccccac

SEQ ID NO: 305606 - RNA, 32 nt, Human
acucagugccugcgucccucacccucaguccc

SEQ ID NO: 305607 - RNA, 32 nt, Human
acucagugcuuuaguuuuaacaacaguaaauu

SEQ ID NO: 305608 - RNA, 32 nt, Human
acucaguggaaccugugugagcuacauguucu

SEQ ID NO: 305609 - RNA, 32 nt, Human
acucaguggccugaacacacaccuucagccac

SEQ ID NO: 305610 - RNA, 32 nt, Human
acucagugggggacauuuuggugaagaugcaa

SEQ ID NO: 305611 - RNA, 32 nt, Human
acucaguggguacuguugugaccauggcugug

SEQ ID NO: 305612 - RNA, 31 nt, Human
acucaguggguggagaggaagcauaugugga

SEQ ID NO: 305613 - RNA, 32 nt, Human
acucagugucuugucucuuagaccagcuccug

SEQ ID NO: 305614 - RNA, 32 nt, Human
acucaguguuacgcaacaggucucugcagcac

SEQ ID NO: 305615 - RNA, 32 nt, Human
acucaguucucuucccugcaguguuuucauuu

SEQ ID NO: 305616 - RNA, 32 nt, Human
acucaguucuuauuugcaccuacuucagugga

SEQ ID NO: 305617 - RNA, 32 nt, Human
acucaguugcccaggcuggauugcgguggcgc

SEQ ID NO: 305618 - RNA, 32 nt, Human
acucaguuucuaggcaccucagaccaaucauc

SEQ ID NO: 305619 - RNA, 32 nt, Human
acucauaccauccacaucagaaucccuuguag

SEQ ID NO: 305620 - RNA, 32 nt, Human
acucauacucacugggcaccagccuugcccuc

SEQ ID NO: 305621 - RNA, 32 nt, Human
acucauacugacuuagagccucuggcugcugu

SEQ ID NO: 305622 - RNA, 32 nt, Human
acucauacugggaauucuaggcugccaaauca

SEQ ID NO: 305623 - RNA, 32 nt, Human
acucauagcaccuaaaaugggucuccaggguc

SEQ ID NO: 305624 - RNA, 32 nt, Human
acucauaggcucaaguaaucuuccugccucaa

SEQ ID NO: 305625 - RNA, 32 nt, Human
acucauaucuggagagaaaaccuaggaguuuc

SEQ ID NO: 305626 - RNA, 32 nt, Human
acucauaugggagagaaagucuagaauauaag

SEQ ID NO: 305627 - RNA, 32 nt, Human
acucaucaacaucagcuaaauauagcugauau

SEQ ID NO: 305628 - RNA, 21 nt, Human
acucaucaauucuucgucccc

SEQ ID NO: 305629 - RNA, 32 nt, Human
acucaucacaugugauagauugcaguggaaau

SEQ ID NO: 305630 - RNA, 32 nt, Human
acucaucacugcagccucagcagggcaggcca

SEQ ID NO: 305631 - RNA, 32 nt, Human
acucaucagauggggaaacaaggccagaagcc

SEQ ID NO: 305632 - RNA, 32 nt, Human
acucaucaggaaccaguccucagucuggucaa

SEQ ID NO: 305633 - RNA, 32 nt, Human
acucauccacaaaggccuuaacuggcucaggg

SEQ ID NO: 305634 - RNA, 32 nt, Human
acucauccaccugcccuccaccaggagugggc

SEQ ID NO: 305635 - RNA, 32 nt, Human
acucauccagccccuucuccaccccuuucaga

SEQ ID NO: 305636 - RNA, 32 nt, Human
acucaucccacucucucccagcauuuugucug

SEQ ID NO: 305637 - RNA, 32 nt, Human
acucauccccucaucuuccucuuaccucaccc

SEQ ID NO: 305638 - RNA, 20 nt, Human
acucauccucuaguccucug

SEQ ID NO: 305639 - RNA, 32 nt, Human
acucaucggucaccagcgaggcgcacgcugaa

SEQ ID NO: 305640 - RNA, 32 nt, Human
acucaucguaugggcucugcaaagggauauuc

SEQ ID NO: 305641 - RNA, 32 nt, Human
acucaucuaccccaaagauaaaguuguauuuu

SEQ ID NO: 305642 - RNA, 32 nt, Human
acucaucuccuccucccacauuucuggagcuu

SEQ ID NO: 305643 - RNA, 19 nt, Human
acucaucucuacagagaua

SEQ ID NO: 305644 - RNA, 32 nt, Human
acucaucugccuagggagggucacagaggcag

SEQ ID NO: 305645 - RNA, 32 nt, Human
acucaucugggguggggagcagcccuaggcag

SEQ ID NO: 305646 - RNA, 32 nt, Human
acucaucuguauccagaaauaauaugggugag

SEQ ID NO: 305647 - RNA, 32 nt, Human
acucaucuuucagaccuaaguccuccugucca

SEQ ID NO: 305648 - RNA, 32 nt, Human
acucaucuuuuaguuuacacuuccuggggaaa

SEQ ID NO: 305649 - RNA, 32 nt, Human
acucaugaaaagagcacagaaaaggauguuug

SEQ ID NO: 305650 - RNA, 22 nt, Human
acucaugaaaauguacaacgcg

SEQ ID NO: 305651 - RNA, 32 nt, Human
acucaugaaguggaucauguucccagucggcu

SEQ ID NO: 305652 - RNA, 29 nt, Human
acucaugaauaccacauuuucuccuaaau

SEQ ID NO: 305653 - RNA, 29 nt, Human
acucaugacaggcuauaccaugcugcgga

SEQ ID NO: 305654 - RNA, 32 nt, Human
acucaugaccucaagugauccgcccacuucgg

SEQ ID NO: 305655 - RNA, 32 nt, Human
acucaugacuguaauccuaguacuuuggaagg

SEQ ID NO: 305656 - RNA, 32 nt, Human
acucaugaggccuagagaaaaguaucaaaggu

SEQ ID NO: 305657 - RNA, 32 nt, Human
acucaugcaaagcauuuuaccguacaaauauc

SEQ ID NO: 305658 - RNA, 32 nt, Human
acucaugcaagacagaagucacugucuauccu

SEQ ID NO: 305659 - RNA, 32 nt, Human
acucaugcaaucuuccugccucaggcuucuga

SEQ ID NO: 305660 - RNA, 32 nt, Human
acucaugcacagagaaggaaaagggaacaucu

SEQ ID NO: 305661 - RNA, 32 nt, Human
acucaugcauuccuacugcuuggaguagcugu

SEQ ID NO: 305662 - RNA, 32 nt, Human
acucaugccagauuuugggauuacaaauagaa

SEQ ID NO: 305663 - RNA, 15 nt, Human
acucaugccauucca

SEQ ID NO: 305664 - RNA, 32 nt, Human
acucaugccuauaaucccagcacuuugggagg

SEQ ID NO: 305665 - RNA, 19 nt, Human
acucaugccugacaucuca

SEQ ID NO: 305666 - RNA, 32 nt, Human
acucaugccugacaucucagcacuucaggagu

SEQ ID NO: 305667 - RNA, 19 nt, Human
acucaugccuguaaaccca

SEQ ID NO: 305668 - RNA, 32 nt, Human
acucaugccuguaaacccagcauuuugugagg

SEQ ID NO: 305669 - RNA, 32 nt, Human
acucaugccuguaaccccagcgcuuugggaag

SEQ ID NO: 305670 - RNA, 32 nt, Human
acucaugccuguaaucccagcacguugggagg

SEQ ID NO: 305671 - RNA, 32 nt, Human
acucaugccuguaaucccagcacugugggaag

SEQ ID NO: 305672 - RNA, 32 nt, Human
acucaugccuguaaucccagcacuuugagagg

SEQ ID NO: 305673 - RNA, 32 nt, Human
acucaugccuguaaucccagcacuuugggagg

SEQ ID NO: 305674 - RNA, 32 nt, Human
acucaugccuguaaucccaguacucugggaag

SEQ ID NO: 305675 - RNA, 32 nt, Human
acucaugccuguaaucccugcacuuugggagg

SEQ ID NO: 305676 - RNA, 32 nt, Human
acucaugccuguaauccuagcacuuugggagg

SEQ ID NO: 305677 - RNA, 32 nt, Human
acucaugccuguaauccuaguacuuugggagg

SEQ ID NO: 305678 - RNA, 32 nt, Human
acucaugccuguaguaaucccagcacuuuugg

SEQ ID NO: 305679 - RNA, 32 nt, Human
acucaugccuugcgugguuuugacucgaguga

SEQ ID NO: 305680 - RNA, 32 nt, Human
acucaugcuuucacauacauacacucacugac

SEQ ID NO: 305681 - RNA, 32 nt, Human
acucauggagaaggguaggauauuuucaauaa

SEQ ID NO: 305682 - RNA, 32 nt, Human
acucauggcacauuuguuuaauauugcuuaua

SEQ ID NO: 305683 - RNA, 32 nt, Human
acucauggccaccaggaggccugcagauccag

SEQ ID NO: 305684 - RNA, 32 nt, Human
acucauggcucugauugcacagucccacuugc

SEQ ID NO: 305685 - RNA, 29 nt, Human
acucauggcuucuccuagcaaggcaguga

SEQ ID NO: 305686 - RNA, 32 nt, Human
acucaugggcuucaguuucaacaucuguaaaa

SEQ ID NO: 305687 - RNA, 32 nt, Human
acucaugucaaugucuccuccaccaucugccc

SEQ ID NO: 305688 - RNA, 32 nt, Human
acucaugucauucagaaaccugaaguguggcu

SEQ ID NO: 305689 - RNA, 32 nt, Human
acucauguccaauacugcuuugccuggugugg

SEQ ID NO: 305690 - RNA, 32 nt, Human
acucaugugagacuucccucuggaugaccaga

SEQ ID NO: 305691 - RNA, 32 nt, Human
acucauguguuuuggggaaaggaagaaguucu

SEQ ID NO: 305692 - RNA, 32 nt, Human
acucauguucauccugcaacagaagcauucuc

SEQ ID NO: 305693 - RNA, 32 nt, Human
acucauguucucuccaaccagggcuggcauca

SEQ ID NO: 305694 - RNA, 32 nt, Human
acucauguucugacccucugugcacuggaucc

SEQ ID NO: 305695 - RNA, 32 nt, Human
acucauguugcucaaugugaggaagcaccagg

SEQ ID NO: 305696 - RNA, 32 nt, Human
acucauuacuacuuuuagcauucuccaggcuu

SEQ ID NO: 305697 - RNA, 32 nt, Human
acucauuagcagauauguagugcagugauuua

SEQ ID NO: 305698 - RNA, 32 nt, Human
acucauuagcugugugacucugggugaguccc

SEQ ID NO: 305699 - RNA, 32 nt, Human
acucauucauagucucaguuacccagauaacc

SEQ ID NO: 305700 - RNA, 32 nt, Human
acucauucaugaggaaucugaugcuccuuugc

SEQ ID NO: 305701 - RNA, 32 nt, Human
acucauucauguugagagggugucaaauugag

SEQ ID NO: 305702 - RNA, 32 nt, Human
acucauucauucuugucccagaauucuguuga

SEQ ID NO: 305703 - RNA, 32 nt, Human
acucauuccguggaugauucuaccuccuuuuu

SEQ ID NO: 305704 - RNA, 32 nt, Human
acucauuccuaaugagccuccuucccauggau

SEQ ID NO: 305705 - RNA, 32 nt, Human
acucauucucagauuaaauugccacuuaaaga

SEQ ID NO: 305706 - RNA, 32 nt, Human
acucauucuccccagacgccaaggaugguggu

SEQ ID NO: 305707 - RNA, 32 nt, Human
acucauucugcagcaccgccucuuggggcagu

SEQ ID NO: 305708 - RNA, 32 nt, Human
acucauugcacaucuucucuucaguuuagaga

SEQ ID NO: 305709 - RNA, 32 nt, Human
acucauugcagccaagaugcacaaagcacagu

SEQ ID NO: 305710 - RNA, 32 nt, Human
acucauugcagccucgaacuccugggcuuaag

SEQ ID NO: 305711 - RNA, 32 nt, Human
acucauugccuguaaucccagcacuuugggag

SEQ ID NO: 305712 - RNA, 32 nt, Human
acucauuguccaccuggccucugaggccaggc

SEQ ID NO: 305713 - RNA, 32 nt, Human
acucauuguccccuuccucuaauuaaaaagau

SEQ ID NO: 305714 - RNA, 32 nt, Human
acucauuguucuccagucucugcagcaggaag

SEQ ID NO: 305715 - RNA, 32 nt, Human
acucauuuagagaauguccuggcgucgguuuu

SEQ ID NO: 305716 - RNA, 32 nt, Human
acucauuuagcagaaaguccagaagugcucga

SEQ ID NO: 305717 - RNA, 32 nt, Human
acucauuucaguaccagccuuugggaagucgu

SEQ ID NO: 305718 - RNA, 32 nt, Human
acucauuuccaaaauucacacaaacuuacaug

SEQ ID NO: 305719 - RNA, 32 nt, Human
acucauuucuggucuuggggccagucucaggg

SEQ ID NO: 305720 - RNA, 32 nt, Human
acucauuugacuuuugcacugacuguauuauc

SEQ ID NO: 305721 - RNA, 32 nt, Human
acuccaaaagugcuggguuuacaggcaugagc

SEQ ID NO: 305722 - RNA, 32 nt, Human
acuccaaacccauggcuccagaacggggaccc

SEQ ID NO: 305723 - RNA, 32 nt, Human
acuccaaacccccacuucccucauuuuuauuu

SEQ ID NO: 305724 - RNA, 32 nt, Human
acuccaaacuggaggcuaucagugaguguucu

SEQ ID NO: 305725 - RNA, 32 nt, Human
acuccaaagguggagguugcaguaagcugaaa

SEQ ID NO: 305726 - RNA, 32 nt, Human
acuccaaaguucucaaaaugagaaggcagaaa

SEQ ID NO: 305727 - RNA, 32 nt, Human
acuccaaauccccucuaguucucccuccccuc

SEQ ID NO: 305728 - RNA, 32 nt, Human
acuccaaccaaaagccaaaaaccaaagcaaga

SEQ ID NO: 305729 - RNA, 32 nt, Human
acuccaaccagcggccauuuuccuaguaccug

SEQ ID NO: 305730 - RNA, 32 nt, Human
acuccaacccugccccuuucugucccauccuu

SEQ ID NO: 305731 - RNA, 32 nt, Human
acuccaacccuugcuugucucaaggcaccuac

SEQ ID NO: 305732 - RNA, 32 nt, Human
acuccaaccugcacuccagccugggcaacaga

SEQ ID NO: 305733 - RNA, 21 nt, Human
acuccaaccugggcaacagaa

SEQ ID NO: 305734 - RNA, 32 nt, Human
acuccaacuuccaauaacugacaggugauuau

SEQ ID NO: 305735 - RNA, 32 nt, Human
acuccaagccugggcaacagagugagacacug

SEQ ID NO: 305736 - RNA, 32 nt, Human
acuccaagccuuccaccaaaacagugccccac

SEQ ID NO: 305737 - RNA, 25 nt, Human
acuccaagcugcacuuucuuggggu

SEQ ID NO: 305738 - RNA, 32 nt, Human
acuccaaggaggucccaggaagaggugucauc

SEQ ID NO: 305739 - RNA, 18 nt, Human
acuccaagucccucugca

SEQ ID NO: 305740 - RNA, 32 nt, Human
acuccaaguccugcccugccacccucggccuc

SEQ ID NO: 305741 - RNA, 32 nt, Human
acuccaaguucucucuuccugucccacacucu

SEQ ID NO: 305742 - RNA, 25 nt, Human
acuccaauaaucacauccaaugacu

SEQ ID NO: 305743 - RNA, 32 nt, Human
acuccaaugccuuucaggaaaggacucggcac

SEQ ID NO: 305744 - RNA, 32 nt, Human
acuccaauuccccuagcacuccagaaggccgg

SEQ ID NO: 305745 - RNA, 22 nt, Human
acuccacacaguguguaaaaua

SEQ ID NO: 305746 - RNA, 32 nt, Human
acuccacaccauucuucuagaucucugguguu

SEQ ID NO: 305747 - RNA, 32 nt, Human
acuccacacccaggggaguuaaagcacaugaa

SEQ ID NO: 305748 - RNA, 32 nt, Human
acuccacacuccuagcaacugugaaaccaagg

SEQ ID NO: 305749 - RNA, 32 nt, Human
acuccacacuuuccuuucugugcuccuuccaa

SEQ ID NO: 305750 - RNA, 32 nt, Human
acuccacagacacugacuguuuuuguccuaug

SEQ ID NO: 305751 - RNA, 32 nt, Human
acuccacagauggguggucucuugggaucaga

SEQ ID NO: 305752 - RNA, 32 nt, Human
acuccacagcaggaagugccacugccugagca

SEQ ID NO: 305753 - RNA, 32 nt, Human
acuccacagcccagaucccauucuuaagagca

SEQ ID NO: 305754 - RNA, 32 nt, Human
acuccacaggcgccuccugccaggucugcucc

SEQ ID NO: 305755 - RNA, 32 nt, Human
acuccacaucuucugccccaguguguccccac

SEQ ID NO: 305756 - RNA, 32 nt, Human
acuccaccaaccgaagcccccaaaaggagccc

SEQ ID NO: 305757 - RNA, 32 nt, Human
acuccaccaaccucacgaguuucuaacaccca

SEQ ID NO: 305758 - RNA, 19 nt, Human
acuccaccacugaguuaaa

SEQ ID NO: 305759 - RNA, 32 nt, Human
acuccaccagaggagagcacaggagagcuagg

SEQ ID NO: 305760 - RNA, 18 nt, Human
acuccaccagcacuggca

SEQ ID NO: 305761 - RNA, 32 nt, Human
acuccaccagccccaguguugcugggcuuccc

SEQ ID NO: 305762 - RNA, 32 nt, Human
acuccaccagccuggaccuccaccuccccugg

SEQ ID NO: 305763 - RNA, 32 nt, Human
acuccaccagcgaccuccacacucccgggacg

SEQ ID NO: 305764 - RNA, 23 nt, Human
acuccacccccuuccaggucccu

SEQ ID NO: 305765 - RNA, 19 nt, Human
acuccaccccuccacaccc

SEQ ID NO: 305766 - RNA, 21 nt, Human
acuccaccccugccaggcccc

SEQ ID NO: 305767 - RNA, 32 nt, Human
acuccacccugagggccccauccucugaaccc

SEQ ID NO: 305768 - RNA, 24 nt, Human
acuccacccuucuccagggacccu

SEQ ID NO: 305769 - RNA, 32 nt, Human
acuccaccugauggcaggugacccggauagaa

SEQ ID NO: 305770 - RNA, 16 nt, Human
acuccaccugccgcca

SEQ ID NO: 305771 - RNA, 32 nt, Human
acuccacguuccccagcacaucccagguggug

SEQ ID NO: 305772 - RNA, 22 nt, Human
acuccacuauacuccagggccc

SEQ ID NO: 305773 - RNA, 24 nt, Human
acuccacucaguguccagggaccc

SEQ ID NO: 305774 - RNA, 32 nt, Human
acuccacuccagccugggcaacagugugagac

SEQ ID NO: 305775 - RNA, 32 nt, Human
acuccacucucccagccccacuuuuucucuug

SEQ ID NO: 305776 - RNA, 32 nt, Human
acuccacugcacuccagccugggcaacagagc

SEQ ID NO: 305777 - RNA, 32 nt, Human
acuccacugcacuccagccugggcgacagaau

SEQ ID NO: 305778 - RNA, 32 nt, Human
acuccacugcacuccagccugggugacagacc

SEQ ID NO: 305779 - RNA, 32 nt, Human
acuccacugccucuauccauugaguacuguau

SEQ ID NO: 305780 - RNA, 32 nt, Human
acuccacuguaguuuacuuugccuguaccauu

SEQ ID NO: 305781 - RNA, 32 nt, Human
acuccacuguugaaacacugugccagugagaa

SEQ ID NO: 305782 - RNA, 32 nt, Human
acuccacuuacuugcucagucuucccacucuc

SEQ ID NO: 305783 - RNA, 20 nt, Human
acuccacuuggcuccagggg

SEQ ID NO: 305784 - RNA, 32 nt, Human
acuccacuugucucuuaacucagcuuucaaga

SEQ ID NO: 305785 - RNA, 32 nt, Human
acuccacuuucuuccuuuguacaguaacuuuc

SEQ ID NO: 305786 - RNA, 32 nt, Human
acuccagaaagccaugcagagccuugugccau

SEQ ID NO: 305787 - RNA, 21 nt, Human
acuccagaagcagcagcuaga

SEQ ID NO: 305788 - RNA, 32 nt, Human
acuccagaauccagagcaaaucagcccuucuc

SEQ ID NO: 305789 - RNA, 22 nt, Human
acuccagaccugcagccccaga

SEQ ID NO: 305790 - RNA, 32 nt, Human
acuccagacuccugcccuuuuauuuucuccag

SEQ ID NO: 305791 - RNA, 19 nt, Human
acuccagagacuucugcca

SEQ ID NO: 305792 - RNA, 32 nt, Human
acuccagagagggagauccccaguacuugacu

SEQ ID NO: 305793 - RNA, 32 nt, Human
acuccagagccaggugcacaccugccagguga

SEQ ID NO: 305794 - RNA, 22 nt, Human
acuccagagccugggcgacaga

SEQ ID NO: 305795 - RNA, 32 nt, Human
acuccagaggccugaggcuccagggcuggcuc

SEQ ID NO: 305796 - RNA, 32 nt, Human
acuccagaggcugaaaugggaggaucucuuga

SEQ ID NO: 305797 - RNA, 32 nt, Human
acuccagaggcugaggcaggagaaucacuuga

SEQ ID NO: 305798 - RNA, 32 nt, Human
acuccagaggcugaggcaggaggauugcuuga

SEQ ID NO: 305799 - RNA, 32 nt, Human
acuccagaggcugagguaggaggaucgccuga

SEQ ID NO: 305800 - RNA, 32 nt, Human
acuccagaggcugaggugggaagaucauuuga

SEQ ID NO: 305801 - RNA, 32 nt, Human
acuccagaggcugucgugggaggaucauguga

SEQ ID NO: 305802 - RNA, 32 nt, Human
acuccagagguagcagcauccuugggggaagg

SEQ ID NO: 305803 - RNA, 32 nt, Human
acuccagagguggagguugcaguaagcugaga

SEQ ID NO: 305804 - RNA, 32 nt, Human
acuccagagucaccugucucaucggcucccag

SEQ ID NO: 305805 - RNA, 30 nt, Human
acuccagagucuuaccugcuccuguguagg

SEQ ID NO: 305806 - RNA, 32 nt, Human
acuccagcaaaugacccaucguuuuccaccag

SEQ ID NO: 305807 - RNA, 32 nt, Human
acuccagcacuccagccugggugacagagcaa

SEQ ID NO: 305808 - RNA, 32 nt, Human
acuccagcagagcccugaaguguggacaagcu

SEQ ID NO: 305809 - RNA, 32 nt, Human
acuccagccaccucaccugauuggcuaucuug

SEQ ID NO: 305810 - RNA, 19 nt, Human
acuccagccaccuucucca

SEQ ID NO: 305811 - RNA, 32 nt, Human
acuccagccagcgccucacagguucaggugau

SEQ ID NO: 305812 - RNA, 32 nt, Human
acuccagccaggggagcagggaagaagaaggg

SEQ ID NO: 305813 - RNA, 32 nt, Human
acuccagcccagaccaccuaauacugcagggu

SEQ ID NO: 305814 - RNA, 32 nt, Human
acuccagccccaggcuguggcucugcagcccc

SEQ ID NO: 305815 - RNA, 22 nt, Human
acuccagcccugacuucugcuc

SEQ ID NO: 305816 - RNA, 32 nt, Human
acuccagccgcugggagcgcgaggccauguaa

SEQ ID NO: 305817 - RNA, 22 nt, Human
acuccagccuggacaacaagag

SEQ ID NO: 305818 - RNA, 32 nt, Human
acuccagccugggagacagagucuugcucugu

SEQ ID NO: 305819 - RNA, 32 nt, Human
acuccagccugggcaacaaagugagacucggu

SEQ ID NO: 305820 - RNA, 32 nt, Human
acuccagccugggcaacaaagugagacucugc

SEQ ID NO: 305821 - RNA, 22 nt, Human
acuccagccugggcaacaagag

SEQ ID NO: 305822 - RNA, 32 nt, Human
acuccagccugggcaacaagagagaagguccu

SEQ ID NO: 305823 - RNA, 32 nt, Human
acuccagccugggcaacaagagcgagacuguc

SEQ ID NO: 305824 - RNA, 32 nt, Human
acuccagccugggcaacaagagcgaggcuccg

SEQ ID NO: 305825 - RNA, 21 nt, Human
acuccagccugggcaacagaa

SEQ ID NO: 305826 - RNA, 32 nt, Human
acuccagccugggccagaaugagacuccgucu

SEQ ID NO: 305827 - RNA, 32 nt, Human
acuccagccugggcgacaagagcgagacucuc

SEQ ID NO: 305828 - RNA, 32 nt, Human
acuccagccugggcgacaagagcgagacucug

SEQ ID NO: 305829 - RNA, 32 nt, Human
acuccagccugggcgacagcaagacuccgucu

SEQ ID NO: 305830 - RNA, 32 nt, Human
acuccagccugggcgacagugagacccugucu

SEQ ID NO: 305831 - RNA, 32 nt, Human
acuccagccugggcgacugugagaccccgucu

SEQ ID NO: 305832 - RNA, 32 nt, Human
acuccagccugggggacaggagcgagacucca

SEQ ID NO: 305833 - RNA, 26 nt, Human
acuccagccugggugacagagcgaga

SEQ ID NO: 305834 - RNA, 26 nt, Human
acuccagccugggugacagagcgagg

SEQ ID NO: 305835 - RNA, 26 nt, Human
acuccagccugggugacagagugaga

SEQ ID NO: 305836 - RNA, 32 nt, Human
acuccagccugggugacagcaagacccugucu

SEQ ID NO: 305837 - RNA, 26 nt, Human
acuccagccugggugacagggugaga

SEQ ID NO: 305838 - RNA, 32 nt, Human
acuccagccugggugaggagagcgagacucuu

SEQ ID NO: 305839 - RNA, 26 nt, Human
acuccagccugggugauagagugaga

SEQ ID NO: 305840 - RNA, 32 nt, Human
acuccagccuggguggacagagcaagacuccg

SEQ ID NO: 305841 - RNA, 26 nt, Human
acuccagccuggguggcagagcgaga

SEQ ID NO: 305842 - RNA, 26 nt, Human
acuccagccuggguggcagagugaga

SEQ ID NO: 305843 - RNA, 32 nt, Human
acuccagccuuggcgacagagggagacucugu

SEQ ID NO: 305844 - RNA, 31 nt, Human
acuccagcucugcuccguaugccaagaggag

SEQ ID NO: 305845 - RNA, 32 nt, Human
acuccagcuggguuggaaaacaguauuuucca

SEQ ID NO: 305846 - RNA, 32 nt, Human
acuccagcuuccccacugccucugugugcccc

SEQ ID NO: 305847 - RNA, 26 nt, Human
acuccagcuugggugacagagcgaga

SEQ ID NO: 305848 - RNA, 26 nt, Human
acuccagcuugggugacagagugaga

SEQ ID NO: 305849 - RNA, 24 nt, Human
acuccaggaagacgcccccggcag

SEQ ID NO: 305850 - RNA, 32 nt, Human
acuccaggaauaagacaaaaggagaggaggag

SEQ ID NO: 305851 - RNA, 32 nt, Human
acuccaggaauggggaaaugugacaccaccau

SEQ ID NO: 305852 - RNA, 32 nt, Human
acuccaggacucacugcccuccagaaaacaga

SEQ ID NO: 305853 - RNA, 32 nt, Human
acuccaggagagaggaaggaagauguucccgc

SEQ ID NO: 305854 - RNA, 32 nt, Human
acuccaggagcuauggcaguguuaaugaacau

SEQ ID NO: 305855 - RNA, 32 nt, Human
acuccaggaggcgcaggcugcagugagcucug

SEQ ID NO: 305856 - RNA, 32 nt, Human
acuccaggaggcggaggaggcuaguggcagua

SEQ ID NO: 305857 - RNA, 32 nt, Human
acuccaggcaaaccugccccaucuugucgcuu

SEQ ID NO: 305858 - RNA, 32 nt, Human
acuccaggcacguaccaucaugcuagcuaauu

SEQ ID NO: 305859 - RNA, 32 nt, Human
acuccaggccugggugacagugcgagacccug

SEQ ID NO: 305860 - RNA, 32 nt, Human
acuccaggcuacagugugagcccagguguucu

SEQ ID NO: 305861 - RNA, 32 nt, Human
acuccaggcucaggcuggagccgugauggcac

SEQ ID NO: 305862 - RNA, 32 nt, Human
acuccaggcuccccaucucccugaagcuucca

SEQ ID NO: 305863 - RNA, 21 nt, Human
acuccagggcagaccuagacu

SEQ ID NO: 305864 - RNA, 18 nt, Human
acuccagggccaaugcac

SEQ ID NO: 305865 - RNA, 22 nt, Human
acuccagggcccuaccugcauu

SEQ ID NO: 305866 - RNA, 32 nt, Human
acuccagggucugagugggccaaccuugacua

SEQ ID NO: 305867 - RNA, 32 nt, Human
acuccagggucugggcucccagguggaccaug

SEQ ID NO: 305868 - RNA, 32 nt, Human
acuccaggguucagacagggcugcacaggcgg

SEQ ID NO: 305869 - RNA, 32 nt, Human
acuccaggugggagugagggagcccagccccc

SEQ ID NO: 305870 - RNA, 32 nt, Human
acuccagguuacugcaacccuaacucacucua

SEQ ID NO: 305871 - RNA, 32 nt, Human
acuccagguucugcaaaaguuugaaggucagc

SEQ ID NO: 305872 - RNA, 32 nt, Human
acuccaguaccacugccuucacccugacaagg

SEQ ID NO: 305873 - RNA, 32 nt, Human
acuccaguauuaaaaaucucucauguuguuuu

SEQ ID NO: 305874 - RNA, 26 nt, Human
acuccagucugggugacagagugaga

SEQ ID NO: 305875 - RNA, 32 nt, Human
acuccagugcagcugcccacccugccgccaug

SEQ ID NO: 305876 - RNA, 32 nt, Human
acuccaguguggcaucauguggcagcugcucc

SEQ ID NO: 305877 - RNA, 32 nt, Human
acuccaguucauucacucaguggcucauccac

SEQ ID NO: 305878 - RNA, 32 nt, Human
acuccaguucccaacaaguuccucaucuucau

SEQ ID NO: 305879 - RNA, 32 nt, Human
acuccaguucucuagcauggccugagguaugg

SEQ ID NO: 305880 - RNA, 32 nt, Human
acuccaguuugggaacuauaacacagcagaac

SEQ ID NO: 305881 - RNA, 32 nt, Human
acuccauagagaggaaugacaggcugggccua

SEQ ID NO: 305882 - RNA, 32 nt, Human
acuccauagcagccccugagccugcugggcug

SEQ ID NO: 305883 - RNA, 32 nt, Human
acuccaucacccaggcuggaguccaguggugu

SEQ ID NO: 305884 - RNA, 32 nt, Human
acuccaucacucaggcuggaguacagugcuga

SEQ ID NO: 305885 - RNA, 32 nt, Human
acuccaucagccaggcuggagugcaguggugc

SEQ ID NO: 305886 - RNA, 32 nt, Human
acuccauccaaagaagagggaaagcaccgaau

SEQ ID NO: 305887 - RNA, 32 nt, Human
acuccauccagccugggugacagggcgagacu

SEQ ID NO: 305888 - RNA, 32 nt, Human
acuccauccagccugggugacagggugagacu

SEQ ID NO: 305889 - RNA, 32 nt, Human
acuccauccaguccugaggagccuuaggaugc

SEQ ID NO: 305890 - RNA, 22 nt, Human
acuccauccuacccagggaccc

SEQ ID NO: 305891 - RNA, 32 nt, Human
acuccaucggcaggcccgagcccagggaccag

SEQ ID NO: 305892 - RNA, 32 nt, Human
acuccaucguccaggcuggagugcaguggcgc

SEQ ID NO: 305893 - RNA, 22 nt, Human
acuccaucuccuuucuuuaaag

SEQ ID NO: 305894 - RNA, 32 nt, Human
acuccaucucugaaaugucucuacuuauuguc

SEQ ID NO: 305895 - RNA, 18 nt, Human
acuccaucuguaauccca

SEQ ID NO: 305896 - RNA, 32 nt, Human
acuccaucugugaaagaaguuugcuaaagcaa

SEQ ID NO: 305897 - RNA, 32 nt, Human
acuccaugagcaccccaaggcugcaguuuguu

SEQ ID NO: 305898 - RNA, 32 nt, Human
acuccaugaggucacuguagaccuggaccauu

SEQ ID NO: 305899 - RNA, 32 nt, Human
acuccaugcagauggagagaugagcaugguga

SEQ ID NO: 305900 - RNA, 32 nt, Human
acuccaugcuucuuagccugguggcaguggug

SEQ ID NO: 305901 - RNA, 32 nt, Human
acuccauggagacagccgaccggcgacagccu

SEQ ID NO: 305902 - RNA, 31 nt, Human
acuccauggcaauaagauaccaaaguauaaa

SEQ ID NO: 305903 - RNA, 32 nt, Human
acuccauguagccaccauccagcuucaacauc

SEQ ID NO: 305904 - RNA, 32 nt, Human
acuccaugucuguaucagcuacccagaggacc

SEQ ID NO: 305905 - RNA, 32 nt, Human
acuccauugcaaauucagcugugaggagauuc

SEQ ID NO: 305906 - RNA, 32 nt, Human
acuccauugcccaggcuggaguacaauggugc

SEQ ID NO: 305907 - RNA, 32 nt, Human
acuccauuggagggaaaggaagagucuuagaa

SEQ ID NO: 305908 - RNA, 32 nt, Human
acuccauuuauaggcacaucuccuucauuucc

SEQ ID NO: 305909 - RNA, 32 nt, Human
acuccauuucauaaaggcacugaucugucacc

SEQ ID NO: 305910 - RNA, 32 nt, Human
acuccauuucaucauuguuucugcaugaauau

SEQ ID NO: 305911 - RNA, 32 nt, Human
acuccauuugggaacucacugccuuauaaagg

SEQ ID NO: 305912 - RNA, 32 nt, Human
acuccauuuugaaaaagaccuguacuuuaaac

SEQ ID NO: 305913 - RNA, 32 nt, Human
acuccauuuugaaaaagaccuguacuuuaaau

SEQ ID NO: 305914 - RNA, 19 nt, Human
acuccauuuugcucaggga

SEQ ID NO: 305915 - RNA, 32 nt, Human
acucccaaacuccagugcucucauccagaggc

SEQ ID NO: 305916 - RNA, 32 nt, Human
acucccaaagugcugaaauuacaggcaugagc

SEQ ID NO: 305917 - RNA, 32 nt, Human
acucccaaagugcugggauuacaggcgugagc

SEQ ID NO: 305918 - RNA, 32 nt, Human
acucccaaagugcugggauuacaggcgugagu

SEQ ID NO: 305919 - RNA, 32 nt, Human
acucccaaagugcugggauuacaggcuugacc

SEQ ID NO: 305920 - RNA, 32 nt, Human
acucccaaagugcugggauuacaggugugagc

SEQ ID NO: 305921 - RNA, 32 nt, Human
acucccaacaugguauccuguccuuucccuaa

SEQ ID NO: 305922 - RNA, 32 nt, Human
acucccaagaagagaagagauuggcaaauggg

SEQ ID NO: 305923 - RNA, 32 nt, Human
acucccaagagcuuacuguuuaaucaccagaa

SEQ ID NO: 305924 - RNA, 32 nt, Human
acucccaagccgccggcagcaggguagcaggg

SEQ ID NO: 305925 - RNA, 32 nt, Human
acucccaauugaugugaccacacucuucuuaa

SEQ ID NO: 305926 - RNA, 32 nt, Human
acucccacaagcucugccuucccucccugguc

SEQ ID NO: 305927 - RNA, 32 nt, Human
acucccacacaggcccacacacccucacugac

SEQ ID NO: 305928 - RNA, 32 nt, Human
acucccacacgcccacacagcaccucugccag

SEQ ID NO: 305929 - RNA, 23 nt, Human
acucccaccaacuacucuuaggg

SEQ ID NO: 305930 - RNA, 32 nt, Human
acucccaccauccugugaaccccacuccacuc

SEQ ID NO: 305931 - RNA, 32 nt, Human
acucccaccaucuucacccccaccucaggucc

SEQ ID NO: 305932 - RNA, 32 nt, Human
acucccaccuucaggcaggauuggguaguaca

SEQ ID NO: 305933 - RNA, 32 nt, Human
acucccacucacugacccugucccacaucuua

SEQ ID NO: 305934 - RNA, 32 nt, Human
acucccacugcacuccagcucggggaacagag

SEQ ID NO: 305935 - RNA, 32 nt, Human
acucccacugcugccucuccugggcauggcug

SEQ ID NO: 305936 - RNA, 32 nt, Human
acucccacugucaucagcuuucaccuuggauu

SEQ ID NO: 305937 - RNA, 32 nt, Human
acucccagaggcugaugcaccucccagacccg

SEQ ID NO: 305938 - RNA, 32 nt, Human
acucccagagggcagugaccuacucugcuccc

SEQ ID NO: 305939 - RNA, 32 nt, Human
acucccagaguuuccauuucaggaggucuggg

SEQ ID NO: 305940 - RNA, 32 nt, Human
acucccagcccagugcaccccaacuuuauagc

SEQ ID NO: 305941 - RNA, 32 nt, Human
acucccagcccuggcccugaccuuugugggcc

SEQ ID NO: 305942 - RNA, 32 nt, Human
acucccagccucaggugauccacccaccucag

SEQ ID NO: 305943 - RNA, 32 nt, Human
acucccagccuccuggccccuucuguacauga

SEQ ID NO: 305944 - RNA, 32 nt, Human
acucccagccugacaaggagggcugcgucucc

SEQ ID NO: 305945 - RNA, 32 nt, Human
acucccagccugggcaacggagugagacucug

SEQ ID NO: 305946 - RNA, 32 nt, Human
acucccagccugggugacagagcgagacucug

SEQ ID NO: 305947 - RNA, 32 nt, Human
acucccagccuuccccauaucuccugccucag

SEQ ID NO: 305948 - RNA, 32 nt, Human
acucccagcuacucaggaggcugaggcaggag

SEQ ID NO: 305949 - RNA, 32 nt, Human
acucccagcuacucgggaggcucaggcaggag

SEQ ID NO: 305950 - RNA, 32 nt, Human
acucccagcuacuugggaggcugagacaggag

SEQ ID NO: 305951 - RNA, 24 nt, Human
acucccagcuccuccugcagcuca

SEQ ID NO: 305952 - RNA, 26 nt, Human
acucccagcuucuucugaucauuuca

SEQ ID NO: 305953 - RNA, 21 nt, Human
acucccagcuuucccuuuuca

SEQ ID NO: 305954 - RNA, 22 nt, Human
acucccagcuuuguuuucauuu

SEQ ID NO: 305955 - RNA, 32 nt, Human
acucccaggagagggaagaugggagccagggc

SEQ ID NO: 305956 - RNA, 32 nt, Human
acucccaggaguuuccucugcagagccccgcg

SEQ ID NO: 305957 - RNA, 32 nt, Human
acucccagggacaagggaaggaagggacacac

SEQ ID NO: 305958 - RNA, 32 nt, Human
acucccaguagaccaggagcuccgggaggcag

SEQ ID NO: 305959 - RNA, 32 nt, Human
acucccaguccaaauguccuccagaagccucu

SEQ ID NO: 305960 - RNA, 32 nt, Human
acucccaguggcacagaugacgacuuugcagu

SEQ ID NO: 305961 - RNA, 25 nt, Human
acucccauaucauauaaaauuucag

SEQ ID NO: 305962 - RNA, 32 nt, Human
acucccauccacccuucuccaugcucaucccc

SEQ ID NO: 305963 - RNA, 19 nt, Human
acucccaucccacucucag

SEQ ID NO: 305964 - RNA, 32 nt, Human
acucccauccuuuccucucuccccguucaugc

SEQ ID NO: 305965 - RNA, 32 nt, Human
acucccaugcugcuguuggcuccaucucucca

SEQ ID NO: 305966 - RNA, 32 nt, Human
acucccauucuuugccaggagaucuuacccau

SEQ ID NO: 305967 - RNA, 32 nt, Human
acucccauuugcuuccugugaaguaguuacua

SEQ ID NO: 305968 - RNA, 32 nt, Human
acucccauuuugcugcaagacccccuuucaac

SEQ ID NO: 305969 - RNA, 32 nt, Human
acuccccaaagugccugccaaaccccagggcc

SEQ ID NO: 305970 - RNA, 32 nt, Human
acuccccacacagcucaugagaugugugaccc

SEQ ID NO: 305971 - RNA, 32 nt, Human
acuccccaccccagcauuucauucauaccaga

SEQ ID NO: 305972 - RNA, 32 nt, Human
acuccccaccucccaccaacauauacauuuug

SEQ ID NO: 305973 - RNA, 32 nt, Human
acuccccagagcagcuuggcccagggaggggg

SEQ ID NO: 305974 - RNA, 32 nt, Human
acuccccagcauggaggaagguggugauuuug

SEQ ID NO: 305975 - RNA, 22 nt, Human
acuccccagccaaaugcacggu

SEQ ID NO: 305976 - RNA, 32 nt, Human
acuccccagcccagagagacgcugcuuuuacc

SEQ ID NO: 305977 - RNA, 21 nt, Human
acuccccagcccagcaccccu

SEQ ID NO: 305978 - RNA, 21 nt, Human
acuccccagcccccucagagu

SEQ ID NO: 305979 - RNA, 22 nt, Human
acuccccagcccuuuccucagg

SEQ ID NO: 305980 - RNA, 32 nt, Human
acuccccagcguuuuuccucuggaaaugccca

SEQ ID NO: 305981 - RNA, 32 nt, Human
acuccccagcuggcugaaaacugguggagcug

SEQ ID NO: 305982 - RNA, 32 nt, Human
acuccccagcugggcuguuuucuaagccgauc

SEQ ID NO: 305983 - RNA, 32 nt, Human
acuccccaggaaaugacugccuuccuugggac

SEQ ID NO: 305984 - RNA, 21 nt, Human
acuccccaggagcucccaggg

SEQ ID NO: 305985 - RNA, 21 nt, Human
acuccccaggccucccacggu

SEQ ID NO: 305986 - RNA, 32 nt, Human
acuccccaggcuugugcucucucagcuugaga

SEQ ID NO: 305987 - RNA, 32 nt, Human
acuccccaguagcugggacuacaggcgcccgc

SEQ ID NO: 305988 - RNA, 23 nt, Human
acuccccaguuccgccuugaggu

SEQ ID NO: 305989 - RNA, 19 nt, Human
acuccccauaccccauucu

SEQ ID NO: 305990 - RNA, 22 nt, Human
acuccccaucuguucucagggu

SEQ ID NO: 305991 - RNA, 32 nt, Human
acucccccaagcugacucauccuaacuaacag

SEQ ID NO: 305992 - RNA, 32 nt, Human
acucccccaccuccucaccacacacaugcucu

SEQ ID NO: 305993 - RNA, 32 nt, Human
acucccccagaacuucccagucugccuucucc

SEQ ID NO: 305994 - RNA, 32 nt, Human
acucccccagccccagagaaacugccacauac

SEQ ID NO: 305995 - RNA, 32 nt, Human
acucccccagcccucaguuuucagucaaguuc

SEQ ID NO: 305996 - RNA, 32 nt, Human
acucccccaucuugcauguugugacaccuuca

SEQ ID NO: 305997 - RNA, 32 nt, Human
acucccccgaagaaggaccagugaagacguca

SEQ ID NO: 305998 - RNA, 32 nt, Human
acucccccgcaugagguaugggcuguucuaua

SEQ ID NO: 305999 - RNA, 19 nt, Human
acucccccgcccugcuggc

SEQ ID NO: 306000 - RNA, 32 nt, Human
acucccccggggaaagggagacccccacccuc

SEQ ID NO: 306001 - RNA, 32 nt, Human
acucccccuccaggccaucucauuggcugcuu

SEQ ID NO: 306002 - RNA, 32 nt, Human
acucccccugcaguucuucacauuucagaggg

SEQ ID NO: 306003 - RNA, 32 nt, Human
acucccccugccggcccucugccaucaaauug

SEQ ID NO: 306004 - RNA, 21 nt, Human
acuccccgaaccacucagggu

SEQ ID NO: 306005 - RNA, 21 nt, Human
acuccccgcaccacucagggu

SEQ ID NO: 306006 - RNA, 32 nt, Human
acuccccgccagggcccugcugucagugcgcc

SEQ ID NO: 306007 - RNA, 32 nt, Human
acuccccggacauggcccugccccuaugggac

SEQ ID NO: 306008 - RNA, 20 nt, Human
acuccccggccacccgcagg

SEQ ID NO: 306009 - RNA, 32 nt, Human
acuccccguucagaccagagugccccggcccc

SEQ ID NO: 306010 - RNA, 32 nt, Human
acuccccucacauuccacaggcccauggacuc

SEQ ID NO: 306011 - RNA, 32 nt, Human
acuccccuccacccuccucucucgcacccacc

SEQ ID NO: 306012 - RNA, 32 nt, Human
acuccccuccagccugggcgacagagugagac

SEQ ID NO: 306013 - RNA, 32 nt, Human
acuccccuccaggguacccacagaucugcauu

SEQ ID NO: 306014 - RNA, 32 nt, Human
acuccccucccgccuacccccaucccaaacug

SEQ ID NO: 306015 - RNA, 32 nt, Human
acuccccuccgcucccuucuuaggcacagcau

SEQ ID NO: 306016 - RNA, 32 nt, Human
acuccccuccugggauggggcuucugcucccg

SEQ ID NO: 306017 - RNA, 32 nt, Human
acuccccucuacuugcugcucugggccucccc

SEQ ID NO: 306018 - RNA, 32 nt, Human
acuccccucucaccuuuugcagucuccagugu

SEQ ID NO: 306019 - RNA, 32 nt, Human
acuccccucugccucugagggcuucaguauug

SEQ ID NO: 306020 - RNA, 32 nt, Human
acuccccugcuguguggccuuaggcaacggcu

SEQ ID NO: 306021 - RNA, 32 nt, Human
acuccccuggccccagcccucuccugccuggc

SEQ ID NO: 306022 - RNA, 32 nt, Human
acuccccugugcugcacugcuggggucagaca

SEQ ID NO: 306023 - RNA, 32 nt, Human
acuccccuucucccaucagcccaaacccagag

SEQ ID NO: 306024 - RNA, 32 nt, Human
acucccgaauagcugggauuacagacaggcac

SEQ ID NO: 306025 - RNA, 32 nt, Human
acucccgagggcuagggcuagagcagacccgg

SEQ ID NO: 306026 - RNA, 32 nt, Human
acucccgaguagcugggacuacaggcacacag

SEQ ID NO: 306027 - RNA, 32 nt, Human
acucccgaguagcugggauuacaggcacaugc

SEQ ID NO: 306028 - RNA, 21 nt, Human
acucccgaguggcuagacagg

SEQ ID NO: 306029 - RNA, 32 nt, Human
acucccgcaaaccugaaucucgagcuaccuau

SEQ ID NO: 306030 - RNA, 32 nt, Human
acucccgcagcccuccaguguggcugcaggcg

SEQ ID NO: 306031 - RNA, 32 nt, Human
acucccgccucccugccuccagcccuggcugc

SEQ ID NO: 306032 - RNA, 32 nt, Human
acucccgcucucuauuccccaguuucuugccc

SEQ ID NO: 306033 - RNA, 32 nt, Human
acucccgcuucccugcacugcugcuccauccu

SEQ ID NO: 306034 - RNA, 32 nt, Human
acucccggaaauuucuuuaucucuguuacauu

SEQ ID NO: 306035 - RNA, 32 nt, Human
acucccggaggaggagaacaaagaaacgaggc

SEQ ID NO: 306036 - RNA, 32 nt, Human
acucccggcacugaacacuacagggaauggac

SEQ ID NO: 306037 - RNA, 32 nt, Human
acucccggcaucuuuacagagcagagcaugau

SEQ ID NO: 306038 - RNA, 32 nt, Human
acucccggggccugcuaaucugaggccgaucc

SEQ ID NO: 306039 - RNA, 32 nt, Human
acucccggugccucucuagggcccuggugacc

SEQ ID NO: 306040 - RNA, 32 nt, Human
acucccguggggaagcagcgucacugugcccu

SEQ ID NO: 306041 - RNA, 32 nt, Human
acucccucauggcugccucucucuccaggccc

SEQ ID NO: 306042 - RNA, 32 nt, Human
acucccuccaacugggucuggugacagacaga

SEQ ID NO: 306043 - RNA, 32 nt, Human
acucccuccagccucagcuggcugaaccucgc

SEQ ID NO: 306044 - RNA, 32 nt, Human
acucccuccauguugcuacaaaggacauaaua

SEQ ID NO: 306045 - RNA, 32 nt, Human
acucccucccucccugcaauccuuccuucuua

SEQ ID NO: 306046 - RNA, 32 nt, Human
acucccuccuccuucuccuuuuuccuccucuu

SEQ ID NO: 306047 - RNA, 32 nt, Human
acucccuccuggcagcuguagggaaggaacca

SEQ ID NO: 306048 - RNA, 32 nt, Human
acucccuccuguuccuccuucuccauccccca

SEQ ID NO: 306049 - RNA, 32 nt, Human
acucccuccuugacauucagagcugcuaaguu

SEQ ID NO: 306050 - RNA, 21 nt, Human
acucccucgcccccagcugcg

SEQ ID NO: 306051 - RNA, 32 nt, Human
acucccucggagacgcagguugcaguggacau

SEQ ID NO: 306052 - RNA, 32 nt, Human
acucccucucagaagaaccugauguuuccuga

SEQ ID NO: 306053 - RNA, 32 nt, Human
acucccucuccacuucagugcaugucuuaguu

SEQ ID NO: 306054 - RNA, 32 nt, Human
acucccucucucugcacagaugaacaccauga

SEQ ID NO: 306055 - RNA, 32 nt, Human
acucccucuggagcuuggagaaucgcucuggu

SEQ ID NO: 306056 - RNA, 32 nt, Human
acucccucugggaaggugaccuggccagagcc

SEQ ID NO: 306057 - RNA, 32 nt, Human
acucccucuuuuucucgcuuguggacuccgau

SEQ ID NO: 306058 - RNA, 32 nt, Human
acucccugaaccuggccuuuggcuucagacuc

SEQ ID NO: 306059 - RNA, 32 nt, Human
acucccugaaggccacccagcuaaucagcagu

SEQ ID NO: 306060 - RNA, 32 nt, Human
acucccugacacucaggaaggcccaggcuggg

SEQ ID NO: 306061 - RNA, 32 nt, Human
acucccugagcacgggccgcuccgcuccccug

SEQ ID NO: 306062 - RNA, 32 nt, Human
acucccugaguuuguuaaaauaguagaaguug

SEQ ID NO: 306063 - RNA, 32 nt, Human
acucccugcaagccucagagcagccaagucau

SEQ ID NO: 306064 - RNA, 32 nt, Human
acucccugcuauaauccuagcacuuugggagg

SEQ ID NO: 306065 - RNA, 23 nt, Human
acucccugcugcuucgcaucccu

SEQ ID NO: 306066 - RNA, 32 nt, Human
acucccugcuuccaugcuuucuccuucagucc

SEQ ID NO: 306067 - RNA, 32 nt, Human
acucccugcuucccuggaagcuucaggaagcu

SEQ ID NO: 306068 - RNA, 32 nt, Human
acucccuggagcuaucuguggucuuagggaag

SEQ ID NO: 306069 - RNA, 32 nt, Human
acucccuggauuuuccuccucucuccaucccu

SEQ ID NO: 306070 - RNA, 32 nt, Human
acucccuggcaggaggggauaaucuugaagua

SEQ ID NO: 306071 - RNA, 32 nt, Human
acucccuggccccaaccugccaccucaccaaa

SEQ ID NO: 306072 - RNA, 21 nt, Human
acucccuggcugcuucacuca

SEQ ID NO: 306073 - RNA, 32 nt, Human
acucccuggcuuccaguccuaggcaaucacua

SEQ ID NO: 306074 - RNA, 32 nt, Human
acucccugggcuggcuggcagguauggcaccc

SEQ ID NO: 306075 - RNA, 32 nt, Human
acucccuggggacaagcggggagccagcagga

SEQ ID NO: 306076 - RNA, 32 nt, Human
acucccuggguuucccuuuucucuuagccaca

SEQ ID NO: 306077 - RNA, 32 nt, Human
acucccugucuuccggagcgugagugaagccc

SEQ ID NO: 306078 - RNA, 32 nt, Human
acucccugugugggugaagugggaagcugugc

SEQ ID NO: 306079 - RNA, 32 nt, Human
acucccuguuucuccuccuccuggcuggcgcu

SEQ ID NO: 306080 - RNA, 32 nt, Human
acucccuuccaaccccuucuucauagggacug

SEQ ID NO: 306081 - RNA, 21 nt, Human
acucccuucccaaguuccuuu

SEQ ID NO: 306082 - RNA, 32 nt, Human
acucccuuccucuccaucucucccucucucca

SEQ ID NO: 306083 - RNA, 32 nt, Human
acucccuucuuucauacagaagcugcuguggu

SEQ ID NO: 306084 - RNA, 32 nt, Human
acucccuugcuuuuugcuguguaguucccucu

SEQ ID NO: 306085 - RNA, 32 nt, Human
acucccuuguuccaucagaagcugcagugacu

SEQ ID NO: 306086 - RNA, 32 nt, Human
acuccgaaagucugaaucucccaaggagggca

SEQ ID NO: 306087 - RNA, 32 nt, Human
acuccgaauuagcgguguauuucuugaaguuu

SEQ ID NO: 306088 - RNA, 32 nt, Human
acuccgagaccccuugcugugugacuucugag

SEQ ID NO: 306089 - RNA, 32 nt, Human
acuccgagaggaagaaaggguugauaaucaau

SEQ ID NO: 306090 - RNA, 32 nt, Human
acuccgagccuggaaaauggccggcggaggcc

SEQ ID NO: 306091 - RNA, 32 nt, Human
acuccgagggcuccuccugccuggugaagacu

SEQ ID NO: 306092 - RNA, 32 nt, Human
acuccgauggcuccuccugccuggugaagacu

SEQ ID NO: 306093 - RNA, 32 nt, Human
acuccgcaagauggacagggagccagcaggca

SEQ ID NO: 306094 - RNA, 32 nt, Human
acuccgcacaucagugcugugaaggcaaccuc

SEQ ID NO: 306095 - RNA, 32 nt, Human
acuccgcagcuuucggccucggugagcgggug

SEQ ID NO: 306096 - RNA, 32 nt, Human
acuccgcauggaccccuauacacucacuucgg

SEQ ID NO: 306097 - RNA, 32 nt, Human
acuccgccaagugcuaaccaaagcucagcaac

SEQ ID NO: 306098 - RNA, 18 nt, Human
acuccgccccaugccuug

SEQ ID NO: 306099 - RNA, 32 nt, Human
acuccgcccgccuacauuggagaagaaccaag

SEQ ID NO: 306100 - RNA, 32 nt, Human
acuccgcggcacccucaaaccccagcccaggc

SEQ ID NO: 306101 - RNA, 32 nt, Human
acuccgcucacugaacuccuuccccacuucug

SEQ ID NO: 306102 - RNA, 32 nt, Human
acuccgcuuaggaaguggugggggcggcgugg

SEQ ID NO: 306103 - RNA, 32 nt, Human
acuccggacacugaugugagaggaucacuuga

SEQ ID NO: 306104 - RNA, 32 nt, Human
acuccggacgugugcggcgcagugagucgcag

SEQ ID NO: 306105 - RNA, 32 nt, Human
acuccggagacaggguuuggcugugucuaaac

SEQ ID NO: 306106 - RNA, 32 nt, Human
acuccggaggcugagccaggagaaucgcuuga

SEQ ID NO: 306107 - RNA, 32 nt, Human
acuccggaggcugaggcaggagaaucacuuga

SEQ ID NO: 306108 - RNA, 32 nt, Human
acuccggaggcugaggcaggagaaucgcuuga

SEQ ID NO: 306109 - RNA, 32 nt, Human
acuccggaggcugaggcaggagaaucucuuga

SEQ ID NO: 306110 - RNA, 32 nt, Human
acuccggaggcugcgguggaaggaucaccuga

SEQ ID NO: 306111 - RNA, 32 nt, Human
acuccggagguagagguuguggugagccgaga

SEQ ID NO: 306112 - RNA, 32 nt, Human
acuccggccagccccagccaaacacacaaaag

SEQ ID NO: 306113 - RNA, 32 nt, Human
acuccggcccaggagcucagcguucacgggca

SEQ ID NO: 306114 - RNA, 32 nt, Human
acuccggccugggugacagaaggaggcucugc

SEQ ID NO: 306115 - RNA, 26 nt, Human
acuccggccugggugacagagugaga

SEQ ID NO: 306116 - RNA, 32 nt, Human
acuccggccuguaaucagcucuccuggcuccc

SEQ ID NO: 306117 - RNA, 32 nt, Human
acuccgggagcacagcauccuccucucaccug

SEQ ID NO: 306118 - RNA, 32 nt, Human
acuccgggagccaagcuacuguaaggagcuga

SEQ ID NO: 306119 - RNA, 32 nt, Human
acuccgggaggcacagggcgcgcgaggugcag

SEQ ID NO: 306120 - RNA, 32 nt, Human
acuccguacggucaacuucaccagaggcaggu

SEQ ID NO: 306121 - RNA, 32 nt, Human
acuccguagcccaggcuggagugcaguggcac

SEQ ID NO: 306122 - RNA, 32 nt, Human
acuccguaggcuucuuaaucuuccaggcauua

SEQ ID NO: 306123 - RNA, 32 nt, Human
acuccgucaggcccggcucugccuccaagcug

SEQ ID NO: 306124 - RNA, 32 nt, Human
acuccgucauccaagcuggagugcaguggugc

SEQ ID NO: 306125 - RNA, 32 nt, Human
acuccguccagccugaucccuggccugagcaa

SEQ ID NO: 306126 - RNA, 32 nt, Human
acuccgucccuguccccgacugugccacgugg

SEQ ID NO: 306127 - RNA, 32 nt, Human
acuccgucucaaaaagaaaaaguuuggaucag

SEQ ID NO: 306128 - RNA, 32 nt, Human
acuccgucucagaaaaaggaaaagaaaaacaa

SEQ ID NO: 306129 - RNA, 32 nt, Human
acuccgugcuuugcacaaagcaggcucuccau

SEQ ID NO: 306130 - RNA, 32 nt, Human
acuccguugccaggcuggagugcuguggcgcu

SEQ ID NO: 306131 - RNA, 32 nt, Human
acuccguugcccaggcuggaguacaauggugc

SEQ ID NO: 306132 - RNA, 32 nt, Human
acuccguugccucaacguccaacccuucugca

SEQ ID NO: 306133 - RNA, 32 nt, Human
acuccuaaauaaaaaguaaacaugacaccucu

SEQ ID NO: 306134 - RNA, 32 nt, Human
acuccuaacccuaggagaggagcccaggccgg

SEQ ID NO: 306135 - RNA, 32 nt, Human
acuccuaaccugcuccagucagccugcuucca

SEQ ID NO: 306136 - RNA, 22 nt, Human
acuccuaaggucuccagccagg

SEQ ID NO: 306137 - RNA, 32 nt, Human
acuccuaaguagcugggauuacaggcaccugc

SEQ ID NO: 306138 - RNA, 23 nt, Human
acuccuacaacucaagcauuccu

SEQ ID NO: 306139 - RNA, 22 nt, Human
acuccuacccuuccagggaccc

SEQ ID NO: 306140 - RNA, 32 nt, Human
acuccuacugcaaucaguacuaugcgaucguc

SEQ ID NO: 306141 - RNA, 32 nt, Human
acuccuacuggaauuucugccugguucagccc

SEQ ID NO: 306142 - RNA, 32 nt, Human
acuccuagacucaagugauccuccugucuugg

SEQ ID NO: 306143 - RNA, 32 nt, Human
acuccuagagggagggagguaacugaauucac

SEQ ID NO: 306144 - RNA, 32 nt, Human
acuccuagcccugggcagcccugcugccugcc

SEQ ID NO: 306145 - RNA, 32 nt, Human
acuccuagcugcauaggagagucugagccggg

SEQ ID NO: 306146 - RNA, 22 nt, Human
acuccuagcugcuccagucuca

SEQ ID NO: 306147 - RNA, 32 nt, Human
acuccuagcuuggugucucagacauugaugua

SEQ ID NO: 306148 - RNA, 32 nt, Human
acuccuagcuuuugcuaaaauaugguuggcac

SEQ ID NO: 306149 - RNA, 32 nt, Human
acuccuaggcuuuucugccuagagcagaauua

SEQ ID NO: 306150 - RNA, 32 nt, Human
acuccuagggcugggcgcccgugggcccuccc

SEQ ID NO: 306151 - RNA, 32 nt, Human
acuccuagucuacagaccuguacaguauaacu

SEQ ID NO: 306152 - RNA, 32 nt, Human
acuccuagucuuaagcaaucuuccugcuuugg

SEQ ID NO: 306153 - RNA, 32 nt, Human
acuccuauccuugagggcucucagccacugcu

SEQ ID NO: 306154 - RNA, 32 nt, Human
acuccucaagcucucccuguaggcugcauuuu

SEQ ID NO: 306155 - RNA, 32 nt, Human
acuccucaagggcagagaacugucuuucauuu

SEQ ID NO: 306156 - RNA, 32 nt, Human
acuccucacacuuacuguaagacauuaguaac

SEQ ID NO: 306157 - RNA, 32 nt, Human
acuccucacccacuccaagagacugcagcccu

SEQ ID NO: 306158 - RNA, 32 nt, Human
acuccucacccauccaccaccugcagcuugag

SEQ ID NO: 306159 - RNA, 21 nt, Human
acuccucagaguuucaguggu

SEQ ID NO: 306160 - RNA, 22 nt, Human
acuccucagccacacggcacag

SEQ ID NO: 306161 - RNA, 24 nt, Human
acuccucagccagcacccuggggu

SEQ ID NO: 306162 - RNA, 32 nt, Human
acuccucagccgaugguggcucuggguuuccu

SEQ ID NO: 306163 - RNA, 32 nt, Human
acuccucagccuccuccgcccagagcggcccc

SEQ ID NO: 306164 - RNA, 32 nt, Human
acuccuccacuggagaacugauagcaguauuc

SEQ ID NO: 306165 - RNA, 21 nt, Human
acuccuccaggggucuucaga

SEQ ID NO: 306166 - RNA, 32 nt, Human
acuccuccccacugcugacaucccccacaagc

SEQ ID NO: 306167 - RNA, 32 nt, Human
acuccuccccuccccucacuucucccaccugc

SEQ ID NO: 306168 - RNA, 32 nt, Human
acuccucccggaccccuggacacacacagccc

SEQ ID NO: 306169 - RNA, 32 nt, Human
acuccucccguuuguaauauggagauuuauuu

SEQ ID NO: 306170 - RNA, 32 nt, Human
acuccucccucuggcccuccugcugagcaggc

SEQ ID NO: 306171 - RNA, 32 nt, Human
acuccucccuuuccuuccuaauuucccuucuu

SEQ ID NO: 306172 - RNA, 32 nt, Human
acuccucccuuuucccucuccugggcccuucc

SEQ ID NO: 306173 - RNA, 32 nt, Human
acuccuccgcuguguagcagaugaggaaaauc

SEQ ID NO: 306174 - RNA, 32 nt, Human
acuccuccuccacuccgccccgaggcagccug

SEQ ID NO: 306175 - RNA, 32 nt, Human
acuccuccuccaggaagccuucucagcuuccc

SEQ ID NO: 306176 - RNA, 32 nt, Human
acuccuccuccuccuccuccucuccugcugcu

SEQ ID NO: 306177 - RNA, 32 nt, Human
acuccuccuccuccucucccggcggcggcugc

SEQ ID NO: 306178 - RNA, 32 nt, Human
acuccuccuccuccucucuucuccucugguuu

SEQ ID NO: 306179 - RNA, 32 nt, Human
acuccuccugccccaaaccucgccagagaagc

SEQ ID NO: 306180 - RNA, 32 nt, Human
acuccuccuguggccaccaccaaaggaugagg

SEQ ID NO: 306181 - RNA, 32 nt, Human
acuccuccuugggcccugaggcugcuggaucc

SEQ ID NO: 306182 - RNA, 32 nt, Human
acuccuccuuucuccuccgaggugguuuuaaa

SEQ ID NO: 306183 - RNA, 22 nt, Human
acuccucggcaguuucaggugu

SEQ ID NO: 306184 - RNA, 32 nt, Human
acuccucucaccggccccuggaaaggguucca

SEQ ID NO: 306185 - RNA, 32 nt, Human
acuccucuccagacuccaccuccccagugggu

SEQ ID NO: 306186 - RNA, 32 nt, Human
acuccucucccauucagcaaucaaccagacua

SEQ ID NO: 306187 - RNA, 32 nt, Human
acuccucuccuccuccuccuccucuuccuccu

SEQ ID NO: 306188 - RNA, 32 nt, Human
acuccucuccugggcaauauuggcugcuugcu

SEQ ID NO: 306189 - RNA, 32 nt, Human
acuccucucucucuuucucugccucagauggu

SEQ ID NO: 306190 - RNA, 32 nt, Human
acuccucucugcagcacugccucccagcgcca

SEQ ID NO: 306191 - RNA, 21 nt, Human
acuccucugccaccuuggggu

SEQ ID NO: 306192 - RNA, 32 nt, Human
acuccucugcgucuauccuguguagcauacug

SEQ ID NO: 306193 - RNA, 32 nt, Human
acuccucuguacccucuccuucuguuuuuauu

SEQ ID NO: 306194 - RNA, 20 nt, Human
acuccucuuaccccccaaaa

SEQ ID NO: 306195 - RNA, 32 nt, Human
acuccucuuagggcaccgcagcagaacagucc

SEQ ID NO: 306196 - RNA, 32 nt, Human
acuccucuucugggcauuuaagcugguauguu

SEQ ID NO: 306197 - RNA, 32 nt, Human
acuccucuuugccuugcucacccuccacuugu

SEQ ID NO: 306198 - RNA, 32 nt, Human
acuccugaaaccucaaacaguaccaaaccuuu

SEQ ID NO: 306199 - RNA, 32 nt, Human
acuccugaaguggucagaagagugugugaccc

SEQ ID NO: 306200 - RNA, 32 nt, Human
acuccugaaguucuguucgaccaaacaucaga

SEQ ID NO: 306201 - RNA, 32 nt, Human
acuccugacagcuuuccugcacugcagcuucc

SEQ ID NO: 306202 - RNA, 32 nt, Human
acuccugaccucaagcaauuugcccaccucgu

SEQ ID NO: 306203 - RNA, 32 nt, Human
acuccugaccucaaggaucugucugcuuuggu

SEQ ID NO: 306204 - RNA, 32 nt, Human
acuccugaccucaaguaaucugcccagccuca

SEQ ID NO: 306205 - RNA, 32 nt, Human
acuccugaccucaagugacccgcccuugucgg

SEQ ID NO: 306206 - RNA, 22 nt, Human
acuccugaccucaagugaucca

SEQ ID NO: 306207 - RNA, 32 nt, Human
acuccugaccucaagugauccacccacuucag

SEQ ID NO: 306208 - RNA, 32 nt, Human
acuccugaccucaagugauccaccugcuucgg

SEQ ID NO: 306209 - RNA, 32 nt, Human
acuccugaccucaagugaucugcccacuucgg

SEQ ID NO: 306210 - RNA, 32 nt, Human
acuccugaccucaagugaucuuccggccucag

SEQ ID NO: 306211 - RNA, 22 nt, Human
acuccugaccucaggugaucca

SEQ ID NO: 306212 - RNA, 32 nt, Human
acuccugaccucaggugauccgcccgccucca

SEQ ID NO: 306213 - RNA, 32 nt, Human
acuccugaccucaggugauccgccugucucag

SEQ ID NO: 306214 - RNA, 32 nt, Human
acuccugaccucaggugaucuacccgccucca

SEQ ID NO: 306215 - RNA, 32 nt, Human
acuccugaccucaggugaucugcccaccccag

SEQ ID NO: 306216 - RNA, 32 nt, Human
acuccugaccucaggugaucugcccgucucgg

SEQ ID NO: 306217 - RNA, 32 nt, Human
acuccugaccucaggugaucugccugucuugg

SEQ ID NO: 306218 - RNA, 32 nt, Human
acuccugaccuuaaaugauuugccugccucgg

SEQ ID NO: 306219 - RNA, 32 nt, Human
acuccugaccuuuccugcauuaguaaaauuuc

SEQ ID NO: 306220 - RNA, 32 nt, Human
acuccugacgcugacauggcugugaagagcug

SEQ ID NO: 306221 - RNA, 32 nt, Human
acuccugagcacuagcaauccacccaccucug

SEQ ID NO: 306222 - RNA, 32 nt, Human
acuccugagccaaggucuugucuucaaccucc

SEQ ID NO: 306223 - RNA, 19 nt, Human
acuccugagcucaagugau

SEQ ID NO: 306224 - RNA, 32 nt, Human
acuccugagcucaagugaucuuccugccuugg

SEQ ID NO: 306225 - RNA, 32 nt, Human
acuccugaggaagcugaaugaagcacuauagg

SEQ ID NO: 306226 - RNA, 32 nt, Human
acuccugaggcugaggugggaggaucgccuga

SEQ ID NO: 306227 - RNA, 32 nt, Human
acuccugaguagcugggauuacaggcaugugc

SEQ ID NO: 306228 - RNA, 32 nt, Human
acuccugcaacuucaggagaccugugagcaca

SEQ ID NO: 306229 - RNA, 32 nt, Human
acuccugcagggcccacggcuccugagcaaca

SEQ ID NO: 306230 - RNA, 32 nt, Human
acuccugcauguccuugggggcgcagcccugu

SEQ ID NO: 306231 - RNA, 32 nt, Human
acuccugcauuccaaccagccugggugacaga

SEQ ID NO: 306232 - RNA, 32 nt, Human
acuccugccagggaacuggccugcugcgcccc

SEQ ID NO: 306233 - RNA, 32 nt, Human
acuccugccggaccugguggggagacacgaug

SEQ ID NO: 306234 - RNA, 32 nt, Human
acuccugccugggcaauagagccagaccuugc

SEQ ID NO: 306235 - RNA, 32 nt, Human
acuccugcucccuguggcacucagggagcauu

SEQ ID NO: 306236 - RNA, 32 nt, Human
acuccugcugcggcucauguuuggaagcuguc

SEQ ID NO: 306237 - RNA, 32 nt, Human
acuccugcuugauacagaacaaaaagagcuua

SEQ ID NO: 306238 - RNA, 32 nt, Human
acuccuggaaagucuguccuucgcugauucug

SEQ ID NO: 306239 - RNA, 32 nt, Human
acuccuggaagugguucagucagguggcaaaa

SEQ ID NO: 306240 - RNA, 25 nt, Human
acuccuggagacgcggaggcccggg

SEQ ID NO: 306241 - RNA, 32 nt, Human
acuccuggagccaagagggaagggcaggguag

SEQ ID NO: 306242 - RNA, 32 nt, Human
acuccuggcacacaccugucuguaaccuguuu

SEQ ID NO: 306243 - RNA, 32 nt, Human
acuccuggcacacaucaugggcuuuggaggca

SEQ ID NO: 306244 - RNA, 32 nt, Human
acuccuggccaacauggugaaaccccgucucu

SEQ ID NO: 306245 - RNA, 32 nt, Human
acuccuggccuaugccagcauucuuuaaaguu

SEQ ID NO: 306246 - RNA, 32 nt, Human
acuccuggccucaagcacuccacccaccucgg

SEQ ID NO: 306247 - RNA, 32 nt, Human
acuccuggccucaagugacccuccugucucag

SEQ ID NO: 306248 - RNA, 32 nt, Human
acuccuggccuccagucauuugccugccucgg

SEQ ID NO: 306249 - RNA, 32 nt, Human
acuccuggccucgagcagucuuccugccucgg

SEQ ID NO: 306250 - RNA, 32 nt, Human
acuccuggcucaaucgauccuccuggauaagc

SEQ ID NO: 306251 - RNA, 32 nt, Human
acuccuggcugucaguuucucaguggcaacua

SEQ ID NO: 306252 - RNA, 25 nt, Human
acuccuggcuucgggugauccgcuu

SEQ ID NO: 306253 - RNA, 32 nt, Human
acuccugggaccccacguccugcaccccggcu

SEQ ID NO: 306254 - RNA, 32 nt, Human
acuccugggagcggggguggucggggcgguuu

SEQ ID NO: 306255 - RNA, 25 nt, Human
acuccugggcucauauuuucagggu

SEQ ID NO: 306256 - RNA, 32 nt, Human
acuccugggcuccuccccaucccccgugucuc

SEQ ID NO: 306257 - RNA, 17 nt, Human
acuccuggggucaagca

SEQ ID NO: 306258 - RNA, 32 nt, Human
acuccugggucccugggaaagaggguacuagg

SEQ ID NO: 306259 - RNA, 32 nt, Human
acuccuggguucaagcagucuuccugccuugg

SEQ ID NO: 306260 - RNA, 32 nt, Human
acuccugucacugucuccauccccaaauaaag

SEQ ID NO: 306261 - RNA, 32 nt, Human
acuccugucccagcccugccuccagggcuccu

SEQ ID NO: 306262 - RNA, 32 nt, Human
acuccuguccgcggggaccuggacccgccugu

SEQ ID NO: 306263 - RNA, 32 nt, Human
acuccuguguccaguuuagaagugagagacuu

SEQ ID NO: 306264 - RNA, 32 nt, Human
acuccuguuacccaggcuggaggacagugaug

SEQ ID NO: 306265 - RNA, 32 nt, Human
acuccuguucccuacaaugggaaaugucacaa

SEQ ID NO: 306266 - RNA, 32 nt, Human
acuccuuaagcugugguuucagucucugcuag

SEQ ID NO: 306267 - RNA, 32 nt, Human
acuccuuaauguggaauuuuccagcaaaaugu

SEQ ID NO: 306268 - RNA, 21 nt, Human
acuccuuagccccgcauuccu

SEQ ID NO: 306269 - RNA, 32 nt, Human
acuccuuaggaaaaugaagaguauuuuuaagg

SEQ ID NO: 306270 - RNA, 32 nt, Human
acuccuuauaaauaugguaaaguacaguggua

SEQ ID NO: 306271 - RNA, 32 nt, Human
acuccuucaccuagggauguguuuguugcccu

SEQ ID NO: 306272 - RNA, 32 nt, Human
acuccuucccaacccuccccuccagggacgag

SEQ ID NO: 306273 - RNA, 32 nt, Human
acuccuuccugcucacugucaugggcuacgac

SEQ ID NO: 306274 - RNA, 32 nt, Human
acuccuuccuggaagccuuccuggauuucacg

SEQ ID NO: 306275 - RNA, 32 nt, Human
acuccuuccuuuccuuccuuucucuuccuucu

SEQ ID NO: 306276 - RNA, 32 nt, Human
acuccuucucaaggaaugcuuuccucuaacug

SEQ ID NO: 306277 - RNA, 32 nt, Human
acuccuucucuagcucgagacgcgucgacccg

SEQ ID NO: 306278 - RNA, 32 nt, Human
acuccuucucucugcaugcaccucagagccag

SEQ ID NO: 306279 - RNA, 32 nt, Human
acuccuucuuccuaucagcucuagaaccccag

SEQ ID NO: 306280 - RNA, 32 nt, Human
acuccuucuuucaacguggcccagggaggcca

SEQ ID NO: 306281 - RNA, 32 nt, Human
acuccuugaccaccauccuguauccaaccauc

SEQ ID NO: 306282 - RNA, 32 nt, Human
acuccuugcagagccuguggcuugcauuuccu

SEQ ID NO: 306283 - RNA, 32 nt, Human
acuccuugccuaggcuggaguuuacagagaca

SEQ ID NO: 306284 - RNA, 32 nt, Human
acuccuugcuccucucccuccugccucaacug

SEQ ID NO: 306285 - RNA, 32 nt, Human
acuccuugcugggcacauauacacagcccacu

SEQ ID NO: 306286 - RNA, 32 nt, Human
acuccuugcuugaccccaucucugguuccugc

SEQ ID NO: 306287 - RNA, 32 nt, Human
acuccuuggagagacgacuaggaggacagcuu

SEQ ID NO: 306288 - RNA, 32 nt, Human
acuccuuggccuagcccacccugcugccuucu

SEQ ID NO: 306289 - RNA, 31 nt, Human
acuccuuggcuucucccaccgcaagcaacgc

SEQ ID NO: 306290 - RNA, 16 nt, Human
acuccuuguaauucca

SEQ ID NO: 306291 - RNA, 32 nt, Human
acuccuuguucaccccagcggggaccacgccc

SEQ ID NO: 306292 - RNA, 32 nt, Human
acuccuuuagcugcauccuguguuucaaugua

SEQ ID NO: 306293 - RNA, 21 nt, Human
acuccuuugccccagggaccc

SEQ ID NO: 306294 - RNA, 32 nt, Human
acuccuuugccucccaaauaugucuguauguu

SEQ ID NO: 306295 - RNA, 32 nt, Human
acuccuuugcguguguuccaugggacucucuu

SEQ ID NO: 306296 - RNA, 32 nt, Human
acuccuuugguaucuggaucuuccuuuuaaac

SEQ ID NO: 306297 - RNA, 32 nt, Human
acucgaacacaaacccugcggucuccaggggg

SEQ ID NO: 306298 - RNA, 32 nt, Human
acucgaacccaagaaguggagguugcagugag

SEQ ID NO: 306299 - RNA, 32 nt, Human
acucgaacccaggaggcagagguugcagugag

SEQ ID NO: 306300 - RNA, 32 nt, Human
acucgaacccguccuuuucacaacagccgcgg

SEQ ID NO: 306301 - RNA, 32 nt, Human
acucgaagaaaauguucucuuuuuaaauauac

SEQ ID NO: 306302 - RNA, 32 nt, Human
acucgaagucauggccaccuccagggacaaag

SEQ ID NO: 306303 - RNA, 32 nt, Human
acucgacaauauggccagcuaaugaaauuaaa

SEQ ID NO: 306304 - RNA, 32 nt, Human
acucgacccagccacacaccaggcugugcuca

SEQ ID NO: 306305 - RNA, 24 nt, Human
acucgaccgccgcccccagccagg

SEQ ID NO: 306306 - RNA, 32 nt, Human
acucgacgagcgcgcacccaccgcgccggagc

SEQ ID NO: 306307 - RNA, 32 nt, Human
acucgacggugaggacuuacgggcgggauagg

SEQ ID NO: 306308 - RNA, 32 nt, Human
acucgagcaagccuggguguuccuuccuccuc

SEQ ID NO: 306309 - RNA, 32 nt, Human
acucgagccauggagcaggccaugggccuuga

SEQ ID NO: 306310 - RNA, 32 nt, Human
acucgagcucacugcccacacacagcaugccu

SEQ ID NO: 306311 - RNA, 32 nt, Human
acucgaggacaggcagauggcuuuggauuaga

SEQ ID NO: 306312 - RNA, 17 nt, Human
acucgaggagcaaggug

SEQ ID NO: 306313 - RNA, 32 nt, Human
acucgaggcuggagccaagauccugccugaua

SEQ ID NO: 306314 - RNA, 32 nt, Human
acucgagggccaggaagaaccgcucucagaua

SEQ ID NO: 306315 - RNA, 32 nt, Human
acucgaguccagcccccaggaagccugcuccc

SEQ ID NO: 306316 - RNA, 32 nt, Human
acucgaguccaugggacccccacgcucgugag

SEQ ID NO: 306317 - RNA, 32 nt, Human
acucgaguccuaggaagagagaggcaccagag

SEQ ID NO: 306318 - RNA, 32 nt, Human
acucgauacgggagccagccugggugacgcuc

SEQ ID NO: 306319 - RNA, 32 nt, Human
acucgaucacagcugcagcccaaguaaggggc

SEQ ID NO: 306320 - RNA, 32 nt, Human
acucgaugguacccaggugcccuucaggcucu

SEQ ID NO: 306321 - RNA, 32 nt, Human
acucgaugugacuucuccccugcccuuccucc

SEQ ID NO: 306322 - RNA, 32 nt, Human
acucgaugugugacuguuuggcacuugagaca

SEQ ID NO: 306323 - RNA, 32 nt, Human
acucgauuucgucucggucuuccccagagcug

SEQ ID NO: 306324 - RNA, 25 nt, Human
acucgauuuugauguuucuuuaaaa

SEQ ID NO: 306325 - RNA, 32 nt, Human
acucgcacaaguguccagagaucguagccaga

SEQ ID NO: 306326 - RNA, 32 nt, Human
acucgcacacagauucccacagaacuuggaua

SEQ ID NO: 306327 - RNA, 32 nt, Human
acucgcacagcccagggaguggggaggauaag

SEQ ID NO: 306328 - RNA, 32 nt, Human
acucgcaccuguaaucccagcacuuugggauu

SEQ ID NO: 306329 - RNA, 32 nt, Human
acucgcaccuguaaucccagcauuuugggagg

SEQ ID NO: 306330 - RNA, 32 nt, Human
acucgcagacucgcgcuggcuccagucucucc

SEQ ID NO: 306331 - RNA, 32 nt, Human
acucgcagcaaccuccgccuccuggguucaag

SEQ ID NO: 306332 - RNA, 32 nt, Human
acucgccaaggcagagcgcaaagugcuagcca

SEQ ID NO: 306333 - RNA, 32 nt, Human
acucgccaauuuaaaugacacagaacuuugua

SEQ ID NO: 306334 - RNA, 32 nt, Human
acucgccagccuccugagcuccaugcccauca

SEQ ID NO: 306335 - RNA, 32 nt, Human
acucgccaggcugcagccucaggcacuggcag

SEQ ID NO: 306336 - RNA, 32 nt, Human
acucgccauugauuggugcccacccagggcac

SEQ ID NO: 306337 - RNA, 32 nt, Human
acucgcccaccagggugaugccacuuuugccu

SEQ ID NO: 306338 - RNA, 32 nt, Human
acucgcccagaucucugcacuucucaguccca

SEQ ID NO: 306339 - RNA, 32 nt, Human
acucgcccccaucuacugacugugccagucuu

SEQ ID NO: 306340 - RNA, 32 nt, Human
acucgcccuccagcuucugcccugccugcugu

SEQ ID NO: 306341 - RNA, 32 nt, Human
acucgcccucccuccucgcucggugacucuuu

SEQ ID NO: 306342 - RNA, 32 nt, Human
acucgcccucggcuucucccugcccggccgcc

SEQ ID NO: 306343 - RNA, 32 nt, Human
acucgcccugccuccaucaccugggcccuugg

SEQ ID NO: 306344 - RNA, 32 nt, Human
acucgccgagcuccucccgggaaacccgguac

SEQ ID NO: 306345 - RNA, 32 nt, Human
acucgccgcucccugggucccuucccagugga

SEQ ID NO: 306346 - RNA, 32 nt, Human
acucgccuauagucccagcuacuugggaggcu

SEQ ID NO: 306347 - RNA, 32 nt, Human
acucgccuccccucggcacccccggccccgga

SEQ ID NO: 306348 - RNA, 32 nt, Human
acucgccugccucugugugcgugcaugugugu

SEQ ID NO: 306349 - RNA, 32 nt, Human
acucgccugccugcccgcccgcucacacgcuc

SEQ ID NO: 306350 - RNA, 32 nt, Human
acucgccugccugcucagagcccugcagggcu

SEQ ID NO: 306351 - RNA, 32 nt, Human
acucgccugggcaguggggaggagaguggccu

SEQ ID NO: 306352 - RNA, 32 nt, Human
acucgccuguaaucucacuacacaggaggcug

SEQ ID NO: 306353 - RNA, 17 nt, Human
acucgccuguaguccca

SEQ ID NO: 306354 - RNA, 32 nt, Human
acucgccuguagucccagcuacucaggaggcu

SEQ ID NO: 306355 - RNA, 32 nt, Human
acucgcgauacacacaucuacacgggcgacag

SEQ ID NO: 306356 - RNA, 18 nt, Human
acucgcggcugggcugcc

SEQ ID NO: 306357 - RNA, 32 nt, Human
acucgcgguggaggccggauuugcacgggcag

SEQ ID NO: 306358 - RNA, 23 nt, Human
acucgcguucccuccagccccug

SEQ ID NO: 306359 - RNA, 32 nt, Human
acucgcuacauggugugacccuccuagggaac

SEQ ID NO: 306360 - RNA, 32 nt, Human
acucgcuccucucucaccuccucucucccucu

SEQ ID NO: 306361 - RNA, 32 nt, Human
acucgcuccucuucuguguauuuaaguccugc

SEQ ID NO: 306362 - RNA, 32 nt, Human
acucgcucgccaugucggcugcagaggcgggg

SEQ ID NO: 306363 - RNA, 21 nt, Human
acucgcucuccuguccccuuc

SEQ ID NO: 306364 - RNA, 32 nt, Human
acucgcucucgcuuguccaucucccucccggg

SEQ ID NO: 306365 - RNA, 32 nt, Human
acucgcugccccucucugggccuguugcucca

SEQ ID NO: 306366 - RNA, 32 nt, Human
acucgcugggcugaggucgucucgggugagga

SEQ ID NO: 306367 - RNA, 32 nt, Human
acucgcuguaccaauauccauggaggaauaug

SEQ ID NO: 306368 - RNA, 32 nt, Human
acucgcugugcucuccccuccuuggggcguuu

SEQ ID NO: 306369 - RNA, 32 nt, Human
acucggaacagccaugcaagggcacagauggg

SEQ ID NO: 306370 - RNA, 32 nt, Human
acucggaaggcugaggcaggaggaucacuuga

SEQ ID NO: 306371 - RNA, 32 nt, Human
acucggacacuggccuugggaacaauguucga

SEQ ID NO: 306372 - RNA, 32 nt, Human
acucggacuggagccucuucucucccaccgcg

SEQ ID NO: 306373 - RNA, 32 nt, Human
acucggagagggcugcgagcauuucccucccg

SEQ ID NO: 306374 - RNA, 32 nt, Human
acucggaucacgcccuccugggcacaggucac

SEQ ID NO: 306375 - RNA, 32 nt, Human
acucggauggggaggaagaggaggaagaggaa

SEQ ID NO: 306376 - RNA, 32 nt, Human
acucggcaacuccgcggaagaccaggguccug

SEQ ID NO: 306377 - RNA, 32 nt, Human
acucggcagaaauggccucuccccaaagccuc

SEQ ID NO: 306378 - RNA, 32 nt, Human
acucggcagcuuugagcccuggcacagcuucg

SEQ ID NO: 306379 - RNA, 32 nt, Human
acucggcaggcugaggugggaggaucaccuaa

SEQ ID NO: 306380 - RNA, 32 nt, Human
acucggcccaggaggucagcagucuguucuug

SEQ ID NO: 306381 - RNA, 32 nt, Human
acucggccccgccucugcgccgggcagcuuaa

SEQ ID NO: 306382 - RNA, 24 nt, Human
acucggccgacgccgccgccgccg

SEQ ID NO: 306383 - RNA, 32 nt, Human
acucggccuggagcuuggggugcucugccaac

SEQ ID NO: 306384 - RNA, 32 nt, Human
acucggccuggccuuccucugccugcaaguga

SEQ ID NO: 306385 - RNA, 32 nt, Human
acucggccuugcgcccgcccucaggcccgcgc

SEQ ID NO: 306386 - RNA, 32 nt, Human
acucggcuacucaggacagggcuggaauuuaa

SEQ ID NO: 306387 - RNA, 32 nt, Human
acucggcucugccucccaguccgcacaccucu

SEQ ID NO: 306388 - RNA, 32 nt, Human
acucggcugggggagagcagaggcagcugggg

SEQ ID NO: 306389 - RNA, 32 nt, Human
acucggcuguucuggacucugaugugugugga

SEQ ID NO: 306390 - RNA, 32 nt, Human
acucgggaacaggaaucaggaaaccugaguuu

SEQ ID NO: 306391 - RNA, 32 nt, Human
acucgggaagcuaaggugggaggaucaccuga

SEQ ID NO: 306392 - RNA, 32 nt, Human
acucgggacgcugaggcgggaggaucacauga

SEQ ID NO: 306393 - RNA, 32 nt, Human
acucgggacuccuuuucuuucucuagcugcca

SEQ ID NO: 306394 - RNA, 32 nt, Human
acucgggacugcugugccuuucacacuugaau

SEQ ID NO: 306395 - RNA, 32 nt, Human
acucgggagacucaugcaggaggaucacuuga

SEQ ID NO: 306396 - RNA, 32 nt, Human
acucgggagacugaggcaggaggaucacuuaa

SEQ ID NO: 306397 - RNA, 32 nt, Human
acucgggaggaagagguugcagugagcugaga

SEQ ID NO: 306398 - RNA, 32 nt, Human
acucgggaggcagagguugcagugagcugaga

SEQ ID NO: 306399 - RNA, 32 nt, Human
acucgggaggcagagguugucaugagcugagc

SEQ ID NO: 306400 - RNA, 32 nt, Human
acucgggaggcagagguuucagggagccaaga

SEQ ID NO: 306401 - RNA, 32 nt, Human
acucgggaggcgaagguugcagugagccgaga

SEQ ID NO: 306402 - RNA, 32 nt, Human
acucgggaggcggagguugcagugagccgaga

SEQ ID NO: 306403 - RNA, 32 nt, Human
acucgggaggcggagucaggagacucucuuga

SEQ ID NO: 306404 - RNA, 32 nt, Human
acucgggaggcggauguugcagugagccaaua

SEQ ID NO: 306405 - RNA, 32 nt, Human
acucgggaggcugaaacaggagaaucacuuga

SEQ ID NO: 306406 - RNA, 32 nt, Human
acucgggaggcugaagcagaagaaucgcuuga

SEQ ID NO: 306407 - RNA, 32 nt, Human
acucgggaggcugaagcaggagaaucacuuga

SEQ ID NO: 306408 - RNA, 32 nt, Human
acucgggaggcugaagcaggagaaucgcuuga

SEQ ID NO: 306409 - RNA, 32 nt, Human
acucgggaggcugaagcaggagaauugcuuga

SEQ ID NO: 306410 - RNA, 32 nt, Human
acucgggaggcugaagcgggaggguccccuaa

SEQ ID NO: 306411 - RNA, 32 nt, Human
acucgggaggcugacgcaggagaaucacuuga

SEQ ID NO: 306412 - RNA, 32 nt, Human
acucgggaggcugagacaggagaaucacuuga

SEQ ID NO: 306413 - RNA, 32 nt, Human
acucgggaggcugagaugggaggaucgcuuga

SEQ ID NO: 306414 - RNA, 32 nt, Human
acucgggaggcugagcuucgaggauugauuga

SEQ ID NO: 306415 - RNA, 32 nt, Human
acucgggaggcugaggagggagaaucgguuga

SEQ ID NO: 306416 - RNA, 32 nt, Human
acucgggaggcugaggcaagagaaucacuuga

SEQ ID NO: 306417 - RNA, 32 nt, Human
acucgggaggcugaggcaagagaaucgcuuga

SEQ ID NO: 306418 - RNA, 32 nt, Human
acucgggaggcugaggcaagagaaucucuuga

SEQ ID NO: 306419 - RNA, 32 nt, Human
acucgggaggcugaggcaagagaauugccuga

SEQ ID NO: 306420 - RNA, 32 nt, Human
acucgggaggcugaggcaagagaauugcuuga

SEQ ID NO: 306421 - RNA, 32 nt, Human
acucgggaggcugaggcaagagaguuacuuga

SEQ ID NO: 306422 - RNA, 32 nt, Human
acucgggaggcugaggcacaagaaaagcuuga

SEQ ID NO: 306423 - RNA, 32 nt, Human
acucgggaggcugaggcacaagaaucacuuga

SEQ ID NO: 306424 - RNA, 32 nt, Human
acucgggaggcugaggcacaagaaucauuuga

SEQ ID NO: 306425 - RNA, 32 nt, Human
acucgggaggcugaggcacgagaaucacuuga

SEQ ID NO: 306426 - RNA, 32 nt, Human
acucgggaggcugaggcacgagaaucgcuuga

SEQ ID NO: 306427 - RNA, 32 nt, Human
acucgggaggcugaggcagaagaaucgcuuga

SEQ ID NO: 306428 - RNA, 32 nt, Human
acucgggaggcugaggcagaaggauugcuuga

SEQ ID NO: 306429 - RNA, 32 nt, Human
acucgggaggcugaggcagaaucgcuugaacc

SEQ ID NO: 306430 - RNA, 32 nt, Human
acucgggaggcugaggcagagaauugcuugaa

SEQ ID NO: 306431 - RNA, 32 nt, Human
acucgggaggcugaggcagcagaaucacuuga

SEQ ID NO: 306432 - RNA, 32 nt, Human
acucgggaggcugaggcaggaaaaucacuuga

SEQ ID NO: 306433 - RNA, 32 nt, Human
acucgggaggcugaggcaggacgauuacuuga

SEQ ID NO: 306434 - RNA, 32 nt, Human
acucgggaggcugaggcaggagaaaggcauga

SEQ ID NO: 306435 - RNA, 32 nt, Human
acucgggaggcugaggcaggagaaucaaucac

SEQ ID NO: 306436 - RNA, 32 nt, Human
acucgggaggcugaggcaggagaaucacauga

SEQ ID NO: 306437 - RNA, 32 nt, Human
acucgggaggcugaggcaggagaaucaccuga

SEQ ID NO: 306438 - RNA, 32 nt, Human
acucgggaggcugaggcaggagaaucacuaga

SEQ ID NO: 306439 - RNA, 32 nt, Human
acucgggaggcugaggcaggagaaucacuuaa

SEQ ID NO: 306440 - RNA, 32 nt, Human
acucgggaggcugaggcaggagaaucacuuca

SEQ ID NO: 306441 - RNA, 32 nt, Human
acucgggaggcugaggcaggagaaucacuuga

SEQ ID NO: 306442 - RNA, 32 nt, Human
acucgggaggcugaggcaggagaaucauuuca

SEQ ID NO: 306443 - RNA, 32 nt, Human
acucgggaggcugaggcaggagaaucccuuga

SEQ ID NO: 306444 - RNA, 32 nt, Human
acucgggaggcugaggcaggagaaucgccuga

SEQ ID NO: 306445 - RNA, 32 nt, Human
acucgggaggcugaggcaggagaaucgcugga

SEQ ID NO: 306446 - RNA, 32 nt, Human
acucgggaggcugaggcaggagaaucgcuuaa

SEQ ID NO: 306447 - RNA, 32 nt, Human
acucgggaggcugaggcaggagaaucgcuuga

SEQ ID NO: 306448 - RNA, 32 nt, Human
acucgggaggcugaggcaggagaaucgucuaa

SEQ ID NO: 306449 - RNA, 32 nt, Human
acucgggaggcugaggcaggagaaucguuuga

SEQ ID NO: 306450 - RNA, 32 nt, Human
acucgggaggcugaggcaggagaaucucuuga

SEQ ID NO: 306451 - RNA, 32 nt, Human
acucgggaggcugaggcaggagagaaucgcuu

SEQ ID NO: 306452 - RNA, 32 nt, Human
acucgggaggcugaggcaggagagugacguga

SEQ ID NO: 306453 - RNA, 32 nt, Human
acucgggaggcugaggcaggagaucgcuggaa

SEQ ID NO: 306454 - RNA, 32 nt, Human
acucgggaggcugaggcaggagcaucgcuuga

SEQ ID NO: 306455 - RNA, 32 nt, Human
acucgggaggcugaggcaggaggaucacuuga

SEQ ID NO: 306456 - RNA, 32 nt, Human
acucgggaggcugaggcaggaggaucgcuuga

SEQ ID NO: 306457 - RNA, 32 nt, Human
acucgggaggcugaggcaggaggaucgcuugg

SEQ ID NO: 306458 - RNA, 32 nt, Human
acucgggaggcugaggcaggaggauugcuuga

SEQ ID NO: 306459 - RNA, 32 nt, Human
acucgggaggcugaggcaggauaaucacuuga

SEQ ID NO: 306460 - RNA, 32 nt, Human
acucgggaggcugaggcaggauugccugagcc

SEQ ID NO: 306461 - RNA, 32 nt, Human
acucgggaggcugaggcagggagaaucgcuug

SEQ ID NO: 306462 - RNA, 32 nt, Human
acucgggaggcugaggcaggggaaucacuuga

SEQ ID NO: 306463 - RNA, 32 nt, Human
acucgggaggcugaggcagggggagcacuuga

SEQ ID NO: 306464 - RNA, 32 nt, Human
acucgggaggcugaggcauaagaaucacuuga

SEQ ID NO: 306465 - RNA, 32 nt, Human
acucgggaggcugaggcaugagaaucgcugca

SEQ ID NO: 306466 - RNA, 32 nt, Human
acucgggaggcugaggcaugagaauuacuuga

SEQ ID NO: 306467 - RNA, 32 nt, Human
acucgggaggcugaggccguaggaucccuuga

SEQ ID NO: 306468 - RNA, 32 nt, Human
acucgggaggcugaggcggaagaaucacuuga

SEQ ID NO: 306469 - RNA, 32 nt, Human
acucgggaggcugaggcgggagaaucacuuga

SEQ ID NO: 306470 - RNA, 32 nt, Human
acucgggaggcugaggcgggaggaucaguuga

SEQ ID NO: 306471 - RNA, 32 nt, Human
acucgggaggcugaggcuggagguucaaucgc

SEQ ID NO: 306472 - RNA, 32 nt, Human
acucgggaggcugagguagagaaucgcuugaa

SEQ ID NO: 306473 - RNA, 32 nt, Human
acucgggaggcugagguaggaggaucgcuuga

SEQ ID NO: 306474 - RNA, 32 nt, Human
acucgggaggcugaggugaaaggaucacuuga

SEQ ID NO: 306475 - RNA, 32 nt, Human
acucgggaggcugagguggaaagauggcccag

SEQ ID NO: 306476 - RNA, 32 nt, Human
acucgggaggcugaggugggagaaucacuuga

SEQ ID NO: 306477 - RNA, 32 nt, Human
acucgggaggcugaggugggaggaucacuuga

SEQ ID NO: 306478 - RNA, 32 nt, Human
acucgggaggcugaggugggaggaucccagga

SEQ ID NO: 306479 - RNA, 32 nt, Human
acucgggaggcugaggugggaggaucccguga

SEQ ID NO: 306480 - RNA, 32 nt, Human
acucgggaggcugaggugggaggaucgcugga

SEQ ID NO: 306481 - RNA, 32 nt, Human
acucgggaggcugaggugggaggaucgcuuga

SEQ ID NO: 306482 - RNA, 32 nt, Human
acucgggaggcugagucaggagaaucacuuga

SEQ ID NO: 306483 - RNA, 32 nt, Human
acucgggaggcuggggcaggagaaucacuuga

SEQ ID NO: 306484 - RNA, 32 nt, Human
acucgggagguagagguugcagugagccaagg

SEQ ID NO: 306485 - RNA, 32 nt, Human
acucgggaggugaaaguugcagugagccgaga

SEQ ID NO: 306486 - RNA, 32 nt, Human
acucgggagguggagauugcaguaagccgaga

SEQ ID NO: 306487 - RNA, 32 nt, Human
acucgggagguggagguggcagugagccgaga

SEQ ID NO: 306488 - RNA, 32 nt, Human
acucgggagguggagguugcagucagccaaga

SEQ ID NO: 306489 - RNA, 25 nt, Human
acucgggagguggagguugcaguga

SEQ ID NO: 306490 - RNA, 32 nt, Human
acucgggagguggagguugcagugagccaaga

SEQ ID NO: 306491 - RNA, 32 nt, Human
acucgggagguggagguugcagugagcugaga

SEQ ID NO: 306492 - RNA, 32 nt, Human
acucgggagguggagguugugaugugcugaga

SEQ ID NO: 306493 - RNA, 32 nt, Human
acucgggcacaggccggcugggccgggaucag

SEQ ID NO: 306494 - RNA, 18 nt, Human
acucgggccucacauggc

SEQ ID NO: 306495 - RNA, 32 nt, Human
acucgggcgcugagggccacucacacagcugc

SEQ ID NO: 306496 - RNA, 32 nt, Human
acucgggcugcaaggugagaagaggcagacag

SEQ ID NO: 306497 - RNA, 32 nt, Human
acucgggcuuguaacugucugagccccggauc

SEQ ID NO: 306498 - RNA, 32 nt, Human
acucggggaggcaggguagcagugcuuccaga

SEQ ID NO: 306499 - RNA, 32 nt, Human
acucggggcugcagggcaaguguuuaggaugg

SEQ ID NO: 306500 - RNA, 32 nt, Human
acucgggggcaucuugcuggcucuaaacucac

SEQ ID NO: 306501 - RNA, 32 nt, Human
acucggggguggagugagacugacugcaagcc

SEQ ID NO: 306502 - RNA, 32 nt, Human
acucggguaucugaggugggaggaucaguuga

SEQ ID NO: 306503 - RNA, 32 nt, Human
acucggguccccuggcacuugcauccugaguc

SEQ ID NO: 306504 - RNA, 32 nt, Human
acucgggugggggagguugcaaugagccgaga

SEQ ID NO: 306505 - RNA, 32 nt, Human
acucggucugagaggucggaggcugcgagugu

SEQ ID NO: 306506 - RNA, 32 nt, Human
acucggugcaggaggcugagugagcaggggag

SEQ ID NO: 306507 - RNA, 32 nt, Human
acucggugcuucccgggguggggaggaggcag

SEQ ID NO: 306508 - RNA, 32 nt, Human
acucgguguacauccuggaggacucuguugug

SEQ ID NO: 306509 - RNA, 32 nt, Human
acucgguguugucggguauguuaaauuugagc

SEQ ID NO: 306510 - RNA, 32 nt, Human
acucgguuucuccaaacugaagcagccucucc

SEQ ID NO: 306511 - RNA, 32 nt, Human
acucgucacacuuaucaccugggccacugcaa

SEQ ID NO: 306512 - RNA, 32 nt, Human
acucgucaccccagcuggagugcaguggugcg

SEQ ID NO: 306513 - RNA, 32 nt, Human
acucgucaggaaggcaggagacaggagacggg

SEQ ID NO: 306514 - RNA, 28 nt, Human
acucgucccccuccugccucaucuuccu

SEQ ID NO: 306515 - RNA, 32 nt, Human
acucguccccucuuccacaccuucccagcauc

SEQ ID NO: 306516 - RNA, 32 nt, Human
acucgucucugagauuuccauggaucuagaag

SEQ ID NO: 306517 - RNA, 32 nt, Human
acucgugaccuccagccugccccuugcugccg

SEQ ID NO: 306518 - RNA, 21 nt, Human
acucgugauccgcccaccuca

SEQ ID NO: 306519 - RNA, 32 nt, Human
acucgugcccuccugguacaugggguuuuaag

SEQ ID NO: 306520 - RNA, 32 nt, Human
acucguggcgcgggagcugggagccaggcucu

SEQ ID NO: 306521 - RNA, 30 nt, Human
acucgugggagccacagggcaggggcagcg

SEQ ID NO: 306522 - RNA, 32 nt, Human
acucgugggagccacagggcaggggcagcggg

SEQ ID NO: 306523 - RNA, 22 nt, Human
acucgugggagggagaggaccc

SEQ ID NO: 306524 - RNA, 32 nt, Human
acucguguugccccggcuggagugcaguggcg

SEQ ID NO: 306525 - RNA, 32 nt, Human
acucguucccaggucagaggucagcagauggg

SEQ ID NO: 306526 - RNA, 32 nt, Human
acucguuccccuccucuuccgagcugcuuugu

SEQ ID NO: 306527 - RNA, 32 nt, Human
acucguugcaggcgacgaugcagagggcugua

SEQ ID NO: 306528 - RNA, 32 nt, Human
acucguugcccaggcuggagugcaguggcgca

SEQ ID NO: 306529 - RNA, 32 nt, Human
acucguugcccaggcuggaguguagaggcgag

SEQ ID NO: 306530 - RNA, 32 nt, Human
acucuaaaauuguuuccuccauucugaggguu

SEQ ID NO: 306531 - RNA, 32 nt, Human
acucuaaauuguggcuggcuucccuuucuguc

SEQ ID NO: 306532 - RNA, 32 nt, Human
acucuaacagcagaaaggagagaugugugcag

SEQ ID NO: 306533 - RNA, 32 nt, Human
acucuaaccuguagcuucagaggccagucugg

SEQ ID NO: 306534 - RNA, 25 nt, Human
acucuaacucuuauucccaagcuua

SEQ ID NO: 306535 - RNA, 25 nt, Human
acucuaacucuuguuuccaagcuua

SEQ ID NO: 306536 - RNA, 32 nt, Human
acucuaagaaaaucaaccauuaaucucucauu

SEQ ID NO: 306537 - RNA, 32 nt, Human
acucuaagaucucaacccuugaucccaaaggc

SEQ ID NO: 306538 - RNA, 32 nt, Human
acucuaagcgaaggaggagcacugccucagcc

SEQ ID NO: 306539 - RNA, 32 nt, Human
acucuaagucaccaccaucuuuugccuugacu

SEQ ID NO: 306540 - RNA, 32 nt, Human
acucuaagucuagcagagaagaugaggcggua

SEQ ID NO: 306541 - RNA, 32 nt, Human
acucuaaugccuggacuggccauguucuaguc

SEQ ID NO: 306542 - RNA, 22 nt, Human
acucuaauguaccaaugaugaa

SEQ ID NO: 306543 - RNA, 32 nt, Human
acucuacaaaaauacaaaaauuagccagguuu

SEQ ID NO: 306544 - RNA, 32 nt, Human
acucuacaaaccugaaagaugcaacagugcuu

SEQ ID NO: 306545 - RNA, 32 nt, Human
acucuacaaaccugaaagaugugacaaugcuu

SEQ ID NO: 306546 - RNA, 32 nt, Human
acucuacaagugacgucuuuuuauuucaaaga

SEQ ID NO: 306547 - RNA, 22 nt, Human
acucuacagaaaauuagacagg

SEQ ID NO: 306548 - RNA, 32 nt, Human
acucuacagacucccacucaguacuguacagg

SEQ ID NO: 306549 - RNA, 32 nt, Human
acucuacagggacgugaugcuggagaacuaug

SEQ ID NO: 306550 - RNA, 32 nt, Human
acucuacauaugugugugugcgugcgugugug

SEQ ID NO: 306551 - RNA, 32 nt, Human
acucuaccaagaaacacaggaagguauuccag

SEQ ID NO: 306552 - RNA, 32 nt, Human
acucuaccaugguucugccuccuggccaagca

SEQ ID NO: 306553 - RNA, 32 nt, Human
acucuaccuacuugaaaccacaggguuguggg

SEQ ID NO: 306554 - RNA, 32 nt, Human
acucuaccuaggcuguuacuaucagccugaau

SEQ ID NO: 306555 - RNA, 32 nt, Human
acucuaccuggcucccugccagccuggccucc

SEQ ID NO: 306556 - RNA, 32 nt, Human
acucuacucaaagccuuuaaauagcucuccau

SEQ ID NO: 306557 - RNA, 21 nt, Human
acucuacuucccaguaacccu

SEQ ID NO: 306558 - RNA, 32 nt, Human
acucuagagcccaccagccucucagagccucc

SEQ ID NO: 306559 - RNA, 32 nt, Human
acucuagaggcugaggugggaggaucacuuga

SEQ ID NO: 306560 - RNA, 32 nt, Human
acucuagaugguacagaagauggauacugugg

SEQ ID NO: 306561 - RNA, 32 nt, Human
acucuagcccaggcuuugucaacuguagagga

SEQ ID NO: 306562 - RNA, 32 nt, Human
acucuagccuacaacaugcugagcuacagccc

SEQ ID NO: 306563 - RNA, 26 nt, Human
acucuagccugggugacagagcgaga

SEQ ID NO: 306564 - RNA, 26 nt, Human
acucuagccugggugacagagugaga

SEQ ID NO: 306565 - RNA, 32 nt, Human
acucuaggaugaucacuugugcuuagcuuagc

SEQ ID NO: 306566 - RNA, 32 nt, Human
acucuaggcuauuuggugauguuaacaaaaua

SEQ ID NO: 306567 - RNA, 32 nt, Human
acucuaggggcaggggcaggggcaggggcuag

SEQ ID NO: 306568 - RNA, 32 nt, Human
acucuagggucugcgaccucccgcuggacugc

SEQ ID NO: 306569 - RNA, 32 nt, Human
acucuagucuccugccuccucaguucugcaag

SEQ ID NO: 306570 - RNA, 32 nt, Human
acucuagugguuacuauccucugccuuccucu

SEQ ID NO: 306571 - RNA, 32 nt, Human
acucuauaaagaaacuuuugaaaaaguguaca

SEQ ID NO: 306572 - RNA, 32 nt, Human
acucuauaccuugcaggcucauuucagcagac

SEQ ID NO: 306573 - RNA, 32 nt, Human
acucuauagucucaaacuauuuuugcaaauau

SEQ ID NO: 306574 - RNA, 31 nt, Human
acucuaucaauaaacaccucuggcugaaaaa

SEQ ID NO: 306575 - RNA, 32 nt, Human
acucuaucacacaggcuggagggcaguggcag

SEQ ID NO: 306576 - RNA, 32 nt, Human
acucuaucacccaagcuggagugcaguggcac

SEQ ID NO: 306577 - RNA, 32 nt, Human
acucuaucacccaggcuggagugcaguguggc

SEQ ID NO: 306578 - RNA, 32 nt, Human
acucuaugaacucaucauuccagccugggcaa

SEQ ID NO: 306579 - RNA, 32 nt, Human
acucuaugaacuucaaaacaaaaacaaaacuu

SEQ ID NO: 306580 - RNA, 32 nt, Human
acucuaugagaaggaagauuacugaaaagcau

SEQ ID NO: 306581 - RNA, 32 nt, Human
acucuaugagcaaauaguaauuuuggaccuug

SEQ ID NO: 306582 - RNA, 32 nt, Human
acucuauuaaaucuagaauuagccgggcaugg

SEQ ID NO: 306583 - RNA, 32 nt, Human
acucuauucuugccaaaaaccucaaugaaugc

SEQ ID NO: 306584 - RNA, 32 nt, Human
acucuauugcccaggcuggagugcacuggcgu

SEQ ID NO: 306585 - RNA, 32 nt, Human
acucuauugcucaggcuggagugugguggcag

SEQ ID NO: 306586 - RNA, 32 nt, Human
acucuauuuaaccuuggacacacuaauaaggu

SEQ ID NO: 306587 - RNA, 32 nt, Human
acucuauuucucuccauacugaaacaugucuu

SEQ ID NO: 306588 - RNA, 32 nt, Human
acucuauuuugaaaaggaccuguacuuuaaac

SEQ ID NO: 306589 - RNA, 18 nt, Human
acucucaaaggcagcgca

SEQ ID NO: 306590 - RNA, 32 nt, Human
acucucaaaggcugcugcacacagaggagaau

SEQ ID NO: 306591 - RNA, 32 nt, Human
acucucaaugaggagcagcucuccccaugagc

SEQ ID NO: 306592 - RNA, 32 nt, Human
acucucacaagaaaaccaaaaguuucucuuca

SEQ ID NO: 306593 - RNA, 32 nt, Human
acucucacacccagcccaggcugcagucucca

SEQ ID NO: 306594 - RNA, 32 nt, Human
acucucacacccaggcuggagugcagucucaa

SEQ ID NO: 306595 - RNA, 32 nt, Human
acucucacaccuccuucccacccuucuccaga

SEQ ID NO: 306596 - RNA, 32 nt, Human
acucucacacggcaguaucugggaaacacaga

SEQ ID NO: 306597 - RNA, 32 nt, Human
acucucacccaggcuggagugcaguggcacaa

SEQ ID NO: 306598 - RNA, 32 nt, Human
acucucaccuccgaggccuccucugccuggaa

SEQ ID NO: 306599 - RNA, 32 nt, Human
acucucaccugacagaugauguaauucuucaa

SEQ ID NO: 306600 - RNA, 32 nt, Human
acucucaccuucugaccuccuggcaagagaaa

SEQ ID NO: 306601 - RNA, 32 nt, Human
acucucagagcauugagcauugagaggcagca

SEQ ID NO: 306602 - RNA, 32 nt, Human
acucucagccuccuggcaggguuaaagggaga

SEQ ID NO: 306603 - RNA, 32 nt, Human
acucucagccugguaaaugaacaggaaaaacu

SEQ ID NO: 306604 - RNA, 32 nt, Human
acucucagguacugagacuuugugggccucag

SEQ ID NO: 306605 - RNA, 18 nt, Human
acucucagugggcugcag

SEQ ID NO: 306606 - RNA, 32 nt, Human
acucucaucacccaggcuagagugcaguggca

SEQ ID NO: 306607 - RNA, 32 nt, Human
acucucaucucuugcagucagcaacagguauc

SEQ ID NO: 306608 - RNA, 32 nt, Human
acucucaugcuuccauggcagcuccuggcucc

SEQ ID NO: 306609 - RNA, 32 nt, Human
acucucauggaugagggcagagccaacuccua

SEQ ID NO: 306610 - RNA, 32 nt, Human
acucucauugcccaggcuggagugcagugagc

SEQ ID NO: 306611 - RNA, 32 nt, Human
acucuccaauuuucuaaaaugauauggagcuc

SEQ ID NO: 306612 - RNA, 32 nt, Human
acucuccacccuucccuucugccugcccagcu

SEQ ID NO: 306613 - RNA, 32 nt, Human
acucuccacccuuucugucugugugacuuggc

SEQ ID NO: 306614 - RNA, 32 nt, Human
acucuccacuggcuuuccucucucccuuucuc

SEQ ID NO: 306615 - RNA, 32 nt, Human
acucuccagaaagcucaucucagcuccugaaa

SEQ ID NO: 306616 - RNA, 32 nt, Human
acucuccagaucuaccauuaauagaaaauaaa

SEQ ID NO: 306617 - RNA, 32 nt, Human
acucuccagccuguuggcucauccuguggauu

SEQ ID NO: 306618 - RNA, 21 nt, Human
acucuccagcuuuccuggggu

SEQ ID NO: 306619 - RNA, 32 nt, Human
acucuccaguaugucacgcaucuuuaacuuuu

SEQ ID NO: 306620 - RNA, 32 nt, Human
acucuccaguugccacaggcccugccaccccc

SEQ ID NO: 306621 - RNA, 32 nt, Human
acucuccauaaauuuggugauucucugcuagg

SEQ ID NO: 306622 - RNA, 32 nt, Human
acucuccaucagaagcccugggguuccuggcc

SEQ ID NO: 306623 - RNA, 32 nt, Human
acucuccauccccuuucccuuccacuuugggu

SEQ ID NO: 306624 - RNA, 32 nt, Human
acucucccaagccugcuugaccuccaaguaga

SEQ ID NO: 306625 - RNA, 32 nt, Human
acucucccagcacccugugugcacugagcuuc

SEQ ID NO: 306626 - RNA, 32 nt, Human
acucucccaguggagcucugcaggccaggcca

SEQ ID NO: 306627 - RNA, 32 nt, Human
acucucccaucuucaccaacagccucugcaau

SEQ ID NO: 306628 - RNA, 32 nt, Human
acucuccccaggagacccagaccuagaacuac

SEQ ID NO: 306629 - RNA, 32 nt, Human
acucucccuccacccugccuccucgggcucca

SEQ ID NO: 306630 - RNA, 32 nt, Human
acucucccugcuuuagcuuaaauuuaaauuag

SEQ ID NO: 306631 - RNA, 32 nt, Human
acucucccuuuccagcucuccccaaaguccac

SEQ ID NO: 306632 - RNA, 32 nt, Human
acucucccuuuguccuccccauagagcugggg

SEQ ID NO: 306633 - RNA, 32 nt, Human
acucuccgagccgcauccugggcuugugggaa

SEQ ID NO: 306634 - RNA, 32 nt, Human
acucuccgaggaggaggaggaggagggaggag

SEQ ID NO: 306635 - RNA, 32 nt, Human
acucuccgcugggcucccagagcugcuggcgu

SEQ ID NO: 306636 - RNA, 32 nt, Human
acucuccgcuucccccagcacacacacauaca

SEQ ID NO: 306637 - RNA, 32 nt, Human
acucuccuccagguugcauuucaguuucuuuc

SEQ ID NO: 306638 - RNA, 32 nt, Human
acucuccuccuccccuccucuucccuuagccu

SEQ ID NO: 306639 - RNA, 32 nt, Human
acucuccuccuugagcccuugccccugcgucc

SEQ ID NO: 306640 - RNA, 32 nt, Human
acucuccucucucuuccccauuuccuuguagc

SEQ ID NO: 306641 - RNA, 20 nt, Human
acucuccucuuccagggccc

SEQ ID NO: 306642 - RNA, 32 nt, Human
acucuccucuucuagcauuucuuccaauuauu

SEQ ID NO: 306643 - RNA, 32 nt, Human
acucuccugccugcccagcugcgcggcggagc

SEQ ID NO: 306644 - RNA, 32 nt, Human
acucuccuguggcaccuggggcugccaucuau

SEQ ID NO: 306645 - RNA, 32 nt, Human
acucuccuuccagcuacucaggaggcugaggc

SEQ ID NO: 306646 - RNA, 32 nt, Human
acucuccuuugcaaaguguaguccccaaaaac

SEQ ID NO: 306647 - RNA, 32 nt, Human
acucuccuuugcucccuuuuuccaauuucuua

SEQ ID NO: 306648 - RNA, 32 nt, Human
acucuccuuuuucugggucccuucccacuucc

SEQ ID NO: 306649 - RNA, 32 nt, Human
acucucggcugcagacacaggagucacagaug

SEQ ID NO: 306650 - RNA, 32 nt, Human
acucucgggaagacuccucuacucacagcuga

SEQ ID NO: 306651 - RNA, 32 nt, Human
acucucgggaaucuucucugucagccuguaca

SEQ ID NO: 306652 - RNA, 32 nt, Human
acucucgguugcuuuugucuaauucuaauggc

SEQ ID NO: 306653 - RNA, 32 nt, Human
acucucgucgcccaggcuggaaugcaguggug

SEQ ID NO: 306654 - RNA, 32 nt, Human
acucucguguggagguuacagcagcaagagau

SEQ ID NO: 306655 - RNA, 32 nt, Human
acucucguugcccaggcuggagugcaauggcg

SEQ ID NO: 306656 - RNA, 32 nt, Human
acucucuaccucuucgcauccucucuugcucg

SEQ ID NO: 306657 - RNA, 32 nt, Human
acucucuacuccuaaaguuauuuacuauuugg

SEQ ID NO: 306658 - RNA, 32 nt, Human
acucucucagaccuucccaucucccuggcuuu

SEQ ID NO: 306659 - RNA, 32 nt, Human
acucucucagccacagaaaccacguuugaaua

SEQ ID NO: 306660 - RNA, 32 nt, Human
acucucuccagcacucaggaagcccggccgag

SEQ ID NO: 306661 - RNA, 28 nt, Human
acucucuccagugcugccagcgucgcac

SEQ ID NO: 306662 - RNA, 32 nt, Human
acucucuccccuucauuggcugcccaggccac

SEQ ID NO: 306663 - RNA, 32 nt, Human
acucucuccugcccaggcuucugggugcuuuc

SEQ ID NO: 306664 - RNA, 32 nt, Human
acucucucgcccaggcuggagugcaacgguac

SEQ ID NO: 306665 - RNA, 32 nt, Human
acucucucgcccaggcuggagugcaguggcgu

SEQ ID NO: 306666 - RNA, 32 nt, Human
acucucucgcccaggcuggagugcaguggugu

SEQ ID NO: 306667 - RNA, 32 nt, Human
acucucucggauccgugcuucucuccauugua

SEQ ID NO: 306668 - RNA, 32 nt, Human
acucucucuauuucuuuuuguuuuucugaugc

SEQ ID NO: 306669 - RNA, 32 nt, Human
acucucucuccccuccucccacucucuucccc

SEQ ID NO: 306670 - RNA, 32 nt, Human
acucucucucugucuccucucugcaccuuuuu

SEQ ID NO: 306671 - RNA, 32 nt, Human
acucucucucuugcuccugcuuuugcuguuga

SEQ ID NO: 306672 - RNA, 32 nt, Human
acucucucuguggggcuuucacccccaucgcu

SEQ ID NO: 306673 - RNA, 32 nt, Human
acucucucuuccuaugugguguccgcaacauu

SEQ ID NO: 306674 - RNA, 32 nt, Human
acucucucuuccuucuccuuuucuuuccuucc

SEQ ID NO: 306675 - RNA, 32 nt, Human
acucucucuuuucuugcuguucucugaaugcu

SEQ ID NO: 306676 - RNA, 25 nt, Human
acucucuggaaagccugggagcuga

SEQ ID NO: 306677 - RNA, 22 nt, Human
acucucuggaauaagggcccga

SEQ ID NO: 306678 - RNA, 32 nt, Human
acucucuggagguggagacugccgugauucac

SEQ ID NO: 306679 - RNA, 32 nt, Human
acucucuggcugccuugccugccuggggcacu

SEQ ID NO: 306680 - RNA, 32 nt, Human
acucucugggacugaaaaagacaaagguaacu

SEQ ID NO: 306681 - RNA, 32 nt, Human
acucucuggggaagucaggggagaagcugaag

SEQ ID NO: 306682 - RNA, 32 nt, Human
acucucuuccauucccagccucccagagaaca

SEQ ID NO: 306683 - RNA, 32 nt, Human
acucucuuccuuguucugaaucauuucuucuu

SEQ ID NO: 306684 - RNA, 32 nt, Human
acucucuucuagggcuucccaccaucagcccc

SEQ ID NO: 306685 - RNA, 32 nt, Human
acucucuucucccuccagaccuuccucugacc

SEQ ID NO: 306686 - RNA, 32 nt, Human
acucucuucucuuccccaaggccucauuggcu

SEQ ID NO: 306687 - RNA, 32 nt, Human
acucucuucuuacuuaaaccagucccagacac

SEQ ID NO: 306688 - RNA, 32 nt, Human
acucucuugcccaggcuggagugcagugguau

SEQ ID NO: 306689 - RNA, 32 nt, Human
acucucuugcccagguaagcuggggcagagcc

SEQ ID NO: 306690 - RNA, 23 nt, Human
acucucuugcccucucucagggu

SEQ ID NO: 306691 - RNA, 32 nt, Human
acucucuuggcucaauccuccugcuuuaaccu

SEQ ID NO: 306692 - RNA, 32 nt, Human
acucucuuucuaaugcuucccaccuuaccuuu

SEQ ID NO: 306693 - RNA, 22 nt, Human
acucugaaaaggcucucagggu

SEQ ID NO: 306694 - RNA, 32 nt, Human
acucugaaagaacgagccagcagcagcuggug

SEQ ID NO: 306695 - RNA, 32 nt, Human
acucugaaagauggacagagagacaggagaug

SEQ ID NO: 306696 - RNA, 32 nt, Human
acucugaaaugagauugccugagcugagaucu

SEQ ID NO: 306697 - RNA, 21 nt, Human
acucugaaccagccgcaggug

SEQ ID NO: 306698 - RNA, 32 nt, Human
acucugaacccccuggcucuccagccuguccc

SEQ ID NO: 306699 - RNA, 32 nt, Human
acucugaacuccugcacucuccagaagugacu

SEQ ID NO: 306700 - RNA, 32 nt, Human
acucugaagccacagcccgagcuguauguugg

SEQ ID NO: 306701 - RNA, 32 nt, Human
acucugaccacagccuguggcugggaagggag

SEQ ID NO: 306702 - RNA, 32 nt, Human
acucugacccagccagaguccagguuuccaca

SEQ ID NO: 306703 - RNA, 32 nt, Human
acucugacccaguaccccacagagaccacugg

SEQ ID NO: 306704 - RNA, 32 nt, Human
acucugaccugugaucauguuucaggaaggaa

SEQ ID NO: 306705 - RNA, 32 nt, Human
acucugagaaagagcacauugugggggcccac

SEQ ID NO: 306706 - RNA, 32 nt, Human
acucugagaaauuugaaaacaucuggagaaaa

SEQ ID NO: 306707 - RNA, 18 nt, Human
acucugagaagcaguaug

SEQ ID NO: 306708 - RNA, 32 nt, Human
acucugagacagauuaucuucuguaaaguuuu

SEQ ID NO: 306709 - RNA, 32 nt, Human
acucugagaccagcccacccccaaacagcuag

SEQ ID NO: 306710 - RNA, 32 nt, Human
acucugagauccgagaggagcuuggaaagcug

SEQ ID NO: 306711 - RNA, 32 nt, Human
acucugagauguggagacugauggccaggcaa

SEQ ID NO: 306712 - RNA, 21 nt, Human
acucugagcuggaacaguagg

SEQ ID NO: 306713 - RNA, 32 nt, Human
acucugaggaagaagcaggacuugguacgguu

SEQ ID NO: 306714 - RNA, 32 nt, Human
acucugagguuuugcagcacuugcugugcccg

SEQ ID NO: 306715 - RNA, 32 nt, Human
acucugaguaacugguugcugugucauaacuu

SEQ ID NO: 306716 - RNA, 32 nt, Human
acucugagugggccaccaucacccaccacacc

SEQ ID NO: 306717 - RNA, 32 nt, Human
acucugaguuugagcuauuaaaguacuucuua

SEQ ID NO: 306718 - RNA, 32 nt, Human
acucugauaccuccaacugucuugccccucag

SEQ ID NO: 306719 - RNA, 32 nt, Human
acucugaugaacacuuuggagucugcuuuagu

SEQ ID NO: 306720 - RNA, 32 nt, Human
acucugaugacaccccuccccgaggccuccca

SEQ ID NO: 306721 - RNA, 32 nt, Human
acucugauucaccucuuccucugguuccuuuc

SEQ ID NO: 306722 - RNA, 32 nt, Human
acucugcaaauguaagaaagaaccacuuggcc

SEQ ID NO: 306723 - RNA, 32 nt, Human
acucugcaccacugccauacgagcuucccacc

SEQ ID NO: 306724 - RNA, 32 nt, Human
acucugcaccuccccacucucuucccauucaa

SEQ ID NO: 306725 - RNA, 32 nt, Human
acucugcaccugccagagacgaacggugaucu

SEQ ID NO: 306726 - RNA, 32 nt, Human
acucugcaccugcugucuuagggaagaaaugg

SEQ ID NO: 306727 - RNA, 32 nt, Human
acucugcaccuuccuccaccaggagccuggga

SEQ ID NO: 306728 - RNA, 32 nt, Human
acucugcacugcaccaugggaggcuccuggga

SEQ ID NO: 306729 - RNA, 32 nt, Human
acucugcacuucucucuccuuuacgagacgaa

SEQ ID NO: 306730 - RNA, 32 nt, Human
acucugcagccucuguguguguuuacagggca

SEQ ID NO: 306731 - RNA, 32 nt, Human
acucugcagccuguguuuucuguuucccccuu

SEQ ID NO: 306732 - RNA, 32 nt, Human
acucugcaggagcuggagaggcugcgggagcu

SEQ ID NO: 306733 - RNA, 32 nt, Human
acucugcaugagcuuccggagggucauggaga

SEQ ID NO: 306734 - RNA, 32 nt, Human
acucugcauuaggagccuccauuuuucuccag

SEQ ID NO: 306735 - RNA, 32 nt, Human
acucugccaaaaccaagauauccacuuaccug

SEQ ID NO: 306736 - RNA, 32 nt, Human
acucugccacagcaucccugcccagccaugug

SEQ ID NO: 306737 - RNA, 32 nt, Human
acucugccacccaagcuggagugcaguggcac

SEQ ID NO: 306738 - RNA, 32 nt, Human
acucugccacccagacugaagugcaguggugc

SEQ ID NO: 306739 - RNA, 24 nt, Human
acucugccacccaggcugcaguga

SEQ ID NO: 306740 - RNA, 32 nt, Human
acucugcccacucauuuuaccacuggggcgaa

SEQ ID NO: 306741 - RNA, 32 nt, Human
acucugccccaccccagccucuuccaggagag

SEQ ID NO: 306742 - RNA, 32 nt, Human
acucugcccgagccuucuaggcucagauccca

SEQ ID NO: 306743 - RNA, 19 nt, Human
acucugcccggccugugca

SEQ ID NO: 306744 - RNA, 19 nt, Human
acucugcccucaccugcca

SEQ ID NO: 306745 - RNA, 32 nt, Human
acucugcccuccugucaguaguggcaggaucu

SEQ ID NO: 306746 - RNA, 20 nt, Human
acucugcccuguccuggcca

SEQ ID NO: 306747 - RNA, 32 nt, Human
acucugccgcccaaacuggagugcaguggcac

SEQ ID NO: 306748 - RNA, 32 nt, Human
acucugccgcccaggcuggacugcagugacac

SEQ ID NO: 306749 - RNA, 20 nt, Human
acucugccgccgccgccgcc

SEQ ID NO: 306750 - RNA, 32 nt, Human
acucugccuccugucuuugucguuggacuuuu

SEQ ID NO: 306751 - RNA, 32 nt, Human
acucugccugcuuacacccugcccucaugcua

SEQ ID NO: 306752 - RNA, 32 nt, Human
acucugccugggcuggagucuagggcuggggc

SEQ ID NO: 306753 - RNA, 32 nt, Human
acucugccuguccccucuccuacucuacagca

SEQ ID NO: 306754 - RNA, 32 nt, Human
acucugccuuugucacagagcagggugcuauu

SEQ ID NO: 306755 - RNA, 32 nt, Human
acucugcgaccaguacagacccuguccuggcu

SEQ ID NO: 306756 - RNA, 32 nt, Human
acucugcgagguguuuacacuggagguggggg

SEQ ID NO: 306757 - RNA, 32 nt, Human
acucugcgccccaggauggaggcuccagccca

SEQ ID NO: 306758 - RNA, 32 nt, Human
acucugcucacugcaaccuccgccucccaggu

SEQ ID NO: 306759 - RNA, 32 nt, Human
acucugcucaucguuauucucuugcccugggc

SEQ ID NO: 306760 - RNA, 32 nt, Human
acucugcuccacguggggccaggcgugugacu

SEQ ID NO: 306761 - RNA, 32 nt, Human
acucugcucccaggaagcugugcggagcugug

SEQ ID NO: 306762 - RNA, 32 nt, Human
acucugcucccaucucagccaugaggccucag

SEQ ID NO: 306763 - RNA, 32 nt, Human
acucugcucccaucuuugccuccaccaugggc

SEQ ID NO: 306764 - RNA, 32 nt, Human
acucugcuccccaggcuugagugagugugugc

SEQ ID NO: 306765 - RNA, 32 nt, Human
acucugcucugcagccuccuguacucauuacu

SEQ ID NO: 306766 - RNA, 22 nt, Human
acucugcugcaccagcugcaga

SEQ ID NO: 306767 - RNA, 32 nt, Human
acucugcugcccaggcuggaguacaguggcac

SEQ ID NO: 306768 - RNA, 32 nt, Human
acucugcugcccgggcuagagugcaguggugg

SEQ ID NO: 306769 - RNA, 32 nt, Human
acucugcugccuaggcugagugcaguggugug

SEQ ID NO: 306770 - RNA, 32 nt, Human
acucugcugcggcggcugggcccggugguggu

SEQ ID NO: 306771 - RNA, 32 nt, Human
acucugcugcucaggcuggagugcaguggugc

SEQ ID NO: 306772 - RNA, 32 nt, Human
acucugcugugccgucucuucauaaagcuuca

SEQ ID NO: 306773 - RNA, 32 nt, Human
acucugcuguuuuucagucauuuccuacugug

SEQ ID NO: 306774 - RNA, 32 nt, Human
acucugcuuccuggcccagcgcucgugaccaa

SEQ ID NO: 306775 - RNA, 32 nt, Human
acucugcuuugccuccccgucccggucccugg

SEQ ID NO: 306776 - RNA, 32 nt, Human
acucugcuuugugcacuuuauggaggaggaag

SEQ ID NO: 306777 - RNA, 32 nt, Human
acucuggaaaauucacuauguuuccacacacc

SEQ ID NO: 306778 - RNA, 32 nt, Human
acucuggaagcacugcucucugucagugauac

SEQ ID NO: 306779 - RNA, 32 nt, Human
acucuggaagcugaagcagcaagaucacuuga

SEQ ID NO: 306780 - RNA, 32 nt, Human
acucuggaagcugaggugagaggaucacuuga

SEQ ID NO: 306781 - RNA, 32 nt, Human
acucuggacucgaacucccagccuccagaacu

SEQ ID NO: 306782 - RNA, 31 nt, Human
acucuggagagcaccguaucacuggagggca

SEQ ID NO: 306783 - RNA, 32 nt, Human
acucuggagagccacaggcacccccagcugga

SEQ ID NO: 306784 - RNA, 32 nt, Human
acucuggagcaacccacacucccgauaaguca

SEQ ID NO: 306785 - RNA, 32 nt, Human
acucuggagcaggccagcucugcuggacagug

SEQ ID NO: 306786 - RNA, 32 nt, Human
acucuggagcuaucagagucugugaugagcac

SEQ ID NO: 306787 - RNA, 32 nt, Human
acucuggagcuguccaggugcugccuggugau

SEQ ID NO: 306788 - RNA, 32 nt, Human
acucuggaggcuaaggugggaggaucacuuga

SEQ ID NO: 306789 - RNA, 32 nt, Human
acucuggaggcugaaaugggaggaucacuuga

SEQ ID NO: 306790 - RNA, 32 nt, Human
acucuggaggcugaaguuggaggauggcuuga

SEQ ID NO: 306791 - RNA, 32 nt, Human
acucuggaggcugagauaggaggaucacuuga

SEQ ID NO: 306792 - RNA, 32 nt, Human
acucuggaggcugaggcacagcaucacuugaa

SEQ ID NO: 306793 - RNA, 32 nt, Human
acucuggaggcugaggcagaagaaucacuuga

SEQ ID NO: 306794 - RNA, 32 nt, Human
acucuggaggcugaggcaggaagaucacugga

SEQ ID NO: 306795 - RNA, 32 nt, Human
acucuggaggcugaggcaggagaaucaauuga

SEQ ID NO: 306796 - RNA, 32 nt, Human
acucuggaggcugaggcaggagaaucacuuga

SEQ ID NO: 306797 - RNA, 32 nt, Human
acucuggaggcugaggcaggagaaucgcuuga

SEQ ID NO: 306798 - RNA, 32 nt, Human
acucuggaggcugaggcaggagaaucucuuga

SEQ ID NO: 306799 - RNA, 32 nt, Human
acucuggaggcugaggcaggaggaucacuuga

SEQ ID NO: 306800 - RNA, 32 nt, Human
acucuggaggcugaggcaggaggaugguguga

SEQ ID NO: 306801 - RNA, 32 nt, Human
acucuggaggcugaggcggaacgaucgcuuga

SEQ ID NO: 306802 - RNA, 32 nt, Human
acucuggaggcugaggcgggagaaucgcuuga

SEQ ID NO: 306803 - RNA, 32 nt, Human
acucuggaggcugaggugaggggaaucaccug

SEQ ID NO: 306804 - RNA, 32 nt, Human
acucuggaggcugaggugggaagaccaccuaa

SEQ ID NO: 306805 - RNA, 32 nt, Human
acucuggaggcugaggugggaggauugcuuaa

SEQ ID NO: 306806 - RNA, 32 nt, Human
acucuggaggcugggcuggagaaucacuugaa

SEQ ID NO: 306807 - RNA, 24 nt, Human
acucuggagggacagagacaggug

SEQ ID NO: 306808 - RNA, 32 nt, Human
acucuggagguggagccuugcccggcgagacg

SEQ ID NO: 306809 - RNA, 32 nt, Human
acucuggcaccacucuccaggcugccaugggg

SEQ ID NO: 306810 - RNA, 24 nt, Human
acucuggcagccacacuucucagg

SEQ ID NO: 306811 - RNA, 32 nt, Human
acucuggcaguggccuaugauccugaagacag

SEQ ID NO: 306812 - RNA, 32 nt, Human
acucuggccaaaaauggcucucuaggugggcu

SEQ ID NO: 306813 - RNA, 32 nt, Human
acucuggccacagccucuggggugggagguuu

SEQ ID NO: 306814 - RNA, 32 nt, Human
acucuggccacccagcaggccaugggcaugcu

SEQ ID NO: 306815 - RNA, 32 nt, Human
acucuggccugggcaacaagagcgagacuuug

SEQ ID NO: 306816 - RNA, 18 nt, Human
acucuggcuccaaaaaua

SEQ ID NO: 306817 - RNA, 32 nt, Human
acucuggcugccucuuugccuuccuaggggca

SEQ ID NO: 306818 - RNA, 32 nt, Human
acucuggcuuccgucaagagcugucuuggaag

SEQ ID NO: 306819 - RNA, 32 nt, Human
acucuggcuucucugugccccuguaaauaguu

SEQ ID NO: 306820 - RNA, 22 nt, Human
acucugggaaauggacaaggug

SEQ ID NO: 306821 - RNA, 26 nt, Human
acucugggaaccuauaaaggcaggua

SEQ ID NO: 306822 - RNA, 32 nt, Human
acucugggacugccuccuccugcugucccugu

SEQ ID NO: 306823 - RNA, 32 nt, Human
acucugggagaccgaggaagggggauugauug

SEQ ID NO: 306824 - RNA, 32 nt, Human
acucugggagccgagugcagagccagggccca

SEQ ID NO: 306825 - RNA, 32 nt, Human
acucugggaggaagacugccucuccaucgcug

SEQ ID NO: 306826 - RNA, 23 nt, Human
acucugggaggcugagacaggua

SEQ ID NO: 306827 - RNA, 32 nt, Human
acucugggaggggcagccagaggggcugagag

SEQ ID NO: 306828 - RNA, 32 nt, Human
acucugggagguggaggaaauguuauuugaag

SEQ ID NO: 306829 - RNA, 32 nt, Human
acucugggcccaaggaccugguguacaccauu

SEQ ID NO: 306830 - RNA, 32 nt, Human
acucugggccuccucaaacucagugccugggu

SEQ ID NO: 306831 - RNA, 32 nt, Human
acucugggccuucagaugucacccuaauccac

SEQ ID NO: 306832 - RNA, 32 nt, Human
acucugggccuugcugacaccugggccuugcc

SEQ ID NO: 306833 - RNA, 24 nt, Human
acucugggcugggugggccaggug

SEQ ID NO: 306834 - RNA, 32 nt, Human
acucuggggacacucugccagcaaagaggacu

SEQ ID NO: 306835 - RNA, 32 nt, Human
acucuggggugaggccagccuucuaggugauu

SEQ ID NO: 306836 - RNA, 32 nt, Human
acucugguagugaaccgaugguggaaccaguu

SEQ ID NO: 306837 - RNA, 32 nt, Human
acucugguaucuagaauucaguggcagaaaau

SEQ ID NO: 306838 - RNA, 32 nt, Human
acucuggucuagauuuaagaggacggacccua

SEQ ID NO: 306839 - RNA, 32 nt, Human
acucuggucucaaacuccugggcucaaccaau

SEQ ID NO: 306840 - RNA, 32 nt, Human
acucuggugaccugggcugcccucucagaaac

SEQ ID NO: 306841 - RNA, 32 nt, Human
acucuggugauggugacugucucucacuaauu

SEQ ID NO: 306842 - RNA, 32 nt, Human
acucugguguguggauggauggguggauggag

SEQ ID NO: 306843 - RNA, 32 nt, Human
acucuggugugugguuugacucugcuuuucuu

SEQ ID NO: 306844 - RNA, 32 nt, Human
acucugguugcccaggcuggagugcaguggug

SEQ ID NO: 306845 - RNA, 32 nt, Human
acucuguaacccaggcuggagugcaguggccu

SEQ ID NO: 306846 - RNA, 32 nt, Human
acucuguacagcccgguccucucccacaucug

SEQ ID NO: 306847 - RNA, 32 nt, Human
acucuguagauuuccaccuguucccauccucc

SEQ ID NO: 306848 - RNA, 32 nt, Human
acucuguagcccagucuggagugcagugguac

SEQ ID NO: 306849 - RNA, 32 nt, Human
acucuguagcccagucuggagugcaguggugu

SEQ ID NO: 306850 - RNA, 32 nt, Human
acucuguaggagaggaaaaguaagcaucucug

SEQ ID NO: 306851 - RNA, 32 nt, Human
acucuguaucuagcucaagguuuguaaacaca

SEQ ID NO: 306852 - RNA, 32 nt, Human
acucuguauuauauacaaguguaauacaugca

SEQ ID NO: 306853 - RNA, 32 nt, Human
acucuguauuuucucaaccucuccuuauuucc

SEQ ID NO: 306854 - RNA, 32 nt, Human
acucugucaaccaggcuggagugcacuggcgc

SEQ ID NO: 306855 - RNA, 32 nt, Human
acucugucacacaggcuggagugcaguacaau

SEQ ID NO: 306856 - RNA, 32 nt, Human
acucugucacacaggcuggagugcaguggcac

SEQ ID NO: 306857 - RNA, 32 nt, Human
acucugucaccagacuggagugcaguggcgcc

SEQ ID NO: 306858 - RNA, 32 nt, Human
acucugucaccaggcuagagugcaguggcacg

SEQ ID NO: 306859 - RNA, 32 nt, Human
acucugucaccaggcuggagugcagugccgca

SEQ ID NO: 306860 - RNA, 32 nt, Human
acucugucaccaggcuggagugcaguggcgca

SEQ ID NO: 306861 - RNA, 32 nt, Human
acucugucacccaagauggagugcaauggcac

SEQ ID NO: 306862 - RNA, 32 nt, Human
acucugucacccaagcuauggugcaguggcac

SEQ ID NO: 306863 - RNA, 32 nt, Human
acucugucacccaagcuggagugcacuggcau

SEQ ID NO: 306864 - RNA, 32 nt, Human
acucugucacccaagcuggagugcaguggugc

SEQ ID NO: 306865 - RNA, 32 nt, Human
acucugucacccaaggcggagugcagugacga

SEQ ID NO: 306866 - RNA, 32 nt, Human
acucugucacccacgcuggagugcugugaugc

SEQ ID NO: 306867 - RNA, 32 nt, Human
acucugucacccagacuggagugcagugccac

SEQ ID NO: 306868 - RNA, 32 nt, Human
acucugucacccagacuggagugcaguggcac

SEQ ID NO: 306869 - RNA, 32 nt, Human
acucugucacccagacuggagugcaguggcgc

SEQ ID NO: 306870 - RNA, 32 nt, Human
acucugucacccaggauggagagcacuggcac

SEQ ID NO: 306871 - RNA, 32 nt, Human
acucugucacccaggccaaguucaauggugca

SEQ ID NO: 306872 - RNA, 32 nt, Human
acucugucacccaggcgggaguggugcaaugg

SEQ ID NO: 306873 - RNA, 32 nt, Human
acucugucacccaggcgggaguuagguggcau

SEQ ID NO: 306874 - RNA, 32 nt, Human
acucugucacccaggcuagagugcaauggcac

SEQ ID NO: 306875 - RNA, 32 nt, Human
acucugucacccaggcuagagugcaguggcgc

SEQ ID NO: 306876 - RNA, 32 nt, Human
acucugucacccaggcugaagugcagugguac

SEQ ID NO: 306877 - RNA, 21 nt, Human
acucugucacccaggcugcag

SEQ ID NO: 306878 - RNA, 32 nt, Human
acucugucacccaggcugcagugcaauggcgc

SEQ ID NO: 306879 - RNA, 32 nt, Human
acucugucacccaggcugcaguguaguggugc

SEQ ID NO: 306880 - RNA, 32 nt, Human
acucugucacccaggcuggaauccaguggcac

SEQ ID NO: 306881 - RNA, 32 nt, Human
acucugucacccaggcuggaaugacgaaguga

SEQ ID NO: 306882 - RNA, 32 nt, Human
acucugucacccaggcuggaaugcaguggugu

SEQ ID NO: 306883 - RNA, 32 nt, Human
acucugucacccaggcuggacugcaaugacgc

SEQ ID NO: 306884 - RNA, 32 nt, Human
acucugucacccaggcuggagagcaauugcac

SEQ ID NO: 306885 - RNA, 32 nt, Human
acucugucacccaggcuggaguacaauggcgu

SEQ ID NO: 306886 - RNA, 32 nt, Human
acucugucacccaggcuggaguacagugacac

SEQ ID NO: 306887 - RNA, 32 nt, Human
acucugucacccaggcuggaguacaguggcac

SEQ ID NO: 306888 - RNA, 32 nt, Human
acucugucacccaggcuggaguacaguggcau

SEQ ID NO: 306889 - RNA, 32 nt, Human
acucugucacccaggcuggagugcaaugcugc

SEQ ID NO: 306890 - RNA, 32 nt, Human
acucugucacccaggcuggagugcaauggcaa

SEQ ID NO: 306891 - RNA, 32 nt, Human
acucugucacccaggcuggagugcaauggcau

SEQ ID NO: 306892 - RNA, 32 nt, Human
acucugucacccaggcuggagugcaauggcgc

SEQ ID NO: 306893 - RNA, 32 nt, Human
acucugucacccaggcuggagugcaauggcgu

SEQ ID NO: 306894 - RNA, 32 nt, Human
acucugucacccaggcuggagugcaauggugc

SEQ ID NO: 306895 - RNA, 32 nt, Human
acucugucacccaggcuggagugcagcaguug

SEQ ID NO: 306896 - RNA, 32 nt, Human
acucugucacccaggcuggagugcaguagcac

SEQ ID NO: 306897 - RNA, 32 nt, Human
acucugucacccaggcuggagugcaguagcgc

SEQ ID NO: 306898 - RNA, 32 nt, Human
acucugucacccaggcuggagugcaguggcac

SEQ ID NO: 306899 - RNA, 32 nt, Human
acucugucacccaggcuggagugcaguggcau

SEQ ID NO: 306900 - RNA, 32 nt, Human
acucugucacccaggcuggagugcaguggcga

SEQ ID NO: 306901 - RNA, 32 nt, Human
acucugucacccaggcuggagugcaguggcgc

SEQ ID NO: 306902 - RNA, 32 nt, Human
acucugucacccaggcuggagugcaguggcgu

SEQ ID NO: 306903 - RNA, 32 nt, Human
acucugucacccaggcuggagugcaguggcuu

SEQ ID NO: 306904 - RNA, 32 nt, Human
acucugucacccaggcuggagugcagugguac

SEQ ID NO: 306905 - RNA, 32 nt, Human
acucugucacccaggcuggagugcagugguau

SEQ ID NO: 306906 - RNA, 32 nt, Human
acucugucacccaggcuggagugcaguggugc

SEQ ID NO: 306907 - RNA, 32 nt, Human
acucugucacccaggcuggagugcaguggugu

SEQ ID NO: 306908 - RNA, 32 nt, Human
acucugucacccaggcuggagugcagugucac

SEQ ID NO: 306909 - RNA, 32 nt, Human
acucugucacccaggcuggagugcgguggcgc

SEQ ID NO: 306910 - RNA, 32 nt, Human
acucugucacccaggcuggagugcgguggugc

SEQ ID NO: 306911 - RNA, 32 nt, Human
acucugucacccaggcuggaguguaguggcau

SEQ ID NO: 306912 - RNA, 32 nt, Human
acucugucacccaggcuggaguguaguggugc

SEQ ID NO: 306913 - RNA, 32 nt, Human
acucugucacccaggcuggaguguaguggugu

SEQ ID NO: 306914 - RNA, 32 nt, Human
acucugucacccaggcugggaauugcaguggc

SEQ ID NO: 306915 - RNA, 32 nt, Human
acucugucacccaggcugggaugcaguggcuu

SEQ ID NO: 306916 - RNA, 32 nt, Human
acucugucacccaggcuguagugcaguggcau

SEQ ID NO: 306917 - RNA, 32 nt, Human
acucugucacccagguucgaguucaguggugc

SEQ ID NO: 306918 - RNA, 32 nt, Human
acucugucacccagguuggagugcagcagggg

SEQ ID NO: 306919 - RNA, 32 nt, Human
acucugucacccaugcuggugugcaguggcgu

SEQ ID NO: 306920 - RNA, 32 nt, Human
acucugucacccauucuggaguacaauggcau

SEQ ID NO: 306921 - RNA, 32 nt, Human
acucugucaccccggcuggagugcaguggugu

SEQ ID NO: 306922 - RNA, 32 nt, Human
acucugucacccuggcuggagugcgguggcga

SEQ ID NO: 306923 - RNA, 32 nt, Human
acucugucaccgaggcuagaguacaguggcac

SEQ ID NO: 306924 - RNA, 32 nt, Human
acucugucaccgagguuggagugcagugguau

SEQ ID NO: 306925 - RNA, 32 nt, Human
acucugucaccuaggcuacagugcaguggugu

SEQ ID NO: 306926 - RNA, 32 nt, Human
acucugucaccuaggcuagagggcagugaugc

SEQ ID NO: 306927 - RNA, 32 nt, Human
acucugucaccuaggcuagagugcaguggugu

SEQ ID NO: 306928 - RNA, 32 nt, Human
acucugucaccuaggcuggagugcaguggcac

SEQ ID NO: 306929 - RNA, 32 nt, Human
acucugucaccuaggcuggagugcaguggugc

SEQ ID NO: 306930 - RNA, 32 nt, Human
acucugucaccuaggcuggaguugcagugguu

SEQ ID NO: 306931 - RNA, 32 nt, Human
acucugucaccuaggcuggauugcaauggugc

SEQ ID NO: 306932 - RNA, 32 nt, Human
acucugucacucaggcuggagugcaaugacgu

SEQ ID NO: 306933 - RNA, 32 nt, Human
acucugucacucaggcuggagugcaguggcgc

SEQ ID NO: 306934 - RNA, 32 nt, Human
acucugucacucaggcuggagugcagugguau

SEQ ID NO: 306935 - RNA, 32 nt, Human
acucugucacucaggcuggagugcggugguau

SEQ ID NO: 306936 - RNA, 32 nt, Human
acucugucacucugucuggaguauaguagugu

SEQ ID NO: 306937 - RNA, 32 nt, Human
acucugucagccaggcuggagugcaauggcau

SEQ ID NO: 306938 - RNA, 32 nt, Human
acucugucauccaggcuggagugcaguggcaa

SEQ ID NO: 306939 - RNA, 32 nt, Human
acucugucauccaggcuggagugcaguggcac

SEQ ID NO: 306940 - RNA, 32 nt, Human
acucugucauccaggcuggagugcaguggugu

SEQ ID NO: 306941 - RNA, 32 nt, Human
acucugucauuuccuuucuagccccugcaucu

SEQ ID NO: 306942 - RNA, 32 nt, Human
acucuguccaacagauaucacugugaauugaa

SEQ ID NO: 306943 - RNA, 32 nt, Human
acucugucccccaggcuggagugcaguggcgc

SEQ ID NO: 306944 - RNA, 32 nt, Human
acucuguccgcccaggcugggugcagucacgg

SEQ ID NO: 306945 - RNA, 32 nt, Human
acucuguccuuacugcugaacauccugcuugu

SEQ ID NO: 306946 - RNA, 32 nt, Human
acucugucgccaggcuggaaugcaguagggca

SEQ ID NO: 306947 - RNA, 32 nt, Human
acucugucgccaggcuggagugcaguggcgug

SEQ ID NO: 306948 - RNA, 32 nt, Human
acucugucgccaggcuggagugcaguggugug

SEQ ID NO: 306949 - RNA, 32 nt, Human
acucugucgcccaagcuggagugcaguggcac

SEQ ID NO: 306950 - RNA, 32 nt, Human
acucugucgcccagacuggaaugugguggcau

SEQ ID NO: 306951 - RNA, 32 nt, Human
acucugucgcccagacuggagugcaguagcgc

SEQ ID NO: 306952 - RNA, 32 nt, Human
acucugucgcccaggcuagagugcaguggcac

SEQ ID NO: 306953 - RNA, 32 nt, Human
acucugucgcccaggcuagagugcaguggcgc

SEQ ID NO: 306954 - RNA, 32 nt, Human
acucugucgcccaggcuggaaugcaguggcau

SEQ ID NO: 306955 - RNA, 32 nt, Human
acucugucgcccaggcuggaaugcaguggcgu

SEQ ID NO: 306956 - RNA, 32 nt, Human
acucugucgcccaggcuggacuacaauggcac

SEQ ID NO: 306957 - RNA, 32 nt, Human
acucugucgcccaggcuggacugcaguggugc

SEQ ID NO: 306958 - RNA, 32 nt, Human
acucugucgcccaggcuggagggcaguggcgu

SEQ ID NO: 306959 - RNA, 32 nt, Human
acucugucgcccaggcuggaguacaauggugc

SEQ ID NO: 306960 - RNA, 32 nt, Human
acucugucgcccaggcuggagugcaauacugc

SEQ ID NO: 306961 - RNA, 32 nt, Human
acucugucgcccaggcuggagugcaguagcgc

SEQ ID NO: 306962 - RNA, 28 nt, Human
acucugucgcccaggcuggagugcagug

SEQ ID NO: 306963 - RNA, 32 nt, Human
acucugucgcccaggcuggagugcagugaugc

SEQ ID NO: 306964 - RNA, 32 nt, Human
acucugucgcccaggcuggagugcaguggcau

SEQ ID NO: 306965 - RNA, 32 nt, Human
acucugucgcccaggcuggagugcaguggcgc

SEQ ID NO: 306966 - RNA, 32 nt, Human
acucugucgcccaggcuggagugcaguggcgu

SEQ ID NO: 306967 - RNA, 32 nt, Human
acucugucgcccaggcuggagugcagugguac

SEQ ID NO: 306968 - RNA, 32 nt, Human
acucugucgcccaggcuggagugcaguggugc

SEQ ID NO: 306969 - RNA, 32 nt, Human
acucugucgcccaggcuggagugcaguggugu

SEQ ID NO: 306970 - RNA, 32 nt, Human
acucugucgcccaggcuggagugcagugucaa

SEQ ID NO: 306971 - RNA, 32 nt, Human
acucugucgcccaggcuggaguguaguggcau

SEQ ID NO: 306972 - RNA, 32 nt, Human
acucugucgcccaggcuggggugcaguggcgc

SEQ ID NO: 306973 - RNA, 32 nt, Human
acucugucgcccaggguggagugcgguggcac

SEQ ID NO: 306974 - RNA, 32 nt, Human
acucugucgcccagucuguaaugcagugcugu

SEQ ID NO: 306975 - RNA, 32 nt, Human
acucugucgcccgggcuggagugcugugagcu

SEQ ID NO: 306976 - RNA, 32 nt, Human
acucugucgccugggcuggaguacaguggugc

SEQ ID NO: 306977 - RNA, 32 nt, Human
acucugucgcgccagcuggagugcagugccau

SEQ ID NO: 306978 - RNA, 32 nt, Human
acucugucgcucaggcuggagugcagugaugc

SEQ ID NO: 306979 - RNA, 32 nt, Human
acucugucggcaccugggaguucaguuggaca

SEQ ID NO: 306980 - RNA, 32 nt, Human
acucugucggccaggcuggaaugcaauggugc

SEQ ID NO: 306981 - RNA, 32 nt, Human
acucugucguccaggcuggagugcaguggcgc

SEQ ID NO: 306982 - RNA, 32 nt, Human
acucugucguccagguuagagugcaauggcuu

SEQ ID NO: 306983 - RNA, 32 nt, Human
acucugucucaaacaaaacaaaacaaaacaaa

SEQ ID NO: 306984 - RNA, 32 nt, Human
acucugucucccagacuggagugaguggugug

SEQ ID NO: 306985 - RNA, 32 nt, Human
acucugucucccaggcuagagugcaguggugc

SEQ ID NO: 306986 - RNA, 32 nt, Human
acucugucucccaggcugcaacauccaccucc

SEQ ID NO: 306987 - RNA, 32 nt, Human
acucugucucccaggcugcuggagugcagugg

SEQ ID NO: 306988 - RNA, 32 nt, Human
acucugucucccaggcuggacugcaguggugc

SEQ ID NO: 306989 - RNA, 32 nt, Human
acucugucucccaggcuggagugcaauggugc

SEQ ID NO: 306990 - RNA, 32 nt, Human
acucugucucccaggcuggagugcaguggagu

SEQ ID NO: 306991 - RNA, 32 nt, Human
acucugucucccaggcuggagugcaguggcac

SEQ ID NO: 306992 - RNA, 32 nt, Human
acucugucucccaggcuggagugcaguggugc

SEQ ID NO: 306993 - RNA, 32 nt, Human
acucugucucccaggcuggagugugauggcgu

SEQ ID NO: 306994 - RNA, 32 nt, Human
acucugucucccaggcuggaguugcaguggug

SEQ ID NO: 306995 - RNA, 32 nt, Human
acucugucuccucugcuggagccaccaguucc

SEQ ID NO: 306996 - RNA, 32 nt, Human
acucugucugggaaggugggaggugcagccag

SEQ ID NO: 306997 - RNA, 32 nt, Human
acucugucuucacagcaggagugcugucucca

SEQ ID NO: 306998 - RNA, 32 nt, Human
acucugugccuggcuucucuugccugccuugg

SEQ ID NO: 306999 - RNA, 32 nt, Human
acucugugcucccuucccucuccuggggcggg

SEQ ID NO: 307000 - RNA, 31 nt, Human
acucugugcucucugaguccugugucgugcu

SEQ ID NO: 307001 - RNA, 32 nt, Human
acucugugcugcugccuucugcagagaggcac

SEQ ID NO: 307002 - RNA, 32 nt, Human
acucuguggcccaggcuggagugcaguggcac

SEQ ID NO: 307003 - RNA, 32 nt, Human
acucuguggcccaggcuggagugcaguggcau

SEQ ID NO: 307004 - RNA, 32 nt, Human
acucuguggcccaggcuggagugcaguggcgc

SEQ ID NO: 307005 - RNA, 32 nt, Human
acucuguggcccaggcuggagugcaguggugc

SEQ ID NO: 307006 - RNA, 32 nt, Human
acucuguggggccacacguuugccaaauuuuc

SEQ ID NO: 307007 - RNA, 32 nt, Human
acucugugucccaggcuggagugcaguggcac

SEQ ID NO: 307008 - RNA, 21 nt, Human
acucugugucuaucccagugg

SEQ ID NO: 307009 - RNA, 32 nt, Human
acucugugucucaggcuggaguacaguggugc

SEQ ID NO: 307010 - RNA, 19 nt, Human
acucugugugagcagggug

SEQ ID NO: 307011 - RNA, 32 nt, Human
acucuguuaccaacuuugcugugugaccuuaa

SEQ ID NO: 307012 - RNA, 32 nt, Human
acucuguuacccaggccggagugcaguggcgc

SEQ ID NO: 307013 - RNA, 32 nt, Human
acucuguuacccaggcuagagugcaguggcgc

SEQ ID NO: 307014 - RNA, 32 nt, Human
acucuguuacccaggcuagaguguaguggcau

SEQ ID NO: 307015 - RNA, 32 nt, Human
acucuguuacccaggcuggaaugcaguggcgc

SEQ ID NO: 307016 - RNA, 32 nt, Human
acucuguuacccaggcuggagugcaauggagu

SEQ ID NO: 307017 - RNA, 32 nt, Human
acucuguuacccaggcuggagugcaguggugc

SEQ ID NO: 307018 - RNA, 32 nt, Human
acucuguuccccaggccggagugcagugguac

SEQ ID NO: 307019 - RNA, 31 nt, Human
acucuguuccucucugcuuuguucuucccug

SEQ ID NO: 307020 - RNA, 32 nt, Human
acucuguugaccaggcuggagugaaguggugu

SEQ ID NO: 307021 - RNA, 32 nt, Human
acucuguugaccaggcuggagugcagugguga

SEQ ID NO: 307022 - RNA, 32 nt, Human
acucuguugccaaggcuggaaugcaguggcga

SEQ ID NO: 307023 - RNA, 32 nt, Human
acucuguugccaggcuggaaugcaguggcguc

SEQ ID NO: 307024 - RNA, 32 nt, Human
acucuguugccaggcuggagugcaguggcgca

SEQ ID NO: 307025 - RNA, 32 nt, Human
acucuguugccaggcuggagugcaguggcgcg

SEQ ID NO: 307026 - RNA, 32 nt, Human
acucuguugcccaagcuggagaacaguggcac

SEQ ID NO: 307027 - RNA, 32 nt, Human
acucuguugcccaagcuggaguacaguagugc

SEQ ID NO: 307028 - RNA, 32 nt, Human
acucuguugcccaagcuggggugcaguggcac

SEQ ID NO: 307029 - RNA, 32 nt, Human
acucuguugcccaagguagagugcaguggcgu

SEQ ID NO: 307030 - RNA, 32 nt, Human
acucuguugcccagacuggagugcaguggcac

SEQ ID NO: 307031 - RNA, 32 nt, Human
acucuguugcccagacuggagugcaguggugu

SEQ ID NO: 307032 - RNA, 32 nt, Human
acucuguugcccagccuggagugcaguggcau

SEQ ID NO: 307033 - RNA, 32 nt, Human
acucuguugcccagccuggagugcaguguguc

SEQ ID NO: 307034 - RNA, 32 nt, Human
acucuguugcccagcuggagugcaguggcgug

SEQ ID NO: 307035 - RNA, 32 nt, Human
acucuguugcccaggauggaaugcaguggcac

SEQ ID NO: 307036 - RNA, 32 nt, Human
acucuguugcccaggauggagugcagugguga

SEQ ID NO: 307037 - RNA, 32 nt, Human
acucuguugcccaggcuagagugcaauggcac

SEQ ID NO: 307038 - RNA, 32 nt, Human
acucuguugcccaggcuagagugcacuaauac

SEQ ID NO: 307039 - RNA, 32 nt, Human
acucuguugcccaggcugaagugcaguggugu

SEQ ID NO: 307040 - RNA, 32 nt, Human
acucuguugcccaggcugagguacaguggcgu

SEQ ID NO: 307041 - RNA, 21 nt, Human
acucuguugcccaggcugcag

SEQ ID NO: 307042 - RNA, 32 nt, Human
acucuguugcccaggcugcagugcaguggugu

SEQ ID NO: 307043 - RNA, 32 nt, Human
acucuguugcccaggcuggaaugcagugauac

SEQ ID NO: 307044 - RNA, 32 nt, Human
acucuguugcccaggcuggaaugcagugguac

SEQ ID NO: 307045 - RNA, 32 nt, Human
acucuguugcccaggcuggacuacaguggcac

SEQ ID NO: 307046 - RNA, 32 nt, Human
acucuguugcccaggcuggaguaaagggcagu

SEQ ID NO: 307047 - RNA, 32 nt, Human
acucuguugcccaggcuggaguacaguggcac

SEQ ID NO: 307048 - RNA, 32 nt, Human
acucuguugcccaggcuggaguacaguggcgu

SEQ ID NO: 307049 - RNA, 32 nt, Human
acucuguugcccaggcuggagugcaauggcac

SEQ ID NO: 307050 - RNA, 32 nt, Human
acucuguugcccaggcuggagugcaggggcac

SEQ ID NO: 307051 - RNA, 32 nt, Human
acucuguugcccaggcuggagugcaggggcgu

SEQ ID NO: 307052 - RNA, 32 nt, Human
acucuguugcccaggcuggagugcagugaugu

SEQ ID NO: 307053 - RNA, 29 nt, Human
acucuguugcccaggcuggagugcagugg

SEQ ID NO: 307054 - RNA, 32 nt, Human
acucuguugcccaggcuggagugcaguggcac

SEQ ID NO: 307055 - RNA, 32 nt, Human
acucuguugcccaggcuggagugcaguggcau

SEQ ID NO: 307056 - RNA, 32 nt, Human
acucuguugcccaggcuggagugcaguggcgc

SEQ ID NO: 307057 - RNA, 32 nt, Human
acucuguugcccaggcuggagugcaguggcgu

SEQ ID NO: 307058 - RNA, 32 nt, Human
acucuguugcccaggcuggagugcaguggugc

SEQ ID NO: 307059 - RNA, 32 nt, Human
acucuguugcccaggcuggagugcaguggugg

SEQ ID NO: 307060 - RNA, 32 nt, Human
acucuguugcccaggcuggagugcagugucac

SEQ ID NO: 307061 - RNA, 32 nt, Human
acucuguugcccaggcuggagugccucuucau

SEQ ID NO: 307062 - RNA, 32 nt, Human
acucuguugcccaggcuggagugcgauggcau

SEQ ID NO: 307063 - RNA, 32 nt, Human
acucuguugcccaggcuggaguguaguggugu

SEQ ID NO: 307064 - RNA, 32 nt, Human
acucuguugcccaggcuggaguucagcggugc

SEQ ID NO: 307065 - RNA, 32 nt, Human
acucuguugcccaggguggagugcaguggcau

SEQ ID NO: 307066 - RNA, 32 nt, Human
acucuguugcccagguuggaguacagcaaugc

SEQ ID NO: 307067 - RNA, 32 nt, Human
acucuguugcccagguuggaguacagcagugc

SEQ ID NO: 307068 - RNA, 32 nt, Human
acucuguugcccagucuggagugcaguggcgc

SEQ ID NO: 307069 - RNA, 32 nt, Human
acucuguugcccagucuggaguucaguggcgc

SEQ ID NO: 307070 - RNA, 32 nt, Human
acucuguugcccaugcuggagggcagugguau

SEQ ID NO: 307071 - RNA, 32 nt, Human
acucuguugccccaggcuggagugcaguggug

SEQ ID NO: 307072 - RNA, 32 nt, Human
acucuguugcccgggcuggagugcagcggcgu

SEQ ID NO: 307073 - RNA, 32 nt, Human
acucuguugcccuggcuggagugcaguagagu

SEQ ID NO: 307074 - RNA, 32 nt, Human
acucuguugccuagacuggagugcaauggcgu

SEQ ID NO: 307075 - RNA, 32 nt, Human
acucuguugccuaggcuagagggcaguggcac

SEQ ID NO: 307076 - RNA, 32 nt, Human
acucuguugccuaggcuggaggacaguggcac

SEQ ID NO: 307077 - RNA, 32 nt, Human
acucuguugccuaggcuggaguacaguggcaa

SEQ ID NO: 307078 - RNA, 32 nt, Human
acucuguugccuaggcuggagugaaaguggcg

SEQ ID NO: 307079 - RNA, 32 nt, Human
acucuguugcuaggcuggagugcaguggcaca

SEQ ID NO: 307080 - RNA, 32 nt, Human
acucuguugcuaggcuggagugcaguggugcg

SEQ ID NO: 307081 - RNA, 32 nt, Human
acucuguugcucaagcuggaguggaguggcac

SEQ ID NO: 307082 - RNA, 32 nt, Human
acucuguugcucaggcuggagugcaguggcac

SEQ ID NO: 307083 - RNA, 32 nt, Human
acucuguuggcagaaggcaggcgaggauaagc

SEQ ID NO: 307084 - RNA, 32 nt, Human
acucuguuguccaggcuggagugcagcgauau

SEQ ID NO: 307085 - RNA, 32 nt, Human
acucuguuucccaggcuggagugcacaaacau

SEQ ID NO: 307086 - RNA, 32 nt, Human
acucuguuucuuuccucgaaggccaccuggac

SEQ ID NO: 307087 - RNA, 32 nt, Human
acucuguuuuucucagaauaccucuuaccuuu

SEQ ID NO: 307088 - RNA, 32 nt, Human
acucuuaacucuauaaacaaccaccuuucaca

SEQ ID NO: 307089 - RNA, 32 nt, Human
acucuuaaggcuguuagguuugaauaacuuga

SEQ ID NO: 307090 - RNA, 32 nt, Human
acucuuaagucacaccuaccacugagcagcug

SEQ ID NO: 307091 - RNA, 32 nt, Human
acucuuacagaagcucuuguggcccuaggaug

SEQ ID NO: 307092 - RNA, 32 nt, Human
acucuuacccuuuugagaauugcucugaauuu

SEQ ID NO: 307093 - RNA, 32 nt, Human
acucuuaccugacaacaccacagccucaggcc

SEQ ID NO: 307094 - RNA, 32 nt, Human
acucuuaccugggcuucucugugugcauuugc

SEQ ID NO: 307095 - RNA, 32 nt, Human
acucuuacuacaaauucuuaguucuguguuug

SEQ ID NO: 307096 - RNA, 32 nt, Human
acucuuacucuuugcuaaucuauuggccuauc

SEQ ID NO: 307097 - RNA, 32 nt, Human
acucuuacugcccacagaaccuccagguuccu

SEQ ID NO: 307098 - RNA, 32 nt, Human
acucuuacuguagaacuauccauuucuuccuu

SEQ ID NO: 307099 - RNA, 32 nt, Human
acucuuagaagagagaaaauaagguuucauaa

SEQ ID NO: 307100 - RNA, 32 nt, Human
acucuuagcuaaaucccuccccgugacugcaa

SEQ ID NO: 307101 - RNA, 32 nt, Human
acucuuaucagccugggcaacacagugagacu

SEQ ID NO: 307102 - RNA, 32 nt, Human
acucuuaucgcccaggcuggggugcaauggcg

SEQ ID NO: 307103 - RNA, 32 nt, Human
acucuuaucuuuccccacuucauuccacccag

SEQ ID NO: 307104 - RNA, 32 nt, Human
acucuuaugcccacgcuggagugcagugagcc

SEQ ID NO: 307105 - RNA, 32 nt, Human
acucuuaugguugggacauucuuuuccugcuu

SEQ ID NO: 307106 - RNA, 32 nt, Human
acucuuauugcccaggcuagagugcaauggug

SEQ ID NO: 307107 - RNA, 32 nt, Human
acucuuauugcccaggcuggagugcaauggug

SEQ ID NO: 307108 - RNA, 32 nt, Human
acucuucaaaaacuguuuuggguagcugccac

SEQ ID NO: 307109 - RNA, 32 nt, Human
acucuucaaugccagcuacugccaccuaaaaa

SEQ ID NO: 307110 - RNA, 20 nt, Human
acucuucacucaggcugcag

SEQ ID NO: 307111 - RNA, 32 nt, Human
acucuucacucaggcugcagugcaguggcgca

SEQ ID NO: 307112 - RNA, 32 nt, Human
acucuucacugacagugguggcuguagucggc

SEQ ID NO: 307113 - RNA, 32 nt, Human
acucuucaugauaaaucuugcugcugcucacu

SEQ ID NO: 307114 - RNA, 32 nt, Human
acucuuccaauuaaacauucucagccaagaag

SEQ ID NO: 307115 - RNA, 32 nt, Human
acucuuccacggugugcugcuuucccuccgag

SEQ ID NO: 307116 - RNA, 32 nt, Human
acucuuccagaagagagacuagacacgcagcu

SEQ ID NO: 307117 - RNA, 32 nt, Human
acucuuccagccagaaagauggugguuuucua

SEQ ID NO: 307118 - RNA, 32 nt, Human
acucuuccagccuccauguccagaccuaguca

SEQ ID NO: 307119 - RNA, 32 nt, Human
acucuuccauuccuccuccucuaggggugcag

SEQ ID NO: 307120 - RNA, 32 nt, Human
acucuucccaucuugccuccccucgggaccuc

SEQ ID NO: 307121 - RNA, 32 nt, Human
acucuucccuuccccucucucauuccccauac

SEQ ID NO: 307122 - RNA, 32 nt, Human
acucuucccuuuucuucucucaguguugucug

SEQ ID NO: 307123 - RNA, 32 nt, Human
acucuuccgcccaggcugcagugcaguggcau

SEQ ID NO: 307124 - RNA, 19 nt, Human
acucuuccugcaacuacca

SEQ ID NO: 307125 - RNA, 32 nt, Human
acucuuccugcaggaaaggcugggcuggaccu

SEQ ID NO: 307126 - RNA, 32 nt, Human
acucuuccugguguguuuuuacauguucacuu

SEQ ID NO: 307127 - RNA, 32 nt, Human
acucuuccuuagcucugucucugaguuacugg

SEQ ID NO: 307128 - RNA, 32 nt, Human
acucuuccuucacacuggacaguuuaggacaa

SEQ ID NO: 307129 - RNA, 32 nt, Human
acucuucgccucgguaauaccugucugaugcc

SEQ ID NO: 307130 - RNA, 32 nt, Human
acucuucucacccaggcuggaaugcaguggca

SEQ ID NO: 307131 - RNA, 32 nt, Human
acucuucucucuccaucucuccuuccuccccc

SEQ ID NO: 307132 - RNA, 32 nt, Human
acucuucugcacucugagcuggccagccccuc

SEQ ID NO: 307133 - RNA, 32 nt, Human
acucuucugccuccuagaccuguucuuuccau

SEQ ID NO: 307134 - RNA, 32 nt, Human
acucuucuggacuguacaggcuugcugccauc

SEQ ID NO: 307135 - RNA, 32 nt, Human
acucuucugguccccacagacucagagagaac

SEQ ID NO: 307136 - RNA, 32 nt, Human
acucuucugugagcugcagcuguggggcagag

SEQ ID NO: 307137 - RNA, 32 nt, Human
acucuucuuccaguguggcacagggaagcuaa

SEQ ID NO: 307138 - RNA, 32 nt, Human
acucuucuucugucuguacaucguugucgucg

SEQ ID NO: 307139 - RNA, 32 nt, Human
acucuucuugaagcucucccugggcuucucuc

SEQ ID NO: 307140 - RNA, 32 nt, Human
acucuucuuuccaauagacugcuaucugaaua

SEQ ID NO: 307141 - RNA, 32 nt, Human
acucuucuuuccucuccauucuccccucagau

SEQ ID NO: 307142 - RNA, 32 nt, Human
acucuugaaaggccaacagcaaguguuugugg

SEQ ID NO: 307143 - RNA, 32 nt, Human
acucuugaaccuaggagguggagguugcagug

SEQ ID NO: 307144 - RNA, 32 nt, Human
acucuugaccucaagugauccaccugucucag

SEQ ID NO: 307145 - RNA, 32 nt, Human
acucuugagcccuccuggaauggagcuguaua

SEQ ID NO: 307146 - RNA, 32 nt, Human
acucuugagcuguggcuuacuugcugucuuca

SEQ ID NO: 307147 - RNA, 32 nt, Human
acucuugauaggacacagaacgagugaaugag

SEQ ID NO: 307148 - RNA, 32 nt, Human
acucuugauucugcuaauuauuaccaacaaaa

SEQ ID NO: 307149 - RNA, 24 nt, Human
acucuugcaaaaaguuuauuugaa

SEQ ID NO: 307150 - RNA, 31 nt, Human
acucuugcacuuucuuaagcaggauauuccu

SEQ ID NO: 307151 - RNA, 32 nt, Human
acucuugcccaggcuggagugcaguggugcga

SEQ ID NO: 307152 - RNA, 32 nt, Human
acucuugcuacugcucacucuuuggguucaca

SEQ ID NO: 307153 - RNA, 32 nt, Human
acucuugcuauguugcucacacuagucuugaa

SEQ ID NO: 307154 - RNA, 32 nt, Human
acucuugcucauucucuccugcccucuaaaag

SEQ ID NO: 307155 - RNA, 32 nt, Human
acucuugcucucccccucccucccuuacucua

SEQ ID NO: 307156 - RNA, 32 nt, Human
acucuugcugcccaggcuggagugcaauggug

SEQ ID NO: 307157 - RNA, 32 nt, Human
acucuugcugcccaggcuggagugcaguggcu

SEQ ID NO: 307158 - RNA, 32 nt, Human
acucuugcuuuauuccagaaugcuguacaucu

SEQ ID NO: 307159 - RNA, 32 nt, Human
acucuuggacucucggcaaccacaacauaaua

SEQ ID NO: 307160 - RNA, 32 nt, Human
acucuuggagcagguguucccccuggggacuc

SEQ ID NO: 307161 - RNA, 32 nt, Human
acucuuggccacguguuuccaguggcuggacc

SEQ ID NO: 307162 - RNA, 32 nt, Human
acucuuggccucccugaacauaggaaacccac

SEQ ID NO: 307163 - RNA, 32 nt, Human
acucuuggccugaucccaaccauagcccucuc

SEQ ID NO: 307164 - RNA, 32 nt, Human
acucuugggcaggugcagugaggugccugcuu

SEQ ID NO: 307165 - RNA, 21 nt, Human
acucuugggccuucucagggu

SEQ ID NO: 307166 - RNA, 32 nt, Human
acucuugggcuucagucugcccaucugcugaa

SEQ ID NO: 307167 - RNA, 32 nt, Human
acucuuggucucccacaggaaaaggccucccc

SEQ ID NO: 307168 - RNA, 32 nt, Human
acucuuggugaggcacgagcuaccagccaauu

SEQ ID NO: 307169 - RNA, 32 nt, Human
acucuuguaccccaggcuggagugcaauggcg

SEQ ID NO: 307170 - RNA, 32 nt, Human
acucuugucaaccagauuggagugcaguggug

SEQ ID NO: 307171 - RNA, 32 nt, Human
acucuugucacccaggcuggaguacaguggca

SEQ ID NO: 307172 - RNA, 32 nt, Human
acucuugucacccaggcuggagugcaauggca

SEQ ID NO: 307173 - RNA, 32 nt, Human
acucuugucacccaggcuggagugcaguagug

SEQ ID NO: 307174 - RNA, 32 nt, Human
acucuugucacccaggcuggagugcaguggca

SEQ ID NO: 307175 - RNA, 32 nt, Human
acucuugucacccaggcuggagugcaguggcg

SEQ ID NO: 307176 - RNA, 32 nt, Human
acucuugucacccaggcuggaguguaguggug

SEQ ID NO: 307177 - RNA, 32 nt, Human
acucuugucaccgaggcuggagugcaaugaca

SEQ ID NO: 307178 - RNA, 32 nt, Human
acucuugucaccuagacuggagugcaauggcg

SEQ ID NO: 307179 - RNA, 32 nt, Human
acucuugucaccuaggcaagagugcaauggca

SEQ ID NO: 307180 - RNA, 32 nt, Human
acucuugucaccugggcugcaguuggaggccu

SEQ ID NO: 307181 - RNA, 32 nt, Human
acucuugucacucaggcuggagugcaguggug

SEQ ID NO: 307182 - RNA, 32 nt, Human
acucuuguccaggcuggaggagugcagucgua

SEQ ID NO: 307183 - RNA, 32 nt, Human
acucuugucgcccaacuagaguguaguggcac

SEQ ID NO: 307184 - RNA, 32 nt, Human
acucuugucucccagacuggagugcaauggca

SEQ ID NO: 307185 - RNA, 32 nt, Human
acucuugugcccaggcuggagugcaauagcuc

SEQ ID NO: 307186 - RNA, 32 nt, Human
acucuuguguccaggcuggagugcaguggcac

SEQ ID NO: 307187 - RNA, 32 nt, Human
acucuuguguuuaggggauggugggaacauau

SEQ ID NO: 307188 - RNA, 32 nt, Human
acucuuguuauccaggcuggggugcaauggug

SEQ ID NO: 307189 - RNA, 32 nt, Human
acucuuguucagcacggggccugaggucagag

SEQ ID NO: 307190 - RNA, 32 nt, Human
acucuuguucuugucugaucucuugucaaauu

SEQ ID NO: 307191 - RNA, 32 nt, Human
acucuuguugcccaagcuggagugcaauggcg

SEQ ID NO: 307192 - RNA, 32 nt, Human
acucuuguugcccaagcuggagugcaguggug

SEQ ID NO: 307193 - RNA, 32 nt, Human
acucuuguugcccacgcuggagugcaauggug

SEQ ID NO: 307194 - RNA, 32 nt, Human
acucuuguugcccaggccagagugcaauggcg

SEQ ID NO: 307195 - RNA, 32 nt, Human
acucuuguugcccaggcggagugcaguggaac

SEQ ID NO: 307196 - RNA, 32 nt, Human
acucuuguugcccaggcuagagggcaauggug

SEQ ID NO: 307197 - RNA, 32 nt, Human
acucuuguugcccaggcuagagugcaauggca

SEQ ID NO: 307198 - RNA, 32 nt, Human
acucuuguugcccaggcuggaaugcaguggca

SEQ ID NO: 307199 - RNA, 23 nt, Human
acucuuguugcccaggcuggagg

SEQ ID NO: 307200 - RNA, 32 nt, Human
acucuuguugcccaggcuggaguacaauggca

SEQ ID NO: 307201 - RNA, 32 nt, Human
acucuuguugcccaggcuggaguacaauggcg

SEQ ID NO: 307202 - RNA, 32 nt, Human
acucuuguugcccaggcuggagugaaauggug

SEQ ID NO: 307203 - RNA, 32 nt, Human
acucuuguugcccaggcuggagugaaguggcg

SEQ ID NO: 307204 - RNA, 32 nt, Human
acucuuguugcccaggcuggagugcaacggca

SEQ ID NO: 307205 - RNA, 32 nt, Human
acucuuguugcccaggcuggagugcaauagca

SEQ ID NO: 307206 - RNA, 32 nt, Human
acucuuguugcccaggcuggagugcaaugcgc

SEQ ID NO: 307207 - RNA, 32 nt, Human
acucuuguugcccaggcuggagugcaauggca

SEQ ID NO: 307208 - RNA, 32 nt, Human
acucuuguugcccaggcuggagugcaauggcg

SEQ ID NO: 307209 - RNA, 32 nt, Human
acucuuguugcccaggcuggagugcaguagca

SEQ ID NO: 307210 - RNA, 32 nt, Human
acucuuguugcccaggcuggagugcaguggug

SEQ ID NO: 307211 - RNA, 32 nt, Human
acucuuguugcccaggcuggagugcgguggua

SEQ ID NO: 307212 - RNA, 32 nt, Human
acucuuguugcccaggcuggagugcguuggcg

SEQ ID NO: 307213 - RNA, 32 nt, Human
acucuuguugccuagcuggagugcaauggcgc

SEQ ID NO: 307214 - RNA, 32 nt, Human
acucuuguugccuaggcuggagugcaauggug

SEQ ID NO: 307215 - RNA, 32 nt, Human
acucuuguuguccagucuggagugcaauggca

SEQ ID NO: 307216 - RNA, 26 nt, Human
acucuuuagcauucauacuuuggggu

SEQ ID NO: 307217 - RNA, 32 nt, Human
acucuuuaucauuacugcuguaaacccugcua

SEQ ID NO: 307218 - RNA, 28 nt, Human
acucuuuauccaagacauuucucagggu

SEQ ID NO: 307219 - RNA, 32 nt, Human
acucuuuaucccaugaggagcuucuggaaacu

SEQ ID NO: 307220 - RNA, 32 nt, Human
acucuuuaucuucucaucuuacuggccugguc

SEQ ID NO: 307221 - RNA, 32 nt, Human
acucuuuaucuuugcuguggugcagugucuag

SEQ ID NO: 307222 - RNA, 32 nt, Human
acucuuucacagugcccaugguauucaugcca

SEQ ID NO: 307223 - RNA, 32 nt, Human
acucuuucacccagacuggagggcagcggcga

SEQ ID NO: 307224 - RNA, 32 nt, Human
acucuuucacccaggcuggagugcaguggcac

SEQ ID NO: 307225 - RNA, 32 nt, Human
acucuuucacucaggcuggaauguaguggaga

SEQ ID NO: 307226 - RNA, 32 nt, Human
acucuuucauucuucucacauccaucuacuuu

SEQ ID NO: 307227 - RNA, 32 nt, Human
acucuuuccaaaacccccuccuggguuuuacu

SEQ ID NO: 307228 - RNA, 32 nt, Human
acucuuucccaucuccccuggggagccugagg

SEQ ID NO: 307229 - RNA, 32 nt, Human
acucuuuccuacccugacauccagaaacaaug

SEQ ID NO: 307230 - RNA, 17 nt, Human
acucuuuccugccacca

SEQ ID NO: 307231 - RNA, 32 nt, Human
acucuuuccuuuccucucuccuguuuuccuuc

SEQ ID NO: 307232 - RNA, 32 nt, Human
acucuuucgcccaggcuggagugcagugguau

SEQ ID NO: 307233 - RNA, 32 nt, Human
acucuuucgcccaggcuggagugcauuggcau

SEQ ID NO: 307234 - RNA, 32 nt, Human
acucuuucucagaaaacaagaagaagaagaca

SEQ ID NO: 307235 - RNA, 21 nt, Human
acucuuugacauuagauuuca

SEQ ID NO: 307236 - RNA, 32 nt, Human
acucuuugaucauggcucucucugccagaauu

SEQ ID NO: 307237 - RNA, 32 nt, Human
acucuuuggaacaacagcuaucuagauagcug

SEQ ID NO: 307238 - RNA, 32 nt, Human
acucuuuggccaaacaccuccaccacugcccc

SEQ ID NO: 307239 - RNA, 32 nt, Human
acucuuuguauaaugucagagacucauguuua

SEQ ID NO: 307240 - RNA, 32 nt, Human
acucuuugugguuccugucaugagaaggugug

SEQ ID NO: 307241 - RNA, 32 nt, Human
acucuuuuaucagaucacaaacuccuagaguc

SEQ ID NO: 307242 - RNA, 32 nt, Human
acucuuuucaucccucuccugggucugcgccc

SEQ ID NO: 307243 - RNA, 18 nt, Human
acucuuuucccucaggga

SEQ ID NO: 307244 - RNA, 32 nt, Human
acucuuuucuacugcuuggcucugcccaagga

SEQ ID NO: 307245 - RNA, 21 nt, Human
acucuuuucucccagggaccc

SEQ ID NO: 307246 - RNA, 32 nt, Human
acucuuuucuguagaauuugacggaacacagc

SEQ ID NO: 307247 - RNA, 32 nt, Human
acucuuuugaaggaugaaggugguggauucuc

SEQ ID NO: 307248 - RNA, 32 nt, Human
acucuuuugcccaggcuggagcgaagugacga

SEQ ID NO: 307249 - RNA, 32 nt, Human
acucuuuuuacccaggcuggagugcaaugaug

SEQ ID NO: 307250 - RNA, 32 nt, Human
acucuuuuuccugcccagggcccauucuugcu

SEQ ID NO: 307251 - RNA, 32 nt, Human
acugaaaaagccccaggcugaaaggacuggac

SEQ ID NO: 307252 - RNA, 32 nt, Human
acugaaaaccuacuugagguuucuggucugaa

SEQ ID NO: 307253 - RNA, 32 nt, Human
acugaaaagccaaagaaauucacucuggcuag

SEQ ID NO: 307254 - RNA, 32 nt, Human
acugaaaaggagcaacaaggagagggucugcu

SEQ ID NO: 307255 - RNA, 32 nt, Human
acugaaaagucaucaaucauacagucagugaa

SEQ ID NO: 307256 - RNA, 32 nt, Human
acugaaaagugaguuugcagaaaccuugggga

SEQ ID NO: 307257 - RNA, 32 nt, Human
acugaaaauaaggugggcuucacuggagaaau

SEQ ID NO: 307258 - RNA, 32 nt, Human
acugaaaauacaaaauaauuagccggguguug

SEQ ID NO: 307259 - RNA, 32 nt, Human
acugaaaauacagaaaaguuagccaggcgugg

SEQ ID NO: 307260 - RNA, 32 nt, Human
acugaaacacagcaacaccaguucucaaggac

SEQ ID NO: 307261 - RNA, 32 nt, Human
acugaaacagcugcuuauuuugccguuaaaaa

SEQ ID NO: 307262 - RNA, 32 nt, Human
acugaaacauggcuguguuugcagccugcucu

SEQ ID NO: 307263 - RNA, 32 nt, Human
acugaaaccacugacaaguaugcugaauagaa

SEQ ID NO: 307264 - RNA, 32 nt, Human
acugaaaccagcugaggcauccugaaagccua

SEQ ID NO: 307265 - RNA, 32 nt, Human
acugaaacccaagaggcagagguugaguaagc

SEQ ID NO: 307266 - RNA, 32 nt, Human
acugaaaccccgugguucccaaugagccagcg

SEQ ID NO: 307267 - RNA, 32 nt, Human
acugaaacccugacccagaaaaguggcuugcu

SEQ ID NO: 307268 - RNA, 32 nt, Human
acugaaaccuacucugagucucacaucucuaa

SEQ ID NO: 307269 - RNA, 32 nt, Human
acugaaacuacugguguuuuucugccuugaga

SEQ ID NO: 307270 - RNA, 32 nt, Human
acugaaagaaaaucaugaacuuaucauucuaa

SEQ ID NO: 307271 - RNA, 32 nt, Human
acugaaagaagauauuucaagaugaccaucug

SEQ ID NO: 307272 - RNA, 24 nt, Human
acugaaagcuccgccucccggguu

SEQ ID NO: 307273 - RNA, 32 nt, Human
acugaaaggaaaggagaaacagauaaguccau

SEQ ID NO: 307274 - RNA, 32 nt, Human
acugaaaggaagagggagcagagcaagaaaaa

SEQ ID NO: 307275 - RNA, 31 nt, Human
acugaaaggagacagccucagagcuaugccu

SEQ ID NO: 307276 - RNA, 32 nt, Human
acuuaggaggcugaggggcaaggauugcuuga

SEQ ID NO: 307277 - RNA, 32 nt, Human
acuuaggaggcugaggugggagaaucacuugg

SEQ ID NO: 307278 - RNA, 32 nt, Human
acuuaggaggcugaggugggagaauuaccuga

SEQ ID NO: 307279 - RNA, 32 nt, Human
acuuaggaggcugaggugggaggauugcuuga

SEQ ID NO: 307280 - RNA, 32 nt, Human
acuuaggaggggcaauggagccgcuuagugcc

SEQ ID NO: 307281 - RNA, 32 nt, Human
acuuaggaguagcuaggacuacaggccacggc

SEQ ID NO: 307282 - RNA, 32 nt, Human
acuuaggcaaaaaggcaacacucaagcaaaau

SEQ ID NO: 307283 - RNA, 32 nt, Human
acuuaggcuucugcccuuugagacucacauga

SEQ ID NO: 307284 - RNA, 32 nt, Human
acuuagggaaguggaagagaaagggaauuuug

SEQ ID NO: 307285 - RNA, 32 nt, Human
acuuagggaagugggaaucuuauuugcggaac

SEQ ID NO: 307286 - RNA, 32 nt, Human
acuuagggaggcagaguggaggaagugagagg

SEQ ID NO: 307287 - RNA, 21 nt, Human
acuuagggaguauguaaaaua

SEQ ID NO: 307288 - RNA, 32 nt, Human
acuuagggcagaggaaugcaaaguccugccca

SEQ ID NO: 307289 - RNA, 32 nt, Human
acuuagggcgugagccaccgcgcccagcuucu

SEQ ID NO: 307290 - RNA, 31 nt, Human
acuuaggggucaaaccugugguguguggaag

SEQ ID NO: 307291 - RNA, 32 nt, Human
acuuaggugaagcagcaucugggugugagagu

SEQ ID NO: 307292 - RNA, 32 nt, Human
acuuaggugccuggcuggcccagggcuugcuc

SEQ ID NO: 307293 - RNA, 32 nt, Human
acuuaguaaagcauuagaagagcccagaggcu

SEQ ID NO: 307294 - RNA, 32 nt, Human
acuuaguaaauuugaagugcagcucuguuagc

SEQ ID NO: 307295 - RNA, 32 nt, Human
acuuaguaauucccaucaggaaaugcugaccu

SEQ ID NO: 307296 - RNA, 32 nt, Human
acuuaguagcugugugaaaauuaauauuucug

SEQ ID NO: 307297 - RNA, 31 nt, Human
acuuagucaauaaaaccuugaaauaaagaug

SEQ ID NO: 307298 - RNA, 32 nt, Human
acuuaguccucaagcucccaaccugcuguccc

SEQ ID NO: 307299 - RNA, 32 nt, Human
acuuagucuaacucccccauuuuacagauuuc

SEQ ID NO: 307300 - RNA, 32 nt, Human
acuuagugcaagacuacaggaguuaacagaug

SEQ ID NO: 307301 - RNA, 32 nt, Human
acuuagugcaucagauguaacagaacaaauua

SEQ ID NO: 307302 - RNA, 32 nt, Human
acuuagugcuuccagguaguuauaguacucca

SEQ ID NO: 307303 - RNA, 32 nt, Human
acuuaguggguugacaaaauuuuaaaauauca

SEQ ID NO: 307304 - RNA, 32 nt, Human
acuuagugguaacuaugguugcagagaaagag

SEQ ID NO: 307305 - RNA, 32 nt, Human
acuuaguguuaauaaggaucuacugaggcuag

SEQ ID NO: 307306 - RNA, 32 nt, Human
acuuaguuauucacugugaccuaaauuuaguc

SEQ ID NO: 307307 - RNA, 32 nt, Human
acuuaguuuugcauaguucuagugcagcugaa

SEQ ID NO: 307308 - RNA, 32 nt, Human
acuuauaaggagcuuagaaaaugcagguuaca

SEQ ID NO: 307309 - RNA, 32 nt, Human
acuuauagaaaaggagaaaauaauuaaacagu

SEQ ID NO: 307310 - RNA, 32 nt, Human
acuuauagacaguaucccuuguccucaagauu

SEQ ID NO: 307311 - RNA, 32 nt, Human
acuuauagacucaacuauguaucuguaguuuu

SEQ ID NO: 307312 - RNA, 32 nt, Human
acuuauagcuuauguugcaccugcucucaggu

SEQ ID NO: 307313 - RNA, 32 nt, Human
acuuaucaccacccuccucuuuucugccugga

SEQ ID NO: 307314 - RNA, 32 nt, Human
acuuaucacugcaccucuugccaaagugcggu

SEQ ID NO: 307315 - RNA, 32 nt, Human
acuuaucagaugcucauugcuuucuaagaucu

SEQ ID NO: 307316 - RNA, 32 nt, Human
acuuaucauagaacaaauauguaucauuaugg

SEQ ID NO: 307317 - RNA, 32 nt, Human
acuuaucauggaguugauaacaagaagaauaa

SEQ ID NO: 307318 - RNA, 32 nt, Human
acuuaucauguggugaaggccgccucaggggu

SEQ ID NO: 307319 - RNA, 32 nt, Human
acuuauccccuuguccccaugugucauuggag

SEQ ID NO: 307320 - RNA, 32 nt, Human
acuuaucccugguuaagaaugcuguuucaaug

SEQ ID NO: 307321 - RNA, 32 nt, Human
acuuaucccuuuuucucuuaagaaagcaggua

SEQ ID NO: 307322 - RNA, 32 nt, Human
acuuaucuagaaggggagaaacucccuccacu

SEQ ID NO: 307323 - RNA, 32 nt, Human
acuuaucuccuugcugggcagcuccccuuggc

SEQ ID NO: 307324 - RNA, 32 nt, Human
acuuaucugaagguuacaaauuagacuuuuaa

SEQ ID NO: 307325 - RNA, 32 nt, Human
acuuaucuggugcauucuccccaccccacccc

SEQ ID NO: 307326 - RNA, 29 nt, Human
acuuaugaaauucaaguuacaugugaauu

SEQ ID NO: 307327 - RNA, 32 nt, Human
acuuaugccucacuccccuccucccgcuccaa

SEQ ID NO: 307328 - RNA, 29 nt, Human
acuuauggauuuugacaagaaaggaggga

SEQ ID NO: 307329 - RNA, 32 nt, Human
acuuauggggaaauaguuaauuguuaaagaaa

SEQ ID NO: 307330 - RNA, 32 nt, Human
acuuauguauuuaugaauccaugaccaaauua

SEQ ID NO: 307331 - RNA, 32 nt, Human
acuuaugugagugaccccauccauccaugacc

SEQ ID NO: 307332 - RNA, 32 nt, Human
acuuaugugcugcuagucucuacucgaaguuc

SEQ ID NO: 307333 - RNA, 32 nt, Human
acuuauguggagacacauacuuaaguguguuc

SEQ ID NO: 307334 - RNA, 32 nt, Human
acuuauuauccacagugcaacagugguuaccc

SEQ ID NO: 307335 - RNA, 32 nt, Human
acuuauuauguauuagguucuuugccagaugu

SEQ ID NO: 307336 - RNA, 32 nt, Human
acuuauucugaguuaaauauuaauacuuuaaa

SEQ ID NO: 307337 - RNA, 32 nt, Human
acuuauucuugcugagaaugcauaaccagaau

SEQ ID NO: 307338 - RNA, 32 nt, Human
acuuauugaaugaaugcuuugccuaaaguuug

SEQ ID NO: 307339 - RNA, 32 nt, Human
acuuauugauccuuucuccucaccuucagaau

SEQ ID NO: 307340 - RNA, 32 nt, Human
acuuauugcacuccagcccgggcgacagagcg

SEQ ID NO: 307341 - RNA, 32 nt, Human
acuuauugcauacugccucagagccauguguc

SEQ ID NO: 307342 - RNA, 32 nt, Human
acuuauuucagaggcuuauuguuuucucugua

SEQ ID NO: 307343 - RNA, 32 nt, Human
acuuauuucucauucucuuuccuuccugaaca

SEQ ID NO: 307344 - RNA, 32 nt, Human
acuuauuucucuaucaauccaguuuucaaaac

SEQ ID NO: 307345 - RNA, 32 nt, Human
acuuauuugcauccaagaguuugcauugagac

SEQ ID NO: 307346 - RNA, 32 nt, Human
acuuauuuuacaaccuaguaauaauguggaua

SEQ ID NO: 307347 - RNA, 32 nt, Human
acuuauuuuccuuacugguagacugucguuuu

SEQ ID NO: 307348 - RNA, 16 nt, Human
acuuauuuugcucccu

SEQ ID NO: 307349 - RNA, 16 nt, Human
acuucaaaacacagua

SEQ ID NO: 307350 - RNA, 21 nt, Human
acuucaaaagccaaaaagagg

SEQ ID NO: 307351 - RNA, 22 nt, Human
acuucaaacacugaucacggga

SEQ ID NO: 307352 - RNA, 24 nt, Human
acuucaaacuccgccucccggguu

SEQ ID NO: 307353 - RNA, 32 nt, Human
acuucaaagacggauggguugagcuggcagcc

SEQ ID NO: 307354 - RNA, 31 nt, Human
acuucaaagagaccaugguuccguuggaggc

SEQ ID NO: 307355 - RNA, 32 nt, Human
acuucaaagaggaaccaggaggacaagaggag

SEQ ID NO: 307356 - RNA, 32 nt, Human
acuucaaagcuggguuagagaugaggcaccuu

SEQ ID NO: 307357 - RNA, 32 nt, Human
acuucaaagugaagccagcaaagugauaauac

SEQ ID NO: 307358 - RNA, 32 nt, Human
acuucaaagugccugggcucagccugguuucu

SEQ ID NO: 307359 - RNA, 32 nt, Human
acuucaacaguuuuuacacaaggaaucucaaa

SEQ ID NO: 307360 - RNA, 32 nt, Human
acuucaaccauccugcaggucaaaacccacug

SEQ ID NO: 307361 - RNA, 32 nt, Human
acuucaaccaugagcuucaccgucugucucuu

SEQ ID NO: 307362 - RNA, 32 nt, Human
acuucaacccaggaggcagaggcuacagugag

SEQ ID NO: 307363 - RNA, 32 nt, Human
acuucaaccugggagguugaggcugcagugag

SEQ ID NO: 307364 - RNA, 32 nt, Human
acuucaacggaaacaaauacacucaagggaag

SEQ ID NO: 307365 - RNA, 32 nt, Human
acuucaacuaaagacuauaaacaacaaaaauc

SEQ ID NO: 307366 - RNA, 32 nt, Human
acuucaagaccauccuggacuguggccacccg

SEQ ID NO: 307367 - RNA, 32 nt, Human
acuucaagagagaaagagagagugggcagaca

SEQ ID NO: 307368 - RNA, 32 nt, Human
acuucaagagccuguggucaggaaaucagguc

SEQ ID NO: 307369 - RNA, 32 nt, Human
acuucaagccgguaacugcacacaacaggccu

SEQ ID NO: 307370 - RNA, 32 nt, Human
acuucaagcuguuauuucuucccugcuuugca

SEQ ID NO: 307371 - RNA, 32 nt, Human
acuucaaggccugggccccucugggcuucagu

SEQ ID NO: 307372 - RNA, 32 nt, Human
acuucaagggcagccuuuggggguugggguuu

SEQ ID NO: 307373 - RNA, 24 nt, Human
acuucaagugauccacccgccuca

SEQ ID NO: 307374 - RNA, 32 nt, Human
acuucaaugauuuuauuuccagcaucaaacua

SEQ ID NO: 307375 - RNA, 32 nt, Human
acuucaauggaaauuauuacaagcagauuaau

SEQ ID NO: 307376 - RNA, 19 nt, Human
acuucaauguuuucacuga

SEQ ID NO: 307377 - RNA, 32 nt, Human
acuucaauuaaagacuauaaacaacaaaaauc

SEQ ID NO: 307378 - RNA, 32 nt, Human
acuucaauuugccugacauuuauuaaaugcau

SEQ ID NO: 307379 - RNA, 32 nt, Human
acuucaauuuucuuuagcuuuuaccaacccaa

SEQ ID NO: 307380 - RNA, 32 nt, Human
acuucacaauuaccuuuucuagugcaguuaua

SEQ ID NO: 307381 - RNA, 32 nt, Human
acuucacacagucccuggcauuuagucaucug

SEQ ID NO: 307382 - RNA, 32 nt, Human
acuucacacgugauucuucaagccacacccac

SEQ ID NO: 307383 - RNA, 32 nt, Human
acuucacagacauggucuagaaucuguacccu

SEQ ID NO: 307384 - RNA, 32 nt, Human
acuucacagcaggccagcugcagugacuuguc

SEQ ID NO: 307385 - RNA, 32 nt, Human
acuucacagcaugucagggaaaaucacuguca

SEQ ID NO: 307386 - RNA, 32 nt, Human
acuucacaggcacuccacugcuuggcaggaau

SEQ ID NO: 307387 - RNA, 32 nt, Human
acuucacaggcagcagcuagcgaggcggucuc

SEQ ID NO: 307388 - RNA, 32 nt, Human
acuucacaguucagaagaaauaacuuaagcag

SEQ ID NO: 307389 - RNA, 32 nt, Human
acuucaccagcuguuauuuuugcuuuuacuuu

SEQ ID NO: 307390 - RNA, 32 nt, Human
acuucacccaggaggagugggccuuguugaau

SEQ ID NO: 307391 - RNA, 32 nt, Human
acuucacccaggaggagugggcuuugcugggu

SEQ ID NO: 307392 - RNA, 32 nt, Human
acuucacccaggaggaguggggucaacuagac

SEQ ID NO: 307393 - RNA, 32 nt, Human
acuucacccaggcggaaugggauggccugucc

SEQ ID NO: 307394 - RNA, 32 nt, Human
acuucacccuggcggaguccaaggccuccagc

SEQ ID NO: 307395 - RNA, 32 nt, Human
acuucaccuaucauuggucuuuccuagcuaua

SEQ ID NO: 307396 - RNA, 32 nt, Human
acuucaccuccaggaacugucauggaugucca

SEQ ID NO: 307397 - RNA, 32 nt, Human
acuucaccucugagccuccgaugcucugugaa

SEQ ID NO: 307398 - RNA, 32 nt, Human
acuucaccugcucuccaacagcuggaacgguc

SEQ ID NO: 307399 - RNA, 32 nt, Human
acuucacuaaucaucacauaaauucaaaugca

SEQ ID NO: 307400 - RNA, 32 nt, Human
acuucacuaugauaugaggcagucucugagcu

SEQ ID NO: 307401 - RNA, 32 nt, Human
acuucacuccagccugggcaacagagugagac

SEQ ID NO: 307402 - RNA, 32 nt, Human
acuucacuccagccugggugacggagugagac

SEQ ID NO: 307403 - RNA, 32 nt, Human
acuucacucugccuuuucauccaggccaguga

SEQ ID NO: 307404 - RNA, 32 nt, Human
acuucacugagguuugugaggacuggagaucg

SEQ ID NO: 307405 - RNA, 32 nt, Human
acuucacugcacuccagucugggugacagagc

SEQ ID NO: 307406 - RNA, 32 nt, Human
acuucacugggucuuuuuccagccuucaguuc

SEQ ID NO: 307407 - RNA, 32 nt, Human
acuucacuuauuucagggucuccaauugagaa

SEQ ID NO: 307408 - RNA, 32 nt, Human
acuucacuugauaguuuuuaagcaauuagaau

SEQ ID NO: 307409 - RNA, 32 nt, Human
acuucagacagaaaccaauaccagcuuccuuu

SEQ ID NO: 307410 - RNA, 19 nt, Human
acuucagaccgccuugcag

SEQ ID NO: 307411 - RNA, 32 nt, Human
acuucagacgcugaaacugcugccuuucagga

SEQ ID NO: 307412 - RNA, 32 nt, Human
acuucagacuuccuguccugcugguaucaugg

SEQ ID NO: 307413 - RNA, 32 nt, Human
acuucagagacaggguuucaccauguuggcca

SEQ ID NO: 307414 - RNA, 32 nt, Human
acuucagagauggcagcagcaaguuuagcauc

SEQ ID NO: 307415 - RNA, 32 nt, Human
acuucagagccagcaguguggcucaggugcca

SEQ ID NO: 307416 - RNA, 32 nt, Human
acuucagagcccccgccuuugccugcacuccu

SEQ ID NO: 307417 - RNA, 20 nt, Human
acuucagagccccuccgcca

SEQ ID NO: 307418 - RNA, 32 nt, Human
acuucagagcuuugcuaaacuaaccuaauuug

SEQ ID NO: 307419 - RNA, 32 nt, Human
acuucagaggcaggagccuuugggcugagcaa

SEQ ID NO: 307420 - RNA, 32 nt, Human
acuucagaggcugagguggaaggaucacuuga

SEQ ID NO: 307421 - RNA, 32 nt, Human
acuucagauccugucugucagucucuguuagg

SEQ ID NO: 307422 - RNA, 32 nt, Human
acuucagaugaucuacccaccuuggcauccua

SEQ ID NO: 307423 - RNA, 32 nt, Human
acuucagaugcuuucaggagugacacaagaac

SEQ ID NO: 307424 - RNA, 32 nt, Human
acuucagauggaccuaguacccacugagauuu

SEQ ID NO: 307425 - RNA, 32 nt, Human
acuucagaugggcucaguaccugucccagcca

SEQ ID NO: 307426 - RNA, 21 nt, Human
acuucagcaaaugcaagcuga

SEQ ID NO: 307427 - RNA, 22 nt, Human
acuucagcaccugccccggcag

SEQ ID NO: 307428 - RNA, 32 nt, Human
acuucagcagcacugccacugccuuuggccac

SEQ ID NO: 307429 - RNA, 32 nt, Human
acuucagcagccucucaggugccugaaacugu

SEQ ID NO: 307430 - RNA, 21 nt, Human
acuucagcauauuuguucuaa

SEQ ID NO: 307431 - RNA, 32 nt, Human
acuucagccaucgggaggaccagcacggcggg

SEQ ID NO: 307432 - RNA, 32 nt, Human
acuucagcccaggaggucaggucaaggcugca

SEQ ID NO: 307433 - RNA, 32 nt, Human
acuucagcccaggagguggagguugcagugag

SEQ ID NO: 307434 - RNA, 32 nt, Human
acuucagcccaggaguuccagacugccuggcu

SEQ ID NO: 307435 - RNA, 32 nt, Human
acuucagcccaggaguuuaaggcugcagugag

SEQ ID NO: 307436 - RNA, 32 nt, Human
acuucagccccagggaccugggcagcacuguc

SEQ ID NO: 307437 - RNA, 32 nt, Human
acuucagcccgggcaacaagagcgagacuccg

SEQ ID NO: 307438 - RNA, 32 nt, Human
acuucagccuaggacguugaggcugcagugag

SEQ ID NO: 307439 - RNA, 32 nt, Human
acuucagccuccagaacugugagaaauacaua

SEQ ID NO: 307440 - RNA, 32 nt, Human
acuucagccucugagcugucauggacccacuc

SEQ ID NO: 307441 - RNA, 26 nt, Human
acuucagccugggugacagagugaga

SEQ ID NO: 307442 - RNA, 32 nt, Human
acuucagccuuccuuccagucugggcugagug

SEQ ID NO: 307443 - RNA, 32 nt, Human
acuucagcuacggcccaugaugcaucagaaau

SEQ ID NO: 307444 - RNA, 32 nt, Human
acuucagcucauccaaaagcagccagcagacc

SEQ ID NO: 307445 - RNA, 32 nt, Human
acuucagcucauccaguccaucagggacuucc

SEQ ID NO: 307446 - RNA, 32 nt, Human
acuucagcuccaggcugcaguaauguguuggu

SEQ ID NO: 307447 - RNA, 32 nt, Human
acuucagcuccucaaguagaugggacuacagg

SEQ ID NO: 307448 - RNA, 32 nt, Human
acuucagcuucugcuguuaccaaugccucagc

SEQ ID NO: 307449 - RNA, 32 nt, Human
acuucagcuuuggaaaacucagucucuuucau

SEQ ID NO: 307450 - RNA, 32 nt, Human
acuucaggaacagcagauuaaaacagugccuu

SEQ ID NO: 307451 - RNA, 32 nt, Human
acuucaggaagccaccagaggagcagcuuccu

SEQ ID NO: 307452 - RNA, 32 nt, Human
acuucaggaagccuaauauccaaaaaguuagu

SEQ ID NO: 307453 - RNA, 32 nt, Human
acuucaggaauugccccaggaggacaccagau

SEQ ID NO: 307454 - RNA, 21 nt, Human
acuucaggacugccccuuuca

SEQ ID NO: 307455 - RNA, 24 nt, Human
acuucaggagcucuuucccggcag

SEQ ID NO: 307456 - RNA, 32 nt, Human
acuucaggagcugagaggagcaggauggaacu

SEQ ID NO: 307457 - RNA, 19 nt, Human
acuucaggagcuucccagc

SEQ ID NO: 307458 - RNA, 32 nt, Human
acuucaggcaagccacuuuaccucucuggaac

SEQ ID NO: 307459 - RNA, 32 nt, Human
acuucaggcauaugcugugcccuugcaguggc

SEQ ID NO: 307460 - RNA, 32 nt, Human
acuucaggccugccuuuccagcgagaauucuu

SEQ ID NO: 307461 - RNA, 32 nt, Human
acuucaggcggagucccaggagagcagcgcgg

SEQ ID NO: 307462 - RNA, 32 nt, Human
acuucaggcucuggacuggagcucucuggcau

SEQ ID NO: 307463 - RNA, 32 nt, Human
acuucaggcugaaauuccaaacaggccaacaa

SEQ ID NO: 307464 - RNA, 32 nt, Human
acuucagggaaggcuugcucaccucgcucggu

SEQ ID NO: 307465 - RNA, 32 nt, Human
acuucagggucugggucugagcccgugggcaa

SEQ ID NO: 307466 - RNA, 32 nt, Human
acuucagguggcugggugacuaaagggcuugu

SEQ ID NO: 307467 - RNA, 32 nt, Human
acuucaguccugcugcaguugugcagcagagg

SEQ ID NO: 307468 - RNA, 32 nt, Human
acuucaguuagcauggugggggagaaccagua

SEQ ID NO: 307469 - RNA, 25 nt, Human
acuucaguugaaaauuagguucuaa

SEQ ID NO: 307470 - RNA, 32 nt, Human
acuucaguuuccaugaaauaaacaaugacuau

SEQ ID NO: 307471 - RNA, 32 nt, Human
acuucauacccaagagaagcucagggagaucc

SEQ ID NO: 307472 - RNA, 32 nt, Human
acuucauagagggagaggcagacaguugaagg

SEQ ID NO: 307473 - RNA, 32 nt, Human
acuucauagauuuccuucccaucccagcugaa

SEQ ID NO: 307474 - RNA, 32 nt, Human
acuucaucagaacauucauacgggagagaagc

SEQ ID NO: 307475 - RNA, 32 nt, Human
acuucaucagagaguagcuaaagagaauaagu

SEQ ID NO: 307476 - RNA, 32 nt, Human
acuucaucaguguggcuucuaugagcccagau

SEQ ID NO: 307477 - RNA, 32 nt, Human
acuucaucauccaccaccuccuggagggagua

SEQ ID NO: 307478 - RNA, 32 nt, Human
acuucaucauccaccaccuccuggagggggua

SEQ ID NO: 307479 - RNA, 32 nt, Human
acuucauccagccacuuuaaugauugaaaaua

SEQ ID NO: 307480 - RNA, 18 nt, Human
acuucauccggcgacuag

SEQ ID NO: 307481 - RNA, 32 nt, Human
acuucauccugucauuccagccuggggucugc

SEQ ID NO: 307482 - RNA, 32 nt, Human
acuucaucuugcacuguuccccaaacuuugga

SEQ ID NO: 307483 - RNA, 32 nt, Human
acuucaucuuucucccugacucacuugguuuc

SEQ ID NO: 307484 - RNA, 32 nt, Human
acuucaugagcagcuggggucuggaaggcucc

SEQ ID NO: 307485 - RNA, 32 nt, Human
acuucauggacuggcaucaguaugaaugacau

SEQ ID NO: 307486 - RNA, 32 nt, Human
acuucauggcagcacagauauaccucauuuua

SEQ ID NO: 307487 - RNA, 32 nt, Human
acuucauguaguucaggcacagaaagaauagc

SEQ ID NO: 307488 - RNA, 24 nt, Human
acuucaugucaguuuauguucuaa

SEQ ID NO: 307489 - RNA, 32 nt, Human
acuucauuacccaggcuggagugcaaggcacg

SEQ ID NO: 307490 - RNA, 32 nt, Human
acuucauucauagauccucccuuauuuaacau

SEQ ID NO: 307491 - RNA, 32 nt, Human
acuucauuccagcaggaggcacuuaggggaga

SEQ ID NO: 307492 - RNA, 32 nt, Human
acuucauugaaggauggagauuuggaagacau

SEQ ID NO: 307493 - RNA, 22 nt, Human
acuucauuuccugccccuuuca

SEQ ID NO: 307494 - RNA, 32 nt, Human
acuucauuucuagcaauuauuuaccaaguacc

SEQ ID NO: 307495 - RNA, 32 nt, Human
acuucauuuggaaaaagauucagucuuuuauc

SEQ ID NO: 307496 - RNA, 32 nt, Human
acuucauuuuucuccucucucuuucauuguuu

SEQ ID NO: 307497 - RNA, 32 nt, Human
acuuccaaagugcugggauuacaggugugagc

SEQ ID NO: 307498 - RNA, 32 nt, Human
acuuccaaguagcugggauuacagacaugcca

SEQ ID NO: 307499 - RNA, 32 nt, Human
acuuccaaguuuccaagacuucucauggaggu

SEQ ID NO: 307500 - RNA, 32 nt, Human
acuuccaaucagaagucucacugguggggcug

SEQ ID NO: 307501 - RNA, 32 nt, Human
acuuccacaaggcccacuggaaaaaugagaga

SEQ ID NO: 307502 - RNA, 32 nt, Human
acuuccacaagucucaagccucagugcuaaag

SEQ ID NO: 307503 - RNA, 32 nt, Human
acuuccacacuauuuauuuggggaugggcugg

SEQ ID NO: 307504 - RNA, 32 nt, Human
acuuccacacuuguggaaggguaguguuguuu

SEQ ID NO: 307505 - RNA, 32 nt, Human
acuuccaccaacaaugggaugagacuugacau

SEQ ID NO: 307506 - RNA, 32 nt, Human
acuuccaccaucaaguuaugagugugauuguu

SEQ ID NO: 307507 - RNA, 22 nt, Human
acuuccaccgaugaggcaggua

SEQ ID NO: 307508 - RNA, 32 nt, Human
acuuccaccucccagguucaagcgauucuuau

SEQ ID NO: 307509 - RNA, 32 nt, Human
acuuccaccucccagguucaagugauucuccu

SEQ ID NO: 307510 - RNA, 32 nt, Human
acuuccaccucccggguucaagcgauccugcc

SEQ ID NO: 307511 - RNA, 32 nt, Human
acuuccaccuccuggguucaagcaauucuccu

SEQ ID NO: 307512 - RNA, 32 nt, Human
acuuccaccuccuggguugaagcaauucuucu

SEQ ID NO: 307513 - RNA, 32 nt, Human
acuuccaccuuccaccaugggaugacgcagua

SEQ ID NO: 307514 - RNA, 32 nt, Human
acuuccacguaagaagugccuuuugccuccca

SEQ ID NO: 307515 - RNA, 32 nt, Human
acuuccacuccccucuacucucucuaggacug

SEQ ID NO: 307516 - RNA, 32 nt, Human
acuuccacuucccagguucaagugauucuccu

SEQ ID NO: 307517 - RNA, 32 nt, Human
acuuccacuucccggguucaagcgauucuccu

SEQ ID NO: 307518 - RNA, 32 nt, Human
acuuccagaaaugacuuuagacugccuuucac

SEQ ID NO: 307519 - RNA, 32 nt, Human
acuuccagacagacugcuuuuccccagucggu

SEQ ID NO: 307520 - RNA, 32 nt, Human
acuuccagaggaggaauuaaugagcgaccuga

SEQ ID NO: 307521 - RNA, 32 nt, Human
acuuccagauuuauacagucuuccuguggaag

SEQ ID NO: 307522 - RNA, 32 nt, Human
acuuccagcaggcaugcaguccuggcccagcu

SEQ ID NO: 307523 - RNA, 32 nt, Human
acuuccagccagucugcugccugcucccucuu

SEQ ID NO: 307524 - RNA, 32 nt, Human
acuuccagcccaaagaacuuauuuuuauuucg

SEQ ID NO: 307525 - RNA, 32 nt, Human
acuuccagccccggaggcgccggacagagccg

SEQ ID NO: 307526 - RNA, 32 nt, Human
acuuccagcccugucugcugucuacguggugg

SEQ ID NO: 307527 - RNA, 32 nt, Human
acuuccagccuccagccuacuuagugaccagc

SEQ ID NO: 307528 - RNA, 32 nt, Human
acuuccagccucuucuccuuguggcucucuug

SEQ ID NO: 307529 - RNA, 32 nt, Human
acuuccagccugggugacacagugagacccug

SEQ ID NO: 307530 - RNA, 32 nt, Human
acuuccagccugggugacagagugagacccug

SEQ ID NO: 307531 - RNA, 32 nt, Human
acuuccagcuccuggguucgaacgauucuccu

SEQ ID NO: 307532 - RNA, 30 nt, Human
acuuccagcuugcacaaggaaauacuggga

SEQ ID NO: 307533 - RNA, 32 nt, Human
acuuccaggaccaccgcaacagagccauggag

SEQ ID NO: 307534 - RNA, 32 nt, Human
acuuccaggagacagagccaccagcagcaaaa

SEQ ID NO: 307535 - RNA, 32 nt, Human
acuuccaguagggguggccgggcagaggcgcc

SEQ ID NO: 307536 - RNA, 32 nt, Human
acuuccaucaaaagacaccauagcaucacauc

SEQ ID NO: 307537 - RNA, 32 nt, Human
acuuccaucuucugcaggguuagugauacaga

SEQ ID NO: 307538 - RNA, 32 nt, Human
acuuccaucuuggucugaaguccugagcucag

SEQ ID NO: 307539 - RNA, 32 nt, Human
acuuccaugccuuaaaccuaccucccacacuc

SEQ ID NO: 307540 - RNA, 32 nt, Human
acuuccauucaagccaaugucaaguuuucauu

SEQ ID NO: 307541 - RNA, 32 nt, Human
acuucccaagcccuggugaccagaccaaggca

SEQ ID NO: 307542 - RNA, 32 nt, Human
acuucccacaaaccucaacaugugccagucac

SEQ ID NO: 307543 - RNA, 32 nt, Human
acuucccagaucaagaaauggacagcauuauc

SEQ ID NO: 307544 - RNA, 32 nt, Human
acuucccagcagagcggguugcuggagccaag

SEQ ID NO: 307545 - RNA, 21 nt, Human
acuucccagcaguucaguggu

SEQ ID NO: 307546 - RNA, 32 nt, Human
acuucccagcaguucagugguggaauggcagc

SEQ ID NO: 307547 - RNA, 32 nt, Human
acuucccagccccucuggggcagcaucugggu

SEQ ID NO: 307548 - RNA, 21 nt, Human
acuucccagcccuggccucca

SEQ ID NO: 307549 - RNA, 32 nt, Human
acuucccaguuuccuuucaguaaucuuucuga

SEQ ID NO: 307550 - RNA, 32 nt, Human
acuucccauauuucuuuucuuugcccuccuga

SEQ ID NO: 307551 - RNA, 32 nt, Human
acuuccccaaccagggcagaaaugagguggga

SEQ ID NO: 307552 - RNA, 32 nt, Human
acuuccccagauagaaacacugggacaguggu

SEQ ID NO: 307553 - RNA, 32 nt, Human
acuuccccaggaaccccguaccagccuguuga

SEQ ID NO: 307554 - RNA, 32 nt, Human
acuuccccaucuucuccucuauucuggucucc

SEQ ID NO: 307555 - RNA, 32 nt, Human
acuucccccacccuccucucuuggauaugguu

SEQ ID NO: 307556 - RNA, 17 nt, Human
acuuccccccugcuugc

SEQ ID NO: 307557 - RNA, 32 nt, Human
acuucccccuccugcaggggauccggguccau

SEQ ID NO: 307558 - RNA, 32 nt, Human
acuuccccucccaccagcugagaauguaugga

SEQ ID NO: 307559 - RNA, 32 nt, Human
acuuccccuccccaucuucccacuuaauuucu

SEQ ID NO: 307560 - RNA, 32 nt, Human
acuuccccuccccuuuccucuccagcauuagg

SEQ ID NO: 307561 - RNA, 32 nt, Human
acuuccccuccugggucaccucugauggcugc

SEQ ID NO: 307562 - RNA, 32 nt, Human
acuuccccuuccccaauuacuauucccuuuga

SEQ ID NO: 307563 - RNA, 32 nt, Human
acuuccccuuggggcucccugugucagggcac

SEQ ID NO: 307564 - RNA, 32 nt, Human
acuuccccuuguauuugaagucuuccagcaag

SEQ ID NO: 307565 - RNA, 32 nt, Human
acuucccgagaggcucccuucuggccucuccu

SEQ ID NO: 307566 - RNA, 32 nt, Human
acuucccgaguugucugccucuccucaaaugc

SEQ ID NO: 307567 - RNA, 32 nt, Human
acuucccgcuguuccucgccacgcucuggguc

SEQ ID NO: 307568 - RNA, 22 nt, Human
acuucccggccgcgacgcaggg

SEQ ID NO: 307569 - RNA, 32 nt, Human
acuucccuaaauccuacucuggcuucagaaag

SEQ ID NO: 307570 - RNA, 32 nt, Human
acuucccuauccacccacugucaucuccauua

SEQ ID NO: 307571 - RNA, 32 nt, Human
acuucccuccacccccacaccccagccguguc

SEQ ID NO: 307572 - RNA, 32 nt, Human
acuucccuccacuccuauguguaucccaggac

SEQ ID NO: 307573 - RNA, 32 nt, Human
acuucccucccggcuuuuccucccgacuuauc

SEQ ID NO: 307574 - RNA, 32 nt, Human
acuucccucucaaagacuaacccagaagggaa

SEQ ID NO: 307575 - RNA, 32 nt, Human
acuucccucuccugcgcuuccuccuggagucc

SEQ ID NO: 307576 - RNA, 32 nt, Human
acuucccugaggccucuggacccaucugucuu

SEQ ID NO: 307577 - RNA, 32 nt, Human
acuucccugcaacccauccaccccugguuucu

SEQ ID NO: 307578 - RNA, 32 nt, Human
acuucccugcagcugcaggccuggugagacaa

SEQ ID NO: 307579 - RNA, 32 nt, Human
acuucccugccugccaucccucugucucucuc

SEQ ID NO: 307580 - RNA, 32 nt, Human
acuucccuuccauacauuauuugaggcugggc

SEQ ID NO: 307581 - RNA, 32 nt, Human
acuucccuugaacugccuugucuuugucaugg

SEQ ID NO: 307582 - RNA, 32 nt, Human
acuucccuuuucucccacccucuuuuccaagc

SEQ ID NO: 307583 - RNA, 32 nt, Human
acuuccgaacuccagccaccacuuuccugugc

SEQ ID NO: 307584 - RNA, 32 nt, Human
acuuccgacucccagguucaagcgauucuccu

SEQ ID NO: 307585 - RNA, 32 nt, Human
acuuccgagagaaaaggggcagcuggaggcag

SEQ ID NO: 307586 - RNA, 32 nt, Human
acuuccgaguagcugggacuacaggcaugagu

SEQ ID NO: 307587 - RNA, 32 nt, Human
acuuccgaguggcugggauuacaggcgcccgc

SEQ ID NO: 307588 - RNA, 32 nt, Human
acuuccgcaucccagguucaagcgauucuccc

SEQ ID NO: 307589 - RNA, 32 nt, Human
acuuccgccucccggguucaagcgauucuccu

SEQ ID NO: 307590 - RNA, 32 nt, Human
acuuccgccucccgguuucaagcaguucucca

SEQ ID NO: 307591 - RNA, 32 nt, Human
acuuccgccuccuggguucaagcaauucuccu

SEQ ID NO: 307592 - RNA, 32 nt, Human
acuuccgccuccuguguucaagcgauucuccu

SEQ ID NO: 307593 - RNA, 32 nt, Human
acuuccgcuucccagguucaagcaauuuuccu

SEQ ID NO: 307594 - RNA, 32 nt, Human
acuuccggacacacaugcacacacaggugcag

SEQ ID NO: 307595 - RNA, 32 nt, Human
acuuccggcuuauggucuccaggcccuucucc

SEQ ID NO: 307596 - RNA, 32 nt, Human
acuuccgggcccugcguggcaguugaaagagu

SEQ ID NO: 307597 - RNA, 32 nt, Human
acuuccggggccgccacuuucacuuucucuuc

SEQ ID NO: 307598 - RNA, 32 nt, Human
acuuccggguaauccagcacccugaggcuuca

SEQ ID NO: 307599 - RNA, 32 nt, Human
acuuccggguuggccuucuccauguuggucuc

SEQ ID NO: 307600 - RNA, 32 nt, Human
acuuccgugguuuugcugucauuucucuugau

SEQ ID NO: 307601 - RNA, 32 nt, Human
acuuccuaagcacugcccugccccauggggug

SEQ ID NO: 307602 - RNA, 32 nt, Human
acuuccuacagagccaaaaugccauuuagcaa

SEQ ID NO: 307603 - RNA, 32 nt, Human
acuuccuaccucccccuccaucucuagauaag

SEQ ID NO: 307604 - RNA, 32 nt, Human
acuuccuagcuaauacccacacugaguccucu

SEQ ID NO: 307605 - RNA, 32 nt, Human
acuuccuaugugugcauugggguggggcuugg

SEQ ID NO: 307606 - RNA, 32 nt, Human
acuuccucaaagcccaaagccaagggaaggau

SEQ ID NO: 307607 - RNA, 21 nt, Human
acuuccucacuauccucuuca

SEQ ID NO: 307608 - RNA, 32 nt, Human
acuuccucagcccgagggcugcccuuccaaac

SEQ ID NO: 307609 - RNA, 32 nt, Human
acuuccuccagccucaggcagccacggcaaug

SEQ ID NO: 307610 - RNA, 32 nt, Human
acuuccuccccucgcccaucagugccagcccc

SEQ ID NO: 307611 - RNA, 32 nt, Human
acuuccucccugggguaucuccaccucuccaa

SEQ ID NO: 307612 - RNA, 32 nt, Human
acuuccucccuguccuccgugccuccugccuc

SEQ ID NO: 307613 - RNA, 32 nt, Human
acuuccuccuacucucauuggccucuuggugc

SEQ ID NO: 307614 - RNA, 32 nt, Human
acuuccuccuccuccuccucaugaccggggug

SEQ ID NO: 307615 - RNA, 32 nt, Human
acuuccucgucuuccagggaaggaaggaugug

SEQ ID NO: 307616 - RNA, 32 nt, Human
acuuccucuaacuccaguggauuguuggccau

SEQ ID NO: 307617 - RNA, 32 nt, Human
acuuccucucaauguuuucuucauauaucugg

SEQ ID NO: 307618 - RNA, 32 nt, Human
acuuccucuccaggaauccgcggagggagcgc

SEQ ID NO: 307619 - RNA, 32 nt, Human
acuuccucugcauuuccagccugaacagaugu

SEQ ID NO: 307620 - RNA, 32 nt, Human
acuuccucugccugccccuccuccuccuucca

SEQ ID NO: 307621 - RNA, 32 nt, Human
acuuccucugcuggucuggccuggugacucuc

SEQ ID NO: 307622 - RNA, 20 nt, Human
acuuccucugucaagguguu

SEQ ID NO: 307623 - RNA, 32 nt, Human
acuuccucuguggcugcucugccuccucccac

SEQ ID NO: 307624 - RNA, 32 nt, Human
acuuccucuuucucucccuccucccuguuuua

SEQ ID NO: 307625 - RNA, 32 nt, Human
acuuccugaccuugugcagauccugccaguaa

SEQ ID NO: 307626 - RNA, 19 nt, Human
acuuccugagaaggacaga

SEQ ID NO: 307627 - RNA, 32 nt, Human
acuuccugagccagacccagggcuaccugcgg

SEQ ID NO: 307628 - RNA, 32 nt, Human
acuuccugagucugugucacaguguguccuca

SEQ ID NO: 307629 - RNA, 32 nt, Human
acuuccugauaaugugucagaaaccuuaaaca

SEQ ID NO: 307630 - RNA, 32 nt, Human
acuuccugcgccugccuucuccuugaaaccuu

SEQ ID NO: 307631 - RNA, 32 nt, Human
acuuccugcugcacuccugucuugccaugcac

SEQ ID NO: 307632 - RNA, 32 nt, Human
acuuccuggaacugccuuucuuccacuaacag

SEQ ID NO: 307633 - RNA, 32 nt, Human
acuuccuggagcugucuuugcuggaggccgag

SEQ ID NO: 307634 - RNA, 32 nt, Human
acuuccuggcugcuucaccuuugcauagcugg

SEQ ID NO: 307635 - RNA, 24 nt, Human
acuuccugggaggucagagacaaa

SEQ ID NO: 307636 - RNA, 21 nt, Human
acuuccugggaguguuaacaa

SEQ ID NO: 307637 - RNA, 32 nt, Human
acuuccugguaucucuguaucuguaaaaugag

SEQ ID NO: 307638 - RNA, 32 nt, Human
acuuccuggucaccaaggcagugcaugcaugu

SEQ ID NO: 307639 - RNA, 32 nt, Human
acuuccuggugcaagauugcagccaggaggcu

SEQ ID NO: 307640 - RNA, 32 nt, Human
acuuccuggugggauccgagugaggcgacggg

SEQ ID NO: 307641 - RNA, 32 nt, Human
acuuccuguacgucaacucaucuggcuccaag

SEQ ID NO: 307642 - RNA, 20 nt, Human
acuuccugucccuuucaggg

SEQ ID NO: 307643 - RNA, 32 nt, Human
acuuccuguggguucacagcuguggggaccca

SEQ ID NO: 307644 - RNA, 32 nt, Human
acuuccugugugacccuggacaaguacuaccu

SEQ ID NO: 307645 - RNA, 32 nt, Human
acuuccugugugaccuugagccaguugaugaa

SEQ ID NO: 307646 - RNA, 32 nt, Human
acuuccuuagugccauucagcucugggccaga

SEQ ID NO: 307647 - RNA, 32 nt, Human
acuuccuucagggauucucccuaaauuuuagc

SEQ ID NO: 307648 - RNA, 32 nt, Human
acuuccuucccaacaccuccuucccaaacccc

SEQ ID NO: 307649 - RNA, 32 nt, Human
acuuccuucccaucaguucuguguugaguugc

SEQ ID NO: 307650 - RNA, 32 nt, Human
acuuccuucccuccucccaaaaugccuccacu

SEQ ID NO: 307651 - RNA, 32 nt, Human
acuuccuucguggaggaaguggacucgaaucc

SEQ ID NO: 307652 - RNA, 32 nt, Human
acuuccuucucaucuuuuucuccauguuuuau

SEQ ID NO: 307653 - RNA, 32 nt, Human
acuuccuugcccacuguuucuuccuuucugug

SEQ ID NO: 307654 - RNA, 32 nt, Human
acuuccuuggggucuuucucuagggucucuuc

SEQ ID NO: 307655 - RNA, 32 nt, Human
acuuccuuuauuucuuuauuccuuccuuuucc

SEQ ID NO: 307656 - RNA, 32 nt, Human
acuuccuuugcccuuuuucccuuuucuccaug

SEQ ID NO: 307657 - RNA, 32 nt, Human
acuuccuuuucuaccaccacacuacugccccc

SEQ ID NO: 307658 - RNA, 32 nt, Human
acuuccuuuuuaaaaugcuuuccucuucuugu

SEQ ID NO: 307659 - RNA, 32 nt, Human
acuuccuuuuuccgcaguugugauggguuuug

SEQ ID NO: 307660 - RNA, 32 nt, Human
acuucgaaugugcacauugaccccugacaccu

SEQ ID NO: 307661 - RNA, 32 nt, Human
acuucgagggccuccgaccugcacggcccuac

SEQ ID NO: 307662 - RNA, 32 nt, Human
acuucgaggggcuuuaccaggaauggugacug

SEQ ID NO: 307663 - RNA, 32 nt, Human
acuucgcacacacccauguaaccacugcacuu

SEQ ID NO: 307664 - RNA, 32 nt, Human
acuucgccacucucucuucuccuuccuaaccc

SEQ ID NO: 307665 - RNA, 32 nt, Human
acuucgccuccccucacuggucuccccuguga

SEQ ID NO: 307666 - RNA, 32 nt, Human
acuucgccuuuccuucuccggcugccaagcag

SEQ ID NO: 307667 - RNA, 32 nt, Human
acuucgccuuucucucggccuuagcgccauuu

SEQ ID NO: 307668 - RNA, 32 nt, Human
acuucggacucuuccagguucacugaggggcc

SEQ ID NO: 307669 - RNA, 32 nt, Human
acuucggacucuuccagguucacugggggccc

SEQ ID NO: 307670 - RNA, 32 nt, Human
acuucggauccuucuaacccuaccacccaacu

SEQ ID NO: 307671 - RNA, 32 nt, Human
acuucggauucagugggugaagacagaacucu

SEQ ID NO: 307672 - RNA, 32 nt, Human
acuucggcaggcguguguuacaguggagucag

SEQ ID NO: 307673 - RNA, 32 nt, Human
acuucggcguugggugaaagaaaauggcccga

SEQ ID NO: 307674 - RNA, 32 nt, Human
acuucggcuccucuaaccugugccacagguga

SEQ ID NO: 307675 - RNA, 23 nt, Human
acuucggcuucucggccggucgg

SEQ ID NO: 307676 - RNA, 32 nt, Human
acuucggggacugaggugggaggaucacuuga

SEQ ID NO: 307677 - RNA, 32 nt, Human
acuucggggcugggaagucguccuuacuccug

SEQ ID NO: 307678 - RNA, 24 nt, Human
acuucggggucuccaccccaggcc

SEQ ID NO: 307679 - RNA, 32 nt, Human
acuucgguuuggacuguggucgugcugaggca

SEQ ID NO: 307680 - RNA, 32 nt, Human
acuucgugucugcugagagcaaccagaccuuc

SEQ ID NO: 307681 - RNA, 32 nt, Human
acuucguuaggcagagagaggaagggauuccu

SEQ ID NO: 307682 - RNA, 32 nt, Human
acuucuaaaaggcauuagccaggcaauggaga

SEQ ID NO: 307683 - RNA, 32 nt, Human
acuucuaagaccugcacaggaggcagaagccc

SEQ ID NO: 307684 - RNA, 32 nt, Human
acuucuaagagugcugcuacagcagcguaguc

SEQ ID NO: 307685 - RNA, 32 nt, Human
acuucuaagaguuuuccuguaaguaauuaaga

SEQ ID NO: 307686 - RNA, 32 nt, Human
acuucuaagcucuucuucuuccuucauuggcc

SEQ ID NO: 307687 - RNA, 32 nt, Human
acuucuaaggacgccauucagagcagagcauu

SEQ ID NO: 307688 - RNA, 19 nt, Human
acuucuacaagaagaaauc

SEQ ID NO: 307689 - RNA, 32 nt, Human
acuucuacaagaaguacaacucagggagagcu

SEQ ID NO: 307690 - RNA, 32 nt, Human
acuucuacagaagcagguugcagugagccgag

SEQ ID NO: 307691 - RNA, 32 nt, Human
acuucuacagcuugaugccuccugcuuuuaua

SEQ ID NO: 307692 - RNA, 32 nt, Human
acuucuacauauaguggaaaucugccaauacu

SEQ ID NO: 307693 - RNA, 32 nt, Human
acuucuaccaccuagguucaagcgauucuugu

SEQ ID NO: 307694 - RNA, 32 nt, Human
acuucuacuacaagugagaugguaguguuuga

SEQ ID NO: 307695 - RNA, 32 nt, Human
acuucuacuucugcccuugccaacggagagcg

SEQ ID NO: 307696 - RNA, 32 nt, Human
acuucuagauagaaugaaugaaaacaacacaa

SEQ ID NO: 307697 - RNA, 32 nt, Human
acuucuagaugccaaguaaaucacagcaagug

SEQ ID NO: 307698 - RNA, 23 nt, Human
acuucuagccuggguuacagagu

SEQ ID NO: 307699 - RNA, 32 nt, Human
acuucuagcuuggaauagcuuguacacauaua

SEQ ID NO: 307700 - RNA, 32 nt, Human
acuucuaggaggaugcugugccucccaagcuc

SEQ ID NO: 307701 - RNA, 32 nt, Human
acuucuaggagggccaguguuccuaguguggg

SEQ ID NO: 307702 - RNA, 32 nt, Human
acuucuaggaguagugaaagaaaacccugaaa

SEQ ID NO: 307703 - RNA, 32 nt, Human
acuucuauagcccucugugucgguccccagug

SEQ ID NO: 307704 - RNA, 32 nt, Human
acuucucaaacuuggaaaugcaugcgaaucac

SEQ ID NO: 307705 - RNA, 32 nt, Human
acuucucaacaaucuagcaccaugucggacac

SEQ ID NO: 307706 - RNA, 32 nt, Human
acuucucaauaugcuuauuuugcuuugcauaa

SEQ ID NO: 307707 - RNA, 32 nt, Human
acuucucacaugcugcuuaagggagcacaaau

SEQ ID NO: 307708 - RNA, 23 nt, Human
acuucucacuuccuaaguucccu

SEQ ID NO: 307709 - RNA, 32 nt, Human
acuucucagacacuucccccacccucauagaa

SEQ ID NO: 307710 - RNA, 32 nt, Human
acuucucagcgccucuggagcgagucccguug

SEQ ID NO: 307711 - RNA, 32 nt, Human
acuucucagggacuacacuugguaguuuucca

SEQ ID NO: 307712 - RNA, 32 nt, Human
acuucucagguuuuuauuuaauucuuuuaaaa

SEQ ID NO: 307713 - RNA, 32 nt, Human
acuucucaguaggaaggggugaggcagcuguc

SEQ ID NO: 307714 - RNA, 32 nt, Human
acuucuccaacaaguaccugugaacaguacag

SEQ ID NO: 307715 - RNA, 21 nt, Human
acuucuccacugucccguuca

SEQ ID NO: 307716 - RNA, 32 nt, Human
acuucuccagcaacacuccaucagcuuuuuaa

SEQ ID NO: 307717 - RNA, 32 nt, Human
acuucuccaguggauugaggcagugcucccuc

SEQ ID NO: 307718 - RNA, 32 nt, Human
acuucuccauaauuauuguuguaauauuauua

SEQ ID NO: 307719 - RNA, 19 nt, Human
acuucuccauaguccugcu

SEQ ID NO: 307720 - RNA, 32 nt, Human
acuucucccacuguccucucccacccaagcuc

SEQ ID NO: 307721 - RNA, 32 nt, Human
acuucuccccacucacacuccccaccaaauaa

SEQ ID NO: 307722 - RNA, 32 nt, Human
acuucucccccaaaaccagagccaccugccag

SEQ ID NO: 307723 - RNA, 32 nt, Human
acuucucccgcggcccagaauccacuugaccc

SEQ ID NO: 307724 - RNA, 32 nt, Human
acuucuccucacgugugcccugguuuuauggg

SEQ ID NO: 307725 - RNA, 32 nt, Human
acuucuccuccuccuuucuccagccagcccug

SEQ ID NO: 307726 - RNA, 22 nt, Human
acuucucuauggaauccuuaga

SEQ ID NO: 307727 - RNA, 32 nt, Human
acuucucucauuuugccacauuuacuuuagua

SEQ ID NO: 307728 - RNA, 32 nt, Human
acuucucucucccaucaccuugcccucauugu

SEQ ID NO: 307729 - RNA, 32 nt, Human
acuucucucucccugcucuugcccagggagca

SEQ ID NO: 307730 - RNA, 32 nt, Human
acuucucucucccuucuucucucucugacaca

SEQ ID NO: 307731 - RNA, 32 nt, Human
acuucucugcaagccugacuccugaaacugug

SEQ ID NO: 307732 - RNA, 32 nt, Human
acuucucugcaagccugacuccugagacugug

SEQ ID NO: 307733 - RNA, 32 nt, Human
acuucucugccugguuuuguguguucuguuau

SEQ ID NO: 307734 - RNA, 21 nt, Human
acuucucugcugacucucaga

SEQ ID NO: 307735 - RNA, 32 nt, Human
acuucucugcugucagucuuuguuucucccag

SEQ ID NO: 307736 - RNA, 32 nt, Human
acuucucugcuuccuccacguccuaacgauuc

SEQ ID NO: 307737 - RNA, 32 nt, Human
acuucucuggaccacaguccucugccagaccc

SEQ ID NO: 307738 - RNA, 32 nt, Human
acuucucugggguuugccuuguggaaccaagu

SEQ ID NO: 307739 - RNA, 32 nt, Human
acuucucuguaaucucagcuucucaggaggcu

SEQ ID NO: 307740 - RNA, 18 nt, Human
acuucucuguaauuuccu

SEQ ID NO: 307741 - RNA, 32 nt, Human
acuucucugucuguccaaagguuuuugagagu

SEQ ID NO: 307742 - RNA, 32 nt, Human
acuucucuucauaaagucauugugcuuccucu

SEQ ID NO: 307743 - RNA, 32 nt, Human
acuucucuugaacaaggaacucacucagagac

SEQ ID NO: 307744 - RNA, 32 nt, Human
acuucucuuucaaagauggacuggggaaagac

SEQ ID NO: 307745 - RNA, 32 nt, Human
acuucugaacaucaguauguucgaggguacua

SEQ ID NO: 307746 - RNA, 32 nt, Human
acuucugaacugccuucgucuucaguuauaug

SEQ ID NO: 307747 - RNA, 32 nt, Human
acuucugaacuuuggcccugagcuccauucuu

SEQ ID NO: 307748 - RNA, 32 nt, Human
acuucugaaggaagauggaaugaccaaacugg

SEQ ID NO: 307749 - RNA, 32 nt, Human
acuucugaagugaauguggauacagcgccacu

SEQ ID NO: 307750 - RNA, 32 nt, Human
acuucugacuccaaguccagaguucuuuacua

SEQ ID NO: 307751 - RNA, 32 nt, Human
acuucugacucugccagcaucuuugaccucug

SEQ ID NO: 307752 - RNA, 32 nt, Human
acuucugagguacgguaucucucuccagccac

SEQ ID NO: 307753 - RNA, 32 nt, Human
acuucugagguauuuucaugaucccaccaugg

SEQ ID NO: 307754 - RNA, 21 nt, Human
acuucugauggagaagcagug

SEQ ID NO: 307755 - RNA, 32 nt, Human
acuucugcacaggcuccuuccugcuuuguagg

SEQ ID NO: 307756 - RNA, 32 nt, Human
acuucugcagaguuugccccagaauucagagu

SEQ ID NO: 307757 - RNA, 31 nt, Human
acuucugcauuuaaggaggucugggagaagg

SEQ ID NO: 307758 - RNA, 32 nt, Human
acuucugcauuuuccuucucucaaguuaaauu

SEQ ID NO: 307759 - RNA, 32 nt, Human
acuucugccacccagguucaagcaauucuccu

SEQ ID NO: 307760 - RNA, 32 nt, Human
acuucugccauauucuguuggccagugugaca

SEQ ID NO: 307761 - RNA, 32 nt, Human
acuucugcccuuucccuuccuccuccucuucu

SEQ ID NO: 307762 - RNA, 32 nt, Human
acuucugccuccuggguucaagcgauuccccu

SEQ ID NO: 307763 - RNA, 32 nt, Human
acuucugccuccuggguucaagcgauucuccu

SEQ ID NO: 307764 - RNA, 32 nt, Human
acuucugccuuccagguucaagcgauucuccu

SEQ ID NO: 307765 - RNA, 32 nt, Human
acuucugcucacaacugcccagucccagccag

SEQ ID NO: 307766 - RNA, 32 nt, Human
acuucugcucaucaaauugcugugauagugaa

SEQ ID NO: 307767 - RNA, 32 nt, Human
acuucugcucccaguaacccaucguuagggca

SEQ ID NO: 307768 - RNA, 32 nt, Human
acuucugcugcugcuaugccucuuggaugcac

SEQ ID NO: 307769 - RNA, 32 nt, Human
acuucugcuuguguuggagugcagagggugca

SEQ ID NO: 307770 - RNA, 32 nt, Human
acuucugcuuucuaaccccaguuccuuaaaua

SEQ ID NO: 307771 - RNA, 32 nt, Human
acuucugcuuugcacuauguucacuuuggggu

SEQ ID NO: 307772 - RNA, 32 nt, Human
acuucuggaagggagaguggauuuggcugggc

SEQ ID NO: 307773 - RNA, 19 nt, Human
acuucuggaggugcugggg

SEQ ID NO: 307774 - RNA, 32 nt, Human
acuucuggccacacugacucagucccaguaac

SEQ ID NO: 307775 - RNA, 32 nt, Human
acuucuggccucaagugauccaccuaccuagu

SEQ ID NO: 307776 - RNA, 32 nt, Human
acuucuggccuuuccuagcuagagaaggaguu

SEQ ID NO: 307777 - RNA, 32 nt, Human
acuucugggacccccuuuccuccacagagccc

SEQ ID NO: 307778 - RNA, 32 nt, Human
acuucugggcuucaguuuucucaucuguaaaa

SEQ ID NO: 307779 - RNA, 32 nt, Human
acuucuggggaaggaaaacaggcuccuggccu

SEQ ID NO: 307780 - RNA, 32 nt, Human
acuucugggggugaggugggaggaucacguga

SEQ ID NO: 307781 - RNA, 32 nt, Human
acuucuggucccagcauuuccuccuuuggccu

SEQ ID NO: 307782 - RNA, 32 nt, Human
acuucuggucucaagcaaucugcccgccucgg

SEQ ID NO: 307783 - RNA, 32 nt, Human
acuucuggugcuggaacauuguucuuuuucug

SEQ ID NO: 307784 - RNA, 32 nt, Human
acuucugguucuguagaaagagcuaggggagg

SEQ ID NO: 307785 - RNA, 32 nt, Human
acuucugguuggggcucucuuuacuuacugcu

SEQ ID NO: 307786 - RNA, 32 nt, Human
acuucuguauuagcugggcagccuuggguucu

SEQ ID NO: 307787 - RNA, 19 nt, Human
acuucugugacuucauuga

SEQ ID NO: 307788 - RNA, 32 nt, Human
acuucugugaguuuagaccugccccucccacc

SEQ ID NO: 307789 - RNA, 32 nt, Human
acuucugugcugcugcuucuccuccaucuugc

SEQ ID NO: 307790 - RNA, 32 nt, Human
acuucugugcugcuugcagucauagcuuuccu

SEQ ID NO: 307791 - RNA, 32 nt, Human
acuucuguucagauuagccugaucuaguauug

SEQ ID NO: 307792 - RNA, 32 nt, Human
acuucuguugcccuugugcuccagucauugca

SEQ ID NO: 307793 - RNA, 32 nt, Human
acuucuuagaggcauucaguuagcaaagaggu

SEQ ID NO: 307794 - RNA, 32 nt, Human
acuucuuaucaccuggauucagagagucuggg

SEQ ID NO: 307795 - RNA, 32 nt, Human
acuucuuaucaucugcauauuuauguccuuuu

SEQ ID NO: 307796 - RNA, 32 nt, Human
acuucuuauucaaagcaucaauaauuaaaaga

SEQ ID NO: 307797 - RNA, 32 nt, Human
acuucuucaccgugucuguucuugucacaccu

SEQ ID NO: 307798 - RNA, 32 nt, Human
acuucuucauggggaauuguagacccuaagua

SEQ ID NO: 307799 - RNA, 32 nt, Human
acuucuuccagcccugcugggccacaguucua

SEQ ID NO: 307800 - RNA, 32 nt, Human
acuucuucccagagagaggaagcucugcucag

SEQ ID NO: 307801 - RNA, 32 nt, Human
acuucuucccuaccugcaucaugugcauguag

SEQ ID NO: 307802 - RNA, 32 nt, Human
acuucuucccugcaugcucccucccagugacu

SEQ ID NO: 307803 - RNA, 32 nt, Human
acuucuucccuuaaguuaaaguguuagagaag

SEQ ID NO: 307804 - RNA, 32 nt, Human
acuucuuccuccuccuccuucccugacucaca

SEQ ID NO: 307805 - RNA, 20 nt, Human
acuucuuccugcgcuguggc

SEQ ID NO: 307806 - RNA, 32 nt, Human
acuucuuccuucauugcagccccucuucuuuu

SEQ ID NO: 307807 - RNA, 32 nt, Human
acuucuuccuucucucuuucucuuuacucaug

SEQ ID NO: 307808 - RNA, 32 nt, Human
acuucuuccuuuccuaccccuuuucucuuuua

SEQ ID NO: 307809 - RNA, 32 nt, Human
acuucuucuaacucccauugacauugcuucuu

SEQ ID NO: 307810 - RNA, 32 nt, Human
acuucuucuucaaugcgcuccugcugcugcuc

SEQ ID NO: 307811 - RNA, 32 nt, Human
acuucuugcccaggcuggaguacaauggugcg

SEQ ID NO: 307812 - RNA, 32 nt, Human
acuucuugcugaaugguacucagaugugcauu

SEQ ID NO: 307813 - RNA, 32 nt, Human
acuucuuggaggaggugguggcugggcugcag

SEQ ID NO: 307814 - RNA, 32 nt, Human
acuucuuguuaggauucagggaaggaacaguu

SEQ ID NO: 307815 - RNA, 32 nt, Human
acuucuuuacuacacugcacuggauugcuaua

SEQ ID NO: 307816 - RNA, 22 nt, Human
acuucuuuaucuuuuccuuucu

SEQ ID NO: 307817 - RNA, 32 nt, Human
acuucuuuccaugggcguguucuaagcagccu

SEQ ID NO: 307818 - RNA, 18 nt, Human
acuucuuuccugcugcug

SEQ ID NO: 307819 - RNA, 32 nt, Human
acuucuuuccuggcccccuccuuggucaggcu

SEQ ID NO: 307820 - RNA, 32 nt, Human
acuucuuugccuuuuaaaguguugccuuuauc

SEQ ID NO: 307821 - RNA, 32 nt, Human
acuucuuugggcagaugcuaggucaguuguuu

SEQ ID NO: 307822 - RNA, 32 nt, Human
acuucuuuguaagaacaccaaccaaccaaggu

SEQ ID NO: 307823 - RNA, 32 nt, Human
acuucuuuguaauccaguugcuguuaagaaug

SEQ ID NO: 307824 - RNA, 32 nt, Human
acuucuuuuauugccagaaaugcaaggaacug

SEQ ID NO: 307825 - RNA, 18 nt, Human
acuucuuuuccaaaaaua

SEQ ID NO: 307826 - RNA, 32 nt, Human
acuugaaaaauacuuuuccuuaccuuuacccc

SEQ ID NO: 307827 - RNA, 32 nt, Human
acuugaaacgggaggcggagguugcagugagc

SEQ ID NO: 307828 - RNA, 32 nt, Human
acuugaaaucaucggucucaucucaagucacu

SEQ ID NO: 307829 - RNA, 32 nt, Human
acuugaacauuagagggaaagacugaaagaga

SEQ ID NO: 307830 - RNA, 32 nt, Human
acuugaacauuuccuuucuaucaaucccaggu

SEQ ID NO: 307831 - RNA, 32 nt, Human
acuugaaccaaggagguggagguugcagugag

SEQ ID NO: 307832 - RNA, 32 nt, Human
acuugaacccaagaggcagaguuugcagugag

SEQ ID NO: 307833 - RNA, 32 nt, Human
acuugaacccagaagacagguugcagugagcc

SEQ ID NO: 307834 - RNA, 32 nt, Human
acuugaacccaggaagcgggguugcagugagc

SEQ ID NO: 307835 - RNA, 32 nt, Human
acuugaacccaggagacggagguugcggugag

SEQ ID NO: 307836 - RNA, 32 nt, Human
acuugaacccaggagacggugguugcagugag

SEQ ID NO: 307837 - RNA, 32 nt, Human
acuugaacccaggagaggaagguugcaguaag

SEQ ID NO: 307838 - RNA, 32 nt, Human
acuugaacccaggaggcagagguugcagucag

SEQ ID NO: 307839 - RNA, 32 nt, Human
acuugaacccaggaggcagagguugcagugag

SEQ ID NO: 307840 - RNA, 32 nt, Human
acuugaacccaggaggcagagguugcaguggg

SEQ ID NO: 307841 - RNA, 32 nt, Human
acuugaacccaggaggcagagguugcggugag

SEQ ID NO: 307842 - RNA, 32 nt, Human
acuugaacccaggaggcagcuguugcagugag

SEQ ID NO: 307843 - RNA, 32 nt, Human
acuugaacccaggaggcagugguugcaaugag

SEQ ID NO: 307844 - RNA, 32 nt, Human
acuugaacccaggaggcggaaguugcagugag

SEQ ID NO: 307845 - RNA, 32 nt, Human
acuugaacccaggaggcggagguugcagugaa

SEQ ID NO: 307846 - RNA, 32 nt, Human
acuugaacccaggaggcggagguugcagugag

SEQ ID NO: 307847 - RNA, 32 nt, Human
acuugaacccaggaggcggagguugcggugag

SEQ ID NO: 307848 - RNA, 32 nt, Human
acuugaacccaggagguagaggcugcagugag

SEQ ID NO: 307849 - RNA, 32 nt, Human
acuugaacccaggagguagagguugcagugag

SEQ ID NO: 307850 - RNA, 32 nt, Human
acuugaacccaggagguggagauugcagugag

SEQ ID NO: 307851 - RNA, 32 nt, Human
acuugaacccaggagguggaggcugcggugag

SEQ ID NO: 307852 - RNA, 32 nt, Human
acuugaacccaggagguggagguuacagugag

SEQ ID NO: 307853 - RNA, 32 nt, Human
acuugaacccaggagguggagguugcagcaag

SEQ ID NO: 307854 - RNA, 32 nt, Human
acuugaacccaggagguggagguugcagugag

SEQ ID NO: 307855 - RNA, 32 nt, Human
acuugaacccaggagguggagguuguagugag

SEQ ID NO: 307856 - RNA, 32 nt, Human
acuugaacccaggagguggagguuguggugag

SEQ ID NO: 307857 - RNA, 32 nt, Human
acuugaacccaggagguggugguugcagugag

SEQ ID NO: 307858 - RNA, 32 nt, Human
acuugaacccaggagguguugcagugaaccaa

SEQ ID NO: 307859 - RNA, 32 nt, Human
acuugaacccaggagguugaggcugcagugag

SEQ ID NO: 307860 - RNA, 32 nt, Human
acuugaacccaggaguucaaaucugcagugcg

SEQ ID NO: 307861 - RNA, 32 nt, Human
acuugaacccggaagcgaagguugcagugagc

SEQ ID NO: 307862 - RNA, 32 nt, Human
acuugaacccggaggcggagguugcgguaagc

SEQ ID NO: 307863 - RNA, 32 nt, Human
acuugaacccgggaggcggaggcugcagugag

SEQ ID NO: 307864 - RNA, 32 nt, Human
acuugaacccgggagguggaggcugcagugag

SEQ ID NO: 307865 - RNA, 32 nt, Human
acuugaaccgggaagugggaggacguagagca

SEQ ID NO: 307866 - RNA, 32 nt, Human
acuugaaccggggaguuggagguugcagugag

SEQ ID NO: 307867 - RNA, 32 nt, Human
acuugaaccuaggaggucgaggcugcagugag

SEQ ID NO: 307868 - RNA, 32 nt, Human
acuugaaccuggagacagagguugcagugagc

SEQ ID NO: 307869 - RNA, 32 nt, Human
acuugaaccuggaggcagagguugcagugagu

SEQ ID NO: 307870 - RNA, 32 nt, Human
acuugaaccugggaggcggaggcugcagugag

SEQ ID NO: 307871 - RNA, 32 nt, Human
acuugaacuaggaggcagagguugcagugagc

SEQ ID NO: 307872 - RNA, 32 nt, Human
acuugaacucaggagguggagguugcagugag

SEQ ID NO: 307873 - RNA, 32 nt, Human
acuugaacucuguucccccacccuccaugcuc

SEQ ID NO: 307874 - RNA, 32 nt, Human
acuugaacuucugaugcuuuuauugcccaguu

SEQ ID NO: 307875 - RNA, 32 nt, Human
acuugaagcagaggacacucagacaagcugca

SEQ ID NO: 307876 - RNA, 32 nt, Human
acuugaagcuaggaguuugagguuugaagaug

SEQ ID NO: 307877 - RNA, 32 nt, Human
acuugaaggcaccuccagcauuggcccagcag

SEQ ID NO: 307878 - RNA, 32 nt, Human
acuugaaggcagcacagaggugagggauuaaa

SEQ ID NO: 307879 - RNA, 32 nt, Human
acuugaaggcaguuugaaagacuuguuuuaca

SEQ ID NO: 307880 - RNA, 32 nt, Human
acuugaaguccaggcagaauucuaaugcaaua

SEQ ID NO: 307881 - RNA, 32 nt, Human
acuugaauauucuaaauaaaacugacauuuac

SEQ ID NO: 307882 - RNA, 32 nt, Human
acuugaaucaugcgaaaggggagcuguuggaa

SEQ ID NO: 307883 - RNA, 32 nt, Human
acuugaaucugagagauggaggcugcagugag

SEQ ID NO: 307884 - RNA, 32 nt, Human
acuugaauguacaaagauacuugaugcacuua

SEQ ID NO: 307885 - RNA, 32 nt, Human
acuugaauuacaccacccuagugugaaaucgg

SEQ ID NO: 307886 - RNA, 32 nt, Human
acuugaauucaggagguggagguugcagugag

SEQ ID NO: 307887 - RNA, 32 nt, Human
acuugacacagcacccgacucccaguuucuca

SEQ ID NO: 307888 - RNA, 32 nt, Human
acuugacacauacucuagcaauucauuggaac

SEQ ID NO: 307889 - RNA, 32 nt, Human
acuugacaccaccaccuuccuccaggggaaag

SEQ ID NO: 307890 - RNA, 32 nt, Human
acuugacagguuguguugaugcucuuaguuga

SEQ ID NO: 307891 - RNA, 32 nt, Human
acuugacaugaaaugucagcugugcuggggca

SEQ ID NO: 307892 - RNA, 32 nt, Human
acuugacauuuugauucuccagccugggcaac

SEQ ID NO: 307893 - RNA, 32 nt, Human
acuugaccacugccacaccagcccugggguca

SEQ ID NO: 307894 - RNA, 32 nt, Human
acuugaccauuuucucucuccuuuugcuuaga

SEQ ID NO: 307895 - RNA, 32 nt, Human
acuugacccaggagguggaggucgcagugagc

SEQ ID NO: 307896 - RNA, 32 nt, Human
acuugacccaggaguucaagaccagccuggcc

SEQ ID NO: 307897 - RNA, 20 nt, Human
acuugaccccaggcugaaca

SEQ ID NO: 307898 - RNA, 32 nt, Human
acuugacgucauguggacagugcacgugccuu

SEQ ID NO: 307899 - RNA, 32 nt, Human
acuugacucccacucuugccacuccuagcucc

SEQ ID NO: 307900 - RNA, 32 nt, Human
acuugacucugccucccuggccagccuugcaa

SEQ ID NO: 307901 - RNA, 32 nt, Human
acuugacuguguuugugaaaacugagcauuaa

SEQ ID NO: 307902 - RNA, 32 nt, Human
acuugacuuccucgggcucuucaggagacuga

SEQ ID NO: 307903 - RNA, 32 nt, Human
acuugacuuuggugaaugugcauuacuuccuu

SEQ ID NO: 307904 - RNA, 22 nt, Human
acuugagaaaauaaacuuaugu

SEQ ID NO: 307905 - RNA, 32 nt, Human
acuugagaaauguuucuguuugaagaaaauag

SEQ ID NO: 307906 - RNA, 32 nt, Human
acuugagaaauuccuuuguucuguuauacaaa

SEQ ID NO: 307907 - RNA, 32 nt, Human
acuugagaagucaggauaagaccccuuggaua

SEQ ID NO: 307908 - RNA, 32 nt, Human
acuugagaccaggaaguugaggcugcaaugag

SEQ ID NO: 307909 - RNA, 32 nt, Human
acuugagaggcugaagcagaagaaucucuuga

SEQ ID NO: 307910 - RNA, 32 nt, Human
acuugagaggcugagacacgagaaucacuuga

SEQ ID NO: 307911 - RNA, 32 nt, Human
acuugagaggcugagauaggagaaucacugga

SEQ ID NO: 307912 - RNA, 32 nt, Human
acuugagaggcugagccaggaggaucgcuuga

SEQ ID NO: 307913 - RNA, 32 nt, Human
acuugagaggcugaggcaggaggaucccuuga

SEQ ID NO: 307914 - RNA, 32 nt, Human
acuugagaggcugaggcaggaggauugcuuga

SEQ ID NO: 307915 - RNA, 32 nt, Human
acuugagaggcugaggccggaggauugcuuaa

SEQ ID NO: 307916 - RNA, 32 nt, Human
acuugagaggcugaggcuggaggaucacuuga

SEQ ID NO: 307917 - RNA, 32 nt, Human
acuugagaggcugaggugggaggauugcuuga

SEQ ID NO: 307918 - RNA, 32 nt, Human
acuugagcaaacuuggaccugggaugaggaug

SEQ ID NO: 307919 - RNA, 32 nt, Human
acuugagcacaggaguuggaggauacagugag

SEQ ID NO: 307920 - RNA, 32 nt, Human
acuugagcacaggaguuugaggcugcagugac

SEQ ID NO: 307921 - RNA, 32 nt, Human
acuugagcaguggagagacgucuuuccuaaaa

SEQ ID NO: 307922 - RNA, 32 nt, Human
acuugagccaccaccagucagaggugcaaguu

SEQ ID NO: 307923 - RNA, 32 nt, Human
acuugagccagcugugggauguugcugcagga

SEQ ID NO: 307924 - RNA, 32 nt, Human
acuugagccaggaggaggagguugcagugagc

SEQ ID NO: 307925 - RNA, 32 nt, Human
acuugagcccagaagcucaaggcugcagugag

SEQ ID NO: 307926 - RNA, 32 nt, Human
acuugagcccagaaggucgaggcugcagggag

SEQ ID NO: 307927 - RNA, 32 nt, Human
acuugagcccagaaguucaaggcugcaaugag

SEQ ID NO: 307928 - RNA, 32 nt, Human
acuugagcccaggaagcggagguuacagugag

SEQ ID NO: 307929 - RNA, 32 nt, Human
acuugagcccaggaagucaaggcugcagugag

SEQ ID NO: 307930 - RNA, 32 nt, Human
acuugagcccaggaaguggagguugcagugag

SEQ ID NO: 307931 - RNA, 32 nt, Human
acuugagcccaggaaguugaggcugcagugag

SEQ ID NO: 307932 - RNA, 32 nt, Human
acuugagcccaggaauucaagacuagccugca

SEQ ID NO: 307933 - RNA, 32 nt, Human
acuugagcccaggaauuggaggcugcagugag

SEQ ID NO: 307934 - RNA, 32 nt, Human
acuugagcccaggagauuaagacuguaguaua

SEQ ID NO: 307935 - RNA, 32 nt, Human
acuugagcccaggagauugaggcugcagugag

SEQ ID NO: 307936 - RNA, 32 nt, Human
acuugagcccaggaggaggaggcugcagugag

SEQ ID NO: 307937 - RNA, 32 nt, Human
acuugagcccaggaggccaagguugcaguggg

SEQ ID NO: 307938 - RNA, 32 nt, Human
acuugagcccaggaggcggaggcugcagugag

SEQ ID NO: 307939 - RNA, 32 nt, Human
acuugagcccaggaggucaaggcugcagugag

SEQ ID NO: 307940 - RNA, 32 nt, Human
acuugagcccaggaggucgaggcugcagugag

SEQ ID NO: 307941 - RNA, 32 nt, Human
acuugagcccaggaggucgaggcugcagugug

SEQ ID NO: 307942 - RNA, 32 nt, Human
acuugagcccaggaggucgagguugcagugag

SEQ ID NO: 307943 - RNA, 32 nt, Human
acuugagcccaggaggucuaggcugcagugag

SEQ ID NO: 307944 - RNA, 32 nt, Human
acuugagcccaggagguggaggcugcaaugag

SEQ ID NO: 307945 - RNA, 32 nt, Human
acuugagcccaggagguggagguugcagugag

SEQ ID NO: 307946 - RNA, 32 nt, Human
acuugagcccaggagguggagguuucagcgag

SEQ ID NO: 307947 - RNA, 32 nt, Human
acuugagcccaggagguugaggcugcagugag

SEQ ID NO: 307948 - RNA, 32 nt, Human
acuugagcccaggagucugaggcuucagugag

SEQ ID NO: 307949 - RNA, 32 nt, Human
acuugagcccaggaguuaagaggcugcaguga

SEQ ID NO: 307950 - RNA, 32 nt, Human
acuugagcccaggaguucaaggccagccuggg

SEQ ID NO: 307951 - RNA, 32 nt, Human
acuugagcccaggaguucaaggcuucagugag

SEQ ID NO: 307952 - RNA, 32 nt, Human
acuugagcccaggaguucaggacuagccuggg

SEQ ID NO: 307953 - RNA, 32 nt, Human
acuugagcccaggaguucgagguuacagugaa

SEQ ID NO: 307954 - RNA, 32 nt, Human
acuugagcccaggaguucugggcuguagugca

SEQ ID NO: 307955 - RNA, 32 nt, Human
acuugagcccaggaguuggagaccugccuggg

SEQ ID NO: 307956 - RNA, 32 nt, Human
acuugagcccaggaguuggaggccacagugag

SEQ ID NO: 307957 - RNA, 32 nt, Human
acuugagcccaggaguuggaggccagccuggg

SEQ ID NO: 307958 - RNA, 32 nt, Human
acuugagcccaggaguuggaggccgcagugag

SEQ ID NO: 307959 - RNA, 32 nt, Human
acuugagcccaggaguuugaggccagccuggg

SEQ ID NO: 307960 - RNA, 32 nt, Human
acuugagcccaggaguuugaggcugcagugaa

SEQ ID NO: 307961 - RNA, 32 nt, Human
acuugagcccaggaguuugaggcugcagugag

SEQ ID NO: 307962 - RNA, 32 nt, Human
acuugagcccaggaguuugaggcugcggugag

SEQ ID NO: 307963 - RNA, 32 nt, Human
acuugagcccaggaguuugagguugcagugag

SEQ ID NO: 307964 - RNA, 32 nt, Human
acuugagcccaggcguucgagacuggcauggg

SEQ ID NO: 307965 - RNA, 32 nt, Human
acuugagcccagggaggcagagguugcuguaa

SEQ ID NO: 307966 - RNA, 32 nt, Human
acuugagcccagggguucacagcugcagugag

SEQ ID NO: 307967 - RNA, 32 nt, Human
acuugagccccagaggucaaggcugcagugag

SEQ ID NO: 307968 - RNA, 32 nt, Human
acuugagccccagggguggaggcugcaaugaa

SEQ ID NO: 307969 - RNA, 32 nt, Human
acuugagcccgggagguugaggcugcaguggg

SEQ ID NO: 307970 - RNA, 32 nt, Human
acuugagcccuggagaucgaggcugcaguaag

SEQ ID NO: 307971 - RNA, 32 nt, Human
acuugagccggcugccccgcccacggugcccg

SEQ ID NO: 307972 - RNA, 32 nt, Human
acuugagccuaagagaucaaggcugcagugag

SEQ ID NO: 307973 - RNA, 32 nt, Human
acuugagccuauuaguuggaggcugcaguaag

SEQ ID NO: 307974 - RNA, 32 nt, Human
acuugagccuccauuucuggcuucuagucugg

SEQ ID NO: 307975 - RNA, 32 nt, Human
acuugagccuggaaaagguugcagugagcugg

SEQ ID NO: 307976 - RNA, 32 nt, Human
acuugagccugggaggucaaggcugcaguaag

SEQ ID NO: 307977 - RNA, 32 nt, Human
acuugagccugggaggucaaggcugcagugag

SEQ ID NO: 307978 - RNA, 32 nt, Human
acuugagccugggagguugugguugcagugag

SEQ ID NO: 307979 - RNA, 32 nt, Human
acuugagccugggaugucaaggcugcagugag

SEQ ID NO: 307980 - RNA, 32 nt, Human
acuugagccugggggacugaggcugcagugag

SEQ ID NO: 307981 - RNA, 32 nt, Human
acuugagcggcacagagauuugggggagugaa

SEQ ID NO: 307982 - RNA, 32 nt, Human
acuugagcuacacuaaaccacaugacaguguu

SEQ ID NO: 307983 - RNA, 32 nt, Human
acuugagcuugucaguccacugaguuuccuuc

SEQ ID NO: 307984 - RNA, 21 nt, Human
acuugagcuuuugugauucaa

SEQ ID NO: 307985 - RNA, 32 nt, Human
acuugaggacaguucauauagcaucuggacag

SEQ ID NO: 307986 - RNA, 32 nt, Human
acuugaggagcagagguggcagcagaggauuc

SEQ ID NO: 307987 - RNA, 32 nt, Human
acuugaggccaggaguuuaaggcuagccuggg

SEQ ID NO: 307988 - RNA, 32 nt, Human
acuugaggccaggaguuugaggcugcagugag

SEQ ID NO: 307989 - RNA, 32 nt, Human
acuugaggccuagccuuggaggcugcagugca

SEQ ID NO: 307990 - RNA, 32 nt, Human
acuugaggcuuuuacgcagccucuagucucug

SEQ ID NO: 307991 - RNA, 32 nt, Human
acuugagggaaagaugaauaaaggaauugugc

SEQ ID NO: 307992 - RNA, 32 nt, Human
acuugaggggaaaugguguccugcuggaggga

SEQ ID NO: 307993 - RNA, 32 nt, Human
acuugaggguggcagagaaaaauguguuaaaa

SEQ ID NO: 307994 - RNA, 32 nt, Human
acuugaggucaggaguucaauguggacaacac

SEQ ID NO: 307995 - RNA, 32 nt, Human
acuugaggucaggaguuugagaccagugugca

SEQ ID NO: 307996 - RNA, 32 nt, Human
acuugagguuagaguucugcaagugagaagac

SEQ ID NO: 307997 - RNA, 32 nt, Human
acuugagucaaauccuggauacugccaaagga

SEQ ID NO: 307998 - RNA, 32 nt, Human
acuugaguccaggaggcggaggcugcagugag

SEQ ID NO: 307999 - RNA, 32 nt, Human
acuugaguccaggaguccgagaccagccuggg

SEQ ID NO: 308000 - RNA, 32 nt, Human
acuugagucugaggccccaggcccuaggauuc

SEQ ID NO: 308001 - RNA, 32 nt, Human
acuugagucugauuucagucaucuucagggac

SEQ ID NO: 308002 - RNA, 32 nt, Human
acuugagugaagaugagaauagauccuaugug

SEQ ID NO: 308003 - RNA, 30 nt, Human
acuugaguggucucugagcuccugucauua

SEQ ID NO: 308004 - RNA, 32 nt, Human
acuugaguguaugcaggauuucauuaucugcc

SEQ ID NO: 308005 - RNA, 32 nt, Human
acuugauaaaggacagcucugauggggaccac

SEQ ID NO: 308006 - RNA, 32 nt, Human
acuugauacaauagaagcugacuuuuaaggca

SEQ ID NO: 308007 - RNA, 32 nt, Human
acuugaucacccaggcuagagugcaguggcgu

SEQ ID NO: 308008 - RNA, 32 nt, Human
acuugaucagggacuaacaccaucgccuccca

SEQ ID NO: 308009 - RNA, 32 nt, Human
acuugaucaguucgcuguucugucuuuuggau

SEQ ID NO: 308010 - RNA, 32 nt, Human
acuugaucccaggaggcggagguugcagugag

SEQ ID NO: 308011 - RNA, 31 nt, Human
acuugaucccucucuggccugggucacauuu

SEQ ID NO: 308012 - RNA, 32 nt, Human
acuugaucuggagagcucuggggagccauaga

SEQ ID NO: 308013 - RNA, 32 nt, Human
acuugaucuuacaguauguauguauguaugua

SEQ ID NO: 308014 - RNA, 32 nt, Human
acuugaucuugcuauguuguccaggcugcucu

SEQ ID NO: 308015 - RNA, 32 nt, Human
acuugaugaauaaucuagaugaucagaaaugu

SEQ ID NO: 308016 - RNA, 32 nt, Human
acuugaugacaccucccggaaugcucucgggg

SEQ ID NO: 308017 - RNA, 32 nt, Human
acuugaugacagacacuucuaaaugaagugca

SEQ ID NO: 308018 - RNA, 32 nt, Human
acuugauuaggucaggcccacccaggauaacc

SEQ ID NO: 308019 - RNA, 32 nt, Human
acuugauuccauucucuccaucccuuccaucc

SEQ ID NO: 308020 - RNA, 32 nt, Human
acuugauuccuguuagaaacaggagugguaga

SEQ ID NO: 308021 - RNA, 32 nt, Human
acuugauuggaaaauguuaggauggaccaagg

SEQ ID NO: 308022 - RNA, 32 nt, Human
acuugauuguagauggagucucggucuuucac

SEQ ID NO: 308023 - RNA, 32 nt, Human
acuugauugugccauuuagagggaacucuugg

SEQ ID NO: 308024 - RNA, 32 nt, Human
acuugauuuacacuuccuagucuacauuacau

SEQ ID NO: 308025 - RNA, 23 nt, Human
acuugauuuauuuuccuuuaaaa

SEQ ID NO: 308026 - RNA, 32 nt, Human
acuugauuuuaacugauuccucuccugacccu

SEQ ID NO: 308027 - RNA, 32 nt, Human
acuugcaacaaaaacaaaaauugacagguggg

SEQ ID NO: 308028 - RNA, 32 nt, Human
acuugcaagguggagguuacagugagcugaaa

SEQ ID NO: 308029 - RNA, 23 nt, Human
acuugcaaugaaaaugccccuca

SEQ ID NO: 308030 - RNA, 22 nt, Human
acuugcaauuuuuauucuuaaa

SEQ ID NO: 308031 - RNA, 32 nt, Human
acuugcacaaaggaagucuguucuugguauug

SEQ ID NO: 308032 - RNA, 32 nt, Human
acuugcacaauguugagaaugaguaccacucu

SEQ ID NO: 308033 - RNA, 32 nt, Human
acuugcacacacaagugaguuaacauuucaaa

SEQ ID NO: 308034 - RNA, 20 nt, Human
acuugcacccaacccucuca

SEQ ID NO: 308035 - RNA, 32 nt, Human
acuugcaccuauaaucccagcacuuugggagg

SEQ ID NO: 308036 - RNA, 32 nt, Human
acuugcaccucuccaccuuuggcacuagaacu

SEQ ID NO: 308037 - RNA, 21 nt, Human
acuugcacuguucacccuuca

SEQ ID NO: 308038 - RNA, 32 nt, Human
acuugcagaggacuugcuauuugccaggugcu

SEQ ID NO: 308039 - RNA, 21 nt, Human
acuugcagaggagcccagugg

SEQ ID NO: 308040 - RNA, 32 nt, Human
acuugcagauuuaggcaaaaagagugguagaa

SEQ ID NO: 308041 - RNA, 23 nt, Human
acuugcagcaggugaggaaggaa

SEQ ID NO: 308042 - RNA, 24 nt, Human
acuugcagccaacucucaaggcaa

SEQ ID NO: 308043 - RNA, 32 nt, Human
acuugcagccugaagcggagagcacaggggga

SEQ ID NO: 308044 - RNA, 32 nt, Human
acuugcagcgagacggcagcacagaccccugg

SEQ ID NO: 308045 - RNA, 32 nt, Human
acuugcagcuagaauugagggaagagagagac

SEQ ID NO: 308046 - RNA, 32 nt, Human
acuugcaggcugugggaggcaagugcccuuaa

SEQ ID NO: 308047 - RNA, 22 nt, Human
acuugcagggcauuugugcaga

SEQ ID NO: 308048 - RNA, 32 nt, Human
acuugcagggccugggaugagcagucuucaag

SEQ ID NO: 308049 - RNA, 32 nt, Human
acuugcaguucugccaucaccuccacuguacc

SEQ ID NO: 308050 - RNA, 32 nt, Human
acuugcauacacaccaacacacauaugcacac

SEQ ID NO: 308051 - RNA, 22 nt, Human
acuugcaugucuaaccccuuca

SEQ ID NO: 308052 - RNA, 32 nt, Human
acuugcauuggaagcuucagcaaccagcauuc

SEQ ID NO: 308053 - RNA, 32 nt, Human
acuugcauuucuaacaaguucccaggugaugc

SEQ ID NO: 308054 - RNA, 32 nt, Human
acuugccaccucagugcccgagcauccucugg

SEQ ID NO: 308055 - RNA, 32 nt, Human
acuugccagacagcuccugaagaggcuuucau

SEQ ID NO: 308056 - RNA, 32 nt, Human
acuugccaggguggaggaggagcauuguccag

SEQ ID NO: 308057 - RNA, 32 nt, Human
acuugccaugagcucugugaaugagaugguuc

SEQ ID NO: 308058 - RNA, 32 nt, Human
acuugccaugugagagucguguuccugacagg

SEQ ID NO: 308059 - RNA, 20 nt, Human
acuugccauugcccccucca

SEQ ID NO: 308060 - RNA, 32 nt, Human
acuugcccaauacugagaagcaacuugcauua

SEQ ID NO: 308061 - RNA, 32 nt, Human
acuugcccacaucuucucaucuugauagaaag

SEQ ID NO: 308062 - RNA, 32 nt, Human
acuugcccaccagaccaagggcagugccccaa

SEQ ID NO: 308063 - RNA, 32 nt, Human
acuugcccaggccaaagaagagaacgugggcu

SEQ ID NO: 308064 - RNA, 32 nt, Human
acuugcccagggcagagguuuuugaagugagc

SEQ ID NO: 308065 - RNA, 32 nt, Human
acuugccccucagaauaguacugucaagggaa

SEQ ID NO: 308066 - RNA, 32 nt, Human
acuugccccuggcugcugucgaucucuccacg

SEQ ID NO: 308067 - RNA, 32 nt, Human
acuugcccuccaguggaccuuugcaggcccgg

SEQ ID NO: 308068 - RNA, 32 nt, Human
acuugcccugcucuccagugauucuguagcuc

SEQ ID NO: 308069 - RNA, 32 nt, Human
acuugccgcggacugccugggcuuagccagcg

SEQ ID NO: 308070 - RNA, 32 nt, Human
acuugccucacacccaggagcugccccugcug

SEQ ID NO: 308071 - RNA, 32 nt, Human
acuugccucauagcuggugaaggauucuucug

SEQ ID NO: 308072 - RNA, 32 nt, Human
acuugccuccgccauggucacucggcagcccu

SEQ ID NO: 308073 - RNA, 32 nt, Human
acuugccucgaagaccaaauaauugcuagucu

SEQ ID NO: 308074 - RNA, 32 nt, Human
acuugccucgggcuaaucccucccucuuccuc

SEQ ID NO: 308075 - RNA, 32 nt, Human
acuugccucuucugugagcacuguggcuuuug

SEQ ID NO: 308076 - RNA, 32 nt, Human
acuugccugaggagcuggaggaaggggaagcc

SEQ ID NO: 308077 - RNA, 32 nt, Human
acuugccugccucugcuugcugcugucccugc

SEQ ID NO: 308078 - RNA, 32 nt, Human
acuugccuguagucucagcuacuuaggaggcu

SEQ ID NO: 308079 - RNA, 31 nt, Human
acuugccuuacuugcaucccugugucuguau

SEQ ID NO: 308080 - RNA, 32 nt, Human
acuugccuucuuggagccucacugucuucauc

SEQ ID NO: 308081 - RNA, 32 nt, Human
acuugccuugacuugcaacuugccuugaacau

SEQ ID NO: 308082 - RNA, 32 nt, Human
acuugccuugccugauaaccagccagcaggcu

SEQ ID NO: 308083 - RNA, 32 nt, Human
acuugcgaaggcaugagacuuggaacccuggc

SEQ ID NO: 308084 - RNA, 32 nt, Human
acuugcgacccuccucucaggcugcuucugac

SEQ ID NO: 308085 - RNA, 32 nt, Human
acuugcgcagccgccugcagcgcggcccguga

SEQ ID NO: 308086 - RNA, 32 nt, Human
acuugcgccucccggguucaagcgauucucca

SEQ ID NO: 308087 - RNA, 32 nt, Human
acuugcgcugucacucagccuggacgcgcuuc

SEQ ID NO: 308088 - RNA, 32 nt, Human
acuugcggggcagaggagggcgugggcguguc

SEQ ID NO: 308089 - RNA, 32 nt, Human
acuugcgguuaauuaugcaaaugauaguuugu

SEQ ID NO: 308090 - RNA, 32 nt, Human
acuugcgucaucucguuuccacaguugacguu

SEQ ID NO: 308091 - RNA, 32 nt, Human
acuugcuacccgcuuccuggagcaaacaguug

SEQ ID NO: 308092 - RNA, 19 nt, Human
acuugcuagcgucccuuca

SEQ ID NO: 308093 - RNA, 32 nt, Human
acuugcucagggacuggccccuggcucuucug

SEQ ID NO: 308094 - RNA, 32 nt, Human
acuugcuccagaaauagcuucaaaaccaucca

SEQ ID NO: 308095 - RNA, 32 nt, Human
acuugcucgagaaccaaagugcauuuggguga

SEQ ID NO: 308096 - RNA, 32 nt, Human
acuugcucuccugguagcggcugcugacugug

SEQ ID NO: 308097 - RNA, 31 nt, Human
acuugcucucuaagagagguugggaccaggc

SEQ ID NO: 308098 - RNA, 32 nt, Human
acuugcucugcagccacucaguagucuucugu

SEQ ID NO: 308099 - RNA, 32 nt, Human
acuugcucuguugcccaggcggaacuugaacu

SEQ ID NO: 308100 - RNA, 32 nt, Human
acuugcugagucugacagccucugggcccggc

SEQ ID NO: 308101 - RNA, 32 nt, Human
acuugcugcaguugcaacuaugcacuuguaua

SEQ ID NO: 308102 - RNA, 32 nt, Human
acuugcugcgugacccuccaaguagaccugug

SEQ ID NO: 308103 - RNA, 32 nt, Human
acuugcugcugucauauaaucauuccauacuu

SEQ ID NO: 308104 - RNA, 32 nt, Human
acuugcugcuucugcacuucauauccauauuu

SEQ ID NO: 308105 - RNA, 32 nt, Human
acuugcugggauuacaggugugagccaccaug

SEQ ID NO: 308106 - RNA, 32 nt, Human
acuugcuggggguggagggugggacacaugag

SEQ ID NO: 308107 - RNA, 32 nt, Human
acuugcuguacuuuuucuuuucuuuuaggggu

SEQ ID NO: 308108 - RNA, 32 nt, Human
acuugcugucuucugcaaaccugccccuucug

SEQ ID NO: 308109 - RNA, 32 nt, Human
acuugcugugugacccugggcaagucacuuaa

SEQ ID NO: 308110 - RNA, 32 nt, Human
acuugcugugugaccucaggccagugugccga

SEQ ID NO: 308111 - RNA, 32 nt, Human
acuugcugugugaccuuaagcaaguuacuuaa

SEQ ID NO: 308112 - RNA, 32 nt, Human
acuugcugugugaccuuaggaagucucugccc

SEQ ID NO: 308113 - RNA, 32 nt, Human
acuugcugugugaccuugggcaaguuccuuuc

SEQ ID NO: 308114 - RNA, 32 nt, Human
acuugcugugugaccuugggcauguggcuuuc

SEQ ID NO: 308115 - RNA, 32 nt, Human
acuugcuguuuccagccgcugaaucugcugag

SEQ ID NO: 308116 - RNA, 32 nt, Human
acuugcuucauuucuuuuucauuugacuuaca

SEQ ID NO: 308117 - RNA, 32 nt, Human
acuugcuuccugcaugguagggagagacacaa

SEQ ID NO: 308118 - RNA, 32 nt, Human
acuugcuucucccaccucugagauuaggacag

SEQ ID NO: 308119 - RNA, 32 nt, Human
acuugcuucugccucauccugccuuagugugc

SEQ ID NO: 308120 - RNA, 32 nt, Human
acuugcuuguauagccuuuugacccuucuuga

SEQ ID NO: 308121 - RNA, 32 nt, Human
acuugcuuugaauucauguuagcaauaaauga

SEQ ID NO: 308122 - RNA, 32 nt, Human
acuugcuuuucccauucucacuuuuagaauua

SEQ ID NO: 308123 - RNA, 32 nt, Human
acuuggaaaagaacaccagcugcggugguagc

SEQ ID NO: 308124 - RNA, 32 nt, Human
acuuggaaacugccuuuuccauucacuuacag

SEQ ID NO: 308125 - RNA, 32 nt, Human
acuuggaagaggaggaggaggaggagaaggag

SEQ ID NO: 308126 - RNA, 32 nt, Human
acuuggaagaugcauuuaaauuacucagcuga

SEQ ID NO: 308127 - RNA, 32 nt, Human
acuuggaaggcugaggugagaggaucacucga

SEQ ID NO: 308128 - RNA, 32 nt, Human
acuuggacagaccugggcuaggaggcacauuc

SEQ ID NO: 308129 - RNA, 32 nt, Human
acuuggacagcccaggccauggcaggaagaau

SEQ ID NO: 308130 - RNA, 32 nt, Human
acuuggaccaggguggcugugaagggaagucu

SEQ ID NO: 308131 - RNA, 20 nt, Human
acuuggacuaaaugcacuaa

SEQ ID NO: 308132 - RNA, 32 nt, Human
acuuggagaagggagcgcgccuggccgccgcu

SEQ ID NO: 308133 - RNA, 32 nt, Human
acuuggagcugcauuuaugagcacuguagaca

SEQ ID NO: 308134 - RNA, 32 nt, Human
acuuggaggcccuggcucaggagcucauagau

SEQ ID NO: 308135 - RNA, 32 nt, Human
acuuggagggcagaggugggaggauggcuuga

SEQ ID NO: 308136 - RNA, 32 nt, Human
acuuggagggcccaggugucucuccaccagcc

SEQ ID NO: 308137 - RNA, 32 nt, Human
acuuggagggggacuuggaaggugagaaagau

SEQ ID NO: 308138 - RNA, 32 nt, Human
acuuggagggucugggggcagcuguccugaac

SEQ ID NO: 308139 - RNA, 32 nt, Human
acuuggaggguuucaagacuucagaggaggaa

SEQ ID NO: 308140 - RNA, 32 nt, Human
acuuggaggugaacagccucuuuugccgguau

SEQ ID NO: 308141 - RNA, 32 nt, Human
acuuggagucagcugauugacaggagggcauc

SEQ ID NO: 308142 - RNA, 32 nt, Human
acuuggagugugaagggcuugagcauacgggg

SEQ ID NO: 308143 - RNA, 32 nt, Human
acuuggaucccaaagcaaggagaucauuugga

SEQ ID NO: 308144 - RNA, 32 nt, Human
acuuggauccugggguagggaggcaggguuag

SEQ ID NO: 308145 - RNA, 32 nt, Human
acuuggaugaaacggugcaggccaggcgggcc

SEQ ID NO: 308146 - RNA, 32 nt, Human
acuuggaugcagcucuugggaccguguucugc

SEQ ID NO: 308147 - RNA, 23 nt, Human
acuuggaugcauucuugcucuca

SEQ ID NO: 308148 - RNA, 32 nt, Human
acuuggaugccauuaaaagcauucccuuuuaa

SEQ ID NO: 308149 - RNA, 32 nt, Human
acuuggauggggaccugaaaaagagaauguug

SEQ ID NO: 308150 - RNA, 32 nt, Human
acuuggcaacagagcaagacccugucccuaaa

SEQ ID NO: 308151 - RNA, 32 nt, Human
acuuggcaaccauauugucaccuguaccuguc

SEQ ID NO: 308152 - RNA, 32 nt, Human
acuuggcagcauuuucagaaacaggaaguuug

SEQ ID NO: 308153 - RNA, 32 nt, Human
acuuggcagccuugaaguuggggucagccucg

SEQ ID NO: 308154 - RNA, 32 nt, Human
acuuggccagccugcaugccuggucaucagga

SEQ ID NO: 308155 - RNA, 32 nt, Human
acuuggccauucccaggaggcuuggagacccc

SEQ ID NO: 308156 - RNA, 32 nt, Human
acuuggccucaagugaaccagcacuucaugag

SEQ ID NO: 308157 - RNA, 19 nt, Human
acuuggccucaccccaccc

SEQ ID NO: 308158 - RNA, 32 nt, Human
acuuggccucacugcuaaugacuccucacacc

SEQ ID NO: 308159 - RNA, 32 nt, Human
acuuggccucacugcuaaugauuccucgcacc

SEQ ID NO: 308160 - RNA, 32 nt, Human
acuuggccuccaccuucucuucacucucaaau

SEQ ID NO: 308161 - RNA, 32 nt, Human
acuuggccucgaggccuuuuauuuuagaaaug

SEQ ID NO: 308162 - RNA, 32 nt, Human
acuuggccucuaauuuauauugcuuugcacuu

SEQ ID NO: 308163 - RNA, 22 nt, Human
acuuggccucuugguuggccag

SEQ ID NO: 308164 - RNA, 32 nt, Human
acuuggccugcuugcccugcccucucaccucu

SEQ ID NO: 308165 - RNA, 32 nt, Human
acuuggccuguucacuuggaaggcuaacucca

SEQ ID NO: 308166 - RNA, 32 nt, Human
acuuggcggugaggagggcagcuggagaucuu

SEQ ID NO: 308167 - RNA, 32 nt, Human
acuuggcuaauucuucuccuccuucacaucag

SEQ ID NO: 308168 - RNA, 32 nt, Human
acuuggcucacugcaaccucugcccccugggu

SEQ ID NO: 308169 - RNA, 32 nt, Human
acuuggcucacugcagccucaacuucuugucc

SEQ ID NO: 308170 - RNA, 32 nt, Human
acuuggcucagugcaaccuccccaccccgggc

SEQ ID NO: 308171 - RNA, 32 nt, Human
acuuggcuccccucuccuccuuagccagaaac

SEQ ID NO: 308172 - RNA, 32 nt, Human
acuuggcugcaaccccagagcccccagggugu

SEQ ID NO: 308173 - RNA, 32 nt, Human
acuuggcugcagcuguccugaacagcccagga

SEQ ID NO: 308174 - RNA, 32 nt, Human
acuuggcuggguuugcagucagauacacagau

SEQ ID NO: 308175 - RNA, 32 nt, Human
acuuggcugucugaccagagaaugcaccucuu

SEQ ID NO: 308176 - RNA, 32 nt, Human
acuuggcugugaucauugugauggagcaagaa

SEQ ID NO: 308177 - RNA, 32 nt, Human
acuuggcuguuaaugucugcccucugaauuca

SEQ ID NO: 308178 - RNA, 32 nt, Human
acuuggcuucccccaggggcaggcuggacuuu

SEQ ID NO: 308179 - RNA, 32 nt, Human
acuugggaaacugaaaguguucccauauagcu

SEQ ID NO: 308180 - RNA, 32 nt, Human
acuugggaacagcagguaauacugaagaaaaa

SEQ ID NO: 308181 - RNA, 32 nt, Human
acuugggaacagcuacacagggagcuagaacc

SEQ ID NO: 308182 - RNA, 32 nt, Human
acuugggaagcacauagauacaucuuacaagu

SEQ ID NO: 308183 - RNA, 32 nt, Human
acuugggaagcagaggcuggaggaucauuuca

SEQ ID NO: 308184 - RNA, 32 nt, Human
acuugggaagcugaagcaggagaaucacuuaa

SEQ ID NO: 308185 - RNA, 32 nt, Human
acuugggaagcugaagugggaggaucaccuga

SEQ ID NO: 308186 - RNA, 32 nt, Human
acuugggaaggugagggauucaggggagguca

SEQ ID NO: 308187 - RNA, 32 nt, Human
acuugggacaucuagcuccugaagaguagaaa

SEQ ID NO: 308188 - RNA, 32 nt, Human
acuugggacuccuggcucggccccaacaggga

SEQ ID NO: 308189 - RNA, 32 nt, Human
acuugggagagggagaccaugacagaagccag

SEQ ID NO: 308190 - RNA, 32 nt, Human
acuugggaggauggcaguaggagccagggcug

SEQ ID NO: 308191 - RNA, 32 nt, Human
acuugggaggcagagggcagcuacugcagguu

SEQ ID NO: 308192 - RNA, 32 nt, Human
acuugggaggcagagguuguggugagccgaga

SEQ ID NO: 308193 - RNA, 32 nt, Human
acuugggaggcagagguuucagugagccgagu

SEQ ID NO: 308194 - RNA, 32 nt, Human
acuugggaggccaaggagggaggaucacuuga

SEQ ID NO: 308195 - RNA, 32 nt, Human
acuugggaggccguggcaggaggaucacgagc

SEQ ID NO: 308196 - RNA, 32 nt, Human
acuugggaggcggagguugcagugagcuaaga

SEQ ID NO: 308197 - RNA, 32 nt, Human
acuugggaggcgguuguugcagugagcuguga

SEQ ID NO: 308198 - RNA, 32 nt, Human
acuugggaggcucaggugggaggaucacuuga

SEQ ID NO: 308199 - RNA, 32 nt, Human
acuugggaggcugaagcaggagaaucacuuua

SEQ ID NO: 308200 - RNA, 32 nt, Human
acuugggaggcugaagcaggagaaucccuuga

SEQ ID NO: 308201 - RNA, 32 nt, Human
acuugggaggcugaagcaggagaaucgcuuga

SEQ ID NO: 308202 - RNA, 32 nt, Human
acuugggaggcugaagcaggagaaucguuuga

SEQ ID NO: 308203 - RNA, 32 nt, Human
acuugggaggcugaagcaggagaauugccuga

SEQ ID NO: 308204 - RNA, 32 nt, Human
acuugggaggcugaagcaggagaauugcucga

SEQ ID NO: 308205 - RNA, 32 nt, Human
acuugggaggcugaagcaggagagucacuuga

SEQ ID NO: 308206 - RNA, 32 nt, Human
acuugggaggcugaagcaggaggauagcuaga

SEQ ID NO: 308207 - RNA, 32 nt, Human
acuugggaggcugaagcaggaggauugaggaa

SEQ ID NO: 308208 - RNA, 32 nt, Human
acuugggaggcugaagcaugagaaucacuuga

SEQ ID NO: 308209 - RNA, 32 nt, Human
acuugggaggcugaagcgggaggaucgcuuga

SEQ ID NO: 308210 - RNA, 32 nt, Human
acuugggaggcugaagugggaagaucacuuga

SEQ ID NO: 308211 - RNA, 32 nt, Human
acuugggaggcugaagugggaggaucauuugu

SEQ ID NO: 308212 - RNA, 32 nt, Human
acuugggaggcugaagugggaggaucgcuuga

SEQ ID NO: 308213 - RNA, 32 nt, Human
acuugggaggcugaagugggaggauggccuga

SEQ ID NO: 308214 - RNA, 32 nt, Human
acuugggaggcugaagugggaggauuacuuga

SEQ ID NO: 308215 - RNA, 32 nt, Human
acuugggaggcugacguggguggcucacuuga

SEQ ID NO: 308216 - RNA, 32 nt, Human
acuugggaggcugagacaggagaaucacuuga

SEQ ID NO: 308217 - RNA, 32 nt, Human
acuugggaggcugagauaggaucacuugggcc

SEQ ID NO: 308218 - RNA, 32 nt, Human
acuugggaggcugagaugggagaaucacuuga

SEQ ID NO: 308219 - RNA, 32 nt, Human
acuugggaggcugagaugggaggaccauuuga

SEQ ID NO: 308220 - RNA, 32 nt, Human
acuugggaggcugagaugggaggagcacuuga

SEQ ID NO: 308221 - RNA, 32 nt, Human
acuugggaggcugagaugggaggaucaucuga

SEQ ID NO: 308222 - RNA, 32 nt, Human
acuugggaggcugagaugugagaaucacuuga

SEQ ID NO: 308223 - RNA, 32 nt, Human
acuugggaggcugagccaggagaaucacuuga

SEQ ID NO: 308224 - RNA, 32 nt, Human
acuugggaggcugagccaggagaaucgcuuga

SEQ ID NO: 308225 - RNA, 32 nt, Human
acuugggaggcugagcccuggaggucgaggcu

SEQ ID NO: 308226 - RNA, 32 nt, Human
acuugggaggcugaggagggauaaucaguuga

SEQ ID NO: 308227 - RNA, 32 nt, Human
acuugggaggcugaggcaagagaaucgcuuga

SEQ ID NO: 308228 - RNA, 32 nt, Human
acuugggaggcugaggcaagagaauugcuuga

SEQ ID NO: 308229 - RNA, 32 nt, Human
acuugggaggcugaggcaagagaauugcuugg

SEQ ID NO: 308230 - RNA, 32 nt, Human
acuugggaggcugaggcaagaggauccuugag

SEQ ID NO: 308231 - RNA, 32 nt, Human
acuugggaggcugaggcaagugaaucacuuga

SEQ ID NO: 308232 - RNA, 32 nt, Human
acuugggaggcugaggcacaagaaucaauaga

SEQ ID NO: 308233 - RNA, 32 nt, Human
acuugggaggcugaggcacaagaaucacuuga

SEQ ID NO: 308234 - RNA, 32 nt, Human
acuugggaggcugaggcacaagaaucgcuuga

SEQ ID NO: 308235 - RNA, 32 nt, Human
acuugggaggcugaggcacgagaaucgcuuga

SEQ ID NO: 308236 - RNA, 32 nt, Human
acuugggaggcugaggcacgagaauuacuuga

SEQ ID NO: 308237 - RNA, 32 nt, Human
acuugggaggcugaggcagaagaaucgcuuaa

SEQ ID NO: 308238 - RNA, 32 nt, Human
acuugggaggcugaggcagaagaaucgcuuga

SEQ ID NO: 308239 - RNA, 32 nt, Human
acuugggaggcugaggcagagaauugcuugaa

SEQ ID NO: 308240 - RNA, 32 nt, Human
acuugggaggcugaggcaggacagucacuuga

SEQ ID NO: 308241 - RNA, 26 nt, Human
acuugggaggcugaggcaggagaauc

SEQ ID NO: 308242 - RNA, 32 nt, Human
acuugggaggcugaggcaggagaaucaccuga

SEQ ID NO: 308243 - RNA, 32 nt, Human
acuugggaggcugaggcaggagaaucacucga

SEQ ID NO: 308244 - RNA, 32 nt, Human
acuugggaggcugaggcaggagaaucacuuga

SEQ ID NO: 308245 - RNA, 32 nt, Human
acuugggaggcugaggcaggagaaucauuuaa

SEQ ID NO: 308246 - RNA, 32 nt, Human
acuugggaggcugaggcaggagaaucauuuga

SEQ ID NO: 308247 - RNA, 32 nt, Human
acuugggaggcugaggcaggagaaucccuuga

SEQ ID NO: 308248 - RNA, 32 nt, Human
acuugggaggcugaggcaggagaaucgccuga

SEQ ID NO: 308249 - RNA, 32 nt, Human
acuugggaggcugaggcaggagaaucgcugga

SEQ ID NO: 308250 - RNA, 32 nt, Human
acuugggaggcugaggcaggagaaucgcuuaa

SEQ ID NO: 308251 - RNA, 32 nt, Human
acuugggaggcugaggcaggagaaucgcuuga

SEQ ID NO: 308252 - RNA, 32 nt, Human
acuugggaggcugaggcaggagaaucucuuga

SEQ ID NO: 308253 - RNA, 32 nt, Human
acuugggaggcugaggcaggagaauuacuuga

SEQ ID NO: 308254 - RNA, 27 nt, Human
acuugggaggcugaggcaggagagucg

SEQ ID NO: 308255 - RNA, 32 nt, Human
acuugggaggcugaggcaggaggaucacuuaa

SEQ ID NO: 308256 - RNA, 32 nt, Human
acuugggaggcugaggcaggaggaucacuuca

SEQ ID NO: 308257 - RNA, 32 nt, Human
acuugggaggcugaggcaggaggaucccuuga

SEQ ID NO: 308258 - RNA, 32 nt, Human
acuugggaggcugaggcaggaggaucgccuga

SEQ ID NO: 308259 - RNA, 32 nt, Human
acuugggaggcugaggcaggaggaucgcuuaa

SEQ ID NO: 308260 - RNA, 32 nt, Human
acuugggaggcugaggcaggaggaucgcuuga

SEQ ID NO: 308261 - RNA, 32 nt, Human
acuugggaggcugaggcaggaggauugccuga

SEQ ID NO: 308262 - RNA, 32 nt, Human
acuugggaggcugaggcaggaggauugcuuga

SEQ ID NO: 308263 - RNA, 32 nt, Human
acuugggaggcugaggcaggaggguugcuuga

SEQ ID NO: 308264 - RNA, 32 nt, Human
acuugggaggcugaggcaggggaaucacuuga

SEQ ID NO: 308265 - RNA, 32 nt, Human
acuugggaggcugaggcaugagaaucaauuga

SEQ ID NO: 308266 - RNA, 32 nt, Human
acuugggaggcugaggcaugagaaucacuuaa

SEQ ID NO: 308267 - RNA, 32 nt, Human
acuugggaggcugaggcauggagaaucgcuug

SEQ ID NO: 308268 - RNA, 32 nt, Human
acuugggaggcugaggcgagagaaucacuuga

SEQ ID NO: 308269 - RNA, 32 nt, Human
acuugggaggcugaggcggcaggaucacuagg

SEQ ID NO: 308270 - RNA, 32 nt, Human
acuugggaggcugaggcuggagaaucgcuuga

SEQ ID NO: 308271 - RNA, 32 nt, Human
acuugggaggcugagggcaggagaauggcaug

SEQ ID NO: 308272 - RNA, 32 nt, Human
acuugggaggcugagggcaggagaauugcuug

SEQ ID NO: 308273 - RNA, 32 nt, Human
acuugggaggcugagguaggagaauuacuuga

SEQ ID NO: 308274 - RNA, 32 nt, Human
acuugggaggcugagguaggaggaucaccuga

SEQ ID NO: 308275 - RNA, 32 nt, Human
acuugggaggcugaggucagaggauggcuuga

SEQ ID NO: 308276 - RNA, 32 nt, Human
acuugggaggcugagguggaaggaucauuuga

SEQ ID NO: 308277 - RNA, 32 nt, Human
acuugggaggcugagguggauggaucaccuga

SEQ ID NO: 308278 - RNA, 32 nt, Human
acuugggaggcugaggugggagaaucaccuga

SEQ ID NO: 308279 - RNA, 32 nt, Human
acuugggaggcugaggugggagaucacuugag

SEQ ID NO: 308280 - RNA, 32 nt, Human
acuugggaggcugaggugggaggaucacuuga

SEQ ID NO: 308281 - RNA, 32 nt, Human
acuugggaggcugaggugggaggauccucuga

SEQ ID NO: 308282 - RNA, 32 nt, Human
acuugggaggcugaggugggaggaucgccuga

SEQ ID NO: 308283 - RNA, 32 nt, Human
acuugggaggcugaggugggaggaucgcuuga

SEQ ID NO: 308284 - RNA, 32 nt, Human
acuugggaggcugaggugggaggaucgguuga

SEQ ID NO: 308285 - RNA, 32 nt, Human
acuugggaggcugaggugggaggaucuuuuga

SEQ ID NO: 308286 - RNA, 32 nt, Human
acuugggaggcugaggugggaggauuaaugga

SEQ ID NO: 308287 - RNA, 32 nt, Human
acuugggaggcugaggugggaggauugccuga

SEQ ID NO: 308288 - RNA, 32 nt, Human
acuugggaggcugaggugggaggauugcuuga

SEQ ID NO: 308289 - RNA, 32 nt, Human
acuugggaggcugaggugggaggauuguuuga

SEQ ID NO: 308290 - RNA, 32 nt, Human
acuugggaggcugaggugggagguucacccaa

SEQ ID NO: 308291 - RNA, 32 nt, Human
acuugggaggcugaggugggcggauuacuuga

SEQ ID NO: 308292 - RNA, 32 nt, Human
acuugggaggcugaggugggggaaucacuuga

SEQ ID NO: 308293 - RNA, 32 nt, Human
acuugggaggcugaggugugaggaucauuuag

SEQ ID NO: 308294 - RNA, 32 nt, Human
acuugggaggcugcagcuguggcuguggcuga

SEQ ID NO: 308295 - RNA, 32 nt, Human
acuugggaggcugggcagaagaaucacuugag

SEQ ID NO: 308296 - RNA, 32 nt, Human
acuugggaggcuggggaaggagaaucacuuga

SEQ ID NO: 308297 - RNA, 32 nt, Human
acuugggaggcuggggugggaggaucgcuuga

SEQ ID NO: 308298 - RNA, 32 nt, Human
acuugggagggagagguugcagugagcccaga

SEQ ID NO: 308299 - RNA, 32 nt, Human
acuugggaggggcggagguagcaguaaagcca

SEQ ID NO: 308300 - RNA, 32 nt, Human
acuugggagggguagguugcagugagcugaga

SEQ ID NO: 308301 - RNA, 32 nt, Human
acuugggagguggagcuuacagugagccgaga

SEQ ID NO: 308302 - RNA, 32 nt, Human
acuugggagguggagguugcagugagccagga

SEQ ID NO: 308303 - RNA, 32 nt, Human
acuugggagguggagguugcagugggccgaga

SEQ ID NO: 308304 - RNA, 32 nt, Human
acuugggcaggcaaagggggcaccaagggcac

SEQ ID NO: 308305 - RNA, 32 nt, Human
acuugggccaaucacugaguuuguggugaucg

SEQ ID NO: 308306 - RNA, 32 nt, Human
acuugggcccaggaggucaagccugcagcgag

SEQ ID NO: 308307 - RNA, 32 nt, Human
acuugggcccaggaguuugaggcugcagugag

SEQ ID NO: 308308 - RNA, 32 nt, Human
acuugggcccccuguucuuucuuucccauuaa

SEQ ID NO: 308309 - RNA, 32 nt, Human
acuugggccgaucugggcugggcuuggacgug

SEQ ID NO: 308310 - RNA, 32 nt, Human
acuugggcggcgagcuggacuguuucuacucc

SEQ ID NO: 308311 - RNA, 32 nt, Human
acuugggcucaagugauccuccuaccugagcc

SEQ ID NO: 308312 - RNA, 32 nt, Human
acuugggcucacaacuucucuucacuuuuucc

SEQ ID NO: 308313 - RNA, 32 nt, Human
acuuggggagccaaagcacaagaucuaaggaa

SEQ ID NO: 308314 - RNA, 32 nt, Human
acuuggggaggaagaauggggagugacugcua

SEQ ID NO: 308315 - RNA, 32 nt, Human
acuuggggaggcaagagacugggagccacuuc

SEQ ID NO: 308316 - RNA, 32 nt, Human
acuuggggaggugaguucuggaaggcaggggc

SEQ ID NO: 308317 - RNA, 32 nt, Human
acuuggggccccacccuuuucucuccuguuuu

SEQ ID NO: 308318 - RNA, 32 nt, Human
acuuggggcccccagcagguugcccaccaagc

SEQ ID NO: 308319 - RNA, 32 nt, Human
acuugggggacugaggcgggaggaucacuuga

SEQ ID NO: 308320 - RNA, 32 nt, Human
acuuggggugcauagcucggagaugcaguccc

SEQ ID NO: 308321 - RNA, 32 nt, Human
acuuggggugggaggggagaaagggaaccuuu

SEQ ID NO: 308322 - RNA, 32 nt, Human
acuugggguucugguggcuucaucucauaaag

SEQ ID NO: 308323 - RNA, 32 nt, Human
acuugggucaaucucucacuuuauuuuguaga

SEQ ID NO: 308324 - RNA, 32 nt, Human
acuuggguccaggagguggaggcugcagugag

SEQ ID NO: 308325 - RNA, 32 nt, Human
acuugggugagcagacacagugaggcuguuag

SEQ ID NO: 308326 - RNA, 32 nt, Human
acuugggugggcagacuuaggaacgcucuacu

SEQ ID NO: 308327 - RNA, 32 nt, Human
acuuggguugguuugucuuugcuuccuacacc

SEQ ID NO: 308328 - RNA, 32 nt, Human
acuuggguuuuggggugguggaaagcgggaaa

SEQ ID NO: 308329 - RNA, 32 nt, Human
acuugguaacaucccuagacuccacucaugaa

SEQ ID NO: 308330 - RNA, 32 nt, Human
acuugguacaguuucaggagcgugaaggacuu

SEQ ID NO: 308331 - RNA, 32 nt, Human
acuugguacuucuuucgcugaaugaccauacu

SEQ ID NO: 308332 - RNA, 32 nt, Human
acuugguaguuagccacauugagaagugguua

SEQ ID NO: 308333 - RNA, 32 nt, Human
acuugguauccaauaaauauuuguuggaugaa

SEQ ID NO: 308334 - RNA, 32 nt, Human
acuugguauucuacuucuuucucccaucucaa

SEQ ID NO: 308335 - RNA, 32 nt, Human
acuuggucacugggcugcugauggucagcucu

SEQ ID NO: 308336 - RNA, 32 nt, Human
acuugguccuugugcucuucagccaggacacc

SEQ ID NO: 308337 - RNA, 32 nt, Human
acuuggucucaagugauucuacugccucagcc

SEQ ID NO: 308338 - RNA, 32 nt, Human
acuuggugcccugcaucccagccacucccaac

SEQ ID NO: 308339 - RNA, 32 nt, Human
acuugguggccaauaccugccuuccaaagaga

SEQ ID NO: 308340 - RNA, 31 nt, Human
acuugguggguggggugggugguuuuuguuu

SEQ ID NO: 308341 - RNA, 32 nt, Human
acuuggugucugcuguccccgccaggcaagcc

SEQ ID NO: 308342 - RNA, 32 nt, Human
acuuggugugggggaggagcacaaaacuccag

SEQ ID NO: 308343 - RNA, 32 nt, Human
acuugguuaacaguguacauuuugauaaccua

SEQ ID NO: 308344 - RNA, 32 nt, Human
acuugguuagaauugugcuacugugaacgcug

SEQ ID NO: 308345 - RNA, 32 nt, Human
acuugguuccaguuccugccuaucuggaguuu

SEQ ID NO: 308346 - RNA, 32 nt, Human
acuugguuugccuggugccacaaugcuuauua

SEQ ID NO: 308347 - RNA, 32 nt, Human
acuuguaaacuauggugcucaguuuugccucu

SEQ ID NO: 308348 - RNA, 32 nt, Human
acuuguaacagauucccugaaacacugcuuuu

SEQ ID NO: 308349 - RNA, 32 nt, Human
acuuguacaacaaaugcuucuuccaggaucua

SEQ ID NO: 308350 - RNA, 32 nt, Human
acuuguacaacauuaucaauguauuuaauacc

SEQ ID NO: 308351 - RNA, 32 nt, Human
acuuguacaaugcugucacugugugacaucca

SEQ ID NO: 308352 - RNA, 32 nt, Human
acuuguacacauauaucaaaaccucauucugc

SEQ ID NO: 308353 - RNA, 32 nt, Human
acuuguacccaggagguggagguugcggugaa

SEQ ID NO: 308354 - RNA, 32 nt, Human
acuuguacuaccuuguccuaugaagcucugag

SEQ ID NO: 308355 - RNA, 32 nt, Human
acuuguacuucccaccacuggaaauguuagca

SEQ ID NO: 308356 - RNA, 32 nt, Human
acuuguagcauugccuguacuacaguauuuuu

SEQ ID NO: 308357 - RNA, 32 nt, Human
acuuguagccgucugaaaagauuguuauaagc

SEQ ID NO: 308358 - RNA, 32 nt, Human
acuuguagcuuaauucagcauugggugaggua

SEQ ID NO: 308359 - RNA, 32 nt, Human
acuuguaggaaagccucuuugcauuuagacgu

SEQ ID NO: 308360 - RNA, 32 nt, Human
acuuguaggcgaucagggcugaagacgcugau

SEQ ID NO: 308361 - RNA, 32 nt, Human
acuuguauaucccacugggagcacuuuguagg

SEQ ID NO: 308362 - RNA, 32 nt, Human
acuuguauaugacaguauuuagggaaggugaa

SEQ ID NO: 308363 - RNA, 32 nt, Human
acuuguauaugcccuauaccucuugggcauac

SEQ ID NO: 308364 - RNA, 22 nt, Human
acuuguauauuacaggaaacaa

SEQ ID NO: 308365 - RNA, 32 nt, Human
acuuguauccucuccccucuucauacacuccu

SEQ ID NO: 308366 - RNA, 32 nt, Human
acuuguauuaucuguaaauuccagacauugua

SEQ ID NO: 308367 - RNA, 32 nt, Human
acuuguauucccuuaacucuaacccuguggaa

SEQ ID NO: 308368 - RNA, 32 nt, Human
acuuguauuuccauugggauguuuucauuuca

SEQ ID NO: 308369 - RNA, 32 nt, Human
acuugucaauguuuuuauucuuuuacaagacc

SEQ ID NO: 308370 - RNA, 32 nt, Human
acuugucacacuugcagucuccugccucacuc

SEQ ID NO: 308371 - RNA, 32 nt, Human
acuugucacaugcuugaucaguuacagcaaua

SEQ ID NO: 308372 - RNA, 32 nt, Human
acuugucacccaggcuggagugcaauggugug

SEQ ID NO: 308373 - RNA, 32 nt, Human
acuugucacccaggcuggagugcaguggcuca

SEQ ID NO: 308374 - RNA, 32 nt, Human
acuugucagacuguuggaauuggaucauagac

SEQ ID NO: 308375 - RNA, 32 nt, Human
acuugucaggcagaaaagguagugaccggccc

SEQ ID NO: 308376 - RNA, 32 nt, Human
acuugucaucacacagcugaagacauuguuuc

SEQ ID NO: 308377 - RNA, 32 nt, Human
acuuguccacaccagugacuccugccugagac

SEQ ID NO: 308378 - RNA, 32 nt, Human
acuuguccccggcuggagcccagcgccccgcc

SEQ ID NO: 308379 - RNA, 20 nt, Human
acuugucccgcuccccuuca

SEQ ID NO: 308380 - RNA, 32 nt, Human
acuuguccucuuggagguuacauucuugcugg

SEQ ID NO: 308381 - RNA, 32 nt, Human
acuuguccuucccaccucuugccuccacaccc

SEQ ID NO: 308382 - RNA, 31 nt, Human
acuugucucaauaaacccuuuggaguaaaaa

SEQ ID NO: 308383 - RNA, 32 nt, Human
acuugucucauuccaccucuucucagagcaac

SEQ ID NO: 308384 - RNA, 23 nt, Human
acuugucucucucauuuccuuca

SEQ ID NO: 308385 - RNA, 32 nt, Human
acuugucugccucuuugaccaccugugaacuc

SEQ ID NO: 308386 - RNA, 32 nt, Human
acuugucugggaaccugggcaggaggcacaga

SEQ ID NO: 308387 - RNA, 32 nt, Human
acuugucugggaacugggugcaggaggagaac

SEQ ID NO: 308388 - RNA, 32 nt, Human
acuugucuucuggaaguucgggugaggacgau

SEQ ID NO: 308389 - RNA, 32 nt, Human
acuugucuuucccugcaguaaggcugguuucc

SEQ ID NO: 308390 - RNA, 32 nt, Human
acuugugaaaauguauaaaagaugcaucuguu

SEQ ID NO: 308391 - RNA, 32 nt, Human
acuugugaggcugaggugggaggaucgcuuga

SEQ ID NO: 308392 - RNA, 32 nt, Human
acuugugaggcugaggugggaggaucguuuga

SEQ ID NO: 308393 - RNA, 32 nt, Human
acuugugauaauuggccucugugucauugugu

SEQ ID NO: 308394 - RNA, 32 nt, Human
acuugugcaaagggauccagaagagacacuuu

SEQ ID NO: 308395 - RNA, 32 nt, Human
acuugugcacaugugugcacagacacaaaaca

SEQ ID NO: 308396 - RNA, 32 nt, Human
acuugugcagcugcaaccaccauauccagggc

SEQ ID NO: 308397 - RNA, 32 nt, Human
acuugugccuccuggguucaagcgauucugcu

SEQ ID NO: 308398 - RNA, 19 nt, Human
acuugugccuguaauucca

SEQ ID NO: 308399 - RNA, 32 nt, Human
acuugugccuguaauuccagcugcucuggaag

SEQ ID NO: 308400 - RNA, 31 nt, Human
acuugugccuuacuguauccugugucauguc

SEQ ID NO: 308401 - RNA, 32 nt, Human
acuuguggaauucagucuacuggauuuaaggg

SEQ ID NO: 308402 - RNA, 32 nt, Human
acuuguggacaucacuggaguuuaccuauugu

SEQ ID NO: 308403 - RNA, 32 nt, Human
acuuguggcagcuucccugaacacucaucccc

SEQ ID NO: 308404 - RNA, 32 nt, Human
acuuguggccuugugcaaucucugccucucug

SEQ ID NO: 308405 - RNA, 32 nt, Human
acuuguggggauagaagggcucacagggcagg

SEQ ID NO: 308406 - RNA, 32 nt, Human
acuuguggggcuaaggcaggaggaucacuuga

SEQ ID NO: 308407 - RNA, 32 nt, Human
acuugugggggcauucccuagcacacaguaua

SEQ ID NO: 308408 - RNA, 32 nt, Human
acuugugggguggagguugcagugagcugaga

SEQ ID NO: 308409 - RNA, 32 nt, Human
acuugugguaccgauuauaucaucucagucuu

SEQ ID NO: 308410 - RNA, 32 nt, Human
acuuguggucaaagcaagaaugaggcugaaca

SEQ ID NO: 308411 - RNA, 32 nt, Human
acuuguguagcagcacagggcccacacuuaga

SEQ ID NO: 308412 - RNA, 32 nt, Human
acuugugugcaccugauuuggccaauaggauc

SEQ ID NO: 308413 - RNA, 32 nt, Human
acuugugugggaugggugcaggucugcauaua

SEQ ID NO: 308414 - RNA, 32 nt, Human
acuugugugugcugauguguuuccauuuguau

SEQ ID NO: 308415 - RNA, 32 nt, Human
acuuguguuuugcuacuugcaaaggaaauguu

SEQ ID NO: 308416 - RNA, 32 nt, Human
acuuguuaaagugcugcaaaaauugcauuuuc

SEQ ID NO: 308417 - RNA, 32 nt, Human
acuuguuacuccaagcaacuugcccaauuuua

SEQ ID NO: 308418 - RNA, 32 nt, Human
acuuguuagaaauacaaauuuuagggccuggc

SEQ ID NO: 308419 - RNA, 32 nt, Human
acuuguuccccgcagugcacaccuagaaugcu

SEQ ID NO: 308420 - RNA, 32 nt, Human
acuuguucucacauaggggcauccucuguccc

SEQ ID NO: 308421 - RNA, 32 nt, Human
acuuguucuuggggcucuaccagauggcugaa

SEQ ID NO: 308422 - RNA, 21 nt, Human
acuuguugaaacaggaagcaa

SEQ ID NO: 308423 - RNA, 32 nt, Human
acuuguugcaacuuuucacuucucuugugucc

SEQ ID NO: 308424 - RNA, 32 nt, Human
acuuguugcccaggcuggagugcaaugguaca

SEQ ID NO: 308425 - RNA, 32 nt, Human
acuuguuggcauuagacaaaucaagcugguga

SEQ ID NO: 308426 - RNA, 32 nt, Human
acuuguugggaggaggaggaaagggaaggcug

SEQ ID NO: 308427 - RNA, 32 nt, Human
acuuguugugguucccggguggcaggugcaca

SEQ ID NO: 308428 - RNA, 32 nt, Human
acuuguuucccuuauccauuuccuuuuucauu

SEQ ID NO: 308429 - RNA, 32 nt, Human
acuuguuucuccugcaccccagccugucacgc

SEQ ID NO: 308430 - RNA, 32 nt, Human
acuuguuugaagacuuguggauauucagagga

SEQ ID NO: 308431 - RNA, 31 nt, Human
acuuguuuggaacaaauacucacuuaaaacu

SEQ ID NO: 308432 - RNA, 32 nt, Human
acuuguuuuauuagauuuuaccaaugaauuuu

SEQ ID NO: 308433 - RNA, 32 nt, Human
acuuguuuuccuguguucuuguuuucagaaaa

SEQ ID NO: 308434 - RNA, 32 nt, Human
acuuguuuuucccaucucuuccuuuccaauuu

SEQ ID NO: 308435 - RNA, 32 nt, Human
acuuuaaaacacacacauacacacacaaaaca

SEQ ID NO: 308436 - RNA, 32 nt, Human
acuuuaaaacaguagagcuagcaaugacaccu

SEQ ID NO: 308437 - RNA, 32 nt, Human
acuuuaaaaccucaaaguugagaaggcuuuuc

SEQ ID NO: 308438 - RNA, 24 nt, Human
acuuuaaaacugcagcuuucuuuu

SEQ ID NO: 308439 - RNA, 32 nt, Human
acuuuaaaaugaaccagcucugaaaaguacuu

SEQ ID NO: 308440 - RNA, 20 nt, Human
acuuuaaaaugacuucuuuu

SEQ ID NO: 308441 - RNA, 32 nt, Human
acuuuaaacaauugcuugcugagauguuguua

SEQ ID NO: 308442 - RNA, 32 nt, Human
acuuuaaacagccugacuguguccuuggcucu

SEQ ID NO: 308443 - RNA, 32 nt, Human
acuuuaaacauuuaaauuauacaaucaucaac

SEQ ID NO: 308444 - RNA, 32 nt, Human
acuuuaaagcagcuuaaucuuuaaggaacaua

SEQ ID NO: 308445 - RNA, 32 nt, Human
acuuuaaaggaaaggauuuggagaauugaacu

SEQ ID NO: 308446 - RNA, 32 nt, Human
acuuuaaaggcuauuuacaaagcuguuuuaaa

SEQ ID NO: 308447 - RNA, 32 nt, Human
acuuuaaaucaaauugaaaauaaauuuuaucc

SEQ ID NO: 308448 - RNA, 32 nt, Human
acuuuaaaugucugcccugccagcagccccgg

SEQ ID NO: 308449 - RNA, 32 nt, Human
acuuuaacacaaauuuguuucaguugggccau

SEQ ID NO: 308450 - RNA, 32 nt, Human
acuuuaacaccacgcucuccuccaccgaccag

SEQ ID NO: 308451 - RNA, 32 nt, Human
acuuuaacaggugagaagacuaugccauggac

SEQ ID NO: 308452 - RNA, 32 nt, Human
acuuuaaccaguuaacuuggugcaaaacuuuu

SEQ ID NO: 308453 - RNA, 32 nt, Human
acuuuaacuguaaaguaaaugcuccaagugug

SEQ ID NO: 308454 - RNA, 32 nt, Human
acuuuaacuguacaauaauguugucacuuacu

SEQ ID NO: 308455 - RNA, 32 nt, Human
acuuuaagagcaggaguaauuaaguauuacug

SEQ ID NO: 308456 - RNA, 32 nt, Human
acuuuaagcuuuaucagaauuaaaugugagau

SEQ ID NO: 308457 - RNA, 32 nt, Human
acuuuaauacuaaaagcacuuuccauuauaua

SEQ ID NO: 308458 - RNA, 32 nt, Human
acuuuaaucaugguuucaugagcauuaaaaag

SEQ ID NO: 308459 - RNA, 32 nt, Human
acuuuaauuuugcuccaacaagggcuuuaugu

SEQ ID NO: 308460 - RNA, 32 nt, Human
acuuuacaaaccugaaagaugugacaaugauu

SEQ ID NO: 308461 - RNA, 32 nt, Human
acuuuacaaaccugaaugaugugacaauaauu

SEQ ID NO: 308462 - RNA, 32 nt, Human
acuuuacaagggcugaaggggucuucuacaug

SEQ ID NO: 308463 - RNA, 32 nt, Human
acuuuacaccucaguauugauuugucccagaa

SEQ ID NO: 308464 - RNA, 32 nt, Human
acuuuacagaagagggacugaggcucugagga

SEQ ID NO: 308465 - RNA, 32 nt, Human
acuuuacagauggggaaacugaggcuugagag

SEQ ID NO: 308466 - RNA, 32 nt, Human
acuuuacagccucuuuucaucuguaaaaugag

SEQ ID NO: 308467 - RNA, 32 nt, Human
acuuuacauaugugagauagaaacaaugguuc

SEQ ID NO: 308468 - RNA, 32 nt, Human
acuuuacauguauuuuguuauuagaaauuuuc

SEQ ID NO: 308469 - RNA, 32 nt, Human
acuuuaccauucuauuucccaagggaaccauc

SEQ ID NO: 308470 - RNA, 31 nt, Human
acuuuacccacggacagcaccaaagcucgcc

SEQ ID NO: 308471 - RNA, 32 nt, Human
acuuuacccagacgccacaggucaucaucugg

SEQ ID NO: 308472 - RNA, 32 nt, Human
acuuuaccuucucuuguacauagucagacuau

SEQ ID NO: 308473 - RNA, 32 nt, Human
acuuuacgccuaagguccucagucucuccagu

SEQ ID NO: 308474 - RNA, 32 nt, Human
acuuuacucauagcacauuucuuguguuaacc

SEQ ID NO: 308475 - RNA, 32 nt, Human
acuuuacugcagcuagucauccauccgucagg

SEQ ID NO: 308476 - RNA, 32 nt, Human
acuuuacuuuguuuuaaaacugaucaguuuug

SEQ ID NO: 308477 - RNA, 32 nt, Human
acuuuagaauuuggacuuaccuaacaagagua

SEQ ID NO: 308478 - RNA, 32 nt, Human
acuuuagacccuauguguagcaggucacaacu

SEQ ID NO: 308479 - RNA, 32 nt, Human
acuuuagaggagggaaagggguggcucuggca

SEQ ID NO: 308480 - RNA, 32 nt, Human
acuuuagaggcuugaucaugaaucacugcacc

SEQ ID NO: 308481 - RNA, 32 nt, Human
acuuuagauauuuuugcugaccugcaaagagc

SEQ ID NO: 308482 - RNA, 32 nt, Human
acuuuagcaacaguuaucacacuuuguaauuu

SEQ ID NO: 308483 - RNA, 32 nt, Human
acuuuagcaguucuuccaucugacucagguuu

SEQ ID NO: 308484 - RNA, 26 nt, Human
acuuuagccugggugacagagcgaga

SEQ ID NO: 308485 - RNA, 32 nt, Human
acuuuagccuuuacauaauuacucuaaguuac

SEQ ID NO: 308486 - RNA, 32 nt, Human
acuuuagcugaagaggagggggaugugcugug

SEQ ID NO: 308487 - RNA, 31 nt, Human
acuuuaggagagcugcccacagcagaaugac

SEQ ID NO: 308488 - RNA, 32 nt, Human
acuuuaggcagacaccagcuguuugcaaacaa

SEQ ID NO: 308489 - RNA, 32 nt, Human
acuuuaggcucccuccagauuccgcguuccuu

SEQ ID NO: 308490 - RNA, 32 nt, Human
acuuuagggccccuuagcagggugagcuguua

SEQ ID NO: 308491 - RNA, 32 nt, Human
acuuuagguauuaagaggcuauuggguuuuac

SEQ ID NO: 308492 - RNA, 32 nt, Human
acuuuaguaucauagugcuacagggaacaugc

SEQ ID NO: 308493 - RNA, 32 nt, Human
acuuuagucacuccugagaauccacaggagug

SEQ ID NO: 308494 - RNA, 19 nt, Human
acuuuaguccuguaucugu

SEQ ID NO: 308495 - RNA, 32 nt, Human
acuuuaguguauuuaaagagcauuucaguuaa

SEQ ID NO: 308496 - RNA, 32 nt, Human
acuuuaguucuuuagugacucuuaguagaggg

SEQ ID NO: 308497 - RNA, 32 nt, Human
acuuuauagcacuccgacauuuucugagcaag

SEQ ID NO: 308498 - RNA, 32 nt, Human
acuuuauaggagaauaagcaagagcuuaggua

SEQ ID NO: 308499 - RNA, 32 nt, Human
acuuuauaguuugggagacagaaucaggucuu

SEQ ID NO: 308500 - RNA, 32 nt, Human
acuuuaucacccaaaucacuggcauugacauu

SEQ ID NO: 308501 - RNA, 32 nt, Human
acuuuaucacccagacuggcgugcaguggcac

SEQ ID NO: 308502 - RNA, 32 nt, Human
acuuuauccugagucccuuaaucuuauggggc

SEQ ID NO: 308503 - RNA, 30 nt, Human
acuuuaugccugaacauagacucucucauc

SEQ ID NO: 308504 - RNA, 32 nt, Human
acuuuaugcugcagcauccaaggugaaagguc

SEQ ID NO: 308505 - RNA, 32 nt, Human
acuuuauggaggaggaagcuagaggaaaaaug

SEQ ID NO: 308506 - RNA, 32 nt, Human
acuuuaugggagaaaauuuagcaaagaagauc

SEQ ID NO: 308507 - RNA, 18 nt, Human
acuuuaugugagcaaggu

SEQ ID NO: 308508 - RNA, 32 nt, Human
acuuuauuaacagguuacugugaagauuuugc

SEQ ID NO: 308509 - RNA, 32 nt, Human
acuuuauuacucuuuugaacugaaagcacacu

SEQ ID NO: 308510 - RNA, 32 nt, Human
acuuuauuagucuguuuucacacugcuaauaa

SEQ ID NO: 308511 - RNA, 31 nt, Human
acuuuauuauacauuuugcauuuaaaaggcu

SEQ ID NO: 308512 - RNA, 32 nt, Human
acuuuauuccuaaaacgugucuuauuuuuaug

SEQ ID NO: 308513 - RNA, 32 nt, Human
acuuuauucucaaucacaagaagcuggggcuu

SEQ ID NO: 308514 - RNA, 32 nt, Human
acuuuauugcuaucgcccuccuuucccuuauu

SEQ ID NO: 308515 - RNA, 32 nt, Human
acuuuauuguuuugauguaauggaacuuaagg

SEQ ID NO: 308516 - RNA, 32 nt, Human
acuuuauuuauuggggguagggggauggagga

SEQ ID NO: 308517 - RNA, 32 nt, Human
acuuuauuucuugguguggaaaugacuuauuc

SEQ ID NO: 308518 - RNA, 32 nt, Human
acuuuauuucuuucucuugacugauugcucug

SEQ ID NO: 308519 - RNA, 32 nt, Human
acuuucaaaacaauuugcauuuagaguguuuc

SEQ ID NO: 308520 - RNA, 21 nt, Human
acuuucaaagucuccuacacu

SEQ ID NO: 308521 - RNA, 32 nt, Human
acuuucacaauggugcaucaggauaucuggca

SEQ ID NO: 308522 - RNA, 32 nt, Human
acuuucacaguccuguccucuggaucacagac

SEQ ID NO: 308523 - RNA, 32 nt, Human
acuuucaccacugucugagugaugaugcuguu

SEQ ID NO: 308524 - RNA, 32 nt, Human
acuuucaccuuaaaaucuuucuaagcaaagug

SEQ ID NO: 308525 - RNA, 32 nt, Human
acuuucacuauauuuugcuuugacagaaggaa

SEQ ID NO: 308526 - RNA, 32 nt, Human
acuuucacuuccuguucuguggcagacaagac

SEQ ID NO: 308527 - RNA, 32 nt, Human
acuuucagaacgaccugaagcugagggugcgc

SEQ ID NO: 308528 - RNA, 32 nt, Human
acuuucagagccucuggucacccuguccugga

SEQ ID NO: 308529 - RNA, 32 nt, Human
acuuucagaguuugaagguaacugagagcaga

SEQ ID NO: 308530 - RNA, 32 nt, Human
acuuucagccugcacuugaguauuccuuaugu

SEQ ID NO: 308531 - RNA, 32 nt, Human
acuuucaggaccuuccuuccucuugcaguugu

SEQ ID NO: 308532 - RNA, 32 nt, Human
acuuucaggagaaagccaaacuccucuguuug

SEQ ID NO: 308533 - RNA, 32 nt, Human
acuuucaggaggcccccagugaagagccccac

SEQ ID NO: 308534 - RNA, 32 nt, Human
acuuucaggauacuagagguugguuguggagu

SEQ ID NO: 308535 - RNA, 32 nt, Human
acuuucagggcacacuccagccugacuuuggc

SEQ ID NO: 308536 - RNA, 32 nt, Human
acuuucagggcucaccaggcacuggcagggag

SEQ ID NO: 308537 - RNA, 32 nt, Human
acuuucauacccugaccucugaccucaccuac

SEQ ID NO: 308538 - RNA, 32 nt, Human
acuuucauggaaguguugcugaggucagccug

SEQ ID NO: 308539 - RNA, 32 nt, Human
acuuucauguguugucuuaacuuuuuaaauuu

SEQ ID NO: 308540 - RNA, 32 nt, Human
acuuucauucaggcuggagugcaguggcauga

SEQ ID NO: 308541 - RNA, 32 nt, Human
acuuuccaaugccacagacaacucacauuguu

SEQ ID NO: 308542 - RNA, 31 nt, Human
acuuuccacagaaguacuuguaggagcucuc

SEQ ID NO: 308543 - RNA, 32 nt, Human
acuuuccacagcccaggagagcuucugaaagg

SEQ ID NO: 308544 - RNA, 32 nt, Human
acuuuccaccacugucagccuggaaagagauc

SEQ ID NO: 308545 - RNA, 32 nt, Human
acuuuccacgugguaccuagauuugcaaauuc

SEQ ID NO: 308546 - RNA, 32 nt, Human
acuuuccagagauuuuaccagagguuuaagau

SEQ ID NO: 308547 - RNA, 32 nt, Human
acuuuccagcucccccucaucaugccuccucc

SEQ ID NO: 308548 - RNA, 32 nt, Human
acuuuccaggaggcuggauggcuuccaggguc

SEQ ID NO: 308549 - RNA, 32 nt, Human
acuuuccagggcaaaaagggcccaggguuaua

SEQ ID NO: 308550 - RNA, 32 nt, Human
acuuuccaguuuaaaagauuuagagaaacugu

SEQ ID NO: 308551 - RNA, 32 nt, Human
acuuuccauaccacagugcaggaaaagcugau

SEQ ID NO: 308552 - RNA, 32 nt, Human
acuuuccauccccacaccauugccugcuccuc

SEQ ID NO: 308553 - RNA, 32 nt, Human
acuuucccaacauccucugcuccuagccuccc

SEQ ID NO: 308554 - RNA, 32 nt, Human
acuuucccaagccagggugugcggagcuuccc

SEQ ID NO: 308555 - RNA, 32 nt, Human
acuuucccacacuuggugcccuggagcaccuu

SEQ ID NO: 308556 - RNA, 32 nt, Human
acuuucccagggaagccugauuucacuuugcc

SEQ ID NO: 308557 - RNA, 32 nt, Human
acuuuccccaggcuccaguggccuggauguca

SEQ ID NO: 308558 - RNA, 32 nt, Human
acuuucccccacccuucccacccucuagacaa

SEQ ID NO: 308559 - RNA, 32 nt, Human
acuuucccccucaguccuggcaaugggguuug

SEQ ID NO: 308560 - RNA, 32 nt, Human
acuuuccccugccugcuccuccaugcugugag

SEQ ID NO: 308561 - RNA, 32 nt, Human
acuuucccugguuaagaaaugaccucaucugu

SEQ ID NO: 308562 - RNA, 32 nt, Human
acuuuccgugagccugugggccaggccucuuu

SEQ ID NO: 308563 - RNA, 32 nt, Human
acuuuccuauuuuucucccaguagucagcucc

SEQ ID NO: 308564 - RNA, 32 nt, Human
acuuuccucacaaaugaguaaaagccaauuua

SEQ ID NO: 308565 - RNA, 32 nt, Human
acuuuccucagccaaaaccaaugcagcacaca

SEQ ID NO: 308566 - RNA, 32 nt, Human
acuuuccuccaggggcuuccucacuggggaau

SEQ ID NO: 308567 - RNA, 32 nt, Human
acuuuccuccuuguccucugauucugagcaaa

SEQ ID NO: 308568 - RNA, 32 nt, Human
acuuuccucuccugcuuucugccugugacuag

SEQ ID NO: 308569 - RNA, 32 nt, Human
acuuuccucuuaggaaccuggccugggccagg

SEQ ID NO: 308570 - RNA, 32 nt, Human
acuuuccucuucagauccuggucugcaccucu

SEQ ID NO: 308571 - RNA, 32 nt, Human
acuuuccugagcagggauaugucuccucuccu

SEQ ID NO: 308572 - RNA, 32 nt, Human
acuuuccugaguagcugacauuacggguacac

SEQ ID NO: 308573 - RNA, 32 nt, Human
acuuuccugcagcugaucacacagcaaacaua

SEQ ID NO: 308574 - RNA, 32 nt, Human
acuuuccugcccaaccugccuccccaacggcc

SEQ ID NO: 308575 - RNA, 32 nt, Human
acuuuccuguacuccagccucugcuggcuccc

SEQ ID NO: 308576 - RNA, 32 nt, Human
acuuuccuguguauauuuaguacucugauguu

SEQ ID NO: 308577 - RNA, 32 nt, Human
acuuuccuucuuccucuccaucacuucuuccc

SEQ ID NO: 308578 - RNA, 32 nt, Human
acuuuccuuucugugcuccuuccaaguuaaau

SEQ ID NO: 308579 - RNA, 32 nt, Human
acuuuccuuugucauuauuagucuucaaaagc

SEQ ID NO: 308580 - RNA, 25 nt, Human
acuuucgaaauuucauuuuccuuca

SEQ ID NO: 308581 - RNA, 32 nt, Human
acuuucgcacacacaaacacgcuaggacgcuc

SEQ ID NO: 308582 - RNA, 32 nt, Human
acuuucgccauguuguccaggcuggucucgaa

SEQ ID NO: 308583 - RNA, 32 nt, Human
acuuucuacaacagcugaccucugcugagcgc

SEQ ID NO: 308584 - RNA, 32 nt, Human
acuuucuacuauaguuuacagaacaaauuauu

SEQ ID NO: 308585 - RNA, 32 nt, Human
acuuucuacuuucauaccuuuuuaaucaguaa

SEQ ID NO: 308586 - RNA, 32 nt, Human
acuuucuagccagaggagagaggacccccuga

SEQ ID NO: 308587 - RNA, 32 nt, Human
acuuucuagcugaacacucagcuucauccacu

SEQ ID NO: 308588 - RNA, 32 nt, Human
acuuucuaguugcccucuaccugacuccugac

SEQ ID NO: 308589 - RNA, 32 nt, Human
acuuucuauacccagagcuggcgcaggggagg

SEQ ID NO: 308590 - RNA, 32 nt, Human
acuuucuaucucauucuguaacuuucaagccu

SEQ ID NO: 308591 - RNA, 32 nt, Human
acuuucucagggaauuggacagaggaaaggaa

SEQ ID NO: 308592 - RNA, 32 nt, Human
acuuucucauguccagggucagauuacaagag

SEQ ID NO: 308593 - RNA, 32 nt, Human
acuuucuccccaccccuccccgacccccacgg

SEQ ID NO: 308594 - RNA, 32 nt, Human
acuuucucccuccaccuggagcaugggcuaac

SEQ ID NO: 308595 - RNA, 32 nt, Human
acuuucuccuccaaccuccaucagucccaggg

SEQ ID NO: 308596 - RNA, 32 nt, Human
acuuucuccucuccccucucccaagcacaucu

SEQ ID NO: 308597 - RNA, 32 nt, Human
acuuucucucacaggcugcuagaacagcccag

SEQ ID NO: 308598 - RNA, 32 nt, Human
acuuucucuccucuuguagcaagccucagacu

SEQ ID NO: 308599 - RNA, 32 nt, Human
acuuucugacaggcacauaagccccagguuua

SEQ ID NO: 308600 - RNA, 32 nt, Human
acuuucugaggaagacaauauuaagaacagcc

SEQ ID NO: 308601 - RNA, 32 nt, Human
acuuucugccuggaguguaugacugcacauga

SEQ ID NO: 308602 - RNA, 32 nt, Human
acuuucugcgcuucgaccacuaccucaacccc

SEQ ID NO: 308603 - RNA, 32 nt, Human
acuuucugcuggaagcugucaggcugggacag

SEQ ID NO: 308604 - RNA, 32 nt, Human
acuuucugcuuugccuccuuccauggccauuc

SEQ ID NO: 308605 - RNA, 22 nt, Human
acuuucugcuuuucuuucuuuc

SEQ ID NO: 308606 - RNA, 32 nt, Human
acuuucuggagcuguuuuauagaagaugaugg

SEQ ID NO: 308607 - RNA, 32 nt, Human
acuuucugugugaacuaaagugauucaauguc

SEQ ID NO: 308608 - RNA, 22 nt, Human
acuuucuguucugaaagcuaag

SEQ ID NO: 308609 - RNA, 32 nt, Human
acuuucuguuuguauuggcagagguagugagg

SEQ ID NO: 308610 - RNA, 31 nt, Human
acuuucuuaauauuuuuacaugcagaguauu

SEQ ID NO: 308611 - RNA, 32 nt, Human
acuuucuuagggaggguaaaagacugaagauu

SEQ ID NO: 308612 - RNA, 32 nt, Human
acuuucuucagaaaugggagagcugcugcaua

SEQ ID NO: 308613 - RNA, 32 nt, Human
acuuucuucucccuuggcuuauaucucuucac

SEQ ID NO: 308614 - RNA, 32 nt, Human
acuuucuucuucuuuuucuucucugggauccc

SEQ ID NO: 308615 - RNA, 32 nt, Human
acuuucuugguauaacaguccuaaagauuaca

SEQ ID NO: 308616 - RNA, 32 nt, Human
acuuucuuuaagucucacauugcuaacaugac

SEQ ID NO: 308617 - RNA, 32 nt, Human
acuuucuuuuucuuccucuuccuucuccuucu

SEQ ID NO: 308618 - RNA, 32 nt, Human
acuuugaaauaacauggagaacauacauggau

SEQ ID NO: 308619 - RNA, 32 nt, Human
acuuugaauagaaugggaggcagguuugcccu

SEQ ID NO: 308620 - RNA, 32 nt, Human
acuuugaauuugaguuugaggcuuagaagcug

SEQ ID NO: 308621 - RNA, 32 nt, Human
acuuugacacccaggcuggagugcaguggugc

SEQ ID NO: 308622 - RNA, 32 nt, Human
acuuugacagugauaaggcaccaccuggccuu

SEQ ID NO: 308623 - RNA, 32 nt, Human
acuuugacagugccuuucucucccagagggag

SEQ ID NO: 308624 - RNA, 32 nt, Human
acuuugacauccaagaacucaccaagauguuu

SEQ ID NO: 308625 - RNA, 32 nt, Human
acuuugaccaucaccuucccagccucuguaac

SEQ ID NO: 308626 - RNA, 32 nt, Human
acuuugacccacccuuucugagccugcagccu

SEQ ID NO: 308627 - RNA, 32 nt, Human
acuuugacccccaggcuggagugcaguggcac

SEQ ID NO: 308628 - RNA, 32 nt, Human
acuuugaccuggcugcaucuuuccucagcucu

SEQ ID NO: 308629 - RNA, 32 nt, Human
acuuugagacaggccugggcccauggaaccgc

SEQ ID NO: 308630 - RNA, 24 nt, Human
acuuugagaccacuaaggcgggug

SEQ ID NO: 308631 - RNA, 32 nt, Human
acuuugagacccagaaauaaauucuuuccuuu

SEQ ID NO: 308632 - RNA, 23 nt, Human
acuuugagaggcaaagacaggua

SEQ ID NO: 308633 - RNA, 27 nt, Human
acuuugagaggccaaggcaggcaggug

SEQ ID NO: 308634 - RNA, 32 nt, Human
acuuugagaggccgaagggggaggaucgcuug

SEQ ID NO: 308635 - RNA, 23 nt, Human
acuuugagaggccgaggcgggug

SEQ ID NO: 308636 - RNA, 32 nt, Human
acuuugagaggcugaggcagggcagauugcau

SEQ ID NO: 308637 - RNA, 32 nt, Human
acuuugagaggcuugcccauggcuggcaugaa

SEQ ID NO: 308638 - RNA, 32 nt, Human
acuuugagcagacgugccuggccacacuguau

SEQ ID NO: 308639 - RNA, 23 nt, Human
acuuugagccaugcuaggaggua

SEQ ID NO: 308640 - RNA, 32 nt, Human
acuuugagcgucuuuccaugugcuugcugcug

SEQ ID NO: 308641 - RNA, 32 nt, Human
acuuugagcuccaaagaauuauuccuagcagg

SEQ ID NO: 308642 - RNA, 32 nt, Human
acuuugagcuucauuuucuucuugucaggauc

SEQ ID NO: 308643 - RNA, 32 nt, Human
acuuugagcuuuguuaauaaacuauuaugcag

SEQ ID NO: 308644 - RNA, 32 nt, Human
acuuugagguuagucugaaucuugaacuuuaa

SEQ ID NO: 308645 - RNA, 21 nt, Human
acuuugaguaguuuguucuaa

SEQ ID NO: 308646 - RNA, 32 nt, Human
acuuugaguucagagcaugagacuuuuaguuc

SEQ ID NO: 308647 - RNA, 31 nt, Human
acuuugauaauaaauaccgguuccugaaaaa

SEQ ID NO: 308648 - RNA, 32 nt, Human
acuuugauacuaacuccagucuuacuauuauu

SEQ ID NO: 308649 - RNA, 23 nt, Human
acuuugauaggcugaggcaggug

SEQ ID NO: 308650 - RNA, 32 nt, Human
acuuugauaucugaucaaauguauagacuugg

SEQ ID NO: 308651 - RNA, 32 nt, Human
acuuugaucaccauuucucuccaggcuuucug

SEQ ID NO: 308652 - RNA, 32 nt, Human
acuuugauggaacuuccauucuguggggaaga

SEQ ID NO: 308653 - RNA, 32 nt, Human
acuuugaugggggcagugagggagacagcccc

SEQ ID NO: 308654 - RNA, 32 nt, Human
acuuugauguuagcuacuuugagaaccacugg

SEQ ID NO: 308655 - RNA, 32 nt, Human
acuuugauucucagggacuguauuauuccuau

SEQ ID NO: 308656 - RNA, 32 nt, Human
acuuugauuuauaaagagaagacugagggcgg

SEQ ID NO: 308657 - RNA, 20 nt, Human
acuuugcaaauauguucuaa

SEQ ID NO: 308658 - RNA, 32 nt, Human
acuuugcaaccagguacguuacaaccaggagu

SEQ ID NO: 308659 - RNA, 32 nt, Human
acuuugcaaccagguaguugcaaccaggaguc

SEQ ID NO: 308660 - RNA, 32 nt, Human
acuuugcaccuccuauccccaggguccgccga

SEQ ID NO: 308661 - RNA, 32 nt, Human
acuuugcacuccucaaauguccuuguuuaaaa

SEQ ID NO: 308662 - RNA, 32 nt, Human
acuuugcacucuuccucuucuccuuuuuccgc

SEQ ID NO: 308663 - RNA, 32 nt, Human
acuuugcagcacagcugagagaggcugucugu

SEQ ID NO: 308664 - RNA, 32 nt, Human
acuuugcagcugguugagaacagguuggagga

SEQ ID NO: 308665 - RNA, 32 nt, Human
acuuugcaggcaguccuuccagaugguucagc

SEQ ID NO: 308666 - RNA, 32 nt, Human
acuuugcaguaugaaaauggcuagagauuggg

SEQ ID NO: 308667 - RNA, 32 nt, Human
acuuugcaucacagucacaugcccauucacac

SEQ ID NO: 308668 - RNA, 32 nt, Human
acuuugccacccaggugaggugcuguguucau

SEQ ID NO: 308669 - RNA, 32 nt, Human
acuuugccaccuguaggccacaccccauccag

SEQ ID NO: 308670 - RNA, 32 nt, Human
acuuugccaccuguuugaugugcaguggaaac

SEQ ID NO: 308671 - RNA, 32 nt, Human
acuuugccaugaacuccugggcuuugggggaa

SEQ ID NO: 308672 - RNA, 32 nt, Human
acuuugccauugccauggacaaguuuggcuuc

SEQ ID NO: 308673 - RNA, 32 nt, Human
acuuugcccugcccucugccuccagggcucca

SEQ ID NO: 308674 - RNA, 32 nt, Human
acuuugccucaagcaaccucuagcucccacaa

SEQ ID NO: 308675 - RNA, 32 nt, Human
acuuugccucguacaauuaauagugauauuuu

SEQ ID NO: 308676 - RNA, 32 nt, Human
acuuugccucuuccuguuucuccugaggaugc

SEQ ID NO: 308677 - RNA, 32 nt, Human
acuuugccugcagcuucugcuuuccugaaauu

SEQ ID NO: 308678 - RNA, 32 nt, Human
acuuugccugcugcacaggagcucccaacacu

SEQ ID NO: 308679 - RNA, 32 nt, Human
acuuugcgcccacuccuagcggcaccggcuua

SEQ ID NO: 308680 - RNA, 32 nt, Human
acuuugcuaaagcagaaccucccagcucuuug

SEQ ID NO: 308681 - RNA, 32 nt, Human
acuuugcuaacugugcuccucacuuccucuuc

SEQ ID NO: 308682 - RNA, 32 nt, Human
acuuugcuaggagauacucuucugccuccuag

SEQ ID NO: 308683 - RNA, 32 nt, Human
acuuugcucccaggcuggaaugcaguggcuau

SEQ ID NO: 308684 - RNA, 32 nt, Human
acuuugcugauuuccccucuucccuucaacau

SEQ ID NO: 308685 - RNA, 32 nt, Human
acuuugcugccccaccaucuugcugacaacuu

SEQ ID NO: 308686 - RNA, 32 nt, Human
acuuugcugcuccugucuguugcccagagagg

SEQ ID NO: 308687 - RNA, 32 nt, Human
acuuugcugcuucuuucuggguuguggccgau

SEQ ID NO: 308688 - RNA, 32 nt, Human
acuuugcuuaauacuuagguagcccuuauguc

SEQ ID NO: 308689 - RNA, 32 nt, Human
acuuugcuucccaggcuggagugcaguggugc

SEQ ID NO: 308690 - RNA, 32 nt, Human
acuuuggaaacugccauuucauucacacaagg

SEQ ID NO: 308691 - RNA, 32 nt, Human
acuuuggaagcagacaaagaucacuauaagag

SEQ ID NO: 308692 - RNA, 23 nt, Human
acuuuggaaggccgaggcaggug

SEQ ID NO: 308693 - RNA, 32 nt, Human
acuuuggacacaaaccaaaacacacaccaaau

SEQ ID NO: 308694 - RNA, 32 nt, Human
acuuuggaccugccuuugucgugguuccugcc

SEQ ID NO: 308695 - RNA, 32 nt, Human
acuuuggaccugcugcccuuggcuccaauaga

SEQ ID NO: 308696 - RNA, 32 nt, Human
acuuuggaggaaucuuuugaaugugauggauc

SEQ ID NO: 308697 - RNA, 32 nt, Human
acuuuggaggagagaggcuagagagcaaagac

SEQ ID NO: 308698 - RNA, 32 nt, Human
acuuuggaggcugaagcggaaggaucccuugg

SEQ ID NO: 308699 - RNA, 32 nt, Human
acuuuggaggcugaggcaggaggauggcuuga

SEQ ID NO: 308700 - RNA, 32 nt, Human
acuuuggagggcucugacaccaugcucacaga

SEQ ID NO: 308701 - RNA, 32 nt, Human
acuuuggagguggggcucugcagcugugagau

SEQ ID NO: 308702 - RNA, 32 nt, Human
acuuuggagugaaguuuaaggaaacagucacc

SEQ ID NO: 308703 - RNA, 32 nt, Human
acuuuggauaaguacuuagaaauggaauuucc

SEQ ID NO: 308704 - RNA, 32 nt, Human
acuuuggaugcucccaucuccaccuccaguga

SEQ ID NO: 308705 - RNA, 32 nt, Human
acuuuggaugggucacuuguccucaguuuuuc

SEQ ID NO: 308706 - RNA, 32 nt, Human
acuuuggcaaugccuuggccuccuggaagcau

SEQ ID NO: 308707 - RNA, 32 nt, Human
acuuuggcagaauauuaugaacaggaagaaau

SEQ ID NO: 308708 - RNA, 32 nt, Human
acuuuggcagccaguugggcaguggcucacaa

SEQ ID NO: 308709 - RNA, 32 nt, Human
acuuuggcauaugccagccuguuccugccaca

SEQ ID NO: 308710 - RNA, 31 nt, Human
acuuuggcaucuacauuacauuuaaagccaa

SEQ ID NO: 308711 - RNA, 32 nt, Human
acuuuggccaagguggaaaaagcuuaccauga

SEQ ID NO: 308712 - RNA, 32 nt, Human
acuuuggcugugagccaggccuaggaugguuc

SEQ ID NO: 308713 - RNA, 32 nt, Human
acuuugggaagcagagguggcaggaucauucc

SEQ ID NO: 308714 - RNA, 32 nt, Human
acuuugggaagcugaggcaggaagauugagcc

SEQ ID NO: 308715 - RNA, 32 nt, Human
acuuugggaagcugaggcagguaagucacuug

SEQ ID NO: 308716 - RNA, 23 nt, Human
acuuugggagaccgagacaggug

SEQ ID NO: 308717 - RNA, 23 nt, Human
acuuugggagaccgaggcaggug

SEQ ID NO: 308718 - RNA, 32 nt, Human
acuuugggagacugaggugggagcaucacuug

SEQ ID NO: 308719 - RNA, 32 nt, Human
acuuugggagccaagguggguggaucacuuga

SEQ ID NO: 308720 - RNA, 32 nt, Human
acuuugggaggcagaggagggaggaucacuug

SEQ ID NO: 308721 - RNA, 32 nt, Human
acuuugggaggcagaggccgguggguugcuuu

SEQ ID NO: 308722 - RNA, 32 nt, Human
acuuugggaggcagaggcgggaggauugcuug

SEQ ID NO: 308723 - RNA, 32 nt, Human
acuuugggaggcagaggugggaggacugcuug

SEQ ID NO: 308724 - RNA, 32 nt, Human
acuuugggaggcagaggugggaggauugcuug

SEQ ID NO: 308725 - RNA, 32 nt, Human
acuuugggaggcagugggagaaucgcuugagc

SEQ ID NO: 308726 - RNA, 32 nt, Human
acuuugggaggccaagccagauggaucaugaa

SEQ ID NO: 308727 - RNA, 32 nt, Human
acuuugggaggccaaggcaggagaagcgcuug

SEQ ID NO: 308728 - RNA, 32 nt, Human
acuuugggaggccgaagcaggaggauugcuug

SEQ ID NO: 308729 - RNA, 23 nt, Human
acuuugggaggccgagacaggug

SEQ ID NO: 308730 - RNA, 32 nt, Human
acuuugggaggccgaggcaggagaaucgcuug

SEQ ID NO: 308731 - RNA, 32 nt, Human
acuuugggaggccgaggcaggagcaucgcuug

SEQ ID NO: 308732 - RNA, 23 nt, Human
acuuugggaggccgaggcaggua

SEQ ID NO: 308733 - RNA, 23 nt, Human
acuuugggaggccgaggcaggug

SEQ ID NO: 308734 - RNA, 32 nt, Human
acuuugggaggcuaggugggcagaucacgagg

SEQ ID NO: 308735 - RNA, 32 nt, Human
acuuugggaggcugaagcaggaggacugcuug

SEQ ID NO: 308736 - RNA, 32 nt, Human
acuuugggaggcugaagcaggaggauugcuug

SEQ ID NO: 308737 - RNA, 32 nt, Human
acuuugggaggcugagacaggagcaucugcuu

SEQ ID NO: 308738 - RNA, 23 nt, Human
acuuugggaggcugagacaggug

SEQ ID NO: 308739 - RNA, 32 nt, Human
acuuugggaggcugaggaaggggcaucacuug

SEQ ID NO: 308740 - RNA, 32 nt, Human
acuuugggaggcugaggcaggaagcacacugg

SEQ ID NO: 308741 - RNA, 32 nt, Human
acuuugggaggcugaggcaggaggaggauaac

SEQ ID NO: 308742 - RNA, 32 nt, Human
acuuugggaggcuuugggaggcugagguggga

SEQ ID NO: 308743 - RNA, 32 nt, Human
acuuugggagguaggaggaucacuugagccca

SEQ ID NO: 308744 - RNA, 23 nt, Human
acuuugggagguccaggcaggug

SEQ ID NO: 308745 - RNA, 32 nt, Human
acuuugggagguggaggcagguggaucacgau

SEQ ID NO: 308746 - RNA, 23 nt, Human
acuuugggagguggaggcgggug

SEQ ID NO: 308747 - RNA, 32 nt, Human
acuuugggagguggaggcggguggaucacaag

SEQ ID NO: 308748 - RNA, 23 nt, Human
acuuugggaguccgaggcaggug

SEQ ID NO: 308749 - RNA, 22 nt, Human
acuuugggcaagucucuguacu

SEQ ID NO: 308750 - RNA, 32 nt, Human
acuuugggcaggucacccucccugucuguaaa

SEQ ID NO: 308751 - RNA, 32 nt, Human
acuuugggcauaaaauccuucucuaaauaaau

SEQ ID NO: 308752 - RNA, 32 nt, Human
acuuugggcuuuucucaugacugugugggucg

SEQ ID NO: 308753 - RNA, 32 nt, Human
acuuuggggaaagaaaaggaagcugcaggaau

SEQ ID NO: 308754 - RNA, 32 nt, Human
acuuuggggagccaaggcaggagaaucgcuuu

SEQ ID NO: 308755 - RNA, 32 nt, Human
acuuuggggaggacaaagugggcggaucaccu

SEQ ID NO: 308756 - RNA, 32 nt, Human
acuuuggguagaagaauggugaaauuaucgau

SEQ ID NO: 308757 - RNA, 32 nt, Human
acuuugggugugugugcaugcacaugugugug

SEQ ID NO: 308758 - RNA, 32 nt, Human
acuuuggguuuuagcauuaacuuuaugcaaag

SEQ ID NO: 308759 - RNA, 21 nt, Human
acuuugguaguuguguaucug

SEQ ID NO: 308760 - RNA, 32 nt, Human
acuuuggucauuggauauuucugauccuuauu

SEQ ID NO: 308761 - RNA, 32 nt, Human
acuuugguccuaccaccucuuguuucaucuuu

SEQ ID NO: 308762 - RNA, 32 nt, Human
acuuugguguaaaauuccaccaguuuccagcc

SEQ ID NO: 308763 - RNA, 32 nt, Human
acuuugguguuucacuucaugcucugaauacu

SEQ ID NO: 308764 - RNA, 32 nt, Human
acuuugguuaagaagagaagacagccagaggc

SEQ ID NO: 308765 - RNA, 32 nt, Human
acuuugguuccauagaacaaguuuucaacuug

SEQ ID NO: 308766 - RNA, 21 nt, Human
acuuugguuuuugauaccugu

SEQ ID NO: 308767 - RNA, 32 nt, Human
acuuuguaacccaggcuggaaugcaauggcau

SEQ ID NO: 308768 - RNA, 32 nt, Human
acuuuguaacuuuuguuacugugaauucaaac

SEQ ID NO: 308769 - RNA, 32 nt, Human
acuuuguacccaucaugugcucuguuuugaca

SEQ ID NO: 308770 - RNA, 22 nt, Human
acuuuguacucccaccaccccc

SEQ ID NO: 308771 - RNA, 32 nt, Human
acuuuguagagauugacuuccuaagcuacuua

SEQ ID NO: 308772 - RNA, 23 nt, Human
acuuuguagauguuuacaucuuu

SEQ ID NO: 308773 - RNA, 32 nt, Human
acuuuguagccuuuagcacccuucccacugua

SEQ ID NO: 308774 - RNA, 32 nt, Human
acuuuguaggacuggacacagacagcagacau

SEQ ID NO: 308775 - RNA, 32 nt, Human
acuuuguagggugggggauuacugagagucag

SEQ ID NO: 308776 - RNA, 32 nt, Human
acuuugucacccaggcuagagugcaguggcau

SEQ ID NO: 308777 - RNA, 32 nt, Human
acuuugucacccaggcuagagugcaguggugc

SEQ ID NO: 308778 - RNA, 32 nt, Human
acuuugucacccaggcuggaaugcaguggcac

SEQ ID NO: 308779 - RNA, 32 nt, Human
acuuugucacccaggcuggaguauaguggcac

SEQ ID NO: 308780 - RNA, 32 nt, Human
acuuugucacccaggcuggagugcaauggcgu

SEQ ID NO: 308781 - RNA, 32 nt, Human
acuuugucacccaggcuggagugcaguggcac

SEQ ID NO: 308782 - RNA, 32 nt, Human
acuuuguccccacaugggguggggagcagagu

SEQ ID NO: 308783 - RNA, 32 nt, Human
acuuugucccccaggcuggagugcagugguac

SEQ ID NO: 308784 - RNA, 32 nt, Human
acuuugucccuggccuccaaaggcuuagggcg

SEQ ID NO: 308785 - RNA, 32 nt, Human
acuuuguccggagcugaggaagugguuucugu

SEQ ID NO: 308786 - RNA, 32 nt, Human
acuuuguccuccucguccccuaccucaacaaa

SEQ ID NO: 308787 - RNA, 32 nt, Human
acuuugucgaagaucaguuggcuguuaaguau

SEQ ID NO: 308788 - RNA, 32 nt, Human
acuuugucgcccaggccggagugcaguggugc

SEQ ID NO: 308789 - RNA, 32 nt, Human
acuuugucgcccaggcuggaguacaguggugc

SEQ ID NO: 308790 - RNA, 32 nt, Human
acuuugucgcccaggcuggagugcaguggcac

SEQ ID NO: 308791 - RNA, 32 nt, Human
acuuugucgcccaggcuggagugcaguggugu

SEQ ID NO: 308792 - RNA, 32 nt, Human
acuuugucgcccgggcaggagugcaguggcuc

SEQ ID NO: 308793 - RNA, 32 nt, Human
acuuugucuccucuguugcuucuguuucugac

SEQ ID NO: 308794 - RNA, 32 nt, Human
acuuugucuugcaggcaacagggagccuccaa

SEQ ID NO: 308795 - RNA, 32 nt, Human
acuuugucuugcauuguccuguauuuaucaca

SEQ ID NO: 308796 - RNA, 32 nt, Human
acuuugucuuucuaagguaagaagccuucacc

SEQ ID NO: 308797 - RNA, 32 nt, Human
acuuugugcccuagacuggagugcaauggcgc

SEQ ID NO: 308798 - RNA, 32 nt, Human
acuuugugccuaucuuuucacugacaauaaag

SEQ ID NO: 308799 - RNA, 32 nt, Human
acuuuguggagcaguguuuugaccuuugauac

SEQ ID NO: 308800 - RNA, 32 nt, Human
acuuuguggggcugagggagaaucacuugggc

SEQ ID NO: 308801 - RNA, 32 nt, Human
acuuugugugcucuuaaccuucugagugcugc

SEQ ID NO: 308802 - RNA, 32 nt, Human
acuuugugugguaagagguuugaguaguccua

SEQ ID NO: 308803 - RNA, 32 nt, Human
acuuugugugugugcguguguguauacauaca

SEQ ID NO: 308804 - RNA, 22 nt, Human
acuuuguguucauuucauuuca

SEQ ID NO: 308805 - RNA, 32 nt, Human
acuuuguuacccaggcuggagugcaguggcac

SEQ ID NO: 308806 - RNA, 19 nt, Human
acuuuguucauuucacuga

SEQ ID NO: 308807 - RNA, 32 nt, Human
acuuuguugcccagaggaugugcaguugucau

SEQ ID NO: 308808 - RNA, 32 nt, Human
acuuuguugcccaggcuggagcgcaguggggu

SEQ ID NO: 308809 - RNA, 32 nt, Human
acuuuguugcccaggcuggagugcaguggucu

SEQ ID NO: 308810 - RNA, 32 nt, Human
acuuuguugcccaggcuggagugcgguggcgu

SEQ ID NO: 308811 - RNA, 32 nt, Human
acuuuguugcuaucauccuccuuucucuuauu

SEQ ID NO: 308812 - RNA, 32 nt, Human
acuuuguuuagacacagauauuuggaauuagc

SEQ ID NO: 308813 - RNA, 32 nt, Human
acuuuguuucaaauccccaacccugguggcgg

SEQ ID NO: 308814 - RNA, 32 nt, Human
acuuuguuuucuaugaaaaugauauggaaacu

SEQ ID NO: 308815 - RNA, 32 nt, Human
acuuuguuuuucucccugugccauuuacccuu

SEQ ID NO: 308816 - RNA, 32 nt, Human
acuuuuaacaucuggcauucggaauggaaaug

SEQ ID NO: 308817 - RNA, 32 nt, Human
acuuuuaagggauuuuuauuaguuuaaaggua

SEQ ID NO: 308818 - RNA, 32 nt, Human
acuuuuaauuugcucuuagguucuaucucugu

SEQ ID NO: 308819 - RNA, 32 nt, Human
acuuuuacaagaaaaucucugucucuucaaca

SEQ ID NO: 308820 - RNA, 32 nt, Human
acuuuuacaccuaucuuuaaaaggaauuuaaa

SEQ ID NO: 308821 - RNA, 32 nt, Human
acuuuuaccgcccaggcuggagugcagugcca

SEQ ID NO: 308822 - RNA, 32 nt, Human
acuuuuacuuuuacacaagaugagcacgcgug

SEQ ID NO: 308823 - RNA, 32 nt, Human
acuuuuagaagagucuaaggauccucagucau

SEQ ID NO: 308824 - RNA, 32 nt, Human
acuuuuaggucauccaaccucuuuccucucug

SEQ ID NO: 308825 - RNA, 32 nt, Human
acuuuuaguagagacacaguuuugccauguug

SEQ ID NO: 308826 - RNA, 32 nt, Human
acuuuuaguucauacuguaucuucucaggaca

SEQ ID NO: 308827 - RNA, 32 nt, Human
acuuuuauauccaggaugauuacagugaugac

SEQ ID NO: 308828 - RNA, 32 nt, Human
acuuuuauaugcuuuuucucagaucugguuuc

SEQ ID NO: 308829 - RNA, 32 nt, Human
acuuuuaugcagucacggagugagugaacaug

SEQ ID NO: 308830 - RNA, 32 nt, Human
acuuuuauuucaaacccucugccuccuuccuu

SEQ ID NO: 308831 - RNA, 32 nt, Human
acuuuucaaaaugccagcaaguuuuuguuugu

SEQ ID NO: 308832 - RNA, 32 nt, Human
acuuuucaaaauuuacaaaucaggauuauaua

SEQ ID NO: 308833 - RNA, 23 nt, Human
acuuuucaaauaaaauacuugaa

SEQ ID NO: 308834 - RNA, 24 nt, Human
acuuuucaaaucuaguaauuugaa

SEQ ID NO: 308835 - RNA, 32 nt, Human
acuuuucaacuucauaaugguuaauuuuguuu

SEQ ID NO: 308836 - RNA, 32 nt, Human
acuuuucaagccuuccuuccauuguuuuucuu

SEQ ID NO: 308837 - RNA, 32 nt, Human
acuuuucaaucaggaauaaaauuccuuaaagc

SEQ ID NO: 308838 - RNA, 32 nt, Human
acuuuucacaccucccucccacacccagccua

SEQ ID NO: 308839 - RNA, 32 nt, Human
acuuuucacugaaaugguucuaaaaauauagg

SEQ ID NO: 308840 - RNA, 32 nt, Human
acuuuucagccaauaauuuauagccuuucccu

SEQ ID NO: 308841 - RNA, 32 nt, Human
acuuuucaggagaaaccugagcaugauuuugg

SEQ ID NO: 308842 - RNA, 32 nt, Human
acuuuucauccagcgccagcacggugugagag

SEQ ID NO: 308843 - RNA, 32 nt, Human
acuuuuccacagaaagauaagguaaacaagau

SEQ ID NO: 308844 - RNA, 32 nt, Human
acuuuuccaccaccugcguccaaaaagaaugu

SEQ ID NO: 308845 - RNA, 23 nt, Human
acuuuuccaccaguguauuugaa

SEQ ID NO: 308846 - RNA, 32 nt, Human
acuuuuccagccucauggguauggcacucuua

SEQ ID NO: 308847 - RNA, 32 nt, Human
acuuuuccaggccacaauuguaaaagcuguaa

SEQ ID NO: 308848 - RNA, 32 nt, Human
acuuuuccagggaggaagaggcagcaggagcu

SEQ ID NO: 308849 - RNA, 32 nt, Human
acuuuuccaguaaaugaagcaagcacugaaua

SEQ ID NO: 308850 - RNA, 32 nt, Human
acuuuucccuauuuccccuccuaucccucugc

SEQ ID NO: 308851 - RNA, 23 nt, Human
acuuuucccuucucaguuccucu

SEQ ID NO: 308852 - RNA, 32 nt, Human
acuuuuccuaguuuucaguauuacuuucaugu

SEQ ID NO: 308853 - RNA, 32 nt, Human
acuuuuccucauucuguggggccauaaaccua

SEQ ID NO: 308854 - RNA, 32 nt, Human
acuuuuccuccaccuuccucugugcccgagcu

SEQ ID NO: 308855 - RNA, 32 nt, Human
acuuuuccuguuguuguacacacacaacagaa

SEQ ID NO: 308856 - RNA, 32 nt, Human
acuuuucgagagaagggaauagggaagacagc

SEQ ID NO: 308857 - RNA, 32 nt, Human
acuuuucggaggccgaggagggcagaucacuu

SEQ ID NO: 308858 - RNA, 32 nt, Human
acuuuucuaaucauuguacauuucucagagug

SEQ ID NO: 308859 - RNA, 20 nt, Human
acuuuucuaccuugagccaa

SEQ ID NO: 308860 - RNA, 32 nt, Human
acuuuucuccccucucuuucuaagagaccuga

SEQ ID NO: 308861 - RNA, 32 nt, Human
acuuuucucccuuuucccuccuguggcuugca

SEQ ID NO: 308862 - RNA, 32 nt, Human
acuuuucuccuuggcuucuguuggcacucacc

SEQ ID NO: 308863 - RNA, 32 nt, Human
acuuuucugaaaaaucuccauuguugaggaga

SEQ ID NO: 308864 - RNA, 32 nt, Human
acuuuucuguaacgccugcuugucccugccca

SEQ ID NO: 308865 - RNA, 23 nt, Human
acuuuucuguaaguuucuauacu

SEQ ID NO: 308866 - RNA, 32 nt, Human
acuuuucuugacuugccuguuuuggccauuag

SEQ ID NO: 308867 - RNA, 32 nt, Human
acuuuugaaaaauaagcuauucuauucaguuu

SEQ ID NO: 308868 - RNA, 32 nt, Human
acuuuugaagcacaaauuuauuggcauuuaau

SEQ ID NO: 308869 - RNA, 32 nt, Human
acuuuugacauuugggaugaaaagccauaugu

SEQ ID NO: 308870 - RNA, 32 nt, Human
acuuuugacccaccccuuccuggaucacuccu

SEQ ID NO: 308871 - RNA, 32 nt, Human
acuuuugagauuuauucaguccagccaagaga

SEQ ID NO: 308872 - RNA, 32 nt, Human
acuuuugaggcugaggcgggcggauuaccuga

SEQ ID NO: 308873 - RNA, 32 nt, Human
acuuuugauuguacaauuguacauuuguauac

SEQ ID NO: 308874 - RNA, 32 nt, Human
acuuuugauuugguucuugccaauuguuuuau

SEQ ID NO: 308875 - RNA, 32 nt, Human
acuuuugauuuucuugaguuuagaugaaguug

SEQ ID NO: 308876 - RNA, 32 nt, Human
acuuuugcacaggcaccagcuaccucagggac

SEQ ID NO: 308877 - RNA, 32 nt, Human
acuuuugcagauggaggaauuucuugauuaau

SEQ ID NO: 308878 - RNA, 32 nt, Human
acuuuugcagccaguucccaccaauaugcccc

SEQ ID NO: 308879 - RNA, 32 nt, Human
acuuuugccaugagccucucugagcuuguuug

SEQ ID NO: 308880 - RNA, 32 nt, Human
acuuuugccaugaguacacaucagauaucuuu

SEQ ID NO: 308881 - RNA, 32 nt, Human
acuuuugcccagaaaaauggcgaauacaugaa

SEQ ID NO: 308882 - RNA, 32 nt, Human
acuuuugcccaggcuggagugcaguggcguga

SEQ ID NO: 308883 - RNA, 32 nt, Human
acuuuuggaagaaaacagccaaaguuggccua

SEQ ID NO: 308884 - RNA, 32 nt, Human
acuuuuggaaggcaugggguugccaguaccac

SEQ ID NO: 308885 - RNA, 32 nt, Human
acuuuuggcaaaaauagcaaaacuucaaagac

SEQ ID NO: 308886 - RNA, 32 nt, Human
acuuuugggaccccacacacuccaggugggau

SEQ ID NO: 308887 - RNA, 32 nt, Human
acuuuugggaggcagagaugggaggauacuug

SEQ ID NO: 308888 - RNA, 32 nt, Human
acuuuugggaggcugaggcggguggaucacuu

SEQ ID NO: 308889 - RNA, 32 nt, Human
acuuuugggugagguccaaagaggagagcugu

SEQ ID NO: 308890 - RNA, 23 nt, Human
acuuuuguccaaucagcuucaga

SEQ ID NO: 308891 - RNA, 32 nt, Human
acuuuugugaacccccaaaaucugagacaggu

SEQ ID NO: 308892 - RNA, 32 nt, Human
acuuuugugggccuccagcuucucucagaguc

SEQ ID NO: 308893 - RNA, 32 nt, Human
acuuuuguuccuuccugcugggcugccucgug

SEQ ID NO: 308894 - RNA, 32 nt, Human
acuuuuguugauguuuauuucagaaucuugug

SEQ ID NO: 308895 - RNA, 32 nt, Human
acuuuuguugcccaggcuggagugcaacggcg

SEQ ID NO: 308896 - RNA, 32 nt, Human
acuuuuguugcccaggcuggagugcaaugaug

SEQ ID NO: 308897 - RNA, 32 nt, Human
acuuuuguugcccaggcuggagugcaauggug

SEQ ID NO: 308898 - RNA, 32 nt, Human
acuuuuguugcccaggcuggaguguaguggcg

SEQ ID NO: 308899 - RNA, 32 nt, Human
acuuuuguugcccaggcuggaguucaguggcg

SEQ ID NO: 308900 - RNA, 32 nt, Human
acuuuuguugcgcaggcuggagugcaauggug

SEQ ID NO: 308901 - RNA, 32 nt, Human
acuuuuguuguuguuguuguucuggguaacuc

SEQ ID NO: 308902 - RNA, 32 nt, Human
acuuuuguuuuccucaugagucaacuugaagg

SEQ ID NO: 308903 - RNA, 32 nt, Human
acuuuuuaaagcuagcugugucgaguuaaaga

SEQ ID NO: 308904 - RNA, 32 nt, Human
acuuuuuaaggcagauuuuuauuuccuuugaa

SEQ ID NO: 308905 - RNA, 32 nt, Human
acuuuuuacuuucugcuaucucccaucucccg

SEQ ID NO: 308906 - RNA, 32 nt, Human
acuuuuuagaaaacagaaaugcccuugauggu

SEQ ID NO: 308907 - RNA, 32 nt, Human
acuuuuuagaaaacuaaucuccuuuaucaucc

SEQ ID NO: 308908 - RNA, 32 nt, Human
acuuuuuagagagauggggucuugccauauuu

SEQ ID NO: 308909 - RNA, 32 nt, Human
acuuuuuagagugcacugagugcacuuuacau

SEQ ID NO: 308910 - RNA, 32 nt, Human
acuuuuuagccugucuuuuguuauuucugccu

SEQ ID NO: 308911 - RNA, 32 nt, Human
acuuuuuaucauuaggaaacaaaaagaauuua

SEQ ID NO: 308912 - RNA, 32 nt, Human
acuuuuuauggugcugauuaauggugaucaag

SEQ ID NO: 308913 - RNA, 32 nt, Human
acuuuuuaugucaucguaaaagcuggaaaaau

SEQ ID NO: 308914 - RNA, 32 nt, Human
acuuuuuauuuuuauggggguggguggugcuu

SEQ ID NO: 308915 - RNA, 32 nt, Human
acuuuuucaagucacacaauacacucuuuaug

SEQ ID NO: 308916 - RNA, 32 nt, Human
acuuuuucacuacuuacaucuucucacauuuc

SEQ ID NO: 308917 - RNA, 32 nt, Human
acuuuuucagcccuuuacuuucuggcugaagc

SEQ ID NO: 308918 - RNA, 32 nt, Human
acuuuuucauucuuuuauaccgcugcauagua

SEQ ID NO: 308919 - RNA, 32 nt, Human
acuuuuucauuucaauucuauuacuucuaauu

SEQ ID NO: 308920 - RNA, 32 nt, Human
acuuuuuccaugggauacaguuuaggacacgg

SEQ ID NO: 308921 - RNA, 32 nt, Human
acuuuuuccuaaaugucccaacacuuacauac

SEQ ID NO: 308922 - RNA, 32 nt, Human
acuuuuuccugccucagcucuguacacaugau

SEQ ID NO: 308923 - RNA, 32 nt, Human
acuuuuuccuuccucccugucuaggcauuggg

SEQ ID NO: 308924 - RNA, 32 nt, Human
acuuuuucuacaugcaguucccagggaaacug

SEQ ID NO: 308925 - RNA, 19 nt, Human
acuuuuucuucuuugcaaa

SEQ ID NO: 308926 - RNA, 32 nt, Human
acuuuuucuugaaaggggaugacagcauggga

SEQ ID NO: 308927 - RNA, 17 nt, Human
acuuuuucuuucucaca

SEQ ID NO: 308928 - RNA, 31 nt, Human
acuuuuugaccaauuucagccaacauuagug

SEQ ID NO: 308929 - RNA, 32 nt, Human
acuuuuugagagguugggcuggcagaucauga

SEQ ID NO: 308930 - RNA, 32 nt, Human
acuuuuugcaccauguacccauggcuuacacu

SEQ ID NO: 308931 - RNA, 32 nt, Human
acuuuuuggcuggagcggagaugaggggccac

SEQ ID NO: 308932 - RNA, 32 nt, Human
acuuuuuggggugggaaaggugaaugccagug

SEQ ID NO: 308933 - RNA, 25 nt, Human
acuuuuuuauuucuguauuuuucca

SEQ ID NO: 308934 - RNA, 19 nt, Human
agaaaaaagaaugucagaa

SEQ ID NO: 308935 - RNA, 19 nt, Human
agaaaaaaggauugacaga

SEQ ID NO: 308936 - RNA, 24 nt, Human
agaaaaaaucagacacuucaggga

SEQ ID NO: 308937 - RNA, 22 nt, Human
agaaaaaauuuggaaggaaguu

SEQ ID NO: 308938 - RNA, 32 nt, Human
agaaaaacacaaacaaaaacagacucccacug

SEQ ID NO: 308939 - RNA, 32 nt, Human
agaaaaacacaagauaaacagccccaggaacc

SEQ ID NO: 308940 - RNA, 32 nt, Human
agaaaaacacagauuuggccuucgcacauuuu

SEQ ID NO: 308941 - RNA, 32 nt, Human
agaaaaacacauuucuuauaccaaaauuugug

SEQ ID NO: 308942 - RNA, 32 nt, Human
agaaaaacacuuguaaguugcuaaacgaguca

SEQ ID NO: 308943 - RNA, 32 nt, Human
agaaaaacagguaagaauaaagcaauguugcc

SEQ ID NO: 308944 - RNA, 32 nt, Human
agaaaaaccaaaacaguagcauaugcaggcaa

SEQ ID NO: 308945 - RNA, 32 nt, Human
agaaaaacccuacaaauguaaagaauguggaa

SEQ ID NO: 308946 - RNA, 32 nt, Human
agaaaaacccuacaaaugugaagaauguggca

SEQ ID NO: 308947 - RNA, 32 nt, Human
agaaaaacccuacaaaugugaagaauguguca

SEQ ID NO: 308948 - RNA, 21 nt, Human
agaaaaaccucucucauucca

SEQ ID NO: 308949 - RNA, 32 nt, Human
agaaaaaccuuacaaaugugaagaaugugaca

SEQ ID NO: 308950 - RNA, 32 nt, Human
agaaaaacgaauguucaucugcuuuaaucagu

SEQ ID NO: 308951 - RNA, 32 nt, Human
agaaaaacggaucacagccacuauggaugaca

SEQ ID NO: 308952 - RNA, 32 nt, Human
agaaaaacucagaacauugagcuggcuuuacc

SEQ ID NO: 308953 - RNA, 32 nt, Human
agaaaaacucagacuuggcauuuucacaauaa

SEQ ID NO: 308954 - RNA, 32 nt, Human
agaaaaacuguaauccugggguugguauggag

SEQ ID NO: 308955 - RNA, 32 nt, Human
agaaaaacuguaauccugggguugguauguag

SEQ ID NO: 308956 - RNA, 32 nt, Human
agaaaaacuguuggauuucaucucugcagggc

SEQ ID NO: 308957 - RNA, 32 nt, Human
agaaaaacuguuuacuucuucacuuucgaagu

SEQ ID NO: 308958 - RNA, 32 nt, Human
agaaaaacuuucagauucaucucucauuuuau

SEQ ID NO: 308959 - RNA, 32 nt, Human
agaaaaacuuuuccucccucuucaucaacaua

SEQ ID NO: 308960 - RNA, 32 nt, Human
agaaaaacuuuucuucccagcuuuucaaugug

SEQ ID NO: 308961 - RNA, 32 nt, Human
agaaaaagaaaaucugucuuucuaauaucccc

SEQ ID NO: 308962 - RNA, 19 nt, Human
agaaaaagaaggugacagg

SEQ ID NO: 308963 - RNA, 25 nt, Human
agaaaaagacaguuugagagagaag

SEQ ID NO: 308964 - RNA, 32 nt, Human
agaaaaagacugcagaaaggagagguggggcu

SEQ ID NO: 308965 - RNA, 32 nt, Human
agaaaaagacugcagagguagugaguucuuug

SEQ ID NO: 308966 - RNA, 32 nt, Human
agaaaaagagccccuccucugggguaaugagc

SEQ ID NO: 308967 - RNA, 32 nt, Human
agaaaaagagcuuccuaaauugcacauuuuug

SEQ ID NO: 308968 - RNA, 32 nt, Human
agaaaaagaggaagaagaagaaggaggaaaau

SEQ ID NO: 308969 - RNA, 32 nt, Human
agaaaaagaggaagaagaagaaggaggaggag

SEQ ID NO: 308970 - RNA, 32 nt, Human
agaaaaagagguuuacuuggacuuacaguucc

SEQ ID NO: 308971 - RNA, 32 nt, Human
agaaaaagaucuuucauuuugcaccugcagcc

SEQ ID NO: 308972 - RNA, 22 nt, Human
agaaaaagauucugaaggaacu

SEQ ID NO: 308973 - RNA, 31 nt, Human
agaaaaagcaagggcagcggcauucacacag

SEQ ID NO: 308974 - RNA, 32 nt, Human
agaaaaagcuguaagaaugaagcaaugaauca

SEQ ID NO: 308975 - RNA, 32 nt, Human
agaaaaagcuuuguuuuuauaacugguaaaaa

SEQ ID NO: 308976 - RNA, 32 nt, Human
agaaaaaggagagaugaaaaaggaggaugagg

SEQ ID NO: 308977 - RNA, 24 nt, Human
agaaaaaggagggagagagaggag

SEQ ID NO: 308978 - RNA, 32 nt, Human
agaaaaagggagauucuuaagagaugggaaau

SEQ ID NO: 308979 - RNA, 32 nt, Human
agaaaaaggggaggguuaaggaaucauuucag

SEQ ID NO: 308980 - RNA, 32 nt, Human
agaaaaagugacagaagcaguccaguaagauu

SEQ ID NO: 308981 - RNA, 32 nt, Human
agaaaaagugauuugucauugcuuuauagacu

SEQ ID NO: 308982 - RNA, 20 nt, Human
agaaaaaguuaugucaugaa

SEQ ID NO: 308983 - RNA, 32 nt, Human
agaaaaauaaaaaggacuacuuaaacauuugu

SEQ ID NO: 308984 - RNA, 32 nt, Human
agaaaaauaagaaggcugucccaagggcauuu

SEQ ID NO: 308985 - RNA, 32 nt, Human
agaaaaauagcuccaccucacuucucuccuac

SEQ ID NO: 308986 - RNA, 32 nt, Human
agaaaaauauauuucauuuucuaggcacaacu

SEQ ID NO: 308987 - RNA, 32 nt, Human
agaaaaauauccauuuuauuaccauuuucuau

SEQ ID NO: 308988 - RNA, 32 nt, Human
agaaaaaucaaaacaucauguagggugaccua

SEQ ID NO: 308989 - RNA, 32 nt, Human
agaaaaaucaaauugaauuagugauacaauaa

SEQ ID NO: 308990 - RNA, 32 nt, Human
agaaaaaucgaaagugcacagcacuuaaaggg

SEQ ID NO: 308991 - RNA, 32 nt, Human
agaaaaaucugaaauuuccaucuggggauuaa

SEQ ID NO: 308992 - RNA, 32 nt, Human
agaaaaaucuguccuuuuugguaccaaaccug

SEQ ID NO: 308993 - RNA, 32 nt, Human
agaaaaaucuuggggcuuccaauugacccauc

SEQ ID NO: 308994 - RNA, 32 nt, Human
agaaaaaugagcugggugugguggcgggcccc

SEQ ID NO: 308995 - RNA, 32 nt, Human
agaaaaaugugcagcuugacucugcugaggaa

SEQ ID NO: 308996 - RNA, 32 nt, Human
agaaaaaugugucuucagcuggcagcauuuau

SEQ ID NO: 308997 - RNA, 32 nt, Human
agaaaaauuaugcaggagauggcuaggauuag

SEQ ID NO: 308998 - RNA, 24 nt, Human
agaaaaauuugaagucugaucaga

SEQ ID NO: 308999 - RNA, 32 nt, Human
agaaaacaaaaacaaacagagcgagaagggcc

SEQ ID NO: 309000 - RNA, 28 nt, Human
agaaaacaaacaaaaacaaaacaaaaca

SEQ ID NO: 309001 - RNA, 23 nt, Human
agaaaacaaacaaacaaacaaaa

SEQ ID NO: 309002 - RNA, 22 nt, Human
agaaaacaaacaaacaacaaca

SEQ ID NO: 309003 - RNA, 32 nt, Human
agaaaacaaggcagaaugaucauucccagaaa

SEQ ID NO: 309004 - RNA, 32 nt, Human
agaaaacaaguauagucagguauucucuccau

SEQ ID NO: 309005 - RNA, 32 nt, Human
agaaaacacaagugccuucuccacggugcaau

SEQ ID NO: 309006 - RNA, 32 nt, Human
agaaaacacagcaacagaagaccuauaccccg

SEQ ID NO: 309007 - RNA, 32 nt, Human
agaaaacagaaagagacauuguucuuuuccug

SEQ ID NO: 309008 - RNA, 32 nt, Human
agaaaacagaaagcaacaggagaaagaugaca

SEQ ID NO: 309009 - RNA, 32 nt, Human
agaaaacagaaaggauccccuuucuccaguuu

SEQ ID NO: 309010 - RNA, 32 nt, Human
agaaaacagaaaucugcaucucagccugagac

SEQ ID NO: 309011 - RNA, 32 nt, Human
agaaaacagauggcuggagaugacauuuaucc

SEQ ID NO: 309012 - RNA, 32 nt, Human
agaaaacagcagagccaagugaagaucaccua

SEQ ID NO: 309013 - RNA, 32 nt, Human
agaaaacagcauggccaguaaacugagcaagg

SEQ ID NO: 309014 - RNA, 32 nt, Human
agaaaacagccagcaggaggagcuucaucugu

SEQ ID NO: 309015 - RNA, 32 nt, Human
agaaaacagcucccuauuugaucuuaaaauaa

SEQ ID NO: 309016 - RNA, 32 nt, Human
agaaaacagcuucacuccucaggaaguaccau

SEQ ID NO: 309017 - RNA, 32 nt, Human
agaaaacagcuuucgaaagugcccucaaagaa

SEQ ID NO: 309018 - RNA, 32 nt, Human
agaaaacaggaccaggaacagcagaaaccucc

SEQ ID NO: 309019 - RNA, 32 nt, Human
agaaaacagggugcagcgucccccagguuggc

SEQ ID NO: 309020 - RNA, 32 nt, Human
agaaaacaucaauauaucaccuaccaucauuu

SEQ ID NO: 309021 - RNA, 32 nt, Human
agaaaacaucggauuuacauuuuaagguaaac

SEQ ID NO: 309022 - RNA, 32 nt, Human
agaaaacauuuaaaaugacuuuuaguuaugua

SEQ ID NO: 309023 - RNA, 32 nt, Human
agaaaacauuuaacauaaugguugugaaaugu

SEQ ID NO: 309024 - RNA, 32 nt, Human
agaaaacauuucuuccuccuuuccuucuggag

SEQ ID NO: 309025 - RNA, 21 nt, Human
agaaaaccaaaaaccaaaaca

SEQ ID NO: 309026 - RNA, 32 nt, Human
agaaaaccaaguguccggauggcaggggccag

SEQ ID NO: 309027 - RNA, 32 nt, Human
agaaaaccacugcaacagacucauugaagaaa

SEQ ID NO: 309028 - RNA, 32 nt, Human
agaaaaccaggaugaggccggagggaggaaaa

SEQ ID NO: 309029 - RNA, 17 nt, Human
agaaaaccagucaagga

SEQ ID NO: 309030 - RNA, 32 nt, Human
agaaaaccaguuccaaccacagcuuuaccacc

SEQ ID NO: 309031 - RNA, 32 nt, Human
agaaaaccauauggggacuauagugcaaccua

SEQ ID NO: 309032 - RNA, 24 nt, Human
agaaaacccaaaauauuaugcaaa

SEQ ID NO: 309033 - RNA, 32 nt, Human
agaaaacccacugccuagaggccaucuuaaag

SEQ ID NO: 309034 - RNA, 32 nt, Human
agaaaacccacugucugugcuagcacaaugau

SEQ ID NO: 309035 - RNA, 32 nt, Human
agaaaacccagacugcauucaguguccucagu

SEQ ID NO: 309036 - RNA, 32 nt, Human
agaaaacccagaggaaagcuguugaugcugaa

SEQ ID NO: 309037 - RNA, 22 nt, Human
agaaaacccaggaggacgcaga

SEQ ID NO: 309038 - RNA, 18 nt, Human
agaaaacccgaguugggg

SEQ ID NO: 309039 - RNA, 32 nt, Human
agaaaacccuucaaaaguucagucuagucugg

SEQ ID NO: 309040 - RNA, 18 nt, Human
agaaaaccgaaacaaaac

SEQ ID NO: 309041 - RNA, 17 nt, Human
agaaaaccgagcugggg

SEQ ID NO: 309042 - RNA, 32 nt, Human
agaaaaccgcacccucaccucccuucaccugc

SEQ ID NO: 309043 - RNA, 20 nt, Human
agaaaaccugaugcugggga

SEQ ID NO: 309044 - RNA, 32 nt, Human
agaaaacuaagcucaguaacaagaaggcauaa

SEQ ID NO: 309045 - RNA, 17 nt, Human
agaaaacuacaugggga

SEQ ID NO: 309046 - RNA, 18 nt, Human
agaaaacucaacugugga

SEQ ID NO: 309047 - RNA, 18 nt, Human
agaaaacucagaaaggga

SEQ ID NO: 309048 - RNA, 32 nt, Human
agaaaacucagccucccuacagggugagcacc

SEQ ID NO: 309049 - RNA, 17 nt, Human
agaaaacucagcucagg

SEQ ID NO: 309050 - RNA, 17 nt, Human
agaaaacucaguggaga

SEQ ID NO: 309051 - RNA, 19 nt, Human
agaaaacucauacuggaga

SEQ ID NO: 309052 - RNA, 32 nt, Human
agaaaacuccacugacugucgggcuuuaaaaa

SEQ ID NO: 309053 - RNA, 17 nt, Human
agaaaacuccacugggg

SEQ ID NO: 309054 - RNA, 32 nt, Human
agaaaacucccagaaguggaguuuuccuuauu

SEQ ID NO: 309055 - RNA, 17 nt, Human
agaaaacucccaggggg

SEQ ID NO: 309056 - RNA, 32 nt, Human
agaaaacucccugagucucucuucacaaauga

SEQ ID NO: 309057 - RNA, 19 nt, Human
agaaaacucccuugggaga

SEQ ID NO: 309058 - RNA, 32 nt, Human
agaaaacuccuccaaaagcagcucucacuauc

SEQ ID NO: 309059 - RNA, 21 nt, Human
agaaaacuccuuaugagggga

SEQ ID NO: 309060 - RNA, 17 nt, Human
agaaaacucuucguggg

SEQ ID NO: 309061 - RNA, 17 nt, Human
agaaaacugaagggggg

SEQ ID NO: 309062 - RNA, 18 nt, Human
agaaaacugaggccaggg

SEQ ID NO: 309063 - RNA, 32 nt, Human
agaaaacugagugcaaaggaagaaaaauauau

SEQ ID NO: 309064 - RNA, 32 nt, Human
agaaaacugauuagaagaauacuugauguuua

SEQ ID NO: 309065 - RNA, 31 nt, Human
agaaaacugcacaauaaaaccaaagccucug

SEQ ID NO: 309066 - RNA, 18 nt, Human
agaaaacugcaguccggg

SEQ ID NO: 309067 - RNA, 16 nt, Human
agaaaacugcugagga

SEQ ID NO: 309068 - RNA, 21 nt, Human
agaaaacugcugcagauggaa

SEQ ID NO: 309069 - RNA, 18 nt, Human
agaaaacuggccacagga

SEQ ID NO: 309070 - RNA, 17 nt, Human
agaaaacuggucaagga

SEQ ID NO: 309071 - RNA, 32 nt, Human
agaaaacugucagcucugcuuucuaaggaacc

SEQ ID NO: 309072 - RNA, 18 nt, Human
agaaaacugucugggaga

SEQ ID NO: 309073 - RNA, 18 nt, Human
agaaaacuuagccaugga

SEQ ID NO: 309074 - RNA, 32 nt, Human
agaaaacuucaagacaucaccaucagcaggcu

SEQ ID NO: 309075 - RNA, 18 nt, Human
agaaaacuucagcacagg

SEQ ID NO: 309076 - RNA, 19 nt, Human
agaaaacuucaguuuucgg

SEQ ID NO: 309077 - RNA, 32 nt, Human
agaaaacuuggcuugugugauggugcagucau

SEQ ID NO: 309078 - RNA, 32 nt, Human
agaaaagaaaagaaaagaaagaaaggaauuag

SEQ ID NO: 309079 - RNA, 32 nt, Human
agaaaagaaagaaagaaagaaagaaagaaaac

SEQ ID NO: 309080 - RNA, 32 nt, Human
agaaaagaaagaaagaaagaaagagaaaaaga

SEQ ID NO: 309081 - RNA, 22 nt, Human
agaaaagaaaugcaaguucaca

SEQ ID NO: 309082 - RNA, 32 nt, Human
agaaaagaacaaggaaaaauggauguuucgcu

SEQ ID NO: 309083 - RNA, 32 nt, Human
agaaaagaagccugggcggagagcagagcccg

SEQ ID NO: 309084 - RNA, 23 nt, Human
agaaaagaaggaaaaaggucaca

SEQ ID NO: 309085 - RNA, 32 nt, Human
agaaaagaauguacauuuagacauuuggguuc

SEQ ID NO: 309086 - RNA, 27 nt, Human
agaaaagaauuccucccuggauggaag

SEQ ID NO: 309087 - RNA, 23 nt, Human
agaaaagacacugaaugagguga

SEQ ID NO: 309088 - RNA, 32 nt, Human
agaaaagacagaggcagaaaggaagauggcuu

SEQ ID NO: 309089 - RNA, 32 nt, Human
agaaaagacauaagcaaagacuaugaggaaua

SEQ ID NO: 309090 - RNA, 22 nt, Human
agaaaagacuagaaaauauaca

SEQ ID NO: 309091 - RNA, 32 nt, Human
agaaaagagaagaggaagggaggccauaucua

SEQ ID NO: 309092 - RNA, 23 nt, Human
agaaaagagacgcaaagugucca

SEQ ID NO: 309093 - RNA, 24 nt, Human
agaaaagagaugugaaagugcaca

SEQ ID NO: 309094 - RNA, 32 nt, Human
agaaaagagcagcaacagcagaggcuggacuc

SEQ ID NO: 309095 - RNA, 32 nt, Human
agaaaagagcgacacagacaaugacuggccaa

SEQ ID NO: 309096 - RNA, 32 nt, Human
agaaaagaggaaaccaaaugaagaggaugugu

SEQ ID NO: 309097 - RNA, 32 nt, Human
agaaaagaggaggaggaggaggaagaaagaaa

SEQ ID NO: 309098 - RNA, 32 nt, Human
agaaaagagggagggguggcagaggaucugca

SEQ ID NO: 309099 - RNA, 23 nt, Human
agaaaagaugugcagauaucaca

SEQ ID NO: 309100 - RNA, 32 nt, Human
agaaaagauuugcacaaagaaaaugcuaauaa

SEQ ID NO: 309101 - RNA, 18 nt, Human
agaaaagcaaaaaugcua

SEQ ID NO: 309102 - RNA, 32 nt, Human
agaaaagcaaaacuacacagucuugacugugu

SEQ ID NO: 309103 - RNA, 32 nt, Human
agaaaagcacagaugcuguuucggcugcugac

SEQ ID NO: 309104 - RNA, 32 nt, Human
agaaaagcagacucccugugguggcgaccagu

SEQ ID NO: 309105 - RNA, 32 nt, Human
agaaaagcagaguugagauacaauucuauaga

SEQ ID NO: 309106 - RNA, 32 nt, Human
agaaaagcagcccagagucagucauugaagcc

SEQ ID NO: 309107 - RNA, 32 nt, Human
agaaaagcagggcuggggagaaugagauggac

SEQ ID NO: 309108 - RNA, 32 nt, Human
agaaaagcauuugccuacagaaauaaaccauu

SEQ ID NO: 309109 - RNA, 32 nt, Human
agaaaagcauuuuaaaaguuugaggaaucuuu

SEQ ID NO: 309110 - RNA, 32 nt, Human
agaaaagcauuuuuauuuguuuauuuccucau

SEQ ID NO: 309111 - RNA, 32 nt, Human
agaaaagccauacaaaugagaagaauguggca

SEQ ID NO: 309112 - RNA, 32 nt, Human
agaaaagccaucauuuucuccuggauuaaucu

SEQ ID NO: 309113 - RNA, 32 nt, Human
agaaaagcccagaagaaaucccauuuuggguc

SEQ ID NO: 309114 - RNA, 32 nt, Human
agaaaagccccaugcuuucauuuuucacuugg

SEQ ID NO: 309115 - RNA, 32 nt, Human
agaaaagccuccaggaaaucuugagagccugu

SEQ ID NO: 309116 - RNA, 32 nt, Human
agaaaagccugaucccugucaguggaaaaggg

SEQ ID NO: 309117 - RNA, 32 nt, Human
agaaaagcggucuugcuuuguugcccagacug

SEQ ID NO: 309118 - RNA, 32 nt, Human
agaaaagcuaacaacuaggaagaaaaggccaa

SEQ ID NO: 309119 - RNA, 32 nt, Human
agaaaagcuaccaagucuugagugcuuuguag

SEQ ID NO: 309120 - RNA, 32 nt, Human
agaaaagcugaaaauucuaaacaucagagcgc

SEQ ID NO: 309121 - RNA, 32 nt, Human
agaaaagcugggucagcaucuggccaccgagc

SEQ ID NO: 309122 - RNA, 32 nt, Human
agaaaagcuguggaaaagagucuuagagauuu

SEQ ID NO: 309123 - RNA, 32 nt, Human
agaaaagcuuccucuuagaucuggccacucag

SEQ ID NO: 309124 - RNA, 32 nt, Human
agaaaagcuucugauggacaugggcuucugug

SEQ ID NO: 309125 - RNA, 32 nt, Human
agaaaaggaaagucugagcaguuuugauuaga

SEQ ID NO: 309126 - RNA, 32 nt, Human
agaaaaggaagaggaaggaaggaaauauuuug

SEQ ID NO: 309127 - RNA, 32 nt, Human
agaaaaggaagaggaggaaaaacaagugugug

SEQ ID NO: 309128 - RNA, 32 nt, Human
agaaaaggaagcaagaaagaaagggaaauuaa

SEQ ID NO: 309129 - RNA, 23 nt, Human
agaaaaggaauaggaucaagaga

SEQ ID NO: 309130 - RNA, 32 nt, Human
agaaaaggaccaaaauaaaagaaaaaugaauu

SEQ ID NO: 309131 - RNA, 32 nt, Human
agaaaaggacuggacggaggaggaccgggccc

SEQ ID NO: 309132 - RNA, 32 nt, Human
agaaaaggagaaaaggaccuuugaaagaugug

SEQ ID NO: 309133 - RNA, 32 nt, Human
agaaaaggagaaaagggagaugagggaucuca

SEQ ID NO: 309134 - RNA, 32 nt, Human
agaaaaggagaaggaaagaagacugggggcag

SEQ ID NO: 309135 - RNA, 32 nt, Human
agaaaaggagagaagaugucaguauguuuagu

SEQ ID NO: 309136 - RNA, 32 nt, Human
agaaaaggagcgcaaggcagaggcucugaagc

SEQ ID NO: 309137 - RNA, 32 nt, Human
agaaaaggaggaaggaaggaaaaggugauucg

SEQ ID NO: 309138 - RNA, 24 nt, Human
agaaaaggaguuaggagaaagaag

SEQ ID NO: 309139 - RNA, 32 nt, Human
agaaaaggcaaccugccuccagccugaaauac

SEQ ID NO: 309140 - RNA, 32 nt, Human
agaaaaggcugcagacagucacagggaagugc

SEQ ID NO: 309141 - RNA, 22 nt, Human
agaaaaggcuucaaaggaacuu

SEQ ID NO: 309142 - RNA, 32 nt, Human
agaaaagggagcuagggaaggagcaguggacu

SEQ ID NO: 309143 - RNA, 32 nt, Human
agaaaagggaggaaacggcagagccagagaga

SEQ ID NO: 309144 - RNA, 32 nt, Human
agaaaagggauuauuauaucaaaagccugaag

SEQ ID NO: 309145 - RNA, 32 nt, Human
agaaaagggccagggcccugagggccuagcau

SEQ ID NO: 309146 - RNA, 32 nt, Human
agaaaaggggcagacuccucacauuccagcac

SEQ ID NO: 309147 - RNA, 32 nt, Human
agaaaagguagaaagagaagacccagagugaa

SEQ ID NO: 309148 - RNA, 24 nt, Human
agaaaaggugacgcgagaaggaag

SEQ ID NO: 309149 - RNA, 32 nt, Human
agaaaaguaauggaagacaggaagaaaagaag

SEQ ID NO: 309150 - RNA, 21 nt, Human
agaaaaguaucccggaagcuc

SEQ ID NO: 309151 - RNA, 32 nt, Human
agaaaagucauggaagacaggaagaaaggaag

SEQ ID NO: 309152 - RNA, 32 nt, Human
agaaaaguccugguacuccacacugcugcggu

SEQ ID NO: 309153 - RNA, 21 nt, Human
agaaaagugaagaaggaacuu

SEQ ID NO: 309154 - RNA, 21 nt, Human
agaaaagugauucagugauuu

SEQ ID NO: 309155 - RNA, 32 nt, Human
agaaaagugggcagugguggcacgggagcagg

SEQ ID NO: 309156 - RNA, 32 nt, Human
agaaaagugucugcuccuagccaagaucuccu

SEQ ID NO: 309157 - RNA, 32 nt, Human
agaaaaguuacccgagggaaaauaaauacagu

SEQ ID NO: 309158 - RNA, 32 nt, Human
agaaaaguucuaauuuucauuagcaauuaaua

SEQ ID NO: 309159 - RNA, 32 nt, Human
agaaaaguucucugcagccugguuugacagcg

SEQ ID NO: 309160 - RNA, 32 nt, Human
agaaaaguugaugauagauugccuucacccuc

SEQ ID NO: 309161 - RNA, 32 nt, Human
agaaaaguugcugauugcaaugguuaugggaa

SEQ ID NO: 309162 - RNA, 32 nt, Human
agaaaauaacagcaaccuauuuacauacauaa

SEQ ID NO: 309163 - RNA, 32 nt, Human
agaaaauaacauccgaucaguugcauuucccu

SEQ ID NO: 309164 - RNA, 32 nt, Human
agaaaauaaccagguauucuuagagcuauaga

SEQ ID NO: 309165 - RNA, 32 nt, Human
agaaaauaaucaagacuugcucugcagccacu

SEQ ID NO: 309166 - RNA, 31 nt, Human
agaaaauacagcuagccaagcucgaagaauc

SEQ ID NO: 309167 - RNA, 32 nt, Human
agaaaauacaucacagauagaagauuaucugc

SEQ ID NO: 309168 - RNA, 32 nt, Human
agaaaauacaugaacagaaacugcccaggugg

SEQ ID NO: 309169 - RNA, 32 nt, Human
agaaaauacuagccuagaaauauagagcauua

SEQ ID NO: 309170 - RNA, 32 nt, Human
agaaaauagaccuccuuccuccuucagccucc

SEQ ID NO: 309171 - RNA, 32 nt, Human
agaaaauagauaugaaaaugcaagcccacaga

SEQ ID NO: 309172 - RNA, 23 nt, Human
agaaaauagaucaauccagggac

SEQ ID NO: 309173 - RNA, 32 nt, Human
agaaaauagauccuccaugcaggaucuaggag

SEQ ID NO: 309174 - RNA, 32 nt, Human
agaaaauaggagaaaaauaagugaccaggagc

SEQ ID NO: 309175 - RNA, 32 nt, Human
agaaaauaggagcaggauuuccccuggggaaa

SEQ ID NO: 309176 - RNA, 32 nt, Human
agaaaauaggcugggugcaguggcucacgccu

SEQ ID NO: 309177 - RNA, 32 nt, Human
agaaaauaggguccaggagaggaaucugcaga

SEQ ID NO: 309178 - RNA, 32 nt, Human
agaaaauaguguccucaauauuuuaaaacaau

SEQ ID NO: 309179 - RNA, 32 nt, Human
agaaaauauauguauucaguagugcaggcauu

SEQ ID NO: 309180 - RNA, 32 nt, Human
agaaaauaucuugcaagcuccaccuucacuuu

SEQ ID NO: 309181 - RNA, 32 nt, Human
agaaaauauuauuugaccuacaguauguccaa

SEQ ID NO: 309182 - RNA, 32 nt, Human
agaaaaucaacgagaaagacccuggcaagaac

SEQ ID NO: 309183 - RNA, 32 nt, Human
agaaaaucaagaaaguaaguauguaaagauga

SEQ ID NO: 309184 - RNA, 32 nt, Human
agaaaaucaagauucaguccagcagaugcaga

SEQ ID NO: 309185 - RNA, 32 nt, Human
agaaaaucaaugagaaagacccugacaacaag

SEQ ID NO: 309186 - RNA, 32 nt, Human
agaaaaucaggcuggccaacggggugaaaccc

SEQ ID NO: 309187 - RNA, 32 nt, Human
agaaaaucagggcaggagagaauauaauugug

SEQ ID NO: 309188 - RNA, 32 nt, Human
agaaaaucaguguugggguugcaggagaccua

SEQ ID NO: 309189 - RNA, 17 nt, Human
agaaaauccacugggga

SEQ ID NO: 309190 - RNA, 32 nt, Human
agaaaauccauagccuucagaucuugguguuu

SEQ ID NO: 309191 - RNA, 32 nt, Human
agaaaauccgaccucauuaaacaucagagaau

SEQ ID NO: 309192 - RNA, 32 nt, Human
agaaaauccuaccagcuggccugcugcucugc

SEQ ID NO: 309193 - RNA, 32 nt, Human
agaaaauccuauugauuucaucucacccauuu

SEQ ID NO: 309194 - RNA, 22 nt, Human
agaaaaucuaccaagaacagag

SEQ ID NO: 309195 - RNA, 32 nt, Human
agaaaaucuacuccccuguccccagccauauc

SEQ ID NO: 309196 - RNA, 32 nt, Human
agaaaaucugcucuccuuucugaucuaaaaac

SEQ ID NO: 309197 - RNA, 32 nt, Human
agaaaaucuguggagccuaucagaccccaagu

SEQ ID NO: 309198 - RNA, 32 nt, Human
agaaaaucuugucuuagaagggccagauaaca

SEQ ID NO: 309199 - RNA, 20 nt, Human
agaaaaugaaaaacaaaaca

SEQ ID NO: 309200 - RNA, 30 nt, Human
agaaaaugaacacauugcaggggccagugu

SEQ ID NO: 309201 - RNA, 30 nt, Human
agaaaaugaagaaaaaugagguuuacgaga

SEQ ID NO: 309202 - RNA, 32 nt, Human
agaaaaugaagcugcugccucaaucgacccag

SEQ ID NO: 309203 - RNA, 32 nt, Human
agaaaaugagcuugagaaaguggucauugagg

SEQ ID NO: 309204 - RNA, 32 nt, Human
agaaaaugaucacaccaacucugccuacacac

SEQ ID NO: 309205 - RNA, 32 nt, Human
agaaaaugcaagucaggccuggcagcuagagc

SEQ ID NO: 309206 - RNA, 32 nt, Human
agaaaaugccaccagauggcggguuaggauug

SEQ ID NO: 309207 - RNA, 32 nt, Human
agaaaaugcuucaagaggaaaauuacuguucc

SEQ ID NO: 309208 - RNA, 32 nt, Human
agaaaauggaauuuuuauuuuuguacuuuaua

SEQ ID NO: 309209 - RNA, 31 nt, Human
agaaaaugggacgugucccagcuccaggggu

SEQ ID NO: 309210 - RNA, 32 nt, Human
agaaaauggugaagccauagaaaaguuacccg

SEQ ID NO: 309211 - RNA, 32 nt, Human
agaaaaugucuacauuaagcaccaggacugca

SEQ ID NO: 309212 - RNA, 32 nt, Human
agaaaauguuuaccucauguaucccagccgag

SEQ ID NO: 309213 - RNA, 32 nt, Human
agaaaauuaaauucagcuucaggccuuuaaac

SEQ ID NO: 309214 - RNA, 32 nt, Human
agaaaauuacuaagaggaagggucaggggcaa

SEQ ID NO: 309215 - RNA, 32 nt, Human
agaaaauuacugccaaucuaggguucuguauc

SEQ ID NO: 309216 - RNA, 18 nt, Human
agaaaauucggcgggaga

SEQ ID NO: 309217 - RNA, 32 nt, Human
agaaaauucuaacgaugauucccaccgaugag

SEQ ID NO: 309218 - RNA, 32 nt, Human
agaaaauucuguucugauuauaucaaggcaaa

SEQ ID NO: 309219 - RNA, 32 nt, Human
agaaaauugaagcuguguaaaugaguauggaa

SEQ ID NO: 309220 - RNA, 32 nt, Human
agaaaauugcaaccuccaccagaccacaagga

SEQ ID NO: 309221 - RNA, 16 nt, Human
agaaaauugccagggg

SEQ ID NO: 309222 - RNA, 32 nt, Human
agaaaauuggagaaugaaaccugcuccaacag

SEQ ID NO: 309223 - RNA, 32 nt, Human
agaaaauugggaaaacaaaaagagcauaaaga

SEQ ID NO: 309224 - RNA, 32 nt, Human
agaaaauuucaguucucaggguguuacaauua

SEQ ID NO: 309225 - RNA, 18 nt, Human
agaaaauuucaugaugcu

SEQ ID NO: 309226 - RNA, 32 nt, Human
agaaaauuugagcccccaggggugggguggac

SEQ ID NO: 309227 - RNA, 32 nt, Human
agaaacaaacuccagacgcaccaccuuaagag

SEQ ID NO: 309228 - RNA, 32 nt, Human
agaaacaaaguaacucuauacacuucaagacu

SEQ ID NO: 309229 - RNA, 21 nt, Human
agaaacaacaaaggcaggaga

SEQ ID NO: 309230 - RNA, 24 nt, Human
agaaacaacaacaaaaaagccuaa

SEQ ID NO: 309231 - RNA, 21 nt, Human
agaaacaacagaugcuggcga

SEQ ID NO: 309232 - RNA, 32 nt, Human
agaaacaaccaccaaacauugugcuuaaggac

SEQ ID NO: 309233 - RNA, 32 nt, Human
agaaacaagagguggaacaugugaaugaaucg

SEQ ID NO: 309234 - RNA, 32 nt, Human
agaaacaagguuucaccauguuggucaggcug

SEQ ID NO: 309235 - RNA, 32 nt, Human
agaaacaaugggcagaaagcugugggacgaaa

SEQ ID NO: 309236 - RNA, 32 nt, Human
agaaacacagccggugcgcgcagggcggcagg

SEQ ID NO: 309237 - RNA, 32 nt, Human
agaaacacaggcaaucuaccuucugaccgaug

SEQ ID NO: 309238 - RNA, 32 nt, Human
agaaacacaggguccaaccacucuccagcagg

SEQ ID NO: 309239 - RNA, 32 nt, Human
agaaacaccaaagaaagcuguggaaaggaccu

SEQ ID NO: 309240 - RNA, 25 nt, Human
agaaacacccgggcuccaucugcca

SEQ ID NO: 309241 - RNA, 32 nt, Human
agaaacaccuagccaaggccaguguuucugca

SEQ ID NO: 309242 - RNA, 32 nt, Human
agaaacaccuagggggacagacagggaaagcu

SEQ ID NO: 309243 - RNA, 32 nt, Human
agaaacacugaacugaucauuuggugacugga

SEQ ID NO: 309244 - RNA, 32 nt, Human
agaaacacuggcagagauucaaagaagccacu

SEQ ID NO: 309245 - RNA, 32 nt, Human
agaaacacuuacugagggcauauuguuugccc

SEQ ID NO: 309246 - RNA, 32 nt, Human
agaaacacuugaaccugggagguggagguugc

SEQ ID NO: 309247 - RNA, 32 nt, Human
agaaacacuuuacaaccugcucucucucugaa

SEQ ID NO: 309248 - RNA, 32 nt, Human
agaaacagacagcaaccaagccacgagcauuu

SEQ ID NO: 309249 - RNA, 32 nt, Human
agaaacagacuugcacauguguggaccuugaa

SEQ ID NO: 309250 - RNA, 32 nt, Human
agaaacagagagagacagagacagagagagac

SEQ ID NO: 309251 - RNA, 32 nt, Human
agaaacagaggaccccagcucaucagggcauu

SEQ ID NO: 309252 - RNA, 32 nt, Human
agaaacagagucucauucugucacccaggcug

SEQ ID NO: 309253 - RNA, 32 nt, Human
agaaacagaguuucaccauguugcuuaggcug

SEQ ID NO: 309254 - RNA, 32 nt, Human
agaaacaggaccuugcccugucacucaggaua

SEQ ID NO: 309255 - RNA, 32 nt, Human
agaaacaggaccuugcccugucacucaggaug

SEQ ID NO: 309256 - RNA, 18 nt, Human
agaaacaggaggaggcag

SEQ ID NO: 309257 - RNA, 32 nt, Human
agaaacaggaucucacuauauugcccaagcug

SEQ ID NO: 309258 - RNA, 32 nt, Human
agaaacaggauuucgccauguuggccaggcug

SEQ ID NO: 309259 - RNA, 21 nt, Human
agaaacaggcagacaacugga

SEQ ID NO: 309260 - RNA, 32 nt, Human
agaaacaggcagcagaggaacccaaaggcagu

SEQ ID NO: 309261 - RNA, 32 nt, Human
agaaacaggcuuucaccauguuggccaggcug

SEQ ID NO: 309262 - RNA, 32 nt, Human
agaaacagggagcauggugcggggagagaagc

SEQ ID NO: 309263 - RNA, 32 nt, Human
agaaacagggucucaccauguuguccagccug

SEQ ID NO: 309264 - RNA, 32 nt, Human
agaaacagggucuugcuauguugcccaggcug

SEQ ID NO: 309265 - RNA, 32 nt, Human
agaaacaggguuucaccaugcuggccaugcug

SEQ ID NO: 309266 - RNA, 32 nt, Human
agaaacaggguuucaccauguuagccaggcug

SEQ ID NO: 309267 - RNA, 32 nt, Human
agaaacaggguuucaccauguuggccaggcug

SEQ ID NO: 309268 - RNA, 32 nt, Human
agaaacaggguuucacuguguuggcccagcug

SEQ ID NO: 309269 - RNA, 20 nt, Human
agaaacaguggcuccuggga

SEQ ID NO: 309270 - RNA, 32 nt, Human
agaaacauacuucuuugcugggcaugguggcu

SEQ ID NO: 309271 - RNA, 32 nt, Human
agaaacauccucucaaaaaucagaugggacau

SEQ ID NO: 309272 - RNA, 32 nt, Human
agaaacaucuggcaaccccacauggcugagau

SEQ ID NO: 309273 - RNA, 32 nt, Human
agaaacaucuuccauccuccccucuccccaaa

SEQ ID NO: 309274 - RNA, 32 nt, Human
agaaacaugcacauacccagaaaccuauuuuc

SEQ ID NO: 309275 - RNA, 22 nt, Human
agaaacaugccaauccugagaa

SEQ ID NO: 309276 - RNA, 32 nt, Human
agaaacauggcuuuuaagaaacacggugauau

SEQ ID NO: 309277 - RNA, 21 nt, Human
agaaacauuaagucucuggga

SEQ ID NO: 309278 - RNA, 23 nt, Human
agaaacauugacaaagggcacaa

SEQ ID NO: 309279 - RNA, 32 nt, Human
agaaaccaaacagaccccaguccagcccugaa

SEQ ID NO: 309280 - RNA, 32 nt, Human
agaaaccaaccacaggcacccaagcacuacca

SEQ ID NO: 309281 - RNA, 32 nt, Human
agaaaccaagccccaugagcagcaguggaaga

SEQ ID NO: 309282 - RNA, 31 nt, Human
agaaaccaaguguccgggauucagaccucuc

SEQ ID NO: 309283 - RNA, 21 nt, Human
agaaaccacagauuagagaaa

SEQ ID NO: 309284 - RNA, 32 nt, Human
agaaaccacaggcugaaggcgacugcaggguc

SEQ ID NO: 309285 - RNA, 22 nt, Human
agaaaccacaguuccccggaaa

SEQ ID NO: 309286 - RNA, 32 nt, Human
agaaaccacaguuggaggaggacggcagagac

SEQ ID NO: 309287 - RNA, 32 nt, Human
agaaaccacccaaauguccuucaaggggcgaa

SEQ ID NO: 309288 - RNA, 32 nt, Human
agaaaccaccgcucccccuccuaggaggcccc

SEQ ID NO: 309289 - RNA, 32 nt, Human
agaaaccacugcauucugaccugcuguacaga

SEQ ID NO: 309290 - RNA, 32 nt, Human
agaaaccagaaaugaacucuauucaagaauaa

SEQ ID NO: 309291 - RNA, 32 nt, Human
agaaaccagagcacuggcagcugagugaccuu

SEQ ID NO: 309292 - RNA, 32 nt, Human
agaaaccaggagacaggggaacuaucuuccuu

SEQ ID NO: 309293 - RNA, 32 nt, Human
agaaaccaggucucacuauguugcccaggccg

SEQ ID NO: 309294 - RNA, 32 nt, Human
agaaaccauaaauaucgugucauauuuucccc

SEQ ID NO: 309295 - RNA, 32 nt, Human
agaaaccaucagcaggcugugagcaucgccag

SEQ ID NO: 309296 - RNA, 32 nt, Human
agaaacccaacaauugggagauugagcuggga

SEQ ID NO: 309297 - RNA, 32 nt, Human
agaaacccagaagaggaagaggaaagcaaagg

SEQ ID NO: 309298 - RNA, 32 nt, Human
agaaacccagaagaggagagcaaaggagucag

SEQ ID NO: 309299 - RNA, 32 nt, Human
agaaaccccaaaccaggaaaccccaccuaccc

SEQ ID NO: 309300 - RNA, 32 nt, Human
agaaaccccagccuaaugaaacccuagguguu

SEQ ID NO: 309301 - RNA, 32 nt, Human
agaaaccccaggaggaagaaaccucagacaga

SEQ ID NO: 309302 - RNA, 32 nt, Human
agaaacccccaggaggagagagaugcugcucc

SEQ ID NO: 309303 - RNA, 20 nt, Human
agaaacccgcccagccgggg

SEQ ID NO: 309304 - RNA, 32 nt, Human
agaaacccuaaaucacuccucucuccacuuga

SEQ ID NO: 309305 - RNA, 32 nt, Human
agaaacccuacacccucccccuccagggaaug

SEQ ID NO: 309306 - RNA, 32 nt, Human
agaaacccuauaaauguacagaaugugggaaa

SEQ ID NO: 309307 - RNA, 32 nt, Human
agaaacccugcuccuucccuucacugaccaau

SEQ ID NO: 309308 - RNA, 20 nt, Human
agaaaccgagaccacuucac

SEQ ID NO: 309309 - RNA, 32 nt, Human
agaaaccgcucuucaaccaucuguagaacacu

SEQ ID NO: 309310 - RNA, 32 nt, Human
agaaaccgggcuugguuguugcagugggaaga

SEQ ID NO: 309311 - RNA, 32 nt, Human
agaaaccguaugaauguacagaaugugggaaa

SEQ ID NO: 309312 - RNA, 32 nt, Human
agaaaccucaacuguuccccagcuacugaggg

SEQ ID NO: 309313 - RNA, 32 nt, Human
agaaaccucacaccuagccagugcccugcucu

SEQ ID NO: 309314 - RNA, 32 nt, Human
agaaaccuccacccuccccaggucccacauug

SEQ ID NO: 309315 - RNA, 18 nt, Human
agaaaccuccguccuccu

SEQ ID NO: 309316 - RNA, 32 nt, Human
agaaaccuccuugucccucuccagucaccucc

SEQ ID NO: 309317 - RNA, 18 nt, Human
agaaaccucgcccagcgg

SEQ ID NO: 309318 - RNA, 32 nt, Human
agaaaccugcaaaggccguguucacacacuca

SEQ ID NO: 309319 - RNA, 32 nt, Human
agaaaccuggggacuuaguuagguagauuaau

SEQ ID NO: 309320 - RNA, 32 nt, Human
agaaaccuucagaaggaaacagaaggaugaga

SEQ ID NO: 309321 - RNA, 32 nt, Human
agaaaccuucauauguauccccaaaccuaaaa

SEQ ID NO: 309322 - RNA, 32 nt, Human
agaaaccuuuaucuuuuucauaccuuucuauu

SEQ ID NO: 309323 - RNA, 32 nt, Human
agaaacgaauagacuggacacuguguggucac

SEQ ID NO: 309324 - RNA, 32 nt, Human
agaaacgagguuucaccacguuggccaggcug

SEQ ID NO: 309325 - RNA, 32 nt, Human
agaaacgcaaaaaguuucuacggacuuuaaau

SEQ ID NO: 309326 - RNA, 32 nt, Human
agaaacgcaaucuucugagcacaauauggaau

SEQ ID NO: 309327 - RNA, 32 nt, Human
agaaacgcaguuuccauggcccaacucacagu

SEQ ID NO: 309328 - RNA, 32 nt, Human
agaaacgcgccuggcccugagcugucaccacc

SEQ ID NO: 309329 - RNA, 32 nt, Human
agaaacgcgguuucaccauguuggccaggcug

SEQ ID NO: 309330 - RNA, 21 nt, Human
agaaacggagucagccggaga

SEQ ID NO: 309331 - RNA, 32 nt, Human
agaaacggaguccuccuguguugcccaggcug

SEQ ID NO: 309332 - RNA, 32 nt, Human
agaaacgggacuucaccauguugcccaggcug

SEQ ID NO: 309333 - RNA, 32 nt, Human
agaaacgggauuucaccacguuggccaggcug

SEQ ID NO: 309334 - RNA, 22 nt, Human
agaaacgggcucgcacucggcc

SEQ ID NO: 309335 - RNA, 32 nt, Human
agaaacgggguuucaccauauuggucaggcug

SEQ ID NO: 309336 - RNA, 32 nt, Human
agaaacgggguuucaccauguugcucaggcug

SEQ ID NO: 309337 - RNA, 32 nt, Human
agaaacgggguuucaccauguuggccaggaug

SEQ ID NO: 309338 - RNA, 32 nt, Human
agaaacgggguuucaccauguuggccaggcug

SEQ ID NO: 309339 - RNA, 32 nt, Human
agaaacgggguuucaccauguuggccgggcug

SEQ ID NO: 309340 - RNA, 32 nt, Human
agaaacgggguuuugccauguuggccagacug

SEQ ID NO: 309341 - RNA, 32 nt, Human
agaaacggucaacauucuaaagagauacaguc

SEQ ID NO: 309342 - RNA, 32 nt, Human
agaaacguucacugcacaaccuguucccugca

SEQ ID NO: 309343 - RNA, 32 nt, Human
agaaacguugacugggaccacuggagacacug

SEQ ID NO: 309344 - RNA, 32 nt, Human
agaaacuaaacagcaaaagcaaagagaaagcu

SEQ ID NO: 309345 - RNA, 32 nt, Human
agaaacuaaggugucagcagagcuguguucuc

SEQ ID NO: 309346 - RNA, 32 nt, Human
agaaacuaccaucagacugaacaggcaaccua

SEQ ID NO: 309347 - RNA, 18 nt, Human
agaaacuaccuaccucac

SEQ ID NO: 309348 - RNA, 32 nt, Human
agaaacuagacauuccauugaacuagaagaga

SEQ ID NO: 309349 - RNA, 32 nt, Human
agaaacuaggacugcagugggcucggauaggc

SEQ ID NO: 309350 - RNA, 32 nt, Human
agaaacuaguaucucuggccuccuggggccca

SEQ ID NO: 309351 - RNA, 32 nt, Human
agaaacuaucuucucccaacauuuacuaacau

SEQ ID NO: 309352 - RNA, 32 nt, Human
agaaacuauuucuguuccagucacauugccau

SEQ ID NO: 309353 - RNA, 32 nt, Human
agaaacucaaagcuuucagaaauuaauaguua

SEQ ID NO: 309354 - RNA, 32 nt, Human
agaaacucaggcccugccuuucugcuacacaa

SEQ ID NO: 309355 - RNA, 32 nt, Human
agaaacucagugugugauguugggcagugugc

SEQ ID NO: 309356 - RNA, 19 nt, Human
agaaacuccaacauuucac

SEQ ID NO: 309357 - RNA, 32 nt, Human
agaaacuccaaccccugcccuuccucuucccc

SEQ ID NO: 309358 - RNA, 32 nt, Human
agaaacucccagagaauaauguauccccaucu

SEQ ID NO: 309359 - RNA, 20 nt, Human
agaaacuccucuuucuucau

SEQ ID NO: 309360 - RNA, 32 nt, Human
agaaacucgcccugcacucaggcauggacuac

SEQ ID NO: 309361 - RNA, 32 nt, Human
agaaacucuaggggugaggaccuagcagucug

SEQ ID NO: 309362 - RNA, 32 nt, Human
agaaacucuguaauaccuggaaccucagauaa

SEQ ID NO: 309363 - RNA, 32 nt, Human
agaaacugaaauuuuaaaacuuaauucagguc

SEQ ID NO: 309364 - RNA, 32 nt, Human
agaaacugaauacauugcucccuuucccuagg

SEQ ID NO: 309365 - RNA, 31 nt, Human
agaaacugacuucuuuagacaaaguuuuaac

SEQ ID NO: 309366 - RNA, 32 nt, Human
agaaacugcagagggcugggcacggugguuua

SEQ ID NO: 309367 - RNA, 32 nt, Human
agaaacugccaguagagggcagccugggcauc

SEQ ID NO: 309368 - RNA, 32 nt, Human
agaaacugcccagguggaacagcacguaaccu

SEQ ID NO: 309369 - RNA, 32 nt, Human
agaaacugccucaugguagccucccaggggag

SEQ ID NO: 309370 - RNA, 32 nt, Human
agaaacugcggcaggccgggugcagugucuca

SEQ ID NO: 309371 - RNA, 32 nt, Human
agaaacuggagacaacuuugcaggcacccugg

SEQ ID NO: 309372 - RNA, 32 nt, Human
agaaacuggagugcuugaaggagcugcagaca

SEQ ID NO: 309373 - RNA, 32 nt, Human
agaaacuggauccugguaggggguggcauuuu

SEQ ID NO: 309374 - RNA, 32 nt, Human
agaaacugggcucaucacaccaaggcaaagca

SEQ ID NO: 309375 - RNA, 32 nt, Human
agaaacugggucucacuauguugcccagguug

SEQ ID NO: 309376 - RNA, 32 nt, Human
agaaacugguagguuucaucaggugguuaaag

SEQ ID NO: 309377 - RNA, 32 nt, Human
agaaacuguauucaugucauauaguccauaaa

SEQ ID NO: 309378 - RNA, 32 nt, Human
agaaacuguccagggccucacagggaggcauu

SEQ ID NO: 309379 - RNA, 32 nt, Human
agaaacugucugcugcucaagacccacaggac

SEQ ID NO: 309380 - RNA, 32 nt, Human
agaaacugugggcugcgguggcucuggagcug

SEQ ID NO: 309381 - RNA, 32 nt, Human
agaaacuguuugauuauagaaaagaccccaga

SEQ ID NO: 309382 - RNA, 32 nt, Human
agaaacuuauuucucauaucaacuuagucaau

SEQ ID NO: 309383 - RNA, 32 nt, Human
agaaacuucuauguucugugcaugccauuaga

SEQ ID NO: 309384 - RNA, 32 nt, Human
agaaacuugacaaaauaggaacaggagauauu

SEQ ID NO: 309385 - RNA, 32 nt, Human
agaaacuugcagaugauaugugcugccuuugc

SEQ ID NO: 309386 - RNA, 32 nt, Human
agaaacuuuccaaggagucuuggguguguagc

SEQ ID NO: 309387 - RNA, 32 nt, Human
agaaagaaaagaaagaaagaaagaaagaaaga

SEQ ID NO: 309388 - RNA, 27 nt, Human
agaaagaaaagaaagaaagagagagag

SEQ ID NO: 309389 - RNA, 32 nt, Human
agaaagaaaagaaggaaggaagagagguagac

SEQ ID NO: 309390 - RNA, 32 nt, Human
agaaagaaagaaaagaaaagaaaaucccuuuu

SEQ ID NO: 309391 - RNA, 32 nt, Human
agaaagaaagaaaagaaagaaagaaagaaaga

SEQ ID NO: 309392 - RNA, 31 nt, Human
agaaagaaagaaaagaaagaaagagagagag

SEQ ID NO: 309393 - RNA, 32 nt, Human
agaaagaaagaaagaaagaaagaaaagaaaga

SEQ ID NO: 309394 - RNA, 18 nt, Human
agaaagaaagaaaucaga

SEQ ID NO: 309395 - RNA, 32 nt, Human
agaaagaaagaaggaaggaaggaaaaacuugu

SEQ ID NO: 309396 - RNA, 32 nt, Human
agaaagaaagaauuugccuaaauagaacagaa

SEQ ID NO: 309397 - RNA, 32 nt, Human
agaaagaaaggcuggggauauuuggguuggcu

SEQ ID NO: 309398 - RNA, 32 nt, Human
agaaagaaaggucagcuuuggcccagaugugg

SEQ ID NO: 309399 - RNA, 18 nt, Human
agaaagaaauucuaagga

SEQ ID NO: 309400 - RNA, 32 nt, Human
agaaagaacggaagaagagaucaggaagagaa

SEQ ID NO: 309401 - RNA, 32 nt, Human
agaaagaacucaaguacaacccaaugagguug

SEQ ID NO: 309402 - RNA, 32 nt, Human
agaaagaagagaggacacaucucccaccauua

SEQ ID NO: 309403 - RNA, 32 nt, Human
agaaagaagccagaagccaggggguggggaag

SEQ ID NO: 309404 - RNA, 32 nt, Human
agaaagaaggaaggaaggaaaaacuuguuacu

SEQ ID NO: 309405 - RNA, 32 nt, Human
agaaagaaggcguggagaagagggagggagcg

SEQ ID NO: 309406 - RNA, 32 nt, Human
agaaagaaggucucgcuacauugcccaggcug

SEQ ID NO: 309407 - RNA, 32 nt, Human
agaaagaauacaaaaaguguacauuccuuuuu

SEQ ID NO: 309408 - RNA, 32 nt, Human
agaaagaaucuugguggauuugugucucaaau

SEQ ID NO: 309409 - RNA, 32 nt, Human
agaaagacacaauguggagaaaucuuaggacu

SEQ ID NO: 309410 - RNA, 32 nt, Human
agaaagacauugggccucccacacucaggcug

SEQ ID NO: 309411 - RNA, 32 nt, Human
agaaagaccuagaagguuguagaugggaaauc

SEQ ID NO: 309412 - RNA, 32 nt, Human
agaaagaccuuucuccuugagcucuuugacuc

SEQ ID NO: 309413 - RNA, 32 nt, Human
agaaagacggagaagaggagagagaagccagg

SEQ ID NO: 309414 - RNA, 18 nt, Human
agaaagacggccaagggc

SEQ ID NO: 309415 - RNA, 32 nt, Human
agaaagacugaagugacagauuaagaguucuu

SEQ ID NO: 309416 - RNA, 32 nt, Human
agaaagacuucucaaggaggugccucagucag

SEQ ID NO: 309417 - RNA, 18 nt, Human
agaaagagaaaaacaagg

SEQ ID NO: 309418 - RNA, 32 nt, Human
agaaagagaaaaagagaaagaaacagaaagaa

SEQ ID NO: 309419 - RNA, 32 nt, Human
agaaagagaaaaggucccagcugagagaaaaa

SEQ ID NO: 309420 - RNA, 32 nt, Human
agaaagagaacuccagaggguuugacaauccc

SEQ ID NO: 309421 - RNA, 32 nt, Human
agaaagagaacugcuccuucaucguaaauuua

SEQ ID NO: 309422 - RNA, 32 nt, Human
agaaagagaagcugaacaggagaaagacaaac

SEQ ID NO: 309423 - RNA, 32 nt, Human
agaaagagaaugagagaaagagaaugagagag

SEQ ID NO: 309424 - RNA, 32 nt, Human
agaaagagagagaaggagagagacaguagcca

SEQ ID NO: 309425 - RNA, 32 nt, Human
agaaagagagagugugugggucuauguaaaug

SEQ ID NO: 309426 - RNA, 32 nt, Human
agaaagagagugaggcuauggaguggcagcag

SEQ ID NO: 309427 - RNA, 20 nt, Human
agaaagagaucucauaggac

SEQ ID NO: 309428 - RNA, 32 nt, Human
agaaagagauggaggaggaggacuggcccaga

SEQ ID NO: 309429 - RNA, 32 nt, Human
agaaagagaugggagguugggggaggugagca

SEQ ID NO: 309430 - RNA, 32 nt, Human
agaaagaggaagaggagccgcugaguggcaau

SEQ ID NO: 309431 - RNA, 22 nt, Human
agaaagaggaagauuccaggac

SEQ ID NO: 309432 - RNA, 32 nt, Human
agaaagaggagaaaggaagggaagcauuacug

SEQ ID NO: 309433 - RNA, 19 nt, Human
agaaagaggagacaaggac

SEQ ID NO: 309434 - RNA, 32 nt, Human
agaaagaggaggagaauuaagaagaggaugau

SEQ ID NO: 309435 - RNA, 32 nt, Human
agaaagaggaggagaguugaaaagagaggaga

SEQ ID NO: 309436 - RNA, 23 nt, Human
agaaagaggaguggucuuuguca

SEQ ID NO: 309437 - RNA, 32 nt, Human
agaaagaggcauugucaucccuauguguauaa

SEQ ID NO: 309438 - RNA, 32 nt, Human
agaaagaggcgaccuuccuugggaucugugcg

SEQ ID NO: 309439 - RNA, 32 nt, Human
agaaagaggcggggcugugugcgucuccuucg

SEQ ID NO: 309440 - RNA, 21 nt, Human
agaaagaggggacagguguca

SEQ ID NO: 309441 - RNA, 19 nt, Human
agaaagagggggaggaaga

SEQ ID NO: 309442 - RNA, 20 nt, Human
agaaagaggucagccaggac

SEQ ID NO: 309443 - RNA, 32 nt, Human
agaaagagguuaggaguagauauugauuacua

SEQ ID NO: 309444 - RNA, 19 nt, Human
agaaagagguuuaauggac

SEQ ID NO: 309445 - RNA, 32 nt, Human
agaaagagucucaaauggacaacuguccugug

SEQ ID NO: 309446 - RNA, 31 nt, Human
agaaagagugagagaggaauugccucuggac

SEQ ID NO: 309447 - RNA, 32 nt, Human
agaaagagugugagcugaugacacagugguuu

SEQ ID NO: 309448 - RNA, 32 nt, Human
agaaagagugugcguucaagaggcagaugagg

SEQ ID NO: 309449 - RNA, 32 nt, Human
agaaagaguguucuaggaagagucuagucccc

SEQ ID NO: 309450 - RNA, 32 nt, Human
agaaagaguguuggaguuaucucucuacuaau

SEQ ID NO: 309451 - RNA, 16 nt, Human
agaaagaguuguucca

SEQ ID NO: 309452 - RNA, 20 nt, Human
agaaagauaagaggaagcua

SEQ ID NO: 309453 - RNA, 32 nt, Human
agaaagauagcuugaguccaggaguuugagac

SEQ ID NO: 309454 - RNA, 32 nt, Human
agaaagaucaaaguuacaaaugaguggccgug

SEQ ID NO: 309455 - RNA, 32 nt, Human
agaaagauccauugccaaacagugccaugggg

SEQ ID NO: 309456 - RNA, 32 nt, Human
agaaagaucugcaagugcgcagagagaagacu

SEQ ID NO: 309457 - RNA, 32 nt, Human
agaaagauggacuggaaggugccugagccuga

SEQ ID NO: 309458 - RNA, 32 nt, Human
agaaagauggcuucccuucuggaacaccagca

SEQ ID NO: 309459 - RNA, 32 nt, Human
agaaagauuuauugugcauuauuugaacccug

SEQ ID NO: 309460 - RNA, 32 nt, Human
agaaagcaaaggugcacuccagacucuggggg

SEQ ID NO: 309461 - RNA, 32 nt, Human
agaaagcaagacaucaaggagggaccugugcc

SEQ ID NO: 309462 - RNA, 32 nt, Human
agaaagcaagaggcacgugaauguugagccgu

SEQ ID NO: 309463 - RNA, 32 nt, Human
agaaagcaaguacaguguggauuucaaauggu

SEQ ID NO: 309464 - RNA, 32 nt, Human
agaaagcaaguauagucagguauucucuccau

SEQ ID NO: 309465 - RNA, 32 nt, Human
agaaagcaauaguucaagucccuaccugugcc

SEQ ID NO: 309466 - RNA, 32 nt, Human
agaaagcaauccagaugugguuuacucugcca

SEQ ID NO: 309467 - RNA, 32 nt, Human
agaaagcacauaaacccaaagggcaaacaauu

SEQ ID NO: 309468 - RNA, 32 nt, Human
agaaagcacccagacgccacaggcucugucgc

SEQ ID NO: 309469 - RNA, 32 nt, Human
agaaagcacucaacugguuugacauugcuaag

SEQ ID NO: 309470 - RNA, 32 nt, Human
agaaagcagaguggcaucacaucuucaugccu

SEQ ID NO: 309471 - RNA, 32 nt, Human
agaaagcagcaguggaccugccccaaggccac

SEQ ID NO: 309472 - RNA, 32 nt, Human
agaaagcauagaggggaaagauggccggagga

SEQ ID NO: 309473 - RNA, 32 nt, Human
agaaagcaucgcuggagggcagccugguggag

SEQ ID NO: 309474 - RNA, 32 nt, Human
agaaagcauugcuggagggcagccugguggag

SEQ ID NO: 309475 - RNA, 32 nt, Human
agaaagcauuuugcaucagccuggagugaacc

SEQ ID NO: 309476 - RNA, 19 nt, Human
agaaagccaaaucaaggac

SEQ ID NO: 309477 - RNA, 32 nt, Human
agaaagccaacauuuuauguuauaauaugcug

SEQ ID NO: 309478 - RNA, 23 nt, Human
agaaagccacagccagccugcca

SEQ ID NO: 309479 - RNA, 32 nt, Human
agaaagccacauaccacaucuucucacuuaua

SEQ ID NO: 309480 - RNA, 32 nt, Human
agaaagccaccaaggccaggcuuuguuaaaag

SEQ ID NO: 309481 - RNA, 32 nt, Human
agaaagccagauucccagggaagccauggagc

SEQ ID NO: 309482 - RNA, 32 nt, Human
agaaagccagcaccugguugauguguauucau

SEQ ID NO: 309483 - RNA, 17 nt, Human
agaaagccccaggcaca

SEQ ID NO: 309484 - RNA, 32 nt, Human
agaaagcccuaaaauacuauuggagagaaaaa

SEQ ID NO: 309485 - RNA, 17 nt, Human
agaaagcccucuaggaa

SEQ ID NO: 309486 - RNA, 32 nt, Human
agaaagccucauucuuuucugugacccuuucg

SEQ ID NO: 309487 - RNA, 32 nt, Human
agaaagccucucucucccucccucucucauga

SEQ ID NO: 309488 - RNA, 18 nt, Human
agaaagccugaaaagcua

SEQ ID NO: 309489 - RNA, 21 nt, Human
agaaagccugagaaccagcua

SEQ ID NO: 309490 - RNA, 32 nt, Human
agaaagccugccaggaaauaaauucaaauaca

SEQ ID NO: 309491 - RNA, 21 nt, Human
agaaagccugggaggggccug

SEQ ID NO: 309492 - RNA, 32 nt, Human
agaaagccugggcuggcaagagcugccgccgg

SEQ ID NO: 309493 - RNA, 32 nt, Human
agaaagccuuauugagccccuuguugacacuu

SEQ ID NO: 309494 - RNA, 32 nt, Human
agaaagccuuucuccaucaucccagccccacg

SEQ ID NO: 309495 - RNA, 22 nt, Human
agaaagcgaggagcggccucca

SEQ ID NO: 309496 - RNA, 32 nt, Human
agaaagcgccauugcacuccagucugggugac

SEQ ID NO: 309497 - RNA, 32 nt, Human
agaaagcggcggcggaggauggaggaaggagg

SEQ ID NO: 309498 - RNA, 32 nt, Human
agaaagcggugacuucaccucauggagcccgg

SEQ ID NO: 309499 - RNA, 32 nt, Human
agaaagcgucccuggagaacagccuggaggaa

SEQ ID NO: 309500 - RNA, 32 nt, Human
agaaagcuaauacccuccuuggaguugcaagu

SEQ ID NO: 309501 - RNA, 32 nt, Human
agaaagcuacaugaauuaauuguacucuaugg

SEQ ID NO: 309502 - RNA, 32 nt, Human
agaaagcucugacucucaggaaguuaucugga

SEQ ID NO: 309503 - RNA, 32 nt, Human
agaaagcugaaaggaaucugcagucuccugcu

SEQ ID NO: 309504 - RNA, 32 nt, Human
agaaagcugaggaggcuuuggaagagaaggug

SEQ ID NO: 309505 - RNA, 32 nt, Human
agaaagcugcuugucgagggcauggggaauca

SEQ ID NO: 309506 - RNA, 32 nt, Human
agaaagcugggaaaggggauggguagaacaag

SEQ ID NO: 309507 - RNA, 32 nt, Human
agaaagcugugaaacucacucauuuccugcau

SEQ ID NO: 309508 - RNA, 22 nt, Human
agaaagcuguggaccugcucgg

SEQ ID NO: 309509 - RNA, 32 nt, Human
agaaagcuuacagauaaauggguuucaagcac

SEQ ID NO: 309510 - RNA, 32 nt, Human
agaaagcuucuaggaaguagauguuccauauc

SEQ ID NO: 309511 - RNA, 32 nt, Human
agaaagcuuguggaaagucucucuccuuccuc

SEQ ID NO: 309512 - RNA, 32 nt, Human
agaaagcuuuaggacaaagcaugggaaaugua

SEQ ID NO: 309513 - RNA, 32 nt, Human
agaaagcuuucaaagaggucacuguggccugu

SEQ ID NO: 309514 - RNA, 32 nt, Human
agaaagcuuuuauagaaagcccagugacaugg

SEQ ID NO: 309515 - RNA, 32 nt, Human
agaaaggaaaaauguuggaaacugacucuugu

SEQ ID NO: 309516 - RNA, 32 nt, Human
agaaaggaaaacagcucucucucuagugagag

SEQ ID NO: 309517 - RNA, 32 nt, Human
agaaaggaaaagaauuagaugcaucagaauac

SEQ ID NO: 309518 - RNA, 32 nt, Human
agaaaggaaacgcagggagacugugugccugg

SEQ ID NO: 309519 - RNA, 32 nt, Human
agaaaggaaagaaagaaagacuguaauaaguu

SEQ ID NO: 309520 - RNA, 32 nt, Human
agaaaggaaagaaggaaggaaggaaggaagga

SEQ ID NO: 309521 - RNA, 32 nt, Human
agaaaggaaaugagaugacaguauuuaaucgc

SEQ ID NO: 309522 - RNA, 32 nt, Human
agaaaggaagaaaagaaggagggagagaggga

SEQ ID NO: 309523 - RNA, 19 nt, Human
agaaaggaagagaauggaa

SEQ ID NO: 309524 - RNA, 32 nt, Human
agaaaggaagcacaauuggcagguuaucacuu

SEQ ID NO: 309525 - RNA, 32 nt, Human
agaaaggaagccuaguuuccagaagccugaca

SEQ ID NO: 309526 - RNA, 32 nt, Human
agaaaggaaggaagaaagggugggagggagga

SEQ ID NO: 309527 - RNA, 32 nt, Human
agaaaggaaggaaggaaagaaggaagggagga

SEQ ID NO: 309528 - RNA, 32 nt, Human
agaaaggaagggaagcauuacuggguuacuau

SEQ ID NO: 309529 - RNA, 32 nt, Human
agaaaggacaaguuccaggggaggugauuuuu

SEQ ID NO: 309530 - RNA, 32 nt, Human
agaaaggacacaugggcuugggagaggggaga

SEQ ID NO: 309531 - RNA, 32 nt, Human
agaaaggacagcucagaaaaucaaagaggcca

SEQ ID NO: 309532 - RNA, 32 nt, Human
agaaaggacaggcuuuuuaugaguaacacaca

SEQ ID NO: 309533 - RNA, 32 nt, Human
agaaaggacccuggacccagaggcagauacug

SEQ ID NO: 309534 - RNA, 32 nt, Human
agaaaggacuccuccuuuuuccaugcccuaaa

SEQ ID NO: 309535 - RNA, 32 nt, Human
agaaaggagagggcgggguagggaugcagcug

SEQ ID NO: 309536 - RNA, 32 nt, Human
agaaaggagaggggcacagaacgguuugccuc

SEQ ID NO: 309537 - RNA, 31 nt, Human
agaaaggagcacuucuacacaccuccucacu

SEQ ID NO: 309538 - RNA, 32 nt, Human
agaaaggagcccaggaaacgggucauuucuuu

SEQ ID NO: 309539 - RNA, 32 nt, Human
agaaaggagcuggagaagagaggcagaaaaau

SEQ ID NO: 309540 - RNA, 32 nt, Human
agaaaggaggcggaacucggugaucugacugg

SEQ ID NO: 309541 - RNA, 32 nt, Human
agaaaggaggggcaguggcuuccccggcagca

SEQ ID NO: 309542 - RNA, 32 nt, Human
agaaaggagucugcacaugcagcugcacccuc

SEQ ID NO: 309543 - RNA, 32 nt, Human
agaaaggaguuucuuuagcugacagaaucucu

SEQ ID NO: 309544 - RNA, 32 nt, Human
agaaaggauacugucgguucacuguugagcag

SEQ ID NO: 309545 - RNA, 32 nt, Human
agaaaggauguuuugucccauuuccuuggagg

SEQ ID NO: 309546 - RNA, 32 nt, Human
agaaaggcaaagcauuugucugaaagcgaaag

SEQ ID NO: 309547 - RNA, 32 nt, Human
agaaaggcaaaggagacaccuguuccuuccca

SEQ ID NO: 309548 - RNA, 32 nt, Human
agaaaggcaaaguuugcuuugcuuggguaugu

SEQ ID NO: 309549 - RNA, 21 nt, Human
agaaaggcaaggaggaggaga

SEQ ID NO: 309550 - RNA, 32 nt, Human
agaaaggcaaggcaacugggaauugcuggaga

SEQ ID NO: 309551 - RNA, 32 nt, Human
agaaaggcaccugcaaggacugcucugugaug

SEQ ID NO: 309552 - RNA, 32 nt, Human
agaaaggcagauggggucuccggggcugggca

SEQ ID NO: 309553 - RNA, 32 nt, Human
agaaaggcagcaugccagccuccggugaugag

SEQ ID NO: 309554 - RNA, 32 nt, Human
agaaaggcagcaugguacauggggaggaagac

SEQ ID NO: 309555 - RNA, 24 nt, Human
agaaaggcaucaguaccaaacgga

SEQ ID NO: 309556 - RNA, 24 nt, Human
agaaaggcaucuuucgccagugga

SEQ ID NO: 309557 - RNA, 32 nt, Human
agaaaggcccaaguccaugagcacagaggguc

SEQ ID NO: 309558 - RNA, 32 nt, Human
agaaaggccggcagcccugggguggcggcggg

SEQ ID NO: 309559 - RNA, 32 nt, Human
agaaaggcuauuucuucgcugugugaucagug

SEQ ID NO: 309560 - RNA, 16 nt, Human
agaaaggcucauucca

SEQ ID NO: 309561 - RNA, 32 nt, Human
agaaaggcuggcucagaucuugaccaagaaac

SEQ ID NO: 309562 - RNA, 32 nt, Human
agaaaggcuggugccuggucucuccucauuuc

SEQ ID NO: 309563 - RNA, 32 nt, Human
agaaaggcuguaaucagcagacuggaaacuga

SEQ ID NO: 309564 - RNA, 32 nt, Human
agaaaggcuguaaucagcagacuggaagcuga

SEQ ID NO: 309565 - RNA, 32 nt, Human
agaaagggaagagaaacaaggguguucauuca

SEQ ID NO: 309566 - RNA, 32 nt, Human
agaaagggaaggagguagagggaagaaacaga

SEQ ID NO: 309567 - RNA, 19 nt, Human
agaaagggaccccucucca

SEQ ID NO: 309568 - RNA, 32 nt, Human
agaaagggagagagggagggagagagagugaa

SEQ ID NO: 309569 - RNA, 32 nt, Human
agaaagggagagagggagggagaggaucguga

SEQ ID NO: 309570 - RNA, 32 nt, Human
agaaagggagagagggagggggagggcgggcg

SEQ ID NO: 309571 - RNA, 32 nt, Human
agaaagggagagauguugcgggaagucaggga

SEQ ID NO: 309572 - RNA, 32 nt, Human
agaaagggagaggggacaggagggaagggugg

SEQ ID NO: 309573 - RNA, 25 nt, Human
agaaagggagggcagagaggacaga

SEQ ID NO: 309574 - RNA, 32 nt, Human
agaaagggaggguggagggugaggccaaauca

SEQ ID NO: 309575 - RNA, 32 nt, Human
agaaagggagucaggcacacugggaaucgugg

SEQ ID NO: 309576 - RNA, 32 nt, Human
agaaagggagucaggcgcauugggaaucgugg

SEQ ID NO: 309577 - RNA, 32 nt, Human
agaaagggcaaggggugaggauaggacagagg

SEQ ID NO: 309578 - RNA, 32 nt, Human
agaaagggcaugcaaggccuucucugggugac

SEQ ID NO: 309579 - RNA, 32 nt, Human
agaaagggcguggagguucagcacauucugag

SEQ ID NO: 309580 - RNA, 32 nt, Human
agaaagggcuccauuaugagcauggguucagg

SEQ ID NO: 309581 - RNA, 32 nt, Human
agaaagggcuggagcagaagggccaagagggc

SEQ ID NO: 309582 - RNA, 32 nt, Human
agaaagggcuuucugccagccugggcaacaua

SEQ ID NO: 309583 - RNA, 32 nt, Human
agaaaggggaaaggaagaaagaaggagagcag

SEQ ID NO: 309584 - RNA, 32 nt, Human
agaaaggggcaggcugaggcugggggaggggc

SEQ ID NO: 309585 - RNA, 32 nt, Human
agaaaggggcuggguaccucuucugguugcug

SEQ ID NO: 309586 - RNA, 32 nt, Human
agaaaggggcuuugggcucugccccucuggcu

SEQ ID NO: 309587 - RNA, 32 nt, Human
agaaagggguggugggcccugcccuuuguaga

SEQ ID NO: 309588 - RNA, 32 nt, Human
agaaagggugggcguggguggggaaggcagag

SEQ ID NO: 309589 - RNA, 32 nt, Human
agaaaggguguagauggagaggcgguggccuc

SEQ ID NO: 309590 - RNA, 32 nt, Human
agaaagguauaaucauguaauuucucauauua

SEQ ID NO: 309591 - RNA, 32 nt, Human
agaaaggugagccccagaagggccaaugucac

SEQ ID NO: 309592 - RNA, 32 nt, Human
agaaaggugauagcauuaaauguucaucuaga

SEQ ID NO: 309593 - RNA, 32 nt, Human
agaaaggugauuguacuugccaaaucuaaaug

SEQ ID NO: 309594 - RNA, 32 nt, Human
agaaaggugcgugugagacaggagaauugucu

SEQ ID NO: 309595 - RNA, 32 nt, Human
agaaagguggaaaagguggcuggugugagaau

SEQ ID NO: 309596 - RNA, 32 nt, Human
agaaagguggugcugaaaggacagaugcuagu

SEQ ID NO: 309597 - RNA, 32 nt, Human
agaaagguuaggaagaaagaggagacaaggac

SEQ ID NO: 309598 - RNA, 32 nt, Human
agaaagguuauuccggauggggacugaugcug

SEQ ID NO: 309599 - RNA, 32 nt, Human
agaaaguacaaagauaaaccuggacuucuccu

SEQ ID NO: 309600 - RNA, 31 nt, Human
agaaaguacaugucucccauugggaggauuu

SEQ ID NO: 309601 - RNA, 32 nt, Human
agaaaguacuauaugccugcuugauagcaugu

SEQ ID NO: 309602 - RNA, 16 nt, Human
agaaaguagcagggga

SEQ ID NO: 309603 - RNA, 32 nt, Human
agaaaguagcccaagaucuaggguuccuaaau

SEQ ID NO: 309604 - RNA, 32 nt, Human
agaaaguagcccucaaauaaacuguuauugca

SEQ ID NO: 309605 - RNA, 32 nt, Human
agaaaguagggaggaaggggaccaagccagag

SEQ ID NO: 309606 - RNA, 32 nt, Human
agaaaguagucugagcagugggagauuuuagu

SEQ ID NO: 309607 - RNA, 32 nt, Human
agaaaguauauguacaccaaaacauguugaac

SEQ ID NO: 309608 - RNA, 32 nt, Human
agaaagucacggacaaguucacugagagcguc

SEQ ID NO: 309609 - RNA, 32 nt, Human
agaaaguccaguaacagagaagaaaugucuca

SEQ ID NO: 309610 - RNA, 32 nt, Human
agaaagucccaccaccugcacauguguagccc

SEQ ID NO: 309611 - RNA, 32 nt, Human
agaaaguccugggcuaggagagugagucccug

SEQ ID NO: 309612 - RNA, 32 nt, Human
agaaaguccuucacuacauggccaggugcagu

SEQ ID NO: 309613 - RNA, 32 nt, Human
agaaagucggggcuucucgccccggaucccca

SEQ ID NO: 309614 - RNA, 32 nt, Human
agaaagucuccaccacuuucaaaaaucccgua

SEQ ID NO: 309615 - RNA, 17 nt, Human
agaaagucuccuggagg

SEQ ID NO: 309616 - RNA, 32 nt, Human
agaaagucugugagccuccacccugccagaaa

SEQ ID NO: 309617 - RNA, 32 nt, Human
agaaagugaaaacuuccagacaacugcagcag

SEQ ID NO: 309618 - RNA, 32 nt, Human
agaaagugacucuguucucuuagcaaccgucu

SEQ ID NO: 309619 - RNA, 32 nt, Human
agaaagugagaggagguuccagcugggcuucc

SEQ ID NO: 309620 - RNA, 24 nt, Human
agaaagugagguggugaccuccca

SEQ ID NO: 309621 - RNA, 31 nt, Human
agaaagugauauugaagaaaagacugaagug

SEQ ID NO: 309622 - RNA, 32 nt, Human
agaaagugauauugaagaaaagacugaaguga

SEQ ID NO: 309623 - RNA, 22 nt, Human
agaaagugauccgccugccugc

SEQ ID NO: 309624 - RNA, 32 nt, Human
agaaagugaucuaccacugaaaucauucuagg

SEQ ID NO: 309625 - RNA, 32 nt, Human
agaaagugcaagacaugccaauuugagacaca

SEQ ID NO: 309626 - RNA, 32 nt, Human
agaaagugccuaaacaucccuacugucucucu

SEQ ID NO: 309627 - RNA, 23 nt, Human
agaaagugcuggcucacuuucua

SEQ ID NO: 309628 - RNA, 32 nt, Human
agaaaguggaggggcgggcagagccagaucca

SEQ ID NO: 309629 - RNA, 32 nt, Human
agaaagugggcccugccugggcucagauuuag

SEQ ID NO: 309630 - RNA, 22 nt, Human
agaaaguggggggcucucagcc

SEQ ID NO: 309631 - RNA, 31 nt, Human
agaaaguguagauaguuaaaagacugcagcu

SEQ ID NO: 309632 - RNA, 32 nt, Human
agaaaguguauccgcuacaauaaaguucuggu

SEQ ID NO: 309633 - RNA, 32 nt, Human
agaaaguguaugauauaaaggacuuccagaca

SEQ ID NO: 309634 - RNA, 32 nt, Human
agaaaguguccaggugggggcuggcagucccu

SEQ ID NO: 309635 - RNA, 32 nt, Human
agaaaguuagaugaaucagugcccaagacaua

SEQ ID NO: 309636 - RNA, 19 nt, Human
agaaaguucagacccagga

SEQ ID NO: 309637 - RNA, 32 nt, Human
agaaaguucauguuugguaaauucuguuacua

SEQ ID NO: 309638 - RNA, 32 nt, Human
agaaaguugcauucucucaggggccuagauug

SEQ ID NO: 309639 - RNA, 32 nt, Human
agaaaguuuucagucgcaaaucacacauggaa

SEQ ID NO: 309640 - RNA, 32 nt, Human
agaaaguuuugguuagugcauaccguggaagg

SEQ ID NO: 309641 - RNA, 32 nt, Human
agaaauaaacucguaacccuguccuucaaaaa

SEQ ID NO: 309642 - RNA, 32 nt, Human
agaaauaaagagucuguuuuugcucaaaccau

SEQ ID NO: 309643 - RNA, 32 nt, Human
agaaauaaaggauggacaacaaucugggagac

SEQ ID NO: 309644 - RNA, 32 nt, Human
agaaauaaaguagggaaagaaggagagaggaa

SEQ ID NO: 309645 - RNA, 20 nt, Human
agaaauaaaguuugcuuaga

SEQ ID NO: 309646 - RNA, 23 nt, Human
agaaauaaaguuuguacuuggag

SEQ ID NO: 309647 - RNA, 18 nt, Human
agaaauaacagcugggga

SEQ ID NO: 309648 - RNA, 32 nt, Human
agaaauaacccagauauccuucaacaggugau

SEQ ID NO: 309649 - RNA, 32 nt, Human
agaaauaagagugcuggaucgcaugguaauuc

SEQ ID NO: 309650 - RNA, 32 nt, Human
agaaauaagagugcuggaucgcgugguaauuc

SEQ ID NO: 309651 - RNA, 19 nt, Human
agaaauaagaucacuuaga

SEQ ID NO: 309652 - RNA, 32 nt, Human
agaaauaagcuaauuggaucaguggcuuaaau

SEQ ID NO: 309653 - RNA, 32 nt, Human
agaaauaaguugacccaggaguacagucucaa

SEQ ID NO: 309654 - RNA, 32 nt, Human
agaaauaauagaaaugucucaaggcaguuaau

SEQ ID NO: 309655 - RNA, 32 nt, Human
agaaauaaucccaagucacaccaccuucuauu

SEQ ID NO: 309656 - RNA, 32 nt, Human
agaaauaauccuucugaagcaaagcaccacga

SEQ ID NO: 309657 - RNA, 32 nt, Human
agaaauaaugguagaaaaugucccagcuuuga

SEQ ID NO: 309658 - RNA, 32 nt, Human
agaaauaaugugcccuacagacccugggaccu

SEQ ID NO: 309659 - RNA, 32 nt, Human
agaaauacaaaaauuggcugggcgcgguggug

SEQ ID NO: 309660 - RNA, 32 nt, Human
agaaauacaguacaagccacuucauuuuggag

SEQ ID NO: 309661 - RNA, 32 nt, Human
agaaauacaguuacaguggaaggacuuuaaga

SEQ ID NO: 309662 - RNA, 32 nt, Human
agaaauaccacagcucagccacugugaugcag

SEQ ID NO: 309663 - RNA, 32 nt, Human
agaaauacccacagcauagugaccucagaccc

SEQ ID NO: 309664 - RNA, 32 nt, Human
agaaauaccuaauguagaugacagguugaugg

SEQ ID NO: 309665 - RNA, 19 nt, Human
agaaauacuguuucuggga

SEQ ID NO: 309666 - RNA, 32 nt, Human
agaaauagaaauuaagcuacuauauaaaacaa

SEQ ID NO: 309667 - RNA, 32 nt, Human
agaaauagagacugagagugagcaaccagcug

SEQ ID NO: 309668 - RNA, 32 nt, Human
agaaauagcaguccauuuucucuugcaagccc

SEQ ID NO: 309669 - RNA, 32 nt, Human
agaaauaggagcaaacccccaagaggcuuaau

SEQ ID NO: 309670 - RNA, 32 nt, Human
agaaauaggaggagacguccagcucuguccuc

SEQ ID NO: 309671 - RNA, 32 nt, Human
agaaauaggaggagguuuugaagaauaaagcc

SEQ ID NO: 309672 - RNA, 32 nt, Human
agaaauaggaucucacuauguugcccaggcug

SEQ ID NO: 309673 - RNA, 32 nt, Human
agaaauauagaccauaauggucauacugaggu

SEQ ID NO: 309674 - RNA, 32 nt, Human
agaaauauuccacuggggaugagggaaaaccc

SEQ ID NO: 309675 - RNA, 32 nt, Human
agaaauauuuuauaaacccuguucacagcaga

SEQ ID NO: 309676 - RNA, 32 nt, Human
agaaaucacaagaacaaauacacuuuauuaau

SEQ ID NO: 309677 - RNA, 32 nt, Human
agaaaucacaccacugcacucuagccugggca

SEQ ID NO: 309678 - RNA, 32 nt, Human
agaaaucacagcuguuuauuuucuguaaauca

SEQ ID NO: 309679 - RNA, 32 nt, Human
agaaaucacauuuuuggccaggcacaguggcu

SEQ ID NO: 309680 - RNA, 18 nt, Human
agaaaucacccgucuucu

SEQ ID NO: 309681 - RNA, 32 nt, Human
agaaaucaccuacaccagagagcuauuuuggu

SEQ ID NO: 309682 - RNA, 32 nt, Human
agaaaucaccugcuuuagggcugguaaaugca

SEQ ID NO: 309683 - RNA, 32 nt, Human
agaaaucagcaaccagccucuguuucaucugg

SEQ ID NO: 309684 - RNA, 32 nt, Human
agaaaucagcucauggcuuaggauggaauuag

SEQ ID NO: 309685 - RNA, 32 nt, Human
agaaaucaggaaaucugaaaacuucgauggaa

SEQ ID NO: 309686 - RNA, 32 nt, Human
agaaaucaguaguuuugcaauguuaauuauuu

SEQ ID NO: 309687 - RNA, 23 nt, Human
agaaaucagucuccgccaguggg

SEQ ID NO: 309688 - RNA, 32 nt, Human
agaaaucauauauguauggauauauuuuaaua

SEQ ID NO: 309689 - RNA, 32 nt, Human
agaaaucaucuagcaguaaacucucucggucu

SEQ ID NO: 309690 - RNA, 32 nt, Human
agaaaucauuagcucaugcgaauauaagagaa

SEQ ID NO: 309691 - RNA, 32 nt, Human
agaaauccaagaaaugaaaccaggaagguuuu

SEQ ID NO: 309692 - RNA, 32 nt, Human
agaaauccaucuuuucccaggucuccuucacu

SEQ ID NO: 309693 - RNA, 32 nt, Human
agaaauccgguuaaaaucagagucggagggag

SEQ ID NO: 309694 - RNA, 32 nt, Human
agaaauccuggccucugcucaugcgcaggcca

SEQ ID NO: 309695 - RNA, 32 nt, Human
agaaaucgagccugucccuugugcacuuggga

SEQ ID NO: 309696 - RNA, 32 nt, Human
agaaaucuacagaucuguuuuguacuuuuuau

SEQ ID NO: 309697 - RNA, 32 nt, Human
agaaaucuacuuuaaugucucuuucgaaagca

SEQ ID NO: 309698 - RNA, 21 nt, Human
agaaaucucagcgacagcaca

SEQ ID NO: 309699 - RNA, 23 nt, Human
agaaaucucagcuccacaaccca

SEQ ID NO: 309700 - RNA, 32 nt, Human
agaaaucuccagcugcucugaugauagccuaa

SEQ ID NO: 309701 - RNA, 32 nt, Human
agaaaucuccucaagccagagccugugcugug

SEQ ID NO: 309702 - RNA, 32 nt, Human
agaaaucugcauuucaacaaaaucccaaguuc

SEQ ID NO: 309703 - RNA, 32 nt, Human
agaaaucuggcuucuggccaggaagcuuuggu

SEQ ID NO: 309704 - RNA, 32 nt, Human
agaaaucuuguggccuuucaggagacuuucuu

SEQ ID NO: 309705 - RNA, 32 nt, Human
agaaaugaaaaauguuguguaugcuugaaaac

SEQ ID NO: 309706 - RNA, 32 nt, Human
agaaaugaaauacaaaugcuauagaaaaauuu

SEQ ID NO: 309707 - RNA, 32 nt, Human
agaaaugaagaaaagagaggaagaaagaaaga

SEQ ID NO: 309708 - RNA, 32 nt, Human
agaaaugaaguuacaggaggggcacaccgucc

SEQ ID NO: 309709 - RNA, 32 nt, Human
agaaaugaauacuuuaaaaagugauauauguu

SEQ ID NO: 309710 - RNA, 32 nt, Human
agaaaugacauacaagaucuccacgaauauca

SEQ ID NO: 309711 - RNA, 32 nt, Human
agaaaugacucugggagaggauuucccuuaug

SEQ ID NO: 309712 - RNA, 32 nt, Human
agaaaugagaucuggccccagcucagcucugc

SEQ ID NO: 309713 - RNA, 32 nt, Human
agaaaugaggaaaggugaagcuggagaggugg

SEQ ID NO: 309714 - RNA, 29 nt, Human
agaaaugaggcagaagcggaaaggagauc

SEQ ID NO: 309715 - RNA, 32 nt, Human
agaaaugagggugggagcaggaucaccacugg

SEQ ID NO: 309716 - RNA, 32 nt, Human
agaaaugaggucucgccauguugcucagacug

SEQ ID NO: 309717 - RNA, 18 nt, Human
agaaaugauacccaggag

SEQ ID NO: 309718 - RNA, 23 nt, Human
agaaaugauauaugcugcuuuua

SEQ ID NO: 309719 - RNA, 32 nt, Human
agaaaugaugcuucugcucaggaauggcccac

SEQ ID NO: 309720 - RNA, 32 nt, Human
agaaaugauucucucacaggcuugggaaaucc

SEQ ID NO: 309721 - RNA, 32 nt, Human
agaaaugcaaggggcugcaugaccuaccagga

SEQ ID NO: 309722 - RNA, 32 nt, Human
agaaaugcacacaacagaaccauaggcaacac

SEQ ID NO: 309723 - RNA, 32 nt, Human
agaaaugccagaccuguaucccagaaaauaaa

SEQ ID NO: 309724 - RNA, 32 nt, Human
agaaaugccagugaaagaugaagagagaugag

SEQ ID NO: 309725 - RNA, 32 nt, Human
agaaaugcccccaucagaaaugcucuuuuaga

SEQ ID NO: 309726 - RNA, 32 nt, Human
agaaaugcuggcauagagcagcacuaaaugac

SEQ ID NO: 309727 - RNA, 32 nt, Human
agaaaugcuugcuuuauagcugcuccacccuc

SEQ ID NO: 309728 - RNA, 32 nt, Human
agaaaugcuuuagaaucugaacuuuuuaagac

SEQ ID NO: 309729 - RNA, 32 nt, Human
agaaaugcuuuuaggauucagguagaaaaagu

SEQ ID NO: 309730 - RNA, 32 nt, Human
agaaauggagaaaagaagagaggacucucaag

SEQ ID NO: 309731 - RNA, 32 nt, Human
agaaauggagagaggcuuggaggcugggggug

SEQ ID NO: 309732 - RNA, 32 nt, Human
agaaauggaggugggagcuuagggaaugcaga

SEQ ID NO: 309733 - RNA, 32 nt, Human
agaaauggcaugggauaagagcagagcucaca

SEQ ID NO: 309734 - RNA, 31 nt, Human
agaaauggccucucuccucugucagagugga

SEQ ID NO: 309735 - RNA, 32 nt, Human
agaaauggcuguauguccaggagaccugcccu

SEQ ID NO: 309736 - RNA, 32 nt, Human
agaaaugggaaagaagagggagggagagagaa

SEQ ID NO: 309737 - RNA, 32 nt, Human
agaaaugggaccccaaguacccaaucuucccu

SEQ ID NO: 309738 - RNA, 32 nt, Human
agaaaugggagacuguuucucuggccucagaa

SEQ ID NO: 309739 - RNA, 32 nt, Human
agaaaugggagggcuccucuucacagcgaggg

SEQ ID NO: 309740 - RNA, 29 nt, Human
agaaaugggaggugaaaaugcagagauaa

SEQ ID NO: 309741 - RNA, 32 nt, Human
agaaaugggccagagaaaaagaugggacacuc

SEQ ID NO: 309742 - RNA, 32 nt, Human
agaaaugggcugggagugcuucuguccugcug

SEQ ID NO: 309743 - RNA, 32 nt, Human
agaaauggggauucaccauguuggucaggcua

SEQ ID NO: 309744 - RNA, 32 nt, Human
agaaauggggucuuguuauguugcccaggcug

SEQ ID NO: 309745 - RNA, 32 nt, Human
agaaaugggguuucaccauguuagccaggaug

SEQ ID NO: 309746 - RNA, 32 nt, Human
agaaaugggguuucaccauguuagccaggcug

SEQ ID NO: 309747 - RNA, 32 nt, Human
agaaaugggguuucaccauguuggccaggcug

SEQ ID NO: 309748 - RNA, 32 nt, Human
agaaaugggguuucaccauguuguccaggcug

SEQ ID NO: 309749 - RNA, 32 nt, Human
agaaaugggguuucacuguguuagccaggaug

SEQ ID NO: 309750 - RNA, 32 nt, Human
agaaaugggguuucgccacguuggccaggcug

SEQ ID NO: 309751 - RNA, 32 nt, Human
agaaaugggguuucgccauguugcucaggcug

SEQ ID NO: 309752 - RNA, 32 nt, Human
agaaaugggguuucgucauguuggccaggcug

SEQ ID NO: 309753 - RNA, 32 nt, Human
agaaaugggguuuuaccauguuguccaggcug

SEQ ID NO: 309754 - RNA, 25 nt, Human
agacaggguuucacuaugcugguca

SEQ ID NO: 309755 - RNA, 19 nt, Human
agacaggguuucacuaugu

SEQ ID NO: 309756 - RNA, 21 nt, Human
agacaggguuucacuauguug

SEQ ID NO: 309757 - RNA, 25 nt, Human
agacaggguuucacuauguuggcca

SEQ ID NO: 309758 - RNA, 20 nt, Human
agacaggguuucacuguguu

SEQ ID NO: 309759 - RNA, 21 nt, Human
agacaggguuucacuguguug

SEQ ID NO: 309760 - RNA, 21 nt, Human
agacaggguuucaucauguug

SEQ ID NO: 309761 - RNA, 22 nt, Human
agacaggguuucaucauguugg

SEQ ID NO: 309762 - RNA, 25 nt, Human
agacaggguuucaucauguuggcca

SEQ ID NO: 309763 - RNA, 21 nt, Human
agacaggguuucccuauguug

SEQ ID NO: 309764 - RNA, 21 nt, Human
agacaggguuucgcaauguug

SEQ ID NO: 309765 - RNA, 21 nt, Human
agacaggguuucgccacauug

SEQ ID NO: 309766 - RNA, 21 nt, Human
agacaggguuucgccauauug

SEQ ID NO: 309767 - RNA, 25 nt, Human
agacaggguuucgccauauuggcca

SEQ ID NO: 309768 - RNA, 21 nt, Human
agacaggguuucgccauguug

SEQ ID NO: 309769 - RNA, 25 nt, Human
agacaggguuucgccauguuggcca

SEQ ID NO: 309770 - RNA, 21 nt, Human
agacaggguuucuccaugcug

SEQ ID NO: 309771 - RNA, 21 nt, Human
agacaggguuucuccauguug

SEQ ID NO: 309772 - RNA, 25 nt, Human
agacaggguuucuccauguugguca

SEQ ID NO: 309773 - RNA, 21 nt, Human
agacaggguuuuaccauguug

SEQ ID NO: 309774 - RNA, 25 nt, Human
agacaggguuuuaccauguuggcca

SEQ ID NO: 309775 - RNA, 25 nt, Human
agacaggguuuuaccauguugguca

SEQ ID NO: 309776 - RNA, 21 nt, Human
agacaggguuuugccacguug

SEQ ID NO: 309777 - RNA, 20 nt, Human
agacaggguuuugccauguu

SEQ ID NO: 309778 - RNA, 21 nt, Human
agacaggguuuugccauguug

SEQ ID NO: 309779 - RNA, 21 nt, Human
agacaggguuuugccguguug

SEQ ID NO: 309780 - RNA, 21 nt, Human
agacaggguuuugcuauguua

SEQ ID NO: 309781 - RNA, 22 nt, Human
agacaggugucucacuguguug

SEQ ID NO: 309782 - RNA, 32 nt, Human
agacagguguuaaugcaucuaugggccaggug

SEQ ID NO: 309783 - RNA, 32 nt, Human
agacagguugucuuuuggaaaugcagguuuaa

SEQ ID NO: 309784 - RNA, 24 nt, Human
agacagguuucaccacauugguca

SEQ ID NO: 309785 - RNA, 20 nt, Human
agacagguuucaccauauug

SEQ ID NO: 309786 - RNA, 24 nt, Human
agacagguuucaccauauuggcca

SEQ ID NO: 309787 - RNA, 20 nt, Human
agacagguuucaccauguug

SEQ ID NO: 309788 - RNA, 24 nt, Human
agacagguuucaccauguuggcca

SEQ ID NO: 309789 - RNA, 20 nt, Human
agacagguuuucaccauguu

SEQ ID NO: 309790 - RNA, 21 nt, Human
agacagguuuucaccauguug

SEQ ID NO: 309791 - RNA, 25 nt, Human
agacagguuuucaccauguugccca

SEQ ID NO: 309792 - RNA, 25 nt, Human
agacagguuuucaccauguuggcca

SEQ ID NO: 309793 - RNA, 25 nt, Human
agacagguuuuugccauguuggcca

SEQ ID NO: 309794 - RNA, 32 nt, Human
agacaguagaggcaugaacacacauggaugca

SEQ ID NO: 309795 - RNA, 32 nt, Human
agacaguauuugcagugccgaugauauagagu

SEQ ID NO: 309796 - RNA, 32 nt, Human
agacagucacacacaggcaguggagcuccccu

SEQ ID NO: 309797 - RNA, 32 nt, Human
agacaguccagccugaggucacugccugggau

SEQ ID NO: 309798 - RNA, 32 nt, Human
agacagucccccaggcugagucaaaagugguu

SEQ ID NO: 309799 - RNA, 32 nt, Human
agacagucccuauccucaaaggaugcuacagu

SEQ ID NO: 309800 - RNA, 32 nt, Human
agacaguccuagccuauagaacuccuaccucc

SEQ ID NO: 309801 - RNA, 32 nt, Human
agacagucuccucuguugccaggcuggaaugc

SEQ ID NO: 309802 - RNA, 32 nt, Human
agacagucucugaggaagccacagaaguucac

SEQ ID NO: 309803 - RNA, 32 nt, Human
agacagucuugcuccagcccaggcuggagugc

SEQ ID NO: 309804 - RNA, 32 nt, Human
agacagugagaggagagcauuaagccaagcuc

SEQ ID NO: 309805 - RNA, 32 nt, Human
agacagugaucauuaggaugaagaggaagaga

SEQ ID NO: 309806 - RNA, 32 nt, Human
agacagugccauugcacuccagccugcacaac

SEQ ID NO: 309807 - RNA, 32 nt, Human
agacagugcuggcugagucuccgccuugcugg

SEQ ID NO: 309808 - RNA, 31 nt, Human
agacaguggacaaucccaguggcccagacaa

SEQ ID NO: 309809 - RNA, 32 nt, Human
agacaguggagaauuuacggaaugacaugaau

SEQ ID NO: 309810 - RNA, 32 nt, Human
agacaguggcaaacgccagcagggcugcugug

SEQ ID NO: 309811 - RNA, 32 nt, Human
agacaguggggcaaccucaggagaagcagacc

SEQ ID NO: 309812 - RNA, 32 nt, Human
agacagugucaggccaggcaugguggcucaca

SEQ ID NO: 309813 - RNA, 32 nt, Human
agacaguguccuuccuuucccagcagcagugc

SEQ ID NO: 309814 - RNA, 32 nt, Human
agacagugugggcugagagcagagggagcccu

SEQ ID NO: 309815 - RNA, 32 nt, Human
agacaguguuagggaucuuggaagcacagcca

SEQ ID NO: 309816 - RNA, 21 nt, Human
agacaguguuucaccauguug

SEQ ID NO: 309817 - RNA, 21 nt, Human
agacaguguuucgccauguug

SEQ ID NO: 309818 - RNA, 25 nt, Human
agacaguguuucgccauguuggcca

SEQ ID NO: 309819 - RNA, 32 nt, Human
agacaguuagagacucugucacccuagcuaua

SEQ ID NO: 309820 - RNA, 32 nt, Human
agacaguucuccuguggcaguggcgauguggc

SEQ ID NO: 309821 - RNA, 32 nt, Human
agacauaaaguuucuggucaaaaggguuauag

SEQ ID NO: 309822 - RNA, 32 nt, Human
agacauaaauguucacuuuaaagcaauugcau

SEQ ID NO: 309823 - RNA, 32 nt, Human
agacauaacuggacauggcagacacugcuuug

SEQ ID NO: 309824 - RNA, 32 nt, Human
agacauaauauuucuccaccuggcagaaaagu

SEQ ID NO: 309825 - RNA, 23 nt, Human
agacauacacacaugugcacaca

SEQ ID NO: 309826 - RNA, 32 nt, Human
agacauacaugggucuuagaaaccacuuuccu

SEQ ID NO: 309827 - RNA, 32 nt, Human
agacauacauuucucauaccuuccccacaucu

SEQ ID NO: 309828 - RNA, 32 nt, Human
agacauacuucugaaaguucugcucuaucuca

SEQ ID NO: 309829 - RNA, 32 nt, Human
agacauagaggaaguagggggugguaugagau

SEQ ID NO: 309830 - RNA, 32 nt, Human
agacauagcccaaacccuggcuuauucuuggg

SEQ ID NO: 309831 - RNA, 21 nt, Human
agacauagucucacucuguca

SEQ ID NO: 309832 - RNA, 32 nt, Human
agacauauaggacacugucuuccuucaagagg

SEQ ID NO: 309833 - RNA, 32 nt, Human
agacauauccuaaaaagaggcagcugcccggu

SEQ ID NO: 309834 - RNA, 32 nt, Human
agacauaucucucauuuuucauuuuguugcua

SEQ ID NO: 309835 - RNA, 32 nt, Human
agacaucaagaaauggagaaagacugaaaguu

SEQ ID NO: 309836 - RNA, 20 nt, Human
agacaucaaggaucaaggau

SEQ ID NO: 309837 - RNA, 32 nt, Human
agacaucaaucagguucucuucucuuucuuag

SEQ ID NO: 309838 - RNA, 32 nt, Human
agacaucacagauuaccugaaaccccuuccag

SEQ ID NO: 309839 - RNA, 32 nt, Human
agacaucacgucacccaccagccugggcccgg

SEQ ID NO: 309840 - RNA, 19 nt, Human
agacaucacucaucuuccu

SEQ ID NO: 309841 - RNA, 32 nt, Human
agacaucacugccaacuuagccccagagugac

SEQ ID NO: 309842 - RNA, 32 nt, Human
agacaucagcacuuaccucugagaaggaaaau

SEQ ID NO: 309843 - RNA, 32 nt, Human
agacaucaucccuuguauaccaucguagacuu

SEQ ID NO: 309844 - RNA, 32 nt, Human
agacaucauccuaccaggccuugcagcgggug

SEQ ID NO: 309845 - RNA, 32 nt, Human
agacaucauuauacuccuacuuggcacugcaa

SEQ ID NO: 309846 - RNA, 32 nt, Human
agacaucauuucagaagguggggcagcugcuu

SEQ ID NO: 309847 - RNA, 31 nt, Human
agacauccaauaaauauuuuuggaaggaaaa

SEQ ID NO: 309848 - RNA, 32 nt, Human
agacauccaccagaaucaacucagccucaggc

SEQ ID NO: 309849 - RNA, 32 nt, Human
agacauccaggaagaugcagccagcagacaaa

SEQ ID NO: 309850 - RNA, 32 nt, Human
agacauccaguuuuaacaacaaaagaguuauu

SEQ ID NO: 309851 - RNA, 32 nt, Human
agacaucccacacccccacccagcacacacac

SEQ ID NO: 309852 - RNA, 32 nt, Human
agacaucccugagacuguucucccugacacug

SEQ ID NO: 309853 - RNA, 32 nt, Human
agacauccucaccaucuccauccgcucucacg

SEQ ID NO: 309854 - RNA, 32 nt, Human
agacauccucagcuccaggccucccuucuucu

SEQ ID NO: 309855 - RNA, 32 nt, Human
agacauccugguucuacaguccuggcugauuc

SEQ ID NO: 309856 - RNA, 22 nt, Human
agacaucuccuauagcuugcua

SEQ ID NO: 309857 - RNA, 32 nt, Human
agacaucugacuaauggcucugugccacacuc

SEQ ID NO: 309858 - RNA, 32 nt, Human
agacaucugcaguguugaggccagucacuguu

SEQ ID NO: 309859 - RNA, 32 nt, Human
agacaucugcuccaucagaccucuuccauuuu

SEQ ID NO: 309860 - RNA, 32 nt, Human
agacaucuggaacuuccguccuguaccugacu

SEQ ID NO: 309861 - RNA, 32 nt, Human
agacaucuuccaagcauauaaacaauugcuuu

SEQ ID NO: 309862 - RNA, 32 nt, Human
agacaucuucucccucccuugccucagauuua

SEQ ID NO: 309863 - RNA, 32 nt, Human
agacaucuucucccucccuugccucagggaag

SEQ ID NO: 309864 - RNA, 32 nt, Human
agacaucuugaagugucagauuacaggaguac

SEQ ID NO: 309865 - RNA, 32 nt, Human
agacaucuuuccucacugccagccugccauug

SEQ ID NO: 309866 - RNA, 20 nt, Human
agacaucuuuccugcauugc

SEQ ID NO: 309867 - RNA, 32 nt, Human
agacaucuuugugacccaggagcaccacuggu

SEQ ID NO: 309868 - RNA, 32 nt, Human
agacaucuuuucucccugccccaccugaaggc

SEQ ID NO: 309869 - RNA, 32 nt, Human
agacaugaaaccuuacacgcucuugggauauu

SEQ ID NO: 309870 - RNA, 32 nt, Human
agacaugaaauccuauauggcauucugucuca

SEQ ID NO: 309871 - RNA, 22 nt, Human
agacaugaagagacaauggaug

SEQ ID NO: 309872 - RNA, 32 nt, Human
agacaugaauuuuaaauaauguauuuacuuuu

SEQ ID NO: 309873 - RNA, 32 nt, Human
agacaugacuuauucucuguucauacagcaag

SEQ ID NO: 309874 - RNA, 29 nt, Human
agacaugagacaccuccuagagcccuuug

SEQ ID NO: 309875 - RNA, 32 nt, Human
agacaugagaugguagccaaacccccaguaau

SEQ ID NO: 309876 - RNA, 32 nt, Human
agacaugagccaccucgcccagccuuuucaua

SEQ ID NO: 309877 - RNA, 32 nt, Human
agacaugaggaaagacccucuuauuugugauu

SEQ ID NO: 309878 - RNA, 32 nt, Human
agacaugagguuuugccauguuguccgggcug

SEQ ID NO: 309879 - RNA, 32 nt, Human
agacaugcaaaaagauuauagcaccagcaaua

SEQ ID NO: 309880 - RNA, 32 nt, Human
agacaugcacacagcauaauucaaugucuauu

SEQ ID NO: 309881 - RNA, 32 nt, Human
agacaugcacacuaauacacauacacaccaaa

SEQ ID NO: 309882 - RNA, 29 nt, Human
agacaugccaccacugcucuuugaggugu

SEQ ID NO: 309883 - RNA, 32 nt, Human
agacaugcccaagaggaaggaaguacugacca

SEQ ID NO: 309884 - RNA, 32 nt, Human
agacaugcuauuguagccucaagacagaugca

SEQ ID NO: 309885 - RNA, 32 nt, Human
agacaugcucuuccucucguuucaugcaggcu

SEQ ID NO: 309886 - RNA, 29 nt, Human
agacaugcugaauuccacgggcgaacugg

SEQ ID NO: 309887 - RNA, 32 nt, Human
agacaugcugcacgucuguacccuucucagau

SEQ ID NO: 309888 - RNA, 31 nt, Human
agacaugcuggugucuacacagcagaagaag

SEQ ID NO: 309889 - RNA, 32 nt, Human
agacaugcuucugcuuuucugcugucuuuguu

SEQ ID NO: 309890 - RNA, 32 nt, Human
agacauggaagaggaagaacaaaguccccucu

SEQ ID NO: 309891 - RNA, 29 nt, Human
agacauggaccagggcuacggaggcuacg

SEQ ID NO: 309892 - RNA, 32 nt, Human
agacauggagccccucccuuggucagacucug

SEQ ID NO: 309893 - RNA, 32 nt, Human
agacauggcacguguucugaaaccacuggugu

SEQ ID NO: 309894 - RNA, 32 nt, Human
agacauggcuuaugauugaaagcacaauuuuc

SEQ ID NO: 309895 - RNA, 32 nt, Human
agacauggcuuccuuauugcuggaagaggagg

SEQ ID NO: 309896 - RNA, 32 nt, Human
agacaugggaaaauugguuuauaccaagaaag

SEQ ID NO: 309897 - RNA, 32 nt, Human
agacaugggagauagaauagagaauccagaaa

SEQ ID NO: 309898 - RNA, 32 nt, Human
agacauggggaguuggagcugaaggaggaaug

SEQ ID NO: 309899 - RNA, 32 nt, Human
agacaugggguuucaccacauuggccaggcug

SEQ ID NO: 309900 - RNA, 23 nt, Human
agacaugggguuucaccauguug

SEQ ID NO: 309901 - RNA, 32 nt, Human
agacaugggguuucaccauguugcccaggcug

SEQ ID NO: 309902 - RNA, 32 nt, Human
agacauggguucuguuuguucuuauggacuuc

SEQ ID NO: 309903 - RNA, 21 nt, Human
agacauggucucacuauguug

SEQ ID NO: 309904 - RNA, 32 nt, Human
agacauguauaugucuugggaucccagagauu

SEQ ID NO: 309905 - RNA, 32 nt, Human
agacaugugcuaaggacuugauuuccccauug

SEQ ID NO: 309906 - RNA, 32 nt, Human
agacauguuagguauauaaggaguguagauaa

SEQ ID NO: 309907 - RNA, 32 nt, Human
agacauguucacgggcaucuaucagaugcccc

SEQ ID NO: 309908 - RNA, 22 nt, Human
agacauguucauuccaagcaca

SEQ ID NO: 309909 - RNA, 32 nt, Human
agacauguucgaggacuagcugagggagagag

SEQ ID NO: 309910 - RNA, 32 nt, Human
agacauguuguugccgggcaugguagcucaca

SEQ ID NO: 309911 - RNA, 32 nt, Human
agacauguuuaaguaagguaggcucauguugc

SEQ ID NO: 309912 - RNA, 32 nt, Human
agacauuaacagcaacauaaggaucuccaucu

SEQ ID NO: 309913 - RNA, 32 nt, Human
agacauuauuucauuggacuguucccaggccc

SEQ ID NO: 309914 - RNA, 32 nt, Human
agacauuccaauacugcuuaauuauagcacuu

SEQ ID NO: 309915 - RNA, 32 nt, Human
agacauuccuccugcgcagggccaagugccca

SEQ ID NO: 309916 - RNA, 32 nt, Human
agacauuccucuugggcuuuuuguaacugaaa

SEQ ID NO: 309917 - RNA, 32 nt, Human
agacauuccuuaaccaucagagcagaggagga

SEQ ID NO: 309918 - RNA, 32 nt, Human
agacauuccuuccuguuucugccaugggaagu

SEQ ID NO: 309919 - RNA, 32 nt, Human
agacauucguaggcugagaaaugauuccugcu

SEQ ID NO: 309920 - RNA, 32 nt, Human
agacauugaccccucccuccaugugguaaacc

SEQ ID NO: 309921 - RNA, 32 nt, Human
agacauugccaaggaauuuuacuggaagacuc

SEQ ID NO: 309922 - RNA, 32 nt, Human
agacauugcccucagaagggcagggaggaggu

SEQ ID NO: 309923 - RNA, 32 nt, Human
agacauugccggugaccuggccccagacuaac

SEQ ID NO: 309924 - RNA, 32 nt, Human
agacauugcgagcuuuguggagcuccaggaag

SEQ ID NO: 309925 - RNA, 32 nt, Human
agacauugcugccagccagcucugccuuccca

SEQ ID NO: 309926 - RNA, 32 nt, Human
agacauugcuguuccugcccaucccagugcca

SEQ ID NO: 309927 - RNA, 22 nt, Human
agacauuggucucacuguguug

SEQ ID NO: 309928 - RNA, 32 nt, Human
agacauugugccaggcaguuguguacugucuc

SEQ ID NO: 309929 - RNA, 32 nt, Human
agacauugugguccacaaagcuuacauuuauu

SEQ ID NO: 309930 - RNA, 32 nt, Human
agacauuuauggaaggaaaacaucccauauaa

SEQ ID NO: 309931 - RNA, 23 nt, Human
agacauuucuuaaugauuccacu

SEQ ID NO: 309932 - RNA, 32 nt, Human
agacauuugcagggaagggagaugucugauuc

SEQ ID NO: 309933 - RNA, 32 nt, Human
agacauuuggacacauggaguuugugcugaag

SEQ ID NO: 309934 - RNA, 32 nt, Human
agacauuuuaaugcagauccucuccuuuacag

SEQ ID NO: 309935 - RNA, 32 nt, Human
agacauuuucaucuccccaaaaggagacccca

SEQ ID NO: 309936 - RNA, 32 nt, Human
agacauuuugccucugauaagcacuuuuuaaa

SEQ ID NO: 309937 - RNA, 24 nt, Human
agaccaaaagcuucuauccagagg

SEQ ID NO: 309938 - RNA, 23 nt, Human
agaccaaaaucccaacucagaga

SEQ ID NO: 309939 - RNA, 32 nt, Human
agaccaaaccaugccaaccacgcuggcaacug

SEQ ID NO: 309940 - RNA, 19 nt, Human
agaccaaacuagaccacca

SEQ ID NO: 309941 - RNA, 32 nt, Human
agaccaaagaugaccucgugucagacuguggg

SEQ ID NO: 309942 - RNA, 32 nt, Human
agaccaaaggcaggccuggcugggugcagugg

SEQ ID NO: 309943 - RNA, 32 nt, Human
agaccaaaggccaacucugcuacuacugccac

SEQ ID NO: 309944 - RNA, 23 nt, Human
agaccaaaguugacccucgggua

SEQ ID NO: 309945 - RNA, 32 nt, Human
agaccaacaccugucugugccucaaugccacc

SEQ ID NO: 309946 - RNA, 32 nt, Human
agaccaaccagccuggccaauucaaaggcaag

SEQ ID NO: 309947 - RNA, 32 nt, Human
agaccaaccaucauuaauguuaauagaggaaa

SEQ ID NO: 309948 - RNA, 32 nt, Human
agaccaaccuauauccaaacuuuuauaaaaua

SEQ ID NO: 309949 - RNA, 24 nt, Human
agaccaaccucuguggccugggca

SEQ ID NO: 309950 - RNA, 32 nt, Human
agaccaaccugaccaacauggagaaacccguc

SEQ ID NO: 309951 - RNA, 32 nt, Human
agaccaaccugaccaacauggagaaacccugu

SEQ ID NO: 309952 - RNA, 32 nt, Human
agaccaaccugacuaacauggugaaaccccau

SEQ ID NO: 309953 - RNA, 22 nt, Human
agaccaaccuggacaacauagc

SEQ ID NO: 309954 - RNA, 24 nt, Human
agaccaaccugggcaacaccguga

SEQ ID NO: 309955 - RNA, 22 nt, Human
agaccaaccugggcaacauagc

SEQ ID NO: 309956 - RNA, 24 nt, Human
agaccaaccugggcaacauaguga

SEQ ID NO: 309957 - RNA, 22 nt, Human
agaccaaccugggcaauauagu

SEQ ID NO: 309958 - RNA, 32 nt, Human
agaccaaccuggugaaaccccgucucuacaaa

SEQ ID NO: 309959 - RNA, 23 nt, Human
agaccaaccuugggcaacauagc

SEQ ID NO: 309960 - RNA, 32 nt, Human
agaccaacgagccaccacagccaccaguccca

SEQ ID NO: 309961 - RNA, 32 nt, Human
agaccaacugaccuucuccuaggcagcuccuu

SEQ ID NO: 309962 - RNA, 32 nt, Human
agaccaacugaugcagaaacaggaggugugag

SEQ ID NO: 309963 - RNA, 32 nt, Human
agaccaagaagucugggcuggguccagucccc

SEQ ID NO: 309964 - RNA, 20 nt, Human
agaccaagaccacucugggu

SEQ ID NO: 309965 - RNA, 32 nt, Human
agaccaagaccacucuggguucuuauucuaac

SEQ ID NO: 309966 - RNA, 32 nt, Human
agaccaagacuuuuguucuguuuuucuacaac

SEQ ID NO: 309967 - RNA, 32 nt, Human
agaccaagagguguggaaggaaaagugggguu

SEQ ID NO: 309968 - RNA, 32 nt, Human
agaccaagaguaucuuugaggguuaguacaga

SEQ ID NO: 309969 - RNA, 32 nt, Human
agaccaagauggaggcuguggagcagcauuuc

SEQ ID NO: 309970 - RNA, 24 nt, Human
agaccaagcagcugacccgugagg

SEQ ID NO: 309971 - RNA, 24 nt, Human
agaccaagcccccuccuccuggaa

SEQ ID NO: 309972 - RNA, 32 nt, Human
agaccaaggaggcagcaaccugccuuuccccc

SEQ ID NO: 309973 - RNA, 32 nt, Human
agaccaaggcagggccagaggggacggugccc

SEQ ID NO: 309974 - RNA, 24 nt, Human
agaccaaggggcagccccuggagg

SEQ ID NO: 309975 - RNA, 32 nt, Human
agaccaaggguuggugcagccuccucgccgcg

SEQ ID NO: 309976 - RNA, 21 nt, Human
agaccaaggucuccagaagcu

SEQ ID NO: 309977 - RNA, 32 nt, Human
agaccaaguauggggaaaaccaggcaccagcc

SEQ ID NO: 309978 - RNA, 32 nt, Human
agaccaaguccuccacagagggcgagccaggg

SEQ ID NO: 309979 - RNA, 21 nt, Human
agaccaagucuccaucugaga

SEQ ID NO: 309980 - RNA, 32 nt, Human
agaccaagucuccugugccucucaccuguccc

SEQ ID NO: 309981 - RNA, 22 nt, Human
agaccaaguugccaucugggga

SEQ ID NO: 309982 - RNA, 32 nt, Human
agaccaauauggugaaaccccaucucuacuaa

SEQ ID NO: 309983 - RNA, 21 nt, Human
agaccaaucucaccccagagg

SEQ ID NO: 309984 - RNA, 32 nt, Human
agaccaauggaacagaacagggcccucagaaa

SEQ ID NO: 309985 - RNA, 32 nt, Human
agaccaaugggaggcacucuuggccgaccuac

SEQ ID NO: 309986 - RNA, 32 nt, Human
agaccaaugucuggccugcggagcugcagggg

SEQ ID NO: 309987 - RNA, 32 nt, Human
agaccacacagcccugaccgggccuuggagga

SEQ ID NO: 309988 - RNA, 32 nt, Human
agaccacaccacugcacuccauccugggcaac

SEQ ID NO: 309989 - RNA, 32 nt, Human
agaccacaccacugcacuccugccugggcaau

SEQ ID NO: 309990 - RNA, 32 nt, Human
agaccacaccauugcacuccagccugggcaac

SEQ ID NO: 309991 - RNA, 32 nt, Human
agaccacacugaggaaguugugaguugauaau

SEQ ID NO: 309992 - RNA, 32 nt, Human
agaccacagaaaagagaaagaaaaggaaaggc

SEQ ID NO: 309993 - RNA, 32 nt, Human
agaccacagagcccuggguuguggaagaggug

SEQ ID NO: 309994 - RNA, 32 nt, Human
agaccacagcacucuaugucuacuucuauuau

SEQ ID NO: 309995 - RNA, 32 nt, Human
agaccacagcauguccaucagcucagcagagc

SEQ ID NO: 309996 - RNA, 32 nt, Human
agaccacaggcaggccguguacugcaccacug

SEQ ID NO: 309997 - RNA, 32 nt, Human
agaccacaggcagggcagaggcacgucugggu

SEQ ID NO: 309998 - RNA, 32 nt, Human
agaccacaggugcgcaccaccauacccagcua

SEQ ID NO: 309999 - RNA, 32 nt, Human
agaccaccaagccuugauugguguugccaguu

SEQ ID NO: 310000 - RNA, 32 nt, Human
agaccaccaccaccuucuccccauagcgacuc

SEQ ID NO: 310001 - RNA, 32 nt, Human
agaccaccacccaugaucccaggcuggaggaa

SEQ ID NO: 310002 - RNA, 21 nt, Human
agaccaccagccacccagugg

SEQ ID NO: 310003 - RNA, 32 nt, Human
agaccaccauguccaaggucugacagcucccc

SEQ ID NO: 310004 - RNA, 32 nt, Human
agaccacccagcccugaccugggaccccaggc

SEQ ID NO: 310005 - RNA, 32 nt, Human
agaccaccccgccugcccucauggccccucug

SEQ ID NO: 310006 - RNA, 32 nt, Human
agaccacccuccugcugggaaaacugccaggg

SEQ ID NO: 310007 - RNA, 32 nt, Human
agaccacccugaccaacauagagaaaccccgu

SEQ ID NO: 310008 - RNA, 32 nt, Human
agaccacccugacuaacauggagagacccugu

SEQ ID NO: 310009 - RNA, 24 nt, Human
agaccacccugggcaacauagcga

SEQ ID NO: 310010 - RNA, 18 nt, Human
agaccaccggccucggcc

SEQ ID NO: 310011 - RNA, 32 nt, Human
agaccaccggcugagggagaaggugaagcagc

SEQ ID NO: 310012 - RNA, 32 nt, Human
agaccaccguguggggacgcccccaggccgga

SEQ ID NO: 310013 - RNA, 23 nt, Human
agaccaccuuggcaacacaguga

SEQ ID NO: 310014 - RNA, 32 nt, Human
agaccaccuuucuccccugagaggagcuucug

SEQ ID NO: 310015 - RNA, 32 nt, Human
agaccacgccacugcacuccagcccgggugac

SEQ ID NO: 310016 - RNA, 32 nt, Human
agaccacgccauugcacuccagccugggugac

SEQ ID NO: 310017 - RNA, 32 nt, Human
agaccacgccauugcacuccagcuugggcaau

SEQ ID NO: 310018 - RNA, 32 nt, Human
agaccacgccguggagaggaccagccucaggu

SEQ ID NO: 310019 - RNA, 32 nt, Human
agaccacgcucccuccugagcgcagguccucu

SEQ ID NO: 310020 - RNA, 32 nt, Human
agaccacggacaucuaugacaaaaagaacaug

SEQ ID NO: 310021 - RNA, 32 nt, Human
agaccacguuuagccaguucuaaagcaaagaa

SEQ ID NO: 310022 - RNA, 32 nt, Human
agaccacucaaaacaugcuuacacuaacacuu

SEQ ID NO: 310023 - RNA, 20 nt, Human
agaccacucauccucuggaa

SEQ ID NO: 310024 - RNA, 32 nt, Human
agaccacuccacugcacccaguguggccguac

SEQ ID NO: 310025 - RNA, 32 nt, Human
agaccacugcacuccagccugggcaacagagc

SEQ ID NO: 310026 - RNA, 21 nt, Human
agaccacugccagcccuccag

SEQ ID NO: 310027 - RNA, 32 nt, Human
agaccacugccauaugauuuacauuuccucac

SEQ ID NO: 310028 - RNA, 32 nt, Human
agaccacugcccuccagccugggcaauagagc

SEQ ID NO: 310029 - RNA, 32 nt, Human
agaccacuguggccauggcaggaguagacaag

SEQ ID NO: 310030 - RNA, 22 nt, Human
agaccacuguuucuggaguauc

SEQ ID NO: 310031 - RNA, 32 nt, Human
agaccagacuccugucucuguuuggaaagaaa

SEQ ID NO: 310032 - RNA, 32 nt, Human
agaccagacucgcuucccauggugggaaacag

SEQ ID NO: 310033 - RNA, 32 nt, Human
agaccagacucugacucuccucuuggggcugc

SEQ ID NO: 310034 - RNA, 32 nt, Human
agaccagacugaccaacauggagaaaccccau

SEQ ID NO: 310035 - RNA, 24 nt, Human
agaccagacuggccaacacagcga

SEQ ID NO: 310036 - RNA, 18 nt, Human
agaccagaggaacagaga

SEQ ID NO: 310037 - RNA, 32 nt, Human
agaccagaguugagacaaaaagaaauaagauu

SEQ ID NO: 310038 - RNA, 32 nt, Human
agaccagaucaguuacauguauaucuugccuc

SEQ ID NO: 310039 - RNA, 32 nt, Human
agaccagauggguugccccaggauccggcugc

SEQ ID NO: 310040 - RNA, 32 nt, Human
agaccagauguuggcugcuguacuuacucccu

SEQ ID NO: 310041 - RNA, 32 nt, Human
agaccagcaaacagcacaaggcguggcccacc

SEQ ID NO: 310042 - RNA, 32 nt, Human
agaccagcaagggggcagaccccgcacucgcc

SEQ ID NO: 310043 - RNA, 32 nt, Human
agaccagcaccagugucugccucugagaaugu

SEQ ID NO: 310044 - RNA, 32 nt, Human
agaccagcagccuggccaauauggugaaacuu

SEQ ID NO: 310045 - RNA, 32 nt, Human
agaccagcaucuccucuccuuaucaggaacau

SEQ ID NO: 310046 - RNA, 32 nt, Human
agaccagcaugaccaacauggagaaaccccgu

SEQ ID NO: 310047 - RNA, 32 nt, Human
agaccagcaugaccaacauggcgaaaccccau

SEQ ID NO: 310048 - RNA, 32 nt, Human
agaccagcaugaccaacauggugaaacccugu

SEQ ID NO: 310049 - RNA, 32 nt, Human
agaccagcauuugcacaauaucaccaggcuuc

SEQ ID NO: 310050 - RNA, 22 nt, Human
agaccagccaaggcaacauggu

SEQ ID NO: 310051 - RNA, 24 nt, Human
agaccagccagagcaacacaguga

SEQ ID NO: 310052 - RNA, 32 nt, Human
agaccagccagauuuucaagcuucauucuguu

SEQ ID NO: 310053 - RNA, 22 nt, Human
agaccagcccagccaacauggc

SEQ ID NO: 310054 - RNA, 32 nt, Human
agaccagcccagccaacauggucccaggugug

SEQ ID NO: 310055 - RNA, 22 nt, Human
agaccagcccaggcaacaaagu

SEQ ID NO: 310056 - RNA, 24 nt, Human
agaccagcccaggcaacaugguga

SEQ ID NO: 310057 - RNA, 22 nt, Human
agaccagcccgggcaacauggc

SEQ ID NO: 310058 - RNA, 21 nt, Human
agaccagcccgggcaagcagu

SEQ ID NO: 310059 - RNA, 32 nt, Human
agaccagcccgggcaauucagugagauguuca

SEQ ID NO: 310060 - RNA, 23 nt, Human
agaccagcccgggccuauggcga

SEQ ID NO: 310061 - RNA, 22 nt, Human
agaccagcccgggcgacacagc

SEQ ID NO: 310062 - RNA, 32 nt, Human
agaccagcccugccgccgccuccuggaagggg

SEQ ID NO: 310063 - RNA, 22 nt, Human
agaccagccggggcaacauagc

SEQ ID NO: 310064 - RNA, 24 nt, Human
agaccagccuaaacaacauaguga

SEQ ID NO: 310065 - RNA, 19 nt, Human
agaccagccuagcagggca

SEQ ID NO: 310066 - RNA, 24 nt, Human
agaccagccuaggcaacacaggga

SEQ ID NO: 310067 - RNA, 24 nt, Human
agaccagccuaggcaacacaguga

SEQ ID NO: 310068 - RNA, 22 nt, Human
agaccagccuaggcaacauagc

SEQ ID NO: 310069 - RNA, 24 nt, Human
agaccagccuaggcaacauaggga

SEQ ID NO: 310070 - RNA, 24 nt, Human
agaccagccuaggcaacauaguga

SEQ ID NO: 310071 - RNA, 24 nt, Human
agaccagccuaggcaacauggaga

SEQ ID NO: 310072 - RNA, 22 nt, Human
agaccagccuaggcaacauggc

SEQ ID NO: 310073 - RNA, 24 nt, Human
agaccagccuaggcaacauggcga

SEQ ID NO: 310074 - RNA, 24 nt, Human
agaccagccuaggcaacaugguga

SEQ ID NO: 310075 - RNA, 22 nt, Human
agaccagccuaggcaacauugc

SEQ ID NO: 310076 - RNA, 22 nt, Human
agaccagccuaggcaagauggc

SEQ ID NO: 310077 - RNA, 22 nt, Human
agaccagccuaggcaauguagu

SEQ ID NO: 310078 - RNA, 24 nt, Human
agaccagccuaggcagcauaguga

SEQ ID NO: 310079 - RNA, 23 nt, Human
agaccagccuaggcaugauaaga

SEQ ID NO: 310080 - RNA, 24 nt, Human
agaccagccucaucaacacaguga

SEQ ID NO: 310081 - RNA, 32 nt, Human
agaccagccuccuggccaacauggugaaacuc

SEQ ID NO: 310082 - RNA, 20 nt, Human
agaccagccucgcacagcga

SEQ ID NO: 310083 - RNA, 24 nt, Human
agaccagccugaacaacaugguga

SEQ ID NO: 310084 - RNA, 32 nt, Human
agaccagccugacauggugaaaccccaucucu

SEQ ID NO: 310085 - RNA, 32 nt, Human
agaccagccugaccaaacauggcgaaacccca

SEQ ID NO: 310086 - RNA, 32 nt, Human
agaccagccugaccaacacggagaaaccccgu

SEQ ID NO: 310087 - RNA, 32 nt, Human
agaccagccugaccaacacggagaaacccuau

SEQ ID NO: 310088 - RNA, 32 nt, Human
agaccagccugaccaacacggugaaaccccgu

SEQ ID NO: 310089 - RNA, 32 nt, Human
agaccagccugaccaacacugagaaaccccau

SEQ ID NO: 310090 - RNA, 32 nt, Human
agaccagccugaccaacauagagaaaccucgu

SEQ ID NO: 310091 - RNA, 32 nt, Human
agaccagccugaccaacauagugaaacccccg

SEQ ID NO: 310092 - RNA, 32 nt, Human
agaccagccugaccaacaucgugaaaugccgu

SEQ ID NO: 310093 - RNA, 32 nt, Human
agaccagccugaccaacaugaagaaaccccau

SEQ ID NO: 310094 - RNA, 21 nt, Human
agaccagccugaccaacaugg

SEQ ID NO: 310095 - RNA, 32 nt, Human
agaccagccugaccaacauggagaaacccaau

SEQ ID NO: 310096 - RNA, 32 nt, Human
agaccagccugaccaacauggagaaacccagu

SEQ ID NO: 310097 - RNA, 32 nt, Human
agaccagccugaccaacauggagaaaccccaa

SEQ ID NO: 310098 - RNA, 32 nt, Human
agaccagccugaccaacauggagaaaccccau

SEQ ID NO: 310099 - RNA, 32 nt, Human
agaccagccugaccaacauggagaaaccccca

SEQ ID NO: 310100 - RNA, 32 nt, Human
agaccagccugaccaacauggagaaaccccgu

SEQ ID NO: 310101 - RNA, 32 nt, Human
agaccagccugaccaacauggagaaaccccug

SEQ ID NO: 310102 - RNA, 32 nt, Human
agaccagccugaccaacauggagaaacccuau

SEQ ID NO: 310103 - RNA, 32 nt, Human
agaccagccugaccaacauggagaaacccugc

SEQ ID NO: 310104 - RNA, 32 nt, Human
agaccagccugaccaacauggagaaacccugu

SEQ ID NO: 310105 - RNA, 32 nt, Human
agaccagccugaccaacauggagaaaccucgu

SEQ ID NO: 310106 - RNA, 32 nt, Human
agaccagccugaccaacauggagaaacgccau

SEQ ID NO: 310107 - RNA, 32 nt, Human
agaccagccugaccaacauggagaaacuccgu

SEQ ID NO: 310108 - RNA, 32 nt, Human
agaccagccugaccaacauggagaaaugccau

SEQ ID NO: 310109 - RNA, 32 nt, Human
agaccagccugaccaacauggagaagccccgu

SEQ ID NO: 310110 - RNA, 32 nt, Human
agaccagccugaccaacauggcgaaaccccau

SEQ ID NO: 310111 - RNA, 32 nt, Human
agaccagccugaccaacauggcgaaaccccgu

SEQ ID NO: 310112 - RNA, 32 nt, Human
agaccagccugaccaacauggugaaacacugu

SEQ ID NO: 310113 - RNA, 32 nt, Human
agaccagccugaccaacauggugaaaccccau

SEQ ID NO: 310114 - RNA, 32 nt, Human
agaccagccugaccaacauggugaaaccccgu

SEQ ID NO: 310115 - RNA, 32 nt, Human
agaccagccugaccaacauggugaaaccccuu

SEQ ID NO: 310116 - RNA, 32 nt, Human
agaccagccugaccaacauggugaaacccuac

SEQ ID NO: 310117 - RNA, 32 nt, Human
agaccagccugaccaacauggugaaacccugu

SEQ ID NO: 310118 - RNA, 32 nt, Human
agaccagccugaccaacauggugaaaccucaa

SEQ ID NO: 310119 - RNA, 32 nt, Human
agaccagccugaccaacauggugaaaccucau

SEQ ID NO: 310120 - RNA, 32 nt, Human
agaccagccugaccaacauggugaaaccucgu

SEQ ID NO: 310121 - RNA, 32 nt, Human
agaccagccugaccaacauggugaaacuccau

SEQ ID NO: 310122 - RNA, 32 nt, Human
agaccagccugaccaacauggugaaauccagu

SEQ ID NO: 310123 - RNA, 32 nt, Human
agaccagccugaccaacauggugaaaucccgu

SEQ ID NO: 310124 - RNA, 32 nt, Human
agaccagccugaccaacauggugaaauccugu

SEQ ID NO: 310125 - RNA, 32 nt, Human
agaccagccugaccaacauggugaaaugaaac

SEQ ID NO: 310126 - RNA, 32 nt, Human
agaccagccugaccaacauggugagacccugu

SEQ ID NO: 310127 - RNA, 32 nt, Human
agaccagccugaccaacaugucgaaaucccgu

SEQ ID NO: 310128 - RNA, 32 nt, Human
agaccagccugaccaacguggagaaacacuau

SEQ ID NO: 310129 - RNA, 32 nt, Human
agaccagccugaccaacguggagaaaccccau

SEQ ID NO: 310130 - RNA, 32 nt, Human
agaccagccugaccaacguggagaaaccccgu

SEQ ID NO: 310131 - RNA, 32 nt, Human
agaccagccugaccaacguggagaaacuccgu

SEQ ID NO: 310132 - RNA, 32 nt, Human
agaccagccugaccaacguggcgaaaccucgu

SEQ ID NO: 310133 - RNA, 32 nt, Human
agaccagccugaccaacguggugaaaccccau

SEQ ID NO: 310134 - RNA, 32 nt, Human
agaccagccugaccaacguggugaaaccccgu

SEQ ID NO: 310135 - RNA, 32 nt, Human
agaccagccugaccaacguggugaaacccugu

SEQ ID NO: 310136 - RNA, 32 nt, Human
agaccagccugaccaacguggugaaacuccgu

SEQ ID NO: 310137 - RNA, 32 nt, Human
agaccagccugaccaauauagugaaacacugu

SEQ ID NO: 310138 - RNA, 32 nt, Human
agaccagccugaccaauauggagaaaucucgc

SEQ ID NO: 310139 - RNA, 32 nt, Human
agaccagccugaccaauauggugaaaccccau

SEQ ID NO: 310140 - RNA, 22 nt, Human
agaccagccugagcaacaaagc

SEQ ID NO: 310141 - RNA, 24 nt, Human
agaccagccugagcaacacuguga

SEQ ID NO: 310142 - RNA, 20 nt, Human
agaccagccugagcaacaua

SEQ ID NO: 310143 - RNA, 22 nt, Human
agaccagccugagcaacauagc

SEQ ID NO: 310144 - RNA, 24 nt, Human
agaccagccugagcaacauagcga

SEQ ID NO: 310145 - RNA, 24 nt, Human
agaccagccugagcaacauaguga

SEQ ID NO: 310146 - RNA, 24 nt, Human
agaccagccugagcaacaugauga

SEQ ID NO: 310147 - RNA, 24 nt, Human
agaccagccugagcaacauggcga

SEQ ID NO: 310148 - RNA, 22 nt, Human
agaccagccugagcagcguagc

SEQ ID NO: 310149 - RNA, 24 nt, Human
agaccagccuggacaacacaguga

SEQ ID NO: 310150 - RNA, 24 nt, Human
agaccagccuggacaacauaauga

SEQ ID NO: 310151 - RNA, 22 nt, Human
agaccagccuggacaacauagc

SEQ ID NO: 310152 - RNA, 23 nt, Human
agaccagccuggacaacauagga

SEQ ID NO: 310153 - RNA, 24 nt, Human
agaccagccuggacaacauaguga

SEQ ID NO: 310154 - RNA, 22 nt, Human
agaccagccuggacaacauggc

SEQ ID NO: 310155 - RNA, 23 nt, Human
agaccagccuggacaacauggga

SEQ ID NO: 310156 - RNA, 24 nt, Human
agaccagccuggacaacaugguga

SEQ ID NO: 310157 - RNA, 22 nt, Human
agaccagccuggacaauauagu

SEQ ID NO: 310158 - RNA, 24 nt, Human
agaccagccuggacagcuuaguga

SEQ ID NO: 310159 - RNA, 21 nt, Human
agaccagccuggcaacacagc

SEQ ID NO: 310160 - RNA, 24 nt, Human
agaccagccuggccaacacaauga

SEQ ID NO: 310161 - RNA, 22 nt, Human
agaccagccuggccaacacagu

SEQ ID NO: 310162 - RNA, 24 nt, Human
agaccagccuggccaacacaguga

SEQ ID NO: 310163 - RNA, 22 nt, Human
agaccagccuggccaacacggc

SEQ ID NO: 310164 - RNA, 22 nt, Human
agaccagccuggccaacauagc

SEQ ID NO: 310165 - RNA, 24 nt, Human
agaccagccuggccaacauagcga

SEQ ID NO: 310166 - RNA, 22 nt, Human
agaccagccuggccaacauagu

SEQ ID NO: 310167 - RNA, 22 nt, Human
agaccagccuggccaacauggc

SEQ ID NO: 310168 - RNA, 22 nt, Human
agaccagccuggccaacauggu

SEQ ID NO: 310169 - RNA, 32 nt, Human
agaccagccuggccaaccaacauggugaaacc

SEQ ID NO: 310170 - RNA, 24 nt, Human
agaccagccuggccaacuuggaga

SEQ ID NO: 310171 - RNA, 24 nt, Human
agaccagccuggcuaacacaguga

SEQ ID NO: 310172 - RNA, 22 nt, Human
agaccagccugggaaaaauagc

SEQ ID NO: 310173 - RNA, 24 nt, Human
agaccagccugggaaacauagcga

SEQ ID NO: 310174 - RNA, 32 nt, Human
agaccagccugggaaacaucugccucuacaaa

SEQ ID NO: 310175 - RNA, 22 nt, Human
agaccagccugggcaaaacagu

SEQ ID NO: 310176 - RNA, 22 nt, Human
agaccagccugggcaaaauagc

SEQ ID NO: 310177 - RNA, 18 nt, Human
agaccagccugggcaaca

SEQ ID NO: 310178 - RNA, 22 nt, Human
agaccagccugggcaacaaagu

SEQ ID NO: 310179 - RNA, 24 nt, Human
agaccagccugggcaacaaaguga

SEQ ID NO: 310180 - RNA, 32 nt, Human
agaccagccugggcaacaaagugagaccccca

SEQ ID NO: 310181 - RNA, 32 nt, Human
agaccagccugggcaacaaagugagacuccau

SEQ ID NO: 310182 - RNA, 24 nt, Human
agaccagccugggcaacaaugaga

SEQ ID NO: 310183 - RNA, 22 nt, Human
agaccagccugggcaacacagc

SEQ ID NO: 310184 - RNA, 24 nt, Human
agaccagccugggcaacacagcga

SEQ ID NO: 310185 - RNA, 23 nt, Human
agaccagccugggcaacacagga

SEQ ID NO: 310186 - RNA, 24 nt, Human
agaccagccugggcaacacaggga

SEQ ID NO: 310187 - RNA, 22 nt, Human
agaccagccugggcaacacagu

SEQ ID NO: 310188 - RNA, 24 nt, Human
agaccagccugggcaacacaguga

SEQ ID NO: 310189 - RNA, 32 nt, Human
agaccagccugggcaacacagugagaacccuc

SEQ ID NO: 310190 - RNA, 24 nt, Human
agaccagccugggcaacacgguga

SEQ ID NO: 310191 - RNA, 21 nt, Human
agaccagccugggcaacagag

SEQ ID NO: 310192 - RNA, 24 nt, Human
agaccagccugggcaacagaguga

SEQ ID NO: 310193 - RNA, 20 nt, Human
agaccagccugggcaacagc

SEQ ID NO: 310194 - RNA, 21 nt, Human
agaccagccugggcaacaggc

SEQ ID NO: 310195 - RNA, 22 nt, Human
agaccagccugggcaacagggu

SEQ ID NO: 310196 - RNA, 20 nt, Human
agaccagccugggcaacaua

SEQ ID NO: 310197 - RNA, 24 nt, Human
agaccagccugggcaacauaauga

SEQ ID NO: 310198 - RNA, 24 nt, Human
agaccagccugggcaacauacaga

SEQ ID NO: 310199 - RNA, 24 nt, Human
agaccagccugggcaacauagaga

SEQ ID NO: 310200 - RNA, 22 nt, Human
agaccagccugggcaacauagc

SEQ ID NO: 310201 - RNA, 24 nt, Human
agaccagccugggcaacauagcga

SEQ ID NO: 310202 - RNA, 23 nt, Human
agaccagccugggcaacauagga

SEQ ID NO: 310203 - RNA, 24 nt, Human
agaccagccugggcaacauaggga

SEQ ID NO: 310204 - RNA, 22 nt, Human
agaccagccugggcaacauagu

SEQ ID NO: 310205 - RNA, 24 nt, Human
agaccagccugggcaacauaguga

SEQ ID NO: 310206 - RNA, 23 nt, Human
agaccagccugggcaacauaugg

SEQ ID NO: 310207 - RNA, 23 nt, Human
agaccagccugggcaacaugaug

SEQ ID NO: 310208 - RNA, 21 nt, Human
agaccagccugggcaacaugg

SEQ ID NO: 310209 - RNA, 24 nt, Human
agaccagccugggcaacauggaga

SEQ ID NO: 310210 - RNA, 22 nt, Human
agaccagccugggcaacauggc

SEQ ID NO: 310211 - RNA, 24 nt, Human
agaccagccugggcaacauggcga

SEQ ID NO: 310212 - RNA, 24 nt, Human
agaccagccugggcaacaugggga

SEQ ID NO: 310213 - RNA, 22 nt, Human
agaccagccugggcaacauggu

SEQ ID NO: 310214 - RNA, 24 nt, Human
agaccagccugggcaacaugguga

SEQ ID NO: 310215 - RNA, 24 nt, Human
agaccagccugggcaacauuggga

SEQ ID NO: 310216 - RNA, 24 nt, Human
agaccagccugggcaaccuaauga

SEQ ID NO: 310217 - RNA, 24 nt, Human
agaccagccugggcaacgcaguga

SEQ ID NO: 310218 - RNA, 22 nt, Human
agaccagccugggcaacguagc

SEQ ID NO: 310219 - RNA, 24 nt, Human
agaccagccugggcaacguauuga

SEQ ID NO: 310220 - RNA, 24 nt, Human
agaccagccugggcaacgugguga

SEQ ID NO: 310221 - RNA, 24 nt, Human
agaccagccugggcaacuuaguga

SEQ ID NO: 310222 - RNA, 22 nt, Human
agaccagccugggcaagauggc

SEQ ID NO: 310223 - RNA, 22 nt, Human
agaccagccugggcaagauggu

SEQ ID NO: 310224 - RNA, 22 nt, Human
agaccagccugggcaauacagc

SEQ ID NO: 310225 - RNA, 24 nt, Human
agaccagccugggcaauacagcga

SEQ ID NO: 310226 - RNA, 24 nt, Human
agaccagccugggcaauacaguga

SEQ ID NO: 310227 - RNA, 22 nt, Human
agaccagccugggcaauauagc

SEQ ID NO: 310228 - RNA, 24 nt, Human
agaccagccugggcaauauaggga

SEQ ID NO: 310229 - RNA, 22 nt, Human
agaccagccugggcaauauagu

SEQ ID NO: 310230 - RNA, 22 nt, Human
agaccagccugggcaauguagc

SEQ ID NO: 310231 - RNA, 22 nt, Human
agaccagccugggcaauguagu

SEQ ID NO: 310232 - RNA, 24 nt, Human
agaccagccugggcaccaugguga

SEQ ID NO: 310233 - RNA, 19 nt, Human
agaccagccugggcagcau

SEQ ID NO: 310234 - RNA, 22 nt, Human
agaccagccugggcagcauagc

SEQ ID NO: 310235 - RNA, 24 nt, Human
agaccagccugggcagcaugguga

SEQ ID NO: 310236 - RNA, 22 nt, Human
agaccagccugggcagccuggc

SEQ ID NO: 310237 - RNA, 23 nt, Human
agaccagccugggcagccuggca

SEQ ID NO: 310238 - RNA, 21 nt, Human
agaccagccugggcgacacgg

SEQ ID NO: 310239 - RNA, 22 nt, Human
agaccagccugggcuacagagc

SEQ ID NO: 310240 - RNA, 24 nt, Human
agaccagccugggcuacauaguga

SEQ ID NO: 310241 - RNA, 25 nt, Human
agaccagccuggggcaacauagcga

SEQ ID NO: 310242 - RNA, 24 nt, Human
agaccagccuggguaacacaggga

SEQ ID NO: 310243 - RNA, 22 nt, Human
agaccagccugggugacacagc

SEQ ID NO: 310244 - RNA, 22 nt, Human
agaccagccuggucaacauagc

SEQ ID NO: 310245 - RNA, 22 nt, Human
agaccagccuggucaacauggu

SEQ ID NO: 310246 - RNA, 20 nt, Human
agaccagccuguggaacaua

SEQ ID NO: 310247 - RNA, 22 nt, Human
agaccagccuguucaacauggc

SEQ ID NO: 310248 - RNA, 32 nt, Human
agaccagccuugcagccaggugcaguggcuca

SEQ ID NO: 310249 - RNA, 24 nt, Human
agaccagccuugccaacacaguga

SEQ ID NO: 310250 - RNA, 32 nt, Human
agaccagcgagccaccacagccaccaguccca

SEQ ID NO: 310251 - RNA, 32 nt, Human
agaccagcggagugggagggagacgcaguaga

SEQ ID NO: 310252 - RNA, 32 nt, Human
agaccagcgugaccaacguggagaaacccccg

SEQ ID NO: 310253 - RNA, 24 nt, Human
agaccagcuaaggcaacacaguga

SEQ ID NO: 310254 - RNA, 21 nt, Human
agaccagcucucgcuauguug

SEQ ID NO: 310255 - RNA, 32 nt, Human
agaccagcugaggcagaggcugcaaggggugg

SEQ ID NO: 310256 - RNA, 32 nt, Human
agaccagcugccgcccugcccgaugcuucccc

SEQ ID NO: 310257 - RNA, 32 nt, Human
agaccagcuggaucuugcucagucucugucag

SEQ ID NO: 310258 - RNA, 32 nt, Human
agaccagcuguagcucauuccagccuguaccu

SEQ ID NO: 310259 - RNA, 22 nt, Human
agaccagcuuaggcaacauagc

SEQ ID NO: 310260 - RNA, 32 nt, Human
agaccagcuugaccaacauggagaaaccucgu

SEQ ID NO: 310261 - RNA, 32 nt, Human
agaccagcuugaccaacauggugaaaccccau

SEQ ID NO: 310262 - RNA, 22 nt, Human
agaccagcuugggcaacauagc

SEQ ID NO: 310263 - RNA, 25 nt, Human
agaccagcuuugggcaacacaguga

SEQ ID NO: 310264 - RNA, 32 nt, Human
agaccaggaaccugagccagagcugggguuga

SEQ ID NO: 310265 - RNA, 32 nt, Human
agaccaggacuuuuuaucuagagaccagcaug

SEQ ID NO: 310266 - RNA, 32 nt, Human
agaccaggagagaauuugggcccuuacugacc

SEQ ID NO: 310267 - RNA, 32 nt, Human
agaccaggagccaagagaccugcccaggcucc

SEQ ID NO: 310268 - RNA, 32 nt, Human
agaccaggagguugaggcugcagugagccgug

SEQ ID NO: 310269 - RNA, 32 nt, Human
agaccaggaguuugagaucagcccugggcaac

SEQ ID NO: 310270 - RNA, 21 nt, Human
agaccaggaugucaccagaga

SEQ ID NO: 310271 - RNA, 32 nt, Human
agaccaggcaacauacacacugcagaaggugg

SEQ ID NO: 310272 - RNA, 32 nt, Human
agaccaggcagccauggccacugccuuccucu

SEQ ID NO: 310273 - RNA, 19 nt, Human
agaccaggcccuugaucac

SEQ ID NO: 310274 - RNA, 23 nt, Human
agaccaggcgguggagcugggga

SEQ ID NO: 310275 - RNA, 32 nt, Human
agaccaggcucuucugacuggcaauggcucug

SEQ ID NO: 310276 - RNA, 32 nt, Human
agaccaggcugacuggaagauggaaagccaca

SEQ ID NO: 310277 - RNA, 21 nt, Human
agaccaggcuucgccauguug

SEQ ID NO: 310278 - RNA, 25 nt, Human
agaccaggcuucgccauguuggcca

SEQ ID NO: 310279 - RNA, 32 nt, Human
agaccagggaaugggccgagcagcugacaaag

SEQ ID NO: 310280 - RNA, 32 nt, Human
agaccagggcuggggguugggcuguaggcagg

SEQ ID NO: 310281 - RNA, 32 nt, Human
agaccagggcugggguuuaaguuccuggcaga

SEQ ID NO: 310282 - RNA, 32 nt, Human
agaccagggcuugucuccuccuggacuugggc

SEQ ID NO: 310283 - RNA, 22 nt, Human
agaccagggguuuucccagaga

SEQ ID NO: 310284 - RNA, 23 nt, Human
agaccaggguaucuccucuggaa

SEQ ID NO: 310285 - RNA, 32 nt, Human
agaccagggucccugucugggagcucagacuu

SEQ ID NO: 310286 - RNA, 32 nt, Human
agaccagggucugauggcuucuagggaugcuc

SEQ ID NO: 310287 - RNA, 32 nt, Human
agaccagguccucagccagcagagccacguuc

SEQ ID NO: 310288 - RNA, 32 nt, Human
agaccagguguggacgggacagugaguggcug

SEQ ID NO: 310289 - RNA, 32 nt, Human
agaccagguuggagaccagccuaggcaacaug

SEQ ID NO: 310290 - RNA, 32 nt, Human
agaccagguuuuccuggucucagaccuaugau

SEQ ID NO: 310291 - RNA, 32 nt, Human
agaccaguaaaaacaaaagcccauagaccuua

SEQ ID NO: 310292 - RNA, 32 nt, Human
agaccaguaaacuuaucuuuggugagaaauga

SEQ ID NO: 310293 - RNA, 32 nt, Human
agaccagucacucccucugccuucaggcuucu

SEQ ID NO: 310294 - RNA, 32 nt, Human
agaccagucucccaggaggcugaggcugcugu

SEQ ID NO: 310295 - RNA, 32 nt, Human
agaccagucugaccaacacggagaaaccccau

SEQ ID NO: 310296 - RNA, 32 nt, Human
agaccagucugaccaacauggagaaaccccau

SEQ ID NO: 310297 - RNA, 32 nt, Human
agaccagucugaccaacauggagaaacccugu

SEQ ID NO: 310298 - RNA, 22 nt, Human
agaccagucugggcaacacagc

SEQ ID NO: 310299 - RNA, 24 nt, Human
agaccagucugggcaacauagcga

SEQ ID NO: 310300 - RNA, 32 nt, Human
agaccagugguagugcccagacuucuccuaga

SEQ ID NO: 310301 - RNA, 32 nt, Human
agaccagugucuggaucccagcaucuucucca

SEQ ID NO: 310302 - RNA, 32 nt, Human
agaccaguucgaggaauccuuggucuccacca

SEQ ID NO: 310303 - RNA, 32 nt, Human
agaccaguucuccaagccccugccuuggucag

SEQ ID NO: 310304 - RNA, 32 nt, Human
agaccaguuuuugcggccucccccuuuccucu

SEQ ID NO: 310305 - RNA, 32 nt, Human
agaccauaauaaauacuccuuuucaagagaaa

SEQ ID NO: 310306 - RNA, 32 nt, Human
agaccauaccacugcauuccagccugggugac

SEQ ID NO: 310307 - RNA, 32 nt, Human
agaccauagagugcuuuggugggaguauuuug

SEQ ID NO: 310308 - RNA, 32 nt, Human
agaccauagugaccaacauagugaaaccccau

SEQ ID NO: 310309 - RNA, 32 nt, Human
agaccauccaagccaaggacgaggucaucauc

SEQ ID NO: 310310 - RNA, 22 nt, Human
agaccauccaccucgggguugc

SEQ ID NO: 310311 - RNA, 32 nt, Human
agaccauccacugucuuugacaccuagaaggu

SEQ ID NO: 310312 - RNA, 24 nt, Human
agaccauccagcucaucacccggg

SEQ ID NO: 310313 - RNA, 32 nt, Human
agaccauccauccgauccuccccuuccccugu

SEQ ID NO: 310314 - RNA, 32 nt, Human
agaccaucccuccagacugccacccucaaagc

SEQ ID NO: 310315 - RNA, 32 nt, Human
agaccaucuccccaggcuaugccaucaccaua

SEQ ID NO: 310316 - RNA, 32 nt, Human
agaccaucucuuccuuucuuuccccuucuuuu

SEQ ID NO: 310317 - RNA, 32 nt, Human
agaccaugaaguucaaccccuccagggaagcu

SEQ ID NO: 310318 - RNA, 27 nt, Human
agaccaugacugugguuucaguggcgu

SEQ ID NO: 310319 - RNA, 18 nt, Human
agaccaugccacugcacu

SEQ ID NO: 310320 - RNA, 32 nt, Human
agaccaugccacugcacuccagccugggcaac

SEQ ID NO: 310321 - RNA, 32 nt, Human
agaccaugccacugcacuccggccugggugac

SEQ ID NO: 310322 - RNA, 32 nt, Human
agaccaugccauugcacuccagccugggcgac

SEQ ID NO: 310323 - RNA, 32 nt, Human
agaccaugccauuggacuccagccugggcaaa

SEQ ID NO: 310324 - RNA, 32 nt, Human
agaccaugggcaaccaaccauugcacuggcua

SEQ ID NO: 310325 - RNA, 32 nt, Human
agaccaugggcuguaggggagaguguggcagg

SEQ ID NO: 310326 - RNA, 30 nt, Human
agaccauggggcaucuggacaaggaagguc

SEQ ID NO: 310327 - RNA, 32 nt, Human
agaccauguagaaaacuuuuacaucugccuug

SEQ ID NO: 310328 - RNA, 30 nt, Human
agaccauguccgggggcagcagcugcagcc

SEQ ID NO: 310329 - RNA, 32 nt, Human
agaccaugugucccaucucaagccacagagca

SEQ ID NO: 310330 - RNA, 32 nt, Human
agaccauuccagagaaagugauagaaucuucc

SEQ ID NO: 310331 - RNA, 32 nt, Human
agaccauuccaggcagggagagcugcugagcu

SEQ ID NO: 310332 - RNA, 32 nt, Human
agaccauucuguucagugucugggugaagcuu

SEQ ID NO: 310333 - RNA, 32 nt, Human
agaccauuggcaggcccuuugcaccaggagga

SEQ ID NO: 310334 - RNA, 23 nt, Human
agaccauugucuccugugccaga

SEQ ID NO: 310335 - RNA, 32 nt, Human
agacccaaaagaaugaaagguggcagugaaga

SEQ ID NO: 310336 - RNA, 32 nt, Human
agacccaaauccccacagaaccagcuucgagu

SEQ ID NO: 310337 - RNA, 32 nt, Human
agacccaacaacugucacccucuucuguaccu

SEQ ID NO: 310338 - RNA, 32 nt, Human
agacccaacuggagcguggggcgggcaggcag

SEQ ID NO: 310339 - RNA, 32 nt, Human
agacccaagccaaggaaagcccaugaucacca

SEQ ID NO: 310340 - RNA, 32 nt, Human
agacccaagggaggguggagaggggcugaggg

SEQ ID NO: 310341 - RNA, 25 nt, Human
agacccaaguagacuggacacaaag

SEQ ID NO: 310342 - RNA, 32 nt, Human
agacccacagagcaggagggaggcagaaagug

SEQ ID NO: 310343 - RNA, 32 nt, Human
agacccacagcccugaaacgagaagugcccuu

SEQ ID NO: 310344 - RNA, 32 nt, Human
agacccaccauccuggacuggcgaggaagauc

SEQ ID NO: 310345 - RNA, 32 nt, Human
agacccacccuacgaaguuggaaugagaccau

SEQ ID NO: 310346 - RNA, 32 nt, Human
agacccacuccugccucccacccgggugccgu

SEQ ID NO: 310347 - RNA, 18 nt, Human
agacccacucuuugccca

SEQ ID NO: 310348 - RNA, 32 nt, Human
agacccacuugcacccuccgggcauccucucc

SEQ ID NO: 310349 - RNA, 32 nt, Human
agacccacuugcacccuccgggcguucucucc

SEQ ID NO: 310350 - RNA, 23 nt, Human
agacccacuugggccuucaugcc

SEQ ID NO: 310351 - RNA, 32 nt, Human
agacccagaaacccaaagagguugagaaacag

SEQ ID NO: 310352 - RNA, 28 nt, Human
agacccagaaguucugccucacucccag

SEQ ID NO: 310353 - RNA, 32 nt, Human
agacccagacuuuaguccccucccaggaaagg

SEQ ID NO: 310354 - RNA, 32 nt, Human
agacccagagagcuagggcuggagggacaggg

SEQ ID NO: 310355 - RNA, 21 nt, Human
agacccagagucacccagggg

SEQ ID NO: 310356 - RNA, 22 nt, Human
agacccagaguugcagccaaga

SEQ ID NO: 310357 - RNA, 32 nt, Human
agacccagauagagacucagaggcagacccag

SEQ ID NO: 310358 - RNA, 32 nt, Human
agacccagccaagagcugaggguaagggcagg

SEQ ID NO: 310359 - RNA, 32 nt, Human
agacccagccagcagagauggagagugacucu

SEQ ID NO: 310360 - RNA, 32 nt, Human
agacccagccgcuggcucccagccuggcugaa

SEQ ID NO: 310361 - RNA, 32 nt, Human
agacccagccugaugcccgcaggagagagcaa

SEQ ID NO: 310362 - RNA, 22 nt, Human
agacccagccuuggcaccuccc

SEQ ID NO: 310363 - RNA, 32 nt, Human
agacccagcggggcacaugaggguucggaucc

SEQ ID NO: 310364 - RNA, 32 nt, Human
agacccagcugcagaccaugccagacccacug

SEQ ID NO: 310365 - RNA, 32 nt, Human
agacccagcugguucuggaguucuaggacauu

SEQ ID NO: 310366 - RNA, 32 nt, Human
agacccaggaaagggaguugcugagggcaggu

SEQ ID NO: 310367 - RNA, 32 nt, Human
agacccaggaagagaaacuccuuucaccugca

SEQ ID NO: 310368 - RNA, 32 nt, Human
agacccaggagaaagcacccucccuuaggaau

SEQ ID NO: 310369 - RNA, 32 nt, Human
agacccaggagcuggagauaauuugcagacau

SEQ ID NO: 310370 - RNA, 32 nt, Human
agacccaggaugaagggaugcagugaggucaa

SEQ ID NO: 310371 - RNA, 28 nt, Human
agacccaggccugcugccugcaucugca

SEQ ID NO: 310372 - RNA, 20 nt, Human
agacccagggaacccaggag

SEQ ID NO: 310373 - RNA, 32 nt, Human
agacccagggaccuggaguguguuuggacugc

SEQ ID NO: 310374 - RNA, 32 nt, Human
agacccagggagaacccacugcuuuucccagg

SEQ ID NO: 310375 - RNA, 32 nt, Human
agacccagggcuacgagccagguaaccagccg

SEQ ID NO: 310376 - RNA, 32 nt, Human
agacccagggggaggaaggguggaggggcccc

SEQ ID NO: 310377 - RNA, 32 nt, Human
agacccaggugcugugucacuggguggugccc

SEQ ID NO: 310378 - RNA, 32 nt, Human
agacccagucacauuggaugugaucuguauaa

SEQ ID NO: 310379 - RNA, 32 nt, Human
agacccagugagcccuucacuccugagaaaaa

SEQ ID NO: 310380 - RNA, 32 nt, Human
agacccauccagccaagcugguggacaaccuc

SEQ ID NO: 310381 - RNA, 32 nt, Human
agacccauccuaguggaggaaaaauccuacca

SEQ ID NO: 310382 - RNA, 31 nt, Human
agacccauggcuggaccugccacccagagcc

SEQ ID NO: 310383 - RNA, 32 nt, Human
agacccauggcuggaccugccacccagagccc

SEQ ID NO: 310384 - RNA, 24 nt, Human
agaccccaacgcucgcuggggcag

SEQ ID NO: 310385 - RNA, 32 nt, Human
agaccccaccaccaccaccaccaccaacacca

SEQ ID NO: 310386 - RNA, 32 nt, Human
agaccccaccauugcacuccaguccgggaaac

SEQ ID NO: 310387 - RNA, 32 nt, Human
agaccccacccagguggaugcaggaggacgag

SEQ ID NO: 310388 - RNA, 21 nt, Human
agaccccacccuaagcccaua

SEQ ID NO: 310389 - RNA, 32 nt, Human
agaccccacccuggguguaugugagugugcaa

SEQ ID NO: 310390 - RNA, 32 nt, Human
agaccccagcagagaugccagaaugggggagg

SEQ ID NO: 310391 - RNA, 32 nt, Human
agaccccagcagaggaggacaguggcucugag

SEQ ID NO: 310392 - RNA, 32 nt, Human
agaccccagcugucugcgcgucugacucuugu

SEQ ID NO: 310393 - RNA, 32 nt, Human
agaccccaggaccagcccuggggcucagggca

SEQ ID NO: 310394 - RNA, 32 nt, Human
agaccccaggaggccaaagggcugcagucacc

SEQ ID NO: 310395 - RNA, 23 nt, Human
agaccccagggucucucuccuca

SEQ ID NO: 310396 - RNA, 31 nt, Human
agaccccaugagcucucagccagcucuuuua

SEQ ID NO: 310397 - RNA, 32 nt, Human
agacccccagauaaccauaacagggaagcagg

SEQ ID NO: 310398 - RNA, 32 nt, Human
agacccccagcagguagcauuccccagcccug

SEQ ID NO: 310399 - RNA, 19 nt, Human
agacccccagccugaggca

SEQ ID NO: 310400 - RNA, 32 nt, Human
agacccccaucucuacaaaaauaaagaaaauu

SEQ ID NO: 310401 - RNA, 32 nt, Human
agacccccggcauccuaguccugggccguggg

SEQ ID NO: 310402 - RNA, 23 nt, Human
agacccccggcggcgucucuccg

SEQ ID NO: 310403 - RNA, 32 nt, Human
agacccccuccacccucugggacuaugcacag

SEQ ID NO: 310404 - RNA, 32 nt, Human
agacccccuccccuccugugucccuuguaaau

SEQ ID NO: 310405 - RNA, 32 nt, Human
agacccccugcagcucaagcaugucugcagga

SEQ ID NO: 310406 - RNA, 32 nt, Human
agacccccuuccccagccucucuaguuuuagu

SEQ ID NO: 310407 - RNA, 32 nt, Human
agaccccgagacacccucccuccacucgggag

SEQ ID NO: 310408 - RNA, 32 nt, Human
agaccccgccacugcacgcccugccggaccuc

SEQ ID NO: 310409 - RNA, 32 nt, Human
agaccccgcccggcgaggaggagggagggccg

SEQ ID NO: 310410 - RNA, 32 nt, Human
agaccccgcugcacucacagggaggaggaggc

SEQ ID NO: 310411 - RNA, 32 nt, Human
agaccccggaggcguggaggagaggagacugu

SEQ ID NO: 310412 - RNA, 18 nt, Human
agaccccgggaucugcug

SEQ ID NO: 310413 - RNA, 19 nt, Human
agaccccgucucuacaaaa

SEQ ID NO: 310414 - RNA, 32 nt, Human
agaccccuacuucgccuuuccuucuccggcug

SEQ ID NO: 310415 - RNA, 32 nt, Human
agaccccuauccacccccaguccccagggccc

SEQ ID NO: 310416 - RNA, 32 nt, Human
agaccccuauugccucuucuucaugcucauuu

SEQ ID NO: 310417 - RNA, 32 nt, Human
agaccccucacugcgguaucugcccaguggca

SEQ ID NO: 310418 - RNA, 32 nt, Human
agaccccucagcaagggugcaaagggggaaga

SEQ ID NO: 310419 - RNA, 32 nt, Human
agaccccuccucuagaaguggggaaggccaga

SEQ ID NO: 310420 - RNA, 32 nt, Human
agaccccucggucccauguccaugggggcacc

SEQ ID NO: 310421 - RNA, 32 nt, Human
agaccccugaccacccuccgaaccucggcugg

SEQ ID NO: 310422 - RNA, 23 nt, Human
agaccccugcacccuagggucag

SEQ ID NO: 310423 - RNA, 32 nt, Human
agaccccugcaggcucccuccacccaccuuga

SEQ ID NO: 310424 - RNA, 32 nt, Human
agaccccugccugcccacccuccacccacugc

SEQ ID NO: 310425 - RNA, 32 nt, Human
agaccccuggugcugggucccugcugcuuucu

SEQ ID NO: 310426 - RNA, 32 nt, Human
agaccccuguaaucccagcuacucaagaggcu

SEQ ID NO: 310427 - RNA, 20 nt, Human
agaccccugucucuacaaaa

SEQ ID NO: 310428 - RNA, 32 nt, Human
agaccccugugaggccccgggaaagguacagc

SEQ ID NO: 310429 - RNA, 32 nt, Human
agaccccuuccagggguuuacagucuauuuga

SEQ ID NO: 310430 - RNA, 32 nt, Human
agaccccuuugaccuugagcagucuccaucug

SEQ ID NO: 310431 - RNA, 32 nt, Human
agacccgcagugccaugcgcaggugcuugcgc

SEQ ID NO: 310432 - RNA, 32 nt, Human
agacccgccacaucagcaccauccgagagcuu

SEQ ID NO: 310433 - RNA, 32 nt, Human
agacccggaguuuccucuuucacuggauggag

SEQ ID NO: 310434 - RNA, 32 nt, Human
agacccggcaggcagucagacugaaugggagc

SEQ ID NO: 310435 - RNA, 32 nt, Human
agacccggccaugcaggagccgcugcugggag

SEQ ID NO: 310436 - RNA, 32 nt, Human
agacccggcucccagcccucgaacucgguaac

SEQ ID NO: 310437 - RNA, 32 nt, Human
agacccgggaccccguccccgcacaccugcca

SEQ ID NO: 310438 - RNA, 32 nt, Human
agacccgggaggcagagguugcagugagccga

SEQ ID NO: 310439 - RNA, 32 nt, Human
agacccgggccacacccaggaggccagagccu

SEQ ID NO: 310440 - RNA, 32 nt, Human
agacccgggcccugagcucccagcuggaggaa

SEQ ID NO: 310441 - RNA, 32 nt, Human
agacccgggggcaggugcugcagugagggguc

SEQ ID NO: 310442 - RNA, 32 nt, Human
agacccggguagggacagggacagagagacgc

SEQ ID NO: 310443 - RNA, 32 nt, Human
agacccguacucuccacacccuagagcuuuuc

SEQ ID NO: 310444 - RNA, 32 nt, Human
agacccgugagccuggccaaggugcugaagac

SEQ ID NO: 310445 - RNA, 32 nt, Human
agacccgugccuguauauuccacgcuuugcgc

SEQ ID NO: 310446 - RNA, 32 nt, Human
agacccuaacucuaccuuucugcuuuaaagca

SEQ ID NO: 310447 - RNA, 32 nt, Human
agacccuaagagaaucuagggagagggcauag

SEQ ID NO: 310448 - RNA, 32 nt, Human
agacccuagguuucccugucuaugccucccga

SEQ ID NO: 310449 - RNA, 32 nt, Human
agacccuaucuauaaggugccaccccaucauc

SEQ ID NO: 310450 - RNA, 32 nt, Human
agacccuauuaaagaaaccacaggguuugauu

SEQ ID NO: 310451 - RNA, 31 nt, Human
agacccucagugaagacucuguugaagacuu

SEQ ID NO: 310452 - RNA, 32 nt, Human
agacccuccuccucccccagagggguggguuc

SEQ ID NO: 310453 - RNA, 32 nt, Human
agacccuccugccaggugacagccgccaagau

SEQ ID NO: 310454 - RNA, 32 nt, Human
agacccuccuggagcuguccaaaggaaagccc

SEQ ID NO: 310455 - RNA, 32 nt, Human
agacccucgccugaacacgcccuacacucugg

SEQ ID NO: 310456 - RNA, 32 nt, Human
agacccucguggccuuccccagccucuucuag

SEQ ID NO: 310457 - RNA, 32 nt, Human
agacccucucacaaccucggaucucaguccuu

SEQ ID NO: 310458 - RNA, 32 nt, Human
agacccucuggccucucaccccacuucagugc

SEQ ID NO: 310459 - RNA, 22 nt, Human
agacccugacagcugcagcugc

SEQ ID NO: 310460 - RNA, 32 nt, Human
agacccugacagcugcagcugccuugccuugc

SEQ ID NO: 310461 - RNA, 21 nt, Human
agacccugagcagaauacugg

SEQ ID NO: 310462 - RNA, 32 nt, Human
agacccugagccccaacugucagaaggagccu

SEQ ID NO: 310463 - RNA, 32 nt, Human
agacccugaguccuugggccagcucuuggcua

SEQ ID NO: 310464 - RNA, 32 nt, Human
agacccugcacuuucaaccaggccaguccggc

SEQ ID NO: 310465 - RNA, 32 nt, Human
agacccugcaggccaugaagagccacucagaa

SEQ ID NO: 310466 - RNA, 18 nt, Human
agacccugcccccugcca

SEQ ID NO: 310467 - RNA, 32 nt, Human
agacccugcccugcagagucaagacuugaggc

SEQ ID NO: 310468 - RNA, 32 nt, Human
agacccuggaauagccugucccuuuucucugg

SEQ ID NO: 310469 - RNA, 21 nt, Human
agacccuggcuggaagccaga

SEQ ID NO: 310470 - RNA, 32 nt, Human
agacccugggcccucaccgcaggcagcaguuu

SEQ ID NO: 310471 - RNA, 32 nt, Human
agacccuggggugggaucagggaccaccccuc

SEQ ID NO: 310472 - RNA, 19 nt, Human
agacccugucucuacaaaa

SEQ ID NO: 310473 - RNA, 32 nt, Human
agacccugugccaccagaauauggccagggcc

SEQ ID NO: 310474 - RNA, 32 nt, Human
agacccuguucaaccucucaggaacagggauu

SEQ ID NO: 310475 - RNA, 32 nt, Human
agacccuuauucaccaccuuugacccaguaac

SEQ ID NO: 310476 - RNA, 32 nt, Human
agacccuuauuggauauaggauuugcaaaugu

SEQ ID NO: 310477 - RNA, 32 nt, Human
agacccuuccaaggaagaggccagaacggaca

SEQ ID NO: 310478 - RNA, 32 nt, Human
agacccuuccauccucccuguucucaguucac

SEQ ID NO: 310479 - RNA, 32 nt, Human
agacccuucccaauuccaucaccacugccaac

SEQ ID NO: 310480 - RNA, 24 nt, Human
agacccuuccccuccaccccccag

SEQ ID NO: 310481 - RNA, 32 nt, Human
agacccuucugggcucugcccgcugggggccu

SEQ ID NO: 310482 - RNA, 32 nt, Human
agacccuugacagccccagccuaggcagaugg

SEQ ID NO: 310483 - RNA, 32 nt, Human
agacccuugggcuccggugucuucccaaagcu

SEQ ID NO: 310484 - RNA, 32 nt, Human
agacccuuucagaaccaaacacaugccaagag

SEQ ID NO: 310485 - RNA, 32 nt, Human
agacccuuucagacuguccauggggccaaaaa

SEQ ID NO: 310486 - RNA, 32 nt, Human
agaccgaaaggcuggacucuuguuucuccuug

SEQ ID NO: 310487 - RNA, 32 nt, Human
agaccgaccagccagggcaacacagugagacc

SEQ ID NO: 310488 - RNA, 32 nt, Human
agaccgacggccgcuggagugcacuggcauga

SEQ ID NO: 310489 - RNA, 32 nt, Human
agaccgacguuauuuuccugguggcuguguuc

SEQ ID NO: 310490 - RNA, 32 nt, Human
agaccgacuuccacagcuguccaggucaaaag

SEQ ID NO: 310491 - RNA, 18 nt, Human
agaccgagaccauccugg

SEQ ID NO: 310492 - RNA, 32 nt, Human
agaccgagagacacagugaugaccucagccua

SEQ ID NO: 310493 - RNA, 32 nt, Human
agaccgagccacuguacuccagccuaggugac

SEQ ID NO: 310494 - RNA, 32 nt, Human
agaccgaggcacagcccagcugggcuaggccg

SEQ ID NO: 310495 - RNA, 32 nt, Human
agaccgaggcacagcccagcuggggcuaggcc

SEQ ID NO: 310496 - RNA, 32 nt, Human
agaccgaggccaugaagcagauucucggggug

SEQ ID NO: 310497 - RNA, 32 nt, Human
agaccgagggcaggggagggaggcgggggugg

SEQ ID NO: 310498 - RNA, 32 nt, Human
agaccgagggccuggcggccgaaggaaccgcc

SEQ ID NO: 310499 - RNA, 32 nt, Human
agaccgauuuccacuccaucuguuucuucucc

SEQ ID NO: 310500 - RNA, 32 nt, Human
agaccgcaccacugcacuccagccugggcgac

SEQ ID NO: 310501 - RNA, 32 nt, Human
agaccgcagagagccaugauagcaccauugca

SEQ ID NO: 310502 - RNA, 32 nt, Human
agaccgcagcagcuggagaggaaggggugagg

SEQ ID NO: 310503 - RNA, 32 nt, Human
agaccgcagccugugugugucuuucccuucga

SEQ ID NO: 310504 - RNA, 32 nt, Human
agaccgccuccaccucccccgcccgccuggcc

SEQ ID NO: 310505 - RNA, 32 nt, Human
agaccgcgccaagaagaagugcgcuggagccc

SEQ ID NO: 310506 - RNA, 32 nt, Human
agaccgcgccacugcacuccagccugggcaac

SEQ ID NO: 310507 - RNA, 32 nt, Human
agaccgcuccuccucacccucuaccucccugu

SEQ ID NO: 310508 - RNA, 16 nt, Human
agaccgcucuggacug

SEQ ID NO: 310509 - RNA, 32 nt, Human
agaccggagaaaaggccagaggugugaaguua

SEQ ID NO: 310510 - RNA, 32 nt, Human
agaccggagggaggaggaggaggaagaagagc

SEQ ID NO: 310511 - RNA, 32 nt, Human
agaccggcaccaaccccuuccucuggccccgc

SEQ ID NO: 310512 - RNA, 32 nt, Human
agaccggcacuuaaagccuggcugucacccag

SEQ ID NO: 310513 - RNA, 32 nt, Human
agaccggcccagacagccaggcuguggcuggu

SEQ ID NO: 310514 - RNA, 32 nt, Human
agaccggccgcauggacccagggacaguggcc

SEQ ID NO: 310515 - RNA, 32 nt, Human
agaccggcugccgccugcuccccggaaaaggg

SEQ ID NO: 310516 - RNA, 21 nt, Human
agaccgggcacccgccagaga

SEQ ID NO: 310517 - RNA, 32 nt, Human
agaccgggcgggcgcaggaugggcgggaacug

SEQ ID NO: 310518 - RNA, 21 nt, Human
agaccgggcuucaccauguug

SEQ ID NO: 310519 - RNA, 25 nt, Human
agaccgggcuucaccauguuggcca

SEQ ID NO: 310520 - RNA, 32 nt, Human
agaccggggcgugggaagagccuggccuaggc

SEQ ID NO: 310521 - RNA, 21 nt, Human
agaccgggguuuaccauguug

SEQ ID NO: 310522 - RNA, 32 nt, Human
agaccgggugcggccucugccugcagccucgu

SEQ ID NO: 310523 - RNA, 21 nt, Human
agaccggguuccgccauguug

SEQ ID NO: 310524 - RNA, 25 nt, Human
agaccggguuccgccauguugguca

SEQ ID NO: 310525 - RNA, 21 nt, Human
agaccgguuuucaccacguug

SEQ ID NO: 310526 - RNA, 25 nt, Human
agaccgguuuucaccacguuggcca

SEQ ID NO: 310527 - RNA, 32 nt, Human
agaccguaaggguuuuuaguuugaucuacucu

SEQ ID NO: 310528 - RNA, 32 nt, Human
agaccguacugagugucagauggagaggaugc

SEQ ID NO: 310529 - RNA, 32 nt, Human
agaccgugaccagugcugcugcagaggagguc

SEQ ID NO: 310530 - RNA, 32 nt, Human
agaccgugccacugcacuccagccuggcaaca

SEQ ID NO: 310531 - RNA, 32 nt, Human
agaccgugccacugcacuccagccugggcaac

SEQ ID NO: 310532 - RNA, 32 nt, Human
agaccgugccacuguacuccagccugggcagc

SEQ ID NO: 310533 - RNA, 32 nt, Human
agaccguggucaccaccuucuucaccuuugca

SEQ ID NO: 310534 - RNA, 32 nt, Human
agaccguguucccaggagcacugacugcaguu

SEQ ID NO: 310535 - RNA, 32 nt, Human
agaccuaagucacacaucauaaugcagcuccu

SEQ ID NO: 310536 - RNA, 32 nt, Human
agaccuacacuuggagcccagguccagcguuc

SEQ ID NO: 310537 - RNA, 32 nt, Human
agaccuacaggacguccucccuuguccugucu

SEQ ID NO: 310538 - RNA, 32 nt, Human
agaccuaccagccugcaccaggguccacagug

SEQ ID NO: 310539 - RNA, 32 nt, Human
agaccuagaacccuuuccccagcacuugguuu

SEQ ID NO: 310540 - RNA, 32 nt, Human
agaccuagaguguccacagcaggccugugcug

SEQ ID NO: 310541 - RNA, 32 nt, Human
agaccuagcccaggcuuggaggccagcuggag

SEQ ID NO: 310542 - RNA, 32 nt, Human
agaccuaggagguggucuuguggugguacauu

SEQ ID NO: 310543 - RNA, 21 nt, Human
agaccuagucucacucuguug

SEQ ID NO: 310544 - RNA, 32 nt, Human
agaccuagugcugagggauggacaggcgaggu

SEQ ID NO: 310545 - RNA, 32 nt, Human
agaccuagugggagagaaagaacaucgcagca

SEQ ID NO: 310546 - RNA, 32 nt, Human
agaccuauccagucuucaaggugcuccagaaa

SEQ ID NO: 310547 - RNA, 32 nt, Human
agaccucaaaacacaggaacucagagugauga

SEQ ID NO: 310548 - RNA, 32 nt, Human
agaccucaaagaauucggagaggagagugaga

SEQ ID NO: 310549 - RNA, 32 nt, Human
agaccucaacacugcugaccaugaucagcgca

SEQ ID NO: 310550 - RNA, 32 nt, Human
agaccucaagagaggguuccuggaccucccac

SEQ ID NO: 310551 - RNA, 32 nt, Human
agaccucacauacacacacauagacgccuuuc

SEQ ID NO: 310552 - RNA, 32 nt, Human
agaccucaccgggccugugauauuugcucucc

SEQ ID NO: 310553 - RNA, 32 nt, Human
agaccucagcagggcugcucagugccugccuc

SEQ ID NO: 310554 - RNA, 32 nt, Human
agaccucagccaaggucgcagagcagaggaga

SEQ ID NO: 310555 - RNA, 32 nt, Human
agaccucagccagcggccuacgcccaggccuu

SEQ ID NO: 310556 - RNA, 32 nt, Human
agaccucagccaugaggaguugcuguuuguuu

SEQ ID NO: 310557 - RNA, 32 nt, Human
agaccucagcuucucccucugaacuucaaguc

SEQ ID NO: 310558 - RNA, 32 nt, Human
agaccucagggcacaaagaugggugaaggcug

SEQ ID NO: 310559 - RNA, 32 nt, Human
agaccucaguacaaaagguauugaaacauuuu

SEQ ID NO: 310560 - RNA, 32 nt, Human
agaccucaucaggaugaacccaggacgcuucu

SEQ ID NO: 310561 - RNA, 32 nt, Human
agaccucaugccaccugcuguagccacugggc

SEQ ID NO: 310562 - RNA, 32 nt, Human
agaccucauggacucugggggcagcacuuugu

SEQ ID NO: 310563 - RNA, 32 nt, Human
agaccuccacugccauuguccuguggccgcca

SEQ ID NO: 310564 - RNA, 32 nt, Human
agaccuccagaagagcagcggagggcggguga

SEQ ID NO: 310565 - RNA, 32 nt, Human
agaccuccaguuucagcccugcccucagccuc

SEQ ID NO: 310566 - RNA, 17 nt, Human
agaccuccccgucuucc

SEQ ID NO: 310567 - RNA, 32 nt, Human
agaccucccucugaacaccacagccagguccu

SEQ ID NO: 310568 - RNA, 32 nt, Human
agaccucccugccuuucccugagcccaggccu

SEQ ID NO: 310569 - RNA, 24 nt, Human
agaccucccuggcccaccuagagg

SEQ ID NO: 310570 - RNA, 32 nt, Human
agaccuccgccucugcacuccagccuggguga

SEQ ID NO: 310571 - RNA, 32 nt, Human
agaccuccuccacucuccauccccuuucccuu

SEQ ID NO: 310572 - RNA, 22 nt, Human
agaccuccuggguccucucagg

SEQ ID NO: 310573 - RNA, 32 nt, Human
agaccucgcugguaaaggucaaauggggucau

SEQ ID NO: 310574 - RNA, 32 nt, Human
agaccucuacucaugcuaucaucaccaaaggg

SEQ ID NO: 310575 - RNA, 32 nt, Human
agaccucucauuuuccuaucucacagugccuc

SEQ ID NO: 310576 - RNA, 32 nt, Human
agaccucuccagaucugcgauugaccugguug

SEQ ID NO: 310577 - RNA, 32 nt, Human
agaccucuccugcuggucccuggaccucuugc

SEQ ID NO: 310578 - RNA, 20 nt, Human
agaccucucgcuucucucgg

SEQ ID NO: 310579 - RNA, 32 nt, Human
agaccucucuauaaugguaaauguaagacauc

SEQ ID NO: 310580 - RNA, 32 nt, Human
agaccucucuucuggauuugucccauggggac

SEQ ID NO: 310581 - RNA, 32 nt, Human
agaccucugaagacuucucagauggauccuag

SEQ ID NO: 310582 - RNA, 22 nt, Human
agaccucuggaguuuccucuug

SEQ ID NO: 310583 - RNA, 32 nt, Human
agaccucuggaucucugcucaacccaagcuuc

SEQ ID NO: 310584 - RNA, 32 nt, Human
agaccucugucucucucgggccuuggcuccuu

SEQ ID NO: 310585 - RNA, 32 nt, Human
agaccucuucauucccccuccuguggugaggg

SEQ ID NO: 310586 - RNA, 31 nt, Human
agaccucuucccucugggccuguucucuugg

SEQ ID NO: 310587 - RNA, 32 nt, Human
agaccucuuggcccaaccugcucaccccaccg

SEQ ID NO: 310588 - RNA, 32 nt, Human
agaccugaaggaugggaagccaggaaguggga

SEQ ID NO: 310589 - RNA, 32 nt, Human
agaccugacaacuaaaugccaugugggacccu

SEQ ID NO: 310590 - RNA, 32 nt, Human
agaccugacauuagaacuagaccugggcuaga

SEQ ID NO: 310591 - RNA, 32 nt, Human
agaccugagcgggagucagggaccugcugcuc

SEQ ID NO: 310592 - RNA, 32 nt, Human
agaccugaguucuucucucaguuccaagcagg

SEQ ID NO: 310593 - RNA, 32 nt, Human
agaccugauuuucaaaaucugcccucagauga

SEQ ID NO: 310594 - RNA, 32 nt, Human
agaccugcagaaccagcguguguggggugcag

SEQ ID NO: 310595 - RNA, 32 nt, Human
agaccugcagccaccagugcuucacuagcgug

SEQ ID NO: 310596 - RNA, 32 nt, Human
agaccugcaggugggaguaccagguugaaacc

SEQ ID NO: 310597 - RNA, 32 nt, Human
agaccugcaguggcagacugcagagcugagcc

SEQ ID NO: 310598 - RNA, 32 nt, Human
agaccugccccggggccagguggagaaaguga

SEQ ID NO: 310599 - RNA, 32 nt, Human
agaccugccccuccucucugcccuaaugcgca

SEQ ID NO: 310600 - RNA, 17 nt, Human
agaccugcccucaagag

SEQ ID NO: 310601 - RNA, 23 nt, Human
agaccugcccucagggauugcag

SEQ ID NO: 310602 - RNA, 32 nt, Human
agaccugccucaccucacccuccuccaggaag

SEQ ID NO: 310603 - RNA, 32 nt, Human
agaccugccugaccaacaugcugaaacccagu

SEQ ID NO: 310604 - RNA, 18 nt, Human
agaccugccugccuuccu

SEQ ID NO: 310605 - RNA, 32 nt, Human
agaccugccugggaaaacagcuucugagccau

SEQ ID NO: 310606 - RNA, 32 nt, Human
agaccugcgggggacagcaggaggacagccgg

SEQ ID NO: 310607 - RNA, 22 nt, Human
agaccugcguggccguccaggg

SEQ ID NO: 310608 - RNA, 32 nt, Human
agaccugcguugugugucuguguguugaguga

SEQ ID NO: 310609 - RNA, 32 nt, Human
agaccugcuuccacuuucaaucucucucauug

SEQ ID NO: 310610 - RNA, 32 nt, Human
agaccuggaaaccaacaggugaccucagggag

SEQ ID NO: 310611 - RNA, 32 nt, Human
agaccuggaagcuguucagcucucacaugaau

SEQ ID NO: 310612 - RNA, 32 nt, Human
agaccuggaauucaaaagaaauggagcuauuc

SEQ ID NO: 310613 - RNA, 32 nt, Human
agaccuggacacuagggucaggcggggugcgu

SEQ ID NO: 310614 - RNA, 32 nt, Human
agaccuggacucacagccuggcugugaugcuu

SEQ ID NO: 310615 - RNA, 32 nt, Human
agaccuggaugccccagagcaaggucuucauu

SEQ ID NO: 310616 - RNA, 32 nt, Human
agaccuggccaacauggugaaacccugucucu

SEQ ID NO: 310617 - RNA, 32 nt, Human
agaccuggcugacugccagaagcagaucuuac

SEQ ID NO: 310618 - RNA, 32 nt, Human
agaccuggcuuccucccugacacucacucugg

SEQ ID NO: 310619 - RNA, 32 nt, Human
agaccugggacaccucagccagcuugcccacc

SEQ ID NO: 310620 - RNA, 32 nt, Human
agaccugggaggaccucagggcccagaauguc

SEQ ID NO: 310621 - RNA, 32 nt, Human
agaccugggcccaaucugugaaccugauuugg

SEQ ID NO: 310622 - RNA, 32 nt, Human
agaccugggcuccacguccagccugggaccug

SEQ ID NO: 310623 - RNA, 32 nt, Human
agaccugggcuggggccuuccuccagggaagg

SEQ ID NO: 310624 - RNA, 32 nt, Human
agaccuggugcuggcgcugggaucccgccucu

SEQ ID NO: 310625 - RNA, 23 nt, Human
agaccugguuggccgugguccag

SEQ ID NO: 310626 - RNA, 32 nt, Human
agaccuguauaugugaccuuuguccucacaua

SEQ ID NO: 310627 - RNA, 32 nt, Human
agaccuguccuucugugccucacaguaaaaug

SEQ ID NO: 310628 - RNA, 32 nt, Human
agaccugugauuugccaagucccuggacccug

SEQ ID NO: 310629 - RNA, 32 nt, Human
agaccugugcaggaucacuggacacaggcucu

SEQ ID NO: 310630 - RNA, 32 nt, Human
agaccugugugugggaccugcuccaggcugau

SEQ ID NO: 310631 - RNA, 32 nt, Human
agaccuguucucucuagccauugauuuaccag

SEQ ID NO: 310632 - RNA, 32 nt, Human
agaccuguucugaccucaugagugucaaacgu

SEQ ID NO: 310633 - RNA, 32 nt, Human
agaccuuaaacuugaggcaacccaucugaggu

SEQ ID NO: 310634 - RNA, 32 nt, Human
agaccuuacagaucaucuaguucuccagccuu

SEQ ID NO: 310635 - RNA, 32 nt, Human
agaccuuccccaccaccuccuuagccuggugu

SEQ ID NO: 310636 - RNA, 32 nt, Human
agaccuuccucacccgcucccaccucacaccc

SEQ ID NO: 310637 - RNA, 32 nt, Human
agaccuuccugaauucagaucaucucagaagu

SEQ ID NO: 310638 - RNA, 32 nt, Human
agaccuucuccaggaagccuccugggacuucc

SEQ ID NO: 310639 - RNA, 32 nt, Human
agaccuucucuuccuuuccuuuccuuuccucu

SEQ ID NO: 310640 - RNA, 32 nt, Human
agaccuugacaggaaagagggaggggccaagg

SEQ ID NO: 310641 - RNA, 32 nt, Human
agaccuugagagccaugacagguccaucagca

SEQ ID NO: 310642 - RNA, 32 nt, Human
agaccuugaggugaucagcauaagaggccaga

SEQ ID NO: 310643 - RNA, 32 nt, Human
agaccuugccagacugccugcuuucauggaua

SEQ ID NO: 310644 - RNA, 32 nt, Human
agaccuugccugggcuugugggcugcuggucg

SEQ ID NO: 310645 - RNA, 32 nt, Human
agaccuugggaagggguuaggaagggagaggc

SEQ ID NO: 310646 - RNA, 32 nt, Human
agaccuuggucuuagaauuuuucuuuuauggu

SEQ ID NO: 310647 - RNA, 23 nt, Human
agaccuuguccagaaaaccaaag

SEQ ID NO: 310648 - RNA, 19 nt, Human
agaccuugucucuacaaaa

SEQ ID NO: 310649 - RNA, 32 nt, Human
agaccuuuauggugauccacuuccacuuaaua

SEQ ID NO: 310650 - RNA, 32 nt, Human
agaccuuucuguguuaaugccuccugguacug

SEQ ID NO: 310651 - RNA, 32 nt, Human
agacgaaacacccucccagucuaugggguagu

SEQ ID NO: 310652 - RNA, 32 nt, Human
agacgaaauuuggccagacacaggguuccuug

SEQ ID NO: 310653 - RNA, 18 nt, Human
agacgaaccagucgggga

SEQ ID NO: 310654 - RNA, 32 nt, Human
agacgaagaagacgauuaaccauuugguccua

SEQ ID NO: 310655 - RNA, 32 nt, Human
agacgaagacaugcucaccggacaaggguucc

SEQ ID NO: 310656 - RNA, 32 nt, Human
agacgaaggagagagagcugaggguggaggca

SEQ ID NO: 310657 - RNA, 32 nt, Human
agacgaagggagagagaaagcaguuuccaagg

SEQ ID NO: 310658 - RNA, 32 nt, Human
agacgacaccacugcacuccagccugggugac

SEQ ID NO: 310659 - RNA, 32 nt, Human
agacgaccaaacuugccguggaagagacaguu

SEQ ID NO: 310660 - RNA, 32 nt, Human
agacgaccagauaagagguugggaugagcaug

SEQ ID NO: 310661 - RNA, 18 nt, Human
agacgaccugccaugucc

SEQ ID NO: 310662 - RNA, 32 nt, Human
agacgacuucagcagacucaccucuggagggu

SEQ ID NO: 310663 - RNA, 32 nt, Human
agacgagacacccuaacucuugcucacucccu

SEQ ID NO: 310664 - RNA, 32 nt, Human
agacgagacuguacaccagcaaaaagauccca

SEQ ID NO: 310665 - RNA, 32 nt, Human
agacgagaggagagaaagagguagaauauuuu

SEQ ID NO: 310666 - RNA, 22 nt, Human
agacgagaggcagccaccccag

SEQ ID NO: 310667 - RNA, 32 nt, Human
agacgagagggugggaggucccggaguaacuu

SEQ ID NO: 310668 - RNA, 32 nt, Human
agacgagcagaggcgccaggugacccuguuuc

SEQ ID NO: 310669 - RNA, 21 nt, Human
agacgagcucagaaaaccaga

SEQ ID NO: 310670 - RNA, 32 nt, Human
agacgaggaggcagcgggugcagccagguguc

SEQ ID NO: 310671 - RNA, 32 nt, Human
agacgaggcaaaaauauuuaacccccaaauau

SEQ ID NO: 310672 - RNA, 32 nt, Human
agacgaggcaggcacagcugccagagaccauc

SEQ ID NO: 310673 - RNA, 32 nt, Human
agacgaggcagggagaggcgggacuucgcggg

SEQ ID NO: 310674 - RNA, 32 nt, Human
agacgaggccuuugcuuuacagcacuguaugu

SEQ ID NO: 310675 - RNA, 21 nt, Human
agacgaggcuucaccauguug

SEQ ID NO: 310676 - RNA, 25 nt, Human
agacgaggcuucaccauguuggcca

SEQ ID NO: 310677 - RNA, 21 nt, Human
agacgaggucccaccauguug

SEQ ID NO: 310678 - RNA, 21 nt, Human
agacgaggucucacuauguug

SEQ ID NO: 310679 - RNA, 32 nt, Human
agacgagguucugcggagagagaggcuccaag

SEQ ID NO: 310680 - RNA, 25 nt, Human
agacgagguuucaacauguuggcca

SEQ ID NO: 310681 - RNA, 21 nt, Human
agacgagguuucaccaucuug

SEQ ID NO: 310682 - RNA, 25 nt, Human
agacgagguuucaccaucuuggcca

SEQ ID NO: 310683 - RNA, 21 nt, Human
agacgagguuucaccauguug

SEQ ID NO: 310684 - RNA, 25 nt, Human
agacgagguuucaccauguuggcca

SEQ ID NO: 310685 - RNA, 20 nt, Human
agacgagguuucaccguguu

SEQ ID NO: 310686 - RNA, 21 nt, Human
agacgagguuucacuguguug

SEQ ID NO: 310687 - RNA, 21 nt, Human
agacgagguuucgccauguug

SEQ ID NO: 310688 - RNA, 21 nt, Human
agacgagguuuugccauguug

SEQ ID NO: 310689 - RNA, 32 nt, Human
agacgagucauaccugauucaccugcacugcu

SEQ ID NO: 310690 - RNA, 32 nt, Human
agacgauccaggagagcagcaaccuaaacgaa

SEQ ID NO: 310691 - RNA, 32 nt, Human
agacgaucugguucagacucuaccucaucacu

SEQ ID NO: 310692 - RNA, 32 nt, Human
agacgauggcaaaccagcauucagccucaucu

SEQ ID NO: 310693 - RNA, 32 nt, Human
agacgaugggcagaggagugacagccgcagac

SEQ ID NO: 310694 - RNA, 32 nt, Human
agacgauguucccagggguuuucgccaugaac

SEQ ID NO: 310695 - RNA, 32 nt, Human
agacgcaaagagaacugcugcgcgggaggcca

SEQ ID NO: 310696 - RNA, 32 nt, Human
agacgcaaggccacguacaaaaacuugaaaua

SEQ ID NO: 310697 - RNA, 32 nt, Human
agacgcacacacacaacagaugcgcagcaacu

SEQ ID NO: 310698 - RNA, 32 nt, Human
agacgcagcacagaaggcucucacugaugaaa

SEQ ID NO: 310699 - RNA, 32 nt, Human
agacgcagcacugggagaggaggacaucguca

SEQ ID NO: 310700 - RNA, 32 nt, Human
agacgcagcagccuguguccuccagggccucu

SEQ ID NO: 310701 - RNA, 32 nt, Human
agacgcagcaguguccaggagcggcagagacu

SEQ ID NO: 310702 - RNA, 32 nt, Human
agacgcagccgcgcucccaccacccacaccca

SEQ ID NO: 310703 - RNA, 32 nt, Human
agacgcagcucugauuucugguguuccugggc

SEQ ID NO: 310704 - RNA, 32 nt, Human
agacgcaggccccggaacccaggcugggucgg

SEQ ID NO: 310705 - RNA, 32 nt, Human
agacgcaggcggcagaggugcuggaccacauc

SEQ ID NO: 310706 - RNA, 32 nt, Human
agacgcagggaaagguggccgugggaacguga

SEQ ID NO: 310707 - RNA, 32 nt, Human
agacgcagggcgacgccacacgccgggguggc

SEQ ID NO: 310708 - RNA, 32 nt, Human
agacgcagugccuggcaguccagaggcagugg

SEQ ID NO: 310709 - RNA, 21 nt, Human
agacgcaguuucaccguguug

SEQ ID NO: 310710 - RNA, 32 nt, Human
agacgccacuggcggcccuaagccacucccgc

SEQ ID NO: 310711 - RNA, 32 nt, Human
agacgccagccgcgccacgcacugccugcguc

SEQ ID NO: 310712 - RNA, 32 nt, Human
agacgccagcuuggcccugcagccagcacagg

SEQ ID NO: 310713 - RNA, 32 nt, Human
agacgccaggcucggaucugugcucagagccg

SEQ ID NO: 310714 - RNA, 32 nt, Human
agacgccagugucaccuuuagcccaaccagug

SEQ ID NO: 310715 - RNA, 32 nt, Human
agacgccauugcaccccagccugggcaaugag

SEQ ID NO: 310716 - RNA, 32 nt, Human
agacgcccacuggccccagaucucauccugcc

SEQ ID NO: 310717 - RNA, 32 nt, Human
agacgcccagaagaagcagcugaaggagcagc

SEQ ID NO: 310718 - RNA, 32 nt, Human
agacgccccucagagcucagugccucugaggc

SEQ ID NO: 310719 - RNA, 19 nt, Human
agacgccgggauccaggag

SEQ ID NO: 310720 - RNA, 32 nt, Human
agacgccuggagaguuguggacuggggcaacc

SEQ ID NO: 310721 - RNA, 32 nt, Human
agacgccuguaaucccagcuacuugggaggcu

SEQ ID NO: 310722 - RNA, 32 nt, Human
agacgccuguaggagcugcgccggagccuuca

SEQ ID NO: 310723 - RNA, 32 nt, Human
agacgcgaugcgguguuccaucaggaaaugcu

SEQ ID NO: 310724 - RNA, 19 nt, Human
agacgcgccagacgcgcca

SEQ ID NO: 310725 - RNA, 18 nt, Human
agacgcgccgccgcugcc

SEQ ID NO: 310726 - RNA, 32 nt, Human
agacgcggcuggagcaggagaucgccaccuac

SEQ ID NO: 310727 - RNA, 32 nt, Human
agacgcuccaagaggcuccucagugugggcga

SEQ ID NO: 310728 - RNA, 32 nt, Human
agacgcuccgcuagugcagacaggagcgcgca

SEQ ID NO: 310729 - RNA, 32 nt, Human
agacgcugaacugccugggauguuuucgggaa

SEQ ID NO: 310730 - RNA, 32 nt, Human
agacgcugaggaggaggaggaggcggaggagg

SEQ ID NO: 310731 - RNA, 32 nt, Human
agacgcugccgcugccgcugcaccacggcguu

SEQ ID NO: 310732 - RNA, 32 nt, Human
agacgcugggcugugcggugcggagggugaug

SEQ ID NO: 310733 - RNA, 32 nt, Human
agacgcuggugaggagagccggguccagguuc

SEQ ID NO: 310734 - RNA, 32 nt, Human
agacgcugucggcauugccagccuggcaauuu

SEQ ID NO: 310735 - RNA, 32 nt, Human
agacgcuugaagcaaagcugccaucccagaag

SEQ ID NO: 310736 - RNA, 32 nt, Human
agacgcuuggggcaaugcugcggggaggaagg

SEQ ID NO: 310737 - RNA, 32 nt, Human
agacggaaaugaggaacuuguugggaacugga

SEQ ID NO: 310738 - RNA, 32 nt, Human
agacggaagaggagacacagacacaaagcagg

SEQ ID NO: 310739 - RNA, 25 nt, Human
agacggaauuucaccaugguggcca

SEQ ID NO: 310740 - RNA, 32 nt, Human
agacggagaagggagagagugggaguuuccca

SEQ ID NO: 310741 - RNA, 32 nt, Human
agacggagcuuccugagggcagggaggcagau

SEQ ID NO: 310742 - RNA, 32 nt, Human
agacggaggaagcauaaaccagguccugaucc

SEQ ID NO: 310743 - RNA, 32 nt, Human
agacggaggagaacugagcagagcagagcauc

SEQ ID NO: 310744 - RNA, 32 nt, Human
agacggagggaugacaguuucaaggaggauuu

SEQ ID NO: 310745 - RNA, 32 nt, Human
agacggagggcagaggugguggaaggggccag

SEQ ID NO: 310746 - RNA, 19 nt, Human
agacggagucacucuguca

SEQ ID NO: 310747 - RNA, 19 nt, Human
agacggagucucacucugu

SEQ ID NO: 310748 - RNA, 21 nt, Human
agacggagucucccuauguug

SEQ ID NO: 310749 - RNA, 21 nt, Human
agacggaguuucaccauauug

SEQ ID NO: 310750 - RNA, 20 nt, Human
agacggaguuucaccauguu

SEQ ID NO: 310751 - RNA, 21 nt, Human
agacggaguuucaccauguug

SEQ ID NO: 310752 - RNA, 25 nt, Human
agacggaguuucaccauguuggcca

SEQ ID NO: 310753 - RNA, 25 nt, Human
agacggaguuucaccauguugguca

SEQ ID NO: 310754 - RNA, 25 nt, Human
agacggaguuucaccauguugguua

SEQ ID NO: 310755 - RNA, 20 nt, Human
agacggaguuucaccguguu

SEQ ID NO: 310756 - RNA, 20 nt, Human
agacggaguuucaucguguu

SEQ ID NO: 310757 - RNA, 19 nt, Human
agacggaguuucgcuguug

SEQ ID NO: 310758 - RNA, 21 nt, Human
agacggaguuucgucauguug

SEQ ID NO: 310759 - RNA, 21 nt, Human
agacggaguuuugccauguug

SEQ ID NO: 310760 - RNA, 32 nt, Human
agacggaguuuugcucuuuguugcccaggcug

SEQ ID NO: 310761 - RNA, 19 nt, Human
agacggauauaaaggaaga

SEQ ID NO: 310762 - RNA, 32 nt, Human
agacggaucccaccucccuuucuuagcagaau

SEQ ID NO: 310763 - RNA, 23 nt, Human
agacggauccucacacaaagagg

SEQ ID NO: 310764 - RNA, 32 nt, Human
agacggaucucucuccgaccugccacagaucc

SEQ ID NO: 310765 - RNA, 32 nt, Human
agacggauggugccuuugaagcaaagaggaag

SEQ ID NO: 310766 - RNA, 19 nt, Human
agacggauucucuauguug

SEQ ID NO: 310767 - RNA, 32 nt, Human
agacggcacccaggcugugaucuguccugggc

SEQ ID NO: 310768 - RNA, 32 nt, Human
agacggcagauguggcuggaggucagggcucu

SEQ ID NO: 310769 - RNA, 32 nt, Human
agacggcagccugaccuuugagcuggcuuguc

SEQ ID NO: 310770 - RNA, 21 nt, Human
agacggcauuucaccauauug

SEQ ID NO: 310771 - RNA, 25 nt, Human
agacggcauuucaccauauugguca

SEQ ID NO: 310772 - RNA, 21 nt, Human
agacggcauuucaccauguug

SEQ ID NO: 310773 - RNA, 25 nt, Human
agacggcauuucaccauguuggcca

SEQ ID NO: 310774 - RNA, 32 nt, Human
agacggccaccugcaggaccccacacucacug

SEQ ID NO: 310775 - RNA, 22 nt, Human
agacggcccuugggcucagggg

SEQ ID NO: 310776 - RNA, 32 nt, Human
agacggcguccucaaggcaucuggagggcuuu

SEQ ID NO: 310777 - RNA, 22 nt, Human
agacggcguccugcgcucccca

SEQ ID NO: 310778 - RNA, 21 nt, Human
agacggcguuucaccauguug

SEQ ID NO: 310779 - RNA, 25 nt, Human
agacggcguuucaccauguuggcca

SEQ ID NO: 310780 - RNA, 21 nt, Human
agacggcguuucaccauuuug

SEQ ID NO: 310781 - RNA, 21 nt, Human
agacggcguuucaccguguug

SEQ ID NO: 310782 - RNA, 25 nt, Human
agacggcguuucaccguguuggcca

SEQ ID NO: 310783 - RNA, 32 nt, Human
agacgggagcccuuugcugugugcucugucca

SEQ ID NO: 310784 - RNA, 32 nt, Human
agacgggagcgagugggcucuccaccagcaca

SEQ ID NO: 310785 - RNA, 20 nt, Human
agacgggaggggaggcauug

SEQ ID NO: 310786 - RNA, 32 nt, Human
agacgggaggggaggcauugacauaggucaua

SEQ ID NO: 310787 - RNA, 32 nt, Human
agacgggauccuucaugagaaaagccagccag

SEQ ID NO: 310788 - RNA, 21 nt, Human
agacgggauucuaccauguug

SEQ ID NO: 310789 - RNA, 21 nt, Human
agacgggauuucaccauguug

SEQ ID NO: 310790 - RNA, 25 nt, Human
agacgggauuucaccauguuggcca

SEQ ID NO: 310791 - RNA, 25 nt, Human
agacgggauuucaccauguugguca

SEQ ID NO: 310792 - RNA, 20 nt, Human
agacgggauuucaccguguu

SEQ ID NO: 310793 - RNA, 20 nt, Human
agacgggauuucacuguguu

SEQ ID NO: 310794 - RNA, 21 nt, Human
agacgggauuucacuguguug

SEQ ID NO: 310795 - RNA, 21 nt, Human
agacgggauuuuaucauguug

SEQ ID NO: 310796 - RNA, 32 nt, Human
agacgggcgcuagauuuggggcucagaaggcc

SEQ ID NO: 310797 - RNA, 32 nt, Human
agacgggcggaugcaguguugugcacaagcca

SEQ ID NO: 310798 - RNA, 31 nt, Human
agacgggcguucucccccaugccaggcgaau

SEQ ID NO: 310799 - RNA, 32 nt, Human
agacgggcugcaagagggagccggcccgacgc

SEQ ID NO: 310800 - RNA, 32 nt, Human
agacgggcuggcuuggccucuggaucauaauc

SEQ ID NO: 310801 - RNA, 32 nt, Human
agacggggacaguaagguuuggaggaaggggg

SEQ ID NO: 310802 - RNA, 32 nt, Human
agacggggagaaacaucuggaaggaugcucga

SEQ ID NO: 310803 - RNA, 32 nt, Human
agacggggagggaggagagaaagggaaauuca

SEQ ID NO: 310804 - RNA, 17 nt, Human
agacggggcaaaugugg

SEQ ID NO: 310805 - RNA, 21 nt, Human
agacggggccucacuauguug

SEQ ID NO: 310806 - RNA, 21 nt, Human
agacggggcuucaccaucuug

SEQ ID NO: 310807 - RNA, 25 nt, Human
agacggggcuucaccaucuuggcca

SEQ ID NO: 310808 - RNA, 21 nt, Human
agacggggcuucacuauguug

SEQ ID NO: 310809 - RNA, 25 nt, Human
agacggggcuucacuauguuggcca

SEQ ID NO: 310810 - RNA, 21 nt, Human
agacggggcuucuccauguug

SEQ ID NO: 310811 - RNA, 25 nt, Human
agacggggcuucuccauguugguca

SEQ ID NO: 310812 - RNA, 23 nt, Human
agacgggggauuucaccauguug

SEQ ID NO: 310813 - RNA, 32 nt, Human
agacgggggauuucaccauguuggccaggcug

SEQ ID NO: 310814 - RNA, 32 nt, Human
agacgggggcugcggcccuggcucggcagcuc

SEQ ID NO: 310815 - RNA, 21 nt, Human
agacggggguuucaccauguu

SEQ ID NO: 310816 - RNA, 22 nt, Human
agacggggguuucaccauguug

SEQ ID NO: 310817 - RNA, 22 nt, Human
agacggggguuucacuauguug

SEQ ID NO: 310818 - RNA, 23 nt, Human
agacggggguuuucaccauguug

SEQ ID NO: 310819 - RNA, 32 nt, Human
agacggggguuuucaccauguuggccaggcug

SEQ ID NO: 310820 - RNA, 21 nt, Human
agacgggguaucacuauauug

SEQ ID NO: 310821 - RNA, 19 nt, Human
agacggggucucacucugu

SEQ ID NO: 310822 - RNA, 20 nt, Human
agacggggucucacucuguu

SEQ ID NO: 310823 - RNA, 21 nt, Human
agacggggucucgccauguug

SEQ ID NO: 310824 - RNA, 25 nt, Human
agacggggucucgccauguuggcca

SEQ ID NO: 310825 - RNA, 21 nt, Human
agacggggucuggcuguguug

SEQ ID NO: 310826 - RNA, 21 nt, Human
agacggggucuugcuauguug

SEQ ID NO: 310827 - RNA, 20 nt, Human
agacgggguucaccauguug

SEQ ID NO: 310828 - RNA, 24 nt, Human
agacgggguucaccauguuggcca

SEQ ID NO: 310829 - RNA, 22 nt, Human
agacgggguugacacaaugcug

SEQ ID NO: 310830 - RNA, 21 nt, Human
agacgggguuuaaccauguug

SEQ ID NO: 310831 - RNA, 25 nt, Human
agacgggguuuaaccauguuggcca

SEQ ID NO: 310832 - RNA, 21 nt, Human
agacgggguuucaacguguug

SEQ ID NO: 310833 - RNA, 20 nt, Human
agacgggguuucacaguguu

SEQ ID NO: 310834 - RNA, 25 nt, Human
agacgggguuucaccacauucguca

SEQ ID NO: 310835 - RNA, 21 nt, Human
agacgggguuucaccacauug

SEQ ID NO: 310836 - RNA, 25 nt, Human
agacgggguuucaccacauuggcca

SEQ ID NO: 310837 - RNA, 25 nt, Human
agacgggguuucaccacauugguca

SEQ ID NO: 310838 - RNA, 21 nt, Human
agacgggguuucaccacguug

SEQ ID NO: 310839 - RNA, 25 nt, Human
agacgggguuucaccacguuggcca

SEQ ID NO: 310840 - RNA, 25 nt, Human
agacgggguuucaccacguuggccg

SEQ ID NO: 310841 - RNA, 20 nt, Human
agacgggguuucaccagguu

SEQ ID NO: 310842 - RNA, 21 nt, Human
agacgggguuucaccaguguu

SEQ ID NO: 310843 - RNA, 21 nt, Human
agacgggguuucaccauauug

SEQ ID NO: 310844 - RNA, 25 nt, Human
agacgggguuucaccauauuggcca

SEQ ID NO: 310845 - RNA, 21 nt, Human
agacgggguuucaccaucuug

SEQ ID NO: 310846 - RNA, 25 nt, Human
agacgggguuucaccaucuuggcca

SEQ ID NO: 310847 - RNA, 18 nt, Human
agacgggguuucaccaug

SEQ ID NO: 310848 - RNA, 21 nt, Human
agacgggguuucaccaugcug

SEQ ID NO: 310849 - RNA, 25 nt, Human
agacgggguuucaccaugcuggcca

SEQ ID NO: 310850 - RNA, 19 nt, Human
agacgggguuucaccaugu

SEQ ID NO: 310851 - RNA, 25 nt, Human
agacgggguuucaccaugugggcca

SEQ ID NO: 310852 - RNA, 20 nt, Human
agacgggguuucaccauguu

SEQ ID NO: 310853 - RNA, 21 nt, Human
agacgggguuucaccauguug

SEQ ID NO: 310854 - RNA, 25 nt, Human
agacgggguuucaccauguugccca

SEQ ID NO: 310855 - RNA, 25 nt, Human
agacgggguuucaccauguugcuca

SEQ ID NO: 310856 - RNA, 22 nt, Human
agacgggguuucaccauguugg

SEQ ID NO: 310857 - RNA, 25 nt, Human
agacgggguuucaccauguuggcca

SEQ ID NO: 310858 - RNA, 25 nt, Human
agacgggguuucaccauguuggccg

SEQ ID NO: 310859 - RNA, 24 nt, Human
agacgggguuucaccauguugguc

SEQ ID NO: 310860 - RNA, 25 nt, Human
agacgggguuucaccauguugguca

SEQ ID NO: 310861 - RNA, 25 nt, Human
agacgggguuucaccauguugucca

SEQ ID NO: 310862 - RNA, 21 nt, Human
agacgggguuucaccauuuug

SEQ ID NO: 310863 - RNA, 25 nt, Human
agacgggguuucaccauuuuggcca

SEQ ID NO: 310864 - RNA, 20 nt, Human
agacgggguuucaccguguu

SEQ ID NO: 310865 - RNA, 25 nt, Human
agacgggguuucaccguguuaguca

SEQ ID NO: 310866 - RNA, 21 nt, Human
agacgggguuucaccguguug

SEQ ID NO: 310867 - RNA, 25 nt, Human
agacgggguuucaccguguuggcca

SEQ ID NO: 310868 - RNA, 21 nt, Human
agacgggguuucaccuuguug

SEQ ID NO: 310869 - RNA, 25 nt, Human
agacgggguuucaccuuguuggcca

SEQ ID NO: 310870 - RNA, 21 nt, Human
agacgggguuucacuauauug

SEQ ID NO: 310871 - RNA, 25 nt, Human
agacgggguuucacuauauuggcca

SEQ ID NO: 310872 - RNA, 21 nt, Human
agacgggguuucacuauguug

SEQ ID NO: 310873 - RNA, 25 nt, Human
agacgggguuucacuauguuggcca

SEQ ID NO: 310874 - RNA, 21 nt, Human
agacgggguuucacucuguca

SEQ ID NO: 310875 - RNA, 18 nt, Human
agacgggguuucacugug

SEQ ID NO: 310876 - RNA, 20 nt, Human
agacgggguuucacuguguu

SEQ ID NO: 310877 - RNA, 21 nt, Human
agacgggguuucacuguguug

SEQ ID NO: 310878 - RNA, 20 nt, Human
agacgggguuucacuuuguu

SEQ ID NO: 310879 - RNA, 21 nt, Human
agacgggguuucagcauauug

SEQ ID NO: 310880 - RNA, 21 nt, Human
agacgggguuucagcauguug

SEQ ID NO: 310881 - RNA, 21 nt, Human
agacgggguuucaucauguug

SEQ ID NO: 310882 - RNA, 22 nt, Human
agacgggguuucaucauguugg

SEQ ID NO: 310883 - RNA, 25 nt, Human
agacgggguuucaucauguuggcca

SEQ ID NO: 310884 - RNA, 20 nt, Human
agacgggguuucaucguguu

SEQ ID NO: 310885 - RNA, 21 nt, Human
agacgggguuucauuauguug

SEQ ID NO: 310886 - RNA, 20 nt, Human
agacgggguuucauuguguu

SEQ ID NO: 310887 - RNA, 21 nt, Human
agacgggguuuccccauguug

SEQ ID NO: 310888 - RNA, 25 nt, Human
agacgggguuuccccauguugguca

SEQ ID NO: 310889 - RNA, 20 nt, Human
agacgggguuuccccguguu

SEQ ID NO: 310890 - RNA, 21 nt, Human
agacgggguuucgccaaguug

SEQ ID NO: 310891 - RNA, 21 nt, Human
agacgggguuucgccauauug

SEQ ID NO: 310892 - RNA, 21 nt, Human
agacgggguuucgccauguug

SEQ ID NO: 310893 - RNA, 20 nt, Human
agacgggguuucgccauuug

SEQ ID NO: 310894 - RNA, 21 nt, Human
agacgggguuucgccguguug

SEQ ID NO: 310895 - RNA, 21 nt, Human
agacgggguuucgccuuguug

SEQ ID NO: 310896 - RNA, 21 nt, Human
agacgggguuucgcuauuuug

SEQ ID NO: 310897 - RNA, 21 nt, Human
agacgggguuucgcucuuguu

SEQ ID NO: 310898 - RNA, 21 nt, Human
agacgggguuucgcuguguug

SEQ ID NO: 310899 - RNA, 21 nt, Human
agacgggguuucggcauguug

SEQ ID NO: 310900 - RNA, 19 nt, Human
agacgggguuucuccaugu

SEQ ID NO: 310901 - RNA, 20 nt, Human
agacgggguuucuccauguu

SEQ ID NO: 310902 - RNA, 21 nt, Human
agacgggguuucuccauguug

SEQ ID NO: 310903 - RNA, 25 nt, Human
agacgggguuucuccauguugguca

SEQ ID NO: 310904 - RNA, 21 nt, Human
agacgggguuucuccguguug

SEQ ID NO: 310905 - RNA, 21 nt, Human
agacgggguuucuccuuguug

SEQ ID NO: 310906 - RNA, 19 nt, Human
agacgggguuucuuggcag

SEQ ID NO: 310907 - RNA, 20 nt, Human
agacgggguuugaccguguu

SEQ ID NO: 310908 - RNA, 20 nt, Human
agacgggguuugccaugcug

SEQ ID NO: 310909 - RNA, 19 nt, Human
agacgggguuugcuguguu

SEQ ID NO: 310910 - RNA, 20 nt, Human
agacgggguuuuaccauguu

SEQ ID NO: 310911 - RNA, 21 nt, Human
agacgggguuuuaccauguug

SEQ ID NO: 310912 - RNA, 25 nt, Human
agacgggguuuuaccauguuggcca

SEQ ID NO: 310913 - RNA, 20 nt, Human
agacgggguuuuaccguguu

SEQ ID NO: 310914 - RNA, 20 nt, Human
agacgggguuuugccauguu

SEQ ID NO: 310915 - RNA, 21 nt, Human
agacgggguuuugccauguug

SEQ ID NO: 310916 - RNA, 21 nt, Human
agacgggguuuugucauguug

SEQ ID NO: 310917 - RNA, 20 nt, Human
agacgggucucacuauguug

SEQ ID NO: 310918 - RNA, 24 nt, Human
agacgggucucacuauguugccca

SEQ ID NO: 310919 - RNA, 32 nt, Human
agacgggugaccuucagacaauacugugccua

SEQ ID NO: 310920 - RNA, 32 nt, Human
agacggguggcauggggagcagcuaaacaaug

SEQ ID NO: 310921 - RNA, 19 nt, Human
agacggguucaccauguug

SEQ ID NO: 310922 - RNA, 23 nt, Human
agacggguucaccauguugccca

SEQ ID NO: 310923 - RNA, 20 nt, Human
agacggguuucaccacguug

SEQ ID NO: 310924 - RNA, 24 nt, Human
agacggguuucaccacguuggcca

SEQ ID NO: 310925 - RNA, 20 nt, Human
agacggguuucaccauauug

SEQ ID NO: 310926 - RNA, 20 nt, Human
agacggguuucaccauguug

SEQ ID NO: 310927 - RNA, 21 nt, Human
agacggguuucaccauguugg

SEQ ID NO: 310928 - RNA, 24 nt, Human
agacggguuucaccauguuggcca

SEQ ID NO: 310929 - RNA, 24 nt, Human
agacggguuucaccauguugguca

SEQ ID NO: 310930 - RNA, 24 nt, Human
agacggguuucaucaugguggcca

SEQ ID NO: 310931 - RNA, 32 nt, Human
agacggguuucaucaugguggccaggaugguc

SEQ ID NO: 310932 - RNA, 19 nt, Human
agacggguuucaucauguu

SEQ ID NO: 310933 - RNA, 21 nt, Human
agacggguuuucaccauguug

SEQ ID NO: 310934 - RNA, 32 nt, Human
agacgguaucuccuccuccugccucuucuauu

SEQ ID NO: 310935 - RNA, 32 nt, Human
agacggucucaaucuaaaagcacuucaagggg

SEQ ID NO: 310936 - RNA, 32 nt, Human
agacggugccauugcucuccagccugggcgac

SEQ ID NO: 310937 - RNA, 22 nt, Human
agacggugguuucaccauguug

SEQ ID NO: 310938 - RNA, 32 nt, Human
agacggugucacugcacuccagccugggugac

SEQ ID NO: 310939 - RNA, 21 nt, Human
agacgguguuucaccauauug

SEQ ID NO: 310940 - RNA, 25 nt, Human
agacgguguuucaccauauuggcca

SEQ ID NO: 310941 - RNA, 20 nt, Human
agacgguguuucaccauguu

SEQ ID NO: 310942 - RNA, 25 nt, Human
agacgguguuucaccauguuaguca

SEQ ID NO: 310943 - RNA, 21 nt, Human
agacgguguuucaccauguug

SEQ ID NO: 310944 - RNA, 25 nt, Human
agacgguguuucaccauguuggcca

SEQ ID NO: 310945 - RNA, 25 nt, Human
agacgguguuucaccauguugguca

SEQ ID NO: 310946 - RNA, 32 nt, Human
agacgguucuucauugugucaggaugaccuuu

SEQ ID NO: 310947 - RNA, 32 nt, Human
agacgguuguuagaggggcagcucuaggcugg

SEQ ID NO: 310948 - RNA, 23 nt, Human
agacgguuucaccaugucggcca

SEQ ID NO: 310949 - RNA, 32 nt, Human
agacguagccaucuugcuccaugaagggugaa

SEQ ID NO: 310950 - RNA, 32 nt, Human
agacguaggaagacaagccacaguuguauggu

SEQ ID NO: 310951 - RNA, 32 nt, Human
agacguaucagggucacacacaccugauuuaa

SEQ ID NO: 310952 - RNA, 32 nt, Human
agacguaugcuaguuuggaaugagcuacuagg

SEQ ID NO: 310953 - RNA, 32 nt, Human
agacgucacagucuggaagugaaauguccaca

SEQ ID NO: 310954 - RNA, 32 nt, Human
agacgucaucuucuucuaaagggccgugacuc

SEQ ID NO: 310955 - RNA, 32 nt, Human
agacguccuccaggaaccccucaacgaagcug

SEQ ID NO: 310956 - RNA, 32 nt, Human
agacguccuccccuuuugaccccguuccuuca

SEQ ID NO: 310957 - RNA, 32 nt, Human
agacgucgccuccccuucauccaccucucucu

SEQ ID NO: 310958 - RNA, 32 nt, Human
agacgucuacguugaauuauucagagaauuaa

SEQ ID NO: 310959 - RNA, 32 nt, Human
agacgucuccccacucauccagccccagaucu

SEQ ID NO: 310960 - RNA, 32 nt, Human
agacgucuguaaucccagcuauucaggaggcu

SEQ ID NO: 310961 - RNA, 20 nt, Human
agacgugagccaccaugccc

SEQ ID NO: 310962 - RNA, 22 nt, Human
agacgugagccaccgcgcccgg

SEQ ID NO: 310963 - RNA, 22 nt, Human
agacgugagccaccgugcccgg

SEQ ID NO: 310964 - RNA, 22 nt, Human
agacgugagccaccgugccugg

SEQ ID NO: 310965 - RNA, 23 nt, Human
agacgugagccacugcguccggu

SEQ ID NO: 310966 - RNA, 32 nt, Human
agacgugaguccuaaccuggccacaguugggg

SEQ ID NO: 310967 - RNA, 32 nt, Human
agacgugcaggugggaguaccagguugaaacc

SEQ ID NO: 310968 - RNA, 32 nt, Human
agacgugcuuguucccccuccgccgugagaag

SEQ ID NO: 310969 - RNA, 32 nt, Human
agacguggccuugaagcccacaggguugaugg

SEQ ID NO: 310970 - RNA, 32 nt, Human
agacguggcuggagcaggagaucgccaccuac

SEQ ID NO: 310971 - RNA, 32 nt, Human
agacgugggaggaucgcuugagccugggagau

SEQ ID NO: 310972 - RNA, 23 nt, Human
agacgugggguuucaccauguug

SEQ ID NO: 310973 - RNA, 32 nt, Human
agacgugggguuucaccauguuggccagacug

SEQ ID NO: 310974 - RNA, 32 nt, Human
agacguggugugagagggacggcucacagggc

SEQ ID NO: 310975 - RNA, 32 nt, Human
agacguguagacacaaacauauacgccuagac

SEQ ID NO: 310976 - RNA, 32 nt, Human
agacguguccugcagcccucucuucuucagag

SEQ ID NO: 310977 - RNA, 32 nt, Human
agacguguuggaugcuccuguucuccgaauuc

SEQ ID NO: 310978 - RNA, 32 nt, Human
agacguuaaagaagggugaagaguaggcagaa

SEQ ID NO: 310979 - RNA, 32 nt, Human
agacguuaaagaccagccugggcaacacagca

SEQ ID NO: 310980 - RNA, 32 nt, Human
agacguucagaaguccacugaacuucugauuc

SEQ ID NO: 310981 - RNA, 32 nt, Human
agacguucccuuggugggccgcgggaccaccc

SEQ ID NO: 310982 - RNA, 32 nt, Human
agacguucuaguggagaaaauguggaaaacaa

SEQ ID NO: 310983 - RNA, 22 nt, Human
agacguugucuauccacagguu

SEQ ID NO: 310984 - RNA, 32 nt, Human
agacguuucugccucccucuuucuuccuccgc

SEQ ID NO: 310985 - RNA, 32 nt, Human
agacguuugagaccagccuggccaacauggug

SEQ ID NO: 310986 - RNA, 32 nt, Human
agacuaacacaaaauuaagaaucuuccauaau

SEQ ID NO: 310987 - RNA, 32 nt, Human
agacuaacagugugccaaacaccagcuaaacc

SEQ ID NO: 310988 - RNA, 32 nt, Human
agacuaacuuuacaacuucuauaacuuuugga

SEQ ID NO: 310989 - RNA, 32 nt, Human
agacuaagacuagguaauuacacagaggcuug

SEQ ID NO: 310990 - RNA, 32 nt, Human
agacuaagcccugucuugcugugugaugcuca

SEQ ID NO: 310991 - RNA, 32 nt, Human
agacuaagggggcagcccugccccugccuacg

SEQ ID NO: 310992 - RNA, 32 nt, Human
agacuaaugaacaaagaaaccugcucuaguuu

SEQ ID NO: 310993 - RNA, 32 nt, Human
agacuaauuauuuuauccccaucccaggguau

SEQ ID NO: 310994 - RNA, 32 nt, Human
agacuacaagcuggacagucacccaggcccaa

SEQ ID NO: 310995 - RNA, 32 nt, Human
agacuacaagugugugccaccaugccucacua

SEQ ID NO: 310996 - RNA, 32 nt, Human
agacuacagauaagcaauccaggauuucaaga

SEQ ID NO: 310997 - RNA, 32 nt, Human
agacuacagauggauaauuggacuuaagccau

SEQ ID NO: 310998 - RNA, 32 nt, Human
agacuacagaugugcaccaccacacuggcuca

SEQ ID NO: 310999 - RNA, 32 nt, Human
agacuacagauuacuuaauaacagggacuaua

SEQ ID NO: 311000 - RNA, 32 nt, Human
agacuacagcgaagaggggauccacuucccgu

SEQ ID NO: 311001 - RNA, 32 nt, Human
agacuacaggcacacaccaccacgcccagcuc

SEQ ID NO: 311002 - RNA, 32 nt, Human
agacuacaggcacacaccaccacgccuggcua

SEQ ID NO: 311003 - RNA, 32 nt, Human
agacuacaggcacgcaccaccaugccugccca

SEQ ID NO: 311004 - RNA, 32 nt, Human
agacuacaggcaugcaccaccacgcccagcua

SEQ ID NO: 311005 - RNA, 32 nt, Human
agacuacaggcgcuugccacuaugcccaacua

SEQ ID NO: 311006 - RNA, 32 nt, Human
agacuacaggcgugcaccaccaugcccguuag

SEQ ID NO: 311007 - RNA, 32 nt, Human
agacuacagggguaugccaccaugcccagcug

SEQ ID NO: 311008 - RNA, 32 nt, Human
agacuacaggguagagaaucagaggcuuguag

SEQ ID NO: 311009 - RNA, 32 nt, Human
agacuacagguaaaugguaucccugagaaaga

SEQ ID NO: 311010 - RNA, 32 nt, Human
agacuacaggugcacaccaccacaccuggcua

SEQ ID NO: 311011 - RNA, 32 nt, Human
agacuacaggugcgcaccaccaugcccagcua

SEQ ID NO: 311012 - RNA, 32 nt, Human
agacuacaggugugagccaccaugcccggccu

SEQ ID NO: 311013 - RNA, 31 nt, Human
agacuacauacuuuuuguuuaaaacaaaauu

SEQ ID NO: 311014 - RNA, 32 nt, Human
agacuaccaaaaccuggugcaucuucaacucg

SEQ ID NO: 311015 - RNA, 32 nt, Human
agacuaccucauucucacuggcucggagacuc

SEQ ID NO: 311016 - RNA, 32 nt, Human
agacuaccugggagguggagggagacaggaga

SEQ ID NO: 311017 - RNA, 32 nt, Human
agacuacgccacugcacuccagccuggaggcc

SEQ ID NO: 311018 - RNA, 32 nt, Human
agacuacuccaaagguggcuaugcuggaucau

SEQ ID NO: 311019 - RNA, 32 nt, Human
agacuacuggacuguaguagaggcauuuggaa

SEQ ID NO: 311020 - RNA, 32 nt, Human
agacuacuucagcagccacagggacgagcucc

SEQ ID NO: 311021 - RNA, 32 nt, Human
agacuacuuggugccaugggguaggggugagg

SEQ ID NO: 311022 - RNA, 32 nt, Human
agacuagagacacgcuuuacacguuuuaacaa

SEQ ID NO: 311023 - RNA, 32 nt, Human
agacuagagggagugggguugcaguggcugcc

SEQ ID NO: 311024 - RNA, 32 nt, Human
agacuagagucuugcagcaacacagaauguaa

SEQ ID NO: 311025 - RNA, 24 nt, Human
agacuagccuaggcaacacaguga

SEQ ID NO: 311026 - RNA, 32 nt, Human
agacuagccugaccaacauggagaaacccugu

SEQ ID NO: 311027 - RNA, 32 nt, Human
agacuagccugaccaacauggugaaacuaugu

SEQ ID NO: 311028 - RNA, 32 nt, Human
agacuagccugaccaacauggugaaacucugu

SEQ ID NO: 311029 - RNA, 24 nt, Human
agacuagccugggcaacauagcga

SEQ ID NO: 311030 - RNA, 32 nt, Human
agacuagcgggaagcucugccucuuuccccag

SEQ ID NO: 311031 - RNA, 20 nt, Human
agacuaggaacaaguugaua

SEQ ID NO: 311032 - RNA, 27 nt, Human
agacuaggaagaguggguacccagaga

SEQ ID NO: 311033 - RNA, 32 nt, Human
agacuaggaaguagcccucguucuccagggca

SEQ ID NO: 311034 - RNA, 32 nt, Human
agacuaggacugagagaaagaagaggagagag

SEQ ID NO: 311035 - RNA, 32 nt, Human
agacuaggccucuccccuuuaccccuccagag

SEQ ID NO: 311036 - RNA, 22 nt, Human
agacuaggcugggcaacaaagc

SEQ ID NO: 311037 - RNA, 32 nt, Human
agacuagucucaaacuccugaccucaagugau

SEQ ID NO: 311038 - RNA, 32 nt, Human
agacuagucucgaacucuugagcucaagcaau

SEQ ID NO: 311039 - RNA, 32 nt, Human
agacuagucuugaacucccgaccucaggugau

SEQ ID NO: 311040 - RNA, 32 nt, Human
agacuagucuugaacuccugaccucaggugau

SEQ ID NO: 311041 - RNA, 32 nt, Human
agacuagugcacagugcuaucuccaucuacug

SEQ ID NO: 311042 - RNA, 32 nt, Human
agacuaguggaaauccccaaauggagccaaga

SEQ ID NO: 311043 - RNA, 32 nt, Human
agacuaguuauuucccucuguaaagaagcugu

SEQ ID NO: 311044 - RNA, 32 nt, Human
agacuauaaacuauaaccacuagcucgacaca

SEQ ID NO: 311045 - RNA, 32 nt, Human
agacuauacugugucaauaucuguaaaaagag

SEQ ID NO: 311046 - RNA, 32 nt, Human
agacuauagguguggaggugaaauuacagguu

SEQ ID NO: 311047 - RNA, 32 nt, Human
agacuaucacaaagcauauauguaauauuaaa

SEQ ID NO: 311048 - RNA, 24 nt, Human
agacuauccaccuuugggucgcuu

SEQ ID NO: 311049 - RNA, 32 nt, Human
agacuauccuggagaagccucguuuugaugcc

SEQ ID NO: 311050 - RNA, 21 nt, Human
agacuaucuuuggagccgcuu

SEQ ID NO: 311051 - RNA, 32 nt, Human
agacuaugagguccacugucucugauuuaaaa

SEQ ID NO: 311052 - RNA, 32 nt, Human
agacuaugccacugcacuccagccuaggugac

SEQ ID NO: 311053 - RNA, 32 nt, Human
agacuaugccacugcacucccgccugggugac

SEQ ID NO: 311054 - RNA, 32 nt, Human
agacuauggaggcugggcagugguucaugccu

SEQ ID NO: 311055 - RNA, 32 nt, Human
agacuauguacagagacugaccucacagacug

SEQ ID NO: 311056 - RNA, 32 nt, Human
agacuaugucaucuuguucuccugccuggguu

SEQ ID NO: 311057 - RNA, 32 nt, Human
agacuauuucacacucuccaugcuuaugucaa

SEQ ID NO: 311058 - RNA, 32 nt, Human
agacuauuugcugugggcucuccuccagccug

SEQ ID NO: 311059 - RNA, 23 nt, Human
agacuauuuuuacuaaggugcuu

SEQ ID NO: 311060 - RNA, 32 nt, Human
agacucaaagcaggggccaggccaggccagug

SEQ ID NO: 311061 - RNA, 32 nt, Human
agacucaacaugagacauuccuuucugcuuuc

SEQ ID NO: 311062 - RNA, 32 nt, Human
agacucaacugccaccaguccccagcugcaga

SEQ ID NO: 311063 - RNA, 32 nt, Human
agacucaagagaauuuaugugaaaugcuuucu

SEQ ID NO: 311064 - RNA, 32 nt, Human
agacucaagcccugaccuuugcagccucccug

SEQ ID NO: 311065 - RNA, 32 nt, Human
agacucacagcaacucuccauuauagcuuuca

SEQ ID NO: 311066 - RNA, 32 nt, Human
agacucacagcagugagcaguccugggggccc

SEQ ID NO: 311067 - RNA, 32 nt, Human
agacucacagccccguccgcagagaagcaaag

SEQ ID NO: 311068 - RNA, 32 nt, Human
agacucacccacccucucccucucccuucagc

SEQ ID NO: 311069 - RNA, 32 nt, Human
agacucaccgcgggcccaugcccgguuuggca

SEQ ID NO: 311070 - RNA, 32 nt, Human
agacucacugcaaccuccaccuccuguguuca

SEQ ID NO: 311071 - RNA, 32 nt, Human
agacucacugcaaguuccugcccaggaggcug

SEQ ID NO: 311072 - RNA, 32 nt, Human
agacucacuuccucaucucccuguccucugag

SEQ ID NO: 311073 - RNA, 32 nt, Human
agacucagaaaugcugcagugaaaauaauucc

SEQ ID NO: 311074 - RNA, 32 nt, Human
agacucagagcaagucaccccuuuguacugaa

SEQ ID NO: 311075 - RNA, 32 nt, Human
agacucagaggacccaccugggccaaggacuc

SEQ ID NO: 311076 - RNA, 32 nt, Human
agacucagagggaaggcucucuggucuaccug

SEQ ID NO: 311077 - RNA, 32 nt, Human
agacucagagggcuggauuuugguucccuugu

SEQ ID NO: 311078 - RNA, 32 nt, Human
agacucagagugccuucuccaucccagugucc

SEQ ID NO: 311079 - RNA, 32 nt, Human
agacucagcaccaagcaggggucaggcccugg

SEQ ID NO: 311080 - RNA, 32 nt, Human
agacucagcccagacccuggcucacagggaag

SEQ ID NO: 311081 - RNA, 32 nt, Human
agacucagcuccuggugaagcucccagccauc

SEQ ID NO: 311082 - RNA, 32 nt, Human
agacucaggagaauggcaaaacccaauccaag

SEQ ID NO: 311083 - RNA, 32 nt, Human
agacucaggcccagaguccucaggacauauca

SEQ ID NO: 311084 - RNA, 22 nt, Human
agacucaggggucacccagagg

SEQ ID NO: 311085 - RNA, 32 nt, Human
agacucaggugccuccgcccuccugagagcag

SEQ ID NO: 311086 - RNA, 32 nt, Human
agacucagguuggcugaauaagaaggaugaca

SEQ ID NO: 311087 - RNA, 32 nt, Human
agacucagucccagccucuccccucuacaacu

SEQ ID NO: 311088 - RNA, 32 nt, Human
agacucagucugcgucaucagagaccaggcuc

SEQ ID NO: 311089 - RNA, 32 nt, Human
agacucagugcacuguccuccucccagcgacc

SEQ ID NO: 311090 - RNA, 32 nt, Human
agacucaguucugccagguauaagccgugugg

SEQ ID NO: 311091 - RNA, 23 nt, Human
agacucauaaggcuaaaagguca

SEQ ID NO: 311092 - RNA, 32 nt, Human
agacucauccuguggucauuuccccagugcca

SEQ ID NO: 311093 - RNA, 32 nt, Human
agacucauggaacugaagggaccuuagcaauc

SEQ ID NO: 311094 - RNA, 32 nt, Human
agacucaugggcaagaucuuucaggcuuccua

SEQ ID NO: 311095 - RNA, 32 nt, Human
agacucaugugagacuucccucuggaugacca

SEQ ID NO: 311096 - RNA, 32 nt, Human
agacucauuucuccccucccauuuucuccuca

SEQ ID NO: 311097 - RNA, 32 nt, Human
agacuccagagacuggagcagcugugggccac

SEQ ID NO: 311098 - RNA, 32 nt, Human
agacuccagcagaguuggggcuggaacuuggc

SEQ ID NO: 311099 - RNA, 32 nt, Human
agacuccagccaccccucuugggcucucuacu

SEQ ID NO: 311100 - RNA, 32 nt, Human
agacuccagcgguggugcucuaccugcacgcu

SEQ ID NO: 311101 - RNA, 32 nt, Human
agacuccagcuucauagacuccucuguaucac

SEQ ID NO: 311102 - RNA, 32 nt, Human
agacuccaggaccccgccaccauguucccgga

SEQ ID NO: 311103 - RNA, 32 nt, Human
agacuccaggagggaggcugcuguguggggaa

SEQ ID NO: 311104 - RNA, 32 nt, Human
agacuccaucacuuucagcuggaguuacaaac

SEQ ID NO: 311105 - RNA, 32 nt, Human
agacuccaugccuucucucucccugcaaagaa

SEQ ID NO: 311106 - RNA, 32 nt, Human
agacuccauggcccaauucgguuucuucggug

SEQ ID NO: 311107 - RNA, 32 nt, Human
agacucccaaagugcugggauuacagguguga

SEQ ID NO: 311108 - RNA, 32 nt, Human
agacucccaaagugcugggauuauagggauga

SEQ ID NO: 311109 - RNA, 32 nt, Human
agacucccaaauagcuaugauuacaggcaccc

SEQ ID NO: 311110 - RNA, 32 nt, Human
agacucccaaggugcugagauuacaggccuga

SEQ ID NO: 311111 - RNA, 32 nt, Human
agacucccagaacuugugucacagggcugcag

SEQ ID NO: 311112 - RNA, 32 nt, Human
agacuccccaguagcugggacuacaggcgccc

SEQ ID NO: 311113 - RNA, 32 nt, Human
agacucccgaauagcugggauuacagacaggc

SEQ ID NO: 311114 - RNA, 32 nt, Human
agacucccgaguagcugggacuacaggcacac

SEQ ID NO: 311115 - RNA, 32 nt, Human
agacucccgaguagcugggauuacaggcacau

SEQ ID NO: 311116 - RNA, 32 nt, Human
agacucccgaugucacaggcagucuguguggu

SEQ ID NO: 311117 - RNA, 20 nt, Human
agacucccuccagcccccca

SEQ ID NO: 311118 - RNA, 32 nt, Human
agacucccuccuccuccaaaucugggcugggu

SEQ ID NO: 311119 - RNA, 32 nt, Human
agacucccugcaccaggcccuaggaggccucu

SEQ ID NO: 311120 - RNA, 32 nt, Human
agacucccugggaccuagaggcuggcaaaugu

SEQ ID NO: 311121 - RNA, 32 nt, Human
agacuccgcuuuggcaccucugcuccggcugg

SEQ ID NO: 311122 - RNA, 32 nt, Human
agacuccgggcuugagcccaggccucccgcac

SEQ ID NO: 311123 - RNA, 32 nt, Human
agacuccggguuguccuguucuuucugggcuu

SEQ ID NO: 311124 - RNA, 32 nt, Human
agacuccgucuccaaaaacaaacaaacaaaaa

SEQ ID NO: 311125 - RNA, 32 nt, Human
agacuccuaaaaggaggguuucuuuccugaag

SEQ ID NO: 311126 - RNA, 32 nt, Human
agacuccuaaguagcugggauuacaggcaccu

SEQ ID NO: 311127 - RNA, 32 nt, Human
agacuccuaccaggccuugucacugcagagcc

SEQ ID NO: 311128 - RNA, 32 nt, Human
agacuccuagacucacuuguucucacugucug

SEQ ID NO: 311129 - RNA, 32 nt, Human
agacuccuauuuuccuuucuguuuucaggccu

SEQ ID NO: 311130 - RNA, 19 nt, Human
agacuccucccgccugccu

SEQ ID NO: 311131 - RNA, 32 nt, Human
agacuccuccuccaaaggcccccuacgccaau

SEQ ID NO: 311132 - RNA, 32 nt, Human
agacuccucuaggcucuccaucuuucccuuga

SEQ ID NO: 311133 - RNA, 32 nt, Human
agacuccucuagguugauauccugggccagag

SEQ ID NO: 311134 - RNA, 32 nt, Human
agacuccucugcguggagagggugggugcagg

SEQ ID NO: 311135 - RNA, 32 nt, Human
agacuccucuggagaagggugagaagguggag

SEQ ID NO: 311136 - RNA, 32 nt, Human
agacuccugagaucgccucccucccagcaugc

SEQ ID NO: 311137 - RNA, 32 nt, Human
agacuccugaguagcugggauuacaggcaugu

SEQ ID NO: 311138 - RNA, 32 nt, Human
agacuccugaguaucugggaccacaggugugc

SEQ ID NO: 311139 - RNA, 32 nt, Human
agacuccugcagcagucgaccaagcccaagga

SEQ ID NO: 311140 - RNA, 32 nt, Human
agacuccugccugcccucugccgaugcugccu

SEQ ID NO: 311141 - RNA, 32 nt, Human
agacuccugcguagcugggaccacagggguau

SEQ ID NO: 311142 - RNA, 19 nt, Human
agacuccuggguucaagca

SEQ ID NO: 311143 - RNA, 20 nt, Human
agacuccugucucuacaaaa

SEQ ID NO: 311144 - RNA, 32 nt, Human
agacuccuugaggaacacaggaaaaggucuuc

SEQ ID NO: 311145 - RNA, 32 nt, Human
agacucgaguuguuagggcugaggaaccaauc

SEQ ID NO: 311146 - RNA, 32 nt, Human
agacucgccuccgagaggaggaagggacagac

SEQ ID NO: 311147 - RNA, 32 nt, Human
agacucgcgcuggcuccagucucuccacgauu

SEQ ID NO: 311148 - RNA, 22 nt, Human
agacucgcggacaacacagcga

SEQ ID NO: 311149 - RNA, 32 nt, Human
agacucgcuggcagagacugggcagaugugag

SEQ ID NO: 311150 - RNA, 32 nt, Human
agacucgcuugaaccugggagguggagguugc

SEQ ID NO: 311151 - RNA, 32 nt, Human
agacucggauuaucaaugcagagaaaucugaa

SEQ ID NO: 311152 - RNA, 32 nt, Human
agacucgggucauccuuccucccauaacuucu

SEQ ID NO: 311153 - RNA, 21 nt, Human
agacucgguuucaccauguug

SEQ ID NO: 311154 - RNA, 25 nt, Human
agacucgguuucaccauguugguca

SEQ ID NO: 311155 - RNA, 32 nt, Human
agacucuacugggaugccccucuggcuggugg

SEQ ID NO: 311156 - RNA, 32 nt, Human
agacucucacugaaagcugcuauuuucauccu

SEQ ID NO: 311157 - RNA, 32 nt, Human
agacucucacugugucacccaggcuggagugc

SEQ ID NO: 311158 - RNA, 32 nt, Human
agacucucagaagaaccuggaguaauugugcc

SEQ ID NO: 311159 - RNA, 32 nt, Human
agacucucagcaucugcugcccugaucacaga

SEQ ID NO: 311160 - RNA, 32 nt, Human
agacucuccagccugggaacuauaacuccucu

SEQ ID NO: 311161 - RNA, 32 nt, Human
agacucucgcaucuucccaaccccuuaagccc

SEQ ID NO: 311162 - RNA, 32 nt, Human
agacucucgcugucccugugcugcugguauuu

SEQ ID NO: 311163 - RNA, 32 nt, Human
agacucugagauguggagacugauggccaggc

SEQ ID NO: 311164 - RNA, 32 nt, Human
agacucugagauucacaaucagcagcucuaaa

SEQ ID NO: 311165 - RNA, 32 nt, Human
agacucugagguuuugcagcacuugcugugcc

SEQ ID NO: 311166 - RNA, 32 nt, Human
agacucugagucugauuacgaaaaguacucua

SEQ ID NO: 311167 - RNA, 32 nt, Human
agacucugauucuccucuucagccucucaucu

SEQ ID NO: 311168 - RNA, 32 nt, Human
agacucugcccuuuuccaggcaccgcccacac

SEQ ID NO: 311169 - RNA, 32 nt, Human
agacucugcuguuuacagcuuugaggccuugg

SEQ ID NO: 311170 - RNA, 32 nt, Human
agacucugcuugaccgaugaccaauaauuauu

SEQ ID NO: 311171 - RNA, 32 nt, Human
agacucugcuuucaaagggcuucugugauuag

SEQ ID NO: 311172 - RNA, 32 nt, Human
agacucuguaaccaccucucugucuuuuuccu

SEQ ID NO: 311173 - RNA, 32 nt, Human
agacucugucuccaaaaacaaaaacaaaaacu

SEQ ID NO: 311174 - RNA, 19 nt, Human
agacucugucucuacaaaa

SEQ ID NO: 311175 - RNA, 32 nt, Human
agacucuuaaugauccagcaaguuugggaaau

SEQ ID NO: 311176 - RNA, 32 nt, Human
agacucuucucaaacuguccuuaugugagugc

SEQ ID NO: 311177 - RNA, 32 nt, Human
agacucuuggucgcagaacuuggcuuuccgcu

SEQ ID NO: 311178 - RNA, 32 nt, Human
agacucuugguugaccguugugguccuuagaa

SEQ ID NO: 311179 - RNA, 32 nt, Human
agacucuugugcugguugcaggccaaguggac

SEQ ID NO: 311180 - RNA, 32 nt, Human
agacucuuuaacacccuuaggaccucaggcca

SEQ ID NO: 311181 - RNA, 32 nt, Human
agacucuuucuucacuacguguucacaggcug

SEQ ID NO: 311182 - RNA, 32 nt, Human
agacugaaaaacuguugguucauccagaagug

SEQ ID NO: 311183 - RNA, 32 nt, Human
agacugaaaacuaaagccugcagagaccucug

SEQ ID NO: 311184 - RNA, 32 nt, Human
agacugaaaaggagguccguucagcuccgccu

SEQ ID NO: 311185 - RNA, 32 nt, Human
agacugaaaaggggguuugaggagaagaugcu

SEQ ID NO: 311186 - RNA, 32 nt, Human
agacugaaagaguagaagauaaggagaaaagu

SEQ ID NO: 311187 - RNA, 32 nt, Human
agacugaaccauuggaaacauuuaacucagac

SEQ ID NO: 311188 - RNA, 32 nt, Human
agacugaaccucuguugccagagaugcugaag

SEQ ID NO: 311189 - RNA, 32 nt, Human
agacugaacuacacaccaaggaucuuguucaa

SEQ ID NO: 311190 - RNA, 32 nt, Human
agacugaacugcuuccucuuuccuucagcuau

SEQ ID NO: 311191 - RNA, 32 nt, Human
agacugaagaggcuggagugcaguggcgcaau

SEQ ID NO: 311192 - RNA, 32 nt, Human
agacugaagccauggcgauucuuuuugcuguu

SEQ ID NO: 311193 - RNA, 32 nt, Human
agacugaagcuacagucucaucuucacuuucu

SEQ ID NO: 311194 - RNA, 32 nt, Human
agacugaaugaauuugaaaggguggggccaaa

SEQ ID NO: 311195 - RNA, 22 nt, Human
agacugaauggugacccaggga

SEQ ID NO: 311196 - RNA, 32 nt, Human
agacugacagacuucaaggaugcagcugcuac

SEQ ID NO: 311197 - RNA, 32 nt, Human
agacugacagccagggcaggggaggagggagg

SEQ ID NO: 311198 - RNA, 32 nt, Human
agacugaccagaguugaaaucuggcuucuccg

SEQ ID NO: 311199 - RNA, 32 nt, Human
agacugaccagugcccugauucauuuacauau

SEQ ID NO: 311200 - RNA, 32 nt, Human
agacugacccacugcauuccagccuggcgaca

SEQ ID NO: 311201 - RNA, 32 nt, Human
agacugacccuugaggcacacuugcacuggag

SEQ ID NO: 311202 - RNA, 32 nt, Human
agacugaccuugaauucagccuggguguucag

SEQ ID NO: 311203 - RNA, 32 nt, Human
agacugacugcucugcaaaccccagccgagga

SEQ ID NO: 311204 - RNA, 32 nt, Human
agacugagaagagagccagccacgccaugcug

SEQ ID NO: 311205 - RNA, 18 nt, Human
agacugagaccauccugg

SEQ ID NO: 311206 - RNA, 32 nt, Human
agacugagaggaagaaggcagugcuggaggug

SEQ ID NO: 311207 - RNA, 32 nt, Human
agacugagagggaggugccggagccagggaca

SEQ ID NO: 311208 - RNA, 21 nt, Human
agacugagcaggcgccggaga

SEQ ID NO: 311209 - RNA, 32 nt, Human
agacugagccacugcacuccagccugggcaau

SEQ ID NO: 311210 - RNA, 32 nt, Human
agacugagcccccugucuccuccaucauuugg

SEQ ID NO: 311211 - RNA, 32 nt, Human
agacugagcgaugacaccacacuuuguuugga

SEQ ID NO: 311212 - RNA, 32 nt, Human
agacugagcugggacccccacagccauccgcu

SEQ ID NO: 311213 - RNA, 32 nt, Human
agacugaggaagagugaucaggaaagcauagg

SEQ ID NO: 311214 - RNA, 32 nt, Human
agacugaggaauccucuuucugccucccauuu

SEQ ID NO: 311215 - RNA, 32 nt, Human
agacugaggagaaugauagagagugaagcaga

SEQ ID NO: 311216 - RNA, 32 nt, Human
agacugaggaggggucaccugaggucaggaug

SEQ ID NO: 311217 - RNA, 32 nt, Human
agacugaggcaggagaaugauuugaaccuagg

SEQ ID NO: 311218 - RNA, 18 nt, Human
agacugaggcaggccagg

SEQ ID NO: 311219 - RNA, 32 nt, Human
agacugaggcugguauuuugcauugcaaugga

SEQ ID NO: 311220 - RNA, 32 nt, Human
agacugagggagcaacaauguggaaagggaag

SEQ ID NO: 311221 - RNA, 32 nt, Human
agacugaggggaaagagaggagagaaagaaaa

SEQ ID NO: 311222 - RNA, 32 nt, Human
agacugaggugaccuucaggaagcacugcaga

SEQ ID NO: 311223 - RNA, 32 nt, Human
agacugagucucccuucucaguuucauuaggu

SEQ ID NO: 311224 - RNA, 32 nt, Human
agacugagucucucccuguugcccaaguugga

SEQ ID NO: 311225 - RNA, 32 nt, Human
agacugaguggcaggccuccuccugagggcag

SEQ ID NO: 311226 - RNA, 32 nt, Human
agacugagugugaaggagagaggacacagggg

SEQ ID NO: 311227 - RNA, 32 nt, Human
agacugaucuugaacuccugacaucaggugau

SEQ ID NO: 311228 - RNA, 32 nt, Human
agacugaucuugaacuccugacgucaggugau

SEQ ID NO: 311229 - RNA, 32 nt, Human
agacugaucuugagcuucugagcuccagcgau

SEQ ID NO: 311230 - RNA, 32 nt, Human
agacugauggaaguuagagagguggaggaggc

SEQ ID NO: 311231 - RNA, 32 nt, Human
agacugauucuuccaccuacuuuuaugaaccu

SEQ ID NO: 311232 - RNA, 32 nt, Human
agacugauugcaccugggacccaggcccuuuc

SEQ ID NO: 311233 - RNA, 32 nt, Human
agacugauuucggccuccugaccucgggaccc

SEQ ID NO: 311234 - RNA, 32 nt, Human
agacugcaacacugcucaucaccccgcggcgu

SEQ ID NO: 311235 - RNA, 24 nt, Human
agacugcaauagaaaacucccaaa

SEQ ID NO: 311236 - RNA, 32 nt, Human
agacugcacaaacuaccgcgggcuccuccgcc

SEQ ID NO: 311237 - RNA, 32 nt, Human
agacugcaccacugcacuccagccugggcaac

SEQ ID NO: 311238 - RNA, 32 nt, Human
agacugcaccacugcacuucagccugggugac

SEQ ID NO: 311239 - RNA, 32 nt, Human
agacugcaccauugcauuccagccugggcaac

SEQ ID NO: 311240 - RNA, 18 nt, Human
agacugcagaaacagaga

SEQ ID NO: 311241 - RNA, 32 nt, Human
agacugcagaccagugcuucacuguguggagu

SEQ ID NO: 311242 - RNA, 19 nt, Human
agacugcagagagcaggga

SEQ ID NO: 311243 - RNA, 21 nt, Human
agacugcagagauuuacagag

SEQ ID NO: 311244 - RNA, 20 nt, Human
agacugcagagggcuagaga

SEQ ID NO: 311245 - RNA, 32 nt, Human
agacugcagcagagugaggagugagggcagcu

SEQ ID NO: 311246 - RNA, 21 nt, Human
agacugcaggguccccaagga

SEQ ID NO: 311247 - RNA, 32 nt, Human
agacugcaguaagccaagaucaugccacugca

SEQ ID NO: 311248 - RNA, 32 nt, Human
agacugcagugagccgagaucacaccacugca

SEQ ID NO: 311249 - RNA, 32 nt, Human
agacugcagugagccgagaucgcaccacugca

SEQ ID NO: 311250 - RNA, 32 nt, Human
agacugcagugagccgagauugugccacugca

SEQ ID NO: 311251 - RNA, 32 nt, Human
agacugcaguucccuccccacccucuacccag

SEQ ID NO: 311252 - RNA, 31 nt, Human
agacugcaguuucuucacagaucucaggaag

SEQ ID NO: 311253 - RNA, 32 nt, Human
agacugcauacagaucucuuuauuucuauuau

SEQ ID NO: 311254 - RNA, 32 nt, Human
agacugcaugcuggagagaaacuugaagaacg

SEQ ID NO: 311255 - RNA, 32 nt, Human
agacugccagccaccacccccucccagacucu

SEQ ID NO: 311256 - RNA, 22 nt, Human
agacugccaggcccucccaggg

SEQ ID NO: 311257 - RNA, 32 nt, Human
agacugcccacucugaacaucuuccuauauug

SEQ ID NO: 311258 - RNA, 32 nt, Human
agacugccguguccuccgagcacuuuguuuuc

SEQ ID NO: 311259 - RNA, 32 nt, Human
agacugcgccaccacaaaacagccuuagccuc

SEQ ID NO: 311260 - RNA, 32 nt, Human
agacugcgccaccgcgcuccagccugggugac

SEQ ID NO: 311261 - RNA, 32 nt, Human
agacugcgccacggcacuccagccugggcgac

SEQ ID NO: 311262 - RNA, 32 nt, Human
agacugcgccacugcacuccagccugggcaac

SEQ ID NO: 311263 - RNA, 32 nt, Human
agacugcgccauugcacuccagcccgggcaac

SEQ ID NO: 311264 - RNA, 19 nt, Human
agacugcgcccugggaagg

SEQ ID NO: 311265 - RNA, 32 nt, Human
agacugcggcuuguugaggugcaauacccuga

SEQ ID NO: 311266 - RNA, 32 nt, Human
agacugcgggaggcaggggaugcauggguguc

SEQ ID NO: 311267 - RNA, 31 nt, Human
agacugcgugagagaaaacagcugugauuua

SEQ ID NO: 311268 - RNA, 32 nt, Human
agacugcucagggcuauccucucagagugaca

SEQ ID NO: 311269 - RNA, 32 nt, Human
agacugcucauccccucuuccuuucuuguccu

SEQ ID NO: 311270 - RNA, 32 nt, Human
agacugcugcacgggugagcucggugagaagg

SEQ ID NO: 311271 - RNA, 32 nt, Human
agacugcugucucucugcuacagcuucuuggc

SEQ ID NO: 311272 - RNA, 32 nt, Human
agacugcuucgccccuagccucagcuuuucag

SEQ ID NO: 311273 - RNA, 32 nt, Human
agacuggaaugcagcaguacugccuucaggcc

SEQ ID NO: 311274 - RNA, 22 nt, Human
agacuggaauguuugugauauc

SEQ ID NO: 311275 - RNA, 22 nt, Human
agacuggacaaagggggucaca

SEQ ID NO: 311276 - RNA, 21 nt, Human
agacuggaccucaggcugcug

SEQ ID NO: 311277 - RNA, 32 nt, Human
agacuggacucgaccgaacugaaggaagggac

SEQ ID NO: 311278 - RNA, 32 nt, Human
agacuggagaggguggggaggggcccagcggc

SEQ ID NO: 311279 - RNA, 32 nt, Human
agacuggagauaagcauuggaggcucuuuuaa

SEQ ID NO: 311280 - RNA, 32 nt, Human
agacuggagauguagaggcugaagugagcugu

SEQ ID NO: 311281 - RNA, 32 nt, Human
agacuggagcaaaauucagcuugaaugaacag

SEQ ID NO: 311282 - RNA, 32 nt, Human
agacuggagccaagugcgcugagcucucacau

SEQ ID NO: 311283 - RNA, 32 nt, Human
agacuggaggcugaaggagaacuucaauauca

SEQ ID NO: 311284 - RNA, 22 nt, Human
agacuggaggggaugacaguca

SEQ ID NO: 311285 - RNA, 32 nt, Human
agacuggcaaggaggcucaggugcuuccaucu

SEQ ID NO: 311286 - RNA, 32 nt, Human
agacuggcaugggggacauuccugacgucaag

SEQ ID NO: 311287 - RNA, 20 nt, Human
agacuggcaugguggcaugc

SEQ ID NO: 311288 - RNA, 32 nt, Human
agacuggccaacagaaugaaacccugucucua

SEQ ID NO: 311289 - RNA, 31 nt, Human
agacuggcccacguccccaugccugggugcu

SEQ ID NO: 311290 - RNA, 32 nt, Human
agacuggcccugccacugacccuccugucccu

SEQ ID NO: 311291 - RNA, 32 nt, Human
agacuggcccugccuaaccucuaccaucaaug

SEQ ID NO: 311292 - RNA, 32 nt, Human
agacuggcccuuccagagacagugccaaccag

SEQ ID NO: 311293 - RNA, 32 nt, Human
agacuggccuuugacacauggacucugccuag

SEQ ID NO: 311294 - RNA, 32 nt, Human
agacuggcgauacuacaaaggucuccagggcc

SEQ ID NO: 311295 - RNA, 32 nt, Human
agacuggcuacuguauguaauguauuuaugua

SEQ ID NO: 311296 - RNA, 32 nt, Human
agacuggcucuggccucagguggggcgcagga

SEQ ID NO: 311297 - RNA, 32 nt, Human
agacuggcuugggcuccaggagggaggcuggg

SEQ ID NO: 311298 - RNA, 20 nt, Human
agacugggacagcccaggaa

SEQ ID NO: 311299 - RNA, 32 nt, Human
agacugggagccacuugaggcuaucauuucag

SEQ ID NO: 311300 - RNA, 32 nt, Human
agacugggagccugaucccaagaggcugcuga

SEQ ID NO: 311301 - RNA, 26 nt, Human
agacugggaggcagagguugcaguga

SEQ ID NO: 311302 - RNA, 32 nt, Human
agacugggaggcagagguugcagugaaccgag

SEQ ID NO: 311303 - RNA, 32 nt, Human
agacugggauucaccacucagaaugggggucc

SEQ ID NO: 311304 - RNA, 32 nt, Human
agacugggcauggugacucaugccuguuaucc

SEQ ID NO: 311305 - RNA, 32 nt, Human
agacugggccacugcacuccagccuggaugac

SEQ ID NO: 311306 - RNA, 32 nt, Human
agacugggcccaugaacacagagagggccuaa

SEQ ID NO: 311307 - RNA, 32 nt, Human
agacugggcuagggagaaugcagagagguuuc

SEQ ID NO: 311308 - RNA, 32 nt, Human
agacugggcugcaggccccaggaagacuuucc

SEQ ID NO: 311309 - RNA, 32 nt, Human
agacugggcuguaguuagcuuuucaucccuaa

SEQ ID NO: 311310 - RNA, 32 nt, Human
agacugggcuuccaauggggaggaggaaagau

SEQ ID NO: 311311 - RNA, 32 nt, Human
agacuggggaaauggacgccuggagaacggaa

SEQ ID NO: 311312 - RNA, 32 nt, Human
agacuggggagcuucacacaacagaaacugcc

SEQ ID NO: 311313 - RNA, 32 nt, Human
agacuggggccagccacacuacucucuaggcc

SEQ ID NO: 311314 - RNA, 32 nt, Human
agacuggggcugucaacgcugccccuuguccu

SEQ ID NO: 311315 - RNA, 20 nt, Human
agacugggggacuccgggaa

SEQ ID NO: 311316 - RNA, 22 nt, Human
agacugggguuucuccauguug

SEQ ID NO: 311317 - RNA, 21 nt, Human
agacuggguagaaaccccagg

SEQ ID NO: 311318 - RNA, 32 nt, Human
agacugggugacagagugagacuccaucucaa

SEQ ID NO: 311319 - RNA, 32 nt, Human
agacuggguuccaaucucaccccaccacauac

SEQ ID NO: 311320 - RNA, 21 nt, Human
agacuggguuucaccacguug

SEQ ID NO: 311321 - RNA, 25 nt, Human
agacuggguuucaccacguuggcca

SEQ ID NO: 311322 - RNA, 19 nt, Human
agacuggguuucaccaugu

SEQ ID NO: 311323 - RNA, 21 nt, Human
agacuggguuucaccauguug

SEQ ID NO: 311324 - RNA, 25 nt, Human
agacuggguuucaccauguugguca

SEQ ID NO: 311325 - RNA, 20 nt, Human
agacuggguuucaccguguu

SEQ ID NO: 311326 - RNA, 32 nt, Human
agacugguagcggggagggggcuuccagguca

SEQ ID NO: 311327 - RNA, 23 nt, Human
agacuggucucaaacuccuaacc

SEQ ID NO: 311328 - RNA, 23 nt, Human
agacuggucucaaacuccugacc

SEQ ID NO: 311329 - RNA, 32 nt, Human
agacuggucucaaacuccugaccucagaugau

SEQ ID NO: 311330 - RNA, 32 nt, Human
agacuggucucaaacuccugaccucaggcgau

SEQ ID NO: 311331 - RNA, 23 nt, Human
agacuggucucaaacuccuggcc

SEQ ID NO: 311332 - RNA, 32 nt, Human
agacuggucucaaacuccuggccucaagcaau

SEQ ID NO: 311333 - RNA, 32 nt, Human
agacuggucucaaacuccuggccucgagucau

SEQ ID NO: 311334 - RNA, 32 nt, Human
agacuggucucaaacuccugggcucaagcgau

SEQ ID NO: 311335 - RNA, 32 nt, Human
agacuggucucaaacuucugaccucaagugau

SEQ ID NO: 311336 - RNA, 32 nt, Human
agacuggucuccaacuccugaccucagauggu

SEQ ID NO: 311337 - RNA, 32 nt, Human
agacuggucucgaacuccugaccucaagugau

SEQ ID NO: 311338 - RNA, 32 nt, Human
agacuggucucgaacuccugaccucaggugau

SEQ ID NO: 311339 - RNA, 32 nt, Human
agacuggucucgaacuccugaccuugugaucc

SEQ ID NO: 311340 - RNA, 32 nt, Human
agacuggucucgaacuccuggccucaagcacu

SEQ ID NO: 311341 - RNA, 32 nt, Human
agacuggucucgaacuccuggccucaagccac

SEQ ID NO: 311342 - RNA, 32 nt, Human
agacuggucucgaacuccuggccucaagugau

SEQ ID NO: 311343 - RNA, 32 nt, Human
agacuggucucgaacuccuggcuacaagugau

SEQ ID NO: 311344 - RNA, 32 nt, Human
agacuggucucgaacuccugggcucaaacagu

SEQ ID NO: 311345 - RNA, 32 nt, Human
agacuggucucgaacucuuggccucaggugau

SEQ ID NO: 311346 - RNA, 32 nt, Human
agacuggucuucauccugccucaugacuccca

SEQ ID NO: 311347 - RNA, 32 nt, Human
agacuggucuucuacacuaagacaccaugaag

SEQ ID NO: 311348 - RNA, 32 nt, Human
agacuggucuugaacucccgaccucagguaau

SEQ ID NO: 311349 - RNA, 32 nt, Human
agacuggucuugaacuccuagguugaagggau

SEQ ID NO: 311350 - RNA, 32 nt, Human
agacuggucuugaacuccugaccucaagcaau

SEQ ID NO: 311351 - RNA, 32 nt, Human
agacuggucuugaacuccugaccucgugauac

SEQ ID NO: 311352 - RNA, 32 nt, Human
agacuggucuugaacuccugagcuuaagcaau

SEQ ID NO: 311353 - RNA, 32 nt, Human
agacuggucuugaacuccuggacucaagggau

SEQ ID NO: 311354 - RNA, 32 nt, Human
agacuggucuugaacuccugggcucaagcgau

SEQ ID NO: 311355 - RNA, 32 nt, Human
agacuggucuugaacuccugggcucaagugau

SEQ ID NO: 311356 - RNA, 32 nt, Human
agacuggucuugaacucuugaccucaggugau

SEQ ID NO: 311357 - RNA, 32 nt, Human
agacuggucuuggacuccugaccucgugaucc

SEQ ID NO: 311358 - RNA, 32 nt, Human
agacuggugaauugggggaaauagaaggaacu

SEQ ID NO: 311359 - RNA, 32 nt, Human
agacugguggacaucugacugugggaugugcu

SEQ ID NO: 311360 - RNA, 32 nt, Human
agacuggugggaucauaggagccuucugaaug

SEQ ID NO: 311361 - RNA, 24 nt, Human
agacugguuaaugacaacgaugca

SEQ ID NO: 311362 - RNA, 24 nt, Human
agacugguuaaugauaacaaugca

SEQ ID NO: 311363 - RNA, 24 nt, Human
agacugguuaaugauaauaaugca

SEQ ID NO: 311364 - RNA, 20 nt, Human
agacugguuagugaugcagu

SEQ ID NO: 311365 - RNA, 26 nt, Human
agacugguugcuuucuaugacaguca

SEQ ID NO: 311366 - RNA, 23 nt, Human
agacugguuggaagcugacugca

SEQ ID NO: 311367 - RNA, 20 nt, Human
agacugguuucuccauguug

SEQ ID NO: 311368 - RNA, 24 nt, Human
agacugguuucuccauguugguca

SEQ ID NO: 311369 - RNA, 32 nt, Human
agacugguuuugaacuccuggccucaggugau

SEQ ID NO: 311370 - RNA, 32 nt, Human
agacuguacacccaagaaagcaaaauggaaua

SEQ ID NO: 311371 - RNA, 32 nt, Human
agacuguaugugugugccuugcacacacaccc

SEQ ID NO: 311372 - RNA, 32 nt, Human
agacugucacugcacauggaccucugggaaga

SEQ ID NO: 311373 - RNA, 32 nt, Human
agacugucagcuuucagucucuuuugauggac

SEQ ID NO: 311374 - RNA, 32 nt, Human
agacugucauucuuaguuugcugccagggcuu

SEQ ID NO: 311375 - RNA, 32 nt, Human
agacuguccagccauaaaauguuaccaccuua

SEQ ID NO: 311376 - RNA, 32 nt, Human
agacuguccaggacuguucccaggaagaagca

SEQ ID NO: 311377 - RNA, 32 nt, Human
agacuguccaguucuccuccacaucucccauc

SEQ ID NO: 311378 - RNA, 32 nt, Human
agacuguccgaaggagggagaggaugggugcc

SEQ ID NO: 311379 - RNA, 19 nt, Human
agacugucucacuauguug

SEQ ID NO: 311380 - RNA, 32 nt, Human
agacugucucacuauguugcccaagcuggucu

SEQ ID NO: 311381 - RNA, 25 nt, Human
agacugucucacuuuguagucacuu

SEQ ID NO: 311382 - RNA, 18 nt, Human
agacugucuguauuauua

SEQ ID NO: 311383 - RNA, 32 nt, Human
agacugugaugacugccagcacagggcaucuc

SEQ ID NO: 311384 - RNA, 32 nt, Human
agacugugauuuuugaacuuccuugccuuucu

SEQ ID NO: 311385 - RNA, 32 nt, Human
agacugugccacugcacuccagccugggcaac

SEQ ID NO: 311386 - RNA, 32 nt, Human
agacugugccacugcacuccagccugggugac

SEQ ID NO: 311387 - RNA, 32 nt, Human
agacugugccacugcaguccagccugggugac

SEQ ID NO: 311388 - RNA, 32 nt, Human
agacugugccauugcacuccagucggguuaac

SEQ ID NO: 311389 - RNA, 32 nt, Human
agacugugcuacugcacuccagccugggcaac

SEQ ID NO: 311390 - RNA, 32 nt, Human
agacuguggaaaugccaaaccaagcaaauuag

SEQ ID NO: 311391 - RNA, 32 nt, Human
agacuguggagcaacuggaacucucauucccu

SEQ ID NO: 311392 - RNA, 32 nt, Human
agacuguggcccagaccccagagcagagaaac

SEQ ID NO: 311393 - RNA, 32 nt, Human
agacuguggugaaacuccuuccaaggcugagg

SEQ ID NO: 311394 - RNA, 32 nt, Human
agacugugucauugcacuccagccugggcgac

SEQ ID NO: 311395 - RNA, 25 nt, Human
agacugugugggggccacccagggg

SEQ ID NO: 311396 - RNA, 32 nt, Human
agacuguuagucaucugugcuuucuuuaccaa

SEQ ID NO: 311397 - RNA, 31 nt, Human
agacuguucaggugauaaaagacugugaaag

SEQ ID NO: 311398 - RNA, 32 nt, Human
agacuguuccagcaugagguucuuagaaugac

SEQ ID NO: 311399 - RNA, 23 nt, Human
agacuguuuauuguaguaaugca

SEQ ID NO: 311400 - RNA, 21 nt, Human
agacuguuucuuggggucagc

SEQ ID NO: 311401 - RNA, 32 nt, Human
agacuguuuucagcucuuuuuauauuguacau

SEQ ID NO: 311402 - RNA, 32 nt, Human
agacuguuuugcaucacucuuugcuauugaag

SEQ ID NO: 311403 - RNA, 32 nt, Human
agacuuaaagaauagucuggugaaguuacucg

SEQ ID NO: 311404 - RNA, 32 nt, Human
agacuuaaagccucugcaccuggaacuguuua

SEQ ID NO: 311405 - RNA, 32 nt, Human
agacuuaaauaaauggagagauacacuguauu

SEQ ID NO: 311406 - RNA, 32 nt, Human
agacuuaacuggagagauaagggugagaacag

SEQ ID NO: 311407 - RNA, 32 nt, Human
agacuuaauucaauucagacaagaccaaaguu

SEQ ID NO: 311408 - RNA, 32 nt, Human
agacuuacaugguccucaggcauggacaggcu

SEQ ID NO: 311409 - RNA, 32 nt, Human
agacuuagcugggcuccagcagccuggcuccg

SEQ ID NO: 311410 - RNA, 32 nt, Human
agacuuaggaguuuuguuuagagcaguuaaca

SEQ ID NO: 311411 - RNA, 32 nt, Human
agacuuaguucuugcccuacuguaucugccuu

SEQ ID NO: 311412 - RNA, 32 nt, Human
agacuuauuuuggcggauuuccaagggauuua

SEQ ID NO: 311413 - RNA, 32 nt, Human
agacuucaauuuccaaagagaagaacuagcag

SEQ ID NO: 311414 - RNA, 32 nt, Human
agacuucaccacaggguggccaacaguggcau

SEQ ID NO: 311415 - RNA, 32 nt, Human
agacuucaccccacuuccucugggcccuggcu

SEQ ID NO: 311416 - RNA, 32 nt, Human
agacuucagaggaggaaggaacuguagauggg

SEQ ID NO: 311417 - RNA, 32 nt, Human
agacuucaggaucaaguuuaggggacaaguuu

SEQ ID NO: 311418 - RNA, 32 nt, Human
agacuucaggcagcaggaggcugugugucccu

SEQ ID NO: 311419 - RNA, 32 nt, Human
agacuucaucacaggcugcuuuuuaucaaaaa

SEQ ID NO: 311420 - RNA, 24 nt, Human
agacuucaucucaaaaggaaaaga

SEQ ID NO: 311421 - RNA, 32 nt, Human
agacuuccaaguagcugggauuacagacaugc

SEQ ID NO: 311422 - RNA, 32 nt, Human
agacuuccagccuccagaacugugggacauaa

SEQ ID NO: 311423 - RNA, 32 nt, Human
agacuuccaggacuuccagacagaguaccagg

SEQ ID NO: 311424 - RNA, 32 nt, Human
agacuuccaggccagcguggaggggcgagggg

SEQ ID NO: 311425 - RNA, 32 nt, Human
agacuuccagucuucagaauggugagaaauaa

SEQ ID NO: 311426 - RNA, 32 nt, Human
agacuucccaggcgcucaggccuggaucuugc

SEQ ID NO: 311427 - RNA, 32 nt, Human
agacuucccuauuucgcuuucuccucggcuca

SEQ ID NO: 311428 - RNA, 32 nt, Human
agacuuccgaguggcugggauuacaggcgccc

SEQ ID NO: 311429 - RNA, 32 nt, Human
agacuuccuccuuaguucugcagccgccaucu

SEQ ID NO: 311430 - RNA, 32 nt, Human
agacuuccugcaggagucagcguucaaucuug

SEQ ID NO: 311431 - RNA, 32 nt, Human
agacuuccuuugcuucucuuuuccuuguaucu

SEQ ID NO: 311432 - RNA, 32 nt, Human
agacuucuaaagagacuauuugaaguccaguu

SEQ ID NO: 311433 - RNA, 32 nt, Human
agacuucuagccaggcugggcugccagugcca

SEQ ID NO: 311434 - RNA, 32 nt, Human
agacuucuagguaaugcaagcaucuaagagag

SEQ ID NO: 311435 - RNA, 32 nt, Human
agacuucuccacccucuugcauaccuccaggg

SEQ ID NO: 311436 - RNA, 32 nt, Human
agacuucucccaggauccucucuuugggagcg

SEQ ID NO: 311437 - RNA, 32 nt, Human
agacuucuccugggaugacaauuugcugagag

SEQ ID NO: 311438 - RNA, 32 nt, Human
agacuucucucucccaucaccuugcccucauu

SEQ ID NO: 311439 - RNA, 32 nt, Human
agacuucucucuucugucacuguaagaucuuu

SEQ ID NO: 311440 - RNA, 32 nt, Human
agacuucugaagaacaaaucagccuggucacc

SEQ ID NO: 311441 - RNA, 32 nt, Human
agacuucugaugggcgaagcccaaagaugcca

SEQ ID NO: 311442 - RNA, 32 nt, Human
agacuucugcuacugugguuucccagggaggg

SEQ ID NO: 311443 - RNA, 32 nt, Human
agacuucuuagaaagauaauuucauucauuuc

SEQ ID NO: 311444 - RNA, 32 nt, Human
agacuucuuagaagggcuucagaaggaacuga

SEQ ID NO: 311445 - RNA, 32 nt, Human
agacuugaacagauaaauaaacuuaacgaucu

SEQ ID NO: 311446 - RNA, 32 nt, Human
agacuugagcuggccuuccuaucauggaugug

SEQ ID NO: 311447 - RNA, 32 nt, Human
agacuugagggaaguaacacagcaaucggaca

SEQ ID NO: 311448 - RNA, 32 nt, Human
agacuugagucugaggccccaggcccuaggau

SEQ ID NO: 311449 - RNA, 32 nt, Human
agacuugauaacgcccguggugccccaucccu

SEQ ID NO: 311450 - RNA, 32 nt, Human
agacuugauaagaggccaggagagugggaacu

SEQ ID NO: 311451 - RNA, 32 nt, Human
agacuugaugcuauguugauuaauauuuaaau

SEQ ID NO: 311452 - RNA, 32 nt, Human
agacuugcagaccuggcacucgcccuagagga

SEQ ID NO: 311453 - RNA, 32 nt, Human
agacuugcagcaucagagucuccugagucgag

SEQ ID NO: 311454 - RNA, 20 nt, Human
agacuugcaggaagaugaug

SEQ ID NO: 311455 - RNA, 32 nt, Human
agacuugcagugaacuguuuuugugccaagaa

SEQ ID NO: 311456 - RNA, 32 nt, Human
agacuugccauucgaucuaauggcagucccug

SEQ ID NO: 311457 - RNA, 32 nt, Human
agacuuggaagaggaggaggaggaggagaagg

SEQ ID NO: 311458 - RNA, 32 nt, Human
agacuuggagccagacagaggaagaggggacg

SEQ ID NO: 311459 - RNA, 32 nt, Human
agacuuggcaugaacugaacaggcuuucauuu

SEQ ID NO: 311460 - RNA, 32 nt, Human
agacuugggaaaauguuucuggagaggcuuuc

SEQ ID NO: 311461 - RNA, 32 nt, Human
agacuugggaacgagcccugacguucucagcc

SEQ ID NO: 311462 - RNA, 32 nt, Human
agacuuggggaccagaggugacaguggaugac

SEQ ID NO: 311463 - RNA, 32 nt, Human
agacuugggggaaggggagauuauugcaaauu

SEQ ID NO: 311464 - RNA, 32 nt, Human
agacuuggugaccaaagaaggguguauucauu

SEQ ID NO: 311465 - RNA, 32 nt, Human
agacuuggugccugagcgcagcuccagggaag

SEQ ID NO: 311466 - RNA, 32 nt, Human
agacuuggugggcggggugggguggggaggga

SEQ ID NO: 311467 - RNA, 32 nt, Human
agacuugguguuuggugcuucagauacauuuu

SEQ ID NO: 311468 - RNA, 32 nt, Human
agacuuguaggcagcaacucacccucaagagg

SEQ ID NO: 311469 - RNA, 31 nt, Human
agacuugugcucaaggaaucggcuggggacu

SEQ ID NO: 311470 - RNA, 32 nt, Human
agacuugugcugcgugcggcuccggagcucug

SEQ ID NO: 311471 - RNA, 32 nt, Human
agacuugugggauggguaguaguuggagaucc

SEQ ID NO: 311472 - RNA, 32 nt, Human
agacuuguucacccuucauguccucaacucug

SEQ ID NO: 311473 - RNA, 32 nt, Human
agacuuuaccauuauuucagugcuaggcauua

SEQ ID NO: 311474 - RNA, 32 nt, Human
agacuuuacuaaaaauacaaaaauuagucagg

SEQ ID NO: 311475 - RNA, 32 nt, Human
agacuuuaucaggaugaacccaggacugcuuc

SEQ ID NO: 311476 - RNA, 32 nt, Human
agacuuucauuauuucucaucuggauuaccag

SEQ ID NO: 311477 - RNA, 32 nt, Human
agacuuucuaauucauuacuucauuccagaca

SEQ ID NO: 311478 - RNA, 32 nt, Human
agacuuucuccuggccccugccugcuggagau

SEQ ID NO: 311479 - RNA, 31 nt, Human
agacuuucuucugugucacaugcagauucuc

SEQ ID NO: 311480 - RNA, 32 nt, Human
agacuuugaagcaggaauguugcauuugacgc

SEQ ID NO: 311481 - RNA, 32 nt, Human
agacuuugcagaaccuuuaauuggauguguua

SEQ ID NO: 311482 - RNA, 32 nt, Human
agacuuugcccaggguccugugccuggauggg

SEQ ID NO: 311483 - RNA, 23 nt, Human
agacuuugggaagccaccuucaa

SEQ ID NO: 311484 - RNA, 32 nt, Human
agacuuugucaggaugggagaggccgcaggug

SEQ ID NO: 311485 - RNA, 32 nt, Human
agacuuuguugaguucuuucugggacuuggag

SEQ ID NO: 311486 - RNA, 22 nt, Human
agacuuuuacuucucuuacacu

SEQ ID NO: 311487 - RNA, 22 nt, Human
agacuuuucauuucuuuuuauu

SEQ ID NO: 311488 - RNA, 23 nt, Human
agacuuuuccauuuuucuucacu

SEQ ID NO: 311489 - RNA, 32 nt, Human
agacuuuucccaagccuacuuuugccauugac

SEQ ID NO: 311490 - RNA, 23 nt, Human
agacuuuucuuguucucuucucu

SEQ ID NO: 311491 - RNA, 32 nt, Human
agacuuuugaagcacaaauuuauuggcauuua

SEQ ID NO: 311492 - RNA, 32 nt, Human
agacuuuugacaccucucaaguucagagcucu

SEQ ID NO: 311493 - RNA, 21 nt, Human
agacuuuuuaaucucuucauu

SEQ ID NO: 311494 - RNA, 23 nt, Human
agacuuuuuauuguuucuuaacu

SEQ ID NO: 311495 - RNA, 24 nt, Human
agacuuuuucacuucuuuguugcu

SEQ ID NO: 311496 - RNA, 24 nt, Human
agacuuuuucuauuucuuuucacu

SEQ ID NO: 311497 - RNA, 21 nt, Human
agacuuuuucugagccuucau

SEQ ID NO: 311498 - RNA, 32 nt, Human
agacuuuuugccugggcuaaaucugauccuca

SEQ ID NO: 311499 - RNA, 32 nt, Human
agacuuuuuguauucagcuccaguuagucaga

SEQ ID NO: 311500 - RNA, 22 nt, Human
agagaaaaagaaaaauagaaga

SEQ ID NO: 311501 - RNA, 19 nt, Human
agagaaaaagaaaaaucag

SEQ ID NO: 311502 - RNA, 20 nt, Human
agagaaaaagaaagaauuag

SEQ ID NO: 311503 - RNA, 23 nt, Human
agagaaaaagaaagauacauaga

SEQ ID NO: 311504 - RNA, 23 nt, Human
agagaaaaagaagagggcucagg

SEQ ID NO: 311505 - RNA, 24 nt, Human
agagaaaaagaaggauugaucaga

SEQ ID NO: 311506 - RNA, 32 nt, Human
agagaaaaccugcuguaaagccaugguagugu

SEQ ID NO: 311507 - RNA, 32 nt, Human
agagaaaacuauucacaagauaaauuccaagu

SEQ ID NO: 311508 - RNA, 31 nt, Human
agagaaaagagaccauguuuauuuggguagg

SEQ ID NO: 311509 - RNA, 18 nt, Human
agagaaaagagagacaag

SEQ ID NO: 311510 - RNA, 32 nt, Human
agagaaaagagcgacaaggaaaaguuaggacu

SEQ ID NO: 311511 - RNA, 32 nt, Human
agagaaaagcaggccuuugcagauaugaugga

SEQ ID NO: 311512 - RNA, 32 nt, Human
agagaaaagcagggcuggggagaaugagaugg

SEQ ID NO: 311513 - RNA, 32 nt, Human
agagaaaagcaguauagacuccaccuuccagg

SEQ ID NO: 311514 - RNA, 32 nt, Human
agagaaaagcuccuaaagugaccuuccgggug

SEQ ID NO: 311515 - RNA, 26 nt, Human
agagaaaaggccggaaagagggagag

SEQ ID NO: 311516 - RNA, 32 nt, Human
agagaaaagggaaggagcaggaggaggaacag

SEQ ID NO: 311517 - RNA, 32 nt, Human
agagaaaaguuugaggcauuaaaagaagaaaa

SEQ ID NO: 311518 - RNA, 32 nt, Human
agagaaaauacagcuucucccacccacaacgu

SEQ ID NO: 311519 - RNA, 32 nt, Human
agagaaaaucaugcucugguaugacagacuau

SEQ ID NO: 311520 - RNA, 32 nt, Human
agagaaaaugagaaaggacagagccagcggcu

SEQ ID NO: 311521 - RNA, 32 nt, Human
agagaaaaugagugaauauucuucucacuuuu

SEQ ID NO: 311522 - RNA, 32 nt, Human
agagaaacagagacagaaagaaagagacagac

SEQ ID NO: 311523 - RNA, 32 nt, Human
agagaaacagagacucagggagagggagacaa

SEQ ID NO: 311524 - RNA, 32 nt, Human
agagaaacagcuccucgccucuucccaacaac

SEQ ID NO: 311525 - RNA, 32 nt, Human
agagaaacauaaaaaggaugggguaacaguua

SEQ ID NO: 311526 - RNA, 32 nt, Human
agagaaaccagaaggaggacuuauauuggcua

SEQ ID NO: 311527 - RNA, 32 nt, Human
agagaaaccauacaaaugugaagaaugugaca

SEQ ID NO: 311528 - RNA, 32 nt, Human
agagaaaccauacaaaugugaagaauguggaa

SEQ ID NO: 311529 - RNA, 32 nt, Human
agagaaaccaugcaauuuaacacuucaguuaa

SEQ ID NO: 311530 - RNA, 32 nt, Human
agagaaacccuacaaaugcgaagaaugugaua

SEQ ID NO: 311531 - RNA, 32 nt, Human
agagaaacccuacaaaugugaaaaaugcggcc

SEQ ID NO: 311532 - RNA, 32 nt, Human
agagaaacccuacaaaugugaaaaauguggca

SEQ ID NO: 311533 - RNA, 32 nt, Human
agagaaacccuacaaaugugaagaaugugaca

SEQ ID NO: 311534 - RNA, 32 nt, Human
agagaaacccuacaaaugugaagaauguggca

SEQ ID NO: 311535 - RNA, 32 nt, Human
agagaaacccuacaaaugugaagaauguggua

SEQ ID NO: 311536 - RNA, 32 nt, Human
agagaaaccguacaaaugugaagaaugugaga

SEQ ID NO: 311537 - RNA, 32 nt, Human
agagaaaccuuacaaaugugaagaaugugaca

SEQ ID NO: 311538 - RNA, 32 nt, Human
agagaaaccuuacaaaugugaagaaugugaua

SEQ ID NO: 311539 - RNA, 32 nt, Human
agagaaaccuuacaaaugugaagaaugugaug

SEQ ID NO: 311540 - RNA, 32 nt, Human
agagaaaccuuacaaaugugaagaauguggca

SEQ ID NO: 311541 - RNA, 32 nt, Human
agagaaacggggagagaaagaaacgauucuaa

SEQ ID NO: 311542 - RNA, 32 nt, Human
agagaaacuacaaaugugaagaauguguuaaa

SEQ ID NO: 311543 - RNA, 32 nt, Human
agagaaacuacccauuccagaaccuccucucu

SEQ ID NO: 311544 - RNA, 32 nt, Human
agagaaacucacacaaccaucugccuggaaga

SEQ ID NO: 311545 - RNA, 32 nt, Human
agagaaacuuggccugcugugcagugggccuu

SEQ ID NO: 311546 - RNA, 32 nt, Human
agagaaagaaagaaagaaagaaagggaaagau

SEQ ID NO: 311547 - RNA, 18 nt, Human
agagaaagaauugaucag

SEQ ID NO: 311548 - RNA, 32 nt, Human
agagaaagagaaagagaaagacaaucaagcag

SEQ ID NO: 311549 - RNA, 32 nt, Human
agagaaagagaaggaaggaaggagaaagagaa

SEQ ID NO: 311550 - RNA, 32 nt, Human
agagaaagagaaggauccccaaggaagaaaaa

SEQ ID NO: 311551 - RNA, 24 nt, Human
agagaaagagacgggagagaggag

SEQ ID NO: 311552 - RNA, 32 nt, Human
agagaaagaggaaaagggaagggggaaacccc

SEQ ID NO: 311553 - RNA, 32 nt, Human
agagaaagaggaagagugggugggcuggaaga

SEQ ID NO: 311554 - RNA, 32 nt, Human
agagaaagaggaggagaauuaagaagaggaug

SEQ ID NO: 311555 - RNA, 32 nt, Human
agagaaagcaagaaacuauaaugcacacucac

SEQ ID NO: 311556 - RNA, 32 nt, Human
agagaaagcaucccccagcucugacagggaga

SEQ ID NO: 311557 - RNA, 32 nt, Human
agagaaaggaaaaggcugcuccagguggggga

SEQ ID NO: 311558 - RNA, 32 nt, Human
agagaaaggaguuggggugagggccagagcug

SEQ ID NO: 311559 - RNA, 32 nt, Human
agagaaaggccuggaaggugauuucccgugug

SEQ ID NO: 311560 - RNA, 32 nt, Human
agagaaaggcuucuuauauccuuuucaauaga

SEQ ID NO: 311561 - RNA, 32 nt, Human
agagaaagggagggcagagggagaaugggaag

SEQ ID NO: 311562 - RNA, 32 nt, Human
agagaaaggggagcucuccagcaaagaagaaa

SEQ ID NO: 311563 - RNA, 32 nt, Human
agagaaagggucucacuauguugcccaggcug

SEQ ID NO: 311564 - RNA, 32 nt, Human
agagaaaggguuucaccauguugguuaggcug

SEQ ID NO: 311565 - RNA, 32 nt, Human
agagaaagguagaaauaaaaacuccuuaacuu

SEQ ID NO: 311566 - RNA, 21 nt, Human
agagaaaggugagaggaggag

SEQ ID NO: 311567 - RNA, 22 nt, Human
agagaaagugaaacugaucaga

SEQ ID NO: 311568 - RNA, 32 nt, Human
agagaaagugaggucuucucaggcucuuaaga

SEQ ID NO: 311569 - RNA, 32 nt, Human
agagaaaucagagcuucuaccccaccacccuc

SEQ ID NO: 311570 - RNA, 32 nt, Human
agagaaauccaggaaauucaccagaggcaaug

SEQ ID NO: 311571 - RNA, 21 nt, Human
agagaaaucuggaaccuucuu

SEQ ID NO: 311572 - RNA, 19 nt, Human
agagaaaugcaggaagcuc

SEQ ID NO: 311573 - RNA, 25 nt, Human
agagaaaugcauucccaccgaggcc

SEQ ID NO: 311574 - RNA, 32 nt, Human
agagaaauuacaaagcccgagcucuuucuuau

SEQ ID NO: 311575 - RNA, 32 nt, Human
agagaaauuacagauccgcagccccgggaugg

SEQ ID NO: 311576 - RNA, 32 nt, Human
agagaaauuauauuccuuacuucaugucaguu

SEQ ID NO: 311577 - RNA, 32 nt, Human
agagaaauuguacugcucuugccaauaaugug

SEQ ID NO: 311578 - RNA, 32 nt, Human
agagaacacaggcuuuugccacugugugaggu

SEQ ID NO: 311579 - RNA, 32 nt, Human
agagaacaccuagggaaggcagccuggcccug

SEQ ID NO: 311580 - RNA, 32 nt, Human
agagaacacuaagaggugaacauguaugagug

SEQ ID NO: 311581 - RNA, 32 nt, Human
agagaacagaaacaagagccccuaagucccag

SEQ ID NO: 311582 - RNA, 32 nt, Human
agagaacagcacucaagcuucuggccgcaugg

SEQ ID NO: 311583 - RNA, 32 nt, Human
agagaacagcaggucugugcagugucugaggg

SEQ ID NO: 311584 - RNA, 32 nt, Human
agagaacagcagugaaggcagcuggagacccu

SEQ ID NO: 311585 - RNA, 32 nt, Human
agagaacaggcaaccucauacacuaaugauau

SEQ ID NO: 311586 - RNA, 32 nt, Human
agagaacagggacuuugucugccuuguuuucu

SEQ ID NO: 311587 - RNA, 32 nt, Human
agagaacaguauacaguauccuuuguaagaua

SEQ ID NO: 311588 - RNA, 32 nt, Human
agagaacauauggcacaugaguuaagauugug

SEQ ID NO: 311589 - RNA, 32 nt, Human
agagaacauccuugcuuugagucaggcugugg

SEQ ID NO: 311590 - RNA, 32 nt, Human
agagaacaucuuccuucucuaccaucacuccu

SEQ ID NO: 311591 - RNA, 32 nt, Human
agagaacaucuucucagaaucaggucuaauua

SEQ ID NO: 311592 - RNA, 32 nt, Human
agagaaccagcccugcucacgccaugcccgcc

SEQ ID NO: 311593 - RNA, 32 nt, Human
agagaaccauuuauguacaccuccagugucua

SEQ ID NO: 311594 - RNA, 32 nt, Human
agagaacccacaaggcuuuucccacugcuuac

SEQ ID NO: 311595 - RNA, 32 nt, Human
agagaacccacgcacaugcacaccacaacaca

SEQ ID NO: 311596 - RNA, 32 nt, Human
agagaacccagaaauaaacccauauaaauaug

SEQ ID NO: 311597 - RNA, 32 nt, Human
agagaacccagaaauaaaggcauauaccuaca

SEQ ID NO: 311598 - RNA, 32 nt, Human
agagaacccucagcuucucucugccucuggag

SEQ ID NO: 311599 - RNA, 32 nt, Human
agagaaccgccaugaagagagaagggggugcc

SEQ ID NO: 311600 - RNA, 32 nt, Human
agagaaccgucuuuaccucagcuccuagggcc

SEQ ID NO: 311601 - RNA, 32 nt, Human
agagaaccuggagcuuccugaagaagcaaagc

SEQ ID NO: 311602 - RNA, 32 nt, Human
agagaaccuguucagauacaggccaguuucuu

SEQ ID NO: 311603 - RNA, 32 nt, Human
agagaacgguugcaaaacuggaaaagacaauu

SEQ ID NO: 311604 - RNA, 32 nt, Human
agagaacuccaaaauucuccugccucaacauc

SEQ ID NO: 311605 - RNA, 32 nt, Human
agagaacucccagagaagaaggagaucagaca

SEQ ID NO: 311606 - RNA, 22 nt, Human
agagaacucccccaccuguggu

SEQ ID NO: 311607 - RNA, 32 nt, Human
agagaacucucuuccuucuuuccaccgacagg

SEQ ID NO: 311608 - RNA, 32 nt, Human
agagaacucugccuugcccucgucccucgucc

SEQ ID NO: 311609 - RNA, 32 nt, Human
agagaagaaaaagaaaaagaagaagaaaggca

SEQ ID NO: 311610 - RNA, 32 nt, Human
agagaagaaaagaaaaaugaagaaaaguaauu

SEQ ID NO: 311611 - RNA, 32 nt, Human
agagaagaaagccaaggaggcagcaggggcca

SEQ ID NO: 311612 - RNA, 32 nt, Human
agagaagacagaaacgacaugagcacagcagg

SEQ ID NO: 311613 - RNA, 32 nt, Human
agagaagacaguggcaaaaugaagaaauuuuu

SEQ ID NO: 311614 - RNA, 32 nt, Human
agagaagacccgauaagugucacuggauguga

SEQ ID NO: 311615 - RNA, 32 nt, Human
agagaagacuguucugaacaccaguaccaacc

SEQ ID NO: 311616 - RNA, 32 nt, Human
agagaagagaccugggaaauuaaguuucuugc

SEQ ID NO: 311617 - RNA, 32 nt, Human
agagaagagagggagugaaggguggcaccaag

SEQ ID NO: 311618 - RNA, 32 nt, Human
agagaagagauucagacaggauuagguggcuu

SEQ ID NO: 311619 - RNA, 32 nt, Human
agagaagagcaguugggaagacaggcagcugg

SEQ ID NO: 311620 - RNA, 32 nt, Human
agagaagagccugcuggaccuggaccuugcug

SEQ ID NO: 311621 - RNA, 32 nt, Human
agagaagaggagaggacacagagacacacaga

SEQ ID NO: 311622 - RNA, 32 nt, Human
agagaagaggaugagugugaagggugguggcg

SEQ ID NO: 311623 - RNA, 32 nt, Human
agagaagagguuucaccauguuggccaggcug

SEQ ID NO: 311624 - RNA, 22 nt, Human
agagaagagucacaggaagcuc

SEQ ID NO: 311625 - RNA, 32 nt, Human
agagaagagucuguccucugaaccacuuuugc

SEQ ID NO: 311626 - RNA, 32 nt, Human
agagaagauacucggaggauuguuggaaugua

SEQ ID NO: 311627 - RNA, 32 nt, Human
agagaagaucacugaagaaacuucugcuuuaa

SEQ ID NO: 311628 - RNA, 32 nt, Human
agagaagcaacacacacgugcacagacauguu

SEQ ID NO: 311629 - RNA, 32 nt, Human
agagaagcacagaaccuggcauucacuggacu

SEQ ID NO: 311630 - RNA, 32 nt, Human
agagaagcagaacagcccagagccccaggugc

SEQ ID NO: 311631 - RNA, 32 nt, Human
agagaagcagaggagucacacuccacucaccu

SEQ ID NO: 311632 - RNA, 32 nt, Human
agagaagcaguuaguaacagcaggaugggugu

SEQ ID NO: 311633 - RNA, 32 nt, Human
agagaagcaguuuugcaccagccuuauuccug

SEQ ID NO: 311634 - RNA, 32 nt, Human
agagaagccaccuucaggccugggaaggaaga

SEQ ID NO: 311635 - RNA, 32 nt, Human
agagaagccagccacagaccccugggagcuuc

SEQ ID NO: 311636 - RNA, 32 nt, Human
agagaagccagccaggcugcacuugcagaaca

SEQ ID NO: 311637 - RNA, 32 nt, Human
agagaagccauggagaacagacuugaaaaguu

SEQ ID NO: 311638 - RNA, 32 nt, Human
agagaagcccagcucugggaacugaaucagga

SEQ ID NO: 311639 - RNA, 32 nt, Human
agagaagcccaggauggucggcugccugggga

SEQ ID NO: 311640 - RNA, 32 nt, Human
agagaagcccagggugggauguuagagggcau

SEQ ID NO: 311641 - RNA, 32 nt, Human
agagaagcccaggucaccugccaagaccaaga

SEQ ID NO: 311642 - RNA, 32 nt, Human
agagaagccccaagaaggagguuggggccagc

SEQ ID NO: 311643 - RNA, 32 nt, Human
agagaagccccagcuacaaccgguacucaagg

SEQ ID NO: 311644 - RNA, 32 nt, Human
agagaagcccuacaaaugugaaaaauguggca

SEQ ID NO: 311645 - RNA, 32 nt, Human
agagaagcccuacaaaugugaagaauguggca

SEQ ID NO: 311646 - RNA, 32 nt, Human
agagaagcccugggaaggagggguggggaacg

SEQ ID NO: 311647 - RNA, 32 nt, Human
agagaagccgggauggaaacuccaaacaccac

SEQ ID NO: 311648 - RNA, 32 nt, Human
agagaagccuuacaaaugugaagaaugugaaa

SEQ ID NO: 311649 - RNA, 32 nt, Human
agagaagccuuccuacacucagccucugucca

SEQ ID NO: 311650 - RNA, 32 nt, Human
agagaagcuaaagaagucuugaaaggagaaaa

SEQ ID NO: 311651 - RNA, 16 nt, Human
agagaagcuccagcuc

SEQ ID NO: 311652 - RNA, 32 nt, Human
agagaagcucugaggcacgucaugcaggucaa

SEQ ID NO: 311653 - RNA, 19 nt, Human
agagaagcugccccuuagc

SEQ ID NO: 311654 - RNA, 32 nt, Human
agagaagcugucagcagccuacccaggccccg

SEQ ID NO: 311655 - RNA, 32 nt, Human
agagaaggaaacaaaaugagggguggcaggga

SEQ ID NO: 311656 - RNA, 32 nt, Human
agagaaggaaacgaggaggaggaugucucacc

SEQ ID NO: 311657 - RNA, 32 nt, Human
agagaaggaagaggaaagcaaaggagucaggg

SEQ ID NO: 311658 - RNA, 32 nt, Human
agagaaggaaggggauaggcagcuuugacagg

SEQ ID NO: 311659 - RNA, 32 nt, Human
agagaaggaauagaguucuccagagccccaag

SEQ ID NO: 311660 - RNA, 32 nt, Human
agagaaggacagucagaggaguggccaccugu

SEQ ID NO: 311661 - RNA, 32 nt, Human
agagaaggaccaagcaaagccaugauauuucc

SEQ ID NO: 311662 - RNA, 32 nt, Human
agagaaggagaaaacugccuugguuggaaccu

SEQ ID NO: 311663 - RNA, 32 nt, Human
agagaaggaggaaccuuuuccuucugcagccc

SEQ ID NO: 311664 - RNA, 32 nt, Human
agagaaggaggcacuuuggccaggauggggag

SEQ ID NO: 311665 - RNA, 32 nt, Human
agagaaggaggcccguguugagcucagggaga

SEQ ID NO: 311666 - RNA, 32 nt, Human
agagaaggagguggaggcagccaagaaucuca

SEQ ID NO: 311667 - RNA, 32 nt, Human
agagaaggauguuuuggaugcauucuagaaca

SEQ ID NO: 311668 - RNA, 32 nt, Human
agagaaggccaaauuuccagcccagggaaguc

SEQ ID NO: 311669 - RNA, 32 nt, Human
agagaaggccaagcaaccuccacuucuucagc

SEQ ID NO: 311670 - RNA, 32 nt, Human
agagaaggcgacagaugccuccuggguuugga

SEQ ID NO: 311671 - RNA, 32 nt, Human
agagaaggcucugccagccccucgccugcagc

SEQ ID NO: 311672 - RNA, 31 nt, Human
agagaagggaaacugucuaggauucagcuga

SEQ ID NO: 311673 - RNA, 32 nt, Human
agagaagggaaaggcugcaugggggagcccca

SEQ ID NO: 311674 - RNA, 32 nt, Human
agagaagggauuucaccauguuggccgggcug

SEQ ID NO: 311675 - RNA, 32 nt, Human
agagaagggccaaggccgggugcagugguuca

SEQ ID NO: 311676 - RNA, 32 nt, Human
agagaagggcucagggcaccagcaaccaagcc

SEQ ID NO: 311677 - RNA, 32 nt, Human
agagaaggggucuugcucugucacccagucug

SEQ ID NO: 311678 - RNA, 32 nt, Human
agagaagggguuucaccacauuggccgggcug

SEQ ID NO: 311679 - RNA, 32 nt, Human
agagaagggugcgagaaacaucagggugcaga

SEQ ID NO: 311680 - RNA, 23 nt, Human
agagaagguugccauggcugcug

SEQ ID NO: 311681 - RNA, 32 nt, Human
agagaaguaaucuuguaaaaauguuuuguaaa

SEQ ID NO: 311682 - RNA, 32 nt, Human
agagaaguagagagagggccacacaacagaug

SEQ ID NO: 311683 - RNA, 32 nt, Human
agagaaguauaugauccaccaugcuaaugaca

SEQ ID NO: 311684 - RNA, 19 nt, Human
agagaagucaaaggaacuu

SEQ ID NO: 311685 - RNA, 19 nt, Human
agagaagucaagcagacuc

SEQ ID NO: 311686 - RNA, 19 nt, Human
agagaagucacccaaguuc

SEQ ID NO: 311687 - RNA, 32 nt, Human
agagaagucagagagacuagaugcuuucacua

SEQ ID NO: 311688 - RNA, 21 nt, Human
agagaagucagcuacuggcuc

SEQ ID NO: 311689 - RNA, 32 nt, Human
agagaagucccuggaguaacccaugugcgcag

SEQ ID NO: 311690 - RNA, 19 nt, Human
agagaagucgcuugagcuc

SEQ ID NO: 311691 - RNA, 20 nt, Human
agagaagucucgaaaggcuc

SEQ ID NO: 311692 - RNA, 32 nt, Human
agagaagucuucuaugaggaggugaugccaaa

SEQ ID NO: 311693 - RNA, 32 nt, Human
agagaagugaacauccagccccaaucauggua

SEQ ID NO: 311694 - RNA, 31 nt, Human
agagaagugauucucccuugacucuggcucc

SEQ ID NO: 311695 - RNA, 32 nt, Human
agagaagugcagcugcugcgacugugccagga

SEQ ID NO: 311696 - RNA, 20 nt, Human
agagaagugccagggaagcu

SEQ ID NO: 311697 - RNA, 32 nt, Human
agagaaguggccagagaggcccaggggacagc

SEQ ID NO: 311698 - RNA, 32 nt, Human
agagaagugggcaaccuggaauugggugccag

SEQ ID NO: 311699 - RNA, 22 nt, Human
agagaaguuuacaagaacgcuc

SEQ ID NO: 311700 - RNA, 32 nt, Human
agagaaguuugcugaggaaugccuucaagcac

SEQ ID NO: 311701 - RNA, 32 nt, Human
agagaauaaauuguuaaaaucugaugcauuuu

SEQ ID NO: 311702 - RNA, 32 nt, Human
agagaauagauaauuuguguguuugcaaugug

SEQ ID NO: 311703 - RNA, 32 nt, Human
agagaauauauuuuucccaucuguauuguucu

SEQ ID NO: 311704 - RNA, 32 nt, Human
agagaaucacagcagcagacugcucuggguca

SEQ ID NO: 311705 - RNA, 32 nt, Human
agagaaucacccuuccuggucuacagauggaa

SEQ ID NO: 311706 - RNA, 32 nt, Human
agagaaucacuugaggccaggaguucgagacc

SEQ ID NO: 311707 - RNA, 32 nt, Human
agagaaucaguaucccuggcccagggaggauu

SEQ ID NO: 311708 - RNA, 32 nt, Human
agagaauccagaaauucucauguaugugugcg

SEQ ID NO: 311709 - RNA, 32 nt, Human
agagaauccugccucuguagaccaacauccag

SEQ ID NO: 311710 - RNA, 32 nt, Human
agagaaucgcuugagccugggacauugaggcu

SEQ ID NO: 311711 - RNA, 32 nt, Human
agagaaucgcuugaggccaggaguuugaggcc

SEQ ID NO: 311712 - RNA, 32 nt, Human
agagaaucugugagagaaaguauuucaggaag

SEQ ID NO: 311713 - RNA, 32 nt, Human
agagaaugagcaccccucauccaucucagcau

SEQ ID NO: 311714 - RNA, 32 nt, Human
agagaaugaugacuguagaacauuugagcaag

SEQ ID NO: 311715 - RNA, 32 nt, Human
agagaaugcaauuuuaaaugcccacugguuuu

SEQ ID NO: 311716 - RNA, 32 nt, Human
agagaaugcuucccauagaaagcccgacaugg

SEQ ID NO: 311717 - RNA, 32 nt, Human
agagaauggaaaagccagggagguggaagauc

SEQ ID NO: 311718 - RNA, 32 nt, Human
agagaauggaaagugaaaagaacacaacagau

SEQ ID NO: 311719 - RNA, 32 nt, Human
agagaauggacucuggaaucugacgucugggu

SEQ ID NO: 311720 - RNA, 24 nt, Human
agagaaugggguccccugcacuga

SEQ ID NO: 311721 - RNA, 23 nt, Human
agagaauuaggacuuuuuucuua

SEQ ID NO: 311722 - RNA, 32 nt, Human
agagaauuccuugagucuaaggcacaggccca

SEQ ID NO: 311723 - RNA, 23 nt, Human
agagaauugccuccuggagccag

SEQ ID NO: 311724 - RNA, 32 nt, Human
agagaauuuauuuuguuucuugcccacacaga

SEQ ID NO: 311725 - RNA, 32 nt, Human
agagacaaaaggaaaucacugaggcuuucuga

SEQ ID NO: 311726 - RNA, 32 nt, Human
agagacaaaggaugccauuuuacauuuaggau

SEQ ID NO: 311727 - RNA, 32 nt, Human
agagacaaaggccauugcauugaaggaggugg

SEQ ID NO: 311728 - RNA, 32 nt, Human
agagacaacaggcugccugacucuccagagcc

SEQ ID NO: 311729 - RNA, 31 nt, Human
agagacaagaaaccuguuucaacuugaagac

SEQ ID NO: 311730 - RNA, 22 nt, Human
agagacaagaggagaaggagag

SEQ ID NO: 311731 - RNA, 32 nt, Human
agagacaagggcuccccauguugcccaggcug

SEQ ID NO: 311732 - RNA, 32 nt, Human
agagacaaggguucaccauguugcccaggcua

SEQ ID NO: 311733 - RNA, 32 nt, Human
agagacaagguccuuggcugggcaugguggcu

SEQ ID NO: 311734 - RNA, 32 nt, Human
agagacaaggucucacuauguugcccaggcug

SEQ ID NO: 311735 - RNA, 32 nt, Human
agagacaaggucuugcuauguugcccaggcua

SEQ ID NO: 311736 - RNA, 32 nt, Human
agagacaaggucuugcuauguugcccaggcug

SEQ ID NO: 311737 - RNA, 32 nt, Human
agagacaaggucuugcuauguuguccagacug

SEQ ID NO: 311738 - RNA, 32 nt, Human
agagacaagguuucaccauauuggccaggcug

SEQ ID NO: 311739 - RNA, 32 nt, Human
agagacaagguuucaccauguugaccaggcug

SEQ ID NO: 311740 - RNA, 32 nt, Human
agagacaagguuucaccauguuggucaggcug

SEQ ID NO: 311741 - RNA, 32 nt, Human
agagacaagguuucaccauguuguccaggcug

SEQ ID NO: 311742 - RNA, 32 nt, Human
agagacaagguuucaccggguuggccaggcug

SEQ ID NO: 311743 - RNA, 32 nt, Human
agagacaagguuucacuauguugcccaggcug

SEQ ID NO: 311744 - RNA, 32 nt, Human
agagacaagguuucacuauguuguccaggcug

SEQ ID NO: 311745 - RNA, 32 nt, Human
agagacaagguuucgccauguugccuaggcug

SEQ ID NO: 311746 - RNA, 32 nt, Human
agagacaagguuucgccauguuggccaggcug

SEQ ID NO: 311747 - RNA, 32 nt, Human
agagacaagguuuugccauguugcccagucag

SEQ ID NO: 311748 - RNA, 32 nt, Human
agagacaagguuuugcuguguugcccaagcug

SEQ ID NO: 311749 - RNA, 32 nt, Human
agagacaaugcucaguauucauucauacacag

SEQ ID NO: 311750 - RNA, 32 nt, Human
agagacaauuuggagucaagauuuuccauuug

SEQ ID NO: 311751 - RNA, 32 nt, Human
agagacacaaaugaagaagaacaaagagccug

SEQ ID NO: 311752 - RNA, 32 nt, Human
agagacacaacaaccuaccuuccagccuuaac

SEQ ID NO: 311753 - RNA, 32 nt, Human
agagacacaagugaaagacagagugaugcugu

SEQ ID NO: 311754 - RNA, 32 nt, Human
agagacacagaagugcuagaagccacuccuca

SEQ ID NO: 311755 - RNA, 32 nt, Human
agagacaccccucccuugccccuuuccugggc

SEQ ID NO: 311756 - RNA, 32 nt, Human
agagacaccgagacgcagagacacucaggagg

SEQ ID NO: 311757 - RNA, 32 nt, Human
agagacacgaggagcaaagcaagugaaggcac

SEQ ID NO: 311758 - RNA, 23 nt, Human
agagacacguaagaaggacuaua

SEQ ID NO: 311759 - RNA, 32 nt, Human
agagacacugauuuuuaaauaucaaaauuucc

SEQ ID NO: 311760 - RNA, 32 nt, Human
agagacacugccugcuucaccaggucuguucg

SEQ ID NO: 311761 - RNA, 32 nt, Human
agagacacuuuauuggaagugcaaucauaguu

SEQ ID NO: 311762 - RNA, 32 nt, Human
agagacagaagccacaggggaagcaaagcaaa

SEQ ID NO: 311763 - RNA, 32 nt, Human
agagacagagaaggagagggggagaucuugag

SEQ ID NO: 311764 - RNA, 32 nt, Human
agagacagagccaggacaggagugggggccag

SEQ ID NO: 311765 - RNA, 32 nt, Human
agagacagaggcaccccggacagagacgugaa

SEQ ID NO: 311766 - RNA, 32 nt, Human
agagacagagucucacucugucacccaggcug

SEQ ID NO: 311767 - RNA, 32 nt, Human
agagacagaguuucaccagguuggucaggcug

SEQ ID NO: 311768 - RNA, 32 nt, Human
agagacagaguuucaccauguuggccaggaug

SEQ ID NO: 311769 - RNA, 32 nt, Human
agagacagaguuucaccauguuggccaggcug

SEQ ID NO: 311770 - RNA, 32 nt, Human
agagacagaguuucgccauguuggccaggcug

SEQ ID NO: 311771 - RNA, 32 nt, Human
agagacagaguuucgucauguugcccaggcug

SEQ ID NO: 311772 - RNA, 32 nt, Human
agagacagauugaaagacaacacacacuauuu

SEQ ID NO: 311773 - RNA, 32 nt, Human
agagacagcagcugagugagacccuaagggag

SEQ ID NO: 311774 - RNA, 32 nt, Human
agagacagcauggggaaggagguccccuuccc

SEQ ID NO: 311775 - RNA, 32 nt, Human
agagacagcccacccuuguguccacugugacc

SEQ ID NO: 311776 - RNA, 32 nt, Human
agagacagcccccacaucccaccccaucaggu

SEQ ID NO: 311777 - RNA, 32 nt, Human
agagacagcccgacccagagaaacccagcaac

SEQ ID NO: 311778 - RNA, 18 nt, Human
agagacagccucugagga

SEQ ID NO: 311779 - RNA, 32 nt, Human
agagacagccuggguaugggcaagaaaugacu

SEQ ID NO: 311780 - RNA, 31 nt, Human
agagacagcuuccagcaccuucuucaguguu

SEQ ID NO: 311781 - RNA, 32 nt, Human
agagacaggacgugucucucuccacgucuucc

SEQ ID NO: 311782 - RNA, 32 nt, Human
agagacaggacuucaucuucaccaucuaccac

SEQ ID NO: 311783 - RNA, 32 nt, Human
agagacaggagagagagggagggagcgagagg

SEQ ID NO: 311784 - RNA, 32 nt, Human
agagacaggaucucacuauguugcccaggcug

SEQ ID NO: 311785 - RNA, 26 nt, Human
agagacaggaucuuaggccacaggga

SEQ ID NO: 311786 - RNA, 32 nt, Human
agagacaggauuucaccauguuggccaggcca

SEQ ID NO: 311787 - RNA, 32 nt, Human
agagacaggauuucaccauguuggccaggcug

SEQ ID NO: 311788 - RNA, 32 nt, Human
agagacaggauuucaucguguugcccaggcug

SEQ ID NO: 311789 - RNA, 32 nt, Human
agagacaggauuuuaccauguuggccaugcug

SEQ ID NO: 311790 - RNA, 32 nt, Human
agagacaggcagagaaggagagaggcagagag

SEQ ID NO: 311791 - RNA, 32 nt, Human
agagacaggcaggucgcuugagcucaggaguu

SEQ ID NO: 311792 - RNA, 32 nt, Human
agagacaggcucuugcuauguugcccaggcug

SEQ ID NO: 311793 - RNA, 32 nt, Human
agagacagggauucgccauguuggccaggcug

SEQ ID NO: 311794 - RNA, 32 nt, Human
agagacagggcuucaccauguuggcuaggagg

SEQ ID NO: 311795 - RNA, 32 nt, Human
agagacaggggaggggcgccgggagccgggcg

SEQ ID NO: 311796 - RNA, 32 nt, Human
agagacagggucgcacuauguugcccgggcug

SEQ ID NO: 311797 - RNA, 32 nt, Human
agagacagggucucaccaugucacccaggcuc

SEQ ID NO: 311798 - RNA, 32 nt, Human
agagacagggucucaccauguugcccagguug

SEQ ID NO: 311799 - RNA, 32 nt, Human
agagacagggucucaccauguuggccaggcug

SEQ ID NO: 311800 - RNA, 32 nt, Human
agagacagggucucacuauauugcucaggcug

SEQ ID NO: 311801 - RNA, 32 nt, Human
agagacagggucucacuauguugcccaggcug

SEQ ID NO: 311802 - RNA, 32 nt, Human
agagacagggucucacucugucacccaggcug

SEQ ID NO: 311803 - RNA, 32 nt, Human
agagacagggucucacucuguugcccagacug

SEQ ID NO: 311804 - RNA, 32 nt, Human
agagacagggucucacucuguugcccaggcug

SEQ ID NO: 311805 - RNA, 32 nt, Human
agagacagggucucacuguguugcccaggcug

SEQ ID NO: 311806 - RNA, 32 nt, Human
agagacagggucucacuuuguugcccacgcug

SEQ ID NO: 311807 - RNA, 32 nt, Human
agagacagggucucacuuuguugcccaugcug

SEQ ID NO: 311808 - RNA, 32 nt, Human
agagacagggucucgcaguguugcccaggcug

SEQ ID NO: 311809 - RNA, 32 nt, Human
agagacagggucucgccauguugcccaggcug

SEQ ID NO: 311810 - RNA, 32 nt, Human
agagacagggucucgcucugucacccaggcug

SEQ ID NO: 311811 - RNA, 32 nt, Human
agagacagggucuucccauguugcccaggcug

SEQ ID NO: 311812 - RNA, 32 nt, Human
agagacagggucuugcuauguugcccaggcug

SEQ ID NO: 311813 - RNA, 32 nt, Human
agagacagggucuugcuauguuggucaggcua

SEQ ID NO: 311814 - RNA, 32 nt, Human
agagacagggucuugcucugucacccagacug

SEQ ID NO: 311815 - RNA, 32 nt, Human
agagacagggucuugcucugucacccaggcug

SEQ ID NO: 311816 - RNA, 32 nt, Human
agagacagggucuugcucugucgcccgggcug

SEQ ID NO: 311817 - RNA, 32 nt, Human
agagacagggucuugcucugucgcucaggcug

SEQ ID NO: 311818 - RNA, 32 nt, Human
agagacagggucuugcucuguugcccaggcug

SEQ ID NO: 311819 - RNA, 32 nt, Human
agagacagggucuugcucuguuguccaggcug

SEQ ID NO: 311820 - RNA, 32 nt, Human
agagacagggucuugcuguguuacccaggcug

SEQ ID NO: 311821 - RNA, 32 nt, Human
agagacagggucuugcuucuguggcccaggcu

SEQ ID NO: 311822 - RNA, 32 nt, Human
agagacagggucuugguauguugcccagacug

SEQ ID NO: 311823 - RNA, 32 nt, Human
agagacagggugugggcaucuccaugccccua

SEQ ID NO: 311824 - RNA, 32 nt, Human
agagacaggguuucacaauguugaccaggcug

SEQ ID NO: 311825 - RNA, 32 nt, Human
agagacaggguuucaccacauuggccaggcug

SEQ ID NO: 311826 - RNA, 32 nt, Human
agagacaggguuucaccacguuggccaggaug

SEQ ID NO: 311827 - RNA, 32 nt, Human
agagacaggguuucaccauauuggccaggcug

SEQ ID NO: 311828 - RNA, 32 nt, Human
agagacaggguuucaccauauuggucaggcug

SEQ ID NO: 311829 - RNA, 32 nt, Human
agagacaggguuucaccauguuaccaccgcgc

SEQ ID NO: 311830 - RNA, 32 nt, Human
agagacaggguuucaccauguuagccacggug

SEQ ID NO: 311831 - RNA, 32 nt, Human
agagacaggguuucaccauguuagccaggaug

SEQ ID NO: 311832 - RNA, 32 nt, Human
agagacaggguuucaccauguuagccaggcug

SEQ ID NO: 311833 - RNA, 32 nt, Human
agagacaggguuucaccauguuagccgggaug

SEQ ID NO: 311834 - RNA, 32 nt, Human
agagacaggguuucaccauguugaccuggcug

SEQ ID NO: 311835 - RNA, 32 nt, Human
agagacaggguuucaccauguugcccaggcug

SEQ ID NO: 311836 - RNA, 32 nt, Human
agagacaggguuucaccauguugcccagucug

SEQ ID NO: 311837 - RNA, 32 nt, Human
agagacaggguuucaccauguugccuaggcug

SEQ ID NO: 311838 - RNA, 32 nt, Human
agagacaggguuucaccauguuggacaggcug

SEQ ID NO: 311839 - RNA, 32 nt, Human
agagacaggguuucaccauguuggccacacug

SEQ ID NO: 311840 - RNA, 32 nt, Human
agagacaggguuucaccauguuggccagccug

SEQ ID NO: 311841 - RNA, 32 nt, Human
agagacaggguuucaccauguuggccagcgug

SEQ ID NO: 311842 - RNA, 32 nt, Human
agagacaggguuucaccauguuggccaggaug

SEQ ID NO: 311843 - RNA, 32 nt, Human
agagacaggguuucaccauguuggccaggcag

SEQ ID NO: 311844 - RNA, 32 nt, Human
agagacaggguuucaccauguuggccaggcug

SEQ ID NO: 311845 - RNA, 32 nt, Human
agagacaggguuucaccauguuggccaguaug

SEQ ID NO: 311846 - RNA, 32 nt, Human
agagacaggguuucaccauguuggccagugug

SEQ ID NO: 311847 - RNA, 32 nt, Human
agagacaggguuucaccauguuggccgggaug

SEQ ID NO: 311848 - RNA, 32 nt, Human
agagacaggguuucaccauguuggccgggcug

SEQ ID NO: 311849 - RNA, 32 nt, Human
agagacaggguuucaccauguuggucaggcgg

SEQ ID NO: 311850 - RNA, 32 nt, Human
agagacaggguuucaccauguuggucaggcua

SEQ ID NO: 311851 - RNA, 32 nt, Human
agagacaggguuucaccauguuggucaggcuc

SEQ ID NO: 311852 - RNA, 32 nt, Human
agagacaggguuucaccauguuggucaggcug

SEQ ID NO: 311853 - RNA, 32 nt, Human
agagacaggguuucaccauguuggucauguug

SEQ ID NO: 311854 - RNA, 32 nt, Human
agagacaggguuucaccauguuggucgggcug

SEQ ID NO: 311855 - RNA, 32 nt, Human
agagacaggguuucaccauguugguuaggcug

SEQ ID NO: 311856 - RNA, 32 nt, Human
agagacaggguuucaccauguuguccaggcug

SEQ ID NO: 311857 - RNA, 32 nt, Human
agagacaggguuucaccauguuugccaggaua

SEQ ID NO: 311858 - RNA, 32 nt, Human
agagacaggguuucaccauuuuggccaggaug

SEQ ID NO: 311859 - RNA, 32 nt, Human
agagacaggguuucaccauuuuggccaggcua

SEQ ID NO: 311860 - RNA, 32 nt, Human
agagacaggguuucaccauuuuggccaggcug

SEQ ID NO: 311861 - RNA, 32 nt, Human
agagacaggguuucaccguguuaaccaggaug

SEQ ID NO: 311862 - RNA, 32 nt, Human
agagacaggguuucaccguguuggccaggaug

SEQ ID NO: 311863 - RNA, 32 nt, Human
agagacaggguuucaccguguuggccaggcug

SEQ ID NO: 311864 - RNA, 32 nt, Human
agagacaggguuucaccguguuggucaggcug

SEQ ID NO: 311865 - RNA, 32 nt, Human
agagacaggguuucacuaugcuggucaggcug

SEQ ID NO: 311866 - RNA, 32 nt, Human
agagacaggguuucacuauguugcccaggcug

SEQ ID NO: 311867 - RNA, 32 nt, Human
agagacaggguuucacuauguuggccaggcug

SEQ ID NO: 311868 - RNA, 32 nt, Human
agagacaggguuucacuguguugcccaggcug

SEQ ID NO: 311869 - RNA, 32 nt, Human
agagacaggguuucaucauguuggccaggaug

SEQ ID NO: 311870 - RNA, 32 nt, Human
agagacaggguuucaucauguuggccaggcua

SEQ ID NO: 311871 - RNA, 32 nt, Human
agagacaggguuucaucauguuggccaggcug

SEQ ID NO: 311872 - RNA, 32 nt, Human
agagacaggguuucaucauuguuggccaggcu

SEQ ID NO: 311873 - RNA, 32 nt, Human
agagacaggguuucauuauguuggccagacug

SEQ ID NO: 311874 - RNA, 32 nt, Human
agagacaggguuucgccauguugacgagacug

SEQ ID NO: 311875 - RNA, 32 nt, Human
agagacaggguuucgccauguugcacagguug

SEQ ID NO: 311876 - RNA, 32 nt, Human
agagacaggguuucgccauguugcccaggcug

SEQ ID NO: 311877 - RNA, 32 nt, Human
agagacaggguuucgccauguugcccagggug

SEQ ID NO: 311878 - RNA, 32 nt, Human
agagacaggguuucgccauguuggccagccug

SEQ ID NO: 311879 - RNA, 32 nt, Human
agagacaggguuucgccauguuggccaggcug

SEQ ID NO: 311880 - RNA, 32 nt, Human
agagacaggguuucgccauguuggcuaugcug

SEQ ID NO: 311881 - RNA, 32 nt, Human
agagacaggguuucuccauguugcccaaguug

SEQ ID NO: 311882 - RNA, 32 nt, Human
agagacaggguuucuccauguuggucaggcua

SEQ ID NO: 311883 - RNA, 32 nt, Human
agagacaggguuucuccauguuggucaggcug

SEQ ID NO: 311884 - RNA, 32 nt, Human
agagacaggguuucuccauguuggucagucug

SEQ ID NO: 311885 - RNA, 32 nt, Human
agagacaggguuucuccauguuggucgggcug

SEQ ID NO: 311886 - RNA, 32 nt, Human
agagacaggguuucuccauguugguuaggcug

SEQ ID NO: 311887 - RNA, 32 nt, Human
agagacaggguuuuaccauguuggccaggcug

SEQ ID NO: 311888 - RNA, 32 nt, Human
agagacaggguuuuaccauguuggucaggcug

SEQ ID NO: 311889 - RNA, 32 nt, Human
agagacaggguuuuaccauguuggucagguug

SEQ ID NO: 311890 - RNA, 32 nt, Human
agagacaggguuuugccauguugcccaggcug

SEQ ID NO: 311891 - RNA, 32 nt, Human
agagacaggguuuugccauguugcucaguccc

SEQ ID NO: 311892 - RNA, 32 nt, Human
agagacaggguuuugccauguuggccaggcug

SEQ ID NO: 311893 - RNA, 32 nt, Human
agagacaggguuuugccauguuguccaggcua

SEQ ID NO: 311894 - RNA, 32 nt, Human
agagacagguuagagggaaagaggcuugggaa

SEQ ID NO: 311895 - RNA, 32 nt, Human
agagacagguuuucaccauguuggccaggcug

SEQ ID NO: 311896 - RNA, 32 nt, Human
agagacaguaaaugguggcauuuuuagugaag

SEQ ID NO: 311897 - RNA, 32 nt, Human
agagacagugucuuucauuugaugagucuggg

SEQ ID NO: 311898 - RNA, 32 nt, Human
agagacaguguuuagccauguugcccaggcug

SEQ ID NO: 311899 - RNA, 32 nt, Human
agagacaguguuucaccauguugaccaggcug

SEQ ID NO: 311900 - RNA, 32 nt, Human
agagacaguguuucaccauguuggccaggcug

SEQ ID NO: 311901 - RNA, 32 nt, Human
agagacaguguuucgccauguuggccaggcug

SEQ ID NO: 311902 - RNA, 32 nt, Human
agagacaguucugggagugugaccuguaagcc

SEQ ID NO: 311903 - RNA, 32 nt, Human
agagacauagucuugcucuguuacccaugcug

SEQ ID NO: 311904 - RNA, 32 nt, Human
agagacaucccuugacuuuuguggccuggggg

SEQ ID NO: 311905 - RNA, 32 nt, Human
agagacaucucaucugcuguauuuuacuuagu

SEQ ID NO: 311906 - RNA, 32 nt, Human
agagacaucugacuucauuucccuucauuaac

SEQ ID NO: 311907 - RNA, 32 nt, Human
agagacaugauccugaaccagaaaaaguaaaa

SEQ ID NO: 311908 - RNA, 32 nt, Human
agagacaugcaaauuaaaacuacaaugagaca

SEQ ID NO: 311909 - RNA, 32 nt, Human
agagacaugcaggugagcccuuuugucaggcu

SEQ ID NO: 311910 - RNA, 32 nt, Human
agagacauggcgauaauucaugcugaagagga

SEQ ID NO: 311911 - RNA, 32 nt, Human
agagacaugggaucacggaagacugaagcaga

SEQ ID NO: 311912 - RNA, 32 nt, Human
agagacaugguuacuguguaauaaaagaaaaa

SEQ ID NO: 311913 - RNA, 32 nt, Human
agagacaugguuuugccauguuggccaggcug

SEQ ID NO: 311914 - RNA, 32 nt, Human
agagacaugucauauucaacagggcacaugac

SEQ ID NO: 311915 - RNA, 32 nt, Human
agagacauguccugggugacaugggaugugac

SEQ ID NO: 311916 - RNA, 32 nt, Human
agagacauucuccuugcagcuaccuccaugug

SEQ ID NO: 311917 - RNA, 32 nt, Human
agagacauucugcacacacacucacacacaca

SEQ ID NO: 311918 - RNA, 32 nt, Human
agagacauuucuggauccaggccaggugaaga

SEQ ID NO: 311919 - RNA, 22 nt, Human
agagaccaacagaacacaggga

SEQ ID NO: 311920 - RNA, 32 nt, Human
agagaccacaccacugcacuccugccugggca

SEQ ID NO: 311921 - RNA, 32 nt, Human
agagaccacagcucuuguucccgcugauccug

SEQ ID NO: 311922 - RNA, 32 nt, Human
agagaccacguuucgccauguuguccagacug

SEQ ID NO: 311923 - RNA, 32 nt, Human
agagaccacugcacuccagccugggcaacaga

SEQ ID NO: 311924 - RNA, 32 nt, Human
agagaccagagagucccugccacuaguuuuca

SEQ ID NO: 311925 - RNA, 32 nt, Human
agagaccagccuggccagcauagugaaacccc

SEQ ID NO: 311926 - RNA, 32 nt, Human
agagaccaggcaacauacacacugcagaaggu

SEQ ID NO: 311927 - RNA, 18 nt, Human
agagaccaggccccaccg

SEQ ID NO: 311928 - RNA, 32 nt, Human
agagaccaggccugcuggguguguacauaguu

SEQ ID NO: 311929 - RNA, 32 nt, Human
agagaccagguuucaccauguuggccaggcug

SEQ ID NO: 311930 - RNA, 32 nt, Human
agagaccaucuaucaccuuuuccccaaagaag

SEQ ID NO: 311931 - RNA, 32 nt, Human
agagaccauggacuguggacucuuuaggucuc

SEQ ID NO: 311932 - RNA, 23 nt, Human
agagacccaaggcuccagaugga

SEQ ID NO: 311933 - RNA, 32 nt, Human
agagacccagaacuuccacagaaggaggaaaa

SEQ ID NO: 311934 - RNA, 32 nt, Human
agagacccagagagcuccaucaccccuucugc

SEQ ID NO: 311935 - RNA, 32 nt, Human
agagacccagcagauguaacucucauuguagc

SEQ ID NO: 311936 - RNA, 19 nt, Human
agagacccaugucaucuua

SEQ ID NO: 311937 - RNA, 32 nt, Human
agagaccccaggcagccugagcucuuggaugu

SEQ ID NO: 311938 - RNA, 32 nt, Human
agagacccggguagggacagggacagagagac

SEQ ID NO: 311939 - RNA, 32 nt, Human
agagacccgugccagugcagguccuugguaug

SEQ ID NO: 311940 - RNA, 32 nt, Human
agagacccguggauugcugugcccugcccucc

SEQ ID NO: 311941 - RNA, 32 nt, Human
agagacccuuuaaaccauugucagcaugcaca

SEQ ID NO: 311942 - RNA, 32 nt, Human
agagaccgagccacuguacuccagccuaggug

SEQ ID NO: 311943 - RNA, 32 nt, Human
agagaccgaguuucgccauguuggccaggcug

SEQ ID NO: 311944 - RNA, 32 nt, Human
agagaccgcgacgccccauccugggccgggcc

SEQ ID NO: 311945 - RNA, 32 nt, Human
agagaccgggcuucaccauguuggccaggcug

SEQ ID NO: 311946 - RNA, 32 nt, Human
agagaccgggucuugccaugcugcccaggcca

SEQ ID NO: 311947 - RNA, 32 nt, Human
agagaccggguuucaccauguuggccaggcug

SEQ ID NO: 311948 - RNA, 32 nt, Human
agagaccggguuuugccauguuggccaggcug

SEQ ID NO: 311949 - RNA, 32 nt, Human
agagaccgguuuucaccacguuggccaggaug

SEQ ID NO: 311950 - RNA, 32 nt, Human
agagaccguaagagaagagagacaaagagaua

SEQ ID NO: 311951 - RNA, 19 nt, Human
agagaccgugggccaggaa

SEQ ID NO: 311952 - RNA, 32 nt, Human
agagaccuaauguaacaaaacgauaauauuuc

SEQ ID NO: 311953 - RNA, 32 nt, Human
agagaccuagacacaguggacaauggcauccu

SEQ ID NO: 311954 - RNA, 32 nt, Human
agagaccuagucugccuucuuucacaagauaa

SEQ ID NO: 311955 - RNA, 32 nt, Human
agagaccucacagcauuguagggcgggguggu

SEQ ID NO: 311956 - RNA, 32 nt, Human
agagaccuccaggugguccuucuggggagaag

SEQ ID NO: 311957 - RNA, 32 nt, Human
agagaccugcagccccuguuucguggcagaca

SEQ ID NO: 311958 - RNA, 32 nt, Human
agagaccugcagcuuugguuuauaaguguuug

SEQ ID NO: 311959 - RNA, 32 nt, Human
agagaccugcuguuauucgcuuuuguucucca

SEQ ID NO: 311960 - RNA, 32 nt, Human
agagaccugggcucaucuugaaugauucucau

SEQ ID NO: 311961 - RNA, 32 nt, Human
agagaccugugcaagggcgccuuguaggagcc

SEQ ID NO: 311962 - RNA, 32 nt, Human
agagaccuuaguccggugugguggcucacacc

SEQ ID NO: 311963 - RNA, 32 nt, Human
agagaccuuauccugauccugaagacgagauu

SEQ ID NO: 311964 - RNA, 32 nt, Human
agagaccuucaguaggcucagaacagcugcgc

SEQ ID NO: 311965 - RNA, 32 nt, Human
agagaccuuccaccgggggcaggauuugugau

SEQ ID NO: 311966 - RNA, 32 nt, Human
agagacgaaguuucaccauguuggccaggcug

SEQ ID NO: 311967 - RNA, 32 nt, Human
agagacgagcccaggaggcugacuggcucaaa

SEQ ID NO: 311968 - RNA, 32 nt, Human
agagacgagccccugacacccagauucauugc

SEQ ID NO: 311969 - RNA, 32 nt, Human
agagacgaggcuucaccauguuggccaggcug

SEQ ID NO: 311970 - RNA, 32 nt, Human
agagacgaggucccaccauguugcccaggcug

SEQ ID NO: 311971 - RNA, 32 nt, Human
agagacgaggucucacuauguugcccaggcug

SEQ ID NO: 311972 - RNA, 32 nt, Human
agagacgaggucuugcuauguugcccaggcug

SEQ ID NO: 311973 - RNA, 32 nt, Human
agagacgaggucuugcucuguugcccaggcug

SEQ ID NO: 311974 - RNA, 32 nt, Human
agagacgaggucuugugauauugcccaggcug

SEQ ID NO: 311975 - RNA, 32 nt, Human
agagacgagguuucaccaucuuggccaggcug

SEQ ID NO: 311976 - RNA, 32 nt, Human
agagacgagguuucaccaugcuggccaagcug

SEQ ID NO: 311977 - RNA, 32 nt, Human
agagacgagguuucaccauguugaccaggcug

SEQ ID NO: 311978 - RNA, 32 nt, Human
agagacgagguuucaccauguugcccaggcug

SEQ ID NO: 311979 - RNA, 32 nt, Human
agagacgagguuucaccauguuggccaggcua

SEQ ID NO: 311980 - RNA, 32 nt, Human
agagacgagguuucaccauguuggccaggcug

SEQ ID NO: 311981 - RNA, 32 nt, Human
agagacgagguuucacuguguuggccaggaug

SEQ ID NO: 311982 - RNA, 32 nt, Human
agagacgagguuucaguuuguugcccaagcug

SEQ ID NO: 311983 - RNA, 32 nt, Human
agagacgagguuucgccauguugcccaggcug

SEQ ID NO: 311984 - RNA, 32 nt, Human
agagacgagguuuugccauguuggccaggcug

SEQ ID NO: 311985 - RNA, 32 nt, Human
agagacgagucaguaagcauucauucauuagu

SEQ ID NO: 311986 - RNA, 32 nt, Human
agagacgagugggagagcgagugcagcgaggg

SEQ ID NO: 311987 - RNA, 32 nt, Human
agagacgcaaucuccccucccucccauccccc

SEQ ID NO: 311988 - RNA, 32 nt, Human
agagacgcagagagacagagacguggagagac

SEQ ID NO: 311989 - RNA, 32 nt, Human
agagacgccguucuuccugucucagcuuggcc

SEQ ID NO: 311990 - RNA, 32 nt, Human
agagacgcugggauuaguggguggggaugcgg

SEQ ID NO: 311991 - RNA, 21 nt, Human
agagacggacuccuguucacc

SEQ ID NO: 311992 - RNA, 32 nt, Human
agagacggagaaagaaauggccaguuggcaag

SEQ ID NO: 311993 - RNA, 32 nt, Human
agagacggagaaagggaagaggcugggauggu

SEQ ID NO: 311994 - RNA, 32 nt, Human
agagacggagcaaguugccugaggucacagag

SEQ ID NO: 311995 - RNA, 32 nt, Human
agagacggagcccggcccugcgccuccgcacc

SEQ ID NO: 311996 - RNA, 32 nt, Human
agagacggaggugggaggauugcccgagucca

SEQ ID NO: 311997 - RNA, 32 nt, Human
agagacggagucccgcucugucacgcaggcug

SEQ ID NO: 311998 - RNA, 32 nt, Human
agagacggagucucccuauguugccuaggcug

SEQ ID NO: 311999 - RNA, 32 nt, Human
agagacggaguugcaccauguuggccaggcug

SEQ ID NO: 312000 - RNA, 32 nt, Human
agagacggaguuucaccauguuagccaggcug

SEQ ID NO: 312001 - RNA, 32 nt, Human
agagacggaguuucaccauguugaccaggcug

SEQ ID NO: 312002 - RNA, 32 nt, Human
agagacggaguuucaccauguuggccacgcug

SEQ ID NO: 312003 - RNA, 32 nt, Human
agagacggaguuucaccauguuggccaggcug

SEQ ID NO: 312004 - RNA, 32 nt, Human
agagacggaguuucaccauguugguuaggcug

SEQ ID NO: 312005 - RNA, 32 nt, Human
agagacggaguuucuccauguuggccagacug

SEQ ID NO: 312006 - RNA, 32 nt, Human
agagacggaguuuugccauguuggccaagcug

SEQ ID NO: 312007 - RNA, 32 nt, Human
agagacggcauuucaccauguuggccaggcug

SEQ ID NO: 312008 - RNA, 32 nt, Human
agagacggcguuucaccauguuggccaggcug

SEQ ID NO: 312009 - RNA, 32 nt, Human
agagacggcguuucaccauuuuggccggccuc

SEQ ID NO: 312010 - RNA, 32 nt, Human
agagacggcguuucaccguguuggccaggcuc

SEQ ID NO: 312011 - RNA, 32 nt, Human
agagacggcuggccaccaugcacggcuccugc

SEQ ID NO: 312012 - RNA, 19 nt, Human
agagacgggaagagggggg

SEQ ID NO: 312013 - RNA, 32 nt, Human
agagacgggaccaggaaggaacugaggaccaa

SEQ ID NO: 312014 - RNA, 32 nt, Human
agagacgggagagagaagaagaguggguuuga

SEQ ID NO: 312015 - RNA, 32 nt, Human
agagacgggauucuaccauguugcccaggcug

SEQ ID NO: 312016 - RNA, 32 nt, Human
agagacgggauuucaccauguuggccaggaug

SEQ ID NO: 312017 - RNA, 32 nt, Human
agagacgggauuucaccauguuggccaggcua

SEQ ID NO: 312018 - RNA, 32 nt, Human
agagacgggauuucaccauguuggucaggcug

SEQ ID NO: 312019 - RNA, 32 nt, Human
agagacgggauuucaucauguugcccaggcug

SEQ ID NO: 312020 - RNA, 32 nt, Human
agagacgggauuucuccauguugaucaggcug

SEQ ID NO: 312021 - RNA, 32 nt, Human
agagacgggcugggcuggcacucacccacgac

SEQ ID NO: 312022 - RNA, 32 nt, Human
agagacgggcuuucaccauguuagccaggaug

SEQ ID NO: 312023 - RNA, 32 nt, Human
agagacggggauucaccauguuggccaggcug

SEQ ID NO: 312024 - RNA, 32 nt, Human
agagacggggcuucaccaucuuggccaggcug

SEQ ID NO: 312025 - RNA, 32 nt, Human
agagacggggcuucuccauguuggucaggcug

SEQ ID NO: 312026 - RNA, 32 nt, Human
agagacggggcuuugccauguuggccaggcug

SEQ ID NO: 312027 - RNA, 32 nt, Human
agagacggggguuugccauguugcccagacug

SEQ ID NO: 312028 - RNA, 32 nt, Human
agagacgggguaucacuauauuggucaggcug

SEQ ID NO: 312029 - RNA, 32 nt, Human
agagacggggucucgcaacauugcccagacuu

SEQ ID NO: 312030 - RNA, 32 nt, Human
agagacggggucuugcuauguuguccaggcug

SEQ ID NO: 312031 - RNA, 32 nt, Human
agagacgggguuuaaccauguuggccaggaug

SEQ ID NO: 312032 - RNA, 32 nt, Human
agagacgggguuucaacauauuggccaggcug

SEQ ID NO: 312033 - RNA, 32 nt, Human
agagacgggguuucaacauguugaccaggaug

SEQ ID NO: 312034 - RNA, 32 nt, Human
agagacgggguuucaccacauugcucaggcug

SEQ ID NO: 312035 - RNA, 32 nt, Human
agagacgggguuucaccacauuggccaggcug

SEQ ID NO: 312036 - RNA, 32 nt, Human
agagacgggguuucaccacauuggucaggcug

SEQ ID NO: 312037 - RNA, 32 nt, Human
agagacgggguuucaccacguuggccaggaug

SEQ ID NO: 312038 - RNA, 32 nt, Human
agagacgggguuucaccacguuggccaggcug

SEQ ID NO: 312039 - RNA, 32 nt, Human
agagacgggguuucaccacguuggccgggcag

SEQ ID NO: 312040 - RNA, 32 nt, Human
agagacgggguuucaccagguuagccaggaug

SEQ ID NO: 312041 - RNA, 32 nt, Human
agagacgggguuucaccaguguuggccaggcu

SEQ ID NO: 312042 - RNA, 32 nt, Human
agagacgggguuucaccauacuggccaggcug

SEQ ID NO: 312043 - RNA, 32 nt, Human
agagacgggguuucaccauacuggccagguug

SEQ ID NO: 312044 - RNA, 32 nt, Human
agagacgggguuucaccauauuggccaagcug

SEQ ID NO: 312045 - RNA, 32 nt, Human
agagacgggguuucaccauauuggccaggcug

SEQ ID NO: 312046 - RNA, 32 nt, Human
agagacgggguuucaccaucuuggccaggcug

SEQ ID NO: 312047 - RNA, 32 nt, Human
agagacgggguuucaccaucuuggccagguug

SEQ ID NO: 312048 - RNA, 32 nt, Human
agagacgggguuucaccaugcaagcccagcug

SEQ ID NO: 312049 - RNA, 32 nt, Human
agagacgggguuucaccaugcuggccaggcug

SEQ ID NO: 312050 - RNA, 32 nt, Human
agagacgggguuucaccaugucggccaggcug

SEQ ID NO: 312051 - RNA, 32 nt, Human
agagacgggguuucaccauguuaccaggaugg

SEQ ID NO: 312052 - RNA, 32 nt, Human
agagacgggguuucaccauguuaccuagggug

SEQ ID NO: 312053 - RNA, 32 nt, Human
agagacgggguuucaccauguuagacaggaug

SEQ ID NO: 312054 - RNA, 32 nt, Human
agagacgggguuucaccauguuagccaagaug

SEQ ID NO: 312055 - RNA, 32 nt, Human
agagacgggguuucaccauguuagccaggaug

SEQ ID NO: 312056 - RNA, 32 nt, Human
agagacgggguuucaccauguuagccaggcua

SEQ ID NO: 312057 - RNA, 32 nt, Human
agagacgggguuucaccauguuagccaggcug

SEQ ID NO: 312058 - RNA, 32 nt, Human
agagacgggguuucaccauguuagcuaggaug

SEQ ID NO: 312059 - RNA, 32 nt, Human
agagacgggguuucaccauguuaggauagucu

SEQ ID NO: 312060 - RNA, 32 nt, Human
agagacgggguuucaccauguucgccaggaua

SEQ ID NO: 312061 - RNA, 32 nt, Human
agagacgggguuucaccauguugaccaggaug

SEQ ID NO: 312062 - RNA, 32 nt, Human
agagacgggguuucaccauguugaccaggcug

SEQ ID NO: 312063 - RNA, 32 nt, Human
agagacgggguuucaccauguugcccaggaug

SEQ ID NO: 312064 - RNA, 32 nt, Human
agagacgggguuucaccauguugcccaggcug

SEQ ID NO: 312065 - RNA, 32 nt, Human
agagacgggguuucaccauguugcccagguug

SEQ ID NO: 312066 - RNA, 32 nt, Human
agagacgggguuucaccauguugcucaggcug

SEQ ID NO: 312067 - RNA, 32 nt, Human
agagacgggguuucaccauguuggccaagaug

SEQ ID NO: 312068 - RNA, 32 nt, Human
agagacgggguuucaccauguuggccagacug

SEQ ID NO: 312069 - RNA, 32 nt, Human
agagacgggguuucaccauguuggccaggaug

SEQ ID NO: 312070 - RNA, 32 nt, Human
agagacgggguuucaccauguuggccaggcua

SEQ ID NO: 312071 - RNA, 32 nt, Human
agagacgggguuucaccauguuggccaggcug

SEQ ID NO: 312072 - RNA, 32 nt, Human
agagacgggguuucaccauguuggccgggaug

SEQ ID NO: 312073 - RNA, 32 nt, Human
agagacgggguuucaccauguuggcuaggaug

SEQ ID NO: 312074 - RNA, 32 nt, Human
agagacgggguuucaccauguuggcuaggcug

SEQ ID NO: 312075 - RNA, 32 nt, Human
agagacgggguuucaccauguugggcaggcua

SEQ ID NO: 312076 - RNA, 32 nt, Human
agagacgggguuucaccauguuggucaggaug

SEQ ID NO: 312077 - RNA, 32 nt, Human
agagacgggguuucaccauguuggucaggcug

SEQ ID NO: 312078 - RNA, 32 nt, Human
agagacgggguuucaccauguuggucagguug

SEQ ID NO: 312079 - RNA, 32 nt, Human
agagacgggguuucaccauguugucaggcugg

SEQ ID NO: 312080 - RNA, 32 nt, Human
agagacgggguuucaccauguuguccaggcua

SEQ ID NO: 312081 - RNA, 32 nt, Human
agagacgggguuucaccauuuugaccaggaug

SEQ ID NO: 312082 - RNA, 32 nt, Human
agagacgggguuucaccauuuuggccaggaug

SEQ ID NO: 312083 - RNA, 32 nt, Human
agagacgggguuucaccguauuaccaggaugu

SEQ ID NO: 312084 - RNA, 32 nt, Human
agagacgggguuucaccguauuagccaggaug

SEQ ID NO: 312085 - RNA, 32 nt, Human
agagacgggguuucaccguguuaaccaggaug

SEQ ID NO: 312086 - RNA, 32 nt, Human
agagacgggguuucaccguguuagccaagaug

SEQ ID NO: 312087 - RNA, 32 nt, Human
agagacgggguuucaccguguuagccaggaag

SEQ ID NO: 312088 - RNA, 32 nt, Human
agagacgggguuucaccguguuagccaggaua

SEQ ID NO: 312089 - RNA, 32 nt, Human
agagacgggguuucaccguguuagccaggaug

SEQ ID NO: 312090 - RNA, 32 nt, Human
agagacgggguuucaccguguuagccagggug

SEQ ID NO: 312091 - RNA, 32 nt, Human
agagacgggguuucaccguguuagccgggaug

SEQ ID NO: 312092 - RNA, 32 nt, Human
agagacgggguuucaccguguuagucaggaug

SEQ ID NO: 312093 - RNA, 32 nt, Human
agagacgggguuucaccguguugaccaggaug

SEQ ID NO: 312094 - RNA, 32 nt, Human
agagacgggguuucaccguguugcccaggcug

SEQ ID NO: 312095 - RNA, 32 nt, Human
agagacgggguuucaccguguuggccaggaug

SEQ ID NO: 312096 - RNA, 32 nt, Human
agagacgggguuucaccguguuggccaggcug

SEQ ID NO: 312097 - RNA, 32 nt, Human
agagacgggguuucaccguguuggccgggcug

SEQ ID NO: 312098 - RNA, 32 nt, Human
agagacgggguuucaccguguuggcuaggcug

SEQ ID NO: 312099 - RNA, 32 nt, Human
agagacgggguuucaccguguuguccaggaug

SEQ ID NO: 312100 - RNA, 32 nt, Human
agagacgggguuucaccucgauggccagguug

SEQ ID NO: 312101 - RNA, 32 nt, Human
agagacgggguuucaccuguuagccaggaugg

SEQ ID NO: 312102 - RNA, 32 nt, Human
agagacgggguuucaccuuguuagccaggaug

SEQ ID NO: 312103 - RNA, 32 nt, Human
agagacgggguuucaccuuguuggccaggaug

SEQ ID NO: 312104 - RNA, 32 nt, Human
agagacgggguuucacuauauuggccaggcug

SEQ ID NO: 312105 - RNA, 32 nt, Human
agagacgggguuucacuaugcuggccaggcuc

SEQ ID NO: 312106 - RNA, 32 nt, Human
agagacgggguuucacuauguuggccaggaua

SEQ ID NO: 312107 - RNA, 32 nt, Human
agagacgggguuucacuauguuggccaggcug

SEQ ID NO: 312108 - RNA, 32 nt, Human
agagacgggguuucacucugucacccaggcug

SEQ ID NO: 312109 - RNA, 32 nt, Human
agagacgggguuucacuguggucucaaucucc

SEQ ID NO: 312110 - RNA, 32 nt, Human
agagacgggguuucacuguguuagccaggaaa

SEQ ID NO: 312111 - RNA, 32 nt, Human
agagacgggguuucacuguguuagccaggacg

SEQ ID NO: 312112 - RNA, 32 nt, Human
agagacgggguuucacuguguuagccaggaug

SEQ ID NO: 312113 - RNA, 32 nt, Human
agagacgggguuucacuguguugcccaggcug

SEQ ID NO: 312114 - RNA, 32 nt, Human
agagacgggguuucacuguguuggccaggcug

SEQ ID NO: 312115 - RNA, 32 nt, Human
agagacgggguuucacuuuguuagccaggaug

SEQ ID NO: 312116 - RNA, 32 nt, Human
agagacgggguuucagcauauugaccaggcug

SEQ ID NO: 312117 - RNA, 32 nt, Human
agagacgggguuucagcauguuggcuaggccg

SEQ ID NO: 312118 - RNA, 32 nt, Human
agagacgggguuucaucauauuggucaggcug

SEQ ID NO: 312119 - RNA, 32 nt, Human
agagacgggguuucaucauguuggccaggaug

SEQ ID NO: 312120 - RNA, 32 nt, Human
agagacgggguuucaucauguuggccaggcua

SEQ ID NO: 312121 - RNA, 32 nt, Human
agagacgggguuucaucauguuggccaggcug

SEQ ID NO: 312122 - RNA, 32 nt, Human
agagacgggguuucaucguguuaaccaggaug

SEQ ID NO: 312123 - RNA, 32 nt, Human
agagacgggguuucaucguguuagccaggaug

SEQ ID NO: 312124 - RNA, 32 nt, Human
agagacgggguuuccccacguugaccaggcug

SEQ ID NO: 312125 - RNA, 32 nt, Human
agagacgggguuuccccauguuggucaggcug

SEQ ID NO: 312126 - RNA, 32 nt, Human
agagacgggguuuccccauguugguuaggcuc

SEQ ID NO: 312127 - RNA, 32 nt, Human
agagacgggguuuccccguguuagccaggaug

SEQ ID NO: 312128 - RNA, 32 nt, Human
agagacgggguuucgccaaguugaccagccca

SEQ ID NO: 312129 - RNA, 32 nt, Human
agagacgggguuucgccauguuacccagacug

SEQ ID NO: 312130 - RNA, 32 nt, Human
agagacgggguuucgccauguugcccaggcug

SEQ ID NO: 312131 - RNA, 32 nt, Human
agagacgggguuucgccauguugcccagguug

SEQ ID NO: 312132 - RNA, 32 nt, Human
agagacgggguuucgccauguuggccaggcua

SEQ ID NO: 312133 - RNA, 32 nt, Human
agagacgggguuucgccauguuggcuagccug

SEQ ID NO: 312134 - RNA, 32 nt, Human
agagacgggguuucgccauguuggucaggcug

SEQ ID NO: 312135 - RNA, 32 nt, Human
agagacgggguuucgccauguuguccgggcug

SEQ ID NO: 312136 - RNA, 32 nt, Human
agagacgggguuucgccauuuggccaggcugg

SEQ ID NO: 312137 - RNA, 32 nt, Human
agagacgggguuucgccauuuuggccaggcug

SEQ ID NO: 312138 - RNA, 32 nt, Human
agagacgggguuucgccguguuggccaggaug

SEQ ID NO: 312139 - RNA, 32 nt, Human
agagacgggguuucgcuauuuuggccgggcug

SEQ ID NO: 312140 - RNA, 32 nt, Human
agagacgggguuucgcuguucccaggcugguc

SEQ ID NO: 312141 - RNA, 32 nt, Human
agagacgggguuucggcauguuggccaggcca

SEQ ID NO: 312142 - RNA, 32 nt, Human
agagacgggguuucguccuguuacccaggcug

SEQ ID NO: 312143 - RNA, 32 nt, Human
agagacgggguuucuccacauuggucaggcug

SEQ ID NO: 312144 - RNA, 32 nt, Human
agagacgggguuucuccauguuagucaggcug

SEQ ID NO: 312145 - RNA, 32 nt, Human
agagacgggguuucuccauguuggucagacug

SEQ ID NO: 312146 - RNA, 32 nt, Human
agagacgggguuucuccauguuggucaggcug

SEQ ID NO: 312147 - RNA, 32 nt, Human
agagacgggguuucuccauguuggucuggcug

SEQ ID NO: 312148 - RNA, 32 nt, Human
agagacgggguuucuccauguugguuaggcug

SEQ ID NO: 312149 - RNA, 32 nt, Human
agagacgggguuucuccguguuggucaggcug

SEQ ID NO: 312150 - RNA, 32 nt, Human
agagacgggguuucuccuuguuggucaggcug

SEQ ID NO: 312151 - RNA, 32 nt, Human
agagacgggguuugaccauguuggucagggug

SEQ ID NO: 312152 - RNA, 32 nt, Human
agagacgggguuuuaccauguuggccagguug

SEQ ID NO: 312153 - RNA, 32 nt, Human
agagacgggguuuuacuauguugcccaggcag

SEQ ID NO: 312154 - RNA, 32 nt, Human
agagacgggguuuugccauguugcccaggcug

SEQ ID NO: 312155 - RNA, 32 nt, Human
agagacgggguuuugccauguugcccgggcug

SEQ ID NO: 312156 - RNA, 32 nt, Human
agagacgggguuuugccauguuggccaggccg

SEQ ID NO: 312157 - RNA, 32 nt, Human
agagacgggguuuugccauguuggccaggcug

SEQ ID NO: 312158 - RNA, 32 nt, Human
agagacgggguuuugccauguuggccaugcug

SEQ ID NO: 312159 - RNA, 32 nt, Human
agagacgggguuuugucucauugcccaggcug

SEQ ID NO: 312160 - RNA, 18 nt, Human
agagacgggucuuuggga

SEQ ID NO: 312161 - RNA, 32 nt, Human
agagacggguuuucaccauguugccccgguug

SEQ ID NO: 312162 - RNA, 32 nt, Human
agagacggguuuucgccauguugccucagcua

SEQ ID NO: 312163 - RNA, 32 nt, Human
agagacggucccggaagaaugggacucuguuc

SEQ ID NO: 312164 - RNA, 32 nt, Human
agagacggucuuuauugggucugcaccuccau

SEQ ID NO: 312165 - RNA, 32 nt, Human
agagacggugucuuguucugucacucaggcug

SEQ ID NO: 312166 - RNA, 32 nt, Human
agagacgguguuucaccauauuggccaggcug

SEQ ID NO: 312167 - RNA, 32 nt, Human
agagacgguguuucaccauguuggucaggcug

SEQ ID NO: 312168 - RNA, 32 nt, Human
agagacgguguuuugccauguuggccaggcug

SEQ ID NO: 312169 - RNA, 32 nt, Human
agagacguaaauuuaaggugugccugugucag

SEQ ID NO: 312170 - RNA, 32 nt, Human
agagacgugcugcuuagaaugugaacugagca

SEQ ID NO: 312171 - RNA, 32 nt, Human
agagacguggaaagacagggagagagacacgg

SEQ ID NO: 312172 - RNA, 32 nt, Human
agagacguggcgccccacccagucucauccgg

SEQ ID NO: 312173 - RNA, 32 nt, Human
agagacgugggagacagugaaaggcugucagg

SEQ ID NO: 312174 - RNA, 32 nt, Human
agagacgugguuucaccauguuggccagacug

SEQ ID NO: 312175 - RNA, 32 nt, Human
agagacuacaaacuccccaaaaccacuuaccc

SEQ ID NO: 312176 - RNA, 18 nt, Human
agagacuacagaagaaug

SEQ ID NO: 312177 - RNA, 32 nt, Human
agagacuacagauggauaauuggacuuaagcc

SEQ ID NO: 312178 - RNA, 32 nt, Human
agagacuacuacaaaauuggaaaaagauuggc

SEQ ID NO: 312179 - RNA, 32 nt, Human
agagacuagguuucaccauguuguccaggcuu

SEQ ID NO: 312180 - RNA, 32 nt, Human
agagacuaguacuacaaaaagggaccacauuu

SEQ ID NO: 312181 - RNA, 23 nt, Human
agagacuauaaagauuucacaaa

SEQ ID NO: 312182 - RNA, 32 nt, Human
agagacuaucagcggcagaucucuccagggaa

SEQ ID NO: 312183 - RNA, 32 nt, Human
agagacuaugcuguucacucugaugaccccag

SEQ ID NO: 312184 - RNA, 32 nt, Human
agagacucagcgcuccuccugugugacuggca

SEQ ID NO: 312185 - RNA, 32 nt, Human
agagacucaggcaggaggaucacuugagcuua

SEQ ID NO: 312186 - RNA, 21 nt, Human
agagacuccagaggccaggga

SEQ ID NO: 312187 - RNA, 32 nt, Human
agagacuccaucucaaaacaaaaacaaacaaa

SEQ ID NO: 312188 - RNA, 32 nt, Human
agagacucccaugccccacugcaggccugggc

SEQ ID NO: 312189 - RNA, 23 nt, Human
agagacucggcgcccggagccag

SEQ ID NO: 312190 - RNA, 32 nt, Human
agagacucgguuucaccauguuggucaggcug

SEQ ID NO: 312191 - RNA, 32 nt, Human
agagacucuauuuucucccaaagacacuauuu

SEQ ID NO: 312192 - RNA, 32 nt, Human
agagacucucuuccugugugcaugcagcagaa

SEQ ID NO: 312193 - RNA, 32 nt, Human
agagacucugaguuuaugaucugugccauaaa

SEQ ID NO: 312194 - RNA, 32 nt, Human
agagacucuguuucccuucagggaguuuuaaa

SEQ ID NO: 312195 - RNA, 32 nt, Human
agagacugacagccucugccccaggccugagu

SEQ ID NO: 312196 - RNA, 32 nt, Human
agagacugaggcaggagaaucgcuugaaccca

SEQ ID NO: 312197 - RNA, 23 nt, Human
agagacugaucauccaggccuca

SEQ ID NO: 312198 - RNA, 32 nt, Human
agagacugauggaaguuagagagguggaggag

SEQ ID NO: 312199 - RNA, 32 nt, Human
agagacugcagcuguugaauccuuucugcuaa

SEQ ID NO: 312200 - RNA, 32 nt, Human
agagacugcccagcuaugacuggcuucuucaa

SEQ ID NO: 312201 - RNA, 32 nt, Human
agagacugcugccagcuaccagccuggcuggc

SEQ ID NO: 312202 - RNA, 32 nt, Human
agagacuggaaacugccuucaaggccacggcu

SEQ ID NO: 312203 - RNA, 32 nt, Human
agagacuggaagagacagagaucagagggaga

SEQ ID NO: 312204 - RNA, 32 nt, Human
agagacuggcagcaccuccuggaacacaagcc

SEQ ID NO: 312205 - RNA, 19 nt, Human
agagacuggcagccaggga

SEQ ID NO: 312206 - RNA, 32 nt, Human
agagacuggcucugccuucuucaacauguucc

SEQ ID NO: 312207 - RNA, 32 nt, Human
agagacugggagaguggggaggggccagggac

SEQ ID NO: 312208 - RNA, 32 nt, Human
agagacugggcugaagggagcuagaggcaaaa

SEQ ID NO: 312209 - RNA, 32 nt, Human
agagacugggucgccuuggauucccucugccu

SEQ ID NO: 312210 - RNA, 32 nt, Human
agagacugggucucacucuguugcccaagcug

SEQ ID NO: 312211 - RNA, 32 nt, Human
agagacugggucucgcuguguugcccaggcug

SEQ ID NO: 312212 - RNA, 32 nt, Human
agagacugggucuugcugcauugcccgggcua

SEQ ID NO: 312213 - RNA, 32 nt, Human
agagacugggucuugcuuuguuacccaugcug

SEQ ID NO: 312214 - RNA, 32 nt, Human
agagacuggguuucaccacguuggccaggcug

SEQ ID NO: 312215 - RNA, 32 nt, Human
agagacuggguuucaccauguagaccaggcug

SEQ ID NO: 312216 - RNA, 32 nt, Human
agagacuggguuucaccauguugaccgggaug

SEQ ID NO: 312217 - RNA, 32 nt, Human
agagacuggguuucaccauguuggccaggcuc

SEQ ID NO: 312218 - RNA, 32 nt, Human
agagacuggguuuugccauguugaccaagcug

SEQ ID NO: 312219 - RNA, 32 nt, Human
agagacugguagcgugaaggauuuuggcauuc

SEQ ID NO: 312220 - RNA, 32 nt, Human
agagacuguagauugcuucuguaguacuccuu

SEQ ID NO: 312221 - RNA, 32 nt, Human
agagacuguagcucagggcgugcaaugugagg

SEQ ID NO: 312222 - RNA, 32 nt, Human
agagacugucauggaagaggguggagccgccg

SEQ ID NO: 312223 - RNA, 32 nt, Human
agagacugucauggagggggaggaggaggcgg

SEQ ID NO: 312224 - RNA, 21 nt, Human
agagacugucccugaaaccua

SEQ ID NO: 312225 - RNA, 32 nt, Human
agagacugugccagucccagccgcccuaccgc

SEQ ID NO: 312226 - RNA, 32 nt, Human
agagacuguguguguauguuaggugcucaaua

SEQ ID NO: 312227 - RNA, 32 nt, Human
agagacuguucuguucuguuccuuguguaacu

SEQ ID NO: 312228 - RNA, 32 nt, Human
agagacuguuuccugcuucccaccccaccccg

SEQ ID NO: 312229 - RNA, 32 nt, Human
agagacuuaaagagauuagagagguggagaaa

SEQ ID NO: 312230 - RNA, 32 nt, Human
agagacuuagacccagcacuccuuggauuagc

SEQ ID NO: 312231 - RNA, 32 nt, Human
agagacuucccuaauaaauuaccagggcccug

SEQ ID NO: 312232 - RNA, 32 nt, Human
agagacuuccucuucguuaagucggccuuccc

SEQ ID NO: 312233 - RNA, 32 nt, Human
agagacuucuaggaggaugcugugccucccaa

SEQ ID NO: 312234 - RNA, 32 nt, Human
agagacuucugccuccccuccuacccucuggc

SEQ ID NO: 312235 - RNA, 32 nt, Human
agagacuugaagccugaaagccuggccaaguu

SEQ ID NO: 312236 - RNA, 32 nt, Human
agagacuugaauguaaggacaugggaaaaucu

SEQ ID NO: 312237 - RNA, 32 nt, Human
agagacuugacacuccagucuuagacagggga

SEQ ID NO: 312238 - RNA, 32 nt, Human
agagacuuggaagaggaggaggaggaggagaa

SEQ ID NO: 312239 - RNA, 32 nt, Human
agagacuuguugaaugacuuugcccaaaaugc

SEQ ID NO: 312240 - RNA, 21 nt, Human
agagacuuguuugcucaaaug

SEQ ID NO: 312241 - RNA, 32 nt, Human
agagacuuuacgaauguacagaaugugggaag

SEQ ID NO: 312242 - RNA, 32 nt, Human
agagacuuuugcacaguuucugcuuggagucu

SEQ ID NO: 312243 - RNA, 32 nt, Human
agagagaaaaagaaaugcuguguuuaaucuuc

SEQ ID NO: 312244 - RNA, 16 nt, Human
agagagaaaaauucaa

SEQ ID NO: 312245 - RNA, 32 nt, Human
agagagaaaagaagaauggggaagagaagggc

SEQ ID NO: 312246 - RNA, 32 nt, Human
agagagaaaaugaaagaacaccucuggguccu

SEQ ID NO: 312247 - RNA, 21 nt, Human
agagagaaaaugacugcuggu

SEQ ID NO: 312248 - RNA, 32 nt, Human
agagagaaacagagacagagaggcagagagag

SEQ ID NO: 312249 - RNA, 32 nt, Human
agagagaaagaaagggagagaaguuugagccc

SEQ ID NO: 312250 - RNA, 32 nt, Human
agagagaaagaaugagaaagaaaaggaaugca

SEQ ID NO: 312251 - RNA, 32 nt, Human
agagagaaagagagguggggagaggggagaga

SEQ ID NO: 312252 - RNA, 21 nt, Human
agagagaaagcacggcugagg

SEQ ID NO: 312253 - RNA, 32 nt, Human
agagagaaagcagaaagagaaguaguugugag

SEQ ID NO: 312254 - RNA, 32 nt, Human
agagagaaaggagaagaaugacuauuuaaaga

SEQ ID NO: 312255 - RNA, 32 nt, Human
agagagaaaggaugcaguucccuccuggcaua

SEQ ID NO: 312256 - RNA, 32 nt, Human
agagagaaaggcugccuacaagcaucacaguc

SEQ ID NO: 312257 - RNA, 32 nt, Human
agagagaacaguuaaaucagaguagagaguuu

SEQ ID NO: 312258 - RNA, 32 nt, Human
agagagaacaucauucugccucuuguuuaaca

SEQ ID NO: 312259 - RNA, 32 nt, Human
agagagaaccaccacugccugacugcccgcuc

SEQ ID NO: 312260 - RNA, 32 nt, Human
agagagaaccaggaggguaacagaagaggagg

SEQ ID NO: 312261 - RNA, 32 nt, Human
agagagaacgagccuggauacagcagauguag

SEQ ID NO: 312262 - RNA, 32 nt, Human
agagagaagaggaggagaagggaggggguggc

SEQ ID NO: 312263 - RNA, 32 nt, Human
agagagaaggagaaaugagaaaagaggaaacc

SEQ ID NO: 312264 - RNA, 32 nt, Human
agagagaaggagaaggaggggagccuguccgu

SEQ ID NO: 312265 - RNA, 23 nt, Human
agagagaaggagucaccugcagu

SEQ ID NO: 312266 - RNA, 32 nt, Human
agagagaaggcuccuccucccuucccuggguu

SEQ ID NO: 312267 - RNA, 20 nt, Human
agagagaaguaccacugugg

SEQ ID NO: 312268 - RNA, 32 nt, Human
agagagaaguagaagcuagaaagcacaugaau

SEQ ID NO: 312269 - RNA, 32 nt, Human
agagagaauaaccuccaucuccugggucccag

SEQ ID NO: 312270 - RNA, 32 nt, Human
agagagacagaaugacagagagagaaaaugau

SEQ ID NO: 312271 - RNA, 32 nt, Human
agagagacagagagacagagagaggggaagag

SEQ ID NO: 312272 - RNA, 32 nt, Human
agagagacagaggggaagagaggcagagaggg

SEQ ID NO: 312273 - RNA, 32 nt, Human
agagagacaggagagagagggagggagcgaga

SEQ ID NO: 312274 - RNA, 32 nt, Human
agagagacaggucaccuugcaggccugcuugc

SEQ ID NO: 312275 - RNA, 23 nt, Human
agagagaccccaucucugcaaaa

SEQ ID NO: 312276 - RNA, 24 nt, Human
agagagacccugucucaaaacaaa

SEQ ID NO: 312277 - RNA, 32 nt, Human
agagagacccuuguggguccaugcuaacaaag

SEQ ID NO: 312278 - RNA, 24 nt, Human
agagagaccucugucucuacaaaa

SEQ ID NO: 312279 - RNA, 32 nt, Human
agagagacggcccuucucucuccucacucacc

SEQ ID NO: 312280 - RNA, 32 nt, Human
agagagacucugggcucuuggcucagaugugu

SEQ ID NO: 312281 - RNA, 32 nt, Human
agagagacugcggcgggagggccaggccgugg

SEQ ID NO: 312282 - RNA, 32 nt, Human
agagagagaaaagagguggauggagggaaggg

SEQ ID NO: 312283 - RNA, 32 nt, Human
agagagagaaacaaacuuuucaaggcuuauau

SEQ ID NO: 312284 - RNA, 32 nt, Human
agagagagaaugagacagagacuuaaggaaga

SEQ ID NO: 312285 - RNA, 32 nt, Human
agagagagacagagacagagaaauaagcauua

SEQ ID NO: 312286 - RNA, 32 nt, Human
agagagagacagagacagagagagacugaggg

SEQ ID NO: 312287 - RNA, 32 nt, Human
agagagagaccagccaacagcuugauagacca

SEQ ID NO: 312288 - RNA, 32 nt, Human
agagagagacuauccuggagaagccucguuuu

SEQ ID NO: 312289 - RNA, 32 nt, Human
agagagagagcauguauacccguauguuauca

SEQ ID NO: 312290 - RNA, 32 nt, Human
agagagagagccagaggagggaagagagcgcc

SEQ ID NO: 312291 - RNA, 32 nt, Human
agagagagaguuucaagaaguguaauuguggc

SEQ ID NO: 312292 - RNA, 32 nt, Human
agagagagaugagagaccaaaguuucuagggc

SEQ ID NO: 312293 - RNA, 32 nt, Human
agagagagcucugggccuucuuccugccaguc

SEQ ID NO: 312294 - RNA, 32 nt, Human
agagagaggaaagggaaggaagaaaggaagga

SEQ ID NO: 312295 - RNA, 32 nt, Human
agagagaggacgaacagauaaaagagggugaa

SEQ ID NO: 312296 - RNA, 32 nt, Human
agagagaggagaaagagagagaaggagagaga

SEQ ID NO: 312297 - RNA, 32 nt, Human
agagugggcugcaucugggauucccaccaagg

SEQ ID NO: 312298 - RNA, 32 nt, Human
agaguggggaaagauggggacugagggaaagg

SEQ ID NO: 312299 - RNA, 32 nt, Human
agaguggggaagguucccaugaccagcugggc

SEQ ID NO: 312300 - RNA, 21 nt, Human
agaguggguuucacuauguug

SEQ ID NO: 312301 - RNA, 32 nt, Human
agaguggucugugucuugucuuagacauaucu

SEQ ID NO: 312302 - RNA, 32 nt, Human
agaguggugggagaacagcugcagugaagcac

SEQ ID NO: 312303 - RNA, 32 nt, Human
agagugguuuugaacuccuggccucaagugau

SEQ ID NO: 312304 - RNA, 32 nt, Human
agaguguacuuacacaaaccuagaugguauau

SEQ ID NO: 312305 - RNA, 32 nt, Human
agaguguaggcaggccaggugcaguggcucau

SEQ ID NO: 312306 - RNA, 24 nt, Human
agaguguagucaagggccugggca

SEQ ID NO: 312307 - RNA, 32 nt, Human
agagugucacccaaccugcaggcagugucaug

SEQ ID NO: 312308 - RNA, 32 nt, Human
agagugucacugaauuuugucucugaauucag

SEQ ID NO: 312309 - RNA, 32 nt, Human
agaguguccugcuaccuuugucucacaugauu

SEQ ID NO: 312310 - RNA, 32 nt, Human
agaguguccuucagcuucucucugacugaagg

SEQ ID NO: 312311 - RNA, 29 nt, Human
agagugucggugugugugcaugugugggg

SEQ ID NO: 312312 - RNA, 32 nt, Human
agagugucucagggugcagaggucagacuaag

SEQ ID NO: 312313 - RNA, 32 nt, Human
agagugucugagcugugaggccagugcuccag

SEQ ID NO: 312314 - RNA, 32 nt, Human
agagugucuucccaucagucccugcacuggga

SEQ ID NO: 312315 - RNA, 32 nt, Human
agagugucuugcuauguugcccaggcuggucu

SEQ ID NO: 312316 - RNA, 32 nt, Human
agagugugaauaaguccuggagacaggaccac

SEQ ID NO: 312317 - RNA, 32 nt, Human
agagugugagccaccacacccagccagcaaua

SEQ ID NO: 312318 - RNA, 32 nt, Human
agagugugagccagaagagaugcugaagacac

SEQ ID NO: 312319 - RNA, 21 nt, Human
agagugugagccgcucuccuc

SEQ ID NO: 312320 - RNA, 32 nt, Human
agagugugagccuucucuuaugccuggacagg

SEQ ID NO: 312321 - RNA, 32 nt, Human
agagugugcaguccaacccuauccaauaggga

SEQ ID NO: 312322 - RNA, 32 nt, Human
agagugugcccuuugacuugcaucgucuaccu

SEQ ID NO: 312323 - RNA, 19 nt, Human
agagugugcucgggagugg

SEQ ID NO: 312324 - RNA, 32 nt, Human
agaguguggcugccccuccuugcuccagcagc

SEQ ID NO: 312325 - RNA, 32 nt, Human
agagugugguauagggaaaaggcuccaggcag

SEQ ID NO: 312326 - RNA, 32 nt, Human
agaguguggucuccccaccaacuccaguuuug

SEQ ID NO: 312327 - RNA, 32 nt, Human
agagugugguggcuucucagaguuuccaagca

SEQ ID NO: 312328 - RNA, 32 nt, Human
agaguguguuuuugcacugucuguaccuaaag

SEQ ID NO: 312329 - RNA, 32 nt, Human
agaguguuaagaucuagaucccuucccacugg

SEQ ID NO: 312330 - RNA, 32 nt, Human
agaguguuaccaccagcacccagaccgaaccc

SEQ ID NO: 312331 - RNA, 32 nt, Human
agaguguuccaggaggagguuugagcugagcu

SEQ ID NO: 312332 - RNA, 29 nt, Human
agaguguugcugugugugcuugugauuug

SEQ ID NO: 312333 - RNA, 32 nt, Human
agaguguuggcuuuggauucaggagggaugga

SEQ ID NO: 312334 - RNA, 32 nt, Human
agaguguuuguuuucagccugcuuuuaaagug

SEQ ID NO: 312335 - RNA, 32 nt, Human
agaguuaaaagucauugcucuggagaauuagg

SEQ ID NO: 312336 - RNA, 32 nt, Human
agaguuaagugaaauaauaggcagcauucaaa

SEQ ID NO: 312337 - RNA, 23 nt, Human
agaguuaccauaaugacuucaga

SEQ ID NO: 312338 - RNA, 32 nt, Human
agaguuacucacuuaaaucaaaggacaccaga

SEQ ID NO: 312339 - RNA, 32 nt, Human
agaguuagaccucauccuccccuagcuuagcu

SEQ ID NO: 312340 - RNA, 32 nt, Human
agaguuagguggaucaauugagcccaggaguu

SEQ ID NO: 312341 - RNA, 32 nt, Human
agaguuauagaccgcuaacaccugucacuggc

SEQ ID NO: 312342 - RNA, 32 nt, Human
agaguuaucugugacauuccaucaggcaccua

SEQ ID NO: 312343 - RNA, 32 nt, Human
agaguucaaaugugacuccaccucuuaaaagc

SEQ ID NO: 312344 - RNA, 32 nt, Human
agaguucaagaguucaagaccagccugggcaa

SEQ ID NO: 312345 - RNA, 32 nt, Human
agaguucaagugaaggaaggaggagguuccug

SEQ ID NO: 312346 - RNA, 32 nt, Human
agaguucaaguuuauguuacugccagggucag

SEQ ID NO: 312347 - RNA, 24 nt, Human
agaguucaauagcuguuucuauga

SEQ ID NO: 312348 - RNA, 32 nt, Human
agaguucacagcccuggucuuggcugaggucc

SEQ ID NO: 312349 - RNA, 32 nt, Human
agaguucacaucccuggcuugaucuacaggua

SEQ ID NO: 312350 - RNA, 17 nt, Human
agaguucacuccaggaa

SEQ ID NO: 312351 - RNA, 32 nt, Human
agaguucacugacuccccagccccaggugggc

SEQ ID NO: 312352 - RNA, 32 nt, Human
agaguucagagaggauccccagguccccaggg

SEQ ID NO: 312353 - RNA, 22 nt, Human
agaguucagcagucacuucaga

SEQ ID NO: 312354 - RNA, 32 nt, Human
agaguucagccgcggcggcagcagcagcagac

SEQ ID NO: 312355 - RNA, 32 nt, Human
agaguucaucuucuugaccuuuggccacugcc

SEQ ID NO: 312356 - RNA, 32 nt, Human
agaguucaugaaaacugcaaugcugggaaaag

SEQ ID NO: 312357 - RNA, 32 nt, Human
agaguucaugggcaaaugucacacuuuucuug

SEQ ID NO: 312358 - RNA, 32 nt, Human
agaguucccccuguccccuccaccuucccuca

SEQ ID NO: 312359 - RNA, 32 nt, Human
agaguuccuaaucaagugaagaggaagcuggc

SEQ ID NO: 312360 - RNA, 32 nt, Human
agaguuccuggaggaaagggacuggggacacu

SEQ ID NO: 312361 - RNA, 32 nt, Human
agaguucgagaacuaagcaaauuagcugagac

SEQ ID NO: 312362 - RNA, 32 nt, Human
agaguucuaaggucaccucuggcugcaggcau

SEQ ID NO: 312363 - RNA, 32 nt, Human
agaguucuagaaggagguucucagggguucag

SEQ ID NO: 312364 - RNA, 32 nt, Human
agaguucuagagcuggggguucuugggccaug

SEQ ID NO: 312365 - RNA, 22 nt, Human
agaguucuagauacucaucuua

SEQ ID NO: 312366 - RNA, 32 nt, Human
agaguucuagggaaauggagguuucuaacuug

SEQ ID NO: 312367 - RNA, 32 nt, Human
agaguucuccaccacucuugcauucugggugc

SEQ ID NO: 312368 - RNA, 32 nt, Human
agaguucuccccugcugcuugagaugccagag

SEQ ID NO: 312369 - RNA, 32 nt, Human
agaguucugaacuccucugucauuucauuagg

SEQ ID NO: 312370 - RNA, 32 nt, Human
agaguucugagaaguuuugaaauagcuuggga

SEQ ID NO: 312371 - RNA, 32 nt, Human
agaguucugagcucuguacuuccucuuggccc

SEQ ID NO: 312372 - RNA, 32 nt, Human
agaguucugcuggucagcccugcuccagggga

SEQ ID NO: 312373 - RNA, 32 nt, Human
agaguucuucauuccuugcugcucacauucug

SEQ ID NO: 312374 - RNA, 32 nt, Human
agaguucuuuccugaccucuagcuccauacuu

SEQ ID NO: 312375 - RNA, 32 nt, Human
agaguugaaagagaggccuuaggauucuccuc

SEQ ID NO: 312376 - RNA, 32 nt, Human
agaguugaaagccacagaguugaaagccacag

SEQ ID NO: 312377 - RNA, 20 nt, Human
agaguugaagacagcuuccc

SEQ ID NO: 312378 - RNA, 32 nt, Human
agaguugaagucaaaggaccuuucugacauaa

SEQ ID NO: 312379 - RNA, 32 nt, Human
agaguugacaacaucucacucacguguaucaa

SEQ ID NO: 312380 - RNA, 32 nt, Human
agaguugacauaaaaauugauggccaggcaug

SEQ ID NO: 312381 - RNA, 32 nt, Human
agaguugaccuccagccccaacauccuuccug

SEQ ID NO: 312382 - RNA, 32 nt, Human
agaguugaggcaggcagcaaagacugggaaag

SEQ ID NO: 312383 - RNA, 32 nt, Human
agaguugaugauuacagucuagaguuacuuga

SEQ ID NO: 312384 - RNA, 32 nt, Human
agaguugauugaggcccuagaucaggaccauu

SEQ ID NO: 312385 - RNA, 32 nt, Human
agaguugccggggucugcugggggagaauuuc

SEQ ID NO: 312386 - RNA, 22 nt, Human
agaguugcgggagacccaggag

SEQ ID NO: 312387 - RNA, 32 nt, Human
agaguuggaaacuuccuguguugcccacgcug

SEQ ID NO: 312388 - RNA, 32 nt, Human
agaguuggaagaggagacugggaggcagcaag

SEQ ID NO: 312389 - RNA, 32 nt, Human
agaguuggaaguuggcucccaagggcugacau

SEQ ID NO: 312390 - RNA, 32 nt, Human
agaguuggagagaagggggacguuucuggaac

SEQ ID NO: 312391 - RNA, 32 nt, Human
agaguuggagccaggguucacagccaggcuga

SEQ ID NO: 312392 - RNA, 32 nt, Human
agaguuggagcucuccagcaacaugccugagc

SEQ ID NO: 312393 - RNA, 32 nt, Human
agaguuggaguacuuaguucucuucuugucca

SEQ ID NO: 312394 - RNA, 32 nt, Human
agaguuggccucagaaugaccugcucuggcuc

SEQ ID NO: 312395 - RNA, 32 nt, Human
agaguugggaggaucaccugaugucagggguu

SEQ ID NO: 312396 - RNA, 23 nt, Human
agaguugggaucucacuauguug

SEQ ID NO: 312397 - RNA, 32 nt, Human
agaguugggcacuggcaaaugucuccucccuc

SEQ ID NO: 312398 - RNA, 23 nt, Human
agaguuggggaccccuguuggcc

SEQ ID NO: 312399 - RNA, 32 nt, Human
agaguuggggucucacuguguugcccagacug

SEQ ID NO: 312400 - RNA, 32 nt, Human
agaguugggguugagggcaaacauagaaccca

SEQ ID NO: 312401 - RNA, 32 nt, Human
agaguuggucucuccccuucuacugccuccaa

SEQ ID NO: 312402 - RNA, 32 nt, Human
agaguuguacagccaugaccacuagcuaauuc

SEQ ID NO: 312403 - RNA, 32 nt, Human
agaguugucuccgucuuuccaagaacagaaca

SEQ ID NO: 312404 - RNA, 32 nt, Human
agaguugucuuguccccucuugacccaucucc

SEQ ID NO: 312405 - RNA, 32 nt, Human
agaguugugguuuuccaucugauccuuccacu

SEQ ID NO: 312406 - RNA, 32 nt, Human
agaguuguugacucauaguacaguaaagggug

SEQ ID NO: 312407 - RNA, 32 nt, Human
agaguuguuggagacaguuucagaugauuauu

SEQ ID NO: 312408 - RNA, 32 nt, Human
agaguuguuggggaaggagggagcugaggagg

SEQ ID NO: 312409 - RNA, 32 nt, Human
agaguuguuucucuccacucugccucaucucu

SEQ ID NO: 312410 - RNA, 32 nt, Human
agaguuuaacaugccaagagaugugaaaugug

SEQ ID NO: 312411 - RNA, 32 nt, Human
agaguuuaauaggcaagaaggaagggagaaga

SEQ ID NO: 312412 - RNA, 32 nt, Human
agaguuuauauccccuguaucuauguuaaaua

SEQ ID NO: 312413 - RNA, 32 nt, Human
agaguuuaucuuuucuauaaguuuacagccuu

SEQ ID NO: 312414 - RNA, 32 nt, Human
agaguuuauuuuuacagaaaagagggugggag

SEQ ID NO: 312415 - RNA, 32 nt, Human
agaguuuauuuuuguacaaggggugagggugg

SEQ ID NO: 312416 - RNA, 19 nt, Human
agaguuucacagacucuua

SEQ ID NO: 312417 - RNA, 32 nt, Human
agaguuucaccagguuggucaggcuggucuca

SEQ ID NO: 312418 - RNA, 21 nt, Human
agaguuucaccauguugcuua

SEQ ID NO: 312419 - RNA, 32 nt, Human
agaguuucaguuaccauuguaugcaagagcca

SEQ ID NO: 312420 - RNA, 22 nt, Human
agaguuucauccaacauucuug

SEQ ID NO: 312421 - RNA, 32 nt, Human
agaguuuccauuguucagcucugugcuuucuu

SEQ ID NO: 312422 - RNA, 32 nt, Human
agaguuucccuucacaagcccucucucucccu

SEQ ID NO: 312423 - RNA, 24 nt, Human
agaguuuccucagaacccacagug

SEQ ID NO: 312424 - RNA, 22 nt, Human
agaguuucuauucaucauuuua

SEQ ID NO: 312425 - RNA, 32 nt, Human
agaguuucucacuuuuaagauucuccaaaucc

SEQ ID NO: 312426 - RNA, 32 nt, Human
agaguuucuccauauuggucaggcugguuucg

SEQ ID NO: 312427 - RNA, 23 nt, Human
agaguuucucuaagcccacaaug

SEQ ID NO: 312428 - RNA, 32 nt, Human
agaguuucucucuguugcccaggcuggagugc

SEQ ID NO: 312429 - RNA, 32 nt, Human
agaguuucucuggagcuuauagcuagaagggg

SEQ ID NO: 312430 - RNA, 32 nt, Human
agaguuucuugcagccuugaaaauuuuauucc

SEQ ID NO: 312431 - RNA, 32 nt, Human
agaguuugaaaauuugacaagcacacuguccu

SEQ ID NO: 312432 - RNA, 32 nt, Human
agaguuugaaggaggugagggaugugaauugc

SEQ ID NO: 312433 - RNA, 32 nt, Human
agaguuugaauccucaguaacucucauugacu

SEQ ID NO: 312434 - RNA, 32 nt, Human
agaguuugcugugcuuauaacacuucuuuuuc

SEQ ID NO: 312435 - RNA, 24 nt, Human
agaguuuggaggggcucacugcca

SEQ ID NO: 312436 - RNA, 20 nt, Human
agaguuuggggagaauugag

SEQ ID NO: 312437 - RNA, 32 nt, Human
agaguuuguauauccuacuccugggccuuaca

SEQ ID NO: 312438 - RNA, 32 nt, Human
agaguuuguccuauuuggggcuuuucuauuua

SEQ ID NO: 312439 - RNA, 24 nt, Human
agaguuuuagaaggcuggauggaa

SEQ ID NO: 312440 - RNA, 32 nt, Human
agaguuuuauuaugcuaauaaaugucaggauu

SEQ ID NO: 312441 - RNA, 32 nt, Human
agaguuuucaaaaugugaaucuuuggaagccu

SEQ ID NO: 312442 - RNA, 32 nt, Human
agaguuuuccuccaaagccacaccucagcugg

SEQ ID NO: 312443 - RNA, 32 nt, Human
agaguuuugggggcaugugccugcugcgcugg

SEQ ID NO: 312444 - RNA, 32 nt, Human
agaguuuuggucacucccaaaauauuuagaua

SEQ ID NO: 312445 - RNA, 32 nt, Human
agaguuuuuggugauugcuacucugaaagcug

SEQ ID NO: 312446 - RNA, 32 nt, Human
agaguuuuugucugagcacaguagccuggccc

SEQ ID NO: 312447 - RNA, 32 nt, Human
agauaaaaacuacuuggugaaaugacuucuug

SEQ ID NO: 312448 - RNA, 21 nt, Human
agauaaaaaugagcuuuucua

SEQ ID NO: 312449 - RNA, 32 nt, Human
agauaaaacuucuauuuaaagacuuuaacuag

SEQ ID NO: 312450 - RNA, 32 nt, Human
agauaaaagaggaguagaagguaaaagaaaau

SEQ ID NO: 312451 - RNA, 32 nt, Human
agauaaaagaucaccaacucagagccagauaa

SEQ ID NO: 312452 - RNA, 32 nt, Human
agauaaaagcacagaaaggacaacccuugaaa

SEQ ID NO: 312453 - RNA, 32 nt, Human
agauaaaagcagugcuuugugaaaugcagugu

SEQ ID NO: 312454 - RNA, 21 nt, Human
agauaaaauaaauauagggua

SEQ ID NO: 312455 - RNA, 32 nt, Human
agauaaacaaaggggaaggaagagaggacaac

SEQ ID NO: 312456 - RNA, 32 nt, Human
agauaaacauaaaaggaggagacauacaaugg

SEQ ID NO: 312457 - RNA, 32 nt, Human
agauaaaccagccucagcuggcgcagcggggc

SEQ ID NO: 312458 - RNA, 32 nt, Human
agauaaaccagcuuuuuauguaaagaguaagg

SEQ ID NO: 312459 - RNA, 32 nt, Human
agauaaaccaggaagggaguuggcaggaagcc

SEQ ID NO: 312460 - RNA, 32 nt, Human
agauaaacccuacaaauguaaagaaugcggga

SEQ ID NO: 312461 - RNA, 32 nt, Human
agauaaacgcgcuuagguuagaagacuauaau

SEQ ID NO: 312462 - RNA, 32 nt, Human
agauaaagagcagagggcacuugcagggccug

SEQ ID NO: 312463 - RNA, 32 nt, Human
agauaaagauggcagaagaaaagggaaagcaa

SEQ ID NO: 312464 - RNA, 32 nt, Human
agauaaagauuugguuucacccuggugguggu

SEQ ID NO: 312465 - RNA, 32 nt, Human
agauaaagcaacagccaauacacacauuacca

SEQ ID NO: 312466 - RNA, 32 nt, Human
agauaaagccaaggugaaggaugaaucacaga

SEQ ID NO: 312467 - RNA, 32 nt, Human
agauaaagcugaggagccugugccagugcugg

SEQ ID NO: 312468 - RNA, 32 nt, Human
agauaaaggcaagucuugucacccucaggcac

SEQ ID NO: 312469 - RNA, 32 nt, Human
agauaaaggggaugagaaagaacagagcucca

SEQ ID NO: 312470 - RNA, 32 nt, Human
agauaaagucuugggcugggugcaguggcuca

SEQ ID NO: 312471 - RNA, 32 nt, Human
agauaaauaugaugccaggucagggcugaaga

SEQ ID NO: 312472 - RNA, 32 nt, Human
agauaaaucaccagucacagacuaugcacccg

SEQ ID NO: 312473 - RNA, 32 nt, Human
agauaaaucucucucugugucucccucuuuaa

SEQ ID NO: 312474 - RNA, 32 nt, Human
agauaaaugaaauaacuggacacacacucaca

SEQ ID NO: 312475 - RNA, 32 nt, Human
agauaacacuacugcauuccagccugggugac

SEQ ID NO: 312476 - RNA, 32 nt, Human
agauaacacuccuucaggaaaaagugaugaug

SEQ ID NO: 312477 - RNA, 32 nt, Human
agauaacacuguaauccaccuccagguuucca

SEQ ID NO: 312478 - RNA, 32 nt, Human
agauaacagagaauuaggggaaagcaugauuu

SEQ ID NO: 312479 - RNA, 32 nt, Human
agauaacagaguagagugaaccagagaaagag

SEQ ID NO: 312480 - RNA, 32 nt, Human
agauaacauaugcaugccacaauaaacugcau

SEQ ID NO: 312481 - RNA, 32 nt, Human
agauaaccagaggggccugggaagggagaaga

SEQ ID NO: 312482 - RNA, 32 nt, Human
agauaacccagaaacaaauacauacaucuaca

SEQ ID NO: 312483 - RNA, 32 nt, Human
agauaacccccuccucuggacuuaaaucaccu

SEQ ID NO: 312484 - RNA, 32 nt, Human
agauaacgccacugcacuccaguguaggcaac

SEQ ID NO: 312485 - RNA, 32 nt, Human
agauaacugcauaaaugaauaaauucagaauu

SEQ ID NO: 312486 - RNA, 32 nt, Human
agauaacugccucuuguacuuggauguguagu

SEQ ID NO: 312487 - RNA, 32 nt, Human
agauaacuuauccccuuguccccaugugucau

SEQ ID NO: 312488 - RNA, 32 nt, Human
agauaacuucacagucauccagucccaacacc

SEQ ID NO: 312489 - RNA, 32 nt, Human
agauaacuuuagccaaggaguucuagccugca

SEQ ID NO: 312490 - RNA, 32 nt, Human
agauaagaaacaguuucuuagagcagauagaa

SEQ ID NO: 312491 - RNA, 32 nt, Human
agauaagaaugagagcaaaaguugaugaaaca

SEQ ID NO: 312492 - RNA, 21 nt, Human
agauaagaccuuuacagagua

SEQ ID NO: 312493 - RNA, 32 nt, Human
agauaagagaugguuaagcuguucuucacccu

SEQ ID NO: 312494 - RNA, 32 nt, Human
agauaagagcacgcaucagcaucgcagccacu

SEQ ID NO: 312495 - RNA, 32 nt, Human
agauaagagguggaggaggugacagggagcua

SEQ ID NO: 312496 - RNA, 32 nt, Human
agauaagcaauaugucuucuauagcaggccua

SEQ ID NO: 312497 - RNA, 32 nt, Human
agauaagcaggaaaauuccaucaaagaaaucc

SEQ ID NO: 312498 - RNA, 32 nt, Human
agauaagccuguaaacucaucaucuguguuuu

SEQ ID NO: 312499 - RNA, 32 nt, Human
agauaagcggccuguccugccuccugggagaa

SEQ ID NO: 312500 - RNA, 32 nt, Human
agauaagcugaguguucccaccaggaagucac

SEQ ID NO: 312501 - RNA, 32 nt, Human
agauaagcuguacaaauugaaucuauguggaa

SEQ ID NO: 312502 - RNA, 32 nt, Human
agauaaggacuggcaaccagagccucagcauc

SEQ ID NO: 312503 - RNA, 32 nt, Human
agauaaggaggcacgucaggcaaugacacacc

SEQ ID NO: 312504 - RNA, 32 nt, Human
agauaaggaggccaggugugguggcucaugcc

SEQ ID NO: 312505 - RNA, 32 nt, Human
agauaagggcagcugcugcccuuggggcaccu

SEQ ID NO: 312506 - RNA, 32 nt, Human
agauaaggggaaacauaucacauaucauugaa

SEQ ID NO: 312507 - RNA, 32 nt, Human
agauaagggugaguucuacuguggcagaaaag

SEQ ID NO: 312508 - RNA, 32 nt, Human
agauaagucuguucuuuaaauuucugaaaugg

SEQ ID NO: 312509 - RNA, 32 nt, Human
agauaagucuguuuuuccuucuggaaccauaa

SEQ ID NO: 312510 - RNA, 32 nt, Human
agauaagucuuucauggcugcuguugcuuaaa

SEQ ID NO: 312511 - RNA, 32 nt, Human
agauaagugggugggaggcacggggaagguuu

SEQ ID NO: 312512 - RNA, 32 nt, Human
agauaauaaagaaaucagaaaugguaccuuuu

SEQ ID NO: 312513 - RNA, 22 nt, Human
agauaauagaacauugcuugua

SEQ ID NO: 312514 - RNA, 32 nt, Human
agauaauagagauaaaagaagaggagggcuuc

SEQ ID NO: 312515 - RNA, 32 nt, Human
agauaauagaggaggguaugaaaggagggaaa

SEQ ID NO: 312516 - RNA, 32 nt, Human
agauaaucaagaaacaaugucgagugaugaua

SEQ ID NO: 312517 - RNA, 32 nt, Human
agauaaucaaguuaguuaaaaguuuccuaguu

SEQ ID NO: 312518 - RNA, 32 nt, Human
agauaaucaucaaggacucacagucugccaga

SEQ ID NO: 312519 - RNA, 32 nt, Human
agauaaucaugguauuuucaucagcuugguac

SEQ ID NO: 312520 - RNA, 32 nt, Human
agauaaucauuagcccacauaccaguaacuua

SEQ ID NO: 312521 - RNA, 32 nt, Human
agauaaucccacugcauuccagccugggcaac

SEQ ID NO: 312522 - RNA, 32 nt, Human
agauaauccccaccccucucccccaaaugcag

SEQ ID NO: 312523 - RNA, 32 nt, Human
agauaaucccuaaaagcacccacauuuguuuc

SEQ ID NO: 312524 - RNA, 32 nt, Human
agauaaucuggauguuucugcaaaggaaaaua

SEQ ID NO: 312525 - RNA, 32 nt, Human
agauaaugaguccuauuuuucucucacauaau

SEQ ID NO: 312526 - RNA, 32 nt, Human
agauaaugccacugcacuccagccugccugga

SEQ ID NO: 312527 - RNA, 32 nt, Human
agauaaugucccaccucuccccacacgccgaa

SEQ ID NO: 312528 - RNA, 32 nt, Human
agauaaugugggugcuagaugcaguggcuuac

SEQ ID NO: 312529 - RNA, 32 nt, Human
agauaauguucuuccagaucugaaaaggaaaa

SEQ ID NO: 312530 - RNA, 32 nt, Human
agauaauuaaggagaaaacagauaaugaaggc

SEQ ID NO: 312531 - RNA, 32 nt, Human
agauaauucaucaugccugcuguggcuucagu

SEQ ID NO: 312532 - RNA, 32 nt, Human
agauaauucuucuccccugacuggaccucugg

SEQ ID NO: 312533 - RNA, 32 nt, Human
agauaauuuguauuuuugcacacugagauaua

SEQ ID NO: 312534 - RNA, 32 nt, Human
agauacaaauggccaacaaaacaugaaacacc

SEQ ID NO: 312535 - RNA, 32 nt, Human
agauacaacuuccagcaacuucccacucagcu

SEQ ID NO: 312536 - RNA, 32 nt, Human
agauacaagaacuuaauggacacuacaauaag

SEQ ID NO: 312537 - RNA, 32 nt, Human
agauacacaaacacaaauagagauuucauagc

SEQ ID NO: 312538 - RNA, 19 nt, Human
agauacacauccaagcuca

SEQ ID NO: 312539 - RNA, 32 nt, Human
agauacacauggugccuucagcggcuucuucc

SEQ ID NO: 312540 - RNA, 32 nt, Human
agauacacugcucuccccacccagaccugccu

SEQ ID NO: 312541 - RNA, 18 nt, Human
agauacagaaccuaggag

SEQ ID NO: 312542 - RNA, 32 nt, Human
agauacagauuggcauagaagaauguaaagaa

SEQ ID NO: 312543 - RNA, 32 nt, Human
agauacagcugagcaaugcacacauuuucagc

SEQ ID NO: 312544 - RNA, 32 nt, Human
agauacaggaagggagaggugucugcuaccuu

SEQ ID NO: 312545 - RNA, 32 nt, Human
agauacaggguuucaccacguugcucaggcug

SEQ ID NO: 312546 - RNA, 32 nt, Human
agauacagucauaggggguugcagugagguuu

SEQ ID NO: 312547 - RNA, 32 nt, Human
agauacaguucagaaccaaaggaauagagaag

SEQ ID NO: 312548 - RNA, 32 nt, Human
agauacaguuuauguacuugauggaagaaaau

SEQ ID NO: 312549 - RNA, 32 nt, Human
agauacauauauacaagauaaaggaauaggau

SEQ ID NO: 312550 - RNA, 32 nt, Human
agauacaucacugucuguuaaaggaaaccaag

SEQ ID NO: 312551 - RNA, 32 nt, Human
agauacaugugaauaaggcaaaagccagaaaa

SEQ ID NO: 312552 - RNA, 32 nt, Human
agauacauuaaaauacucacugaagagaagcc

SEQ ID NO: 312553 - RNA, 21 nt, Human
agauaccaaaggaaaacaaga

SEQ ID NO: 312554 - RNA, 32 nt, Human
agauaccacaaacccugcugaacacagugucu

SEQ ID NO: 312555 - RNA, 20 nt, Human
agauaccacauguggcaagc

SEQ ID NO: 312556 - RNA, 32 nt, Human
agauaccacuuggccacucccgcugaggccac

SEQ ID NO: 312557 - RNA, 32 nt, Human
agauaccagaggccaagccacagagaggauaa

SEQ ID NO: 312558 - RNA, 32 nt, Human
agauaccagaugcaccagaacaggcuucgagu

SEQ ID NO: 312559 - RNA, 32 nt, Human
agauaccagcagagagggaguaggagagaaga

SEQ ID NO: 312560 - RNA, 32 nt, Human
agauaccagccccuguauggcacuggcauugu

SEQ ID NO: 312561 - RNA, 32 nt, Human
agauacccucuccuugcugaaguuuuucuuga

SEQ ID NO: 312562 - RNA, 32 nt, Human
agauaccuacucauuuucuaagugacuggcca

SEQ ID NO: 312563 - RNA, 32 nt, Human
agauaccuccuugugccuccacugaugcagga

SEQ ID NO: 312564 - RNA, 32 nt, Human
agauaccugcacacgcauguuuauacagcaca

SEQ ID NO: 312565 - RNA, 32 nt, Human
agauaccuggcauuuugggaagugaccaaaga

SEQ ID NO: 312566 - RNA, 32 nt, Human
agauaccuuagaguaugugaccgcgcuccaga

SEQ ID NO: 312567 - RNA, 32 nt, Human
agauaccuucuuugggcagcacaauguucaaa

SEQ ID NO: 312568 - RNA, 32 nt, Human
agauacgcagccauuccauauucaucuccaac

SEQ ID NO: 312569 - RNA, 32 nt, Human
agauacggggucuugcucugucucccaggcug

SEQ ID NO: 312570 - RNA, 32 nt, Human
agauacgggguuucaccaugcuggccagacug

SEQ ID NO: 312571 - RNA, 23 nt, Human
agauacgggguuucaccauguug

SEQ ID NO: 312572 - RNA, 27 nt, Human
agauacgggguuucaccauguuggcca

SEQ ID NO: 312573 - RNA, 32 nt, Human
agauacuaccuacacggagcaggauggcugcu

SEQ ID NO: 312574 - RNA, 32 nt, Human
agauacuaccugcaauuuuauacauguauuuu

SEQ ID NO: 312575 - RNA, 32 nt, Human
agauacuauaagaagaugaacaugacaauuuu

SEQ ID NO: 312576 - RNA, 32 nt, Human
agauacucaccaggaccaggaaggggacucug

SEQ ID NO: 312577 - RNA, 32 nt, Human
agauacucaccaggaugaggaagaggacuuug

SEQ ID NO: 312578 - RNA, 32 nt, Human
agauacuccagccugggugacagagcgagacu

SEQ ID NO: 312579 - RNA, 32 nt, Human
agauacucuaggggcaggggcaggggcagggg

SEQ ID NO: 312580 - RNA, 32 nt, Human
agauacugacaugcagaagaaauaagugcauu

SEQ ID NO: 312581 - RNA, 32 nt, Human
agauacugagaccaaggauucagcauuagaac

SEQ ID NO: 312582 - RNA, 32 nt, Human
agauacugagaccuguguguacaguaggacca

SEQ ID NO: 312583 - RNA, 31 nt, Human
agauacuggaaggagccucagauugcucaca

SEQ ID NO: 312584 - RNA, 32 nt, Human
agauacuggauagccagcauccucucauuccc

SEQ ID NO: 312585 - RNA, 32 nt, Human
agauacuguuggacccagaagagaagggcacu

SEQ ID NO: 312586 - RNA, 32 nt, Human
agauacuuauaagaaaugacuuaaacaaaucc

SEQ ID NO: 312587 - RNA, 32 nt, Human
agauacuugggaggcugagauaggaucacuug

SEQ ID NO: 312588 - RNA, 21 nt, Human
agauacuuguuguguguguug

SEQ ID NO: 312589 - RNA, 32 nt, Human
agauagaagauccaagaaaacaauggaggggg

SEQ ID NO: 312590 - RNA, 32 nt, Human
agauagaaggaaauacgugauuuggugaaggc

SEQ ID NO: 312591 - RNA, 32 nt, Human
agauagaagucaugggaugcagcaguucuuca

SEQ ID NO: 312592 - RNA, 21 nt, Human
agauagaaucucacuauguug

SEQ ID NO: 312593 - RNA, 32 nt, Human
agauagacauaucugggucacacacaccugau

SEQ ID NO: 312594 - RNA, 32 nt, Human
agauagacucggcuugaaucucagcugccugc

SEQ ID NO: 312595 - RNA, 19 nt, Human
agauagagccucgcucugu

SEQ ID NO: 312596 - RNA, 32 nt, Human
agauagaggaggaggagggggaggaagaggag

SEQ ID NO: 312597 - RNA, 32 nt, Human
agauagaggggcugcugacaccagugcuggag

SEQ ID NO: 312598 - RNA, 21 nt, Human
agauagaguuucaucauguug

SEQ ID NO: 312599 - RNA, 25 nt, Human
agauagaguuucaucauguuggcca

SEQ ID NO: 312600 - RNA, 32 nt, Human
agauagauaccacaaguaacacaaagcaucau

SEQ ID NO: 312601 - RNA, 32 nt, Human
agauagauggagaaguguuuucagauuccugg

SEQ ID NO: 312602 - RNA, 32 nt, Human
agauagauucgagagaaagcacguggccaugu

SEQ ID NO: 312603 - RNA, 32 nt, Human
agauagcaccacugcacuccagccugggagac

SEQ ID NO: 312604 - RNA, 32 nt, Human
agauagcaccacugcacuccaggcugggugac

SEQ ID NO: 312605 - RNA, 32 nt, Human
agauagcaccacugcacuuuagccugggcgac

SEQ ID NO: 312606 - RNA, 32 nt, Human
agauagcaccacugcaugcaagccugggcaau

SEQ ID NO: 312607 - RNA, 32 nt, Human
agauagcaccauugcacuccagccugggcgac

SEQ ID NO: 312608 - RNA, 32 nt, Human
agauagcaccuacccaacccaggaugaaugag

SEQ ID NO: 312609 - RNA, 32 nt, Human
agauagcagacaccuuccccgauuugugucuc

SEQ ID NO: 312610 - RNA, 32 nt, Human
agauagcaggcagggaagcaauguaguguggu

SEQ ID NO: 312611 - RNA, 32 nt, Human
agauagcauagaggagauuaagggugaggcca

SEQ ID NO: 312612 - RNA, 32 nt, Human
agauagcauucaacaaaagcugccucaacuuu

SEQ ID NO: 312613 - RNA, 32 nt, Human
agauagcccaggacucugcguggacgcgcccc

SEQ ID NO: 312614 - RNA, 32 nt, Human
agauagcccaggagcaacagccuaaucccgug

SEQ ID NO: 312615 - RNA, 32 nt, Human
agauagccccacugcacuccagccugggugac

SEQ ID NO: 312616 - RNA, 32 nt, Human
agauagcgccacugcacugcacgccagccuag

SEQ ID NO: 312617 - RNA, 32 nt, Human
agauagcgccacugcaguccggccugggugaa

SEQ ID NO: 312618 - RNA, 32 nt, Human
agauagcgccauugcacuccagccugagcgac

SEQ ID NO: 312619 - RNA, 32 nt, Human
agauagcgccauugcacuccagccugggcaac

SEQ ID NO: 312620 - RNA, 32 nt, Human
agauagcgccauugcacuccagccugggcgac

SEQ ID NO: 312621 - RNA, 32 nt, Human
agauagcggcacugcacuccagccugggugac

SEQ ID NO: 312622 - RNA, 32 nt, Human
agauagcggcauugcacuccagccugggcaac

SEQ ID NO: 312623 - RNA, 32 nt, Human
agauagcuauguuacacugcaagaacagaguu

SEQ ID NO: 312624 - RNA, 32 nt, Human
agauagcuccuuucuggaccucaguccuucac

SEQ ID NO: 312625 - RNA, 32 nt, Human
agauaggaacccaggagcagcaguguuuccug

SEQ ID NO: 312626 - RNA, 32 nt, Human
agauaggaagacuccuuccucucccaguacuu

SEQ ID NO: 312627 - RNA, 32 nt, Human
agauaggacuucuuccuguuuaauccacugga

SEQ ID NO: 312628 - RNA, 32 nt, Human
agauaggagaugaaaaguugggaggaugucuu

SEQ ID NO: 312629 - RNA, 32 nt, Human
agauaggagguggcccauaggagcagucccgc

SEQ ID NO: 312630 - RNA, 32 nt, Human
agauaggaucuaggagugauuuuauuguuuug

SEQ ID NO: 312631 - RNA, 32 nt, Human
agauaggcaccacuguauccuccagcuccuuc

SEQ ID NO: 312632 - RNA, 32 nt, Human
agauaggcagagaacaucuccagaaaugugug

SEQ ID NO: 312633 - RNA, 32 nt, Human
agauaggcaggcagcgcugcuccaucagccgg

SEQ ID NO: 312634 - RNA, 32 nt, Human
agauaggcuaucuccccaccucccacccuacu

SEQ ID NO: 312635 - RNA, 32 nt, Human
agauagggaaacugaggcuuugggaggacuca

SEQ ID NO: 312636 - RNA, 32 nt, Human
agauagggaccagaguuuaacauagcgaucua

SEQ ID NO: 312637 - RNA, 32 nt, Human
agauagggagaagggaaaaggggccucacuuu

SEQ ID NO: 312638 - RNA, 32 nt, Human
agauagggcagcuucuuucugcccucaggagc

SEQ ID NO: 312639 - RNA, 32 nt, Human
agauagggccuuucucauacuacccuggaaua

SEQ ID NO: 312640 - RNA, 32 nt, Human
agauaggggcagauaggagcugcaggggugcc

SEQ ID NO: 312641 - RNA, 32 nt, Human
agauaggggcccugggccuccgcccuggccuu

SEQ ID NO: 312642 - RNA, 21 nt, Human
agauagggguuucaccguguu

SEQ ID NO: 312643 - RNA, 18 nt, Human
agauaggguagccauguu

SEQ ID NO: 312644 - RNA, 21 nt, Human
agauagggucucacuauguug

SEQ ID NO: 312645 - RNA, 21 nt, Human
agauagggucuugcuguguug

SEQ ID NO: 312646 - RNA, 21 nt, Human
agauagggucuuucuauguug

SEQ ID NO: 312647 - RNA, 21 nt, Human
agauaggguuucacaauguug

SEQ ID NO: 312648 - RNA, 25 nt, Human
agauaggguuucacaauguuggcca

SEQ ID NO: 312649 - RNA, 21 nt, Human
agauaggguuucaccauguug

SEQ ID NO: 312650 - RNA, 25 nt, Human
agauaggguuucaccauguuggcca

SEQ ID NO: 312651 - RNA, 21 nt, Human
agauaggguuucaccguguug

SEQ ID NO: 312652 - RNA, 25 nt, Human
agauaggguuucaccguguuggcca

SEQ ID NO: 312653 - RNA, 21 nt, Human
agauaggguuucauuacauug

SEQ ID NO: 312654 - RNA, 20 nt, Human
agauaggguuuuaccauguu

SEQ ID NO: 312655 - RNA, 32 nt, Human
agauagguaacugaggcacacagagcauuuug

SEQ ID NO: 312656 - RNA, 32 nt, Human
agauagguacaggaguccacaggaggccaggu

SEQ ID NO: 312657 - RNA, 32 nt, Human
agauaggucucaaacuccugacuucaggugau

SEQ ID NO: 312658 - RNA, 31 nt, Human
agauagguuucucagcaccgcccucagcucu

SEQ ID NO: 312659 - RNA, 32 nt, Human
agauaguacauacuugccauuucuauacuagg

SEQ ID NO: 312660 - RNA, 32 nt, Human
agauaguaccacugcacuccagccugggcgac

SEQ ID NO: 312661 - RNA, 32 nt, Human
agauagucaagcauuuagaagugcagugaacu

SEQ ID NO: 312662 - RNA, 31 nt, Human
agauagucaauaaaacaucuugaaaauccca

SEQ ID NO: 312663 - RNA, 32 nt, Human
agauagucugaauuguugggcagcagaaaacc

SEQ ID NO: 312664 - RNA, 32 nt, Human
agauagugaaaacaggcuauugcucuucccau

SEQ ID NO: 312665 - RNA, 32 nt, Human
agauagugccacagcucuccagccugggcgac

SEQ ID NO: 312666 - RNA, 32 nt, Human
agauagugccacugcacuacagcccgggcgac

SEQ ID NO: 312667 - RNA, 32 nt, Human
agauagugccacugcacuccagccugggcaac

SEQ ID NO: 312668 - RNA, 32 nt, Human
agauagugccacugcacuccagccugggugac

SEQ ID NO: 312669 - RNA, 32 nt, Human
agauagugccacugcacuucagccugggugac

SEQ ID NO: 312670 - RNA, 32 nt, Human
agauagugccacugcacuucagcuugggcaac

SEQ ID NO: 312671 - RNA, 32 nt, Human
agauagugccacugcauuccggccugggcgac

SEQ ID NO: 312672 - RNA, 32 nt, Human
agauagugccacugugcuccagccuggaugac

SEQ ID NO: 312673 - RNA, 32 nt, Human
agauagugccaucgcacuccagccuggacaac

SEQ ID NO: 312674 - RNA, 32 nt, Human
agauagugccauugcacuccggccugggcaac

SEQ ID NO: 312675 - RNA, 32 nt, Human
agauagugccauuguacuccagcuugggcaac

SEQ ID NO: 312676 - RNA, 32 nt, Human
agauagugccucugcacuccagccugcgugac

SEQ ID NO: 312677 - RNA, 32 nt, Human
agauaguggcucugcuguuuucuuaggcugcu

SEQ ID NO: 312678 - RNA, 32 nt, Human
agauagugggagggggccaggcugcaggagaa

SEQ ID NO: 312679 - RNA, 32 nt, Human
agauagugucagcuuauuugaagauuaauuuu

SEQ ID NO: 312680 - RNA, 32 nt, Human
agauagugugggcauucagucaggcugguggg

SEQ ID NO: 312681 - RNA, 32 nt, Human
agauagugugugacugugggaagauggaggag

SEQ ID NO: 312682 - RNA, 32 nt, Human
agauaguuaaauccuaagauagagauuaaguc

SEQ ID NO: 312683 - RNA, 32 nt, Human
agauaguucccauucuacuuggagauuuggcu

SEQ ID NO: 312684 - RNA, 19 nt, Human
agauaguuucacaauuugg

SEQ ID NO: 312685 - RNA, 32 nt, Human
agauaguuugacugaacccccaccuugaccuu

SEQ ID NO: 312686 - RNA, 32 nt, Human
agauaguuuggcugcuccugugcugucaccug

SEQ ID NO: 312687 - RNA, 32 nt, Human
agauauaaagagaguucuuucauuucccugcu

SEQ ID NO: 312688 - RNA, 32 nt, Human
agauauaauuuccaauauaccauucaacuaca

SEQ ID NO: 312689 - RNA, 32 nt, Human
agauauacaaauauacagauauacaaauaagu

SEQ ID NO: 312690 - RNA, 32 nt, Human
agauauacagauauacaaauauacagauauac

SEQ ID NO: 312691 - RNA, 32 nt, Human
agauauacuagguaguguaugaaugugcauaa

SEQ ID NO: 312692 - RNA, 32 nt, Human
agauauagcuggagcuacauccugcuuccuuu

SEQ ID NO: 312693 - RNA, 32 nt, Human
agauauaugcauaccuggauuuccuuggcuuc

SEQ ID NO: 312694 - RNA, 32 nt, Human
agauaucauaauaucacacccacacaucaggc

SEQ ID NO: 312695 - RNA, 32 nt, Human
agauaucauccaggcccaaggccccucucccu

SEQ ID NO: 312696 - RNA, 32 nt, Human
agauaucaucugagagguaguuaauuuggcac

SEQ ID NO: 312697 - RNA, 32 nt, Human
agauaucaucuguaccucagcacuguugugac

SEQ ID NO: 312698 - RNA, 32 nt, Human
agauaucgccacugcacuccagccugggugac

SEQ ID NO: 312699 - RNA, 32 nt, Human
agauaucuauuuguauaaucucuggcuguaau

SEQ ID NO: 312700 - RNA, 22 nt, Human
agauaucucagccugggcacuc

SEQ ID NO: 312701 - RNA, 32 nt, Human
agauaucugaaaauguggaagcaacauuggaa

SEQ ID NO: 312702 - RNA, 32 nt, Human
agauaucugcugucugaagaucuuucagagcu

SEQ ID NO: 312703 - RNA, 32 nt, Human
agauaucuggggaccaaacuguagggacagag

SEQ ID NO: 312704 - RNA, 32 nt, Human
agauaugagcaaccccagcuuuccagacaguc

SEQ ID NO: 312705 - RNA, 32 nt, Human
agauaugcacacacacggaugcacacacagau

SEQ ID NO: 312706 - RNA, 32 nt, Human
agauaugcacacacagguauuuuguugcuaaa

SEQ ID NO: 312707 - RNA, 32 nt, Human
agauaugcacacuuccauuaccagucuccaac

SEQ ID NO: 312708 - RNA, 32 nt, Human
agauauggaaggcagaagugaagaaagcauua

SEQ ID NO: 312709 - RNA, 32 nt, Human
agauauggagaaacuagaacucuccuacauug

SEQ ID NO: 312710 - RNA, 23 nt, Human
agauauggagcuggaaaacaaga

SEQ ID NO: 312711 - RNA, 32 nt, Human
agauauggaguuucaccacguuggccaagaca

SEQ ID NO: 312712 - RNA, 32 nt, Human
agauauggcuuaaaggcuuucaagaugaggac

SEQ ID NO: 312713 - RNA, 32 nt, Human
agauaugggguuucaccguguuagccaggaug

SEQ ID NO: 312714 - RNA, 27 nt, Human
agauaugggguuucgccauguuggcca

SEQ ID NO: 312715 - RNA, 32 nt, Human
agauaugggguuucgccauguuggccaggcug

SEQ ID NO: 312716 - RNA, 32 nt, Human
agauaugucauccucagaaugugagcuguuug

SEQ ID NO: 312717 - RNA, 32 nt, Human
agauauguguccagcaaggaguuuacagucaa

SEQ ID NO: 312718 - RNA, 32 nt, Human
agauauguuuuuaaaagcuuaucuaacaaauu

SEQ ID NO: 312719 - RNA, 32 nt, Human
agauauuaugaauaauaucacaggguguacac

SEQ ID NO: 312720 - RNA, 32 nt, Human
agauauuaugaauaguaucacaggguguacac

SEQ ID NO: 312721 - RNA, 32 nt, Human
agauauucaggagccucacacuguucagacgu

SEQ ID NO: 312722 - RNA, 32 nt, Human
agauauucauucuuuuggucaccuagggaucu

SEQ ID NO: 312723 - RNA, 32 nt, Human
agauauuccaccuguaauagcacuuuggaacu

SEQ ID NO: 312724 - RNA, 32 nt, Human
agauauuccaggagugugggugcggccuuaaa

SEQ ID NO: 312725 - RNA, 32 nt, Human
agauauucucccaagagaccucuugauacaaa

SEQ ID NO: 312726 - RNA, 32 nt, Human
agauauugaacaauaaaggagaaugguaccga

SEQ ID NO: 312727 - RNA, 32 nt, Human
agauauugaacugucauuuuugcacauuugaa

SEQ ID NO: 312728 - RNA, 32 nt, Human
agauauugccauacugaaccucauucuaaacu

SEQ ID NO: 312729 - RNA, 32 nt, Human
agauauuuaucuuucaguuuauuugaaagagg

SEQ ID NO: 312730 - RNA, 32 nt, Human
agauauuuguacugaagucugauacagaauua

SEQ ID NO: 312731 - RNA, 32 nt, Human
agauauuuguauuuauuuccagaccaauaaau

SEQ ID NO: 312732 - RNA, 32 nt, Human
agauauuuguuucaguagaugagcacacaaau

SEQ ID NO: 312733 - RNA, 32 nt, Human
agauauuuugcaccuggaugaacaccagggua

SEQ ID NO: 312734 - RNA, 32 nt, Human
agaucaaaaagcuuguuaagacuccuagcugg

SEQ ID NO: 312735 - RNA, 32 nt, Human
agaucaaaaccagccuggccaacauggugaaa

SEQ ID NO: 312736 - RNA, 23 nt, Human
agaucaaacacucaagguuccau

SEQ ID NO: 312737 - RNA, 32 nt, Human
agaucaaaccaccacaggccuaugucugaccu

SEQ ID NO: 312738 - RNA, 31 nt, Human
agaucaaagagaccucucucggggucuggau

SEQ ID NO: 312739 - RNA, 31 nt, Human
agaucaaagagaccucucuuggggucuggau

SEQ ID NO: 312740 - RNA, 32 nt, Human
agaucaaaguggacacugacagcagggagaag

SEQ ID NO: 312741 - RNA, 32 nt, Human
agaucaacaguuacugugacugagucggccca

SEQ ID NO: 312742 - RNA, 32 nt, Human
agaucaagacauguuaaccuuuuauaaauuua

SEQ ID NO: 312743 - RNA, 23 nt, Human
agaucaagagaaccacccggagg

SEQ ID NO: 312744 - RNA, 32 nt, Human
agaucaagagcagaugcaagaaaguuuaugug

SEQ ID NO: 312745 - RNA, 32 nt, Human
agaucaagaucauggcugucucugagcacaag

SEQ ID NO: 312746 - RNA, 32 nt, Human
agaucaagccauugcacuccagccugggcaac

SEQ ID NO: 312747 - RNA, 32 nt, Human
agaucaagccauuguacuccagccuggacaac

SEQ ID NO: 312748 - RNA, 32 nt, Human
agaucaaggaagagagugaggcauuuucugaa

SEQ ID NO: 312749 - RNA, 32 nt, Human
agaucaaggagaagauaguggaacaaaauguu

SEQ ID NO: 312750 - RNA, 32 nt, Human
agaucaagggcaugaaauuggggaagaguguu

SEQ ID NO: 312751 - RNA, 32 nt, Human
agaucaauaagaaauguucaggagagaggaaa

SEQ ID NO: 312752 - RNA, 32 nt, Human
agaucacaaagccaaccaugcccagccccucc

SEQ ID NO: 312753 - RNA, 32 nt, Human
agaucacaaagccaaccaugcccagcccuucc

SEQ ID NO: 312754 - RNA, 32 nt, Human
agaucacaacauugcacuucagccuggugaca

SEQ ID NO: 312755 - RNA, 32 nt, Human
agaucacacaauugcaguccagccugggcagc

SEQ ID NO: 312756 - RNA, 32 nt, Human
agaucacacagccagucagggcagagccggga

SEQ ID NO: 312757 - RNA, 31 nt, Human
agaucacacagcuaggaaaugugaagccugg

SEQ ID NO: 312758 - RNA, 32 nt, Human
agaucacaccaccacuccagccugggcgagag

SEQ ID NO: 312759 - RNA, 32 nt, Human
agaucacaccaccgcacuccacccugggaagc

SEQ ID NO: 312760 - RNA, 32 nt, Human
agaucacaccacuacacuccagccuaggcaac

SEQ ID NO: 312761 - RNA, 32 nt, Human
agaucacaccacuacacuccagccugggcgac

SEQ ID NO: 312762 - RNA, 32 nt, Human
agaucacaccacuacacuccagccugggcgag

SEQ ID NO: 312763 - RNA, 32 nt, Human
agaucacaccacuccacuccagucuggacaac

SEQ ID NO: 312764 - RNA, 32 nt, Human
agaucacaccacugaccucuagccugguggca

SEQ ID NO: 312765 - RNA, 32 nt, Human
agaucacaccacugcaauccagccugggcgac

SEQ ID NO: 312766 - RNA, 32 nt, Human
agaucacaccacugcacuacagccucggcaau

SEQ ID NO: 312767 - RNA, 32 nt, Human
agaucacaccacugcacucagccugggugaca

SEQ ID NO: 312768 - RNA, 32 nt, Human
agaucacaccacugcacuccaaccuggacaac

SEQ ID NO: 312769 - RNA, 32 nt, Human
agaucacaccacugcacuccaaccugggaaac

SEQ ID NO: 312770 - RNA, 32 nt, Human
agaucacaccacugcacuccagccagggcaac

SEQ ID NO: 312771 - RNA, 32 nt, Human
agaucacaccacugcacuccagcccaggugac

SEQ ID NO: 312772 - RNA, 32 nt, Human
agaucacaccacugcacuccagccuaggcaac

SEQ ID NO: 312773 - RNA, 32 nt, Human
agaucacaccacugcacuccagccuggcaaca

SEQ ID NO: 312774 - RNA, 32 nt, Human
agaucacaccacugcacuccagccuggcgaca

SEQ ID NO: 312775 - RNA, 32 nt, Human
agaucacaccacugcacuccagccugggagag

SEQ ID NO: 312776 - RNA, 32 nt, Human
agaucacaccacugcacuccagccugggcaac

SEQ ID NO: 312777 - RNA, 32 nt, Human
agaucacaccacugcacuccagccugggcaau

SEQ ID NO: 312778 - RNA, 32 nt, Human
agaucacaccacugcacuccagccugggcgac

SEQ ID NO: 312779 - RNA, 32 nt, Human
agaucacaccacugcacuccagccugggcggc

SEQ ID NO: 312780 - RNA, 32 nt, Human
agaucacaccacugcacuccagccugggggac

SEQ ID NO: 312781 - RNA, 32 nt, Human
agaucacaccacugcacuccagccugggguga

SEQ ID NO: 312782 - RNA, 32 nt, Human
agaucacaccacugcacuccagccuggguaaa

SEQ ID NO: 312783 - RNA, 32 nt, Human
agaucacaccacugcacuccagccugggugac

SEQ ID NO: 312784 - RNA, 32 nt, Human
agaucacaccacugcacuccagccugggugau

SEQ ID NO: 312785 - RNA, 32 nt, Human
agaucacaccacugcacuccagccuggguggc

SEQ ID NO: 312786 - RNA, 32 nt, Human
agaucacaccacugcacuccagccuggucaac

SEQ ID NO: 312787 - RNA, 32 nt, Human
agaucacaccacugcacuccagccuggugaca

SEQ ID NO: 312788 - RNA, 32 nt, Human
agaucacaccacugcacuccagccugugcgac

SEQ ID NO: 312789 - RNA, 32 nt, Human
agaucacaccacugcacuccagccuuggcgac

SEQ ID NO: 312790 - RNA, 32 nt, Human
agaucacaccacugcacuccagccuuggugac

SEQ ID NO: 312791 - RNA, 32 nt, Human
agaucacaccacugcacuccagucugggcacc

SEQ ID NO: 312792 - RNA, 32 nt, Human
agaucacaccacugcacuccagugugagcaac

SEQ ID NO: 312793 - RNA, 32 nt, Human
agaucacaccacugcacuccauccagccuggg

SEQ ID NO: 312794 - RNA, 32 nt, Human
agaucacaccacugcacuccggccugggcgac

SEQ ID NO: 312795 - RNA, 32 nt, Human
agaucacaccacugcacucuagccugggugac

SEQ ID NO: 312796 - RNA, 32 nt, Human
agaucacaccacugcacuucauccuaggcaac

SEQ ID NO: 312797 - RNA, 32 nt, Human
agaucacaccacugcauuccagccugggcacu

SEQ ID NO: 312798 - RNA, 32 nt, Human
agaucacaccacugcauuccagccugggugac

SEQ ID NO: 312799 - RNA, 32 nt, Human
agaucacaccacugcauucccgccugggcagc

SEQ ID NO: 312800 - RNA, 32 nt, Human
agaucacaccacugcgcucuagccuggacaac

SEQ ID NO: 312801 - RNA, 32 nt, Human
agaucacaccacugcgcucuagccugggcaac

SEQ ID NO: 312802 - RNA, 32 nt, Human
agaucacaccacuggcacuccagccugggcaa

SEQ ID NO: 312803 - RNA, 32 nt, Human
agaucacaccacuguaccacagccugagcaac

SEQ ID NO: 312804 - RNA, 32 nt, Human
agaucacaccacuguacuccagcccggcacuc

SEQ ID NO: 312805 - RNA, 32 nt, Human
agaucacaccacuguacuccagccugagugac

SEQ ID NO: 312806 - RNA, 32 nt, Human
agaucacaccacuguacuccagccuggaugac

SEQ ID NO: 312807 - RNA, 32 nt, Human
agaucacaccacuguacuccagccugggugac

SEQ ID NO: 312808 - RNA, 32 nt, Human
agaucacaccacuguauuccagccugggugac

SEQ ID NO: 312809 - RNA, 32 nt, Human
agaucacaccacugugcucuagccuggacaac

SEQ ID NO: 312810 - RNA, 32 nt, Human
agaucacaccagugcacuccagccugggcgac

SEQ ID NO: 312811 - RNA, 32 nt, Human
agaucacaccaucgcacuccagccuaggcaac

SEQ ID NO: 312812 - RNA, 32 nt, Human
agaucacaccauugcacuccaaccugggcaac

SEQ ID NO: 312813 - RNA, 32 nt, Human
agaucacaccauugcacuccagccuagauaac

SEQ ID NO: 312814 - RNA, 32 nt, Human
agaucacaccauugcacuccagccuaggcaac

SEQ ID NO: 312815 - RNA, 32 nt, Human
agaucacaccauugcacuccagccuaggcaug

SEQ ID NO: 312816 - RNA, 32 nt, Human
agaucacaccauugcacuccagccugagcaac

SEQ ID NO: 312817 - RNA, 32 nt, Human
agaucacaccauugcacuccagccugggaaac

SEQ ID NO: 312818 - RNA, 32 nt, Human
agaucacaccauugcacuccagccugggcaaa

SEQ ID NO: 312819 - RNA, 32 nt, Human
agaucacaccauugcacuccagccugggcaac

SEQ ID NO: 312820 - RNA, 32 nt, Human
agaucacaccauugcacuccagccugggcgac

SEQ ID NO: 312821 - RNA, 32 nt, Human
agaucacaccauugcacugcagccugggugaa

SEQ ID NO: 312822 - RNA, 32 nt, Human
agaucacaccauugcccuccagccugggugac

SEQ ID NO: 312823 - RNA, 32 nt, Human
agaucacaccauugcgcuucagccugggcaac

SEQ ID NO: 312824 - RNA, 32 nt, Human
agaucacaccgcugcacucaagccugggugac

SEQ ID NO: 312825 - RNA, 32 nt, Human
agaucacacgccacugcacuccagccugggug

SEQ ID NO: 312826 - RNA, 32 nt, Human
agaucacacuacugcacuccagccugggcaac

SEQ ID NO: 312827 - RNA, 32 nt, Human
agaucacacuacugcacuccagccugggcgac

SEQ ID NO: 312828 - RNA, 32 nt, Human
agaucacacuacugcacuccugcaugggcgac

SEQ ID NO: 312829 - RNA, 32 nt, Human
agaucacacuacugcauuccagccugagcaac

SEQ ID NO: 312830 - RNA, 32 nt, Human
agaucacacuauugcacuccagccugggcgac

SEQ ID NO: 312831 - RNA, 32 nt, Human
agaucacagcacugcacugcugccugggcgac

SEQ ID NO: 312832 - RNA, 32 nt, Human
agaucacagccaccaaaauccccaaaagccuc

SEQ ID NO: 312833 - RNA, 32 nt, Human
agaucacaggagcacuggaggaggagugggcu

SEQ ID NO: 312834 - RNA, 32 nt, Human
agaucacaucacaggacucuuugcagacacuc

SEQ ID NO: 312835 - RNA, 32 nt, Human
agaucacaucacugcacuccagccuggguaac

SEQ ID NO: 312836 - RNA, 32 nt, Human
agaucacaucacugcacuccauccugggugac

SEQ ID NO: 312837 - RNA, 32 nt, Human
agaucacccaacaccuuugaggcuuaaacacc

SEQ ID NO: 312838 - RNA, 32 nt, Human
agaucaccccacugcauuccagccugggugac

SEQ ID NO: 312839 - RNA, 32 nt, Human
agaucaccccacuguccuccagccugggcaac

SEQ ID NO: 312840 - RNA, 32 nt, Human
agaucaccccauugcacuccagccuggacaac

SEQ ID NO: 312841 - RNA, 32 nt, Human
agaucaccccauuucacuccagccugggcgac

SEQ ID NO: 312842 - RNA, 18 nt, Human
agaucaccugaggucagg

SEQ ID NO: 312843 - RNA, 18 nt, Human
agaucaccugaggucggg

SEQ ID NO: 312844 - RNA, 32 nt, Human
agaucaccuggagucccucgucuguggucuug

SEQ ID NO: 312845 - RNA, 32 nt, Human
agaucaccuuugaucaaaaugguuggugaacc

SEQ ID NO: 312846 - RNA, 32 nt, Human
agaucacgacacugcacuccagccugggcaac

SEQ ID NO: 312847 - RNA, 32 nt, Human
agaucacgccacagcacuccagccugggcgac

SEQ ID NO: 312848 - RNA, 32 nt, Human
agaucacgccacuacacuccagccugggcgac

SEQ ID NO: 312849 - RNA, 32 nt, Human
agaucacgccacugaacuccagccugggagac

SEQ ID NO: 312850 - RNA, 32 nt, Human
agaucacgccacugcaacuccagcuuggguga

SEQ ID NO: 312851 - RNA, 32 nt, Human
agaucacgccacugcacuacagccuggacgac

SEQ ID NO: 312852 - RNA, 32 nt, Human
agaucacgccacugcacuauagccuaggugac

SEQ ID NO: 312853 - RNA, 32 nt, Human
agaucacgccacugcacucaagccugggcgac

SEQ ID NO: 312854 - RNA, 32 nt, Human
agaucacgccacugcacuccaaccugggugac

SEQ ID NO: 312855 - RNA, 32 nt, Human
agaucacgccacugcacuccaacuugggcaac

SEQ ID NO: 312856 - RNA, 32 nt, Human
agaucacgccacugcacuccaccugggcaaca

SEQ ID NO: 312857 - RNA, 32 nt, Human
agaucacgccacugcacuccagcacccugggc

SEQ ID NO: 312858 - RNA, 32 nt, Human
agaucacgccacugcacuccagcccgggcgac

SEQ ID NO: 312859 - RNA, 32 nt, Human
agaucacgccacugcacuccagcccgggcggc

SEQ ID NO: 312860 - RNA, 32 nt, Human
agaucacgccacugcacuccagcccggggaca

SEQ ID NO: 312861 - RNA, 32 nt, Human
agaucacgccacugcacuccagccuaggcgac

SEQ ID NO: 312862 - RNA, 32 nt, Human
agaucacgccacugcacuccagccucggugac

SEQ ID NO: 312863 - RNA, 32 nt, Human
agaucacgccacugcacuccagccugagugac

SEQ ID NO: 312864 - RNA, 32 nt, Human
agaucacgccacugcacuccagccugcggaca

SEQ ID NO: 312865 - RNA, 32 nt, Human
agaucacgccacugcacuccagccuggacaac

SEQ ID NO: 312866 - RNA, 32 nt, Human
agaucacgccacugcacuccagccuggaugac

SEQ ID NO: 312867 - RNA, 32 nt, Human
agaucacgccacugcacuccagccuggcgaca

SEQ ID NO: 312868 - RNA, 32 nt, Human
agaucacgccacugcacuccagccugggagac

SEQ ID NO: 312869 - RNA, 32 nt, Human
agaucacgccacugcacuccagccugggcaac

SEQ ID NO: 312870 - RNA, 32 nt, Human
agaucacgccacugcacuccagccugggccac

SEQ ID NO: 312871 - RNA, 32 nt, Human
agaucacgccacugcacuccagccugggcgac

SEQ ID NO: 312872 - RNA, 32 nt, Human
agaucacgccacugcacuccagccugggcgau

SEQ ID NO: 312873 - RNA, 32 nt, Human
agaucacgccacugcacuccagccuggguaac

SEQ ID NO: 312874 - RNA, 32 nt, Human
agaucacgccacugcacuccagccugggugac

SEQ ID NO: 312875 - RNA, 32 nt, Human
agaucacgccacugcacuccagccuggucaac

SEQ ID NO: 312876 - RNA, 32 nt, Human
agaucacgccacugcacuccagccuggugaca

SEQ ID NO: 312877 - RNA, 32 nt, Human
agaucacgccacugcacuccagccuguugaca

SEQ ID NO: 312878 - RNA, 32 nt, Human
agaucacgccacugcacuccagcuggagugac

SEQ ID NO: 312879 - RNA, 32 nt, Human
agaucacgccacugcacuccagucugggugac

SEQ ID NO: 312880 - RNA, 32 nt, Human
agaucacgccacugcacuccauccagccuggg

SEQ ID NO: 312881 - RNA, 32 nt, Human
agaucacgccacugcacucuagccuaggcgac

SEQ ID NO: 312882 - RNA, 32 nt, Human
agaucacgccacugcacucuagccugggauac

SEQ ID NO: 312883 - RNA, 32 nt, Human
agaucacgccacugcacucuagccugggcaac

SEQ ID NO: 312884 - RNA, 32 nt, Human
agaucacgccacugcacucuagccugggcaau

SEQ ID NO: 312885 - RNA, 32 nt, Human
agaucacgccacugcacuugagccugggcgac

SEQ ID NO: 312886 - RNA, 32 nt, Human
agaucacgccacugcauuacagccuggugcag

SEQ ID NO: 312887 - RNA, 32 nt, Human
agaucacgccacugcauuccagacugggcgac

SEQ ID NO: 312888 - RNA, 32 nt, Human
agaucacgccacugcauuccagccugggcgac

SEQ ID NO: 312889 - RNA, 32 nt, Human
agaucacgccacugcauuccagccuggugaca

SEQ ID NO: 312890 - RNA, 32 nt, Human
agaucacgccacugcauuccagccugugcgac

SEQ ID NO: 312891 - RNA, 32 nt, Human
agaucacgccacugcccuccagccuggggaga

SEQ ID NO: 312892 - RNA, 32 nt, Human
agaucacgccacugcgcuccagccugggcgaa

SEQ ID NO: 312893 - RNA, 32 nt, Human
agaucacgccacuguacuccagccuggaugac

SEQ ID NO: 312894 - RNA, 32 nt, Human
agaucacgccacuguacuccagccugggagac

SEQ ID NO: 312895 - RNA, 32 nt, Human
agaucacgccacugugcuccagccugggcaac

SEQ ID NO: 312896 - RNA, 32 nt, Human
agaucacgccagugcacuccagccugagagac

SEQ ID NO: 312897 - RNA, 32 nt, Human
agaucacgccauuacacuccagccuggcugac

SEQ ID NO: 312898 - RNA, 32 nt, Human
agaucacgccauuacacuccagccugggcaac

SEQ ID NO: 312899 - RNA, 32 nt, Human
agaucacgccauugcacuacagccugggugac

SEQ ID NO: 312900 - RNA, 32 nt, Human
agaucacgccauugcacuccaaccugggugac

SEQ ID NO: 312901 - RNA, 32 nt, Human
agaucacgccauugcacuccagccuaggcaac

SEQ ID NO: 312902 - RNA, 32 nt, Human
agaucacgccauugcacuccagccuaggcgac

SEQ ID NO: 312903 - RNA, 32 nt, Human
agaucacgccauugcacuccagccugggcaac

SEQ ID NO: 312904 - RNA, 32 nt, Human
agaucacgccauugcacuccagccugggcaau

SEQ ID NO: 312905 - RNA, 32 nt, Human
agaucacgccauugcacuccagccugggcgac

SEQ ID NO: 312906 - RNA, 32 nt, Human
agaucacgccauugcacuccagccugggggac

SEQ ID NO: 312907 - RNA, 32 nt, Human
agaucacgccauugcacuccagccugggugac

SEQ ID NO: 312908 - RNA, 32 nt, Human
agaucacgccauugcacuccagccugugcgac

SEQ ID NO: 312909 - RNA, 32 nt, Human
agaucacgccauugcacuccagucugagcaac

SEQ ID NO: 312910 - RNA, 32 nt, Human
agaucacgccauugcacuccagucugguugac

SEQ ID NO: 312911 - RNA, 32 nt, Human
agaucacgccauuguacuccagccuggcaaca

SEQ ID NO: 312912 - RNA, 32 nt, Human
agaucacgccauuguacuccagccugggcaac

SEQ ID NO: 312913 - RNA, 32 nt, Human
agaucacgccauuguacuccagccugggcgac

SEQ ID NO: 312914 - RNA, 32 nt, Human
agaucacgccgcugcacuccagccugagcaca

SEQ ID NO: 312915 - RNA, 32 nt, Human
agaucacgccguugcacuccagccugggcaac

SEQ ID NO: 312916 - RNA, 32 nt, Human
agaucacgccucugcacuccagccugggcaac

SEQ ID NO: 312917 - RNA, 32 nt, Human
agaucacgcuacugcgcuccagccugagugau

SEQ ID NO: 312918 - RNA, 32 nt, Human
agaucacggcacugcgcugcagccugggcaac

SEQ ID NO: 312919 - RNA, 32 nt, Human
agaucacgucacugcacuccagcuugggcaac

SEQ ID NO: 312920 - RNA, 32 nt, Human
agaucacgucacugcacuccggccugggugac

SEQ ID NO: 312921 - RNA, 32 nt, Human
agaucacgucacuguacuccagccugggugac

SEQ ID NO: 312922 - RNA, 32 nt, Human
agaucacgucauugcacuccagccuggucaac

SEQ ID NO: 312923 - RNA, 32 nt, Human
agaucacgucauugcucuccagccugggcaac

SEQ ID NO: 312924 - RNA, 32 nt, Human
agaucacuccacugcacuccagccugggcaac

SEQ ID NO: 312925 - RNA, 32 nt, Human
agaucacuccacugcacuccagccugggcgac

SEQ ID NO: 312926 - RNA, 32 nt, Human
agaucacucggguccccaccuuagaagggucc

SEQ ID NO: 312927 - RNA, 23 nt, Human
agaucacugcaaccuccaccucc

SEQ ID NO: 312928 - RNA, 32 nt, Human
agaucacugcaaccuccaccucccagguucaa

SEQ ID NO: 312929 - RNA, 32 nt, Human
agaucacugcaaccuccgccuccuggguucaa

SEQ ID NO: 312930 - RNA, 32 nt, Human
agaucacugcaaccucugccucccggguucaa

SEQ ID NO: 312931 - RNA, 32 nt, Human
agaucacugcaaccucugccuccuggguucaa

SEQ ID NO: 312932 - RNA, 32 nt, Human
agaucacugcagccucaaacuccugggcucaa

SEQ ID NO: 312933 - RNA, 32 nt, Human
agaucacugcagccuccaacuccugggcucaa

SEQ ID NO: 312934 - RNA, 32 nt, Human
agaucacugccugggaggcuuggcuuaguacu

SEQ ID NO: 312935 - RNA, 32 nt, Human
agaucacugccuugggcuucauggaaaacagg

SEQ ID NO: 312936 - RNA, 19 nt, Human
agaucacuucagccuggga

SEQ ID NO: 312937 - RNA, 32 nt, Human
agaucacuugagcucaggaguaugagacuagc

SEQ ID NO: 312938 - RNA, 32 nt, Human
agaucacuugagcucaggaguucgagaccacc

SEQ ID NO: 312939 - RNA, 18 nt, Human
agaucacuugaggucagg

SEQ ID NO: 312940 - RNA, 32 nt, Human
agaucacuugaguucaagaccagccuggccaa

SEQ ID NO: 312941 - RNA, 32 nt, Human
agaucagaaagaaagagacuuagggaagugga

SEQ ID NO: 312942 - RNA, 21 nt, Human
agaucagaaagaggccucccu

SEQ ID NO: 312943 - RNA, 32 nt, Human
agaucagaagacuacaaaaaugaagcugcucu

SEQ ID NO: 312944 - RNA, 32 nt, Human
agaucagacagugaucacucugaaagauugaa

SEQ ID NO: 312945 - RNA, 32 nt, Human
agaucagaccacugcccuccagccugggcaau

SEQ ID NO: 312946 - RNA, 32 nt, Human
agaucagagaggcagagguggcacaggacagu

SEQ ID NO: 312947 - RNA, 32 nt, Human
agaucagagaugcuguucaucagucccaacaa

SEQ ID NO: 312948 - RNA, 32 nt, Human
agaucagagcaucugacugcccugccuuggag

SEQ ID NO: 312949 - RNA, 32 nt, Human
agaucagagggaggaaggagaccccgggcccc

SEQ ID NO: 312950 - RNA, 32 nt, Human
agaucagcaccucucugcccagaucugcacau

SEQ ID NO: 312951 - RNA, 22 nt, Human
agaucagcagaacacccagagg

SEQ ID NO: 312952 - RNA, 32 nt, Human
agaucagcaggaagccuugcugccugggacau

SEQ ID NO: 312953 - RNA, 32 nt, Human
agaucagcauuuuuagccaucucaaccgcacc

SEQ ID NO: 312954 - RNA, 32 nt, Human
agaucagccuccugucucaucuggaagaccac

SEQ ID NO: 312955 - RNA, 32 nt, Human
agaucagccugaccaacauggagaaaccccau

SEQ ID NO: 312956 - RNA, 32 nt, Human
agaucagccugaccaacauggagaaaccccgu

SEQ ID NO: 312957 - RNA, 32 nt, Human
agaucagccugaccaacauggagaaacccuac

SEQ ID NO: 312958 - RNA, 32 nt, Human
agaucagccugaccaacauggugaaaccccau

SEQ ID NO: 312959 - RNA, 22 nt, Human
agaucagccugaccaauauggu

SEQ ID NO: 312960 - RNA, 22 nt, Human
agaucagccugagcaacauagc

SEQ ID NO: 312961 - RNA, 32 nt, Human
agaucagcgacugccacaucauugaaguggag

SEQ ID NO: 312962 - RNA, 32 nt, Human
agaucagcgcauuuucuacgccugugucauug

SEQ ID NO: 312963 - RNA, 32 nt, Human
agaucagcugaugccggaggguuugaagccgc

SEQ ID NO: 312964 - RNA, 32 nt, Human
agaucagcuggguccagaguuuaaugggcaac

SEQ ID NO: 312965 - RNA, 32 nt, Human
agaucagcuuagguagaacaguucucggugag

SEQ ID NO: 312966 - RNA, 32 nt, Human
agaucaggaauagauuuguucaguucaguauu

SEQ ID NO: 312967 - RNA, 32 nt, Human
agaucaggagagaagguuuggauaucagcugu

SEQ ID NO: 312968 - RNA, 32 nt, Human
agaucaggauguuccgcuucaugagggacgug

SEQ ID NO: 312969 - RNA, 32 nt, Human
agaucaggcaacagugauucuauagaaaggga

SEQ ID NO: 312970 - RNA, 32 nt, Human
agaucaggcacuucagccugggcgacagagcg

SEQ ID NO: 312971 - RNA, 32 nt, Human
agaucaggccacugcacuccagccugaacaac

SEQ ID NO: 312972 - RNA, 32 nt, Human
agaucaggccacugcacuccagccugggcaac

SEQ ID NO: 312973 - RNA, 32 nt, Human
agaucaggccauugcacuccagccugggcaau

SEQ ID NO: 312974 - RNA, 32 nt, Human
agaucaggccauugcacuucagccugggugac

SEQ ID NO: 312975 - RNA, 32 nt, Human
agaucaggcccucggcagagacacaggaagcg

SEQ ID NO: 312976 - RNA, 32 nt, Human
agaucaggcuguuccuuugcugccagguacac

SEQ ID NO: 312977 - RNA, 32 nt, Human
agaucagggacaaccugggaacugaauaacuu

SEQ ID NO: 312978 - RNA, 21 nt, Human
agaucagggcagaauagcaga

SEQ ID NO: 312979 - RNA, 24 nt, Human
agaucagggcccugccacccaggg

SEQ ID NO: 312980 - RNA, 32 nt, Human
agaucaggggcaggcaccggaguugaggcugu

SEQ ID NO: 312981 - RNA, 32 nt, Human
agaucagguauucugcacauucauuccaaggu

SEQ ID NO: 312982 - RNA, 32 nt, Human
agaucaggugucuggagguugcugagcagcgc

SEQ ID NO: 312983 - RNA, 32 nt, Human
agaucagucaaauuggaaaaagugccaagacu

SEQ ID NO: 312984 - RNA, 32 nt, Human
agaucaguccccaaaucacugaauugucccag

SEQ ID NO: 312985 - RNA, 32 nt, Human
agaucagucuucaugugaccugcaguauuuuu

SEQ ID NO: 312986 - RNA, 23 nt, Human
agaucagugccucuggguuguua

SEQ ID NO: 312987 - RNA, 32 nt, Human
agaucaguggagccuucuuucugccaucuugu

SEQ ID NO: 312988 - RNA, 32 nt, Human
agaucaguggagugccuggcaugcugaaccca

SEQ ID NO: 312989 - RNA, 32 nt, Human
agaucaguguaccauuugccucccgggcucaa

SEQ ID NO: 312990 - RNA, 32 nt, Human
agaucauaagguaccugaggccagggaucuug

SEQ ID NO: 312991 - RNA, 32 nt, Human
agaucauaauuuuaugaacagaaagaacucag

SEQ ID NO: 312992 - RNA, 32 nt, Human
agaucauaccacggcacuccagccugggugac

SEQ ID NO: 312993 - RNA, 32 nt, Human
agaucauaccacugcacuccagccuggcgaca

SEQ ID NO: 312994 - RNA, 32 nt, Human
agaucauaccacugcacugcagccugagugac

SEQ ID NO: 312995 - RNA, 32 nt, Human
agaucauaccacuucauuccagccugggugac

SEQ ID NO: 312996 - RNA, 32 nt, Human
agaucauaccauugcacuccagccuaggcaac

SEQ ID NO: 312997 - RNA, 32 nt, Human
agaucauaccauugcacuccagccugggcaac

SEQ ID NO: 312998 - RNA, 32 nt, Human
agaucauacgacucaucggacacuaauuuaua

SEQ ID NO: 312999 - RNA, 32 nt, Human
agaucauacuacugcacuccagccugggcgac

SEQ ID NO: 313000 - RNA, 32 nt, Human
agaucauauagcuaaugaauuaggcaggggag

SEQ ID NO: 313001 - RNA, 32 nt, Human
agaucauaucacugcacuccagccuggcugac

SEQ ID NO: 313002 - RNA, 32 nt, Human
agaucauauuagcuuguugcugaggaugucac

SEQ ID NO: 313003 - RNA, 32 nt, Human
agaucaucaaugcuaacaccucacaaugugug

SEQ ID NO: 313004 - RNA, 21 nt, Human
agaucaucaugggacccugga

SEQ ID NO: 313005 - RNA, 21 nt, Human
agaucauccaagaccauggca

SEQ ID NO: 313006 - RNA, 18 nt, Human
agaucaucugaggucagg

SEQ ID NO: 313007 - RNA, 32 nt, Human
agaucaugacacugcacuccagccugggcaac

SEQ ID NO: 313008 - RNA, 32 nt, Human
agaucaugagcccuuuuucuccaguaguacag

SEQ ID NO: 313009 - RNA, 32 nt, Human
agaucaugcagagcgaagccaccaagacuuua

SEQ ID NO: 313010 - RNA, 32 nt, Human
agaucaugccacaucacuccagccugggcaac

SEQ ID NO: 313011 - RNA, 32 nt, Human
agaucaugccaccgcacuccagccugggcaac

SEQ ID NO: 313012 - RNA, 32 nt, Human
agaucaugccaccgcacuucagccugggugac

SEQ ID NO: 313013 - RNA, 32 nt, Human
agaucaugccacuacacuccagccuggcgaca

SEQ ID NO: 313014 - RNA, 32 nt, Human
agaucaugccacuccacuccagucugggcgac

SEQ ID NO: 313015 - RNA, 32 nt, Human
agaucaugccacugaacuccagccugggcaac

SEQ ID NO: 313016 - RNA, 32 nt, Human
agaucaugccacugaacuccagccugggugac

SEQ ID NO: 313017 - RNA, 32 nt, Human
agaucaugccacugcaaucuagccugggugac

SEQ ID NO: 313018 - RNA, 32 nt, Human
agaucaugccacugcacccaucuugggcaaca

SEQ ID NO: 313019 - RNA, 32 nt, Human
agaucaugccacugcaccccagcaccuggcua

SEQ ID NO: 313020 - RNA, 32 nt, Human
agaucaugccacugcaccccagccugggcaac

SEQ ID NO: 313021 - RNA, 32 nt, Human
agaucaugccacugcacccuagcuuggguggc

SEQ ID NO: 313022 - RNA, 32 nt, Human
agaucaugccacugcacuagagccugggcaac

SEQ ID NO: 313023 - RNA, 32 nt, Human
agaucaugccacugcacuccaaccugggcgac

SEQ ID NO: 313024 - RNA, 32 nt, Human
agaucaugccacugcacuccaaccugggugac

SEQ ID NO: 313025 - RNA, 32 nt, Human
agaucaugccacugcacuccagcccaggugac

SEQ ID NO: 313026 - RNA, 32 nt, Human
agaucaugccacugcacuccagccuaugugac

SEQ ID NO: 313027 - RNA, 32 nt, Human
agaucaugccacugcacuccagccugagugac

SEQ ID NO: 313028 - RNA, 32 nt, Human
agaucaugccacugcacuccagccuggacaac

SEQ ID NO: 313029 - RNA, 32 nt, Human
agaucaugccacugcacuccagccuggaugac

SEQ ID NO: 313030 - RNA, 32 nt, Human
agaucaugccacugcacuccagccugggcaac

SEQ ID NO: 313031 - RNA, 32 nt, Human
agaucaugccacugcacuccagccugggcaau

SEQ ID NO: 313032 - RNA, 32 nt, Human
agaucaugccacugcacuccagccugggcagc

SEQ ID NO: 313033 - RNA, 32 nt, Human
agaucaugccacugcacuccagccugggcaug

SEQ ID NO: 313034 - RNA, 32 nt, Human
agaucaugccacugcacuccagccugggccag

SEQ ID NO: 313035 - RNA, 32 nt, Human
agaucaugccacugcacuccagccugggcgac

SEQ ID NO: 313036 - RNA, 32 nt, Human
agaucaugccacugcacuccagccugggcgau

SEQ ID NO: 313037 - RNA, 32 nt, Human
agaucaugccacugcacuccagccugggcggc

SEQ ID NO: 313038 - RNA, 32 nt, Human
agaucaugccacugcacuccagccugggugac

SEQ ID NO: 313039 - RNA, 32 nt, Human
agaucaugccacugcacuccauccugggcaac

SEQ ID NO: 313040 - RNA, 32 nt, Human
agaucaugccacugcacuccggccuaggugac

SEQ ID NO: 313041 - RNA, 32 nt, Human
agaucaugccacugcacuccugccugggugac

SEQ ID NO: 313042 - RNA, 32 nt, Human
agaucaugccacugcacugcacuccagccugg

SEQ ID NO: 313043 - RNA, 32 nt, Human
agaucaugccacugcacugcagcccgggcgac

SEQ ID NO: 313044 - RNA, 32 nt, Human
agaucaugccacugcacuuuagccugggugac

SEQ ID NO: 313045 - RNA, 32 nt, Human
agaucaugccacugcaugccagccugggcaac

SEQ ID NO: 313046 - RNA, 32 nt, Human
agaucaugccacugcauucuagccugggcaac

SEQ ID NO: 313047 - RNA, 32 nt, Human
agaucaugccacuggacuccagccugggugaa

SEQ ID NO: 313048 - RNA, 32 nt, Human
agaucaugccacuguacuccagccuaggugac

SEQ ID NO: 313049 - RNA, 32 nt, Human
agaucaugccagugcacuccagccugggcaac

SEQ ID NO: 313050 - RNA, 32 nt, Human
agaucaugccauggcacuccauccugggugac

SEQ ID NO: 313051 - RNA, 32 nt, Human
agaucaugccauuacacuccagccugggcgac

SEQ ID NO: 313052 - RNA, 32 nt, Human
agaucaugccauuacuccagccugggugacau

SEQ ID NO: 313053 - RNA, 32 nt, Human
agaucaugccauuauacuccagccugggugac

SEQ ID NO: 313054 - RNA, 32 nt, Human
agaucaugccauugcacagcagccugggugac

SEQ ID NO: 313055 - RNA, 32 nt, Human
agaucaugccauugcacuccaaccugggugac

SEQ ID NO: 313056 - RNA, 32 nt, Human
agaucaugccauugcacuccagcccagguaac

SEQ ID NO: 313057 - RNA, 32 nt, Human
agaucaugccauugcacuccagcccggguuac

SEQ ID NO: 313058 - RNA, 32 nt, Human
agaucaugccauugcacuccagccuaggcaac

SEQ ID NO: 313059 - RNA, 32 nt, Human
agaucaugccauugcacuccagccugagugac

SEQ ID NO: 313060 - RNA, 32 nt, Human
agaucaugccauugcacuccagccuggacaac

SEQ ID NO: 313061 - RNA, 32 nt, Human
agaucaugccauugcacuccagccugggcaac

SEQ ID NO: 313062 - RNA, 32 nt, Human
agaucaugccauugcacuccagccugggcgac

SEQ ID NO: 313063 - RNA, 32 nt, Human
agaucaugccauugcacuccagccugggugac

SEQ ID NO: 313064 - RNA, 32 nt, Human
agaucaugccauugcacuccagccugggugau

SEQ ID NO: 313065 - RNA, 32 nt, Human
agaucaugccauugcacuccagcuugggugac

SEQ ID NO: 313066 - RNA, 32 nt, Human
agaucaugccauugcacuccagucugggcgac

SEQ ID NO: 313067 - RNA, 32 nt, Human
agaucaugccauugcacuccgacucugggcaa

SEQ ID NO: 313068 - RNA, 32 nt, Human
agaucaugccauugcauuccagccuaggcaac

SEQ ID NO: 313069 - RNA, 32 nt, Human
agaucaugccauugcauuccagccuuggcgac

SEQ ID NO: 313070 - RNA, 32 nt, Human
agaucaugccccugcauuccagccuaggcgac

SEQ ID NO: 313071 - RNA, 30 nt, Human
agaucaugccgcugcauuccagccugggug

SEQ ID NO: 313072 - RNA, 32 nt, Human
agaucaugccguuguacuccagcuugggcaac

SEQ ID NO: 313073 - RNA, 32 nt, Human
agaucaugccuacugcacuccagccugggcaa

SEQ ID NO: 313074 - RNA, 32 nt, Human
agaucaugccuguaaucccaguacuuugggag

SEQ ID NO: 313075 - RNA, 32 nt, Human
agaucaugcuacugcacuccagccugggcgac

SEQ ID NO: 313076 - RNA, 32 nt, Human
agaucaugcuacugcacuccagccugggugac

SEQ ID NO: 313077 - RNA, 32 nt, Human
agaucaugcuacugcacuccagcuuagguggc

SEQ ID NO: 313078 - RNA, 32 nt, Human
agaucaugcuacugcacucuagccugagcgac

SEQ ID NO: 313079 - RNA, 32 nt, Human
agaucaugcuacugcaugccagccugggugac

SEQ ID NO: 313080 - RNA, 32 nt, Human
agaucaugcuagugcgcuccagccugggcaac

SEQ ID NO: 313081 - RNA, 30 nt, Human
agaucauggaagggaagugguugcugugua

SEQ ID NO: 313082 - RNA, 32 nt, Human
agaucaugggacugcacuccagccugggugac

SEQ ID NO: 313083 - RNA, 32 nt, Human
agaucauggugacaguggaugggaaaaaguga

SEQ ID NO: 313084 - RNA, 32 nt, Human
agaucaugucacugcacuccagccugggugac

SEQ ID NO: 313085 - RNA, 32 nt, Human
agaucaugucacugcacucuagcuugggagac

SEQ ID NO: 313086 - RNA, 32 nt, Human
agaucaugucacuguacuccagccugggcaac

SEQ ID NO: 313087 - RNA, 32 nt, Human
agaucaugugacccuauacucuugccuuggug

SEQ ID NO: 313088 - RNA, 32 nt, Human
agaucauguucucaccaauggucugccacuuc

SEQ ID NO: 313089 - RNA, 32 nt, Human
agaucauuaacacaucauuauaaugcuaaaau

SEQ ID NO: 313090 - RNA, 32 nt, Human
agaucauucacucauacaucuggccguugaug

SEQ ID NO: 313091 - RNA, 32 nt, Human
agaucauuccauuacacuccagccugggcacc

SEQ ID NO: 313092 - RNA, 32 nt, Human
agaucauugcacuccagccugggcaauaagag

SEQ ID NO: 313093 - RNA, 32 nt, Human
agaucauuucaccucacuccagccugggugac

SEQ ID NO: 313094 - RNA, 32 nt, Human
agaucauuucuacugcuuuucuuucugcuuca

SEQ ID NO: 313095 - RNA, 32 nt, Human
agaucauuucuuuccaguuuuuggggaaaugg

SEQ ID NO: 313096 - RNA, 32 nt, Human
agauccaaccagccuuggauaggaaauauuug

SEQ ID NO: 313097 - RNA, 32 nt, Human
agauccaagcauccugagcaacucuugauuau

SEQ ID NO: 313098 - RNA, 32 nt, Human
agauccacaguuacaagugacacgcaugcaca

SEQ ID NO: 313099 - RNA, 32 nt, Human
agauccacaucacccacgacccugccacuguu

SEQ ID NO: 313100 - RNA, 32 nt, Human
agauccacuacagcuacaacgaggagaaagau

SEQ ID NO: 313101 - RNA, 24 nt, Human
agauccacuagaucgucgucucca

SEQ ID NO: 313102 - RNA, 32 nt, Human
agauccacuugaggcccgacuucagaguggac

SEQ ID NO: 313103 - RNA, 32 nt, Human
agauccagaagcagggaaagaaaacggcggau

SEQ ID NO: 313104 - RNA, 32 nt, Human
agauccagaaugcaugugucucuucccacgca

SEQ ID NO: 313105 - RNA, 32 nt, Human
agauccagacaucagggcugggcacagcgguu

SEQ ID NO: 313106 - RNA, 32 nt, Human
agauccagaguguuacuggcuuacaaauugga

SEQ ID NO: 313107 - RNA, 32 nt, Human
agauccagcaggaguucuggucuuacacgaaa

SEQ ID NO: 313108 - RNA, 32 nt, Human
agauccagccacagcacuccagccugggugac

SEQ ID NO: 313109 - RNA, 32 nt, Human
agauccagccugggcgacagagccagacucuu

SEQ ID NO: 313110 - RNA, 32 nt, Human
agauccagcuacucgggaggcugaggcagggg

SEQ ID NO: 313111 - RNA, 32 nt, Human
agauccaggagggauggaauguucuuuaaaau

SEQ ID NO: 313112 - RNA, 32 nt, Human
agauccaggaguugaagaccagccugggcaac

SEQ ID NO: 313113 - RNA, 32 nt, Human
agauccaggcuucucccggaccuggacuaggg

SEQ ID NO: 313114 - RNA, 32 nt, Human
agauccagggccugggaaagaggggcugaggc

SEQ ID NO: 313115 - RNA, 32 nt, Human
agauccagguggagcuugaccugaaguaccag

SEQ ID NO: 313116 - RNA, 32 nt, Human
agauccaguuuggaaaugagagaggacuagca

SEQ ID NO: 313117 - RNA, 32 nt, Human
agauccauccacuccaccccaggcuggcucca

SEQ ID NO: 313118 - RNA, 31 nt, Human
agauccaugcugcugcugacucggagcccca

SEQ ID NO: 313119 - RNA, 32 nt, Human
agaucccaacucccaugaccucuggcuucagu

SEQ ID NO: 313120 - RNA, 32 nt, Human
agaucccaccacugcacuccagccugggcgac

SEQ ID NO: 313121 - RNA, 32 nt, Human
agaucccaccauugcacuccagccugggcaac

SEQ ID NO: 313122 - RNA, 32 nt, Human
agaucccagcacuucggaaggccgagguggga

SEQ ID NO: 313123 - RNA, 32 nt, Human
agaucccaggagagaagagcucaggagauggg

SEQ ID NO: 313124 - RNA, 32 nt, Human
agaucccagggucaggagagaccccucuguau

SEQ ID NO: 313125 - RNA, 32 nt, Human
agaucccagucugaguuauacccuggagcagc

SEQ ID NO: 313126 - RNA, 32 nt, Human
agaucccaguuuccuuuugcccuucacuauuu

SEQ ID NO: 313127 - RNA, 32 nt, Human
agaucccaugccaggugguagcugugaguacc

SEQ ID NO: 313128 - RNA, 32 nt, Human
agaucccauggcugaugccuggaacacaaugu

SEQ ID NO: 313129 - RNA, 32 nt, Human
agauccccaacaagaccgagacccuggacgag

SEQ ID NO: 313130 - RNA, 32 nt, Human
agauccccaacugcuccagccucugccgcugc

SEQ ID NO: 313131 - RNA, 32 nt, Human
agauccccagaacagggagagacugcauacaa

SEQ ID NO: 313132 - RNA, 32 nt, Human
agauccccagacuucauagaauacucagggaa

SEQ ID NO: 313133 - RNA, 32 nt, Human
agauccccagagucagggagggcagagggugg

SEQ ID NO: 313134 - RNA, 21 nt, Human
agauccccagcuaagacgcca

SEQ ID NO: 313135 - RNA, 23 nt, Human
agauccccaggcugcucucucca

SEQ ID NO: 313136 - RNA, 32 nt, Human
agauccccaggggacugggugcaguggcucau

SEQ ID NO: 313137 - RNA, 21 nt, Human
agaucccccaauucucuggaa

SEQ ID NO: 313138 - RNA, 32 nt, Human
agaucccccaucucuggcagugcagugugccu

SEQ ID NO: 313139 - RNA, 32 nt, Human
agaucccccgaccgcacuccagccugggcgac

SEQ ID NO: 313140 - RNA, 32 nt, Human
agaucccccucccauuuaacuguccucacagg

SEQ ID NO: 313141 - RNA, 32 nt, Human
agauccccgccuguggcacaccccagagccag

SEQ ID NO: 313142 - RNA, 32 nt, Human
agauccccggggcuggggcccagcacaacugc

SEQ ID NO: 313143 - RNA, 32 nt, Human
agauccccucaggacugcaacaggcuugugca

SEQ ID NO: 313144 - RNA, 18 nt, Human
agauccccuccccugccc

SEQ ID NO: 313145 - RNA, 32 nt, Human
agauccccugcuccuguuguguucuguuguaa

SEQ ID NO: 313146 - RNA, 32 nt, Human
agauccccugcugaacagauauacagaguucu

SEQ ID NO: 313147 - RNA, 32 nt, Human
agauccccuggaaacccaccucucuggaaggc

SEQ ID NO: 313148 - RNA, 32 nt, Human
agauccccuucccacccucuccguuggccuca

SEQ ID NO: 313149 - RNA, 32 nt, Human
agaucccgccacucacuccagccuggauaaaa

SEQ ID NO: 313150 - RNA, 32 nt, Human
agaucccgccacugcacgccagccugggcgac

SEQ ID NO: 313151 - RNA, 32 nt, Human
agaucccgccacugcacuccagacugggcgac

SEQ ID NO: 313152 - RNA, 32 nt, Human
agaucccgccacugcacuccagcccaggugac

SEQ ID NO: 313153 - RNA, 32 nt, Human
agaucccgccacugcacuccagccugggcgac

SEQ ID NO: 313154 - RNA, 32 nt, Human
agaucccuaucaucuugggaaacaguagccca

SEQ ID NO: 313155 - RNA, 32 nt, Human
agaucccucacaugugccguucacaacagguu

SEQ ID NO: 313156 - RNA, 32 nt, Human
agaucccuccagggccucauugucaguccugu

SEQ ID NO: 313157 - RNA, 22 nt, Human
agaucccugccagguuuuggaa

SEQ ID NO: 313158 - RNA, 32 nt, Human
agaucccugccugggacccuuuccuggggcuc

SEQ ID NO: 313159 - RNA, 23 nt, Human
agaucccugccuuacaauuggaa

SEQ ID NO: 313160 - RNA, 32 nt, Human
agaucccuggacccaguaagaauaagaaggaa

SEQ ID NO: 313161 - RNA, 32 nt, Human
agaucccuugcucccucucugccugcaaucac

SEQ ID NO: 313162 - RNA, 32 nt, Human
agauccgagccgggcuggcugcagagaaaccg

SEQ ID NO: 313163 - RNA, 32 nt, Human
agauccgcaaagugcuuuguuccuggaaauca

SEQ ID NO: 313164 - RNA, 32 nt, Human
agauccgcaauguggagcagcagccacugcac

SEQ ID NO: 313165 - RNA, 32 nt, Human
agauccgccacugcacuccagccugggugaca

SEQ ID NO: 313166 - RNA, 32 nt, Human
agauccgcuuuggcagcgacccugccaccuac

SEQ ID NO: 313167 - RNA, 22 nt, Human
agauccggccgccagcacuucc

SEQ ID NO: 313168 - RNA, 32 nt, Human
agauccggcgcgcgucuuccaccacaaugccu

SEQ ID NO: 313169 - RNA, 32 nt, Human
agauccgggagcugcagucccagaucuccaac

SEQ ID NO: 313170 - RNA, 22 nt, Human
agauccgggccccaggcugcug

SEQ ID NO: 313171 - RNA, 32 nt, Human
agauccuaccuguucagacacagccauccuuc

SEQ ID NO: 313172 - RNA, 32 nt, Human
agauccuaucauuccuugucuggauuauuuca

SEQ ID NO: 313173 - RNA, 32 nt, Human
agauccucaaauagcaaguuucaaauuuuacu

SEQ ID NO: 313174 - RNA, 18 nt, Human
agauccuccagccuccag

SEQ ID NO: 313175 - RNA, 32 nt, Human
agauccuccaguuccuccuuuucaucccuuau

SEQ ID NO: 313176 - RNA, 32 nt, Human
agauccuccugccucagccuccuaaguaccug

SEQ ID NO: 313177 - RNA, 32 nt, Human
agauccuccugccucagccuccugagcagcug

SEQ ID NO: 313178 - RNA, 32 nt, Human
agauccuccuuccaggccccaggcuggaugcu

SEQ ID NO: 313179 - RNA, 32 nt, Human
agauccucugccagggcagugcagaagggaaa

SEQ ID NO: 313180 - RNA, 32 nt, Human
agauccucuucuacccugcucugcaccugugc

SEQ ID NO: 313181 - RNA, 32 nt, Human
agauccugaaaccucugucauggaaaaguacc

SEQ ID NO: 313182 - RNA, 32 nt, Human
agauccugauugugcuuuauacauuccucccc

SEQ ID NO: 313183 - RNA, 32 nt, Human
agauccugcacaagguggaguguacuggcuac

SEQ ID NO: 313184 - RNA, 32 nt, Human
agauccugcauuucuaacaagcucccagguaa

SEQ ID NO: 313185 - RNA, 32 nt, Human
agauccugccacugcacuccagccugggcaac

SEQ ID NO: 313186 - RNA, 32 nt, Human
agauccugccacugcacuccagccugugccac

SEQ ID NO: 313187 - RNA, 32 nt, Human
agauccugcccagcaauggccuuucccuucua

SEQ ID NO: 313188 - RNA, 32 nt, Human
agauccugccucccacagucacccugcuccca

SEQ ID NO: 313189 - RNA, 32 nt, Human
agauccuggaaccagggcugaggcucgcaucc

SEQ ID NO: 313190 - RNA, 32 nt, Human
agauccuggccugugguagugguagcaguuuu

SEQ ID NO: 313191 - RNA, 32 nt, Human
agauccuguccucaggaccagaagcacgucuc

SEQ ID NO: 313192 - RNA, 19 nt, Human
agauccugucucuacaaaa

SEQ ID NO: 313193 - RNA, 18 nt, Human
agauccugugcaggcugc

SEQ ID NO: 313194 - RNA, 32 nt, Human
agauccugugggcugaagagaggucaggcuuu

SEQ ID NO: 313195 - RNA, 32 nt, Human
agauccuguguguuucucuguacccagcugac

SEQ ID NO: 313196 - RNA, 32 nt, Human
agauccuuccuucucuccuccuucuucauucu

SEQ ID NO: 313197 - RNA, 32 nt, Human
agauccuucuccagauccccaggguuucuuug

SEQ ID NO: 313198 - RNA, 32 nt, Human
agauccuugaggaaucuuugucuuccacaaug

SEQ ID NO: 313199 - RNA, 32 nt, Human
agauccuugccaucugucagugucugccugcg

SEQ ID NO: 313200 - RNA, 32 nt, Human
agauccuugggaagacaguagaucagacagga

SEQ ID NO: 313201 - RNA, 32 nt, Human
agauccuugucauuuacaauuuacagaucaug

SEQ ID NO: 313202 - RNA, 32 nt, Human
agaucgaaccauuguacuccagccugggugac

SEQ ID NO: 313203 - RNA, 32 nt, Human
agaucgaagaugagaaaaaggaugaagaaaaa

SEQ ID NO: 313204 - RNA, 32 nt, Human
agaucgacaucaugccacccugggcaaaagag

SEQ ID NO: 313205 - RNA, 32 nt, Human
agaucgaccccaaugcccagugugugaagcau

SEQ ID NO: 313206 - RNA, 32 nt, Human
agaucgagccacugcacuccagccugggcagc

SEQ ID NO: 313207 - RNA, 32 nt, Human
agaucgagccacugcacuccagccugggcgac

SEQ ID NO: 313208 - RNA, 32 nt, Human
agaucgagccacugcacuccagccugggugac

SEQ ID NO: 313209 - RNA, 32 nt, Human
agaucgagccacugcacuccagccugggugau

SEQ ID NO: 313210 - RNA, 32 nt, Human
agaucgagccacugcacuccugggcaacagag

SEQ ID NO: 313211 - RNA, 32 nt, Human
agaucgagccacugcauuccagccugggcgaa

SEQ ID NO: 313212 - RNA, 32 nt, Human
agaucgagccauugcacuccagccuggacagc

SEQ ID NO: 313213 - RNA, 32 nt, Human
agaucgagccauugcacuccagccugggcaac

SEQ ID NO: 313214 - RNA, 32 nt, Human
agaucgauugagcccaggaguucgagaccagc

SEQ ID NO: 313215 - RNA, 32 nt, Human
agaucgcaacacuacacuccagccugggcgac

SEQ ID NO: 313216 - RNA, 32 nt, Human
agaucgcaacacugcacuccagccugggcgac

SEQ ID NO: 313217 - RNA, 32 nt, Human
agaucgcaacacugcacuccagccugggugac

SEQ ID NO: 313218 - RNA, 32 nt, Human
agaucgcaacacugcccuccagccugggcaac

SEQ ID NO: 313219 - RNA, 32 nt, Human
agaucgcaacauugcacuccaggcugggcagc

SEQ ID NO: 313220 - RNA, 31 nt, Human
agaucgcacagcuaguaaauggcagaaguag

SEQ ID NO: 313221 - RNA, 32 nt, Human
agaucgcaccacagcacuccagcccaggcggc

SEQ ID NO: 313222 - RNA, 32 nt, Human
agaucgcaccaccacacuccagccugggugac

SEQ ID NO: 313223 - RNA, 32 nt, Human
agaucgcaccacggcacuccagccuggcgaca

SEQ ID NO: 313224 - RNA, 32 nt, Human
agaucgcaccacugaacuccagccugggcgac

SEQ ID NO: 313225 - RNA, 32 nt, Human
agaucgcaccacugcaccccagccugggcaac

SEQ ID NO: 313226 - RNA, 32 nt, Human
agaucgcaccacugcaccccagcgugggcaac

SEQ ID NO: 313227 - RNA, 32 nt, Human
agaucgcaccacugcacgcacuccagccuggg

SEQ ID NO: 313228 - RNA, 32 nt, Human
agaucgcaccacugcacuacagccugggcgac

SEQ ID NO: 313229 - RNA, 32 nt, Human
agaucgcaccacugcacucaagccugggcgac

SEQ ID NO: 313230 - RNA, 32 nt, Human
agaucgcaccacugcacuccaaccugggcaac

SEQ ID NO: 313231 - RNA, 32 nt, Human
agaucgcaccacugcacuccaaccugggugac

SEQ ID NO: 313232 - RNA, 32 nt, Human
agaucgcaccacugcacuccaaucugggcaag

SEQ ID NO: 313233 - RNA, 32 nt, Human
agaucgcaccacugcacuccagcaugagugac

SEQ ID NO: 313234 - RNA, 32 nt, Human
agaucgcaccacugcacuccagccuggaagac

SEQ ID NO: 313235 - RNA, 32 nt, Human
agaucgcaccacugcacuccagccuggacaac

SEQ ID NO: 313236 - RNA, 32 nt, Human
agaucgcaccacugcacuccagccugggagac

SEQ ID NO: 313237 - RNA, 32 nt, Human
agaucgcaccacugcacuccagccugggagau

SEQ ID NO: 313238 - RNA, 32 nt, Human
agaucgcaccacugcacuccagccugggcaac

SEQ ID NO: 313239 - RNA, 32 nt, Human
agaucgcaccacugcacuccagccugggcgaa

SEQ ID NO: 313240 - RNA, 32 nt, Human
agaucgcaccacugcacuccagccugggcgac

SEQ ID NO: 313241 - RNA, 32 nt, Human
agaucgcaccacugcacuccagccugggcggc

SEQ ID NO: 313242 - RNA, 32 nt, Human
agaucgcaccacugcacuccagccugggugac

SEQ ID NO: 313243 - RNA, 32 nt, Human
agaucgcaccacugcacuccagccugggugau

SEQ ID NO: 313244 - RNA, 32 nt, Human
agaucgcaccacugcacuccagccuggucgac

SEQ ID NO: 313245 - RNA, 32 nt, Human
agaucgcaccacugcacuccagccuggugaca

SEQ ID NO: 313246 - RNA, 32 nt, Human
agaucgcaccacugcacuccagccugguuaca

SEQ ID NO: 313247 - RNA, 32 nt, Human
agaucgcaccacugcacuccagcuuggaggaa

SEQ ID NO: 313248 - RNA, 32 nt, Human
agaucgcaccacugcacuccagucuggcaaca

SEQ ID NO: 313249 - RNA, 32 nt, Human
agaucgcaccacugcacucccgcuuggcaaua

SEQ ID NO: 313250 - RNA, 32 nt, Human
agaucgcaccacugcacucuagccugggugaa

SEQ ID NO: 313251 - RNA, 32 nt, Human
agaucgcaccacugcacucuagccuuggcaac

SEQ ID NO: 313252 - RNA, 32 nt, Human
agaucgcaccacugcacucuagcuugggcaac

SEQ ID NO: 313253 - RNA, 32 nt, Human
agaucgcaccacugcacugcagccuggcaaca

SEQ ID NO: 313254 - RNA, 32 nt, Human
agaucgcaccacugcacuucagccugggugac

SEQ ID NO: 313255 - RNA, 32 nt, Human
agaucgcaccacugcauuccagccuaagcaau

SEQ ID NO: 313256 - RNA, 32 nt, Human
agaucgcaccacugcauuccagccugggcaac

SEQ ID NO: 313257 - RNA, 32 nt, Human
agaucgcaccacugcauuccagccugggugac

SEQ ID NO: 313258 - RNA, 32 nt, Human
agaucgcaccacugcauugcagccuggugaca

SEQ ID NO: 313259 - RNA, 32 nt, Human
agaucgcaccacugcccuccagccuaggugac

SEQ ID NO: 313260 - RNA, 32 nt, Human
agaucgcaccacugcucuccagccuggcgaca

SEQ ID NO: 313261 - RNA, 32 nt, Human
agaucgcaccacuguacuccagccugggcaac

SEQ ID NO: 313262 - RNA, 32 nt, Human
agaucgcaccacuguacuccagccugggcgac

SEQ ID NO: 313263 - RNA, 32 nt, Human
agaucgcaccacuguacuccagccugggugac

SEQ ID NO: 313264 - RNA, 32 nt, Human
agaucgcaccacuugcacugcagccugagaga

SEQ ID NO: 313265 - RNA, 32 nt, Human
agaucgcaccagugcacuccagccuuggugac

SEQ ID NO: 313266 - RNA, 32 nt, Human
agaucgcaccauuacacuccagccugggcaac

SEQ ID NO: 313267 - RNA, 32 nt, Human
agaucgcaccauugcacuccagcccgggcaac

SEQ ID NO: 313268 - RNA, 32 nt, Human
agaucgcaccauugcacuccagccuaggcaaa

SEQ ID NO: 313269 - RNA, 32 nt, Human
agaucgcaccauugcacuccagccuggaugau

SEQ ID NO: 313270 - RNA, 32 nt, Human
agaucgcaccauugcacuccagccuggcgacc

SEQ ID NO: 313271 - RNA, 32 nt, Human
agaucgcaccauugcacuccagccugggcaac

SEQ ID NO: 313272 - RNA, 32 nt, Human
agaucgcaccauugcacuccagccugugcaac

SEQ ID NO: 313273 - RNA, 32 nt, Human
agaucgcaccauugcacuccagcugggagaca

SEQ ID NO: 313274 - RNA, 32 nt, Human
agaucgcaccauugcacuccugccugggcaac

SEQ ID NO: 313275 - RNA, 32 nt, Human
agaucgcaccauugcacuucagccugggcaac

SEQ ID NO: 313276 - RNA, 32 nt, Human
agaucgcaccauugcauuccagccugggcaac

SEQ ID NO: 313277 - RNA, 32 nt, Human
agaucgcaccauugcccuccagccugggcaac

SEQ ID NO: 313278 - RNA, 32 nt, Human
agaucgcaccauuguacuccagccugggcaac

SEQ ID NO: 313279 - RNA, 32 nt, Human
agaucgcaccccugcacuccagccugggcaac

SEQ ID NO: 313280 - RNA, 32 nt, Human
agaucgcacccuuacacuucagccugggcgac

SEQ ID NO: 313281 - RNA, 32 nt, Human
agaucgcaccgcugcacuccagccugggcaac

SEQ ID NO: 313282 - RNA, 32 nt, Human
agaucgcaccgcugcacuccagccugggcaag

SEQ ID NO: 313283 - RNA, 32 nt, Human
agaucgcaccgcugcacuccagccugggugac

SEQ ID NO: 313284 - RNA, 32 nt, Human
agaucgcaccgcugcccuccagccugggcaac

SEQ ID NO: 313285 - RNA, 32 nt, Human
agaucgcacuacugcacuccagccugggugac

SEQ ID NO: 313286 - RNA, 32 nt, Human
agaucgcacugcuguacccagccugggccaca

SEQ ID NO: 313287 - RNA, 32 nt, Human
agaucgcagcacuguacuccagccugggcgau

SEQ ID NO: 313288 - RNA, 32 nt, Human
agaucgcagugaauuuuccuuggggaacaucg

SEQ ID NO: 313289 - RNA, 32 nt, Human
agaucgcaguggacugugugauugaccugaca

SEQ ID NO: 313290 - RNA, 32 nt, Human
agaucgcaucacugcaguccagccuggaugac

SEQ ID NO: 313291 - RNA, 32 nt, Human
agaucgcaugcuacugcacuccagccugggag

SEQ ID NO: 313292 - RNA, 32 nt, Human
agaucgcauuacugcacuccagccuggguaac

SEQ ID NO: 313293 - RNA, 32 nt, Human
agaucgccacugcacuccagccugggaaauag

SEQ ID NO: 313294 - RNA, 32 nt, Human
agaucgccagaacuuaggacacaugggaugga

SEQ ID NO: 313295 - RNA, 32 nt, Human
agaucgcccacugcacuccagguugggcuaca

SEQ ID NO: 313296 - RNA, 32 nt, Human
agaucgccccacuacacuccagccuggucaac

SEQ ID NO: 313297 - RNA, 32 nt, Human
agaucgccccacugcacuccagccuggcaaua

SEQ ID NO: 313298 - RNA, 32 nt, Human
agaucgccccacugcacuccagccugggcgac

SEQ ID NO: 313299 - RNA, 32 nt, Human
agaucgccccacugcacuccagccuggugacu

SEQ ID NO: 313300 - RNA, 32 nt, Human
agaucgccccauuguacuccagccuggggaac

SEQ ID NO: 313301 - RNA, 32 nt, Human
agaucgcccugcugcacuccagccugggcaac

SEQ ID NO: 313302 - RNA, 32 nt, Human
agaucgcccugcugcacuccagccugggugac

SEQ ID NO: 313303 - RNA, 20 nt, Human
agaucgccugagcccaggag

SEQ ID NO: 313304 - RNA, 32 nt, Human
agaucgccuggagcuucugucuaccuuuaaug

SEQ ID NO: 313305 - RNA, 32 nt, Human
agaucgcgacacugcacuccagccugggcaac

SEQ ID NO: 313306 - RNA, 32 nt, Human
agaucgcgacacugcgcuccagccugggcaac

SEQ ID NO: 313307 - RNA, 32 nt, Human
agaucgcgcaauugcgcuccagccugggcgac

SEQ ID NO: 313308 - RNA, 32 nt, Human
agaucgcgcacaccuaugacauuuacaacgca

SEQ ID NO: 313309 - RNA, 32 nt, Human
agaucgcgcagcugcacuccagccugggcaac

SEQ ID NO: 313310 - RNA, 32 nt, Human
agaucgcgccaaugcacuccagccugggcgac

SEQ ID NO: 313311 - RNA, 32 nt, Human
agaucgcgccaccacacuccagccugagcgac

SEQ ID NO: 313312 - RNA, 32 nt, Human
agaucgcgccacccacuccagcccgggugaca

SEQ ID NO: 313313 - RNA, 32 nt, Human
agaucgcgccaccgcacuccagccucgccgac

SEQ ID NO: 313314 - RNA, 32 nt, Human
agaucgcgccaccgcauuccagccugggcgac

SEQ ID NO: 313315 - RNA, 32 nt, Human
agaucgcgccaccgcccuccagccugggcgac

SEQ ID NO: 313316 - RNA, 32 nt, Human
agaucgcgccacggcacuccagccugggagac

SEQ ID NO: 313317 - RNA, 32 nt, Human
agaucgcgccacuacuccagccugggugacaa

SEQ ID NO: 313318 - RNA, 32 nt, Human
agaucgcgccacuauacuccagccugggcaac

SEQ ID NO: 313319 - RNA, 32 nt, Human
agaucgcgccacugcaacccagccugggugac

SEQ ID NO: 313320 - RNA, 32 nt, Human
agaucgcgccacugcacagccagggcgacggu

SEQ ID NO: 313321 - RNA, 32 nt, Human
agaucgcgccacugcacucaagccugggcaac

SEQ ID NO: 313322 - RNA, 32 nt, Human
agaucgcgccacugcacuccaaccugggugac

SEQ ID NO: 313323 - RNA, 32 nt, Human
agaucgcgccacugcacuccacccuggguaac

SEQ ID NO: 313324 - RNA, 32 nt, Human
agaucgcgccacugcacuccagcagucugggc

SEQ ID NO: 313325 - RNA, 32 nt, Human
agaucgcgccacugcacuccagccuagacgac

SEQ ID NO: 313326 - RNA, 32 nt, Human
agaucgcgccacugcacuccagccuaggggac

SEQ ID NO: 313327 - RNA, 32 nt, Human
agaucgcgccacugcacuccagccuaggugac

SEQ ID NO: 313328 - RNA, 32 nt, Human
agaucgcgccacugcacuccagccucagcaau

SEQ ID NO: 313329 - RNA, 32 nt, Human
agaucgcgccacugcacuccagccucggcaac

SEQ ID NO: 313330 - RNA, 32 nt, Human
agaucgcgccacugcacuccagccucggugac

SEQ ID NO: 313331 - RNA, 32 nt, Human
agaucgcgccacugcacuccagccuggacgac

SEQ ID NO: 313332 - RNA, 32 nt, Human
agaucgcgccacugcacuccagccuggcaaca

SEQ ID NO: 313333 - RNA, 32 nt, Human
agaucgcgccacugcacuccagccuggcgaca

SEQ ID NO: 313334 - RNA, 32 nt, Human
agaucgcgccacugcacuccagccugggcaac

SEQ ID NO: 313335 - RNA, 32 nt, Human
agaucgcgccacugcacuccagccugggcgac

SEQ ID NO: 313336 - RNA, 32 nt, Human
agaucgcgccacugcacuccagccugggcgag

SEQ ID NO: 313337 - RNA, 32 nt, Human
agaucgcgccacugcacuccagccugggcgau

SEQ ID NO: 313338 - RNA, 32 nt, Human
agaucgcgccacugcacuccagccuggguaac

SEQ ID NO: 313339 - RNA, 32 nt, Human
agaucgcgccacugcacuccagccugggugac

SEQ ID NO: 313340 - RNA, 32 nt, Human
agaucgcgccacugcacuccagccugggugau

SEQ ID NO: 313341 - RNA, 32 nt, Human
agaucgcgccacugcacuccagccuggugaca

SEQ ID NO: 313342 - RNA, 32 nt, Human
agaucgcgccacugcacuccagcuugggcaac

SEQ ID NO: 313343 - RNA, 32 nt, Human
agaucgcgccacugcacuccaggccuggguga

SEQ ID NO: 313344 - RNA, 32 nt, Human
agaucgcgccacugcacuccaggcugggcgac

SEQ ID NO: 313345 - RNA, 32 nt, Human
agaucgcgccacugcacuccagucugggcaac

SEQ ID NO: 313346 - RNA, 32 nt, Human
agaucgcgccacugcacuccaguuugggcaac

SEQ ID NO: 313347 - RNA, 32 nt, Human
agaucgcgccacugcacuccggccugaugaca

SEQ ID NO: 313348 - RNA, 32 nt, Human
agaucgcgccacugcacuccugccugggacac

SEQ ID NO: 313349 - RNA, 32 nt, Human
agaucgcgccacugcacucuagccggagugac

SEQ ID NO: 313350 - RNA, 32 nt, Human
agaucgcgccacugcacucuagccugagugac

SEQ ID NO: 313351 - RNA, 32 nt, Human
agaucgcgccacugcacucuagccugggccau

SEQ ID NO: 313352 - RNA, 32 nt, Human
agaucgcgccacugcacucuagccugggugac

SEQ ID NO: 313353 - RNA, 32 nt, Human
agaucgcgccacugcaguccagccugggcaac

SEQ ID NO: 313354 - RNA, 32 nt, Human
agaucgcgccacugcccuccagccugggcgac

SEQ ID NO: 313355 - RNA, 32 nt, Human
agaucgcgccacugcgcuucagccugggagac

SEQ ID NO: 313356 - RNA, 32 nt, Human
agaucgcgccacugcucuccagccuggguggc

SEQ ID NO: 313357 - RNA, 32 nt, Human
agaucgcgccacuggacuccagccuggacaac

SEQ ID NO: 313358 - RNA, 32 nt, Human
agaucgcgccacugggcuccagccugggcgac

SEQ ID NO: 313359 - RNA, 32 nt, Human
agaucgcgccacuguacuccagccuggacaac

SEQ ID NO: 313360 - RNA, 32 nt, Human
agaucgcgccacuguacuccagccugggcaac

SEQ ID NO: 313361 - RNA, 32 nt, Human
agaucgcgccacugugcuccagccugggcaac

SEQ ID NO: 313362 - RNA, 32 nt, Human
agaucgcgccaguacacuccagccuggguaac

SEQ ID NO: 313363 - RNA, 32 nt, Human
agaucgcgccagugcacuccagccugggcaag

SEQ ID NO: 313364 - RNA, 32 nt, Human
agaucgcgccauagcacuccagccuuagccug

SEQ ID NO: 313365 - RNA, 32 nt, Human
agaucgcgccaucacacuccagccuaggcgac

SEQ ID NO: 313366 - RNA, 32 nt, Human
agaucgcgccaucgcacuccagccugggcaac

SEQ ID NO: 313367 - RNA, 32 nt, Human
agaucgcgccaucgcacuccagccugggugac

SEQ ID NO: 313368 - RNA, 32 nt, Human
agaucgcgccauuacacuucagccugggcaac

SEQ ID NO: 313369 - RNA, 32 nt, Human
agaucgcgccauucuacuccagccugggccac

SEQ ID NO: 313370 - RNA, 32 nt, Human
agaucgcgccauugcacuccaaccuaggugac

SEQ ID NO: 313371 - RNA, 32 nt, Human
agaucgcgccauugcacuccaaccuggacgac

SEQ ID NO: 313372 - RNA, 32 nt, Human
agaucgcgccauugcacuccagccuggacaac

SEQ ID NO: 313373 - RNA, 32 nt, Human
agaucgcgccauugcacuccagccuggccuau

SEQ ID NO: 313374 - RNA, 32 nt, Human
agaucgcgccauugcacuccagccugggcaac

SEQ ID NO: 313375 - RNA, 32 nt, Human
agaucgcgccauugcacuccagccugggcgac

SEQ ID NO: 313376 - RNA, 32 nt, Human
agaucgcgccauugcacuccagccugggcggc

SEQ ID NO: 313377 - RNA, 32 nt, Human
agaucgcgccauugcacuccagccugggggac

SEQ ID NO: 313378 - RNA, 32 nt, Human
agaucgcgccauugcacuccagccuggguaac

SEQ ID NO: 313379 - RNA, 32 nt, Human
agaucgcgccauugcacuccagccugggugac

SEQ ID NO: 313380 - RNA, 32 nt, Human
agaucgcgccauugcacuccauccuggacaac

SEQ ID NO: 313381 - RNA, 32 nt, Human
agaucgcgccauugcacucccgccugggcgac

SEQ ID NO: 313382 - RNA, 32 nt, Human
agaucgcgccauugcacuccggccuggggaca

SEQ ID NO: 313383 - RNA, 32 nt, Human
agaucgcgccauuguacuccagccugggcgau

SEQ ID NO: 313384 - RNA, 32 nt, Human
agaucgcgccccugcacuccagccugggugac

SEQ ID NO: 313385 - RNA, 32 nt, Human
agaucgcgccgcugcacuccagccugggccac

SEQ ID NO: 313386 - RNA, 32 nt, Human
agaucgcgccgcugcacuccagccugggcgac

SEQ ID NO: 313387 - RNA, 32 nt, Human
agaucgcgccgcugcacuccagccugggcggc

SEQ ID NO: 313388 - RNA, 32 nt, Human
agaucgcgccgcugcacuccagccugggugac

SEQ ID NO: 313389 - RNA, 32 nt, Human
agaucgcgccgcugcauuccagccugggugac

SEQ ID NO: 313390 - RNA, 32 nt, Human
agaucgcgccguugcacuccagccugggcaac

SEQ ID NO: 313391 - RNA, 32 nt, Human
agaucgcgccuuugcacuccagccuggaagac

SEQ ID NO: 313392 - RNA, 32 nt, Human
agaucgcgcuacugcacuccagccugggcgac

SEQ ID NO: 313393 - RNA, 32 nt, Human
agaucgcgcuacugcacuccagccugggugac

SEQ ID NO: 313394 - RNA, 32 nt, Human
agaucgcgcuacugcauuccagccugggcgcc

SEQ ID NO: 313395 - RNA, 32 nt, Human
agaucgcgcuauugcacuccagccugggugac

SEQ ID NO: 313396 - RNA, 32 nt, Human
agaucgcgcugcugcacuccagccugggugac

SEQ ID NO: 313397 - RNA, 32 nt, Human
agaucgcggcauugcacuucagccugggcgau

SEQ ID NO: 313398 - RNA, 32 nt, Human
agaucgcggcgcugcacucuagccugggugac

SEQ ID NO: 313399 - RNA, 32 nt, Human
agaucgcgucacugcacuccagccuggacaac

SEQ ID NO: 313400 - RNA, 32 nt, Human
agaucgcgucacugcacuccagccugggagac

SEQ ID NO: 313401 - RNA, 32 nt, Human
agaucgcgucacugcacuccagccugggcgac

SEQ ID NO: 313402 - RNA, 32 nt, Human
agaucgcgucacugcacuccagcgugggcgac

SEQ ID NO: 313403 - RNA, 32 nt, Human
agaucgcgucaguacacuccagccugggcaac

SEQ ID NO: 313404 - RNA, 32 nt, Human
agaucgcgucauugcacuccagccugggcaac

SEQ ID NO: 313405 - RNA, 32 nt, Human
agaucgcgucgcuggacuccagcccgggcgac

SEQ ID NO: 313406 - RNA, 32 nt, Human
agaucgcuccacugcacuccagcccaggugac

SEQ ID NO: 313407 - RNA, 32 nt, Human
agaucgcuccacugcacuccagccugggugac

SEQ ID NO: 313408 - RNA, 32 nt, Human
agaucgcuccauugcacuccagccugggugac

SEQ ID NO: 313409 - RNA, 32 nt, Human
agaucgcucccacugcacuccagccugggcga

SEQ ID NO: 313410 - RNA, 32 nt, Human
agaucgcugcacuccagccugggcgacaagag

SEQ ID NO: 313411 - RNA, 32 nt, Human
agaucgggccacggcacuccagccugggugac

SEQ ID NO: 313412 - RNA, 32 nt, Human
agaucgggccacugcacuccagcuugggugac

SEQ ID NO: 313413 - RNA, 32 nt, Human
agaucgggccgcugcacuccagccugggggac

SEQ ID NO: 313414 - RNA, 21 nt, Human
agaucgggcuugggcccagag

SEQ ID NO: 313415 - RNA, 32 nt, Human
agaucgggugucagaggacgaccaaucuuagg

SEQ ID NO: 313416 - RNA, 32 nt, Human
agaucggucaggcgcaacaccccucauuauag

SEQ ID NO: 313417 - RNA, 32 nt, Human
agaucgguccuaaauuggaaugggaugucuuc

SEQ ID NO: 313418 - RNA, 32 nt, Human
agaucguaccacugcacuccagccugggcgac

SEQ ID NO: 313419 - RNA, 32 nt, Human
agaucguaccacugcacuccagccugggugac

SEQ ID NO: 313420 - RNA, 32 nt, Human
agaucguaccacugcacuccagucugggcgac

SEQ ID NO: 313421 - RNA, 32 nt, Human
agaucguaccacugcacucuggccugggcaac

SEQ ID NO: 313422 - RNA, 32 nt, Human
agaucguaccauugcacuccagccugggcaac

SEQ ID NO: 313423 - RNA, 32 nt, Human
agaucguaccgcugcacuccagccugggugau

SEQ ID NO: 313424 - RNA, 32 nt, Human
agaucguaccuauugcacuccauccuggauga

SEQ ID NO: 313425 - RNA, 32 nt, Human
agaucguagcacugcaguccagccugggcgac

SEQ ID NO: 313426 - RNA, 32 nt, Human
agaucguccacaccacacccucuuucagggac

SEQ ID NO: 313427 - RNA, 32 nt, Human
agaucgucccacugcacuccagcccgggcaac

SEQ ID NO: 313428 - RNA, 32 nt, Human
agaucgucccacugcacuccagccugggcaac

SEQ ID NO: 313429 - RNA, 32 nt, Human
agaucgugacacugcacuccagccugggcgac

SEQ ID NO: 313430 - RNA, 32 nt, Human
agaucgugacacugcacuucagccuggcugac

SEQ ID NO: 313431 - RNA, 32 nt, Human
agaucgugcaacugcacuccaaccugggcaac

SEQ ID NO: 313432 - RNA, 32 nt, Human
agaucgugcaacugcacuccagccugggcaaa

SEQ ID NO: 313433 - RNA, 32 nt, Human
agaucgugccaaugcacuccauccugggcaaa

SEQ ID NO: 313434 - RNA, 32 nt, Human
agaucgugccaccuacacuccagccuggguga

SEQ ID NO: 313435 - RNA, 32 nt, Human
agaucgugccacuacacuccagccugggcaaa

SEQ ID NO: 313436 - RNA, 32 nt, Human
agaucgugccacuacacuccagccugggggac

SEQ ID NO: 313437 - RNA, 32 nt, Human
agaucgugccacugcacaccauccuggaugac

SEQ ID NO: 313438 - RNA, 32 nt, Human
agaucgugccacugcaccacuccagccugggc

SEQ ID NO: 313439 - RNA, 32 nt, Human
agaucgugccacugcaccccagccugggcaac

SEQ ID NO: 313440 - RNA, 32 nt, Human
agaucgugccacugcaccguagccugggugau

SEQ ID NO: 313441 - RNA, 32 nt, Human
agaucgugccacugcacgccagccugggcaac

SEQ ID NO: 313442 - RNA, 32 nt, Human
agaucgugccacugcacucaagccugggugac

SEQ ID NO: 313443 - RNA, 32 nt, Human
agaucgugccacugcacucaagccuggugaca

SEQ ID NO: 313444 - RNA, 32 nt, Human
agaucgugccacugcacuccagacugggggag

SEQ ID NO: 313445 - RNA, 32 nt, Human
agaucgugccacugcacuccagacuuggugac

SEQ ID NO: 313446 - RNA, 32 nt, Human
agaucgugccacugcacuccagagccugggcg

SEQ ID NO: 313447 - RNA, 32 nt, Human
agaucgugccacugcacuccagcccaggcaac

SEQ ID NO: 313448 - RNA, 32 nt, Human
agaucgugccacugcacuccagccugaagaca

SEQ ID NO: 313449 - RNA, 32 nt, Human
agaucgugccacugcacuccagccugagcaac

SEQ ID NO: 313450 - RNA, 32 nt, Human
agaucgugccacugcacuccagccugcgggac

SEQ ID NO: 313451 - RNA, 32 nt, Human
agaucgugccacugcacuccagccuggacaac

SEQ ID NO: 313452 - RNA, 32 nt, Human
agaucgugccacugcacuccagccuggauuac

SEQ ID NO: 313453 - RNA, 32 nt, Human
agaucgugccacugcacuccagccuggcgaca

SEQ ID NO: 313454 - RNA, 32 nt, Human
agaucgugccacugcacuccagccugggagac

SEQ ID NO: 313455 - RNA, 32 nt, Human
agaucgugccacugcacuccagccugggcaac

SEQ ID NO: 313456 - RNA, 32 nt, Human
agaucgugccacugcacuccagccugggcacc

SEQ ID NO: 313457 - RNA, 32 nt, Human
agaucgugccacugcacuccagccugggccac

SEQ ID NO: 313458 - RNA, 32 nt, Human
agaucgugccacugcacuccagccugggcgac

SEQ ID NO: 313459 - RNA, 32 nt, Human
agaucgugccacugcacuccagccugggcuac

SEQ ID NO: 313460 - RNA, 32 nt, Human
agaucgugccacugcacuccagccuggggaac

SEQ ID NO: 313461 - RNA, 32 nt, Human
agaucgugccacugcacuccagccugggugac

SEQ ID NO: 313462 - RNA, 32 nt, Human
agaucgugccacugcacuccagccugggugau

SEQ ID NO: 313463 - RNA, 32 nt, Human
agaucgugccacugcacuccagccugggugga

SEQ ID NO: 313464 - RNA, 32 nt, Human
agaucgugccacugcacuccagccuggucaac

SEQ ID NO: 313465 - RNA, 32 nt, Human
agaucgugccacugcacuccagccuggugaca

SEQ ID NO: 313466 - RNA, 32 nt, Human
agaucgugccacugcacuccagccuggugaga

SEQ ID NO: 313467 - RNA, 32 nt, Human
agaucgugccacugcacuccagccugguugac

SEQ ID NO: 313468 - RNA, 32 nt, Human
agaucgugccacugcacuccagccuugagaca

SEQ ID NO: 313469 - RNA, 32 nt, Human
agaucgugccacugcacuccagccuuggugac

SEQ ID NO: 313470 - RNA, 32 nt, Human
agaucgugccacugcacuccagcuugggcaac

SEQ ID NO: 313471 - RNA, 32 nt, Human
agaucgugccacugcacuccaggcugggcgac

SEQ ID NO: 313472 - RNA, 32 nt, Human
agaucgugccacugcacuccaggcugggugac

SEQ ID NO: 313473 - RNA, 32 nt, Human
agaucgugccacugcacuccagucugggcaac

SEQ ID NO: 313474 - RNA, 32 nt, Human
agaucgugccacugcacuccagucugggugac

SEQ ID NO: 313475 - RNA, 32 nt, Human
agaucgugccacugcacuccauccuggacgac

SEQ ID NO: 313476 - RNA, 32 nt, Human
agaucgugccacugcacucccagccugggcaa

SEQ ID NO: 313477 - RNA, 32 nt, Human
agaucgugccacugcacuccggccugggugau

SEQ ID NO: 313478 - RNA, 32 nt, Human
agaucgugccacugcacucuagccugggcgac

SEQ ID NO: 313479 - RNA, 32 nt, Human
agaucgugccacugcacucuagccugggugac

SEQ ID NO: 313480 - RNA, 32 nt, Human
agaucgugccacugcacucuauccuggguaac

SEQ ID NO: 313481 - RNA, 32 nt, Human
agaucgugccacugcacuucagccugggugac

SEQ ID NO: 313482 - RNA, 32 nt, Human
agaucgugccacugcauuccagccugagcgac

SEQ ID NO: 313483 - RNA, 32 nt, Human
agaucgugccacugcauuccagccugggcgac

SEQ ID NO: 313484 - RNA, 32 nt, Human
agaucgugccacugcauuccagccugguugac

SEQ ID NO: 313485 - RNA, 32 nt, Human
agaucgugccacugcgcuccagccugggugac

SEQ ID NO: 313486 - RNA, 32 nt, Human
agaucgugccacugcgcuccagccuggguggc

SEQ ID NO: 313487 - RNA, 32 nt, Human
agaucgugccacugcucuccagccugggugac

SEQ ID NO: 313488 - RNA, 32 nt, Human
agaucgugccacuguacuucagccugagcaac

SEQ ID NO: 313489 - RNA, 32 nt, Human
agaucgugccacuucacuccagccugggcaaa

SEQ ID NO: 313490 - RNA, 32 nt, Human
agaucgugccagugcacuccagccugggugac

SEQ ID NO: 313491 - RNA, 32 nt, Human
agaucgugccauuacacuccagccugggcgaa

SEQ ID NO: 313492 - RNA, 32 nt, Human
agaucgugccauuccacuccagccugggcaac

SEQ ID NO: 313493 - RNA, 32 nt, Human
agaucgugccauugcacuacagccugggcaac

SEQ ID NO: 313494 - RNA, 32 nt, Human
agaucgugccauugcacuccagcccaggcgac

SEQ ID NO: 313495 - RNA, 32 nt, Human
agaucgugccauugcacuccagcccggaugac

SEQ ID NO: 313496 - RNA, 32 nt, Human
agaucgugccauugcacuccagccuaggcaac

SEQ ID NO: 313497 - RNA, 32 nt, Human
agaucgugccauugcacuccagccuaggcaag

SEQ ID NO: 313498 - RNA, 32 nt, Human
agaucgugccauugcacuccagccuaggcaau

SEQ ID NO: 313499 - RNA, 32 nt, Human
agaucgugccauugcacuccagccuggaugac

SEQ ID NO: 313500 - RNA, 32 nt, Human
agaucgugccauugcacuccagccuggccaca

SEQ ID NO: 313501 - RNA, 32 nt, Human
agaucgugccauugcacuccagccuggcgaca

SEQ ID NO: 313502 - RNA, 32 nt, Human
agaucgugccauugcacuccagccugggcaac

SEQ ID NO: 313503 - RNA, 32 nt, Human
agaucgugccauugcacuccagccugggcaau

SEQ ID NO: 313504 - RNA, 32 nt, Human
agaucgugccauugcacuccagccugggcgac

SEQ ID NO: 313505 - RNA, 32 nt, Human
agaucgugccauugcacuccagccugggugac

SEQ ID NO: 313506 - RNA, 32 nt, Human
agaucgugccauugcacuccagucugggagac

SEQ ID NO: 313507 - RNA, 32 nt, Human
agaucgugccauugcacuccagucuggguaag

SEQ ID NO: 313508 - RNA, 32 nt, Human
agaucgugccauugcacuccggccugggcaac

SEQ ID NO: 313509 - RNA, 32 nt, Human
agaucgugccauugcauuccagccugggagac

SEQ ID NO: 313510 - RNA, 32 nt, Human
agaucgugccauugcgcuccagccuaggugac

SEQ ID NO: 313511 - RNA, 32 nt, Human
agaucgugccauugcgcuccagccugggcaac

SEQ ID NO: 313512 - RNA, 32 nt, Human
agaucgugccauuguauuccagccucggcaac

SEQ ID NO: 313513 - RNA, 32 nt, Human
agaucgugccauugugcuccagccugggcaac

SEQ ID NO: 313514 - RNA, 32 nt, Human
agaucgugccguugcacuccagccugggcaac

SEQ ID NO: 313515 - RNA, 32 nt, Human
agaucgugccguugcacuccagccugggcgac

SEQ ID NO: 313516 - RNA, 32 nt, Human
agaucgugccucugcacuccaaccugggugau

SEQ ID NO: 313517 - RNA, 32 nt, Human
agaucgugccuuugcacuccagcguggaagac

SEQ ID NO: 313518 - RNA, 32 nt, Human
agaucgugcuacugcacuccagccccagcugg

SEQ ID NO: 313519 - RNA, 32 nt, Human
agaucgugcuacugcacuccagccugggggac

SEQ ID NO: 313520 - RNA, 32 nt, Human
agaucgugcuacugcacuccagucugggugac

SEQ ID NO: 313521 - RNA, 32 nt, Human
agaucgugcuacugcaguccagccugggcuac

SEQ ID NO: 313522 - RNA, 32 nt, Human
agaucgugcuauugcacuccagccugggcgac

SEQ ID NO: 313523 - RNA, 32 nt, Human
agaucgugcugcugcacuccagccugggcaau

SEQ ID NO: 313524 - RNA, 32 nt, Human
agaucguggagacagagcgcauguacguacag

SEQ ID NO: 313525 - RNA, 32 nt, Human
agaucguggagagagccagggcccagaagaac

SEQ ID NO: 313526 - RNA, 32 nt, Human
agaucguggccacugcaauccagccugggcga

SEQ ID NO: 313527 - RNA, 31 nt, Human
agaucguggggacagagaugggugauggaac

SEQ ID NO: 313528 - RNA, 32 nt, Human
agaucgugggucuguguguccgugaagugagu

SEQ ID NO: 313529 - RNA, 32 nt, Human
agaucgugucacuacacuccaggcugggugac

SEQ ID NO: 313530 - RNA, 32 nt, Human
agaucgugucacugcacuccagccuggcgaca

SEQ ID NO: 313531 - RNA, 32 nt, Human
agaucgugucacugcacuccagccugggcgac

SEQ ID NO: 313532 - RNA, 32 nt, Human
agaucgugucacugcacuccagccugggugac

SEQ ID NO: 313533 - RNA, 32 nt, Human
agaucgugucacugcacuccagccuggugaca

SEQ ID NO: 313534 - RNA, 32 nt, Human
agaucuaaccauuuucauacucuuaacugauu

SEQ ID NO: 313535 - RNA, 32 nt, Human
agaucuaagaauggacagucugccuccucaag

SEQ ID NO: 313536 - RNA, 32 nt, Human
agaucuaagccauaguuucuaguggggacagu

SEQ ID NO: 313537 - RNA, 32 nt, Human
agaucuaagggcaccguagcucuggaaucugg

SEQ ID NO: 313538 - RNA, 32 nt, Human
agaucuacaaugaugccagcugugacauuucu

SEQ ID NO: 313539 - RNA, 21 nt, Human
agaucuacagccacccagagg

SEQ ID NO: 313540 - RNA, 32 nt, Human
agaucuaccaaacugaaggggucuccagauua

SEQ ID NO: 313541 - RNA, 20 nt, Human
agaucuagagacuccaggag

SEQ ID NO: 313542 - RNA, 32 nt, Human
agaucuagcaauuggaaaguuaguaagccuaa

SEQ ID NO: 313543 - RNA, 32 nt, Human
agaucuagccugcccugccugccugcccuggg

SEQ ID NO: 313544 - RNA, 32 nt, Human
agaucuaggcaccagccccacccacuggcugu

SEQ ID NO: 313545 - RNA, 32 nt, Human
agaucuaugauggaaaauuaaaggaacuggga

SEQ ID NO: 313546 - RNA, 32 nt, Human
agaucuauggcauaaauaggcacacaaaaagg

SEQ ID NO: 313547 - RNA, 32 nt, Human
agaucucaccacugaacuccagccugggcgac

SEQ ID NO: 313548 - RNA, 32 nt, Human
agaucucaccacugcacuccagccugggcagc

SEQ ID NO: 313549 - RNA, 32 nt, Human
agaucucaccauuacacuccagccugggcgac

SEQ ID NO: 313550 - RNA, 32 nt, Human
agaucucaccauugcacuccagccugggcgac

SEQ ID NO: 313551 - RNA, 32 nt, Human
agaucucagacuccugggcucaagcgauccuc

SEQ ID NO: 313552 - RNA, 32 nt, Human
agaucucauaaauauaacaguauuaaggccau

SEQ ID NO: 313553 - RNA, 32 nt, Human
agaucucauuucagaagaacggcaugaacagu

SEQ ID NO: 313554 - RNA, 32 nt, Human
agaucuccaacaugucuguggugcuguccaug

SEQ ID NO: 313555 - RNA, 32 nt, Human
agaucuccaagaacucacuaacacagaauagc

SEQ ID NO: 313556 - RNA, 28 nt, Human
agaucuccaauugcugccuccauugaug

SEQ ID NO: 313557 - RNA, 21 nt, Human
agaucuccagaacuuuuucau

SEQ ID NO: 313558 - RNA, 21 nt, Human
agaucuccagcuccacacaug

SEQ ID NO: 313559 - RNA, 32 nt, Human
agaucucccuucucaucuccccacgccccguc

SEQ ID NO: 313560 - RNA, 32 nt, Human
agaucuccucaccucuugcccuucaccuccug

SEQ ID NO: 313561 - RNA, 32 nt, Human
agaucuccuccuccuucaugcagccaggauug

SEQ ID NO: 313562 - RNA, 32 nt, Human
agaucuccugugcaccugacuuuggagacgau

SEQ ID NO: 313563 - RNA, 32 nt, Human
agaucuccuugccugaccccuggaccuggaaa

SEQ ID NO: 313564 - RNA, 32 nt, Human
agaucucgccacugcacuccaggcugggcgac

SEQ ID NO: 313565 - RNA, 32 nt, Human
agaucucgccacugcgcuccagccugggcaac

SEQ ID NO: 313566 - RNA, 32 nt, Human
agaucucgccacugugcuccagccugggcaac

SEQ ID NO: 313567 - RNA, 32 nt, Human
agaucucgccauugcacuccauucugggcaac

SEQ ID NO: 313568 - RNA, 32 nt, Human
agaucucgugauccgcccgccugggccuacua

SEQ ID NO: 313569 - RNA, 32 nt, Human
agaucucuaaucuccauuucucucucauauau

SEQ ID NO: 313570 - RNA, 32 nt, Human
agaucucucacugucucaguuguaauuuugcg

SEQ ID NO: 313571 - RNA, 23 nt, Human
agaucucucagcaaauccccugg

SEQ ID NO: 313572 - RNA, 21 nt, Human
agaucucugcauccaucauca

SEQ ID NO: 313573 - RNA, 32 nt, Human
agaucucuugaacucuggguucucccagcccc

SEQ ID NO: 313574 - RNA, 32 nt, Human
agaucucuuuauuggggaugggagaaauaggg

SEQ ID NO: 313575 - RNA, 32 nt, Human
agaucucuuuuuaucauauaugacauuaaggc

SEQ ID NO: 313576 - RNA, 32 nt, Human
agaucugaagagcacaguaggaagggaggcgg

SEQ ID NO: 313577 - RNA, 32 nt, Human
agaucugaagccgagcaacuugcccaaguccu

SEQ ID NO: 313578 - RNA, 32 nt, Human
agaucugaaggacauuugggagagggaugccc

SEQ ID NO: 313579 - RNA, 32 nt, Human
agaucugaagugaaauugugcaaagucaccug

SEQ ID NO: 313580 - RNA, 32 nt, Human
agaucugacaguugcccuaggguuaaagucuc

SEQ ID NO: 313581 - RNA, 32 nt, Human
agaucugacuggcugcaucucccuuuccucug

SEQ ID NO: 313582 - RNA, 32 nt, Human
agaucugcaccaagcacucacacacaugcaau

SEQ ID NO: 313583 - RNA, 32 nt, Human
agaucugcagagcccugagcagggacucuuuc

SEQ ID NO: 313584 - RNA, 32 nt, Human
agaucugcauuccgacugccuaugaacgggug

SEQ ID NO: 313585 - RNA, 32 nt, Human
agaucugccacugcacuccagccuggcgacag

SEQ ID NO: 313586 - RNA, 32 nt, Human
agaucugccccaguaauuuaccaaagguagca

SEQ ID NO: 313587 - RNA, 32 nt, Human
agaucugcccucccaggggucuccaauuuucu

SEQ ID NO: 313588 - RNA, 32 nt, Human
agaucugccugggagcagacauugaccuuuga

SEQ ID NO: 313589 - RNA, 32 nt, Human
agaucugcgguuuccccucuacccugccuccu

SEQ ID NO: 313590 - RNA, 32 nt, Human
agaucugcuauaacuaacuaacucagcuucua

SEQ ID NO: 313591 - RNA, 32 nt, Human
agaucugcucacugccaggcuccucuccccuu

SEQ ID NO: 313592 - RNA, 32 nt, Human
agaucugcugcuuucaaucacacccacugccu

SEQ ID NO: 313593 - RNA, 32 nt, Human
agaucugcuucuucaucuugacauguaaugaa

SEQ ID NO: 313594 - RNA, 32 nt, Human
agaucuggagacuuaaaaagaaaacaaaaaca

SEQ ID NO: 313595 - RNA, 32 nt, Human
agaucuggagcugcugcucccugcugcggaga

SEQ ID NO: 313596 - RNA, 32 nt, Human
agaucuggaggcagcagugcuggauggaauug

SEQ ID NO: 313597 - RNA, 32 nt, Human
agaucuggagugaaaaggcagcagaugcaaca

SEQ ID NO: 313598 - RNA, 32 nt, Human
agaucuggaucuggcccugcugcuucucagac

SEQ ID NO: 313599 - RNA, 32 nt, Human
agaucuggauuuacauaugcucuguuagcugc

SEQ ID NO: 313600 - RNA, 32 nt, Human
agaucuggccauugcacuccagcgugggcaac

SEQ ID NO: 313601 - RNA, 32 nt, Human
agaucuggcuggagcccagaaaaagaagcaug

SEQ ID NO: 313602 - RNA, 32 nt, Human
agaucuggcuguagacgcucuuuauuuauguc

SEQ ID NO: 313603 - RNA, 32 nt, Human
agaucugggaggccaggcuggcaugauuccug

SEQ ID NO: 313604 - RNA, 32 nt, Human
agaucuggguggggacacagcccaaccauauc

SEQ ID NO: 313605 - RNA, 32 nt, Human
agaucugguuccagaaccgcaggaugaaaaug

SEQ ID NO: 313606 - RNA, 22 nt, Human
agaucugguugacucaucauca

SEQ ID NO: 313607 - RNA, 32 nt, Human
agaucuguaaguacaaaggauauucuguuucu

SEQ ID NO: 313608 - RNA, 32 nt, Human
agaucuguccucaguguuggcaggagccgucc

SEQ ID NO: 313609 - RNA, 32 nt, Human
agaucugugcacgucccuuuacaccccaccau

SEQ ID NO: 313610 - RNA, 32 nt, Human
agaucuguuggguuaaagaggaaugagccuuu

SEQ ID NO: 313611 - RNA, 32 nt, Human
agaucuuaaagccaaaauuagaaaaauaacuc

SEQ ID NO: 313612 - RNA, 32 nt, Human
agaucuuacucccuuuggcauuuuacaccuua

SEQ ID NO: 313613 - RNA, 32 nt, Human
agaucuuauaccacucuguauuggacaaaggc

SEQ ID NO: 313614 - RNA, 32 nt, Human
agaucuucaaagugaugcugcucugcaggugg

SEQ ID NO: 313615 - RNA, 32 nt, Human
agaucuuccagccauauguggagucgcuggug

SEQ ID NO: 313616 - RNA, 32 nt, Human
agaucuuccaucagggccggaguaaaucccua

SEQ ID NO: 313617 - RNA, 32 nt, Human
agaucuucccacugcacuccagccuggccaau

SEQ ID NO: 313618 - RNA, 21 nt, Human
agaucuucgugaagacccuga

SEQ ID NO: 313619 - RNA, 32 nt, Human
agaucuucugaaaugaaacaaauaaucacauu

SEQ ID NO: 313620 - RNA, 32 nt, Human
agaucuucugcuacuccagccacaggagguau

SEQ ID NO: 313621 - RNA, 32 nt, Human
agaucuugagacugaaggaaacccaaagccgu

SEQ ID NO: 313622 - RNA, 32 nt, Human
agaucuugauuucuuggucauuucucaaccug

SEQ ID NO: 313623 - RNA, 32 nt, Human
agaucuugccacugcacaccagccugggcaac

SEQ ID NO: 313624 - RNA, 32 nt, Human
agaucuugccacugcacuccagccugggcaac

SEQ ID NO: 313625 - RNA, 32 nt, Human
agaucuugccacugcucuccagccugagcgac

SEQ ID NO: 313626 - RNA, 32 nt, Human
agaucuugccacuguacuccagccugaagagc

SEQ ID NO: 313627 - RNA, 32 nt, Human
agaucuuggagauaauuucuuaccucacauag

SEQ ID NO: 313628 - RNA, 32 nt, Human
agaucuuggcaaucugcccaaggggagacaca

SEQ ID NO: 313629 - RNA, 32 nt, Human
agaucuugguuuuuccaaacuggaccauccug

SEQ ID NO: 313630 - RNA, 32 nt, Human
agaucuuuaaagaagcgagagaggaggcccca

SEQ ID NO: 313631 - RNA, 32 nt, Human
agaucuuuaccuauggcuguucuggguuuuug

SEQ ID NO: 313632 - RNA, 32 nt, Human
agaugaaaaaggcaagauacaugugaauaagg

SEQ ID NO: 313633 - RNA, 32 nt, Human
agaugaaaagaaggaaggaaggaagaaugugc

SEQ ID NO: 313634 - RNA, 32 nt, Human
agaugaaaccaaagacugcaagaaauacucca

SEQ ID NO: 313635 - RNA, 32 nt, Human
agaugaaaccgaagacuacaagaaauacucca

SEQ ID NO: 313636 - RNA, 32 nt, Human
agaugaaacucccagaggugucagagguggcu

SEQ ID NO: 313637 - RNA, 32 nt, Human
agaugaaaggaguggagugugguuuggcagaa

SEQ ID NO: 313638 - RNA, 32 nt, Human
agaugaaagugcagcaaagcaaugaaaaauga

SEQ ID NO: 313639 - RNA, 32 nt, Human
agaugaaaucagcuauuacaccugcuguacac

SEQ ID NO: 313640 - RNA, 32 nt, Human
agaugaaaugcuucccuccacuguuuauguac

SEQ ID NO: 313641 - RNA, 32 nt, Human
agaugaaauugacucugcaaccacacagguga

SEQ ID NO: 313642 - RNA, 32 nt, Human
agaugaaccaaggaucgggauagcaguauaaa

SEQ ID NO: 313643 - RNA, 32 nt, Human
agaugaaccuugaggauguugugccaagugca

SEQ ID NO: 313644 - RNA, 32 nt, Human
agaugaacuauuugccgcccugucuuuuccug

SEQ ID NO: 313645 - RNA, 32 nt, Human
agaugaacuucuauucaccguuucuggaauuc

SEQ ID NO: 313646 - RNA, 32 nt, Human
agaugaagaaaaugaguucucaaggagggaau

SEQ ID NO: 313647 - RNA, 32 nt, Human
agaugaagaacugaggcacagauuaaaggacu

SEQ ID NO: 313648 - RNA, 32 nt, Human
agaugaagaagagggguggggcaacaaguggu

SEQ ID NO: 313649 - RNA, 32 nt, Human
agaugaagacaauguuguaaucccagcaaguu

SEQ ID NO: 313650 - RNA, 32 nt, Human
agaugaagagagggccagaguaguguucugaa

SEQ ID NO: 313651 - RNA, 32 nt, Human
agaugaagagccaagaugcuggugaagcaggu

SEQ ID NO: 313652 - RNA, 32 nt, Human
agaugaagcauccgugccuaggaaaaggggac

SEQ ID NO: 313653 - RNA, 32 nt, Human
agaugaagccaagaguaucagagauguaccua

SEQ ID NO: 313654 - RNA, 32 nt, Human
agaugaagcucucuuugcucuuccugcuuuca

SEQ ID NO: 313655 - RNA, 32 nt, Human
agaugaaggagaaaauggagagcuccagcagc

SEQ ID NO: 313656 - RNA, 32 nt, Human
agaugaagucucacugcacucaggcuggagug

SEQ ID NO: 313657 - RNA, 21 nt, Human
agaugaagucucacuguguug

SEQ ID NO: 313658 - RNA, 31 nt, Human
agaugaagugagauacaaagcuggguuugau

SEQ ID NO: 313659 - RNA, 32 nt, Human
agaugaauggaauaaaagugagagccaaaaau

SEQ ID NO: 313660 - RNA, 32 nt, Human
agaugaauguguugagggaaugaauaaguauu

SEQ ID NO: 313661 - RNA, 32 nt, Human
agaugaauucuguacccaaagcagaaucccca

SEQ ID NO: 313662 - RNA, 32 nt, Human
agaugaauugggaguaucucuccaguuauucc

SEQ ID NO: 313663 - RNA, 32 nt, Human
agaugaauuguuuuguuucacaaucauuuuaa

SEQ ID NO: 313664 - RNA, 32 nt, Human
agaugacaaaaacaccagauugaaggaugguc

SEQ ID NO: 313665 - RNA, 32 nt, Human
agaugacaaagaggaguggaagaagacagaga

SEQ ID NO: 313666 - RNA, 27 nt, Human
agaugacaacagcagccaggccaaccu

SEQ ID NO: 313667 - RNA, 32 nt, Human
agaugacacaacugcacuccagcuugggcaac

SEQ ID NO: 313668 - RNA, 32 nt, Human
agaugacacaccuacugcuucuuuucuaggau

SEQ ID NO: 313669 - RNA, 32 nt, Human
agaugacacaguuagcuggggucuagaagauu

SEQ ID NO: 313670 - RNA, 22 nt, Human
agaugacacgcgccagagcugg

SEQ ID NO: 313671 - RNA, 32 nt, Human
agaugacacggucacuagcucugccucagaaa

SEQ ID NO: 313672 - RNA, 32 nt, Human
agaugacagcauauuaaaguggugacccugcg

SEQ ID NO: 313673 - RNA, 32 nt, Human
agaugacagccauguggagaugucaaguuaga

SEQ ID NO: 313674 - RNA, 32 nt, Human
agaugacagccccaggucugggguacagagac

SEQ ID NO: 313675 - RNA, 32 nt, Human
agaugacagcugcagggaugguugugagccgc

SEQ ID NO: 313676 - RNA, 32 nt, Human
agaugacaggcgcacaucaccacgcccagcug

SEQ ID NO: 313677 - RNA, 32 nt, Human
agaugacagugcaaaggauuugggagagagaa

SEQ ID NO: 313678 - RNA, 32 nt, Human
agaugacauaaauaaguuuaaauaucaauuug

SEQ ID NO: 313679 - RNA, 32 nt, Human
agaugacaucuguaggucucaggcuacaggaa

SEQ ID NO: 313680 - RNA, 32 nt, Human
agaugacauuuaccuagcauauaaacccuggu

SEQ ID NO: 313681 - RNA, 32 nt, Human
agaugacauuugaggacugauggccaaagagc

SEQ ID NO: 313682 - RNA, 32 nt, Human
agaugaccaaagaccaccuccgccaggcccag

SEQ ID NO: 313683 - RNA, 32 nt, Human
agaugaccaccaggcaggcucgggcgacaggg

SEQ ID NO: 313684 - RNA, 32 nt, Human
agaugaccagauuugaucucagccugaugacc

SEQ ID NO: 313685 - RNA, 32 nt, Human
agaugaccaggauaaaacugagaaggauuuac

SEQ ID NO: 313686 - RNA, 32 nt, Human
agaugaccccuucagaucaucugugccuaccu

SEQ ID NO: 313687 - RNA, 27 nt, Human
agaugacccgagagagaaugaugggag

SEQ ID NO: 313688 - RNA, 32 nt, Human
agaugaccuauuugucaguggugcaaaauuaa

SEQ ID NO: 313689 - RNA, 32 nt, Human
agaugaccucucgcugccucacaagcagugac

SEQ ID NO: 313690 - RNA, 32 nt, Human
agaugaccuugaccaccacaauaccaggcccu

SEQ ID NO: 313691 - RNA, 24 nt, Human
agaugaccuugugacacucaugca

SEQ ID NO: 313692 - RNA, 32 nt, Human
agaugacgccauugcacuccagccugggugag

SEQ ID NO: 313693 - RNA, 32 nt, Human
agaugacguaugugccuugaacugaauauuug

SEQ ID NO: 313694 - RNA, 32 nt, Human
agaugacuaaagaucugaaggacucuagcagg

SEQ ID NO: 313695 - RNA, 32 nt, Human
agaugacuagccaggguagggagggaccuccu

SEQ ID NO: 313696 - RNA, 32 nt, Human
agaugacuccauugaaaacaaacaggcaaaaa

SEQ ID NO: 313697 - RNA, 19 nt, Human
agaugacugaaccuugcag

SEQ ID NO: 313698 - RNA, 32 nt, Human
agaugacugaggacaucgccuuugccaaggcc

SEQ ID NO: 313699 - RNA, 32 nt, Human
agaugacuggcugguugcugggggcagguguc

SEQ ID NO: 313700 - RNA, 32 nt, Human
agaugacuucucaucucuccccacaccaugau

SEQ ID NO: 313701 - RNA, 32 nt, Human
agaugacuuuggugaaaccccgucucuacuaa

SEQ ID NO: 313702 - RNA, 25 nt, Human
agaugacuuuuauaucccauuuugg

SEQ ID NO: 313703 - RNA, 32 nt, Human
agaugagaaaacccaacagauccaucccuuga

SEQ ID NO: 313704 - RNA, 32 nt, Human
agaugagaauuagcaucaggaaagccugaaau

SEQ ID NO: 313705 - RNA, 32 nt, Human
agaugagaccaaagaaucuggcaaacaucaca

SEQ ID NO: 313706 - RNA, 32 nt, Human
agaugagaccucugacguccaagccuuguucc

SEQ ID NO: 313707 - RNA, 32 nt, Human
agaugagacuugcuuagccucccagccuacau

SEQ ID NO: 313708 - RNA, 32 nt, Human
agaugagaggaggcaugaagcugcagugccac

SEQ ID NO: 313709 - RNA, 32 nt, Human
agaugagaggcagaggcagacaggcgcuggac

SEQ ID NO: 313710 - RNA, 32 nt, Human
agaugagagggaacccaggaauugugagguua

SEQ ID NO: 313711 - RNA, 32 nt, Human
agaugagaggggaaugaauacuucagaugcuu

SEQ ID NO: 313712 - RNA, 32 nt, Human
agaugagaguccauuuacuucagccuuugauu

SEQ ID NO: 313713 - RNA, 32 nt, Human
agaugagauccuugccuucaccaagcuuaugu

SEQ ID NO: 313714 - RNA, 21 nt, Human
agaugagaucucgcuauguug

SEQ ID NO: 313715 - RNA, 21 nt, Human
agaugagauuucaccauguug

SEQ ID NO: 313716 - RNA, 25 nt, Human
agaugagauuucaccauguuggcca

SEQ ID NO: 313717 - RNA, 32 nt, Human
agaugagcacagagccaggccucuuagaggau

SEQ ID NO: 313718 - RNA, 32 nt, Human
agaugagcagaaggaagagagcagggaaggag

SEQ ID NO: 313719 - RNA, 32 nt, Human
agaugagcagauccacaggaaaacuugaaugc

SEQ ID NO: 313720 - RNA, 32 nt, Human
agaugagcagugagcugguuuccacccucugg

SEQ ID NO: 313721 - RNA, 32 nt, Human
agaugagccaagcagaacauuccauccaggac

SEQ ID NO: 313722 - RNA, 32 nt, Human
agaugagccacuuguaagagucuccgugacag

SEQ ID NO: 313723 - RNA, 32 nt, Human
agaugagccccaggaccccuggggagccaagc

SEQ ID NO: 313724 - RNA, 32 nt, Human
agaugagccugcccgcccgccugcugccugga

SEQ ID NO: 313725 - RNA, 32 nt, Human
agaugagcugccgagccucugccuccacucuc

SEQ ID NO: 313726 - RNA, 32 nt, Human
agaugagcugggaaccuggaaguggguugcau

SEQ ID NO: 313727 - RNA, 32 nt, Human
agaugagcuuccuaaagcugacccugggucug

SEQ ID NO: 313728 - RNA, 32 nt, Human
agaugagcuugagggacugagguggggugugg

SEQ ID NO: 313729 - RNA, 27 nt, Human
agaugagcuuugauccaaaccuucucc

SEQ ID NO: 313730 - RNA, 32 nt, Human
agaugaggaaaaguuuggaggagcagcugacu

SEQ ID NO: 313731 - RNA, 32 nt, Human
agaugaggaaacagcaacccagagaggagaac

SEQ ID NO: 313732 - RNA, 32 nt, Human
agaugaggaaacugagccuugcggaaguaguu

SEQ ID NO: 313733 - RNA, 32 nt, Human
agaugaggaaacugaggcacagaagggcugag

SEQ ID NO: 313734 - RNA, 32 nt, Human
agaugaggaaacugaggcccagagaagcggaa

SEQ ID NO: 313735 - RNA, 32 nt, Human
agaugaggaaacugaggccuagagaagcucaa

SEQ ID NO: 313736 - RNA, 32 nt, Human
agaugaggaaacugaggcuugggaaggguaga

SEQ ID NO: 313737 - RNA, 32 nt, Human
agaugaggacaggaagagaguguuagaaaggg

SEQ ID NO: 313738 - RNA, 32 nt, Human
agaugaggagaggcagcagggauuucccugcc

SEQ ID NO: 313739 - RNA, 32 nt, Human
agaugaggaggccuccagaaauggcagaauuc

SEQ ID NO: 313740 - RNA, 32 nt, Human
agaugaggagggagagaaggaggccgccagac

SEQ ID NO: 313741 - RNA, 32 nt, Human
agaugaggagugccacuguguugcccaggcug

SEQ ID NO: 313742 - RNA, 20 nt, Human
agaugaggaguugcuucuua

SEQ ID NO: 313743 - RNA, 32 nt, Human
agaugaggaugggcacaugguggagagucgug

SEQ ID NO: 313744 - RNA, 32 nt, Human
agaugaggcaggacuagcaggagcgccucaga

SEQ ID NO: 313745 - RNA, 32 nt, Human
agaugaggccugagcccugccuaugcucaaag

SEQ ID NO: 313746 - RNA, 32 nt, Human
agaugaggcuucugcugcuucuccuaguggcg

SEQ ID NO: 313747 - RNA, 32 nt, Human
agaugaggggcaggcagucaggcagaaauggg

SEQ ID NO: 313748 - RNA, 32 nt, Human
agaugaggguuauuuucugaaaugcagauggg

SEQ ID NO: 313749 - RNA, 21 nt, Human
agaugaggguucacuauguug

SEQ ID NO: 313750 - RNA, 25 nt, Human
agaugaggguucacuauguuggcca

SEQ ID NO: 313751 - RNA, 32 nt, Human
agaugaggucccugguuuuucauggcaacuug

SEQ ID NO: 313752 - RNA, 21 nt, Human
agaugaggucucacuauguug

SEQ ID NO: 313753 - RNA, 21 nt, Human
agaugaggucucacuguguug

SEQ ID NO: 313754 - RNA, 20 nt, Human
agaugaggucuugccauguu

SEQ ID NO: 313755 - RNA, 21 nt, Human
agaugaggucuugcuauguug

SEQ ID NO: 313756 - RNA, 21 nt, Human
agaugaggucuugcuguguug

SEQ ID NO: 313757 - RNA, 32 nt, Human
agaugaggugcuuggcuuucuucccaggaccc

SEQ ID NO: 313758 - RNA, 32 nt, Human
agaugagguugcuagagaauguuagaggaucc

SEQ ID NO: 313759 - RNA, 18 nt, Human
agaugagguuucaccaug

SEQ ID NO: 313760 - RNA, 25 nt, Human
agaugagguuucaccaugauggcca

SEQ ID NO: 313761 - RNA, 21 nt, Human
agaugagguuucaccauguug

SEQ ID NO: 313762 - RNA, 25 nt, Human
agaugagguuucaccauguuggcca

SEQ ID NO: 313763 - RNA, 21 nt, Human
agaugagguuucaccauuuug

SEQ ID NO: 313764 - RNA, 25 nt, Human
agaugagguuucaccauuuuggcca

SEQ ID NO: 313765 - RNA, 21 nt, Human
agaugagguuucaccguguug

SEQ ID NO: 313766 - RNA, 25 nt, Human
agaugagguuucaccguguuggcca

SEQ ID NO: 313767 - RNA, 21 nt, Human
agaugagguuucaccuuguug

SEQ ID NO: 313768 - RNA, 25 nt, Human
agaugagguuucaccuuguuggcca

SEQ ID NO: 313769 - RNA, 25 nt, Human
agaugagguuucaccuuguugguca

SEQ ID NO: 313770 - RNA, 21 nt, Human
agaugagguuucacucuguug

SEQ ID NO: 313771 - RNA, 20 nt, Human
agaugagguuucgccauguu

SEQ ID NO: 313772 - RNA, 21 nt, Human
agaugagguuucuccauguug

SEQ ID NO: 313773 - RNA, 25 nt, Human
agaugagguuucuccauguugguca

SEQ ID NO: 313774 - RNA, 21 nt, Human
agaugagguuuugccauuuug

SEQ ID NO: 313775 - RNA, 21 nt, Human
agaugaguaaaauaccaagua

SEQ ID NO: 313776 - RNA, 22 nt, Human
agaugaguaaaggcauccagca

SEQ ID NO: 313777 - RNA, 24 nt, Human
agaugaguaagggaaccccaggca

SEQ ID NO: 313778 - RNA, 32 nt, Human
agaugaguccauuugccucuucugccuucacu

SEQ ID NO: 313779 - RNA, 20 nt, Human
agaugagucucacuauguug

SEQ ID NO: 313780 - RNA, 24 nt, Human
agaugagucucacuauguugccca

SEQ ID NO: 313781 - RNA, 19 nt, Human
agaugagucuuggaugcau

SEQ ID NO: 313782 - RNA, 32 nt, Human
agaugaguggauagguccccaaaagugucacc

SEQ ID NO: 313783 - RNA, 20 nt, Human
agaugagugucacuauguug

SEQ ID NO: 313784 - RNA, 32 nt, Human
agaugagugugcugaagguggggagggcagca

SEQ ID NO: 313785 - RNA, 20 nt, Human
agaugaguuucaccauguug

SEQ ID NO: 313786 - RNA, 24 nt, Human
agaugaguuucaccauguugguca

SEQ ID NO: 313787 - RNA, 32 nt, Human
agaugaguuugagagagaaaaaguguaauuga

SEQ ID NO: 313788 - RNA, 32 nt, Human
agaugauaaacaucacauggcauuuuaaguga

SEQ ID NO: 313789 - RNA, 32 nt, Human
agaugauaacaguguuauaaugcagcuuccuu

SEQ ID NO: 313790 - RNA, 32 nt, Human
agaugauaccaugaagagaaguuuacaggccc

SEQ ID NO: 313791 - RNA, 32 nt, Human
agaugauaggugaauucccugccccuccccca

SEQ ID NO: 313792 - RNA, 32 nt, Human
agaugauauaaaauauuguugcucugacaaaa

SEQ ID NO: 313793 - RNA, 32 nt, Human
agaugauauucagaagaugaacccaccuaagu

SEQ ID NO: 313794 - RNA, 32 nt, Human
agaugaucaagaaggugaaaagaagagaaaag

SEQ ID NO: 313795 - RNA, 32 nt, Human
agaugaucacacccacuuugcuucacuuucau

SEQ ID NO: 313796 - RNA, 32 nt, Human
agaugaucacacucagagcccagugagaggca

SEQ ID NO: 313797 - RNA, 32 nt, Human
agaugauccagagacauguggcagcaggcaug

SEQ ID NO: 313798 - RNA, 32 nt, Human
agaugaugacacuggaguuuucagagagcauu

SEQ ID NO: 313799 - RNA, 32 nt, Human
agaugaugcaggaacaggaagagaagaugugg

SEQ ID NO: 313800 - RNA, 32 nt, Human
agaugaugccacugcacuccagccugggcuac

SEQ ID NO: 313801 - RNA, 32 nt, Human
agaugaugccauugcacuccagccugggcaac

SEQ ID NO: 313802 - RNA, 32 nt, Human
agaugaugccuucuguugaauucuguuauuaa

SEQ ID NO: 313803 - RNA, 32 nt, Human
agaugaugcuuuuacuaugcaggagagaguuu

SEQ ID NO: 313804 - RNA, 32 nt, Human
agaugauggauagaauuaaaaagggaguucau

SEQ ID NO: 313805 - RNA, 32 nt, Human
agaugaugguuccauugcucuuggcuucaugg

SEQ ID NO: 313806 - RNA, 32 nt, Human
agaugaugugauuuauucaaggucacauagag

SEQ ID NO: 313807 - RNA, 32 nt, Human
agaugaugugcaaagaaauccuugcuuuauga

SEQ ID NO: 313808 - RNA, 32 nt, Human
agaugauguugaaccugcuccuuggaccucug

SEQ ID NO: 313809 - RNA, 32 nt, Human
agaugauguuugacauuuucagcacuuccugu

SEQ ID NO: 313810 - RNA, 32 nt, Human
agaugauuacugaccuacuauacuccucaagg

SEQ ID NO: 313811 - RNA, 32 nt, Human
agaugauucagggcauacucuucaaggucacg

SEQ ID NO: 313812 - RNA, 32 nt, Human
agaugauuccaguggccagccauuugaaucag

SEQ ID NO: 313813 - RNA, 32 nt, Human
agaugauucuuuuguuuuucuucuacuucaug

SEQ ID NO: 313814 - RNA, 32 nt, Human
agaugauuuaugguaucugauggaagaaauuu

SEQ ID NO: 313815 - RNA, 32 nt, Human
agaugauuuccaagccucucuggcacuuugag

SEQ ID NO: 313816 - RNA, 32 nt, Human
agaugauuucuggaacauucagucuagaaaga

SEQ ID NO: 313817 - RNA, 32 nt, Human
agaugauuuuaaaaucuguuguauuuaggucc

SEQ ID NO: 313818 - RNA, 20 nt, Human
agaugcaaaaguucacuguu

SEQ ID NO: 313819 - RNA, 21 nt, Human
agaugcaacauguggccuguu

SEQ ID NO: 313820 - RNA, 32 nt, Human
agaugcaagcuacucauucacacagaacuuuu

SEQ ID NO: 313821 - RNA, 32 nt, Human
agaugcaaggcugccagcaucuuugcucucca

SEQ ID NO: 313822 - RNA, 32 nt, Human
agaugcaaucuagcaaaagucagucaggguga

SEQ ID NO: 313823 - RNA, 27 nt, Human
agaugcacaaggaagcagagaugcuaa

SEQ ID NO: 313824 - RNA, 31 nt, Human
agaugcacaaugucuccuucaggugaucaca

SEQ ID NO: 313825 - RNA, 32 nt, Human
agaugcacacacacaagcacacaugcacagag

SEQ ID NO: 313826 - RNA, 25 nt, Human
agaugcacacacagaugcacacaca

SEQ ID NO: 313827 - RNA, 32 nt, Human
agaugcacagccacacuuccaucucacccuaa

SEQ ID NO: 313828 - RNA, 18 nt, Human
agaugcacaucgcuauua

SEQ ID NO: 313829 - RNA, 32 nt, Human
agaugcaccacugcaccccagccugggcgacg

SEQ ID NO: 313830 - RNA, 32 nt, Human
agaugcaccagagacacaaggcuugaagcucu

SEQ ID NO: 313831 - RNA, 32 nt, Human
agaugcacgaggauaugaucuccauacagaac

SEQ ID NO: 313832 - RNA, 32 nt, Human
agaugcacuaccauugcuguucuacuuuuugg

SEQ ID NO: 313833 - RNA, 32 nt, Human
agaugcacugcaccccagccugggcgacagag

SEQ ID NO: 313834 - RNA, 32 nt, Human
agaugcagaagaacccagaaaggagcaggucu

SEQ ID NO: 313835 - RNA, 32 nt, Human
agaugcagagagagcacaagccucccuccuca

SEQ ID NO: 313836 - RNA, 32 nt, Human
agaugcagagggcuggauggacuggcccaugg

SEQ ID NO: 313837 - RNA, 32 nt, Human
agaugcagaucccggcccuggagcuuuaaaau

SEQ ID NO: 313838 - RNA, 16 nt, Human
agaugcagccuugcag

SEQ ID NO: 313839 - RNA, 32 nt, Human
agaugcagcucuuccuggacaggccagguggu

SEQ ID NO: 313840 - RNA, 32 nt, Human
agaugcagcugaagguuccauggauguauuug

SEQ ID NO: 313841 - RNA, 32 nt, Human
agaugcaggaaggaguaaagagcacuggaaag

SEQ ID NO: 313842 - RNA, 27 nt, Human
agaugcaggaggcagauaucaguggcu

SEQ ID NO: 313843 - RNA, 27 nt, Human
agaugcaggccugcauggugccggggc

SEQ ID NO: 313844 - RNA, 32 nt, Human
agaugcagggagcacucgccugugcugugagg

SEQ ID NO: 313845 - RNA, 32 nt, Human
agaugcaggggugggaagcggccaggcagaaa

SEQ ID NO: 313846 - RNA, 32 nt, Human
agaugcaguaaugauguuuaccagagauuauu

SEQ ID NO: 313847 - RNA, 32 nt, Human
agaugcaguauauacuuuucucauuuuuaaac

SEQ ID NO: 313848 - RNA, 32 nt, Human
agaugcagugguuccucccucuccugaauccu

SEQ ID NO: 313849 - RNA, 19 nt, Human
agaugcauaacagcuauua

SEQ ID NO: 313850 - RNA, 32 nt, Human
agaugcaucugggagagguggggaagauggca

SEQ ID NO: 313851 - RNA, 32 nt, Human
agaugcaugaaugaaggguacuuuuugcuuuu

SEQ ID NO: 313852 - RNA, 22 nt, Human
agaugcaugcguguccaggcug

SEQ ID NO: 313853 - RNA, 32 nt, Human
agaugcaugucugccaaaaugcaacauacggg

SEQ ID NO: 313854 - RNA, 32 nt, Human
agaugcauguugcagugagcugagauugcacc

SEQ ID NO: 313855 - RNA, 32 nt, Human
agaugcauucuuggugcucaaaccagaucgaa

SEQ ID NO: 313856 - RNA, 32 nt, Human
agaugcauuucagggccugggaaaagaagaug

SEQ ID NO: 313857 - RNA, 32 nt, Human
agaugccaacagcaacagguuugccacucguc

SEQ ID NO: 313858 - RNA, 32 nt, Human
agaugccacagcaauagagagguuuccuaaau

SEQ ID NO: 313859 - RNA, 32 nt, Human
agaugccacugcggccuggcugcuggggacga

SEQ ID NO: 313860 - RNA, 18 nt, Human
agaugccagaugcauugg

SEQ ID NO: 313861 - RNA, 32 nt, Human
agaugccagcacucccaccauucguggcaacc

SEQ ID NO: 313862 - RNA, 32 nt, Human
agaugccagcccagcuaccacaggggaucccu

SEQ ID NO: 313863 - RNA, 32 nt, Human
agaugccaggagcccugcugcccacaugcaag

SEQ ID NO: 313864 - RNA, 32 nt, Human
agaugccauacagaccuccugugcuuaaguua

SEQ ID NO: 313865 - RNA, 32 nt, Human
agaugccauacaguguucaauaauagaagguc

SEQ ID NO: 313866 - RNA, 32 nt, Human
agaugccauccacccccaucuaggugagggcu

SEQ ID NO: 313867 - RNA, 32 nt, Human
agaugccaucugcagaagugcugguagcauaa

SEQ ID NO: 313868 - RNA, 32 nt, Human
agaugccauguacucucuccuccagggaggca

SEQ ID NO: 313869 - RNA, 32 nt, Human
agaugccauugcacuccagccugggcaacaga

SEQ ID NO: 313870 - RNA, 32 nt, Human
agaugccauuguacuuguaggcauuuuauuuu

SEQ ID NO: 313871 - RNA, 27 nt, Human
agaugcccaacaacagcacugcucugu

SEQ ID NO: 313872 - RNA, 32 nt, Human
agaugcccaggaggaggagcccuagggaagaa

SEQ ID NO: 313873 - RNA, 32 nt, Human
agaugcccaucuggagugagugcaggaccagg

SEQ ID NO: 313874 - RNA, 32 nt, Human
agaugccccaggagaccuggcaccaugaggau

SEQ ID NO: 313875 - RNA, 32 nt, Human
agaugccccugagaccacccagaaaucaagcg

SEQ ID NO: 313876 - RNA, 18 nt, Human
agaugccccuucuaggaa

SEQ ID NO: 313877 - RNA, 32 nt, Human
agaugcccgcugaggguauucuccccucaacc

SEQ ID NO: 313878 - RNA, 32 nt, Human
agaugcccggcaauguucccucccaggcccuc

SEQ ID NO: 313879 - RNA, 32 nt, Human
agaugcccggcagguccugcugguagagggag

SEQ ID NO: 313880 - RNA, 32 nt, Human
agaugcccuguuaacuuauucuccccaguuca

SEQ ID NO: 313881 - RNA, 24 nt, Human
agaugcccuucagacaucucuuca

SEQ ID NO: 313882 - RNA, 32 nt, Human
agaugccgaagcacacgccuucaagaguccca

SEQ ID NO: 313883 - RNA, 32 nt, Human
agaugccggguggcagggagccgguggcgguc

SEQ ID NO: 313884 - RNA, 27 nt, Human
agaugccucgaauuaugaucaaggggg

SEQ ID NO: 313885 - RNA, 22 nt, Human
agaugccucgcagagcaccagg

SEQ ID NO: 313886 - RNA, 26 nt, Human
agaugccucguggugaaaggaucuca

SEQ ID NO: 313887 - RNA, 32 nt, Human
agaugccugcccaccucugucuccugccucug

SEQ ID NO: 313888 - RNA, 32 nt, Human
agaugccugcucccacuuugccuucugccaug

SEQ ID NO: 313889 - RNA, 32 nt, Human
agaugccuggacagcacagccacccaucuccc

SEQ ID NO: 313890 - RNA, 32 nt, Human
agaugccugggucugcagccaugguuugggug

SEQ ID NO: 313891 - RNA, 32 nt, Human
agaugccuguaauuccagcuacucaggaggcu

SEQ ID NO: 313892 - RNA, 32 nt, Human
agaugccuguagucccagcuacuugugaggcu

SEQ ID NO: 313893 - RNA, 32 nt, Human
agaugccuguggaacauuccagccaggcugca

SEQ ID NO: 313894 - RNA, 32 nt, Human
agaugccuucaagggcugcacugugcugacca

SEQ ID NO: 313895 - RNA, 32 nt, Human
agaugccuuccaggcugcagucagugcagaug

SEQ ID NO: 313896 - RNA, 32 nt, Human
agaugccuucccagacuacccuugucucacuu

SEQ ID NO: 313897 - RNA, 32 nt, Human
agaugccuugacccagaccagagacccaagcc

SEQ ID NO: 313898 - RNA, 23 nt, Human
agaugccuugguuccucuucacu

SEQ ID NO: 313899 - RNA, 32 nt, Human
agaugcgaaagccauggaguugagcugcagcg

SEQ ID NO: 313900 - RNA, 32 nt, Human
agaugcgaacauaguacacugcagccuccaac

SEQ ID NO: 313901 - RNA, 32 nt, Human
agaugcgccacugcacuccagccugggcgaca

SEQ ID NO: 313902 - RNA, 32 nt, Human
agaugcggauggaaacagaugcaccaaagcaa

SEQ ID NO: 313903 - RNA, 32 nt, Human
agaugcggcucccgccggcucugggucuggag

SEQ ID NO: 313904 - RNA, 32 nt, Human
agaugcgggcauugggcccugggaagcguggg

SEQ ID NO: 313905 - RNA, 32 nt, Human
agaugcgggcccuggcccuggaccugggcagc

SEQ ID NO: 313906 - RNA, 32 nt, Human
agaugcggguuaucuugaaagaaacaaacuga

SEQ ID NO: 313907 - RNA, 32 nt, Human
agaugcguguguggcuucugggcucuccuggu

SEQ ID NO: 313908 - RNA, 32 nt, Human
agaugcguuugucccaggcucgggggcucagu

SEQ ID NO: 313909 - RNA, 32 nt, Human
agaugcuaagucugagcuccagaagagacugu

SEQ ID NO: 313910 - RNA, 20 nt, Human
agaugcuaauuucagugacu

SEQ ID NO: 313911 - RNA, 32 nt, Human
agaugcuacucagaugcuggcuucagcuaagu

SEQ ID NO: 313912 - RNA, 32 nt, Human
agaugcuagaacugcaugugcugugcauauuc

SEQ ID NO: 313913 - RNA, 32 nt, Human
agaugcuagaacuuauugggcaugugguauac

SEQ ID NO: 313914 - RNA, 32 nt, Human
agaugcuagcacugcaugugcugugcauauuc

SEQ ID NO: 313915 - RNA, 32 nt, Human
agaugcuagcgcugcacuccauuuugcaaugg

SEQ ID NO: 313916 - RNA, 32 nt, Human
agaugcuagugccaugcuuccucugcagccug

SEQ ID NO: 313917 - RNA, 32 nt, Human
agaugcuaguugccauuuuaacaaagcaggua

SEQ ID NO: 313918 - RNA, 32 nt, Human
agaugcuauaggguuuucucucacuguugcca

SEQ ID NO: 313919 - RNA, 32 nt, Human
agaugcuaucuuggugcacacacacaacauug

SEQ ID NO: 313920 - RNA, 27 nt, Human
agaugcucaauaaacacuuguugaaug

SEQ ID NO: 313921 - RNA, 22 nt, Human
agaugcucaccacaucucccca

SEQ ID NO: 313922 - RNA, 32 nt, Human
agaugcucagaacauguucuugggggaaaacg

SEQ ID NO: 313923 - RNA, 32 nt, Human
agaugcucagcuuuauaggugugaccuacaca

SEQ ID NO: 313924 - RNA, 32 nt, Human
agaugcucagcuuuuccauaugauuaggugag

SEQ ID NO: 313925 - RNA, 32 nt, Human
agaugcucauaaggagugcacaaccgccgggc

SEQ ID NO: 313926 - RNA, 32 nt, Human
agaugcuccaggccaaugagaagaauuagaca

SEQ ID NO: 313927 - RNA, 32 nt, Human
agaugcuccaucugaucaaagugacacuucug

SEQ ID NO: 313928 - RNA, 32 nt, Human
agaugcuccaucugcuucucccccuuucucuu

SEQ ID NO: 313929 - RNA, 27 nt, Human
agaugcucccucuccccucaugcuccc

SEQ ID NO: 313930 - RNA, 32 nt, Human
agaugcuccuguccucuccuuucaaagacuga

SEQ ID NO: 313931 - RNA, 32 nt, Human
agaugcuccuguucuggugauaccaaaccugc

SEQ ID NO: 313932 - RNA, 32 nt, Human
agaugcucucucuccacggccucagagccacu

SEQ ID NO: 313933 - RNA, 32 nt, Human
agaugcucugagcaggggagacagggaucccg

SEQ ID NO: 313934 - RNA, 32 nt, Human
agaugcucuggcuucucucuugaaugcucacu

SEQ ID NO: 313935 - RNA, 32 nt, Human
agaugcucuggugguagagguggacuuaguag

SEQ ID NO: 313936 - RNA, 32 nt, Human
agaugcugaaggcagagcagcugagggagggg

SEQ ID NO: 313937 - RNA, 32 nt, Human
agaugcugaggaagagauuccgggaggaaacu

SEQ ID NO: 313938 - RNA, 32 nt, Human
agaugcugauacacagcacacagggaaaggaa

SEQ ID NO: 313939 - RNA, 32 nt, Human
agaugcugcacuuggcugggcacaguggcaca

SEQ ID NO: 313940 - RNA, 32 nt, Human
agaugcugcagccgugggcaaugacuuugcug

SEQ ID NO: 313941 - RNA, 32 nt, Human
agaugcugcaggaacugagaggauagaagacc

SEQ ID NO: 313942 - RNA, 32 nt, Human
agaugcugccacauagggguaauuccuaacca

SEQ ID NO: 313943 - RNA, 32 nt, Human
agaugcugcucccgccugauuggggccucacc

SEQ ID NO: 313944 - RNA, 32 nt, Human
agaugcugcucuggcccugggagcugaauucc

SEQ ID NO: 313945 - RNA, 32 nt, Human
agaugcugcugcucccuggccucagaggaaag

SEQ ID NO: 313946 - RNA, 32 nt, Human
agaugcuggaaggagagaaggaagcgggaagu

SEQ ID NO: 313947 - RNA, 32 nt, Human
agaugcuggaugcuaacuugauacuaaccauc

SEQ ID NO: 313948 - RNA, 32 nt, Human
agaugcuggcccagggccagagcccagcucca

SEQ ID NO: 313949 - RNA, 32 nt, Human
agaugcugggacugaggguggagcagcaaacu

SEQ ID NO: 313950 - RNA, 32 nt, Human
agaugcugggggcugcggccacggucagaggg

SEQ ID NO: 313951 - RNA, 32 nt, Human
agaugcuggugaagcaggugcagugaggaucc

SEQ ID NO: 313952 - RNA, 32 nt, Human
agaugcuguggacucugggaccugcagcucug

SEQ ID NO: 313953 - RNA, 32 nt, Human
agaugcuguguccaccacccagcuucaccccu

SEQ ID NO: 313954 - RNA, 32 nt, Human
agaugcugugucccccgugaugcagcuggaac

SEQ ID NO: 313955 - RNA, 32 nt, Human
agaugcuguuaaucuguaucccuauccccaac

SEQ ID NO: 313956 - RNA, 18 nt, Human
agaugcuguuuaagugac

SEQ ID NO: 313957 - RNA, 32 nt, Human
agaugcuguuucuacaaagcugugugaugggu

SEQ ID NO: 313958 - RNA, 32 nt, Human
agaugcuguuucuauaaagcugugugaugggu

SEQ ID NO: 313959 - RNA, 32 nt, Human
agaugcuguuucuauaaagcugugugauggua

SEQ ID NO: 313960 - RNA, 22 nt, Human
agaugcuuaucuaaccucccca

SEQ ID NO: 313961 - RNA, 23 nt, Human
agaugcuucaacaacaauuuuua

SEQ ID NO: 313962 - RNA, 32 nt, Human
agaugcuucauuuugacccuuggcugcagugg

SEQ ID NO: 313963 - RNA, 32 nt, Human
agaugcuuccaaggagcuacuuaguuuuaggg

SEQ ID NO: 313964 - RNA, 32 nt, Human
agaugcuucccaagaacuuucaagccaacaaa

SEQ ID NO: 313965 - RNA, 32 nt, Human
agaugcuucccaaggaggagucuguuuuguug

SEQ ID NO: 313966 - RNA, 32 nt, Human
agaugcuugugugguggcuucuuguccuucuc

SEQ ID NO: 313967 - RNA, 32 nt, Human
agaugcuuucagcugagaacagauuugacuca

SEQ ID NO: 313968 - RNA, 32 nt, Human
agaugcuuucaucgucucuccuucccucaagu

SEQ ID NO: 313969 - RNA, 32 nt, Human
agaugcuuucauuauggccuccagaggaaacc

SEQ ID NO: 313970 - RNA, 32 nt, Human
agaugcuuuccaacaugacaccugaacaucuu

SEQ ID NO: 313971 - RNA, 27 nt, Human
agaugcuuuugagccagaaugccuuca

SEQ ID NO: 313972 - RNA, 32 nt, Human
agaugcuuuuguacggguucccaugaaucuuc

SEQ ID NO: 313973 - RNA, 32 nt, Human
agaugcuuuuugagcugucuuacuuugauauc

SEQ ID NO: 313974 - RNA, 32 nt, Human
agauggaaacuacaagaguggcugguuugggg

SEQ ID NO: 313975 - RNA, 32 nt, Human
agauggaaaguagaugaaacuacuuugaaaau

SEQ ID NO: 313976 - RNA, 32 nt, Human
agauggaaagugaaccaaaaaggcuagaaacc

SEQ ID NO: 313977 - RNA, 32 nt, Human
agauggaaaugagggcaacugcugcuugaugg

SEQ ID NO: 313978 - RNA, 32 nt, Human
agauggaacacauggugaaugcauacagcaaa

SEQ ID NO: 313979 - RNA, 32 nt, Human
agauggaaccuggccucaguuuaggaacaggg

SEQ ID NO: 313980 - RNA, 32 nt, Human
agauggaaccuucucuucuuccuucuccucuu

SEQ ID NO: 313981 - RNA, 32 nt, Human
agauggaacuccaggaaauccaacucaaagaa

SEQ ID NO: 313982 - RNA, 32 nt, Human
agauggaagaggagacacagacacaaagcagg

SEQ ID NO: 313983 - RNA, 32 nt, Human
agauggaagagggagcucuggagugcuaacuu

SEQ ID NO: 313984 - RNA, 32 nt, Human
agauggaagagggaggaacaugagagcugaag

SEQ ID NO: 313985 - RNA, 32 nt, Human
agauggaagcaaaggaauccugccugccuuca

SEQ ID NO: 313986 - RNA, 32 nt, Human
agauggaaggagaucaaacacagaaucauaau

SEQ ID NO: 313987 - RNA, 32 nt, Human
agauggaaggcagaggauacugcgaccacccc

SEQ ID NO: 313988 - RNA, 32 nt, Human
agauggaaggcaggugaggaugucaggaugag

SEQ ID NO: 313989 - RNA, 32 nt, Human
agauggaagggaggcauuugcugacagaggac

SEQ ID NO: 313990 - RNA, 32 nt, Human
agauggaagucgcauuguagauucaagaaauu

SEQ ID NO: 313991 - RNA, 32 nt, Human
agauggaauuccaggaaagaacuucagguguc

SEQ ID NO: 313992 - RNA, 20 nt, Human
agauggaauuucaccauguu

SEQ ID NO: 313993 - RNA, 21 nt, Human
agauggaauuucaccguguug

SEQ ID NO: 313994 - RNA, 32 nt, Human
agauggacacugugccuggagugaaccugagc

SEQ ID NO: 313995 - RNA, 32 nt, Human
agauggacagggccacgacagggcucugagag

SEQ ID NO: 313996 - RNA, 32 nt, Human
agauggaccacgggaugagacucuccacugcc

SEQ ID NO: 313997 - RNA, 32 nt, Human
agauggaccggcucuugcucccagcuccuauu

SEQ ID NO: 313998 - RNA, 23 nt, Human
agauggaccucugugguugguca

SEQ ID NO: 313999 - RNA, 32 nt, Human
agauggaccugcaggaaagugagcaaacaucg

SEQ ID NO: 314000 - RNA, 32 nt, Human
agauggacgaggucugcagacggagggcagag

SEQ ID NO: 314001 - RNA, 27 nt, Human
agauggacucgguggagaagggggccg

SEQ ID NO: 314002 - RNA, 32 nt, Human
agauggacucugccaccuccucccagcuggac

SEQ ID NO: 314003 - RNA, 32 nt, Human
agauggacugcuugaguccaggaauuugagac

SEQ ID NO: 314004 - RNA, 32 nt, Human
agauggacuguggccgggcaaguggaucacag

SEQ ID NO: 314005 - RNA, 32 nt, Human
agauggagaauaggaagggcauuccaggcaga

SEQ ID NO: 314006 - RNA, 32 nt, Human
agauggagaccccuuucuacaggaugaccccu

SEQ ID NO: 314007 - RNA, 32 nt, Human
agauggagacugaggcccacgcuugggucccc

SEQ ID NO: 314008 - RNA, 32 nt, Human
agauggagagagaccuaaaaaccugagaggaa

SEQ ID NO: 314009 - RNA, 32 nt, Human
agauggagaggaggggagagagaaagagaggu

SEQ ID NO: 314010 - RNA, 32 nt, Human
agauggagaggauugaccagaggaauaacuua

SEQ ID NO: 314011 - RNA, 32 nt, Human
agauggagaggugguggccgagaguggaaaua

SEQ ID NO: 314012 - RNA, 32 nt, Human
agauggagagugacucuguuggcagaaggcag

SEQ ID NO: 314013 - RNA, 32 nt, Human
agauggagccacugcacuccagcccaggugac

SEQ ID NO: 314014 - RNA, 32 nt, Human
agauggagccacugcacuccagccugggcgac

SEQ ID NO: 314015 - RNA, 32 nt, Human
agauggagccacugcacuccagccugggggaa

SEQ ID NO: 314016 - RNA, 27 nt, Human
agauggagccaucucaguguguggagg

SEQ ID NO: 314017 - RNA, 32 nt, Human
agauggagccugggcaacaagagcgaaacucc

SEQ ID NO: 314018 - RNA, 32 nt, Human
agauggagcugguacccagcaggucuccucuc

SEQ ID NO: 314019 - RNA, 24 nt, Human
agauggagcuuccuacucauguug

SEQ ID NO: 314020 - RNA, 32 nt, Human
agauggaggcagcagacgugcagugccauaag

SEQ ID NO: 314021 - RNA, 32 nt, Human
agauggaggcaguggcuggagugaaugaacgg

SEQ ID NO: 314022 - RNA, 32 nt, Human
agauggagggccugguggaugcccuccucccu

SEQ ID NO: 314023 - RNA, 32 nt, Human
agauggagggcgucuuuccuucuguuaagcug

SEQ ID NO: 314024 - RNA, 21 nt, Human
agauggaguaucgcuauguug

SEQ ID NO: 314025 - RNA, 21 nt, Human
agauggagucucacuauguug

SEQ ID NO: 314026 - RNA, 19 nt, Human
agauggagucucgcucugu

SEQ ID NO: 314027 - RNA, 32 nt, Human
agauggagucucuugcucugucauccagguug

SEQ ID NO: 314028 - RNA, 32 nt, Human
agauggagucuggcuuugucccccaggcugga

SEQ ID NO: 314029 - RNA, 19 nt, Human
agauggagucuuacucugu

SEQ ID NO: 314030 - RNA, 19 nt, Human
agauggagucuugcucugu

SEQ ID NO: 314031 - RNA, 21 nt, Human
agauggaguugcuccauguug

SEQ ID NO: 314032 - RNA, 32 nt, Human
agauggaguugguauucagaugccaugccugu

SEQ ID NO: 314033 - RNA, 21 nt, Human
agauggaguuucaccauauug

SEQ ID NO: 314034 - RNA, 25 nt, Human
agauggaguuucaccauauugccca

SEQ ID NO: 314035 - RNA, 18 nt, Human
agauggaguuucaccaug

SEQ ID NO: 314036 - RNA, 25 nt, Human
agauggaguuucaccauggugguca

SEQ ID NO: 314037 - RNA, 20 nt, Human
agauggaguuucaccauguu

SEQ ID NO: 314038 - RNA, 21 nt, Human
agauggaguuucaccauguug

SEQ ID NO: 314039 - RNA, 25 nt, Human
agauggaguuucaccauguuggcca

SEQ ID NO: 314040 - RNA, 25 nt, Human
agauggaguuucaccauguugguca

SEQ ID NO: 314041 - RNA, 21 nt, Human
agauggaguuucacccuuguu

SEQ ID NO: 314042 - RNA, 20 nt, Human
agauggaguuucacucuguu

SEQ ID NO: 314043 - RNA, 21 nt, Human
agauggaguuucacucuguug

SEQ ID NO: 314044 - RNA, 21 nt, Human
agauggaguuucacucuuguu

SEQ ID NO: 314045 - RNA, 21 nt, Human
agauggaguuucacuguguca

SEQ ID NO: 314046 - RNA, 32 nt, Human
agauggaguuucacugugucagccaggauggu

SEQ ID NO: 314047 - RNA, 21 nt, Human
agauggaguuucgcucuguug

SEQ ID NO: 314048 - RNA, 21 nt, Human
agauggaguuucgcucuuguu

SEQ ID NO: 314049 - RNA, 19 nt, Human
agauggaguuucgcuguug

SEQ ID NO: 314050 - RNA, 22 nt, Human
agauggaguuucgcuuuuguug

SEQ ID NO: 314051 - RNA, 18 nt, Human
agauggaguuugcuguug

SEQ ID NO: 314052 - RNA, 27 nt, Human
agauggaguuuucgcucuuguugccca

SEQ ID NO: 314053 - RNA, 19 nt, Human
agauggaguuuugccaugu

SEQ ID NO: 314054 - RNA, 32 nt, Human
agauggaguuuugcucucguugccaaggcugg

SEQ ID NO: 314055 - RNA, 32 nt, Human
agauggaucacgaggucagggguucaagacca

SEQ ID NO: 314056 - RNA, 32 nt, Human
agauggaugcuacagagagagagggggacuuc

SEQ ID NO: 314057 - RNA, 32 nt, Human
agauggauugccaaucuucugccaucaauuuu

SEQ ID NO: 314058 - RNA, 32 nt, Human
agauggcaaaaucaucuuacauuuuucagacu

SEQ ID NO: 314059 - RNA, 32 nt, Human
agauggcaaagagcagcuuggccaggugagga

SEQ ID NO: 314060 - RNA, 32 nt, Human
agauggcaacacccuccagucuguagcagagc

SEQ ID NO: 314061 - RNA, 32 nt, Human
agauggcaagacugaggccuggagaaguggaa

SEQ ID NO: 314062 - RNA, 32 nt, Human
agauggcaaugccaccauuguugaugugacuc

SEQ ID NO: 314063 - RNA, 32 nt, Human
agauggcacauccuugcugcuggggacuuggc

SEQ ID NO: 314064 - RNA, 32 nt, Human
agauggcaccacuacacuccagcccgggcgac

SEQ ID NO: 314065 - RNA, 32 nt, Human
agauggcaccacuacauuucagccugggcgaa

SEQ ID NO: 314066 - RNA, 32 nt, Human
agauggcaccacugcacuccagccuaggugac

SEQ ID NO: 314067 - RNA, 27 nt, Human
agauggcaccacugcacuccagccugg

SEQ ID NO: 314068 - RNA, 32 nt, Human
agauggcaccacugcacuccagccuggacgac

SEQ ID NO: 314069 - RNA, 32 nt, Human
agauggcaccacugcacuccagccugggagac

SEQ ID NO: 314070 - RNA, 32 nt, Human
agauggcaccacugcacuccagccugggcaac

SEQ ID NO: 314071 - RNA, 32 nt, Human
agauggcaccacugcacuccagccugggugac

SEQ ID NO: 314072 - RNA, 32 nt, Human
agauggcaccacugcacuccagccugggugag

SEQ ID NO: 314073 - RNA, 32 nt, Human
agauggcaccacugcacuccagcuugggugac

SEQ ID NO: 314074 - RNA, 32 nt, Human
agauggcaccacugcacuccauccugggugac

SEQ ID NO: 314075 - RNA, 32 nt, Human
agauggcaccacugcacuccggccuaggcaac

SEQ ID NO: 314076 - RNA, 32 nt, Human
agauggcaccacugcauuccagccugggugac

SEQ ID NO: 314077 - RNA, 32 nt, Human
agauggcaccacuggacuccagccugggcgac

SEQ ID NO: 314078 - RNA, 32 nt, Human
agauggcaccacuuauugcacuccagcccggg

SEQ ID NO: 314079 - RNA, 32 nt, Human
agauggcaccauuacacuccagccugggcaac

SEQ ID NO: 314080 - RNA, 32 nt, Human
agauggcaccauugcacuccagccugggugac

SEQ ID NO: 314081 - RNA, 26 nt, Human
agauggcaccuuucaccacuugguca

SEQ ID NO: 314082 - RNA, 32 nt, Human
agauggcacuguccuaaagugcugucagggug

SEQ ID NO: 314083 - RNA, 32 nt, Human
agauggcagacaggagagaugggccccaggau

SEQ ID NO: 314084 - RNA, 27 nt, Human
agauggcagcagcgugucggagcguga

SEQ ID NO: 314085 - RNA, 32 nt, Human
agauggcagccccucccccgcaugcaugcacc

SEQ ID NO: 314086 - RNA, 27 nt, Human
agauggcagcgguaaaggcaucaacau

SEQ ID NO: 314087 - RNA, 32 nt, Human
agauggcaggagguggggugugcuugugugga

SEQ ID NO: 314088 - RNA, 32 nt, Human
agauggcagggacagcgcgccaugaccgagag

SEQ ID NO: 314089 - RNA, 32 nt, Human
agauggcaggugugugggacagacuggaggau

SEQ ID NO: 314090 - RNA, 32 nt, Human
agauggcaguggugaaggcaucaacaucaaaa

SEQ ID NO: 314091 - RNA, 32 nt, Human
agauggcaguguaucuaccucacaaagcagug

SEQ ID NO: 314092 - RNA, 32 nt, Human
agauggcaucccucaucaggguugccagaugg

SEQ ID NO: 314093 - RNA, 21 nt, Human
agauggcaucucacuauguug

SEQ ID NO: 314094 - RNA, 32 nt, Human
agauggcauuaugugguuaagagcauggggcg

SEQ ID NO: 314095 - RNA, 21 nt, Human
agauggcauuucaccauguug

SEQ ID NO: 314096 - RNA, 32 nt, Human
agauggccaaaagcauucaagccugggggaag

SEQ ID NO: 314097 - RNA, 32 nt, Human
agauggccacacccccagccacagauggccuc

SEQ ID NO: 314098 - RNA, 27 nt, Human
agauggccacggucauccccagccccc

SEQ ID NO: 314099 - RNA, 32 nt, Human
agauggccaguucuuucuaccucagagugagu

SEQ ID NO: 314100 - RNA, 32 nt, Human
agauggcccagcccgugggguggcagcuggcu

SEQ ID NO: 314101 - RNA, 32 nt, Human
agauggcccaggcuggggaagucgcucucaug

SEQ ID NO: 314102 - RNA, 32 nt, Human
agauggcccccucuuucccuuuccccacucug

SEQ ID NO: 314103 - RNA, 32 nt, Human
agauggcccuggggguccccuguucucugaau

SEQ ID NO: 314104 - RNA, 32 nt, Human
agauggccucauuccuccuguucucccaguuu

SEQ ID NO: 314105 - RNA, 27 nt, Human
agauggccugguuugcccucuaccucc

SEQ ID NO: 314106 - RNA, 32 nt, Human
agauggccuguaaucccagcacuuugggaggc

SEQ ID NO: 314107 - RNA, 32 nt, Human
agauggcgccacuacacuccagccugggcaac

SEQ ID NO: 314108 - RNA, 32 nt, Human
agauggcgccacuacacuccagccugggcgac

SEQ ID NO: 314109 - RNA, 32 nt, Human
agauggcgccacugcacuccagcccgggcgac

SEQ ID NO: 314110 - RNA, 32 nt, Human
agauggcgccacugcacuccagccuaggcaac

SEQ ID NO: 314111 - RNA, 32 nt, Human
agauggcgccacugcacuccagccugagugac

SEQ ID NO: 314112 - RNA, 32 nt, Human
agauggcgccacugcacuccagccugggcgac

SEQ ID NO: 314113 - RNA, 32 nt, Human
agauggcgccacugcacuccagccugggcguc

SEQ ID NO: 314114 - RNA, 32 nt, Human
agauggcgccacugcacuccagccugggugac

SEQ ID NO: 314115 - RNA, 32 nt, Human
agauggcgccacugcacuccagccugggugag

SEQ ID NO: 314116 - RNA, 32 nt, Human
agauggcgccacugcacuccagucugggcgau

SEQ ID NO: 314117 - RNA, 32 nt, Human
agauggcgccacugcacucccgucugggggag

SEQ ID NO: 314118 - RNA, 32 nt, Human
agauggcgccacugcauuccagccugggcaac

SEQ ID NO: 314119 - RNA, 32 nt, Human
agauggcgccacugcgcuccagccugggcaac

SEQ ID NO: 314120 - RNA, 32 nt, Human
agauggcgccaucacacuccagccugcucuuc

SEQ ID NO: 314121 - RNA, 32 nt, Human
agauggcgccauugcacuccagccugggcaaa

SEQ ID NO: 314122 - RNA, 32 nt, Human
agauggcgccauugcacuccagccugggugac

SEQ ID NO: 314123 - RNA, 32 nt, Human
agauggcgccauuucacuccagccugggcgac

SEQ ID NO: 314124 - RNA, 32 nt, Human
agauggcgccuccaccgggaugagcuagccag

SEQ ID NO: 314125 - RNA, 32 nt, Human
agauggcgcgacugcacuccagccugggcgag

SEQ ID NO: 314126 - RNA, 32 nt, Human
agauggcgcuauugcacuccagucuggguaac

SEQ ID NO: 314127 - RNA, 32 nt, Human
agauggcgcugcugcacucaagcuuggaugac

SEQ ID NO: 314128 - RNA, 27 nt, Human
agauggcggaagguggaggcugccgug

SEQ ID NO: 314129 - RNA, 32 nt, Human
agauggcggagcaagacagaagaaaggaaaag

SEQ ID NO: 314130 - RNA, 27 nt, Human
agauggcggccccuguaguggcgccgc

SEQ ID NO: 314131 - RNA, 32 nt, Human
agauggcggcgccugaggggucuugggggcuc

SEQ ID NO: 314132 - RNA, 27 nt, Human
agauggcggcggcagacacagcagcag

SEQ ID NO: 314133 - RNA, 32 nt, Human
agauggcgggagaagaggcgagugaagaugca

SEQ ID NO: 314134 - RNA, 32 nt, Human
agauggcgguagcugagggguugaccgagaga

SEQ ID NO: 314135 - RNA, 21 nt, Human
agauggcguuucaccauguug

SEQ ID NO: 314136 - RNA, 25 nt, Human
agauggcguuucaccauguuggcca

SEQ ID NO: 314137 - RNA, 32 nt, Human
agauggcuaagaguccaucaggcagaugaaau

SEQ ID NO: 314138 - RNA, 24 nt, Human
agauggcucacaccugugauccca

SEQ ID NO: 314139 - RNA, 32 nt, Human
agauggcucccaagguuccuaggcauugcagg

SEQ ID NO: 314140 - RNA, 32 nt, Human
agauggcuccuugggaugaagaggguagagug

SEQ ID NO: 314141 - RNA, 32 nt, Human
agauggcucugccaccagccagcucugugauc

SEQ ID NO: 314142 - RNA, 32 nt, Human
agauggcugagugaggguuauggggagccuga

SEQ ID NO: 314143 - RNA, 32 nt, Human
agauggcugcagcccucgaccuccugggcuca

SEQ ID NO: 314144 - RNA, 27 nt, Human
agauggcugccucugccuuugcuggug

SEQ ID NO: 314145 - RNA, 32 nt, Human
agauggcuggcuacucuuguuuucccucauga

SEQ ID NO: 314146 - RNA, 32 nt, Human
agauggcugggaagagaggaggaguggcagaa

SEQ ID NO: 314147 - RNA, 27 nt, Human
agauggcuggggacacagaagugugga

SEQ ID NO: 314148 - RNA, 32 nt, Human
agauggcuucaguucaugagacgggaucugag

SEQ ID NO: 314149 - RNA, 32 nt, Human
agauggcuugagcccaggagguugaggcugca

SEQ ID NO: 314150 - RNA, 32 nt, Human
agauggcuuugaaaaaggugauccaagcaggc

SEQ ID NO: 314151 - RNA, 32 nt, Human
agaugggaaaaauaauagcccauccguguacu

SEQ ID NO: 314152 - RNA, 32 nt, Human
agaugggaaaacugaggccuggagguaggaag

SEQ ID NO: 314153 - RNA, 32 nt, Human
agaugggaaagagguacaaaauaaucugcugc

SEQ ID NO: 314154 - RNA, 32 nt, Human
agaugggaaauggccaaaagaauaaaccauuu

SEQ ID NO: 314155 - RNA, 24 nt, Human
agaugggaaguggcuguggucuca

SEQ ID NO: 314156 - RNA, 32 nt, Human
agaugggaaugaggugggagguggaagaaggg

SEQ ID NO: 314157 - RNA, 32 nt, Human
agaugggacuacaggaguaugccaccaugccc

SEQ ID NO: 314158 - RNA, 32 nt, Human
agaugggacuacaggcacaggccauuaugccu

SEQ ID NO: 314159 - RNA, 32 nt, Human
agaugggacuacaggcaccugccaacacgccc

SEQ ID NO: 314160 - RNA, 32 nt, Human
agaugggacucaagcaggaugggugcuauauc

SEQ ID NO: 314161 - RNA, 32 nt, Human
agaugggacuccuccuuuauuccagcauggag

SEQ ID NO: 314162 - RNA, 32 nt, Human
agaugggagacaggagagaugagccccaggac

SEQ ID NO: 314163 - RNA, 32 nt, Human
agaugggagagggaagggggaggugugaaacg

SEQ ID NO: 314164 - RNA, 32 nt, Human
agaugggagcaguccuggguccuggucuuagc

SEQ ID NO: 314165 - RNA, 24 nt, Human
agaugggaggacgaagagguccca

SEQ ID NO: 314166 - RNA, 23 nt, Human
agaugggaggauacuugaaucca

SEQ ID NO: 314167 - RNA, 24 nt, Human
agaugggaggaucacuugaaccca

SEQ ID NO: 314168 - RNA, 24 nt, Human
agaugggaggaucgcuugagacca

SEQ ID NO: 314169 - RNA, 24 nt, Human
agaugggaggaucgcuugagccca

SEQ ID NO: 314170 - RNA, 24 nt, Human
agaugggaggauggcuugagccca

SEQ ID NO: 314171 - RNA, 24 nt, Human
agaugggaggauugccugagccca

SEQ ID NO: 314172 - RNA, 24 nt, Human
agaugggaggauugcuugagccca

SEQ ID NO: 314173 - RNA, 23 nt, Human
agaugggaggauugcuugagucc

SEQ ID NO: 314174 - RNA, 22 nt, Human
agaugggaguuucaccauguug

SEQ ID NO: 314175 - RNA, 26 nt, Human
agaugggaguuucaccauguuggcca

SEQ ID NO: 314176 - RNA, 19 nt, Human
agaugggaucacuauguug

SEQ ID NO: 314177 - RNA, 21 nt, Human
agaugggaucucaccauguug

SEQ ID NO: 314178 - RNA, 25 nt, Human
agaugggaucucaccauguugccca

SEQ ID NO: 314179 - RNA, 21 nt, Human
agaugggaucucacuagguug

SEQ ID NO: 314180 - RNA, 21 nt, Human
agaugggaucucacuauguug

SEQ ID NO: 314181 - RNA, 21 nt, Human
agaugggaucucauuuuguug

SEQ ID NO: 314182 - RNA, 21 nt, Human
agaugggaucuuucuauguug

SEQ ID NO: 314183 - RNA, 32 nt, Human
agaugggauuacaggcgccugccaccacgccc

SEQ ID NO: 314184 - RNA, 32 nt, Human
agaugggauucugcuguagagucucuagagaa

SEQ ID NO: 314185 - RNA, 21 nt, Human
agaugggauuucaccauguug

SEQ ID NO: 314186 - RNA, 25 nt, Human
agaugggauuucaccauguuggcca

SEQ ID NO: 314187 - RNA, 21 nt, Human
agaugggauuucacuguguug

SEQ ID NO: 314188 - RNA, 21 nt, Human
agaugggauuucaucauguug

SEQ ID NO: 314189 - RNA, 25 nt, Human
agaugggauuucaucauguuggcca

SEQ ID NO: 314190 - RNA, 21 nt, Human
agaugggauuucgccauguug

SEQ ID NO: 314191 - RNA, 25 nt, Human
agaugggauuucgccauguuggcca

SEQ ID NO: 314192 - RNA, 21 nt, Human
agaugggauuuuaccacauug

SEQ ID NO: 314193 - RNA, 25 nt, Human
agaugggauuuuaccacauugguca

SEQ ID NO: 314194 - RNA, 21 nt, Human
agaugggauuuugccauguug

SEQ ID NO: 314195 - RNA, 32 nt, Human
agaugggcaaaaagauuuucaugcuaaucuuc

SEQ ID NO: 314196 - RNA, 32 nt, Human
agaugggcaaacugaggcccagaggggcaggg

SEQ ID NO: 314197 - RNA, 32 nt, Human
agaugggcacuuuucuuccccuucccugccua

SEQ ID NO: 314198 - RNA, 26 nt, Human
agaugggcagaucacuugaggucagg

SEQ ID NO: 314199 - RNA, 32 nt, Human
agaugggcagggcagagacccucaaaugcucg

SEQ ID NO: 314200 - RNA, 32 nt, Human
agaugggcaguuaccuucucuccgucucucuc

SEQ ID NO: 314201 - RNA, 32 nt, Human
agaugggcauguagacuagugcuuucucaacc

SEQ ID NO: 314202 - RNA, 30 nt, Human
agaugggccucaauaaaaugguugaguugc

SEQ ID NO: 314203 - RNA, 26 nt, Human
agaugggcggaucaccugaggucagg

SEQ ID NO: 314204 - RNA, 24 nt, Human
agaugggcggaucacgaggucagg

SEQ ID NO: 314205 - RNA, 24 nt, Human
agaugggcggaucaugaagucagg

SEQ ID NO: 314206 - RNA, 26 nt, Human
agaugggcggaucuuuugaggucagg

SEQ ID NO: 314207 - RNA, 26 nt, Human
agaugggcggauugcuugaggucagg

SEQ ID NO: 314208 - RNA, 32 nt, Human
agaugggcucaagcaucuacacaccucagccu

SEQ ID NO: 314209 - RNA, 32 nt, Human
agauggggaaacugaggccuugagaaggaaaa

SEQ ID NO: 314210 - RNA, 32 nt, Human
agauggggaaacugaggcucaaggaaggcaug

SEQ ID NO: 314211 - RNA, 32 nt, Human
agauggggaaacugaggcuuaggaagagaaug

SEQ ID NO: 314212 - RNA, 27 nt, Human
agauggggacggaggccacagagcagg

SEQ ID NO: 314213 - RNA, 22 nt, Human
agauggggacuucaccguguug

SEQ ID NO: 314214 - RNA, 26 nt, Human
agauggggacuucaccguguuggcca

SEQ ID NO: 314215 - RNA, 32 nt, Human
agauggggagagaaacggggagagaaagaaac

SEQ ID NO: 314216 - RNA, 32 nt, Human
agauggggaggaagccccaucucugcuguucc

SEQ ID NO: 314217 - RNA, 19 nt, Human
agauggggagggaguccca

SEQ ID NO: 314218 - RNA, 22 nt, Human
agauggggaucucacuguguug

SEQ ID NO: 314219 - RNA, 32 nt, Human
agauggggauuccacccaggucugucugcagc

SEQ ID NO: 314220 - RNA, 32 nt, Human
agauggggcacugacccaggaggagaaagcag

SEQ ID NO: 314221 - RNA, 21 nt, Human
agauggggccucacuacauug

SEQ ID NO: 314222 - RNA, 20 nt, Human
agauggggccucuuuauguu

SEQ ID NO: 314223 - RNA, 21 nt, Human
agauggggcggucacaugucc

SEQ ID NO: 314224 - RNA, 19 nt, Human
agauggggcuacuguuguu

SEQ ID NO: 314225 - RNA, 19 nt, Human
agauggggcugucuaguug

SEQ ID NO: 314226 - RNA, 21 nt, Human
agauggggcuucaccauguug

SEQ ID NO: 314227 - RNA, 25 nt, Human
agauggggcuucaccauguuggcca

SEQ ID NO: 314228 - RNA, 18 nt, Human
agauggggcuucccacgu

SEQ ID NO: 314229 - RNA, 21 nt, Human
agauggggcuucgccaugcug

SEQ ID NO: 314230 - RNA, 32 nt, Human
agaugggggaaaggaagauaaucuggaaaguu

SEQ ID NO: 314231 - RNA, 32 nt, Human
agaugggggaauguguuauuguaugggaggag

SEQ ID NO: 314232 - RNA, 32 nt, Human
agaugggggagggguuuaacuuuuacauuauu

SEQ ID NO: 314233 - RNA, 31 nt, Human
agaugggggcagagagaaggucugaguccgg

SEQ ID NO: 314234 - RNA, 21 nt, Human
agaugggggcucccuauguug

SEQ ID NO: 314235 - RNA, 25 nt, Human
agaugggggguuuguggaguguuua

SEQ ID NO: 314236 - RNA, 22 nt, Human
agaugggggucucacuaugcug

SEQ ID NO: 314237 - RNA, 22 nt, Human
agaugggggucucacuauguug

SEQ ID NO: 314238 - RNA, 22 nt, Human
agauggggguuucaccauauug

SEQ ID NO: 314239 - RNA, 26 nt, Human
agauggggguuucaccauauuggcca

SEQ ID NO: 314240 - RNA, 22 nt, Human
agauggggguuucaccauguug

SEQ ID NO: 314241 - RNA, 26 nt, Human
agauggggguuucaccauguuggcca

SEQ ID NO: 314242 - RNA, 19 nt, Human
agaugggguacacaugucc

SEQ ID NO: 314243 - RNA, 19 nt, Human
agauggggucacaaugcug

SEQ ID NO: 314244 - RNA, 21 nt, Human
agauggggucucacaguguug

SEQ ID NO: 314245 - RNA, 20 nt, Human
agauggggucucaccauguu

SEQ ID NO: 314246 - RNA, 21 nt, Human
agauggggucucacccuguca

SEQ ID NO: 314247 - RNA, 21 nt, Human
agauggggucucacccuguug

SEQ ID NO: 314248 - RNA, 21 nt, Human
agauggggucucacuauguug

SEQ ID NO: 314249 - RNA, 20 nt, Human
agauggggucucacuguguu

SEQ ID NO: 314250 - RNA, 21 nt, Human
agauggggucucccuauguug

SEQ ID NO: 314251 - RNA, 21 nt, Human
agauggggucucgcacugucc

SEQ ID NO: 314252 - RNA, 21 nt, Human
agauggggucucgccguguug

SEQ ID NO: 314253 - RNA, 21 nt, Human
agauggggucucgcuauguug

SEQ ID NO: 314254 - RNA, 21 nt, Human
agauggggucucgcucuguca

SEQ ID NO: 314255 - RNA, 21 nt, Human
agauggggucucuccauguug

SEQ ID NO: 314256 - RNA, 25 nt, Human
agauggggucucuccauguugguca

SEQ ID NO: 314257 - RNA, 21 nt, Human
agauggggucuuacuauguug

SEQ ID NO: 314258 - RNA, 21 nt, Human
agauggggucuuccucuguug

SEQ ID NO: 314259 - RNA, 21 nt, Human
agauggggucuugcuauauug

SEQ ID NO: 314260 - RNA, 19 nt, Human
agauggggucuugcuaugu

SEQ ID NO: 314261 - RNA, 21 nt, Human
agauggggucuugcuauguug

SEQ ID NO: 314262 - RNA, 20 nt, Human
agauggggucuugcuguguu

SEQ ID NO: 314263 - RNA, 21 nt, Human
agauggggucuugcuguguug

SEQ ID NO: 314264 - RNA, 21 nt, Human
agauggggucuugcuuuguug

SEQ ID NO: 314265 - RNA, 21 nt, Human
agauggggucuuguuauauug

SEQ ID NO: 314266 - RNA, 32 nt, Human
agauggggugcaggucagcucacucaguuguu

SEQ ID NO: 314267 - RNA, 21 nt, Human
agauggggugucaccauguug

SEQ ID NO: 314268 - RNA, 25 nt, Human
agauggggugucaccauguuggcca

SEQ ID NO: 314269 - RNA, 20 nt, Human
agaugggguucaccauguug

SEQ ID NO: 314270 - RNA, 24 nt, Human
agaugggguucaccauguuggcca

SEQ ID NO: 314271 - RNA, 22 nt, Human
agaugggguucccacuauguug

SEQ ID NO: 314272 - RNA, 26 nt, Human
agaugggguucccacuauguugauca

SEQ ID NO: 314273 - RNA, 20 nt, Human
agaugggguucucaucaguu

SEQ ID NO: 314274 - RNA, 20 nt, Human
agaugggguuuaccauguug

SEQ ID NO: 314275 - RNA, 24 nt, Human
agaugggguuuaccauguuggcca

SEQ ID NO: 314276 - RNA, 21 nt, Human
agaugggguuuauccauguug

SEQ ID NO: 314277 - RNA, 25 nt, Human
agaugggguuuauccauguugguca

SEQ ID NO: 314278 - RNA, 21 nt, Human
agaugggguuucacaauguug

SEQ ID NO: 314279 - RNA, 25 nt, Human
agaugggguuucacaauguuggcca

SEQ ID NO: 314280 - RNA, 21 nt, Human
agaugggguuucaccaaguug

SEQ ID NO: 314281 - RNA, 21 nt, Human
agaugggguuucaccacauug

SEQ ID NO: 314282 - RNA, 25 nt, Human
agaugggguuucaccacauuggcca

SEQ ID NO: 314283 - RNA, 20 nt, Human
agaugggguuucaccacguu

SEQ ID NO: 314284 - RNA, 21 nt, Human
agaugggguuucaccacguug

SEQ ID NO: 314285 - RNA, 32 nt, Human
agaugggguuucaccacguugcccaggcuggu

SEQ ID NO: 314286 - RNA, 25 nt, Human
agaugggguuucaccacguuggcca

SEQ ID NO: 314287 - RNA, 22 nt, Human
agaugggguuucaccauacugg

SEQ ID NO: 314288 - RNA, 21 nt, Human
agaugggguuucaccauauug

SEQ ID NO: 314289 - RNA, 22 nt, Human
agaugggguuucaccauauugg

SEQ ID NO: 314290 - RNA, 25 nt, Human
agaugggguuucaccauauuggcca

SEQ ID NO: 314291 - RNA, 25 nt, Human
agaugggguuucaccauauugguca

SEQ ID NO: 314292 - RNA, 21 nt, Human
agaugggguuucaccaucuug

SEQ ID NO: 314293 - RNA, 25 nt, Human
agaugggguuucaccaucuuggcca

SEQ ID NO: 314294 - RNA, 21 nt, Human
agaugggguuucaccaugcug

SEQ ID NO: 314295 - RNA, 25 nt, Human
agaugggguuucaccaugcuggcca

SEQ ID NO: 314296 - RNA, 19 nt, Human
agaugggguuucaccaugu

SEQ ID NO: 314297 - RNA, 25 nt, Human
agaugggguuucaccauguaggcca

SEQ ID NO: 314298 - RNA, 20 nt, Human
agaugggguuucaccauguu

SEQ ID NO: 314299 - RNA, 25 nt, Human
agaugggguuucaccauguuaguca

SEQ ID NO: 314300 - RNA, 21 nt, Human
agaugggguuucaccauguug

SEQ ID NO: 314301 - RNA, 25 nt, Human
agaugggguuucaccauguugauca

SEQ ID NO: 314302 - RNA, 22 nt, Human
agaugggguuucaccauguugg

SEQ ID NO: 314303 - RNA, 25 nt, Human
agaugggguuucaccauguuggcca

SEQ ID NO: 314304 - RNA, 25 nt, Human
agaugggguuucaccauguugguca

SEQ ID NO: 314305 - RNA, 25 nt, Human
agaugggguuucaccauguugucca

SEQ ID NO: 314306 - RNA, 21 nt, Human
agaugggguuucaccauuuug

SEQ ID NO: 314307 - RNA, 25 nt, Human
agaugggguuucaccauuuuggcca

SEQ ID NO: 314308 - RNA, 25 nt, Human
agaugggguuucacccuauugguca

SEQ ID NO: 314309 - RNA, 20 nt, Human
agaugggguuucacccuguu

SEQ ID NO: 314310 - RNA, 20 nt, Human
agaugggguuucaccguguu

SEQ ID NO: 314311 - RNA, 25 nt, Human
agaugggguuucaccguguuaguca

SEQ ID NO: 314312 - RNA, 21 nt, Human
agaugggguuucaccguguug

SEQ ID NO: 314313 - RNA, 25 nt, Human
agaugggguuucaccguguuggcca

SEQ ID NO: 314314 - RNA, 21 nt, Human
agaugggguuucaccuuguug

SEQ ID NO: 314315 - RNA, 25 nt, Human
agaugggguuucaccuuguuggcca

SEQ ID NO: 314316 - RNA, 25 nt, Human
agaugggguuucaccuuguugguca

SEQ ID NO: 314317 - RNA, 21 nt, Human
agaugggguuucacgauguug

SEQ ID NO: 314318 - RNA, 25 nt, Human
agaugggguuucacgauguuggcca

SEQ ID NO: 314319 - RNA, 21 nt, Human
agaugggguuucacuauguug

SEQ ID NO: 314320 - RNA, 25 nt, Human
agaugggguuucacuauguuggcca

SEQ ID NO: 314321 - RNA, 25 nt, Human
agaugggguuucacuauguugguca

SEQ ID NO: 314322 - RNA, 19 nt, Human
agaugggguuucacugugu

SEQ ID NO: 314323 - RNA, 20 nt, Human
agaugggguuucacuguguu

SEQ ID NO: 314324 - RNA, 21 nt, Human
agaugggguuucacuguguug

SEQ ID NO: 314325 - RNA, 21 nt, Human
agaugggguuucagcauauug

SEQ ID NO: 314326 - RNA, 25 nt, Human
agaugggguuucagcauauuggcca

SEQ ID NO: 314327 - RNA, 21 nt, Human
agaugggguuucaucacguug

SEQ ID NO: 314328 - RNA, 21 nt, Human
agaugggguuucaucauauug

SEQ ID NO: 314329 - RNA, 25 nt, Human
agaugggguuucaucauauugguca

SEQ ID NO: 314330 - RNA, 20 nt, Human
agaugggguuucaucauguu

SEQ ID NO: 314331 - RNA, 21 nt, Human
agaugggguuucaucauguug

SEQ ID NO: 314332 - RNA, 25 nt, Human
agaugggguuucaucauguuggcca

SEQ ID NO: 314333 - RNA, 21 nt, Human
agaugggguuuccccauguug

SEQ ID NO: 314334 - RNA, 25 nt, Human
agaugggguuuccccauguuggcca

SEQ ID NO: 314335 - RNA, 21 nt, Human
agaugggguuucgccagguug

SEQ ID NO: 314336 - RNA, 21 nt, Human
agaugggguuucgccauauug

SEQ ID NO: 314337 - RNA, 25 nt, Human
agaugggguuucgccauauugauca

SEQ ID NO: 314338 - RNA, 20 nt, Human
agaugggguuucgccauguu

SEQ ID NO: 314339 - RNA, 21 nt, Human
agaugggguuucgccauguug

SEQ ID NO: 314340 - RNA, 25 nt, Human
agaugggguuucgccauguuggcca

SEQ ID NO: 314341 - RNA, 20 nt, Human
agaugggguuucgcgaguug

SEQ ID NO: 314342 - RNA, 21 nt, Human
agaugggguuucgcuauguug

SEQ ID NO: 314343 - RNA, 21 nt, Human
agaugggguuucgucauguug

SEQ ID NO: 314344 - RNA, 20 nt, Human
agaugggguuucucauauug

SEQ ID NO: 314345 - RNA, 18 nt, Human
agaugggguuucuccaug

SEQ ID NO: 314346 - RNA, 32 nt, Human
agaugggguuucuccauguauugcccaggcug

SEQ ID NO: 314347 - RNA, 21 nt, Human
agaugggguuucuccauguug

SEQ ID NO: 314348 - RNA, 25 nt, Human
agaugggguuucuccauguugauca

SEQ ID NO: 314349 - RNA, 25 nt, Human
agaugggguuucuccauguuggcca

SEQ ID NO: 314350 - RNA, 25 nt, Human
agaugggguuucuccauguugguca

SEQ ID NO: 314351 - RNA, 21 nt, Human
agaugggguuucucgauguug

SEQ ID NO: 314352 - RNA, 21 nt, Human
agaugggguuugaccauguug

SEQ ID NO: 314353 - RNA, 25 nt, Human
agaugggguuugaccauguuggcca

SEQ ID NO: 314354 - RNA, 20 nt, Human
agaugggguuugaccguguu

SEQ ID NO: 314355 - RNA, 18 nt, Human
agaugggguuugccaugu

SEQ ID NO: 314356 - RNA, 21 nt, Human
agaugggguuuuaccauauug

SEQ ID NO: 314357 - RNA, 19 nt, Human
agaugggguuuuaccaugu

SEQ ID NO: 314358 - RNA, 21 nt, Human
agaugggguuuuaccauguug

SEQ ID NO: 314359 - RNA, 25 nt, Human
agaugggguuuuaccauguuggcca

SEQ ID NO: 314360 - RNA, 25 nt, Human
agaugggguuuuaccauguugguca

SEQ ID NO: 314361 - RNA, 21 nt, Human
agaugggguuuuacccuguug

SEQ ID NO: 314362 - RNA, 20 nt, Human
agaugggguuuugccauguu

SEQ ID NO: 314363 - RNA, 21 nt, Human
agaugggguuuugccauguug

SEQ ID NO: 314364 - RNA, 21 nt, Human
agaugggguuuugccuuguug

SEQ ID NO: 314365 - RNA, 21 nt, Human
agaugggguuuugcuauguug

SEQ ID NO: 314366 - RNA, 21 nt, Human
agaugggguuuugucauguug

SEQ ID NO: 314367 - RNA, 21 nt, Human
agaugggguuuuuccacguug

SEQ ID NO: 314368 - RNA, 32 nt, Human
agauggguaaacugaggcacagggagccgggc

SEQ ID NO: 314369 - RNA, 32 nt, Human
agaugggugaagagguccagaaugauaugcaa

SEQ ID NO: 314370 - RNA, 24 nt, Human
agaugggugaaucaugaggucagg

SEQ ID NO: 314371 - RNA, 32 nt, Human
agaugggugaguaaacagacguauguggcagc

SEQ ID NO: 314372 - RNA, 32 nt, Human
agaugggugaugucugcauuuccaucugaggc

SEQ ID NO: 314373 - RNA, 26 nt, Human
agauggguggaucaccugaggucagg

SEQ ID NO: 314374 - RNA, 26 nt, Human
agauggguggaucacuugaggucagg

SEQ ID NO: 314375 - RNA, 23 nt, Human
agauggguggaucaugaggucag

SEQ ID NO: 314376 - RNA, 24 nt, Human
agauggguggaucaugaggucagg

SEQ ID NO: 314377 - RNA, 26 nt, Human
agauggguggauuaccugaggucagg

SEQ ID NO: 314378 - RNA, 24 nt, Human
agauggguggauugcuugagccca

SEQ ID NO: 314379 - RNA, 32 nt, Human
agauggguuacugggagaaucucuucaguggc

SEQ ID NO: 314380 - RNA, 32 nt, Human
agauggguucaucaauaacucaccagcaaaua

SEQ ID NO: 314381 - RNA, 23 nt, Human
agauggguucaucagucugguca

SEQ ID NO: 314382 - RNA, 21 nt, Human
agauggguucucacuauauug

SEQ ID NO: 314383 - RNA, 20 nt, Human
agauggguuucaccauguug

SEQ ID NO: 314384 - RNA, 24 nt, Human
agauggguuucaccauguuggcca

SEQ ID NO: 314385 - RNA, 21 nt, Human
agauggguuuucaccauauug

SEQ ID NO: 314386 - RNA, 25 nt, Human
agauggguuuucaccauauugguca

SEQ ID NO: 314387 - RNA, 21 nt, Human
agauggguuuucaccauguug

SEQ ID NO: 314388 - RNA, 25 nt, Human
agauggguuuucaccauguuggcca

SEQ ID NO: 314389 - RNA, 24 nt, Human
agauggguuuugccauguugucca

SEQ ID NO: 314390 - RNA, 32 nt, Human
agaugguaagguaggauaagucuggaaagagu

SEQ ID NO: 314391 - RNA, 27 nt, Human
agaugguaauaaaucuuugccucccac

SEQ ID NO: 314392 - RNA, 32 nt, Human
agaugguaccacugcacuccagccugggugac

SEQ ID NO: 314393 - RNA, 32 nt, Human
agaugguaccucugcacugcagccugggcaac

SEQ ID NO: 314394 - RNA, 32 nt, Human
agaugguaggaaauggagacggagaaauggca

SEQ ID NO: 314395 - RNA, 32 nt, Human
agauggucagagaagaugcgggccaggagacu

SEQ ID NO: 314396 - RNA, 32 nt, Human
agaugguccaugagagaggcagaaggaugggg

SEQ ID NO: 314397 - RNA, 32 nt, Human
agaugguccuaggucaggauuaguggucauuc

SEQ ID NO: 314398 - RNA, 32 nt, Human
agaugguccuccugccucagcuuccaaaggca

SEQ ID NO: 314399 - RNA, 32 nt, Human
agauggucgcaauaaugucugcccagaaccuu

SEQ ID NO: 314400 - RNA, 32 nt, Human
agauggucguuugaagccaggagaucaacuug

SEQ ID NO: 314401 - RNA, 32 nt, Human
agauggucuucaucggcguccagaccugggug

SEQ ID NO: 314402 - RNA, 32 nt, Human
agauggugaaaaggaaggguaauuaaaaugga

SEQ ID NO: 314403 - RNA, 32 nt, Human
agauggugagaaggcguggcugagggacucag

SEQ ID NO: 314404 - RNA, 32 nt, Human
agauggugaggaagaagaggagaggggagagg

SEQ ID NO: 314405 - RNA, 32 nt, Human
agauggugaggugacaauggaggcagagauug

SEQ ID NO: 314406 - RNA, 32 nt, Human
agauggugccacugcaccaucuggacaacaga

SEQ ID NO: 314407 - RNA, 32 nt, Human
agauggugccacugcacuccagccuaggugac

SEQ ID NO: 314408 - RNA, 32 nt, Human
agauggugccacugcacuccagccuggcgaca

SEQ ID NO: 314409 - RNA, 32 nt, Human
agauggugccacugcacuccagccugggcaac

SEQ ID NO: 314410 - RNA, 32 nt, Human
agauggugccacugcacuccagccugggcgaa

SEQ ID NO: 314411 - RNA, 32 nt, Human
agauggugccacugcacuccagccugggggac

SEQ ID NO: 314412 - RNA, 32 nt, Human
agauggugccacugcacuccagccugggugac

SEQ ID NO: 314413 - RNA, 32 nt, Human
agauggugccacugcacuccagcuuaggugac

SEQ ID NO: 314414 - RNA, 32 nt, Human
agauggugccacugcacucuaaccugggcgac

SEQ ID NO: 314415 - RNA, 32 nt, Human
agauggugccacugcacuucagccugggcaac

SEQ ID NO: 314416 - RNA, 32 nt, Human
agauggugccacugcauuccagccugggcaac

SEQ ID NO: 314417 - RNA, 32 nt, Human
agauggugccacugcauuucugccuggcaaca

SEQ ID NO: 314418 - RNA, 32 nt, Human
agauggugccacuguacuccagccugggugau

SEQ ID NO: 314419 - RNA, 32 nt, Human
agauggugccauugcccuccagccugggcaag

SEQ ID NO: 314420 - RNA, 32 nt, Human
agauggugccguugcacuccagccgggcaaca

SEQ ID NO: 314421 - RNA, 32 nt, Human
agauggugcuggagccagggagcugcuguccc

SEQ ID NO: 314422 - RNA, 32 nt, Human
agaugguggggcugccucuggugagggucuuc

SEQ ID NO: 314423 - RNA, 21 nt, Human
agauggugucucacucuguug

SEQ ID NO: 314424 - RNA, 32 nt, Human
agauggugugauugcacuccagcccaggggac

SEQ ID NO: 314425 - RNA, 25 nt, Human
agaugguguggucuacgaggucagg

SEQ ID NO: 314426 - RNA, 32 nt, Human
agaugguguuacugagaaggaaacuaaggacu

SEQ ID NO: 314427 - RNA, 21 nt, Human
agaugguguuucaccauguug

SEQ ID NO: 314428 - RNA, 25 nt, Human
agaugguguuucaccauguuggcca

SEQ ID NO: 314429 - RNA, 25 nt, Human
agaugguguuuccccacguugguca

SEQ ID NO: 314430 - RNA, 32 nt, Human
agaugguuccaucaucuccuuccauaucucac

SEQ ID NO: 314431 - RNA, 17 nt, Human
agaugguuccugaacug

SEQ ID NO: 314432 - RNA, 32 nt, Human
agaugguucguguucauacugcagcuuaaaac

SEQ ID NO: 314433 - RNA, 32 nt, Human
agaugguugagccucagacugcaggguguguu

SEQ ID NO: 314434 - RNA, 32 nt, Human
agaugguuggaucauuccaaacauugucucag

SEQ ID NO: 314435 - RNA, 32 nt, Human
agaugguuguuggagaaagugcuuaagccacu

SEQ ID NO: 314436 - RNA, 23 nt, Human
agaugguuucaccauguuggcca

SEQ ID NO: 314437 - RNA, 32 nt, Human
agaugguuugaguccucggugccuggguagca

SEQ ID NO: 314438 - RNA, 32 nt, Human
agaugguuuuauuaguacccuggucauuuugu

SEQ ID NO: 314439 - RNA, 32 nt, Human
agauguaaaacacucacauacaaguucauacu

SEQ ID NO: 314440 - RNA, 32 nt, Human
agauguaacuuagguguugguauaacuaaauc

SEQ ID NO: 314441 - RNA, 32 nt, Human
agauguaauucuguauccagacauggcaaaug

SEQ ID NO: 314442 - RNA, 32 nt, Human
agauguacauacaagucauccauuaaacaaag

SEQ ID NO: 314443 - RNA, 32 nt, Human
agauguaccacagcuuaacuggaagaggaagc

SEQ ID NO: 314444 - RNA, 32 nt, Human
agauguacucucugaaguuuggucuugauuug

SEQ ID NO: 314445 - RNA, 32 nt, Human
agauguagcaaaaacuucacaacaauucagca

SEQ ID NO: 314446 - RNA, 32 nt, Human
agauguagcaauaaaccaaaugugcuaaaacc

SEQ ID NO: 314447 - RNA, 32 nt, Human
agauguagcacaguaagaaaacucccuuagug

SEQ ID NO: 314448 - RNA, 32 nt, Human
agauguagccucuguuccuccuggacauagga

SEQ ID NO: 314449 - RNA, 32 nt, Human
agauguaguggauuuggcagcuaauucacucu

SEQ ID NO: 314450 - RNA, 32 nt, Human
agauguaguuaguuucucuguuuaugaaauua

SEQ ID NO: 314451 - RNA, 32 nt, Human
agauguaucuucaaccucuguuauucugguga

SEQ ID NO: 314452 - RNA, 32 nt, Human
agauguauggaggugacagagagaagaggcca

SEQ ID NO: 314453 - RNA, 32 nt, Human
agaugucaacacuguggagauugugcuaugaa

SEQ ID NO: 314454 - RNA, 32 nt, Human
agaugucaagagcaucacuguuguuauuuaaa

SEQ ID NO: 314455 - RNA, 32 nt, Human
agaugucacagauuccugcagagccauggucc

SEQ ID NO: 314456 - RNA, 32 nt, Human
agaugucaccacugcccuccagccugggugac

SEQ ID NO: 314457 - RNA, 32 nt, Human
agaugucacuuucucccccucugccuuuuagu

SEQ ID NO: 314458 - RNA, 32 nt, Human
agaugucagacuggcuggcugcagugacgugc

SEQ ID NO: 314459 - RNA, 32 nt, Human
agaugucaucccuuguauaccaucguagacuu

SEQ ID NO: 314460 - RNA, 32 nt, Human
agaugucauggccuacauuucugccaucacuc

SEQ ID NO: 314461 - RNA, 32 nt, Human
agauguccaauacuguaauuaauuuauuaaag

SEQ ID NO: 314462 - RNA, 32 nt, Human
agauguccaucaagggaggaagggugggucau

SEQ ID NO: 314463 - RNA, 32 nt, Human
agaugucccgggcaugagcugaccucagagga

SEQ ID NO: 314464 - RNA, 32 nt, Human
agaugucccucuccuccucaaccuucucuccc

SEQ ID NO: 314465 - RNA, 32 nt, Human
agauguccuuucucccuggucaguugguucca

SEQ ID NO: 314466 - RNA, 32 nt, Human
agauguccuuuguccaaugugaagauuuauuc

SEQ ID NO: 314467 - RNA, 32 nt, Human
agaugucgccauugaacggacaguguuuucau

SEQ ID NO: 314468 - RNA, 32 nt, Human
agaugucuauucuuguuggagacaugggauga

SEQ ID NO: 314469 - RNA, 32 nt, Human
agaugucucaaucugaauuuauuuggcuacac

SEQ ID NO: 314470 - RNA, 32 nt, Human
agaugucuccaacagguuugcagugucuguua

SEQ ID NO: 314471 - RNA, 32 nt, Human
agaugucugaaggucccugaggccugaccauc

SEQ ID NO: 314472 - RNA, 32 nt, Human
agaugucugcacuccuggcugcagcuggacaa

SEQ ID NO: 314473 - RNA, 23 nt, Human
agaugucugcuccuccucuugaa

SEQ ID NO: 314474 - RNA, 32 nt, Human
agaugucuucucacgcaaccccaaacucccug

SEQ ID NO: 314475 - RNA, 32 nt, Human
agaugucuuuuccuucuccaucaucuuagagc

SEQ ID NO: 314476 - RNA, 32 nt, Human
agaugugaacuccaauuaagggacuggagaga

SEQ ID NO: 314477 - RNA, 32 nt, Human
agaugugaagaaaacaacacacacuccaacac

SEQ ID NO: 314478 - RNA, 32 nt, Human
agaugugacagaaccaggacacuacugcuuaa

SEQ ID NO: 314479 - RNA, 32 nt, Human
agaugugaccaggacaaacgugcaauaaugcc

SEQ ID NO: 314480 - RNA, 32 nt, Human
agaugugaccauugaccauauucaucaauaua

SEQ ID NO: 314481 - RNA, 32 nt, Human
agaugugaccuugaacaccaguccauuucaca

SEQ ID NO: 314482 - RNA, 32 nt, Human
agaugugagagggagcaagcaagguuagcaac

SEQ ID NO: 314483 - RNA, 32 nt, Human
agaugugagagugaggaagugggauggggccu

SEQ ID NO: 314484 - RNA, 32 nt, Human
agaugugagcagucagagacugacagccaugc

SEQ ID NO: 314485 - RNA, 32 nt, Human
agaugugagcaucuucaaaguacgaauauugc

SEQ ID NO: 314486 - RNA, 32 nt, Human
agaugugagccaacgcacccggcuacaccuuc

SEQ ID NO: 314487 - RNA, 32 nt, Human
agaugugagccagcacaccgggccaagugaag

SEQ ID NO: 314488 - RNA, 24 nt, Human
agaugugaggcuguucuuggcaca

SEQ ID NO: 314489 - RNA, 32 nt, Human
agaugugagggcagaauauacacaacagaugc

SEQ ID NO: 314490 - RNA, 32 nt, Human
agaugugaguuaaaaagacuugccaaauuaua

SEQ ID NO: 314491 - RNA, 32 nt, Human
agaugugauaugaggcaacacaagcacagaca

SEQ ID NO: 314492 - RNA, 32 nt, Human
agaugugauguuggaaaacuucaggaaccuca

SEQ ID NO: 314493 - RNA, 32 nt, Human
agaugugauuucuuccauccagaaagacagaa

SEQ ID NO: 314494 - RNA, 32 nt, Human
agaugugcagcccucuggucagcugguccagg

SEQ ID NO: 314495 - RNA, 32 nt, Human
agaugugcaggaggacggugaggcucacuaca

SEQ ID NO: 314496 - RNA, 32 nt, Human
agaugugccagugccccugccugccgugccag

SEQ ID NO: 314497 - RNA, 22 nt, Human
agaugugcgaaagaaggcccaa

SEQ ID NO: 314498 - RNA, 32 nt, Human
agaugugcuagacaauggaaggaugcaggcca

SEQ ID NO: 314499 - RNA, 32 nt, Human
agauguggagaaacuggauuucucauagauug

SEQ ID NO: 314500 - RNA, 32 nt, Human
agauguggaggaggggaagggaagaccaggcc

SEQ ID NO: 314501 - RNA, 32 nt, Human
agaugugggcaggaccuuuuggaaggauguuu

SEQ ID NO: 314502 - RNA, 18 nt, Human
agaugugggccaccaugu

SEQ ID NO: 314503 - RNA, 32 nt, Human
agaugugggcucuguuuggggaagaugcaagg

SEQ ID NO: 314504 - RNA, 32 nt, Human
agaugugggucagaggcagagauggaaguugg

SEQ ID NO: 314505 - RNA, 32 nt, Human
agaugugggugcaggcaugcacacacacgaug

SEQ ID NO: 314506 - RNA, 32 nt, Human
agaugugguauucagccagggugaagggaaag

SEQ ID NO: 314507 - RNA, 32 nt, Human
agauguggucaccaagaucuaaguuacuuguu

SEQ ID NO: 314508 - RNA, 20 nt, Human
agauguggucucacuauguu

SEQ ID NO: 314509 - RNA, 21 nt, Human
agaugugguuucuccauguug

SEQ ID NO: 314510 - RNA, 25 nt, Human
agaugugguuucuccauguuggcca

SEQ ID NO: 314511 - RNA, 32 nt, Human
agauguguagagagagaaaggaagggaaggaa

SEQ ID NO: 314512 - RNA, 32 nt, Human
agauguguagguccucacagaggccaacuuau

SEQ ID NO: 314513 - RNA, 32 nt, Human
agaugugugcccaccccaccacugccuggaac

SEQ ID NO: 314514 - RNA, 32 nt, Human
agaugugugugugcacacacacagaaaccacg

SEQ ID NO: 314515 - RNA, 31 nt, Human
agauguguguucucugggcuuuauguaucug

SEQ ID NO: 314516 - RNA, 32 nt, Human
agauguguuucugcauuucuggaagucuaugc

SEQ ID NO: 314517 - RNA, 32 nt, Human
agauguuacaucugguagauguaacauucuac

SEQ ID NO: 314518 - RNA, 31 nt, Human
agauguucaauaaauauuuguugaaugagua

SEQ ID NO: 314519 - RNA, 32 nt, Human
agauguucacgggagauggaucagccccucuu

SEQ ID NO: 314520 - RNA, 32 nt, Human
agauguucacucagacugggggaugcaaugug

SEQ ID NO: 314521 - RNA, 32 nt, Human
agauguucagggacccugccuacaccucauuu

SEQ ID NO: 314522 - RNA, 27 nt, Human
agauguucgagccugugagcugcaccu

SEQ ID NO: 314523 - RNA, 32 nt, Human
agauguucuccucuguguucuuccccaggucc

SEQ ID NO: 314524 - RNA, 32 nt, Human
agauguucucuaauccucccucuccuuaccac

SEQ ID NO: 314525 - RNA, 32 nt, Human
agauguugaaaaucauuuucccuucuuaaaca

SEQ ID NO: 314526 - RNA, 23 nt, Human
agauguugacccagaguccucug

SEQ ID NO: 314527 - RNA, 32 nt, Human
agauguugcaccauugucagccaaauuugcug

SEQ ID NO: 314528 - RNA, 22 nt, Human
agauguugcuaacagcaacaca

SEQ ID NO: 314529 - RNA, 32 nt, Human
agauguugcuggacagaacucacagcucugug

SEQ ID NO: 314530 - RNA, 32 nt, Human
agauguuggagccacaccagccuggauuucaa

SEQ ID NO: 314531 - RNA, 29 nt, Human
agauguuggcugcuguacuuacucccuga

SEQ ID NO: 314532 - RNA, 32 nt, Human
agauguugggaaaggcuucuugaaauuacacg

SEQ ID NO: 314533 - RNA, 32 nt, Human
agauguugggagagagcuggggcagagcgggg

SEQ ID NO: 314534 - RNA, 32 nt, Human
agauguuguuauacuguauuauggcugauuuu

SEQ ID NO: 314535 - RNA, 32 nt, Human
agauguuuauuauauguugccauaaaauucaa

SEQ ID NO: 314536 - RNA, 18 nt, Human
agauguuucacuacguug

SEQ ID NO: 314537 - RNA, 32 nt, Human
agauguuucauuuuggccuggccaguggcuga

SEQ ID NO: 314538 - RNA, 32 nt, Human
agauguuuuugcccuuucugcuucacugcaug

SEQ ID NO: 314539 - RNA, 32 nt, Human
agauuaaaacucaauaaggagcucaguggcag

SEQ ID NO: 314540 - RNA, 32 nt, Human
agauuaaacauggugcaauggcaccucugucc

SEQ ID NO: 314541 - RNA, 32 nt, Human
agauuaaacucugauuuugagcacuuugugcu

SEQ ID NO: 314542 - RNA, 32 nt, Human
agauuaaagccucuguuuugcaccuguaaaaa

SEQ ID NO: 314543 - RNA, 32 nt, Human
agauuaaauggugaagggccauuucugauucu

SEQ ID NO: 314544 - RNA, 32 nt, Human
agauuaaauguucuuuuccaaauggggaguuu

SEQ ID NO: 314545 - RNA, 32 nt, Human
agauuaacaggccagaguggcaauggcgucuu

SEQ ID NO: 314546 - RNA, 32 nt, Human
agauuaacaguagaaacgagaacucacgucuc

SEQ ID NO: 314547 - RNA, 32 nt, Human
agauuaacucacaaauucaccucagaaggccu

SEQ ID NO: 314548 - RNA, 32 nt, Human
agauuaagagcagaaauugaaguuuuaacaga

SEQ ID NO: 314549 - RNA, 32 nt, Human
agauuaagccaccgcacuccagccugggcgac

SEQ ID NO: 314550 - RNA, 21 nt, Human
agauuaagcuguccccaggga

SEQ ID NO: 314551 - RNA, 32 nt, Human
agauuaagcuguugaaccuauauuugccauua

SEQ ID NO: 314552 - RNA, 32 nt, Human
agauuaaggaggaaggaauacaccugguccaa

SEQ ID NO: 314553 - RNA, 32 nt, Human
agauuaaggccccucagagaucaacagaccaa

SEQ ID NO: 314554 - RNA, 32 nt, Human
agauuaaucuccucuuuuuauagaugaguccu

SEQ ID NO: 314555 - RNA, 32 nt, Human
agauuacaaaccuguacaaccuguuacuguac

SEQ ID NO: 314556 - RNA, 32 nt, Human
agauuacaagcgugaaccaccaugccaggagg

SEQ ID NO: 314557 - RNA, 32 nt, Human
agauuacaccauugcauuccagccuaggcaac

SEQ ID NO: 314558 - RNA, 32 nt, Human
agauuacaccccuggacuccagcuugggugac

SEQ ID NO: 314559 - RNA, 32 nt, Human
agauuacaggcacacaccaccacgcccagcua

SEQ ID NO: 314560 - RNA, 32 nt, Human
agauuacaggcacccaccaccaugcccagcua

SEQ ID NO: 314561 - RNA, 32 nt, Human
agauuacaggcacccaccaccaugcccagcug

SEQ ID NO: 314562 - RNA, 32 nt, Human
agauuacaggcaugcaccaccacgcccggcua

SEQ ID NO: 314563 - RNA, 32 nt, Human
agauuacaggcaugcaccaccaugcccggcua

SEQ ID NO: 314564 - RNA, 32 nt, Human
agauuacaggccucugccaccaugcucagcua

SEQ ID NO: 314565 - RNA, 32 nt, Human
agauuacaggcgcacaccaccacgcccaacug

SEQ ID NO: 314566 - RNA, 32 nt, Human
agauuacaggcgcacaccaccacgcccggcua

SEQ ID NO: 314567 - RNA, 32 nt, Human
agauuacaggcgcccgccaccacgcccagaga

SEQ ID NO: 314568 - RNA, 32 nt, Human
agauuacaggcgcccgccaccacgcccagcau

SEQ ID NO: 314569 - RNA, 32 nt, Human
agauuacaggcgcccgccaccaugcccagcua

SEQ ID NO: 314570 - RNA, 32 nt, Human
agauuacaggcgcccgccaccaugcccggcua

SEQ ID NO: 314571 - RNA, 32 nt, Human
agauuacaggcgugagccaccaugccuggcca

SEQ ID NO: 314572 - RNA, 32 nt, Human
agauuacagguacgcaccaccaugcccagcuu

SEQ ID NO: 314573 - RNA, 32 nt, Human
agauuacaggugcacaccaccacaucuggcua

SEQ ID NO: 314574 - RNA, 32 nt, Human
agauuacaggugcccgccaccaugcccggcua

SEQ ID NO: 314575 - RNA, 32 nt, Human
agauuacaggugugagccaccaugcccagccu

SEQ ID NO: 314576 - RNA, 32 nt, Human
agauuacaggugugagugcccaugccuggcag

SEQ ID NO: 314577 - RNA, 32 nt, Human
agauuacaggugugcaccaccacgcccggcua

SEQ ID NO: 314578 - RNA, 32 nt, Human
agauuacaugaucuuauaucuagaaaaaugua

SEQ ID NO: 314579 - RNA, 32 nt, Human
agauuaccccucucaacaggccagcugcuggu

SEQ ID NO: 314580 - RNA, 32 nt, Human
agauuaccuuacuauuucuuuuguuccaaguu

SEQ ID NO: 314581 - RNA, 32 nt, Human
agauuacgccacugcaccccaaccugggcgac

SEQ ID NO: 314582 - RNA, 32 nt, Human
agauuacgccacugcacuaaugucuggugaca

SEQ ID NO: 314583 - RNA, 32 nt, Human
agauuacgccacugcacuccagccugggcaac

SEQ ID NO: 314584 - RNA, 32 nt, Human
agauuacgccacugcacuccagccugggugac

SEQ ID NO: 314585 - RNA, 32 nt, Human
agauuacgucacugcauuccagccugggugac

SEQ ID NO: 314586 - RNA, 32 nt, Human
agauuacuuccugcugcacuccugucuugcca

SEQ ID NO: 314587 - RNA, 32 nt, Human
agauuagaaaaauuucaacuguaggugccuuu

SEQ ID NO: 314588 - RNA, 32 nt, Human
agauuagacugucaugucucagugucuaucug

SEQ ID NO: 314589 - RNA, 32 nt, Human
agauuagauccagagaagacucuagauuugcu

SEQ ID NO: 314590 - RNA, 32 nt, Human
agauuagcacagacacguuuugauguugaaug

SEQ ID NO: 314591 - RNA, 32 nt, Human
agauuagcagggugacuuucacccugcaacag

SEQ ID NO: 314592 - RNA, 32 nt, Human
agauuagcucaccuuucuccuaggcaauuaua

SEQ ID NO: 314593 - RNA, 32 nt, Human
agauuagcuucauguccauuauagcauugagg

SEQ ID NO: 314594 - RNA, 32 nt, Human
agauuagcuugucucagggugggaagugggag

SEQ ID NO: 314595 - RNA, 32 nt, Human
agauuaggacacagcagagacuuucuaaaugc

SEQ ID NO: 314596 - RNA, 32 nt, Human
agauuaggaugugggccccacuuuagaggcac

SEQ ID NO: 314597 - RNA, 24 nt, Human
agauuaggcaugaauacacagaga

SEQ ID NO: 314598 - RNA, 32 nt, Human
agauuaggccauugcacuccagccucagcaac

SEQ ID NO: 314599 - RNA, 21 nt, Human
agauuagggagugguuugaga

SEQ ID NO: 314600 - RNA, 25 nt, Human
agauuaggguauaggcaucuagaga

SEQ ID NO: 314601 - RNA, 32 nt, Human
agauuaggguggcuguccaucccuggauagcu

SEQ ID NO: 314602 - RNA, 26 nt, Human
agauuaggguuggugguggcagugca

SEQ ID NO: 314603 - RNA, 32 nt, Human
agauuagguagacuuugcuuaguauugacaac

SEQ ID NO: 314604 - RNA, 32 nt, Human
agauuaguaggaggagaagugaauguaaauuu

SEQ ID NO: 314605 - RNA, 32 nt, Human
agauuauaacauccuguauuucaguuucugag

SEQ ID NO: 314606 - RNA, 32 nt, Human
agauuauaggcgugcaccaccacaccuggcua

SEQ ID NO: 314607 - RNA, 32 nt, Human
agauuauauggugaaccuacuuuuagagugua

SEQ ID NO: 314608 - RNA, 32 nt, Human
agauuaucaaagcuaauuugacuaguuugaac

SEQ ID NO: 314609 - RNA, 32 nt, Human
agauuaucucagaaaguaaaucugagagguaa

SEQ ID NO: 314610 - RNA, 32 nt, Human
agauuaugaacaaauagcacuuagguuaccug

SEQ ID NO: 314611 - RNA, 32 nt, Human
agauuaugaauagccucagcucuagaaugcuu

SEQ ID NO: 314612 - RNA, 32 nt, Human
agauuaugagacugacgugcugcccacugcac

SEQ ID NO: 314613 - RNA, 32 nt, Human
agauuaugccacugcacuccagccugggugac

SEQ ID NO: 314614 - RNA, 32 nt, Human
agauuaugccacugcacuccagccuggugaca

SEQ ID NO: 314615 - RNA, 32 nt, Human
agauuaugccacugcacuucagccugggugac

SEQ ID NO: 314616 - RNA, 32 nt, Human
agauuaugccacuguacuccagccugggugac

SEQ ID NO: 314617 - RNA, 32 nt, Human
agauuaugccacuguacuccagcgugggugac

SEQ ID NO: 314618 - RNA, 32 nt, Human
agauuaugccauugcacuccagccugggugac

SEQ ID NO: 314619 - RNA, 32 nt, Human
agauuauggggaaacugcucagcuucaauaaa

SEQ ID NO: 314620 - RNA, 32 nt, Human
agauuaugucacuccagccugggcaacagagu

SEQ ID NO: 314621 - RNA, 32 nt, Human
agauuaugucacugcacuccauccugggugac

SEQ ID NO: 314622 - RNA, 32 nt, Human
agauuaugugguuggccaauaaagauagauga

SEQ ID NO: 314623 - RNA, 32 nt, Human
agauuauugcaucacccauauauugagccuaa

SEQ ID NO: 314624 - RNA, 32 nt, Human
agauuauuuccaaggcuuaaagccugaagcug

SEQ ID NO: 314625 - RNA, 32 nt, Human
agauuauuugacuucccaggaauuuucugucu

SEQ ID NO: 314626 - RNA, 32 nt, Human
agauuauuugagcucaggaguuugagaccauc

SEQ ID NO: 314627 - RNA, 32 nt, Human
agauuauuuugaggcagacagagagcuguuau

SEQ ID NO: 314628 - RNA, 32 nt, Human
agauucaaagacgaccuuccaugugaugcaca

SEQ ID NO: 314629 - RNA, 32 nt, Human
agauucaaagcaagagauuacacagaacaaau

SEQ ID NO: 314630 - RNA, 32 nt, Human
agauucaacaucuuccuaaucuuucuagugca

SEQ ID NO: 314631 - RNA, 32 nt, Human
agauucaaccaccacccagggagugcuugcag

SEQ ID NO: 314632 - RNA, 32 nt, Human
agauucacaagcugcccugcaguggccuuggc

SEQ ID NO: 314633 - RNA, 32 nt, Human
agauucacacuugccagccuccacaaucgcag

SEQ ID NO: 314634 - RNA, 32 nt, Human
agauucacaugcuggcuccugaagggugcuca

SEQ ID NO: 314635 - RNA, 32 nt, Human
agauucacuugaaccugggagguggagguugc

SEQ ID NO: 314636 - RNA, 32 nt, Human
agauucagagcuggccagaguuucagugauag

SEQ ID NO: 314637 - RNA, 32 nt, Human
agauucagccacugcaagcccugggccucugg

SEQ ID NO: 314638 - RNA, 32 nt, Human
agauucagccauccaauugguuuuaggucuug

SEQ ID NO: 314639 - RNA, 18 nt, Human
agauucagggcagacaga

SEQ ID NO: 314640 - RNA, 32 nt, Human
agauucagggguauaugugcagguuuguuaca

SEQ ID NO: 314641 - RNA, 32 nt, Human
agauucaucaauuccaaaugugcaaaauacau

SEQ ID NO: 314642 - RNA, 32 nt, Human
agauucaucauaccuugaccuguaccucuucu

SEQ ID NO: 314643 - RNA, 32 nt, Human
agauuccaaaaauacaaacacuaguuguucca

SEQ ID NO: 314644 - RNA, 32 nt, Human
agauuccaaccagccuuucuucccugguuccc

SEQ ID NO: 314645 - RNA, 32 nt, Human
agauuccaauuuaaaagcagaaaagcaaaaac

SEQ ID NO: 314646 - RNA, 32 nt, Human
agauuccacaaagccucucuccccucccucgu

SEQ ID NO: 314647 - RNA, 32 nt, Human
agauuccacagaaucccgccaaauaugaagaa

SEQ ID NO: 314648 - RNA, 32 nt, Human
agauuccacagaggcugagagcaguggcucau

SEQ ID NO: 314649 - RNA, 32 nt, Human
agauuccacauaaaaauuuucugagguugucc

SEQ ID NO: 314650 - RNA, 22 nt, Human
agauuccagaagccucuccucc

SEQ ID NO: 314651 - RNA, 32 nt, Human
agauuccagcacugagccgugagccggucaug

SEQ ID NO: 314652 - RNA, 32 nt, Human
agauuccagcagaguugguucuuucugagguc

SEQ ID NO: 314653 - RNA, 32 nt, Human
agauuccagcuccuucagguguuuguuccagc

SEQ ID NO: 314654 - RNA, 32 nt, Human
agauuccagcugggcuagaggcugagaaccuu

SEQ ID NO: 314655 - RNA, 32 nt, Human
agauuccagcugggcuagaggcugagcaccuu

SEQ ID NO: 314656 - RNA, 32 nt, Human
agauuccagcugguaugagccuucugcagagc

SEQ ID NO: 314657 - RNA, 32 nt, Human
agauuccaggaggagcagagaaagcacagaug

SEQ ID NO: 314658 - RNA, 32 nt, Human
agauuccagguagaggauguauagacuggcua

SEQ ID NO: 314659 - RNA, 32 nt, Human
agauuccauacagcuccaaggaaggagccaag

SEQ ID NO: 314660 - RNA, 32 nt, Human
agauuccauaucuuugcuacuguaaacagagc

SEQ ID NO: 314661 - RNA, 32 nt, Human
agauuccaugccuucagccucuggugagacgu

SEQ ID NO: 314662 - RNA, 32 nt, Human
agauuccaugggugagucaccaugcuuggcca

SEQ ID NO: 314663 - RNA, 32 nt, Human
agauuccauuuaggaacugagguggaguccca

SEQ ID NO: 314664 - RNA, 32 nt, Human
agauucccacagcagacaagguugagaaucca

SEQ ID NO: 314665 - RNA, 32 nt, Human
agauucccaggcccuccagaauuuccacagca

SEQ ID NO: 314666 - RNA, 32 nt, Human
agauucccccuucuccucuccccuacuggagg

SEQ ID NO: 314667 - RNA, 32 nt, Human
agauuccccugccucagccucccaaguagcug

SEQ ID NO: 314668 - RNA, 32 nt, Human
agauucccgaguagcugggauuacagaugugc

SEQ ID NO: 314669 - RNA, 32 nt, Human
agauucccuacacauacauacauauguaugca

SEQ ID NO: 314670 - RNA, 32 nt, Human
agauucccuaucuccuuuuagaccugggacgg

SEQ ID NO: 314671 - RNA, 32 nt, Human
agauucccuccaccugauuuucaagcugucac

SEQ ID NO: 314672 - RNA, 32 nt, Human
agauuccgaaauagcauuuucuuuaccaguau

SEQ ID NO: 314673 - RNA, 32 nt, Human
agauuccgcgagccgacaccaugcgauccaag

SEQ ID NO: 314674 - RNA, 32 nt, Human
agauuccguccuuuaccagcugcagaaucuug

SEQ ID NO: 314675 - RNA, 32 nt, Human
agauuccuccgcuccucugagugcacgugugu

SEQ ID NO: 314676 - RNA, 32 nt, Human
agauuccucuggugguggucuccaggcugaca

SEQ ID NO: 314677 - RNA, 32 nt, Human
agauuccugaguagcugggaccacagauuacu

SEQ ID NO: 314678 - RNA, 32 nt, Human
agauuccugcaaccucaagagacuucccaggc

SEQ ID NO: 314679 - RNA, 32 nt, Human
agauuccugccugacaaggucucccucaggua

SEQ ID NO: 314680 - RNA, 32 nt, Human
agauuccugcgguccagccuccaacuuugguu

SEQ ID NO: 314681 - RNA, 32 nt, Human
agauuccugggcuggcaaguggggcaacgugu

SEQ ID NO: 314682 - RNA, 32 nt, Human
agauuccugucugacuaaagggaccucaaaaa

SEQ ID NO: 314683 - RNA, 31 nt, Human
agauucggagcggugcccaugccagggaucu

SEQ ID NO: 314684 - RNA, 32 nt, Human
agauucguaugcacgcccugcccagcugguca

SEQ ID NO: 314685 - RNA, 32 nt, Human
agauucuaaaacaugcugcagcaagaggaccc

SEQ ID NO: 314686 - RNA, 32 nt, Human
agauucuaacauccuuguuuuagaauucuaag

SEQ ID NO: 314687 - RNA, 32 nt, Human
agauucuaagcuccuuuuaaggcaguaauugc

SEQ ID NO: 314688 - RNA, 32 nt, Human
agauucuacacauacuuauccccaccaagacc

SEQ ID NO: 314689 - RNA, 32 nt, Human
agauucuacagcccuggccacaguacuuuggu

SEQ ID NO: 314690 - RNA, 32 nt, Human
agauucuaggcagaggcuggaaugcaaugaug

SEQ ID NO: 314691 - RNA, 28 nt, Human
agauucuauaaauaaagcuauauucugu

SEQ ID NO: 314692 - RNA, 32 nt, Human
agauucuaucaaaaucuugcaaaggaaaacaa

SEQ ID NO: 314693 - RNA, 32 nt, Human
agauucuauggacugaaaaagccccaggcuga

SEQ ID NO: 314694 - RNA, 32 nt, Human
agauucucaaaccacacgugcuuuguuaaagc

SEQ ID NO: 314695 - RNA, 32 nt, Human
agauucucaaauauccuugauuuuggauguuc

SEQ ID NO: 314696 - RNA, 32 nt, Human
agauucucacaguccccagugagccccaucca

SEQ ID NO: 314697 - RNA, 32 nt, Human
agauucucaccagauaaacagaagagcuucgu

SEQ ID NO: 314698 - RNA, 32 nt, Human
agauucucacucaguugcccaggcuggauugc

SEQ ID NO: 314699 - RNA, 32 nt, Human
agauucucagugugccuaacuuauuggagcac

SEQ ID NO: 314700 - RNA, 32 nt, Human
agauucucauaaggagcaaacaaccaagaucc

SEQ ID NO: 314701 - RNA, 32 nt, Human
agauucucauaaggagugcacaaucuagaucc

SEQ ID NO: 314702 - RNA, 32 nt, Human
agauucucauaaggagugugcaaucuagaucc

SEQ ID NO: 314703 - RNA, 32 nt, Human
agauucucauaaggaguucacagccuagaucc

SEQ ID NO: 314704 - RNA, 32 nt, Human
agauucuccugccucagccucacaaguagcug

SEQ ID NO: 314705 - RNA, 32 nt, Human
agauucuccugccucagccuccccaguagcug

SEQ ID NO: 314706 - RNA, 32 nt, Human
agauucuccugccucagccucccgaguagcug

SEQ ID NO: 314707 - RNA, 32 nt, Human
agauucuccugccucagccuccgaaguagcug

SEQ ID NO: 314708 - RNA, 32 nt, Human
agauucuccugccucagccuccugaguagcug

SEQ ID NO: 314709 - RNA, 32 nt, Human
agauucuccugccucagucucccgaguagcua

SEQ ID NO: 314710 - RNA, 32 nt, Human
agauucuccugccucggccugccggguagcug

SEQ ID NO: 314711 - RNA, 32 nt, Human
agauucugaacuggacagucagaaccacaggu

SEQ ID NO: 314712 - RNA, 32 nt, Human
agauucugaaggaacucacucccaacuauauc

SEQ ID NO: 314713 - RNA, 32 nt, Human
agauucugaaguauuuacugucaauucauagg

SEQ ID NO: 314714 - RNA, 32 nt, Human
agauucugagugugcaaggauaacccccguca

SEQ ID NO: 314715 - RNA, 32 nt, Human
agauucugcaccugcuagcacagcuguccacg

SEQ ID NO: 314716 - RNA, 32 nt, Human
agauucugcaccuggccauucccuguccuguc

SEQ ID NO: 314717 - RNA, 32 nt, Human
agauucugccaaggaucagaacucaugugaaa

SEQ ID NO: 314718 - RNA, 32 nt, Human
agauucugccaucucugugaucccaagauguc

SEQ ID NO: 314719 - RNA, 32 nt, Human
agauucuggaaaugcaucaauaaccuaagaaa

SEQ ID NO: 314720 - RNA, 31 nt, Human
agauucuggauggaaagacugaaucuuugac

SEQ ID NO: 314721 - RNA, 32 nt, Human
agauucugguacacgguguucaucucaauaga

SEQ ID NO: 314722 - RNA, 32 nt, Human
agauucuguacauuuauuugggagaaaauuuu

SEQ ID NO: 314723 - RNA, 32 nt, Human
agauucuuaaaaugucuaggcuaaguaugcac

SEQ ID NO: 314724 - RNA, 32 nt, Human
agauucuuaagagagguugcaaugugaaugau

SEQ ID NO: 314725 - RNA, 32 nt, Human
agauucuuaauauuucuccaucauggccuuuu

SEQ ID NO: 314726 - RNA, 32 nt, Human
agauucuuacacacacuaaaguuuggacaaag

SEQ ID NO: 314727 - RNA, 32 nt, Human
agauucuucacgcccagccucugccucacagu

SEQ ID NO: 314728 - RNA, 32 nt, Human
agauucuucacgcccagcuucuaccucacugu

SEQ ID NO: 314729 - RNA, 32 nt, Human
agauucuucucccacccccaacuuuauuugca

SEQ ID NO: 314730 - RNA, 32 nt, Human
agauucuuuaccaggcugugagccaguguuag

SEQ ID NO: 314731 - RNA, 32 nt, Human
agauucuuugccugguguaauugugacucaug

SEQ ID NO: 314732 - RNA, 32 nt, Human
agauugaaaauuguguucaguauaccuauaaa

SEQ ID NO: 314733 - RNA, 32 nt, Human
agauugaaagucucuaaugagcucuuuccccc

SEQ ID NO: 314734 - RNA, 32 nt, Human
agauugaacaaguaguggucugagggagacac

SEQ ID NO: 314735 - RNA, 32 nt, Human
agauugaacacauggaaugcaaugcaaugaga

SEQ ID NO: 314736 - RNA, 32 nt, Human
agauugaagaagaaacugagcaguugaaaaau

SEQ ID NO: 314737 - RNA, 32 nt, Human
agauugaauugcuuucccugggagugugcagu

SEQ ID NO: 314738 - RNA, 32 nt, Human
agauugacuaaaaagucuaccauacuucaagg

SEQ ID NO: 314739 - RNA, 32 nt, Human
agauugagaccauccuggauaacauggugaaa

SEQ ID NO: 314740 - RNA, 32 nt, Human
agauugagagcggcagagaagcucugagagcc

SEQ ID NO: 314741 - RNA, 32 nt, Human
agauugagagggcuaagaaaguagcccucaaa

SEQ ID NO: 314742 - RNA, 32 nt, Human
agauugagcaacuguacuccagcuuggcgaca

SEQ ID NO: 314743 - RNA, 32 nt, Human
agauugagccacugcacuccagccugggugac

SEQ ID NO: 314744 - RNA, 32 nt, Human
agauugagccauugcucuccagccugggugac

SEQ ID NO: 314745 - RNA, 32 nt, Human
agauugagcccucuccuacucucccccaacuc

SEQ ID NO: 314746 - RNA, 32 nt, Human
agauugagguagagaauaagagcaaaucauuc

SEQ ID NO: 314747 - RNA, 32 nt, Human
agauugagguuagaggaucaguaggacauuuu

SEQ ID NO: 314748 - RNA, 32 nt, Human
agauugauuaggacucuguucuuagagacucu

SEQ ID NO: 314749 - RNA, 32 nt, Human
agauugcaaacugccacaucucagccuguaag

SEQ ID NO: 314750 - RNA, 32 nt, Human
agauugcaacacugccacuccagccuggguga

SEQ ID NO: 314751 - RNA, 32 nt, Human
agauugcaaccuugacaggccacugccucuua

SEQ ID NO: 314752 - RNA, 32 nt, Human
agauugcacaauugcacuccagccuggcgaca

SEQ ID NO: 314753 - RNA, 32 nt, Human
agauugcacacugcacuccagccugggugacu

SEQ ID NO: 314754 - RNA, 32 nt, Human
agauugcaccacagcacuccaaccugggugac

SEQ ID NO: 314755 - RNA, 32 nt, Human
agauugcaccaccacacuccagccugggugac

SEQ ID NO: 314756 - RNA, 32 nt, Human
agauugcaccaccgcacuccagccugggugac

SEQ ID NO: 314757 - RNA, 32 nt, Human
agauugcaccacggcacuccagccugggugac

SEQ ID NO: 314758 - RNA, 32 nt, Human
agauugcaccacuacacuccagccuggaugac

SEQ ID NO: 314759 - RNA, 32 nt, Human
agauugcaccacuacacuccagccugggcaac

SEQ ID NO: 314760 - RNA, 32 nt, Human
agauugcaccacuacacuccagccugggugac

SEQ ID NO: 314761 - RNA, 32 nt, Human
agauugcaccacugcacgccagccugggugaa

SEQ ID NO: 314762 - RNA, 32 nt, Human
agauugcaccacugcacuacagcuugggugac

SEQ ID NO: 314763 - RNA, 32 nt, Human
agauugcaccacugcacuccaaccugggugac

SEQ ID NO: 314764 - RNA, 32 nt, Human
agauugcaccacugcacuccacagagugagac

SEQ ID NO: 314765 - RNA, 32 nt, Human
agauugcaccacugcacuccagcccaggcaac

SEQ ID NO: 314766 - RNA, 32 nt, Human
agauugcaccacugcacuccagccuaggcgac

SEQ ID NO: 314767 - RNA, 32 nt, Human
agauugcaccacugcacuccagccugagugag

SEQ ID NO: 314768 - RNA, 32 nt, Human
agauugcaccacugcacuccagccuggcgaca

SEQ ID NO: 314769 - RNA, 32 nt, Human
agauugcaccacugcacuccagccugggcaac

SEQ ID NO: 314770 - RNA, 32 nt, Human
agauugcaccacugcacuccagccugggcgac

SEQ ID NO: 314771 - RNA, 32 nt, Human
agauugcaccacugcacuccagccugggcggc

SEQ ID NO: 314772 - RNA, 32 nt, Human
agauugcaccacugcacuccagccuggggaca

SEQ ID NO: 314773 - RNA, 32 nt, Human
agauugcaccacugcacuccagccuggguaac

SEQ ID NO: 314774 - RNA, 32 nt, Human
agauugcaccacugcacuccagccugggugac

SEQ ID NO: 314775 - RNA, 32 nt, Human
agauugcaccacugcacuccagccuggguggc

SEQ ID NO: 314776 - RNA, 32 nt, Human
agauugcaccacugcacuccagccuggugaca

SEQ ID NO: 314777 - RNA, 32 nt, Human
agauugcaccacugcacuccagucugggcaac

SEQ ID NO: 314778 - RNA, 32 nt, Human
agauugcaccacugcacuccagucugggugag

SEQ ID NO: 314779 - RNA, 32 nt, Human
agauugcaccacugcacucccuuccaggugaa

SEQ ID NO: 314780 - RNA, 32 nt, Human
agauugcaccacugcacucuagccuggguaac

SEQ ID NO: 314781 - RNA, 32 nt, Human
agauugcaccacugcacuucagccuggugaca

SEQ ID NO: 314782 - RNA, 32 nt, Human
agauugcaccacugcaguucagccuggaugau

SEQ ID NO: 314783 - RNA, 32 nt, Human
agauugcaccacugcauuccaaccugggcggc

SEQ ID NO: 314784 - RNA, 32 nt, Human
agauugcaccacugcauuccagcauggccaca

SEQ ID NO: 314785 - RNA, 32 nt, Human
agauugcaccacugcauuccagccuggaugac

SEQ ID NO: 314786 - RNA, 32 nt, Human
agauugcaccacugcauuccagccuggcgaca

SEQ ID NO: 314787 - RNA, 32 nt, Human
agauugcaccacugcucuccagccuggggaac

SEQ ID NO: 314788 - RNA, 32 nt, Human
agauugcaccacugcucucuagccugggcaaa

SEQ ID NO: 314789 - RNA, 32 nt, Human
agauugcaccacuguacuccaaccugggcgac

SEQ ID NO: 314790 - RNA, 32 nt, Human
agauugcaccacuguacuccagccugggcaac

SEQ ID NO: 314791 - RNA, 32 nt, Human
agauugcaccacuguacuccagccugggugac

SEQ ID NO: 314792 - RNA, 32 nt, Human
agauugcaccacuuacuccagccugggcaaca

SEQ ID NO: 314793 - RNA, 32 nt, Human
agauugcaccacuucacuccagccugggugac

SEQ ID NO: 314794 - RNA, 32 nt, Human
agauugcaccagugcacuccagcugggcgaca

SEQ ID NO: 314795 - RNA, 32 nt, Human
agauugcaccauugaacuccagccugggcaac

SEQ ID NO: 314796 - RNA, 32 nt, Human
agauugcaccauugcacuccagccugcgcaac

SEQ ID NO: 314797 - RNA, 32 nt, Human
agauugcaccauugcacuccagccuggcgaca

SEQ ID NO: 314798 - RNA, 32 nt, Human
agauugcaccauugcacuccagccugggcaac

SEQ ID NO: 314799 - RNA, 32 nt, Human
agauugcaccauugcacuccagccugggcgac

SEQ ID NO: 314800 - RNA, 32 nt, Human
agauugcaccauugcacuccagccugggugac

SEQ ID NO: 314801 - RNA, 32 nt, Human
agauugcaccauugcacuccagccugugcaac

SEQ ID NO: 314802 - RNA, 32 nt, Human
agcauccccugaauacauggccaucuggagga

SEQ ID NO: 314803 - RNA, 32 nt, Human
agcaucccgaguagcugggacuacaggugcac

SEQ ID NO: 314804 - RNA, 32 nt, Human
agcaucccucaaguccugcuguggaccacaca

SEQ ID NO: 314805 - RNA, 32 nt, Human
agcaucccuggccucugcccacuagacaucag

SEQ ID NO: 314806 - RNA, 32 nt, Human
agcauccgagcuggcgaggaaacaguacaggg

SEQ ID NO: 314807 - RNA, 23 nt, Human
agcauccggguuuuaguauuuaa

SEQ ID NO: 314808 - RNA, 32 nt, Human
agcauccuaacaaaccguuagaacagccccgu

SEQ ID NO: 314809 - RNA, 32 nt, Human
agcauccuaauuaguugggauuacaggcgccc

SEQ ID NO: 314810 - RNA, 32 nt, Human
agcauccuaucccucaaacccaaaaagaaaga

SEQ ID NO: 314811 - RNA, 22 nt, Human
agcauccucccacccgcccucc

SEQ ID NO: 314812 - RNA, 32 nt, Human
agcauccucccugguggcccugggcaggugca

SEQ ID NO: 314813 - RNA, 32 nt, Human
agcauccucuggcaggugcucccaccagguca

SEQ ID NO: 314814 - RNA, 32 nt, Human
agcauccugaggcacagcucccaggggacaga

SEQ ID NO: 314815 - RNA, 32 nt, Human
agcauccugcagcugggacagaggccagcucc

SEQ ID NO: 314816 - RNA, 32 nt, Human
agcauccugccccagccagcuuccaucccuga

SEQ ID NO: 314817 - RNA, 32 nt, Human
agcauccugccugccgccgccugacucugcug

SEQ ID NO: 314818 - RNA, 32 nt, Human
agcauccuguuaaucagaaucaugggggagaa

SEQ ID NO: 314819 - RNA, 32 nt, Human
agcaucgcaguaagccuggcaggccuguaacu

SEQ ID NO: 314820 - RNA, 32 nt, Human
agcaucgcuccacugucucuccugccucccuc

SEQ ID NO: 314821 - RNA, 32 nt, Human
agcaucgcucuccugcuaacagucuugcaggu

SEQ ID NO: 314822 - RNA, 32 nt, Human
agcaucgcuggagggcagccugguggagaugg

SEQ ID NO: 314823 - RNA, 32 nt, Human
agcaucgcuugaaccugggagguggagguugc

SEQ ID NO: 314824 - RNA, 32 nt, Human
agcaucguggccccucaccucucccucucccc

SEQ ID NO: 314825 - RNA, 32 nt, Human
agcaucguggggcgaagcagagccauugugca

SEQ ID NO: 314826 - RNA, 32 nt, Human
agcaucuaaccccuccuuucuuaggcuagaca

SEQ ID NO: 314827 - RNA, 32 nt, Human
agcaucuacccguucacuccagucccacccca

SEQ ID NO: 314828 - RNA, 32 nt, Human
agcaucuacugaggcagaccugcaacagaagu

SEQ ID NO: 314829 - RNA, 17 nt, Human
agcaucuaggcuggcca

SEQ ID NO: 314830 - RNA, 32 nt, Human
agcaucuauucauguggcaggccccuguccua

SEQ ID NO: 314831 - RNA, 32 nt, Human
agcaucuauuuuugggcucugaaauggaauua

SEQ ID NO: 314832 - RNA, 32 nt, Human
agcaucucagacaccaaccacuaugcugucag

SEQ ID NO: 314833 - RNA, 32 nt, Human
agcaucuccaacaucucuccccaccucaugau

SEQ ID NO: 314834 - RNA, 19 nt, Human
agcaucucccacccaccca

SEQ ID NO: 314835 - RNA, 18 nt, Human
agcaucucccuccaggaa

SEQ ID NO: 314836 - RNA, 32 nt, Human
agcaucuccuggggcccccauggcuggggcag

SEQ ID NO: 314837 - RNA, 32 nt, Human
agcaucuccuuuuccuucuccucuuccucuuc

SEQ ID NO: 314838 - RNA, 32 nt, Human
agcaucucgaguagcugggauuacaggcaugc

SEQ ID NO: 314839 - RNA, 32 nt, Human
agcaucucucaugugccagcugcucgggauac

SEQ ID NO: 314840 - RNA, 32 nt, Human
agcaucucuccccucagcccugucuccucuuc

SEQ ID NO: 314841 - RNA, 32 nt, Human
agcaucucugaaaggggguaccaggaagcacc

SEQ ID NO: 314842 - RNA, 32 nt, Human
agcaucucugacccagucuucggacucauucu

SEQ ID NO: 314843 - RNA, 32 nt, Human
agcaucucugagcucaggacccugggcagggu

SEQ ID NO: 314844 - RNA, 32 nt, Human
agcaucucuggagagaaagaggagagccucac

SEQ ID NO: 314845 - RNA, 32 nt, Human
agcaucucuguggagcugccauccacuguaua

SEQ ID NO: 314846 - RNA, 32 nt, Human
agcaucucuucuucccugucagccugacucuu

SEQ ID NO: 314847 - RNA, 32 nt, Human
agcaucugaugccuuuuucuuugcuggggguc

SEQ ID NO: 314848 - RNA, 32 nt, Human
agcaucugcagacccaggcuccaggccucccg

SEQ ID NO: 314849 - RNA, 32 nt, Human
agcaucugccaagaagggugcugaaggcucca

SEQ ID NO: 314850 - RNA, 32 nt, Human
agcaucugcccgcaggccccagcccuucccug

SEQ ID NO: 314851 - RNA, 32 nt, Human
agcaucuggaaaaggaaccugguauuucugca

SEQ ID NO: 314852 - RNA, 32 nt, Human
agcaucuggaagugaggguaggagcuggguug

SEQ ID NO: 314853 - RNA, 32 nt, Human
agcaucuggaguagcugggacuacaggucagu

SEQ ID NO: 314854 - RNA, 32 nt, Human
agcaucuggauccccuuccuuuacagucaucc

SEQ ID NO: 314855 - RNA, 32 nt, Human
agcaucugggaaauuugccauggaauuaauga

SEQ ID NO: 314856 - RNA, 32 nt, Human
agcaucugggccuuggccuggagcacaaagac

SEQ ID NO: 314857 - RNA, 32 nt, Human
agcaucugggcugccagccacagggaagggcc

SEQ ID NO: 314858 - RNA, 32 nt, Human
agcaucuguaguguccaucagcaggugaaugg

SEQ ID NO: 314859 - RNA, 23 nt, Human
agcaucuucaucaagaucauuga

SEQ ID NO: 314860 - RNA, 22 nt, Human
agcaucuuccucccuccuuuaa

SEQ ID NO: 314861 - RNA, 32 nt, Human
agcaucuucgcuacaaccacugacaccagcug

SEQ ID NO: 314862 - RNA, 32 nt, Human
agcaucuugggcugauauugcuagcaagccug

SEQ ID NO: 314863 - RNA, 32 nt, Human
agcaucuugguggucgaugguagauuuuauug

SEQ ID NO: 314864 - RNA, 32 nt, Human
agcaucuuguucaaagauaagaaaguuacagu

SEQ ID NO: 314865 - RNA, 32 nt, Human
agcaugaaaacugagaugcugaaggugagagg

SEQ ID NO: 314866 - RNA, 32 nt, Human
agcaugaaaauggugcccaugccugacgcucc

SEQ ID NO: 314867 - RNA, 32 nt, Human
agcaugaaauguuuuuauuuuauuuugcuuau

SEQ ID NO: 314868 - RNA, 21 nt, Human
agcaugaagauuuaaugccua

SEQ ID NO: 314869 - RNA, 32 nt, Human
agcaugaaggaaaugaagcuggagaggaaggu

SEQ ID NO: 314870 - RNA, 32 nt, Human
agcaugaagugauuaaccugcuugaauuauuu

SEQ ID NO: 314871 - RNA, 32 nt, Human
agcaugaauugaaaggauuucuucugaaagcu

SEQ ID NO: 314872 - RNA, 21 nt, Human
agcaugaauuuuaauaucuag

SEQ ID NO: 314873 - RNA, 28 nt, Human
agcaugacacagcacuuuugggcacaag

SEQ ID NO: 314874 - RNA, 32 nt, Human
agcaugacaucaggaagccuguacuguccuga

SEQ ID NO: 314875 - RNA, 32 nt, Human
agcaugaccagcuguccaggggcugccuccug

SEQ ID NO: 314876 - RNA, 32 nt, Human
agcaugaccaugggcuccuuccaggccugguu

SEQ ID NO: 314877 - RNA, 32 nt, Human
agcaugaccucugggugucucuccaacucacc

SEQ ID NO: 314878 - RNA, 32 nt, Human
agcaugagaacuagcaccucugaaaaguaaaa

SEQ ID NO: 314879 - RNA, 28 nt, Human
agcaugagaagcauuuccagcacuccag

SEQ ID NO: 314880 - RNA, 23 nt, Human
agcaugagacugggcggcugucc

SEQ ID NO: 314881 - RNA, 32 nt, Human
agcaugagccaccacaccuggccuaugugugu

SEQ ID NO: 314882 - RNA, 32 nt, Human
agcaugagccaccacaccuggccuguuauucc

SEQ ID NO: 314883 - RNA, 28 nt, Human
agcaugagccggagggagggaagucugg

SEQ ID NO: 314884 - RNA, 32 nt, Human
agcaugaggaaauucaggguccccuaccagau

SEQ ID NO: 314885 - RNA, 32 nt, Human
agcaugaggcuggaugcagugguggugaggcc

SEQ ID NO: 314886 - RNA, 32 nt, Human
agcaugagguggaccuguuugcugggaacccc

SEQ ID NO: 314887 - RNA, 32 nt, Human
agcaugaguccuucaaggaagacagagugagc

SEQ ID NO: 314888 - RNA, 27 nt, Human
agcaugagugacagagacucugucucc

SEQ ID NO: 314889 - RNA, 32 nt, Human
agcaugaguugugaauggcagggaucauucug

SEQ ID NO: 314890 - RNA, 32 nt, Human
agcaugaucgacagagugaguuugucaaaagu

SEQ ID NO: 314891 - RNA, 32 nt, Human
agcaugaugauggauggauggacuggagcuag

SEQ ID NO: 314892 - RNA, 32 nt, Human
agcaugaugcagcgugaggacagcugagcagg

SEQ ID NO: 314893 - RNA, 32 nt, Human
agcaugaugccucugaggccagccuggccucc

SEQ ID NO: 314894 - RNA, 32 nt, Human
agcaugaugggaacccaagcugagggauacag

SEQ ID NO: 314895 - RNA, 32 nt, Human
agcaugcaaagucauuguuacaacagggaucu

SEQ ID NO: 314896 - RNA, 32 nt, Human
agcaugcaacuccaaagaaucugugaugccac

SEQ ID NO: 314897 - RNA, 32 nt, Human
agcaugcacccacugacaagagaccuccagcu

SEQ ID NO: 314898 - RNA, 32 nt, Human
agcaugcagacugugaagaugcaggccgcgau

SEQ ID NO: 314899 - RNA, 32 nt, Human
agcaugcagccagcugcucugcagccccaaau

SEQ ID NO: 314900 - RNA, 32 nt, Human
agcaugcaggguaaacgcaaagcacugaaguu

SEQ ID NO: 314901 - RNA, 32 nt, Human
agcaugccaccacaguaacacacauuagagaa

SEQ ID NO: 314902 - RNA, 32 nt, Human
agcaugccacuauacuccagccugggcaacaa

SEQ ID NO: 314903 - RNA, 32 nt, Human
agcaugccacuguacuccagccugagcuacag

SEQ ID NO: 314904 - RNA, 32 nt, Human
agcaugccacuuccagcaggcaugcaguccug

SEQ ID NO: 314905 - RNA, 32 nt, Human
agcaugccccacccacccuccugggcccaggc

SEQ ID NO: 314906 - RNA, 32 nt, Human
agcaugcccccgugaccugccugcugugguau

SEQ ID NO: 314907 - RNA, 20 nt, Human
agcaugcccuuugcuugcca

SEQ ID NO: 314908 - RNA, 32 nt, Human
agcaugccgcugcacuccagccugggagacug

SEQ ID NO: 314909 - RNA, 32 nt, Human
agcaugccugcccuuugcaagcagguuugggu

SEQ ID NO: 314910 - RNA, 32 nt, Human
agcaugccuuggagagagcagacacugugggg

SEQ ID NO: 314911 - RNA, 32 nt, Human
agcaugccuuucucucuuucucuuaauaagcc

SEQ ID NO: 314912 - RNA, 32 nt, Human
agcaugcgugagccauaccauccuccauccug

SEQ ID NO: 314913 - RNA, 32 nt, Human
agcaugcuacagccuuggacuccugggcucaa

SEQ ID NO: 314914 - RNA, 32 nt, Human
agcaugcucaaggacuccuaggcugguggcac

SEQ ID NO: 314915 - RNA, 32 nt, Human
agcaugcucaauaaauguaagcucuuuuguuc

SEQ ID NO: 314916 - RNA, 32 nt, Human
agcaugcuccacccccuugccacgugaugccc

SEQ ID NO: 314917 - RNA, 32 nt, Human
agcaugcugggaaccugagaaggaagguuucu

SEQ ID NO: 314918 - RNA, 32 nt, Human
agcaugcugguaaaaccacuacccucagagag

SEQ ID NO: 314919 - RNA, 19 nt, Human
agcaugcugugcucugccc

SEQ ID NO: 314920 - RNA, 32 nt, Human
agcaugcuuagcaauguucuaaucacuaugga

SEQ ID NO: 314921 - RNA, 32 nt, Human
agcauggaacagcaucuccccugggcuugcuc

SEQ ID NO: 314922 - RNA, 21 nt, Human
agcauggaagcccuaagcuua

SEQ ID NO: 314923 - RNA, 32 nt, Human
agcauggaagugagaggugaagccagcugguc

SEQ ID NO: 314924 - RNA, 32 nt, Human
agcauggaauacaguucagcagggccaaagag

SEQ ID NO: 314925 - RNA, 24 nt, Human
agcauggaauuaacauuaaacuua

SEQ ID NO: 314926 - RNA, 24 nt, Human
agcauggaauuagcauuaaacuua

SEQ ID NO: 314927 - RNA, 32 nt, Human
agcauggagagggaugcuugacagcaugcuaa

SEQ ID NO: 314928 - RNA, 28 nt, Human
agcauggagccggcggcggggagcagca

SEQ ID NO: 314929 - RNA, 32 nt, Human
agcauggagccggcggcggggagcagcaugga

SEQ ID NO: 314930 - RNA, 28 nt, Human
agcauggagcugcuguccacgccccaca

SEQ ID NO: 314931 - RNA, 32 nt, Human
agcauggaggcagauguggggcugagcugggg

SEQ ID NO: 314932 - RNA, 20 nt, Human
agcauggcaaacgugggcgg

SEQ ID NO: 314933 - RNA, 32 nt, Human
agcauggcaaagcccuuucucucccaagcccc

SEQ ID NO: 314934 - RNA, 24 nt, Human
agcauggcagucguggcccgggga

SEQ ID NO: 314935 - RNA, 32 nt, Human
agcauggcaguggaaggguuugucuugugccc

SEQ ID NO: 314936 - RNA, 28 nt, Human
agcauggccagcaagcucaucaucuccc

SEQ ID NO: 314937 - RNA, 32 nt, Human
agcauggccagcgguuuaguuuacagaucucc

SEQ ID NO: 314938 - RNA, 32 nt, Human
agcauggccucaccauaccuuuacuucagacu

SEQ ID NO: 314939 - RNA, 16 nt, Human
agcauggccuggacug

SEQ ID NO: 314940 - RNA, 32 nt, Human
agcauggccugggagcuuggaagggaggggug

SEQ ID NO: 314941 - RNA, 32 nt, Human
agcauggcuggcaggggcagcugcuguggcaa

SEQ ID NO: 314942 - RNA, 32 nt, Human
agcaugggacuggccugccuccuccgcccagc

SEQ ID NO: 314943 - RNA, 32 nt, Human
agcaugggagccaagaguaugaggagcuggug

SEQ ID NO: 314944 - RNA, 32 nt, Human
agcaugggaggcagagguugcagugagccaag

SEQ ID NO: 314945 - RNA, 32 nt, Human
agcaugggauguguccaguauugaaaaggcug

SEQ ID NO: 314946 - RNA, 32 nt, Human
agcaugggcagaggagacaggaacaagcguag

SEQ ID NO: 314947 - RNA, 32 nt, Human
agcaugggccucaccuccucugugauuucuuu

SEQ ID NO: 314948 - RNA, 21 nt, Human
agcaugggcgccugaggcugc

SEQ ID NO: 314949 - RNA, 32 nt, Human
agcaugggcucaaauggcacccuggcuggcug

SEQ ID NO: 314950 - RNA, 32 nt, Human
agcaugggcucagcucauccucccucuggccc

SEQ ID NO: 314951 - RNA, 32 nt, Human
agcaugggcugcagucaggacugcugcagacu

SEQ ID NO: 314952 - RNA, 21 nt, Human
agcaugggcuuguaguccuag

SEQ ID NO: 314953 - RNA, 32 nt, Human
agcauggggaagggaggaaggaagggauggga

SEQ ID NO: 314954 - RNA, 32 nt, Human
agcauggggcaguggcuggauuucugcccaag

SEQ ID NO: 314955 - RNA, 32 nt, Human
agcauggggcccagcugcagcugugcuuguuc

SEQ ID NO: 314956 - RNA, 32 nt, Human
agcaugggguucccagcagccugggggaagug

SEQ ID NO: 314957 - RNA, 32 nt, Human
agcaugggucagagugggagguugucaacaga

SEQ ID NO: 314958 - RNA, 32 nt, Human
agcaugggucuggggaagaggagcagcuuugc

SEQ ID NO: 314959 - RNA, 32 nt, Human
agcaugguaagcaacaggacauaucccagccu

SEQ ID NO: 314960 - RNA, 32 nt, Human
agcaugguacuuucacucagcuuaacaugcag

SEQ ID NO: 314961 - RNA, 28 nt, Human
agcaugguccagcugaggaagcugcucc

SEQ ID NO: 314962 - RNA, 32 nt, Human
agcauggucugggaacauuccuucuuuauugu

SEQ ID NO: 314963 - RNA, 32 nt, Human
agcauggugcuaacaucugaucagcuuguagg

SEQ ID NO: 314964 - RNA, 32 nt, Human
agcauggugcugcugcuucugcugcuucucca

SEQ ID NO: 314965 - RNA, 32 nt, Human
agcauggugcuggcauuugcucagcuucuagg

SEQ ID NO: 314966 - RNA, 32 nt, Human
agcaugguuauuucagaaaaucuggaaaacau

SEQ ID NO: 314967 - RNA, 31 nt, Human
agcauguaggagugagaaaaagucauugagc

SEQ ID NO: 314968 - RNA, 32 nt, Human
agcauguaggagugagaaaaagucauugagca

SEQ ID NO: 314969 - RNA, 32 nt, Human
agcauguaggcaggcucucagauguagguggc

SEQ ID NO: 314970 - RNA, 21 nt, Human
agcaugucacuuuuccauuaa

SEQ ID NO: 314971 - RNA, 19 nt, Human
agcaugucaggaaugcugg

SEQ ID NO: 314972 - RNA, 32 nt, Human
agcauguccaggcacuguacuaaccuacagag

SEQ ID NO: 314973 - RNA, 22 nt, Human
agcaugucucucaugccaagaa

SEQ ID NO: 314974 - RNA, 32 nt, Human
agcaugucugggccaggcagaggugcuccuca

SEQ ID NO: 314975 - RNA, 23 nt, Human
agcaugucuucaaaugccugagg

SEQ ID NO: 314976 - RNA, 32 nt, Human
agcaugucuuccuuuaccucccccuaaggaga

SEQ ID NO: 314977 - RNA, 32 nt, Human
agcaugucuuggaaccugucuugaguggggac

SEQ ID NO: 314978 - RNA, 32 nt, Human
agcaugugauuacuucacuccuggacugugac

SEQ ID NO: 314979 - RNA, 32 nt, Human
agcaugugcaccaaagccagccccaggcaggg

SEQ ID NO: 314980 - RNA, 32 nt, Human
agcaugugccuguaaucccagcuucuugggaa

SEQ ID NO: 314981 - RNA, 32 nt, Human
agcaugugccuguaauuccagcuacucgggag

SEQ ID NO: 314982 - RNA, 29 nt, Human
agcaugugccugugugugaaucugggagu

SEQ ID NO: 314983 - RNA, 32 nt, Human
agcauguggcugggugccuaucaccuucuucc

SEQ ID NO: 314984 - RNA, 32 nt, Human
agcaugugggaggcugaggauggagcugggaa

SEQ ID NO: 314985 - RNA, 32 nt, Human
agcaugugggauggacccaaggagaacgucag

SEQ ID NO: 314986 - RNA, 32 nt, Human
agcaugugguacagaggcaagagcagagccug

SEQ ID NO: 314987 - RNA, 32 nt, Human
agcauguggucuucagccuccugucucuguuc

SEQ ID NO: 314988 - RNA, 32 nt, Human
agcauguguaagucaaaauauguaugugaagg

SEQ ID NO: 314989 - RNA, 32 nt, Human
agcaugugugggcggggauggcucggccacug

SEQ ID NO: 314990 - RNA, 32 nt, Human
agcaugugugugugcauguaccggggaaugaa

SEQ ID NO: 314991 - RNA, 32 nt, Human
agcauguguuuaaccuuagugaagauuugugg

SEQ ID NO: 314992 - RNA, 32 nt, Human
agcauguuccagcucuugauguuuuuaaacuu

SEQ ID NO: 314993 - RNA, 19 nt, Human
agcauguuuaacccaggug

SEQ ID NO: 314994 - RNA, 32 nt, Human
agcauguuugauuuaagaaaagccuccaggaa

SEQ ID NO: 314995 - RNA, 32 nt, Human
agcauguuuuaaaucaguguaguccaggauca

SEQ ID NO: 314996 - RNA, 32 nt, Human
agcauuaaaaagcaaagggaaaaaggaugugu

SEQ ID NO: 314997 - RNA, 26 nt, Human
agcauuaauacuuacaguauuuucuu

SEQ ID NO: 314998 - RNA, 22 nt, Human
agcauuaauguaugacaugcug

SEQ ID NO: 314999 - RNA, 24 nt, Human
agcauuaaugugggagguacgcua

SEQ ID NO: 315000 - RNA, 32 nt, Human
agcauuaauucaaaugaggaguagucaguccu

SEQ ID NO: 315001 - RNA, 32 nt, Human
agcauuacacuucucccaguggagcccaugac

SEQ ID NO: 315002 - RNA, 32 nt, Human
agcauuacauugucuugagcaccagaaaauaa

SEQ ID NO: 315003 - RNA, 32 nt, Human
agcauuacccuccucucuccccagaugugacu

SEQ ID NO: 315004 - RNA, 32 nt, Human
agcauuacuaaauauaagaaaauucaugcugg

SEQ ID NO: 315005 - RNA, 32 nt, Human
agcauuacuguacaugcaaugaaaaauacuau

SEQ ID NO: 315006 - RNA, 32 nt, Human
agcauuagaaagcugaaggcccaaugaaauaa

SEQ ID NO: 315007 - RNA, 32 nt, Human
agcauuagaacugcauuguucauucaggagcc

SEQ ID NO: 315008 - RNA, 32 nt, Human
agcauuagcagauguccacugcguugucccau

SEQ ID NO: 315009 - RNA, 25 nt, Human
agcauuagcugccacugccaugcug

SEQ ID NO: 315010 - RNA, 32 nt, Human
agcauuagugccaugauaucuacuggauuuua

SEQ ID NO: 315011 - RNA, 32 nt, Human
agcauuaguugcucaaacuuuguucgacauca

SEQ ID NO: 315012 - RNA, 32 nt, Human
agcauuaucucagcaaaaggcuagagauaacc

SEQ ID NO: 315013 - RNA, 32 nt, Human
agcauuaucuuagacauuaaauuugaaguaac

SEQ ID NO: 315014 - RNA, 32 nt, Human
agcauuauggucuucaucccuccaucaaccuu

SEQ ID NO: 315015 - RNA, 26 nt, Human
agcauuaugguuuucagaacacuuca

SEQ ID NO: 315016 - RNA, 24 nt, Human
agcauuauuacauguuauuguucu

SEQ ID NO: 315017 - RNA, 21 nt, Human
agcauuauuucaauuuuucuu

SEQ ID NO: 315018 - RNA, 21 nt, Human
agcauucaagaugugaccugg

SEQ ID NO: 315019 - RNA, 31 nt, Human
agcauucaaggcacuuuacaugcagggcucu

SEQ ID NO: 315020 - RNA, 32 nt, Human
agcauucaccuugccaucugucuugucauugu

SEQ ID NO: 315021 - RNA, 32 nt, Human
agcauucagaucuuucuagucaccuuagaacu

SEQ ID NO: 315022 - RNA, 32 nt, Human
agcauucagcaacccuuuaaagaaaaagaauu

SEQ ID NO: 315023 - RNA, 32 nt, Human
agcauucagggcuguguggcccaaccuuccag

SEQ ID NO: 315024 - RNA, 32 nt, Human
agcauucaguccaauuccacagacacagugag

SEQ ID NO: 315025 - RNA, 32 nt, Human
agcauucauacaccucaccugccuuggcaagc

SEQ ID NO: 315026 - RNA, 21 nt, Human
agcauucaucagcagccucaa

SEQ ID NO: 315027 - RNA, 32 nt, Human
agcauucaucccuuuccauauaacaggaggga

SEQ ID NO: 315028 - RNA, 22 nt, Human
agcauucaugccugcugcccug

SEQ ID NO: 315029 - RNA, 32 nt, Human
agcauuccaaagugcugggauuacagguguga

SEQ ID NO: 315030 - RNA, 32 nt, Human
agcauuccagaacaggagggaagagaaagaga

SEQ ID NO: 315031 - RNA, 32 nt, Human
agcauuccagaacucuaaauccuguagaggua

SEQ ID NO: 315032 - RNA, 32 nt, Human
agcauuccagcagccacccagaccaugcuccg

SEQ ID NO: 315033 - RNA, 32 nt, Human
agcauuccagccugggcgauggagugagaccu

SEQ ID NO: 315034 - RNA, 32 nt, Human
agcauuccagcuguuucacccuucagcaacau

SEQ ID NO: 315035 - RNA, 32 nt, Human
agcauuccaggagagaaagggaccgcuuggag

SEQ ID NO: 315036 - RNA, 32 nt, Human
agcauuccagguucugggcuucuccccauguc

SEQ ID NO: 315037 - RNA, 32 nt, Human
agcauucccaaagcucuuaauucuccauaaaa

SEQ ID NO: 315038 - RNA, 32 nt, Human
agcauuccccugggcucccuggcagcuguugg

SEQ ID NO: 315039 - RNA, 32 nt, Human
agcauuccuuucuccaggguauggggcaagga

SEQ ID NO: 315040 - RNA, 32 nt, Human
agcauucgagaaacuccucucuacuuuagcac

SEQ ID NO: 315041 - RNA, 32 nt, Human
agcauucuaagcugccugaccuugggcauuug

SEQ ID NO: 315042 - RNA, 32 nt, Human
agcauucucaaaggcuuuagcccuggacccag

SEQ ID NO: 315043 - RNA, 32 nt, Human
agcauucucaacuauaucaaguuacuguucag

SEQ ID NO: 315044 - RNA, 32 nt, Human
agcauucucauuccuauauuagaugaaaugua

SEQ ID NO: 315045 - RNA, 32 nt, Human
agcauucuccacccuuaacccugugcucaggc

SEQ ID NO: 315046 - RNA, 32 nt, Human
agcauucucccugagaugaugucuucaguaau

SEQ ID NO: 315047 - RNA, 32 nt, Human
agcauucuccuggagaaaacugaaacagaagg

SEQ ID NO: 315048 - RNA, 32 nt, Human
agcauucugccugucucagccucccaaaaagc

SEQ ID NO: 315049 - RNA, 32 nt, Human
agcauucuguacuaauacagcucuuccauagg

SEQ ID NO: 315050 - RNA, 32 nt, Human
agcauucuugcugcugcugccugccugcccac

SEQ ID NO: 315051 - RNA, 32 nt, Human
agcauugaaaggacagcuuggggauggaauuu

SEQ ID NO: 315052 - RNA, 32 nt, Human
agcauugacacauagcuucaucugaggugaga

SEQ ID NO: 315053 - RNA, 32 nt, Human
agcauugagccugaggaccaaaaugaaaccuu

SEQ ID NO: 315054 - RNA, 32 nt, Human
agcauugaggggaacaagaugagucuaauccg

SEQ ID NO: 315055 - RNA, 32 nt, Human
agcauugaggugacugaaugccuccacuuauu

SEQ ID NO: 315056 - RNA, 32 nt, Human
agcauugaucacuuaauccuguuucucauguc

SEQ ID NO: 315057 - RNA, 32 nt, Human
agcauugauuucuuaauuuugauaccuguacu

SEQ ID NO: 315058 - RNA, 32 nt, Human
agcauugcacuccagccugggugacagaacga

SEQ ID NO: 315059 - RNA, 32 nt, Human
agcauugcagaacaugagugcugaugagggca

SEQ ID NO: 315060 - RNA, 32 nt, Human
agcauugccaucacuggcccuccuaggcucac

SEQ ID NO: 315061 - RNA, 32 nt, Human
agcauugccgcuccacaucuuugcucaauguu

SEQ ID NO: 315062 - RNA, 32 nt, Human
agcauugccuggacugaccacaccaaccaggc

SEQ ID NO: 315063 - RNA, 32 nt, Human
agcauugcuacugcucagcuucuucuuucauu

SEQ ID NO: 315064 - RNA, 32 nt, Human
agcauugcucuuccuacuguacauauugggga

SEQ ID NO: 315065 - RNA, 32 nt, Human
agcauugcugcccuccaaccuccugggauuca

SEQ ID NO: 315066 - RNA, 32 nt, Human
agcauuggaauagaaguaauugguuuaaagaa

SEQ ID NO: 315067 - RNA, 32 nt, Human
agcauuggcaaaaagcugaggaugacaagcuu

SEQ ID NO: 315068 - RNA, 32 nt, Human
agcauuggcagucagagauuuuauagggaaga

SEQ ID NO: 315069 - RNA, 32 nt, Human
agcauuggcuugcuucaguuguuucucuuccc

SEQ ID NO: 315070 - RNA, 24 nt, Human
agcauugggaccgugaccugcagg

SEQ ID NO: 315071 - RNA, 32 nt, Human
agcauugggagauguggaccagagauccacuc

SEQ ID NO: 315072 - RNA, 32 nt, Human
agcauugggauuacaggcaucagccaccacac

SEQ ID NO: 315073 - RNA, 22 nt, Human
agcauuggggagcaggaggcug

SEQ ID NO: 315074 - RNA, 32 nt, Human
agcauugggguucggcccugcccguagcacag

SEQ ID NO: 315075 - RNA, 32 nt, Human
agcauugguagugcuuuccuuaucaguaacug

SEQ ID NO: 315076 - RNA, 32 nt, Human
agcauuguaggauguuuagcagcauccguggc

SEQ ID NO: 315077 - RNA, 32 nt, Human
agcauuguggagcaaauuuaggguuccuguga

SEQ ID NO: 315078 - RNA, 32 nt, Human
agcauuguguacaugcagaagugcacaguacc

SEQ ID NO: 315079 - RNA, 32 nt, Human
agcauugugucaccugugaguuuuuggaauug

SEQ ID NO: 315080 - RNA, 32 nt, Human
agcauuguguucuuggcaugugaucugggaaa

SEQ ID NO: 315081 - RNA, 32 nt, Human
agcauuguuucugcuucugaaaucuguauagu

SEQ ID NO: 315082 - RNA, 32 nt, Human
agcauuuagagaguguguugucuuccagaguc

SEQ ID NO: 315083 - RNA, 32 nt, Human
agcauuuagaucaggaggcaaaguaauuucuu

SEQ ID NO: 315084 - RNA, 32 nt, Human
agcauuuauuucccaaaucuguuaacauggca

SEQ ID NO: 315085 - RNA, 32 nt, Human
agcauuucaagaaacaaccauaugguguugua

SEQ ID NO: 315086 - RNA, 21 nt, Human
agcauuucauuugcacaucuu

SEQ ID NO: 315087 - RNA, 32 nt, Human
agcauuucccacccuccaucuaccccuuccag

SEQ ID NO: 315088 - RNA, 32 nt, Human
agcauuucccuuuuccccuccuuugccuuuca

SEQ ID NO: 315089 - RNA, 23 nt, Human
agcauuucuacuccuuccaagaa

SEQ ID NO: 315090 - RNA, 32 nt, Human
agcauuucugaacaaaugaaacucuucuccau

SEQ ID NO: 315091 - RNA, 32 nt, Human
agcauuucugcaaagcucacacuuguuucacc

SEQ ID NO: 315092 - RNA, 32 nt, Human
agcauuucuguuaggauauuuagauggagguu

SEQ ID NO: 315093 - RNA, 32 nt, Human
agcauuucuuuagcccacaaguccagacccag

SEQ ID NO: 315094 - RNA, 32 nt, Human
agcauuugacaugcauuuuaacuuuuugguuc

SEQ ID NO: 315095 - RNA, 32 nt, Human
agcauuugcagagccuagcacagcauuaggcc

SEQ ID NO: 315096 - RNA, 32 nt, Human
agcauuugcagcguucggggcagggccacucg

SEQ ID NO: 315097 - RNA, 32 nt, Human
agcauuuggaaguaacaggaccucuuucuagc

SEQ ID NO: 315098 - RNA, 32 nt, Human
agcauuuggaauuggaauuuccuaggaauauc

SEQ ID NO: 315099 - RNA, 32 nt, Human
agcauuuggcucugcugcccccaaggggacag

SEQ ID NO: 315100 - RNA, 29 nt, Human
agcauuuggcugcuuuuuccuucacguuc

SEQ ID NO: 315101 - RNA, 32 nt, Human
agcauuuggcugcuuuuuccuucacguucacu

SEQ ID NO: 315102 - RNA, 23 nt, Human
agcauuuguaauaaugcuaaaaa

SEQ ID NO: 315103 - RNA, 23 nt, Human
agcauuugucucccaccucauca

SEQ ID NO: 315104 - RNA, 32 nt, Human
agcauuuuaaaccauuuguuuuuaaaauuaau

SEQ ID NO: 315105 - RNA, 32 nt, Human
agcauuuuaaagaggcgguugcaggacucuga

SEQ ID NO: 315106 - RNA, 32 nt, Human
agcauuuuaguuugaaccaggcauuguguuag

SEQ ID NO: 315107 - RNA, 32 nt, Human
agcauuuuccuugagcuaaauaccuaauaacc

SEQ ID NO: 315108 - RNA, 32 nt, Human
agcauuuucuuccucaccuuuggaaaguaaaa

SEQ ID NO: 315109 - RNA, 32 nt, Human
agcauuuugcucaugcugcagucccuggucug

SEQ ID NO: 315110 - RNA, 32 nt, Human
agccaaaaacagagacagggaagaacucauug

SEQ ID NO: 315111 - RNA, 32 nt, Human
agccaaaaucaaauagcuugggagacuggaca

SEQ ID NO: 315112 - RNA, 32 nt, Human
agccaaaaucucaagaaauucccagcagguua

SEQ ID NO: 315113 - RNA, 32 nt, Human
agccaaacacauaacaauaaaaaccaaacucu

SEQ ID NO: 315114 - RNA, 32 nt, Human
agccaaaccucaccaacuccuaguucuagaaa

SEQ ID NO: 315115 - RNA, 32 nt, Human
agccaaaccucagggcccggugcaguguccag

SEQ ID NO: 315116 - RNA, 22 nt, Human
agccaaacggaguggaguucug

SEQ ID NO: 315117 - RNA, 18 nt, Human
agccaaacuagaccacca

SEQ ID NO: 315118 - RNA, 20 nt, Human
agccaaacucugccagccac

SEQ ID NO: 315119 - RNA, 32 nt, Human
agccaaagaagagauuuguauugcugagcuca

SEQ ID NO: 315120 - RNA, 32 nt, Human
agccaaagaggaagguuagguuggcuugucga

SEQ ID NO: 315121 - RNA, 32 nt, Human
agccaaagaggaggaggcaggagaagcaggca

SEQ ID NO: 315122 - RNA, 32 nt, Human
agccaaagcacaagacaaacacaaagucuugc

SEQ ID NO: 315123 - RNA, 32 nt, Human
agccaaagcccaccuucuccucagccugagcu

SEQ ID NO: 315124 - RNA, 32 nt, Human
agccaaagcccuguuugagaaggugaagaagu

SEQ ID NO: 315125 - RNA, 32 nt, Human
agccaaagccuucugugccaguccugugcuag

SEQ ID NO: 315126 - RNA, 22 nt, Human
agccaaagcggcggccccaggg

SEQ ID NO: 315127 - RNA, 32 nt, Human
agccaaaggagagugcauggaggacaauccug

SEQ ID NO: 315128 - RNA, 32 nt, Human
agccaaaggccgugccugguggggcggacgga

SEQ ID NO: 315129 - RNA, 32 nt, Human
agccaaaggccuggggcuuccuuggcucuucu

SEQ ID NO: 315130 - RNA, 32 nt, Human
agccaaaggcgcugucccagacuguccccagc

SEQ ID NO: 315131 - RNA, 32 nt, Human
agccaaagguagagacagggaggacagggcca

SEQ ID NO: 315132 - RNA, 32 nt, Human
agccaaaguaaacacauuuccaggaauagaag

SEQ ID NO: 315133 - RNA, 22 nt, Human
agccaaaguuaaauguaucaca

SEQ ID NO: 315134 - RNA, 32 nt, Human
agccaaaguuaugcaagggacuguguguugcc

SEQ ID NO: 315135 - RNA, 32 nt, Human
agccaaaguugaguacucuggacaccagaaua

SEQ ID NO: 315136 - RNA, 32 nt, Human
agccaaauuuucugucggucuaagaagacaua

SEQ ID NO: 315137 - RNA, 32 nt, Human
agccaacacaguuagaucagagaaagcaauug

SEQ ID NO: 315138 - RNA, 32 nt, Human
agccaacaccaaaacccagcaugugaaguuac

SEQ ID NO: 315139 - RNA, 32 nt, Human
agccaacaguguugucaggaaucugagguccu

SEQ ID NO: 315140 - RNA, 32 nt, Human
agccaacaucgugaaaccccaucucuacuaaa

SEQ ID NO: 315141 - RNA, 32 nt, Human
agccaacaucucccgcaggacccccuaaucuu

SEQ ID NO: 315142 - RNA, 32 nt, Human
agccaacaugcugaaacuccaucucuacuaaa

SEQ ID NO: 315143 - RNA, 32 nt, Human
agccaacauggcaaaaccccaucucuacuaaa

SEQ ID NO: 315144 - RNA, 32 nt, Human
agccaacauggugaaaacccaucuguacuaaa

SEQ ID NO: 315145 - RNA, 32 nt, Human
agccaacauggugaaaacccugucucuacuaa

SEQ ID NO: 315146 - RNA, 32 nt, Human
agccaacauggugaaaccccaucuguacuaaa

SEQ ID NO: 315147 - RNA, 32 nt, Human
agccaacauggugaaacccccgucucgacuaa

SEQ ID NO: 315148 - RNA, 32 nt, Human
agccaacauggugaaaccccgucucuauuaaa

SEQ ID NO: 315149 - RNA, 32 nt, Human
agccaacauggugaaaccccgucucuucuaaa

SEQ ID NO: 315150 - RNA, 32 nt, Human
agccaacauggugaaaccucgccucuacuaaa

SEQ ID NO: 315151 - RNA, 28 nt, Human
agccaacauggugaaaucccaucucuac

SEQ ID NO: 315152 - RNA, 32 nt, Human
agccaacauggugaacuaccaucucuacuaaa

SEQ ID NO: 315153 - RNA, 32 nt, Human
agccaacaugguguaaacacugucucuacuaa

SEQ ID NO: 315154 - RNA, 22 nt, Human
agccaacauuuucauuuccacc

SEQ ID NO: 315155 - RNA, 24 nt, Human
agccaaccaaagugcugggauuac

SEQ ID NO: 315156 - RNA, 24 nt, Human
agccaaccacauuuuccuuuggga

SEQ ID NO: 315157 - RNA, 22 nt, Human
agccaaccacuuucaccuggga

SEQ ID NO: 315158 - RNA, 32 nt, Human
agccaaccauggucuucagacccuacguuaau

SEQ ID NO: 315159 - RNA, 32 nt, Human
agccaacccugcccucuuccuccccugucccc

SEQ ID NO: 315160 - RNA, 32 nt, Human
agccaacccugcugcucucugccuccuuuaaa

SEQ ID NO: 315161 - RNA, 32 nt, Human
agccaaccucuccugccacccccacaccaaga

SEQ ID NO: 315162 - RNA, 32 nt, Human
agccaacgucaucugcucuucaguuccucacu

SEQ ID NO: 315163 - RNA, 26 nt, Human
agccaacguggugaaaccucaucucu

SEQ ID NO: 315164 - RNA, 32 nt, Human
agccaacuccaaccaacuucugacccccaacu

SEQ ID NO: 315165 - RNA, 32 nt, Human
agccaacuccaaugcguagugcucauuuugga

SEQ ID NO: 315166 - RNA, 32 nt, Human
agccaacucugggaauacaggggugaaagggg

SEQ ID NO: 315167 - RNA, 32 nt, Human
agccaacugcaacuuaguggcucuguuuguau

SEQ ID NO: 315168 - RNA, 20 nt, Human
agccaacugccagugcuaga

SEQ ID NO: 315169 - RNA, 32 nt, Human
agccaacugcucacucgcucaccucccuccuu

SEQ ID NO: 315170 - RNA, 22 nt, Human
agccaacugcuuuuugugcggu

SEQ ID NO: 315171 - RNA, 32 nt, Human
agccaacuucaugucugagugcacgagcagca

SEQ ID NO: 315172 - RNA, 32 nt, Human
agccaacuugcaaauagaaaacucagugaugc

SEQ ID NO: 315173 - RNA, 18 nt, Human
agccaagaaacacugccu

SEQ ID NO: 315174 - RNA, 23 nt, Human
agccaagaaagcccaccucuccu

SEQ ID NO: 315175 - RNA, 32 nt, Human
agccaagaaggaacuuucccacacuacugaau

SEQ ID NO: 315176 - RNA, 19 nt, Human
agccaagaaguuggucuua

SEQ ID NO: 315177 - RNA, 32 nt, Human
agccaagaauugccacugcaccugagauaagg

SEQ ID NO: 315178 - RNA, 32 nt, Human
agccaagacaaggugcaggcagugaguccugc

SEQ ID NO: 315179 - RNA, 32 nt, Human
agccaagacaguggcagcaaaggaagacuugg

SEQ ID NO: 315180 - RNA, 32 nt, Human
agccaagacauuugaccuuugacauuugaccu

SEQ ID NO: 315181 - RNA, 32 nt, Human
agccaagaccugaggguggaaguguccucuua

SEQ ID NO: 315182 - RNA, 32 nt, Human
agccaagacgccauugcaccccagccugggca

SEQ ID NO: 315183 - RNA, 23 nt, Human
agccaagacuaugccacugcacu

SEQ ID NO: 315184 - RNA, 32 nt, Human
agccaagagaccagagagucccugccacuagu

SEQ ID NO: 315185 - RNA, 32 nt, Human
agccaagagacuagcagagaagguacguuagc

SEQ ID NO: 315186 - RNA, 32 nt, Human
agccaagagccuucccuugaaguccccaagca

SEQ ID NO: 315187 - RNA, 32 nt, Human
agccaagauaagauccacacacacauuauuaa

SEQ ID NO: 315188 - RNA, 32 nt, Human
agccaagaucacaccacugaccucuagccugg

SEQ ID NO: 315189 - RNA, 23 nt, Human
agccaagaucacaccacugcacu

SEQ ID NO: 315190 - RNA, 23 nt, Human
agccaagaucacaccacuggcac

SEQ ID NO: 315191 - RNA, 32 nt, Human
agccaagaucacaccacuggcacuccagccug

SEQ ID NO: 315192 - RNA, 32 nt, Human
agccaagaucacgccacugaacuccagccugg

SEQ ID NO: 315193 - RNA, 23 nt, Human
agccaagaucacgccauuguacu

SEQ ID NO: 315194 - RNA, 32 nt, Human
agccaagaucauaccacggcacuccagccugg

SEQ ID NO: 315195 - RNA, 32 nt, Human
agccaagaucauaccacugcacugcagccuga

SEQ ID NO: 315196 - RNA, 32 nt, Human
agccaagaucauaccauugcacuccagccugg

SEQ ID NO: 315197 - RNA, 32 nt, Human
agccaagaucauacuacugcacuccagccugg

SEQ ID NO: 315198 - RNA, 32 nt, Human
agccaagaucgcaccacugaacuccagccugg

SEQ ID NO: 315199 - RNA, 23 nt, Human
agccaagaucgcgccacugcacu

SEQ ID NO: 315200 - RNA, 23 nt, Human
agccaagaucgcgccauugcacu

SEQ ID NO: 315201 - RNA, 32 nt, Human
agccaagaucguaccacugcacuccagccugg

SEQ ID NO: 315202 - RNA, 32 nt, Human
agccaagaucguaccacugcacuccagucugg

SEQ ID NO: 315203 - RNA, 32 nt, Human
agccaagaucguaccacugcacucuggccugg

SEQ ID NO: 315204 - RNA, 23 nt, Human
agccaagaucgugccauugcacu

SEQ ID NO: 315205 - RNA, 23 nt, Human
agccaagaucgugccccugcacu

SEQ ID NO: 315206 - RNA, 23 nt, Human
agccaagaucgugccucugcacu

SEQ ID NO: 315207 - RNA, 23 nt, Human
agccaagaucugccagcccugcc

SEQ ID NO: 315208 - RNA, 32 nt, Human
agccaagaugaaacuccccuuacuucuggcuc

SEQ ID NO: 315209 - RNA, 32 nt, Human
agccaagaugauguaggaccccaaaggugggu

SEQ ID NO: 315210 - RNA, 32 nt, Human
agccaagauggugaaaccccaucucuacuaaa

SEQ ID NO: 315211 - RNA, 32 nt, Human
agccaagauggugaaaccccgucucuaguaaa

SEQ ID NO: 315212 - RNA, 32 nt, Human
agccaagauugcaccaccacacuccagccugg

SEQ ID NO: 315213 - RNA, 32 nt, Human
agccaagauugcaccauugaacuccagccugg

SEQ ID NO: 315214 - RNA, 23 nt, Human
agccaagauugcgccacugcacu

SEQ ID NO: 315215 - RNA, 23 nt, Human
agccaagauuguaccacugcacu

SEQ ID NO: 315216 - RNA, 32 nt, Human
agccaagauuguaccacugcacuccaaccugg

SEQ ID NO: 315217 - RNA, 32 nt, Human
agccaagauuguaccacugcacuccagccugg

SEQ ID NO: 315218 - RNA, 32 nt, Human
agccaagauuguaccacugcacuccaguuugg

SEQ ID NO: 315219 - RNA, 32 nt, Human
agccaagauuguaccacuguacuccagccugg

SEQ ID NO: 315220 - RNA, 32 nt, Human
agccaagauugugccaccacacuccagccugg

SEQ ID NO: 315221 - RNA, 32 nt, Human
agccaagauugugccacugaacucuagccugg

SEQ ID NO: 315222 - RNA, 22 nt, Human
agccaagauuucaccaccgccu

SEQ ID NO: 315223 - RNA, 32 nt, Human
agccaagauuuucuugccuccugggcucccuc

SEQ ID NO: 315224 - RNA, 32 nt, Human
agccaagcaaagccaagaaagccaguccaagg

SEQ ID NO: 315225 - RNA, 32 nt, Human
agccaagcaacccccuaaacauucauaucuag

SEQ ID NO: 315226 - RNA, 32 nt, Human
agccaagcacugccacgguccuccaggaccug

SEQ ID NO: 315227 - RNA, 32 nt, Human
agccaagcagaugucaguaccaugcuuguaca

SEQ ID NO: 315228 - RNA, 32 nt, Human
agccaagcagcccuucaaguucuuuuauuucu

SEQ ID NO: 315229 - RNA, 32 nt, Human
agccaagcaguuccauuuacagcucuguuuuu

SEQ ID NO: 315230 - RNA, 32 nt, Human
agccaagcaguuucuuucaaagaagccagcag

SEQ ID NO: 315231 - RNA, 32 nt, Human
agccaagcaucgcauccccugugauuugcacg

SEQ ID NO: 315232 - RNA, 19 nt, Human
agccaagcaucuggccuga

SEQ ID NO: 315233 - RNA, 17 nt, Human
agccaagccagccccac

SEQ ID NO: 315234 - RNA, 32 nt, Human
agccaagcccacaucccuccuugggcagggca

SEQ ID NO: 315235 - RNA, 32 nt, Human
agccaagcccaggcaucaggaggcuguuauga

SEQ ID NO: 315236 - RNA, 19 nt, Human
agccaagccugcauguaca

SEQ ID NO: 315237 - RNA, 32 nt, Human
agccaagcgcggacgguagccacccaguucau

SEQ ID NO: 315238 - RNA, 32 nt, Human
agccaagcgcgugccauuucacuccagccugg

SEQ ID NO: 315239 - RNA, 18 nt, Human
agccaagcuaauguggua

SEQ ID NO: 315240 - RNA, 32 nt, Human
agccaagcuacaaauuaaauccucagccugga

SEQ ID NO: 315241 - RNA, 32 nt, Human
agccaagcucaaggauggaagugcaguuaggg

SEQ ID NO: 315242 - RNA, 32 nt, Human
agccaagcuggccgagguugcaguccaugagc

SEQ ID NO: 315243 - RNA, 32 nt, Human
agccaagcuguugcaagacagaguggcuacaa

SEQ ID NO: 315244 - RNA, 32 nt, Human
agccaagcuuucuccccacccucugugggcca

SEQ ID NO: 315245 - RNA, 32 nt, Human
agccaaggaaaaagauacaagagcagaauagu

SEQ ID NO: 315246 - RNA, 19 nt, Human
agccaaggaaaagcuacac

SEQ ID NO: 315247 - RNA, 32 nt, Human
agccaaggaaaaggagucuggaagggagauga

SEQ ID NO: 315248 - RNA, 32 nt, Human
agccaaggaaaauauuguggauuuaauauuug

SEQ ID NO: 315249 - RNA, 32 nt, Human
agccaaggaaacacugauuuugcugcugaaga

SEQ ID NO: 315250 - RNA, 19 nt, Human
agccaaggagccccaggga

SEQ ID NO: 315251 - RNA, 32 nt, Human
agccaaggaggugaggagcagagcaggcaauu

SEQ ID NO: 315252 - RNA, 32 nt, Human
agccaaggagugcaccacugcacuccagccug

SEQ ID NO: 315253 - RNA, 23 nt, Human
agccaaggcaggcguguguggua

SEQ ID NO: 315254 - RNA, 32 nt, Human
agccaaggcccaccaaggaguuuuccacccgu

SEQ ID NO: 315255 - RNA, 32 nt, Human
agccaaggccuggagggcuggagccagaagca

SEQ ID NO: 315256 - RNA, 18 nt, Human
agccaaggccuguguggu

SEQ ID NO: 315257 - RNA, 32 nt, Human
agccaaggcgggugcuggaagccagacggaac

SEQ ID NO: 315258 - RNA, 32 nt, Human
agccaaggcuaguggcuggguuacugauggau

SEQ ID NO: 315259 - RNA, 32 nt, Human
agccaaggcugaaccuccucagaagagcaacu

SEQ ID NO: 315260 - RNA, 32 nt, Human
agccaagggaaagugggcugcugagagcauag

SEQ ID NO: 315261 - RNA, 32 nt, Human
agccaagggacagugccauccuuggggacagg

SEQ ID NO: 315262 - RNA, 32 nt, Human
agccaagggcagcaggggcugcuccuggugag

SEQ ID NO: 315263 - RNA, 32 nt, Human
agccaaggguggaggcuucaggucuccagcuu

SEQ ID NO: 315264 - RNA, 32 nt, Human
agccaagguagccaaguacgagagggacacac

SEQ ID NO: 315265 - RNA, 32 nt, Human
agccaaggucauaccagugcacuccaggcggg

SEQ ID NO: 315266 - RNA, 23 nt, Human
agccaaggucaugccacugcacu

SEQ ID NO: 315267 - RNA, 32 nt, Human
agccaaggucauggugcucagccaaggaacac

SEQ ID NO: 315268 - RNA, 32 nt, Human
agccaagguggccuguccaguccuggugcugu

SEQ ID NO: 315269 - RNA, 32 nt, Human
agccaaguacuacagcccugggggugucacac

SEQ ID NO: 315270 - RNA, 26 nt, Human
agccaagucccuuccauuccuuucca

SEQ ID NO: 315271 - RNA, 32 nt, Human
agccaagugugguagagugugccugaaguccc

SEQ ID NO: 315272 - RNA, 32 nt, Human
agccaaguucaaggaagcagccuggcuaaagc

SEQ ID NO: 315273 - RNA, 22 nt, Human
agccaaguuucucccugccuca

SEQ ID NO: 315274 - RNA, 32 nt, Human
agccaauaacaugacaggagcugggacugguu

SEQ ID NO: 315275 - RNA, 32 nt, Human
agccaauauacccaguuuuuacucaguuugau

SEQ ID NO: 315276 - RNA, 32 nt, Human
agccaauauggugaaaccccgucucuacuaaa

SEQ ID NO: 315277 - RNA, 32 nt, Human
agccaaucacgucgccgcgguccugguucuaa

SEQ ID NO: 315278 - RNA, 32 nt, Human
agccaaucaguagccagcaucugccuccccuu

SEQ ID NO: 315279 - RNA, 32 nt, Human
agccaaucccccagagacuucgagaucagcca

SEQ ID NO: 315280 - RNA, 20 nt, Human
agccaauccuuugugcagug

SEQ ID NO: 315281 - RNA, 32 nt, Human
agccaaucuccaagccuccaaacggaacguca

SEQ ID NO: 315282 - RNA, 32 nt, Human
agccaaugacaacucacucuccccuacuccac

SEQ ID NO: 315283 - RNA, 32 nt, Human
agccaaugacaccuuccaucuuuccagcuaug

SEQ ID NO: 315284 - RNA, 32 nt, Human
agccaaugacaggugaaacccagacacucucc

SEQ ID NO: 315285 - RNA, 32 nt, Human
agccaaugaggguaaauguacuauguugcuaa

SEQ ID NO: 315286 - RNA, 32 nt, Human
agccaaugaguuggaggcugcagugagcuaua

SEQ ID NO: 315287 - RNA, 21 nt, Human
agccaaugccuuuguguggua

SEQ ID NO: 315288 - RNA, 32 nt, Human
agccaaugcuaagcauucacacacaaccagaa

SEQ ID NO: 315289 - RNA, 32 nt, Human
agccaauggaaaaucuggguucaaccagcccc

SEQ ID NO: 315290 - RNA, 32 nt, Human
agccaauggagacugucucaagagggcacugg

SEQ ID NO: 315291 - RNA, 32 nt, Human
agccaauggagggagagggagcgucagaagcc

SEQ ID NO: 315292 - RNA, 32 nt, Human
agccaaugguauagacugccucuggggaagca

SEQ ID NO: 315293 - RNA, 16 nt, Human
agccaaugucaugugg

SEQ ID NO: 315294 - RNA, 17 nt, Human
agccaaugugcgugugg

SEQ ID NO: 315295 - RNA, 32 nt, Human
agccaauguguggcucagugccuggacaaaug

SEQ ID NO: 315296 - RNA, 32 nt, Human
agccaauguuaggaauguuuaaaggcagcugc

SEQ ID NO: 315297 - RNA, 32 nt, Human
agccaauuuagugaaaccccaucucuacuaaa

SEQ ID NO: 315298 - RNA, 32 nt, Human
agccaauuucacccucuccucccccugccaac

SEQ ID NO: 315299 - RNA, 32 nt, Human
agccacaaacuccauccagauccggaacguca

SEQ ID NO: 315300 - RNA, 32 nt, Human
agccacaaagugaaagggagugaggcggcgug

SEQ ID NO: 315301 - RNA, 18 nt, Human
agccacaacacccagcca

SEQ ID NO: 315302 - RNA, 32 nt, Human
agccacaagcgcaaucaugcuuuucaaugacc

SEQ ID NO: 315303 - RNA, 32 nt, Human
agccacaaucagaaaaaggacaaggacaugag

SEQ ID NO: 315304 - RNA, 18 nt, Human
agccacacacccagggcc

SEQ ID NO: 315305 - RNA, 32 nt, Human
agccacacacugugcauacacgcacaccccac

SEQ ID NO: 315306 - RNA, 32 nt, Human
agccacacagcccagaaggccagaaaaggcag

SEQ ID NO: 315307 - RNA, 32 nt, Human
agccacacagcccgggccacugucaggaugag

SEQ ID NO: 315308 - RNA, 32 nt, Human
agccacacagccgccuucuggcccaacacucu

SEQ ID NO: 315309 - RNA, 18 nt, Human
agccacacagcgagguca

SEQ ID NO: 315310 - RNA, 23 nt, Human
agccacacaggaguccugggcac

SEQ ID NO: 315311 - RNA, 32 nt, Human
agccacacagucagagggggauguaagagcca

SEQ ID NO: 315312 - RNA, 32 nt, Human
agccacacaugggcaucuaugggagaguguca

SEQ ID NO: 315313 - RNA, 32 nt, Human
agccacacauucccugaccacagggaagcacc

SEQ ID NO: 315314 - RNA, 32 nt, Human
agccacaccacaccugcacuucugccucacuu

SEQ ID NO: 315315 - RNA, 32 nt, Human
agccacaccaccugugacuccagcucugacuu

SEQ ID NO: 315316 - RNA, 32 nt, Human
agccacaccaugacacaaucuugaagaggaag

SEQ ID NO: 315317 - RNA, 32 nt, Human
agccacaccgucccucugggccugcuggcucc

SEQ ID NO: 315318 - RNA, 32 nt, Human
agccacaccuccacuugccucuuauugucuua

SEQ ID NO: 315319 - RNA, 32 nt, Human
agccacacgaagaccaaagugaagagcaagga

SEQ ID NO: 315320 - RNA, 19 nt, Human
agccacacgcuucauggcc

SEQ ID NO: 315321 - RNA, 32 nt, Human
agccacacucaucagcuguggugaggcggcug

SEQ ID NO: 315322 - RNA, 23 nt, Human
agccacacucauucauccuuucc

SEQ ID NO: 315323 - RNA, 32 nt, Human
agccacacugcacuguggccccuugggaagag

SEQ ID NO: 315324 - RNA, 32 nt, Human
agccacacuguggcuagauuauacuucuuugg

SEQ ID NO: 315325 - RNA, 22 nt, Human
agccacagaaacgggcucgcuc

SEQ ID NO: 315326 - RNA, 32 nt, Human
agccacagaagauacacuuccgcaagauaucu

SEQ ID NO: 315327 - RNA, 32 nt, Human
agccacagaaggcugcggagugaggcggcagc

SEQ ID NO: 315328 - RNA, 32 nt, Human
agccacagacagacacugucuccucucagaga

SEQ ID NO: 315329 - RNA, 32 nt, Human
agccacagacuugccaguuccuucccucuuuc

SEQ ID NO: 315330 - RNA, 32 nt, Human
agccacagagggcugugagcuugcccagcccc

SEQ ID NO: 315331 - RNA, 32 nt, Human
agccacagaguacaccuuuccuucccugcaua

SEQ ID NO: 315332 - RNA, 32 nt, Human
agccacagaguugaaagccacagaguuaagug

SEQ ID NO: 315333 - RNA, 32 nt, Human
agccacagaguugaaagccacagaguugaaag

SEQ ID NO: 315334 - RNA, 32 nt, Human
agccacagcacaaucaucucaguggcgaagca

SEQ ID NO: 315335 - RNA, 32 nt, Human
agccacagcacuccagccugggugacagagca

SEQ ID NO: 315336 - RNA, 32 nt, Human
agccacagccagcagauagaggaaaagacaca

SEQ ID NO: 315337 - RNA, 32 nt, Human
agccacagccagccugccauaggauccaacug

SEQ ID NO: 315338 - RNA, 32 nt, Human
agccacagccccagcagccacccuccacccag

SEQ ID NO: 315339 - RNA, 19 nt, Human
agccacagccuccagggac

SEQ ID NO: 315340 - RNA, 32 nt, Human
agccacagcucagcuaaggcaauccaguccag

SEQ ID NO: 315341 - RNA, 32 nt, Human
agccacagcucccugcugguuccgcccuggau

SEQ ID NO: 315342 - RNA, 20 nt, Human
agccacagcugucucuggga

SEQ ID NO: 315343 - RNA, 32 nt, Human
agccacaggaacaggccccguccaccgccucc

SEQ ID NO: 315344 - RNA, 32 nt, Human
agccacaggaagagaaggaagaccagcgcaug

SEQ ID NO: 315345 - RNA, 32 nt, Human
agccacaggaagcaaaagucagccuuuucuuc

SEQ ID NO: 315346 - RNA, 32 nt, Human
agccacaggaagggaaguagacauuguaugcu

SEQ ID NO: 315347 - RNA, 32 nt, Human
agccacagggacgagcuccagagcagaaaggc

SEQ ID NO: 315348 - RNA, 32 nt, Human
agccacagggaggcauggagugccauggaagg

SEQ ID NO: 315349 - RNA, 32 nt, Human
agccacaggggcccugcggggagcacauccuc

SEQ ID NO: 315350 - RNA, 32 nt, Human
agccacaggguuucaccguguuggccaggaug

SEQ ID NO: 315351 - RNA, 32 nt, Human
agccacagguuggccaagcacccucgagugcc

SEQ ID NO: 315352 - RNA, 32 nt, Human
agccacagugcagaggagaggugggcuaucug

SEQ ID NO: 315353 - RNA, 32 nt, Human
agccacagugccuggcccauucuugaguuuug

SEQ ID NO: 315354 - RNA, 32 nt, Human
agccacauccagggguccucauuucuccggcu

SEQ ID NO: 315355 - RNA, 32 nt, Human
agccacauccuccaguccaucuggacuagcaa

SEQ ID NO: 315356 - RNA, 21 nt, Human
agccacaucgcugccuuguuc

SEQ ID NO: 315357 - RNA, 32 nt, Human
agccacaucugcaaagcagggaugguccagau

SEQ ID NO: 315358 - RNA, 22 nt, Human
agccacaugcuuggcuguguca

SEQ ID NO: 315359 - RNA, 32 nt, Human
agccacauucugaagccguccucugcccaccu

SEQ ID NO: 315360 - RNA, 32 nt, Human
agccacauugcucucuccuaagccccaacccc

SEQ ID NO: 315361 - RNA, 32 nt, Human
agccacauuuaacuccagccuuggguuugacc

SEQ ID NO: 315362 - RNA, 32 nt, Human
agccacauuuuccuccuuuguguuaggggaca

SEQ ID NO: 315363 - RNA, 32 nt, Human
agccaccaaaauagcugggauuacaggcgccc

SEQ ID NO: 315364 - RNA, 32 nt, Human
agccaccaagagaggaaggagaagggucccgu

SEQ ID NO: 315365 - RNA, 32 nt, Human
agccaccaagaguucuccaccacucuugcauu

SEQ ID NO: 315366 - RNA, 32 nt, Human
agccaccaagcuauguggcugcugcugccacc

SEQ ID NO: 315367 - RNA, 31 nt, Human
agccaccaagugucuccacaucggagcuugc

SEQ ID NO: 315368 - RNA, 32 nt, Human
agccaccaaguucccagaugucaguuuugcaa

SEQ ID NO: 315369 - RNA, 32 nt, Human
agccaccaaguugcccauugaugggugagccu

SEQ ID NO: 315370 - RNA, 21 nt, Human
agccaccacaccuggccacuc

SEQ ID NO: 315371 - RNA, 32 nt, Human
agccaccaccaucugcgacuccugccugccgc

SEQ ID NO: 315372 - RNA, 20 nt, Human
agccaccacccucucuggga

SEQ ID NO: 315373 - RNA, 32 nt, Human
agccaccacgcccaacugggaccaggguuuuc

SEQ ID NO: 315374 - RNA, 20 nt, Human
agccaccacgcccggccuaa

SEQ ID NO: 315375 - RNA, 32 nt, Human
agccaccacgccuggccaauuauguaauuuuu

SEQ ID NO: 315376 - RNA, 32 nt, Human
agccaccagagcugcagcaggagcagcagaag

SEQ ID NO: 315377 - RNA, 32 nt, Human
agccaccagaguagcugagacuacagggguau

SEQ ID NO: 315378 - RNA, 32 nt, Human
agccaccagccaaugaucuuuucaaugcugcg

SEQ ID NO: 315379 - RNA, 32 nt, Human
agccaccagcggcugcucauggggcugauggu

SEQ ID NO: 315380 - RNA, 32 nt, Human
agccaccagcuauuuccuggugacacaagcuc

SEQ ID NO: 315381 - RNA, 32 nt, Human
agccaccagcuggccugguuggcucuggauuu

SEQ ID NO: 315382 - RNA, 26 nt, Human
agccaccaggcccugccugguuuuca

SEQ ID NO: 315383 - RNA, 31 nt, Human
agccaccagggaccuguuucaggcugugggc

SEQ ID NO: 315384 - RNA, 32 nt, Human
agccaccagggaccuguuucaggcugugggca

SEQ ID NO: 315385 - RNA, 16 nt, Human
agccaccagggccuaa

SEQ ID NO: 315386 - RNA, 32 nt, Human
agccaccaucguaccacugcacuccagccugg

SEQ ID NO: 315387 - RNA, 21 nt, Human
agccaccaucuuaccucacag

SEQ ID NO: 315388 - RNA, 32 nt, Human
agccaccaugcaguucugccuggguuggaguu

SEQ ID NO: 315389 - RNA, 19 nt, Human
agccaccaugcccagccug

SEQ ID NO: 315390 - RNA, 32 nt, Human
agccaccaugucugguccucugacccuuuuag

SEQ ID NO: 315391 - RNA, 32 nt, Human
agccaccauucaaagccaggcagucuggcccc

SEQ ID NO: 315392 - RNA, 20 nt, Human
agccaccauucugcuugcca

SEQ ID NO: 315393 - RNA, 25 nt, Human
agccaccauugccaccuacugcagc

SEQ ID NO: 315394 - RNA, 32 nt, Human
agccaccauuuuguccaagccugggcaugggu

SEQ ID NO: 315395 - RNA, 32 nt, Human
agccacccaaaaugcugggauuacaggcauga

SEQ ID NO: 315396 - RNA, 32 nt, Human
agccacccaaagugcuggaauuacauggguga

SEQ ID NO: 315397 - RNA, 32 nt, Human
agccacccaaaguguugggauuacaggcauga

SEQ ID NO: 315398 - RNA, 32 nt, Human
agccacccaaaguguugggauuacagguguga

SEQ ID NO: 315399 - RNA, 32 nt, Human
agccacccaacgucaccuccagcccggucuca

SEQ ID NO: 315400 - RNA, 32 nt, Human
agccacccaagaagcugggaccacagggauca

SEQ ID NO: 315401 - RNA, 32 nt, Human
agccacccaaguagcuggaauuacaggcaccu

SEQ ID NO: 315402 - RNA, 32 nt, Human
agccacccaaguagcugggaccacaggugcau

SEQ ID NO: 315403 - RNA, 32 nt, Human
agccacccaaguagcugggacuacaggugccc

SEQ ID NO: 315404 - RNA, 20 nt, Human
agccacccagcagggcccgu

SEQ ID NO: 315405 - RNA, 21 nt, Human
agccacccagccucagcacuc

SEQ ID NO: 315406 - RNA, 32 nt, Human
agccacccaggcagggagcaaguggccugguc

SEQ ID NO: 315407 - RNA, 32 nt, Human
agccacccaggcagggcaggggccaagguaag

SEQ ID NO: 315408 - RNA, 32 nt, Human
agccacccaggcucccaccacucucauaccug

SEQ ID NO: 315409 - RNA, 32 nt, Human
agccacccaucaggcaugcucucccccaccuc

SEQ ID NO: 315410 - RNA, 21 nt, Human
agccaccccagcgccaggcgc

SEQ ID NO: 315411 - RNA, 24 nt, Human
agccacccccaccccaacacacuc

SEQ ID NO: 315412 - RNA, 21 nt, Human
agccacccccagccccaccac

SEQ ID NO: 315413 - RNA, 24 nt, Human
agccaccccccugcccccacucca

SEQ ID NO: 315414 - RNA, 32 nt, Human
agccaccccguccgcagccaggaaaagcacaa

SEQ ID NO: 315415 - RNA, 23 nt, Human
agccaccccuaccccagucacuc

SEQ ID NO: 315416 - RNA, 32 nt, Human
agccaccccucuguaaccuccauaauccauca

SEQ ID NO: 315417 - RNA, 22 nt, Human
agccaccccugcccaggcccuc

SEQ ID NO: 315418 - RNA, 32 nt, Human
agccaccccugcccaggcccucacagacauug

SEQ ID NO: 315419 - RNA, 32 nt, Human
agccacccgaguagcugagauuacaggccucu

SEQ ID NO: 315420 - RNA, 21 nt, Human
agccacccgcaccuucacaga

SEQ ID NO: 315421 - RNA, 32 nt, Human
agccacccgccugcuuucaucucccucaaaua

SEQ ID NO: 315422 - RNA, 32 nt, Human
agccacccuaccucccuguccacuacagccuc

SEQ ID NO: 315423 - RNA, 32 nt, Human
agccacccucaccaggugccuuccauuagagu

SEQ ID NO: 315424 - RNA, 20 nt, Human
agccacccucagcccuucac

SEQ ID NO: 315425 - RNA, 23 nt, Human
agccacccucagcccuucacagg

SEQ ID NO: 315426 - RNA, 32 nt, Human
agccacccucaggccugggaagaggccugggc

SEQ ID NO: 315427 - RNA, 21 nt, Human
agccacccucccugcagcuac

SEQ ID NO: 315428 - RNA, 32 nt, Human
agccacccucggagaguccacaacagcagcca

SEQ ID NO: 315429 - RNA, 21 nt, Human
agccacccugccagcugcagc

SEQ ID NO: 315430 - RNA, 32 nt, Human
agccacccugccucucaggggucuguguuggg

SEQ ID NO: 315431 - RNA, 23 nt, Human
agccacccugcuuuagaucacuc

SEQ ID NO: 315432 - RNA, 24 nt, Human
agccacccuggcucccucuccucc

SEQ ID NO: 315433 - RNA, 24 nt, Human
agccacccugugggccgggcaauc

SEQ ID NO: 315434 - RNA, 32 nt, Human
agccaccgacaggacauggccucagcugggug

SEQ ID NO: 315435 - RNA, 32 nt, Human
agccaccgagacugaaccaaacccaggaagcg

SEQ ID NO: 315436 - RNA, 32 nt, Human
agccaccgaggagcagagagguugagaacaac

SEQ ID NO: 315437 - RNA, 32 nt, Human
agccaccgcacuccagccugggcgacagagca

SEQ ID NO: 315438 - RNA, 22 nt, Human
agccaccgccucuugcucacca

SEQ ID NO: 315439 - RNA, 32 nt, Human
agccaccgccugugccugccccucucuggccc

SEQ ID NO: 315440 - RNA, 32 nt, Human
agccaccgcgccuggccgaugguacuauuuag

SEQ ID NO: 315441 - RNA, 32 nt, Human
agccaccgcggggccucagugggggucucugg

SEQ ID NO: 315442 - RNA, 32 nt, Human
agccaccgcucacugcaagcacugccucccuc

SEQ ID NO: 315443 - RNA, 32 nt, Human
agccaccggccucagcccuggagcugaaagug

SEQ ID NO: 315444 - RNA, 20 nt, Human
agccaccgggaccccaggag

SEQ ID NO: 315445 - RNA, 32 nt, Human
agccaccgggcacggccuugccaggcugacgu

SEQ ID NO: 315446 - RNA, 32 nt, Human
agccaccgugaagccucuuauggcuacuauua

SEQ ID NO: 315447 - RNA, 21 nt, Human
agccaccgugcccaggcccuc

SEQ ID NO: 315448 - RNA, 32 nt, Human
agccaccgugccugccccagaaugguuuuuaa

SEQ ID NO: 315449 - RNA, 32 nt, Human
agccaccgugccuggccgaggcuccuucuuuu

SEQ ID NO: 315450 - RNA, 32 nt, Human
agccaccguguuucacaccugccgugcucugg

SEQ ID NO: 315451 - RNA, 32 nt, Human
agccaccuccacuugcuuccuccuccuucccu

SEQ ID NO: 315452 - RNA, 32 nt, Human
agccaccuccagggcagucccagggacugaau

SEQ ID NO: 315453 - RNA, 32 nt, Human
agccaccucccucccaaacuugcccauugccc

SEQ ID NO: 315454 - RNA, 21 nt, Human
agccaccuccuuccucuggga

SEQ ID NO: 315455 - RNA, 32 nt, Human
agccaccuccuuggcaccggccucuauuuguc

SEQ ID NO: 315456 - RNA, 32 nt, Human
agccaccucgccuggccagaugcuagcauuuu

SEQ ID NO: 315457 - RNA, 24 nt, Human
agccaccucgggaccccagcacuc

SEQ ID NO: 315458 - RNA, 21 nt, Human
agccaccucugcaacugcagc

SEQ ID NO: 315459 - RNA, 32 nt, Human
agccaccugacuagcugggauugcagccugca

SEQ ID NO: 315460 - RNA, 32 nt, Human
agccaccugagcagcugggauugcaggugcau

SEQ ID NO: 315461 - RNA, 32 nt, Human
agccaccugagccaccaccgagccauggcagg

SEQ ID NO: 315462 - RNA, 32 nt, Human
agccaccugaguagcagggauuacaggugugu

SEQ ID NO: 315463 - RNA, 32 nt, Human
agccaccugaguagcugggaguacaggcaugu

SEQ ID NO: 315464 - RNA, 32 nt, Human
agccaccugaguagcugggauuacacgcacau

SEQ ID NO: 315465 - RNA, 24 nt, Human
agccaccugaucuccccgggccuc

SEQ ID NO: 315466 - RNA, 32 nt, Human
agccaccugcacuuuucccucacccaccacac

SEQ ID NO: 315467 - RNA, 32 nt, Human
agccaccugcacuuuucccucacccaccacgc

SEQ ID NO: 315468 - RNA, 32 nt, Human
agccaccugccucuggcuucaugugagcuguc

SEQ ID NO: 315469 - RNA, 24 nt, Human
agccaccugccugacacccaggga

SEQ ID NO: 315470 - RNA, 32 nt, Human
agccaccugcuaccucugccuucuggguucaa

SEQ ID NO: 315471 - RNA, 32 nt, Human
agccaccugcuuccuccaccccaccuuccauu

SEQ ID NO: 315472 - RNA, 19 nt, Human
agccaccuggacugaggcg

SEQ ID NO: 315473 - RNA, 32 nt, Human
agccaccugggagcccgaagcuuagccuguag

SEQ ID NO: 315474 - RNA, 32 nt, Human
agccaccuggggauucagcaacagguuuccac

SEQ ID NO: 315475 - RNA, 32 nt, Human
agccaccuggggauucagcaacagguuuucac

SEQ ID NO: 315476 - RNA, 32 nt, Human
agccaccugggggagcuggaagugaucucauc

SEQ ID NO: 315477 - RNA, 21 nt, Human
agccaccuuagcacgaacaua

SEQ ID NO: 315478 - RNA, 32 nt, Human
agccaccuuagcaggagcagauuuuucccaga

SEQ ID NO: 315479 - RNA, 22 nt, Human
agccaccuuccucacagggacu

SEQ ID NO: 315480 - RNA, 32 nt, Human
agccaccuuggcaagugccugugcagggcccg

SEQ ID NO: 315481 - RNA, 32 nt, Human
agccaccuuguccguucagccaugaagacaga

SEQ ID NO: 315482 - RNA, 32 nt, Human
agccacgacagcagccagacccugucccggcc

SEQ ID NO: 315483 - RNA, 32 nt, Human
agccacgaccuccaccuauucaaucuuugcug

SEQ ID NO: 315484 - RNA, 32 nt, Human
agccacgaggggcagacagaggcgccagugcc

SEQ ID NO: 315485 - RNA, 32 nt, Human
agccacgcacccuacucuugcugguaaaauca

SEQ ID NO: 315486 - RNA, 22 nt, Human
agccacgcagcggcugagcuca

SEQ ID NO: 315487 - RNA, 32 nt, Human
agccacgcaggaucucacagcugcagucuaau

SEQ ID NO: 315488 - RNA, 25 nt, Human
agccacgcaugguggcacacaccug

SEQ ID NO: 315489 - RNA, 32 nt, Human
agccacgcgugagacuucucuaagcaaccacc

SEQ ID NO: 315490 - RNA, 32 nt, Human
agccacggagccugggcgaggagccagcgcug

SEQ ID NO: 315491 - RNA, 32 nt, Human
agccacggcucaugccgccgucgccagcggcg

SEQ ID NO: 315492 - RNA, 32 nt, Human
agccacggcucucauugcucgggguugguugg

SEQ ID NO: 315493 - RNA, 18 nt, Human
agccacgggaaccaggag

SEQ ID NO: 315494 - RNA, 32 nt, Human
agccacgggcugggucauaaggacacuucucc

SEQ ID NO: 315495 - RNA, 32 nt, Human
agccacguaaggagcuggggagaggggagucu

SEQ ID NO: 315496 - RNA, 22 nt, Human
agccacgucagcuuuucuggga

SEQ ID NO: 315497 - RNA, 32 nt, Human
agccacgugagcugaucguggcugcaccuggg

SEQ ID NO: 315498 - RNA, 32 nt, Human
agccacguguggcugcuggcugugggagagaa

SEQ ID NO: 315499 - RNA, 32 nt, Human
agccacuaaccagcugggcucugucagcaaag

SEQ ID NO: 315500 - RNA, 32 nt, Human
agccacuagaggcugaggugggaggaucacug

SEQ ID NO: 315501 - RNA, 32 nt, Human
agccacuaucacugcuccccugggcaacugca

SEQ ID NO: 315502 - RNA, 20 nt, Human
agccacuaucccuggccuaa

SEQ ID NO: 315503 - RNA, 32 nt, Human
agccacucagaagaaaaagguuggaguaauac

SEQ ID NO: 315504 - RNA, 32 nt, Human
agccacucagccccagggugcgucaucccuca

SEQ ID NO: 315505 - RNA, 32 nt, Human
agccacuccaacucuccaccuccagcuucuag

SEQ ID NO: 315506 - RNA, 32 nt, Human
agccacuccagccccagcccagccuggggugc

SEQ ID NO: 315507 - RNA, 32 nt, Human
agccacuccagcuuguccugugcugccucccu

SEQ ID NO: 315508 - RNA, 32 nt, Human
agccacucccaguucuggagagugaggaugac

SEQ ID NO: 315509 - RNA, 32 nt, Human
agccacucccauuuuaugagcuacucacauga

SEQ ID NO: 315510 - RNA, 32 nt, Human
agccacucccugucccugucucccugcccauu

SEQ ID NO: 315511 - RNA, 32 nt, Human
agccacuccugggccuuuuaugugccgaguua

SEQ ID NO: 315512 - RNA, 32 nt, Human
agccacucucuugcuuguccccaaaucaccua

SEQ ID NO: 315513 - RNA, 32 nt, Human
agccacucucuuggcucccugugucauuccuu

SEQ ID NO: 315514 - RNA, 32 nt, Human
agccacucuucugagaaggcuuugccuccucg

SEQ ID NO: 315515 - RNA, 32 nt, Human
agccacucuuggaaaaagcacaaccuaacaaa

SEQ ID NO: 315516 - RNA, 32 nt, Human
agccacugaaguauuccccuuuauguacagga

SEQ ID NO: 315517 - RNA, 31 nt, Human
agccacugacuucucucuuuuacguaagaca

SEQ ID NO: 315518 - RNA, 32 nt, Human
agccacugagagagggaaacucugauuuuauu

SEQ ID NO: 315519 - RNA, 32 nt, Human
agccacugagauccuccagccuggacaugcug

SEQ ID NO: 315520 - RNA, 32 nt, Human
agccacugagcccagcccuaguucaguaucuu

SEQ ID NO: 315521 - RNA, 20 nt, Human
agccacugagcccggccuaa

SEQ ID NO: 315522 - RNA, 32 nt, Human
agccacugagccuggcccugaagcguuuuucu

SEQ ID NO: 315523 - RNA, 32 nt, Human
agccacugagccuugugacuugagcagauguc

SEQ ID NO: 315524 - RNA, 23 nt, Human
agccacugcaagcccugggccuc

SEQ ID NO: 315525 - RNA, 32 nt, Human
agccacugcaccucgccagauguccaaugucu

SEQ ID NO: 315526 - RNA, 32 nt, Human
agccacugcaccugaccugcugaauuguuuau

SEQ ID NO: 315527 - RNA, 32 nt, Human
agccacugcaccuggcagugaugucauuccuu

SEQ ID NO: 315528 - RNA, 32 nt, Human
agccacugcaccuggccagcucuagucuuauu

SEQ ID NO: 315529 - RNA, 32 nt, Human
agccacugcaccuggccgguuauucucucuuu

SEQ ID NO: 315530 - RNA, 32 nt, Human
agccacugcaccuggccucaugucucuggauu

SEQ ID NO: 315531 - RNA, 32 nt, Human
agccacugcaccuggccugacauucuuuauga

SEQ ID NO: 315532 - RNA, 32 nt, Human
agccacugcaccuggcggaaucuaguccauuu

SEQ ID NO: 315533 - RNA, 32 nt, Human
agccacugcaccuggcggggucuugcuuauuu

SEQ ID NO: 315534 - RNA, 32 nt, Human
agccacugcacuccaaucugggugacagaaua

SEQ ID NO: 315535 - RNA, 32 nt, Human
agccacugcacuccagcccaggugacagagug

SEQ ID NO: 315536 - RNA, 19 nt, Human
agccacugcacuccagccu

SEQ ID NO: 315537 - RNA, 32 nt, Human
agccacugcacuccagccugaugacagagcaa

SEQ ID NO: 315538 - RNA, 32 nt, Human
agccacugcacuccagccugggcaacagauga

SEQ ID NO: 315539 - RNA, 32 nt, Human
agccacugcacuccagccugggcaacguggug

SEQ ID NO: 315540 - RNA, 32 nt, Human
agccacugcacuccagccugggcaauagagca

SEQ ID NO: 315541 - RNA, 32 nt, Human
agccacugcacuccagccugggcaauauagca

SEQ ID NO: 315542 - RNA, 32 nt, Human
agccacugcacuccagccugggcagcugaaca

SEQ ID NO: 315543 - RNA, 32 nt, Human
agccacugcacuccagccugggcgacagagca

SEQ ID NO: 315544 - RNA, 32 nt, Human
agccacugcacuccagccugggggaaagagcg

SEQ ID NO: 315545 - RNA, 32 nt, Human
agccacugcacuccagccugggugacagagcg

SEQ ID NO: 315546 - RNA, 32 nt, Human
agccacugcacuccagccugggugacagagug

SEQ ID NO: 315547 - RNA, 32 nt, Human
agccacugcacuccagccugggugacagcgcg

SEQ ID NO: 315548 - RNA, 32 nt, Human
agccacugcacuccagccugggugacugagcg

SEQ ID NO: 315549 - RNA, 32 nt, Human
agccacugcacuccagccugggugaugaagac

SEQ ID NO: 315550 - RNA, 32 nt, Human
agccacugcacuccaucuugggcaacacagug

SEQ ID NO: 315551 - RNA, 32 nt, Human
agccacugcacucuagucuggggaacauauga

SEQ ID NO: 315552 - RNA, 32 nt, Human
agccacugcauuccagccugggcgaaagagaa

SEQ ID NO: 315553 - RNA, 32 nt, Human
agccacugccaagcuuccugugcccucacccc

SEQ ID NO: 315554 - RNA, 32 nt, Human
agccacugccacuccaguccugccaccacccu

SEQ ID NO: 315555 - RNA, 32 nt, Human
agccacugcccaaagccaucuuccugccuacu

SEQ ID NO: 315556 - RNA, 32 nt, Human
agccacugcccagccgcacuccaggcaagggc

SEQ ID NO: 315557 - RNA, 32 nt, Human
agccacugcccaggacuaagggucuucaagga

SEQ ID NO: 315558 - RNA, 18 nt, Human
agccacugcgcccggcca

SEQ ID NO: 315559 - RNA, 32 nt, Human
agccacugcgcccggcccaaaucuuuuauuuu

SEQ ID NO: 315560 - RNA, 18 nt, Human
agccacugcgccuggcca

SEQ ID NO: 315561 - RNA, 32 nt, Human
agccacugcgccuggccaucagguaaccuuua

SEQ ID NO: 315562 - RNA, 32 nt, Human
agccacugcggaguccaggcugcuagaggugc

SEQ ID NO: 315563 - RNA, 32 nt, Human
agccacugcuguggcccugcccagggcuuggu

SEQ ID NO: 315564 - RNA, 32 nt, Human
agccacuggagggagaaauggaaaacaugaaa

SEQ ID NO: 315565 - RNA, 29 nt, Human
agccacuggcugcuaacaagucaccaaaa

SEQ ID NO: 315566 - RNA, 32 nt, Human
agccacugggagaagcaggccagagccuucca

SEQ ID NO: 315567 - RNA, 32 nt, Human
agccacugggcucagcccuggagcugagagca

SEQ ID NO: 315568 - RNA, 32 nt, Human
agccacugggcugugggggaaggggucaaggc

SEQ ID NO: 315569 - RNA, 32 nt, Human
agccacuguacuccagccuaggugacaaagca

SEQ ID NO: 315570 - RNA, 32 nt, Human
agccacuguccccaccaugaugaugacacagc

SEQ ID NO: 315571 - RNA, 32 nt, Human
agccacugugccagacucacuuuccaaauuuu

SEQ ID NO: 315572 - RNA, 32 nt, Human
agccacugugccaggcccaaaccuagcuucug

SEQ ID NO: 315573 - RNA, 32 nt, Human
agccacugugcccagccgaucugaugcuuuua

SEQ ID NO: 315574 - RNA, 32 nt, Human
agccacugugcccagccuucuuuauggcuauc

SEQ ID NO: 315575 - RNA, 32 nt, Human
agccacugugccuggcagcagcacuuuugauc

SEQ ID NO: 315576 - RNA, 18 nt, Human
agccacugugccuggcca

SEQ ID NO: 315577 - RNA, 18 nt, Human
agccacugugccuggccu

SEQ ID NO: 315578 - RNA, 32 nt, Human
agccacugugcuccagccugggcaacaccauc

SEQ ID NO: 315579 - RNA, 32 nt, Human
agccacugugcugaauucugcaauguuuuccu

SEQ ID NO: 315580 - RNA, 32 nt, Human
agccacugugggcuccaagaagcacaggcauu

SEQ ID NO: 315581 - RNA, 32 nt, Human
agccacugugucuggcccuauuuccuuuaaaa

SEQ ID NO: 315582 - RNA, 20 nt, Human
agccacugugucuggccuag

SEQ ID NO: 315583 - RNA, 32 nt, Human
agccacuuaaccucucuggaccuuguuuguaa

SEQ ID NO: 315584 - RNA, 32 nt, Human
agccacuuaucugugaauaaaaccauaaaucu

SEQ ID NO: 315585 - RNA, 32 nt, Human
agccacuucccagcgaguuggaaaugugccuu

SEQ ID NO: 315586 - RNA, 32 nt, Human
agccacuugccaggguggaggaggagcauugu

SEQ ID NO: 315587 - RNA, 32 nt, Human
agccacuuguguccuggagcccccaguucaaa

SEQ ID NO: 315588 - RNA, 32 nt, Human
agccacuugugucuagggaguuagugaggacu

SEQ ID NO: 315589 - RNA, 32 nt, Human
agccacuuguuucaucccaccugggcauuagg

SEQ ID NO: 315590 - RNA, 32 nt, Human
agccacuuuccuauauaccacaccucccuguc

SEQ ID NO: 315591 - RNA, 19 nt, Human
agccacuuucuguguggua

SEQ ID NO: 315592 - RNA, 32 nt, Human
agccacuuugauccaaccuggagcucacaaaa

SEQ ID NO: 315593 - RNA, 22 nt, Human
agccacuuugccuucucuggac

SEQ ID NO: 315594 - RNA, 23 nt, Human
agccagaaaaggagccagagcag

SEQ ID NO: 315595 - RNA, 25 nt, Human
agccagaaaaggaggaggcacgggu

SEQ ID NO: 315596 - RNA, 18 nt, Human
agccagaaaauuagcuua

SEQ ID NO: 315597 - RNA, 21 nt, Human
agccagaaacaagcccugugg

SEQ ID NO: 315598 - RNA, 32 nt, Human
agccagaaacagcagggagcugcccuggugag

SEQ ID NO: 315599 - RNA, 32 nt, Human
agccagaaagcucuggagcaucagggagacuc

SEQ ID NO: 315600 - RNA, 24 nt, Human
agccagaaaugccuuaaacugcaa

SEQ ID NO: 315601 - RNA, 32 nt, Human
agccagaacaugucuuucaaccugcaaucauc

SEQ ID NO: 315602 - RNA, 32 nt, Human
agccagaacucacaaccagauccagaggcaac

SEQ ID NO: 315603 - RNA, 32 nt, Human
agccagaagaacacugauauuugcauuuaaug

SEQ ID NO: 315604 - RNA, 32 nt, Human
agccagaagagagguuuucuuuugcauaguuu

SEQ ID NO: 315605 - RNA, 32 nt, Human
agccagaagcaucuccucugagagcccuugcc

SEQ ID NO: 315606 - RNA, 32 nt, Human
agccagaagccagaggauacccagggacagua

SEQ ID NO: 315607 - RNA, 32 nt, Human
agccagaagcugcaccuggccgagaacgccga

SEQ ID NO: 315608 - RNA, 21 nt, Human
agccagaaggacacacaccug

SEQ ID NO: 315609 - RNA, 32 nt, Human
agccagaaggagauguggcaaugugauuccuu

SEQ ID NO: 315610 - RNA, 32 nt, Human
agccagaaggggacccaggugugcauagcucu

SEQ ID NO: 315611 - RNA, 32 nt, Human
agccagaaggggcacgccugcccagccucgca

SEQ ID NO: 315612 - RNA, 20 nt, Human
agccagaagggguguccugc

SEQ ID NO: 315613 - RNA, 32 nt, Human
agccagaagucgcggaugaguguguggcaggu

SEQ ID NO: 315614 - RNA, 32 nt, Human
agccagaauguccguuugaaacuccuagcuca

SEQ ID NO: 315615 - RNA, 32 nt, Human
agccagaauguucaacuaauaagagaaggcug

SEQ ID NO: 315616 - RNA, 32 nt, Human
agccagaauguucaggaugcugaacagcaguu

SEQ ID NO: 315617 - RNA, 32 nt, Human
agccagacaaagaugcaucuugaucucccuug

SEQ ID NO: 315618 - RNA, 32 nt, Human
agccagacacaaaaggccacauacuguaugaa

SEQ ID NO: 315619 - RNA, 32 nt, Human
agccagacacugcacccugacuggggauccug

SEQ ID NO: 315620 - RNA, 32 nt, Human
agccagacaggauucagaauaaggagagaaug

SEQ ID NO: 315621 - RNA, 32 nt, Human
agccagacauccugauggggaggcagagccag

SEQ ID NO: 315622 - RNA, 32 nt, Human
agccagaccaagccuuucuguguguagcgcac

SEQ ID NO: 315623 - RNA, 32 nt, Human
agccagaccagaagauucuaucccccgcagcg

SEQ ID NO: 315624 - RNA, 32 nt, Human
agccagacccccggggacccagccucucacag

SEQ ID NO: 315625 - RNA, 32 nt, Human
agccagacccuccagccccagucaagccuucg

SEQ ID NO: 315626 - RNA, 24 nt, Human
agccagacccuccuugggcagaca

SEQ ID NO: 315627 - RNA, 32 nt, Human
agccagacccucuucagggaagggaccaauua

SEQ ID NO: 315628 - RNA, 32 nt, Human
agccagaccuauuccuccugggccccucaucu

SEQ ID NO: 315629 - RNA, 32 nt, Human
agccagacucuuggcggagcagugccacuucu

SEQ ID NO: 315630 - RNA, 32 nt, Human
agccagacuggcaucauguccacagcaucgcu

SEQ ID NO: 315631 - RNA, 32 nt, Human
agccagacuuggugguucccacuugcaauccc

SEQ ID NO: 315632 - RNA, 32 nt, Human
agccagacuuuguggcuguccccagccugcac

SEQ ID NO: 315633 - RNA, 23 nt, Human
agccagagaaaggcagauggggu

SEQ ID NO: 315634 - RNA, 32 nt, Human
agccagagaacugcuaagucuccugcaauguu

SEQ ID NO: 315635 - RNA, 22 nt, Human
agccagagaagaaagauggggu

SEQ ID NO: 315636 - RNA, 32 nt, Human
agccagagacauuuccugaagacauggggaac

SEQ ID NO: 315637 - RNA, 22 nt, Human
agccagagagcaccgccaggga

SEQ ID NO: 315638 - RNA, 32 nt, Human
agccagagagguagaggcugcagugagcuaug

SEQ ID NO: 315639 - RNA, 32 nt, Human
agccagagaguauaggauucuucuuuauauca

SEQ ID NO: 315640 - RNA, 32 nt, Human
agccagagaucugcuuaaaaagcugcugaaaa

SEQ ID NO: 315641 - RNA, 17 nt, Human
agccagagcacaggaag

SEQ ID NO: 315642 - RNA, 22 nt, Human
agccagagcagaaggcgaggga

SEQ ID NO: 315643 - RNA, 21 nt, Human
agccagagcagugcccagggg

SEQ ID NO: 315644 - RNA, 19 nt, Human
agccagagccagccuuccu

SEQ ID NO: 315645 - RNA, 32 nt, Human
agccagagcccaaugugucuuauuccccgugg

SEQ ID NO: 315646 - RNA, 32 nt, Human
agccagagcccaccggacacacccucacuucg

SEQ ID NO: 315647 - RNA, 32 nt, Human
agccagagcccagagcauagacaggaguguag

SEQ ID NO: 315648 - RNA, 23 nt, Human
agccagagcccucacagugaagu

SEQ ID NO: 315649 - RNA, 22 nt, Human
agccagaggaaaagaagaggag

SEQ ID NO: 315650 - RNA, 24 nt, Human
agccagaggaaggacuucauggag

SEQ ID NO: 315651 - RNA, 23 nt, Human
agccagaggaaggcaggcaggag

SEQ ID NO: 315652 - RNA, 32 nt, Human
agccagaggaaggcaggcaggagcucugucuc

SEQ ID NO: 315653 - RNA, 32 nt, Human
agccagaggaccuugagaauggggaagagagc

SEQ ID NO: 315654 - RNA, 22 nt, Human
agccagaggaggagggcaaagg

SEQ ID NO: 315655 - RNA, 21 nt, Human
agccagaggaggcaauacagu

SEQ ID NO: 315656 - RNA, 20 nt, Human
agccagaggaggcauuugga

SEQ ID NO: 315657 - RNA, 22 nt, Human
agccagaggaggccggugaagu

SEQ ID NO: 315658 - RNA, 32 nt, Human
agccagaggauagaauucuauacccccaaccc

SEQ ID NO: 315659 - RNA, 32 nt, Human
agccagaggcagcuccagccugggggacaggu

SEQ ID NO: 315660 - RNA, 32 nt, Human
agccagaggccccagcaccuugagguuaagca

SEQ ID NO: 315661 - RNA, 32 nt, Human
agccagaggccuggggaccuccuugccuuccc

SEQ ID NO: 315662 - RNA, 32 nt, Human
agccagaggcguagggcccaggagagccccca

SEQ ID NO: 315663 - RNA, 32 nt, Human
agccagaggcuucauuuuaucaucuguggaaa

SEQ ID NO: 315664 - RNA, 32 nt, Human
agccagagggaacaguaacagcccaggggccu

SEQ ID NO: 315665 - RNA, 21 nt, Human
agccagagggagagaccccag

SEQ ID NO: 315666 - RNA, 18 nt, Human
agccagaguaagccuucc

SEQ ID NO: 315667 - RNA, 32 nt, Human
agccagaguagcugccgccaccagaguccgga

SEQ ID NO: 315668 - RNA, 21 nt, Human
agccagagucaagggcugcag

SEQ ID NO: 315669 - RNA, 21 nt, Human
agccagagugagaccagcaga

SEQ ID NO: 315670 - RNA, 32 nt, Human
agccagaguggaggaaugagcucugagacaca

SEQ ID NO: 315671 - RNA, 32 nt, Human
agccagaguucacuccuuccuccuggcucucu

SEQ ID NO: 315672 - RNA, 32 nt, Human
agccagaguucagaugaggagcccucaggcaa

SEQ ID NO: 315673 - RNA, 21 nt, Human
agccagaguuguuucucucca

SEQ ID NO: 315674 - RNA, 32 nt, Human
agccagaucagccuuaagucaccucccaucca

SEQ ID NO: 315675 - RNA, 21 nt, Human
agccagaucaucugggacuga

SEQ ID NO: 315676 - RNA, 21 nt, Human
agccagauccuagccacuugg

SEQ ID NO: 315677 - RNA, 32 nt, Human
agccagaugccuggcccugugcuggggcagac

SEQ ID NO: 315678 - RNA, 32 nt, Human
agccagaugugguugcacacaucucuaguccc

SEQ ID NO: 315679 - RNA, 22 nt, Human
agccagauucauuccuucuuca

SEQ ID NO: 315680 - RNA, 32 nt, Human
agccagauuggguggaguccaagcuuugggca

SEQ ID NO: 315681 - RNA, 32 nt, Human
agccagauuuugcucuaguggcccucuuccug

SEQ ID NO: 315682 - RNA, 32 nt, Human
agccagcaaaggccauagaaacaacaauuuau

SEQ ID NO: 315683 - RNA, 32 nt, Human
agccagcaacaccaaccaaaugcuacucucuu

SEQ ID NO: 315684 - RNA, 32 nt, Human
agccagcaagagcaaggcaugggagaggggag

SEQ ID NO: 315685 - RNA, 32 nt, Human
agccagcaagaggcgccugcgcgauguccggg

SEQ ID NO: 315686 - RNA, 24 nt, Human
agccagcaagugcuuccaggaacu

SEQ ID NO: 315687 - RNA, 32 nt, Human
agccagcacaguuaaaagaagagaaaauggaa

SEQ ID NO: 315688 - RNA, 18 nt, Human
agccagcacauccugccu

SEQ ID NO: 315689 - RNA, 32 nt, Human
agccagcacauccugccugcuguugcagccug

SEQ ID NO: 315690 - RNA, 17 nt, Human
agccagcaccacacacc

SEQ ID NO: 315691 - RNA, 24 nt, Human
agccagcaccaugggcaggcccug

SEQ ID NO: 315692 - RNA, 32 nt, Human
agccagcaccaugggcaggcccugccauggac

SEQ ID NO: 315693 - RNA, 32 nt, Human
agccagcacccagcuuaaccccugccauccca

SEQ ID NO: 315694 - RNA, 28 nt, Human
agccagcacccugggcucucagggacug

SEQ ID NO: 315695 - RNA, 32 nt, Human
agccagcaccucuuuucccagcuguaaaaugg

SEQ ID NO: 315696 - RNA, 21 nt, Human
agccagcagagccggggacug

SEQ ID NO: 315697 - RNA, 21 nt, Human
agccagcagcccagggcacug

SEQ ID NO: 315698 - RNA, 21 nt, Human
agccagcagcuguuuccugug

SEQ ID NO: 315699 - RNA, 32 nt, Human
agccagcaggaggaugagccagcucugcaguu

SEQ ID NO: 315700 - RNA, 32 nt, Human
agccagcagguccagaaacaauaucaaaagug

SEQ ID NO: 315701 - RNA, 32 nt, Human
agccagcaguugagccuaagguccuucuaccu

SEQ ID NO: 315702 - RNA, 31 nt, Human
agccagcaguuucaguuauacucaaccaugc

SEQ ID NO: 315703 - RNA, 32 nt, Human
agccagcauccagaauuuccucccucucugau

SEQ ID NO: 315704 - RNA, 21 nt, Human
agccagcaucgcaccgaaccu

SEQ ID NO: 315705 - RNA, 23 nt, Human
agccagcaucgcggguaggccug

SEQ ID NO: 315706 - RNA, 32 nt, Human
agccagcaugccuggcugugugcaguggccag

SEQ ID NO: 315707 - RNA, 32 nt, Human
agccagccaagugccaaggucagcuuggcugg

SEQ ID NO: 315708 - RNA, 19 nt, Human
agccagccaccccucuuca

SEQ ID NO: 315709 - RNA, 32 nt, Human
agccagccacugcaucugcugcacaguugaac

SEQ ID NO: 315710 - RNA, 32 nt, Human
agccagccagaagaaaaagcgauagcaagaga

SEQ ID NO: 315711 - RNA, 32 nt, Human
agccagccagaccaugaacccaccagaaggaa

SEQ ID NO: 315712 - RNA, 24 nt, Human
agccagccagagaggacaguggag

SEQ ID NO: 315713 - RNA, 20 nt, Human
agccagccagcagcuccgug

SEQ ID NO: 315714 - RNA, 24 nt, Human
agccagccagccacauuucccugu

SEQ ID NO: 315715 - RNA, 32 nt, Human
agccagccagcccccuggcagcagguucuccu

SEQ ID NO: 315716 - RNA, 19 nt, Human
agccagccaggcccuggug

SEQ ID NO: 315717 - RNA, 32 nt, Human
agccagccagggcccugcccagcuucaauuua

SEQ ID NO: 315718 - RNA, 32 nt, Human
agccagccaucuuuggcaaaggucccugagcu

SEQ ID NO: 315719 - RNA, 32 nt, Human
agccagccaugcuuccuccugccugugugacg

SEQ ID NO: 315720 - RNA, 32 nt, Human
agccagcccacccugggcugggcccaggugcg

SEQ ID NO: 315721 - RNA, 32 nt, Human
agccagcccagcugccuaaagcgacaugagac

SEQ ID NO: 315722 - RNA, 32 nt, Human
agccagccccaaccuccagggcugucacaacc

SEQ ID NO: 315723 - RNA, 15 nt, Human
agccagccccuccca

SEQ ID NO: 315724 - RNA, 32 nt, Human
agccagccccugugggaagcaggcuggguuua

SEQ ID NO: 315725 - RNA, 32 nt, Human
agccagcccggugcgccccuccaccuccugcu

SEQ ID NO: 315726 - RNA, 32 nt, Human
agccagcccuaucuucuugucucaagaccaag

SEQ ID NO: 315727 - RNA, 32 nt, Human
agccagcccuggaggcuggauggcuccccuga

SEQ ID NO: 315728 - RNA, 32 nt, Human
agccagcccuggcuggagagcgggacguggca

SEQ ID NO: 315729 - RNA, 32 nt, Human
agccagccuaucucuagcccaugguuuuggag

SEQ ID NO: 315730 - RNA, 32 nt, Human
agccagccucaaggagacaucugguuuaggcc

SEQ ID NO: 315731 - RNA, 32 nt, Human
agccagccuccacuccagagcaaaccccugac

SEQ ID NO: 315732 - RNA, 32 nt, Human
agccagccucuucccccugggcuucgggcgaa

SEQ ID NO: 315733 - RNA, 32 nt, Human
agccagccugaagaaaugucaagcagagcccc

SEQ ID NO: 315734 - RNA, 32 nt, Human
agccagccugggggcugggaggauccuggaga

SEQ ID NO: 315735 - RNA, 32 nt, Human
agccagcgaggagcggcggcagaggaaaggcc

SEQ ID NO: 315736 - RNA, 32 nt, Human
agccagcggauugccagcucccagcucucccc

SEQ ID NO: 315737 - RNA, 32 nt, Human
agccagcucacagagaagaaaauaacuugcag

SEQ ID NO: 315738 - RNA, 32 nt, Human
agccagcucccagcagcuucuccggaagcugc

SEQ ID NO: 315739 - RNA, 32 nt, Human
agccagcuccccacucaggacgcuuccucauu

SEQ ID NO: 315740 - RNA, 32 nt, Human
agccagcucucaggacuguggcuggaggcugg

SEQ ID NO: 315741 - RNA, 32 nt, Human
agccagcucugccuucccaucaucuccuuuca

SEQ ID NO: 315742 - RNA, 32 nt, Human
agccagcugcagcucuaucucaccugccacgg

SEQ ID NO: 315743 - RNA, 32 nt, Human
agccagcugccuggccucccuccuguguuucc

SEQ ID NO: 315744 - RNA, 32 nt, Human
agccagcugggacagcgaccgagcccagagag

SEQ ID NO: 315745 - RNA, 17 nt, Human
agccagcugggaggaga

SEQ ID NO: 315746 - RNA, 32 nt, Human
agccagcuguggguaguugaaucuuuuucccg

SEQ ID NO: 315747 - RNA, 32 nt, Human
agccagcugugugugcugggcccacugaucag

SEQ ID NO: 315748 - RNA, 32 nt, Human
agccagcuugcagagagagcaagaacagagcc

SEQ ID NO: 315749 - RNA, 32 nt, Human
agccagcuuuaaaucacagcuuuuaccuauuu

SEQ ID NO: 315750 - RNA, 32 nt, Human
agccaggaaaagcacaaagaagaaacugcaac

SEQ ID NO: 315751 - RNA, 24 nt, Human
agccaggaaacagagugaccaagg

SEQ ID NO: 315752 - RNA, 22 nt, Human
agccaggaacgggucacccugc

SEQ ID NO: 315753 - RNA, 32 nt, Human
agccaggaaggaagaagagggagggccagugc

SEQ ID NO: 315754 - RNA, 32 nt, Human
agccaggaagguugagguugcagugagcuaug

SEQ ID NO: 315755 - RNA, 32 nt, Human
agccaggacacagaggggcagagcaagucagc

SEQ ID NO: 315756 - RNA, 32 nt, Human
agccaggacacagucuagaagcuuugagguuu

SEQ ID NO: 315757 - RNA, 25 nt, Human
agccaggaccagccagaccagcaga

SEQ ID NO: 315758 - RNA, 32 nt, Human
agccaggaccaggccccgcggaggcuugcugg

SEQ ID NO: 315759 - RNA, 22 nt, Human
agccaggacccagaaacucaga

SEQ ID NO: 315760 - RNA, 32 nt, Human
agccaggacuacaggugcaugccaccacgccc

SEQ ID NO: 315761 - RNA, 32 nt, Human
agccaggacuccucauuucaucucacagacac

SEQ ID NO: 315762 - RNA, 21 nt, Human
agccaggagaaagcagcccug

SEQ ID NO: 315763 - RNA, 20 nt, Human
agccaggagacaggccuggg

SEQ ID NO: 315764 - RNA, 32 nt, Human
agccaggagacccugggagcuguggcugucuu

SEQ ID NO: 315765 - RNA, 24 nt, Human
agccaggagaccugcagcccugcg

SEQ ID NO: 315766 - RNA, 31 nt, Human
agccaggagagaccuuuucugccuggagaga

SEQ ID NO: 315767 - RNA, 32 nt, Human
agccaggagagggacggcugauggacucagca

SEQ ID NO: 315768 - RNA, 32 nt, Human
agccaggagaugggcaagauuuugccucuuca

SEQ ID NO: 315769 - RNA, 19 nt, Human
agccaggagccaagagcag

SEQ ID NO: 315770 - RNA, 32 nt, Human
agccaggagcccagggagucacucugggcccu

SEQ ID NO: 315771 - RNA, 31 nt, Human
agccaggagcccucuuuuccugugucaaagc

SEQ ID NO: 315772 - RNA, 21 nt, Human
agccaggagcgcugccccagg

SEQ ID NO: 315773 - RNA, 23 nt, Human
agccaggagcgcugccccaggga

SEQ ID NO: 315774 - RNA, 21 nt, Human
agccaggaggagcccaacaga

SEQ ID NO: 315775 - RNA, 32 nt, Human
agccaggaggaggagguugcagugagccgaga

SEQ ID NO: 315776 - RNA, 24 nt, Human
agccaggaggcaaacccaaggccc

SEQ ID NO: 315777 - RNA, 20 nt, Human
agccaggaggcagagguugc

SEQ ID NO: 315778 - RNA, 32 nt, Human
agccaggaggcagagguugcagugagccaagc

SEQ ID NO: 315779 - RNA, 32 nt, Human
agccaggaggcagagguugcaguuagcccaga

SEQ ID NO: 315780 - RNA, 22 nt, Human
agccaggaggcaggagcagcgg

SEQ ID NO: 315781 - RNA, 20 nt, Human
agccaggaggcaggcgcgcg

SEQ ID NO: 315782 - RNA, 21 nt, Human
agccaggaggcaggguguccu

SEQ ID NO: 315783 - RNA, 24 nt, Human
agccaggaggcaguggggcugugg

SEQ ID NO: 315784 - RNA, 32 nt, Human
agccaggaggcaguggggcugugggcucagag

SEQ ID NO: 315785 - RNA, 32 nt, Human
agccaggaggccaagacagcggccaggagaag

SEQ ID NO: 315786 - RNA, 32 nt, Human
agccaggaggcggagguugcagugagccgaga

SEQ ID NO: 315787 - RNA, 22 nt, Human
agccaggagggagcuggcccug

SEQ ID NO: 315788 - RNA, 20 nt, Human
agccaggagggaggccccgc

SEQ ID NO: 315789 - RNA, 32 nt, Human
agccaggagggcccugaccucccacugcccag

SEQ ID NO: 315790 - RNA, 32 nt, Human
agccaggaggggcaguggggcugggccugggu

SEQ ID NO: 315791 - RNA, 32 nt, Human
agccaggaggucuagaacuggagcuuagucca

SEQ ID NO: 315792 - RNA, 25 nt, Human
agccaggagguugagguugcaguga

SEQ ID NO: 315793 - RNA, 32 nt, Human
agccaggagguugagguugcagugagcugaga

SEQ ID NO: 315794 - RNA, 32 nt, Human
agccaggaguauagguaugugccaccacacuc

SEQ ID NO: 315795 - RNA, 32 nt, Human
agccaggaucuguacccaugcaggugccccua

SEQ ID NO: 315796 - RNA, 21 nt, Human
agccaggaugcugauaucuaa

SEQ ID NO: 315797 - RNA, 32 nt, Human
agccaggauuaaaggugccugccaccacacau

SEQ ID NO: 315798 - RNA, 32 nt, Human
agccaggauuacaggcacccuccacuaggccc

SEQ ID NO: 315799 - RNA, 32 nt, Human
agccaggauugauggcagcugagggaaauucu

SEQ ID NO: 315800 - RNA, 32 nt, Human
agccaggauugcgccaccacacuccagccugg

SEQ ID NO: 315801 - RNA, 32 nt, Human
agccaggauuucuaagggucaggaggccuuca

SEQ ID NO: 315802 - RNA, 25 nt, Human
agccaggauuugaaagcaggcagcc

SEQ ID NO: 315803 - RNA, 32 nt, Human
agccaggcaaaaacauuacaagaaaggaaaac

SEQ ID NO: 315804 - RNA, 32 nt, Human
agccaggcaaaucgcuugaggcucaggaguuc

SEQ ID NO: 315805 - RNA, 32 nt, Human
agccaggcaaugguguggcccugcacuggccc

SEQ ID NO: 315806 - RNA, 32 nt, Human
agccaggcacaucuggccuugggaaacucauc

SEQ ID NO: 315807 - RNA, 32 nt, Human
agccaggcacugcccugcugugcuacuccugc

SEQ ID NO: 315808 - RNA, 32 nt, Human
agccaggcagaaacaacuccagagccacaccu

SEQ ID NO: 315809 - RNA, 32 nt, Human
agccaggcagagccaggggugagaggcagcag

SEQ ID NO: 315810 - RNA, 23 nt, Human
agccaggcagagcccacagagca

SEQ ID NO: 315811 - RNA, 32 nt, Human
agccaggcagcacaucacagcgggaggagcug

SEQ ID NO: 315812 - RNA, 32 nt, Human
agccaggcagcagaagcaggcacuuccaaacc

SEQ ID NO: 315813 - RNA, 17 nt, Human
agccaggcagcagagca

SEQ ID NO: 315814 - RNA, 22 nt, Human
agccaggcagggcgaugucugc

SEQ ID NO: 315815 - RNA, 22 nt, Human
agccaggcagucccuccugccu

SEQ ID NO: 315816 - RNA, 32 nt, Human
agccaggcagugagacuggcucgggcgggccg

SEQ ID NO: 315817 - RNA, 32 nt, Human
agccaggcaguuggggcacuuucugagugcug

SEQ ID NO: 315818 - RNA, 32 nt, Human
agccaggcauaacauauccacugugugcauag

SEQ ID NO: 315819 - RNA, 25 nt, Human
agccaggcauaauggcacacaccug

SEQ ID NO: 315820 - RNA, 25 nt, Human
agccaggcaugauggcacacaccug

SEQ ID NO: 315821 - RNA, 25 nt, Human
agccaggcaugguggcacacaccug

SEQ ID NO: 315822 - RNA, 25 nt, Human
agccaggcaugguggcgcacaccua

SEQ ID NO: 315823 - RNA, 32 nt, Human
agccaggcaugguggugggugccuggaguccc

SEQ ID NO: 315824 - RNA, 32 nt, Human
agccaggcauuuucaaugcucacaacaacucu

SEQ ID NO: 315825 - RNA, 21 nt, Human
agccaggccaacauggugaaa

SEQ ID NO: 315826 - RNA, 32 nt, Human
agccaggccaacuagaccacacuuauuggucu

SEQ ID NO: 315827 - RNA, 23 nt, Human
agccaggcccaagacacagcaga

SEQ ID NO: 315828 - RNA, 22 nt, Human
agccaggcccaccccagagcca

SEQ ID NO: 315829 - RNA, 32 nt, Human
agccaggcccagacauguccguccuuguaagu

SEQ ID NO: 315830 - RNA, 23 nt, Human
agccaggcccccaggucuucuca

SEQ ID NO: 315831 - RNA, 32 nt, Human
agccaggcccccaggucuucucauuguaugca

SEQ ID NO: 315832 - RNA, 23 nt, Human
agccaggccccccaggaggcagc

SEQ ID NO: 315833 - RNA, 18 nt, Human
agccaggcccccgcuuca

SEQ ID NO: 315834 - RNA, 20 nt, Human
agccaggccccgaggcgcca

SEQ ID NO: 315835 - RNA, 24 nt, Human
agccaggccccggggagggagcca

SEQ ID NO: 315836 - RNA, 32 nt, Human
agccaggcccucaggcgagcagggugggcaag

SEQ ID NO: 315837 - RNA, 22 nt, Human
agccaggcccugaggaacagcc

SEQ ID NO: 315838 - RNA, 22 nt, Human
agccaggcccugaguccccagc

SEQ ID NO: 315839 - RNA, 20 nt, Human
agccaggcccuuauccuguu

SEQ ID NO: 315840 - RNA, 23 nt, Human
agccaggccgagagcagacacca

SEQ ID NO: 315841 - RNA, 32 nt, Human
agccaggccgccugcccccacccagaaccuuc

SEQ ID NO: 315842 - RNA, 22 nt, Human
agccaggccggcccagaagcca

SEQ ID NO: 315843 - RNA, 32 nt, Human
agccaggccucccugcucugugguguuggaca

SEQ ID NO: 315844 - RNA, 24 nt, Human
agccaggccugcgccggcauccuc

SEQ ID NO: 315845 - RNA, 32 nt, Human
agccaggccugcgccggcauccuccgagauaa

SEQ ID NO: 315846 - RNA, 32 nt, Human
agccaggccugcggccacuccugcugcugcca

SEQ ID NO: 315847 - RNA, 32 nt, Human
agccaggccugggggcagccucuccccagccu

SEQ ID NO: 315848 - RNA, 32 nt, Human
agccaggccuuggguuuccccagcacagccuc

SEQ ID NO: 315849 - RNA, 17 nt, Human
agccaggcgaggccacu

SEQ ID NO: 315850 - RNA, 20 nt, Human
agccaggcuagccugaggug

SEQ ID NO: 315851 - RNA, 28 nt, Human
agccaggcucaggcugccucuucguuuu

SEQ ID NO: 315852 - RNA, 24 nt, Human
agccaggcucguggcacacaccua

SEQ ID NO: 315853 - RNA, 32 nt, Human
agccaggcugggccaucuucuccuggacaccu

SEQ ID NO: 315854 - RNA, 32 nt, Human
agccaggcuguugccaagcaacuggcaggagc

SEQ ID NO: 315855 - RNA, 32 nt, Human
agccagggaaccaggcuccagaccaugaacau

SEQ ID NO: 315856 - RNA, 32 nt, Human
agccagggaagccgaaggggaagaggcggcgg

SEQ ID NO: 315857 - RNA, 32 nt, Human
agccagggaaggugggagccacauggacccac

SEQ ID NO: 315858 - RNA, 32 nt, Human
agccagggagagaggggcaaggagcucagagg

SEQ ID NO: 315859 - RNA, 32 nt, Human
agccagggagagccgcacaacauacaauuaua

SEQ ID NO: 315860 - RNA, 32 nt, Human
agccagggagagggugugagggcagaucuggg

SEQ ID NO: 315861 - RNA, 32 nt, Human
agccagggagggagacaggagggcaggaggaa

SEQ ID NO: 315862 - RNA, 24 nt, Human
agccagggaggucaaggcugcagu

SEQ ID NO: 315863 - RNA, 32 nt, Human
agccagggaggucaaggcugcagugagccgug

SEQ ID NO: 315864 - RNA, 32 nt, Human
agccagggagguggaggcuacagugagccaug

SEQ ID NO: 315865 - RNA, 26 nt, Human
agccagggagguggagguugcaguga

SEQ ID NO: 315866 - RNA, 19 nt, Human
agccagggcaacacagcga

SEQ ID NO: 315867 - RNA, 32 nt, Human
agccagggcaggcagaagcuagggccuggggg

SEQ ID NO: 315868 - RNA, 32 nt, Human
agccagggcagggccauucuccaccuuacuga

SEQ ID NO: 315869 - RNA, 22 nt, Human
agccagggccagcccagaggca

SEQ ID NO: 315870 - RNA, 26 nt, Human
agccagggccccucggagcccggccg

SEQ ID NO: 315871 - RNA, 18 nt, Human
agccagggccgggugucu

SEQ ID NO: 315872 - RNA, 30 nt, Human
agccagggccucuccaagccgcugcuguga

SEQ ID NO: 315873 - RNA, 32 nt, Human
agccagggcggcuuccugaaggaugugggaug

SEQ ID NO: 315874 - RNA, 20 nt, Human
agccagggcgggcgcggccu

SEQ ID NO: 315875 - RNA, 19 nt, Human
agccagggcuccagggccu

SEQ ID NO: 315876 - RNA, 19 nt, Human
agccagggcuggugcuuaa

SEQ ID NO: 315877 - RNA, 32 nt, Human
agccagggcuguagcagagaggcuaguccauc

SEQ ID NO: 315878 - RNA, 32 nt, Human
agccaggggagcagggaagaagaaggggcucc

SEQ ID NO: 315879 - RNA, 32 nt, Human
agccaggggcaagcaugaccagagccagggac

SEQ ID NO: 315880 - RNA, 32 nt, Human
agccaggggcagggugggauggggaagaccag

SEQ ID NO: 315881 - RNA, 32 nt, Human
agccaggggccagacacagugcaggcacaguc

SEQ ID NO: 315882 - RNA, 32 nt, Human
agccagggggagcugggaugcagugggagagg

SEQ ID NO: 315883 - RNA, 19 nt, Human
agccagggggcccucuuca

SEQ ID NO: 315884 - RNA, 32 nt, Human
agccagggggccugugcagccucccuguguag

SEQ ID NO: 315885 - RNA, 32 nt, Human
agccaggggucugagggcaccuggcuguguuc

SEQ ID NO: 315886 - RNA, 32 nt, Human
agccaggggugagaggcagcagugauggcuac

SEQ ID NO: 315887 - RNA, 32 nt, Human
agccaggguggggcauucccucuagauucagg

SEQ ID NO: 315888 - RNA, 21 nt, Human
agccagguacugcucccuuca

SEQ ID NO: 315889 - RNA, 20 nt, Human
agccagguccauaccccuuc

SEQ ID NO: 315890 - RNA, 21 nt, Human
agccaggucccaggccguuca

SEQ ID NO: 315891 - RNA, 21 nt, Human
agccagguccuccuccuccuc

SEQ ID NO: 315892 - RNA, 32 nt, Human
agccagguccuccuccuccuccuucuccucuu

SEQ ID NO: 315893 - RNA, 18 nt, Human
agccagguccugacccuc

SEQ ID NO: 315894 - RNA, 21 nt, Human
agccaggucuccaccucugca

SEQ ID NO: 315895 - RNA, 19 nt, Human
agccaggucucuccucuca

SEQ ID NO: 315896 - RNA, 20 nt, Human
agccaggucugcccucccca

SEQ ID NO: 315897 - RNA, 20 nt, Human
agccaggucuucucucuuca

SEQ ID NO: 315898 - RNA, 23 nt, Human
agccaggugaagcgaaccugcug

SEQ ID NO: 315899 - RNA, 32 nt, Human
agccaggugaggaccauuuucacugggaccca

SEQ ID NO: 315900 - RNA, 32 nt, Human
agccaggugaggaggagccaggaaggcaguug

SEQ ID NO: 315901 - RNA, 32 nt, Human
agccaggugaugacugcucugaagauggagag

SEQ ID NO: 315902 - RNA, 32 nt, Human
agccaggugcagccuggacaacaugaugagau

SEQ ID NO: 315903 - RNA, 32 nt, Human
agccaggugccacccucgccucacagccccgg

SEQ ID NO: 315904 - RNA, 32 nt, Human
agccaggugcgggauauaaucuuguggcgcgc

SEQ ID NO: 315905 - RNA, 32 nt, Human
agccaggugcgggauauaaucuuguggugcgc

SEQ ID NO: 315906 - RNA, 32 nt, Human
agccaggugggaccagugugucugucaugaaa

SEQ ID NO: 315907 - RNA, 32 nt, Human
agccagguggguggagggagggagaucaugag

SEQ ID NO: 315908 - RNA, 32 nt, Human
agccaggugguggcacacgccuguaaucccag

SEQ ID NO: 315909 - RNA, 25 nt, Human
agccagguguagcgacacacaccug

SEQ ID NO: 315910 - RNA, 19 nt, Human
agccagguguccucuugca

SEQ ID NO: 315911 - RNA, 24 nt, Human
agccaggugucugcagagcagcca

SEQ ID NO: 315912 - RNA, 23 nt, Human
agccaggugugguggcacacacc

SEQ ID NO: 315913 - RNA, 25 nt, Human
agccaggugugguggcacacaccua

SEQ ID NO: 315914 - RNA, 32 nt, Human
agccaggugugugugauugggccccgcgaccu

SEQ ID NO: 315915 - RNA, 32 nt, Human
agccagguuauucucuggagguugguggauga

SEQ ID NO: 315916 - RNA, 32 nt, Human
agccagguucugacucuuggcacagcauggag

SEQ ID NO: 315917 - RNA, 32 nt, Human
agccaguacagcugugagcagaggcugguuau

SEQ ID NO: 315918 - RNA, 18 nt, Human
agccaguaccugcaucuu

SEQ ID NO: 315919 - RNA, 19 nt, Human
agccaguacgacagagcag

SEQ ID NO: 315920 - RNA, 32 nt, Human
agccaguacucagagaggaggaccuucucaac

SEQ ID NO: 315921 - RNA, 32 nt, Human
agccaguacuccugcucugcuaacccugcgug

SEQ ID NO: 315922 - RNA, 32 nt, Human
agccagucacacccucccgugggaaccagggc

SEQ ID NO: 315923 - RNA, 32 nt, Human
agccagucaccuguaagaguccuguccucugc

SEQ ID NO: 315924 - RNA, 32 nt, Human
agccagucauuaaacaaaggcuuggagcaaac

SEQ ID NO: 315925 - RNA, 32 nt, Human
agccaguccaggaguggaccggccagaugagg

SEQ ID NO: 315926 - RNA, 32 nt, Human
agccaguccaucugcccagcagucccugggca

SEQ ID NO: 315927 - RNA, 32 nt, Human
agccaguccauguguugucucuaacugauuua

SEQ ID NO: 315928 - RNA, 32 nt, Human
agccaguccccauuggcugacagugccaccug

SEQ ID NO: 315929 - RNA, 19 nt, Human
agccagucccugcuccaca

SEQ ID NO: 315930 - RNA, 20 nt, Human
agccaguccucccagggacu

SEQ ID NO: 315931 - RNA, 32 nt, Human
agccaguccuggugacuggccucugccuucca

SEQ ID NO: 315932 - RNA, 32 nt, Human
agccagucucaccaguugauucugccuuaauc

SEQ ID NO: 315933 - RNA, 20 nt, Human
agccagucuccgcgccucca

SEQ ID NO: 315934 - RNA, 32 nt, Human
agccagucuccuggucuagcccagguugccag

SEQ ID NO: 315935 - RNA, 32 nt, Human
agccagucuucuggagccucugggcagaaccc

SEQ ID NO: 315936 - RNA, 32 nt, Human
agccagugaacugucaccuucucuucaucaca

SEQ ID NO: 315937 - RNA, 32 nt, Human
agccagugacaguugaccuggcuauugguucu

SEQ ID NO: 315938 - RNA, 32 nt, Human
agccagugagccaagcgccacagccagcaaag

SEQ ID NO: 315939 - RNA, 32 nt, Human
agccagugagcugggcuucaguuuuucccagg

SEQ ID NO: 315940 - RNA, 32 nt, Human
agccagugagucuauugcaugguguuuugaga

SEQ ID NO: 315941 - RNA, 21 nt, Human
agccagugaucagcagcucuu

SEQ ID NO: 315942 - RNA, 32 nt, Human
agccagugcacgccagccugggcgacagacuc

SEQ ID NO: 315943 - RNA, 22 nt, Human
agccagugccaaaacccagcca

SEQ ID NO: 315944 - RNA, 18 nt, Human
agccagugcgguggugug

SEQ ID NO: 315945 - RNA, 32 nt, Human
agccagugcuccaagcccggaauugucuucau

SEQ ID NO: 315946 - RNA, 20 nt, Human
agccagugcuccgugcggug

SEQ ID NO: 315947 - RNA, 32 nt, Human
agccagugcucuggaaauugagcuccaagcac

SEQ ID NO: 315948 - RNA, 32 nt, Human
agccaguggaaauguuccauaagggagaguuc

SEQ ID NO: 315949 - RNA, 32 nt, Human
agccaguggcaucugcgcggcuugccuggcuc

SEQ ID NO: 315950 - RNA, 25 nt, Human
agccaguggcuuccugaacgugccu

SEQ ID NO: 315951 - RNA, 32 nt, Human
agccagugggaacugccagaggaagaucuggc

SEQ ID NO: 315952 - RNA, 32 nt, Human
agccagugguacaggggccugggcagggcggu

SEQ ID NO: 315953 - RNA, 32 nt, Human
agccagugugccaccaggcugggcagggacaa

SEQ ID NO: 315954 - RNA, 32 nt, Human
agccaguguguuggauuccggaagaaaugaua

SEQ ID NO: 315955 - RNA, 32 nt, Human
agccaguguugcuggcuggagaggcagcaaca

SEQ ID NO: 315956 - RNA, 20 nt, Human
agccaguguuuuuuguggua

SEQ ID NO: 315957 - RNA, 32 nt, Human
agccaguuauuaggaagagcaagcucaccaca

SEQ ID NO: 315958 - RNA, 32 nt, Human
agccaguuccacccucagcuucucucagaagg

SEQ ID NO: 315959 - RNA, 32 nt, Human
agccaguuccuaaaacuaaaacuccauucuag

SEQ ID NO: 315960 - RNA, 32 nt, Human
agccaguucuccaaucagccuaucaccccuug

SEQ ID NO: 315961 - RNA, 32 nt, Human
agccaguucucugcuucauauucaugugaccc

SEQ ID NO: 315962 - RNA, 32 nt, Human
agccaguuucaucaaacaguucaacagagagc

SEQ ID NO: 315963 - RNA, 32 nt, Human
agccaguuucugccaccccacucuccaggcca

SEQ ID NO: 315964 - RNA, 32 nt, Human
agccauaauuccaccaucauacagaucaggca

SEQ ID NO: 315965 - RNA, 32 nt, Human
agccauacaaauuauuucagucuuccauuagu

SEQ ID NO: 315966 - RNA, 32 nt, Human
agccauacauaaaaggaccuugggacauaaga

SEQ ID NO: 315967 - RNA, 32 nt, Human
agccauagaguaagguuaacaaaaagaauaaa

SEQ ID NO: 315968 - RNA, 31 nt, Human
agccauagcuacuucuuuaagcuccuccagu

SEQ ID NO: 315969 - RNA, 32 nt, Human
agccauaggaaaacaugugagcaacaaccccc

SEQ ID NO: 315970 - RNA, 32 nt, Human
agccauauauucaaauauguaauuuuccucau

SEQ ID NO: 315971 - RNA, 32 nt, Human
agccauauuucugucuccacuugcucucuggg

SEQ ID NO: 315972 - RNA, 32 nt, Human
agccaucaacuucccuucauccuugccguguc

SEQ ID NO: 315973 - RNA, 32 nt, Human
agccaucaaggacauguuuguggugugaugca

SEQ ID NO: 315974 - RNA, 32 nt, Human
agccaucacucacugccaccugggccaucaac

SEQ ID NO: 315975 - RNA, 32 nt, Human
agccaucacugcuggcagccugggcaaaccgg

SEQ ID NO: 315976 - RNA, 32 nt, Human
agccaucaggaguguuucuugaaugccccagg

SEQ ID NO: 315977 - RNA, 32 nt, Human
agccaucaucucucacgguaccacaggccugg

SEQ ID NO: 315978 - RNA, 32 nt, Human
agccaucaugcaugcuuuugaaaacuuagaga

SEQ ID NO: 315979 - RNA, 32 nt, Human
agccaucauuguaggaaaggcuuugcaggaga

SEQ ID NO: 315980 - RNA, 32 nt, Human
agccauccaaauagcugggaccacaggugugc

SEQ ID NO: 315981 - RNA, 32 nt, Human
agccauccaccaccagcuccuccucuaggcuc

SEQ ID NO: 315982 - RNA, 32 nt, Human
agccauccagccucccugacccuccacacgga

SEQ ID NO: 315983 - RNA, 32 nt, Human
agccauccauuuucuccuucauugacuggcug

SEQ ID NO: 315984 - RNA, 21 nt, Human
agccaucccaacguccucccc

SEQ ID NO: 315985 - RNA, 32 nt, Human
agccaucccagagauuugaguucugaugccac

SEQ ID NO: 315986 - RNA, 22 nt, Human
agccauccccccgcucugcccc

SEQ ID NO: 315987 - RNA, 32 nt, Human
agccaucccggggcuccagccaggagcccugc

SEQ ID NO: 315988 - RNA, 32 nt, Human
agccauccuccacggcaagcucagaccacccg

SEQ ID NO: 315989 - RNA, 32 nt, Human
agccauccucgucugcucuccucucucuucca

SEQ ID NO: 315990 - RNA, 18 nt, Human
agccauccucucaccuca

SEQ ID NO: 315991 - RNA, 20 nt, Human
agccauccugccucgccucc

SEQ ID NO: 315992 - RNA, 32 nt, Human
agccaucgcgccacugcacucuagccugggug

SEQ ID NO: 315993 - RNA, 32 nt, Human
agccaucgguggcccaggcuccacgugcuuac

SEQ ID NO: 315994 - RNA, 32 nt, Human
agccaucuauguauaugucuuaccucaucucc

SEQ ID NO: 315995 - RNA, 32 nt, Human
agccaucuccaucuugaaggaacucaaagacu

SEQ ID NO: 315996 - RNA, 32 nt, Human
agccaucucgguccuugcuggaagguggagac

SEQ ID NO: 315997 - RNA, 32 nt, Human
agccaucucuuccucugaucuggggucuguuu

SEQ ID NO: 315998 - RNA, 32 nt, Human
agccaucugcagcaggccccucccagcaacag

SEQ ID NO: 315999 - RNA, 24 nt, Human
agccaucugcccgccucauccucc

SEQ ID NO: 316000 - RNA, 32 nt, Human
agccaucugccuccucucaacucucgcugccc

SEQ ID NO: 316001 - RNA, 32 nt, Human
agccaucugcucucccgggaguccagugacuc

SEQ ID NO: 316002 - RNA, 32 nt, Human
agccaucugucaggaaauguaacuuugguuuu

SEQ ID NO: 316003 - RNA, 32 nt, Human
agccaucuguggggcaggcacacacaccuccc

SEQ ID NO: 316004 - RNA, 32 nt, Human
agccaucuucacuggaggguggggagcuccgu

SEQ ID NO: 316005 - RNA, 32 nt, Human
agccaucuuccaggacccagaggggcugccug

SEQ ID NO: 316006 - RNA, 32 nt, Human
agccaucuuuacgcauguccaucggugaaaga

SEQ ID NO: 316007 - RNA, 32 nt, Human
agccaucuuuuuccuuugcguuuuucuugacu

SEQ ID NO: 316008 - RNA, 32 nt, Human
agccaugaaacccacagacuuggugccugagc

SEQ ID NO: 316009 - RNA, 24 nt, Human
agccaugaaaguagcacgaucaua

SEQ ID NO: 316010 - RNA, 32 nt, Human
agccaugacgucaauagcagcccagggcacuu

SEQ ID NO: 316011 - RNA, 29 nt, Human
agccaugacuauacuccccaaaaagaagc

SEQ ID NO: 316012 - RNA, 32 nt, Human
agccaugacucugugaagaugaauguugucuc

SEQ ID NO: 316013 - RNA, 22 nt, Human
agccaugacuucauuucucgcc

SEQ ID NO: 316014 - RNA, 32 nt, Human
agccaugagcagggaaagaacucucccaaccc

SEQ ID NO: 316015 - RNA, 32 nt, Human
agccaugagccaagagcccucuucacgcugcu

SEQ ID NO: 316016 - RNA, 29 nt, Human
agccaugagggaaggacaggagauggggc

SEQ ID NO: 316017 - RNA, 32 nt, Human
agccaugagugggaagugggaaaaugaguuug

SEQ ID NO: 316018 - RNA, 32 nt, Human
agccaugaguugucccggccagcuucauacuu

SEQ ID NO: 316019 - RNA, 32 nt, Human
agccaugauaguucaacauacagagauuucca

SEQ ID NO: 316020 - RNA, 32 nt, Human
agccaugaucauaccacugcacuccagccugg

SEQ ID NO: 316021 - RNA, 32 nt, Human
agccaugauccuaccacugcacuucagccuag

SEQ ID NO: 316022 - RNA, 32 nt, Human
agccaugauucugccucuguuuuauaccugca

SEQ ID NO: 316023 - RNA, 32 nt, Human
agccaugauugagccaccacacuccaaccuag

SEQ ID NO: 316024 - RNA, 32 nt, Human
agccaugcagacaccaaggugaagagcuacug

SEQ ID NO: 316025 - RNA, 32 nt, Human
agccaugcagagccuugugccaugaaggacuu

SEQ ID NO: 316026 - RNA, 32 nt, Human
agccaugcagggacccaggacuguaaccuggg

SEQ ID NO: 316027 - RNA, 32 nt, Human
agccaugcauuccguuccaaggcauccgugag

SEQ ID NO: 316028 - RNA, 32 nt, Human
agccaugccaaugcacuccagucugggcaaca

SEQ ID NO: 316029 - RNA, 32 nt, Human
agccaugccacaucuguauauagaugggguuu

SEQ ID NO: 316030 - RNA, 32 nt, Human
agccaugcccucugacugcccucugccccuuu

SEQ ID NO: 316031 - RNA, 32 nt, Human
agccaugccugcagugcugcaggccucgcuuu

SEQ ID NO: 316032 - RNA, 32 nt, Human
agccaugccugccucugaccaguccacuuuuc

SEQ ID NO: 316033 - RNA, 32 nt, Human
agccaugccuucaaccuggcaggagguguagc

SEQ ID NO: 316034 - RNA, 32 nt, Human
agccaugccuucucgcuggauguggccucggc

SEQ ID NO: 316035 - RNA, 32 nt, Human
agccaugcgaguagcugggacuacagacaugc

SEQ ID NO: 316036 - RNA, 32 nt, Human
agccaugcguggacucagugggccacacagac

SEQ ID NO: 316037 - RNA, 32 nt, Human
agccaugcugggaugcugcuggcggggagcac

SEQ ID NO: 316038 - RNA, 29 nt, Human
agccauggacacaccccugcccagaccuc

SEQ ID NO: 316039 - RNA, 32 nt, Human
agccauggacaguaaaguugugugggaaaaga

SEQ ID NO: 316040 - RNA, 32 nt, Human
agccauggagcgcggcccuggggccccggggc

SEQ ID NO: 316041 - RNA, 32 nt, Human
agccauggagugagacccaggagccggacacu

SEQ ID NO: 316042 - RNA, 32 nt, Human
agccauggcagauuuccagccuggugaugcug

SEQ ID NO: 316043 - RNA, 18 nt, Human
agccauggcccagagcag

SEQ ID NO: 316044 - RNA, 32 nt, Human
agccauggcccgccgccgagagcccaggcccc

SEQ ID NO: 316045 - RNA, 29 nt, Human
agccauggcccugucccugccucugggcc

SEQ ID NO: 316046 - RNA, 32 nt, Human
agccauggccuuccucuccugcgugagaccag

SEQ ID NO: 316047 - RNA, 32 nt, Human
agccauggcgacacuaaaggaggaggagccgg

SEQ ID NO: 316048 - RNA, 29 nt, Human
agccauggcugaaggggaaaucaccaccu

SEQ ID NO: 316049 - RNA, 32 nt, Human
agccauggcugcagcaggaauggaugucccac

SEQ ID NO: 316050 - RNA, 32 nt, Human
agccauggcuuuagggaggggugcaggcucau

SEQ ID NO: 316051 - RNA, 32 nt, Human
agccaugggaggccaagaagcugcuguggcug

SEQ ID NO: 316052 - RNA, 32 nt, Human
agccaugggcugggagaucauagcccuuccua

SEQ ID NO: 316053 - RNA, 32 nt, Human
agccauggggcaguugaccugggucuugaaag

SEQ ID NO: 316054 - RNA, 32 nt, Human
agccauggggccggagccgcagugagcaccau

SEQ ID NO: 316055 - RNA, 32 nt, Human
agccaugggggagcucacccaccccacaauuc

SEQ ID NO: 316056 - RNA, 32 nt, Human
agccauggggucugcuguggggucugcccugg

SEQ ID NO: 316057 - RNA, 29 nt, Human
agccauggucggcagaagagcacugaucg

SEQ ID NO: 316058 - RNA, 32 nt, Human
agccaugguguccccucugccuccccuccccc

SEQ ID NO: 316059 - RNA, 32 nt, Human
agccaugguguuucaccauguuggccaggcug

SEQ ID NO: 316060 - RNA, 32 nt, Human
agccauguaaaaccugcagugccugaaaccug

SEQ ID NO: 316061 - RNA, 32 nt, Human
agccauguaccacauaacaacaucuugguaaa

SEQ ID NO: 316062 - RNA, 29 nt, Human
agccaugucaucugagccucccccaccac

SEQ ID NO: 316063 - RNA, 32 nt, Human
agccaugucccaagcaucucacaaaggaauaa

SEQ ID NO: 316064 - RNA, 29 nt, Human
agccaugucugugucuaaucacuacaggc

SEQ ID NO: 316065 - RNA, 19 nt, Human
agccaugugacugcgcaga

SEQ ID NO: 316066 - RNA, 32 nt, Human
agccauguggaacugcuggagugcaguggcau

SEQ ID NO: 316067 - RNA, 32 nt, Human
agccauguuccccaguucaguguugcauguau

SEQ ID NO: 316068 - RNA, 32 nt, Human
agccauguuuuuaagcagaaccagcgaaaccc

SEQ ID NO: 316069 - RNA, 32 nt, Human
agccauuaaaacugacaacucugaaugcaagc

SEQ ID NO: 316070 - RNA, 32 nt, Human
agccauuaaaugucacaugaagccuugauaga

SEQ ID NO: 316071 - RNA, 32 nt, Human
agccauuacagcuguggaggaugcaugaaaca

SEQ ID NO: 316072 - RNA, 32 nt, Human
agccauuacaucuucuuucuucuucucuccuu

SEQ ID NO: 316073 - RNA, 32 nt, Human
agccauuaccuuuuaugcuucaucucaacauu

SEQ ID NO: 316074 - RNA, 32 nt, Human
agccauuagaaaaugugaaacuguucuuauga

SEQ ID NO: 316075 - RNA, 32 nt, Human
agccauucaagugccuuacacagcuuugaaga

SEQ ID NO: 316076 - RNA, 32 nt, Human
agccauucagaaaagacuuccuuuguguucag

SEQ ID NO: 316077 - RNA, 32 nt, Human
agccauucagaagagaaaaauggaauaucaga

SEQ ID NO: 316078 - RNA, 32 nt, Human
agccauuccccuguugcucuccuuaucuuggu

SEQ ID NO: 316079 - RNA, 23 nt, Human
agccauuccugaaucuccccuuc

SEQ ID NO: 316080 - RNA, 32 nt, Human
agccauucuaacagcagcaccuugucggaccg

SEQ ID NO: 316081 - RNA, 32 nt, Human
agccauugaaaacaaagacauucuucccacuu

SEQ ID NO: 316082 - RNA, 16 nt, Human
agccauugaacugguc

SEQ ID NO: 316083 - RNA, 32 nt, Human
agccauugagcaucuccucuucuugaaggcca

SEQ ID NO: 316084 - RNA, 32 nt, Human
agccauugcacuccagccuggacagcaggagc

SEQ ID NO: 316085 - RNA, 32 nt, Human
agccauugcacuccagccugggcaacaagagc

SEQ ID NO: 316086 - RNA, 32 nt, Human
agccauugcacuccagccugggcaacaagagu

SEQ ID NO: 316087 - RNA, 32 nt, Human
agccauugcauuuaaguucccuaggagggggu

SEQ ID NO: 316088 - RNA, 32 nt, Human
agccauugccauucccuguccuggcccccuuc

SEQ ID NO: 316089 - RNA, 32 nt, Human
agccauugcuccccucucccugccacccuucc

SEQ ID NO: 316090 - RNA, 32 nt, Human
agccauugcucuccagccugggugacacagca

SEQ ID NO: 316091 - RNA, 32 nt, Human
agccauugcugcacucugggggcuuggcaugg

SEQ ID NO: 316092 - RNA, 32 nt, Human
agccauuguaucaguugaaguaauacuuguuu

SEQ ID NO: 316093 - RNA, 32 nt, Human
agccauugucaugcucagccugugccaccauu

SEQ ID NO: 316094 - RNA, 32 nt, Human
agccauugucucugugucuccgucagccgugc

SEQ ID NO: 316095 - RNA, 24 nt, Human
agccauuguuggagcaggcaggca

SEQ ID NO: 316096 - RNA, 21 nt, Human
agccauuucacauuucacccc

SEQ ID NO: 316097 - RNA, 32 nt, Human
agccauuucguccucuccaguuuggggcggaa

SEQ ID NO: 316098 - RNA, 32 nt, Human
agccauuucuacugcuuacucaugucccuauu

SEQ ID NO: 316099 - RNA, 32 nt, Human
agccauuugacagggaggggccagcagugagc

SEQ ID NO: 316100 - RNA, 32 nt, Human
agcccaaaagccccagauccccuuaaagcaga

SEQ ID NO: 316101 - RNA, 24 nt, Human
agcccaaaaguuugaggcugcagu

SEQ ID NO: 316102 - RNA, 29 nt, Human
agcccaaaauaaaagaaauccugagaagg

SEQ ID NO: 316103 - RNA, 32 nt, Human
agcccaaagucgucuucucugccuucaaguca

SEQ ID NO: 316104 - RNA, 32 nt, Human
agcccaaauagcaaguugcauuucucacugga

SEQ ID NO: 316105 - RNA, 32 nt, Human
agcccaacacaacccaaaggcucuuuucagag

SEQ ID NO: 316106 - RNA, 32 nt, Human
agcccaacagccgagaaggggagggagggcag

SEQ ID NO: 316107 - RNA, 21 nt, Human
agcccaacccucucauugccu

SEQ ID NO: 316108 - RNA, 32 nt, Human
agcccaacccuuccagcacccagccggcccuc

SEQ ID NO: 316109 - RNA, 25 nt, Human
agcccaaccuucuccagggcugcag

SEQ ID NO: 316110 - RNA, 21 nt, Human
agcccaacugggaccaacaca

SEQ ID NO: 316111 - RNA, 24 nt, Human
agcccaagagguagagguugcagu

SEQ ID NO: 316112 - RNA, 32 nt, Human
agcccaagagguagagguugcagugagccaag

SEQ ID NO: 316113 - RNA, 24 nt, Human
agcccaagaggucaaggcuucagu

SEQ ID NO: 316114 - RNA, 23 nt, Human
agcccaagagguccaggcugcag

SEQ ID NO: 316115 - RNA, 24 nt, Human
agcccaagagguggagguuacagu

SEQ ID NO: 316116 - RNA, 32 nt, Human
agcccaagagguggagguuacagugagcagag

SEQ ID NO: 316117 - RNA, 24 nt, Human
agcccaagagguugaggcugcagu

SEQ ID NO: 316118 - RNA, 32 nt, Human
agcccaagagguugaggcugcagugagccaug

SEQ ID NO: 316119 - RNA, 24 nt, Human
agcccaagaguccaaggcugcagu

SEQ ID NO: 316120 - RNA, 32 nt, Human
agcccaagcccaggcauugcagugcacagagc

SEQ ID NO: 316121 - RNA, 32 nt, Human
agcccaagcccgccaccucuggccugaggaac

SEQ ID NO: 316122 - RNA, 20 nt, Human
agcccaagcuaacugagcug

SEQ ID NO: 316123 - RNA, 32 nt, Human
agcccaagcuacaccuggcugcagggcugggu

SEQ ID NO: 316124 - RNA, 32 nt, Human
agcccaaggagagcggcaggaggggugggacc

SEQ ID NO: 316125 - RNA, 25 nt, Human
agcccaaggaggucaaggcuguagu

SEQ ID NO: 316126 - RNA, 32 nt, Human
agcccaaggaguuuagggcugcagugaaccug

SEQ ID NO: 316127 - RNA, 32 nt, Human
agcccaaggccagugggaacuuguauaaauca

SEQ ID NO: 316128 - RNA, 32 nt, Human
agcccaaggcccccucggccuccugggcaacu

SEQ ID NO: 316129 - RNA, 18 nt, Human
agcccaaggcgccaggau

SEQ ID NO: 316130 - RNA, 32 nt, Human
agcccaaggcuacuuggaccucaggaccugga

SEQ ID NO: 316131 - RNA, 30 nt, Human
agcccaaggcucuccaugccuuucuaccua

SEQ ID NO: 316132 - RNA, 32 nt, Human
agcccaagggcuguuucugccacuugcucucc

SEQ ID NO: 316133 - RNA, 17 nt, Human
agcccaagugaaaucaa

SEQ ID NO: 316134 - RNA, 19 nt, Human
agcccaagugggugaauca

SEQ ID NO: 316135 - RNA, 32 nt, Human
agcccaaguugaucagcuuaccggaagaaaug

SEQ ID NO: 316136 - RNA, 32 nt, Human
agcccaauaagcuuuugucuaaguugucaucu

SEQ ID NO: 316137 - RNA, 32 nt, Human
agcccaaucacaaauagaaacuaggaaccuau

SEQ ID NO: 316138 - RNA, 32 nt, Human
agcccaaucacuacaaccacuaaccacaacau

SEQ ID NO: 316139 - RNA, 16 nt, Human
agcccaaucgcaucag

SEQ ID NO: 316140 - RNA, 21 nt, Human
agcccaauucaaagcugcagu

SEQ ID NO: 316141 - RNA, 22 nt, Human
agcccaauuggugacgcugcag

SEQ ID NO: 316142 - RNA, 32 nt, Human
agcccacaaggacuccagccugcuggcuggug

SEQ ID NO: 316143 - RNA, 32 nt, Human
agcccacaaggcuggggcuggagaaugagaga

SEQ ID NO: 316144 - RNA, 32 nt, Human
agcccacacagcccaggcagcauccgggccag

SEQ ID NO: 316145 - RNA, 32 nt, Human
agcccacacagcccgagccccuuggggagcag

SEQ ID NO: 316146 - RNA, 32 nt, Human
agcccacaccacugcccugcuccaucucccac

SEQ ID NO: 316147 - RNA, 32 nt, Human
agcccacacccaccccagacggccaccacacu

SEQ ID NO: 316148 - RNA, 32 nt, Human
agcccacaccuuccuugcugauuuguauuuuu

SEQ ID NO: 316149 - RNA, 32 nt, Human
agcccacacucugccaccuccuggcccugucc

SEQ ID NO: 316150 - RNA, 32 nt, Human
agcccacagcaacccacaggccgagcggccug

SEQ ID NO: 316151 - RNA, 32 nt, Human
agcccacagcagaacccagacguacugaggcc

SEQ ID NO: 316152 - RNA, 32 nt, Human
agcccacagcuucucccagccugaaaccaaca

SEQ ID NO: 316153 - RNA, 32 nt, Human
agcccacaggauucagcagcauggacagucac

SEQ ID NO: 316154 - RNA, 20 nt, Human
agcccacaggccuguucccu

SEQ ID NO: 316155 - RNA, 32 nt, Human
agcccacaggguggagcacuguggacugaaug

SEQ ID NO: 316156 - RNA, 32 nt, Human
agcccacaucccuccuugggcagggcagcagc

SEQ ID NO: 316157 - RNA, 32 nt, Human
agcccacaugaccaugccucagacugucaccc

SEQ ID NO: 316158 - RNA, 28 nt, Human
agcccaccaagaggugccucauuagaac

SEQ ID NO: 316159 - RNA, 22 nt, Human
agcccaccacgcccaccccucc

SEQ ID NO: 316160 - RNA, 32 nt, Human
agcccaccagcaguugcugggccaccccgcug

SEQ ID NO: 316161 - RNA, 32 nt, Human
agcccaccagccccagcacugaccuccaagcc

SEQ ID NO: 316162 - RNA, 32 nt, Human
agcccaccagccuggcauccauguugacaucu

SEQ ID NO: 316163 - RNA, 32 nt, Human
agcccaccaugcuaaaaggaccccaaauggug

SEQ ID NO: 316164 - RNA, 32 nt, Human
agcccaccaugggauggggaggggguggaggc

SEQ ID NO: 316165 - RNA, 32 nt, Human
agcccaccauuucuccucaccugggccuucuc

SEQ ID NO: 316166 - RNA, 32 nt, Human
agcccacccccaaacagacacagcguagcccg

SEQ ID NO: 316167 - RNA, 22 nt, Human
agcccacccccagcuacauggg

SEQ ID NO: 316168 - RNA, 21 nt, Human
agcccacccccgcacccacua

SEQ ID NO: 316169 - RNA, 24 nt, Human
agcccaccccgcccccacugcagc

SEQ ID NO: 316170 - RNA, 19 nt, Human
agcccacccuccccgcacc

SEQ ID NO: 316171 - RNA, 32 nt, Human
agcccacccuccugcaaccucucacccgaaca

SEQ ID NO: 316172 - RNA, 32 nt, Human
agcccacccuccugcucaugagggcagacagg

SEQ ID NO: 316173 - RNA, 23 nt, Human
agcccacccuggauccugaggcg

SEQ ID NO: 316174 - RNA, 32 nt, Human
agcccacccuuuccucuccccacugccuccuc

SEQ ID NO: 316175 - RNA, 32 nt, Human
agcccaccuccccugcucuccuucccagcauu

SEQ ID NO: 316176 - RNA, 32 nt, Human
agcccaccugcaggaagagauuuggcuggguu

SEQ ID NO: 316177 - RNA, 32 nt, Human
agcccaccugcccuccccuuuuucgggacucu

SEQ ID NO: 316178 - RNA, 32 nt, Human
agcccaccuggguaccugacccccaggggaug

SEQ ID NO: 316179 - RNA, 32 nt, Human
agcccaccuguggcggagcgugccauccugcc

SEQ ID NO: 316180 - RNA, 32 nt, Human
agcccaccuucucuuuucacauaggagggaac

SEQ ID NO: 316181 - RNA, 20 nt, Human
agcccaccuugucucuugga

SEQ ID NO: 316182 - RNA, 32 nt, Human
agcccacgaggauggucacaugccaugugcag

SEQ ID NO: 316183 - RNA, 24 nt, Human
agcccacgaguucaaggcugcagu

SEQ ID NO: 316184 - RNA, 32 nt, Human
agcccacgaguucaaggcugcagugagucgug

SEQ ID NO: 316185 - RNA, 20 nt, Human
agcccacgcccacccccucc

SEQ ID NO: 316186 - RNA, 32 nt, Human
agcccacgccucuaaucccagcacuuugggag

SEQ ID NO: 316187 - RNA, 32 nt, Human
agcccacgucuguaaucccugcacuuugggag

SEQ ID NO: 316188 - RNA, 25 nt, Human
agcccacuaccucauaagcugcagu

SEQ ID NO: 316189 - RNA, 32 nt, Human
agcccacuaggcccccucccaaccccaguacc

SEQ ID NO: 316190 - RNA, 21 nt, Human
agcccacuauaggcccaggcg

SEQ ID NO: 316191 - RNA, 32 nt, Human
agcccacucauccuuuccccagcccucuucag

SEQ ID NO: 316192 - RNA, 32 nt, Human
agcccacuccaaugcaccaaucacagcucaug

SEQ ID NO: 316193 - RNA, 32 nt, Human
agcccacuccacccugccagcagcuuccagcc

SEQ ID NO: 316194 - RNA, 32 nt, Human
agcccacuccagccaggggagcagggaagaag

SEQ ID NO: 316195 - RNA, 23 nt, Human
agcccacucugcaaggcugcggu

SEQ ID NO: 316196 - RNA, 32 nt, Human
agcccacugcagccuccaacuccugggcucaa

SEQ ID NO: 316197 - RNA, 23 nt, Human
agcccacugcagccuccaccucc

SEQ ID NO: 316198 - RNA, 32 nt, Human
agcccacugcagccuccaccucccaggcucaa

SEQ ID NO: 316199 - RNA, 32 nt, Human
agcccacugcagcugccacaucccugagccua

SEQ ID NO: 316200 - RNA, 32 nt, Human
agcccacugcagcugccacaucccuggacaca

SEQ ID NO: 316201 - RNA, 32 nt, Human
agcccacugccuccugccugggguggccuggc

SEQ ID NO: 316202 - RNA, 32 nt, Human
agcccacugccuggaaagcccuucggagagcu

SEQ ID NO: 316203 - RNA, 32 nt, Human
agcccacugcggcugcucaagacccuggagcu

SEQ ID NO: 316204 - RNA, 32 nt, Human
agcccacugcucauuguauaagccccgaggcc

SEQ ID NO: 316205 - RNA, 32 nt, Human
agcccacugcuccccacugccccgcccuuucg

SEQ ID NO: 316206 - RNA, 32 nt, Human
agcccacugcugucagugcuuccaguuguaau

SEQ ID NO: 316207 - RNA, 32 nt, Human
agcccacuggggcucucaccuccacauguggg

SEQ ID NO: 316208 - RNA, 32 nt, Human
agcccacugggucuucagggugcacuggaagc

SEQ ID NO: 316209 - RNA, 32 nt, Human
agcccacugugucuccuuccccuaccugcaac

SEQ ID NO: 316210 - RNA, 32 nt, Human
agcccacuucgccugcucacagcccaucuggg

SEQ ID NO: 316211 - RNA, 32 nt, Human
agcccacuuuccccaucucaucacagauccag

SEQ ID NO: 316212 - RNA, 32 nt, Human
agcccacuuuccccaucucaucaccagugauu

SEQ ID NO: 316213 - RNA, 20 nt, Human
agcccagaaaguggcugcag

SEQ ID NO: 316214 - RNA, 32 nt, Human
agcccagaagaacacuuuucugccauuuaaaa

SEQ ID NO: 316215 - RNA, 32 nt, Human
agcccagaagagcaagauaaacuugaaaauaa

SEQ ID NO: 316216 - RNA, 24 nt, Human
agcccagaagcucaaggcugcagu

SEQ ID NO: 316217 - RNA, 24 nt, Human
agcccagaagcuugaagcugcagu

SEQ ID NO: 316218 - RNA, 32 nt, Human
agcccagaaggcagagguuguagugagcugag

SEQ ID NO: 316219 - RNA, 32 nt, Human
agcccagaaggccgcagugaggugagaucgcg

SEQ ID NO: 316220 - RNA, 23 nt, Human
agcccagaaggucgaggcugcag

SEQ ID NO: 316221 - RNA, 24 nt, Human
agcccagaaggucgaggcugcagu

SEQ ID NO: 316222 - RNA, 32 nt, Human
agcccagaaggucgaggcugcagugagcugag

SEQ ID NO: 316223 - RNA, 24 nt, Human
agcccagaagguugagacugcagu

SEQ ID NO: 316224 - RNA, 22 nt, Human
agcccagaaguucaaggcugca

SEQ ID NO: 316225 - RNA, 32 nt, Human
agcccagaaguucgagguugcagugagccaug

SEQ ID NO: 316226 - RNA, 23 nt, Human
agcccagaaguuugagccugggc

SEQ ID NO: 316227 - RNA, 22 nt, Human
agcccagaaguuugaggcugca

SEQ ID NO: 316228 - RNA, 22 nt, Human
agcccagaauucccaaaggcau

SEQ ID NO: 316229 - RNA, 32 nt, Human
agcccagacaccucacucuguuccgucuaagc

SEQ ID NO: 316230 - RNA, 32 nt, Human
agcccagacacucacagcccccugccagacca

SEQ ID NO: 316231 - RNA, 32 nt, Human
agcccagacagcugcaagucaccauggacgcu

SEQ ID NO: 316232 - RNA, 32 nt, Human
agcccagacaguuccagccacuaggaggccgu

SEQ ID NO: 316233 - RNA, 32 nt, Human
agcccagaccacaccugccacggucuuccagg

SEQ ID NO: 316234 - RNA, 32 nt, Human
agcccagaccacaugcaguuuucaugcgucau

SEQ ID NO: 316235 - RNA, 32 nt, Human
agcccagacucugcccuguugugcuggcagaa

SEQ ID NO: 316236 - RNA, 20 nt, Human
agcccagacugcccuggggc

SEQ ID NO: 316237 - RNA, 32 nt, Human
agcccagacuuugacaaacccaccucaacauc

SEQ ID NO: 316238 - RNA, 32 nt, Human
agcccagagagcuuagucaaagacgauaucac

SEQ ID NO: 316239 - RNA, 32 nt, Human
agcccagagaugcugcugcugccccugcugcu

SEQ ID NO: 316240 - RNA, 32 nt, Human
agcccagagcccaagauggagccccagcuggg

SEQ ID NO: 316241 - RNA, 32 nt, Human
agcccagagccugucuggaagggcugucugug

SEQ ID NO: 316242 - RNA, 20 nt, Human
agcccagagcugcugaggug

SEQ ID NO: 316243 - RNA, 32 nt, Human
agcccagaggcagccucagcuccagggcuaag

SEQ ID NO: 316244 - RNA, 32 nt, Human
agcccagaggcggagguugcagugagccgaga

SEQ ID NO: 316245 - RNA, 32 nt, Human
agcccagagggugggagccuaaggaagcgugg

SEQ ID NO: 316246 - RNA, 32 nt, Human
agcccagagguagaggcugcagugagccauga

SEQ ID NO: 316247 - RNA, 32 nt, Human
agcccagauggaccuggugccccugcgagguc

SEQ ID NO: 316248 - RNA, 24 nt, Human
agcccagauguuggagccacacca

SEQ ID NO: 316249 - RNA, 23 nt, Human
agcccagauugugccacugcacu

SEQ ID NO: 316250 - RNA, 32 nt, Human
agcccagcaaaugaucagccuugcaaauaauc

SEQ ID NO: 316251 - RNA, 24 nt, Human
agcccagcaacgggguccugaggc

SEQ ID NO: 316252 - RNA, 31 nt, Human
agcccagcaaugucugugcucaaggagcaaa

SEQ ID NO: 316253 - RNA, 25 nt, Human
agcccagcacaucacagccccauca

SEQ ID NO: 316254 - RNA, 32 nt, Human
agcccagcagaggccacuccacacccagcuuc

SEQ ID NO: 316255 - RNA, 32 nt, Human
agcccagcagagggcucuaugcacggguuuca

SEQ ID NO: 316256 - RNA, 32 nt, Human
agcccagcagaugccagcaccaugcuuccuau

SEQ ID NO: 316257 - RNA, 32 nt, Human
agcccagcagcuggcugggaucccauggggga

SEQ ID NO: 316258 - RNA, 32 nt, Human
agcccagcaggcagagguugcagugagcugag

SEQ ID NO: 316259 - RNA, 32 nt, Human
agcccagcaguuggaggcugcagugagcuaug

SEQ ID NO: 316260 - RNA, 32 nt, Human
agcccagccacuuucugaguguuguccugggg

SEQ ID NO: 316261 - RNA, 32 nt, Human
agcccagccagcaggagggacugaggcccucu

SEQ ID NO: 316262 - RNA, 31 nt, Human
agcccagccagcaucugacaugcugaauuca

SEQ ID NO: 316263 - RNA, 32 nt, Human
agcccagccagcccagccagcccagccagccc

SEQ ID NO: 316264 - RNA, 32 nt, Human
agcccagccagcccagccagcccggaggucau

SEQ ID NO: 316265 - RNA, 32 nt, Human
agcccagccagccccagacuccagugcaccag

SEQ ID NO: 316266 - RNA, 32 nt, Human
agcccagccagccucuacccaucccucccucc

SEQ ID NO: 316267 - RNA, 32 nt, Human
agcccagcccaggaguuugaggcugcaaugag

SEQ ID NO: 316268 - RNA, 32 nt, Human
agcccagccccaggaugugucgcaccagcagc

SEQ ID NO: 316269 - RNA, 32 nt, Human
agcccagccccucaggugcccccacacacagc

SEQ ID NO: 316270 - RNA, 32 nt, Human
agcccagccccuggcccugccucccgcgcccc

SEQ ID NO: 316271 - RNA, 32 nt, Human
agcccagcccuggaagguggaaaaagaaaagu

SEQ ID NO: 316272 - RNA, 24 nt, Human
agcccagcccugugcccccgcuga

SEQ ID NO: 316273 - RNA, 32 nt, Human
agcccagccuaggaaagaggcagcagucucag

SEQ ID NO: 316274 - RNA, 24 nt, Human
agcccagccuaggcaacauagcga

SEQ ID NO: 316275 - RNA, 17 nt, Human
agcccagccuccccccu

SEQ ID NO: 316276 - RNA, 32 nt, Human
agcccagccugaccaauauggugaaaccccgu

SEQ ID NO: 316277 - RNA, 17 nt, Human
agcccagccugcccccu

SEQ ID NO: 316278 - RNA, 32 nt, Human
agcccagccugccucaucccaccccaaugcuu

SEQ ID NO: 316279 - RNA, 32 nt, Human
agcccagccugggaacacagaugccccgcggg

SEQ ID NO: 316280 - RNA, 17 nt, Human
agcccagcguggccccu

SEQ ID NO: 316281 - RNA, 32 nt, Human
agcccagcucaagcuucaucuuccucaaaaug

SEQ ID NO: 316282 - RNA, 32 nt, Human
agcccagcuccugguggccccagugggacuga

SEQ ID NO: 316283 - RNA, 18 nt, Human
agcccagcucugucaccu

SEQ ID NO: 316284 - RNA, 21 nt, Human
agcccagcucuugcugugcca

SEQ ID NO: 316285 - RNA, 32 nt, Human
agcccagcugagucagaaagguugugaccuga

SEQ ID NO: 316286 - RNA, 32 nt, Human
agcccagcuggagggcccgaggcugcagggug

SEQ ID NO: 316287 - RNA, 32 nt, Human
agcccaggaaaagaugucuggaguuaaggaag

SEQ ID NO: 316288 - RNA, 21 nt, Human
agcccaggaaaggccugaagg

SEQ ID NO: 316289 - RNA, 24 nt, Human
agcccaggaaauugaggcugcagu

SEQ ID NO: 316290 - RNA, 32 nt, Human
agcccaggaaauugaggcugcagugagccaug

SEQ ID NO: 316291 - RNA, 24 nt, Human
agcccaggaaauuggggcugcagu

SEQ ID NO: 316292 - RNA, 16 nt, Human
agcccaggaacccccc

SEQ ID NO: 316293 - RNA, 18 nt, Human
agcccaggaacugaggcg

SEQ ID NO: 316294 - RNA, 24 nt, Human
agcccaggaagcagagguugcagu

SEQ ID NO: 316295 - RNA, 32 nt, Human
agcccaggaagcagagguugcagugagccucg

SEQ ID NO: 316296 - RNA, 21 nt, Human
agcccaggaagccacuccagu

SEQ ID NO: 316297 - RNA, 32 nt, Human
agcccaggaagccucaguuggccaaagugcua

SEQ ID NO: 316298 - RNA, 24 nt, Human
agcccaggaagcggaggcugcagu

SEQ ID NO: 316299 - RNA, 32 nt, Human
agcccaggaagcggagguuacagugagcugau

SEQ ID NO: 316300 - RNA, 22 nt, Human
agcccaggaagcggagguugca

SEQ ID NO: 316301 - RNA, 32 nt, Human
agcccaggaagcggagguugcaaugagccgag

SEQ ID NO: 316302 - RNA, 32 nt, Human
agcccaggaagguuagauguguuugcaaauaa

SEQ ID NO: 316303 - RNA, 24 nt, Human
agcccaggaagucaaggcugcagu

SEQ ID NO: 316304 - RNA, 32 nt, Human
agcccaggaagucaaggcugcagugagcugug

SEQ ID NO: 316305 - RNA, 24 nt, Human
agcccaggaaguggaggcugcagu

SEQ ID NO: 316306 - RNA, 32 nt, Human
agcccaggaaguggaggcugcagugaccuaug

SEQ ID NO: 316307 - RNA, 24 nt, Human
agcccaggaaguggagguugcagu

SEQ ID NO: 316308 - RNA, 26 nt, Human
agcccaggaaguggagguugcaguga

SEQ ID NO: 316309 - RNA, 32 nt, Human
agcccaggaaguggagguugcagugagcagag

SEQ ID NO: 316310 - RNA, 24 nt, Human
agcccaggaaguugaggcugcagu

SEQ ID NO: 316311 - RNA, 32 nt, Human
agcccaggaaguugaggcugcagugagcugug

SEQ ID NO: 316312 - RNA, 24 nt, Human
agcccaggaauucaaggcugcagu

SEQ ID NO: 316313 - RNA, 24 nt, Human
agcccaggaauuggaggcugcagu

SEQ ID NO: 316314 - RNA, 32 nt, Human
agcccaggaauuggaggcugcagugagcuaug

SEQ ID NO: 316315 - RNA, 23 nt, Human
agcccaggaauuugaggcugcag

SEQ ID NO: 316316 - RNA, 32 nt, Human
agcccaggaauuugaggcugcagugagcuauu

SEQ ID NO: 316317 - RNA, 32 nt, Human
agcccaggacacugccuuugcugccuucuguc

SEQ ID NO: 316318 - RNA, 24 nt, Human
agcccaggacaucgaggcugcggu

SEQ ID NO: 316319 - RNA, 17 nt, Human
agcccaggacccaggag

SEQ ID NO: 316320 - RNA, 20 nt, Human
agcccaggacugcccgggcg

SEQ ID NO: 316321 - RNA, 22 nt, Human
agcccaggacuucgaggcugca

SEQ ID NO: 316322 - RNA, 32 nt, Human
agcccaggagacagagguugcagugagccaag

SEQ ID NO: 316323 - RNA, 32 nt, Human
agcccaggagaugcaggcuugcagugagccau

SEQ ID NO: 316324 - RNA, 24 nt, Human
agcccaggagauggagguugcagu

SEQ ID NO: 316325 - RNA, 26 nt, Human
agcccaggagauggagguugcaguga

SEQ ID NO: 316326 - RNA, 24 nt, Human
agcccaggagauuaagacuguagu

SEQ ID NO: 316327 - RNA, 24 nt, Human
agcccaggagauugaggcugcagu

SEQ ID NO: 316328 - RNA, 32 nt, Human
agcccaggagauugaggcugcagugagcauga

SEQ ID NO: 316329 - RNA, 32 nt, Human
agcccaggagauugaggcugcagugagccaug

SEQ ID NO: 316330 - RNA, 32 nt, Human
agcccaggagccaccagaucucccaacaccau

SEQ ID NO: 316331 - RNA, 32 nt, Human
agcccaggagccagggggugacugggguggcu

SEQ ID NO: 316332 - RNA, 17 nt, Human
agcccaggagccccccu

SEQ ID NO: 316333 - RNA, 32 nt, Human
agcccaggagccucucugaaggaccagucugg

SEQ ID NO: 316334 - RNA, 19 nt, Human
agcccaggagccugagggg

SEQ ID NO: 316335 - RNA, 32 nt, Human
agcccaggagcgguggcucacacuuguaaucc

SEQ ID NO: 316336 - RNA, 24 nt, Human
agcccaggagcucaagauugcagu

SEQ ID NO: 316337 - RNA, 32 nt, Human
agcccaggagcucaagauugcagugagcuaug

SEQ ID NO: 316338 - RNA, 17 nt, Human
agcccaggagcuccccu

SEQ ID NO: 316339 - RNA, 32 nt, Human
agcccaggagcuggaggcugcagugaacuaug

SEQ ID NO: 316340 - RNA, 24 nt, Human
agcccaggaggaggaggcugcagu

SEQ ID NO: 316341 - RNA, 32 nt, Human
agcccaggaggaggaggcugcagugagcuaag

SEQ ID NO: 316342 - RNA, 24 nt, Human
agcccaggaggcacaggcugcagu

SEQ ID NO: 316343 - RNA, 32 nt, Human
agcccaggaggcacaggcugcagugagcagag

SEQ ID NO: 316344 - RNA, 32 nt, Human
agcccaggaggcagaauuugcagugagcugag

SEQ ID NO: 316345 - RNA, 24 nt, Human
agcccaggaggcagaggcugcagu

SEQ ID NO: 316346 - RNA, 32 nt, Human
agcccaggaggcagaggcugcagugagccaug

SEQ ID NO: 316347 - RNA, 32 nt, Human
agcccaggaggcagaggcugcagugagccgag

SEQ ID NO: 316348 - RNA, 24 nt, Human
agcccaggaggcagagguugcagu

SEQ ID NO: 316349 - RNA, 32 nt, Human
agcccaggaggcagagguugcaguaagccgag

SEQ ID NO: 316350 - RNA, 32 nt, Human
agcccaggaggcagagguugcagugagccaag

SEQ ID NO: 316351 - RNA, 32 nt, Human
agcccaggaggccaagguugcagugggcccag

SEQ ID NO: 316352 - RNA, 24 nt, Human
agcccaggaggccaagucugcagu

SEQ ID NO: 316353 - RNA, 32 nt, Human
agcccaggaggccaagucugcagugagcuaug

SEQ ID NO: 316354 - RNA, 24 nt, Human
agcccaggaggcggagauugcagu

SEQ ID NO: 316355 - RNA, 26 nt, Human
agcccaggaggcggagauugcaguga

SEQ ID NO: 316356 - RNA, 32 nt, Human
agcccaggaggcggagauugcagugagccgag

SEQ ID NO: 316357 - RNA, 32 nt, Human
agcccaggaggcggagcuugcagugagucgag

SEQ ID NO: 316358 - RNA, 24 nt, Human
agcccaggaggcggaggcugcagu

SEQ ID NO: 316359 - RNA, 32 nt, Human
agcccaggaggcggaggcugcagugagcugag

SEQ ID NO: 316360 - RNA, 24 nt, Human
agcccaggaggcggagguugcagu

SEQ ID NO: 316361 - RNA, 32 nt, Human
agcccaggaggcggagguugcagugagcugag

SEQ ID NO: 316362 - RNA, 26 nt, Human
agcccaggaggcggagguugcgguga

SEQ ID NO: 316363 - RNA, 18 nt, Human
agcccaggaggcugaggc

SEQ ID NO: 316364 - RNA, 22 nt, Human
agcccaggaggcugaggcugca

SEQ ID NO: 316365 - RNA, 32 nt, Human
agcccaggaggucaagacugcagugagcuaug

SEQ ID NO: 316366 - RNA, 32 nt, Human
agcccaggaggucaaggcuacagugagccgug

SEQ ID NO: 316367 - RNA, 24 nt, Human
agcccaggaggucaaggcugaagu

SEQ ID NO: 316368 - RNA, 24 nt, Human
agcccaggaggucaaggcugcagu

SEQ ID NO: 316369 - RNA, 32 nt, Human
agcccaggaggucaaggcugcagugagccgug

SEQ ID NO: 316370 - RNA, 32 nt, Human
agcccaggaggucaaggcugcagugagcugca

SEQ ID NO: 316371 - RNA, 32 nt, Human
agcccaggaggucaaggcugcagugagcugug

SEQ ID NO: 316372 - RNA, 32 nt, Human
agcccaggaggucaaggcugcagugagcuuug

SEQ ID NO: 316373 - RNA, 24 nt, Human
agcccaggaggucaaggguacagu

SEQ ID NO: 316374 - RNA, 32 nt, Human
agcccaggaggucaaggguacagugagccgag

SEQ ID NO: 316375 - RNA, 24 nt, Human
agcccaggaggucagggcugcagu

SEQ ID NO: 316376 - RNA, 32 nt, Human
agcccaggaggucagggcugcagugagccgag

SEQ ID NO: 316377 - RNA, 32 nt, Human
agcccaggaggucgaagcugcagugagguaug

SEQ ID NO: 316378 - RNA, 24 nt, Human
agcccaggaggucgaggcugcagu

SEQ ID NO: 316379 - RNA, 32 nt, Human
agcccaggaggucgaggcugcagugagccaug

SEQ ID NO: 316380 - RNA, 32 nt, Human
agcccaggaggucgaggcugcagugagcccug

SEQ ID NO: 316381 - RNA, 32 nt, Human
agcccaggaggucgaggcugcagugagcuaug

SEQ ID NO: 316382 - RNA, 32 nt, Human
agcccaggaggucgaggcugcagugagcugug

SEQ ID NO: 316383 - RNA, 32 nt, Human
agcccaggaggucgagguugcagugagcagua

SEQ ID NO: 316384 - RNA, 24 nt, Human
agcccaggaggucuaggcugcagu

SEQ ID NO: 316385 - RNA, 32 nt, Human
agcccaggaggucuaggcugcagugagcuuau

SEQ ID NO: 316386 - RNA, 23 nt, Human
agcccaggagguggaaacugcag

SEQ ID NO: 316387 - RNA, 32 nt, Human
agcccaggagguggaaacugcagagagucaug

SEQ ID NO: 316388 - RNA, 22 nt, Human
agcccaggagguggaggcugca

SEQ ID NO: 316389 - RNA, 32 nt, Human
agcccaggagguggaggcugcaaugagcugag

SEQ ID NO: 316390 - RNA, 24 nt, Human
agcccaggagguggaggcugcagu

SEQ ID NO: 316391 - RNA, 26 nt, Human
agcccaggagguggaggcugcaguga

SEQ ID NO: 316392 - RNA, 32 nt, Human
agcccaggagguggaggcugcagugagccaug

SEQ ID NO: 316393 - RNA, 32 nt, Human
agcccaggagguggagguugcaaugagccgag

SEQ ID NO: 316394 - RNA, 26 nt, Human
agcccaggagguggagguugcacuga

SEQ ID NO: 316395 - RNA, 32 nt, Human
agcccaggagguggagguugcacugagcggag

SEQ ID NO: 316396 - RNA, 24 nt, Human
agcccaggagguggagguugcagu

SEQ ID NO: 316397 - RNA, 26 nt, Human
agcccaggagguggagguugcaguga

SEQ ID NO: 316398 - RNA, 32 nt, Human
agcccaggagguggagguugcagugagcagag

SEQ ID NO: 316399 - RNA, 32 nt, Human
agcccaggagguggagguugcagugagccaag

SEQ ID NO: 316400 - RNA, 32 nt, Human
agcccaggagguggagguugcagugagccaug

SEQ ID NO: 316401 - RNA, 32 nt, Human
agcccaggagguggagguugcagugagccgag

SEQ ID NO: 316402 - RNA, 32 nt, Human
agcccaggagguggagguugcagugagcggag

SEQ ID NO: 316403 - RNA, 32 nt, Human
agcccaggagguggagguugcagugagcugag

SEQ ID NO: 316404 - RNA, 32 nt, Human
agcccaggagguggagguuucagcgagcugag

SEQ ID NO: 316405 - RNA, 32 nt, Human
agcccaggagguugagaaugcagugagcuugu

SEQ ID NO: 316406 - RNA, 24 nt, Human
agcccaggagguugaggcugcagu

SEQ ID NO: 316407 - RNA, 32 nt, Human
agcccaggagguugaggcugcagugaacuaag

SEQ ID NO: 316408 - RNA, 32 nt, Human
agcccaggagguugaggcugcagugagcagag

SEQ ID NO: 316409 - RNA, 32 nt, Human
agcccaggagguugaggcugcagugagccaug

SEQ ID NO: 316410 - RNA, 32 nt, Human
agcccaggagguugaggcugcagugagcuaug

SEQ ID NO: 316411 - RNA, 32 nt, Human
agcccaggagguugaggcugcagugagguaug

SEQ ID NO: 316412 - RNA, 32 nt, Human
agcccaggagguugaggcugcagugaggugug

SEQ ID NO: 316413 - RNA, 32 nt, Human
agcccaggagguugaggcugcagugaguucua

SEQ ID NO: 316414 - RNA, 32 nt, Human
agcccaggagguuguggauacagugaguuaug

SEQ ID NO: 316415 - RNA, 23 nt, Human
agcccaggagguuguggcugcag

SEQ ID NO: 316416 - RNA, 32 nt, Human
agcccaggagguuguggcugcagugagcugug

SEQ ID NO: 316417 - RNA, 22 nt, Human
agcccaggaguccagccugggc

SEQ ID NO: 316418 - RNA, 18 nt, Human
agcccaggagucugaggc

SEQ ID NO: 316419 - RNA, 32 nt, Human
agcccaggagucuugagaccagccugggcaac

SEQ ID NO: 316420 - RNA, 25 nt, Human
agcccaggaguuaagaggcugcagu

SEQ ID NO: 316421 - RNA, 32 nt, Human
agcccaggaguuaagaggcugcagugaccgau

SEQ ID NO: 316422 - RNA, 22 nt, Human
agcccaggaguucaaagcugca

SEQ ID NO: 316423 - RNA, 24 nt, Human
agcccaggaguucaaagcugcagu

SEQ ID NO: 316424 - RNA, 32 nt, Human
agcccaggaguucaaagcugcagugagucaug

SEQ ID NO: 316425 - RNA, 24 nt, Human
agcccaggaguucaaagcuguagu

SEQ ID NO: 316426 - RNA, 32 nt, Human
agcccaggaguucaagaccacccugggcaaca

SEQ ID NO: 316427 - RNA, 22 nt, Human
agcccaggaguucaaggcugca

SEQ ID NO: 316428 - RNA, 24 nt, Human
agcccaggaguucaaggcugcagu

SEQ ID NO: 316429 - RNA, 32 nt, Human
agcccaggaguucaaggcugcgguggucguga

SEQ ID NO: 316430 - RNA, 24 nt, Human
agcccaggaguucaaggcuucagu

SEQ ID NO: 316431 - RNA, 31 nt, Human
agcccaggaguucaauaccugucugggaaac

SEQ ID NO: 316432 - RNA, 24 nt, Human
agcccaggaguucagggcugcagu

SEQ ID NO: 316433 - RNA, 32 nt, Human
agcccaggaguucagggcugcagugagccuug

SEQ ID NO: 316434 - RNA, 32 nt, Human
agcccaggaguucagggcugcagugagguacg

SEQ ID NO: 316435 - RNA, 23 nt, Human
agcccaggaguucgaagcugcag

SEQ ID NO: 316436 - RNA, 32 nt, Human
agcccaggaguucgagaccacccugggcaaca

SEQ ID NO: 316437 - RNA, 23 nt, Human
agcccaggaguucgaggcugcag

SEQ ID NO: 316438 - RNA, 24 nt, Human
agcccaggaguucgaggcugcagu

SEQ ID NO: 316439 - RNA, 32 nt, Human
agcccaggaguucgaggcugcagugagcuaug

SEQ ID NO: 316440 - RNA, 24 nt, Human
agcccaggaguucgagguuacagu

SEQ ID NO: 316441 - RNA, 32 nt, Human
agcccaggaguucgagguuacagugaacuaug

SEQ ID NO: 316442 - RNA, 32 nt, Human
agcccaggaguucgggguuacagugagcugug

SEQ ID NO: 316443 - RNA, 24 nt, Human
agcccaggaguuggaggccgcagu

SEQ ID NO: 316444 - RNA, 32 nt, Human
agcccaggaguuggaggccgcagugagcugug

SEQ ID NO: 316445 - RNA, 24 nt, Human
agcccaggaguuggaggcuacagu

SEQ ID NO: 316446 - RNA, 24 nt, Human
agcccaggaguuuaaggcugcagu

SEQ ID NO: 316447 - RNA, 32 nt, Human
agcccaggaguuuaaggcugcagugagcuaug

SEQ ID NO: 316448 - RNA, 32 nt, Human
agcccaggaguuuaaggcugcagugagcuugg

SEQ ID NO: 316449 - RNA, 24 nt, Human
agcccaggaguuugaagcugcagu

SEQ ID NO: 316450 - RNA, 32 nt, Human
agcccaggaguuugaagcugcagugagcuaug

SEQ ID NO: 316451 - RNA, 24 nt, Human
agcccaggaguuugagacuacagu

SEQ ID NO: 316452 - RNA, 24 nt, Human
agcccaggaguuugagacuguagu

SEQ ID NO: 316453 - RNA, 32 nt, Human
agcccaggaguuugagaucagccuggucaaca

SEQ ID NO: 316454 - RNA, 32 nt, Human
agcccaggaguuugaggaugcagugagcuaug

SEQ ID NO: 316455 - RNA, 24 nt, Human
agcccaggaguuugaggcuacagu

SEQ ID NO: 316456 - RNA, 32 nt, Human
agcccaggaguuugaggcuacagugagcugug

SEQ ID NO: 316457 - RNA, 24 nt, Human
agcccaggaguuugaggcuccagu

SEQ ID NO: 316458 - RNA, 22 nt, Human
agcccaggaguuugaggcugca

SEQ ID NO: 316459 - RNA, 23 nt, Human
agcccaggaguuugaggcugcag

SEQ ID NO: 316460 - RNA, 24 nt, Human
agcccaggaguuugaggcugcagu

SEQ ID NO: 316461 - RNA, 32 nt, Human
agcccaggaguuugaggcugcagugagccaug

SEQ ID NO: 316462 - RNA, 32 nt, Human
agcccaggaguuugaggcugcagugagcuaug

SEQ ID NO: 316463 - RNA, 32 nt, Human
agcccaggaguuugaggcugcagugagcuauu

SEQ ID NO: 316464 - RNA, 32 nt, Human
agcccaggaguuugaggcugcagugagcugug

SEQ ID NO: 316465 - RNA, 32 nt, Human
agcccaggaguuugaggcugcagugaguuaug

SEQ ID NO: 316466 - RNA, 24 nt, Human
agcccaggaguuugaggcugcggu

SEQ ID NO: 316467 - RNA, 24 nt, Human
agcccaggaguuugagguugcagu

SEQ ID NO: 316468 - RNA, 32 nt, Human
agcccaggaguuugagguugcagugagcugau

SEQ ID NO: 316469 - RNA, 32 nt, Human
agcccaggaguuugagguugcagugagcugug

SEQ ID NO: 316470 - RNA, 17 nt, Human
agcccaggaucuguccc

SEQ ID NO: 316471 - RNA, 32 nt, Human
agcccaggaugcagagguugaagugagccaag

SEQ ID NO: 316472 - RNA, 32 nt, Human
agcccaggauggagguggcggucgcggcggcg

SEQ ID NO: 316473 - RNA, 32 nt, Human
agcccaggauuucaaguccagccugggcuaca

SEQ ID NO: 316474 - RNA, 32 nt, Human
agcccaggcaaggagagcaggagccagcguga

SEQ ID NO: 316475 - RNA, 21 nt, Human
agcccaggcacugcugagggg

SEQ ID NO: 316476 - RNA, 20 nt, Human
agcccaggcagccugaaggc

SEQ ID NO: 316477 - RNA, 21 nt, Human
agcccaggcaugagcucuggc

SEQ ID NO: 316478 - RNA, 18 nt, Human
agcccaggcaugguggug

SEQ ID NO: 316479 - RNA, 21 nt, Human
agcccaggccaaagagaaggc

SEQ ID NO: 316480 - RNA, 22 nt, Human
agcccaggcccagcauaaaggc

SEQ ID NO: 316481 - RNA, 32 nt, Human
agcccaggcccaggugcaggugcccaggucau

SEQ ID NO: 316482 - RNA, 21 nt, Human
agcccaggcccccucccuccc

SEQ ID NO: 316483 - RNA, 20 nt, Human
agcccaggccccgggcugca

SEQ ID NO: 316484 - RNA, 17 nt, Human
agcccaggccucccucu

SEQ ID NO: 316485 - RNA, 30 nt, Human
agcccaggccuccuugagcuccuguagccu

SEQ ID NO: 316486 - RNA, 21 nt, Human
agcccaggccuggugucugca

SEQ ID NO: 316487 - RNA, 16 nt, Human
agcccaggccuucccc

SEQ ID NO: 316488 - RNA, 18 nt, Human
agcccaggcgcccagcca

SEQ ID NO: 316489 - RNA, 18 nt, Human
agcccaggcggguccccu

SEQ ID NO: 316490 - RNA, 18 nt, Human
agcccaggcgguugaggc

SEQ ID NO: 316491 - RNA, 32 nt, Human
agcccaggcgguugaggcugcagugagccaug

SEQ ID NO: 316492 - RNA, 19 nt, Human
agcccaggcguccgcggcg

SEQ ID NO: 316493 - RNA, 22 nt, Human
agcccaggcugcccgacugcag

SEQ ID NO: 316494 - RNA, 32 nt, Human
agcccaggcugcugccaacagcgcccagccca

SEQ ID NO: 316495 - RNA, 32 nt, Human
agcccaggcuggagcaggaggcauuucaacuc

SEQ ID NO: 316496 - RNA, 17 nt, Human
agcccaggcuucugagg

SEQ ID NO: 316497 - RNA, 32 nt, Human
agcccaggcuuucaggcgaccucugcccuccc

SEQ ID NO: 316498 - RNA, 32 nt, Human
agcccagggaaaggcccagugacaggugugga

SEQ ID NO: 316499 - RNA, 32 nt, Human
agcccagggaaaggcccaguggcagguguggg

SEQ ID NO: 316500 - RNA, 32 nt, Human
agcccagggaagggaagggaccggucguggaa

SEQ ID NO: 316501 - RNA, 23 nt, Human
agcccagggacauccaagagcac

SEQ ID NO: 316502 - RNA, 17 nt, Human
agcccagggaccccccu

SEQ ID NO: 316503 - RNA, 32 nt, Human
agcccagggagccccgggaccccugguccagg

SEQ ID NO: 316504 - RNA, 32 nt, Human
agcccagggaggcagagguugcuguaaguuga

SEQ ID NO: 316505 - RNA, 32 nt, Human
agcccagggaggucaaggcugcagugagcaau

SEQ ID NO: 316506 - RNA, 21 nt, Human
agcccagggagucccagaggc

SEQ ID NO: 316507 - RNA, 32 nt, Human
agcccagggaugcaaagguugcagugaguuga

SEQ ID NO: 316508 - RNA, 22 nt, Human
agcccagggaugcccccaggcg

SEQ ID NO: 316509 - RNA, 19 nt, Human
agcccagggaugcugaggc

SEQ ID NO: 316510 - RNA, 24 nt, Human
agcccagggaugugacagcugcag

SEQ ID NO: 316511 - RNA, 24 nt, Human
agcccagggauguggcagcugcag

SEQ ID NO: 316512 - RNA, 32 nt, Human
agcccagggcaagaggaugcggguguccugag

SEQ ID NO: 316513 - RNA, 17 nt, Human
agcccagggcagccccu

SEQ ID NO: 316514 - RNA, 21 nt, Human
agcccagggcagccccugggc

SEQ ID NO: 316515 - RNA, 21 nt, Human
agcccagggcaugaagcccaa

SEQ ID NO: 316516 - RNA, 20 nt, Human
agcccagggccgcugagccg

SEQ ID NO: 316517 - RNA, 24 nt, Human
agcccagggcgcacggccugaggc

SEQ ID NO: 316518 - RNA, 19 nt, Human
agcccagggcucucugggc

SEQ ID NO: 316519 - RNA, 31 nt, Human
agcccagggcucucugggcagcugaugucug

SEQ ID NO: 316520 - RNA, 21 nt, Human
agcccagggcuggccugaagc

SEQ ID NO: 316521 - RNA, 32 nt, Human
agcccagggcugggggcugcuugucugcuauc

SEQ ID NO: 316522 - RNA, 32 nt, Human
agcccagggcuucagucuuccuuuauuuauaa

SEQ ID NO: 316523 - RNA, 21 nt, Human
agcccaggggccagccuaggc

SEQ ID NO: 316524 - RNA, 32 nt, Human
agcccaggggcugagcguuccuaggcgguuuc

SEQ ID NO: 316525 - RNA, 22 nt, Human
agcccagggggcaaggacacag

SEQ ID NO: 316526 - RNA, 22 nt, Human
agcccagggguaaaggcugaag

SEQ ID NO: 316527 - RNA, 24 nt, Human
agcccagggguucacagcugcagu

SEQ ID NO: 316528 - RNA, 32 nt, Human
agcccagggguuugaggcugcagugagccaca

SEQ ID NO: 316529 - RNA, 32 nt, Human
agcccagggguuugcggcugcagugagcugug

SEQ ID NO: 316530 - RNA, 22 nt, Human
agcccaggguaaaggcagcagu

SEQ ID NO: 316531 - RNA, 32 nt, Human
agcccaggguggcagagcuguggugcaggguu

SEQ ID NO: 316532 - RNA, 23 nt, Human
agcccagguaaguccuacugcag

SEQ ID NO: 316533 - RNA, 18 nt, Human
agcccagguacaugaggc

SEQ ID NO: 316534 - RNA, 23 nt, Human
agcccagguacccaggcccgggc

SEQ ID NO: 316535 - RNA, 32 nt, Human
agcccagguaggggcaggauggagggcugagc

SEQ ID NO: 316536 - RNA, 21 nt, Human
agcccagguauuaucaugcag

SEQ ID NO: 316537 - RNA, 23 nt, Human
agcccagguccagcccugcgcag

SEQ ID NO: 316538 - RNA, 22 nt, Human
agcccagguccaggcccgccag

SEQ ID NO: 316539 - RNA, 22 nt, Human
agcccaggucccccacugucag

SEQ ID NO: 316540 - RNA, 20 nt, Human
agcccaggucccugccuccu

SEQ ID NO: 316541 - RNA, 28 nt, Human
agcccagguccugcugccucucuuucac

SEQ ID NO: 316542 - RNA, 18 nt, Human
agcccagguccuggcugc

SEQ ID NO: 316543 - RNA, 21 nt, Human
agcccaggucuccagcuggag

SEQ ID NO: 316544 - RNA, 18 nt, Human
agcccaggucuccugggc

SEQ ID NO: 316545 - RNA, 32 nt, Human
agcccaggucugcacucgccuggaucaccuuc

SEQ ID NO: 316546 - RNA, 19 nt, Human
agcccaggucugcaugcug

SEQ ID NO: 316547 - RNA, 27 nt, Human
agcccaggucuggugcaacugcugcag

SEQ ID NO: 316548 - RNA, 21 nt, Human
agcccaggugaacaagcucag

SEQ ID NO: 316549 - RNA, 32 nt, Human
agcccaggugcacugcucacacccccaccugc

SEQ ID NO: 316550 - RNA, 22 nt, Human
agcccaggugccagccugaggc

SEQ ID NO: 316551 - RNA, 19 nt, Human
agcccaggugcccggaagc

SEQ ID NO: 316552 - RNA, 19 nt, Human
agcccaggugcgccagagc

SEQ ID NO: 316553 - RNA, 19 nt, Human
agcccagguggcacacgcc

SEQ ID NO: 316554 - RNA, 18 nt, Human
agcccagguggggcaggc

SEQ ID NO: 316555 - RNA, 22 nt, Human
agcccagguuccucuguaagcg

SEQ ID NO: 316556 - RNA, 32 nt, Human
agcccaguaggaggggcaggaggccgacacac

SEQ ID NO: 316557 - RNA, 24 nt, Human
agcccaguaggucgaggcugcagu

SEQ ID NO: 316558 - RNA, 32 nt, Human
agcccaguaggucgaggcugcagugagcugug

SEQ ID NO: 316559 - RNA, 32 nt, Human
agcccagucuggagugcagugguacaauaaug

SEQ ID NO: 316560 - RNA, 32 nt, Human
agcccagugaaacugaucguugacuucuggac

SEQ ID NO: 316561 - RNA, 32 nt, Human
agcccagugaagccucugagggauugaggggc

SEQ ID NO: 316562 - RNA, 32 nt, Human
agcccagugacacuuagccccugggacaauga

SEQ ID NO: 316563 - RNA, 32 nt, Human
agcccagugcagcucacugacaggguugacau

SEQ ID NO: 316564 - RNA, 32 nt, Human
agcccagugccagaaaccagcacuccaugaag

SEQ ID NO: 316565 - RNA, 32 nt, Human
agcccagugccagaggacagacagguucaaaa

SEQ ID NO: 316566 - RNA, 17 nt, Human
agcccagugccuccccu

SEQ ID NO: 316567 - RNA, 32 nt, Human
agcccagugccuccccuccaccccuaaagaau

SEQ ID NO: 316568 - RNA, 32 nt, Human
agcccagugcugucccggaacccccugcagcu

SEQ ID NO: 316569 - RNA, 22 nt, Human
agcccaguggcccucugagcug

SEQ ID NO: 316570 - RNA, 32 nt, Human
agcccagugggacuucagagauguggggucca

SEQ ID NO: 316571 - RNA, 32 nt, Human
agcccagugggugggaggaaggaugagggccc

SEQ ID NO: 316572 - RNA, 32 nt, Human
agcccaguuagcaaggugccgggucacccugc

SEQ ID NO: 316573 - RNA, 21 nt, Human
agcccaguucaaggcugcagu

SEQ ID NO: 316574 - RNA, 32 nt, Human
agcccaguucucucuuauuuucagcuuuacag

SEQ ID NO: 316575 - RNA, 20 nt, Human
agcccaguugcuguaucuga

SEQ ID NO: 316576 - RNA, 32 nt, Human
agcccaguuguccucgcccacaggguccugca

SEQ ID NO: 316577 - RNA, 32 nt, Human
agcccaguuucaaacuccugaccucaggugau

SEQ ID NO: 316578 - RNA, 32 nt, Human
agcccauaaccucccuguuccuagucacacau

SEQ ID NO: 316579 - RNA, 32 nt, Human
agcccauaagcacgugggcugaucuuguugga

SEQ ID NO: 316580 - RNA, 24 nt, Human
agcccauaaucccagcacuuuggg

SEQ ID NO: 316581 - RNA, 32 nt, Human
agcccauacccaggcuggcuccuggggcgacg

SEQ ID NO: 316582 - RNA, 32 nt, Human
agcccauaccucaccccugccuggugaggaug

SEQ ID NO: 316583 - RNA, 32 nt, Human
agcccaucaauaaaacuauugcaccuguccug

SEQ ID NO: 316584 - RNA, 32 nt, Human
agcccauccaccaauccucaccucucaccucu

SEQ ID NO: 316585 - RNA, 32 nt, Human
agcccauccagaggaacccgggaaugcccagg

SEQ ID NO: 316586 - RNA, 32 nt, Human
agcccauccagagguucccacaguucauacuc

SEQ ID NO: 316587 - RNA, 19 nt, Human
agcccaucccagcuacuug

SEQ ID NO: 316588 - RNA, 32 nt, Human
agcccaucccuggauuuccaccaggaguuacu

SEQ ID NO: 316589 - RNA, 19 nt, Human
agcccauccgcuugucccc

SEQ ID NO: 316590 - RNA, 22 nt, Human
agcccauccucugcagaaacag

SEQ ID NO: 316591 - RNA, 16 nt, Human
agcccauccugucccc

SEQ ID NO: 316592 - RNA, 32 nt, Human
agcccauccuuuccuuccguccuucugaaacc

SEQ ID NO: 316593 - RNA, 32 nt, Human
agcccaucuauuuccacacccagugagcauug

SEQ ID NO: 316594 - RNA, 32 nt, Human
agcccaucucacugcauucccuggcugcccga

SEQ ID NO: 316595 - RNA, 32 nt, Human
agcccaucucuagcacaccuugaccccaggaa

SEQ ID NO: 316596 - RNA, 32 nt, Human
agcccaucucucucagcugaauacuaagcuca

SEQ ID NO: 316597 - RNA, 21 nt, Human
agcccaucugccucaacuccu

SEQ ID NO: 316598 - RNA, 32 nt, Human
agcccaucuggcugcugaucugcuaucaccug

SEQ ID NO: 316599 - RNA, 32 nt, Human
agcccaucuucagaggagggccaaguguccau

SEQ ID NO: 316600 - RNA, 23 nt, Human
agcccaugaagucaggcugcagu

SEQ ID NO: 316601 - RNA, 32 nt, Human
agcccaugaagucaggcugcagugagcuguga

SEQ ID NO: 316602 - RNA, 32 nt, Human
agcccaugaggcccagguuacagugagccaag

SEQ ID NO: 316603 - RNA, 32 nt, Human
agcccaugagggugcgcagagcagggcuggca

SEQ ID NO: 316604 - RNA, 32 nt, Human
agcccaugagguggaggcuacaguggcuguga

SEQ ID NO: 316605 - RNA, 32 nt, Human
agcccaugaguucaaggcugcagugagucgug

SEQ ID NO: 316606 - RNA, 32 nt, Human
agcccaugccaaccccuccuggagccagccga

SEQ ID NO: 316607 - RNA, 32 nt, Human
agcccaugccauuaccuccugcuuccuuauca

SEQ ID NO: 316608 - RNA, 32 nt, Human
agcccaugcccagcuaauuuuguauuuuuagu

SEQ ID NO: 316609 - RNA, 32 nt, Human
agcccaugcgagcccuucuccugcugcucugg

SEQ ID NO: 316610 - RNA, 32 nt, Human
agcccaugcucaguacauauccuaaugaggaa

SEQ ID NO: 316611 - RNA, 32 nt, Human
agcccaugcuggccucaaacuccugggcucua

SEQ ID NO: 316612 - RNA, 31 nt, Human
agcccauggacaagcucaguccaggaccugu

SEQ ID NO: 316613 - RNA, 32 nt, Human
agcccauggagugcucucccacuggcaacauc

SEQ ID NO: 316614 - RNA, 32 nt, Human
agcccaugggaaugcccugaaacuacuguauc

SEQ ID NO: 316615 - RNA, 32 nt, Human
agcccauggggccugaagggaaaugggcagcu

SEQ ID NO: 316616 - RNA, 32 nt, Human
agcccaugucaugccaagagucagugccaucu

SEQ ID NO: 316617 - RNA, 32 nt, Human
agcccauuaguggcauagcugagggaguggau

SEQ ID NO: 316618 - RNA, 32 nt, Human
agcccauucaugcuuagaguccugccguggcu

SEQ ID NO: 316619 - RNA, 22 nt, Human
agcccauugccacugcuugcca

SEQ ID NO: 316620 - RNA, 21 nt, Human
agcccauuguggccuaagagg

SEQ ID NO: 316621 - RNA, 32 nt, Human
agcccauuucccccaaauuaaacguaaauguu

SEQ ID NO: 316622 - RNA, 32 nt, Human
agcccauuucucuccauuuccuccucauuagc

SEQ ID NO: 316623 - RNA, 23 nt, Human
agcccauuucuguuaaccucuua

SEQ ID NO: 316624 - RNA, 32 nt, Human
agccccaaaauacuucugauuuuucacgccuc

SEQ ID NO: 316625 - RNA, 32 nt, Human
agccccaaacauccuucuugaugcuuuggggg

SEQ ID NO: 316626 - RNA, 32 nt, Human
agccccaaagaucccacgggagaggggagagg

SEQ ID NO: 316627 - RNA, 32 nt, Human
agccccaaagccccagauccccuuaaagcaga

SEQ ID NO: 316628 - RNA, 23 nt, Human
agccccaaaggacuagccccaca

SEQ ID NO: 316629 - RNA, 32 nt, Human
agccccaaaugugacuuuauuuggaaauggga

SEQ ID NO: 316630 - RNA, 32 nt, Human
agccccaacacagaggugagaccaggaauaag

SEQ ID NO: 316631 - RNA, 22 nt, Human
agccccaaccuucagggcucag

SEQ ID NO: 316632 - RNA, 32 nt, Human
agccccaagcaggacgaaaaagaggcauacac

SEQ ID NO: 316633 - RNA, 18 nt, Human
agccccaagcagguggug

SEQ ID NO: 316634 - RNA, 32 nt, Human
agccccaagcccgagccgcgcccagcccgagc

SEQ ID NO: 316635 - RNA, 21 nt, Human
agccccaaggccaccccacca

SEQ ID NO: 316636 - RNA, 22 nt, Human
agccccaaggcccgaccccucc

SEQ ID NO: 316637 - RNA, 32 nt, Human
agccccaagggcccugggggcagccacccucc

SEQ ID NO: 316638 - RNA, 20 nt, Human
agccccaagguugaucccac

SEQ ID NO: 316639 - RNA, 32 nt, Human
agccccaagugugguccugaacuggggccggg

SEQ ID NO: 316640 - RNA, 32 nt, Human
agccccaaguguugcccagccuccgcauccac

SEQ ID NO: 316641 - RNA, 23 nt, Human
agccccaauucugcuuucccaca

SEQ ID NO: 316642 - RNA, 32 nt, Human
agccccacaaguagcugagacuacaggcacac

SEQ ID NO: 316643 - RNA, 32 nt, Human
agccccacagcaccuggagcugcccacugucu

SEQ ID NO: 316644 - RNA, 32 nt, Human
agccccacagccgcgugcucgggacuauggga

SEQ ID NO: 316645 - RNA, 32 nt, Human
agccccacaggcacgaucuguuccuccuggga

SEQ ID NO: 316646 - RNA, 32 nt, Human
agccccacaucccgcggccccagcacaaggug

SEQ ID NO: 316647 - RNA, 32 nt, Human
agccccacccaagaggagggcagcgugugccu

SEQ ID NO: 316648 - RNA, 32 nt, Human
agccccacccaccccugcccuuucagaccccu

SEQ ID NO: 316649 - RNA, 21 nt, Human
agccccacccaggccaggcau

SEQ ID NO: 316650 - RNA, 27 nt, Human
agccccacccaggcccccaucugggau

SEQ ID NO: 316651 - RNA, 32 nt, Human
agccccaccccacauggagcucagggggaagc

SEQ ID NO: 316652 - RNA, 32 nt, Human
agccccacccccagguuuuugcccauccuccc

SEQ ID NO: 316653 - RNA, 32 nt, Human
agccccaccccgagcgcacacugugauggagg

SEQ ID NO: 316654 - RNA, 32 nt, Human
agccccaccuccuaacaccauggauucaaagu

SEQ ID NO: 316655 - RNA, 32 nt, Human
agccccaccugcccccagccucugugacagug

SEQ ID NO: 316656 - RNA, 32 nt, Human
agccccaccugcccuucuucagguacugcuug

SEQ ID NO: 316657 - RNA, 32 nt, Human
agccccacgcagccccuguucugcugagugcg

SEQ ID NO: 316658 - RNA, 21 nt, Human
agccccacgccgccccaggga

SEQ ID NO: 316659 - RNA, 32 nt, Human
agccccacgugcacuccccggccugcauccgg

SEQ ID NO: 316660 - RNA, 32 nt, Human
agccccacguggugcugcucagccuucucugc

SEQ ID NO: 316661 - RNA, 32 nt, Human
agccccacuacauacagagaaacuaucaaccu

SEQ ID NO: 316662 - RNA, 32 nt, Human
agccccacucacacagcagccuaggaaggaag

SEQ ID NO: 316663 - RNA, 32 nt, Human
agccccacucccaguacauuucagugggagac

SEQ ID NO: 316664 - RNA, 20 nt, Human
agccccacucccgccccucc

SEQ ID NO: 316665 - RNA, 32 nt, Human
agccccacuccucugcugaccugcugaccugu

SEQ ID NO: 316666 - RNA, 32 nt, Human
agccccacugcacuccagccugggugacagag

SEQ ID NO: 316667 - RNA, 32 nt, Human
agccccacugcugaugacgaacuaucucuaac

SEQ ID NO: 316668 - RNA, 32 nt, Human
agccccacugcuuccaaacucugccugugucc

SEQ ID NO: 316669 - RNA, 32 nt, Human
agccccacuggcuguuugggaccauggagcgg

SEQ ID NO: 316670 - RNA, 32 nt, Human
agccccacugucucuaaccacuccugggcuaa

SEQ ID NO: 316671 - RNA, 32 nt, Human
agccccacuguuaaacugagguuggggguuuc

SEQ ID NO: 316672 - RNA, 32 nt, Human
agccccagaaaaggaaccuacucuccaugcac

SEQ ID NO: 316673 - RNA, 32 nt, Human
agccccagacagggagugagugaggcaagugg

SEQ ID NO: 316674 - RNA, 32 nt, Human
agccccagacagggcaugaggggcagagaauu

SEQ ID NO: 316675 - RNA, 32 nt, Human
agccccagagccuggcaacagccuggccugca

SEQ ID NO: 316676 - RNA, 32 nt, Human
agccccagaggcagagguuguggugagccgag

SEQ ID NO: 316677 - RNA, 24 nt, Human
agccccagaggucaaggcugcagu

SEQ ID NO: 316678 - RNA, 32 nt, Human
agccccagaggucaaggcugcagugagcugug

SEQ ID NO: 316679 - RNA, 32 nt, Human
agccccagaguauauugaauagaaauucugca

SEQ ID NO: 316680 - RNA, 32 nt, Human
agccccagagucagagcuggccacaggcuggc

SEQ ID NO: 316681 - RNA, 32 nt, Human
agccccagagugacaguggcccagcuggacug

SEQ ID NO: 316682 - RNA, 32 nt, Human
agccccagaguucuuccacaacaggaacaggc

SEQ ID NO: 316683 - RNA, 32 nt, Human
agccccagcagaagaauggagaggaggaggag

SEQ ID NO: 316684 - RNA, 32 nt, Human
agccccagcaggaagggugggccagccaggcc

SEQ ID NO: 316685 - RNA, 32 nt, Human
agccccagcccagaucuacuucaagagcaucu

SEQ ID NO: 316686 - RNA, 32 nt, Human
agccccagcccaucacccucccuggcuuuuag

SEQ ID NO: 316687 - RNA, 19 nt, Human
agccccagccccuuccagg

SEQ ID NO: 316688 - RNA, 32 nt, Human
agccccagccgccagccccgccuucucuuccu

SEQ ID NO: 316689 - RNA, 32 nt, Human
agccccagccucccaccacgcucacugccugg

SEQ ID NO: 316690 - RNA, 32 nt, Human
agccccagcuacuagggaggcugaggagggag

SEQ ID NO: 316691 - RNA, 32 nt, Human
agccccagcuacucaagaggcugaggcaggag

SEQ ID NO: 316692 - RNA, 32 nt, Human
agccccagcuacucaggaagcuagagcacgag

SEQ ID NO: 316693 - RNA, 32 nt, Human
agccccagcuacucaggcuggggugggaggau

SEQ ID NO: 316694 - RNA, 32 nt, Human
agccccagcuacucgggaggcugagaugggag

SEQ ID NO: 316695 - RNA, 32 nt, Human
agccccagcuacucgggaggcugaggcaggag

SEQ ID NO: 316696 - RNA, 32 nt, Human
agccccagcuacucgggaggcugagguggaaa

SEQ ID NO: 316697 - RNA, 32 nt, Human
agccccagcuacuugggaggcugaagcaggag

SEQ ID NO: 316698 - RNA, 32 nt, Human
agccccagcuacuugggaggcugaggcgggag

SEQ ID NO: 316699 - RNA, 32 nt, Human
agccccagcuacuugggaggcugaggugggag

SEQ ID NO: 316700 - RNA, 32 nt, Human
agccccagcuauucaggagacugaggcaggag

SEQ ID NO: 316701 - RNA, 32 nt, Human
agccccagcuccucuucuugccccgcauaucc

SEQ ID NO: 316702 - RNA, 32 nt, Human
agccccagcucugcauaccugcaccugcaccc

SEQ ID NO: 316703 - RNA, 24 nt, Human
agccccagcucuuccacuuguuaa

SEQ ID NO: 316704 - RNA, 32 nt, Human
agccccagcuguucucugucagcacacccacc

SEQ ID NO: 316705 - RNA, 32 nt, Human
agccccaggaagcccaacacaguggccaaaac

SEQ ID NO: 316706 - RNA, 32 nt, Human
agccccaggaagggcaaggcaagaugguggac

SEQ ID NO: 316707 - RNA, 32 nt, Human
agccccaggaagguuugcacagcugugcccca

SEQ ID NO: 316708 - RNA, 19 nt, Human
agccccaggaccuggggcg

SEQ ID NO: 316709 - RNA, 32 nt, Human
agccccaggaggucgaggcugcagugagccau

SEQ ID NO: 316710 - RNA, 32 nt, Human
agccccaggcagcccugucacagugagaagua

SEQ ID NO: 316711 - RNA, 23 nt, Human
agccccaggcauggcuaaccccu

SEQ ID NO: 316712 - RNA, 21 nt, Human
agccccaggcccaccucuccu

SEQ ID NO: 316713 - RNA, 32 nt, Human
agccccaggccuggccucgccugccuuucugc

SEQ ID NO: 316714 - RNA, 32 nt, Human
agccccaggccugguugcugggucugcccaca

SEQ ID NO: 316715 - RNA, 32 nt, Human
agccccaggcuccgucacccccucucugcuug

SEQ ID NO: 316716 - RNA, 32 nt, Human
agccccaggcugucuuagccccuggaguucag

SEQ ID NO: 316717 - RNA, 32 nt, Human
agccccagggaagcaggcuaggaugugagaga

SEQ ID NO: 316718 - RNA, 32 nt, Human
agccccagggaccugggcagcacuguccagca

SEQ ID NO: 316719 - RNA, 32 nt, Human
agccccagggccugggacagccugccgcugcc

SEQ ID NO: 316720 - RNA, 32 nt, Human
agccccaggggcuggcuuucaccagcugcagg

SEQ ID NO: 316721 - RNA, 32 nt, Human
agccccagggguggaggcugcaaugaacugug

SEQ ID NO: 316722 - RNA, 21 nt, Human
agccccagggugcccccaggc

SEQ ID NO: 316723 - RNA, 20 nt, Human
agccccagguacuugggcug

SEQ ID NO: 316724 - RNA, 32 nt, Human
agccccaggucggcggguguucccaggaagag

SEQ ID NO: 316725 - RNA, 32 nt, Human
agccccaguacacucuucucuggaccagaucu

SEQ ID NO: 316726 - RNA, 25 nt, Human
agccccaguccugccccccacccca

SEQ ID NO: 316727 - RNA, 32 nt, Human
agccccaguuuucuccuccucacuaggcugug

SEQ ID NO: 316728 - RNA, 32 nt, Human
agccccauaaguuuggagguucagaggcugga

SEQ ID NO: 316729 - RNA, 32 nt, Human
agccccaucacacuggcucuggcuucaagggc

SEQ ID NO: 316730 - RNA, 32 nt, Human
agccccauccacccugccuucaguuccuccca

SEQ ID NO: 316731 - RNA, 32 nt, Human
agccccaucccaaacccuucagugccaaaaac

SEQ ID NO: 316732 - RNA, 32 nt, Human
agccccaucccacucccuguuucgggccucgu

SEQ ID NO: 316733 - RNA, 32 nt, Human
agccccauccccaaugaagagcuugaguuuga

SEQ ID NO: 316734 - RNA, 32 nt, Human
agccccauccugaugaccucacagacaaggcc

SEQ ID NO: 316735 - RNA, 22 nt, Human
agccccaugccacgcccuggga

SEQ ID NO: 316736 - RNA, 22 nt, Human
agccccaugccgugccuagaga

SEQ ID NO: 316737 - RNA, 32 nt, Human
agccccauggaaauccccaaagagcucuggau

SEQ ID NO: 316738 - RNA, 17 nt, Human
agccccauggccccguc

SEQ ID NO: 316739 - RNA, 32 nt, Human
agccccauguacaaagcucaccaagccccugc

SEQ ID NO: 316740 - RNA, 32 nt, Human
agccccauguguccuggaagcugagggucccc

SEQ ID NO: 316741 - RNA, 32 nt, Human
agccccauugacacaaacccucaaagcagacg

SEQ ID NO: 316742 - RNA, 32 nt, Human
agccccauugcccaccuccacuucccauuggc

SEQ ID NO: 316743 - RNA, 32 nt, Human
agccccauuucucaggugcaguacagcacguc

SEQ ID NO: 316744 - RNA, 32 nt, Human
agcccccaacacaggcaaguccaccccauaau

SEQ ID NO: 316745 - RNA, 21 nt, Human
agcccccaaggaaggaggcug

SEQ ID NO: 316746 - RNA, 32 nt, Human
agcccccaaggcagaggcugagaaucagaaga

SEQ ID NO: 316747 - RNA, 32 nt, Human
agcccccaagugaaacugagguucaggagacc

SEQ ID NO: 316748 - RNA, 32 nt, Human
agcccccaaugcccaccaccugggccccgguc

SEQ ID NO: 316749 - RNA, 32 nt, Human
agcccccaaugcccggccaggcuaagccgcag

SEQ ID NO: 316750 - RNA, 32 nt, Human
agcccccacagcccuccagguccuccagcucu

SEQ ID NO: 316751 - RNA, 32 nt, Human
agcccccacaggcucugcuccacagaaacuua

SEQ ID NO: 316752 - RNA, 32 nt, Human
agcccccaccugcuggugacggggccagagag

SEQ ID NO: 316753 - RNA, 32 nt, Human
agcccccacucugccaagggcacuugcccgcc

SEQ ID NO: 316754 - RNA, 32 nt, Human
agcccccacugaggccgccgcugccgggccuc

SEQ ID NO: 316755 - RNA, 32 nt, Human
agcccccacugaggggccguagcccuaucuag

SEQ ID NO: 316756 - RNA, 18 nt, Human
agcccccacugugcccag

SEQ ID NO: 316757 - RNA, 32 nt, Human
agcccccagaagcagagcuuuguuuuggaggu

SEQ ID NO: 316758 - RNA, 32 nt, Human
agcccccagaguagcugggauuacaggcaugu

SEQ ID NO: 316759 - RNA, 32 nt, Human
agcccccagaucuugggugcaucugugggcag

SEQ ID NO: 316760 - RNA, 32 nt, Human
agcccccagcagaggcaggcugggacggacca

SEQ ID NO: 316761 - RNA, 24 nt, Human
agcccccagcagcugccccaggga

SEQ ID NO: 316762 - RNA, 32 nt, Human
agcccccagccaggagagaugacgcccccucc

SEQ ID NO: 316763 - RNA, 32 nt, Human
agcccccagccuccucccucagccugggcuac

SEQ ID NO: 316764 - RNA, 32 nt, Human
agcccccagccucuccccuccuccuccuuguc

SEQ ID NO: 316765 - RNA, 32 nt, Human
agcccccagcuggcuugauuuggcuggucuug

SEQ ID NO: 316766 - RNA, 32 nt, Human
agcccccaggagagggggucaguguuuccugg

SEQ ID NO: 316767 - RNA, 22 nt, Human
agcccccaggagccgcccacca

SEQ ID NO: 316768 - RNA, 32 nt, Human
agcccccaggcacccacccagcugggguguuu

SEQ ID NO: 316769 - RNA, 32 nt, Human
agcccccaggcagagucgcugguccucaggug

SEQ ID NO: 316770 - RNA, 32 nt, Human
agcccccaggcagugccuuaccuguggugccc

SEQ ID NO: 316771 - RNA, 23 nt, Human
agcccccaggcgcagugggcucu

SEQ ID NO: 316772 - RNA, 32 nt, Human
agcccccaggcugugagcuccuugggggcagg

SEQ ID NO: 316773 - RNA, 32 nt, Human
agcccccagguaacugggacuacaggcaugca

SEQ ID NO: 316774 - RNA, 32 nt, Human
agcccccagguggaagagaucaugcagcuggu

SEQ ID NO: 316775 - RNA, 32 nt, Human
agcccccagucacguuccucaggcuuacuuga

SEQ ID NO: 316776 - RNA, 24 nt, Human
agcccccaucacugcccccacccc

SEQ ID NO: 316777 - RNA, 32 nt, Human
agcccccaucccagucccgggaggcugccgcg

SEQ ID NO: 316778 - RNA, 32 nt, Human
agcccccaucccuguguuccccaagaauucag

SEQ ID NO: 316779 - RNA, 16 nt, Human
agcccccauggccuaa

SEQ ID NO: 316780 - RNA, 18 nt, Human
agcccccauguccgcaga

SEQ ID NO: 316781 - RNA, 32 nt, Human
agcccccauuauagccaugcgugcgguuuaua

SEQ ID NO: 316782 - RNA, 22 nt, Human
agcccccauucacuagaagcac

SEQ ID NO: 316783 - RNA, 32 nt, Human
agcccccauuuccuccuucauccuguggaguc

SEQ ID NO: 316784 - RNA, 25 nt, Human
agccccccaccccccagccccuccu

SEQ ID NO: 316785 - RNA, 25 nt, Human
agccccccaggcccccuaccccucu

SEQ ID NO: 316786 - RNA, 19 nt, Human
agcccccgcagcucugccc

SEQ ID NO: 316787 - RNA, 21 nt, Human
agcccccgccuccugagacug

SEQ ID NO: 316788 - RNA, 17 nt, Human
agcccccgcuccugccc

SEQ ID NO: 316789 - RNA, 24 nt, Human
agcccccgcuccugccccacccca

SEQ ID NO: 316790 - RNA, 32 nt, Human
agcccccgcugcucugugcccuguccggccag

SEQ ID NO: 316791 - RNA, 32 nt, Human
agcccccggaguagcugggaccacaggcacac

SEQ ID NO: 316792 - RNA, 26 nt, Human
agcccccgggagcuggaggguggcug

SEQ ID NO: 316793 - RNA, 32 nt, Human
agcccccguccacccuugugggucucugcucc

SEQ ID NO: 316794 - RNA, 32 nt, Human
agcccccgugcccgccacgccugcugccgccc

SEQ ID NO: 316795 - RNA, 21 nt, Human
agcccccguggcucuggacug

SEQ ID NO: 316796 - RNA, 32 nt, Human
agcccccguuccccaggguccugugggcugag

SEQ ID NO: 316797 - RNA, 19 nt, Human
agcccccuacccaauggca

SEQ ID NO: 316798 - RNA, 18 nt, Human
agcccccuaccccacaga

SEQ ID NO: 316799 - RNA, 22 nt, Human
agcccccuccacucccucccca

SEQ ID NO: 316800 - RNA, 32 nt, Human
agcccccuccacucccuccccauuccucccac

SEQ ID NO: 316801 - RNA, 32 nt, Human
agcccccuccacuggcgacacaacugcaccuu

SEQ ID NO: 316802 - RNA, 21 nt, Human
agcccccuccagagcccugcc

SEQ ID NO: 316803 - RNA, 21 nt, Human
agcccccucgggccucggggg

SEQ ID NO: 316804 - RNA, 32 nt, Human
agcccccucuccugaagcagugucgccguccc

SEQ ID NO: 316805 - RNA, 32 nt, Human
agcccccugacuuccaaaaucagugccuuugg

SEQ ID NO: 316806 - RNA, 32 nt, Human
agcccccugaguaccucagaugacaggugcgu

SEQ ID NO: 316807 - RNA, 32 nt, Human
agcccccugaguagcugggauuacaggugcac

SEQ ID NO: 316808 - RNA, 32 nt, Human
agcccccugaguagcugggauuacaggugccu

SEQ ID NO: 316809 - RNA, 32 nt, Human
agcccccugcagcugauggagcugugucacca

SEQ ID NO: 316810 - RNA, 32 nt, Human
agcccccugcccugcccugccccguguccacc

SEQ ID NO: 316811 - RNA, 32 nt, Human
agcccccugccugauccccugcuggcuggggg

SEQ ID NO: 316812 - RNA, 32 nt, Human
agcccccugcucaugcugaucaucuuccucuu

SEQ ID NO: 316813 - RNA, 32 nt, Human
agcccccugcugccauaggacuuggggccuau

SEQ ID NO: 316814 - RNA, 32 nt, Human
agcccccugcuuccuggccuaggcgaggguuc

SEQ ID NO: 316815 - RNA, 32 nt, Human
agcccccuggacucgcaggcgagcccaggacu

SEQ ID NO: 316816 - RNA, 32 nt, Human
agcccccugucuccuccaucauuugguuuccu

SEQ ID NO: 316817 - RNA, 32 nt, Human
agcccccuguggagagggugacugugggagag

SEQ ID NO: 316818 - RNA, 32 nt, Human
agcccccuuucuucccuuuucuguuuuacuuc

SEQ ID NO: 316819 - RNA, 32 nt, Human
agccccgaagaaugcggggaggugcggaggag

SEQ ID NO: 316820 - RNA, 32 nt, Human
agccccgaggaggaggaggaggaggaggaaga

SEQ ID NO: 316821 - RNA, 32 nt, Human
agccccgagggaacccagaagguggacgccac

SEQ ID NO: 316822 - RNA, 26 nt, Human
agccccgagggcacgcggcccgggca

SEQ ID NO: 316823 - RNA, 32 nt, Human
agccccgaggggaccccgcgccguaggaggga

SEQ ID NO: 316824 - RNA, 32 nt, Human
agccccgaugauucguaacaccaccuuucgcc

SEQ ID NO: 316825 - RNA, 32 nt, Human
agccccgauuccagcacccaccaccgccugac

SEQ ID NO: 316826 - RNA, 32 nt, Human
agccccgcaaaguacucggauuacagguguga

SEQ ID NO: 316827 - RNA, 19 nt, Human
agccccgcagccccggccg

SEQ ID NO: 316828 - RNA, 22 nt, Human
agccccgcagcccggcccgggc

SEQ ID NO: 316829 - RNA, 32 nt, Human
agccccgcagccgccgcgcggagaacagcgac

SEQ ID NO: 316830 - RNA, 32 nt, Human
agccccgcauuccuauuguaccaaaaugucug

SEQ ID NO: 316831 - RNA, 19 nt, Human
agccccgccagccccgcca

SEQ ID NO: 316832 - RNA, 32 nt, Human
agccccgccccgggccccagagguccccugca

SEQ ID NO: 316833 - RNA, 32 nt, Human
agccccgccccuggcccugcugccauguugcu

SEQ ID NO: 316834 - RNA, 32 nt, Human
agccccgcccuccaccagcgacugacagcgca

SEQ ID NO: 316835 - RNA, 32 nt, Human
agccccgcccuuccucucccagugggcccucg

SEQ ID NO: 316836 - RNA, 32 nt, Human
agccccgccgugucuguggcccucucuuaaug

SEQ ID NO: 316837 - RNA, 32 nt, Human
agccccgccugacauggaacagaacggagcca

SEQ ID NO: 316838 - RNA, 32 nt, Human
agccccgccugcugcuucuccaccuccccucc

SEQ ID NO: 316839 - RNA, 32 nt, Human
agccccgcgaaaacaucugccucccaggaggg

SEQ ID NO: 316840 - RNA, 20 nt, Human
agccccgcgcggaccagaca

SEQ ID NO: 316841 - RNA, 20 nt, Human
agccccgcggcggccugggc

SEQ ID NO: 316842 - RNA, 21 nt, Human
agccccgcggcggccugggca

SEQ ID NO: 316843 - RNA, 32 nt, Human
agccccgcuacuuacauggaucaucgaguuuc

SEQ ID NO: 316844 - RNA, 32 nt, Human
agccccgcugcugccgccuuguggcgcgcccg

SEQ ID NO: 316845 - RNA, 32 nt, Human
agccccggaaugcuuccaguugcuugcaaggg

SEQ ID NO: 316846 - RNA, 32 nt, Human
agccccggacagcuccaggauccgugcagugg

SEQ ID NO: 316847 - RNA, 32 nt, Human
agccccggaggacgugaugugagacccgcuug

SEQ ID NO: 316848 - RNA, 20 nt, Human
agccccggaggcccaggacg

SEQ ID NO: 316849 - RNA, 32 nt, Human
agccccggaggucgaggcuacagugacccaag

SEQ ID NO: 316850 - RNA, 32 nt, Human
agccccggcagcgaccccuuccccagcccgac

SEQ ID NO: 316851 - RNA, 18 nt, Human
agccccggccccuagccc

SEQ ID NO: 316852 - RNA, 25 nt, Human
agccccggcccuggcccccacccca

SEQ ID NO: 316853 - RNA, 22 nt, Human
agccccggccgccggcccggca

SEQ ID NO: 316854 - RNA, 32 nt, Human
agccccggccgcgcccagcccggcgaggacag

SEQ ID NO: 316855 - RNA, 21 nt, Human
agccccggcgccagcccgggc

SEQ ID NO: 316856 - RNA, 17 nt, Human
agccccggcuccugccu

SEQ ID NO: 316857 - RNA, 21 nt, Human
agccccggcuccugccuguca

SEQ ID NO: 316858 - RNA, 32 nt, Human
agccccggcugcacucuagccgccgcgcccgg

SEQ ID NO: 316859 - RNA, 32 nt, Human
agccccggcugcacucuagccgccugggugug

SEQ ID NO: 316860 - RNA, 32 nt, Human
agccccggcuuccuccacauggaggucccagg

SEQ ID NO: 316861 - RNA, 32 nt, Human
agccccgggcccugcaucccuugcugacugca

SEQ ID NO: 316862 - RNA, 32 nt, Human
agccccgggccucccacaggagcggagacgcg

SEQ ID NO: 316863 - RNA, 32 nt, Human
agccccgggccugagaagugggcggcggggug

SEQ ID NO: 316864 - RNA, 32 nt, Human
agccccggggaccccauggggugcuguaauca

SEQ ID NO: 316865 - RNA, 19 nt, Human
agccccggggccugagccg

SEQ ID NO: 316866 - RNA, 32 nt, Human
agccccggggcugaggccgccccauggcaaag

SEQ ID NO: 316867 - RNA, 32 nt, Human
agccccgggggcugagguugcugugagccgag

SEQ ID NO: 316868 - RNA, 32 nt, Human
agccccggugggagguggucacagaagcuuug

SEQ ID NO: 316869 - RNA, 24 nt, Human
agccccguagcacugcccacccca

SEQ ID NO: 316870 - RNA, 32 nt, Human
agccccgucccaaacacagaugggaccaugaa

SEQ ID NO: 316871 - RNA, 32 nt, Human
agccccguccuugagcagauugaccucaucuu

SEQ ID NO: 316872 - RNA, 32 nt, Human
agccccgucuccaggaaaaggagagggguuaa

SEQ ID NO: 316873 - RNA, 32 nt, Human
agccccgucuccgccucccaaaguguuaggau

SEQ ID NO: 316874 - RNA, 32 nt, Human
agccccgucugaccccagcccagacagcaagg

SEQ ID NO: 316875 - RNA, 32 nt, Human
agccccgugcgagggcccugcuuguagcugga

SEQ ID NO: 316876 - RNA, 32 nt, Human
agccccgugcggugggucccagccugagggug

SEQ ID NO: 316877 - RNA, 32 nt, Human
agccccgugggugggggcagggcaugaguucc

SEQ ID NO: 316878 - RNA, 32 nt, Human
agccccguucuguggggcacugggugauacuc

SEQ ID NO: 316879 - RNA, 32 nt, Human
agccccuaaauuccucccuuucucagucuacc

SEQ ID NO: 316880 - RNA, 25 nt, Human
agccccuaaguaggcccuccccucc

SEQ ID NO: 316881 - RNA, 32 nt, Human
agccccuacagugaguccccaugccaugggca

SEQ ID NO: 316882 - RNA, 24 nt, Human
agccccuacccacccacacccccu

SEQ ID NO: 316883 - RNA, 20 nt, Human
agccccuaccuaccccugcc

SEQ ID NO: 316884 - RNA, 32 nt, Human
agccccuaccuccaaauaccaccacacugggg

SEQ ID NO: 316885 - RNA, 32 nt, Human
agccccuagaagcuagaaaaggcagggacccg

SEQ ID NO: 316886 - RNA, 32 nt, Human
agccccuagccccuagccccuggcagacauag

SEQ ID NO: 316887 - RNA, 32 nt, Human
agccccucaaguagcugggacuacaagcgcac

SEQ ID NO: 316888 - RNA, 32 nt, Human
agccccucaaguagcugggacuacaggugcau

SEQ ID NO: 316889 - RNA, 32 nt, Human
agccccucacaguccagccuucuaggugauca

SEQ ID NO: 316890 - RNA, 32 nt, Human
agccccucacauuuccaaucuugagguuacaa

SEQ ID NO: 316891 - RNA, 32 nt, Human
agccccucagaacugggaaggccagguaacuc

SEQ ID NO: 316892 - RNA, 32 nt, Human
agccccucagaagauguucccugcugauaaca

SEQ ID NO: 316893 - RNA, 32 nt, Human
agccccucagacuguuuuaucucugaacuggu

SEQ ID NO: 316894 - RNA, 32 nt, Human
agccccucagccuguagaaacagcccucggcg

SEQ ID NO: 316895 - RNA, 32 nt, Human
agccccucaguggcggcuugcucucuucucuc

SEQ ID NO: 316896 - RNA, 32 nt, Human
agccccucaguuagcaguggugaggccggagu

SEQ ID NO: 316897 - RNA, 23 nt, Human
agccccucaugccccacccgcca

SEQ ID NO: 316898 - RNA, 32 nt, Human
agccccuccaccgcaccguccugggccggugc

SEQ ID NO: 316899 - RNA, 32 nt, Human
agccccuccauggcccagaaggaagaggcugc

SEQ ID NO: 316900 - RNA, 22 nt, Human
agccccuccaugggaccccucu

SEQ ID NO: 316901 - RNA, 22 nt, Human
agccccucccaaagaaccuucu

SEQ ID NO: 316902 - RNA, 23 nt, Human
agccccucccagccacaccugcc

SEQ ID NO: 316903 - RNA, 21 nt, Human
agccccucccagcccuugccc

SEQ ID NO: 316904 - RNA, 23 nt, Human
agccccucccagccucucccgcu

SEQ ID NO: 316905 - RNA, 24 nt, Human
agccccucccagccugccccuucu

SEQ ID NO: 316906 - RNA, 23 nt, Human
agccccucccagucagcccuccc

SEQ ID NO: 316907 - RNA, 25 nt, Human
agccccucccauuuccaaccccucc

SEQ ID NO: 316908 - RNA, 23 nt, Human
agccccuccccaagcuccccucc

SEQ ID NO: 316909 - RNA, 32 nt, Human
agccccuccccaccaucccuccacaugcugca

SEQ ID NO: 316910 - RNA, 23 nt, Human
agccccuccccagcccccucucc

SEQ ID NO: 316911 - RNA, 22 nt, Human
agccccuccccagggccccacc

SEQ ID NO: 316912 - RNA, 22 nt, Human
agccccucccccaugucccacc

SEQ ID NO: 316913 - RNA, 21 nt, Human
agccccuccccgccccucucc

SEQ ID NO: 316914 - RNA, 22 nt, Human
agccccucccgcacucugcuga

SEQ ID NO: 316915 - RNA, 32 nt, Human
agccccucccgggaccucucccccuccacccc

SEQ ID NO: 316916 - RNA, 32 nt, Human
agccccucccuaaucccuggcccucccagcug

SEQ ID NO: 316917 - RNA, 18 nt, Human
agccccucccuguccccu

SEQ ID NO: 316918 - RNA, 20 nt, Human
agccccucccuguccccucc

SEQ ID NO: 316919 - RNA, 24 nt, Human
agccccuccuccacucuccucucc

SEQ ID NO: 316920 - RNA, 32 nt, Human
agccccuccucccaguauucccauccccgcau

SEQ ID NO: 316921 - RNA, 32 nt, Human
agccccuccucccucagacccagcgguccaau

SEQ ID NO: 316922 - RNA, 32 nt, Human
agccccuccucccucagacccaggagccccag

SEQ ID NO: 316923 - RNA, 32 nt, Human
agccccuccucccucagacccaggaguccaga

SEQ ID NO: 316924 - RNA, 32 nt, Human
agccccuccucccucagacccaggaguccagc

SEQ ID NO: 316925 - RNA, 32 nt, Human
agccccuccucccucagacccaggaguccagg

SEQ ID NO: 316926 - RNA, 32 nt, Human
agccccuccucccucagacccagggguccagg

SEQ ID NO: 316927 - RNA, 24 nt, Human
agccccuccucugccaccuccccu

SEQ ID NO: 316928 - RNA, 20 nt, Human
agccccuccugcagcccucc

SEQ ID NO: 316929 - RNA, 24 nt, Human
agccccuccugguauuccccuccu

SEQ ID NO: 316930 - RNA, 32 nt, Human
agccccuccugucucuugccccugguuuugug

SEQ ID NO: 316931 - RNA, 24 nt, Human
agccccuccuucgcuccuuccaca

SEQ ID NO: 316932 - RNA, 23 nt, Human
agccccuccuuggcacccccucu

SEQ ID NO: 316933 - RNA, 19 nt, Human
agccccucggcucggccga

SEQ ID NO: 316934 - RNA, 23 nt, Human
agccccucgggagcaccccaccu

SEQ ID NO: 316935 - RNA, 32 nt, Human
agccccucuacccucccuggagauuggagggu

SEQ ID NO: 316936 - RNA, 32 nt, Human
agccccucuccaggugggcauaaggaguaaca

SEQ ID NO: 316937 - RNA, 18 nt, Human
agccccucuccccugccc

SEQ ID NO: 316938 - RNA, 32 nt, Human
agccccucuccucccggauggucauguuuuug

SEQ ID NO: 316939 - RNA, 32 nt, Human
agccccucuccucuucaggcuacaggguuguc

SEQ ID NO: 316940 - RNA, 32 nt, Human
agccccucucuacuucugugccuuuguaaaac

SEQ ID NO: 316941 - RNA, 32 nt, Human
agccccucugcagagacacaauaaaagccagc

SEQ ID NO: 316942 - RNA, 32 nt, Human
agccccucugcagaucuccucuggccacugca

SEQ ID NO: 316943 - RNA, 32 nt, Human
agccccucugcagcucacccuuggcuuguuuu

SEQ ID NO: 316944 - RNA, 19 nt, Human
agccccucuuccuccucca

SEQ ID NO: 316945 - RNA, 21 nt, Human
agccccucuucuguccccucc

SEQ ID NO: 316946 - RNA, 32 nt, Human
agccccucuucuucagcucauccugcagaaac

SEQ ID NO: 316947 - RNA, 23 nt, Human
agccccucuugccccccacccca

SEQ ID NO: 316948 - RNA, 32 nt, Human
agccccucuuucucccaugcugcacuuacucc

SEQ ID NO: 316949 - RNA, 32 nt, Human
agccccugaacaguaaaguuuugcuccagcca

SEQ ID NO: 316950 - RNA, 32 nt, Human
agccccugaagacaagcagcacugcaguggca

SEQ ID NO: 316951 - RNA, 32 nt, Human
agccccugaagaccagucccacccaccuuucu

SEQ ID NO: 316952 - RNA, 32 nt, Human
agccccugaauguaggcuugcagugcuuucug

SEQ ID NO: 316953 - RNA, 32 nt, Human
agccccugaccagccuccucccaugacuggug

SEQ ID NO: 316954 - RNA, 32 nt, Human
agccccugaccccuggguucugaggcugccag

SEQ ID NO: 316955 - RNA, 32 nt, Human
agccccugaccuuccucuauccccugcccauc

SEQ ID NO: 316956 - RNA, 32 nt, Human
agccccugagcagcaauuugaggcggcugcug

SEQ ID NO: 316957 - RNA, 21 nt, Human
agccccugagggagucugcug

SEQ ID NO: 316958 - RNA, 32 nt, Human
agccccugagucugacucaucucugcacaacc

SEQ ID NO: 316959 - RNA, 32 nt, Human
agccccugcaccuggcagccagcgagcuacug

SEQ ID NO: 316960 - RNA, 20 nt, Human
agccccugcagcacugggca

SEQ ID NO: 316961 - RNA, 32 nt, Human
agccccugcauggauuccuuguggcuuuucug

SEQ ID NO: 316962 - RNA, 32 nt, Human
agccccugccaagcaggggcaggggugggccg

SEQ ID NO: 316963 - RNA, 32 nt, Human
agccccugccaaggagacccuggaggggcucu

SEQ ID NO: 316964 - RNA, 32 nt, Human
agccccugccaucgcaggaagggaugaugucc

SEQ ID NO: 316965 - RNA, 32 nt, Human
agccccugcccaccuucagcaggaugaggccc

SEQ ID NO: 316966 - RNA, 19 nt, Human
agccccugcccacugcacu

SEQ ID NO: 316967 - RNA, 32 nt, Human
agccccugcccagcacaaaaccccaggacccu

SEQ ID NO: 316968 - RNA, 32 nt, Human
agccccugcccaggccacugugagggugggug

SEQ ID NO: 316969 - RNA, 31 nt, Human
agccccugccucuggggcucugugguguagg

SEQ ID NO: 316970 - RNA, 32 nt, Human
agccccugcgcagggcccuccugcucugaggg

SEQ ID NO: 316971 - RNA, 32 nt, Human
agccccugcgugucugugacuguccacuuccc

SEQ ID NO: 316972 - RNA, 32 nt, Human
agccccugcucggcauaaugaccuuauuaagu

SEQ ID NO: 316973 - RNA, 32 nt, Human
agccccugcucuaggaaacaguuuaagaaauc

SEQ ID NO: 316974 - RNA, 32 nt, Human
agccccugcuggcugagcuccagccugugccc

SEQ ID NO: 316975 - RNA, 32 nt, Human
agccccugcugugggaggagguuggagggcua

SEQ ID NO: 316976 - RNA, 25 nt, Human
agccccugcuuccccacccccuccu

SEQ ID NO: 316977 - RNA, 32 nt, Human
agccccuggccacucuaagcugggcagacgga

SEQ ID NO: 316978 - RNA, 32 nt, Human
agccccugggaaaggaaucuuuagaaaugcag

SEQ ID NO: 316979 - RNA, 32 nt, Human
agccccugggcccuggcaggcgaugcaggugg

SEQ ID NO: 316980 - RNA, 24 nt, Human
agccccugggcugcccucacccca

SEQ ID NO: 316981 - RNA, 32 nt, Human
agccccugggcuguaggccagggcagccacag

SEQ ID NO: 316982 - RNA, 32 nt, Human
agccccuggggaaaagcagccucccuucuccu

SEQ ID NO: 316983 - RNA, 32 nt, Human
agccccugguuggugccuccaaaggaaggugg

SEQ ID NO: 316984 - RNA, 32 nt, Human
agccccuguaaucccagcuacuugggaggcug

SEQ ID NO: 316985 - RNA, 32 nt, Human
agccccuguaccaccccugcuguugccugggc

SEQ ID NO: 316986 - RNA, 32 nt, Human
agccccuguccaggcccugcucaccugcaaag

SEQ ID NO: 316987 - RNA, 22 nt, Human
agccccuguccccacccuuccu

SEQ ID NO: 316988 - RNA, 24 nt, Human
agccccuguggaugcccccgccga

SEQ ID NO: 316989 - RNA, 32 nt, Human
agccccuguuuugcacagccgaguacuggcga

SEQ ID NO: 316990 - RNA, 32 nt, Human
agccccuuacuaugaucucaggagcuugcaag

SEQ ID NO: 316991 - RNA, 32 nt, Human
agccccuuauacaaaacuuggagcucagacca

SEQ ID NO: 316992 - RNA, 32 nt, Human
agccccuucacuucugggcuccuggcccuuug

SEQ ID NO: 316993 - RNA, 32 nt, Human
agccccuucagccucugccucuguguacaccc

SEQ ID NO: 316994 - RNA, 32 nt, Human
agccccuucccugaggcugucuccugggaaug

SEQ ID NO: 316995 - RNA, 32 nt, Human
agccccuucccuucccuucccuucccuuccuu

SEQ ID NO: 316996 - RNA, 22 nt, Human
agccccuuccugccccacccca

SEQ ID NO: 316997 - RNA, 18 nt, Human
agccccuuccuucugccc

SEQ ID NO: 316998 - RNA, 32 nt, Human
agccccuucucuucucagaaaggucuguuuuu

SEQ ID NO: 316999 - RNA, 24 nt, Human
agccccuucugcccaccccauccu

SEQ ID NO: 317000 - RNA, 32 nt, Human
agccccuucuguacagcaccucuuguccaggu

SEQ ID NO: 317001 - RNA, 32 nt, Human
agccccuucuguccagcaccagcuggaggcac

SEQ ID NO: 317002 - RNA, 32 nt, Human
agccccuucuuucuugccccagucuccaguuc

SEQ ID NO: 317003 - RNA, 32 nt, Human
agccccuugcucuccccugcccugcugccgcc

SEQ ID NO: 317004 - RNA, 32 nt, Human
agccccuuggaggcugugagguugcagcaaag

SEQ ID NO: 317005 - RNA, 32 nt, Human
agccccuuggcaucacgcaccucccucugggc

SEQ ID NO: 317006 - RNA, 19 nt, Human
agccccuugucagccgcag

SEQ ID NO: 317007 - RNA, 31 nt, Human
agccccuuguuucucccuccuuccaggguuu

SEQ ID NO: 317008 - RNA, 32 nt, Human
agccccuuucauccugggaccugccgaccacg

SEQ ID NO: 317009 - RNA, 32 nt, Human
agccccuuucugcugcugcaucccuccagugu

SEQ ID NO: 317010 - RNA, 32 nt, Human
agcccgaacugauucuggagcucuguguucug

SEQ ID NO: 317011 - RNA, 19 nt, Human
agcccgaagagcaggaggc

SEQ ID NO: 317012 - RNA, 20 nt, Human
agcccgacacggccugagcg

SEQ ID NO: 317013 - RNA, 21 nt, Human
agcccgaccaagcuguccccu

SEQ ID NO: 317014 - RNA, 32 nt, Human
agcccgacuggaggaacagcagcucugggagg

SEQ ID NO: 317015 - RNA, 19 nt, Human
agcccgacuucuaccgggg

SEQ ID NO: 317016 - RNA, 32 nt, Human
agcccgagaaacacaggagagcgagcgcaagc

SEQ ID NO: 317017 - RNA, 32 nt, Human
agcccgagagacagagguugcagugagccgag

SEQ ID NO: 317018 - RNA, 32 nt, Human
agcccgagagcuguggaucugcguccccuggc

SEQ ID NO: 317019 - RNA, 32 nt, Human
agcccgagagguggaggcuggagugaacagag

SEQ ID NO: 317020 - RNA, 32 nt, Human
agcccgagagguggagguugcagugagccgag

SEQ ID NO: 317021 - RNA, 32 nt, Human
agcccgagaguuuccaggauggcuucugcauc

SEQ ID NO: 317022 - RNA, 32 nt, Human
agcccgagcccaaaccccgccaccaucauagg

SEQ ID NO: 317023 - RNA, 32 nt, Human
agcccgagcccagcccuuccuggcuuuagagc

SEQ ID NO: 317024 - RNA, 32 nt, Human
agcccgaggaguagaggcagcagcagcuggac

SEQ ID NO: 317025 - RNA, 32 nt, Human
agcccgagucuccagcccaaaccugccuuccu

SEQ ID NO: 317026 - RNA, 32 nt, Human
agcccgcaaguuugagaccacccugggcaaca

SEQ ID NO: 317027 - RNA, 32 nt, Human
agcccgcacucccgcccugccuguucgcugcc

SEQ ID NO: 317028 - RNA, 32 nt, Human
agcccgcagcagaguccugggcaaagaccaag

SEQ ID NO: 317029 - RNA, 32 nt, Human
agcccgcagcccgcagaggacgcccagagcgg

SEQ ID NO: 317030 - RNA, 32 nt, Human
agcccgcaguguuugcaagugaaauguagaca

SEQ ID NO: 317031 - RNA, 32 nt, Human
agcccgcaucaagcaagcccuccugggccacc

SEQ ID NO: 317032 - RNA, 32 nt, Human
agcccgcccgccucucucugcccgugucaguc

SEQ ID NO: 317033 - RNA, 32 nt, Human
agcccgccggagccaccguuccugcugcugcc

SEQ ID NO: 317034 - RNA, 32 nt, Human
agcccgccugccuggcugcccaaccagcucca

SEQ ID NO: 317035 - RNA, 32 nt, Human
agcccgccuuccuguccaucugaccccuucug

SEQ ID NO: 317036 - RNA, 32 nt, Human
agcccgccuuugggaaccccuugcugugaacu

SEQ ID NO: 317037 - RNA, 32 nt, Human
agcccgcgagccuggccagcgaggguagccgc

SEQ ID NO: 317038 - RNA, 18 nt, Human
agcccgcgccccgggcca

SEQ ID NO: 317039 - RNA, 32 nt, Human
agcccgcgcccgccccgaugcccagcuccgcg

SEQ ID NO: 317040 - RNA, 32 nt, Human
agcccgcggcccucccccuccucggcguaauu

SEQ ID NO: 317041 - RNA, 32 nt, Human
agcccgcggguccucucauacauggcuucugu

SEQ ID NO: 317042 - RNA, 21 nt, Human
agcccgcgguggccugaggcg

SEQ ID NO: 317043 - RNA, 32 nt, Human
agcccgcguucccaggugcccgucuggccgcu

SEQ ID NO: 317044 - RNA, 32 nt, Human
agcccgcuacccacucugaggcuccuaggagg

SEQ ID NO: 317045 - RNA, 32 nt, Human
agcccgcuaggcgcgccguccccagccccgcc

SEQ ID NO: 317046 - RNA, 32 nt, Human
agcccgcucccaggagcuaaugguagagcguc

SEQ ID NO: 317047 - RNA, 32 nt, Human
agcccgcuccugacccuuaucuucccagagac

SEQ ID NO: 317048 - RNA, 16 nt, Human
agcccgcucugagcug

SEQ ID NO: 317049 - RNA, 32 nt, Human
agcccgcugaguagcuggcacuuuaaggcagg

SEQ ID NO: 317050 - RNA, 32 nt, Human
agcccgcugcagcugccacaucccagggcuua

SEQ ID NO: 317051 - RNA, 32 nt, Human
agcccgcugcagcugccacaucccuggacaca

SEQ ID NO: 317052 - RNA, 32 nt, Human
agcccgcugcagcugccacaucccugggcuua

SEQ ID NO: 317053 - RNA, 32 nt, Human
agcccgcugcagcugucacaucccuggacaca

SEQ ID NO: 317054 - RNA, 32 nt, Human
agcccgcugcagcugucacaucccugggcuua

SEQ ID NO: 317055 - RNA, 32 nt, Human
agcccgcugcagcuuccacaucccuggacaca

SEQ ID NO: 317056 - RNA, 32 nt, Human
agcccgcugcuguccuggaggccuuggggagg

SEQ ID NO: 317057 - RNA, 32 nt, Human
agcccgcugcuuuuucuauccucccagucacc

SEQ ID NO: 317058 - RNA, 32 nt, Human
agcccggaacccagccaucagagcagggggcc

SEQ ID NO: 317059 - RNA, 32 nt, Human
agcccggaagcagcacaugagcacugagcuga

SEQ ID NO: 317060 - RNA, 32 nt, Human
agcccggaaggcagagguugcagugagcugag

SEQ ID NO: 317061 - RNA, 32 nt, Human
agcccggaaggcggagguugcagugagcugag

SEQ ID NO: 317062 - RNA, 32 nt, Human
agcccggacucggcacucacagcugcugugca

SEQ ID NO: 317063 - RNA, 32 nt, Human
agcccggagagggcgggccacuggcgcucgag

SEQ ID NO: 317064 - RNA, 32 nt, Human
agcccggaggaggaggaggaggaggaggagga

SEQ ID NO: 317065 - RNA, 23 nt, Human
agcccggcaaaugcgcacgaccu

SEQ ID NO: 317066 - RNA, 32 nt, Human
agcccggcagaggcagagacacacgcggagag

SEQ ID NO: 317067 - RNA, 19 nt, Human
agcccggcagcccggggcg

SEQ ID NO: 317068 - RNA, 19 nt, Human
agcccggcagccugaauug

SEQ ID NO: 317069 - RNA, 22 nt, Human
agcccggccaaacccaggggca

SEQ ID NO: 317070 - RNA, 32 nt, Human
agcccggccagccugagcuugcugcccuccag

SEQ ID NO: 317071 - RNA, 32 nt, Human
agcccggcccacccucuccagaugccaguccc

SEQ ID NO: 317072 - RNA, 32 nt, Human
agcccggcccagaaagcuuuggagucugguua

SEQ ID NO: 317073 - RNA, 20 nt, Human
agcccggccccaggggugcc

SEQ ID NO: 317074 - RNA, 23 nt, Human
agcccggccccgccgacccgccu

SEQ ID NO: 317075 - RNA, 20 nt, Human
agcccggcccggaccccauc

SEQ ID NO: 317076 - RNA, 18 nt, Human
agcccggccuccauggcc

SEQ ID NO: 317077 - RNA, 32 nt, Human
agcccggccugcaggccguggugaggaggggc

SEQ ID NO: 317078 - RNA, 32 nt, Human
agcccggccugucuuuugccccgggcucaaug

SEQ ID NO: 317079 - RNA, 32 nt, Human
agcccggccuuucaugaugcaggagagcaggg

SEQ ID NO: 317080 - RNA, 32 nt, Human
agcccggcgcauuccccucucucccucccucu

SEQ ID NO: 317081 - RNA, 32 nt, Human
agcccggcgcucaccuccgccaccuccucagg

SEQ ID NO: 317082 - RNA, 32 nt, Human
agcccggcgcucaugcugagccccaggcacgc

SEQ ID NO: 317083 - RNA, 32 nt, Human
agcccggcggcucugggaagcucacuccucca

SEQ ID NO: 317084 - RNA, 32 nt, Human
agcccggcucccacggccucugaggcucggcg

SEQ ID NO: 317085 - RNA, 32 nt, Human
agcccggcuccuggucaccuaggaagccucag

SEQ ID NO: 317086 - RNA, 32 nt, Human
  misc_feature (32)..(32): n is a, c, g or u
agcccgggaagcagagguugcagugaacugan

SEQ ID NO: 317087 - RNA, 32 nt, Human
agcccgggaaguggagguugcacugagcugag

SEQ ID NO: 317088 - RNA, 32 nt, Human
agcccgggacacccccucaacguccgcaggcg

SEQ ID NO: 317089 - RNA, 32 nt, Human
agcccgggacaggcacacaggcccaggugugu

SEQ ID NO: 317090 - RNA, 32 nt, Human
agcccgggacccacagcagcccuagccagucc

SEQ ID NO: 317091 - RNA, 18 nt, Human
agcccgggaccugccccu

SEQ ID NO: 317092 - RNA, 32 nt, Human
agcccgggagcuuggcagcaucacacacagaa

SEQ ID NO: 317093 - RNA, 32 nt, Human
agcccgggaggcagaaccugcagugagccaaa

SEQ ID NO: 317094 - RNA, 32 nt, Human
agcccgggaggcagaggcugcagugaaccaag

SEQ ID NO: 317095 - RNA, 32 nt, Human
agcccgggaggcagaggcugcaguggcugaga

SEQ ID NO: 317096 - RNA, 32 nt, Human
agcccgggaggcagagguugcagugagccaug

SEQ ID NO: 317097 - RNA, 32 nt, Human
agcccgggaggcagagguugcagugagccgug

SEQ ID NO: 317098 - RNA, 32 nt, Human
agcccgggaggcggagauugcggugagccaag

SEQ ID NO: 317099 - RNA, 32 nt, Human
agcccgggaggcggagcuuacagugagcugag

SEQ ID NO: 317100 - RNA, 32 nt, Human
agcccgggaggcggagcuugcagugagcugag

SEQ ID NO: 317101 - RNA, 32 nt, Human
agcccgggaggcggagcuugcggugggccggg

SEQ ID NO: 317102 - RNA, 26 nt, Human
agcccgggaggcggagguugcaguga

SEQ ID NO: 317103 - RNA, 32 nt, Human
agcccgggaggcggagguugcagugagcugag

SEQ ID NO: 317104 - RNA, 32 nt, Human
agcccgggaggcggagguugccgagccgagau

SEQ ID NO: 317105 - RNA, 32 nt, Human
agcccgggaggucaagguugcagugagucaug

SEQ ID NO: 317106 - RNA, 26 nt, Human
agcccgggagguggagguugcaguga

SEQ ID NO: 317107 - RNA, 32 nt, Human
agcccgggagguggagguugcagugagccaag

SEQ ID NO: 317108 - RNA, 32 nt, Human
agcccgggagguggagguugcagugagcccag

SEQ ID NO: 317109 - RNA, 32 nt, Human
agcccgggcaacaacagcgaaacuccaucuca

SEQ ID NO: 317110 - RNA, 32 nt, Human
agcccgggcaacaagagcgaaaccccaucucg

SEQ ID NO: 317111 - RNA, 21 nt, Human
agcccgggcaacauggugaaa

SEQ ID NO: 317112 - RNA, 17 nt, Human
agcccgggcacccgccc

SEQ ID NO: 317113 - RNA, 32 nt, Human
agcccgggcaggaggggaaggaaggcggccgc

SEQ ID NO: 317114 - RNA, 23 nt, Human
agcccgggccgcacagcccgggc

SEQ ID NO: 317115 - RNA, 32 nt, Human
agcccgggcgcggcgcccaccaugcgcggcug

SEQ ID NO: 317116 - RNA, 32 nt, Human
agcccgggcuauccuucccugaaggagcggcc

SEQ ID NO: 317117 - RNA, 32 nt, Human
agcccggggaaaggauaugaacauaaggcaaa

SEQ ID NO: 317118 - RNA, 21 nt, Human
agcccggggagcacgucgccu

SEQ ID NO: 317119 - RNA, 21 nt, Human
agcccggggagcagaacgcug

SEQ ID NO: 317120 - RNA, 32 nt, Human
agcccggggcagccccugccucuggggcucug

SEQ ID NO: 317121 - RNA, 32 nt, Human
agcccggggcgcuggcccugccuaggccuuuu

SEQ ID NO: 317122 - RNA, 18 nt, Human
agcccgggggcccagggc

SEQ ID NO: 317123 - RNA, 32 nt, Human
agcccgggucaucuguaccucugccuccuuuc

SEQ ID NO: 317124 - RNA, 21 nt, Human
agcccggguggcccgagggcg

SEQ ID NO: 317125 - RNA, 32 nt, Human
agcccggugcagccucuaacuccugggcucaa

SEQ ID NO: 317126 - RNA, 32 nt, Human
agcccggugguuuggaaccaguggcuuuggga

SEQ ID NO: 317127 - RNA, 32 nt, Human
agcccggugugugcaguggccucagggauccg

SEQ ID NO: 317128 - RNA, 18 nt, Human
agcccgguucucugaacu

SEQ ID NO: 317129 - RNA, 24 nt, Human
agcccguagucccagcuacucagg

SEQ ID NO: 317130 - RNA, 32 nt, Human
agcccgucagccagggcacaggccuggcucac

SEQ ID NO: 317131 - RNA, 16 nt, Human
agcccgucccuguccc

SEQ ID NO: 317132 - RNA, 32 nt, Human
agcccgucucccagggcagacacggaggcauc

SEQ ID NO: 317133 - RNA, 24 nt, Human
agcccgugaagucgaggcugcagu

SEQ ID NO: 317134 - RNA, 32 nt, Human
agcccgugaagucgaggcugcagugagcccag

SEQ ID NO: 317135 - RNA, 32 nt, Human
agcccguggaggaggaaaagagcaucucagag

SEQ ID NO: 317136 - RNA, 32 nt, Human
agcccguggggcaguccuuugaggccugguaa

SEQ ID NO: 317137 - RNA, 20 nt, Human
agcccgugggggcugaacug

SEQ ID NO: 317138 - RNA, 21 nt, Human
agcccguggugcccugaggcg

SEQ ID NO: 317139 - RNA, 18 nt, Human
agcccguucgcuggacug

SEQ ID NO: 317140 - RNA, 32 nt, Human
agcccguucgcuuggcacugaggucccuggcg

SEQ ID NO: 317141 - RNA, 32 nt, Human
agcccguuggccuacuggaguguguaaggaac

SEQ ID NO: 317142 - RNA, 32 nt, Human
agcccguuuccuagacaagugcaccugggguu

SEQ ID NO: 317143 - RNA, 32 nt, Human
agcccuaaaaugcucaaauccugccagccaaa

SEQ ID NO: 317144 - RNA, 32 nt, Human
agcccuaaaguccccugcucccuggacuucuc

SEQ ID NO: 317145 - RNA, 32 nt, Human
agcccuaaccgucucuccccagcccuauccgg

SEQ ID NO: 317146 - RNA, 32 nt, Human
agcccuaagggagcaguuacagguccucuuug

SEQ ID NO: 317147 - RNA, 21 nt, Human
agcccuaaugaugacuggaaa

SEQ ID NO: 317148 - RNA, 32 nt, Human
agcccuacaucaucugcuacccugaaggaucu

SEQ ID NO: 317149 - RNA, 32 nt, Human
agcccuaccccagacauuggaaauaggugacc

SEQ ID NO: 317150 - RNA, 32 nt, Human
agcccuacccgccuggcccacuaugguccaga

SEQ ID NO: 317151 - RNA, 32 nt, Human
agcccuaccuccaaguugcacuguuuacuuau

SEQ ID NO: 317152 - RNA, 32 nt, Human
agcccuaccuggcagucuaccugcacucggag

SEQ ID NO: 317153 - RNA, 32 nt, Human
agcccuacuccacccugucccugcacucccuu

SEQ ID NO: 317154 - RNA, 24 nt, Human
agcccuacugcccaccccacccca

SEQ ID NO: 317155 - RNA, 32 nt, Human
agcccuagacuuccaucauuccggagaccaac

SEQ ID NO: 317156 - RNA, 32 nt, Human
agcccuagaggucgaggcugcagugagcuaug

SEQ ID NO: 317157 - RNA, 32 nt, Human
agcccuagagguugaggcugcagugagcuaug

SEQ ID NO: 317158 - RNA, 24 nt, Human
agcccuagccuggagcaggggcug

SEQ ID NO: 317159 - RNA, 24 nt, Human
agcccuagcgugacuacccagaga

SEQ ID NO: 317160 - RNA, 32 nt, Human
agcccuagcuacucuggaggcugaggcaggag

SEQ ID NO: 317161 - RNA, 32 nt, Human
agcccuagcuugggagcggacccacacgaacu

SEQ ID NO: 317162 - RNA, 32 nt, Human
agcccuaggagucugcgagagccuccuugguu

SEQ ID NO: 317163 - RNA, 32 nt, Human
agcccuaggcugucccugcagccagggugucc

SEQ ID NO: 317164 - RNA, 32 nt, Human
agcccuagguagcuaaagguugcaugaaggcc

SEQ ID NO: 317165 - RNA, 32 nt, Human
agcccuauaaagauugaucuguccgucuuucc

SEQ ID NO: 317166 - RNA, 24 nt, Human
agcccuauacaguuucauagcuuu

SEQ ID NO: 317167 - RNA, 32 nt, Human
agcccucaaaacacaaaggaacaaagacaguc

SEQ ID NO: 317168 - RNA, 21 nt, Human
agcccucaacaggcccaggga

SEQ ID NO: 317169 - RNA, 32 nt, Human
agcccucaauccagagagcucucccacagccc

SEQ ID NO: 317170 - RNA, 32 nt, Human
agcccucacaacuggauagaccuuucucaagg

SEQ ID NO: 317171 - RNA, 32 nt, Human
agcccucaccucccuguuccaggcugagaacu

SEQ ID NO: 317172 - RNA, 32 nt, Human
agcccucagaacccuuggcuugcccacgugga

SEQ ID NO: 317173 - RNA, 32 nt, Human
agcccucagaacuuuaguaacagcacaacaaa

SEQ ID NO: 317174 - RNA, 32 nt, Human
agcccucagacccugggguccuggagcugccu

SEQ ID NO: 317175 - RNA, 32 nt, Human
agcccucagagcuguuucuaggcaucucucag

SEQ ID NO: 317176 - RNA, 32 nt, Human
agcccucagccaagcacuuagaacugaguaaa

SEQ ID NO: 317177 - RNA, 32 nt, Human
agcccucagccccuccuuccucucuaucuuaa

SEQ ID NO: 317178 - RNA, 32 nt, Human
agcccucagccccucuuuccucccucuccuaa

SEQ ID NO: 317179 - RNA, 19 nt, Human
agcccucagcuaucuuccc

SEQ ID NO: 317180 - RNA, 32 nt, Human
agcccucagguccccagcuccuugagggauga

SEQ ID NO: 317181 - RNA, 32 nt, Human
agcccucaguguccaagacccaggcagcccgg

SEQ ID NO: 317182 - RNA, 32 nt, Human
agcccucauccucaugggaaccacacugcagu

SEQ ID NO: 317183 - RNA, 32 nt, Human
agcccucauccuggcauucaagggcauggacg

SEQ ID NO: 317184 - RNA, 32 nt, Human
agcccucaucuucucuuucucuccucaguuua

SEQ ID NO: 317185 - RNA, 32 nt, Human
agcccuccaacucucaaggaaaggacaggccc

SEQ ID NO: 317186 - RNA, 21 nt, Human
agcccuccaauccccauccca

SEQ ID NO: 317187 - RNA, 22 nt, Human
agcccuccagagcaggagacug

SEQ ID NO: 317188 - RNA, 32 nt, Human
agcccuccagagccagcccuccuggguaccgg

SEQ ID NO: 317189 - RNA, 32 nt, Human
agcccuccagucccuacuucaggcugagccau

SEQ ID NO: 317190 - RNA, 32 nt, Human
agcccuccagugucuccugcagccuggagccu

SEQ ID NO: 317191 - RNA, 32 nt, Human
agcccucccaacacagcacacuagucagccca

SEQ ID NO: 317192 - RNA, 19 nt, Human
agcccucccagccuacucc

SEQ ID NO: 317193 - RNA, 32 nt, Human
agcccucccagcggccacuccugggucagcgc

SEQ ID NO: 317194 - RNA, 32 nt, Human
agcccuccccaagccuucagggcugcucggag

SEQ ID NO: 317195 - RNA, 18 nt, Human
agcccuccccaccccaca

SEQ ID NO: 317196 - RNA, 32 nt, Human
agcccuccccacccuggcucuccuugcauuuc

SEQ ID NO: 317197 - RNA, 19 nt, Human
agcccucccuccccacccc

SEQ ID NO: 317198 - RNA, 25 nt, Human
agcccucccugccgcugccugcuga

SEQ ID NO: 317199 - RNA, 32 nt, Human
agcccucccugccucggcagcgcggcgcagug

SEQ ID NO: 317200 - RNA, 32 nt, Human
agcccucccuggcagcccauguucuccucuuu

SEQ ID NO: 317201 - RNA, 32 nt, Human
agcccucccuggcugcuuccucucgcucaucc

SEQ ID NO: 317202 - RNA, 32 nt, Human
agcccucccugguccccauaggcacaguuggg

SEQ ID NO: 317203 - RNA, 18 nt, Human
agcccuccguuccugcca

SEQ ID NO: 317204 - RNA, 32 nt, Human
agcccuccucaaggaccccugugagauaaguc

SEQ ID NO: 317205 - RNA, 32 nt, Human
agcccuccucaccgcucuuccuuuaguuccuu

SEQ ID NO: 317206 - RNA, 22 nt, Human
agcccuccugagcacccgcuga

SEQ ID NO: 317207 - RNA, 32 nt, Human
agcccuccugggagcucaguggcugggaugcu

SEQ ID NO: 317208 - RNA, 32 nt, Human
agcccuccuugccucccuccagccacuggacc

SEQ ID NO: 317209 - RNA, 32 nt, Human
agcccucgaaacuugacauggggccagaaggg

SEQ ID NO: 317210 - RNA, 23 nt, Human
agcccucgaccuccugggcucaa

SEQ ID NO: 317211 - RNA, 25 nt, Human
agcccucgcaccgcuccccacccca

SEQ ID NO: 317212 - RNA, 24 nt, Human
agcccucgcccggcccccacccca

SEQ ID NO: 317213 - RNA, 21 nt, Human
agcccucgcccggcccggaca

SEQ ID NO: 317214 - RNA, 32 nt, Human
agcccucgccggauucaacuuuugccaacggu

SEQ ID NO: 317215 - RNA, 27 nt, Human
agcccucggccgcccgagcaggggcug

SEQ ID NO: 317216 - RNA, 22 nt, Human
agcccucgggcccagcaggcug

SEQ ID NO: 317217 - RNA, 32 nt, Human
agcccucgggggaauggacccccagaacacgu

SEQ ID NO: 317218 - RNA, 32 nt, Human
agcccucuacagccugacuuucucuccagcgg

SEQ ID NO: 317219 - RNA, 32 nt, Human
agcccucucaaccccauuguccugcaccugca

SEQ ID NO: 317220 - RNA, 32 nt, Human
agcccucucacaggcauggccaccuccaguuc

SEQ ID NO: 317221 - RNA, 32 nt, Human
agcccucucaucuccuggaaccauggccagca

SEQ ID NO: 317222 - RNA, 22 nt, Human
agcccucucucucugcuugcca

SEQ ID NO: 317223 - RNA, 32 nt, Human
agcccucucugcacucccuaguccagaccugg

SEQ ID NO: 317224 - RNA, 32 nt, Human
agcccucucuuccucgcuuuccuuccuaccua

SEQ ID NO: 317225 - RNA, 26 nt, Human
agcccucugcccacugggcccaggga

SEQ ID NO: 317226 - RNA, 32 nt, Human
agcccucugggccuguguugcuguuauuccua

SEQ ID NO: 317227 - RNA, 32 nt, Human
agcccucugucugacaucauguccuucaacug

SEQ ID NO: 317228 - RNA, 32 nt, Human
agcccucuguuucucuuuccaucccauggagu

SEQ ID NO: 317229 - RNA, 32 nt, Human
agcccucuuccaucauguccccaaaccugcaa

SEQ ID NO: 317230 - RNA, 20 nt, Human
agcccucuucccaccugggu

SEQ ID NO: 317231 - RNA, 32 nt, Human
agcccucuuccucacguggcugaggccaccgc

SEQ ID NO: 317232 - RNA, 32 nt, Human
agcccucuuuucuucacaccucaucaaacaga

SEQ ID NO: 317233 - RNA, 32 nt, Human
agcccucuuuuucgcaccucaucaaacagaac

SEQ ID NO: 317234 - RNA, 32 nt, Human
agcccugaaaguacacugggacgguuugcgau

SEQ ID NO: 317235 - RNA, 32 nt, Human
agcccugaacucgggcccugagcuccucacug

SEQ ID NO: 317236 - RNA, 32 nt, Human
agcccugaacuuacuccaguuggccucuccag

SEQ ID NO: 317237 - RNA, 32 nt, Human
agcccugaagaaaggaguuaagagaggaagga

SEQ ID NO: 317238 - RNA, 32 nt, Human
agcccugaagauugaggcuacagugagccuug

SEQ ID NO: 317239 - RNA, 32 nt, Human
agcccugaagcccacauuucugggggugucgu

SEQ ID NO: 317240 - RNA, 32 nt, Human
agcccugaccaaggcccuaaccuaagacugag

SEQ ID NO: 317241 - RNA, 32 nt, Human
agcccugaccaccaccagaaguggaagagugg

SEQ ID NO: 317242 - RNA, 23 nt, Human
agcccugaccauagacccagcca

SEQ ID NO: 317243 - RNA, 32 nt, Human
agcccugaccuggaaugucuccaccucggauu

SEQ ID NO: 317244 - RNA, 22 nt, Human
agcccugagacacaggcccuca

SEQ ID NO: 317245 - RNA, 32 nt, Human
agcccugagauggugacaggcuggccugcagu

SEQ ID NO: 317246 - RNA, 32 nt, Human
agcccugagauguuacaguugaagagcuuggu

SEQ ID NO: 317247 - RNA, 32 nt, Human
agcccugagcugcaacagaagacugaauggag

SEQ ID NO: 317248 - RNA, 32 nt, Human
agcccugauauugaaguauaggacccggccag

SEQ ID NO: 317249 - RNA, 32 nt, Human
agcccugaugcugcugucagagaaggacacug

SEQ ID NO: 317250 - RNA, 32 nt, Human
agcccugaugcuguaaggauucacaucagaga

SEQ ID NO: 317251 - RNA, 22 nt, Human
agcccugauuuacccccaggga

SEQ ID NO: 317252 - RNA, 32 nt, Human
agcccugcaccaugcugcuggggaagacagug

SEQ ID NO: 317253 - RNA, 32 nt, Human
agcccugcacgcccuggcuggcacuguugccg

SEQ ID NO: 317254 - RNA, 32 nt, Human
agcccugcacuguuuucccuccaccacagcca

SEQ ID NO: 317255 - RNA, 32 nt, Human
agcccugcagcccucagaaucagggccaggga

SEQ ID NO: 317256 - RNA, 32 nt, Human
agcccugcagcgccuggauuggaggugugaca

SEQ ID NO: 317257 - RNA, 32 nt, Human
agcccugcagcuucagcaccugccccacccag

SEQ ID NO: 317258 - RNA, 24 nt, Human
agcccugcauaaaguguccagaga

SEQ ID NO: 317259 - RNA, 18 nt, Human
agcccugcauccuccaca

SEQ ID NO: 317260 - RNA, 21 nt, Human
agcccugccacagcccaaggg

SEQ ID NO: 317261 - RNA, 32 nt, Human
agcccugccagaccucccuggucaugacagag

SEQ ID NO: 317262 - RNA, 32 nt, Human
agcccugccaggcagccccuggcuccagguuc

SEQ ID NO: 317263 - RNA, 32 nt, Human
agcccugccaguuuccagagaaggcgcuugag

SEQ ID NO: 317264 - RNA, 32 nt, Human
agcccugccauggacgggcaggcuccaggcuc

SEQ ID NO: 317265 - RNA, 21 nt, Human
agcccugcccaacagccaggg

SEQ ID NO: 317266 - RNA, 28 nt, Human
agcccugcccacagcaggugcccaguga

SEQ ID NO: 317267 - RNA, 32 nt, Human
agcccugcccgaggcuaguaggcugcaacccu

SEQ ID NO: 317268 - RNA, 32 nt, Human
agcccugcccugugguuaggggaggugggugu

SEQ ID NO: 317269 - RNA, 32 nt, Human
agcccugccgagguggaagcuuggaguggcuc

SEQ ID NO: 317270 - RNA, 32 nt, Human
agcccugccgcagcugugccgugguguccagc

SEQ ID NO: 317271 - RNA, 32 nt, Human
agcccugccucccaagaggcugcuguggaugg

SEQ ID NO: 317272 - RNA, 32 nt, Human
agcccugccuccuggguucaagcaauucugua

SEQ ID NO: 317273 - RNA, 32 nt, Human
agcccugccucuguacagccucgaguggacag

SEQ ID NO: 317274 - RNA, 32 nt, Human
agcccugccucuuccccugauuugacccugga

SEQ ID NO: 317275 - RNA, 32 nt, Human
agcccugccucuugaugcagccuggauccagc

SEQ ID NO: 317276 - RNA, 32 nt, Human
agcccugccucuuucauuuccagaccuuggag

SEQ ID NO: 317277 - RNA, 19 nt, Human
agcccugccugcccugccc

SEQ ID NO: 317278 - RNA, 32 nt, Human
agcccugccugcccugccccuccagggggcca

SEQ ID NO: 317279 - RNA, 32 nt, Human
agcccugccuugcugcagccccagcccagaug

SEQ ID NO: 317280 - RNA, 32 nt, Human
agcccugccuuuccuguuauccuuuugaauua

SEQ ID NO: 317281 - RNA, 32 nt, Human
agcccugcgucccugccaguccaggcuuucuu

SEQ ID NO: 317282 - RNA, 32 nt, Human
agcccugcuagauuuuguaugaugcugaauua

SEQ ID NO: 317283 - RNA, 24 nt, Human
agcccugcucacugugcccaggga

SEQ ID NO: 317284 - RNA, 32 nt, Human
agcccugcuccagcagcacuugcccauuccuu

SEQ ID NO: 317285 - RNA, 32 nt, Human
agcccugcuccuccugccuccugggguccagu

SEQ ID NO: 317286 - RNA, 32 nt, Human
agcccugcuccugauggccauggaaggaacau

SEQ ID NO: 317287 - RNA, 32 nt, Human
agcccugcugcaaagccuuuccagaaaaauaa

SEQ ID NO: 317288 - RNA, 25 nt, Human
agcccugcuggauugaugcccaggg

SEQ ID NO: 317289 - RNA, 32 nt, Human
agcccugcuguggccuccuugugguggucccu

SEQ ID NO: 317290 - RNA, 32 nt, Human
agcccuggacaccuaggcaugggugagcuacu

SEQ ID NO: 317291 - RNA, 32 nt, Human
agcccuggagaagggacuggauuccaugaacg

SEQ ID NO: 317292 - RNA, 32 nt, Human
agcccuggagcagcaacuggcugcagaucaca

SEQ ID NO: 317293 - RNA, 32 nt, Human
agcccuggagcuugccagagcagagcgagaaa

SEQ ID NO: 317294 - RNA, 20 nt, Human
agcccuggaggccugagccg

SEQ ID NO: 317295 - RNA, 32 nt, Human
agcccuggaggggagagcgcggacucuagcca

SEQ ID NO: 317296 - RNA, 24 nt, Human
agcccuggaggucaaggcugcagu

SEQ ID NO: 317297 - RNA, 32 nt, Human
agcccuggaggucaaggcugcagugagccaug

SEQ ID NO: 317298 - RNA, 32 nt, Human
agcccuggaggucgaggcuacagugagcuaug

SEQ ID NO: 317299 - RNA, 32 nt, Human
agcccuggagguugaggcugcagugagcuggg

SEQ ID NO: 317300 - RNA, 32 nt, Human
agcccuggagguuucugcagacgaugcggcug

SEQ ID NO: 317301 - RNA, 24 nt, Human
agcccuggaguucaaggcugcagu

SEQ ID NO: 317302 - RNA, 32 nt, Human
agcccuggaguucaaggcugcagugagcugug

SEQ ID NO: 317303 - RNA, 26 nt, Human
agcccuggaguuggagguugcaguga

SEQ ID NO: 317304 - RNA, 32 nt, Human
agcccuggaguuggagguugcagugagcagag

SEQ ID NO: 317305 - RNA, 32 nt, Human
agcccuggaguuugaguccagccugggugaca

SEQ ID NO: 317306 - RNA, 22 nt, Human
agcccuggauuuccugcugcca

SEQ ID NO: 317307 - RNA, 32 nt, Human
agcccuggcagacugaggagccucccaggagc

SEQ ID NO: 317308 - RNA, 19 nt, Human
agcccuggcagcaggaggc

SEQ ID NO: 317309 - RNA, 32 nt, Human
agcccuggccaucuuggacuucuggagcuacc

SEQ ID NO: 317310 - RNA, 32 nt, Human
agcccuggcccagguggugagcgguuugcagu

SEQ ID NO: 317311 - RNA, 18 nt, Human
agcccuggccuccugccc

SEQ ID NO: 317312 - RNA, 32 nt, Human
agcccuggcggcagagguugcagugagccaag

SEQ ID NO: 317313 - RNA, 32 nt, Human
agcccuggcuacaccugcuucagugcaacugg

SEQ ID NO: 317314 - RNA, 32 nt, Human
agcccuggcuccaagggcugccuccugacagc

SEQ ID NO: 317315 - RNA, 32 nt, Human
agcccuggcucccauucaaccuccuuagccag

SEQ ID NO: 317316 - RNA, 32 nt, Human
agcccuggcuccugccuguucucagccccggc

SEQ ID NO: 317317 - RNA, 32 nt, Human
agcccuggcucucacgcugggguuuuggacac

SEQ ID NO: 317318 - RNA, 32 nt, Human
agcccuggcugaagcaagcagucaguacuugc

SEQ ID NO: 317319 - RNA, 32 nt, Human
agcccuggcugcuccaaaaccaaaaagcuggg

SEQ ID NO: 317320 - RNA, 24 nt, Human
agcccugggacccugccagucuca

SEQ ID NO: 317321 - RNA, 25 nt, Human
agcccugggaggagggcagaaggcu

SEQ ID NO: 317322 - RNA, 25 nt, Human
agcccugggaggucaaggcugcagu

SEQ ID NO: 317323 - RNA, 32 nt, Human
agcccugggaggucaaggcugcagugagcugc

SEQ ID NO: 317324 - RNA, 32 nt, Human
agcccugggcaggcaguaggggaggcgccacc

SEQ ID NO: 317325 - RNA, 32 nt, Human
agcccugggccaaggaacacccccuaguccug

SEQ ID NO: 317326 - RNA, 32 nt, Human
agcccugggccuguugacccaccagcuuagga

SEQ ID NO: 317327 - RNA, 32 nt, Human
agcccugggccuugccuucagggaguugacag

SEQ ID NO: 317328 - RNA, 32 nt, Human
agcccuggggcucugaaucugcacuugggagc

SEQ ID NO: 317329 - RNA, 32 nt, Human
agcccugggguggaggcccauugaggauggcc

SEQ ID NO: 317330 - RNA, 32 nt, Human
agcccugggucacccccacucugccucauuuc

SEQ ID NO: 317331 - RNA, 32 nt, Human
agcccuggguggcaccagcaaguguuuggcaa

SEQ ID NO: 317332 - RNA, 32 nt, Human
agcccugguaucuccccaucccuacucccagc

SEQ ID NO: 317333 - RNA, 32 nt, Human
agcccuggucccaccuccuuggcucuacccca

SEQ ID NO: 317334 - RNA, 32 nt, Human
agcccuggugcagggacuccagugaguagggc

SEQ ID NO: 317335 - RNA, 32 nt, Human
agcccuggugggcagagagguagggauggggc

SEQ ID NO: 317336 - RNA, 32 nt, Human
agcccugguuccugcucuuccaugaucagugu

SEQ ID NO: 317337 - RNA, 32 nt, Human
agcccugguuguuaaaaguagggacucugccu

SEQ ID NO: 317338 - RNA, 32 nt, Human
agcccuguauucuuccccuugacccuguguca

SEQ ID NO: 317339 - RNA, 32 nt, Human
agcccugucaccaccugguccuucaugaagag

SEQ ID NO: 317340 - RNA, 21 nt, Human
agcccugucaccuccucuuca

SEQ ID NO: 317341 - RNA, 32 nt, Human
agcccugucaccugugcacaucuugcuggugg

SEQ ID NO: 317342 - RNA, 32 nt, Human
agcccugucccaucccccuccccggguuccuu

SEQ ID NO: 317343 - RNA, 32 nt, Human
agcccuguccccacucacguggcuucucagcg

SEQ ID NO: 317344 - RNA, 32 nt, Human
agcccugucccucccugccuccgccuugccca

SEQ ID NO: 317345 - RNA, 32 nt, Human
agcccugucuccuccccaccucccaaaggucu

SEQ ID NO: 317346 - RNA, 32 nt, Human
agcccugugccuccuagcccaggauuugucuc

SEQ ID NO: 317347 - RNA, 32 nt, Human
agcccugugcuaggcagagcucaggagaccag

SEQ ID NO: 317348 - RNA, 32 nt, Human
agcccuguggcugccuugggccugcccucagc

SEQ ID NO: 317349 - RNA, 32 nt, Human
agcccugugggagggggacaagaauguauagg

SEQ ID NO: 317350 - RNA, 32 nt, Human
agcccuguggucaugguucugaugacaucauc

SEQ ID NO: 317351 - RNA, 32 nt, Human
agcccugugguccugcccuccuggggcucaca

SEQ ID NO: 317352 - RNA, 32 nt, Human
agcccuguucuuccucucccacugaauucuaa

SEQ ID NO: 317353 - RNA, 32 nt, Human
agcccuguuguucugucauggccagugggcag

SEQ ID NO: 317354 - RNA, 18 nt, Human
agcccuguuuuguuggua

SEQ ID NO: 317355 - RNA, 32 nt, Human
agcccuuacaagagguggagcaugcagaugag

SEQ ID NO: 317356 - RNA, 32 nt, Human
agcccuuacuccugguucagugccacgcaggg

SEQ ID NO: 317357 - RNA, 32 nt, Human
agcccuucagaauacugucauuguccuugggg

SEQ ID NO: 317358 - RNA, 32 nt, Human
agcccuucagccaccggucucgaccucuccuc

SEQ ID NO: 317359 - RNA, 32 nt, Human
agcccuucaucccacuuuggagaaugguuuug

SEQ ID NO: 317360 - RNA, 23 nt, Human
agcccuucccacuggcucccuga

SEQ ID NO: 317361 - RNA, 32 nt, Human
agcccuucccagcuccagccccggcuggcccg

SEQ ID NO: 317362 - RNA, 32 nt, Human
agcccuuccccgagacugcugaugucuguaac

SEQ ID NO: 317363 - RNA, 32 nt, Human
agcccuucccuaauuacaccuauccccuacac

SEQ ID NO: 317364 - RNA, 22 nt, Human
agcccuucccuggccccgccgg

SEQ ID NO: 317365 - RNA, 19 nt, Human
agcccuucccuuccccucu

SEQ ID NO: 317366 - RNA, 32 nt, Human
agcgaggaugcagagugacuggaacuucccgu

SEQ ID NO: 317367 - RNA, 32 nt, Human
agcgaggcaugaagcaaagagcugagugaguc

SEQ ID NO: 317368 - RNA, 32 nt, Human
agcgaggcccaaaggggaagccuagcggagcu

SEQ ID NO: 317369 - RNA, 24 nt, Human
agcgaggcccccaggccgccagga

SEQ ID NO: 317370 - RNA, 22 nt, Human
agcgaggcccccagguucaagg

SEQ ID NO: 317371 - RNA, 32 nt, Human
agcgaggcccccagguucaagguguuggcggg

SEQ ID NO: 317372 - RNA, 32 nt, Human
agcgaggcccuccccucugcaccagcucauug

SEQ ID NO: 317373 - RNA, 21 nt, Human
agcgaggccuaagcccccgga

SEQ ID NO: 317374 - RNA, 23 nt, Human
agcgaggccuuccucacucagga

SEQ ID NO: 317375 - RNA, 32 nt, Human
agcgaggcgcgacacugcuggggagaggaggg

SEQ ID NO: 317376 - RNA, 18 nt, Human
agcgaggcggacgggcgg

SEQ ID NO: 317377 - RNA, 32 nt, Human
agcgaggcgggggcgggugaggagggggugac

SEQ ID NO: 317378 - RNA, 32 nt, Human
agcgagggaagguugaggaggagccagagccg

SEQ ID NO: 317379 - RNA, 32 nt, Human
agcgagggaagguugaggaggagccagagccu

SEQ ID NO: 317380 - RNA, 32 nt, Human
agcgagggacgcauggcccugaggcggccgca

SEQ ID NO: 317381 - RNA, 32 nt, Human
agcgagggagaagggaaaggcugucccgggac

SEQ ID NO: 317382 - RNA, 32 nt, Human
agcgagggagagagcgagcgggcgagccggag

SEQ ID NO: 317383 - RNA, 32 nt, Human
agcgagggagagaggaccggucccagcuuuug

SEQ ID NO: 317384 - RNA, 32 nt, Human
agcgagggaggaaguuuccuccgaucaguaga

SEQ ID NO: 317385 - RNA, 32 nt, Human
agcgagggcaaggagagagcagugaggccgga

SEQ ID NO: 317386 - RNA, 32 nt, Human
agcgagggccacuacacuccagccugggugac

SEQ ID NO: 317387 - RNA, 31 nt, Human
agcgagggcuacagaacaggcauucaggagu

SEQ ID NO: 317388 - RNA, 32 nt, Human
agcgaggggcagcagccgaguuaaaguggggg

SEQ ID NO: 317389 - RNA, 32 nt, Human
agcgaggggcgcaagggugggugcauccugcg

SEQ ID NO: 317390 - RNA, 32 nt, Human
agcgaggguccaauccugcccugcgcuagucc

SEQ ID NO: 317391 - RNA, 29 nt, Human
agcgaggguuuuguggugccuggagccug

SEQ ID NO: 317392 - RNA, 32 nt, Human
agcgaggucagcgaguuugagggaggaccgcg

SEQ ID NO: 317393 - RNA, 32 nt, Human
agcgaggugaagcuuugggugcucuggaaggg

SEQ ID NO: 317394 - RNA, 32 nt, Human
agcgaguccagcagaaagcugcagugacccug

SEQ ID NO: 317395 - RNA, 32 nt, Human
agcgagugcccagggugaaucaauggaaaccc

SEQ ID NO: 317396 - RNA, 23 nt, Human
agcgaguggaucaccugagguca

SEQ ID NO: 317397 - RNA, 32 nt, Human
agcgagugugugagcuauggagcgaagagccu

SEQ ID NO: 317398 - RNA, 32 nt, Human
agcgaguuccaggacgaucccgugcugcaggu

SEQ ID NO: 317399 - RNA, 32 nt, Human
agcgauagggucucaccauguugcccaggcug

SEQ ID NO: 317400 - RNA, 32 nt, Human
agcgaucacaucuggugaccaggcugcuucau

SEQ ID NO: 317401 - RNA, 32 nt, Human
agcgaucagacuccggaguuuggcccgggagc

SEQ ID NO: 317402 - RNA, 32 nt, Human
agcgaucagggauaggggcagguuguauggca

SEQ ID NO: 317403 - RNA, 32 nt, Human
agcgaucaugugccuaagccuccugaguagcu

SEQ ID NO: 317404 - RNA, 32 nt, Human
agcgauccacccaucuuggccucccagagugc

SEQ ID NO: 317405 - RNA, 32 nt, Human
agcgauccacccgcccaugccucccagagugc

SEQ ID NO: 317406 - RNA, 32 nt, Human
agcgauccucccacuucagccuuucaaguggc

SEQ ID NO: 317407 - RNA, 32 nt, Human
agcgauccucccaucucagccucccagagugc

SEQ ID NO: 317408 - RNA, 32 nt, Human
agcgauccuccugccuuagccucccagaguac

SEQ ID NO: 317409 - RNA, 32 nt, Human
agcgaucgaugacaccaccagaguuacucacu

SEQ ID NO: 317410 - RNA, 32 nt, Human
agcgaucugccugcuucagccucccagagugc

SEQ ID NO: 317411 - RNA, 32 nt, Human
agcgaugaagaaugucucuagaagagaaugaa

SEQ ID NO: 317412 - RNA, 32 nt, Human
agcgaugacauuugcucucacagcagaugaca

SEQ ID NO: 317413 - RNA, 32 nt, Human
agcgaugacuccagucugggugucccagcgag

SEQ ID NO: 317414 - RNA, 32 nt, Human
agcgaugcaguugggagaggaagcuagaaggg

SEQ ID NO: 317415 - RNA, 29 nt, Human
agcgaugccaagccagcgacccaccaugg

SEQ ID NO: 317416 - RNA, 32 nt, Human
agcgaugcuaucuccucaacucucccucuucu

SEQ ID NO: 317417 - RNA, 32 nt, Human
agcgauggacaaaggcaggcugcccggcuggc

SEQ ID NO: 317418 - RNA, 19 nt, Human
agcgauggauaauaccuaa

SEQ ID NO: 317419 - RNA, 29 nt, Human
agcgauggcggcugggccgaguggguguc

SEQ ID NO: 317420 - RNA, 32 nt, Human
agcgaugugcauuuuguaagcacuuuggagcc

SEQ ID NO: 317421 - RNA, 29 nt, Human
agcgauguugugcgcccauuucucagauc

SEQ ID NO: 317422 - RNA, 32 nt, Human
agcgauguuucaugggcucaagggauccugcc

SEQ ID NO: 317423 - RNA, 32 nt, Human
agcgauucucaugccucagccucccagguagc

SEQ ID NO: 317424 - RNA, 32 nt, Human
agcgauucucaugccucagccucccaguagcu

SEQ ID NO: 317425 - RNA, 32 nt, Human
agcgauucuccucccucagccuccugaguagc

SEQ ID NO: 317426 - RNA, 32 nt, Human
agcgauucuccugccucagccucccagguugc

SEQ ID NO: 317427 - RNA, 32 nt, Human
agcgauucuccuguaucggccucccagguagc

SEQ ID NO: 317428 - RNA, 32 nt, Human
agcgauucucuugccucagccucccagguagc

SEQ ID NO: 317429 - RNA, 32 nt, Human
agcgauucuucugccucagucucccaaguagc

SEQ ID NO: 317430 - RNA, 32 nt, Human
agcgauucuucugcuucagucucccaaguagc

SEQ ID NO: 317431 - RNA, 32 nt, Human
agcgauuucuagaccugggcaucuccauugcu

SEQ ID NO: 317432 - RNA, 32 nt, Human
agcgauuucuggcugcugucaccuccuugcuc

SEQ ID NO: 317433 - RNA, 32 nt, Human
agcgauuugacagcucaccagccuggagcuuu

SEQ ID NO: 317434 - RNA, 32 nt, Human
agcgcaaagaagagcucugacucuccaggggu

SEQ ID NO: 317435 - RNA, 32 nt, Human
agcgcaaaguagaaacugaaaguacacugcug

SEQ ID NO: 317436 - RNA, 22 nt, Human
agcgcaaccaagccuaaaggca

SEQ ID NO: 317437 - RNA, 32 nt, Human
agcgcaagaaccuguucgcagagaugcgcgag

SEQ ID NO: 317438 - RNA, 31 nt, Human
agcgcaaggacaaucucaaccugcacaagaa

SEQ ID NO: 317439 - RNA, 32 nt, Human
agcgcaaugcuacugcccuuccagaaacugug

SEQ ID NO: 317440 - RNA, 32 nt, Human
agcgcacaccuguaauuccagcuacucgggag

SEQ ID NO: 317441 - RNA, 32 nt, Human
agcgcaccauugcacuccagccuugggcgaca

SEQ ID NO: 317442 - RNA, 32 nt, Human
agcgcacgccuguaaucccagcuacucaggag

SEQ ID NO: 317443 - RNA, 32 nt, Human
agcgcacugcaaccuggaccuccugggcucaa

SEQ ID NO: 317444 - RNA, 32 nt, Human
agcgcacugcagccuugaacuccugggcucaa

SEQ ID NO: 317445 - RNA, 32 nt, Human
agcgcagaagucagauggaccgauuggaucga

SEQ ID NO: 317446 - RNA, 19 nt, Human
agcgcagacuggagccuaa

SEQ ID NO: 317447 - RNA, 21 nt, Human
agcgcagaguguaaaauuuaa

SEQ ID NO: 317448 - RNA, 32 nt, Human
agcgcagcaguagcuucagccugucuugggcu

SEQ ID NO: 317449 - RNA, 32 nt, Human
agcgcagccaacaugucggauaccaagguaaa

SEQ ID NO: 317450 - RNA, 32 nt, Human
agcgcagccguucagcacuaccccugccuaua

SEQ ID NO: 317451 - RNA, 32 nt, Human
agcgcaggagaaaaggagggggaagagagucc

SEQ ID NO: 317452 - RNA, 32 nt, Human
agcgcaggcugccacccaccugggcgaccucc

SEQ ID NO: 317453 - RNA, 21 nt, Human
agcgcagggcgcaccccgcuc

SEQ ID NO: 317454 - RNA, 32 nt, Human
agcgcagggcucaggagccagcagggcagagu

SEQ ID NO: 317455 - RNA, 32 nt, Human
agcgcagggggaacccagggagcgcgaugggc

SEQ ID NO: 317456 - RNA, 21 nt, Human
agcgcaggucaggcuaaggcc

SEQ ID NO: 317457 - RNA, 23 nt, Human
agcgcaguccaagaccuugcagg

SEQ ID NO: 317458 - RNA, 20 nt, Human
agcgcagugacagugccuaa

SEQ ID NO: 317459 - RNA, 32 nt, Human
agcgcagugggaacugggaagagcuagcccgg

SEQ ID NO: 317460 - RNA, 32 nt, Human
agcgcaguggucaggcaggagaggcagucgga

SEQ ID NO: 317461 - RNA, 32 nt, Human
agcgcaguucccagcugucucccugcuccucu

SEQ ID NO: 317462 - RNA, 32 nt, Human
agcgcauagauacagcagagcucacagugagu

SEQ ID NO: 317463 - RNA, 32 nt, Human
agcgcaucaaagaggagggggaguggccucac

SEQ ID NO: 317464 - RNA, 32 nt, Human
agcgcaucacacuggccgaggcccugcugcac

SEQ ID NO: 317465 - RNA, 32 nt, Human
agcgcauccuuuuugaucuccugggcggagug

SEQ ID NO: 317466 - RNA, 30 nt, Human
agcgcauggagccagaggaggaggaugaac

SEQ ID NO: 317467 - RNA, 32 nt, Human
agcgcauggcuguaauccuggcuacucaggag

SEQ ID NO: 317468 - RNA, 32 nt, Human
agcgcaugugugugcaccagugcacaagugua

SEQ ID NO: 317469 - RNA, 32 nt, Human
agcgccaagccuugcccaucugggcugcucgc

SEQ ID NO: 317470 - RNA, 32 nt, Human
agcgccaaggcagcaacugggaugggagagug

SEQ ID NO: 317471 - RNA, 32 nt, Human
agcgccacaaggaguacuuggugaggaagagu

SEQ ID NO: 317472 - RNA, 32 nt, Human
agcgccacccccuagccuucuucaaggccucc

SEQ ID NO: 317473 - RNA, 32 nt, Human
agcgccacccgcuucgcuugcaucagcugcgc

SEQ ID NO: 317474 - RNA, 16 nt, Human
agcgccacggcggcgg

SEQ ID NO: 317475 - RNA, 32 nt, Human
agcgccacugcacugcacgccagccuaggcga

SEQ ID NO: 317476 - RNA, 32 nt, Human
agcgccacugcaguccggccugggugaaagag

SEQ ID NO: 317477 - RNA, 20 nt, Human
agcgccagacgcggagcugg

SEQ ID NO: 317478 - RNA, 32 nt, Human
agcgccagagccgaagaaggagacugaaagug

SEQ ID NO: 317479 - RNA, 19 nt, Human
agcgccagagggaggccgg

SEQ ID NO: 317480 - RNA, 21 nt, Human
agcgccagcagcagcagagcg

SEQ ID NO: 317481 - RNA, 32 nt, Human
agcgccagcagcccugcacuccacgcuggcca

SEQ ID NO: 317482 - RNA, 17 nt, Human
agcgccagcagccgggc

SEQ ID NO: 317483 - RNA, 15 nt, Human
agcgccagcagcgcg

SEQ ID NO: 317484 - RNA, 21 nt, Human
agcgccagcagggacaguggc

SEQ ID NO: 317485 - RNA, 18 nt, Human
agcgccagcaguuccggc

SEQ ID NO: 317486 - RNA, 16 nt, Human
agcgccagccaggggc

SEQ ID NO: 317487 - RNA, 18 nt, Human
agcgccagcccauuggcg

SEQ ID NO: 317488 - RNA, 20 nt, Human
agcgccagcccucgggccgg

SEQ ID NO: 317489 - RNA, 32 nt, Human
agcgccagccugggccguggaggugggggcgg

SEQ ID NO: 317490 - RNA, 19 nt, Human
agcgccagcggccgggacg

SEQ ID NO: 317491 - RNA, 17 nt, Human
agcgccagcgucaccgg

SEQ ID NO: 317492 - RNA, 19 nt, Human
agcgccagcguccgagcgg

SEQ ID NO: 317493 - RNA, 20 nt, Human
agcgccagcuccagcaggcg

SEQ ID NO: 317494 - RNA, 19 nt, Human
agcgccagcucugggcugg

SEQ ID NO: 317495 - RNA, 18 nt, Human
agcgccagcugcgugagg

SEQ ID NO: 317496 - RNA, 17 nt, Human
agcgccaggcagcgcgg

SEQ ID NO: 317497 - RNA, 20 nt, Human
agcgccaggcccccgggggg

SEQ ID NO: 317498 - RNA, 17 nt, Human
agcgccaggcccggcgg

SEQ ID NO: 317499 - RNA, 18 nt, Human
agcgccaggccggggugg

SEQ ID NO: 317500 - RNA, 19 nt, Human
agcgccaggccuggggagg

SEQ ID NO: 317501 - RNA, 16 nt, Human
agcgccaggcgcgggc

SEQ ID NO: 317502 - RNA, 17 nt, Human
agcgccaggcgcggggg

SEQ ID NO: 317503 - RNA, 18 nt, Human
agcgccaggcggcggcgg

SEQ ID NO: 317504 - RNA, 20 nt, Human
agcgccaggcguggggccgg

SEQ ID NO: 317505 - RNA, 16 nt, Human
agcgccagggcaagug

SEQ ID NO: 317506 - RNA, 16 nt, Human
agcgccagggcacgcg

SEQ ID NO: 317507 - RNA, 18 nt, Human
agcgccagggucgcgggc

SEQ ID NO: 317508 - RNA, 16 nt, Human
agcgccagugcgggug

SEQ ID NO: 317509 - RNA, 18 nt, Human
agcgccaguuugaggagg

SEQ ID NO: 317510 - RNA, 32 nt, Human
agcgccaucucccgccuccaccauggagccca

SEQ ID NO: 317511 - RNA, 32 nt, Human
agcgccauugcacuccagccugagcgacagag

SEQ ID NO: 317512 - RNA, 32 nt, Human
agcgccauugcacuccagccugggcaacaaga

SEQ ID NO: 317513 - RNA, 32 nt, Human
agcgccauugcacuccagccugggcgacugaa

SEQ ID NO: 317514 - RNA, 32 nt, Human
agcgccauugcacuccagucugggugacagag

SEQ ID NO: 317515 - RNA, 17 nt, Human
agcgccauuggcugggc

SEQ ID NO: 317516 - RNA, 32 nt, Human
agcgcccaagaagaaaauggccauaaguggag

SEQ ID NO: 317517 - RNA, 32 nt, Human
agcgcccagacuaucugaauaaaaugacggga

SEQ ID NO: 317518 - RNA, 32 nt, Human
agcgcccagagccccagucugaggcuuggcgc

SEQ ID NO: 317519 - RNA, 32 nt, Human
agcgcccagcacaucugcccacccugcacagg

SEQ ID NO: 317520 - RNA, 32 nt, Human
agcgcccccaccacagccccaucacaaaggaa

SEQ ID NO: 317521 - RNA, 32 nt, Human
agcgcccccugagaaauguucacucuucaaug

SEQ ID NO: 317522 - RNA, 32 nt, Human
agcgcccccugcccccgaagcuggcuggaaag

SEQ ID NO: 317523 - RNA, 32 nt, Human
agcgccccgccuggccacugcgucuggcauuc

SEQ ID NO: 317524 - RNA, 32 nt, Human
agcgccccucacugcccgugggcacagugagg

SEQ ID NO: 317525 - RNA, 32 nt, Human
agcgccccucagccucugccacugugaaccgg

SEQ ID NO: 317526 - RNA, 32 nt, Human
agcgccccuccccacccagcgcccucacagag

SEQ ID NO: 317527 - RNA, 32 nt, Human
agcgcccggccgucaccccacccgaugaccug

SEQ ID NO: 317528 - RNA, 32 nt, Human
agcgcccggcugggacagucucuccauacccc

SEQ ID NO: 317529 - RNA, 32 nt, Human
agcgcccgggcggaugcagcgagcccacggag

SEQ ID NO: 317530 - RNA, 32 nt, Human
agcgcccuacuuccugugccugccccugccug

SEQ ID NO: 317531 - RNA, 32 nt, Human
agcgcccucccuguccaguuccuugaaggccc

SEQ ID NO: 317532 - RNA, 32 nt, Human
agcgcccugccuggcucggccggcgaagcucu

SEQ ID NO: 317533 - RNA, 32 nt, Human
agcgcccuggacugcugagggugggccaacag

SEQ ID NO: 317534 - RNA, 32 nt, Human
agcgcccugggaccccaaguaugaagccaaag

SEQ ID NO: 317535 - RNA, 17 nt, Human
agcgccgacaggagcgg

SEQ ID NO: 317536 - RNA, 32 nt, Human
agcgccgacccacgcccugccugcucuuccag

SEQ ID NO: 317537 - RNA, 32 nt, Human
agcgccgagcccagauacgcaagaacaucacg

SEQ ID NO: 317538 - RNA, 32 nt, Human
agcgccgaggagagugggaaauucagcccagc

SEQ ID NO: 317539 - RNA, 32 nt, Human
agcgccgaggaggaagagguugauggcggcgg

SEQ ID NO: 317540 - RNA, 22 nt, Human
agcgccgcagccaccgcagcca

SEQ ID NO: 317541 - RNA, 22 nt, Human
agcgccgcccccgccagccagc

SEQ ID NO: 317542 - RNA, 24 nt, Human
agcgccgcccccugcuccacagcg

SEQ ID NO: 317543 - RNA, 22 nt, Human
agcgccgcccuccugcucgcca

SEQ ID NO: 317544 - RNA, 32 nt, Human
agcgccgccgaggcccggggccccagacccug

SEQ ID NO: 317545 - RNA, 23 nt, Human
agcgccgccugguggcagccggc

SEQ ID NO: 317546 - RNA, 32 nt, Human
agcgccgccuucuagucgcagcuccugugcug

SEQ ID NO: 317547 - RNA, 22 nt, Human
agcgccgcgcgagcaggagcgg

SEQ ID NO: 317548 - RNA, 32 nt, Human
agcgccgcuccccucccugcccuccgcccggg

SEQ ID NO: 317549 - RNA, 32 nt, Human
agcgccgcugaauucuaggcagaaagaaaaga

SEQ ID NO: 317550 - RNA, 32 nt, Human
agcgccggaccacccucuguccgccccgagga

SEQ ID NO: 317551 - RNA, 32 nt, Human
agcgccggagcgcgucccugcccuuagcgggg

SEQ ID NO: 317552 - RNA, 32 nt, Human
agcgccggcgcuccgggcccuaggugaccccu

SEQ ID NO: 317553 - RNA, 32 nt, Human
agcgccggcuccaagcccagccagucccucua

SEQ ID NO: 317554 - RNA, 19 nt, Human
agcgccgggaaggcugcug

SEQ ID NO: 317555 - RNA, 32 nt, Human
agcgccgggaagggguuugcagcugcuccguc

SEQ ID NO: 317556 - RNA, 17 nt, Human
agcgccgggcgagggcg

SEQ ID NO: 317557 - RNA, 32 nt, Human
agcgccggggcgugggcugagcacagcgcuuc

SEQ ID NO: 317558 - RNA, 19 nt, Human
agcgccgguugacgugcgg

SEQ ID NO: 317559 - RNA, 21 nt, Human
agcgccuagcagccccaagca

SEQ ID NO: 317560 - RNA, 18 nt, Human
agcgccuauuguuuguaa

SEQ ID NO: 317561 - RNA, 32 nt, Human
agcgccuccaagguuugucuugaagcauagcu

SEQ ID NO: 317562 - RNA, 32 nt, Human
agcgccucccagccugccgcccggcuaugaug

SEQ ID NO: 317563 - RNA, 32 nt, Human
agcgccucccaguucuggaggagccagguucc

SEQ ID NO: 317564 - RNA, 32 nt, Human
agcgccuccgucucucuccauuguguuccgac

SEQ ID NO: 317565 - RNA, 32 nt, Human
agcgccuccuccagguccuccuggguccccuc

SEQ ID NO: 317566 - RNA, 32 nt, Human
agcgccucgccugccccugccuuggccaaugc

SEQ ID NO: 317567 - RNA, 17 nt, Human
agcgccucuaugagaug

SEQ ID NO: 317568 - RNA, 32 nt, Human
agcgccucuccuccaugguccugucugucagc

SEQ ID NO: 317569 - RNA, 19 nt, Human
agcgccucugccacugccu

SEQ ID NO: 317570 - RNA, 32 nt, Human
agcgccucugcucucucccgguauccgcauuu

SEQ ID NO: 317571 - RNA, 32 nt, Human
agcgccucugucgcugggacccuucagaacuc

SEQ ID NO: 317572 - RNA, 32 nt, Human
agcgccugaggcaggagaaucgcuugaacccc

SEQ ID NO: 317573 - RNA, 32 nt, Human
agcgccugcagucccagcuacuugggaggcua

SEQ ID NO: 317574 - RNA, 32 nt, Human
agcgccugccucggccccuccucugcccccgc

SEQ ID NO: 317575 - RNA, 32 nt, Human
agcgccugcgucgcuucaucucccaggagcug

SEQ ID NO: 317576 - RNA, 32 nt, Human
agcgccugggaggcucgguaggaggagucuuc

SEQ ID NO: 317577 - RNA, 32 nt, Human
agcgccugggggagggggacuggagaggcgag

SEQ ID NO: 317578 - RNA, 19 nt, Human
agcgccugguauggugcgg

SEQ ID NO: 317579 - RNA, 32 nt, Human
agcgccuguagucccagcuacucgagagccug

SEQ ID NO: 317580 - RNA, 32 nt, Human
agcgccuguagucccagcuacucgggaggcug

SEQ ID NO: 317581 - RNA, 32 nt, Human
agcgccuguagucccagcuacucuggaggcug

SEQ ID NO: 317582 - RNA, 32 nt, Human
agcgccuguucaacuuuguccucucucagaga

SEQ ID NO: 317583 - RNA, 32 nt, Human
agcgccuucccaacaaugugccccucaccccu

SEQ ID NO: 317584 - RNA, 32 nt, Human
agcgccuugaaggagcacagcuggggugccug

SEQ ID NO: 317585 - RNA, 32 nt, Human
agcgccuuuccugucugugguuuaagucuuug

SEQ ID NO: 317586 - RNA, 32 nt, Human
agcgcgaccaugucccaucacuggggguacgg

SEQ ID NO: 317587 - RNA, 32 nt, Human
agcgcgagccgcggccggcgccgcugcagagc

SEQ ID NO: 317588 - RNA, 32 nt, Human
agcgcgagugccagagcccagccggcgcggag

SEQ ID NO: 317589 - RNA, 32 nt, Human
agcgcgcauccucccuuccuccuuucggagaa

SEQ ID NO: 317590 - RNA, 32 nt, Human
agcgcgccauccccaaggcagcuccugcugug

SEQ ID NO: 317591 - RNA, 22 nt, Human
agcgcgccccagcagggcccgc

SEQ ID NO: 317592 - RNA, 20 nt, Human
agcgcgcccccgccccggac

SEQ ID NO: 317593 - RNA, 32 nt, Human
agcgcgcccugcccuggcgcagccagagccgc

SEQ ID NO: 317594 - RNA, 19 nt, Human
agcgcgccggcgugagcgg

SEQ ID NO: 317595 - RNA, 23 nt, Human
agcgcgccuggaagccccgggca

SEQ ID NO: 317596 - RNA, 16 nt, Human
agcgcgccuggccuga

SEQ ID NO: 317597 - RNA, 20 nt, Human
agcgcgcgacacugcccgga

SEQ ID NO: 317598 - RNA, 32 nt, Human
agcgcgcggagaagaacggggagccagcauca

SEQ ID NO: 317599 - RNA, 32 nt, Human
agcgcgcggccuuggagccgucucuugggccc

SEQ ID NO: 317600 - RNA, 21 nt, Human
agcgcgcgggcuggcaggcug

SEQ ID NO: 317601 - RNA, 19 nt, Human
agcgcgcggggcccggcca

SEQ ID NO: 317602 - RNA, 32 nt, Human
agcgcgcgucccuucgugccuaggcgagagcc

SEQ ID NO: 317603 - RNA, 21 nt, Human
agcgcgcgugcaccuccagac

SEQ ID NO: 317604 - RNA, 22 nt, Human
agcgcgcgugcagccccggaca

SEQ ID NO: 317605 - RNA, 19 nt, Human
agcgcgcgugcagccgccg

SEQ ID NO: 317606 - RNA, 19 nt, Human
agcgcgcgugcgcacgaca

SEQ ID NO: 317607 - RNA, 32 nt, Human
agcgcgcucccggggagguguugcagccaugg

SEQ ID NO: 317608 - RNA, 32 nt, Human
agcgcgcucugcccggcuuccucagucuccuc

SEQ ID NO: 317609 - RNA, 32 nt, Human
agcgcgcucugccugccgccugccugccugcc

SEQ ID NO: 317610 - RNA, 32 nt, Human
agcgcgcugagcagacagagcgggagaacgcg

SEQ ID NO: 317611 - RNA, 21 nt, Human
agcgcgcugcugcggcugcug

SEQ ID NO: 317612 - RNA, 32 nt, Human
agcgcgcugugcaaagcgcucucggggucuuu

SEQ ID NO: 317613 - RNA, 22 nt, Human
agcgcggacggcugggcugcug

SEQ ID NO: 317614 - RNA, 32 nt, Human
agcgcggagacagcaagagaucuuguccagac

SEQ ID NO: 317615 - RNA, 32 nt, Human
agcgcggagaggaggcuggaagaggaagaugc

SEQ ID NO: 317616 - RNA, 32 nt, Human
agcgcggagagggcagcggacugagcggagcc

SEQ ID NO: 317617 - RNA, 32 nt, Human
agcgcggaggggaagggagcccccagcccugc

SEQ ID NO: 317618 - RNA, 32 nt, Human
agcgcggcaggguuaucaccagaucugggcuu

SEQ ID NO: 317619 - RNA, 32 nt, Human
agcgcggccaccggcgggagugcagcggccac

SEQ ID NO: 317620 - RNA, 32 nt, Human
agcgcggccugggaugcuuuuucccuccggca

SEQ ID NO: 317621 - RNA, 18 nt, Human
agcgcggcgggggcugcu

SEQ ID NO: 317622 - RNA, 32 nt, Human
agcgcggcugacacacacguucaagcccagga

SEQ ID NO: 317623 - RNA, 32 nt, Human
agcgcgggacaggcagaugcagugagugaggg

SEQ ID NO: 317624 - RNA, 24 nt, Human
agcgcgggaccagcagcaagggcc

SEQ ID NO: 317625 - RNA, 32 nt, Human
agcgcgggagagagugagagagagugagagca

SEQ ID NO: 317626 - RNA, 32 nt, Human
agcgcgggagcagcagcagaggcggaggcucc

SEQ ID NO: 317627 - RNA, 32 nt, Human
agcgcgggaggcggcggcggcgcggagcccag

SEQ ID NO: 317628 - RNA, 32 nt, Human
agcgcgggauuuccuuucucucucacucucuu

SEQ ID NO: 317629 - RNA, 21 nt, Human
agcgcgggcugcagcaugggc

SEQ ID NO: 317630 - RNA, 20 nt, Human
agcgcggggagacaugccug

SEQ ID NO: 317631 - RNA, 18 nt, Human
agcgcggggagcggcagc

SEQ ID NO: 317632 - RNA, 20 nt, Human
agcgcggggagcggggccgc

SEQ ID NO: 317633 - RNA, 32 nt, Human
agcgcggggaggcucugggcucagggaagcug

SEQ ID NO: 317634 - RNA, 32 nt, Human
agcgcgggggagaagagugcgcaggucagagg

SEQ ID NO: 317635 - RNA, 19 nt, Human
agcgcgggggcggcuccug

SEQ ID NO: 317636 - RNA, 22 nt, Human
agcgcggggggcaaauaagacc

SEQ ID NO: 317637 - RNA, 20 nt, Human
agcgcggggggccgcggcug

SEQ ID NO: 317638 - RNA, 32 nt, Human
agcgcgguuucagcauuuaauuuuaagggagc

SEQ ID NO: 317639 - RNA, 32 nt, Human
agcgcguagccggagcgccuggggaaggcgga

SEQ ID NO: 317640 - RNA, 32 nt, Human
agcgcgucccccaucaguggggcaccagcgcu

SEQ ID NO: 317641 - RNA, 32 nt, Human
agcgcgucccgcagccggcuggucccugucgc

SEQ ID NO: 317642 - RNA, 32 nt, Human
agcgcguccuggccaagccgaguagugucuuc

SEQ ID NO: 317643 - RNA, 32 nt, Human
agcgcgucuuucuccugucuccuccccaagau

SEQ ID NO: 317644 - RNA, 32 nt, Human
agcgcgugccauuucacuccagccuggacaac

SEQ ID NO: 317645 - RNA, 32 nt, Human
agcgcuacuggagaagaggagcaacaccugug

SEQ ID NO: 317646 - RNA, 32 nt, Human
agcgcuaggauuacaagcaugagccacggcag

SEQ ID NO: 317647 - RNA, 32 nt, Human
agcgcuaggauuacaggugugagccacugcgc

SEQ ID NO: 317648 - RNA, 32 nt, Human
agcgcuauggcagagggcagcggggaaguggu

SEQ ID NO: 317649 - RNA, 32 nt, Human
agcgcucaggccagggccggcgggggcacugc

SEQ ID NO: 317650 - RNA, 23 nt, Human
agcgcucaggcugggugcagugg

SEQ ID NO: 317651 - RNA, 32 nt, Human
agcgcuccagccuggucgacagagugagacuc

SEQ ID NO: 317652 - RNA, 32 nt, Human
agcgcucccccugccuugccccuggggccucc

SEQ ID NO: 317653 - RNA, 32 nt, Human
agcgcuccucacggaucccucucucucgggcc

SEQ ID NO: 317654 - RNA, 32 nt, Human
agcgcuccugguagcugggacuacaggcacag

SEQ ID NO: 317655 - RNA, 22 nt, Human
agcgcucgccacgcucagugcc

SEQ ID NO: 317656 - RNA, 32 nt, Human
agcgcucgcuucuccguuguguguuuugcaug

SEQ ID NO: 317657 - RNA, 32 nt, Human
agcgcucggagcagugcagguuucguuauccu

SEQ ID NO: 317658 - RNA, 32 nt, Human
agcgcucucuggccuccgccuccgccagggag

SEQ ID NO: 317659 - RNA, 32 nt, Human
agcgcugaaacugaacaucuccuggguucuuc

SEQ ID NO: 317660 - RNA, 32 nt, Human
agcgcugagauuacaggugugagccaccgugc

SEQ ID NO: 317661 - RNA, 32 nt, Human
agcgcugagcagagcagguggaagaggaacuu

SEQ ID NO: 317662 - RNA, 32 nt, Human
agcgcugagccaugcucgcgaacugugggucu

SEQ ID NO: 317663 - RNA, 32 nt, Human
agcgcugcaagggccagcgcccaaccugucgc

SEQ ID NO: 317664 - RNA, 32 nt, Human
agcgcugcagcagggagguggggugggcggua

SEQ ID NO: 317665 - RNA, 32 nt, Human
agcgcugcagccccagccugagcagcagccgu

SEQ ID NO: 317666 - RNA, 32 nt, Human
agcgcugcauuuucuccccucucccucccucc

SEQ ID NO: 317667 - RNA, 18 nt, Human
agcgcugccccaaggcgg

SEQ ID NO: 317668 - RNA, 23 nt, Human
agcgcugccccugcccccacccu

SEQ ID NO: 317669 - RNA, 22 nt, Human
agcgcuggccccagcauggagg

SEQ ID NO: 317670 - RNA, 16 nt, Human
agcgcuggcugaacug

SEQ ID NO: 317671 - RNA, 32 nt, Human
agcgcugggaaucagucacugugcuauccuug

SEQ ID NO: 317672 - RNA, 32 nt, Human
agcgcugggauuacaggcaggagccacugagc

SEQ ID NO: 317673 - RNA, 32 nt, Human
agcgcugggauuacaggcaugagccaccaugc

SEQ ID NO: 317674 - RNA, 32 nt, Human
agcgcugggauuacaggcaugagccaccgugc

SEQ ID NO: 317675 - RNA, 32 nt, Human
agcgcugggauuacaggcgugagccaccacac

SEQ ID NO: 317676 - RNA, 32 nt, Human
agcgcugggauuacaggcgugagccaccgcgc

SEQ ID NO: 317677 - RNA, 32 nt, Human
agcgcugggauuacaggcgugagccaccucgc

SEQ ID NO: 317678 - RNA, 32 nt, Human
agcgcugggauuacaggugugagccacugagc

SEQ ID NO: 317679 - RNA, 32 nt, Human
agcgcugggauuacaggugugagccacugugc

SEQ ID NO: 317680 - RNA, 32 nt, Human
agcgcugggauuauaggcgugagccaccgccc

SEQ ID NO: 317681 - RNA, 32 nt, Human
agcgcugggauuauaggucugugccgccuccc

SEQ ID NO: 317682 - RNA, 23 nt, Human
agcgcugggcuggugugcagugg

SEQ ID NO: 317683 - RNA, 32 nt, Human
agcgcugggcuggugugcaguggugcgaccac

SEQ ID NO: 317684 - RNA, 32 nt, Human
agcgcugggguuuugcagacgugaccuagggc

SEQ ID NO: 317685 - RNA, 32 nt, Human
agcgcuggucccaccuccuuccuuccaaacug

SEQ ID NO: 317686 - RNA, 32 nt, Human
agcgcuggugaagccaacauagagacugucaa

SEQ ID NO: 317687 - RNA, 32 nt, Human
agcgcugguguggacgggaagcucccggcccg

SEQ ID NO: 317688 - RNA, 32 nt, Human
agcgcugucugugggucccuugccccggagcu

SEQ ID NO: 317689 - RNA, 32 nt, Human
agcgcugugugugugcucuuauuuccacuggc

SEQ ID NO: 317690 - RNA, 32 nt, Human
agcgcuuacccacucuuuccgggaggccaguu

SEQ ID NO: 317691 - RNA, 32 nt, Human
agcgcuucagcaaccgcucccaccuccuccag

SEQ ID NO: 317692 - RNA, 32 nt, Human
agcgcuucagggaggucagaauggagccgaac

SEQ ID NO: 317693 - RNA, 17 nt, Human
agcgcuucagugggcgg

SEQ ID NO: 317694 - RNA, 19 nt, Human
agcgcuuccaggcccacca

SEQ ID NO: 317695 - RNA, 32 nt, Human
agcgcuuccgagcugugcccagucccgggaau

SEQ ID NO: 317696 - RNA, 32 nt, Human
agcgcuuccuaccugguggucuucagcaaugc

SEQ ID NO: 317697 - RNA, 32 nt, Human
agcgcuuccuucaguuccucacccaucagcca

SEQ ID NO: 317698 - RNA, 32 nt, Human
agcgcuucggccuguccuccgcacuggagacu

SEQ ID NO: 317699 - RNA, 19 nt, Human
agcgcuucguagccccgga

SEQ ID NO: 317700 - RNA, 32 nt, Human
agcgcuucuacuggcccuccugcugccaccac

SEQ ID NO: 317701 - RNA, 32 nt, Human
agcgcuugaggcuugaagagggagacaagcua

SEQ ID NO: 317702 - RNA, 32 nt, Human
agcgcuugccucucccuggcccagggcugacu

SEQ ID NO: 317703 - RNA, 32 nt, Human
agcgcuuguccacccucccuuagcucugacuc

SEQ ID NO: 317704 - RNA, 32 nt, Human
agcgcuuucagcuggaccacucaggccuggac

SEQ ID NO: 317705 - RNA, 32 nt, Human
agcgcuuugcacaugcacccuccugaguuugg

SEQ ID NO: 317706 - RNA, 32 nt, Human
agcgcuuuugccugugugauuuccucuggguu

SEQ ID NO: 317707 - RNA, 32 nt, Human
agcggaaaaugauccagucacagauaucauuu

SEQ ID NO: 317708 - RNA, 32 nt, Human
agcggaaaccgcgggagccgagcccagcuagg

SEQ ID NO: 317709 - RNA, 31 nt, Human
agcggaaagcggucucccauguauaagaaaa

SEQ ID NO: 317710 - RNA, 32 nt, Human
agcggaacaagaaaauagauuuccaguggguu

SEQ ID NO: 317711 - RNA, 32 nt, Human
agcggaacgaacagcugucugccuuguuguga

SEQ ID NO: 317712 - RNA, 32 nt, Human
agcggaagaaaagagagaguucaaguggaugg

SEQ ID NO: 317713 - RNA, 32 nt, Human
agcggaaggccgcuuccuuucucagcugaacc

SEQ ID NO: 317714 - RNA, 32 nt, Human
agcggaaggugaggcaccugaggcagagaaag

SEQ ID NO: 317715 - RNA, 32 nt, Human
agcggaauggguacugucuaggaggacugggc

SEQ ID NO: 317716 - RNA, 32 nt, Human
agcggacaccuccucaggcuuaaaucucaggc

SEQ ID NO: 317717 - RNA, 32 nt, Human
agcggacaggcuggugggcgagcgagaggcgg

SEQ ID NO: 317718 - RNA, 32 nt, Human
agcggacccacuccccucacauuccacaggcc

SEQ ID NO: 317719 - RNA, 32 nt, Human
agcggaccuaaaggaaggaccccacacacacc

SEQ ID NO: 317720 - RNA, 23 nt, Human
agcggaccucacagcagccccag

SEQ ID NO: 317721 - RNA, 32 nt, Human
agcggacggaggagcagagggagaaagcgagg

SEQ ID NO: 317722 - RNA, 21 nt, Human
agcggacggcggcggaggaga

SEQ ID NO: 317723 - RNA, 32 nt, Human
agcggacucccagccccucauuagauuguuuu

SEQ ID NO: 317724 - RNA, 32 nt, Human
agcggacucuuucucucucacucucucucuuu

SEQ ID NO: 317725 - RNA, 32 nt, Human
agcggacugcagccgcgagcuccuggaggcgg

SEQ ID NO: 317726 - RNA, 32 nt, Human
agcggacuuauuuaccaagcauuggaggaaua

SEQ ID NO: 317727 - RNA, 22 nt, Human
agcggagagcugaccccagaga

SEQ ID NO: 317728 - RNA, 32 nt, Human
agcggagagggcuagcccugagcccggcgcuc

SEQ ID NO: 317729 - RNA, 19 nt, Human
agcggagcagggcgccgag

SEQ ID NO: 317730 - RNA, 32 nt, Human
agcggagccagcugagcccgagcccagcccgc

SEQ ID NO: 317731 - RNA, 32 nt, Human
agcggagcccaggagagcagagagcgagccug

SEQ ID NO: 317732 - RNA, 32 nt, Human
agcggagccggggagagcgaggaccccgcaca

SEQ ID NO: 317733 - RNA, 18 nt, Human
agcggagcgccugggcgg

SEQ ID NO: 317734 - RNA, 32 nt, Human
agcggaggaggacgcccaggaggaggcggcgg

SEQ ID NO: 317735 - RNA, 32 nt, Human
agcggaggaggaggaggaggcgaggaggagag

SEQ ID NO: 317736 - RNA, 32 nt, Human
agcggaggccgcacuccagcacugcgcaggga

SEQ ID NO: 317737 - RNA, 32 nt, Human
agcggaggcugcagcccgggccgcgauggggg

SEQ ID NO: 317738 - RNA, 32 nt, Human
agcggagggaggggccgcgccgcggagcgugc

SEQ ID NO: 317739 - RNA, 32 nt, Human
agcggagggcgaggaggagcagaggagcacac

SEQ ID NO: 317740 - RNA, 32 nt, Human
agcggagggcgggaagaaggaggaggccucua

SEQ ID NO: 317741 - RNA, 32 nt, Human
agcggagucacccucccgccguuacccgcggc

SEQ ID NO: 317742 - RNA, 32 nt, Human
agcggaguugcagaauccaaggacccauuuug

SEQ ID NO: 317743 - RNA, 32 nt, Human
agcggaguugggagccugauggaggacaagua

SEQ ID NO: 317744 - RNA, 32 nt, Human
agcggaguuuacucgggagagggcggagaaau

SEQ ID NO: 317745 - RNA, 32 nt, Human
agcggauagagcaggagagcaccaccggagcc

SEQ ID NO: 317746 - RNA, 32 nt, Human
agcggauagggaggucggguagaggcucccgg

SEQ ID NO: 317747 - RNA, 32 nt, Human
agcggaucccagcagguuaggccggaggaaca

SEQ ID NO: 317748 - RNA, 32 nt, Human
agcggaucccggggcugggauugcgcgcccgc

SEQ ID NO: 317749 - RNA, 32 nt, Human
agcggaugaacagcagguucuccuaggcuuug

SEQ ID NO: 317750 - RNA, 32 nt, Human
agcggaugugugugugcgugugcgcgcguggc

SEQ ID NO: 317751 - RNA, 32 nt, Human
agcggauguguuuugggggaaacagagagaaa

SEQ ID NO: 317752 - RNA, 32 nt, Human
agcggcaaccucuagccaggagcccaguggcc

SEQ ID NO: 317753 - RNA, 32 nt, Human
agcggcaccauggcuuuccucuggcuccucuc

SEQ ID NO: 317754 - RNA, 32 nt, Human
agcggcacugcacuccagccugggugacaaag

SEQ ID NO: 317755 - RNA, 32 nt, Human
agcggcagcagcggcgccgccucccagaguuc

SEQ ID NO: 317756 - RNA, 32 nt, Human
agcggcagccaucuugguuuuaggaaaugggg

SEQ ID NO: 317757 - RNA, 32 nt, Human
agcggcaggaauagcaggcaacgugauuucaa

SEQ ID NO: 317758 - RNA, 32 nt, Human
agcggcaggagaguccggccgcgacaggacga

SEQ ID NO: 317759 - RNA, 32 nt, Human
agcggcaguacgagcugcagcccuaccggccg

SEQ ID NO: 317760 - RNA, 32 nt, Human
agcggcauccaggcuucucucaccuccauuag

SEQ ID NO: 317761 - RNA, 32 nt, Human
agcggcauugcacuccagccugggcaacaaga

SEQ ID NO: 317762 - RNA, 32 nt, Human
agcggccacaacugucuagggcucagacacca

SEQ ID NO: 317763 - RNA, 31 nt, Human
agcggccacagcuagaaaacagucugcagug

SEQ ID NO: 317764 - RNA, 32 nt, Human
agcggccccaaaauucccaccuugauuuccau

SEQ ID NO: 317765 - RNA, 32 nt, Human
agcggccccagugcccuugaccaggaacaucu

SEQ ID NO: 317766 - RNA, 32 nt, Human
agcggccccgagaguccggggagggagguuua

SEQ ID NO: 317767 - RNA, 32 nt, Human
agcggcccggugaggcggggaggcggcggccg

SEQ ID NO: 317768 - RNA, 32 nt, Human
agcggcccuccagccggcgucgcucaggcugc

SEQ ID NO: 317769 - RNA, 32 nt, Human
agcggcccugcagggggccagccugggggaac

SEQ ID NO: 317770 - RNA, 18 nt, Human
agcggcccugcgcuguca

SEQ ID NO: 317771 - RNA, 32 nt, Human
agcggccggaccagcuggaggagacgcgcccg

SEQ ID NO: 317772 - RNA, 32 nt, Human
agcggccuacagcucccugcaggcugguggcc

SEQ ID NO: 317773 - RNA, 19 nt, Human
agcggccucagccccggca

SEQ ID NO: 317774 - RNA, 22 nt, Human
agcggccucagcgcuuccgcug

SEQ ID NO: 317775 - RNA, 31 nt, Human
agcggccuccagugugggccugguccagaca

SEQ ID NO: 317776 - RNA, 32 nt, Human
agcggccuccugaaggaggggaagggacgugg

SEQ ID NO: 317777 - RNA, 32 nt, Human
agcggccucugcaggaucugcagcuguggaag

SEQ ID NO: 317778 - RNA, 24 nt, Human
agcggccugaucuggguuccgcug

SEQ ID NO: 317779 - RNA, 32 nt, Human
agcggccugccugccucccugcgcacccgcag

SEQ ID NO: 317780 - RNA, 21 nt, Human
agcggcgacccagcacggcgg

SEQ ID NO: 317781 - RNA, 32 nt, Human
agcggcgaccggagcgguaggagcagcaauuu

SEQ ID NO: 317782 - RNA, 24 nt, Human
agcggcgcuggcgcggcccaggca

SEQ ID NO: 317783 - RNA, 32 nt, Human
agcggcggaggagcgaggcggggcgaggcagg

SEQ ID NO: 317784 - RNA, 18 nt, Human
agcggcggcacauggcgg

SEQ ID NO: 317785 - RNA, 20 nt, Human
agcggcggcagcagcaggcg

SEQ ID NO: 317786 - RNA, 20 nt, Human
agcggcggccagcagggcgg

SEQ ID NO: 317787 - RNA, 32 nt, Human
agcggcggcgaaggaggggaagaagagccgcg

SEQ ID NO: 317788 - RNA, 32 nt, Human
agcggcggcgggcgcuggaggcuuucaaaggu

SEQ ID NO: 317789 - RNA, 32 nt, Human
agcggcggcucaugccuguaaucccaggacuu

SEQ ID NO: 317790 - RNA, 32 nt, Human
agcggcggcugcggaaagcggagggaguccga

SEQ ID NO: 317791 - RNA, 32 nt, Human
agcggcggcuuuagcgucagugacuaggcagc

SEQ ID NO: 317792 - RNA, 32 nt, Human
agcggcgggagcggugcgggagagggguugga

SEQ ID NO: 317793 - RNA, 32 nt, Human
agcggcgggccgcagagguucaagcgauucuc

SEQ ID NO: 317794 - RNA, 32 nt, Human
agcggcgggcugaagggcuccucaagcguggc

SEQ ID NO: 317795 - RNA, 32 nt, Human
agcggcgggcugaagggcuccucaagugccgc

SEQ ID NO: 317796 - RNA, 32 nt, Human
agcggcggggucgcgggacaggagaagcggag

SEQ ID NO: 317797 - RNA, 32 nt, Human
agcggcggugggaggagugggggaccuggagg

SEQ ID NO: 317798 - RNA, 32 nt, Human
agcggcggugugagcgcggugggugcggaggg

SEQ ID NO: 317799 - RNA, 32 nt, Human
agcggcgugcguaaugucggcacuuugcuggg

SEQ ID NO: 317800 - RNA, 32 nt, Human
agcggcguugggguuuggcugcaguggcagug

SEQ ID NO: 317801 - RNA, 32 nt, Human
agcggcucagcagucccugggggaagccauug

SEQ ID NO: 317802 - RNA, 32 nt, Human
agcggcuccagaggaggcaggcgagugagcga

SEQ ID NO: 317803 - RNA, 32 nt, Human
agcggcuccaggccuccucugggcccagggcc

SEQ ID NO: 317804 - RNA, 32 nt, Human
agcggcucccgcaggacagggugcucggcguc

SEQ ID NO: 317805 - RNA, 32 nt, Human
agcggcuccuccccaucucacccccagcacac

SEQ ID NO: 317806 - RNA, 22 nt, Human
agcggcucucaacacacaccua

SEQ ID NO: 317807 - RNA, 32 nt, Human
agcggcucucacaccagcaucuugcuggauag

SEQ ID NO: 317808 - RNA, 32 nt, Human
agcggcucuguuuccuccuuccuuccuuggcc

SEQ ID NO: 317809 - RNA, 32 nt, Human
agcggcugaggcaggagaauugcuugaaccug

SEQ ID NO: 317810 - RNA, 32 nt, Human
agcggcugcagcguugguagcaucagcaucag

SEQ ID NO: 317811 - RNA, 32 nt, Human
agcggcugccgaucacgguccacccaccccag

SEQ ID NO: 317812 - RNA, 32 nt, Human
agcggcuggccagaggaugagacuccccaaac

SEQ ID NO: 317813 - RNA, 23 nt, Human
agcggcuggcggugccugggcca

SEQ ID NO: 317814 - RNA, 32 nt, Human
agcggcugggcccaggcuguggcaugauggcc

SEQ ID NO: 317815 - RNA, 32 nt, Human
agcggcuggucagggccaguucugcucccugg

SEQ ID NO: 317816 - RNA, 20 nt, Human
agcggcuguacacgggccgg

SEQ ID NO: 317817 - RNA, 32 nt, Human
agcggcuguaccugcugcggcaguggcgguca

SEQ ID NO: 317818 - RNA, 32 nt, Human
agcggcuguuccaggcuaacagcugugggagg

SEQ ID NO: 317819 - RNA, 32 nt, Human
agcggcuuccgcucgugguggaaggugaaggg

SEQ ID NO: 317820 - RNA, 32 nt, Human
agcggcuuuccaggacggugcgaugugcugcg

SEQ ID NO: 317821 - RNA, 32 nt, Human
agcgggaacacggggugucugcgcauguuucc

SEQ ID NO: 317822 - RNA, 32 nt, Human
agcgggaauggguggaggccgggggaauaaaa

SEQ ID NO: 317823 - RNA, 21 nt, Human
agcgggacaggaugucacaga

SEQ ID NO: 317824 - RNA, 32 nt, Human
agcgggacagggccacggagacaaacuaagga

SEQ ID NO: 317825 - RNA, 32 nt, Human
agcgggaccagagagacaggcugcuggguucc

SEQ ID NO: 317826 - RNA, 32 nt, Human
agcgggaccagguggaggcggcggcggcagag

SEQ ID NO: 317827 - RNA, 32 nt, Human
agcgggaccauuauuacuggugcaaaaugagu

SEQ ID NO: 317828 - RNA, 32 nt, Human
agcgggacccagucaaaccccauucaggucau

SEQ ID NO: 317829 - RNA, 22 nt, Human
agcgggaccccagcgcgggcgg

SEQ ID NO: 317830 - RNA, 32 nt, Human
agcgggaccggccucagcuccaacacagccuc

SEQ ID NO: 317831 - RNA, 32 nt, Human
agcgggaccgguaggggccggagcagcggcgg

SEQ ID NO: 317832 - RNA, 23 nt, Human
agcgggaccuagagggccuggaa

SEQ ID NO: 317833 - RNA, 32 nt, Human
agcgggacuucugcucaaauccuguccagggg

SEQ ID NO: 317834 - RNA, 32 nt, Human
agcgggagccggcggcgcaccaccaugaccca

SEQ ID NO: 317835 - RNA, 32 nt, Human
agcgggagcgcaagaugcgggagcagcagaag

SEQ ID NO: 317836 - RNA, 32 nt, Human
agcgggaggaggcacaucacauagcaagagug

SEQ ID NO: 317837 - RNA, 32 nt, Human
agcgggaggcagcagaggggaaguggucagcg

SEQ ID NO: 317838 - RNA, 32 nt, Human
agcgggaggccguccgggcagcgcggccggcg

SEQ ID NO: 317839 - RNA, 32 nt, Human
agcgggagucaggaccgccuguccucagaccc

SEQ ID NO: 317840 - RNA, 32 nt, Human
agcgggagucgaagcccagcccagggcagccc

SEQ ID NO: 317841 - RNA, 32 nt, Human
agcgggagugauguggaggucgcccugggagc

SEQ ID NO: 317842 - RNA, 17 nt, Human
agcgggaucaagaauuu

SEQ ID NO: 317843 - RNA, 32 nt, Human
agcgggaucacgggugcccaccagggaagggg

SEQ ID NO: 317844 - RNA, 32 nt, Human
agcgggauggagguggaugcagcaguaguccc

SEQ ID NO: 317845 - RNA, 32 nt, Human
agcgggcaaggauugcacguccugccugacca

SEQ ID NO: 317846 - RNA, 32 nt, Human
agcgggcaaugcuagcccuguucuccaauccc

SEQ ID NO: 317847 - RNA, 31 nt, Human
agcgggcacagcuagugcaaaggcccugaga

SEQ ID NO: 317848 - RNA, 32 nt, Human
agcgggcaccaggcuugggggcugaggcccag

SEQ ID NO: 317849 - RNA, 17 nt, Human
agcgggcagcagcaggc

SEQ ID NO: 317850 - RNA, 32 nt, Human
agcgggcagccucagugaaacucuuagguuaa

SEQ ID NO: 317851 - RNA, 32 nt, Human
agcgggcagugcagaaugggccagcagggcug

SEQ ID NO: 317852 - RNA, 32 nt, Human
agcgggcccagagggaccaugaccuugggcuc

SEQ ID NO: 317853 - RNA, 32 nt, Human
agcgggcccaggagccaggcucagguccagcu

SEQ ID NO: 317854 - RNA, 32 nt, Human
agcgggcccuggagcuugcagucggagggccu

SEQ ID NO: 317855 - RNA, 19 nt, Human
agcgggccggaggcggccg

SEQ ID NO: 317856 - RNA, 22 nt, Human
agcgggccggcagcaugugcgg

SEQ ID NO: 317857 - RNA, 32 nt, Human
agcgggccgugcugccccggcugccucgcucu

SEQ ID NO: 317858 - RNA, 32 nt, Human
agcgggccuagggaggaggagcgagaaucagc

SEQ ID NO: 317859 - RNA, 32 nt, Human
agcgggccugagagacaaggacauguggaucc

SEQ ID NO: 317860 - RNA, 32 nt, Human
agcgggccugccgccucuacggaccagucccu

SEQ ID NO: 317861 - RNA, 20 nt, Human
agcgggcgagagaacgcgag

SEQ ID NO: 317862 - RNA, 32 nt, Human
agcgggcgagccggagcgaggaagggaaagcg

SEQ ID NO: 317863 - RNA, 32 nt, Human
agcgggcggagcuggcccugccucugccuggc

SEQ ID NO: 317864 - RNA, 22 nt, Human
agcgggcggaucaccugagguc

SEQ ID NO: 317865 - RNA, 25 nt, Human
agcgggcggcaggagccggcgcgag

SEQ ID NO: 317866 - RNA, 32 nt, Human
agcgggcggcgccgcuggccggaguggcuucg

SEQ ID NO: 317867 - RNA, 32 nt, Human
agcgggcggguguggaagauauuccaucuggg

SEQ ID NO: 317868 - RNA, 32 nt, Human
agcgggcugagauuguuguccucugucaccag

SEQ ID NO: 317869 - RNA, 32 nt, Human
agcgggcuuguagguguccggcuuugcuggcc

SEQ ID NO: 317870 - RNA, 32 nt, Human
agcggggaaauguugagcucaaauggguaaau

SEQ ID NO: 317871 - RNA, 32 nt, Human
agcggggaagaggagagcagcuucaggccgug

SEQ ID NO: 317872 - RNA, 32 nt, Human
agcggggaauggcugagccagggguucgccgc

SEQ ID NO: 317873 - RNA, 32 nt, Human
agcggggacaguggggacagcagggacagcgg

SEQ ID NO: 317874 - RNA, 32 nt, Human
agcggggacccaccaacagaggccaguuucaa

SEQ ID NO: 317875 - RNA, 32 nt, Human
agcggggacucggcgacccugcccucccgacc

SEQ ID NO: 317876 - RNA, 32 nt, Human
agcggggagaggggucagggaggcuaaugguu

SEQ ID NO: 317877 - RNA, 32 nt, Human
agcggggagcccagccgccagagcaggcaccc

SEQ ID NO: 317878 - RNA, 32 nt, Human
agcggggagcccaggcggagcccagucgacuc

SEQ ID NO: 317879 - RNA, 32 nt, Human
agcggggagccuggggcugagauucugggcac

SEQ ID NO: 317880 - RNA, 32 nt, Human
agcggggagcugcuccccaggccacagcagac

SEQ ID NO: 317881 - RNA, 32 nt, Human
agcggggaggaggagaaggaugcagccgccga

SEQ ID NO: 317882 - RNA, 32 nt, Human
agcggggaggcggggcgcagggauccggaaac

SEQ ID NO: 317883 - RNA, 32 nt, Human
agcggggaggggcagaggaguuccccggaacc

SEQ ID NO: 317884 - RNA, 32 nt, Human
agcggggagguggaggaagcugugcggugcag

SEQ ID NO: 317885 - RNA, 32 nt, Human
agcggggaucacaggcaugagccgccacaccc

SEQ ID NO: 317886 - RNA, 32 nt, Human
agcggggauuacaggcacgcgcugccacgccc

SEQ ID NO: 317887 - RNA, 32 nt, Human
agcggggauuacaggcgcacaccaccacaucc

SEQ ID NO: 317888 - RNA, 32 nt, Human
agcggggauuacuggugcgugccaccacaccc

SEQ ID NO: 317889 - RNA, 32 nt, Human
agcggggcaagccgcggagggggugggggagg

SEQ ID NO: 317890 - RNA, 32 nt, Human
agcggggcaggacaaucaucucaguccugcau

SEQ ID NO: 317891 - RNA, 32 nt, Human
agcggggcaggcagggcuguggcagacaggcc

SEQ ID NO: 317892 - RNA, 32 nt, Human
agcggggccaugccauggcagauaaagcucag

SEQ ID NO: 317893 - RNA, 32 nt, Human
agcggggccgggaguggagcagccgccgcggc

SEQ ID NO: 317894 - RNA, 32 nt, Human
agcggggccucggggagcaggugcaggacagg

SEQ ID NO: 317895 - RNA, 32 nt, Human
agcggggcgaacugaggcgagugaaguggacu

SEQ ID NO: 317896 - RNA, 32 nt, Human
agcggggcugagcuuguccugccuucguauug

SEQ ID NO: 317897 - RNA, 32 nt, Human
agcgggggaggaagagaagggagguagcuggc

SEQ ID NO: 317898 - RNA, 32 nt, Human
agcgggggagugaacaagugugcagauguaag

SEQ ID NO: 317899 - RNA, 32 nt, Human
agcgggggcagaggccaagugggcaccggaua

SEQ ID NO: 317900 - RNA, 31 nt, Human
agcggggucgccucugggccucugucugagc

SEQ ID NO: 317901 - RNA, 32 nt, Human
agcggggucugugggagcuagcuuugucagug

SEQ ID NO: 317902 - RNA, 32 nt, Human
agcggggugcaggacuggcuagaggugggugu

SEQ ID NO: 317903 - RNA, 32 nt, Human
agcggggugggauaaacggagcuggacgacuc

SEQ ID NO: 317904 - RNA, 32 nt, Human
agcggggugguggcucaugccuguaaucccag

SEQ ID NO: 317905 - RNA, 32 nt, Human
agcgggguuagaugcagggaguuauguuguga

SEQ ID NO: 317906 - RNA, 32 nt, Human
agcgggguugcgcgggagacuauggcguccuc

SEQ ID NO: 317907 - RNA, 32 nt, Human
agcgggguugggggugguagggauagggcaug

SEQ ID NO: 317908 - RNA, 32 nt, Human
agcgggguuugugguuggcugagguggaggaa

SEQ ID NO: 317909 - RNA, 32 nt, Human
agcggguaacccugccuuguucugucauccag

SEQ ID NO: 317910 - RNA, 23 nt, Human
agcggguagaucacuugagguca

SEQ ID NO: 317911 - RNA, 32 nt, Human
agcgggucucggguugcggguugcagguugca

SEQ ID NO: 317912 - RNA, 32 nt, Human
agcgggugaagcaccugauugccuaaaccacu

SEQ ID NO: 317913 - RNA, 32 nt, Human
agcgggugccuguaaucccaguuacucaggag

SEQ ID NO: 317914 - RNA, 23 nt, Human
agcggguggaucacccgagguca

SEQ ID NO: 317915 - RNA, 23 nt, Human
agcggguggaucaccugagguca

SEQ ID NO: 317916 - RNA, 32 nt, Human
agcggguggcucuuccccaccuugccagcagg

SEQ ID NO: 317917 - RNA, 31 nt, Human
agcgggugggugggugugaagggaugagaau

SEQ ID NO: 317918 - RNA, 32 nt, Human
agcgggugugggugaccaugcccagaaggcca

SEQ ID NO: 317919 - RNA, 32 nt, Human
agcggguuuggcucauuugaaaaugagggucc

SEQ ID NO: 317920 - RNA, 32 nt, Human
agcgguaagaacagugaacacagugguuggga

SEQ ID NO: 317921 - RNA, 20 nt, Human
agcgguagcagcccgggcgg

SEQ ID NO: 317922 - RNA, 32 nt, Human
agcgguccaucucagcgucucccuucaggaac

SEQ ID NO: 317923 - RNA, 32 nt, Human
agcggucccagagccacccugugguccugaua

SEQ ID NO: 317924 - RNA, 32 nt, Human
agcggugaaucggggcccucaccaugaguucc

SEQ ID NO: 317925 - RNA, 32 nt, Human
agcggugacacaccugcaggugucaggcaugg

SEQ ID NO: 317926 - RNA, 32 nt, Human
agcggugagggguggagggaugucgcggagag

SEQ ID NO: 317927 - RNA, 32 nt, Human
agcggugauuugaggggcaaggugcuuagaga

SEQ ID NO: 317928 - RNA, 32 nt, Human
agcggugccaagcagaggggcggcagagacgg

SEQ ID NO: 317929 - RNA, 32 nt, Human
agcggugccacccaaucaugcccagcuucugu

SEQ ID NO: 317930 - RNA, 32 nt, Human
agcgguggaucacgccuguaaucccagcgcuu

SEQ ID NO: 317931 - RNA, 32 nt, Human
agcgguggcaggggcugcaggagcaagugacc

SEQ ID NO: 317932 - RNA, 32 nt, Human
agcgguggcccaccucuuccucccacuacagc

SEQ ID NO: 317933 - RNA, 32 nt, Human
agcgguggcgacaugagcagcggggcggcguc

SEQ ID NO: 317934 - RNA, 32 nt, Human
agcgguggcgaggagaggcgggcggauuuggg

SEQ ID NO: 317935 - RNA, 32 nt, Human
agcgguggcucacaccuguaaucccaacacuu

SEQ ID NO: 317936 - RNA, 32 nt, Human
agcgguggcucacaccuguaaucccagcacuu

SEQ ID NO: 317937 - RNA, 32 nt, Human
agcgguggcucacacuuguaaucccagcacuu

SEQ ID NO: 317938 - RNA, 32 nt, Human
agcgguggcucacgccuguaauccuagcaccu

SEQ ID NO: 317939 - RNA, 32 nt, Human
agcgguggcucaugccuguaaucccagcacuu

SEQ ID NO: 317940 - RNA, 32 nt, Human
agcgguggcucaugccuguaaucccagcccuu

SEQ ID NO: 317941 - RNA, 32 nt, Human
agcggugggcggcaugucuguggccggugggg

SEQ ID NO: 317942 - RNA, 32 nt, Human
agcggugggcugaagggcuccucaagugcccc

SEQ ID NO: 317943 - RNA, 32 nt, Human
agcgguggggaggcggggaggagcagcuggga

SEQ ID NO: 317944 - RNA, 32 nt, Human
agcgguggggcagaggcugcggagccccagga

SEQ ID NO: 317945 - RNA, 32 nt, Human
agcgguggucagacauggaaaugguggggaga

SEQ ID NO: 317946 - RNA, 32 nt, Human
agcgguggucagacguggaaaugguggggaga

SEQ ID NO: 317947 - RNA, 32 nt, Human
agcggugguccccaggacagccagcagguccc

SEQ ID NO: 317948 - RNA, 32 nt, Human
agcgguggugguuccgcgaugguaggcggcgg

SEQ ID NO: 317949 - RNA, 32 nt, Human
agcggugguucaugccuauaaucccaacacuu

SEQ ID NO: 317950 - RNA, 32 nt, Human
agcggugugcagccaccauguucagcuggcug

SEQ ID NO: 317951 - RNA, 32 nt, Human
agcgguucagcccuggcuggggcugcaggggc

SEQ ID NO: 317952 - RNA, 32 nt, Human
agcgguuccagugcccucaaagcaaucugucu

SEQ ID NO: 317953 - RNA, 32 nt, Human
agcgguucuggcugccagccugggcagccugg

SEQ ID NO: 317954 - RNA, 32 nt, Human
agcgguugggccugagccccagggacaaaaga

SEQ ID NO: 317955 - RNA, 32 nt, Human
agcgguuugggcuuggacugaaugacgccacc

SEQ ID NO: 317956 - RNA, 32 nt, Human
agcgguuuguguagaaauuggagagaacuaug

SEQ ID NO: 317957 - RNA, 32 nt, Human
agcguaaguaugcacagaugaagauggaacua

SEQ ID NO: 317958 - RNA, 32 nt, Human
agcguacacuugguuucuuucuuaucugccag

SEQ ID NO: 317959 - RNA, 32 nt, Human
agcguacauagggaagggaggaagggaaaaca

SEQ ID NO: 317960 - RNA, 32 nt, Human
agcguagcagagaagcagagaagcugucagca

SEQ ID NO: 317961 - RNA, 32 nt, Human
agcguagccauucgagagcagccugggcaacg

SEQ ID NO: 317962 - RNA, 32 nt, Human
agcguaggagaaaggccacuggaaaccagagu

SEQ ID NO: 317963 - RNA, 32 nt, Human
agcguaggccuuuuccugucugccuuucuucu

SEQ ID NO: 317964 - RNA, 32 nt, Human
agcguagguuaggagguuuccgggaggcugcu

SEQ ID NO: 317965 - RNA, 19 nt, Human
agcgucaccguggccgugg

SEQ ID NO: 317966 - RNA, 32 nt, Human
agcgucagacuccauuauguacugacugugug

SEQ ID NO: 317967 - RNA, 32 nt, Human
agcgucagcuaggccaauaggaacagaccggg

SEQ ID NO: 317968 - RNA, 32 nt, Human
agcgucaggcugggacacgccaacgcuguucc

SEQ ID NO: 317969 - RNA, 32 nt, Human
agcgucaggcugggggcagucugguacggaac

SEQ ID NO: 317970 - RNA, 32 nt, Human
agcgucaggguccgagagguuaggggucggca

SEQ ID NO: 317971 - RNA, 32 nt, Human
agcgucagguccaccccggaaucccagggacu

SEQ ID NO: 317972 - RNA, 32 nt, Human
agcgucaguagagacagagaacaaggggugaa

SEQ ID NO: 317973 - RNA, 32 nt, Human
agcgucauuuugacaugucauuuccuaucucc

SEQ ID NO: 317974 - RNA, 32 nt, Human
agcguccagcacuccggcgagucuguggagcc

SEQ ID NO: 317975 - RNA, 32 nt, Human
agcguccaguggagaagaaggaagcgaggccc

SEQ ID NO: 317976 - RNA, 32 nt, Human
agcguccauccaucuguccggcuggcggucca

SEQ ID NO: 317977 - RNA, 32 nt, Human
agcguccauggagcaaaaggaaugccaggauc

SEQ ID NO: 317978 - RNA, 32 nt, Human
agcgucccaaagugcugggauuauaggcguga

SEQ ID NO: 317979 - RNA, 32 nt, Human
agcgucccaaguagcuggaauuacagccaugc

SEQ ID NO: 317980 - RNA, 32 nt, Human
agcgucccagagugcugggauuacaguuguga

SEQ ID NO: 317981 - RNA, 20 nt, Human
agcguccccucccuccuccc

SEQ ID NO: 317982 - RNA, 32 nt, Human
agcguccccugcggaagccuggccugcugggg

SEQ ID NO: 317983 - RNA, 32 nt, Human
agcgucccgaagugcugggauuacagguguga

SEQ ID NO: 317984 - RNA, 32 nt, Human
agcgucccgaggagcugggauuacaggcaccc

SEQ ID NO: 317985 - RNA, 32 nt, Human
agcgucccgaguaacugggauuacaggcaccc

SEQ ID NO: 317986 - RNA, 32 nt, Human
agcgucccgaguaguuggcacuacaggugccc

SEQ ID NO: 317987 - RNA, 32 nt, Human
agcgucccgcguagcuggcauacaggugcaag

SEQ ID NO: 317988 - RNA, 32 nt, Human
agcgucccgugcuaaagaaacagagccucacu

SEQ ID NO: 317989 - RNA, 22 nt, Human
agcguccgggcagcguaggcgg

SEQ ID NO: 317990 - RNA, 32 nt, Human
agcguccugaguagcugggaccacaggugccc

SEQ ID NO: 317991 - RNA, 32 nt, Human
agcguccugaguagcugggacuacaggcgcgc

SEQ ID NO: 317992 - RNA, 32 nt, Human
agcguccugaguagcuggggauuacaggcgcc

SEQ ID NO: 317993 - RNA, 32 nt, Human
agcguccugcaaccccagcccucaccaggauu

SEQ ID NO: 317994 - RNA, 32 nt, Human
agcgucgacuccugccggaauuuccagccugc

SEQ ID NO: 317995 - RNA, 18 nt, Human
agcgucggacauggaugg

SEQ ID NO: 317996 - RNA, 17 nt, Human
agcgucgggcacagggc

SEQ ID NO: 317997 - RNA, 32 nt, Human
agcgucgggccuggcccgagcugucucugugg

SEQ ID NO: 317998 - RNA, 32 nt, Human
agcgucggucucggagccccuuguggcagcag

SEQ ID NO: 317999 - RNA, 20 nt, Human
agcgucgugccagcaugggc

SEQ ID NO: 318000 - RNA, 32 nt, Human
agcgucuacaggcccaaccucugccucauggg

SEQ ID NO: 318001 - RNA, 32 nt, Human
agcgucuccaucuaaaauuccuagggcaagcu

SEQ ID NO: 318002 - RNA, 32 nt, Human
agcgucuccaucuaaucccaggggaacacagg

SEQ ID NO: 318003 - RNA, 32 nt, Human
agcgucuccugccuccuacccaacugagugcc

SEQ ID NO: 318004 - RNA, 32 nt, Human
agcgucucucugcugugccuccuccuggcggc

SEQ ID NO: 318005 - RNA, 32 nt, Human
agcgucucugccuggcagaggcugcaaucucu

SEQ ID NO: 318006 - RNA, 32 nt, Human
agcgucugcucucucggccucugccuccgcuu

SEQ ID NO: 318007 - RNA, 32 nt, Human
agcgucuggcagauacuccuuuugccacugcu

SEQ ID NO: 318008 - RNA, 32 nt, Human
agcgucugggugagaaaaacaggcugugaucc

SEQ ID NO: 318009 - RNA, 32 nt, Human
agcgucuguaucucuggagcagccaggcgcuc

SEQ ID NO: 318010 - RNA, 32 nt, Human
agcgucuuucaaguaagccucgcugaagaggg

SEQ ID NO: 318011 - RNA, 32 nt, Human
agcgugaaagaagcuugugauccugcccccac

SEQ ID NO: 318012 - RNA, 32 nt, Human
agcgugaaccugggaggcagagcuugcaguga

SEQ ID NO: 318013 - RNA, 32 nt, Human
agcgugaccgcugaagcacagcaccacaggaa

SEQ ID NO: 318014 - RNA, 32 nt, Human
agcgugacugcgugcauuuucucuccuuuccc

SEQ ID NO: 318015 - RNA, 32 nt, Human
agcgugagccacugcacccagccuguaaaaua

SEQ ID NO: 318016 - RNA, 30 nt, Human
agcgugagccucucugacugcuucuucccc

SEQ ID NO: 318017 - RNA, 32 nt, Human
agcgugaggaaagacucuccacccucacuccc

SEQ ID NO: 318018 - RNA, 32 nt, Human
agcgugcagcccccgucccaguacgacauacc

SEQ ID NO: 318019 - RNA, 32 nt, Human
agcgugcagggauagagagggagccagacgga

SEQ ID NO: 318020 - RNA, 32 nt, Human
agcgugccaagugaccuggugccugugggaag

SEQ ID NO: 318021 - RNA, 32 nt, Human
agcgugcccagcugcccuguuggcagaggccu

SEQ ID NO: 318022 - RNA, 32 nt, Human
agcgugccccuuagagcuccugugcugcuggg

SEQ ID NO: 318023 - RNA, 32 nt, Human
agcgugcccuguacucuucacucacauaagcc

SEQ ID NO: 318024 - RNA, 32 nt, Human
agcgugcccuuccucaccuccuggagcacccu

SEQ ID NO: 318025 - RNA, 24 nt, Human
agcgugcgcagugaacgugcgcuc

SEQ ID NO: 318026 - RNA, 32 nt, Human
agcgugcggagagaugucaccaucccggacua

SEQ ID NO: 318027 - RNA, 32 nt, Human
agcgugcguccguucgcacaggcagcgggagg

SEQ ID NO: 318028 - RNA, 20 nt, Human
agcguggacaccuucagggg

SEQ ID NO: 318029 - RNA, 32 nt, Human
agcguggagacggaugggaauucugcagccac

SEQ ID NO: 318030 - RNA, 32 nt, Human
agcguggaggcugcaccaggagaggacaggga

SEQ ID NO: 318031 - RNA, 32 nt, Human
agcguggaggggcgaggggauggggccaggga

SEQ ID NO: 318032 - RNA, 21 nt, Human
agcguggccaacaugaggaaa

SEQ ID NO: 318033 - RNA, 21 nt, Human
agcguggccaacaugaugaaa

SEQ ID NO: 318034 - RNA, 32 nt, Human
agcguggccagccugccaaacugaccagggga

SEQ ID NO: 318035 - RNA, 24 nt, Human
agcguggcccuccagcccagcuca

SEQ ID NO: 318036 - RNA, 17 nt, Human
agcguggcgaugggcgg

SEQ ID NO: 318037 - RNA, 32 nt, Human
agcguggcgcccgucgggagguugcagaguuc

SEQ ID NO: 318038 - RNA, 21 nt, Human
agcguggcuaacacggugaaa

SEQ ID NO: 318039 - RNA, 31 nt, Human
agcguggcuuggacggggccugugucagagu

SEQ ID NO: 318040 - RNA, 32 nt, Human
agcguggcuuuugaggaagaugugacaacuac

SEQ ID NO: 318041 - RNA, 32 nt, Human
agcgugggaaggcagcuggcagggacaggagc

SEQ ID NO: 318042 - RNA, 32 nt, Human
agcgugggacggcuccagcucaggacugucug

SEQ ID NO: 318043 - RNA, 32 nt, Human
agcgugggaggaggggauggaaaugagguugg

SEQ ID NO: 318044 - RNA, 22 nt, Human
agcgugggcaucuucaggcaca

SEQ ID NO: 318045 - RNA, 32 nt, Human
agcgugggcucugccaaugugggcugccccuc

SEQ ID NO: 318046 - RNA, 32 nt, Human
agcguggggaggggguaagggagccagccaac

SEQ ID NO: 318047 - RNA, 31 nt, Human
agcguggggccgcuggaaugggugaauuuaa

SEQ ID NO: 318048 - RNA, 32 nt, Human
agcguggggcuuggguaaaaauggcugaauau

SEQ ID NO: 318049 - RNA, 32 nt, Human
agcgugggguggggacacugacagcccuaucu

SEQ ID NO: 318050 - RNA, 32 nt, Human
agcgugggugaggcauacguacucacacgccg

SEQ ID NO: 318051 - RNA, 32 nt, Human
agcguggucuugaacgccugaccucagaugau

SEQ ID NO: 318052 - RNA, 32 nt, Human
agcguggugaagccucaucucugcugagaaug

SEQ ID NO: 318053 - RNA, 32 nt, Human
agcgugguggcagccagcucucuggccaccau

SEQ ID NO: 318054 - RNA, 32 nt, Human
agcgugguggguggguggugugaguggcaucu

SEQ ID NO: 318055 - RNA, 32 nt, Human
agcguggugguacaccuguagucucagcuacu

SEQ ID NO: 318056 - RNA, 32 nt, Human
agcguguacugaaugccagucuggccggcaca

SEQ ID NO: 318057 - RNA, 32 nt, Human
agcgugucaaccuuuaccacugaggcuggaaa

SEQ ID NO: 318058 - RNA, 32 nt, Human
agcgugucuccaucccccucucuaggggcucu

SEQ ID NO: 318059 - RNA, 32 nt, Human
agcgugucuggcaggggcagcugcugugggca

SEQ ID NO: 318060 - RNA, 32 nt, Human
agcgugucuggguuugggggcgggagacaggc

SEQ ID NO: 318061 - RNA, 32 nt, Human
agcgugugaggguuggcacuaggcccacggcu

SEQ ID NO: 318062 - RNA, 29 nt, Human
agcgugugucugugugugcgugcgcggcc

SEQ ID NO: 318063 - RNA, 32 nt, Human
agcgugugugcgugcgucuacuuuguacuggg

SEQ ID NO: 318064 - RNA, 20 nt, Human
agcguguucugccaggucca

SEQ ID NO: 318065 - RNA, 32 nt, Human
agcguuaaguggaggaaagcuuggggaagccc

SEQ ID NO: 318066 - RNA, 32 nt, Human
agcguuaggagaagaagagaggcagggaagac

SEQ ID NO: 318067 - RNA, 32 nt, Human
agcguuagucccucacccccaaagaggugcgg

SEQ ID NO: 318068 - RNA, 32 nt, Human
agcguucagcacacuccugggcauggcggaag

SEQ ID NO: 318069 - RNA, 32 nt, Human
agcguucccacagggaaagugaaaguugcaag

SEQ ID NO: 318070 - RNA, 32 nt, Human
agcguucccagauuccuucuccuuagccaagc

SEQ ID NO: 318071 - RNA, 32 nt, Human
agcguuccccaggcugcucaggagaacguuug

SEQ ID NO: 318072 - RNA, 32 nt, Human
agcguucccugcuggacaaggucugcgcccac

SEQ ID NO: 318073 - RNA, 32 nt, Human
agcguuccuggccucugcagccaacacaguag

SEQ ID NO: 318074 - RNA, 32 nt, Human
agcguucugaguagcugggauuagaggcgugu

SEQ ID NO: 318075 - RNA, 32 nt, Human
agcguucuguucugcggaaggucuuccacucu

SEQ ID NO: 318076 - RNA, 32 nt, Human
agcguugagauuacaagcgugagccaccauuc

SEQ ID NO: 318077 - RNA, 32 nt, Human
agcguugcaacauagcccccuccaucauccuu

SEQ ID NO: 318078 - RNA, 32 nt, Human
agcguugcagcucucccagcagcccuggacag

SEQ ID NO: 318079 - RNA, 32 nt, Human
agcguugcagcucucccagcagcccuggacgg

SEQ ID NO: 318080 - RNA, 32 nt, Human
agcguuggaggcagaauucaaaaccaggcuga

SEQ ID NO: 318081 - RNA, 32 nt, Human
agcguugggauuacaggcaugagccaccucaa

SEQ ID NO: 318082 - RNA, 32 nt, Human
agcguugggauuauaggcaugagccaugugcc

SEQ ID NO: 318083 - RNA, 32 nt, Human
agcguuggugcugccuggguaucagaaagcaa

SEQ ID NO: 318084 - RNA, 32 nt, Human
agcguugugacaccuucuuuagggcucugugg

SEQ ID NO: 318085 - RNA, 32 nt, Human
agcguuuacaucauugcacuauuugauccagg

SEQ ID NO: 318086 - RNA, 32 nt, Human
agcguuuccugcacacuuuaccucucaugugc

SEQ ID NO: 318087 - RNA, 22 nt, Human
agcguuugcaccuguucacuca

SEQ ID NO: 318088 - RNA, 32 nt, Human
  misc_feature (4)..(4): n is a, c, g or u
agcngcgcacagaaugggccgaugcugcuucu

SEQ ID NO: 318089 - RNA, 31 nt, Human
agcuaaaagagaccugucucauggucugccc

SEQ ID NO: 318090 - RNA, 32 nt, Human
agcuaaaauauccucuggacaaagaagaaggg

SEQ ID NO: 318091 - RNA, 32 nt, Human
agcuaaaaucaagucaccacacuccagccugg

SEQ ID NO: 318092 - RNA, 32 nt, Human
agcuaaacacagaagaauguauaaauauguau

SEQ ID NO: 318093 - RNA, 32 nt, Human
agcuaaacaugcugccaaccagcuuguccaac

SEQ ID NO: 318094 - RNA, 32 nt, Human
agcuaaacucagcggagccagcgcggcgcgau

SEQ ID NO: 318095 - RNA, 32 nt, Human
agcuaaagaaagauggauacuaugaugcugaa

SEQ ID NO: 318096 - RNA, 32 nt, Human
agcuaaagaggcggagcaggaggcagaggagc

SEQ ID NO: 318097 - RNA, 32 nt, Human
agcuaaagaugguggugaugaacagccugagg

SEQ ID NO: 318098 - RNA, 32 nt, Human
agcuaaaggagaaagaaaaauaccuccuuuua

SEQ ID NO: 318099 - RNA, 32 nt, Human
agcuaaaggaggcugagguugcagugagcuga

SEQ ID NO: 318100 - RNA, 32 nt, Human
agcuaaaggccggcgcacgcugggcgguggug

SEQ ID NO: 318101 - RNA, 32 nt, Human
agcuaaagggagaagagaugggggcuugaaca

SEQ ID NO: 318102 - RNA, 32 nt, Human
agcuaaauacagagguagaagaagugggaaaa

SEQ ID NO: 318103 - RNA, 22 nt, Human
agcuaaaucuguuucuuuggga

SEQ ID NO: 318104 - RNA, 31 nt, Human
agcuaaauguugaaauggcuucccuuucuuu

SEQ ID NO: 318105 - RNA, 21 nt, Human
agcuaaauucaaagcugaaag

SEQ ID NO: 318106 - RNA, 32 nt, Human
agcuaaauugccuuuuaaauuccuucaagcuu

SEQ ID NO: 318107 - RNA, 32 nt, Human
agcuaacaagggcugagccccagguacagguu

SEQ ID NO: 318108 - RNA, 32 nt, Human
agcuaacaaggugacccacacacucaccauga

SEQ ID NO: 318109 - RNA, 32 nt, Human
agcuaacaaguguuguaacaauaauccauugu

SEQ ID NO: 318110 - RNA, 32 nt, Human
agcuaacaccacggcacuucagccugggugac

SEQ ID NO: 318111 - RNA, 32 nt, Human
agcuaacacgccucucugagccugucagcaga

SEQ ID NO: 318112 - RNA, 21 nt, Human
agcuaacagcucaaucucuua

SEQ ID NO: 318113 - RNA, 32 nt, Human
agcuaacauggcaaaaccccauugcuacuaaa

SEQ ID NO: 318114 - RNA, 32 nt, Human
agcuaacauucccuggacagggcacagcaagg

SEQ ID NO: 318115 - RNA, 32 nt, Human
agcuaaccaaguagcugggacuacaggugcau

SEQ ID NO: 318116 - RNA, 32 nt, Human
agcuaaccccucuacuccacuuucaaaacuac

SEQ ID NO: 318117 - RNA, 32 nt, Human
agcuaacccggaggaaaggcaguccuggacag

SEQ ID NO: 318118 - RNA, 32 nt, Human
agcuaacccguggcuaggcgaguggggcgggg

SEQ ID NO: 318119 - RNA, 32 nt, Human
agcuaacccuagauauggcagcucuuuaaugu

SEQ ID NO: 318120 - RNA, 21 nt, Human
agcuaaccuccacagaugcug

SEQ ID NO: 318121 - RNA, 32 nt, Human
agcuaaccuuugggauacaucacagaggauac

SEQ ID NO: 318122 - RNA, 32 nt, Human
agcuaacgcuaacuucccaggugacaguagca

SEQ ID NO: 318123 - RNA, 32 nt, Human
agcuaacgcugguaauaaagguaggaaaacaa

SEQ ID NO: 318124 - RNA, 32 nt, Human
agcuaacucgcggccuuauuucugccuuuaau

SEQ ID NO: 318125 - RNA, 21 nt, Human
agcuaacugcagcagcuggac

SEQ ID NO: 318126 - RNA, 32 nt, Human
agcuaacuuccuccuuucauccuuuccaauuu

SEQ ID NO: 318127 - RNA, 32 nt, Human
agcuaacuuucuucuugucuagcuauuaacau

SEQ ID NO: 318128 - RNA, 32 nt, Human
agcuaagaccacaggugugugccaccacaccu

SEQ ID NO: 318129 - RNA, 32 nt, Human
agcuaagacuacagacaugugccaccaugccu

SEQ ID NO: 318130 - RNA, 32 nt, Human
agcuaagacuacaggugcacaccaccacaccu

SEQ ID NO: 318131 - RNA, 32 nt, Human
agcuaagagauggcuccagacaccccaggucc

SEQ ID NO: 318132 - RNA, 32 nt, Human
agcuaagagucacuaaacuuucuugaaaaggu

SEQ ID NO: 318133 - RNA, 32 nt, Human
agcuaagauagagucccugccccacugccacc

SEQ ID NO: 318134 - RNA, 32 nt, Human
agcuaagauucagacccagggcucaggcucug

SEQ ID NO: 318135 - RNA, 32 nt, Human
agcuaagcagcugcugggacucagggacuggu

SEQ ID NO: 318136 - RNA, 32 nt, Human
agcuaagcauccuucuaaccaguucccaaagu

SEQ ID NO: 318137 - RNA, 32 nt, Human
agcuaagccaucauaucuccugugaccugcac

SEQ ID NO: 318138 - RNA, 32 nt, Human
agcuaagccccuggucacucugcagucucuau

SEQ ID NO: 318139 - RNA, 32 nt, Human
agcuaagcuacaccuggauuccugacccacag

SEQ ID NO: 318140 - RNA, 32 nt, Human
agcuaagcuacugcuguucuucuuuaucauuu

SEQ ID NO: 318141 - RNA, 32 nt, Human
agcuaagcuuccacuuauaagugagaacaugc

SEQ ID NO: 318142 - RNA, 32 nt, Human
agcuaaggaaaccaggugugggcggcugggcc

SEQ ID NO: 318143 - RNA, 32 nt, Human
agcuaaggacaggauggcaggagcgcccaugg

SEQ ID NO: 318144 - RNA, 32 nt, Human
agcuaagggaagagaguagaccgggacagagg

SEQ ID NO: 318145 - RNA, 32 nt, Human
agcuaagggaggaggaggccaggagggaggca

SEQ ID NO: 318146 - RNA, 32 nt, Human
agcuaaggucauuccuccuggguuuuaguggc

SEQ ID NO: 318147 - RNA, 32 nt, Human
agcuaaguaaccugaccauggcccaacagcaa

SEQ ID NO: 318148 - RNA, 32 nt, Human
agcuaaguauccagccucucccaaaccucuuu

SEQ ID NO: 318149 - RNA, 32 nt, Human
agcuaagucucgcucaccacugcaagcuaaga

SEQ ID NO: 318150 - RNA, 32 nt, Human
agcuaauagagugguaugacauggcacuaaaa

SEQ ID NO: 318151 - RNA, 32 nt, Human
agcuaauauuagcugcuauugcaugcuccuag

SEQ ID NO: 318152 - RNA, 32 nt, Human
agcuaaucaggaagcugagacaggaggaucgc

SEQ ID NO: 318153 - RNA, 28 nt, Human
agcuaaucaucuucaaagaagcugaaag

SEQ ID NO: 318154 - RNA, 19 nt, Human
agcuaauccccuucuguua

SEQ ID NO: 318155 - RNA, 32 nt, Human
agcuaaucuucuuccccucccuuuccucuccc

SEQ ID NO: 318156 - RNA, 32 nt, Human
agcuaaugcuccagaaacuuugccaaccuguu

SEQ ID NO: 318157 - RNA, 23 nt, Human
agcuaauggauuguuaauucuga

SEQ ID NO: 318158 - RNA, 32 nt, Human
agcuaauuaagguuugcccugccugcagccuc

SEQ ID NO: 318159 - RNA, 23 nt, Human
agcuaauuccaaagcccagcaga

SEQ ID NO: 318160 - RNA, 32 nt, Human
agcuaauugcuccccuuucagccucuguugca

SEQ ID NO: 318161 - RNA, 32 nt, Human
agcuacaacgaggagaaagaugaggaccacug

SEQ ID NO: 318162 - RNA, 32 nt, Human
agcuacaacuggagaggaagugggcagagccc

SEQ ID NO: 318163 - RNA, 32 nt, Human
agcuacaagcacgcacugaagcacuuuacuga

SEQ ID NO: 318164 - RNA, 32 nt, Human
agcuacaagguagggaguucugagggaagccg

SEQ ID NO: 318165 - RNA, 32 nt, Human
agcuacaagucuaucuucuuucuugacccauu

SEQ ID NO: 318166 - RNA, 32 nt, Human
agcuacacagaagagaugggagaagaggcuaa

SEQ ID NO: 318167 - RNA, 32 nt, Human
agcuacacagcaucuguuacgguuaaugagag

SEQ ID NO: 318168 - RNA, 32 nt, Human
agcuacacuacugcuaaacuauuuuuagcaua

SEQ ID NO: 318169 - RNA, 32 nt, Human
agcuacagaucguccuacucaccagcugggug

SEQ ID NO: 318170 - RNA, 32 nt, Human
agcuacagccgcggaacaaccacgccugggcc

SEQ ID NO: 318171 - RNA, 32 nt, Human
agcuacagcuccugcccaucugucccaacaca

SEQ ID NO: 318172 - RNA, 32 nt, Human
agcuacaguagggccuccucaccccguacccc

SEQ ID NO: 318173 - RNA, 32 nt, Human
agcuacagucggcugcaggugcagugacuuuu

SEQ ID NO: 318174 - RNA, 32 nt, Human
agcuacagucucuucaccuggagcuuagacac

SEQ ID NO: 318175 - RNA, 32 nt, Human
agcuacauacaaaucacauauaguuuaaucuu

SEQ ID NO: 318176 - RNA, 32 nt, Human
agcuacaucaagaacucagcugugcugugccu

SEQ ID NO: 318177 - RNA, 21 nt, Human
agcuacauccuacugcuuuga

SEQ ID NO: 318178 - RNA, 32 nt, Human
agcuacauggaaaaggagaaucccaccuccuu

SEQ ID NO: 318179 - RNA, 32 nt, Human
agcuacauuagcaacaggaaauucagcacauc

SEQ ID NO: 318180 - RNA, 32 nt, Human
agcuaccaaaacugaacugugaagggaaagcu

SEQ ID NO: 318181 - RNA, 32 nt, Human
agcuaccacaugcaaacauacaagcagucuca

SEQ ID NO: 318182 - RNA, 32 nt, Human
agcuaccacuuuugcucgccugugccaacaag

SEQ ID NO: 318183 - RNA, 32 nt, Human
agcuaccagacugcacuauaagaaaaguccuc

SEQ ID NO: 318184 - RNA, 32 nt, Human
agcuaccagauggguccagcugccgcaggcuc

SEQ ID NO: 318185 - RNA, 32 nt, Human
agcuaccagccaauugcucuucaucacagcua

SEQ ID NO: 318186 - RNA, 32 nt, Human
agcuaccaggaucucacugggucucagggccc

SEQ ID NO: 318187 - RNA, 32 nt, Human
agcuaccauucccaauggggcagucaacucug

SEQ ID NO: 318188 - RNA, 25 nt, Human
agcuaccauugacuuucuucacaga

SEQ ID NO: 318189 - RNA, 32 nt, Human
agcuacccaaguagcuggaacuacaggcgugu

SEQ ID NO: 318190 - RNA, 20 nt, Human
agcuacccagaacugaacua

SEQ ID NO: 318191 - RNA, 32 nt, Human
agcuaccccucagcuccgguagucgccagucc

SEQ ID NO: 318192 - RNA, 32 nt, Human
agcuaccccugacuuagagccugguggaggug

SEQ ID NO: 318193 - RNA, 32 nt, Human
agcuacccuaggcuggauugcacucgccuucu

SEQ ID NO: 318194 - RNA, 32 nt, Human
agcuacccuccccgucuccagccugggcuccc

SEQ ID NO: 318195 - RNA, 32 nt, Human
agcuacccugaaggcugaggcaggagcauugc

SEQ ID NO: 318196 - RNA, 32 nt, Human
agcuaccucaaacuuccagucagguaguugca

SEQ ID NO: 318197 - RNA, 32 nt, Human
agcuaccucaccucagcuugagagagccaguu

SEQ ID NO: 318198 - RNA, 32 nt, Human
agcuaccuccggguaaaggcaagagcaagacc

SEQ ID NO: 318199 - RNA, 32 nt, Human
agcuaccugaggaggaggcagggcagaagggc

SEQ ID NO: 318200 - RNA, 32 nt, Human
agcuaccugccccugcucacuaagcugggcag

SEQ ID NO: 318201 - RNA, 32 nt, Human
agcuaccuggagccacaggucacuuuccaaaa

SEQ ID NO: 318202 - RNA, 32 nt, Human
agcuaccuggucucaucccucugccucugaga

SEQ ID NO: 318203 - RNA, 32 nt, Human
agcuaccuguggugauguugccaccuguuaaa

SEQ ID NO: 318204 - RNA, 32 nt, Human
agcuacgacugcaagcaccugccaccauaaag

SEQ ID NO: 318205 - RNA, 32 nt, Human
agcuacgagccgcggcggcagcggggcggcgg

SEQ ID NO: 318206 - RNA, 23 nt, Human
agcuacgaucacaccacugcacu

SEQ ID NO: 318207 - RNA, 32 nt, Human
agcuacgauguucuuccagggcacugggggcu

SEQ ID NO: 318208 - RNA, 32 nt, Human
agcuacgccugccuccccugugcaguccuggg

SEQ ID NO: 318209 - RNA, 32 nt, Human
agcuacgcucacugcaggcuccgccuccuggg

SEQ ID NO: 318210 - RNA, 32 nt, Human
agcuacggagagaagcagccagcaugguguuc

SEQ ID NO: 318211 - RNA, 32 nt, Human
agcuacgggcagcagaguucauucugacagga

SEQ ID NO: 318212 - RNA, 32 nt, Human
agcuacgugggaggcagaggcaggagaaucau

SEQ ID NO: 318213 - RNA, 32 nt, Human
agcuacuagggaggaugaggcagaagaaucac

SEQ ID NO: 318214 - RNA, 32 nt, Human
agcuacuagggaggaugaggcaggagaauugc

SEQ ID NO: 318215 - RNA, 32 nt, Human
agcuacuagggaggcaggaggaucacuugagc

SEQ ID NO: 318216 - RNA, 32 nt, Human
agcuacuagggaggcggaggaagaagaaucgc

SEQ ID NO: 318217 - RNA, 32 nt, Human
agcuacuagggaggcugagccaggaggaucac

SEQ ID NO: 318218 - RNA, 32 nt, Human
agcuacuagggaggcugaggcaagaggcuuga

SEQ ID NO: 318219 - RNA, 32 nt, Human
agcuacuagggaggcugaggcagaagaaucgc

SEQ ID NO: 318220 - RNA, 32 nt, Human
agcuacuagggaggcugaggcaggagaaucac

SEQ ID NO: 318221 - RNA, 32 nt, Human
agcuacuagggaggcugaggcaggagaaucgc

SEQ ID NO: 318222 - RNA, 32 nt, Human
agcuacuagggaggcugaggcaggagaaucuc

SEQ ID NO: 318223 - RNA, 32 nt, Human
agcuacuagggaggcugaggcaggagaauggc

SEQ ID NO: 318224 - RNA, 32 nt, Human
agcuacuagggaggcugaggcaggagaauggu

SEQ ID NO: 318225 - RNA, 32 nt, Human
agcuacuagggaggcugaggcaggagaauugc

SEQ ID NO: 318226 - RNA, 32 nt, Human
agcuacuagggaggcugcggcaggagaauugc

SEQ ID NO: 318227 - RNA, 32 nt, Human
agcuacucaacuuuuaagccccugccaugguu

SEQ ID NO: 318228 - RNA, 32 nt, Human
agcuacucaccucugcuguuguagcuagagag

SEQ ID NO: 318229 - RNA, 32 nt, Human
agcuacucagcaggcugagaugggaggauggc

SEQ ID NO: 318230 - RNA, 32 nt, Human
agcuacucaggagguugaggcagcagaauugc

SEQ ID NO: 318231 - RNA, 32 nt, Human
agcuacucagggacuucucuugccuggagggu

SEQ ID NO: 318232 - RNA, 32 nt, Human
agcuacucagggagguugaggcagcaggauug

SEQ ID NO: 318233 - RNA, 32 nt, Human
agcuacucagggcugaggcaggagaauugcuu

SEQ ID NO: 318234 - RNA, 32 nt, Human
agcuacuccagaaaauaggguuauguguguca

SEQ ID NO: 318235 - RNA, 32 nt, Human
agcuacuccgggaggcugaggcaggagaguca

SEQ ID NO: 318236 - RNA, 32 nt, Human
agcuacucgggaggcugaggcagagaauugcu

SEQ ID NO: 318237 - RNA, 32 nt, Human
agcuacucgggaggcugaugcagaagaauggc

SEQ ID NO: 318238 - RNA, 32 nt, Human
agcuacucucuugccagcauuuucacauuuug

SEQ ID NO: 318239 - RNA, 32 nt, Human
agcuacugagagcucuggaaagaaggauguca

SEQ ID NO: 318240 - RNA, 32 nt, Human
agcuacugcacuccaaccugggcaacauagug

SEQ ID NO: 318241 - RNA, 32 nt, Human
agcuacugcccagggcccgcaguguuggcugc

SEQ ID NO: 318242 - RNA, 32 nt, Human
agcuacugucucuuuuaaaaaccacguacaaa

SEQ ID NO: 318243 - RNA, 32 nt, Human
agcuacuucccaggaccccacagaacagccaa

SEQ ID NO: 318244 - RNA, 32 nt, Human
agcuacuucuguuccugcuuucccucucacgu

SEQ ID NO: 318245 - RNA, 32 nt, Human
agcuacuucuuuccuuaauguuuuuccuucua

SEQ ID NO: 318246 - RNA, 32 nt, Human
agcuacuugaagagaaggugacaggaaacuuc

SEQ ID NO: 318247 - RNA, 32 nt, Human
agcuacuugaaggcugauuaugugccauuuua

SEQ ID NO: 318248 - RNA, 32 nt, Human
agcuacuugagaggcagaggcaggagaaucgc

SEQ ID NO: 318249 - RNA, 32 nt, Human
agcuacuugagaggcugagauaggagaaucac

SEQ ID NO: 318250 - RNA, 32 nt, Human
agcuacuugcagcaucuccugaggacuugcuu

SEQ ID NO: 318251 - RNA, 32 nt, Human
agcuacuugggaagcugagacaggagaauugc

SEQ ID NO: 318252 - RNA, 32 nt, Human
agcuacuugggaggcagaggcaggagaaucau

SEQ ID NO: 318253 - RNA, 32 nt, Human
agcuacuugggaggcagaggcaggagaaucgc

SEQ ID NO: 318254 - RNA, 32 nt, Human
agcuacuugggaggcagaggcaggagaaucgu

SEQ ID NO: 318255 - RNA, 32 nt, Human
agcuacuugggaggcagaggcaggagaauggc

SEQ ID NO: 318256 - RNA, 32 nt, Human
agcuacuugggaggcugagaugggagaaucac

SEQ ID NO: 318257 - RNA, 32 nt, Human
agcuacuugggaggcugagaugggaggaccau

SEQ ID NO: 318258 - RNA, 32 nt, Human
agcuacuugggaggcugagaugggaggagcac

SEQ ID NO: 318259 - RNA, 32 nt, Human
agcuacuugggaggcugagaugggaggaucau

SEQ ID NO: 318260 - RNA, 32 nt, Human
agcuacuugggaggcugaggcagagaauugcu

SEQ ID NO: 318261 - RNA, 32 nt, Human
agcuacuugggaggcugaggcagagcugcuug

SEQ ID NO: 318262 - RNA, 32 nt, Human
agcuacuugggaggcugaggcagcauugcuug

SEQ ID NO: 318263 - RNA, 19 nt, Human
agcuacuugguaguuacaa

SEQ ID NO: 318264 - RNA, 32 nt, Human
agcuacuuguguucucuucauuugucuguaaa

SEQ ID NO: 318265 - RNA, 32 nt, Human
agcuacuuucuuucuuauuuuucguccuacua

SEQ ID NO: 318266 - RNA, 32 nt, Human
agcuagaaccacauguacacaccaccacgguc

SEQ ID NO: 318267 - RNA, 32 nt, Human
agcuagaaccgcaggugcaugucaccaugucc

SEQ ID NO: 318268 - RNA, 32 nt, Human
agcuagaagagaggauuuugaaaguucucaac

SEQ ID NO: 318269 - RNA, 22 nt, Human
agcuagaaggcccugcagcuac

SEQ ID NO: 318270 - RNA, 32 nt, Human
agcuagaagggcccuuuacagagcucuguacu

SEQ ID NO: 318271 - RNA, 32 nt, Human
agcuagaauaagaggugcaggauuucacaaaa

SEQ ID NO: 318272 - RNA, 32 nt, Human
agcuagacacagauugcugaugggcgcauuua

SEQ ID NO: 318273 - RNA, 24 nt, Human
agcuagaccagccugggcaacaua

SEQ ID NO: 318274 - RNA, 32 nt, Human
agcuagaccaggcuuccccacaugguggucuc

SEQ ID NO: 318275 - RNA, 32 nt, Human
agcuagaccuauaggcgccugccaccaugccc

SEQ ID NO: 318276 - RNA, 32 nt, Human
agcuagaccucacccucuuggguagaugcauc

SEQ ID NO: 318277 - RNA, 17 nt, Human
agcuagaccucccaggg

SEQ ID NO: 318278 - RNA, 32 nt, Human
agcuagaccugacauuagaacuagaccugggc

SEQ ID NO: 318279 - RNA, 32 nt, Human
agcuagacuuacuccggcagcugggaaaggag

SEQ ID NO: 318280 - RNA, 32 nt, Human
agcuagagaaacaauauuacugccuuugcucu

SEQ ID NO: 318281 - RNA, 32 nt, Human
agcuagagcccucagucacaggcaaaggcugg

SEQ ID NO: 318282 - RNA, 32 nt, Human
agcuagaggacaggcaagccagcucuggggga

SEQ ID NO: 318283 - RNA, 32 nt, Human
agcuagagguacuguuauuaauguaucagcaa

SEQ ID NO: 318284 - RNA, 32 nt, Human
agcuagagguggcagagagggggugaccagca

SEQ ID NO: 318285 - RNA, 32 nt, Human
agcuagagucauauuaucauacuuaucauaau

SEQ ID NO: 318286 - RNA, 32 nt, Human
agcuagaguccgggauccccagccuacugccu

SEQ ID NO: 318287 - RNA, 32 nt, Human
agcuagauaugggacccuggcaagugaccaaa

SEQ ID NO: 318288 - RNA, 32 nt, Human
agcuagaugaaaaggcaaugcaggcaguagaa

SEQ ID NO: 318289 - RNA, 32 nt, Human
agcuagauguaacuccuaccacccucacuaga

SEQ ID NO: 318290 - RNA, 32 nt, Human
agcuagcacacagcacuugggccagcaaaucc

SEQ ID NO: 318291 - RNA, 32 nt, Human
agcuagcacauggcuguuucuauauucugaug

SEQ ID NO: 318292 - RNA, 20 nt, Human
agcuagcagcccaccccucc

SEQ ID NO: 318293 - RNA, 32 nt, Human
agcuagcagcgucugcagccgcgcccggccag

SEQ ID NO: 318294 - RNA, 32 nt, Human
agcuagcagcuggccuccauggccccacagcc

SEQ ID NO: 318295 - RNA, 32 nt, Human
agcuagcagcuggcuguguuugcagugcaaau

SEQ ID NO: 318296 - RNA, 32 nt, Human
agcuagcauacugaugccacugugcugcaucu

SEQ ID NO: 318297 - RNA, 32 nt, Human
agcuagccaggcaaagggggcaauggcggcuu

SEQ ID NO: 318298 - RNA, 32 nt, Human
agcuagcccagcugccuugggcuggggccugc

SEQ ID NO: 318299 - RNA, 32 nt, Human
agcuagccgggcaugaggagaucgugucucca

SEQ ID NO: 318300 - RNA, 32 nt, Human
agcuagcgccgucgucgucucccuucagucgc

SEQ ID NO: 318301 - RNA, 31 nt, Human
agcuagcgccucucuggguguccgugccagu

SEQ ID NO: 318302 - RNA, 32 nt, Human
agcuagcuaucauuauugucacaucuaaugcu

SEQ ID NO: 318303 - RNA, 32 nt, Human
agcuagcuaugucccuagcugcaggaagcccc

SEQ ID NO: 318304 - RNA, 32 nt, Human
agcuagcuguguccccaggccugggcccaggg

SEQ ID NO: 318305 - RNA, 32 nt, Human
agcuagcuuucacuuucagaguggccaauuca

SEQ ID NO: 318306 - RNA, 31 nt, Human
agcuaggaaagcuucuuuauaucuugcauua

SEQ ID NO: 318307 - RNA, 32 nt, Human
agcuaggaacucaaggagucagccuagacccc

SEQ ID NO: 318308 - RNA, 32 nt, Human
agcuaggacaacaggugcgugcuaccaugcau

SEQ ID NO: 318309 - RNA, 32 nt, Human
agcuaggaccacaggugcgugucaccaugcuu

SEQ ID NO: 318310 - RNA, 32 nt, Human
agcuaggaccaugggugccugccaccacacgu

SEQ ID NO: 318311 - RNA, 32 nt, Human
agcuaggacuacaagcaugugccaccauggcc

SEQ ID NO: 318312 - RNA, 32 nt, Human
agcuaggacuacaagugugugccaccacaccc

SEQ ID NO: 318313 - RNA, 32 nt, Human
agcuaggacuacaggcacaugccaccaccaag

SEQ ID NO: 318314 - RNA, 32 nt, Human
agcuaggacuacaggcacgugccaccacgccc

SEQ ID NO: 318315 - RNA, 32 nt, Human
agcuaggacuacaggcacucaccaccaugccc

SEQ ID NO: 318316 - RNA, 32 nt, Human
agcuaggacuacaggcagugugccaccacauc

SEQ ID NO: 318317 - RNA, 32 nt, Human
agcuaggacuacaggcaugcacuaccacgccc

SEQ ID NO: 318318 - RNA, 32 nt, Human
agcuaggacuacaggcaugugccaccaccccc

SEQ ID NO: 318319 - RNA, 32 nt, Human
agcuaggacuacaggcauguggcaccaugccc

SEQ ID NO: 318320 - RNA, 32 nt, Human
agcuaggacuacaggcgcccaccaccacacca

SEQ ID NO: 318321 - RNA, 32 nt, Human
agcuaggacuacaggugcaugccaacacgccc

SEQ ID NO: 318322 - RNA, 32 nt, Human
agcuaggacuacaggugcccgccaccacaccc

SEQ ID NO: 318323 - RNA, 32 nt, Human
agcuaggacuacaggugugcaccaccacgccc

SEQ ID NO: 318324 - RNA, 32 nt, Human
agcuaggacuacaggugugcaccaccaugccc

SEQ ID NO: 318325 - RNA, 32 nt, Human
agcuaggacuaccggcgugcaccaccaugcca

SEQ ID NO: 318326 - RNA, 32 nt, Human
agcuaggacuauaggcaugcaccaccacgccc

SEQ ID NO: 318327 - RNA, 32 nt, Human
agcuaggacugcaggugugcaccaccaugccc

SEQ ID NO: 318328 - RNA, 21 nt, Human
agcuaggacuucgcuaacaga

SEQ ID NO: 318329 - RNA, 32 nt, Human
agcuaggagacaccaaacccucaggaagauuu

SEQ ID NO: 318330 - RNA, 32 nt, Human
agcuaggagaggggagaagccgggggcugcag

SEQ ID NO: 318331 - RNA, 32 nt, Human
agcuaggagaugucaaaagcccauaugaggag

SEQ ID NO: 318332 - RNA, 32 nt, Human
agcuaggagccaagacccaucucuucacuauu

SEQ ID NO: 318333 - RNA, 32 nt, Human
agcuaggaggcugaggcaggagaaucacugga

SEQ ID NO: 318334 - RNA, 32 nt, Human
agcuaggaguggagaaucagggccaaguuugc

SEQ ID NO: 318335 - RNA, 32 nt, Human
agcuaggaucauaccaacaugcuccagccuga

SEQ ID NO: 318336 - RNA, 32 nt, Human
agcuaggauuaaaggugcgugccaccaugccc

SEQ ID NO: 318337 - RNA, 32 nt, Human
agcuaggauuacagaagcaugccaccacgccu

SEQ ID NO: 318338 - RNA, 32 nt, Human
agcuaggauuacagauacgugccaccauaccc

SEQ ID NO: 318339 - RNA, 32 nt, Human
agcuaggauuacaggcacaugccaccaugccc

SEQ ID NO: 318340 - RNA, 32 nt, Human
agcuaggauuacaggcacgcaccacuacugcc

SEQ ID NO: 318341 - RNA, 32 nt, Human
agcuaggauuacaggcaugcaccaccacgcug

SEQ ID NO: 318342 - RNA, 32 nt, Human
agcuaggauuacaggcaugugccaccacgccc

SEQ ID NO: 318343 - RNA, 32 nt, Human
agcuaggauuacaggcaugugccaccauguaa

SEQ ID NO: 318344 - RNA, 32 nt, Human
agcuaggauuacagguacgcaccaccacgccc

SEQ ID NO: 318345 - RNA, 32 nt, Human
agcuaggauuacaggugccugccaccacaccc

SEQ ID NO: 318346 - RNA, 32 nt, Human
agcuaggauuacaggugugugccaccacgccu

SEQ ID NO: 318347 - RNA, 32 nt, Human
agcuaggauuacaggugugugccaccaugccc

SEQ ID NO: 318348 - RNA, 32 nt, Human
agcuaggauuaucucauuuaauccuuauacca

SEQ ID NO: 318349 - RNA, 32 nt, Human
agcuaggccgucucccuggucagcuuccuuga

SEQ ID NO: 318350 - RNA, 32 nt, Human
agcuaggccugguggcagaggccuguaauccc

SEQ ID NO: 318351 - RNA, 32 nt, Human
agcuaggcgugguggcugggaccuguaauccc

SEQ ID NO: 318352 - RNA, 32 nt, Human
agcuaggcugaaugccucccagggaugagaaa

SEQ ID NO: 318353 - RNA, 32 nt, Human
agcuagggaagguaugggggaggaaagagaau

SEQ ID NO: 318354 - RNA, 32 nt, Human
agcuagggaccucacuuucuucaucuguagac

SEQ ID NO: 318355 - RNA, 32 nt, Human
agcuagggagaaaggagacucccccgcggagc

SEQ ID NO: 318356 - RNA, 32 nt, Human
agcuagggagaguguccugggugucagccaga

SEQ ID NO: 318357 - RNA, 32 nt, Human
agcuagggaggcaaagcaggcugcagucaguc

SEQ ID NO: 318358 - RNA, 32 nt, Human
agcuagggagggcagaguccccaucacguggc

SEQ ID NO: 318359 - RNA, 32 nt, Human
agcuagggccaggccagccuggggaagaacaa

SEQ ID NO: 318360 - RNA, 21 nt, Human
agcuagggcgaagccagcaga

SEQ ID NO: 318361 - RNA, 25 nt, Human
agcuagggcggggcccgcgggcuga

SEQ ID NO: 318362 - RNA, 20 nt, Human
agcuagggcguagcugugau

SEQ ID NO: 318363 - RNA, 32 nt, Human
agcuagggcuuggucucccaggacagagaguu

SEQ ID NO: 318364 - RNA, 32 nt, Human
agcuaggguggggucuggucacacacaggugu

SEQ ID NO: 318365 - RNA, 32 nt, Human
agcuagguacagaggaauguuugcuaccuuua

SEQ ID NO: 318366 - RNA, 32 nt, Human
agcuaggucuuuggggaaguccuggcugacug

SEQ ID NO: 318367 - RNA, 32 nt, Human
agcuaggugccagcggggaaaguuucccugcu

SEQ ID NO: 318368 - RNA, 32 nt, Human
agcuagguggacagacccuugcagugaugucc

SEQ ID NO: 318369 - RNA, 32 nt, Human
agcuaguacuauaggugugcaccaccacgccc

SEQ ID NO: 318370 - RNA, 32 nt, Human
agcuagucauuccugucauauucccaguagaa

SEQ ID NO: 318371 - RNA, 32 nt, Human
agcuagucuucccucuguucuuccugccucca

SEQ ID NO: 318372 - RNA, 32 nt, Human
agcuagugagaggaggaggaggugggcagagg

SEQ ID NO: 318373 - RNA, 32 nt, Human
agcuaguggagaaggagcaaugcugaggggug

SEQ ID NO: 318374 - RNA, 32 nt, Human
agcuaguuucaaacuccugggcucaagcgaug

SEQ ID NO: 318375 - RNA, 21 nt, Human
agcuaguuucaugcucagaug

SEQ ID NO: 318376 - RNA, 32 nt, Human
agcuaguuugggagguggcggcagaauaaggg

SEQ ID NO: 318377 - RNA, 32 nt, Human
agcuaguuuggggcuggggagcucaggcaaaa

SEQ ID NO: 318378 - RNA, 32 nt, Human
agcuauacgacuucacaucaucagaggacgcc

SEQ ID NO: 318379 - RNA, 19 nt, Human
agcuauagcauccaccaga

SEQ ID NO: 318380 - RNA, 23 nt, Human
agcuauagcuggccauuuagagg

SEQ ID NO: 318381 - RNA, 32 nt, Human
agcuauaggugcuaccuaccucuuggggacau

SEQ ID NO: 318382 - RNA, 32 nt, Human
agcuauagucguucucccuugugggcccgggg

SEQ ID NO: 318383 - RNA, 32 nt, Human
agcuauauagcagcgggggagaggguaaacug

SEQ ID NO: 318384 - RNA, 32 nt, Human
agcuauaugcacagggccuggugcgagcaggu

SEQ ID NO: 318385 - RNA, 32 nt, Human
agcuaucacaggugaauugcagugagcgcuau

SEQ ID NO: 318386 - RNA, 32 nt, Human
agcuaucaggccaagaccccagcuucauuaug

SEQ ID NO: 318387 - RNA, 19 nt, Human
agcuaucauaccaagcaca

SEQ ID NO: 318388 - RNA, 32 nt, Human
agcuaucauagaauuaaccaagcuauuaaaau

SEQ ID NO: 318389 - RNA, 32 nt, Human
agcuaucauccaguuacccaagaugucccauu

SEQ ID NO: 318390 - RNA, 32 nt, Human
agcuauccaccaccaucacagucagacucugc

SEQ ID NO: 318391 - RNA, 32 nt, Human
agcuaucccagaggucgaggcugcagugagcu

SEQ ID NO: 318392 - RNA, 32 nt, Human
agcuaucuaagggggaggguccccgcaccuac

SEQ ID NO: 318393 - RNA, 32 nt, Human
agcuaucuguaaccaagauggaugcaaagagg

SEQ ID NO: 318394 - RNA, 32 nt, Human
agcuaucugucugccuuggguucccaaaguac

SEQ ID NO: 318395 - RNA, 32 nt, Human
agcuaucuuguuggaugugagguggaaucuau

SEQ ID NO: 318396 - RNA, 32 nt, Human
agcuaugacuacagguaugugccaccacgucu

SEQ ID NO: 318397 - RNA, 32 nt, Human
agcuaugaucacaccaccacacuccagccuga

SEQ ID NO: 318398 - RNA, 23 nt, Human
agcuaugaucaugccacugcacu

SEQ ID NO: 318399 - RNA, 32 nt, Human
agcuaugauuacaggcacccgccaccacgccc

SEQ ID NO: 318400 - RNA, 32 nt, Human
agcuaugauuguaccacugcacuccagccugg

SEQ ID NO: 318401 - RNA, 32 nt, Human
agcuaugccacuuaccagcugugggaccuugg

SEQ ID NO: 318402 - RNA, 32 nt, Human
agcuaugccuauacuauuaugcaaaguaacug

SEQ ID NO: 318403 - RNA, 32 nt, Human
agcuaugccucaucuucuaacgagccaagcca

SEQ ID NO: 318404 - RNA, 19 nt, Human
agcuauggaggucgagggg

SEQ ID NO: 318405 - RNA, 32 nt, Human
agcuaugggagcaaggagagggagcucucacc

SEQ ID NO: 318406 - RNA, 22 nt, Human
agcuaugggcuccagcuagcau

SEQ ID NO: 318407 - RNA, 32 nt, Human
agcuauggucauaccaccgcacuccagccuga

SEQ ID NO: 318408 - RNA, 32 nt, Human
agcuaugguugacugcucugguguuuuuauau

SEQ ID NO: 318409 - RNA, 29 nt, Human
agcuauguccuacccugugaccagucagc

SEQ ID NO: 318410 - RNA, 32 nt, Human
agcuaugugcagcugcacaacacaguccuucc

SEQ ID NO: 318411 - RNA, 32 nt, Human
agcuauguuuuuaaaguguacauuuuauaaag

SEQ ID NO: 318412 - RNA, 32 nt, Human
agcuauuagggaggcugaggcaggagaaucgc

SEQ ID NO: 318413 - RNA, 32 nt, Human
agcuauucaaagccuuaauugggcaucacuca

SEQ ID NO: 318414 - RNA, 32 nt, Human
agcuauuccacccucugccugccugccugccu

SEQ ID NO: 318415 - RNA, 32 nt, Human
agcuauuccagcugcuacugcuuuggcucugg

SEQ ID NO: 318416 - RNA, 32 nt, Human
agcuauuccucccaccaccaguagccuugggc

SEQ ID NO: 318417 - RNA, 32 nt, Human
agcuauucucacucugagaacucuccaauaac

SEQ ID NO: 318418 - RNA, 32 nt, Human
agcuauucucacugaugcacugauggcccuga

SEQ ID NO: 318419 - RNA, 32 nt, Human
agcuauucuguugacuauccaucaggauaaua

SEQ ID NO: 318420 - RNA, 32 nt, Human
agcuauugaaaaucauuugugcuuuucagcuu

SEQ ID NO: 318421 - RNA, 32 nt, Human
agcuauugcaccacugcucuccaagcugggca

SEQ ID NO: 318422 - RNA, 32 nt, Human
agcuauugcuuuucuaauuuccuuccauaucc

SEQ ID NO: 318423 - RNA, 32 nt, Human
agcuauuggaaaugagucugauaguacauugg

SEQ ID NO: 318424 - RNA, 31 nt, Human
agcuauuggguggaccaagcgggugaggcgc

SEQ ID NO: 318425 - RNA, 32 nt, Human
agcuauuuacauagccuucuaaguaaaggcaa

SEQ ID NO: 318426 - RNA, 32 nt, Human
agcuauuuacauagccuucuaaguaaaggcag

SEQ ID NO: 318427 - RNA, 32 nt, Human
agcuauuugagacacaaaccucacgaguggaa

SEQ ID NO: 318428 - RNA, 32 nt, Human
agcuauuugucugucaaaaugucugcaaaauu

SEQ ID NO: 318429 - RNA, 32 nt, Human
agcucaaaauagaaauuagguuaaaaugccau

SEQ ID NO: 318430 - RNA, 32 nt, Human
agcucaaacccuguaaguuacagucacaauuu

SEQ ID NO: 318431 - RNA, 32 nt, Human
agcucaaaccuauaaucccagcacuuugggag

SEQ ID NO: 318432 - RNA, 32 nt, Human
agcucaaagcuggagugcaauggcgcaaucuc

SEQ ID NO: 318433 - RNA, 32 nt, Human
agcucaaagggcuuagugaauauugucuuaac

SEQ ID NO: 318434 - RNA, 32 nt, Human
agcucaaagugcucauccugaaugacaaccuu

SEQ ID NO: 318435 - RNA, 32 nt, Human
agcucaaauguauuuuccuaauugcccacuug

SEQ ID NO: 318436 - RNA, 32 nt, Human
agcucaacuauuaaacacuacucucaucaccc

SEQ ID NO: 318437 - RNA, 32 nt, Human
agcucaacugcacuugccucgcagaggcagcc

SEQ ID NO: 318438 - RNA, 32 nt, Human
agcucaagaggccgagguugcagugagccgug

SEQ ID NO: 318439 - RNA, 32 nt, Human
agcucaagagguugaggcugcagugagcccug

SEQ ID NO: 318440 - RNA, 32 nt, Human
agcucaagcaguucucccaccugggccuccca

SEQ ID NO: 318441 - RNA, 32 nt, Human
agcucaagccaaacgcuucuguccucuuuccu

SEQ ID NO: 318442 - RNA, 20 nt, Human
agcucaagcccuaagagaca

SEQ ID NO: 318443 - RNA, 32 nt, Human
agcucaagccuguaaucccagcacuuugggag

SEQ ID NO: 318444 - RNA, 20 nt, Human
agcucaaggaagcucaggga

SEQ ID NO: 318445 - RNA, 32 nt, Human
agcucaaggacgaauuauucagacaagccagu

SEQ ID NO: 318446 - RNA, 32 nt, Human
agcucaagugaggagggggaggcuggguuuuu

SEQ ID NO: 318447 - RNA, 32 nt, Human
agcucaagugaucuuccugccuuggcacccaa

SEQ ID NO: 318448 - RNA, 32 nt, Human
agcucaauaaauccccuggcccucucuccacu

SEQ ID NO: 318449 - RNA, 32 nt, Human
agcucaaucuaugccagcucucuggcaucugg

SEQ ID NO: 318450 - RNA, 32 nt, Human
agcucaaugaauauagaagggaaaaguaugag

SEQ ID NO: 318451 - RNA, 32 nt, Human
agcucacaacuccggaaggaauggggacuuag

SEQ ID NO: 318452 - RNA, 32 nt, Human
agcucacacagcaggaacugagccagaaacgc

SEQ ID NO: 318453 - RNA, 32 nt, Human
agcucacacccuguaaucccagcacuuuggga

SEQ ID NO: 318454 - RNA, 32 nt, Human
agcucacaccuauaaucccagcacuuugggag

SEQ ID NO: 318455 - RNA, 32 nt, Human
agcucacaccuguaaacccagcacuuugggag

SEQ ID NO: 318456 - RNA, 32 nt, Human
agcucacaccuguaaucccagaacuuugggag

SEQ ID NO: 318457 - RNA, 32 nt, Human
agcucacaccuguaaucccagcacuuuaggag

SEQ ID NO: 318458 - RNA, 32 nt, Human
agcucacaccuguaaucccagcacuuugggag

SEQ ID NO: 318459 - RNA, 32 nt, Human
agcucacaccuguaauucccagcgcuuuggga

SEQ ID NO: 318460 - RNA, 32 nt, Human
agcucacaccuguccuucccucauggaagcua

SEQ ID NO: 318461 - RNA, 32 nt, Human
agcucacacuucauggagcacugacagcagug

SEQ ID NO: 318462 - RNA, 32 nt, Human
agcucacacuuguaaucccgacacuuugggag

SEQ ID NO: 318463 - RNA, 32 nt, Human
agcucacagcaaccuccgccucccagguucaa

SEQ ID NO: 318464 - RNA, 32 nt, Human
agcucacagcaaccuccgccucccggguucaa

SEQ ID NO: 318465 - RNA, 32 nt, Human
agcucacagcaaccucugccuccuggguucaa

SEQ ID NO: 318466 - RNA, 32 nt, Human
agcucacagcacugaggcgcugggggagggcc

SEQ ID NO: 318467 - RNA, 32 nt, Human
agcucacagcagcaggagcuucagagaggaag

SEQ ID NO: 318468 - RNA, 32 nt, Human
agcucacagcuauuguggugggaaagggaggg

SEQ ID NO: 318469 - RNA, 32 nt, Human
agcucaccaaaaacuauuucuucagccccuuc

SEQ ID NO: 318470 - RNA, 32 nt, Human
agcucaccaagguccccucucaguccccuucc

SEQ ID NO: 318471 - RNA, 32 nt, Human
agcucaccaaucagacugcccuugucuaucca

SEQ ID NO: 318472 - RNA, 32 nt, Human
agcucaccacaaccuccaccuccuggguuuaa

SEQ ID NO: 318473 - RNA, 32 nt, Human
agcucaccacaaccuccgccucccagguucaa

SEQ ID NO: 318474 - RNA, 23 nt, Human
agcucaccacaaccuugaacucc

SEQ ID NO: 318475 - RNA, 32 nt, Human
agcucaccacagccuccaacuccugggcucaa

SEQ ID NO: 318476 - RNA, 32 nt, Human
agcucaccacccagaaugaugcagucagccuc

SEQ ID NO: 318477 - RNA, 32 nt, Human
agcucaccagcaaacgccacugcagacgaagg

SEQ ID NO: 318478 - RNA, 32 nt, Human
agcucacccaagccugcuccagucccaggggc

SEQ ID NO: 318479 - RNA, 32 nt, Human
agcucacccgggaagagaggagagaagcccau

SEQ ID NO: 318480 - RNA, 32 nt, Human
agcucacccuuguaaucccagcacuuugggag

SEQ ID NO: 318481 - RNA, 23 nt, Human
agcucaccgcaaccuccaccucc

SEQ ID NO: 318482 - RNA, 32 nt, Human
agcucaccgcaaccuccaccuccaggguugac

SEQ ID NO: 318483 - RNA, 32 nt, Human
agcucaccgcaaccuccaccucccggguucaa

SEQ ID NO: 318484 - RNA, 24 nt, Human
agcucaccgcaaccuccaccuccu

SEQ ID NO: 318485 - RNA, 32 nt, Human
agcucaccgcaaccuccaccuccuggguucaa

SEQ ID NO: 318486 - RNA, 32 nt, Human
agcucaccgcaaccuccacucgcagguucaag

SEQ ID NO: 318487 - RNA, 23 nt, Human
agcucaccgcaaccuccgccucc

SEQ ID NO: 318488 - RNA, 32 nt, Human
agcucaccgcaaccuccgccucccggguucaa

SEQ ID NO: 318489 - RNA, 32 nt, Human
agcucaccgcaaccucugccucccagauucaa

SEQ ID NO: 318490 - RNA, 32 nt, Human
agcucaccgcaacgucuaccucccagguucaa

SEQ ID NO: 318491 - RNA, 32 nt, Human
agcucaccgcaaucuccgccucccagauucaa

SEQ ID NO: 318492 - RNA, 32 nt, Human
agcucaccgcauccuccaccucccagguucaa

SEQ ID NO: 318493 - RNA, 22 nt, Human
agcucaccgugcccagccuccu

SEQ ID NO: 318494 - RNA, 32 nt, Human
agcucaccucaaccuccgccucccggguucaa

SEQ ID NO: 318495 - RNA, 32 nt, Human
agcucaccuccaggacccagagucugcccuuc

SEQ ID NO: 318496 - RNA, 32 nt, Human
agcucaccugggaacugaauccaccuaaccau

SEQ ID NO: 318497 - RNA, 32 nt, Human
agcucacgccuauaaucccaacacuuugggaa

SEQ ID NO: 318498 - RNA, 32 nt, Human
agcucacgccuauaaucccagcauuuugggag

SEQ ID NO: 318499 - RNA, 32 nt, Human
agcucacgccugaaaucucagcacuuugguag

SEQ ID NO: 318500 - RNA, 32 nt, Human
agcucacgccuguaaucccaacacuuugggag

SEQ ID NO: 318501 - RNA, 32 nt, Human
agcucacgccuguaaucccagcacuuugggag

SEQ ID NO: 318502 - RNA, 32 nt, Human
agcucacgccuguaaucccaucacuuugggag

SEQ ID NO: 318503 - RNA, 32 nt, Human
agcucacgccuguaauuccagcacuuugggag

SEQ ID NO: 318504 - RNA, 32 nt, Human
agcucacgccuguauucccagcaguuugggag

SEQ ID NO: 318505 - RNA, 32 nt, Human
agcucacgccugugauuccagcacuuugggag

SEQ ID NO: 318506 - RNA, 32 nt, Human
agcucacgccuguuaaguccagcacuuuggga

SEQ ID NO: 318507 - RNA, 32 nt, Human
agcucacggcaaccuccgccucccggguucaa

SEQ ID NO: 318508 - RNA, 23 nt, Human
agcucacggcagccucaaccucc

SEQ ID NO: 318509 - RNA, 18 nt, Human
agcucacggccuccggga

SEQ ID NO: 318510 - RNA, 32 nt, Human
agcucacggcuaccucugccucccggguucaa

SEQ ID NO: 318511 - RNA, 32 nt, Human
agcucacggucuucucagguucaucuguggaa

SEQ ID NO: 318512 - RNA, 32 nt, Human
agcucacuacaaccuccacuuuccagguucaa

SEQ ID NO: 318513 - RNA, 23 nt, Human
agcucacuacaaccuccgccucc

SEQ ID NO: 318514 - RNA, 32 nt, Human
agcucacuacaaccuccgccucccauguucaa

SEQ ID NO: 318515 - RNA, 32 nt, Human
agcucacuacaaccuccugcuccuggguucga

SEQ ID NO: 318516 - RNA, 32 nt, Human
agcucacuacaaccucugccacugggauucaa

SEQ ID NO: 318517 - RNA, 23 nt, Human
agcucacuacaaccucugccucc

SEQ ID NO: 318518 - RNA, 32 nt, Human
agcucacuacaaccucugccucccagguucaa

SEQ ID NO: 318519 - RNA, 32 nt, Human
agcucacuacaaccucugccuccggguucaag

SEQ ID NO: 318520 - RNA, 32 nt, Human
agcucacuacaaccucugccuucugguuucaa

SEQ ID NO: 318521 - RNA, 23 nt, Human
agcucacuacaacuucugccucc

SEQ ID NO: 318522 - RNA, 32 nt, Human
agcucacuacaacuucugccucccaggcucaa

SEQ ID NO: 318523 - RNA, 32 nt, Human
agcucacuacaagcuccccuucccagguucaa

SEQ ID NO: 318524 - RNA, 32 nt, Human
agcucacuacagccuugaacuccugggcucaa

SEQ ID NO: 318525 - RNA, 32 nt, Human
agcucacuauaaccuugaacuccugggcucaa

SEQ ID NO: 318526 - RNA, 23 nt, Human
agcucacuauaagcuccaccucc

SEQ ID NO: 318527 - RNA, 32 nt, Human
agcucacuauaagcuccaccucccagguucau

SEQ ID NO: 318528 - RNA, 32 nt, Human
agcucacucaguuuagauauggagauuuugcu

SEQ ID NO: 318529 - RNA, 32 nt, Human
agcucacuccagccuccaacuccugggcucaa

SEQ ID NO: 318530 - RNA, 32 nt, Human
agcucacuccagccuccacuucccagguucaa

SEQ ID NO: 318531 - RNA, 32 nt, Human
agcucacucccagaaccgcagcugauguuuau

SEQ ID NO: 318532 - RNA, 32 nt, Human
agcucacucuaaccugcaccucccggguucaa

SEQ ID NO: 318533 - RNA, 32 nt, Human
agcucacucucugaagcacacaucauuggcuu

SEQ ID NO: 318534 - RNA, 32 nt, Human
agcucacucucuucagcuuccggcccucaaca

SEQ ID NO: 318535 - RNA, 32 nt, Human
agcucacucugcaaccuccacuucccagguuc

SEQ ID NO: 318536 - RNA, 32 nt, Human
agcucacugaaaccucugccucccggguucaa

SEQ ID NO: 318537 - RNA, 23 nt, Human
agcucacugaagucucgaccucc

SEQ ID NO: 318538 - RNA, 32 nt, Human
agcucacugaagucucgaccucccaggcucaa

SEQ ID NO: 318539 - RNA, 32 nt, Human
agcucacugcaaacuccaccucccagguucaa

SEQ ID NO: 318540 - RNA, 32 nt, Human
agcucacugcaacaccgccucccggguucaag

SEQ ID NO: 318541 - RNA, 32 nt, Human
agcucacugcaacauccaccuccuggguucaa

SEQ ID NO: 318542 - RNA, 23 nt, Human
agcucacugcaacauccgccucu

SEQ ID NO: 318543 - RNA, 32 nt, Human
agcucacugcaacauccgccucugggguucaa

SEQ ID NO: 318544 - RNA, 23 nt, Human
agcucacugcaaccaacaccuuc

SEQ ID NO: 318545 - RNA, 23 nt, Human
agcucacugcaaccacugccucc

SEQ ID NO: 318546 - RNA, 32 nt, Human
agcucacugcaaccacugccucccaggcucaa

SEQ ID NO: 318547 - RNA, 23 nt, Human
agcucacugcaacccccgccucc

SEQ ID NO: 318548 - RNA, 32 nt, Human
agcucacugcaacccccgccucccggguucag

SEQ ID NO: 318549 - RNA, 32 nt, Human
agcucacugcaacccccgccuccuggguucaa

SEQ ID NO: 318550 - RNA, 23 nt, Human
agcucacugcaaccccuccuccu

SEQ ID NO: 318551 - RNA, 32 nt, Human
agcucacugcaaccuacgccuucuggguucac

SEQ ID NO: 318552 - RNA, 24 nt, Human
agcucacugcaaccucaaacuccu

SEQ ID NO: 318553 - RNA, 32 nt, Human
agcucacugcaaccucaaacuccugggcucaa

SEQ ID NO: 318554 - RNA, 22 nt, Human
agcucacugcaaccucaauccu

SEQ ID NO: 318555 - RNA, 32 nt, Human
agcucacugcaaccucaauccugggcucaagu

SEQ ID NO: 318556 - RNA, 32 nt, Human
agcucacugcaaccuccaacugcugggcuuaa

SEQ ID NO: 318557 - RNA, 23 nt, Human
agcucacugcaaccuccaccccc

SEQ ID NO: 318558 - RNA, 22 nt, Human
agcucacugcaaccuccaccuc

SEQ ID NO: 318559 - RNA, 23 nt, Human
agcucacugcaaccuccaccucc

SEQ ID NO: 318560 - RNA, 32 nt, Human
agcucacugcaaccuccaccucccagacucaa

SEQ ID NO: 318561 - RNA, 32 nt, Human
agcucacugcaaccuccaccucccaggaucaa

SEQ ID NO: 318562 - RNA, 32 nt, Human
agcucacugcaaccuccaccucccaggcucaa

SEQ ID NO: 318563 - RNA, 32 nt, Human
agcucacugcaaccuccaccucccaggugcaa

SEQ ID NO: 318564 - RNA, 32 nt, Human
agcucacugcaaccuccaccucccagguucaa

SEQ ID NO: 318565 - RNA, 32 nt, Human
agcucacugcaaccuccaccucccgggucaag

SEQ ID NO: 318566 - RNA, 32 nt, Human
agcucacugcaaccuccaccucccggguucaa

SEQ ID NO: 318567 - RNA, 32 nt, Human
agcucacugcaaccuccaccucccggguucac

SEQ ID NO: 318568 - RNA, 32 nt, Human
agcucacugcaaccuccaccucccggguucag

SEQ ID NO: 318569 - RNA, 32 nt, Human
agcucacugcaaccuccaccucccggguucau

SEQ ID NO: 318570 - RNA, 32 nt, Human
agcucacugcaaccuccaccucccggguuuca

SEQ ID NO: 318571 - RNA, 32 nt, Human
agcucacugcaaccuccaccucccugguucaa

SEQ ID NO: 318572 - RNA, 32 nt, Human
agcucacugcaaccuccaccuccggguucaag

SEQ ID NO: 318573 - RNA, 24 nt, Human
agcucacugcaaccuccaccuccu

SEQ ID NO: 318574 - RNA, 32 nt, Human
agcucacugcaaccuccaccuccuggauucga

SEQ ID NO: 318575 - RNA, 32 nt, Human
agcucacugcaaccuccaccuccuggguucaa

SEQ ID NO: 318576 - RNA, 32 nt, Human
agcucacugcaaccuccaccuccuggguugaa

SEQ ID NO: 318577 - RNA, 32 nt, Human
agcucacugcaaccuccaccucgcagguucaa

SEQ ID NO: 318578 - RNA, 23 nt, Human
agcucacugcaaccuccaccucu

SEQ ID NO: 318579 - RNA, 32 nt, Human
agcucacugcaaccuccaccucucagguucaa

SEQ ID NO: 318580 - RNA, 32 nt, Human
agcucacugcaaccuccaccucuuauguucaa

SEQ ID NO: 318581 - RNA, 22 nt, Human
agcucacugcaaccuccaccuu

SEQ ID NO: 318582 - RNA, 23 nt, Human
agcucacugcaaccuccaucucc

SEQ ID NO: 318583 - RNA, 32 nt, Human
agcucacugcaaccuccaucuccagguuucaa

SEQ ID NO: 318584 - RNA, 32 nt, Human
agcucacugcaaccuccaucucccggauucca

SEQ ID NO: 318585 - RNA, 24 nt, Human
agcucacugcaaccuccaucuccu

SEQ ID NO: 318586 - RNA, 32 nt, Human
agcucacugcaaccuccaucuccuggauucaa

SEQ ID NO: 318587 - RNA, 32 nt, Human
agcucacugcaaccucccccuccuggguucaa

SEQ ID NO: 318588 - RNA, 23 nt, Human
agcucacugcaaccuccgcagcc

SEQ ID NO: 318589 - RNA, 23 nt, Human
agcucacugcaaccuccgcaucc

SEQ ID NO: 318590 - RNA, 32 nt, Human
agcucacugcaaccuccgcaucccggguucaa

SEQ ID NO: 318591 - RNA, 24 nt, Human
agcucacugcaaccuccgcccccu

SEQ ID NO: 318592 - RNA, 32 nt, Human
agcucacugcaaccuccgcccccuggguucaa

SEQ ID NO: 318593 - RNA, 23 nt, Human
agcucacugcaaccuccgccucc

SEQ ID NO: 318594 - RNA, 32 nt, Human
agcucacugcaaccuccgccucccaaguucaa

SEQ ID NO: 318595 - RNA, 32 nt, Human
agcucacugcaaccuccgccucccagguucaa

SEQ ID NO: 318596 - RNA, 32 nt, Human
agcucacugcaaccuccgccucccggguucaa

SEQ ID NO: 318597 - RNA, 24 nt, Human
agcucacugcaaccuccgccuccu

SEQ ID NO: 318598 - RNA, 32 nt, Human
agcucacugcaaccuccgccuccugagguuca

SEQ ID NO: 318599 - RNA, 32 nt, Human
agcucacugcaaccuccgccuccugggaucaa

SEQ ID NO: 318600 - RNA, 32 nt, Human
agcucacugcaaccuccgccuccuggguucaa

SEQ ID NO: 318601 - RNA, 32 nt, Human
agcucacugcaaccuccgccuccuggguucac

SEQ ID NO: 318602 - RNA, 24 nt, Human
agcucacugcaaccuccgccucuu

SEQ ID NO: 318603 - RNA, 32 nt, Human
agcucacugcaaccuccgccucuuggguucaa

SEQ ID NO: 318604 - RNA, 24 nt, Human
agcucacugcaaccuccgccugcu

SEQ ID NO: 318605 - RNA, 32 nt, Human
agcucacugcaaccuccgccugcuggguucaa

SEQ ID NO: 318606 - RNA, 32 nt, Human
agcucacugcaaccuccgccuucuggguucag

SEQ ID NO: 318607 - RNA, 24 nt, Human
agcucacugcaaccuccgcuuccu

SEQ ID NO: 318608 - RNA, 32 nt, Human
agcucacugcaaccuccgguucccgggcucaa

SEQ ID NO: 318609 - RNA, 23 nt, Human
agcucacugcaaccuccgucucc

SEQ ID NO: 318610 - RNA, 32 nt, Human
agcucacugcaaccuccgucuccaggguucaa

SEQ ID NO: 318611 - RNA, 24 nt, Human
agcucacugcaaccuccgucuccu

SEQ ID NO: 318612 - RNA, 23 nt, Human
agcucacugcaaccuccgucucu

SEQ ID NO: 318613 - RNA, 32 nt, Human
agcucacugcaaccuccguuuccuggguucga

SEQ ID NO: 318614 - RNA, 23 nt, Human
agcucacugcaaccuccuccucc

SEQ ID NO: 318615 - RNA, 32 nt, Human
agcucacugcaaccuccuccucccggguucaa

SEQ ID NO: 318616 - RNA, 24 nt, Human
agcucacugcaaccuccuccuucu

SEQ ID NO: 318617 - RNA, 32 nt, Human
agcucacugcaaccuccuccuucuggguucaa

SEQ ID NO: 318618 - RNA, 24 nt, Human
agcucacugcaaccucgaccucuu

SEQ ID NO: 318619 - RNA, 32 nt, Human
agcucacugcaaccucgaccucuuggguucaa

SEQ ID NO: 318620 - RNA, 23 nt, Human
agcucacugcaaccucggccucc

SEQ ID NO: 318621 - RNA, 24 nt, Human
agcucacugcaaccucuaccuccu

SEQ ID NO: 318622 - RNA, 32 nt, Human
agcucacugcaaccucuaccuccuggguucaa

SEQ ID NO: 318623 - RNA, 32 nt, Human
agcucacugcaaccucuacucccaggcucaag

SEQ ID NO: 318624 - RNA, 23 nt, Human
agcucacugcaaccucucucucc

SEQ ID NO: 318625 - RNA, 32 nt, Human
agcucacugcaaccucucucucccggguucaa

SEQ ID NO: 318626 - RNA, 32 nt, Human
agcucacugcaaccucugacucccagacucaa

SEQ ID NO: 318627 - RNA, 24 nt, Human
agcucacugcaaccucugacuccu

SEQ ID NO: 318628 - RNA, 23 nt, Human
agcucacugcaaccucugccucc

SEQ ID NO: 318629 - RNA, 32 nt, Human
agcucacugcaaccucugccuccagaguucaa

SEQ ID NO: 318630 - RNA, 32 nt, Human
agcucacugcaaccucugccucccaaguucaa

SEQ ID NO: 318631 - RNA, 32 nt, Human
agcucacugcaaccucugccucccagguucaa

SEQ ID NO: 318632 - RNA, 32 nt, Human
agcucacugcaaccucugccucccaguucaag

SEQ ID NO: 318633 - RNA, 32 nt, Human
agcucacugcaaccucugccucccggauucaa

SEQ ID NO: 318634 - RNA, 32 nt, Human
agcucacugcaaccucugccucccggauuuaa

SEQ ID NO: 318635 - RNA, 32 nt, Human
agcucacugcaaccucugccucccggguucaa

SEQ ID NO: 318636 - RNA, 32 nt, Human
agcucacugcaaccucugccucccgguuuuuc

SEQ ID NO: 318637 - RNA, 32 nt, Human
agcucacugcaaccucugccucccugguucaa

SEQ ID NO: 318638 - RNA, 24 nt, Human
agcucacugcaaccucugccuccu

SEQ ID NO: 318639 - RNA, 32 nt, Human
agcucacugcaaccucugccuccugaguucaa

SEQ ID NO: 318640 - RNA, 32 nt, Human
agcucacugcaaccucugccuccuggauucaa

SEQ ID NO: 318641 - RNA, 32 nt, Human
agcucacugcaaccucugccuccugggcucaa

SEQ ID NO: 318642 - RNA, 32 nt, Human
agcucacugcaaccucugccuccuggguucaa

SEQ ID NO: 318643 - RNA, 32 nt, Human
agcucacugcaaccucugccuccuggguucuc

SEQ ID NO: 318644 - RNA, 32 nt, Human
agcucacugcaaccucugccuccuggguuuaa

SEQ ID NO: 318645 - RNA, 32 nt, Human
agcucacugcaaccucugccuccugguucaag

SEQ ID NO: 318646 - RNA, 24 nt, Human
agcucacugcaaccucugccuucu

SEQ ID NO: 318647 - RNA, 32 nt, Human
agcucacugcaaccucugccuucuggauucaa

SEQ ID NO: 318648 - RNA, 23 nt, Human
agcucacugcaaccucugcuucc

SEQ ID NO: 318649 - RNA, 32 nt, Human
agcucacugcaaccucugcuucccggguucac

SEQ ID NO: 318650 - RNA, 24 nt, Human
agcucacugcaaccucugcuuccu

SEQ ID NO: 318651 - RNA, 32 nt, Human
agcucacugcaaccucugcuuccuggguucaa

SEQ ID NO: 318652 - RNA, 32 nt, Human
agcucacugcaaccucugucucccggguucaa

SEQ ID NO: 318653 - RNA, 24 nt, Human
agcucacugcaaccucugucuccu

SEQ ID NO: 318654 - RNA, 32 nt, Human
agcucacugcaaccucugucuccuggguucaa

SEQ ID NO: 318655 - RNA, 32 nt, Human
agcucacugcaaccucugucuccuggguucag

SEQ ID NO: 318656 - RNA, 32 nt, Human
agcucacugcaaccucugugcagguucaagug

SEQ ID NO: 318657 - RNA, 23 nt, Human
agcucacugcaaccugugccucc

SEQ ID NO: 318658 - RNA, 32 nt, Human
agcucacugcaaccugugccucccggcuucaa

SEQ ID NO: 318659 - RNA, 32 nt, Human
agcucacugcaaccuuacuccuaggcucaagu

SEQ ID NO: 318660 - RNA, 32 nt, Human
agcucacugcaaccuucaccucccagguucaa

SEQ ID NO: 318661 - RNA, 24 nt, Human
agcucacugcaaccuucgccaccu

SEQ ID NO: 318662 - RNA, 32 nt, Human
agcucacugcaaccuucgccaccuggguucca

SEQ ID NO: 318663 - RNA, 32 nt, Human
agcucacugcaaccuucgccucccagcuucaa

SEQ ID NO: 318664 - RNA, 23 nt, Human
agcucacugcaaccuuggccucc

SEQ ID NO: 318665 - RNA, 32 nt, Human
agcucacugcaaccuuggccucccguguucaa

SEQ ID NO: 318666 - RNA, 23 nt, Human
agcucacugcaaccuuugucucc

SEQ ID NO: 318667 - RNA, 32 nt, Human
agcucacugcaaccuuugucucccgggcucaa

SEQ ID NO: 318668 - RNA, 32 nt, Human
agcucacugcaacguccaccuccuggguucaa

SEQ ID NO: 318669 - RNA, 24 nt, Human
agcucacugcaacguccaccucuu

SEQ ID NO: 318670 - RNA, 32 nt, Human
agcucacugcaacguccaccucuugaguucaa

SEQ ID NO: 318671 - RNA, 23 nt, Human
agcucacugcaacgucugccucc

SEQ ID NO: 318672 - RNA, 32 nt, Human
agcucacugcaacgucugccucccggguucaa

SEQ ID NO: 318673 - RNA, 23 nt, Human
agcucacugcaacuuccaccucc

SEQ ID NO: 318674 - RNA, 32 nt, Human
agcucacugcaacuuccaccucccagguucaa

SEQ ID NO: 318675 - RNA, 23 nt, Human
agcucacugcaacuuccgcaucc

SEQ ID NO: 318676 - RNA, 32 nt, Human
agcucacugcaacuuccgcaucccagguucaa

SEQ ID NO: 318677 - RNA, 32 nt, Human
agcucacugcaacuuccgccccgccagguucg

SEQ ID NO: 318678 - RNA, 32 nt, Human
agcucacugcaacuucugccucccagguucaa

SEQ ID NO: 318679 - RNA, 24 nt, Human
agcucacugcaacuucugccuccu

SEQ ID NO: 318680 - RNA, 32 nt, Human
agcucacugcaacuucugccuccuggguucaa

SEQ ID NO: 318681 - RNA, 32 nt, Human
agcucacugcaacuucugccuccugguaucaa

SEQ ID NO: 318682 - RNA, 23 nt, Human
agcucacugcaagcuccaacucc

SEQ ID NO: 318683 - RNA, 32 nt, Human
agcucacugcaagcuccaacucccggguucac

SEQ ID NO: 318684 - RNA, 23 nt, Human
agcucacugcaagcuccaccucc

SEQ ID NO: 318685 - RNA, 32 nt, Human
agcucacugcaagcuccaccucccggguucac

SEQ ID NO: 318686 - RNA, 32 nt, Human
agcucacugcaagcuccaccucccggguucau

SEQ ID NO: 318687 - RNA, 32 nt, Human
agcucacugcaagcuccaccucccggguuuau

SEQ ID NO: 318688 - RNA, 24 nt, Human
agcucacugcaagcuccaccuccu

SEQ ID NO: 318689 - RNA, 32 nt, Human
agcucacugcaagcuccaccuuccggguucac

SEQ ID NO: 318690 - RNA, 21 nt, Human
agcucacugcaagcuccgccu

SEQ ID NO: 318691 - RNA, 32 nt, Human
agcucacugcaagcuccgccucccagguucac

SEQ ID NO: 318692 - RNA, 32 nt, Human
agcucacugcaagcuccgccucccagguucau

SEQ ID NO: 318693 - RNA, 32 nt, Human
agcucacugcaagcuccgccucccggguacaa

SEQ ID NO: 318694 - RNA, 32 nt, Human
agcucacugcaagcuccgccuccucccggguu

SEQ ID NO: 318695 - RNA, 32 nt, Human
agcucacugcaagcuccgccuccuggguucac

SEQ ID NO: 318696 - RNA, 32 nt, Human
agcucacugcaagcucuaccucuugguucacg

SEQ ID NO: 318697 - RNA, 32 nt, Human
agcucacugcaagcucugccucccggguucau

SEQ ID NO: 318698 - RNA, 32 nt, Human
agcucacugcaagcucugccucucagguucaa

SEQ ID NO: 318699 - RNA, 24 nt, Human
agcucacugcaaucuccaccuccu

SEQ ID NO: 318700 - RNA, 32 nt, Human
agcucacugcaaucuccaccuccuggguucaa

SEQ ID NO: 318701 - RNA, 21 nt, Human
agcucacugcaaucuccgccu

SEQ ID NO: 318702 - RNA, 32 nt, Human
agcucacugcaaucuccgccucccggguucaa

SEQ ID NO: 318703 - RNA, 32 nt, Human
agcucacugcaaucucugccacccagauucaa

SEQ ID NO: 318704 - RNA, 32 nt, Human
agcucacugcaaucucugccuccuggguucag

SEQ ID NO: 318705 - RNA, 32 nt, Human
agcucacugcaaucuucaccuccuaggcucaa

SEQ ID NO: 318706 - RNA, 24 nt, Human
agcucacugcacccucaaccuccu

SEQ ID NO: 318707 - RNA, 32 nt, Human
agcucacugcacccucaaccuccuggguucaa

SEQ ID NO: 318708 - RNA, 32 nt, Human
agcucacugcacccuccgccucucggguucaa

SEQ ID NO: 318709 - RNA, 32 nt, Human
agcucacugcacccucugugucccggauucaa

SEQ ID NO: 318710 - RNA, 32 nt, Human
agcucacugcagacuccaacuccuggccucaa

SEQ ID NO: 318711 - RNA, 32 nt, Human
agcucacugcagccacugccucccagguucaa

SEQ ID NO: 318712 - RNA, 32 nt, Human
agcucacugcagcccccgccucccagguucga

SEQ ID NO: 318713 - RNA, 32 nt, Human
agcucacugcagcccugaacuccugggcucaa

SEQ ID NO: 318714 - RNA, 24 nt, Human
agcucacugcagccucaaacuccu

SEQ ID NO: 318715 - RNA, 32 nt, Human
agcucacugcagccucaaacuccuggauucaa

SEQ ID NO: 318716 - RNA, 32 nt, Human
agcucacugcagccucaaacuccugggcucaa

SEQ ID NO: 318717 - RNA, 32 nt, Human
agcucacugcagccucaaacuccugggcucag

SEQ ID NO: 318718 - RNA, 24 nt, Human
agcucacugcagccucaaccuccu

SEQ ID NO: 318719 - RNA, 24 nt, Human
agcucacugcagccucaacuuccu

SEQ ID NO: 318720 - RNA, 32 nt, Human
agcucacugcagccucauacuccugggcucaa

SEQ ID NO: 318721 - RNA, 32 nt, Human
agcucacugcagccuccaacuccuggguucaa

SEQ ID NO: 318722 - RNA, 23 nt, Human
agcucacugcagccuccaccucc

SEQ ID NO: 318723 - RNA, 32 nt, Human
agcucacugcagccuccaccucccaggcucaa

SEQ ID NO: 318724 - RNA, 32 nt, Human
agcucacugcagccuccaccucccagguucaa

SEQ ID NO: 318725 - RNA, 24 nt, Human
agcucacugcagccuccaccuccu

SEQ ID NO: 318726 - RNA, 32 nt, Human
agcucacugcagccuccaccuccugggcucau

SEQ ID NO: 318727 - RNA, 32 nt, Human
agcucacugcagccuccaccuccuggguucaa

SEQ ID NO: 318728 - RNA, 32 nt, Human
agcucacugcagccuccacuuccuggguucac

SEQ ID NO: 318729 - RNA, 32 nt, Human
agcucacugcagccuccaucuccuaggcucaa

SEQ ID NO: 318730 - RNA, 32 nt, Human
agcucacugcagccuccgucucccagguucaa

SEQ ID NO: 318731 - RNA, 32 nt, Human
agcucacugcagccucgaacuccugggcucaa

SEQ ID NO: 318732 - RNA, 32 nt, Human
agcucacugcagccucgaacucuugggcuuca

SEQ ID NO: 318733 - RNA, 23 nt, Human
agcucacugcagccucgaccucc

SEQ ID NO: 318734 - RNA, 32 nt, Human
agcucacugcagccucgaccucccgggcucaa

SEQ ID NO: 318735 - RNA, 24 nt, Human
agcucacugcagccucgaccuccu

SEQ ID NO: 318736 - RNA, 32 nt, Human
agcucacugcagccucgaccuccugcgcucag

SEQ ID NO: 318737 - RNA, 32 nt, Human
agcucacugcagccucgaccuccuggacucag

SEQ ID NO: 318738 - RNA, 32 nt, Human
agcucacugcagccucgaccuccugggcucaa

SEQ ID NO: 318739 - RNA, 32 nt, Human
agcucacugcagccucgacuucccaggcucaa

SEQ ID NO: 318740 - RNA, 32 nt, Human
agcucacugcagccucugccacccagauucaa

SEQ ID NO: 318741 - RNA, 32 nt, Human
agcucacugcagccucugccucccggguucaa

SEQ ID NO: 318742 - RNA, 32 nt, Human
agcucacugcagccucugccuccugaguucaa

SEQ ID NO: 318743 - RNA, 32 nt, Human
agcucacugcagccucugucucccgggcucaa

SEQ ID NO: 318744 - RNA, 32 nt, Human
agcucacugcagccuggaacuccugggaucaa

SEQ ID NO: 318745 - RNA, 32 nt, Human
agcucacugcagccuggaacuccugggcucag

SEQ ID NO: 318746 - RNA, 32 nt, Human
agcucacugcagccuggaccuccuggccucaa

SEQ ID NO: 318747 - RNA, 32 nt, Human
agcucacugcagccuugaacuccuggacucaa

SEQ ID NO: 318748 - RNA, 32 nt, Human
agcucacugcagccuugaacuccugggaucaa

SEQ ID NO: 318749 - RNA, 32 nt, Human
agcucacugcagccuugaccucccgggcucaa

SEQ ID NO: 318750 - RNA, 32 nt, Human
agcucacugcagccuugaccuccugggcugaa

SEQ ID NO: 318751 - RNA, 32 nt, Human
agcucacugcagccuugaccuccuggguucaa

SEQ ID NO: 318752 - RNA, 32 nt, Human
agcucacugcagccuugaccuccuggguuccg

SEQ ID NO: 318753 - RNA, 32 nt, Human
agcucacugcagccuugagcuccugggcuacc

SEQ ID NO: 318754 - RNA, 32 nt, Human
agcucacugcagccuugagcuccugggcucaa

SEQ ID NO: 318755 - RNA, 32 nt, Human
agcucacugcagccuuguccucccaggcucaa

SEQ ID NO: 318756 - RNA, 32 nt, Human
agcucacugcagcuucaaacucuugggcucaa

SEQ ID NO: 318757 - RNA, 23 nt, Human
agcucacugcagcuucaacaccc

SEQ ID NO: 318758 - RNA, 32 nt, Human
agcucacugcagcuucaaucuccuggcucaag

SEQ ID NO: 318759 - RNA, 32 nt, Human
agcucacugcagcuuugaccucccagacccaa

SEQ ID NO: 318760 - RNA, 32 nt, Human
agcucacugcagcuuugaccuugccgggcuca

SEQ ID NO: 318761 - RNA, 32 nt, Human
agcucacugcaggcucugccuccuggguucca

SEQ ID NO: 318762 - RNA, 32 nt, Human
agcucacugcagucuccaccuccugagcucaa

SEQ ID NO: 318763 - RNA, 32 nt, Human
agcucacugcagucucgaacuccuggacucaa

SEQ ID NO: 318764 - RNA, 32 nt, Human
agcucacugcagucucugccucccggguucga

SEQ ID NO: 318765 - RNA, 24 nt, Human
agcucacugcagucuucagccucc

SEQ ID NO: 318766 - RNA, 32 nt, Human
agcucacugcagucuucagccuccccaguagc

SEQ ID NO: 318767 - RNA, 32 nt, Human
agcucacugcagucuugaacuccugggcucaa

SEQ ID NO: 318768 - RNA, 32 nt, Human
agcucacugcauccucugccucccggguucaa

SEQ ID NO: 318769 - RNA, 32 nt, Human
agcucacugcauccuugaccucccagacucaa

SEQ ID NO: 318770 - RNA, 32 nt, Human
agcucacugccaccucugccucccagguucac

SEQ ID NO: 318771 - RNA, 32 nt, Human
agcucacugccaccuuugccuccuggguucaa

SEQ ID NO: 318772 - RNA, 32 nt, Human
agcucacugccagcugcggccugggcaccgcg

SEQ ID NO: 318773 - RNA, 32 nt, Human
agcucacugccuccugggcucagcucaaaccc

SEQ ID NO: 318774 - RNA, 23 nt, Human
agcucacugcgaccuccaccucc

SEQ ID NO: 318775 - RNA, 32 nt, Human
agcucacugcgaccuccaccucccauguucaa

SEQ ID NO: 318776 - RNA, 24 nt, Human
agcucacugcgaccuccaccuccu

SEQ ID NO: 318777 - RNA, 32 nt, Human
agcucacugcgaccuccaccuccuggguucaa

SEQ ID NO: 318778 - RNA, 32 nt, Human
agcucacugcgaccugcaccuccuggguucaa

SEQ ID NO: 318779 - RNA, 32 nt, Human
agcucacugcggccuugaacuccugggcuuaa

SEQ ID NO: 318780 - RNA, 32 nt, Human
agcucacugcugccucaaccucccaggcucaa

SEQ ID NO: 318781 - RNA, 32 nt, Human
agcucacuggagccucugccuuccagguucaa

SEQ ID NO: 318782 - RNA, 32 nt, Human
agcucacuggcaacaucugccucccggguuca

SEQ ID NO: 318783 - RNA, 32 nt, Human
agcucacugguccauuucucaguggcuucucc

SEQ ID NO: 318784 - RNA, 32 nt, Human
agcucacuguaaccucaaaauccugggcucaa

SEQ ID NO: 318785 - RNA, 24 nt, Human
agcucacuguaaccucaaacuccu

SEQ ID NO: 318786 - RNA, 32 nt, Human
agcucacuguaaccucaaacuccuggacucaa

SEQ ID NO: 318787 - RNA, 32 nt, Human
agcucacuguaaccucaaacuccuggacucau

SEQ ID NO: 318788 - RNA, 32 nt, Human
agcucacuguaaccucaaacucuggggcucaa

SEQ ID NO: 318789 - RNA, 23 nt, Human
agcucacuguaaccuccaccucc

SEQ ID NO: 318790 - RNA, 32 nt, Human
agcucacuguaaccuccaccucccggauucaa

SEQ ID NO: 318791 - RNA, 32 nt, Human
agcucacuguaaccucugccucccugcuucaa

SEQ ID NO: 318792 - RNA, 32 nt, Human
agcucacuguaacuucgaccaccugggcucaa

SEQ ID NO: 318793 - RNA, 32 nt, Human
agcucacuguacccuugaacuccugggcucaa

SEQ ID NO: 318794 - RNA, 32 nt, Human
agcucacuguacuccagcccggguucaagcaa

SEQ ID NO: 318795 - RNA, 32 nt, Human
agcucacuguagccucuaacucccaggcucaa

SEQ ID NO: 318796 - RNA, 32 nt, Human
agcucacuguagccucuaucuccugggcucaa

SEQ ID NO: 318797 - RNA, 32 nt, Human
agcucacuguagccuugaucuccugggcucaa

SEQ ID NO: 318798 - RNA, 32 nt, Human
agcucacuguagucuccaccacucccuuuugu

SEQ ID NO: 318799 - RNA, 32 nt, Human
agcucacugugaccuccgccuccuggguucaa

SEQ ID NO: 318800 - RNA, 32 nt, Human
agcucacuucaagcucacccugcuccuaccua

SEQ ID NO: 318801 - RNA, 32 nt, Human
agcucacuucacccucuccccaugccauccca

SEQ ID NO: 318802 - RNA, 32 nt, Human
agcucacuucacugcacuccagucugggugac

SEQ ID NO: 318803 - RNA, 32 nt, Human
agcucacuugcagacacccugccggaagcaga

SEQ ID NO: 318804 - RNA, 32 nt, Human
agcucacuugcagcugccacugcagacaagua

SEQ ID NO: 318805 - RNA, 32 nt, Human
agcucagaaagccauucuuggggcaaacacac

SEQ ID NO: 318806 - RNA, 32 nt, Human
agcucagaaauucuaccuuugggagucaccac

SEQ ID NO: 318807 - RNA, 32 nt, Human
agcucagaaauucuaucuucgggagucaccac

SEQ ID NO: 318808 - RNA, 32 nt, Human
agcucagaagcagcagaacugacauugggacc

SEQ ID NO: 318809 - RNA, 32 nt, Human
agcucagaagcugaggagucacagagagaccu

SEQ ID NO: 318810 - RNA, 32 nt, Human
agcucagaccagcuggaucuugcucagucucu

SEQ ID NO: 318811 - RNA, 32 nt, Human
agcucagacuauaagcacacaccaccacaccc

SEQ ID NO: 318812 - RNA, 32 nt, Human
agcucagagagagaaagaucugagggaagaug

SEQ ID NO: 318813 - RNA, 32 nt, Human
agcucagagaugacccugagucuugauucgag

SEQ ID NO: 318814 - RNA, 32 nt, Human
agcucagagcaguggcugauggggacacugag

SEQ ID NO: 318815 - RNA, 32 nt, Human
agcucagagccauacaaaaguaggcuggauuc

SEQ ID NO: 318816 - RNA, 32 nt, Human
agcucagaggaaagaagaaaagggccaggagu

SEQ ID NO: 318817 - RNA, 32 nt, Human
agcucagaggagaccugcaguggguagcuccu

SEQ ID NO: 318818 - RNA, 32 nt, Human
agcucagauaugagucaaggcuugucugacuc

SEQ ID NO: 318819 - RNA, 32 nt, Human
agcucagauguccuaaugaacaugcaccuaca

SEQ ID NO: 318820 - RNA, 32 nt, Human
agcucagauuacaggcaugugccaccacgccc

SEQ ID NO: 318821 - RNA, 32 nt, Human
agcucagauuccugaauuaacaauucacacug

SEQ ID NO: 318822 - RNA, 32 nt, Human
agcucagcaaagccucuguagccagacugccu

SEQ ID NO: 318823 - RNA, 32 nt, Human
agcucagcaagugcacaagccuuacuuugguu

SEQ ID NO: 318824 - RNA, 32 nt, Human
agcucagcagaggcucacguggcccaggcugg

SEQ ID NO: 318825 - RNA, 32 nt, Human
agcucagcagaggcugugguacaacauggucc

SEQ ID NO: 318826 - RNA, 21 nt, Human
agcucagcagcauccagagcc

SEQ ID NO: 318827 - RNA, 32 nt, Human
agcucagcaguguuuaaugauccucuuccaca

SEQ ID NO: 318828 - RNA, 32 nt, Human
agcucagccacggccauccagacccuugggcu

SEQ ID NO: 318829 - RNA, 32 nt, Human
agcucagccccagggguucuuucacacacaag

SEQ ID NO: 318830 - RNA, 32 nt, Human
agcucagccccuccccuccaacucucauccca

SEQ ID NO: 318831 - RNA, 32 nt, Human
agcucagccggcguugcuggucagggucuccc

SEQ ID NO: 318832 - RNA, 32 nt, Human
agcucagccucaaucaugucuuaacaaaauga

SEQ ID NO: 318833 - RNA, 32 nt, Human
agcucagccucucuccucacucugccucuuug

SEQ ID NO: 318834 - RNA, 32 nt, Human
agcucagccuugacccugacccuugcucuccc

SEQ ID NO: 318835 - RNA, 32 nt, Human
agcucagcgccggcuccaagcccagccagucc

SEQ ID NO: 318836 - RNA, 32 nt, Human
agcucagcgcuugacauuuccuaagugugcca

SEQ ID NO: 318837 - RNA, 32 nt, Human
agcucagcguucacgggcaucuugccauucag

SEQ ID NO: 318838 - RNA, 32 nt, Human
agcucagcuagcucugccccaggacggcccug

SEQ ID NO: 318839 - RNA, 32 nt, Human
agcucagcucacugcaaccuccaccucccagg

SEQ ID NO: 318840 - RNA, 32 nt, Human
agcucagcuccuggagggacagugagaauuua

SEQ ID NO: 318841 - RNA, 18 nt, Human
agcucagcugaccugcga

SEQ ID NO: 318842 - RNA, 32 nt, Human
agcucagcugcaggaggcaggauggucuggag

SEQ ID NO: 318843 - RNA, 32 nt, Human
agcucagcuguggagccagcagcuccgacuca

SEQ ID NO: 318844 - RNA, 32 nt, Human
agcucagcuuacuguaaccucugccuccugga

SEQ ID NO: 318845 - RNA, 32 nt, Human
agcucaggaacaucacugguguauuuguuuuu

SEQ ID NO: 318846 - RNA, 32 nt, Human
agcucaggaagcaugucuaaggcucagaaguu

SEQ ID NO: 318847 - RNA, 32 nt, Human
agcucaggagaaggggagagacaggucgccca

SEQ ID NO: 318848 - RNA, 32 nt, Human
agcucaggaggcagagguugcagugagccaaa

SEQ ID NO: 318849 - RNA, 32 nt, Human
agcucaggaggcagagguugcagugagcugag

SEQ ID NO: 318850 - RNA, 32 nt, Human
agcucaggagguugggucugcagugagcuauc

SEQ ID NO: 318851 - RNA, 32 nt, Human
agcucaggaguucgagaccacccugggcaaca

SEQ ID NO: 318852 - RNA, 32 nt, Human
agcucaggaguuucagaccagccugggcaaca

SEQ ID NO: 318853 - RNA, 32 nt, Human
agcucaggauagcugcuggccacuccuguccu

SEQ ID NO: 318854 - RNA, 32 nt, Human
agcucaggccacugcaggucccaccuggccuu

SEQ ID NO: 318855 - RNA, 32 nt, Human
agcucaggccuguaaucucagcacuuugggag

SEQ ID NO: 318856 - RNA, 32 nt, Human
agcucaggcggcgccgcuccagcccggggccc

SEQ ID NO: 318857 - RNA, 32 nt, Human
agcucagggaaagacaaucagugcaagaggaa

SEQ ID NO: 318858 - RNA, 32 nt, Human
agcucagggaggcugagugucccaggccuguu

SEQ ID NO: 318859 - RNA, 32 nt, Human
agcucagggcccaucccuucucugcagcucug

SEQ ID NO: 318860 - RNA, 32 nt, Human
agcucagggcccugucugcucuguggacucaa

SEQ ID NO: 318861 - RNA, 32 nt, Human
agcucagggcccugugcccgcuugccuguucc

SEQ ID NO: 318862 - RNA, 32 nt, Human
agcucagggcuggggacuuguccuucucuucc

SEQ ID NO: 318863 - RNA, 32 nt, Human
agcucagggcuuccucugcccaugcagucccc

SEQ ID NO: 318864 - RNA, 32 nt, Human
agcucaggggaacgcccgagacccccaccucu

SEQ ID NO: 318865 - RNA, 32 nt, Human
agcucagggggccaaggcugcagugagucaug

SEQ ID NO: 318866 - RNA, 32 nt, Human
agcucagggguggagggcgaugggucgggaag

SEQ ID NO: 318867 - RNA, 32 nt, Human
agcucaggguggagcagcugcagccaugggac

SEQ ID NO: 318868 - RNA, 32 nt, Human
agcucaggugcuggucccguccccugcagggc

SEQ ID NO: 318869 - RNA, 32 nt, Human
agcucagguggcuggggagaacuaaaacaccu

SEQ ID NO: 318870 - RNA, 32 nt, Human
agcucagguugugcaucugauggaaaccacug

SEQ ID NO: 318871 - RNA, 32 nt, Human
agcucaguauagaacuacauuaucugcaaacu

SEQ ID NO: 318872 - RNA, 32 nt, Human
agcucagucaggugaggguggggaugacccau

SEQ ID NO: 318873 - RNA, 32 nt, Human
agcucagucguuucuaugaugaugccaucgug

SEQ ID NO: 318874 - RNA, 32 nt, Human
agcucagugaccugggugggcaguggccaagc

SEQ ID NO: 318875 - RNA, 32 nt, Human
agcucagugcaaccuccgccacccggguucag

SEQ ID NO: 318876 - RNA, 32 nt, Human
agcucagugcaaccuccgcccccugggaucaa

SEQ ID NO: 318877 - RNA, 32 nt, Human
agcucagugcaaccuccgccucccgaguucaa

SEQ ID NO: 318878 - RNA, 32 nt, Human
agcucagugcagccucaaacuccugggcucaa

SEQ ID NO: 318879 - RNA, 32 nt, Human
agcucagugcagccuccaacuccugggcucaa

SEQ ID NO: 318880 - RNA, 32 nt, Human
agcucaguggcaggagaaucaaaccuaagcuu

SEQ ID NO: 318881 - RNA, 32 nt, Human
agcucagugggcaguggcaggaacugagugcc

SEQ ID NO: 318882 - RNA, 32 nt, Human
agcucagugucacagaccuuuguggaagcaac

SEQ ID NO: 318883 - RNA, 32 nt, Human
agcucaguguccucaccuauaauaugggguau

SEQ ID NO: 318884 - RNA, 32 nt, Human
agcucaguucacaguuuggauauuucuuccca

SEQ ID NO: 318885 - RNA, 32 nt, Human
agcucaguucccauugcuugugcucagggcug

SEQ ID NO: 318886 - RNA, 32 nt, Human
agcucaguucuccagaucuggcuaggagcagu

SEQ ID NO: 318887 - RNA, 32 nt, Human
agcucaguuggcugcaggagcagcuagcacag

SEQ ID NO: 318888 - RNA, 32 nt, Human
agcucauaccuguaaucccaggacuuugggag

SEQ ID NO: 318889 - RNA, 32 nt, Human
agcucauacuguucucaccugggaaacuuggg

SEQ ID NO: 318890 - RNA, 32 nt, Human
agcucauacuuguaacccagcacuuugggaag

SEQ ID NO: 318891 - RNA, 32 nt, Human
agcucauagccucuuggcugccuuaggagcuu

SEQ ID NO: 318892 - RNA, 32 nt, Human
agcucauaugaacaugccaaacuccagaggug

SEQ ID NO: 318893 - RNA, 32 nt, Human
agcucaucacagcgaaccaggucucucaaaag

SEQ ID NO: 318894 - RNA, 32 nt, Human
agcucaucacccauuaagguuuguuguugaau

SEQ ID NO: 318895 - RNA, 32 nt, Human
agcucaucagacacuggaaugcagugauucuu

SEQ ID NO: 318896 - RNA, 32 nt, Human
agcucauccucaacguccugugccucuggaag

SEQ ID NO: 318897 - RNA, 32 nt, Human
agcucauccucccgggaacgucuccaccagcu

SEQ ID NO: 318898 - RNA, 32 nt, Human
agcucaucuccucccuggauucuggauuagga

SEQ ID NO: 318899 - RNA, 32 nt, Human
agcucaugacuguaaucccagcacuuugggag

SEQ ID NO: 318900 - RNA, 32 nt, Human
agcucaugagacaaauacugauuuaauauuuu

SEQ ID NO: 318901 - RNA, 32 nt, Human
agcucaugagggugguuccuaauccaguguga

SEQ ID NO: 318902 - RNA, 32 nt, Human
agcucaugccgguaaucucagcacuuugggag

SEQ ID NO: 318903 - RNA, 32 nt, Human
agcucaugccuauaaucccaggacuuugggaa

SEQ ID NO: 318904 - RNA, 32 nt, Human
agcucaugccuguaacccuggcacuuaagggg

SEQ ID NO: 318905 - RNA, 32 nt, Human
agcucaugccuguaaucccaauacuuugggag

SEQ ID NO: 318906 - RNA, 32 nt, Human
agcucaugccuguaaucccagcacuuugggag

SEQ ID NO: 318907 - RNA, 32 nt, Human
agcucaugccuguaauccuagcacuuuggaag

SEQ ID NO: 318908 - RNA, 32 nt, Human
agcucaugccuguaaucuccagcacuuuggga

SEQ ID NO: 318909 - RNA, 32 nt, Human
agcucaugccuguagucccagcuacuccagag

SEQ ID NO: 318910 - RNA, 32 nt, Human
agcucaugcgacugcacuccagccugggugac

SEQ ID NO: 318911 - RNA, 32 nt, Human
agcucaugcuuacaaccuguguggaaguauau

SEQ ID NO: 318912 - RNA, 32 nt, Human
agcucauggcaccuuaguccucagccugauga

SEQ ID NO: 318913 - RNA, 32 nt, Human
agcucauggcccugucauguuugggaaaugac

SEQ ID NO: 318914 - RNA, 32 nt, Human
agcucaugggcaacaucacuggggcccagaga

SEQ ID NO: 318915 - RNA, 32 nt, Human
agcucaugggggccuguguucuggguguucag

SEQ ID NO: 318916 - RNA, 30 nt, Human
agcucaugucuguaaucccagcacuuuggg

SEQ ID NO: 318917 - RNA, 32 nt, Human
agcucauuauaggacacggaacucccugggua

SEQ ID NO: 318918 - RNA, 32 nt, Human
agcucauuaugaaaaacaucccaaacuuuaaa

SEQ ID NO: 318919 - RNA, 32 nt, Human
agcucauuccagccuguaccuuggaugagggg

SEQ ID NO: 318920 - RNA, 32 nt, Human
agcucauuccccgagcacuccagccuggcagu

SEQ ID NO: 318921 - RNA, 32 nt, Human
agcucauucccuuuuggcuuuuuccuuguuug

SEQ ID NO: 318922 - RNA, 32 nt, Human
agcucauuccucacgucggccauuccaggccc

SEQ ID NO: 318923 - RNA, 32 nt, Human
agcucauuccucugaccugccaggaagcagag

SEQ ID NO: 318924 - RNA, 32 nt, Human
agcucauucuccuuguguuacuaaguuuuuau

SEQ ID NO: 318925 - RNA, 32 nt, Human
agcucauucuugugacuuacagugccaacauu

SEQ ID NO: 318926 - RNA, 32 nt, Human
agcucauugaagccucgcacuccugggcucaa

SEQ ID NO: 318927 - RNA, 32 nt, Human
agcucauugcaaccucugccuaacggguucaa

SEQ ID NO: 318928 - RNA, 32 nt, Human
agcucauugcaaccucugucucccagguucaa

SEQ ID NO: 318929 - RNA, 32 nt, Human
agcucauugcaacuuccaccuccuggguugaa

SEQ ID NO: 318930 - RNA, 32 nt, Human
agcucauugcagccucaaacuccugggcucaa

SEQ ID NO: 318931 - RNA, 23 nt, Human
agcucauugcagccucaaccucc

SEQ ID NO: 318932 - RNA, 32 nt, Human
agcucauugcagccucaaccucccaggcucaa

SEQ ID NO: 318933 - RNA, 32 nt, Human
agcucauugcagccuccacuuccugggcucaa

SEQ ID NO: 318934 - RNA, 32 nt, Human
agcucauugcagccuccgccaccuggguucaa

SEQ ID NO: 318935 - RNA, 32 nt, Human
agcucauugcagccuucaauuccugggcucag

SEQ ID NO: 318936 - RNA, 32 nt, Human
agcucauugcagcuuugaccuccugggcuuag

SEQ ID NO: 318937 - RNA, 32 nt, Human
agcucauuguaaccuccaucuccugugcucaa

SEQ ID NO: 318938 - RNA, 32 nt, Human
agcucauuuccucaaauucuguccucagugga

SEQ ID NO: 318939 - RNA, 32 nt, Human
agcucauuucugcuugaccuuuccuuguugcc

SEQ ID NO: 318940 - RNA, 32 nt, Human
agcucauuugccuggccggcaaguuuugcaaa

SEQ ID NO: 318941 - RNA, 20 nt, Human
agcuccaaaaauauacuuca

SEQ ID NO: 318942 - RNA, 32 nt, Human
agcuccaaaagccacugaugacaagggcccca

SEQ ID NO: 318943 - RNA, 32 nt, Human
agcuccaaaccuggaaccuccugaucaguuug

SEQ ID NO: 318944 - RNA, 32 nt, Human
agcuccaaccaccacagccagaacgcaccugg

SEQ ID NO: 318945 - RNA, 32 nt, Human
agcuccaacccccaacuucccccagacuuuag

SEQ ID NO: 318946 - RNA, 19 nt, Human
agcuccaaccuggaggcug
